United States Patent 8,822,426 (PREVENTION AND TREATMENT OF NOSEMA DISEASE IN BEES) - sequence listing, part 2

SEQ ID NO: 31476 - DNA, 26 bp, Artificial sequence
  SiRNA target sequence
attgtcttttaccatctttctttctc

SEQ ID NO: 31477 - DNA, 26 bp, Artificial sequence
  SiRNA target sequence
ttgtcttttaccatctttctttctcc

SEQ ID NO: 31478 - DNA, 26 bp, Artificial sequence
  SiRNA target sequence
tgtcttttaccatctttctttctcct

SEQ ID NO: 31479 - DNA, 26 bp, Artificial sequence
  SiRNA target sequence
gtcttttaccatctttctttctcctt

SEQ ID NO: 31480 - DNA, 26 bp, Artificial sequence
  SiRNA target sequence
tcttttaccatctttctttctccttg

SEQ ID NO: 31481 - DNA, 26 bp, Artificial sequence
  SiRNA target sequence
cttttaccatctttctttctccttga

SEQ ID NO: 31482 - DNA, 26 bp, Artificial sequence
  SiRNA target sequence
ttttaccatctttctttctccttgat

SEQ ID NO: 31483 - DNA, 26 bp, Artificial sequence
  SiRNA target sequence
tttaccatctttctttctccttgata

SEQ ID NO: 31484 - DNA, 26 bp, Artificial sequence
  SiRNA target sequence
ttaccatctttctttctccttgatat

SEQ ID NO: 31485 - DNA, 26 bp, Artificial sequence
  SiRNA target sequence
taccatctttctttctccttgatata

SEQ ID NO: 31486 - DNA, 26 bp, Artificial sequence
  SiRNA target sequence
accatctttctttctccttgatatat

SEQ ID NO: 31487 - DNA, 26 bp, Artificial sequence
  SiRNA target sequence
ccatctttctttctccttgatatatt

SEQ ID NO: 31488 - DNA, 26 bp, Artificial sequence
  SiRNA target sequence
catctttctttctccttgatatattc

SEQ ID NO: 31489 - DNA, 26 bp, Artificial sequence
  SiRNA target sequence
atctttctttctccttgatatattct

SEQ ID NO: 31490 - DNA, 26 bp, Artificial sequence
  SiRNA target sequence
tctttctttctccttgatatattcta

SEQ ID NO: 31491 - DNA, 26 bp, Artificial sequence
  SiRNA target sequence
ctttctttctccttgatatattctaa

SEQ ID NO: 31492 - DNA, 26 bp, Artificial sequence
  SiRNA target sequence
tttctttctccttgatatattctaat

SEQ ID NO: 31493 - DNA, 26 bp, Artificial sequence
  SiRNA target sequence
ttctttctccttgatatattctaata

SEQ ID NO: 31494 - DNA, 26 bp, Artificial sequence
  SiRNA target sequence
tctttctccttgatatattctaatat

SEQ ID NO: 31495 - DNA, 26 bp, Artificial sequence
  SiRNA target sequence
ctttctccttgatatattctaatatc

SEQ ID NO: 31496 - DNA, 26 bp, Artificial sequence
  SiRNA target sequence
tttctccttgatatattctaatatct

SEQ ID NO: 31497 - DNA, 26 bp, Artificial sequence
  SiRNA target sequence
ttctccttgatatattctaatatcta

SEQ ID NO: 31498 - DNA, 26 bp, Artificial sequence
  SiRNA target sequence
tctccttgatatattctaatatctac

SEQ ID NO: 31499 - DNA, 26 bp, Artificial sequence
  SiRNA target sequence
ctccttgatatattctaatatctact

SEQ ID NO: 31500 - DNA, 26 bp, Artificial sequence
  SiRNA target sequence
tccttgatatattctaatatctactt

SEQ ID NO: 31501 - DNA, 26 bp, Artificial sequence
  SiRNA target sequence
ccttgatatattctaatatctacttc

SEQ ID NO: 31502 - DNA, 26 bp, Artificial sequence
  SiRNA target sequence
cttgatatattctaatatctacttcg

SEQ ID NO: 31503 - DNA, 26 bp, Artificial sequence
  SiRNA target sequence
ttgatatattctaatatctacttcgg

SEQ ID NO: 31504 - DNA, 26 bp, Artificial sequence
  SiRNA target sequence
tgatatattctaatatctacttcgga

SEQ ID NO: 31505 - DNA, 26 bp, Artificial sequence
  SiRNA target sequence
gatatattctaatatctacttcggat

SEQ ID NO: 31506 - DNA, 26 bp, Artificial sequence
  SiRNA target sequence
atatattctaatatctacttcggatt

SEQ ID NO: 31507 - DNA, 26 bp, Artificial sequence
  SiRNA target sequence
tatattctaatatctacttcggattg

SEQ ID NO: 31508 - DNA, 26 bp, Artificial sequence
  SiRNA target sequence
atattctaatatctacttcggattga

SEQ ID NO: 31509 - DNA, 26 bp, Artificial sequence
  SiRNA target sequence
tattctaatatctacttcggattgat

SEQ ID NO: 31510 - DNA, 26 bp, Artificial sequence
  SiRNA target sequence
attctaatatctacttcggattgatt

SEQ ID NO: 31511 - DNA, 26 bp, Artificial sequence
  SiRNA target sequence
ttctaatatctacttcggattgatta

SEQ ID NO: 31512 - DNA, 26 bp, Artificial sequence
  SiRNA target sequence
tctaatatctacttcggattgattat

SEQ ID NO: 31513 - DNA, 26 bp, Artificial sequence
  SiRNA target sequence
ctaatatctacttcggattgattatc

SEQ ID NO: 31514 - DNA, 26 bp, Artificial sequence
  SiRNA target sequence
taatatctacttcggattgattatct

SEQ ID NO: 31515 - DNA, 26 bp, Artificial sequence
  SiRNA target sequence
aatatctacttcggattgattatctt

SEQ ID NO: 31516 - DNA, 26 bp, Artificial sequence
  SiRNA target sequence
atatctacttcggattgattatcttc

SEQ ID NO: 31517 - DNA, 26 bp, Artificial sequence
  SiRNA target sequence
tatctacttcggattgattatcttca

SEQ ID NO: 31518 - DNA, 26 bp, Artificial sequence
  SiRNA target sequence
atctacttcggattgattatcttcag

SEQ ID NO: 31519 - DNA, 26 bp, Artificial sequence
  SiRNA target sequence
tctacttcggattgattatcttcaga

SEQ ID NO: 31520 - DNA, 26 bp, Artificial sequence
  SiRNA target sequence
ctacttcggattgattatcttcagag

SEQ ID NO: 31521 - DNA, 26 bp, Artificial sequence
  SiRNA target sequence
tacttcggattgattatcttcagagg

SEQ ID NO: 31522 - DNA, 26 bp, Artificial sequence
  SiRNA target sequence
acttcggattgattatcttcagaggt

SEQ ID NO: 31523 - DNA, 26 bp, Artificial sequence
  SiRNA target sequence
cttcggattgattatcttcagaggta

SEQ ID NO: 31524 - DNA, 26 bp, Artificial sequence
  SiRNA target sequence
ttcggattgattatcttcagaggtag

SEQ ID NO: 31525 - DNA, 26 bp, Artificial sequence
  SiRNA target sequence
tcggattgattatcttcagaggtaga

SEQ ID NO: 31526 - DNA, 26 bp, Artificial sequence
  SiRNA target sequence
cggattgattatcttcagaggtagaa

SEQ ID NO: 31527 - DNA, 26 bp, Artificial sequence
  SiRNA target sequence
ggattgattatcttcagaggtagaaa

SEQ ID NO: 31528 - DNA, 26 bp, Artificial sequence
  SiRNA target sequence
gattgattatcttcagaggtagaaaa

SEQ ID NO: 31529 - DNA, 26 bp, Artificial sequence
  SiRNA target sequence
attgattatcttcagaggtagaaaaa

SEQ ID NO: 31530 - DNA, 26 bp, Artificial sequence
  SiRNA target sequence
ttgattatcttcagaggtagaaaaac

SEQ ID NO: 31531 - DNA, 26 bp, Artificial sequence
  SiRNA target sequence
tgattatcttcagaggtagaaaaact

SEQ ID NO: 31532 - DNA, 26 bp, Artificial sequence
  SiRNA target sequence
gattatcttcagaggtagaaaaactg

SEQ ID NO: 31533 - DNA, 26 bp, Artificial sequence
  SiRNA target sequence
attatcttcagaggtagaaaaactgt

SEQ ID NO: 31534 - DNA, 26 bp, Artificial sequence
  SiRNA target sequence
ttatcttcagaggtagaaaaactgtg

SEQ ID NO: 31535 - DNA, 26 bp, Artificial sequence
  SiRNA target sequence
tatcttcagaggtagaaaaactgtgt

SEQ ID NO: 31536 - DNA, 26 bp, Artificial sequence
  SiRNA target sequence
atcttcagaggtagaaaaactgtgtg

SEQ ID NO: 31537 - DNA, 26 bp, Artificial sequence
  SiRNA target sequence
tcttcagaggtagaaaaactgtgtgt

SEQ ID NO: 31538 - DNA, 26 bp, Artificial sequence
  SiRNA target sequence
cttcagaggtagaaaaactgtgtgtt

SEQ ID NO: 31539 - DNA, 26 bp, Artificial sequence
  SiRNA target sequence
ttcagaggtagaaaaactgtgtgttt

SEQ ID NO: 31540 - DNA, 26 bp, Artificial sequence
  SiRNA target sequence
tcagaggtagaaaaactgtgtgtttc

SEQ ID NO: 31541 - DNA, 26 bp, Artificial sequence
  SiRNA target sequence
cagaggtagaaaaactgtgtgtttcc

SEQ ID NO: 31542 - DNA, 26 bp, Artificial sequence
  SiRNA target sequence
agaggtagaaaaactgtgtgtttcct

SEQ ID NO: 31543 - DNA, 26 bp, Artificial sequence
  SiRNA target sequence
gaggtagaaaaactgtgtgtttcctt

SEQ ID NO: 31544 - DNA, 26 bp, Artificial sequence
  SiRNA target sequence
aggtagaaaaactgtgtgtttcctta

SEQ ID NO: 31545 - DNA, 26 bp, Artificial sequence
  SiRNA target sequence
ggtagaaaaactgtgtgtttccttaa

SEQ ID NO: 31546 - DNA, 26 bp, Artificial sequence
  SiRNA target sequence
gtagaaaaactgtgtgtttccttaaa

SEQ ID NO: 31547 - DNA, 26 bp, Artificial sequence
  SiRNA target sequence
tagaaaaactgtgtgtttccttaaat

SEQ ID NO: 31548 - DNA, 26 bp, Artificial sequence
  SiRNA target sequence
agaaaaactgtgtgtttccttaaatg

SEQ ID NO: 31549 - DNA, 26 bp, Artificial sequence
  SiRNA target sequence
gaaaaactgtgtgtttccttaaatgg

SEQ ID NO: 31550 - DNA, 26 bp, Artificial sequence
  SiRNA target sequence
aaaaactgtgtgtttccttaaatgga

SEQ ID NO: 31551 - DNA, 26 bp, Artificial sequence
  SiRNA target sequence
aaaactgtgtgtttccttaaatggaa

SEQ ID NO: 31552 - DNA, 26 bp, Artificial sequence
  SiRNA target sequence
aaactgtgtgtttccttaaatggaat

SEQ ID NO: 31553 - DNA, 26 bp, Artificial sequence
  SiRNA target sequence
aactgtgtgtttccttaaatggaata

SEQ ID NO: 31554 - DNA, 26 bp, Artificial sequence
  SiRNA target sequence
actgtgtgtttccttaaatggaatag

SEQ ID NO: 31555 - DNA, 26 bp, Artificial sequence
  SiRNA target sequence
ctgtgtgtttccttaaatggaatagt

SEQ ID NO: 31556 - DNA, 26 bp, Artificial sequence
  SiRNA target sequence
tgtgtgtttccttaaatggaatagta

SEQ ID NO: 31557 - DNA, 26 bp, Artificial sequence
  SiRNA target sequence
gtgtgtttccttaaatggaatagtag

SEQ ID NO: 31558 - DNA, 26 bp, Artificial sequence
  SiRNA target sequence
tgtgtttccttaaatggaatagtaga

SEQ ID NO: 31559 - DNA, 26 bp, Artificial sequence
  SiRNA target sequence
gtgtttccttaaatggaatagtagaa

SEQ ID NO: 31560 - DNA, 26 bp, Artificial sequence
  SiRNA target sequence
tgtttccttaaatggaatagtagaat

SEQ ID NO: 31561 - DNA, 26 bp, Artificial sequence
  SiRNA target sequence
gtttccttaaatggaatagtagaatt

SEQ ID NO: 31562 - DNA, 26 bp, Artificial sequence
  SiRNA target sequence
tttccttaaatggaatagtagaattt

SEQ ID NO: 31563 - DNA, 26 bp, Artificial sequence
  SiRNA target sequence
ttccttaaatggaatagtagaatttc

SEQ ID NO: 31564 - DNA, 26 bp, Artificial sequence
  SiRNA target sequence
tccttaaatggaatagtagaatttct

SEQ ID NO: 31565 - DNA, 26 bp, Artificial sequence
  SiRNA target sequence
ccttaaatggaatagtagaatttcta

SEQ ID NO: 31566 - DNA, 26 bp, Artificial sequence
  SiRNA target sequence
cttaaatggaatagtagaatttctat

SEQ ID NO: 31567 - DNA, 26 bp, Artificial sequence
  SiRNA target sequence
ttaaatggaatagtagaatttctatg

SEQ ID NO: 31568 - DNA, 26 bp, Artificial sequence
  SiRNA target sequence
taaatggaatagtagaatttctatga

SEQ ID NO: 31569 - DNA, 26 bp, Artificial sequence
  SiRNA target sequence
aaatggaatagtagaatttctatgaa

SEQ ID NO: 31570 - DNA, 26 bp, Artificial sequence
  SiRNA target sequence
aatggaatagtagaatttctatgaat

SEQ ID NO: 31571 - DNA, 26 bp, Artificial sequence
  SiRNA target sequence
atggaatagtagaatttctatgaatt

SEQ ID NO: 31572 - DNA, 26 bp, Artificial sequence
  SiRNA target sequence
tggaatagtagaatttctatgaatta

SEQ ID NO: 31573 - DNA, 26 bp, Artificial sequence
  SiRNA target sequence
ggaatagtagaatttctatgaattat

SEQ ID NO: 31574 - DNA, 26 bp, Artificial sequence
  SiRNA target sequence
gaatagtagaatttctatgaattatc

SEQ ID NO: 31575 - DNA, 26 bp, Artificial sequence
  SiRNA target sequence
aatagtagaatttctatgaattatct

SEQ ID NO: 31576 - DNA, 26 bp, Artificial sequence
  SiRNA target sequence
atagtagaatttctatgaattatctt

SEQ ID NO: 31577 - DNA, 26 bp, Artificial sequence
  SiRNA target sequence
tagtagaatttctatgaattatctta

SEQ ID NO: 31578 - DNA, 26 bp, Artificial sequence
  SiRNA target sequence
agtagaatttctatgaattatcttat

SEQ ID NO: 31579 - DNA, 26 bp, Artificial sequence
  SiRNA target sequence
gtagaatttctatgaattatcttatt

SEQ ID NO: 31580 - DNA, 26 bp, Artificial sequence
  SiRNA target sequence
tagaatttctatgaattatcttatta

SEQ ID NO: 31581 - DNA, 26 bp, Artificial sequence
  SiRNA target sequence
agaatttctatgaattatcttattaa

SEQ ID NO: 31582 - DNA, 26 bp, Artificial sequence
  SiRNA target sequence
gaatttctatgaattatcttattaaa

SEQ ID NO: 31583 - DNA, 26 bp, Artificial sequence
  SiRNA target sequence
aatttctatgaattatcttattaaaa

SEQ ID NO: 31584 - DNA, 26 bp, Artificial sequence
  SiRNA target sequence
atttctatgaattatcttattaaaaa

SEQ ID NO: 31585 - DNA, 26 bp, Artificial sequence
  SiRNA target sequence
tttctatgaattatcttattaaaaat

SEQ ID NO: 31586 - DNA, 26 bp, Artificial sequence
  SiRNA target sequence
ttctatgaattatcttattaaaaatc

SEQ ID NO: 31587 - DNA, 26 bp, Artificial sequence
  SiRNA target sequence
tctatgaattatcttattaaaaatcc

SEQ ID NO: 31588 - DNA, 26 bp, Artificial sequence
  SiRNA target sequence
ctatgaattatcttattaaaaatccc

SEQ ID NO: 31589 - DNA, 26 bp, Artificial sequence
  SiRNA target sequence
tatgaattatcttattaaaaatcccg

SEQ ID NO: 31590 - DNA, 26 bp, Artificial sequence
  SiRNA target sequence
atgaattatcttattaaaaatcccgc

SEQ ID NO: 31591 - DNA, 26 bp, Artificial sequence
  SiRNA target sequence
tgaattatcttattaaaaatcccgcc

SEQ ID NO: 31592 - DNA, 26 bp, Artificial sequence
  SiRNA target sequence
gaattatcttattaaaaatcccgccc

SEQ ID NO: 31593 - DNA, 26 bp, Artificial sequence
  SiRNA target sequence
aattatcttattaaaaatcccgccca

SEQ ID NO: 31594 - DNA, 26 bp, Artificial sequence
  SiRNA target sequence
attatcttattaaaaatcccgcccaa

SEQ ID NO: 31595 - DNA, 26 bp, Artificial sequence
  SiRNA target sequence
ttatcttattaaaaatcccgcccaaa

SEQ ID NO: 31596 - DNA, 26 bp, Artificial sequence
  SiRNA target sequence
tatcttattaaaaatcccgcccaaaa

SEQ ID NO: 31597 - DNA, 26 bp, Artificial sequence
  SiRNA target sequence
atcttattaaaaatcccgcccaaaag

SEQ ID NO: 31598 - DNA, 26 bp, Artificial sequence
  SiRNA target sequence
tcttattaaaaatcccgcccaaaagc

SEQ ID NO: 31599 - DNA, 26 bp, Artificial sequence
  SiRNA target sequence
cttattaaaaatcccgcccaaaagct

SEQ ID NO: 31600 - DNA, 26 bp, Artificial sequence
  SiRNA target sequence
ttattaaaaatcccgcccaaaagctc

SEQ ID NO: 31601 - DNA, 26 bp, Artificial sequence
  SiRNA target sequence
tattaaaaatcccgcccaaaagctct

SEQ ID NO: 31602 - DNA, 26 bp, Artificial sequence
  SiRNA target sequence
attaaaaatcccgcccaaaagctcta

SEQ ID NO: 31603 - DNA, 26 bp, Artificial sequence
  SiRNA target sequence
ttaaaaatcccgcccaaaagctctat

SEQ ID NO: 31604 - DNA, 26 bp, Artificial sequence
  SiRNA target sequence
taaaaatcccgcccaaaagctctata

SEQ ID NO: 31605 - DNA, 26 bp, Artificial sequence
  SiRNA target sequence
aaaaatcccgcccaaaagctctatac

SEQ ID NO: 31606 - DNA, 26 bp, Artificial sequence
  SiRNA target sequence
aaaatcccgcccaaaagctctatacc

SEQ ID NO: 31607 - DNA, 26 bp, Artificial sequence
  SiRNA target sequence
aaatcccgcccaaaagctctatacct

SEQ ID NO: 31608 - DNA, 26 bp, Artificial sequence
  SiRNA target sequence
aatcccgcccaaaagctctataccta

SEQ ID NO: 31609 - DNA, 26 bp, Artificial sequence
  SiRNA target sequence
atcccgcccaaaagctctatacctaa

SEQ ID NO: 31610 - DNA, 26 bp, Artificial sequence
  SiRNA target sequence
tcccgcccaaaagctctatacctaaa

SEQ ID NO: 31611 - DNA, 26 bp, Artificial sequence
  SiRNA target sequence
cccgcccaaaagctctatacctaaac

SEQ ID NO: 31612 - DNA, 26 bp, Artificial sequence
  SiRNA target sequence
ccgcccaaaagctctatacctaaact

SEQ ID NO: 31613 - DNA, 26 bp, Artificial sequence
  SiRNA target sequence
cgcccaaaagctctatacctaaactc

SEQ ID NO: 31614 - DNA, 26 bp, Artificial sequence
  SiRNA target sequence
gcccaaaagctctatacctaaactca

SEQ ID NO: 31615 - DNA, 26 bp, Artificial sequence
  SiRNA target sequence
cccaaaagctctatacctaaactcaa

SEQ ID NO: 31616 - DNA, 26 bp, Artificial sequence
  SiRNA target sequence
ccaaaagctctatacctaaactcaat

SEQ ID NO: 31617 - DNA, 26 bp, Artificial sequence
  SiRNA target sequence
caaaagctctatacctaaactcaatg

SEQ ID NO: 31618 - DNA, 26 bp, Artificial sequence
  SiRNA target sequence
aaaagctctatacctaaactcaatgg

SEQ ID NO: 31619 - DNA, 26 bp, Artificial sequence
  SiRNA target sequence
aaagctctatacctaaactcaatggt

SEQ ID NO: 31620 - DNA, 26 bp, Artificial sequence
  SiRNA target sequence
aagctctatacctaaactcaatggta

SEQ ID NO: 31621 - DNA, 26 bp, Artificial sequence
  SiRNA target sequence
agctctatacctaaactcaatggtac

SEQ ID NO: 31622 - DNA, 26 bp, Artificial sequence
  SiRNA target sequence
gctctatacctaaactcaatggtact

SEQ ID NO: 31623 - DNA, 26 bp, Artificial sequence
  SiRNA target sequence
ctctatacctaaactcaatggtacta

SEQ ID NO: 31624 - DNA, 26 bp, Artificial sequence
  SiRNA target sequence
tctatacctaaactcaatggtactac

SEQ ID NO: 31625 - DNA, 26 bp, Artificial sequence
  SiRNA target sequence
ctatacctaaactcaatggtactaca

SEQ ID NO: 31626 - DNA, 26 bp, Artificial sequence
  SiRNA target sequence
tatacctaaactcaatggtactacat

SEQ ID NO: 31627 - DNA, 26 bp, Artificial sequence
  SiRNA target sequence
atacctaaactcaatggtactacatc

SEQ ID NO: 31628 - DNA, 26 bp, Artificial sequence
  SiRNA target sequence
tacctaaactcaatggtactacatcc

SEQ ID NO: 31629 - DNA, 26 bp, Artificial sequence
  SiRNA target sequence
acctaaactcaatggtactacatcca

SEQ ID NO: 31630 - DNA, 26 bp, Artificial sequence
  SiRNA target sequence
cctaaactcaatggtactacatccaa

SEQ ID NO: 31631 - DNA, 26 bp, Artificial sequence
  SiRNA target sequence
ctaaactcaatggtactacatccaat

SEQ ID NO: 31632 - DNA, 26 bp, Artificial sequence
  SiRNA target sequence
taaactcaatggtactacatccaata

SEQ ID NO: 31633 - DNA, 26 bp, Artificial sequence
  SiRNA target sequence
aaactcaatggtactacatccaataa

SEQ ID NO: 31634 - DNA, 26 bp, Artificial sequence
  SiRNA target sequence
aactcaatggtactacatccaataat

SEQ ID NO: 31635 - DNA, 26 bp, Artificial sequence
  SiRNA target sequence
actcaatggtactacatccaataata

SEQ ID NO: 31636 - DNA, 26 bp, Artificial sequence
  SiRNA target sequence
ctcaatggtactacatccaataatag

SEQ ID NO: 31637 - DNA, 26 bp, Artificial sequence
  SiRNA target sequence
tcaatggtactacatccaataatagg

SEQ ID NO: 31638 - DNA, 26 bp, Artificial sequence
  SiRNA target sequence
caatggtactacatccaataatagga

SEQ ID NO: 31639 - DNA, 26 bp, Artificial sequence
  SiRNA target sequence
aatggtactacatccaataataggac

SEQ ID NO: 31640 - DNA, 26 bp, Artificial sequence
  SiRNA target sequence
atggtactacatccaataataggaca

SEQ ID NO: 31641 - DNA, 26 bp, Artificial sequence
  SiRNA target sequence
tggtactacatccaataataggacat

SEQ ID NO: 31642 - DNA, 26 bp, Artificial sequence
  SiRNA target sequence
ggtactacatccaataataggacatc

SEQ ID NO: 31643 - DNA, 26 bp, Artificial sequence
  SiRNA target sequence
gtactacatccaataataggacatct

SEQ ID NO: 31644 - DNA, 26 bp, Artificial sequence
  SiRNA target sequence
tactacatccaataataggacatctt

SEQ ID NO: 31645 - DNA, 26 bp, Artificial sequence
  SiRNA target sequence
actacatccaataataggacatcttt

SEQ ID NO: 31646 - DNA, 26 bp, Artificial sequence
  SiRNA target sequence
ctacatccaataataggacatctttt

SEQ ID NO: 31647 - DNA, 26 bp, Artificial sequence
  SiRNA target sequence
tacatccaataataggacatctttta

SEQ ID NO: 31648 - DNA, 26 bp, Artificial sequence
  SiRNA target sequence
acatccaataataggacatcttttat

SEQ ID NO: 31649 - DNA, 26 bp, Artificial sequence
  SiRNA target sequence
catccaataataggacatcttttatt

SEQ ID NO: 31650 - DNA, 26 bp, Artificial sequence
  SiRNA target sequence
atccaataataggacatcttttattt

SEQ ID NO: 31651 - DNA, 26 bp, Artificial sequence
  SiRNA target sequence
tccaataataggacatcttttatttt

SEQ ID NO: 31652 - DNA, 26 bp, Artificial sequence
  SiRNA target sequence
ccaataataggacatcttttattttt

SEQ ID NO: 31653 - DNA, 26 bp, Artificial sequence
  SiRNA target sequence
caataataggacatcttttatttttc

SEQ ID NO: 31654 - DNA, 26 bp, Artificial sequence
  SiRNA target sequence
aataataggacatcttttatttttcc

SEQ ID NO: 31655 - DNA, 26 bp, Artificial sequence
  SiRNA target sequence
ataataggacatcttttatttttcct

SEQ ID NO: 31656 - DNA, 26 bp, Artificial sequence
  SiRNA target sequence
taataggacatcttttatttttcctt

SEQ ID NO: 31657 - DNA, 26 bp, Artificial sequence
  SiRNA target sequence
aataggacatcttttatttttccttc

SEQ ID NO: 31658 - DNA, 26 bp, Artificial sequence
  SiRNA target sequence
ataggacatcttttatttttccttct

SEQ ID NO: 31659 - DNA, 26 bp, Artificial sequence
  SiRNA target sequence
taggacatcttttatttttccttcta

SEQ ID NO: 31660 - DNA, 26 bp, Artificial sequence
  SiRNA target sequence
aggacatcttttatttttccttctaa

SEQ ID NO: 31661 - DNA, 26 bp, Artificial sequence
  SiRNA target sequence
ggacatcttttatttttccttctaac

SEQ ID NO: 31662 - DNA, 26 bp, Artificial sequence
  SiRNA target sequence
gacatcttttatttttccttctaaca

SEQ ID NO: 31663 - DNA, 26 bp, Artificial sequence
  SiRNA target sequence
acatcttttatttttccttctaacac

SEQ ID NO: 31664 - DNA, 26 bp, Artificial sequence
  SiRNA target sequence
catcttttatttttccttctaacacg

SEQ ID NO: 31665 - DNA, 26 bp, Artificial sequence
  SiRNA target sequence
atcttttatttttccttctaacacgc

SEQ ID NO: 31666 - DNA, 26 bp, Artificial sequence
  SiRNA target sequence
tcttttatttttccttctaacacgcc

SEQ ID NO: 31667 - DNA, 26 bp, Artificial sequence
  SiRNA target sequence
cttttatttttccttctaacacgcct

SEQ ID NO: 31668 - DNA, 26 bp, Artificial sequence
  SiRNA target sequence
ttttatttttccttctaacacgcctg

SEQ ID NO: 31669 - DNA, 26 bp, Artificial sequence
  SiRNA target sequence
tttatttttccttctaacacgcctgc

SEQ ID NO: 31670 - DNA, 26 bp, Artificial sequence
  SiRNA target sequence
ttatttttccttctaacacgcctgct

SEQ ID NO: 31671 - DNA, 26 bp, Artificial sequence
  SiRNA target sequence
tatttttccttctaacacgcctgctt

SEQ ID NO: 31672 - DNA, 26 bp, Artificial sequence
  SiRNA target sequence
atttttccttctaacacgcctgcttg

SEQ ID NO: 31673 - DNA, 26 bp, Artificial sequence
  SiRNA target sequence
tttttccttctaacacgcctgcttgt

SEQ ID NO: 31674 - DNA, 26 bp, Artificial sequence
  SiRNA target sequence
ttttccttctaacacgcctgcttgta

SEQ ID NO: 31675 - DNA, 26 bp, Artificial sequence
  SiRNA target sequence
tttccttctaacacgcctgcttgtag

SEQ ID NO: 31676 - DNA, 26 bp, Artificial sequence
  SiRNA target sequence
ttccttctaacacgcctgcttgtaga

SEQ ID NO: 31677 - DNA, 26 bp, Artificial sequence
  SiRNA target sequence
tccttctaacacgcctgcttgtagag

SEQ ID NO: 31678 - DNA, 26 bp, Artificial sequence
  SiRNA target sequence
ccttctaacacgcctgcttgtagagc

SEQ ID NO: 31679 - DNA, 26 bp, Artificial sequence
  SiRNA target sequence
cttctaacacgcctgcttgtagagcg

SEQ ID NO: 31680 - DNA, 26 bp, Artificial sequence
  SiRNA target sequence
ttctaacacgcctgcttgtagagcgg

SEQ ID NO: 31681 - DNA, 26 bp, Artificial sequence
  SiRNA target sequence
tctaacacgcctgcttgtagagcggc

SEQ ID NO: 31682 - DNA, 26 bp, Artificial sequence
  SiRNA target sequence
ctaacacgcctgcttgtagagcggcc

SEQ ID NO: 31683 - DNA, 26 bp, Artificial sequence
  SiRNA target sequence
taacacgcctgcttgtagagcggccc

SEQ ID NO: 31684 - DNA, 26 bp, Artificial sequence
  SiRNA target sequence
aacacgcctgcttgtagagcggcccc

SEQ ID NO: 31685 - DNA, 26 bp, Artificial sequence
  SiRNA target sequence
acacgcctgcttgtagagcggcccct

SEQ ID NO: 31686 - DNA, 26 bp, Artificial sequence
  SiRNA target sequence
cacgcctgcttgtagagcggcccctt

SEQ ID NO: 31687 - DNA, 26 bp, Artificial sequence
  SiRNA target sequence
acgcctgcttgtagagcggccccttt

SEQ ID NO: 31688 - DNA, 26 bp, Artificial sequence
  SiRNA target sequence
cgcctgcttgtagagcggccccttta

SEQ ID NO: 31689 - DNA, 26 bp, Artificial sequence
  SiRNA target sequence
gcctgcttgtagagcggcccctttag

SEQ ID NO: 31690 - DNA, 26 bp, Artificial sequence
  SiRNA target sequence
cctgcttgtagagcggcccctttagc

SEQ ID NO: 31691 - DNA, 26 bp, Artificial sequence
  SiRNA target sequence
ctgcttgtagagcggcccctttagca

SEQ ID NO: 31692 - DNA, 26 bp, Artificial sequence
  SiRNA target sequence
tgcttgtagagcggcccctttagcaa

SEQ ID NO: 31693 - DNA, 26 bp, Artificial sequence
  SiRNA target sequence
gcttgtagagcggcccctttagcaac

SEQ ID NO: 31694 - DNA, 26 bp, Artificial sequence
  SiRNA target sequence
cttgtagagcggcccctttagcaaca

SEQ ID NO: 31695 - DNA, 26 bp, Artificial sequence
  SiRNA target sequence
ttgtagagcggcccctttagcaacag

SEQ ID NO: 31696 - DNA, 26 bp, Artificial sequence
  SiRNA target sequence
tgtagagcggcccctttagcaacagc

SEQ ID NO: 31697 - DNA, 26 bp, Artificial sequence
  SiRNA target sequence
gtagagcggcccctttagcaacagct

SEQ ID NO: 31698 - DNA, 26 bp, Artificial sequence
  SiRNA target sequence
tagagcggcccctttagcaacagctt

SEQ ID NO: 31699 - DNA, 26 bp, Artificial sequence
  SiRNA target sequence
agagcggcccctttagcaacagcttc

SEQ ID NO: 31700 - DNA, 26 bp, Artificial sequence
  SiRNA target sequence
gagcggcccctttagcaacagcttca

SEQ ID NO: 31701 - DNA, 26 bp, Artificial sequence
  SiRNA target sequence
agcggcccctttagcaacagcttcat

SEQ ID NO: 31702 - DNA, 26 bp, Artificial sequence
  SiRNA target sequence
gcggcccctttagcaacagcttcatc

SEQ ID NO: 31703 - DNA, 26 bp, Artificial sequence
  SiRNA target sequence
cggcccctttagcaacagcttcatct

SEQ ID NO: 31704 - DNA, 26 bp, Artificial sequence
  SiRNA target sequence
ggcccctttagcaacagcttcatctg

SEQ ID NO: 31705 - DNA, 26 bp, Artificial sequence
  SiRNA target sequence
gcccctttagcaacagcttcatctgg

SEQ ID NO: 31706 - DNA, 26 bp, Artificial sequence
  SiRNA target sequence
cccctttagcaacagcttcatctgga

SEQ ID NO: 31707 - DNA, 26 bp, Artificial sequence
  SiRNA target sequence
ccctttagcaacagcttcatctggat

SEQ ID NO: 31708 - DNA, 26 bp, Artificial sequence
  SiRNA target sequence
cctttagcaacagcttcatctggatt

SEQ ID NO: 31709 - DNA, 26 bp, Artificial sequence
  SiRNA target sequence
ctttagcaacagcttcatctggatta

SEQ ID NO: 31710 - DNA, 26 bp, Artificial sequence
  SiRNA target sequence
tttagcaacagcttcatctggattaa

SEQ ID NO: 31711 - DNA, 26 bp, Artificial sequence
  SiRNA target sequence
ttagcaacagcttcatctggattaat

SEQ ID NO: 31712 - DNA, 26 bp, Artificial sequence
  SiRNA target sequence
tagcaacagcttcatctggattaata

SEQ ID NO: 31713 - DNA, 26 bp, Artificial sequence
  SiRNA target sequence
agcaacagcttcatctggattaatat

SEQ ID NO: 31714 - DNA, 26 bp, Artificial sequence
  SiRNA target sequence
gcaacagcttcatctggattaatatt

SEQ ID NO: 31715 - DNA, 26 bp, Artificial sequence
  SiRNA target sequence
caacagcttcatctggattaatattt

SEQ ID NO: 31716 - DNA, 26 bp, Artificial sequence
  SiRNA target sequence
aacagcttcatctggattaatatttg

SEQ ID NO: 31717 - DNA, 26 bp, Artificial sequence
  SiRNA target sequence
acagcttcatctggattaatatttgt

SEQ ID NO: 31718 - DNA, 26 bp, Artificial sequence
  SiRNA target sequence
cagcttcatctggattaatatttgta

SEQ ID NO: 31719 - DNA, 26 bp, Artificial sequence
  SiRNA target sequence
agcttcatctggattaatatttgtag

SEQ ID NO: 31720 - DNA, 26 bp, Artificial sequence
  SiRNA target sequence
gcttcatctggattaatatttgtaga

SEQ ID NO: 31721 - DNA, 26 bp, Artificial sequence
  SiRNA target sequence
cttcatctggattaatatttgtagaa

SEQ ID NO: 31722 - DNA, 26 bp, Artificial sequence
  SiRNA target sequence
ttcatctggattaatatttgtagaag

SEQ ID NO: 31723 - DNA, 26 bp, Artificial sequence
  SiRNA target sequence
tcatctggattaatatttgtagaagg

SEQ ID NO: 31724 - DNA, 26 bp, Artificial sequence
  SiRNA target sequence
catctggattaatatttgtagaaggc

SEQ ID NO: 31725 - DNA, 26 bp, Artificial sequence
  SiRNA target sequence
atctggattaatatttgtagaaggct

SEQ ID NO: 31726 - DNA, 26 bp, Artificial sequence
  SiRNA target sequence
tctggattaatatttgtagaaggctc

SEQ ID NO: 31727 - DNA, 26 bp, Artificial sequence
  SiRNA target sequence
ctggattaatatttgtagaaggctcg

SEQ ID NO: 31728 - DNA, 26 bp, Artificial sequence
  SiRNA target sequence
tggattaatatttgtagaaggctcga

SEQ ID NO: 31729 - DNA, 26 bp, Artificial sequence
  SiRNA target sequence
ggattaatatttgtagaaggctcgat

SEQ ID NO: 31730 - DNA, 26 bp, Artificial sequence
  SiRNA target sequence
gattaatatttgtagaaggctcgata

SEQ ID NO: 31731 - DNA, 26 bp, Artificial sequence
  SiRNA target sequence
attaatatttgtagaaggctcgatac

SEQ ID NO: 31732 - DNA, 26 bp, Artificial sequence
  SiRNA target sequence
ttaatatttgtagaaggctcgatacc

SEQ ID NO: 31733 - DNA, 26 bp, Artificial sequence
  SiRNA target sequence
taatatttgtagaaggctcgatacca

SEQ ID NO: 31734 - DNA, 26 bp, Artificial sequence
  SiRNA target sequence
aatatttgtagaaggctcgataccaa

SEQ ID NO: 31735 - DNA, 26 bp, Artificial sequence
  SiRNA target sequence
atatttgtagaaggctcgataccaaa

SEQ ID NO: 31736 - DNA, 26 bp, Artificial sequence
  SiRNA target sequence
tatttgtagaaggctcgataccaaaa

SEQ ID NO: 31737 - DNA, 26 bp, Artificial sequence
  SiRNA target sequence
atttgtagaaggctcgataccaaaaa

SEQ ID NO: 31738 - DNA, 26 bp, Artificial sequence
  SiRNA target sequence
tttgtagaaggctcgataccaaaaat

SEQ ID NO: 31739 - DNA, 26 bp, Artificial sequence
  SiRNA target sequence
ttgtagaaggctcgataccaaaaatc

SEQ ID NO: 31740 - DNA, 26 bp, Artificial sequence
  SiRNA target sequence
tgtagaaggctcgataccaaaaatct

SEQ ID NO: 31741 - DNA, 26 bp, Artificial sequence
  SiRNA target sequence
gtagaaggctcgataccaaaaatctt

SEQ ID NO: 31742 - DNA, 26 bp, Artificial sequence
  SiRNA target sequence
tagaaggctcgataccaaaaatcttc

SEQ ID NO: 31743 - DNA, 26 bp, Artificial sequence
  SiRNA target sequence
agaaggctcgataccaaaaatcttct

SEQ ID NO: 31744 - DNA, 26 bp, Artificial sequence
  SiRNA target sequence
gaaggctcgataccaaaaatcttctt

SEQ ID NO: 31745 - DNA, 26 bp, Artificial sequence
  SiRNA target sequence
aaggctcgataccaaaaatcttctta

SEQ ID NO: 31746 - DNA, 26 bp, Artificial sequence
  SiRNA target sequence
aggctcgataccaaaaatcttcttaa

SEQ ID NO: 31747 - DNA, 26 bp, Artificial sequence
  SiRNA target sequence
ggctcgataccaaaaatcttcttaac

SEQ ID NO: 31748 - DNA, 26 bp, Artificial sequence
  SiRNA target sequence
gctcgataccaaaaatcttcttaaca

SEQ ID NO: 31749 - DNA, 26 bp, Artificial sequence
  SiRNA target sequence
ctcgataccaaaaatcttcttaacaa

SEQ ID NO: 31750 - DNA, 26 bp, Artificial sequence
  SiRNA target sequence
tcgataccaaaaatcttcttaacaag

SEQ ID NO: 31751 - DNA, 26 bp, Artificial sequence
  SiRNA target sequence
cgataccaaaaatcttcttaacaagt

SEQ ID NO: 31752 - DNA, 26 bp, Artificial sequence
  SiRNA target sequence
gataccaaaaatcttcttaacaagtt

SEQ ID NO: 31753 - DNA, 26 bp, Artificial sequence
  SiRNA target sequence
ataccaaaaatcttcttaacaagttt

SEQ ID NO: 31754 - DNA, 26 bp, Artificial sequence
  SiRNA target sequence
taccaaaaatcttcttaacaagtttt

SEQ ID NO: 31755 - DNA, 26 bp, Artificial sequence
  SiRNA target sequence
accaaaaatcttcttaacaagttttc

SEQ ID NO: 31756 - DNA, 26 bp, Artificial sequence
  SiRNA target sequence
ccaaaaatcttcttaacaagttttct

SEQ ID NO: 31757 - DNA, 26 bp, Artificial sequence
  SiRNA target sequence
caaaaatcttcttaacaagttttcta

SEQ ID NO: 31758 - DNA, 26 bp, Artificial sequence
  SiRNA target sequence
aaaaatcttcttaacaagttttctaa

SEQ ID NO: 31759 - DNA, 26 bp, Artificial sequence
  SiRNA target sequence
aaaatcttcttaacaagttttctaac

SEQ ID NO: 31760 - DNA, 26 bp, Artificial sequence
  SiRNA target sequence
aaatcttcttaacaagttttctaaca

SEQ ID NO: 31761 - DNA, 26 bp, Artificial sequence
  SiRNA target sequence
aatcttcttaacaagttttctaacat

SEQ ID NO: 31762 - DNA, 26 bp, Artificial sequence
  SiRNA target sequence
atcttcttaacaagttttctaacata

SEQ ID NO: 31763 - DNA, 26 bp, Artificial sequence
  SiRNA target sequence
tcttcttaacaagttttctaacatac

SEQ ID NO: 31764 - DNA, 26 bp, Artificial sequence
  SiRNA target sequence
cttcttaacaagttttctaacatacg

SEQ ID NO: 31765 - DNA, 26 bp, Artificial sequence
  SiRNA target sequence
ttcttaacaagttttctaacatacgg

SEQ ID NO: 31766 - DNA, 26 bp, Artificial sequence
  SiRNA target sequence
tcttaacaagttttctaacatacggc

SEQ ID NO: 31767 - DNA, 26 bp, Artificial sequence
  SiRNA target sequence
cttaacaagttttctaacatacggca

SEQ ID NO: 31768 - DNA, 26 bp, Artificial sequence
  SiRNA target sequence
ttaacaagttttctaacatacggcat

SEQ ID NO: 31769 - DNA, 26 bp, Artificial sequence
  SiRNA target sequence
taacaagttttctaacatacggcatt

SEQ ID NO: 31770 - DNA, 26 bp, Artificial sequence
  SiRNA target sequence
aacaagttttctaacatacggcattc

SEQ ID NO: 31771 - DNA, 26 bp, Artificial sequence
  SiRNA target sequence
acaagttttctaacatacggcattcg

SEQ ID NO: 31772 - DNA, 26 bp, Artificial sequence
  SiRNA target sequence
caagttttctaacatacggcattcgt

SEQ ID NO: 31773 - DNA, 26 bp, Artificial sequence
  SiRNA target sequence
aagttttctaacatacggcattcgtg

SEQ ID NO: 31774 - DNA, 26 bp, Artificial sequence
  SiRNA target sequence
agttttctaacatacggcattcgtgt

SEQ ID NO: 31775 - DNA, 26 bp, Artificial sequence
  SiRNA target sequence
gttttctaacatacggcattcgtgtc

SEQ ID NO: 31776 - DNA, 26 bp, Artificial sequence
  SiRNA target sequence
ttttctaacatacggcattcgtgtca

SEQ ID NO: 31777 - DNA, 26 bp, Artificial sequence
  SiRNA target sequence
tttctaacatacggcattcgtgtcat

SEQ ID NO: 31778 - DNA, 26 bp, Artificial sequence
  SiRNA target sequence
ttctaacatacggcattcgtgtcatt

SEQ ID NO: 31779 - DNA, 26 bp, Artificial sequence
  SiRNA target sequence
tctaacatacggcattcgtgtcattc

SEQ ID NO: 31780 - DNA, 26 bp, Artificial sequence
  SiRNA target sequence
ctaacatacggcattcgtgtcattcc

SEQ ID NO: 31781 - DNA, 26 bp, Artificial sequence
  SiRNA target sequence
taacatacggcattcgtgtcattcca

SEQ ID NO: 31782 - DNA, 26 bp, Artificial sequence
  SiRNA target sequence
aacatacggcattcgtgtcattccac

SEQ ID NO: 31783 - DNA, 26 bp, Artificial sequence
  SiRNA target sequence
acatacggcattcgtgtcattccacc

SEQ ID NO: 31784 - DNA, 26 bp, Artificial sequence
  SiRNA target sequence
catacggcattcgtgtcattccaccc

SEQ ID NO: 31785 - DNA, 26 bp, Artificial sequence
  SiRNA target sequence
atacggcattcgtgtcattccaccca

SEQ ID NO: 31786 - DNA, 26 bp, Artificial sequence
  SiRNA target sequence
tacggcattcgtgtcattccacccac

SEQ ID NO: 31787 - DNA, 26 bp, Artificial sequence
  SiRNA target sequence
acggcattcgtgtcattccacccaca

SEQ ID NO: 31788 - DNA, 26 bp, Artificial sequence
  SiRNA target sequence
cggcattcgtgtcattccacccacaa

SEQ ID NO: 31789 - DNA, 26 bp, Artificial sequence
  SiRNA target sequence
ggcattcgtgtcattccacccacaag

SEQ ID NO: 31790 - DNA, 26 bp, Artificial sequence
  SiRNA target sequence
gcattcgtgtcattccacccacaagt

SEQ ID NO: 31791 - DNA, 26 bp, Artificial sequence
  SiRNA target sequence
cattcgtgtcattccacccacaagta

SEQ ID NO: 31792 - DNA, 26 bp, Artificial sequence
  SiRNA target sequence
attcgtgtcattccacccacaagtat

SEQ ID NO: 31793 - DNA, 26 bp, Artificial sequence
  SiRNA target sequence
ttcgtgtcattccacccacaagtata

SEQ ID NO: 31794 - DNA, 26 bp, Artificial sequence
  SiRNA target sequence
tcgtgtcattccacccacaagtataa

SEQ ID NO: 31795 - DNA, 26 bp, Artificial sequence
  SiRNA target sequence
cgtgtcattccacccacaagtataac

SEQ ID NO: 31796 - DNA, 26 bp, Artificial sequence
  SiRNA target sequence
gtgtcattccacccacaagtataacg

SEQ ID NO: 31797 - DNA, 26 bp, Artificial sequence
  SiRNA target sequence
tgtcattccacccacaagtataacgt

SEQ ID NO: 31798 - DNA, 26 bp, Artificial sequence
  SiRNA target sequence
gtcattccacccacaagtataacgtg

SEQ ID NO: 31799 - DNA, 26 bp, Artificial sequence
  SiRNA target sequence
tcattccacccacaagtataacgtgt

SEQ ID NO: 31800 - DNA, 26 bp, Artificial sequence
  SiRNA target sequence
cattccacccacaagtataacgtgtt

SEQ ID NO: 31801 - DNA, 26 bp, Artificial sequence
  SiRNA target sequence
attccacccacaagtataacgtgttt

SEQ ID NO: 31802 - DNA, 26 bp, Artificial sequence
  SiRNA target sequence
ttccacccacaagtataacgtgttta

SEQ ID NO: 31803 - DNA, 26 bp, Artificial sequence
  SiRNA target sequence
tccacccacaagtataacgtgtttaa

SEQ ID NO: 31804 - DNA, 26 bp, Artificial sequence
  SiRNA target sequence
ccacccacaagtataacgtgtttaat

SEQ ID NO: 31805 - DNA, 26 bp, Artificial sequence
  SiRNA target sequence
cacccacaagtataacgtgtttaata

SEQ ID NO: 31806 - DNA, 26 bp, Artificial sequence
  SiRNA target sequence
acccacaagtataacgtgtttaatat

SEQ ID NO: 31807 - DNA, 26 bp, Artificial sequence
  SiRNA target sequence
cccacaagtataacgtgtttaatatc

SEQ ID NO: 31808 - DNA, 26 bp, Artificial sequence
  SiRNA target sequence
ccacaagtataacgtgtttaatatca

SEQ ID NO: 31809 - DNA, 26 bp, Artificial sequence
  SiRNA target sequence
cacaagtataacgtgtttaatatcac

SEQ ID NO: 31810 - DNA, 26 bp, Artificial sequence
  SiRNA target sequence
acaagtataacgtgtttaatatcact

SEQ ID NO: 31811 - DNA, 26 bp, Artificial sequence
  SiRNA target sequence
caagtataacgtgtttaatatcactt

SEQ ID NO: 31812 - DNA, 26 bp, Artificial sequence
  SiRNA target sequence
aagtataacgtgtttaatatcacttt

SEQ ID NO: 31813 - DNA, 26 bp, Artificial sequence
  SiRNA target sequence
agtataacgtgtttaatatcactttt

SEQ ID NO: 31814 - DNA, 26 bp, Artificial sequence
  SiRNA target sequence
gtataacgtgtttaatatcactttta

SEQ ID NO: 31815 - DNA, 26 bp, Artificial sequence
  SiRNA target sequence
tataacgtgtttaatatcacttttag

SEQ ID NO: 31816 - DNA, 26 bp, Artificial sequence
  SiRNA target sequence
ataacgtgtttaatatcacttttagt

SEQ ID NO: 31817 - DNA, 26 bp, Artificial sequence
  SiRNA target sequence
taacgtgtttaatatcacttttagtt

SEQ ID NO: 31818 - DNA, 26 bp, Artificial sequence
  SiRNA target sequence
aacgtgtttaatatcacttttagtta

SEQ ID NO: 31819 - DNA, 26 bp, Artificial sequence
  SiRNA target sequence
acgtgtttaatatcacttttagttat

SEQ ID NO: 31820 - DNA, 26 bp, Artificial sequence
  SiRNA target sequence
cgtgtttaatatcacttttagttata

SEQ ID NO: 31821 - DNA, 26 bp, Artificial sequence
  SiRNA target sequence
gtgtttaatatcacttttagttatat

SEQ ID NO: 31822 - DNA, 26 bp, Artificial sequence
  SiRNA target sequence
tgtttaatatcacttttagttatatt

SEQ ID NO: 31823 - DNA, 26 bp, Artificial sequence
  SiRNA target sequence
gtttaatatcacttttagttatattg

SEQ ID NO: 31824 - DNA, 26 bp, Artificial sequence
  SiRNA target sequence
tttaatatcacttttagttatattgg

SEQ ID NO: 31825 - DNA, 26 bp, Artificial sequence
  SiRNA target sequence
ttaatatcacttttagttatattggc

SEQ ID NO: 31826 - DNA, 26 bp, Artificial sequence
  SiRNA target sequence
taatatcacttttagttatattggca

SEQ ID NO: 31827 - DNA, 26 bp, Artificial sequence
  SiRNA target sequence
aatatcacttttagttatattggcat

SEQ ID NO: 31828 - DNA, 26 bp, Artificial sequence
  SiRNA target sequence
atatcacttttagttatattggcatc

SEQ ID NO: 31829 - DNA, 26 bp, Artificial sequence
  SiRNA target sequence
tatcacttttagttatattggcatct

SEQ ID NO: 31830 - DNA, 26 bp, Artificial sequence
  SiRNA target sequence
atcacttttagttatattggcatctc

SEQ ID NO: 31831 - DNA, 26 bp, Artificial sequence
  SiRNA target sequence
tcacttttagttatattggcatctct

SEQ ID NO: 31832 - DNA, 26 bp, Artificial sequence
  SiRNA target sequence
cacttttagttatattggcatctcta

SEQ ID NO: 31833 - DNA, 26 bp, Artificial sequence
  SiRNA target sequence
acttttagttatattggcatctctaa

SEQ ID NO: 31834 - DNA, 26 bp, Artificial sequence
  SiRNA target sequence
cttttagttatattggcatctctaat

SEQ ID NO: 31835 - DNA, 26 bp, Artificial sequence
  SiRNA target sequence
ttttagttatattggcatctctaata

SEQ ID NO: 31836 - DNA, 26 bp, Artificial sequence
  SiRNA target sequence
tttagttatattggcatctctaatag

SEQ ID NO: 31837 - DNA, 26 bp, Artificial sequence
  SiRNA target sequence
ttagttatattggcatctctaatagc

SEQ ID NO: 31838 - DNA, 26 bp, Artificial sequence
  SiRNA target sequence
tagttatattggcatctctaatagct

SEQ ID NO: 31839 - DNA, 26 bp, Artificial sequence
  SiRNA target sequence
agttatattggcatctctaatagctt

SEQ ID NO: 31840 - DNA, 26 bp, Artificial sequence
  SiRNA target sequence
gttatattggcatctctaatagcttt

SEQ ID NO: 31841 - DNA, 26 bp, Artificial sequence
  SiRNA target sequence
ttatattggcatctctaatagcttta

SEQ ID NO: 31842 - DNA, 26 bp, Artificial sequence
  SiRNA target sequence
tatattggcatctctaatagctttaa

SEQ ID NO: 31843 - DNA, 26 bp, Artificial sequence
  SiRNA target sequence
atattggcatctctaatagctttaag

SEQ ID NO: 31844 - DNA, 26 bp, Artificial sequence
  SiRNA target sequence
tattggcatctctaatagctttaaga

SEQ ID NO: 31845 - DNA, 26 bp, Artificial sequence
  SiRNA target sequence
attggcatctctaatagctttaagac

SEQ ID NO: 31846 - DNA, 26 bp, Artificial sequence
  SiRNA target sequence
ttggcatctctaatagctttaagaca

SEQ ID NO: 31847 - DNA, 26 bp, Artificial sequence
  SiRNA target sequence
tggcatctctaatagctttaagacag

SEQ ID NO: 31848 - DNA, 26 bp, Artificial sequence
  SiRNA target sequence
ggcatctctaatagctttaagacagg

SEQ ID NO: 31849 - DNA, 26 bp, Artificial sequence
  SiRNA target sequence
gcatctctaatagctttaagacaggg

SEQ ID NO: 31850 - DNA, 26 bp, Artificial sequence
  SiRNA target sequence
catctctaatagctttaagacagggg

SEQ ID NO: 31851 - DNA, 26 bp, Artificial sequence
  SiRNA target sequence
atctctaatagctttaagacaggggt

SEQ ID NO: 31852 - DNA, 26 bp, Artificial sequence
  SiRNA target sequence
tctctaatagctttaagacaggggtt

SEQ ID NO: 31853 - DNA, 26 bp, Artificial sequence
  SiRNA target sequence
ctctaatagctttaagacaggggttt

SEQ ID NO: 31854 - DNA, 26 bp, Artificial sequence
  SiRNA target sequence
tctaatagctttaagacaggggttta

SEQ ID NO: 31855 - DNA, 26 bp, Artificial sequence
  SiRNA target sequence
ctaatagctttaagacaggggtttat

SEQ ID NO: 31856 - DNA, 26 bp, Artificial sequence
  SiRNA target sequence
taatagctttaagacaggggtttatt

SEQ ID NO: 31857 - DNA, 26 bp, Artificial sequence
  SiRNA target sequence
aatagctttaagacaggggtttattg

SEQ ID NO: 31858 - DNA, 26 bp, Artificial sequence
  SiRNA target sequence
atagctttaagacaggggtttattgt

SEQ ID NO: 31859 - DNA, 26 bp, Artificial sequence
  SiRNA target sequence
tagctttaagacaggggtttattgtt

SEQ ID NO: 31860 - DNA, 26 bp, Artificial sequence
  SiRNA target sequence
agctttaagacaggggtttattgttt

SEQ ID NO: 31861 - DNA, 26 bp, Artificial sequence
  SiRNA target sequence
gctttaagacaggggtttattgtttt

SEQ ID NO: 31862 - DNA, 26 bp, Artificial sequence
  SiRNA target sequence
ctttaagacaggggtttattgttttg

SEQ ID NO: 31863 - DNA, 26 bp, Artificial sequence
  SiRNA target sequence
tttaagacaggggtttattgttttgt

SEQ ID NO: 31864 - DNA, 26 bp, Artificial sequence
  SiRNA target sequence
ttaagacaggggtttattgttttgtc

SEQ ID NO: 31865 - DNA, 26 bp, Artificial sequence
  SiRNA target sequence
taagacaggggtttattgttttgtct

SEQ ID NO: 31866 - DNA, 26 bp, Artificial sequence
  SiRNA target sequence
aagacaggggtttattgttttgtcta

SEQ ID NO: 31867 - DNA, 26 bp, Artificial sequence
  SiRNA target sequence
agacaggggtttattgttttgtctat

SEQ ID NO: 31868 - DNA, 26 bp, Artificial sequence
  SiRNA target sequence
gacaggggtttattgttttgtctatt

SEQ ID NO: 31869 - DNA, 26 bp, Artificial sequence
  SiRNA target sequence
acaggggtttattgttttgtctatta

SEQ ID NO: 31870 - DNA, 26 bp, Artificial sequence
  SiRNA target sequence
caggggtttattgttttgtctattaa

SEQ ID NO: 31871 - DNA, 26 bp, Artificial sequence
  SiRNA target sequence
aggggtttattgttttgtctattaac

SEQ ID NO: 31872 - DNA, 26 bp, Artificial sequence
  SiRNA target sequence
ggggtttattgttttgtctattaact

SEQ ID NO: 31873 - DNA, 26 bp, Artificial sequence
  SiRNA target sequence
gggtttattgttttgtctattaactt

SEQ ID NO: 31874 - DNA, 26 bp, Artificial sequence
  SiRNA target sequence
ggtttattgttttgtctattaacttt

SEQ ID NO: 31875 - DNA, 26 bp, Artificial sequence
  SiRNA target sequence
gtttattgttttgtctattaactttt

SEQ ID NO: 31876 - DNA, 26 bp, Artificial sequence
  SiRNA target sequence
tttattgttttgtctattaacttttt

SEQ ID NO: 31877 - DNA, 26 bp, Artificial sequence
  SiRNA target sequence
ttattgttttgtctattaactttttt

SEQ ID NO: 31878 - DNA, 26 bp, Artificial sequence
  SiRNA target sequence
tattgttttgtctattaacttttttg

SEQ ID NO: 31879 - DNA, 26 bp, Artificial sequence
  SiRNA target sequence
attgttttgtctattaacttttttgt

SEQ ID NO: 31880 - DNA, 26 bp, Artificial sequence
  SiRNA target sequence
ttgttttgtctattaacttttttgta

SEQ ID NO: 31881 - DNA, 26 bp, Artificial sequence
  SiRNA target sequence
tgttttgtctattaacttttttgtaa

SEQ ID NO: 31882 - DNA, 26 bp, Artificial sequence
  SiRNA target sequence
gttttgtctattaacttttttgtaat

SEQ ID NO: 31883 - DNA, 26 bp, Artificial sequence
  SiRNA target sequence
ttttgtctattaacttttttgtaatt

SEQ ID NO: 31884 - DNA, 26 bp, Artificial sequence
  SiRNA target sequence
tttgtctattaacttttttgtaattt

SEQ ID NO: 31885 - DNA, 26 bp, Artificial sequence
  SiRNA target sequence
ttgtctattaacttttttgtaatttt

SEQ ID NO: 31886 - DNA, 26 bp, Artificial sequence
  SiRNA target sequence
tgtctattaacttttttgtaattttt

SEQ ID NO: 31887 - DNA, 26 bp, Artificial sequence
  SiRNA target sequence
gtctattaacttttttgtaatttttt

SEQ ID NO: 31888 - DNA, 26 bp, Artificial sequence
  SiRNA target sequence
tctattaacttttttgtaattttttc

SEQ ID NO: 31889 - DNA, 26 bp, Artificial sequence
  SiRNA target sequence
ctattaacttttttgtaattttttca

SEQ ID NO: 31890 - DNA, 26 bp, Artificial sequence
  SiRNA target sequence
tattaacttttttgtaattttttcaa

SEQ ID NO: 31891 - DNA, 26 bp, Artificial sequence
  SiRNA target sequence
attaacttttttgtaattttttcaaa

SEQ ID NO: 31892 - DNA, 26 bp, Artificial sequence
  SiRNA target sequence
ttaacttttttgtaattttttcaaat

SEQ ID NO: 31893 - DNA, 26 bp, Artificial sequence
  SiRNA target sequence
taacttttttgtaattttttcaaatt

SEQ ID NO: 31894 - DNA, 26 bp, Artificial sequence
  SiRNA target sequence
aacttttttgtaattttttcaaattc

SEQ ID NO: 31895 - DNA, 26 bp, Artificial sequence
  SiRNA target sequence
acttttttgtaattttttcaaattcg

SEQ ID NO: 31896 - DNA, 26 bp, Artificial sequence
  SiRNA target sequence
cttttttgtaattttttcaaattcgt

SEQ ID NO: 31897 - DNA, 26 bp, Artificial sequence
  SiRNA target sequence
ttttttgtaattttttcaaattcgtc

SEQ ID NO: 31898 - DNA, 26 bp, Artificial sequence
  SiRNA target sequence
tttttgtaattttttcaaattcgtcg

SEQ ID NO: 31899 - DNA, 26 bp, Artificial sequence
  SiRNA target sequence
ttttgtaattttttcaaattcgtcgc

SEQ ID NO: 31900 - DNA, 26 bp, Artificial sequence
  SiRNA target sequence
tttgtaattttttcaaattcgtcgcg

SEQ ID NO: 31901 - DNA, 26 bp, Artificial sequence
  SiRNA target sequence
ttgtaattttttcaaattcgtcgcgt

SEQ ID NO: 31902 - DNA, 26 bp, Artificial sequence
  SiRNA target sequence
tgtaattttttcaaattcgtcgcgtg

SEQ ID NO: 31903 - DNA, 26 bp, Artificial sequence
  SiRNA target sequence
gtaattttttcaaattcgtcgcgtgt

SEQ ID NO: 31904 - DNA, 26 bp, Artificial sequence
  SiRNA target sequence
taattttttcaaattcgtcgcgtgta

SEQ ID NO: 31905 - DNA, 26 bp, Artificial sequence
  SiRNA target sequence
aattttttcaaattcgtcgcgtgtaa

SEQ ID NO: 31906 - DNA, 26 bp, Artificial sequence
  SiRNA target sequence
attttttcaaattcgtcgcgtgtaat

SEQ ID NO: 31907 - DNA, 26 bp, Artificial sequence
  SiRNA target sequence
ttttttcaaattcgtcgcgtgtaatt

SEQ ID NO: 31908 - DNA, 26 bp, Artificial sequence
  SiRNA target sequence
tttttcaaattcgtcgcgtgtaatta

SEQ ID NO: 31909 - DNA, 26 bp, Artificial sequence
  SiRNA target sequence
ttttcaaattcgtcgcgtgtaattac

SEQ ID NO: 31910 - DNA, 26 bp, Artificial sequence
  SiRNA target sequence
tttcaaattcgtcgcgtgtaattacc

SEQ ID NO: 31911 - DNA, 26 bp, Artificial sequence
  SiRNA target sequence
ttcaaattcgtcgcgtgtaattacct

SEQ ID NO: 31912 - DNA, 26 bp, Artificial sequence
  SiRNA target sequence
tcaaattcgtcgcgtgtaattacctc

SEQ ID NO: 31913 - DNA, 26 bp, Artificial sequence
  SiRNA target sequence
caaattcgtcgcgtgtaattacctct

SEQ ID NO: 31914 - DNA, 26 bp, Artificial sequence
  SiRNA target sequence
aaattcgtcgcgtgtaattacctctt

SEQ ID NO: 31915 - DNA, 26 bp, Artificial sequence
  SiRNA target sequence
aattcgtcgcgtgtaattacctcttt

SEQ ID NO: 31916 - DNA, 26 bp, Artificial sequence
  SiRNA target sequence
attcgtcgcgtgtaattacctctttt

SEQ ID NO: 31917 - DNA, 26 bp, Artificial sequence
  SiRNA target sequence
ttcgtcgcgtgtaattacctctttta

SEQ ID NO: 31918 - DNA, 26 bp, Artificial sequence
  SiRNA target sequence
tcgtcgcgtgtaattacctcttttaa

SEQ ID NO: 31919 - DNA, 26 bp, Artificial sequence
  SiRNA target sequence
cgtcgcgtgtaattacctcttttaag

SEQ ID NO: 31920 - DNA, 26 bp, Artificial sequence
  SiRNA target sequence
gtcgcgtgtaattacctcttttaagt

SEQ ID NO: 31921 - DNA, 26 bp, Artificial sequence
  SiRNA target sequence
tcgcgtgtaattacctcttttaagtg

SEQ ID NO: 31922 - DNA, 26 bp, Artificial sequence
  SiRNA target sequence
cgcgtgtaattacctcttttaagtga

SEQ ID NO: 31923 - DNA, 26 bp, Artificial sequence
  SiRNA target sequence
gcgtgtaattacctcttttaagtgat

SEQ ID NO: 31924 - DNA, 26 bp, Artificial sequence
  SiRNA target sequence
cgtgtaattacctcttttaagtgata

SEQ ID NO: 31925 - DNA, 26 bp, Artificial sequence
  SiRNA target sequence
gtgtaattacctcttttaagtgataa

SEQ ID NO: 31926 - DNA, 26 bp, Artificial sequence
  SiRNA target sequence
tgtaattacctcttttaagtgataat

SEQ ID NO: 31927 - DNA, 26 bp, Artificial sequence
  SiRNA target sequence
gtaattacctcttttaagtgataatt

SEQ ID NO: 31928 - DNA, 26 bp, Artificial sequence
  SiRNA target sequence
taattacctcttttaagtgataattc

SEQ ID NO: 31929 - DNA, 26 bp, Artificial sequence
  SiRNA target sequence
aattacctcttttaagtgataattct

SEQ ID NO: 31930 - DNA, 26 bp, Artificial sequence
  SiRNA target sequence
attacctcttttaagtgataattctt

SEQ ID NO: 31931 - DNA, 26 bp, Artificial sequence
  SiRNA target sequence
ttacctcttttaagtgataattcttt

SEQ ID NO: 31932 - DNA, 26 bp, Artificial sequence
  SiRNA target sequence
tacctcttttaagtgataattctttt

SEQ ID NO: 31933 - DNA, 26 bp, Artificial sequence
  SiRNA target sequence
acctcttttaagtgataattcttttt

SEQ ID NO: 31934 - DNA, 26 bp, Artificial sequence
  SiRNA target sequence
cctcttttaagtgataattcttttta

SEQ ID NO: 31935 - DNA, 26 bp, Artificial sequence
  SiRNA target sequence
ctcttttaagtgataattctttttac

SEQ ID NO: 31936 - DNA, 26 bp, Artificial sequence
  SiRNA target sequence
tcttttaagtgataattctttttact

SEQ ID NO: 31937 - DNA, 26 bp, Artificial sequence
  SiRNA target sequence
cttttaagtgataattctttttacta

SEQ ID NO: 31938 - DNA, 26 bp, Artificial sequence
  SiRNA target sequence
ttttaagtgataattctttttactat

SEQ ID NO: 31939 - DNA, 26 bp, Artificial sequence
  SiRNA target sequence
tttaagtgataattctttttactatc

SEQ ID NO: 31940 - DNA, 26 bp, Artificial sequence
  SiRNA target sequence
ttaagtgataattctttttactatcg

SEQ ID NO: 31941 - DNA, 26 bp, Artificial sequence
  SiRNA target sequence
taagtgataattctttttactatcgt

SEQ ID NO: 31942 - DNA, 26 bp, Artificial sequence
  SiRNA target sequence
aagtgataattctttttactatcgtt

SEQ ID NO: 31943 - DNA, 26 bp, Artificial sequence
  SiRNA target sequence
agtgataattctttttactatcgtta

SEQ ID NO: 31944 - DNA, 26 bp, Artificial sequence
  SiRNA target sequence
gtgataattctttttactatcgttat

SEQ ID NO: 31945 - DNA, 26 bp, Artificial sequence
  SiRNA target sequence
tgataattctttttactatcgttata

SEQ ID NO: 31946 - DNA, 26 bp, Artificial sequence
  SiRNA target sequence
gataattctttttactatcgttataa

SEQ ID NO: 31947 - DNA, 26 bp, Artificial sequence
  SiRNA target sequence
ataattctttttactatcgttataaa

SEQ ID NO: 31948 - DNA, 26 bp, Artificial sequence
  SiRNA target sequence
taattctttttactatcgttataaat

SEQ ID NO: 31949 - DNA, 26 bp, Artificial sequence
  SiRNA target sequence
aattctttttactatcgttataaata

SEQ ID NO: 31950 - DNA, 26 bp, Artificial sequence
  SiRNA target sequence
attctttttactatcgttataaatat

SEQ ID NO: 31951 - DNA, 26 bp, Artificial sequence
  SiRNA target sequence
ttctttttactatcgttataaatata

SEQ ID NO: 31952 - DNA, 26 bp, Artificial sequence
  SiRNA target sequence
tctttttactatcgttataaatatac

SEQ ID NO: 31953 - DNA, 26 bp, Artificial sequence
  SiRNA target sequence
ctttttactatcgttataaatatacg

SEQ ID NO: 31954 - DNA, 26 bp, Artificial sequence
  SiRNA target sequence
tttttactatcgttataaatatacgg

SEQ ID NO: 31955 - DNA, 26 bp, Artificial sequence
  SiRNA target sequence
ttttactatcgttataaatatacgga

SEQ ID NO: 31956 - DNA, 26 bp, Artificial sequence
  SiRNA target sequence
tttactatcgttataaatatacggaa

SEQ ID NO: 31957 - DNA, 26 bp, Artificial sequence
  SiRNA target sequence
ttactatcgttataaatatacggaat

SEQ ID NO: 31958 - DNA, 26 bp, Artificial sequence
  SiRNA target sequence
tactatcgttataaatatacggaata

SEQ ID NO: 31959 - DNA, 26 bp, Artificial sequence
  SiRNA target sequence
actatcgttataaatatacggaatat

SEQ ID NO: 31960 - DNA, 26 bp, Artificial sequence
  SiRNA target sequence
ctatcgttataaatatacggaatatt

SEQ ID NO: 31961 - DNA, 26 bp, Artificial sequence
  SiRNA target sequence
tatcgttataaatatacggaatatta

SEQ ID NO: 31962 - DNA, 26 bp, Artificial sequence
  SiRNA target sequence
atcgttataaatatacggaatattaa

SEQ ID NO: 31963 - DNA, 26 bp, Artificial sequence
  SiRNA target sequence
tcgttataaatatacggaatattaat

SEQ ID NO: 31964 - DNA, 26 bp, Artificial sequence
  SiRNA target sequence
cgttataaatatacggaatattaatt

SEQ ID NO: 31965 - DNA, 26 bp, Artificial sequence
  SiRNA target sequence
gttataaatatacggaatattaattt

SEQ ID NO: 31966 - DNA, 26 bp, Artificial sequence
  SiRNA target sequence
ttataaatatacggaatattaatttc

SEQ ID NO: 31967 - DNA, 26 bp, Artificial sequence
  SiRNA target sequence
tataaatatacggaatattaatttca

SEQ ID NO: 31968 - DNA, 26 bp, Artificial sequence
  SiRNA target sequence
ataaatatacggaatattaatttcag

SEQ ID NO: 31969 - DNA, 26 bp, Artificial sequence
  SiRNA target sequence
taaatatacggaatattaatttcaga

SEQ ID NO: 31970 - DNA, 26 bp, Artificial sequence
  SiRNA target sequence
aaatatacggaatattaatttcagac

SEQ ID NO: 31971 - DNA, 26 bp, Artificial sequence
  SiRNA target sequence
aatatacggaatattaatttcagacg

SEQ ID NO: 31972 - DNA, 26 bp, Artificial sequence
  SiRNA target sequence
atatacggaatattaatttcagacga

SEQ ID NO: 31973 - DNA, 26 bp, Artificial sequence
  SiRNA target sequence
tatacggaatattaatttcagacgaa

SEQ ID NO: 31974 - DNA, 26 bp, Artificial sequence
  SiRNA target sequence
atacggaatattaatttcagacgaaa

SEQ ID NO: 31975 - DNA, 26 bp, Artificial sequence
  SiRNA target sequence
tacggaatattaatttcagacgaaag

SEQ ID NO: 31976 - DNA, 26 bp, Artificial sequence
  SiRNA target sequence
acggaatattaatttcagacgaaaga

SEQ ID NO: 31977 - DNA, 26 bp, Artificial sequence
  SiRNA target sequence
cggaatattaatttcagacgaaagat

SEQ ID NO: 31978 - DNA, 26 bp, Artificial sequence
  SiRNA target sequence
ggaatattaatttcagacgaaagatt

SEQ ID NO: 31979 - DNA, 26 bp, Artificial sequence
  SiRNA target sequence
gaatattaatttcagacgaaagatta

SEQ ID NO: 31980 - DNA, 26 bp, Artificial sequence
  SiRNA target sequence
aatattaatttcagacgaaagattag

SEQ ID NO: 31981 - DNA, 26 bp, Artificial sequence
  SiRNA target sequence
atattaatttcagacgaaagattaga

SEQ ID NO: 31982 - DNA, 26 bp, Artificial sequence
  SiRNA target sequence
tattaatttcagacgaaagattagac

SEQ ID NO: 31983 - DNA, 26 bp, Artificial sequence
  SiRNA target sequence
attaatttcagacgaaagattagacg

SEQ ID NO: 31984 - DNA, 26 bp, Artificial sequence
  SiRNA target sequence
ttaatttcagacgaaagattagacga

SEQ ID NO: 31985 - DNA, 26 bp, Artificial sequence
  SiRNA target sequence
taatttcagacgaaagattagacgac

SEQ ID NO: 31986 - DNA, 26 bp, Artificial sequence
  SiRNA target sequence
aatttcagacgaaagattagacgaca

SEQ ID NO: 31987 - DNA, 26 bp, Artificial sequence
  SiRNA target sequence
atttcagacgaaagattagacgacag

SEQ ID NO: 31988 - DNA, 26 bp, Artificial sequence
  SiRNA target sequence
tttcagacgaaagattagacgacagt

SEQ ID NO: 31989 - DNA, 26 bp, Artificial sequence
  SiRNA target sequence
ttcagacgaaagattagacgacagtt

SEQ ID NO: 31990 - DNA, 26 bp, Artificial sequence
  SiRNA target sequence
tcagacgaaagattagacgacagttc

SEQ ID NO: 31991 - DNA, 26 bp, Artificial sequence
  SiRNA target sequence
cagacgaaagattagacgacagttct

SEQ ID NO: 31992 - DNA, 26 bp, Artificial sequence
  SiRNA target sequence
agacgaaagattagacgacagttctt

SEQ ID NO: 31993 - DNA, 26 bp, Artificial sequence
  SiRNA target sequence
gacgaaagattagacgacagttcttt

SEQ ID NO: 31994 - DNA, 26 bp, Artificial sequence
  SiRNA target sequence
acgaaagattagacgacagttctttt

SEQ ID NO: 31995 - DNA, 26 bp, Artificial sequence
  SiRNA target sequence
cgaaagattagacgacagttcttttt

SEQ ID NO: 31996 - DNA, 26 bp, Artificial sequence
  SiRNA target sequence
gaaagattagacgacagttctttttt

SEQ ID NO: 31997 - DNA, 26 bp, Artificial sequence
  SiRNA target sequence
aaagattagacgacagttcttttttc

SEQ ID NO: 31998 - DNA, 26 bp, Artificial sequence
  SiRNA target sequence
aagattagacgacagttcttttttca

SEQ ID NO: 31999 - DNA, 26 bp, Artificial sequence
  SiRNA target sequence
agattagacgacagttcttttttcat

SEQ ID NO: 32000 - DNA, 26 bp, Artificial sequence
  SiRNA target sequence
gattagacgacagttcttttttcatt

SEQ ID NO: 32001 - DNA, 26 bp, Artificial sequence
  SiRNA target sequence
attagacgacagttcttttttcattt

SEQ ID NO: 32002 - DNA, 26 bp, Artificial sequence
  SiRNA target sequence
ttagacgacagttcttttttcatttt

SEQ ID NO: 32003 - DNA, 26 bp, Artificial sequence
  SiRNA target sequence
tagacgacagttcttttttcattttt

SEQ ID NO: 32004 - DNA, 26 bp, Artificial sequence
  SiRNA target sequence
agacgacagttcttttttcatttttt

SEQ ID NO: 32005 - DNA, 26 bp, Artificial sequence
  SiRNA target sequence
gacgacagttcttttttcattttttc

SEQ ID NO: 32006 - DNA, 26 bp, Artificial sequence
  SiRNA target sequence
acgacagttcttttttcattttttcc

SEQ ID NO: 32007 - DNA, 26 bp, Artificial sequence
  SiRNA target sequence
cgacagttcttttttcattttttccg

SEQ ID NO: 32008 - DNA, 26 bp, Artificial sequence
  SiRNA target sequence
gacagttcttttttcattttttccgc

SEQ ID NO: 32009 - DNA, 26 bp, Artificial sequence
  SiRNA target sequence
acagttcttttttcattttttccgct

SEQ ID NO: 32010 - DNA, 26 bp, Artificial sequence
  SiRNA target sequence
cagttcttttttcattttttccgctg

SEQ ID NO: 32011 - DNA, 26 bp, Artificial sequence
  SiRNA target sequence
agttcttttttcattttttccgctgc

SEQ ID NO: 32012 - DNA, 26 bp, Artificial sequence
  SiRNA target sequence
gttcttttttcattttttccgctgct

SEQ ID NO: 32013 - DNA, 26 bp, Artificial sequence
  SiRNA target sequence
ttcttttttcattttttccgctgctt

SEQ ID NO: 32014 - DNA, 26 bp, Artificial sequence
  SiRNA target sequence
tcttttttcattttttccgctgcttc

SEQ ID NO: 32015 - DNA, 26 bp, Artificial sequence
  SiRNA target sequence
cttttttcattttttccgctgcttct

SEQ ID NO: 32016 - DNA, 26 bp, Artificial sequence
  SiRNA target sequence
ttttttcattttttccgctgcttctt

SEQ ID NO: 32017 - DNA, 26 bp, Artificial sequence
  SiRNA target sequence
tttttcattttttccgctgcttcttt

SEQ ID NO: 32018 - DNA, 26 bp, Artificial sequence
  SiRNA target sequence
ttttcattttttccgctgcttcttta

SEQ ID NO: 32019 - DNA, 26 bp, Artificial sequence
  SiRNA target sequence
tttcattttttccgctgcttctttaa

SEQ ID NO: 32020 - DNA, 26 bp, Artificial sequence
  SiRNA target sequence
ttcattttttccgctgcttctttaat

SEQ ID NO: 32021 - DNA, 26 bp, Artificial sequence
  SiRNA target sequence
tcattttttccgctgcttctttaatt

SEQ ID NO: 32022 - DNA, 26 bp, Artificial sequence
  SiRNA target sequence
cattttttccgctgcttctttaattc

SEQ ID NO: 32023 - DNA, 26 bp, Artificial sequence
  SiRNA target sequence
attttttccgctgcttctttaattct

SEQ ID NO: 32024 - DNA, 26 bp, Artificial sequence
  SiRNA target sequence
ttttttccgctgcttctttaattcta

SEQ ID NO: 32025 - DNA, 26 bp, Artificial sequence
  SiRNA target sequence
tttttccgctgcttctttaattctat

SEQ ID NO: 32026 - DNA, 26 bp, Artificial sequence
  SiRNA target sequence
ttttccgctgcttctttaattctatt

SEQ ID NO: 32027 - DNA, 26 bp, Artificial sequence
  SiRNA target sequence
tttccgctgcttctttaattctatta

SEQ ID NO: 32028 - DNA, 26 bp, Artificial sequence
  SiRNA target sequence
ttccgctgcttctttaattctattat

SEQ ID NO: 32029 - DNA, 26 bp, Artificial sequence
  SiRNA target sequence
tccgctgcttctttaattctattata

SEQ ID NO: 32030 - DNA, 26 bp, Artificial sequence
  SiRNA target sequence
ccgctgcttctttaattctattataa

SEQ ID NO: 32031 - DNA, 26 bp, Artificial sequence
  SiRNA target sequence
cgctgcttctttaattctattataac

SEQ ID NO: 32032 - DNA, 26 bp, Artificial sequence
  SiRNA target sequence
gctgcttctttaattctattataaca

SEQ ID NO: 32033 - DNA, 26 bp, Artificial sequence
  SiRNA target sequence
ctgcttctttaattctattataacaa

SEQ ID NO: 32034 - DNA, 26 bp, Artificial sequence
  SiRNA target sequence
tgcttctttaattctattataacaag

SEQ ID NO: 32035 - DNA, 26 bp, Artificial sequence
  SiRNA target sequence
gcttctttaattctattataacaaga

SEQ ID NO: 32036 - DNA, 26 bp, Artificial sequence
  SiRNA target sequence
cttctttaattctattataacaagaa

SEQ ID NO: 32037 - DNA, 26 bp, Artificial sequence
  SiRNA target sequence
ttctttaattctattataacaagaat

SEQ ID NO: 32038 - DNA, 26 bp, Artificial sequence
  SiRNA target sequence
tctttaattctattataacaagaatc

SEQ ID NO: 32039 - DNA, 26 bp, Artificial sequence
  SiRNA target sequence
ctttaattctattataacaagaatcg

SEQ ID NO: 32040 - DNA, 26 bp, Artificial sequence
  SiRNA target sequence
tttaattctattataacaagaatcgt

SEQ ID NO: 32041 - DNA, 26 bp, Artificial sequence
  SiRNA target sequence
ttaattctattataacaagaatcgtg

SEQ ID NO: 32042 - DNA, 26 bp, Artificial sequence
  SiRNA target sequence
taattctattataacaagaatcgtgt

SEQ ID NO: 32043 - DNA, 26 bp, Artificial sequence
  SiRNA target sequence
aattctattataacaagaatcgtgtt

SEQ ID NO: 32044 - DNA, 26 bp, Artificial sequence
  SiRNA target sequence
attctattataacaagaatcgtgttt

SEQ ID NO: 32045 - DNA, 26 bp, Artificial sequence
  SiRNA target sequence
ttctattataacaagaatcgtgttta

SEQ ID NO: 32046 - DNA, 26 bp, Artificial sequence
  SiRNA target sequence
tctattataacaagaatcgtgtttaa

SEQ ID NO: 32047 - DNA, 26 bp, Artificial sequence
  SiRNA target sequence
ctattataacaagaatcgtgtttaag

SEQ ID NO: 32048 - DNA, 26 bp, Artificial sequence
  SiRNA target sequence
tattataacaagaatcgtgtttaagt

SEQ ID NO: 32049 - DNA, 26 bp, Artificial sequence
  SiRNA target sequence
attataacaagaatcgtgtttaagta

SEQ ID NO: 32050 - DNA, 26 bp, Artificial sequence
  SiRNA target sequence
ttataacaagaatcgtgtttaagtaa

SEQ ID NO: 32051 - DNA, 26 bp, Artificial sequence
  SiRNA target sequence
tataacaagaatcgtgtttaagtaaa

SEQ ID NO: 32052 - DNA, 26 bp, Artificial sequence
  SiRNA target sequence
ataacaagaatcgtgtttaagtaaat

SEQ ID NO: 32053 - DNA, 26 bp, Artificial sequence
  SiRNA target sequence
taacaagaatcgtgtttaagtaaatc

SEQ ID NO: 32054 - DNA, 26 bp, Artificial sequence
  SiRNA target sequence
aacaagaatcgtgtttaagtaaatca

SEQ ID NO: 32055 - DNA, 26 bp, Artificial sequence
  SiRNA target sequence
acaagaatcgtgtttaagtaaatcaa

SEQ ID NO: 32056 - DNA, 26 bp, Artificial sequence
  SiRNA target sequence
caagaatcgtgtttaagtaaatcaat

SEQ ID NO: 32057 - DNA, 26 bp, Artificial sequence
  SiRNA target sequence
aagaatcgtgtttaagtaaatcaatt

SEQ ID NO: 32058 - DNA, 26 bp, Artificial sequence
  SiRNA target sequence
agaatcgtgtttaagtaaatcaattc

SEQ ID NO: 32059 - DNA, 26 bp, Artificial sequence
  SiRNA target sequence
gaatcgtgtttaagtaaatcaattcc

SEQ ID NO: 32060 - DNA, 26 bp, Artificial sequence
  SiRNA target sequence
aatcgtgtttaagtaaatcaattcct

SEQ ID NO: 32061 - DNA, 26 bp, Artificial sequence
  SiRNA target sequence
atcgtgtttaagtaaatcaattcctg

SEQ ID NO: 32062 - DNA, 26 bp, Artificial sequence
  SiRNA target sequence
tcgtgtttaagtaaatcaattcctgt

SEQ ID NO: 32063 - DNA, 26 bp, Artificial sequence
  SiRNA target sequence
cgtgtttaagtaaatcaattcctgtt

SEQ ID NO: 32064 - DNA, 26 bp, Artificial sequence
  SiRNA target sequence
gtgtttaagtaaatcaattcctgttc

SEQ ID NO: 32065 - DNA, 26 bp, Artificial sequence
  SiRNA target sequence
tgtttaagtaaatcaattcctgttct

SEQ ID NO: 32066 - DNA, 26 bp, Artificial sequence
  SiRNA target sequence
gtttaagtaaatcaattcctgttcta

SEQ ID NO: 32067 - DNA, 26 bp, Artificial sequence
  SiRNA target sequence
tttaagtaaatcaattcctgttctac

SEQ ID NO: 32068 - DNA, 26 bp, Artificial sequence
  SiRNA target sequence
ttaagtaaatcaattcctgttctact

SEQ ID NO: 32069 - DNA, 26 bp, Artificial sequence
  SiRNA target sequence
taagtaaatcaattcctgttctactt

SEQ ID NO: 32070 - DNA, 26 bp, Artificial sequence
  SiRNA target sequence
aagtaaatcaattcctgttctacttt

SEQ ID NO: 32071 - DNA, 26 bp, Artificial sequence
  SiRNA target sequence
agtaaatcaattcctgttctactttt

SEQ ID NO: 32072 - DNA, 26 bp, Artificial sequence
  SiRNA target sequence
gtaaatcaattcctgttctactttta

SEQ ID NO: 32073 - DNA, 26 bp, Artificial sequence
  SiRNA target sequence
taaatcaattcctgttctacttttaa

SEQ ID NO: 32074 - DNA, 26 bp, Artificial sequence
  SiRNA target sequence
aaatcaattcctgttctacttttaaa

SEQ ID NO: 32075 - DNA, 26 bp, Artificial sequence
  SiRNA target sequence
aatcaattcctgttctacttttaaat

SEQ ID NO: 32076 - DNA, 26 bp, Artificial sequence
  SiRNA target sequence
atcaattcctgttctacttttaaatt

SEQ ID NO: 32077 - DNA, 26 bp, Artificial sequence
  SiRNA target sequence
tcaattcctgttctacttttaaattt

SEQ ID NO: 32078 - DNA, 26 bp, Artificial sequence
  SiRNA target sequence
caattcctgttctacttttaaatttt

SEQ ID NO: 32079 - DNA, 26 bp, Artificial sequence
  SiRNA target sequence
aattcctgttctacttttaaattttt

SEQ ID NO: 32080 - DNA, 26 bp, Artificial sequence
  SiRNA target sequence
attcctgttctacttttaaatttttc

SEQ ID NO: 32081 - DNA, 26 bp, Artificial sequence
  SiRNA target sequence
ttcctgttctacttttaaatttttca

SEQ ID NO: 32082 - DNA, 26 bp, Artificial sequence
  SiRNA target sequence
tcctgttctacttttaaatttttcat

SEQ ID NO: 32083 - DNA, 26 bp, Artificial sequence
  SiRNA target sequence
cctgttctacttttaaatttttcatt

SEQ ID NO: 32084 - DNA, 26 bp, Artificial sequence
  SiRNA target sequence
ctgttctacttttaaatttttcatta

SEQ ID NO: 32085 - DNA, 26 bp, Artificial sequence
  SiRNA target sequence
tgttctacttttaaatttttcattaa

SEQ ID NO: 32086 - DNA, 26 bp, Artificial sequence
  SiRNA target sequence
gttctacttttaaatttttcattaat

SEQ ID NO: 32087 - DNA, 26 bp, Artificial sequence
  SiRNA target sequence
ttctacttttaaatttttcattaata

SEQ ID NO: 32088 - DNA, 26 bp, Artificial sequence
  SiRNA target sequence
tctacttttaaatttttcattaatat

SEQ ID NO: 32089 - DNA, 26 bp, Artificial sequence
  SiRNA target sequence
ctacttttaaatttttcattaatata

SEQ ID NO: 32090 - DNA, 26 bp, Artificial sequence
  SiRNA target sequence
tacttttaaatttttcattaatataa

SEQ ID NO: 32091 - DNA, 26 bp, Artificial sequence
  SiRNA target sequence
acttttaaatttttcattaatataat

SEQ ID NO: 32092 - DNA, 26 bp, Artificial sequence
  SiRNA target sequence
cttttaaatttttcattaatataatc

SEQ ID NO: 32093 - DNA, 26 bp, Artificial sequence
  SiRNA target sequence
ttttaaatttttcattaatataatct

SEQ ID NO: 32094 - DNA, 26 bp, Artificial sequence
  SiRNA target sequence
tttaaatttttcattaatataatcta

SEQ ID NO: 32095 - DNA, 26 bp, Artificial sequence
  SiRNA target sequence
ttaaatttttcattaatataatctac

SEQ ID NO: 32096 - DNA, 26 bp, Artificial sequence
  SiRNA target sequence
taaatttttcattaatataatctact

SEQ ID NO: 32097 - DNA, 26 bp, Artificial sequence
  SiRNA target sequence
aaatttttcattaatataatctacta

SEQ ID NO: 32098 - DNA, 26 bp, Artificial sequence
  SiRNA target sequence
aatttttcattaatataatctactaa

SEQ ID NO: 32099 - DNA, 26 bp, Artificial sequence
  SiRNA target sequence
atttttcattaatataatctactaaa

SEQ ID NO: 32100 - DNA, 26 bp, Artificial sequence
  SiRNA target sequence
tttttcattaatataatctactaaag

SEQ ID NO: 32101 - DNA, 26 bp, Artificial sequence
  SiRNA target sequence
ttttcattaatataatctactaaagt

SEQ ID NO: 32102 - DNA, 26 bp, Artificial sequence
  SiRNA target sequence
tttcattaatataatctactaaagta

SEQ ID NO: 32103 - DNA, 26 bp, Artificial sequence
  SiRNA target sequence
ttcattaatataatctactaaagtat

SEQ ID NO: 32104 - DNA, 26 bp, Artificial sequence
  SiRNA target sequence
tcattaatataatctactaaagtatt

SEQ ID NO: 32105 - DNA, 26 bp, Artificial sequence
  SiRNA target sequence
cattaatataatctactaaagtatta

SEQ ID NO: 32106 - DNA, 26 bp, Artificial sequence
  SiRNA target sequence
attaatataatctactaaagtattat

SEQ ID NO: 32107 - DNA, 26 bp, Artificial sequence
  SiRNA target sequence
ttaatataatctactaaagtattatc

SEQ ID NO: 32108 - DNA, 26 bp, Artificial sequence
  SiRNA target sequence
taatataatctactaaagtattatcc

SEQ ID NO: 32109 - DNA, 26 bp, Artificial sequence
  SiRNA target sequence
aatataatctactaaagtattatcca

SEQ ID NO: 32110 - DNA, 26 bp, Artificial sequence
  SiRNA target sequence
atataatctactaaagtattatccaa

SEQ ID NO: 32111 - DNA, 26 bp, Artificial sequence
  SiRNA target sequence
tataatctactaaagtattatccaaa

SEQ ID NO: 32112 - DNA, 26 bp, Artificial sequence
  SiRNA target sequence
ataatctactaaagtattatccaaat

SEQ ID NO: 32113 - DNA, 26 bp, Artificial sequence
  SiRNA target sequence
taatctactaaagtattatccaaatc

SEQ ID NO: 32114 - DNA, 26 bp, Artificial sequence
  SiRNA target sequence
aatctactaaagtattatccaaatct

SEQ ID NO: 32115 - DNA, 26 bp, Artificial sequence
  SiRNA target sequence
atctactaaagtattatccaaatctt

SEQ ID NO: 32116 - DNA, 26 bp, Artificial sequence
  SiRNA target sequence
tctactaaagtattatccaaatcttc

SEQ ID NO: 32117 - DNA, 26 bp, Artificial sequence
  SiRNA target sequence
ctactaaagtattatccaaatcttct

SEQ ID NO: 32118 - DNA, 26 bp, Artificial sequence
  SiRNA target sequence
tactaaagtattatccaaatcttctc

SEQ ID NO: 32119 - DNA, 26 bp, Artificial sequence
  SiRNA target sequence
actaaagtattatccaaatcttctcc

SEQ ID NO: 32120 - DNA, 26 bp, Artificial sequence
  SiRNA target sequence
ctaaagtattatccaaatcttctcct

SEQ ID NO: 32121 - DNA, 26 bp, Artificial sequence
  SiRNA target sequence
taaagtattatccaaatcttctcctc

SEQ ID NO: 32122 - DNA, 26 bp, Artificial sequence
  SiRNA target sequence
aaagtattatccaaatcttctcctcc

SEQ ID NO: 32123 - DNA, 26 bp, Artificial sequence
  SiRNA target sequence
aagtattatccaaatcttctcctcct

SEQ ID NO: 32124 - DNA, 26 bp, Artificial sequence
  SiRNA target sequence
agtattatccaaatcttctcctccta

SEQ ID NO: 32125 - DNA, 26 bp, Artificial sequence
  SiRNA target sequence
gtattatccaaatcttctcctcctaa

SEQ ID NO: 32126 - DNA, 26 bp, Artificial sequence
  SiRNA target sequence
tattatccaaatcttctcctcctaaa

SEQ ID NO: 32127 - DNA, 26 bp, Artificial sequence
  SiRNA target sequence
attatccaaatcttctcctcctaaaa

SEQ ID NO: 32128 - DNA, 26 bp, Artificial sequence
  SiRNA target sequence
ttatccaaatcttctcctcctaaaaa

SEQ ID NO: 32129 - DNA, 26 bp, Artificial sequence
  SiRNA target sequence
tatccaaatcttctcctcctaaaaaa

SEQ ID NO: 32130 - DNA, 26 bp, Artificial sequence
  SiRNA target sequence
atccaaatcttctcctcctaaaaaag

SEQ ID NO: 32131 - DNA, 26 bp, Artificial sequence
  SiRNA target sequence
tccaaatcttctcctcctaaaaaagt

SEQ ID NO: 32132 - DNA, 26 bp, Artificial sequence
  SiRNA target sequence
ccaaatcttctcctcctaaaaaagta

SEQ ID NO: 32133 - DNA, 26 bp, Artificial sequence
  SiRNA target sequence
caaatcttctcctcctaaaaaagtat

SEQ ID NO: 32134 - DNA, 26 bp, Artificial sequence
  SiRNA target sequence
aaatcttctcctcctaaaaaagtatt

SEQ ID NO: 32135 - DNA, 26 bp, Artificial sequence
  SiRNA target sequence
aatcttctcctcctaaaaaagtattt

SEQ ID NO: 32136 - DNA, 26 bp, Artificial sequence
  SiRNA target sequence
atcttctcctcctaaaaaagtatttc

SEQ ID NO: 32137 - DNA, 26 bp, Artificial sequence
  SiRNA target sequence
tcttctcctcctaaaaaagtatttcc

SEQ ID NO: 32138 - DNA, 26 bp, Artificial sequence
  SiRNA target sequence
cttctcctcctaaaaaagtatttccg

SEQ ID NO: 32139 - DNA, 26 bp, Artificial sequence
  SiRNA target sequence
ttctcctcctaaaaaagtatttccgt

SEQ ID NO: 32140 - DNA, 26 bp, Artificial sequence
  SiRNA target sequence
tctcctcctaaaaaagtatttccgtt

SEQ ID NO: 32141 - DNA, 26 bp, Artificial sequence
  SiRNA target sequence
ctcctcctaaaaaagtatttccgtta

SEQ ID NO: 32142 - DNA, 26 bp, Artificial sequence
  SiRNA target sequence
tcctcctaaaaaagtatttccgttag

SEQ ID NO: 32143 - DNA, 26 bp, Artificial sequence
  SiRNA target sequence
cctcctaaaaaagtatttccgttagt

SEQ ID NO: 32144 - DNA, 26 bp, Artificial sequence
  SiRNA target sequence
ctcctaaaaaagtatttccgttagta

SEQ ID NO: 32145 - DNA, 26 bp, Artificial sequence
  SiRNA target sequence
tcctaaaaaagtatttccgttagtag

SEQ ID NO: 32146 - DNA, 26 bp, Artificial sequence
  SiRNA target sequence
cctaaaaaagtatttccgttagtaga

SEQ ID NO: 32147 - DNA, 26 bp, Artificial sequence
  SiRNA target sequence
ctaaaaaagtatttccgttagtagat

SEQ ID NO: 32148 - DNA, 26 bp, Artificial sequence
  SiRNA target sequence
taaaaaagtatttccgttagtagatt

SEQ ID NO: 32149 - DNA, 26 bp, Artificial sequence
  SiRNA target sequence
aaaaaagtatttccgttagtagattt

SEQ ID NO: 32150 - DNA, 26 bp, Artificial sequence
  SiRNA target sequence
aaaaagtatttccgttagtagatttt

SEQ ID NO: 32151 - DNA, 26 bp, Artificial sequence
  SiRNA target sequence
aaaagtatttccgttagtagatttta

SEQ ID NO: 32152 - DNA, 26 bp, Artificial sequence
  SiRNA target sequence
aaagtatttccgttagtagattttac

SEQ ID NO: 32153 - DNA, 26 bp, Artificial sequence
  SiRNA target sequence
aagtatttccgttagtagattttaca

SEQ ID NO: 32154 - DNA, 26 bp, Artificial sequence
  SiRNA target sequence
agtatttccgttagtagattttacat

SEQ ID NO: 32155 - DNA, 26 bp, Artificial sequence
  SiRNA target sequence
gtatttccgttagtagattttacatg

SEQ ID NO: 32156 - DNA, 26 bp, Artificial sequence
  SiRNA target sequence
tatttccgttagtagattttacatga

SEQ ID NO: 32157 - DNA, 26 bp, Artificial sequence
  SiRNA target sequence
atttccgttagtagattttacatgaa

SEQ ID NO: 32158 - DNA, 26 bp, Artificial sequence
  SiRNA target sequence
tttccgttagtagattttacatgaaa

SEQ ID NO: 32159 - DNA, 26 bp, Artificial sequence
  SiRNA target sequence
ttccgttagtagattttacatgaaaa

SEQ ID NO: 32160 - DNA, 26 bp, Artificial sequence
  SiRNA target sequence
tccgttagtagattttacatgaaaaa

SEQ ID NO: 32161 - DNA, 26 bp, Artificial sequence
  SiRNA target sequence
ccgttagtagattttacatgaaaaat

SEQ ID NO: 32162 - DNA, 26 bp, Artificial sequence
  SiRNA target sequence
cgttagtagattttacatgaaaaata

SEQ ID NO: 32163 - DNA, 26 bp, Artificial sequence
  SiRNA target sequence
gttagtagattttacatgaaaaatac

SEQ ID NO: 32164 - DNA, 26 bp, Artificial sequence
  SiRNA target sequence
ttagtagattttacatgaaaaatacc

SEQ ID NO: 32165 - DNA, 26 bp, Artificial sequence
  SiRNA target sequence
tagtagattttacatgaaaaatacca

SEQ ID NO: 32166 - DNA, 26 bp, Artificial sequence
  SiRNA target sequence
agtagattttacatgaaaaataccat

SEQ ID NO: 32167 - DNA, 26 bp, Artificial sequence
  SiRNA target sequence
gtagattttacatgaaaaataccatt

SEQ ID NO: 32168 - DNA, 26 bp, Artificial sequence
  SiRNA target sequence
tagattttacatgaaaaataccatta

SEQ ID NO: 32169 - DNA, 26 bp, Artificial sequence
  SiRNA target sequence
agattttacatgaaaaataccattat

SEQ ID NO: 32170 - DNA, 26 bp, Artificial sequence
  SiRNA target sequence
gattttacatgaaaaataccattatc

SEQ ID NO: 32171 - DNA, 26 bp, Artificial sequence
  SiRNA target sequence
attttacatgaaaaataccattatct

SEQ ID NO: 32172 - DNA, 26 bp, Artificial sequence
  SiRNA target sequence
ttttacatgaaaaataccattatcta

SEQ ID NO: 32173 - DNA, 26 bp, Artificial sequence
  SiRNA target sequence
tttacatgaaaaataccattatctaa

SEQ ID NO: 32174 - DNA, 26 bp, Artificial sequence
  SiRNA target sequence
ttacatgaaaaataccattatctaat

SEQ ID NO: 32175 - DNA, 26 bp, Artificial sequence
  SiRNA target sequence
tacatgaaaaataccattatctaatt

SEQ ID NO: 32176 - DNA, 26 bp, Artificial sequence
  SiRNA target sequence
acatgaaaaataccattatctaattc

SEQ ID NO: 32177 - DNA, 26 bp, Artificial sequence
  SiRNA target sequence
catgaaaaataccattatctaattct

SEQ ID NO: 32178 - DNA, 26 bp, Artificial sequence
  SiRNA target sequence
atgaaaaataccattatctaattcta

SEQ ID NO: 32179 - DNA, 26 bp, Artificial sequence
  SiRNA target sequence
tgaaaaataccattatctaattctaa

SEQ ID NO: 32180 - DNA, 26 bp, Artificial sequence
  SiRNA target sequence
gaaaaataccattatctaattctaat

SEQ ID NO: 32181 - DNA, 26 bp, Artificial sequence
  SiRNA target sequence
aaaaataccattatctaattctaata

SEQ ID NO: 32182 - DNA, 26 bp, Artificial sequence
  SiRNA target sequence
aaaataccattatctaattctaatat

SEQ ID NO: 32183 - DNA, 26 bp, Artificial sequence
  SiRNA target sequence
aaataccattatctaattctaatata

SEQ ID NO: 32184 - DNA, 26 bp, Artificial sequence
  SiRNA target sequence
aataccattatctaattctaatatac

SEQ ID NO: 32185 - DNA, 26 bp, Artificial sequence
  SiRNA target sequence
ataccattatctaattctaatatact

SEQ ID NO: 32186 - DNA, 26 bp, Artificial sequence
  SiRNA target sequence
taccattatctaattctaatatacta

SEQ ID NO: 32187 - DNA, 26 bp, Artificial sequence
  SiRNA target sequence
accattatctaattctaatatactaa

SEQ ID NO: 32188 - DNA, 26 bp, Artificial sequence
  SiRNA target sequence
ccattatctaattctaatatactaat

SEQ ID NO: 32189 - DNA, 26 bp, Artificial sequence
  SiRNA target sequence
cattatctaattctaatatactaatg

SEQ ID NO: 32190 - DNA, 26 bp, Artificial sequence
  SiRNA target sequence
attatctaattctaatatactaatgt

SEQ ID NO: 32191 - DNA, 26 bp, Artificial sequence
  SiRNA target sequence
ttatctaattctaatatactaatgtc

SEQ ID NO: 32192 - DNA, 26 bp, Artificial sequence
  SiRNA target sequence
tatctaattctaatatactaatgtca

SEQ ID NO: 32193 - DNA, 26 bp, Artificial sequence
  SiRNA target sequence
atctaattctaatatactaatgtcaa

SEQ ID NO: 32194 - DNA, 26 bp, Artificial sequence
  SiRNA target sequence
tctaattctaatatactaatgtcaaa

SEQ ID NO: 32195 - DNA, 26 bp, Artificial sequence
  SiRNA target sequence
ctaattctaatatactaatgtcaaaa

SEQ ID NO: 32196 - DNA, 26 bp, Artificial sequence
  SiRNA target sequence
taattctaatatactaatgtcaaaag

SEQ ID NO: 32197 - DNA, 26 bp, Artificial sequence
  SiRNA target sequence
aattctaatatactaatgtcaaaagt

SEQ ID NO: 32198 - DNA, 26 bp, Artificial sequence
  SiRNA target sequence
attctaatatactaatgtcaaaagtt

SEQ ID NO: 32199 - DNA, 26 bp, Artificial sequence
  SiRNA target sequence
ttctaatatactaatgtcaaaagttc

SEQ ID NO: 32200 - DNA, 26 bp, Artificial sequence
  SiRNA target sequence
tctaatatactaatgtcaaaagttcc

SEQ ID NO: 32201 - DNA, 26 bp, Artificial sequence
  SiRNA target sequence
ctaatatactaatgtcaaaagttcct

SEQ ID NO: 32202 - DNA, 26 bp, Artificial sequence
  SiRNA target sequence
taatatactaatgtcaaaagttcctc

SEQ ID NO: 32203 - DNA, 26 bp, Artificial sequence
  SiRNA target sequence
aatatactaatgtcaaaagttcctcc

SEQ ID NO: 32204 - DNA, 26 bp, Artificial sequence
  SiRNA target sequence
atatactaatgtcaaaagttcctcct

SEQ ID NO: 32205 - DNA, 26 bp, Artificial sequence
  SiRNA target sequence
tatactaatgtcaaaagttcctcctc

SEQ ID NO: 32206 - DNA, 26 bp, Artificial sequence
  SiRNA target sequence
atactaatgtcaaaagttcctcctcc

SEQ ID NO: 32207 - DNA, 26 bp, Artificial sequence
  SiRNA target sequence
tactaatgtcaaaagttcctcctccc

SEQ ID NO: 32208 - DNA, 26 bp, Artificial sequence
  SiRNA target sequence
actaatgtcaaaagttcctcctccca

SEQ ID NO: 32209 - DNA, 26 bp, Artificial sequence
  SiRNA target sequence
ctaatgtcaaaagttcctcctcccag

SEQ ID NO: 32210 - DNA, 26 bp, Artificial sequence
  SiRNA target sequence
taatgtcaaaagttcctcctcccaga

SEQ ID NO: 32211 - DNA, 26 bp, Artificial sequence
  SiRNA target sequence
aatgtcaaaagttcctcctcccagat

SEQ ID NO: 32212 - DNA, 26 bp, Artificial sequence
  SiRNA target sequence
atgtcaaaagttcctcctcccagatc

SEQ ID NO: 32213 - DNA, 26 bp, Artificial sequence
  SiRNA target sequence
tgtcaaaagttcctcctcccagatca

SEQ ID NO: 32214 - DNA, 26 bp, Artificial sequence
  SiRNA target sequence
gtcaaaagttcctcctcccagatcat

SEQ ID NO: 32215 - DNA, 26 bp, Artificial sequence
  SiRNA target sequence
tcaaaagttcctcctcccagatcata

SEQ ID NO: 32216 - DNA, 26 bp, Artificial sequence
  SiRNA target sequence
caaaagttcctcctcccagatcataa

SEQ ID NO: 32217 - DNA, 26 bp, Artificial sequence
  SiRNA target sequence
aaaagttcctcctcccagatcataaa

SEQ ID NO: 32218 - DNA, 26 bp, Artificial sequence
  SiRNA target sequence
aaagttcctcctcccagatcataaac

SEQ ID NO: 32219 - DNA, 26 bp, Artificial sequence
  SiRNA target sequence
aagttcctcctcccagatcataaaca

SEQ ID NO: 32220 - DNA, 26 bp, Artificial sequence
  SiRNA target sequence
agttcctcctcccagatcataaacag

SEQ ID NO: 32221 - DNA, 26 bp, Artificial sequence
  SiRNA target sequence
gttcctcctcccagatcataaacagc

SEQ ID NO: 32222 - DNA, 26 bp, Artificial sequence
  SiRNA target sequence
ttcctcctcccagatcataaacagct

SEQ ID NO: 32223 - DNA, 26 bp, Artificial sequence
  SiRNA target sequence
tcctcctcccagatcataaacagcta

SEQ ID NO: 32224 - DNA, 26 bp, Artificial sequence
  SiRNA target sequence
cctcctcccagatcataaacagctat

SEQ ID NO: 32225 - DNA, 26 bp, Artificial sequence
  SiRNA target sequence
ctcctcccagatcataaacagctata

SEQ ID NO: 32226 - DNA, 26 bp, Artificial sequence
  SiRNA target sequence
tcctcccagatcataaacagctataa

SEQ ID NO: 32227 - DNA, 26 bp, Artificial sequence
  SiRNA target sequence
cctcccagatcataaacagctataat

SEQ ID NO: 32228 - DNA, 26 bp, Artificial sequence
  SiRNA target sequence
ctcccagatcataaacagctataata

SEQ ID NO: 32229 - DNA, 26 bp, Artificial sequence
  SiRNA target sequence
tcccagatcataaacagctataatac

SEQ ID NO: 32230 - DNA, 26 bp, Artificial sequence
  SiRNA target sequence
cccagatcataaacagctataatacc

SEQ ID NO: 32231 - DNA, 26 bp, Artificial sequence
  SiRNA target sequence
ccagatcataaacagctataataccc

SEQ ID NO: 32232 - DNA, 26 bp, Artificial sequence
  SiRNA target sequence
cagatcataaacagctataataccct

SEQ ID NO: 32233 - DNA, 26 bp, Artificial sequence
  SiRNA target sequence
agatcataaacagctataataccctg

SEQ ID NO: 32234 - DNA, 26 bp, Artificial sequence
  SiRNA target sequence
gatcataaacagctataataccctgt

SEQ ID NO: 32235 - DNA, 26 bp, Artificial sequence
  SiRNA target sequence
atcataaacagctataataccctgtg

SEQ ID NO: 32236 - DNA, 26 bp, Artificial sequence
  SiRNA target sequence
tcataaacagctataataccctgtgc

SEQ ID NO: 32237 - DNA, 26 bp, Artificial sequence
  SiRNA target sequence
cataaacagctataataccctgtgca

SEQ ID NO: 32238 - DNA, 26 bp, Artificial sequence
  SiRNA target sequence
ataaacagctataataccctgtgcag

SEQ ID NO: 32239 - DNA, 26 bp, Artificial sequence
  SiRNA target sequence
taaacagctataataccctgtgcaga

SEQ ID NO: 32240 - DNA, 26 bp, Artificial sequence
  SiRNA target sequence
aaacagctataataccctgtgcagac

SEQ ID NO: 32241 - DNA, 26 bp, Artificial sequence
  SiRNA target sequence
aacagctataataccctgtgcagact

SEQ ID NO: 32242 - DNA, 26 bp, Artificial sequence
  SiRNA target sequence
acagctataataccctgtgcagactt

SEQ ID NO: 32243 - DNA, 26 bp, Artificial sequence
  SiRNA target sequence
cagctataataccctgtgcagacttg

SEQ ID NO: 32244 - DNA, 26 bp, Artificial sequence
  SiRNA target sequence
agctataataccctgtgcagacttgt

SEQ ID NO: 32245 - DNA, 26 bp, Artificial sequence
  SiRNA target sequence
gctataataccctgtgcagacttgtc

SEQ ID NO: 32246 - DNA, 26 bp, Artificial sequence
  SiRNA target sequence
ctataataccctgtgcagacttgtca

SEQ ID NO: 32247 - DNA, 26 bp, Artificial sequence
  SiRNA target sequence
tataataccctgtgcagacttgtcaa

SEQ ID NO: 32248 - DNA, 26 bp, Artificial sequence
  SiRNA target sequence
ataataccctgtgcagacttgtcaag

SEQ ID NO: 32249 - DNA, 26 bp, Artificial sequence
  SiRNA target sequence
taataccctgtgcagacttgtcaagc

SEQ ID NO: 32250 - DNA, 26 bp, Artificial sequence
  SiRNA target sequence
aataccctgtgcagacttgtcaagcc

SEQ ID NO: 32251 - DNA, 26 bp, Artificial sequence
  SiRNA target sequence
ataccctgtgcagacttgtcaagccc

SEQ ID NO: 32252 - DNA, 26 bp, Artificial sequence
  SiRNA target sequence
taccctgtgcagacttgtcaagccca

SEQ ID NO: 32253 - DNA, 26 bp, Artificial sequence
  SiRNA target sequence
accctgtgcagacttgtcaagcccat

SEQ ID NO: 32254 - DNA, 26 bp, Artificial sequence
  SiRNA target sequence
ccctgtgcagacttgtcaagcccata

SEQ ID NO: 32255 - DNA, 26 bp, Artificial sequence
  SiRNA target sequence
cctgtgcagacttgtcaagcccataa

SEQ ID NO: 32256 - DNA, 26 bp, Artificial sequence
  SiRNA target sequence
ctgtgcagacttgtcaagcccataag

SEQ ID NO: 32257 - DNA, 26 bp, Artificial sequence
  SiRNA target sequence
tgtgcagacttgtcaagcccataagc

SEQ ID NO: 32258 - DNA, 26 bp, Artificial sequence
  SiRNA target sequence
gtgcagacttgtcaagcccataagca

SEQ ID NO: 32259 - DNA, 26 bp, Artificial sequence
  SiRNA target sequence
tgcagacttgtcaagcccataagcaa

SEQ ID NO: 32260 - DNA, 26 bp, Artificial sequence
  SiRNA target sequence
gcagacttgtcaagcccataagcaag

SEQ ID NO: 32261 - DNA, 26 bp, Artificial sequence
  SiRNA target sequence
cagacttgtcaagcccataagcaagt

SEQ ID NO: 32262 - DNA, 26 bp, Artificial sequence
  SiRNA target sequence
agacttgtcaagcccataagcaagtg

SEQ ID NO: 32263 - DNA, 26 bp, Artificial sequence
  SiRNA target sequence
gacttgtcaagcccataagcaagtgc

SEQ ID NO: 32264 - DNA, 26 bp, Artificial sequence
  SiRNA target sequence
acttgtcaagcccataagcaagtgct

SEQ ID NO: 32265 - DNA, 26 bp, Artificial sequence
  SiRNA target sequence
cttgtcaagcccataagcaagtgctg

SEQ ID NO: 32266 - DNA, 26 bp, Artificial sequence
  SiRNA target sequence
ttgtcaagcccataagcaagtgctgc

SEQ ID NO: 32267 - DNA, 26 bp, Artificial sequence
  SiRNA target sequence
tgtcaagcccataagcaagtgctgcc

SEQ ID NO: 32268 - DNA, 26 bp, Artificial sequence
  SiRNA target sequence
gtcaagcccataagcaagtgctgccg

SEQ ID NO: 32269 - DNA, 26 bp, Artificial sequence
  SiRNA target sequence
tcaagcccataagcaagtgctgccgc

SEQ ID NO: 32270 - DNA, 26 bp, Artificial sequence
  SiRNA target sequence
caagcccataagcaagtgctgccgca

SEQ ID NO: 32271 - DNA, 26 bp, Artificial sequence
  SiRNA target sequence
aagcccataagcaagtgctgccgcag

SEQ ID NO: 32272 - DNA, 26 bp, Artificial sequence
  SiRNA target sequence
agcccataagcaagtgctgccgcagt

SEQ ID NO: 32273 - DNA, 26 bp, Artificial sequence
  SiRNA target sequence
gcccataagcaagtgctgccgcagta

SEQ ID NO: 32274 - DNA, 26 bp, Artificial sequence
  SiRNA target sequence
cccataagcaagtgctgccgcagtag

SEQ ID NO: 32275 - DNA, 26 bp, Artificial sequence
  SiRNA target sequence
ccataagcaagtgctgccgcagtagg

SEQ ID NO: 32276 - DNA, 26 bp, Artificial sequence
  SiRNA target sequence
cataagcaagtgctgccgcagtaggc

SEQ ID NO: 32277 - DNA, 26 bp, Artificial sequence
  SiRNA target sequence
ataagcaagtgctgccgcagtaggct

SEQ ID NO: 32278 - DNA, 26 bp, Artificial sequence
  SiRNA target sequence
taagcaagtgctgccgcagtaggctc

SEQ ID NO: 32279 - DNA, 26 bp, Artificial sequence
  SiRNA target sequence
aagcaagtgctgccgcagtaggctca

SEQ ID NO: 32280 - DNA, 26 bp, Artificial sequence
  SiRNA target sequence
agcaagtgctgccgcagtaggctcat

SEQ ID NO: 32281 - DNA, 26 bp, Artificial sequence
  SiRNA target sequence
gcaagtgctgccgcagtaggctcatt

SEQ ID NO: 32282 - DNA, 26 bp, Artificial sequence
  SiRNA target sequence
caagtgctgccgcagtaggctcatta

SEQ ID NO: 32283 - DNA, 26 bp, Artificial sequence
  SiRNA target sequence
aagtgctgccgcagtaggctcattaa

SEQ ID NO: 32284 - DNA, 26 bp, Artificial sequence
  SiRNA target sequence
agtgctgccgcagtaggctcattaat

SEQ ID NO: 32285 - DNA, 26 bp, Artificial sequence
  SiRNA target sequence
gtgctgccgcagtaggctcattaatc

SEQ ID NO: 32286 - DNA, 26 bp, Artificial sequence
  SiRNA target sequence
tgctgccgcagtaggctcattaatca

SEQ ID NO: 32287 - DNA, 26 bp, Artificial sequence
  SiRNA target sequence
gctgccgcagtaggctcattaatcac

SEQ ID NO: 32288 - DNA, 26 bp, Artificial sequence
  SiRNA target sequence
ctgccgcagtaggctcattaatcact

SEQ ID NO: 32289 - DNA, 26 bp, Artificial sequence
  SiRNA target sequence
tgccgcagtaggctcattaatcactc

SEQ ID NO: 32290 - DNA, 26 bp, Artificial sequence
  SiRNA target sequence
gccgcagtaggctcattaatcactct

SEQ ID NO: 32291 - DNA, 26 bp, Artificial sequence
  SiRNA target sequence
ccgcagtaggctcattaatcactcta

SEQ ID NO: 32292 - DNA, 26 bp, Artificial sequence
  SiRNA target sequence
cgcagtaggctcattaatcactctaa

SEQ ID NO: 32293 - DNA, 26 bp, Artificial sequence
  SiRNA target sequence
gcagtaggctcattaatcactctaag

SEQ ID NO: 32294 - DNA, 26 bp, Artificial sequence
  SiRNA target sequence
cagtaggctcattaatcactctaagc

SEQ ID NO: 32295 - DNA, 26 bp, Artificial sequence
  SiRNA target sequence
agtaggctcattaatcactctaagca

SEQ ID NO: 32296 - DNA, 26 bp, Artificial sequence
  SiRNA target sequence
gtaggctcattaatcactctaagcac

SEQ ID NO: 32297 - DNA, 26 bp, Artificial sequence
  SiRNA target sequence
taggctcattaatcactctaagcact

SEQ ID NO: 32298 - DNA, 26 bp, Artificial sequence
  SiRNA target sequence
aggctcattaatcactctaagcactt

SEQ ID NO: 32299 - DNA, 26 bp, Artificial sequence
  SiRNA target sequence
ggctcattaatcactctaagcacttg

SEQ ID NO: 32300 - DNA, 26 bp, Artificial sequence
  SiRNA target sequence
gctcattaatcactctaagcacttgt

SEQ ID NO: 32301 - DNA, 26 bp, Artificial sequence
  SiRNA target sequence
ctcattaatcactctaagcacttgta

SEQ ID NO: 32302 - DNA, 26 bp, Artificial sequence
  SiRNA target sequence
tcattaatcactctaagcacttgtaa

SEQ ID NO: 32303 - DNA, 26 bp, Artificial sequence
  SiRNA target sequence
cattaatcactctaagcacttgtaat

SEQ ID NO: 32304 - DNA, 26 bp, Artificial sequence
  SiRNA target sequence
attaatcactctaagcacttgtaatc

SEQ ID NO: 32305 - DNA, 26 bp, Artificial sequence
  SiRNA target sequence
ttaatcactctaagcacttgtaatcc

SEQ ID NO: 32306 - DNA, 26 bp, Artificial sequence
  SiRNA target sequence
taatcactctaagcacttgtaatccc

SEQ ID NO: 32307 - DNA, 26 bp, Artificial sequence
  SiRNA target sequence
aatcactctaagcacttgtaatcccg

SEQ ID NO: 32308 - DNA, 26 bp, Artificial sequence
  SiRNA target sequence
atcactctaagcacttgtaatcccgc

SEQ ID NO: 32309 - DNA, 26 bp, Artificial sequence
  SiRNA target sequence
tcactctaagcacttgtaatcccgca

SEQ ID NO: 32310 - DNA, 26 bp, Artificial sequence
  SiRNA target sequence
cactctaagcacttgtaatcccgcaa

SEQ ID NO: 32311 - DNA, 26 bp, Artificial sequence
  SiRNA target sequence
actctaagcacttgtaatcccgcaat

SEQ ID NO: 32312 - DNA, 26 bp, Artificial sequence
  SiRNA target sequence
ctctaagcacttgtaatcccgcaatc

SEQ ID NO: 32313 - DNA, 26 bp, Artificial sequence
  SiRNA target sequence
tctaagcacttgtaatcccgcaatcc

SEQ ID NO: 32314 - DNA, 26 bp, Artificial sequence
  SiRNA target sequence
ctaagcacttgtaatcccgcaatcct

SEQ ID NO: 32315 - DNA, 26 bp, Artificial sequence
  SiRNA target sequence
taagcacttgtaatcccgcaatcctt

SEQ ID NO: 32316 - DNA, 26 bp, Artificial sequence
  SiRNA target sequence
aagcacttgtaatcccgcaatccttc

SEQ ID NO: 32317 - DNA, 26 bp, Artificial sequence
  SiRNA target sequence
agcacttgtaatcccgcaatccttcc

SEQ ID NO: 32318 - DNA, 26 bp, Artificial sequence
  SiRNA target sequence
gcacttgtaatcccgcaatccttccc

SEQ ID NO: 32319 - DNA, 26 bp, Artificial sequence
  SiRNA target sequence
cacttgtaatcccgcaatccttcccg

SEQ ID NO: 32320 - DNA, 26 bp, Artificial sequence
  SiRNA target sequence
acttgtaatcccgcaatccttcccgc

SEQ ID NO: 32321 - DNA, 26 bp, Artificial sequence
  SiRNA target sequence
cttgtaatcccgcaatccttcccgca

SEQ ID NO: 32322 - DNA, 26 bp, Artificial sequence
  SiRNA target sequence
ttgtaatcccgcaatccttcccgcat

SEQ ID NO: 32323 - DNA, 26 bp, Artificial sequence
  SiRNA target sequence
tgtaatcccgcaatccttcccgcatc

SEQ ID NO: 32324 - DNA, 26 bp, Artificial sequence
  SiRNA target sequence
gtaatcccgcaatccttcccgcatct

SEQ ID NO: 32325 - DNA, 26 bp, Artificial sequence
  SiRNA target sequence
taatcccgcaatccttcccgcatctt

SEQ ID NO: 32326 - DNA, 26 bp, Artificial sequence
  SiRNA target sequence
aatcccgcaatccttcccgcatcttt

SEQ ID NO: 32327 - DNA, 26 bp, Artificial sequence
  SiRNA target sequence
atcccgcaatccttcccgcatcttta

SEQ ID NO: 32328 - DNA, 26 bp, Artificial sequence
  SiRNA target sequence
tcccgcaatccttcccgcatctttag

SEQ ID NO: 32329 - DNA, 26 bp, Artificial sequence
  SiRNA target sequence
cccgcaatccttcccgcatctttagt

SEQ ID NO: 32330 - DNA, 26 bp, Artificial sequence
  SiRNA target sequence
ccgcaatccttcccgcatctttagta

SEQ ID NO: 32331 - DNA, 26 bp, Artificial sequence
  SiRNA target sequence
cgcaatccttcccgcatctttagtag

SEQ ID NO: 32332 - DNA, 26 bp, Artificial sequence
  SiRNA target sequence
gcaatccttcccgcatctttagtagc

SEQ ID NO: 32333 - DNA, 26 bp, Artificial sequence
  SiRNA target sequence
caatccttcccgcatctttagtagct

SEQ ID NO: 32334 - DNA, 26 bp, Artificial sequence
  SiRNA target sequence
aatccttcccgcatctttagtagctt

SEQ ID NO: 32335 - DNA, 26 bp, Artificial sequence
  SiRNA target sequence
atccttcccgcatctttagtagcttg

SEQ ID NO: 32336 - DNA, 26 bp, Artificial sequence
  SiRNA target sequence
tccttcccgcatctttagtagcttgc

SEQ ID NO: 32337 - DNA, 26 bp, Artificial sequence
  SiRNA target sequence
ccttcccgcatctttagtagcttgcc

SEQ ID NO: 32338 - DNA, 26 bp, Artificial sequence
  SiRNA target sequence
cttcccgcatctttagtagcttgcct

SEQ ID NO: 32339 - DNA, 26 bp, Artificial sequence
  SiRNA target sequence
ttcccgcatctttagtagcttgcctt

SEQ ID NO: 32340 - DNA, 26 bp, Artificial sequence
  SiRNA target sequence
tcccgcatctttagtagcttgccttt

SEQ ID NO: 32341 - DNA, 26 bp, Artificial sequence
  SiRNA target sequence
cccgcatctttagtagcttgcctttg

SEQ ID NO: 32342 - DNA, 26 bp, Artificial sequence
  SiRNA target sequence
ccgcatctttagtagcttgcctttgc

SEQ ID NO: 32343 - DNA, 26 bp, Artificial sequence
  SiRNA target sequence
cgcatctttagtagcttgcctttgca

SEQ ID NO: 32344 - DNA, 26 bp, Artificial sequence
  SiRNA target sequence
gcatctttagtagcttgcctttgcat

SEQ ID NO: 32345 - DNA, 26 bp, Artificial sequence
  SiRNA target sequence
catctttagtagcttgcctttgcatg

SEQ ID NO: 32346 - DNA, 26 bp, Artificial sequence
  SiRNA target sequence
atctttagtagcttgcctttgcatgt

SEQ ID NO: 32347 - DNA, 26 bp, Artificial sequence
  SiRNA target sequence
tctttagtagcttgcctttgcatgtc

SEQ ID NO: 32348 - DNA, 26 bp, Artificial sequence
  SiRNA target sequence
ctttagtagcttgcctttgcatgtca

SEQ ID NO: 32349 - DNA, 26 bp, Artificial sequence
  SiRNA target sequence
tttagtagcttgcctttgcatgtcat

SEQ ID NO: 32350 - DNA, 26 bp, Artificial sequence
  SiRNA target sequence
ttagtagcttgcctttgcatgtcatc

SEQ ID NO: 32351 - DNA, 26 bp, Artificial sequence
  SiRNA target sequence
tagtagcttgcctttgcatgtcatca

SEQ ID NO: 32352 - DNA, 26 bp, Artificial sequence
  SiRNA target sequence
agtagcttgcctttgcatgtcatcaa

SEQ ID NO: 32353 - DNA, 26 bp, Artificial sequence
  SiRNA target sequence
gtagcttgcctttgcatgtcatcaaa

SEQ ID NO: 32354 - DNA, 26 bp, Artificial sequence
  SiRNA target sequence
tagcttgcctttgcatgtcatcaaaa

SEQ ID NO: 32355 - DNA, 26 bp, Artificial sequence
  SiRNA target sequence
agcttgcctttgcatgtcatcaaaat

SEQ ID NO: 32356 - DNA, 26 bp, Artificial sequence
  SiRNA target sequence
gcttgcctttgcatgtcatcaaaata

SEQ ID NO: 32357 - DNA, 26 bp, Artificial sequence
  SiRNA target sequence
cttgcctttgcatgtcatcaaaatat

SEQ ID NO: 32358 - DNA, 26 bp, Artificial sequence
  SiRNA target sequence
ttgcctttgcatgtcatcaaaatatg

SEQ ID NO: 32359 - DNA, 26 bp, Artificial sequence
  SiRNA target sequence
tgcctttgcatgtcatcaaaatatgc

SEQ ID NO: 32360 - DNA, 26 bp, Artificial sequence
  SiRNA target sequence
gcctttgcatgtcatcaaaatatgcg

SEQ ID NO: 32361 - DNA, 26 bp, Artificial sequence
  SiRNA target sequence
cctttgcatgtcatcaaaatatgcgg

SEQ ID NO: 32362 - DNA, 26 bp, Artificial sequence
  SiRNA target sequence
ctttgcatgtcatcaaaatatgcggg

SEQ ID NO: 32363 - DNA, 26 bp, Artificial sequence
  SiRNA target sequence
tttgcatgtcatcaaaatatgcgggc

SEQ ID NO: 32364 - DNA, 26 bp, Artificial sequence
  SiRNA target sequence
ttgcatgtcatcaaaatatgcgggca

SEQ ID NO: 32365 - DNA, 26 bp, Artificial sequence
  SiRNA target sequence
tgcatgtcatcaaaatatgcgggcac

SEQ ID NO: 32366 - DNA, 26 bp, Artificial sequence
  SiRNA target sequence
gcatgtcatcaaaatatgcgggcact

SEQ ID NO: 32367 - DNA, 26 bp, Artificial sequence
  SiRNA target sequence
catgtcatcaaaatatgcgggcactg

SEQ ID NO: 32368 - DNA, 26 bp, Artificial sequence
  SiRNA target sequence
atgtcatcaaaatatgcgggcactgt

SEQ ID NO: 32369 - DNA, 26 bp, Artificial sequence
  SiRNA target sequence
tgtcatcaaaatatgcgggcactgtt

SEQ ID NO: 32370 - DNA, 26 bp, Artificial sequence
  SiRNA target sequence
gtcatcaaaatatgcgggcactgtta

SEQ ID NO: 32371 - DNA, 26 bp, Artificial sequence
  SiRNA target sequence
tcatcaaaatatgcgggcactgttat

SEQ ID NO: 32372 - DNA, 26 bp, Artificial sequence
  SiRNA target sequence
catcaaaatatgcgggcactgttata

SEQ ID NO: 32373 - DNA, 26 bp, Artificial sequence
  SiRNA target sequence
atcaaaatatgcgggcactgttataa

SEQ ID NO: 32374 - DNA, 26 bp, Artificial sequence
  SiRNA target sequence
tcaaaatatgcgggcactgttataac

SEQ ID NO: 32375 - DNA, 26 bp, Artificial sequence
  SiRNA target sequence
caaaatatgcgggcactgttataaca

SEQ ID NO: 32376 - DNA, 26 bp, Artificial sequence
  SiRNA target sequence
aaaatatgcgggcactgttataacag

SEQ ID NO: 32377 - DNA, 26 bp, Artificial sequence
  SiRNA target sequence
aaatatgcgggcactgttataacaga

SEQ ID NO: 32378 - DNA, 26 bp, Artificial sequence
  SiRNA target sequence
aatatgcgggcactgttataacagat

SEQ ID NO: 32379 - DNA, 26 bp, Artificial sequence
  SiRNA target sequence
atatgcgggcactgttataacagatc

SEQ ID NO: 32380 - DNA, 26 bp, Artificial sequence
  SiRNA target sequence
tatgcgggcactgttataacagatct

SEQ ID NO: 32381 - DNA, 26 bp, Artificial sequence
  SiRNA target sequence
atgcgggcactgttataacagatctt

SEQ ID NO: 32382 - DNA, 26 bp, Artificial sequence
  SiRNA target sequence
tgcgggcactgttataacagatctta

SEQ ID NO: 32383 - DNA, 26 bp, Artificial sequence
  SiRNA target sequence
gcgggcactgttataacagatcttaa

SEQ ID NO: 32384 - DNA, 26 bp, Artificial sequence
  SiRNA target sequence
cgggcactgttataacagatcttaat

SEQ ID NO: 32385 - DNA, 26 bp, Artificial sequence
  SiRNA target sequence
gggcactgttataacagatcttaata

SEQ ID NO: 32386 - DNA, 26 bp, Artificial sequence
  SiRNA target sequence
ggcactgttataacagatcttaatac

SEQ ID NO: 32387 - DNA, 26 bp, Artificial sequence
  SiRNA target sequence
gcactgttataacagatcttaatact

SEQ ID NO: 32388 - DNA, 26 bp, Artificial sequence
  SiRNA target sequence
cactgttataacagatcttaatactt

SEQ ID NO: 32389 - DNA, 26 bp, Artificial sequence
  SiRNA target sequence
actgttataacagatcttaatacttt

SEQ ID NO: 32390 - DNA, 26 bp, Artificial sequence
  SiRNA target sequence
ctgttataacagatcttaatacttta

SEQ ID NO: 32391 - DNA, 26 bp, Artificial sequence
  SiRNA target sequence
tgttataacagatcttaatactttag

SEQ ID NO: 32392 - DNA, 26 bp, Artificial sequence
  SiRNA target sequence
gttataacagatcttaatactttaga

SEQ ID NO: 32393 - DNA, 26 bp, Artificial sequence
  SiRNA target sequence
ttataacagatcttaatactttagaa

SEQ ID NO: 32394 - DNA, 26 bp, Artificial sequence
  SiRNA target sequence
tataacagatcttaatactttagaat

SEQ ID NO: 32395 - DNA, 26 bp, Artificial sequence
  SiRNA target sequence
ataacagatcttaatactttagaatt

SEQ ID NO: 32396 - DNA, 26 bp, Artificial sequence
  SiRNA target sequence
taacagatcttaatactttagaattt

SEQ ID NO: 32397 - DNA, 26 bp, Artificial sequence
  SiRNA target sequence
aacagatcttaatactttagaattta

SEQ ID NO: 32398 - DNA, 26 bp, Artificial sequence
  SiRNA target sequence
acagatcttaatactttagaatttaa

SEQ ID NO: 32399 - DNA, 26 bp, Artificial sequence
  SiRNA target sequence
cagatcttaatactttagaatttaaa

SEQ ID NO: 32400 - DNA, 26 bp, Artificial sequence
  SiRNA target sequence
agatcttaatactttagaatttaaaa

SEQ ID NO: 32401 - DNA, 26 bp, Artificial sequence
  SiRNA target sequence
gatcttaatactttagaatttaaaaa

SEQ ID NO: 32402 - DNA, 26 bp, Artificial sequence
  SiRNA target sequence
atcttaatactttagaatttaaaaaa

SEQ ID NO: 32403 - DNA, 26 bp, Artificial sequence
  SiRNA target sequence
tcttaatactttagaatttaaaaaat

SEQ ID NO: 32404 - DNA, 26 bp, Artificial sequence
  SiRNA target sequence
cttaatactttagaatttaaaaaatt

SEQ ID NO: 32405 - DNA, 26 bp, Artificial sequence
  SiRNA target sequence
ttaatactttagaatttaaaaaattc

SEQ ID NO: 32406 - DNA, 26 bp, Artificial sequence
  SiRNA target sequence
taatactttagaatttaaaaaattct

SEQ ID NO: 32407 - DNA, 26 bp, Artificial sequence
  SiRNA target sequence
aatactttagaatttaaaaaattctc

SEQ ID NO: 32408 - DNA, 26 bp, Artificial sequence
  SiRNA target sequence
atactttagaatttaaaaaattctct

SEQ ID NO: 32409 - DNA, 26 bp, Artificial sequence
  SiRNA target sequence
tactttagaatttaaaaaattctctg

SEQ ID NO: 32410 - DNA, 26 bp, Artificial sequence
  SiRNA target sequence
actttagaatttaaaaaattctctgc

SEQ ID NO: 32411 - DNA, 26 bp, Artificial sequence
  SiRNA target sequence
ctttagaatttaaaaaattctctgcg

SEQ ID NO: 32412 - DNA, 26 bp, Artificial sequence
  SiRNA target sequence
tttagaatttaaaaaattctctgcgg

SEQ ID NO: 32413 - DNA, 26 bp, Artificial sequence
  SiRNA target sequence
ttagaatttaaaaaattctctgcggc

SEQ ID NO: 32414 - DNA, 26 bp, Artificial sequence
  SiRNA target sequence
tagaatttaaaaaattctctgcggca

SEQ ID NO: 32415 - DNA, 26 bp, Artificial sequence
  SiRNA target sequence
agaatttaaaaaattctctgcggcat

SEQ ID NO: 32416 - DNA, 26 bp, Artificial sequence
  SiRNA target sequence
gaatttaaaaaattctctgcggcatt

SEQ ID NO: 32417 - DNA, 26 bp, Artificial sequence
  SiRNA target sequence
aatttaaaaaattctctgcggcattt

SEQ ID NO: 32418 - DNA, 26 bp, Artificial sequence
  SiRNA target sequence
atttaaaaaattctctgcggcatttt

SEQ ID NO: 32419 - DNA, 26 bp, Artificial sequence
  SiRNA target sequence
tttaaaaaattctctgcggcattttt

SEQ ID NO: 32420 - DNA, 26 bp, Artificial sequence
  SiRNA target sequence
ttaaaaaattctctgcggcatttttc

SEQ ID NO: 32421 - DNA, 26 bp, Artificial sequence
  SiRNA target sequence
taaaaaattctctgcggcatttttca

SEQ ID NO: 32422 - DNA, 26 bp, Artificial sequence
  SiRNA target sequence
aaaaaattctctgcggcatttttcat

SEQ ID NO: 32423 - DNA, 26 bp, Artificial sequence
  SiRNA target sequence
aaaaattctctgcggcatttttcatt

SEQ ID NO: 32424 - DNA, 26 bp, Artificial sequence
  SiRNA target sequence
aaaattctctgcggcatttttcattt

SEQ ID NO: 32425 - DNA, 26 bp, Artificial sequence
  SiRNA target sequence
aaattctctgcggcatttttcatttt

SEQ ID NO: 32426 - DNA, 26 bp, Artificial sequence
  SiRNA target sequence
aattctctgcggcatttttcattttt

SEQ ID NO: 32427 - DNA, 26 bp, Artificial sequence
  SiRNA target sequence
attctctgcggcatttttcatttttg

SEQ ID NO: 32428 - DNA, 26 bp, Artificial sequence
  SiRNA target sequence
ttctctgcggcatttttcatttttga

SEQ ID NO: 32429 - DNA, 26 bp, Artificial sequence
  SiRNA target sequence
tctctgcggcatttttcatttttgac

SEQ ID NO: 32430 - DNA, 26 bp, Artificial sequence
  SiRNA target sequence
ctctgcggcatttttcatttttgaca

SEQ ID NO: 32431 - DNA, 26 bp, Artificial sequence
  SiRNA target sequence
tctgcggcatttttcatttttgacaa

SEQ ID NO: 32432 - DNA, 26 bp, Artificial sequence
  SiRNA target sequence
ctgcggcatttttcatttttgacaaa

SEQ ID NO: 32433 - DNA, 26 bp, Artificial sequence
  SiRNA target sequence
tgcggcatttttcatttttgacaaaa

SEQ ID NO: 32434 - DNA, 26 bp, Artificial sequence
  SiRNA target sequence
gcggcatttttcatttttgacaaaat

SEQ ID NO: 32435 - DNA, 26 bp, Artificial sequence
  SiRNA target sequence
cggcatttttcatttttgacaaaata

SEQ ID NO: 32436 - DNA, 26 bp, Artificial sequence
  SiRNA target sequence
ggcatttttcatttttgacaaaataa

SEQ ID NO: 32437 - DNA, 26 bp, Artificial sequence
  SiRNA target sequence
gcatttttcatttttgacaaaataaa

SEQ ID NO: 32438 - DNA, 26 bp, Artificial sequence
  SiRNA target sequence
catttttcatttttgacaaaataaat

SEQ ID NO: 32439 - DNA, 26 bp, Artificial sequence
  SiRNA target sequence
atttttcatttttgacaaaataaatg

SEQ ID NO: 32440 - DNA, 26 bp, Artificial sequence
  SiRNA target sequence
tttttcatttttgacaaaataaatgc

SEQ ID NO: 32441 - DNA, 26 bp, Artificial sequence
  SiRNA target sequence
ttttcatttttgacaaaataaatgca

SEQ ID NO: 32442 - DNA, 26 bp, Artificial sequence
  SiRNA target sequence
tttcatttttgacaaaataaatgcac

SEQ ID NO: 32443 - DNA, 26 bp, Artificial sequence
  SiRNA target sequence
ttcatttttgacaaaataaatgcacc

SEQ ID NO: 32444 - DNA, 26 bp, Artificial sequence
  SiRNA target sequence
tcatttttgacaaaataaatgcacca

SEQ ID NO: 32445 - DNA, 26 bp, Artificial sequence
  SiRNA target sequence
catttttgacaaaataaatgcaccaa

SEQ ID NO: 32446 - DNA, 26 bp, Artificial sequence
  SiRNA target sequence
atttttgacaaaataaatgcaccaat

SEQ ID NO: 32447 - DNA, 26 bp, Artificial sequence
  SiRNA target sequence
tttttgacaaaataaatgcaccaatt

SEQ ID NO: 32448 - DNA, 26 bp, Artificial sequence
  SiRNA target sequence
ttttgacaaaataaatgcaccaattt

SEQ ID NO: 32449 - DNA, 26 bp, Artificial sequence
  SiRNA target sequence
tttgacaaaataaatgcaccaatttg

SEQ ID NO: 32450 - DNA, 26 bp, Artificial sequence
  SiRNA target sequence
ttgacaaaataaatgcaccaatttgt

SEQ ID NO: 32451 - DNA, 26 bp, Artificial sequence
  SiRNA target sequence
tgacaaaataaatgcaccaatttgtg

SEQ ID NO: 32452 - DNA, 26 bp, Artificial sequence
  SiRNA target sequence
gacaaaataaatgcaccaatttgtgc

SEQ ID NO: 32453 - DNA, 26 bp, Artificial sequence
  SiRNA target sequence
acaaaataaatgcaccaatttgtgca

SEQ ID NO: 32454 - DNA, 26 bp, Artificial sequence
  SiRNA target sequence
caaaataaatgcaccaatttgtgcag

SEQ ID NO: 32455 - DNA, 26 bp, Artificial sequence
  SiRNA target sequence
aaaataaatgcaccaatttgtgcagg

SEQ ID NO: 32456 - DNA, 26 bp, Artificial sequence
  SiRNA target sequence
aaataaatgcaccaatttgtgcagga

SEQ ID NO: 32457 - DNA, 26 bp, Artificial sequence
  SiRNA target sequence
aataaatgcaccaatttgtgcaggag

SEQ ID NO: 32458 - DNA, 26 bp, Artificial sequence
  SiRNA target sequence
ataaatgcaccaatttgtgcaggaga

SEQ ID NO: 32459 - DNA, 26 bp, Artificial sequence
  SiRNA target sequence
taaatgcaccaatttgtgcaggagaa

SEQ ID NO: 32460 - DNA, 26 bp, Artificial sequence
  SiRNA target sequence
aaatgcaccaatttgtgcaggagaat

SEQ ID NO: 32461 - DNA, 26 bp, Artificial sequence
  SiRNA target sequence
aatgcaccaatttgtgcaggagaata

SEQ ID NO: 32462 - DNA, 26 bp, Artificial sequence
  SiRNA target sequence
atgcaccaatttgtgcaggagaatat

SEQ ID NO: 32463 - DNA, 26 bp, Artificial sequence
  SiRNA target sequence
tgcaccaatttgtgcaggagaatatt

SEQ ID NO: 32464 - DNA, 26 bp, Artificial sequence
  SiRNA target sequence
gcaccaatttgtgcaggagaatattt

SEQ ID NO: 32465 - DNA, 26 bp, Artificial sequence
  SiRNA target sequence
caccaatttgtgcaggagaatatttc

SEQ ID NO: 32466 - DNA, 26 bp, Artificial sequence
  SiRNA target sequence
accaatttgtgcaggagaatatttct

SEQ ID NO: 32467 - DNA, 26 bp, Artificial sequence
  SiRNA target sequence
ccaatttgtgcaggagaatatttctt

SEQ ID NO: 32468 - DNA, 26 bp, Artificial sequence
  SiRNA target sequence
caatttgtgcaggagaatatttctta

SEQ ID NO: 32469 - DNA, 26 bp, Artificial sequence
  SiRNA target sequence
aatttgtgcaggagaatatttcttat

SEQ ID NO: 32470 - DNA, 26 bp, Artificial sequence
  SiRNA target sequence
atttgtgcaggagaatatttcttatt

SEQ ID NO: 32471 - DNA, 26 bp, Artificial sequence
  SiRNA target sequence
tttgtgcaggagaatatttcttattg

SEQ ID NO: 32472 - DNA, 26 bp, Artificial sequence
  SiRNA target sequence
ttgtgcaggagaatatttcttattgt

SEQ ID NO: 32473 - DNA, 26 bp, Artificial sequence
  SiRNA target sequence
tgtgcaggagaatatttcttattgtc

SEQ ID NO: 32474 - DNA, 26 bp, Artificial sequence
  SiRNA target sequence
gtgcaggagaatatttcttattgtca

SEQ ID NO: 32475 - DNA, 26 bp, Artificial sequence
  SiRNA target sequence
tgcaggagaatatttcttattgtcaa

SEQ ID NO: 32476 - DNA, 26 bp, Artificial sequence
  SiRNA target sequence
gcaggagaatatttcttattgtcaat

SEQ ID NO: 32477 - DNA, 26 bp, Artificial sequence
  SiRNA target sequence
caggagaatatttcttattgtcaatt

SEQ ID NO: 32478 - DNA, 26 bp, Artificial sequence
  SiRNA target sequence
aggagaatatttcttattgtcaattt

SEQ ID NO: 32479 - DNA, 26 bp, Artificial sequence
  SiRNA target sequence
ggagaatatttcttattgtcaatttt

SEQ ID NO: 32480 - DNA, 26 bp, Artificial sequence
  SiRNA target sequence
gagaatatttcttattgtcaattttt

SEQ ID NO: 32481 - DNA, 26 bp, Artificial sequence
  SiRNA target sequence
agaatatttcttattgtcaattttta

SEQ ID NO: 32482 - DNA, 26 bp, Artificial sequence
  SiRNA target sequence
gaatatttcttattgtcaatttttat

SEQ ID NO: 32483 - DNA, 26 bp, Artificial sequence
  SiRNA target sequence
aatatttcttattgtcaatttttatc

SEQ ID NO: 32484 - DNA, 26 bp, Artificial sequence
  SiRNA target sequence
atatttcttattgtcaatttttatcc

SEQ ID NO: 32485 - DNA, 26 bp, Artificial sequence
  SiRNA target sequence
tatttcttattgtcaatttttatcca

SEQ ID NO: 32486 - DNA, 26 bp, Artificial sequence
  SiRNA target sequence
atttcttattgtcaatttttatccaa

SEQ ID NO: 32487 - DNA, 26 bp, Artificial sequence
  SiRNA target sequence
tttcttattgtcaatttttatccaaa

SEQ ID NO: 32488 - DNA, 26 bp, Artificial sequence
  SiRNA target sequence
ttcttattgtcaatttttatccaaat

SEQ ID NO: 32489 - DNA, 26 bp, Artificial sequence
  SiRNA target sequence
tcttattgtcaatttttatccaaata

SEQ ID NO: 32490 - DNA, 26 bp, Artificial sequence
  SiRNA target sequence
cttattgtcaatttttatccaaatat

SEQ ID NO: 32491 - DNA, 26 bp, Artificial sequence
  SiRNA target sequence
ttattgtcaatttttatccaaatatc

SEQ ID NO: 32492 - DNA, 26 bp, Artificial sequence
  SiRNA target sequence
tattgtcaatttttatccaaatatcg

SEQ ID NO: 32493 - DNA, 26 bp, Artificial sequence
  SiRNA target sequence
attgtcaatttttatccaaatatcgc

SEQ ID NO: 32494 - DNA, 26 bp, Artificial sequence
  SiRNA target sequence
ttgtcaatttttatccaaatatcgcc

SEQ ID NO: 32495 - DNA, 26 bp, Artificial sequence
  SiRNA target sequence
tgtcaatttttatccaaatatcgccg

SEQ ID NO: 32496 - DNA, 26 bp, Artificial sequence
  SiRNA target sequence
gtcaatttttatccaaatatcgccgt

SEQ ID NO: 32497 - DNA, 26 bp, Artificial sequence
  SiRNA target sequence
tcaatttttatccaaatatcgccgtt

SEQ ID NO: 32498 - DNA, 26 bp, Artificial sequence
  SiRNA target sequence
caatttttatccaaatatcgccgtta

SEQ ID NO: 32499 - DNA, 26 bp, Artificial sequence
  SiRNA target sequence
aatttttatccaaatatcgccgttac

SEQ ID NO: 32500 - DNA, 26 bp, Artificial sequence
  SiRNA target sequence
atttttatccaaatatcgccgttaca

SEQ ID NO: 32501 - DNA, 26 bp, Artificial sequence
  SiRNA target sequence
tttttatccaaatatcgccgttacaa

SEQ ID NO: 32502 - DNA, 26 bp, Artificial sequence
  SiRNA target sequence
ttttatccaaatatcgccgttacaat

SEQ ID NO: 32503 - DNA, 26 bp, Artificial sequence
  SiRNA target sequence
tttatccaaatatcgccgttacaatg

SEQ ID NO: 32504 - DNA, 26 bp, Artificial sequence
  SiRNA target sequence
ttatccaaatatcgccgttacaatgc

SEQ ID NO: 32505 - DNA, 26 bp, Artificial sequence
  SiRNA target sequence
tatccaaatatcgccgttacaatgct

SEQ ID NO: 32506 - DNA, 26 bp, Artificial sequence
  SiRNA target sequence
atccaaatatcgccgttacaatgctt

SEQ ID NO: 32507 - DNA, 26 bp, Artificial sequence
  SiRNA target sequence
tccaaatatcgccgttacaatgctta

SEQ ID NO: 32508 - DNA, 26 bp, Artificial sequence
  SiRNA target sequence
ccaaatatcgccgttacaatgcttag

SEQ ID NO: 32509 - DNA, 26 bp, Artificial sequence
  SiRNA target sequence
caaatatcgccgttacaatgcttagt

SEQ ID NO: 32510 - DNA, 26 bp, Artificial sequence
  SiRNA target sequence
aaatatcgccgttacaatgcttagta

SEQ ID NO: 32511 - DNA, 26 bp, Artificial sequence
  SiRNA target sequence
aatatcgccgttacaatgcttagtag

SEQ ID NO: 32512 - DNA, 26 bp, Artificial sequence
  SiRNA target sequence
atatcgccgttacaatgcttagtagt

SEQ ID NO: 32513 - DNA, 26 bp, Artificial sequence
  SiRNA target sequence
tatcgccgttacaatgcttagtagtg

SEQ ID NO: 32514 - DNA, 26 bp, Artificial sequence
  SiRNA target sequence
atcgccgttacaatgcttagtagtgt

SEQ ID NO: 32515 - DNA, 26 bp, Artificial sequence
  SiRNA target sequence
tcgccgttacaatgcttagtagtgtc

SEQ ID NO: 32516 - DNA, 26 bp, Artificial sequence
  SiRNA target sequence
cgccgttacaatgcttagtagtgtca

SEQ ID NO: 32517 - DNA, 26 bp, Artificial sequence
  SiRNA target sequence
gccgttacaatgcttagtagtgtcat

SEQ ID NO: 32518 - DNA, 26 bp, Artificial sequence
  SiRNA target sequence
ccgttacaatgcttagtagtgtcata

SEQ ID NO: 32519 - DNA, 26 bp, Artificial sequence
  SiRNA target sequence
cgttacaatgcttagtagtgtcatat

SEQ ID NO: 32520 - DNA, 26 bp, Artificial sequence
  SiRNA target sequence
gttacaatgcttagtagtgtcatatg

SEQ ID NO: 32521 - DNA, 26 bp, Artificial sequence
  SiRNA target sequence
ttacaatgcttagtagtgtcatatgg

SEQ ID NO: 32522 - DNA, 26 bp, Artificial sequence
  SiRNA target sequence
tacaatgcttagtagtgtcatatggt

SEQ ID NO: 32523 - DNA, 26 bp, Artificial sequence
  SiRNA target sequence
acaatgcttagtagtgtcatatggta

SEQ ID NO: 32524 - DNA, 26 bp, Artificial sequence
  SiRNA target sequence
caatgcttagtagtgtcatatggtaa

SEQ ID NO: 32525 - DNA, 26 bp, Artificial sequence
  SiRNA target sequence
aatgcttagtagtgtcatatggtaag

SEQ ID NO: 32526 - DNA, 26 bp, Artificial sequence
  SiRNA target sequence
atgcttagtagtgtcatatggtaagc

SEQ ID NO: 32527 - DNA, 26 bp, Artificial sequence
  SiRNA target sequence
tgcttagtagtgtcatatggtaagct

SEQ ID NO: 32528 - DNA, 26 bp, Artificial sequence
  SiRNA target sequence
gcttagtagtgtcatatggtaagctt

SEQ ID NO: 32529 - DNA, 26 bp, Artificial sequence
  SiRNA target sequence
cttagtagtgtcatatggtaagcttt

SEQ ID NO: 32530 - DNA, 26 bp, Artificial sequence
  SiRNA target sequence
ttagtagtgtcatatggtaagctttt

SEQ ID NO: 32531 - DNA, 26 bp, Artificial sequence
  SiRNA target sequence
tagtagtgtcatatggtaagcttttt

SEQ ID NO: 32532 - DNA, 26 bp, Artificial sequence
  SiRNA target sequence
agtagtgtcatatggtaagcttttta

SEQ ID NO: 32533 - DNA, 26 bp, Artificial sequence
  SiRNA target sequence
gtagtgtcatatggtaagctttttaa

SEQ ID NO: 32534 - DNA, 26 bp, Artificial sequence
  SiRNA target sequence
tagtgtcatatggtaagctttttaaa

SEQ ID NO: 32535 - DNA, 26 bp, Artificial sequence
  SiRNA target sequence
agtgtcatatggtaagctttttaaat

SEQ ID NO: 32536 - DNA, 26 bp, Artificial sequence
  SiRNA target sequence
gtgtcatatggtaagctttttaaata

SEQ ID NO: 32537 - DNA, 26 bp, Artificial sequence
  SiRNA target sequence
tgtcatatggtaagctttttaaataa

SEQ ID NO: 32538 - DNA, 26 bp, Artificial sequence
  SiRNA target sequence
gtcatatggtaagctttttaaataat

SEQ ID NO: 32539 - DNA, 26 bp, Artificial sequence
  SiRNA target sequence
tcatatggtaagctttttaaataatc

SEQ ID NO: 32540 - DNA, 26 bp, Artificial sequence
  SiRNA target sequence
catatggtaagctttttaaataatct

SEQ ID NO: 32541 - DNA, 26 bp, Artificial sequence
  SiRNA target sequence
atatggtaagctttttaaataatctt

SEQ ID NO: 32542 - DNA, 26 bp, Artificial sequence
  SiRNA target sequence
tatggtaagctttttaaataatcttt

SEQ ID NO: 32543 - DNA, 26 bp, Artificial sequence
  SiRNA target sequence
atggtaagctttttaaataatctttt

SEQ ID NO: 32544 - DNA, 26 bp, Artificial sequence
  SiRNA target sequence
tggtaagctttttaaataatctttta

SEQ ID NO: 32545 - DNA, 26 bp, Artificial sequence
  SiRNA target sequence
ggtaagctttttaaataatcttttaa

SEQ ID NO: 32546 - DNA, 26 bp, Artificial sequence
  SiRNA target sequence
gtaagctttttaaataatcttttaat

SEQ ID NO: 32547 - DNA, 26 bp, Artificial sequence
  SiRNA target sequence
taagctttttaaataatcttttaatt

SEQ ID NO: 32548 - DNA, 26 bp, Artificial sequence
  SiRNA target sequence
aagctttttaaataatcttttaattc

SEQ ID NO: 32549 - DNA, 26 bp, Artificial sequence
  SiRNA target sequence
agctttttaaataatcttttaattct

SEQ ID NO: 32550 - DNA, 26 bp, Artificial sequence
  SiRNA target sequence
gctttttaaataatcttttaattcta

SEQ ID NO: 32551 - DNA, 26 bp, Artificial sequence
  SiRNA target sequence
ctttttaaataatcttttaattctac

SEQ ID NO: 32552 - DNA, 26 bp, Artificial sequence
  SiRNA target sequence
tttttaaataatcttttaattctaca

SEQ ID NO: 32553 - DNA, 26 bp, Artificial sequence
  SiRNA target sequence
ttttaaataatcttttaattctacat

SEQ ID NO: 32554 - DNA, 26 bp, Artificial sequence
  SiRNA target sequence
tttaaataatcttttaattctacatc

SEQ ID NO: 32555 - DNA, 26 bp, Artificial sequence
  SiRNA target sequence
ttaaataatcttttaattctacatca

SEQ ID NO: 32556 - DNA, 26 bp, Artificial sequence
  SiRNA target sequence
taaataatcttttaattctacatcat

SEQ ID NO: 32557 - DNA, 26 bp, Artificial sequence
  SiRNA target sequence
aaataatcttttaattctacatcatc

SEQ ID NO: 32558 - DNA, 26 bp, Artificial sequence
  SiRNA target sequence
aataatcttttaattctacatcatca

SEQ ID NO: 32559 - DNA, 26 bp, Artificial sequence
  SiRNA target sequence
ataatcttttaattctacatcatcaa

SEQ ID NO: 32560 - DNA, 26 bp, Artificial sequence
  SiRNA target sequence
taatcttttaattctacatcatcaaa

SEQ ID NO: 32561 - DNA, 26 bp, Artificial sequence
  SiRNA target sequence
aatcttttaattctacatcatcaaat

SEQ ID NO: 32562 - DNA, 26 bp, Artificial sequence
  SiRNA target sequence
atcttttaattctacatcatcaaatt

SEQ ID NO: 32563 - DNA, 26 bp, Artificial sequence
  SiRNA target sequence
tcttttaattctacatcatcaaattt

SEQ ID NO: 32564 - DNA, 26 bp, Artificial sequence
  SiRNA target sequence
cttttaattctacatcatcaaatttt

SEQ ID NO: 32565 - DNA, 26 bp, Artificial sequence
  SiRNA target sequence
ttttaattctacatcatcaaattttc

SEQ ID NO: 32566 - DNA, 26 bp, Artificial sequence
  SiRNA target sequence
tttaattctacatcatcaaattttcg

SEQ ID NO: 32567 - DNA, 26 bp, Artificial sequence
  SiRNA target sequence
ttaattctacatcatcaaattttcgt

SEQ ID NO: 32568 - DNA, 26 bp, Artificial sequence
  SiRNA target sequence
taattctacatcatcaaattttcgtc

SEQ ID NO: 32569 - DNA, 26 bp, Artificial sequence
  SiRNA target sequence
aattctacatcatcaaattttcgtcc

SEQ ID NO: 32570 - DNA, 26 bp, Artificial sequence
  SiRNA target sequence
attctacatcatcaaattttcgtccc

SEQ ID NO: 32571 - DNA, 26 bp, Artificial sequence
  SiRNA target sequence
ttctacatcatcaaattttcgtccca

SEQ ID NO: 32572 - DNA, 26 bp, Artificial sequence
  SiRNA target sequence
tctacatcatcaaattttcgtcccag

SEQ ID NO: 32573 - DNA, 26 bp, Artificial sequence
  SiRNA target sequence
ctacatcatcaaattttcgtcccagc

SEQ ID NO: 32574 - DNA, 26 bp, Artificial sequence
  SiRNA target sequence
tacatcatcaaattttcgtcccagca

SEQ ID NO: 32575 - DNA, 26 bp, Artificial sequence
  SiRNA target sequence
acatcatcaaattttcgtcccagcaa

SEQ ID NO: 32576 - DNA, 26 bp, Artificial sequence
  SiRNA target sequence
catcatcaaattttcgtcccagcaat

SEQ ID NO: 32577 - DNA, 26 bp, Artificial sequence
  SiRNA target sequence
atcatcaaattttcgtcccagcaatc

SEQ ID NO: 32578 - DNA, 26 bp, Artificial sequence
  SiRNA target sequence
tcatcaaattttcgtcccagcaatct

SEQ ID NO: 32579 - DNA, 26 bp, Artificial sequence
  SiRNA target sequence
catcaaattttcgtcccagcaatctc

SEQ ID NO: 32580 - DNA, 26 bp, Artificial sequence
  SiRNA target sequence
atcaaattttcgtcccagcaatctct

SEQ ID NO: 32581 - DNA, 26 bp, Artificial sequence
  SiRNA target sequence
tcaaattttcgtcccagcaatctctt

SEQ ID NO: 32582 - DNA, 26 bp, Artificial sequence
  SiRNA target sequence
caaattttcgtcccagcaatctctta

SEQ ID NO: 32583 - DNA, 26 bp, Artificial sequence
  SiRNA target sequence
aaattttcgtcccagcaatctcttag

SEQ ID NO: 32584 - DNA, 26 bp, Artificial sequence
  SiRNA target sequence
aattttcgtcccagcaatctcttaga

SEQ ID NO: 32585 - DNA, 26 bp, Artificial sequence
  SiRNA target sequence
attttcgtcccagcaatctcttagac

SEQ ID NO: 32586 - DNA, 26 bp, Artificial sequence
  SiRNA target sequence
ttttcgtcccagcaatctcttagacg

SEQ ID NO: 32587 - DNA, 26 bp, Artificial sequence
  SiRNA target sequence
tttcgtcccagcaatctcttagacgc

SEQ ID NO: 32588 - DNA, 26 bp, Artificial sequence
  SiRNA target sequence
ttcgtcccagcaatctcttagacgca

SEQ ID NO: 32589 - DNA, 26 bp, Artificial sequence
  SiRNA target sequence
tcgtcccagcaatctcttagacgcaa

SEQ ID NO: 32590 - DNA, 26 bp, Artificial sequence
  SiRNA target sequence
cgtcccagcaatctcttagacgcaaa

SEQ ID NO: 32591 - DNA, 26 bp, Artificial sequence
  SiRNA target sequence
gtcccagcaatctcttagacgcaaaa

SEQ ID NO: 32592 - DNA, 26 bp, Artificial sequence
  SiRNA target sequence
tcccagcaatctcttagacgcaaaaa

SEQ ID NO: 32593 - DNA, 26 bp, Artificial sequence
  SiRNA target sequence
cccagcaatctcttagacgcaaaaat

SEQ ID NO: 32594 - DNA, 26 bp, Artificial sequence
  SiRNA target sequence
ccagcaatctcttagacgcaaaaatc

SEQ ID NO: 32595 - DNA, 26 bp, Artificial sequence
  SiRNA target sequence
cagcaatctcttagacgcaaaaatcg

SEQ ID NO: 32596 - DNA, 26 bp, Artificial sequence
  SiRNA target sequence
agcaatctcttagacgcaaaaatcgt

SEQ ID NO: 32597 - DNA, 26 bp, Artificial sequence
  SiRNA target sequence
gcaatctcttagacgcaaaaatcgta

SEQ ID NO: 32598 - DNA, 26 bp, Artificial sequence
  SiRNA target sequence
caatctcttagacgcaaaaatcgtat

SEQ ID NO: 32599 - DNA, 26 bp, Artificial sequence
  SiRNA target sequence
aatctcttagacgcaaaaatcgtatt

SEQ ID NO: 32600 - DNA, 26 bp, Artificial sequence
  SiRNA target sequence
atctcttagacgcaaaaatcgtattc

SEQ ID NO: 32601 - DNA, 26 bp, Artificial sequence
  SiRNA target sequence
tctcttagacgcaaaaatcgtattct

SEQ ID NO: 32602 - DNA, 26 bp, Artificial sequence
  SiRNA target sequence
ctcttagacgcaaaaatcgtattctt

SEQ ID NO: 32603 - DNA, 26 bp, Artificial sequence
  SiRNA target sequence
tcttagacgcaaaaatcgtattcttg

SEQ ID NO: 32604 - DNA, 26 bp, Artificial sequence
  SiRNA target sequence
cttagacgcaaaaatcgtattcttgg

SEQ ID NO: 32605 - DNA, 26 bp, Artificial sequence
  SiRNA target sequence
ttagacgcaaaaatcgtattcttggg

SEQ ID NO: 32606 - DNA, 26 bp, Artificial sequence
  SiRNA target sequence
tagacgcaaaaatcgtattcttggga

SEQ ID NO: 32607 - DNA, 26 bp, Artificial sequence
  SiRNA target sequence
agacgcaaaaatcgtattcttgggat

SEQ ID NO: 32608 - DNA, 26 bp, Artificial sequence
  SiRNA target sequence
gacgcaaaaatcgtattcttgggatg

SEQ ID NO: 32609 - DNA, 26 bp, Artificial sequence
  SiRNA target sequence
acgcaaaaatcgtattcttgggatgt

SEQ ID NO: 32610 - DNA, 26 bp, Artificial sequence
  SiRNA target sequence
cgcaaaaatcgtattcttgggatgta

SEQ ID NO: 32611 - DNA, 26 bp, Artificial sequence
  SiRNA target sequence
gcaaaaatcgtattcttgggatgtaa

SEQ ID NO: 32612 - DNA, 26 bp, Artificial sequence
  SiRNA target sequence
caaaaatcgtattcttgggatgtaat

SEQ ID NO: 32613 - DNA, 26 bp, Artificial sequence
  SiRNA target sequence
aaaaatcgtattcttgggatgtaata

SEQ ID NO: 32614 - DNA, 26 bp, Artificial sequence
  SiRNA target sequence
aaaatcgtattcttgggatgtaataa

SEQ ID NO: 32615 - DNA, 26 bp, Artificial sequence
  SiRNA target sequence
aaatcgtattcttgggatgtaataac

SEQ ID NO: 32616 - DNA, 26 bp, Artificial sequence
  SiRNA target sequence
aatcgtattcttgggatgtaataaca

SEQ ID NO: 32617 - DNA, 26 bp, Artificial sequence
  SiRNA target sequence
atcgtattcttgggatgtaataacaa

SEQ ID NO: 32618 - DNA, 26 bp, Artificial sequence
  SiRNA target sequence
tcgtattcttgggatgtaataacaag

SEQ ID NO: 32619 - DNA, 26 bp, Artificial sequence
  SiRNA target sequence
cgtattcttgggatgtaataacaagt

SEQ ID NO: 32620 - DNA, 26 bp, Artificial sequence
  SiRNA target sequence
gtattcttgggatgtaataacaagtt

SEQ ID NO: 32621 - DNA, 26 bp, Artificial sequence
  SiRNA target sequence
tattcttgggatgtaataacaagtta

SEQ ID NO: 32622 - DNA, 26 bp, Artificial sequence
  SiRNA target sequence
attcttgggatgtaataacaagttag

SEQ ID NO: 32623 - DNA, 26 bp, Artificial sequence
  SiRNA target sequence
ttcttgggatgtaataacaagttaga

SEQ ID NO: 32624 - DNA, 26 bp, Artificial sequence
  SiRNA target sequence
tcttgggatgtaataacaagttagac

SEQ ID NO: 32625 - DNA, 26 bp, Artificial sequence
  SiRNA target sequence
cttgggatgtaataacaagttagact

SEQ ID NO: 32626 - DNA, 26 bp, Artificial sequence
  SiRNA target sequence
ttgggatgtaataacaagttagactt

SEQ ID NO: 32627 - DNA, 26 bp, Artificial sequence
  SiRNA target sequence
tgggatgtaataacaagttagactta

SEQ ID NO: 32628 - DNA, 26 bp, Artificial sequence
  SiRNA target sequence
gggatgtaataacaagttagacttag

SEQ ID NO: 32629 - DNA, 26 bp, Artificial sequence
  SiRNA target sequence
ggatgtaataacaagttagacttagc

SEQ ID NO: 32630 - DNA, 26 bp, Artificial sequence
  SiRNA target sequence
gatgtaataacaagttagacttagct

SEQ ID NO: 32631 - DNA, 26 bp, Artificial sequence
  SiRNA target sequence
atgtaataacaagttagacttagctt

SEQ ID NO: 32632 - DNA, 26 bp, Artificial sequence
  SiRNA target sequence
tgtaataacaagttagacttagcttg

SEQ ID NO: 32633 - DNA, 26 bp, Artificial sequence
  SiRNA target sequence
gtaataacaagttagacttagcttgc

SEQ ID NO: 32634 - DNA, 26 bp, Artificial sequence
  SiRNA target sequence
taataacaagttagacttagcttgct

SEQ ID NO: 32635 - DNA, 26 bp, Artificial sequence
  SiRNA target sequence
aataacaagttagacttagcttgctc

SEQ ID NO: 32636 - DNA, 26 bp, Artificial sequence
  SiRNA target sequence
ataacaagttagacttagcttgctca

SEQ ID NO: 32637 - DNA, 26 bp, Artificial sequence
  SiRNA target sequence
taacaagttagacttagcttgctcac

SEQ ID NO: 32638 - DNA, 26 bp, Artificial sequence
  SiRNA target sequence
aacaagttagacttagcttgctcacc

SEQ ID NO: 32639 - DNA, 26 bp, Artificial sequence
  SiRNA target sequence
acaagttagacttagcttgctcacct

SEQ ID NO: 32640 - DNA, 26 bp, Artificial sequence
  SiRNA target sequence
caagttagacttagcttgctcacctg

SEQ ID NO: 32641 - DNA, 26 bp, Artificial sequence
  SiRNA target sequence
aagttagacttagcttgctcacctgt

SEQ ID NO: 32642 - DNA, 26 bp, Artificial sequence
  SiRNA target sequence
agttagacttagcttgctcacctgtt

SEQ ID NO: 32643 - DNA, 26 bp, Artificial sequence
  SiRNA target sequence
gttagacttagcttgctcacctgtta

SEQ ID NO: 32644 - DNA, 26 bp, Artificial sequence
  SiRNA target sequence
ttagacttagcttgctcacctgttaa

SEQ ID NO: 32645 - DNA, 26 bp, Artificial sequence
  SiRNA target sequence
tagacttagcttgctcacctgttaaa

SEQ ID NO: 32646 - DNA, 26 bp, Artificial sequence
  SiRNA target sequence
agacttagcttgctcacctgttaaaa

SEQ ID NO: 32647 - DNA, 26 bp, Artificial sequence
  SiRNA target sequence
gacttagcttgctcacctgttaaaat

SEQ ID NO: 32648 - DNA, 26 bp, Artificial sequence
  SiRNA target sequence
acttagcttgctcacctgttaaaatt

SEQ ID NO: 32649 - DNA, 26 bp, Artificial sequence
  SiRNA target sequence
cttagcttgctcacctgttaaaattt

SEQ ID NO: 32650 - DNA, 26 bp, Artificial sequence
  SiRNA target sequence
ttagcttgctcacctgttaaaatttt

SEQ ID NO: 32651 - DNA, 26 bp, Artificial sequence
  SiRNA target sequence
tagcttgctcacctgttaaaatttta

SEQ ID NO: 32652 - DNA, 26 bp, Artificial sequence
  SiRNA target sequence
agcttgctcacctgttaaaattttat

SEQ ID NO: 32653 - DNA, 26 bp, Artificial sequence
  SiRNA target sequence
gcttgctcacctgttaaaattttatc

SEQ ID NO: 32654 - DNA, 26 bp, Artificial sequence
  SiRNA target sequence
cttgctcacctgttaaaattttatct

SEQ ID NO: 32655 - DNA, 26 bp, Artificial sequence
  SiRNA target sequence
ttgctcacctgttaaaattttatctt

SEQ ID NO: 32656 - DNA, 26 bp, Artificial sequence
  SiRNA target sequence
tgctcacctgttaaaattttatcttt

SEQ ID NO: 32657 - DNA, 26 bp, Artificial sequence
  SiRNA target sequence
gctcacctgttaaaattttatcttta

SEQ ID NO: 32658 - DNA, 26 bp, Artificial sequence
  SiRNA target sequence
ctcacctgttaaaattttatctttaa

SEQ ID NO: 32659 - DNA, 26 bp, Artificial sequence
  SiRNA target sequence
tcacctgttaaaattttatctttaaa

SEQ ID NO: 32660 - DNA, 26 bp, Artificial sequence
  SiRNA target sequence
cacctgttaaaattttatctttaaaa

SEQ ID NO: 32661 - DNA, 26 bp, Artificial sequence
  SiRNA target sequence
acctgttaaaattttatctttaaaaa

SEQ ID NO: 32662 - DNA, 26 bp, Artificial sequence
  SiRNA target sequence
cctgttaaaattttatctttaaaaat

SEQ ID NO: 32663 - DNA, 26 bp, Artificial sequence
  SiRNA target sequence
ctgttaaaattttatctttaaaaatt

SEQ ID NO: 32664 - DNA, 26 bp, Artificial sequence
  SiRNA target sequence
tgttaaaattttatctttaaaaattg

SEQ ID NO: 32665 - DNA, 26 bp, Artificial sequence
  SiRNA target sequence
gttaaaattttatctttaaaaattga

SEQ ID NO: 32666 - DNA, 26 bp, Artificial sequence
  SiRNA target sequence
ttaaaattttatctttaaaaattgat

SEQ ID NO: 32667 - DNA, 26 bp, Artificial sequence
  SiRNA target sequence
taaaattttatctttaaaaattgata

SEQ ID NO: 32668 - DNA, 26 bp, Artificial sequence
  SiRNA target sequence
aaaattttatctttaaaaattgatac

SEQ ID NO: 32669 - DNA, 26 bp, Artificial sequence
  SiRNA target sequence
aaattttatctttaaaaattgatacc

SEQ ID NO: 32670 - DNA, 26 bp, Artificial sequence
  SiRNA target sequence
aattttatctttaaaaattgatacca

SEQ ID NO: 32671 - DNA, 26 bp, Artificial sequence
  SiRNA target sequence
attttatctttaaaaattgataccac

SEQ ID NO: 32672 - DNA, 26 bp, Artificial sequence
  SiRNA target sequence
ttttatctttaaaaattgataccacc

SEQ ID NO: 32673 - DNA, 26 bp, Artificial sequence
  SiRNA target sequence
tttatctttaaaaattgataccaccg

SEQ ID NO: 32674 - DNA, 26 bp, Artificial sequence
  SiRNA target sequence
ttatctttaaaaattgataccaccga

SEQ ID NO: 32675 - DNA, 26 bp, Artificial sequence
  SiRNA target sequence
tatctttaaaaattgataccaccgat

SEQ ID NO: 32676 - DNA, 26 bp, Artificial sequence
  SiRNA target sequence
atctttaaaaattgataccaccgatg

SEQ ID NO: 32677 - DNA, 26 bp, Artificial sequence
  SiRNA target sequence
tctttaaaaattgataccaccgatgg

SEQ ID NO: 32678 - DNA, 26 bp, Artificial sequence
  SiRNA target sequence
ctttaaaaattgataccaccgatggt

SEQ ID NO: 32679 - DNA, 26 bp, Artificial sequence
  SiRNA target sequence
tttaaaaattgataccaccgatggtg

SEQ ID NO: 32680 - DNA, 26 bp, Artificial sequence
  SiRNA target sequence
ttaaaaattgataccaccgatggtgt

SEQ ID NO: 32681 - DNA, 26 bp, Artificial sequence
  SiRNA target sequence
taaaaattgataccaccgatggtgta

SEQ ID NO: 32682 - DNA, 26 bp, Artificial sequence
  SiRNA target sequence
aaaaattgataccaccgatggtgtag

SEQ ID NO: 32683 - DNA, 26 bp, Artificial sequence
  SiRNA target sequence
aaaattgataccaccgatggtgtagt

SEQ ID NO: 32684 - DNA, 26 bp, Artificial sequence
  SiRNA target sequence
aaattgataccaccgatggtgtagtt

SEQ ID NO: 32685 - DNA, 26 bp, Artificial sequence
  SiRNA target sequence
aattgataccaccgatggtgtagttc

SEQ ID NO: 32686 - DNA, 26 bp, Artificial sequence
  SiRNA target sequence
attgataccaccgatggtgtagttct

SEQ ID NO: 32687 - DNA, 26 bp, Artificial sequence
  SiRNA target sequence
ttgataccaccgatggtgtagttcta

SEQ ID NO: 32688 - DNA, 26 bp, Artificial sequence
  SiRNA target sequence
tgataccaccgatggtgtagttctac

SEQ ID NO: 32689 - DNA, 26 bp, Artificial sequence
  SiRNA target sequence
gataccaccgatggtgtagttctacc

SEQ ID NO: 32690 - DNA, 26 bp, Artificial sequence
  SiRNA target sequence
ataccaccgatggtgtagttctacca

SEQ ID NO: 32691 - DNA, 26 bp, Artificial sequence
  SiRNA target sequence
taccaccgatggtgtagttctaccac

SEQ ID NO: 32692 - DNA, 26 bp, Artificial sequence
  SiRNA target sequence
accaccgatggtgtagttctaccacc

SEQ ID NO: 32693 - DNA, 26 bp, Artificial sequence
  SiRNA target sequence
ccaccgatggtgtagttctaccacct

SEQ ID NO: 32694 - DNA, 26 bp, Artificial sequence
  SiRNA target sequence
caccgatggtgtagttctaccacctt

SEQ ID NO: 32695 - DNA, 26 bp, Artificial sequence
  SiRNA target sequence
accgatggtgtagttctaccaccttc

SEQ ID NO: 32696 - DNA, 26 bp, Artificial sequence
  SiRNA target sequence
ccgatggtgtagttctaccaccttct

SEQ ID NO: 32697 - DNA, 26 bp, Artificial sequence
  SiRNA target sequence
cgatggtgtagttctaccaccttctt

SEQ ID NO: 32698 - DNA, 26 bp, Artificial sequence
  SiRNA target sequence
gatggtgtagttctaccaccttcttc

SEQ ID NO: 32699 - DNA, 26 bp, Artificial sequence
  SiRNA target sequence
atggtgtagttctaccaccttcttcg

SEQ ID NO: 32700 - DNA, 26 bp, Artificial sequence
  SiRNA target sequence
tggtgtagttctaccaccttcttcgt

SEQ ID NO: 32701 - DNA, 26 bp, Artificial sequence
  SiRNA target sequence
ggtgtagttctaccaccttcttcgtt

SEQ ID NO: 32702 - DNA, 26 bp, Artificial sequence
  SiRNA target sequence
gtgtagttctaccaccttcttcgttt

SEQ ID NO: 32703 - DNA, 26 bp, Artificial sequence
  SiRNA target sequence
tgtagttctaccaccttcttcgtttt

SEQ ID NO: 32704 - DNA, 26 bp, Artificial sequence
  SiRNA target sequence
gtagttctaccaccttcttcgttttc

SEQ ID NO: 32705 - DNA, 26 bp, Artificial sequence
  SiRNA target sequence
tagttctaccaccttcttcgttttca

SEQ ID NO: 32706 - DNA, 26 bp, Artificial sequence
  SiRNA target sequence
agttctaccaccttcttcgttttcaa

SEQ ID NO: 32707 - DNA, 26 bp, Artificial sequence
  SiRNA target sequence
gttctaccaccttcttcgttttcaat

SEQ ID NO: 32708 - DNA, 26 bp, Artificial sequence
  SiRNA target sequence
ttctaccaccttcttcgttttcaata

SEQ ID NO: 32709 - DNA, 26 bp, Artificial sequence
  SiRNA target sequence
tctaccaccttcttcgttttcaataa

SEQ ID NO: 32710 - DNA, 26 bp, Artificial sequence
  SiRNA target sequence
ctaccaccttcttcgttttcaataat

SEQ ID NO: 32711 - DNA, 26 bp, Artificial sequence
  SiRNA target sequence
taccaccttcttcgttttcaataatt

SEQ ID NO: 32712 - DNA, 26 bp, Artificial sequence
  SiRNA target sequence
accaccttcttcgttttcaataattt

SEQ ID NO: 32713 - DNA, 26 bp, Artificial sequence
  SiRNA target sequence
ccaccttcttcgttttcaataatttg

SEQ ID NO: 32714 - DNA, 26 bp, Artificial sequence
  SiRNA target sequence
caccttcttcgttttcaataatttgt

SEQ ID NO: 32715 - DNA, 26 bp, Artificial sequence
  SiRNA target sequence
accttcttcgttttcaataatttgtg

SEQ ID NO: 32716 - DNA, 26 bp, Artificial sequence
  SiRNA target sequence
ccttcttcgttttcaataatttgtgg

SEQ ID NO: 32717 - DNA, 26 bp, Artificial sequence
  SiRNA target sequence
cttcttcgttttcaataatttgtggg

SEQ ID NO: 32718 - DNA, 26 bp, Artificial sequence
  SiRNA target sequence
ttcttcgttttcaataatttgtggga

SEQ ID NO: 32719 - DNA, 26 bp, Artificial sequence
  SiRNA target sequence
tcttcgttttcaataatttgtgggat

SEQ ID NO: 32720 - DNA, 26 bp, Artificial sequence
  SiRNA target sequence
cttcgttttcaataatttgtgggata

SEQ ID NO: 32721 - DNA, 26 bp, Artificial sequence
  SiRNA target sequence
ttcgttttcaataatttgtgggatat

SEQ ID NO: 32722 - DNA, 26 bp, Artificial sequence
  SiRNA target sequence
tcgttttcaataatttgtgggatatt

SEQ ID NO: 32723 - DNA, 26 bp, Artificial sequence
  SiRNA target sequence
cgttttcaataatttgtgggatattg

SEQ ID NO: 32724 - DNA, 26 bp, Artificial sequence
  SiRNA target sequence
gttttcaataatttgtgggatattgt

SEQ ID NO: 32725 - DNA, 26 bp, Artificial sequence
  SiRNA target sequence
ttttcaataatttgtgggatattgtt

SEQ ID NO: 32726 - DNA, 26 bp, Artificial sequence
  SiRNA target sequence
tttcaataatttgtgggatattgtta

SEQ ID NO: 32727 - DNA, 26 bp, Artificial sequence
  SiRNA target sequence
ttcaataatttgtgggatattgttat

SEQ ID NO: 32728 - DNA, 26 bp, Artificial sequence
  SiRNA target sequence
tcaataatttgtgggatattgttatg

SEQ ID NO: 32729 - DNA, 26 bp, Artificial sequence
  SiRNA target sequence
caataatttgtgggatattgttatgt

SEQ ID NO: 32730 - DNA, 26 bp, Artificial sequence
  SiRNA target sequence
aataatttgtgggatattgttatgta

SEQ ID NO: 32731 - DNA, 26 bp, Artificial sequence
  SiRNA target sequence
ataatttgtgggatattgttatgtat

SEQ ID NO: 32732 - DNA, 26 bp, Artificial sequence
  SiRNA target sequence
taatttgtgggatattgttatgtata

SEQ ID NO: 32733 - DNA, 26 bp, Artificial sequence
  SiRNA target sequence
aatttgtgggatattgttatgtataa

SEQ ID NO: 32734 - DNA, 26 bp, Artificial sequence
  SiRNA target sequence
atttgtgggatattgttatgtataag

SEQ ID NO: 32735 - DNA, 26 bp, Artificial sequence
  SiRNA target sequence
tttgtgggatattgttatgtataaga

SEQ ID NO: 32736 - DNA, 26 bp, Artificial sequence
  SiRNA target sequence
ttgtgggatattgttatgtataagag

SEQ ID NO: 32737 - DNA, 26 bp, Artificial sequence
  SiRNA target sequence
tgtgggatattgttatgtataagaga

SEQ ID NO: 32738 - DNA, 26 bp, Artificial sequence
  SiRNA target sequence
gtgggatattgttatgtataagagac

SEQ ID NO: 32739 - DNA, 26 bp, Artificial sequence
  SiRNA target sequence
tgggatattgttatgtataagagaca

SEQ ID NO: 32740 - DNA, 26 bp, Artificial sequence
  SiRNA target sequence
gggatattgttatgtataagagacac

SEQ ID NO: 32741 - DNA, 26 bp, Artificial sequence
  SiRNA target sequence
ggatattgttatgtataagagacaca

SEQ ID NO: 32742 - DNA, 26 bp, Artificial sequence
  SiRNA target sequence
gatattgttatgtataagagacacac

SEQ ID NO: 32743 - DNA, 26 bp, Artificial sequence
  SiRNA target sequence
atattgttatgtataagagacacaca

SEQ ID NO: 32744 - DNA, 26 bp, Artificial sequence
  SiRNA target sequence
tattgttatgtataagagacacacaa

SEQ ID NO: 32745 - DNA, 26 bp, Artificial sequence
  SiRNA target sequence
attgttatgtataagagacacacaag

SEQ ID NO: 32746 - DNA, 26 bp, Artificial sequence
  SiRNA target sequence
ttgttatgtataagagacacacaaga

SEQ ID NO: 32747 - DNA, 26 bp, Artificial sequence
  SiRNA target sequence
tgttatgtataagagacacacaagaa

SEQ ID NO: 32748 - DNA, 26 bp, Artificial sequence
  SiRNA target sequence
gttatgtataagagacacacaagaat

SEQ ID NO: 32749 - DNA, 26 bp, Artificial sequence
  SiRNA target sequence
ttatgtataagagacacacaagaatt

SEQ ID NO: 32750 - DNA, 26 bp, Artificial sequence
  SiRNA target sequence
tatgtataagagacacacaagaattg

SEQ ID NO: 32751 - DNA, 26 bp, Artificial sequence
  SiRNA target sequence
atgtataagagacacacaagaattgg

SEQ ID NO: 32752 - DNA, 26 bp, Artificial sequence
  SiRNA target sequence
tgtataagagacacacaagaattggt

SEQ ID NO: 32753 - DNA, 26 bp, Artificial sequence
  SiRNA target sequence
gtataagagacacacaagaattggtt

SEQ ID NO: 32754 - DNA, 26 bp, Artificial sequence
  SiRNA target sequence
tataagagacacacaagaattggttg

SEQ ID NO: 32755 - DNA, 26 bp, Artificial sequence
  SiRNA target sequence
ataagagacacacaagaattggttgt

SEQ ID NO: 32756 - DNA, 26 bp, Artificial sequence
  SiRNA target sequence
taagagacacacaagaattggttgtt

SEQ ID NO: 32757 - DNA, 26 bp, Artificial sequence
  SiRNA target sequence
aagagacacacaagaattggttgttc

SEQ ID NO: 32758 - DNA, 26 bp, Artificial sequence
  SiRNA target sequence
agagacacacaagaattggttgttcc

SEQ ID NO: 32759 - DNA, 26 bp, Artificial sequence
  SiRNA target sequence
gagacacacaagaattggttgttcct

SEQ ID NO: 32760 - DNA, 26 bp, Artificial sequence
  SiRNA target sequence
agacacacaagaattggttgttccta

SEQ ID NO: 32761 - DNA, 26 bp, Artificial sequence
  SiRNA target sequence
gacacacaagaattggttgttcctag

SEQ ID NO: 32762 - DNA, 26 bp, Artificial sequence
  SiRNA target sequence
acacacaagaattggttgttcctaga

SEQ ID NO: 32763 - DNA, 26 bp, Artificial sequence
  SiRNA target sequence
cacacaagaattggttgttcctagat

SEQ ID NO: 32764 - DNA, 26 bp, Artificial sequence
  SiRNA target sequence
acacaagaattggttgttcctagatc

SEQ ID NO: 32765 - DNA, 26 bp, Artificial sequence
  SiRNA target sequence
cacaagaattggttgttcctagatca

SEQ ID NO: 32766 - DNA, 26 bp, Artificial sequence
  SiRNA target sequence
acaagaattggttgttcctagatcaa

SEQ ID NO: 32767 - DNA, 26 bp, Artificial sequence
  SiRNA target sequence
caagaattggttgttcctagatcaat

SEQ ID NO: 32768 - DNA, 26 bp, Artificial sequence
  SiRNA target sequence
aagaattggttgttcctagatcaatt

SEQ ID NO: 32769 - DNA, 26 bp, Artificial sequence
  SiRNA target sequence
agaattggttgttcctagatcaattc

SEQ ID NO: 32770 - DNA, 26 bp, Artificial sequence
  SiRNA target sequence
gaattggttgttcctagatcaattcc

SEQ ID NO: 32771 - DNA, 26 bp, Artificial sequence
  SiRNA target sequence
aattggttgttcctagatcaattcct

SEQ ID NO: 32772 - DNA, 26 bp, Artificial sequence
  SiRNA target sequence
attggttgttcctagatcaattccta

SEQ ID NO: 32773 - DNA, 26 bp, Artificial sequence
  SiRNA target sequence
ttggttgttcctagatcaattcctat

SEQ ID NO: 32774 - DNA, 26 bp, Artificial sequence
  SiRNA target sequence
tggttgttcctagatcaattcctatt

SEQ ID NO: 32775 - DNA, 26 bp, Artificial sequence
  SiRNA target sequence
ggttgttcctagatcaattcctatta

SEQ ID NO: 32776 - DNA, 26 bp, Artificial sequence
  SiRNA target sequence
gttgttcctagatcaattcctattat

SEQ ID NO: 32777 - DNA, 26 bp, Artificial sequence
  SiRNA target sequence
ttgttcctagatcaattcctattatt

SEQ ID NO: 32778 - DNA, 26 bp, Artificial sequence
  SiRNA target sequence
tgttcctagatcaattcctattattt

SEQ ID NO: 32779 - DNA, 26 bp, Artificial sequence
  SiRNA target sequence
gttcctagatcaattcctattatttt

SEQ ID NO: 32780 - DNA, 26 bp, Artificial sequence
  SiRNA target sequence
ttcctagatcaattcctattatttta

SEQ ID NO: 32781 - DNA, 26 bp, Artificial sequence
  SiRNA target sequence
tcctagatcaattcctattattttag

SEQ ID NO: 32782 - DNA, 26 bp, Artificial sequence
  SiRNA target sequence
cctagatcaattcctattattttaga

SEQ ID NO: 32783 - DNA, 26 bp, Artificial sequence
  SiRNA target sequence
ctagatcaattcctattattttagag

SEQ ID NO: 32784 - DNA, 26 bp, Artificial sequence
  SiRNA target sequence
tagatcaattcctattattttagagc

SEQ ID NO: 32785 - DNA, 26 bp, Artificial sequence
  SiRNA target sequence
agatcaattcctattattttagagct

SEQ ID NO: 32786 - DNA, 26 bp, Artificial sequence
  SiRNA target sequence
gatcaattcctattattttagagcta

SEQ ID NO: 32787 - DNA, 26 bp, Artificial sequence
  SiRNA target sequence
atcaattcctattattttagagctaa

SEQ ID NO: 32788 - DNA, 26 bp, Artificial sequence
  SiRNA target sequence
tcaattcctattattttagagctaat

SEQ ID NO: 32789 - DNA, 26 bp, Artificial sequence
  SiRNA target sequence
caattcctattattttagagctaatt

SEQ ID NO: 32790 - DNA, 26 bp, Artificial sequence
  SiRNA target sequence
aattcctattattttagagctaattt

SEQ ID NO: 32791 - DNA, 26 bp, Artificial sequence
  SiRNA target sequence
attcctattattttagagctaatttc

SEQ ID NO: 32792 - DNA, 26 bp, Artificial sequence
  SiRNA target sequence
ttcctattattttagagctaatttct

SEQ ID NO: 32793 - DNA, 26 bp, Artificial sequence
  SiRNA target sequence
tcctattattttagagctaatttctt

SEQ ID NO: 32794 - DNA, 26 bp, Artificial sequence
  SiRNA target sequence
cctattattttagagctaatttcttc

SEQ ID NO: 32795 - DNA, 26 bp, Artificial sequence
  SiRNA target sequence
ctattattttagagctaatttcttct

SEQ ID NO: 32796 - DNA, 26 bp, Artificial sequence
  SiRNA target sequence
tattattttagagctaatttcttctt

SEQ ID NO: 32797 - DNA, 26 bp, Artificial sequence
  SiRNA target sequence
attattttagagctaatttcttcttt

SEQ ID NO: 32798 - DNA, 26 bp, Artificial sequence
  SiRNA target sequence
ttattttagagctaatttcttcttta

SEQ ID NO: 32799 - DNA, 26 bp, Artificial sequence
  SiRNA target sequence
tattttagagctaatttcttctttag

SEQ ID NO: 32800 - DNA, 26 bp, Artificial sequence
  SiRNA target sequence
attttagagctaatttcttctttaga

SEQ ID NO: 32801 - DNA, 26 bp, Artificial sequence
  SiRNA target sequence
ttttagagctaatttcttctttagac

SEQ ID NO: 32802 - DNA, 26 bp, Artificial sequence
  SiRNA target sequence
tttagagctaatttcttctttagaca

SEQ ID NO: 32803 - DNA, 26 bp, Artificial sequence
  SiRNA target sequence
ttagagctaatttcttctttagacat

SEQ ID NO: 32804 - DNA, 27 bp, Artificial sequence
  SiRNA target sequence
ttaagaatttttcaatattttttttgc

SEQ ID NO: 32805 - DNA, 27 bp, Artificial sequence
  SiRNA target sequence
taagaatttttcaatattttttttgct

SEQ ID NO: 32806 - DNA, 27 bp, Artificial sequence
  SiRNA target sequence
aagaatttttcaatattttttttgctt

SEQ ID NO: 32807 - DNA, 27 bp, Artificial sequence
  SiRNA target sequence
agaatttttcaatattttttttgcttg

SEQ ID NO: 32808 - DNA, 27 bp, Artificial sequence
  SiRNA target sequence
gaatttttcaatattttttttgcttgt

SEQ ID NO: 32809 - DNA, 27 bp, Artificial sequence
  SiRNA target sequence
aatttttcaatattttttttgcttgtt

SEQ ID NO: 32810 - DNA, 27 bp, Artificial sequence
  SiRNA target sequence
atttttcaatattttttttgcttgttc

SEQ ID NO: 32811 - DNA, 27 bp, Artificial sequence
  SiRNA target sequence
tttttcaatattttttttgcttgttct

SEQ ID NO: 32812 - DNA, 27 bp, Artificial sequence
  SiRNA target sequence
ttttcaatattttttttgcttgttcta

SEQ ID NO: 32813 - DNA, 27 bp, Artificial sequence
  SiRNA target sequence
tttcaatattttttttgcttgttctaa

SEQ ID NO: 32814 - DNA, 27 bp, Artificial sequence
  SiRNA target sequence
ttcaatattttttttgcttgttctaag

SEQ ID NO: 32815 - DNA, 27 bp, Artificial sequence
  SiRNA target sequence
tcaatattttttttgcttgttctaagt

SEQ ID NO: 32816 - DNA, 27 bp, Artificial sequence
  SiRNA target sequence
caatattttttttgcttgttctaagtc

SEQ ID NO: 32817 - DNA, 27 bp, Artificial sequence
  SiRNA target sequence
aatattttttttgcttgttctaagtca

SEQ ID NO: 32818 - DNA, 27 bp, Artificial sequence
  SiRNA target sequence
atattttttttgcttgttctaagtcat

SEQ ID NO: 32819 - DNA, 27 bp, Artificial sequence
  SiRNA target sequence
tattttttttgcttgttctaagtcata

SEQ ID NO: 32820 - DNA, 27 bp, Artificial sequence
  SiRNA target sequence
attttttttgcttgttctaagtcataa

SEQ ID NO: 32821 - DNA, 27 bp, Artificial sequence
  SiRNA target sequence
ttttttttgcttgttctaagtcataaa

SEQ ID NO: 32822 - DNA, 27 bp, Artificial sequence
  SiRNA target sequence
tttttttgcttgttctaagtcataaat

SEQ ID NO: 32823 - DNA, 27 bp, Artificial sequence
  SiRNA target sequence
ttttttgcttgttctaagtcataaatt

SEQ ID NO: 32824 - DNA, 27 bp, Artificial sequence
  SiRNA target sequence
tttttgcttgttctaagtcataaattt

SEQ ID NO: 32825 - DNA, 27 bp, Artificial sequence
  SiRNA target sequence
ttttgcttgttctaagtcataaatttt

SEQ ID NO: 32826 - DNA, 27 bp, Artificial sequence
  SiRNA target sequence
tttgcttgttctaagtcataaattttt

SEQ ID NO: 32827 - DNA, 27 bp, Artificial sequence
  SiRNA target sequence
ttgcttgttctaagtcataaatttttt

SEQ ID NO: 32828 - DNA, 27 bp, Artificial sequence
  SiRNA target sequence
tgcttgttctaagtcataaattttttt

SEQ ID NO: 32829 - DNA, 27 bp, Artificial sequence
  SiRNA target sequence
gcttgttctaagtcataaattttttta

SEQ ID NO: 32830 - DNA, 27 bp, Artificial sequence
  SiRNA target sequence
cttgttctaagtcataaatttttttag

SEQ ID NO: 32831 - DNA, 27 bp, Artificial sequence
  SiRNA target sequence
ttgttctaagtcataaatttttttagt

SEQ ID NO: 32832 - DNA, 27 bp, Artificial sequence
  SiRNA target sequence
tgttctaagtcataaatttttttagtc

SEQ ID NO: 32833 - DNA, 27 bp, Artificial sequence
  SiRNA target sequence
gttctaagtcataaatttttttagtca

SEQ ID NO: 32834 - DNA, 27 bp, Artificial sequence
  SiRNA target sequence
ttctaagtcataaatttttttagtcaa

SEQ ID NO: 32835 - DNA, 27 bp, Artificial sequence
  SiRNA target sequence
tctaagtcataaatttttttagtcaaa

SEQ ID NO: 32836 - DNA, 27 bp, Artificial sequence
  SiRNA target sequence
ctaagtcataaatttttttagtcaaat

SEQ ID NO: 32837 - DNA, 27 bp, Artificial sequence
  SiRNA target sequence
taagtcataaatttttttagtcaaata

SEQ ID NO: 32838 - DNA, 27 bp, Artificial sequence
  SiRNA target sequence
aagtcataaatttttttagtcaaatat

SEQ ID NO: 32839 - DNA, 27 bp, Artificial sequence
  SiRNA target sequence
agtcataaatttttttagtcaaatatg

SEQ ID NO: 32840 - DNA, 27 bp, Artificial sequence
  SiRNA target sequence
gtcataaatttttttagtcaaatatga

SEQ ID NO: 32841 - DNA, 27 bp, Artificial sequence
  SiRNA target sequence
tcataaatttttttagtcaaatatgac

SEQ ID NO: 32842 - DNA, 27 bp, Artificial sequence
  SiRNA target sequence
cataaatttttttagtcaaatatgact

SEQ ID NO: 32843 - DNA, 27 bp, Artificial sequence
  SiRNA target sequence
ataaatttttttagtcaaatatgactt

SEQ ID NO: 32844 - DNA, 27 bp, Artificial sequence
  SiRNA target sequence
taaatttttttagtcaaatatgacttt

SEQ ID NO: 32845 - DNA, 27 bp, Artificial sequence
  SiRNA target sequence
aaatttttttagtcaaatatgacttta

SEQ ID NO: 32846 - DNA, 27 bp, Artificial sequence
  SiRNA target sequence
aatttttttagtcaaatatgactttaa

SEQ ID NO: 32847 - DNA, 27 bp, Artificial sequence
  SiRNA target sequence
atttttttagtcaaatatgactttaaa

SEQ ID NO: 32848 - DNA, 27 bp, Artificial sequence
  SiRNA target sequence
tttttttagtcaaatatgactttaaaa

SEQ ID NO: 32849 - DNA, 27 bp, Artificial sequence
  SiRNA target sequence
ttttttagtcaaatatgactttaaaat

SEQ ID NO: 32850 - DNA, 27 bp, Artificial sequence
  SiRNA target sequence
tttttagtcaaatatgactttaaaatc

SEQ ID NO: 32851 - DNA, 27 bp, Artificial sequence
  SiRNA target sequence
ttttagtcaaatatgactttaaaatct

SEQ ID NO: 32852 - DNA, 27 bp, Artificial sequence
  SiRNA target sequence
tttagtcaaatatgactttaaaatctc

SEQ ID NO: 32853 - DNA, 27 bp, Artificial sequence
  SiRNA target sequence
ttagtcaaatatgactttaaaatctct

SEQ ID NO: 32854 - DNA, 27 bp, Artificial sequence
  SiRNA target sequence
tagtcaaatatgactttaaaatctctt

SEQ ID NO: 32855 - DNA, 27 bp, Artificial sequence
  SiRNA target sequence
agtcaaatatgactttaaaatctcttt

SEQ ID NO: 32856 - DNA, 27 bp, Artificial sequence
  SiRNA target sequence
gtcaaatatgactttaaaatctctttt

SEQ ID NO: 32857 - DNA, 27 bp, Artificial sequence
  SiRNA target sequence
tcaaatatgactttaaaatctcttttg

SEQ ID NO: 32858 - DNA, 27 bp, Artificial sequence
  SiRNA target sequence
caaatatgactttaaaatctcttttgt

SEQ ID NO: 32859 - DNA, 27 bp, Artificial sequence
  SiRNA target sequence
aaatatgactttaaaatctcttttgtt

SEQ ID NO: 32860 - DNA, 27 bp, Artificial sequence
  SiRNA target sequence
aatatgactttaaaatctcttttgttt

SEQ ID NO: 32861 - DNA, 27 bp, Artificial sequence
  SiRNA target sequence
atatgactttaaaatctcttttgtttc

SEQ ID NO: 32862 - DNA, 27 bp, Artificial sequence
  SiRNA target sequence
tatgactttaaaatctcttttgtttca

SEQ ID NO: 32863 - DNA, 27 bp, Artificial sequence
  SiRNA target sequence
atgactttaaaatctcttttgtttcat

SEQ ID NO: 32864 - DNA, 27 bp, Artificial sequence
  SiRNA target sequence
tgactttaaaatctcttttgtttcatc

SEQ ID NO: 32865 - DNA, 27 bp, Artificial sequence
  SiRNA target sequence
gactttaaaatctcttttgtttcatct

SEQ ID NO: 32866 - DNA, 27 bp, Artificial sequence
  SiRNA target sequence
actttaaaatctcttttgtttcatctg

SEQ ID NO: 32867 - DNA, 27 bp, Artificial sequence
  SiRNA target sequence
ctttaaaatctcttttgtttcatctgt

SEQ ID NO: 32868 - DNA, 27 bp, Artificial sequence
  SiRNA target sequence
tttaaaatctcttttgtttcatctgtt

SEQ ID NO: 32869 - DNA, 27 bp, Artificial sequence
  SiRNA target sequence
ttaaaatctcttttgtttcatctgtta

SEQ ID NO: 32870 - DNA, 27 bp, Artificial sequence
  SiRNA target sequence
taaaatctcttttgtttcatctgttac

SEQ ID NO: 32871 - DNA, 27 bp, Artificial sequence
  SiRNA target sequence
aaaatctcttttgtttcatctgttact

SEQ ID NO: 32872 - DNA, 27 bp, Artificial sequence
  SiRNA target sequence
aaatctcttttgtttcatctgttactt

SEQ ID NO: 32873 - DNA, 27 bp, Artificial sequence
  SiRNA target sequence
aatctcttttgtttcatctgttacttg

SEQ ID NO: 32874 - DNA, 27 bp, Artificial sequence
  SiRNA target sequence
atctcttttgtttcatctgttacttgt

SEQ ID NO: 32875 - DNA, 27 bp, Artificial sequence
  SiRNA target sequence
tctcttttgtttcatctgttacttgtt

SEQ ID NO: 32876 - DNA, 27 bp, Artificial sequence
  SiRNA target sequence
ctcttttgtttcatctgttacttgttt

SEQ ID NO: 32877 - DNA, 27 bp, Artificial sequence
  SiRNA target sequence
tcttttgtttcatctgttacttgtttg

SEQ ID NO: 32878 - DNA, 27 bp, Artificial sequence
  SiRNA target sequence
cttttgtttcatctgttacttgtttgt

SEQ ID NO: 32879 - DNA, 27 bp, Artificial sequence
  SiRNA target sequence
ttttgtttcatctgttacttgtttgta

SEQ ID NO: 32880 - DNA, 27 bp, Artificial sequence
  SiRNA target sequence
tttgtttcatctgttacttgtttgtac

SEQ ID NO: 32881 - DNA, 27 bp, Artificial sequence
  SiRNA target sequence
ttgtttcatctgttacttgtttgtact

SEQ ID NO: 32882 - DNA, 27 bp, Artificial sequence
  SiRNA target sequence
tgtttcatctgttacttgtttgtactt

SEQ ID NO: 32883 - DNA, 27 bp, Artificial sequence
  SiRNA target sequence
gtttcatctgttacttgtttgtacttt

SEQ ID NO: 32884 - DNA, 27 bp, Artificial sequence
  SiRNA target sequence
tttcatctgttacttgtttgtacttta

SEQ ID NO: 32885 - DNA, 27 bp, Artificial sequence
  SiRNA target sequence
ttcatctgttacttgtttgtactttaa

SEQ ID NO: 32886 - DNA, 27 bp, Artificial sequence
  SiRNA target sequence
tcatctgttacttgtttgtactttaaa

SEQ ID NO: 32887 - DNA, 27 bp, Artificial sequence
  SiRNA target sequence
catctgttacttgtttgtactttaaaa

SEQ ID NO: 32888 - DNA, 27 bp, Artificial sequence
  SiRNA target sequence
atctgttacttgtttgtactttaaaaa

SEQ ID NO: 32889 - DNA, 27 bp, Artificial sequence
  SiRNA target sequence
tctgttacttgtttgtactttaaaaat

SEQ ID NO: 32890 - DNA, 27 bp, Artificial sequence
  SiRNA target sequence
ctgttacttgtttgtactttaaaaatt

SEQ ID NO: 32891 - DNA, 27 bp, Artificial sequence
  SiRNA target sequence
tgttacttgtttgtactttaaaaattg

SEQ ID NO: 32892 - DNA, 27 bp, Artificial sequence
  SiRNA target sequence
gttacttgtttgtactttaaaaattgt

SEQ ID NO: 32893 - DNA, 27 bp, Artificial sequence
  SiRNA target sequence
ttacttgtttgtactttaaaaattgtt

SEQ ID NO: 32894 - DNA, 27 bp, Artificial sequence
  SiRNA target sequence
tacttgtttgtactttaaaaattgttg

SEQ ID NO: 32895 - DNA, 27 bp, Artificial sequence
  SiRNA target sequence
acttgtttgtactttaaaaattgttga

SEQ ID NO: 32896 - DNA, 27 bp, Artificial sequence
  SiRNA target sequence
cttgtttgtactttaaaaattgttgaa

SEQ ID NO: 32897 - DNA, 27 bp, Artificial sequence
  SiRNA target sequence
ttgtttgtactttaaaaattgttgaat

SEQ ID NO: 32898 - DNA, 27 bp, Artificial sequence
  SiRNA target sequence
tgtttgtactttaaaaattgttgaatt

SEQ ID NO: 32899 - DNA, 27 bp, Artificial sequence
  SiRNA target sequence
gtttgtactttaaaaattgttgaattt

SEQ ID NO: 32900 - DNA, 27 bp, Artificial sequence
  SiRNA target sequence
tttgtactttaaaaattgttgaatttc

SEQ ID NO: 32901 - DNA, 27 bp, Artificial sequence
  SiRNA target sequence
ttgtactttaaaaattgttgaatttca

SEQ ID NO: 32902 - DNA, 27 bp, Artificial sequence
  SiRNA target sequence
tgtactttaaaaattgttgaatttcaa

SEQ ID NO: 32903 - DNA, 27 bp, Artificial sequence
  SiRNA target sequence
gtactttaaaaattgttgaatttcaat

SEQ ID NO: 32904 - DNA, 27 bp, Artificial sequence
  SiRNA target sequence
tactttaaaaattgttgaatttcaatt

SEQ ID NO: 32905 - DNA, 27 bp, Artificial sequence
  SiRNA target sequence
actttaaaaattgttgaatttcaattt

SEQ ID NO: 32906 - DNA, 27 bp, Artificial sequence
  SiRNA target sequence
ctttaaaaattgttgaatttcaatttt

SEQ ID NO: 32907 - DNA, 27 bp, Artificial sequence
  SiRNA target sequence
tttaaaaattgttgaatttcaatttta

SEQ ID NO: 32908 - DNA, 27 bp, Artificial sequence
  SiRNA target sequence
ttaaaaattgttgaatttcaattttaa

SEQ ID NO: 32909 - DNA, 27 bp, Artificial sequence
  SiRNA target sequence
taaaaattgttgaatttcaattttaaa

SEQ ID NO: 32910 - DNA, 27 bp, Artificial sequence
  SiRNA target sequence
aaaaattgttgaatttcaattttaaat

SEQ ID NO: 32911 - DNA, 27 bp, Artificial sequence
  SiRNA target sequence
aaaattgttgaatttcaattttaaatt

SEQ ID NO: 32912 - DNA, 27 bp, Artificial sequence
  SiRNA target sequence
aaattgttgaatttcaattttaaattc

SEQ ID NO: 32913 - DNA, 27 bp, Artificial sequence
  SiRNA target sequence
aattgttgaatttcaattttaaattcg

SEQ ID NO: 32914 - DNA, 27 bp, Artificial sequence
  SiRNA target sequence
attgttgaatttcaattttaaattcgg

SEQ ID NO: 32915 - DNA, 27 bp, Artificial sequence
  SiRNA target sequence
ttgttgaatttcaattttaaattcggc

SEQ ID NO: 32916 - DNA, 27 bp, Artificial sequence
  SiRNA target sequence
tgttgaatttcaattttaaattcggca

SEQ ID NO: 32917 - DNA, 27 bp, Artificial sequence
  SiRNA target sequence
gttgaatttcaattttaaattcggcac

SEQ ID NO: 32918 - DNA, 27 bp, Artificial sequence
  SiRNA target sequence
ttgaatttcaattttaaattcggcaca

SEQ ID NO: 32919 - DNA, 27 bp, Artificial sequence
  SiRNA target sequence
tgaatttcaattttaaattcggcacaa

SEQ ID NO: 32920 - DNA, 27 bp, Artificial sequence
  SiRNA target sequence
gaatttcaattttaaattcggcacaat

SEQ ID NO: 32921 - DNA, 27 bp, Artificial sequence
  SiRNA target sequence
aatttcaattttaaattcggcacaatt

SEQ ID NO: 32922 - DNA, 27 bp, Artificial sequence
  SiRNA target sequence
atttcaattttaaattcggcacaattt

SEQ ID NO: 32923 - DNA, 27 bp, Artificial sequence
  SiRNA target sequence
tttcaattttaaattcggcacaatttt

SEQ ID NO: 32924 - DNA, 27 bp, Artificial sequence
  SiRNA target sequence
ttcaattttaaattcggcacaattttt

SEQ ID NO: 32925 - DNA, 27 bp, Artificial sequence
  SiRNA target sequence
tcaattttaaattcggcacaatttttt

SEQ ID NO: 32926 - DNA, 27 bp, Artificial sequence
  SiRNA target sequence
caattttaaattcggcacaattttttt

SEQ ID NO: 32927 - DNA, 27 bp, Artificial sequence
  SiRNA target sequence
aattttaaattcggcacaatttttttc

SEQ ID NO: 32928 - DNA, 27 bp, Artificial sequence
  SiRNA target sequence
attttaaattcggcacaatttttttca

SEQ ID NO: 32929 - DNA, 27 bp, Artificial sequence
  SiRNA target sequence
ttttaaattcggcacaatttttttcaa

SEQ ID NO: 32930 - DNA, 27 bp, Artificial sequence
  SiRNA target sequence
tttaaattcggcacaatttttttcaat

SEQ ID NO: 32931 - DNA, 27 bp, Artificial sequence
  SiRNA target sequence
ttaaattcggcacaatttttttcaatt

SEQ ID NO: 32932 - DNA, 27 bp, Artificial sequence
  SiRNA target sequence
taaattcggcacaatttttttcaattt

SEQ ID NO: 32933 - DNA, 27 bp, Artificial sequence
  SiRNA target sequence
aaattcggcacaatttttttcaatttc

SEQ ID NO: 32934 - DNA, 27 bp, Artificial sequence
  SiRNA target sequence
aattcggcacaatttttttcaatttca

SEQ ID NO: 32935 - DNA, 27 bp, Artificial sequence
  SiRNA target sequence
attcggcacaatttttttcaatttcat

SEQ ID NO: 32936 - DNA, 27 bp, Artificial sequence
  SiRNA target sequence
ttcggcacaatttttttcaatttcatc

SEQ ID NO: 32937 - DNA, 27 bp, Artificial sequence
  SiRNA target sequence
tcggcacaatttttttcaatttcatct

SEQ ID NO: 32938 - DNA, 27 bp, Artificial sequence
  SiRNA target sequence
cggcacaatttttttcaatttcatctt

SEQ ID NO: 32939 - DNA, 27 bp, Artificial sequence
  SiRNA target sequence
ggcacaatttttttcaatttcatcttt

SEQ ID NO: 32940 - DNA, 27 bp, Artificial sequence
  SiRNA target sequence
gcacaatttttttcaatttcatctttt

SEQ ID NO: 32941 - DNA, 27 bp, Artificial sequence
  SiRNA target sequence
cacaatttttttcaatttcatcttttt

SEQ ID NO: 32942 - DNA, 27 bp, Artificial sequence
  SiRNA target sequence
acaatttttttcaatttcatctttttt

SEQ ID NO: 32943 - DNA, 27 bp, Artificial sequence
  SiRNA target sequence
caatttttttcaatttcatcttttttc

SEQ ID NO: 32944 - DNA, 27 bp, Artificial sequence
  SiRNA target sequence
aatttttttcaatttcatcttttttcg

SEQ ID NO: 32945 - DNA, 27 bp, Artificial sequence
  SiRNA target sequence
atttttttcaatttcatcttttttcga

SEQ ID NO: 32946 - DNA, 27 bp, Artificial sequence
  SiRNA target sequence
tttttttcaatttcatcttttttcgaa

SEQ ID NO: 32947 - DNA, 27 bp, Artificial sequence
  SiRNA target sequence
ttttttcaatttcatcttttttcgaat

SEQ ID NO: 32948 - DNA, 27 bp, Artificial sequence
  SiRNA target sequence
tttttcaatttcatcttttttcgaatt

SEQ ID NO: 32949 - DNA, 27 bp, Artificial sequence
  SiRNA target sequence
ttttcaatttcatcttttttcgaattt

SEQ ID NO: 32950 - DNA, 27 bp, Artificial sequence
  SiRNA target sequence
tttcaatttcatcttttttcgaatttt

SEQ ID NO: 32951 - DNA, 27 bp, Artificial sequence
  SiRNA target sequence
ttcaatttcatcttttttcgaattttc

SEQ ID NO: 32952 - DNA, 27 bp, Artificial sequence
  SiRNA target sequence
tcaatttcatcttttttcgaattttct

SEQ ID NO: 32953 - DNA, 27 bp, Artificial sequence
  SiRNA target sequence
caatttcatcttttttcgaattttctt

SEQ ID NO: 32954 - DNA, 27 bp, Artificial sequence
  SiRNA target sequence
aatttcatcttttttcgaattttcttc

SEQ ID NO: 32955 - DNA, 27 bp, Artificial sequence
  SiRNA target sequence
atttcatcttttttcgaattttcttcg

SEQ ID NO: 32956 - DNA, 27 bp, Artificial sequence
  SiRNA target sequence
tttcatcttttttcgaattttcttcgg

SEQ ID NO: 32957 - DNA, 27 bp, Artificial sequence
  SiRNA target sequence
ttcatcttttttcgaattttcttcggc

SEQ ID NO: 32958 - DNA, 27 bp, Artificial sequence
  SiRNA target sequence
tcatcttttttcgaattttcttcggct

SEQ ID NO: 32959 - DNA, 27 bp, Artificial sequence
  SiRNA target sequence
catcttttttcgaattttcttcggctt

SEQ ID NO: 32960 - DNA, 27 bp, Artificial sequence
  SiRNA target sequence
atcttttttcgaattttcttcggcttc

SEQ ID NO: 32961 - DNA, 27 bp, Artificial sequence
  SiRNA target sequence
tcttttttcgaattttcttcggcttct

SEQ ID NO: 32962 - DNA, 27 bp, Artificial sequence
  SiRNA target sequence
cttttttcgaattttcttcggcttctc

SEQ ID NO: 32963 - DNA, 27 bp, Artificial sequence
  SiRNA target sequence
ttttttcgaattttcttcggcttctcg

SEQ ID NO: 32964 - DNA, 27 bp, Artificial sequence
  SiRNA target sequence
tttttcgaattttcttcggcttctcgt

SEQ ID NO: 32965 - DNA, 27 bp, Artificial sequence
  SiRNA target sequence
ttttcgaattttcttcggcttctcgta

SEQ ID NO: 32966 - DNA, 27 bp, Artificial sequence
  SiRNA target sequence
tttcgaattttcttcggcttctcgtat

SEQ ID NO: 32967 - DNA, 27 bp, Artificial sequence
  SiRNA target sequence
ttcgaattttcttcggcttctcgtatc

SEQ ID NO: 32968 - DNA, 27 bp, Artificial sequence
  SiRNA target sequence
tcgaattttcttcggcttctcgtatca

SEQ ID NO: 32969 - DNA, 27 bp, Artificial sequence
  SiRNA target sequence
cgaattttcttcggcttctcgtatcat

SEQ ID NO: 32970 - DNA, 27 bp, Artificial sequence
  SiRNA target sequence
gaattttcttcggcttctcgtatcatt

SEQ ID NO: 32971 - DNA, 27 bp, Artificial sequence
  SiRNA target sequence
aattttcttcggcttctcgtatcattt

SEQ ID NO: 32972 - DNA, 27 bp, Artificial sequence
  SiRNA target sequence
attttcttcggcttctcgtatcatttg

SEQ ID NO: 32973 - DNA, 27 bp, Artificial sequence
  SiRNA target sequence
ttttcttcggcttctcgtatcatttgc

SEQ ID NO: 32974 - DNA, 27 bp, Artificial sequence
  SiRNA target sequence
tttcttcggcttctcgtatcatttgcg

SEQ ID NO: 32975 - DNA, 27 bp, Artificial sequence
  SiRNA target sequence
ttcttcggcttctcgtatcatttgcga

SEQ ID NO: 32976 - DNA, 27 bp, Artificial sequence
  SiRNA target sequence
tcttcggcttctcgtatcatttgcgaa

SEQ ID NO: 32977 - DNA, 27 bp, Artificial sequence
  SiRNA target sequence
cttcggcttctcgtatcatttgcgaaa

SEQ ID NO: 32978 - DNA, 27 bp, Artificial sequence
  SiRNA target sequence
ttcggcttctcgtatcatttgcgaaat

SEQ ID NO: 32979 - DNA, 27 bp, Artificial sequence
  SiRNA target sequence
tcggcttctcgtatcatttgcgaaatt

SEQ ID NO: 32980 - DNA, 27 bp, Artificial sequence
  SiRNA target sequence
cggcttctcgtatcatttgcgaaattt

SEQ ID NO: 32981 - DNA, 27 bp, Artificial sequence
  SiRNA target sequence
ggcttctcgtatcatttgcgaaatttc

SEQ ID NO: 32982 - DNA, 27 bp, Artificial sequence
  SiRNA target sequence
gcttctcgtatcatttgcgaaatttca

SEQ ID NO: 32983 - DNA, 27 bp, Artificial sequence
  SiRNA target sequence
cttctcgtatcatttgcgaaatttcac

SEQ ID NO: 32984 - DNA, 27 bp, Artificial sequence
  SiRNA target sequence
ttctcgtatcatttgcgaaatttcacc

SEQ ID NO: 32985 - DNA, 27 bp, Artificial sequence
  SiRNA target sequence
tctcgtatcatttgcgaaatttcacct

SEQ ID NO: 32986 - DNA, 27 bp, Artificial sequence
  SiRNA target sequence
ctcgtatcatttgcgaaatttcacctt

SEQ ID NO: 32987 - DNA, 27 bp, Artificial sequence
  SiRNA target sequence
tcgtatcatttgcgaaatttcaccttc

SEQ ID NO: 32988 - DNA, 27 bp, Artificial sequence
  SiRNA target sequence
cgtatcatttgcgaaatttcaccttca

SEQ ID NO: 32989 - DNA, 27 bp, Artificial sequence
  SiRNA target sequence
gtatcatttgcgaaatttcaccttcat

SEQ ID NO: 32990 - DNA, 27 bp, Artificial sequence
  SiRNA target sequence
tatcatttgcgaaatttcaccttcatt

SEQ ID NO: 32991 - DNA, 27 bp, Artificial sequence
  SiRNA target sequence
atcatttgcgaaatttcaccttcattt

SEQ ID NO: 32992 - DNA, 27 bp, Artificial sequence
  SiRNA target sequence
tcatttgcgaaatttcaccttcattta

SEQ ID NO: 32993 - DNA, 27 bp, Artificial sequence
  SiRNA target sequence
catttgcgaaatttcaccttcatttaa

SEQ ID NO: 32994 - DNA, 27 bp, Artificial sequence
  SiRNA target sequence
atttgcgaaatttcaccttcatttaat

SEQ ID NO: 32995 - DNA, 27 bp, Artificial sequence
  SiRNA target sequence
tttgcgaaatttcaccttcatttaatc

SEQ ID NO: 32996 - DNA, 27 bp, Artificial sequence
  SiRNA target sequence
ttgcgaaatttcaccttcatttaatcc

SEQ ID NO: 32997 - DNA, 27 bp, Artificial sequence
  SiRNA target sequence
tgcgaaatttcaccttcatttaatcca

SEQ ID NO: 32998 - DNA, 27 bp, Artificial sequence
  SiRNA target sequence
gcgaaatttcaccttcatttaatccac

SEQ ID NO: 32999 - DNA, 27 bp, Artificial sequence
  SiRNA target sequence
cgaaatttcaccttcatttaatccact

SEQ ID NO: 33000 - DNA, 27 bp, Artificial sequence
  SiRNA target sequence
gaaatttcaccttcatttaatccactt

SEQ ID NO: 33001 - DNA, 27 bp, Artificial sequence
  SiRNA target sequence
aaatttcaccttcatttaatccacttg

SEQ ID NO: 33002 - DNA, 27 bp, Artificial sequence
  SiRNA target sequence
aatttcaccttcatttaatccacttga

SEQ ID NO: 33003 - DNA, 27 bp, Artificial sequence
  SiRNA target sequence
atttcaccttcatttaatccacttgaa

SEQ ID NO: 33004 - DNA, 27 bp, Artificial sequence
  SiRNA target sequence
tttcaccttcatttaatccacttgaag

SEQ ID NO: 33005 - DNA, 27 bp, Artificial sequence
  SiRNA target sequence
ttcaccttcatttaatccacttgaagg

SEQ ID NO: 33006 - DNA, 27 bp, Artificial sequence
  SiRNA target sequence
tcaccttcatttaatccacttgaaggc

SEQ ID NO: 33007 - DNA, 27 bp, Artificial sequence
  SiRNA target sequence
caccttcatttaatccacttgaaggca

SEQ ID NO: 33008 - DNA, 27 bp, Artificial sequence
  SiRNA target sequence
accttcatttaatccacttgaaggcac

SEQ ID NO: 33009 - DNA, 27 bp, Artificial sequence
  SiRNA target sequence
ccttcatttaatccacttgaaggcaca

SEQ ID NO: 33010 - DNA, 27 bp, Artificial sequence
  SiRNA target sequence
cttcatttaatccacttgaaggcacaa

SEQ ID NO: 33011 - DNA, 27 bp, Artificial sequence
  SiRNA target sequence
ttcatttaatccacttgaaggcacaat

SEQ ID NO: 33012 - DNA, 27 bp, Artificial sequence
  SiRNA target sequence
tcatttaatccacttgaaggcacaatt

SEQ ID NO: 33013 - DNA, 27 bp, Artificial sequence
  SiRNA target sequence
catttaatccacttgaaggcacaattt

SEQ ID NO: 33014 - DNA, 27 bp, Artificial sequence
  SiRNA target sequence
atttaatccacttgaaggcacaatttc

SEQ ID NO: 33015 - DNA, 27 bp, Artificial sequence
  SiRNA target sequence
tttaatccacttgaaggcacaatttcg

SEQ ID NO: 33016 - DNA, 27 bp, Artificial sequence
  SiRNA target sequence
ttaatccacttgaaggcacaatttcga

SEQ ID NO: 33017 - DNA, 27 bp, Artificial sequence
  SiRNA target sequence
taatccacttgaaggcacaatttcgat

SEQ ID NO: 33018 - DNA, 27 bp, Artificial sequence
  SiRNA target sequence
aatccacttgaaggcacaatttcgatt

SEQ ID NO: 33019 - DNA, 27 bp, Artificial sequence
  SiRNA target sequence
atccacttgaaggcacaatttcgattt

SEQ ID NO: 33020 - DNA, 27 bp, Artificial sequence
  SiRNA target sequence
tccacttgaaggcacaatttcgatttc

SEQ ID NO: 33021 - DNA, 27 bp, Artificial sequence
  SiRNA target sequence
ccacttgaaggcacaatttcgatttct

SEQ ID NO: 33022 - DNA, 27 bp, Artificial sequence
  SiRNA target sequence
cacttgaaggcacaatttcgatttctt

SEQ ID NO: 33023 - DNA, 27 bp, Artificial sequence
  SiRNA target sequence
acttgaaggcacaatttcgatttcttg

SEQ ID NO: 33024 - DNA, 27 bp, Artificial sequence
  SiRNA target sequence
cttgaaggcacaatttcgatttcttgc

SEQ ID NO: 33025 - DNA, 27 bp, Artificial sequence
  SiRNA target sequence
ttgaaggcacaatttcgatttcttgct

SEQ ID NO: 33026 - DNA, 27 bp, Artificial sequence
  SiRNA target sequence
tgaaggcacaatttcgatttcttgctt

SEQ ID NO: 33027 - DNA, 27 bp, Artificial sequence
  SiRNA target sequence
gaaggcacaatttcgatttcttgcttt

SEQ ID NO: 33028 - DNA, 27 bp, Artificial sequence
  SiRNA target sequence
aaggcacaatttcgatttcttgctttt

SEQ ID NO: 33029 - DNA, 27 bp, Artificial sequence
  SiRNA target sequence
aggcacaatttcgatttcttgcttttt

SEQ ID NO: 33030 - DNA, 27 bp, Artificial sequence
  SiRNA target sequence
ggcacaatttcgatttcttgctttttt

SEQ ID NO: 33031 - DNA, 27 bp, Artificial sequence
  SiRNA target sequence
gcacaatttcgatttcttgcttttttt

SEQ ID NO: 33032 - DNA, 27 bp, Artificial sequence
  SiRNA target sequence
cacaatttcgatttcttgctttttttt

SEQ ID NO: 33033 - DNA, 27 bp, Artificial sequence
  SiRNA target sequence
acaatttcgatttcttgcttttttttc

SEQ ID NO: 33034 - DNA, 27 bp, Artificial sequence
  SiRNA target sequence
caatttcgatttcttgcttttttttcg

SEQ ID NO: 33035 - DNA, 27 bp, Artificial sequence
  SiRNA target sequence
aatttcgatttcttgcttttttttcgt

SEQ ID NO: 33036 - DNA, 27 bp, Artificial sequence
  SiRNA target sequence
atttcgatttcttgcttttttttcgtt

SEQ ID NO: 33037 - DNA, 27 bp, Artificial sequence
  SiRNA target sequence
tttcgatttcttgcttttttttcgtta

SEQ ID NO: 33038 - DNA, 27 bp, Artificial sequence
  SiRNA target sequence
ttcgatttcttgcttttttttcgttat

SEQ ID NO: 33039 - DNA, 27 bp, Artificial sequence
  SiRNA target sequence
tcgatttcttgcttttttttcgttatc

SEQ ID NO: 33040 - DNA, 27 bp, Artificial sequence
  SiRNA target sequence
cgatttcttgcttttttttcgttatcc

SEQ ID NO: 33041 - DNA, 27 bp, Artificial sequence
  SiRNA target sequence
gatttcttgcttttttttcgttatccc

SEQ ID NO: 33042 - DNA, 27 bp, Artificial sequence
  SiRNA target sequence
atttcttgcttttttttcgttatcccg

SEQ ID NO: 33043 - DNA, 27 bp, Artificial sequence
  SiRNA target sequence
tttcttgcttttttttcgttatcccgt

SEQ ID NO: 33044 - DNA, 27 bp, Artificial sequence
  SiRNA target sequence
ttcttgcttttttttcgttatcccgtc

SEQ ID NO: 33045 - DNA, 27 bp, Artificial sequence
  SiRNA target sequence
tcttgcttttttttcgttatcccgtct

SEQ ID NO: 33046 - DNA, 27 bp, Artificial sequence
  SiRNA target sequence
cttgcttttttttcgttatcccgtctt

SEQ ID NO: 33047 - DNA, 27 bp, Artificial sequence
  SiRNA target sequence
ttgcttttttttcgttatcccgtcttg

SEQ ID NO: 33048 - DNA, 27 bp, Artificial sequence
  SiRNA target sequence
tgcttttttttcgttatcccgtcttgc

SEQ ID NO: 33049 - DNA, 27 bp, Artificial sequence
  SiRNA target sequence
gcttttttttcgttatcccgtcttgcg

SEQ ID NO: 33050 - DNA, 27 bp, Artificial sequence
  SiRNA target sequence
cttttttttcgttatcccgtcttgcgc

SEQ ID NO: 33051 - DNA, 27 bp, Artificial sequence
  SiRNA target sequence
ttttttttcgttatcccgtcttgcgca

SEQ ID NO: 33052 - DNA, 27 bp, Artificial sequence
  SiRNA target sequence
tttttttcgttatcccgtcttgcgcag

SEQ ID NO: 33053 - DNA, 27 bp, Artificial sequence
  SiRNA target sequence
ttttttcgttatcccgtcttgcgcaga

SEQ ID NO: 33054 - DNA, 27 bp, Artificial sequence
  SiRNA target sequence
tttttcgttatcccgtcttgcgcagat

SEQ ID NO: 33055 - DNA, 27 bp, Artificial sequence
  SiRNA target sequence
ttttcgttatcccgtcttgcgcagata

SEQ ID NO: 33056 - DNA, 27 bp, Artificial sequence
  SiRNA target sequence
tttcgttatcccgtcttgcgcagatac

SEQ ID NO: 33057 - DNA, 27 bp, Artificial sequence
  SiRNA target sequence
ttcgttatcccgtcttgcgcagatact

SEQ ID NO: 33058 - DNA, 27 bp, Artificial sequence
  SiRNA target sequence
tcgttatcccgtcttgcgcagatactt

SEQ ID NO: 33059 - DNA, 27 bp, Artificial sequence
  SiRNA target sequence
cgttatcccgtcttgcgcagatacttt

SEQ ID NO: 33060 - DNA, 27 bp, Artificial sequence
  SiRNA target sequence
gttatcccgtcttgcgcagatactttg

SEQ ID NO: 33061 - DNA, 27 bp, Artificial sequence
  SiRNA target sequence
ttatcccgtcttgcgcagatactttgt

SEQ ID NO: 33062 - DNA, 27 bp, Artificial sequence
  SiRNA target sequence
tatcccgtcttgcgcagatactttgta

SEQ ID NO: 33063 - DNA, 27 bp, Artificial sequence
  SiRNA target sequence
atcccgtcttgcgcagatactttgtat

SEQ ID NO: 33064 - DNA, 27 bp, Artificial sequence
  SiRNA target sequence
tcccgtcttgcgcagatactttgtata

SEQ ID NO: 33065 - DNA, 27 bp, Artificial sequence
  SiRNA target sequence
cccgtcttgcgcagatactttgtatat

SEQ ID NO: 33066 - DNA, 27 bp, Artificial sequence
  SiRNA target sequence
ccgtcttgcgcagatactttgtatatt

SEQ ID NO: 33067 - DNA, 27 bp, Artificial sequence
  SiRNA target sequence
cgtcttgcgcagatactttgtatattc

SEQ ID NO: 33068 - DNA, 27 bp, Artificial sequence
  SiRNA target sequence
gtcttgcgcagatactttgtatattcc

SEQ ID NO: 33069 - DNA, 27 bp, Artificial sequence
  SiRNA target sequence
tcttgcgcagatactttgtatattccg

SEQ ID NO: 33070 - DNA, 27 bp, Artificial sequence
  SiRNA target sequence
cttgcgcagatactttgtatattccgt

SEQ ID NO: 33071 - DNA, 27 bp, Artificial sequence
  SiRNA target sequence
ttgcgcagatactttgtatattccgtt

SEQ ID NO: 33072 - DNA, 27 bp, Artificial sequence
  SiRNA target sequence
tgcgcagatactttgtatattccgtta

SEQ ID NO: 33073 - DNA, 27 bp, Artificial sequence
  SiRNA target sequence
gcgcagatactttgtatattccgttag

SEQ ID NO: 33074 - DNA, 27 bp, Artificial sequence
  SiRNA target sequence
cgcagatactttgtatattccgttagc

SEQ ID NO: 33075 - DNA, 27 bp, Artificial sequence
  SiRNA target sequence
gcagatactttgtatattccgttagca

SEQ ID NO: 33076 - DNA, 27 bp, Artificial sequence
  SiRNA target sequence
cagatactttgtatattccgttagcat

SEQ ID NO: 33077 - DNA, 27 bp, Artificial sequence
  SiRNA target sequence
agatactttgtatattccgttagcatc

SEQ ID NO: 33078 - DNA, 27 bp, Artificial sequence
  SiRNA target sequence
gatactttgtatattccgttagcatcg

SEQ ID NO: 33079 - DNA, 27 bp, Artificial sequence
  SiRNA target sequence
atactttgtatattccgttagcatcgg

SEQ ID NO: 33080 - DNA, 27 bp, Artificial sequence
  SiRNA target sequence
tactttgtatattccgttagcatcggc

SEQ ID NO: 33081 - DNA, 27 bp, Artificial sequence
  SiRNA target sequence
actttgtatattccgttagcatcggct

SEQ ID NO: 33082 - DNA, 27 bp, Artificial sequence
  SiRNA target sequence
ctttgtatattccgttagcatcggctt

SEQ ID NO: 33083 - DNA, 27 bp, Artificial sequence
  SiRNA target sequence
tttgtatattccgttagcatcggcttc

SEQ ID NO: 33084 - DNA, 27 bp, Artificial sequence
  SiRNA target sequence
ttgtatattccgttagcatcggcttca

SEQ ID NO: 33085 - DNA, 27 bp, Artificial sequence
  SiRNA target sequence
tgtatattccgttagcatcggcttcaa

SEQ ID NO: 33086 - DNA, 27 bp, Artificial sequence
  SiRNA target sequence
gtatattccgttagcatcggcttcaaa

SEQ ID NO: 33087 - DNA, 27 bp, Artificial sequence
  SiRNA target sequence
tatattccgttagcatcggcttcaaat

SEQ ID NO: 33088 - DNA, 27 bp, Artificial sequence
  SiRNA target sequence
atattccgttagcatcggcttcaaatg

SEQ ID NO: 33089 - DNA, 27 bp, Artificial sequence
  SiRNA target sequence
tattccgttagcatcggcttcaaatgt

SEQ ID NO: 33090 - DNA, 27 bp, Artificial sequence
  SiRNA target sequence
attccgttagcatcggcttcaaatgta

SEQ ID NO: 33091 - DNA, 27 bp, Artificial sequence
  SiRNA target sequence
ttccgttagcatcggcttcaaatgtaa

SEQ ID NO: 33092 - DNA, 27 bp, Artificial sequence
  SiRNA target sequence
tccgttagcatcggcttcaaatgtaac

SEQ ID NO: 33093 - DNA, 27 bp, Artificial sequence
  SiRNA target sequence
ccgttagcatcggcttcaaatgtaaca

SEQ ID NO: 33094 - DNA, 27 bp, Artificial sequence
  SiRNA target sequence
cgttagcatcggcttcaaatgtaacat

SEQ ID NO: 33095 - DNA, 27 bp, Artificial sequence
  SiRNA target sequence
gttagcatcggcttcaaatgtaacatc

SEQ ID NO: 33096 - DNA, 27 bp, Artificial sequence
  SiRNA target sequence
ttagcatcggcttcaaatgtaacatct

SEQ ID NO: 33097 - DNA, 27 bp, Artificial sequence
  SiRNA target sequence
tagcatcggcttcaaatgtaacatcta

SEQ ID NO: 33098 - DNA, 27 bp, Artificial sequence
  SiRNA target sequence
agcatcggcttcaaatgtaacatctat

SEQ ID NO: 33099 - DNA, 27 bp, Artificial sequence
  SiRNA target sequence
gcatcggcttcaaatgtaacatctatc

SEQ ID NO: 33100 - DNA, 27 bp, Artificial sequence
  SiRNA target sequence
catcggcttcaaatgtaacatctatct

SEQ ID NO: 33101 - DNA, 27 bp, Artificial sequence
  SiRNA target sequence
atcggcttcaaatgtaacatctatctt

SEQ ID NO: 33102 - DNA, 27 bp, Artificial sequence
  SiRNA target sequence
tcggcttcaaatgtaacatctatcttt

SEQ ID NO: 33103 - DNA, 27 bp, Artificial sequence
  SiRNA target sequence
cggcttcaaatgtaacatctatctttg

SEQ ID NO: 33104 - DNA, 27 bp, Artificial sequence
  SiRNA target sequence
ggcttcaaatgtaacatctatctttgg

SEQ ID NO: 33105 - DNA, 27 bp, Artificial sequence
  SiRNA target sequence
gcttcaaatgtaacatctatctttgga

SEQ ID NO: 33106 - DNA, 27 bp, Artificial sequence
  SiRNA target sequence
cttcaaatgtaacatctatctttggaa

SEQ ID NO: 33107 - DNA, 27 bp, Artificial sequence
  SiRNA target sequence
ttcaaatgtaacatctatctttggaat

SEQ ID NO: 33108 - DNA, 27 bp, Artificial sequence
  SiRNA target sequence
tcaaatgtaacatctatctttggaata

SEQ ID NO: 33109 - DNA, 27 bp, Artificial sequence
  SiRNA target sequence
caaatgtaacatctatctttggaatac

SEQ ID NO: 33110 - DNA, 27 bp, Artificial sequence
  SiRNA target sequence
aaatgtaacatctatctttggaatacc

SEQ ID NO: 33111 - DNA, 27 bp, Artificial sequence
  SiRNA target sequence
aatgtaacatctatctttggaatacct

SEQ ID NO: 33112 - DNA, 27 bp, Artificial sequence
  SiRNA target sequence
atgtaacatctatctttggaatacctg

SEQ ID NO: 33113 - DNA, 27 bp, Artificial sequence
  SiRNA target sequence
tgtaacatctatctttggaatacctgc

SEQ ID NO: 33114 - DNA, 27 bp, Artificial sequence
  SiRNA target sequence
gtaacatctatctttggaatacctgca

SEQ ID NO: 33115 - DNA, 27 bp, Artificial sequence
  SiRNA target sequence
taacatctatctttggaatacctgcag

SEQ ID NO: 33116 - DNA, 27 bp, Artificial sequence
  SiRNA target sequence
aacatctatctttggaatacctgcagg

SEQ ID NO: 33117 - DNA, 27 bp, Artificial sequence
  SiRNA target sequence
acatctatctttggaatacctgcaggt

SEQ ID NO: 33118 - DNA, 27 bp, Artificial sequence
  SiRNA target sequence
catctatctttggaatacctgcaggtg

SEQ ID NO: 33119 - DNA, 27 bp, Artificial sequence
  SiRNA target sequence
atctatctttggaatacctgcaggtgc

SEQ ID NO: 33120 - DNA, 27 bp, Artificial sequence
  SiRNA target sequence
tctatctttggaatacctgcaggtgct

SEQ ID NO: 33121 - DNA, 27 bp, Artificial sequence
  SiRNA target sequence
ctatctttggaatacctgcaggtgctt

SEQ ID NO: 33122 - DNA, 27 bp, Artificial sequence
  SiRNA target sequence
tatctttggaatacctgcaggtgcttt

SEQ ID NO: 33123 - DNA, 27 bp, Artificial sequence
  SiRNA target sequence
atctttggaatacctgcaggtgcttta

SEQ ID NO: 33124 - DNA, 27 bp, Artificial sequence
  SiRNA target sequence
tctttggaatacctgcaggtgctttag

SEQ ID NO: 33125 - DNA, 27 bp, Artificial sequence
  SiRNA target sequence
ctttggaatacctgcaggtgctttagg

SEQ ID NO: 33126 - DNA, 27 bp, Artificial sequence
  SiRNA target sequence
tttggaatacctgcaggtgctttagga

SEQ ID NO: 33127 - DNA, 27 bp, Artificial sequence
  SiRNA target sequence
ttggaatacctgcaggtgctttaggaa

SEQ ID NO: 33128 - DNA, 27 bp, Artificial sequence
  SiRNA target sequence
tggaatacctgcaggtgctttaggaat

SEQ ID NO: 33129 - DNA, 27 bp, Artificial sequence
  SiRNA target sequence
ggaatacctgcaggtgctttaggaatg

SEQ ID NO: 33130 - DNA, 27 bp, Artificial sequence
  SiRNA target sequence
gaatacctgcaggtgctttaggaatgt

SEQ ID NO: 33131 - DNA, 27 bp, Artificial sequence
  SiRNA target sequence
aatacctgcaggtgctttaggaatgtt

SEQ ID NO: 33132 - DNA, 27 bp, Artificial sequence
  SiRNA target sequence
atacctgcaggtgctttaggaatgttt

SEQ ID NO: 33133 - DNA, 27 bp, Artificial sequence
  SiRNA target sequence
tacctgcaggtgctttaggaatgtttt

SEQ ID NO: 33134 - DNA, 27 bp, Artificial sequence
  SiRNA target sequence
acctgcaggtgctttaggaatgttttt

SEQ ID NO: 33135 - DNA, 27 bp, Artificial sequence
  SiRNA target sequence
cctgcaggtgctttaggaatgtttttg

SEQ ID NO: 33136 - DNA, 27 bp, Artificial sequence
  SiRNA target sequence
ctgcaggtgctttaggaatgtttttga

SEQ ID NO: 33137 - DNA, 27 bp, Artificial sequence
  SiRNA target sequence
tgcaggtgctttaggaatgtttttgag

SEQ ID NO: 33138 - DNA, 27 bp, Artificial sequence
  SiRNA target sequence
gcaggtgctttaggaatgtttttgagc

SEQ ID NO: 33139 - DNA, 27 bp, Artificial sequence
  SiRNA target sequence
caggtgctttaggaatgtttttgagct

SEQ ID NO: 33140 - DNA, 27 bp, Artificial sequence
  SiRNA target sequence
aggtgctttaggaatgtttttgagctt

SEQ ID NO: 33141 - DNA, 27 bp, Artificial sequence
  SiRNA target sequence
ggtgctttaggaatgtttttgagcttt

SEQ ID NO: 33142 - DNA, 27 bp, Artificial sequence
  SiRNA target sequence
gtgctttaggaatgtttttgagcttta

SEQ ID NO: 33143 - DNA, 27 bp, Artificial sequence
  SiRNA target sequence
tgctttaggaatgtttttgagctttat

SEQ ID NO: 33144 - DNA, 27 bp, Artificial sequence
  SiRNA target sequence
gctttaggaatgtttttgagctttata

SEQ ID NO: 33145 - DNA, 27 bp, Artificial sequence
  SiRNA target sequence
ctttaggaatgtttttgagctttatag

SEQ ID NO: 33146 - DNA, 27 bp, Artificial sequence
  SiRNA target sequence
tttaggaatgtttttgagctttatagc

SEQ ID NO: 33147 - DNA, 27 bp, Artificial sequence
  SiRNA target sequence
ttaggaatgtttttgagctttatagct

SEQ ID NO: 33148 - DNA, 27 bp, Artificial sequence
  SiRNA target sequence
taggaatgtttttgagctttatagctc

SEQ ID NO: 33149 - DNA, 27 bp, Artificial sequence
  SiRNA target sequence
aggaatgtttttgagctttatagctcc

SEQ ID NO: 33150 - DNA, 27 bp, Artificial sequence
  SiRNA target sequence
ggaatgtttttgagctttatagctcct

SEQ ID NO: 33151 - DNA, 27 bp, Artificial sequence
  SiRNA target sequence
gaatgtttttgagctttatagctccta

SEQ ID NO: 33152 - DNA, 27 bp, Artificial sequence
  SiRNA target sequence
aatgtttttgagctttatagctcctaa

SEQ ID NO: 33153 - DNA, 27 bp, Artificial sequence
  SiRNA target sequence
atgtttttgagctttatagctcctaaa

SEQ ID NO: 33154 - DNA, 27 bp, Artificial sequence
  SiRNA target sequence
tgtttttgagctttatagctcctaaat

SEQ ID NO: 33155 - DNA, 27 bp, Artificial sequence
  SiRNA target sequence
gtttttgagctttatagctcctaaata

SEQ ID NO: 33156 - DNA, 27 bp, Artificial sequence
  SiRNA target sequence
tttttgagctttatagctcctaaatat

SEQ ID NO: 33157 - DNA, 27 bp, Artificial sequence
  SiRNA target sequence
ttttgagctttatagctcctaaatatt

SEQ ID NO: 33158 - DNA, 27 bp, Artificial sequence
  SiRNA target sequence
tttgagctttatagctcctaaatattt

SEQ ID NO: 33159 - DNA, 27 bp, Artificial sequence
  SiRNA target sequence
ttgagctttatagctcctaaatattta

SEQ ID NO: 33160 - DNA, 27 bp, Artificial sequence
  SiRNA target sequence
tgagctttatagctcctaaatatttat

SEQ ID NO: 33161 - DNA, 27 bp, Artificial sequence
  SiRNA target sequence
gagctttatagctcctaaatatttatt

SEQ ID NO: 33162 - DNA, 27 bp, Artificial sequence
  SiRNA target sequence
agctttatagctcctaaatatttattg

SEQ ID NO: 33163 - DNA, 27 bp, Artificial sequence
  SiRNA target sequence
gctttatagctcctaaatatttattgt

SEQ ID NO: 33164 - DNA, 27 bp, Artificial sequence
  SiRNA target sequence
ctttatagctcctaaatatttattgtc

SEQ ID NO: 33165 - DNA, 27 bp, Artificial sequence
  SiRNA target sequence
tttatagctcctaaatatttattgtct

SEQ ID NO: 33166 - DNA, 27 bp, Artificial sequence
  SiRNA target sequence
ttatagctcctaaatatttattgtctt

SEQ ID NO: 33167 - DNA, 27 bp, Artificial sequence
  SiRNA target sequence
tatagctcctaaatatttattgtcttt

SEQ ID NO: 33168 - DNA, 27 bp, Artificial sequence
  SiRNA target sequence
atagctcctaaatatttattgtctttt

SEQ ID NO: 33169 - DNA, 27 bp, Artificial sequence
  SiRNA target sequence
tagctcctaaatatttattgtctttta

SEQ ID NO: 33170 - DNA, 27 bp, Artificial sequence
  SiRNA target sequence
agctcctaaatatttattgtcttttac

SEQ ID NO: 33171 - DNA, 27 bp, Artificial sequence
  SiRNA target sequence
gctcctaaatatttattgtcttttacc

SEQ ID NO: 33172 - DNA, 27 bp, Artificial sequence
  SiRNA target sequence
ctcctaaatatttattgtcttttacca

SEQ ID NO: 33173 - DNA, 27 bp, Artificial sequence
  SiRNA target sequence
tcctaaatatttattgtcttttaccat

SEQ ID NO: 33174 - DNA, 27 bp, Artificial sequence
  SiRNA target sequence
cctaaatatttattgtcttttaccatc

SEQ ID NO: 33175 - DNA, 27 bp, Artificial sequence
  SiRNA target sequence
ctaaatatttattgtcttttaccatct

SEQ ID NO: 33176 - DNA, 27 bp, Artificial sequence
  SiRNA target sequence
taaatatttattgtcttttaccatctt

SEQ ID NO: 33177 - DNA, 27 bp, Artificial sequence
  SiRNA target sequence
aaatatttattgtcttttaccatcttt

SEQ ID NO: 33178 - DNA, 27 bp, Artificial sequence
  SiRNA target sequence
aatatttattgtcttttaccatctttc

SEQ ID NO: 33179 - DNA, 27 bp, Artificial sequence
  SiRNA target sequence
atatttattgtcttttaccatctttct

SEQ ID NO: 33180 - DNA, 27 bp, Artificial sequence
  SiRNA target sequence
tatttattgtcttttaccatctttctt

SEQ ID NO: 33181 - DNA, 27 bp, Artificial sequence
  SiRNA target sequence
atttattgtcttttaccatctttcttt

SEQ ID NO: 33182 - DNA, 27 bp, Artificial sequence
  SiRNA target sequence
tttattgtcttttaccatctttctttc

SEQ ID NO: 33183 - DNA, 27 bp, Artificial sequence
  SiRNA target sequence
ttattgtcttttaccatctttctttct

SEQ ID NO: 33184 - DNA, 27 bp, Artificial sequence
  SiRNA target sequence
tattgtcttttaccatctttctttctc

SEQ ID NO: 33185 - DNA, 27 bp, Artificial sequence
  SiRNA target sequence
attgtcttttaccatctttctttctcc

SEQ ID NO: 33186 - DNA, 27 bp, Artificial sequence
  SiRNA target sequence
ttgtcttttaccatctttctttctcct

SEQ ID NO: 33187 - DNA, 27 bp, Artificial sequence
  SiRNA target sequence
tgtcttttaccatctttctttctcctt

SEQ ID NO: 33188 - DNA, 27 bp, Artificial sequence
  SiRNA target sequence
gtcttttaccatctttctttctccttg

SEQ ID NO: 33189 - DNA, 27 bp, Artificial sequence
  SiRNA target sequence
tcttttaccatctttctttctccttga

SEQ ID NO: 33190 - DNA, 27 bp, Artificial sequence
  SiRNA target sequence
cttttaccatctttctttctccttgat

SEQ ID NO: 33191 - DNA, 27 bp, Artificial sequence
  SiRNA target sequence
ttttaccatctttctttctccttgata

SEQ ID NO: 33192 - DNA, 27 bp, Artificial sequence
  SiRNA target sequence
tttaccatctttctttctccttgatat

SEQ ID NO: 33193 - DNA, 27 bp, Artificial sequence
  SiRNA target sequence
ttaccatctttctttctccttgatata

SEQ ID NO: 33194 - DNA, 27 bp, Artificial sequence
  SiRNA target sequence
taccatctttctttctccttgatatat

SEQ ID NO: 33195 - DNA, 27 bp, Artificial sequence
  SiRNA target sequence
accatctttctttctccttgatatatt

SEQ ID NO: 33196 - DNA, 27 bp, Artificial sequence
  SiRNA target sequence
ccatctttctttctccttgatatattc

SEQ ID NO: 33197 - DNA, 27 bp, Artificial sequence
  SiRNA target sequence
catctttctttctccttgatatattct

SEQ ID NO: 33198 - DNA, 27 bp, Artificial sequence
  SiRNA target sequence
atctttctttctccttgatatattcta

SEQ ID NO: 33199 - DNA, 27 bp, Artificial sequence
  SiRNA target sequence
tctttctttctccttgatatattctaa

SEQ ID NO: 33200 - DNA, 27 bp, Artificial sequence
  SiRNA target sequence
ctttctttctccttgatatattctaat

SEQ ID NO: 33201 - DNA, 27 bp, Artificial sequence
  SiRNA target sequence
tttctttctccttgatatattctaata

SEQ ID NO: 33202 - DNA, 27 bp, Artificial sequence
  SiRNA target sequence
ttctttctccttgatatattctaatat

SEQ ID NO: 33203 - DNA, 27 bp, Artificial sequence
  SiRNA target sequence
tctttctccttgatatattctaatatc

SEQ ID NO: 33204 - DNA, 27 bp, Artificial sequence
  SiRNA target sequence
ctttctccttgatatattctaatatct

SEQ ID NO: 33205 - DNA, 27 bp, Artificial sequence
  SiRNA target sequence
tttctccttgatatattctaatatcta

SEQ ID NO: 33206 - DNA, 27 bp, Artificial sequence
  SiRNA target sequence
ttctccttgatatattctaatatctac

SEQ ID NO: 33207 - DNA, 27 bp, Artificial sequence
  SiRNA target sequence
tctccttgatatattctaatatctact

SEQ ID NO: 33208 - DNA, 27 bp, Artificial sequence
  SiRNA target sequence
ctccttgatatattctaatatctactt

SEQ ID NO: 33209 - DNA, 27 bp, Artificial sequence
  SiRNA target sequence
tccttgatatattctaatatctacttc

SEQ ID NO: 33210 - DNA, 27 bp, Artificial sequence
  SiRNA target sequence
ccttgatatattctaatatctacttcg

SEQ ID NO: 33211 - DNA, 27 bp, Artificial sequence
  SiRNA target sequence
cttgatatattctaatatctacttcgg

SEQ ID NO: 33212 - DNA, 27 bp, Artificial sequence
  SiRNA target sequence
ttgatatattctaatatctacttcgga

SEQ ID NO: 33213 - DNA, 27 bp, Artificial sequence
  SiRNA target sequence
tgatatattctaatatctacttcggat

SEQ ID NO: 33214 - DNA, 27 bp, Artificial sequence
  SiRNA target sequence
gatatattctaatatctacttcggatt

SEQ ID NO: 33215 - DNA, 27 bp, Artificial sequence
  SiRNA target sequence
atatattctaatatctacttcggattg

SEQ ID NO: 33216 - DNA, 27 bp, Artificial sequence
  SiRNA target sequence
tatattctaatatctacttcggattga

SEQ ID NO: 33217 - DNA, 27 bp, Artificial sequence
  SiRNA target sequence
atattctaatatctacttcggattgat

SEQ ID NO: 33218 - DNA, 27 bp, Artificial sequence
  SiRNA target sequence
tattctaatatctacttcggattgatt

SEQ ID NO: 33219 - DNA, 27 bp, Artificial sequence
  SiRNA target sequence
attctaatatctacttcggattgatta

SEQ ID NO: 33220 - DNA, 27 bp, Artificial sequence
  SiRNA target sequence
ttctaatatctacttcggattgattat

SEQ ID NO: 33221 - DNA, 27 bp, Artificial sequence
  SiRNA target sequence
tctaatatctacttcggattgattatc

SEQ ID NO: 33222 - DNA, 27 bp, Artificial sequence
  SiRNA target sequence
ctaatatctacttcggattgattatct

SEQ ID NO: 33223 - DNA, 27 bp, Artificial sequence
  SiRNA target sequence
taatatctacttcggattgattatctt

SEQ ID NO: 33224 - DNA, 27 bp, Artificial sequence
  SiRNA target sequence
aatatctacttcggattgattatcttc

SEQ ID NO: 33225 - DNA, 27 bp, Artificial sequence
  SiRNA target sequence
atatctacttcggattgattatcttca

SEQ ID NO: 33226 - DNA, 27 bp, Artificial sequence
  SiRNA target sequence
tatctacttcggattgattatcttcag

SEQ ID NO: 33227 - DNA, 27 bp, Artificial sequence
  SiRNA target sequence
atctacttcggattgattatcttcaga

SEQ ID NO: 33228 - DNA, 27 bp, Artificial sequence
  SiRNA target sequence
tctacttcggattgattatcttcagag

SEQ ID NO: 33229 - DNA, 27 bp, Artificial sequence
  SiRNA target sequence
ctacttcggattgattatcttcagagg

SEQ ID NO: 33230 - DNA, 27 bp, Artificial sequence
  SiRNA target sequence
tacttcggattgattatcttcagaggt

SEQ ID NO: 33231 - DNA, 27 bp, Artificial sequence
  SiRNA target sequence
acttcggattgattatcttcagaggta

SEQ ID NO: 33232 - DNA, 27 bp, Artificial sequence
  SiRNA target sequence
cttcggattgattatcttcagaggtag

SEQ ID NO: 33233 - DNA, 27 bp, Artificial sequence
  SiRNA target sequence
ttcggattgattatcttcagaggtaga

SEQ ID NO: 33234 - DNA, 27 bp, Artificial sequence
  SiRNA target sequence
tcggattgattatcttcagaggtagaa

SEQ ID NO: 33235 - DNA, 27 bp, Artificial sequence
  SiRNA target sequence
cggattgattatcttcagaggtagaaa

SEQ ID NO: 33236 - DNA, 27 bp, Artificial sequence
  SiRNA target sequence
ggattgattatcttcagaggtagaaaa

SEQ ID NO: 33237 - DNA, 27 bp, Artificial sequence
  SiRNA target sequence
gattgattatcttcagaggtagaaaaa

SEQ ID NO: 33238 - DNA, 27 bp, Artificial sequence
  SiRNA target sequence
attgattatcttcagaggtagaaaaac

SEQ ID NO: 33239 - DNA, 27 bp, Artificial sequence
  SiRNA target sequence
ttgattatcttcagaggtagaaaaact

SEQ ID NO: 33240 - DNA, 27 bp, Artificial sequence
  SiRNA target sequence
tgattatcttcagaggtagaaaaactg

SEQ ID NO: 33241 - DNA, 27 bp, Artificial sequence
  SiRNA target sequence
gattatcttcagaggtagaaaaactgt

SEQ ID NO: 33242 - DNA, 27 bp, Artificial sequence
  SiRNA target sequence
attatcttcagaggtagaaaaactgtg

SEQ ID NO: 33243 - DNA, 27 bp, Artificial sequence
  SiRNA target sequence
ttatcttcagaggtagaaaaactgtgt

SEQ ID NO: 33244 - DNA, 27 bp, Artificial sequence
  SiRNA target sequence
tatcttcagaggtagaaaaactgtgtg

SEQ ID NO: 33245 - DNA, 27 bp, Artificial sequence
  SiRNA target sequence
atcttcagaggtagaaaaactgtgtgt

SEQ ID NO: 33246 - DNA, 27 bp, Artificial sequence
  SiRNA target sequence
tcttcagaggtagaaaaactgtgtgtt

SEQ ID NO: 33247 - DNA, 27 bp, Artificial sequence
  SiRNA target sequence
cttcagaggtagaaaaactgtgtgttt

SEQ ID NO: 33248 - DNA, 27 bp, Artificial sequence
  SiRNA target sequence
ttcagaggtagaaaaactgtgtgtttc

SEQ ID NO: 33249 - DNA, 27 bp, Artificial sequence
  SiRNA target sequence
tcagaggtagaaaaactgtgtgtttcc

SEQ ID NO: 33250 - DNA, 27 bp, Artificial sequence
  SiRNA target sequence
cagaggtagaaaaactgtgtgtttcct

SEQ ID NO: 33251 - DNA, 27 bp, Artificial sequence
  SiRNA target sequence
agaggtagaaaaactgtgtgtttcctt

SEQ ID NO: 33252 - DNA, 27 bp, Artificial sequence
  SiRNA target sequence
gaggtagaaaaactgtgtgtttcctta

SEQ ID NO: 33253 - DNA, 27 bp, Artificial sequence
  SiRNA target sequence
aggtagaaaaactgtgtgtttccttaa

SEQ ID NO: 33254 - DNA, 27 bp, Artificial sequence
  SiRNA target sequence
ggtagaaaaactgtgtgtttccttaaa

SEQ ID NO: 33255 - DNA, 27 bp, Artificial sequence
  SiRNA target sequence
gtagaaaaactgtgtgtttccttaaat

SEQ ID NO: 33256 - DNA, 27 bp, Artificial sequence
  SiRNA target sequence
tagaaaaactgtgtgtttccttaaatg

SEQ ID NO: 33257 - DNA, 27 bp, Artificial sequence
  SiRNA target sequence
agaaaaactgtgtgtttccttaaatgg

SEQ ID NO: 33258 - DNA, 27 bp, Artificial sequence
  SiRNA target sequence
gaaaaactgtgtgtttccttaaatgga

SEQ ID NO: 33259 - DNA, 27 bp, Artificial sequence
  SiRNA target sequence
aaaaactgtgtgtttccttaaatggaa

SEQ ID NO: 33260 - DNA, 27 bp, Artificial sequence
  SiRNA target sequence
aaaactgtgtgtttccttaaatggaat

SEQ ID NO: 33261 - DNA, 27 bp, Artificial sequence
  SiRNA target sequence
aaactgtgtgtttccttaaatggaata

SEQ ID NO: 33262 - DNA, 27 bp, Artificial sequence
  SiRNA target sequence
aactgtgtgtttccttaaatggaatag

SEQ ID NO: 33263 - DNA, 27 bp, Artificial sequence
  SiRNA target sequence
actgtgtgtttccttaaatggaatagt

SEQ ID NO: 33264 - DNA, 27 bp, Artificial sequence
  SiRNA target sequence
ctgtgtgtttccttaaatggaatagta

SEQ ID NO: 33265 - DNA, 27 bp, Artificial sequence
  SiRNA target sequence
tgtgtgtttccttaaatggaatagtag

SEQ ID NO: 33266 - DNA, 27 bp, Artificial sequence
  SiRNA target sequence
gtgtgtttccttaaatggaatagtaga

SEQ ID NO: 33267 - DNA, 27 bp, Artificial sequence
  SiRNA target sequence
tgtgtttccttaaatggaatagtagaa

SEQ ID NO: 33268 - DNA, 27 bp, Artificial sequence
  SiRNA target sequence
gtgtttccttaaatggaatagtagaat

SEQ ID NO: 33269 - DNA, 27 bp, Artificial sequence
  SiRNA target sequence
tgtttccttaaatggaatagtagaatt

SEQ ID NO: 33270 - DNA, 27 bp, Artificial sequence
  SiRNA target sequence
gtttccttaaatggaatagtagaattt

SEQ ID NO: 33271 - DNA, 27 bp, Artificial sequence
  SiRNA target sequence
tttccttaaatggaatagtagaatttc

SEQ ID NO: 33272 - DNA, 27 bp, Artificial sequence
  SiRNA target sequence
ttccttaaatggaatagtagaatttct

SEQ ID NO: 33273 - DNA, 27 bp, Artificial sequence
  SiRNA target sequence
tccttaaatggaatagtagaatttcta

SEQ ID NO: 33274 - DNA, 27 bp, Artificial sequence
  SiRNA target sequence
ccttaaatggaatagtagaatttctat

SEQ ID NO: 33275 - DNA, 27 bp, Artificial sequence
  SiRNA target sequence
cttaaatggaatagtagaatttctatg

SEQ ID NO: 33276 - DNA, 27 bp, Artificial sequence
  SiRNA target sequence
ttaaatggaatagtagaatttctatga

SEQ ID NO: 33277 - DNA, 27 bp, Artificial sequence
  SiRNA target sequence
taaatggaatagtagaatttctatgaa

SEQ ID NO: 33278 - DNA, 27 bp, Artificial sequence
  SiRNA target sequence
aaatggaatagtagaatttctatgaat

SEQ ID NO: 33279 - DNA, 27 bp, Artificial sequence
  SiRNA target sequence
aatggaatagtagaatttctatgaatt

SEQ ID NO: 33280 - DNA, 27 bp, Artificial sequence
  SiRNA target sequence
atggaatagtagaatttctatgaatta

SEQ ID NO: 33281 - DNA, 27 bp, Artificial sequence
  SiRNA target sequence
tggaatagtagaatttctatgaattat

SEQ ID NO: 33282 - DNA, 27 bp, Artificial sequence
  SiRNA target sequence
ggaatagtagaatttctatgaattatc

SEQ ID NO: 33283 - DNA, 27 bp, Artificial sequence
  SiRNA target sequence
gaatagtagaatttctatgaattatct

SEQ ID NO: 33284 - DNA, 27 bp, Artificial sequence
  SiRNA target sequence
aatagtagaatttctatgaattatctt

SEQ ID NO: 33285 - DNA, 27 bp, Artificial sequence
  SiRNA target sequence
atagtagaatttctatgaattatctta

SEQ ID NO: 33286 - DNA, 27 bp, Artificial sequence
  SiRNA target sequence
tagtagaatttctatgaattatcttat

SEQ ID NO: 33287 - DNA, 27 bp, Artificial sequence
  SiRNA target sequence
agtagaatttctatgaattatcttatt

SEQ ID NO: 33288 - DNA, 27 bp, Artificial sequence
  SiRNA target sequence
gtagaatttctatgaattatcttatta

SEQ ID NO: 33289 - DNA, 27 bp, Artificial sequence
  SiRNA target sequence
tagaatttctatgaattatcttattaa

SEQ ID NO: 33290 - DNA, 27 bp, Artificial sequence
  SiRNA target sequence
agaatttctatgaattatcttattaaa

SEQ ID NO: 33291 - DNA, 27 bp, Artificial sequence
  SiRNA target sequence
gaatttctatgaattatcttattaaaa

SEQ ID NO: 33292 - DNA, 27 bp, Artificial sequence
  SiRNA target sequence
aatttctatgaattatcttattaaaaa

SEQ ID NO: 33293 - DNA, 27 bp, Artificial sequence
  SiRNA target sequence
atttctatgaattatcttattaaaaat

SEQ ID NO: 33294 - DNA, 27 bp, Artificial sequence
  SiRNA target sequence
tttctatgaattatcttattaaaaatc

SEQ ID NO: 33295 - DNA, 27 bp, Artificial sequence
  SiRNA target sequence
ttctatgaattatcttattaaaaatcc

SEQ ID NO: 33296 - DNA, 27 bp, Artificial sequence
  SiRNA target sequence
tctatgaattatcttattaaaaatccc

SEQ ID NO: 33297 - DNA, 27 bp, Artificial sequence
  SiRNA target sequence
ctatgaattatcttattaaaaatcccg

SEQ ID NO: 33298 - DNA, 27 bp, Artificial sequence
  SiRNA target sequence
tatgaattatcttattaaaaatcccgc

SEQ ID NO: 33299 - DNA, 27 bp, Artificial sequence
  SiRNA target sequence
atgaattatcttattaaaaatcccgcc

SEQ ID NO: 33300 - DNA, 27 bp, Artificial sequence
  SiRNA target sequence
tgaattatcttattaaaaatcccgccc

SEQ ID NO: 33301 - DNA, 27 bp, Artificial sequence
  SiRNA target sequence
gaattatcttattaaaaatcccgccca

SEQ ID NO: 33302 - DNA, 27 bp, Artificial sequence
  SiRNA target sequence
aattatcttattaaaaatcccgcccaa

SEQ ID NO: 33303 - DNA, 27 bp, Artificial sequence
  SiRNA target sequence
attatcttattaaaaatcccgcccaaa

SEQ ID NO: 33304 - DNA, 27 bp, Artificial sequence
  SiRNA target sequence
ttatcttattaaaaatcccgcccaaaa

SEQ ID NO: 33305 - DNA, 27 bp, Artificial sequence
  SiRNA target sequence
tatcttattaaaaatcccgcccaaaag

SEQ ID NO: 33306 - DNA, 27 bp, Artificial sequence
  SiRNA target sequence
atcttattaaaaatcccgcccaaaagc

SEQ ID NO: 33307 - DNA, 27 bp, Artificial sequence
  SiRNA target sequence
tcttattaaaaatcccgcccaaaagct

SEQ ID NO: 33308 - DNA, 27 bp, Artificial sequence
  SiRNA target sequence
cttattaaaaatcccgcccaaaagctc

SEQ ID NO: 33309 - DNA, 27 bp, Artificial sequence
  SiRNA target sequence
ttattaaaaatcccgcccaaaagctct

SEQ ID NO: 33310 - DNA, 27 bp, Artificial sequence
  SiRNA target sequence
tattaaaaatcccgcccaaaagctcta

SEQ ID NO: 33311 - DNA, 27 bp, Artificial sequence
  SiRNA target sequence
attaaaaatcccgcccaaaagctctat

SEQ ID NO: 33312 - DNA, 27 bp, Artificial sequence
  SiRNA target sequence
ttaaaaatcccgcccaaaagctctata

SEQ ID NO: 33313 - DNA, 27 bp, Artificial sequence
  SiRNA target sequence
taaaaatcccgcccaaaagctctatac

SEQ ID NO: 33314 - DNA, 27 bp, Artificial sequence
  SiRNA target sequence
aaaaatcccgcccaaaagctctatacc

SEQ ID NO: 33315 - DNA, 27 bp, Artificial sequence
  SiRNA target sequence
aaaatcccgcccaaaagctctatacct

SEQ ID NO: 33316 - DNA, 27 bp, Artificial sequence
  SiRNA target sequence
aaatcccgcccaaaagctctataccta

SEQ ID NO: 33317 - DNA, 27 bp, Artificial sequence
  SiRNA target sequence
aatcccgcccaaaagctctatacctaa

SEQ ID NO: 33318 - DNA, 27 bp, Artificial sequence
  SiRNA target sequence
atcccgcccaaaagctctatacctaaa

SEQ ID NO: 33319 - DNA, 27 bp, Artificial sequence
  SiRNA target sequence
tcccgcccaaaagctctatacctaaac

SEQ ID NO: 33320 - DNA, 27 bp, Artificial sequence
  SiRNA target sequence
cccgcccaaaagctctatacctaaact

SEQ ID NO: 33321 - DNA, 27 bp, Artificial sequence
  SiRNA target sequence
ccgcccaaaagctctatacctaaactc

SEQ ID NO: 33322 - DNA, 27 bp, Artificial sequence
  SiRNA target sequence
cgcccaaaagctctatacctaaactca

SEQ ID NO: 33323 - DNA, 27 bp, Artificial sequence
  SiRNA target sequence
gcccaaaagctctatacctaaactcaa

SEQ ID NO: 33324 - DNA, 27 bp, Artificial sequence
  SiRNA target sequence
cccaaaagctctatacctaaactcaat

SEQ ID NO: 33325 - DNA, 27 bp, Artificial sequence
  SiRNA target sequence
ccaaaagctctatacctaaactcaatg

SEQ ID NO: 33326 - DNA, 27 bp, Artificial sequence
  SiRNA target sequence
caaaagctctatacctaaactcaatgg

SEQ ID NO: 33327 - DNA, 27 bp, Artificial sequence
  SiRNA target sequence
aaaagctctatacctaaactcaatggt

SEQ ID NO: 33328 - DNA, 27 bp, Artificial sequence
  SiRNA target sequence
aaagctctatacctaaactcaatggta

SEQ ID NO: 33329 - DNA, 27 bp, Artificial sequence
  SiRNA target sequence
aagctctatacctaaactcaatggtac

SEQ ID NO: 33330 - DNA, 27 bp, Artificial sequence
  SiRNA target sequence
agctctatacctaaactcaatggtact

SEQ ID NO: 33331 - DNA, 27 bp, Artificial sequence
  SiRNA target sequence
gctctatacctaaactcaatggtacta

SEQ ID NO: 33332 - DNA, 27 bp, Artificial sequence
  SiRNA target sequence
ctctatacctaaactcaatggtactac

SEQ ID NO: 33333 - DNA, 27 bp, Artificial sequence
  SiRNA target sequence
tctatacctaaactcaatggtactaca

SEQ ID NO: 33334 - DNA, 27 bp, Artificial sequence
  SiRNA target sequence
ctatacctaaactcaatggtactacat

SEQ ID NO: 33335 - DNA, 27 bp, Artificial sequence
  SiRNA target sequence
tatacctaaactcaatggtactacatc

SEQ ID NO: 33336 - DNA, 27 bp, Artificial sequence
  SiRNA target sequence
atacctaaactcaatggtactacatcc

SEQ ID NO: 33337 - DNA, 27 bp, Artificial sequence
  SiRNA target sequence
tacctaaactcaatggtactacatcca

SEQ ID NO: 33338 - DNA, 27 bp, Artificial sequence
  SiRNA target sequence
acctaaactcaatggtactacatccaa

SEQ ID NO: 33339 - DNA, 27 bp, Artificial sequence
  SiRNA target sequence
cctaaactcaatggtactacatccaat

SEQ ID NO: 33340 - DNA, 27 bp, Artificial sequence
  SiRNA target sequence
ctaaactcaatggtactacatccaata

SEQ ID NO: 33341 - DNA, 27 bp, Artificial sequence
  SiRNA target sequence
taaactcaatggtactacatccaataa

SEQ ID NO: 33342 - DNA, 27 bp, Artificial sequence
  SiRNA target sequence
aaactcaatggtactacatccaataat

SEQ ID NO: 33343 - DNA, 27 bp, Artificial sequence
  SiRNA target sequence
aactcaatggtactacatccaataata

SEQ ID NO: 33344 - DNA, 27 bp, Artificial sequence
  SiRNA target sequence
actcaatggtactacatccaataatag

SEQ ID NO: 33345 - DNA, 27 bp, Artificial sequence
  SiRNA target sequence
ctcaatggtactacatccaataatagg

SEQ ID NO: 33346 - DNA, 27 bp, Artificial sequence
  SiRNA target sequence
tcaatggtactacatccaataatagga

SEQ ID NO: 33347 - DNA, 27 bp, Artificial sequence
  SiRNA target sequence
caatggtactacatccaataataggac

SEQ ID NO: 33348 - DNA, 27 bp, Artificial sequence
  SiRNA target sequence
aatggtactacatccaataataggaca

SEQ ID NO: 33349 - DNA, 27 bp, Artificial sequence
  SiRNA target sequence
atggtactacatccaataataggacat

SEQ ID NO: 33350 - DNA, 27 bp, Artificial sequence
  SiRNA target sequence
tggtactacatccaataataggacatc

SEQ ID NO: 33351 - DNA, 27 bp, Artificial sequence
  SiRNA target sequence
ggtactacatccaataataggacatct

SEQ ID NO: 33352 - DNA, 27 bp, Artificial sequence
  SiRNA target sequence
gtactacatccaataataggacatctt

SEQ ID NO: 33353 - DNA, 27 bp, Artificial sequence
  SiRNA target sequence
tactacatccaataataggacatcttt

SEQ ID NO: 33354 - DNA, 27 bp, Artificial sequence
  SiRNA target sequence
actacatccaataataggacatctttt

SEQ ID NO: 33355 - DNA, 27 bp, Artificial sequence
  SiRNA target sequence
ctacatccaataataggacatctttta

SEQ ID NO: 33356 - DNA, 27 bp, Artificial sequence
  SiRNA target sequence
tacatccaataataggacatcttttat

SEQ ID NO: 33357 - DNA, 27 bp, Artificial sequence
  SiRNA target sequence
acatccaataataggacatcttttatt

SEQ ID NO: 33358 - DNA, 27 bp, Artificial sequence
  SiRNA target sequence
catccaataataggacatcttttattt

SEQ ID NO: 33359 - DNA, 27 bp, Artificial sequence
  SiRNA target sequence
atccaataataggacatcttttatttt

SEQ ID NO: 33360 - DNA, 27 bp, Artificial sequence
  SiRNA target sequence
tccaataataggacatcttttattttt

SEQ ID NO: 33361 - DNA, 27 bp, Artificial sequence
  SiRNA target sequence
ccaataataggacatcttttatttttc

SEQ ID NO: 33362 - DNA, 27 bp, Artificial sequence
  SiRNA target sequence
caataataggacatcttttatttttcc

SEQ ID NO: 33363 - DNA, 27 bp, Artificial sequence
  SiRNA target sequence
aataataggacatcttttatttttcct

SEQ ID NO: 33364 - DNA, 27 bp, Artificial sequence
  SiRNA target sequence
ataataggacatcttttatttttcctt

SEQ ID NO: 33365 - DNA, 27 bp, Artificial sequence
  SiRNA target sequence
taataggacatcttttatttttccttc

SEQ ID NO: 33366 - DNA, 27 bp, Artificial sequence
  SiRNA target sequence
aataggacatcttttatttttccttct

SEQ ID NO: 33367 - DNA, 27 bp, Artificial sequence
  SiRNA target sequence
ataggacatcttttatttttccttcta

SEQ ID NO: 33368 - DNA, 27 bp, Artificial sequence
  SiRNA target sequence
taggacatcttttatttttccttctaa

SEQ ID NO: 33369 - DNA, 27 bp, Artificial sequence
  SiRNA target sequence
aggacatcttttatttttccttctaac

SEQ ID NO: 33370 - DNA, 27 bp, Artificial sequence
  SiRNA target sequence
ggacatcttttatttttccttctaaca

SEQ ID NO: 33371 - DNA, 27 bp, Artificial sequence
  SiRNA target sequence
gacatcttttatttttccttctaacac

SEQ ID NO: 33372 - DNA, 27 bp, Artificial sequence
  SiRNA target sequence
acatcttttatttttccttctaacacg

SEQ ID NO: 33373 - DNA, 27 bp, Artificial sequence
  SiRNA target sequence
catcttttatttttccttctaacacgc

SEQ ID NO: 33374 - DNA, 27 bp, Artificial sequence
  SiRNA target sequence
atcttttatttttccttctaacacgcc

SEQ ID NO: 33375 - DNA, 27 bp, Artificial sequence
  SiRNA target sequence
tcttttatttttccttctaacacgcct

SEQ ID NO: 33376 - DNA, 27 bp, Artificial sequence
  SiRNA target sequence
cttttatttttccttctaacacgcctg

SEQ ID NO: 33377 - DNA, 27 bp, Artificial sequence
  SiRNA target sequence
ttttatttttccttctaacacgcctgc

SEQ ID NO: 33378 - DNA, 27 bp, Artificial sequence
  SiRNA target sequence
tttatttttccttctaacacgcctgct

SEQ ID NO: 33379 - DNA, 27 bp, Artificial sequence
  SiRNA target sequence
ttatttttccttctaacacgcctgctt

SEQ ID NO: 33380 - DNA, 27 bp, Artificial sequence
  SiRNA target sequence
tatttttccttctaacacgcctgcttg

SEQ ID NO: 33381 - DNA, 27 bp, Artificial sequence
  SiRNA target sequence
atttttccttctaacacgcctgcttgt

SEQ ID NO: 33382 - DNA, 27 bp, Artificial sequence
  SiRNA target sequence
tttttccttctaacacgcctgcttgta

SEQ ID NO: 33383 - DNA, 27 bp, Artificial sequence
  SiRNA target sequence
ttttccttctaacacgcctgcttgtag

SEQ ID NO: 33384 - DNA, 27 bp, Artificial sequence
  SiRNA target sequence
tttccttctaacacgcctgcttgtaga

SEQ ID NO: 33385 - DNA, 27 bp, Artificial sequence
  SiRNA target sequence
ttccttctaacacgcctgcttgtagag

SEQ ID NO: 33386 - DNA, 27 bp, Artificial sequence
  SiRNA target sequence
tccttctaacacgcctgcttgtagagc

SEQ ID NO: 33387 - DNA, 27 bp, Artificial sequence
  SiRNA target sequence
ccttctaacacgcctgcttgtagagcg

SEQ ID NO: 33388 - DNA, 27 bp, Artificial sequence
  SiRNA target sequence
cttctaacacgcctgcttgtagagcgg

SEQ ID NO: 33389 - DNA, 27 bp, Artificial sequence
  SiRNA target sequence
ttctaacacgcctgcttgtagagcggc

SEQ ID NO: 33390 - DNA, 27 bp, Artificial sequence
  SiRNA target sequence
tctaacacgcctgcttgtagagcggcc

SEQ ID NO: 33391 - DNA, 27 bp, Artificial sequence
  SiRNA target sequence
ctaacacgcctgcttgtagagcggccc

SEQ ID NO: 33392 - DNA, 27 bp, Artificial sequence
  SiRNA target sequence
taacacgcctgcttgtagagcggcccc

SEQ ID NO: 33393 - DNA, 27 bp, Artificial sequence
  SiRNA target sequence
aacacgcctgcttgtagagcggcccct

SEQ ID NO: 33394 - DNA, 27 bp, Artificial sequence
  SiRNA target sequence
acacgcctgcttgtagagcggcccctt

SEQ ID NO: 33395 - DNA, 27 bp, Artificial sequence
  SiRNA target sequence
cacgcctgcttgtagagcggccccttt

SEQ ID NO: 33396 - DNA, 27 bp, Artificial sequence
  SiRNA target sequence
acgcctgcttgtagagcggccccttta

SEQ ID NO: 33397 - DNA, 27 bp, Artificial sequence
  SiRNA target sequence
cgcctgcttgtagagcggcccctttag

SEQ ID NO: 33398 - DNA, 27 bp, Artificial sequence
  SiRNA target sequence
gcctgcttgtagagcggcccctttagc

SEQ ID NO: 33399 - DNA, 27 bp, Artificial sequence
  SiRNA target sequence
cctgcttgtagagcggcccctttagca

SEQ ID NO: 33400 - DNA, 27 bp, Artificial sequence
  SiRNA target sequence
ctgcttgtagagcggcccctttagcaa

SEQ ID NO: 33401 - DNA, 27 bp, Artificial sequence
  SiRNA target sequence
tgcttgtagagcggcccctttagcaac

SEQ ID NO: 33402 - DNA, 27 bp, Artificial sequence
  SiRNA target sequence
gcttgtagagcggcccctttagcaaca

SEQ ID NO: 33403 - DNA, 27 bp, Artificial sequence
  SiRNA target sequence
cttgtagagcggcccctttagcaacag

SEQ ID NO: 33404 - DNA, 27 bp, Artificial sequence
  SiRNA target sequence
ttgtagagcggcccctttagcaacagc

SEQ ID NO: 33405 - DNA, 27 bp, Artificial sequence
  SiRNA target sequence
tgtagagcggcccctttagcaacagct

SEQ ID NO: 33406 - DNA, 27 bp, Artificial sequence
  SiRNA target sequence
gtagagcggcccctttagcaacagctt

SEQ ID NO: 33407 - DNA, 27 bp, Artificial sequence
  SiRNA target sequence
tagagcggcccctttagcaacagcttc

SEQ ID NO: 33408 - DNA, 27 bp, Artificial sequence
  SiRNA target sequence
agagcggcccctttagcaacagcttca

SEQ ID NO: 33409 - DNA, 27 bp, Artificial sequence
  SiRNA target sequence
gagcggcccctttagcaacagcttcat

SEQ ID NO: 33410 - DNA, 27 bp, Artificial sequence
  SiRNA target sequence
agcggcccctttagcaacagcttcatc

SEQ ID NO: 33411 - DNA, 27 bp, Artificial sequence
  SiRNA target sequence
gcggcccctttagcaacagcttcatct

SEQ ID NO: 33412 - DNA, 27 bp, Artificial sequence
  SiRNA target sequence
cggcccctttagcaacagcttcatctg

SEQ ID NO: 33413 - DNA, 27 bp, Artificial sequence
  SiRNA target sequence
ggcccctttagcaacagcttcatctgg

SEQ ID NO: 33414 - DNA, 27 bp, Artificial sequence
  SiRNA target sequence
gcccctttagcaacagcttcatctgga

SEQ ID NO: 33415 - DNA, 27 bp, Artificial sequence
  SiRNA target sequence
cccctttagcaacagcttcatctggat

SEQ ID NO: 33416 - DNA, 27 bp, Artificial sequence
  SiRNA target sequence
ccctttagcaacagcttcatctggatt

SEQ ID NO: 33417 - DNA, 27 bp, Artificial sequence
  SiRNA target sequence
cctttagcaacagcttcatctggatta

SEQ ID NO: 33418 - DNA, 27 bp, Artificial sequence
  SiRNA target sequence
ctttagcaacagcttcatctggattaa

SEQ ID NO: 33419 - DNA, 27 bp, Artificial sequence
  SiRNA target sequence
tttagcaacagcttcatctggattaat

SEQ ID NO: 33420 - DNA, 27 bp, Artificial sequence
  SiRNA target sequence
ttagcaacagcttcatctggattaata

SEQ ID NO: 33421 - DNA, 27 bp, Artificial sequence
  SiRNA target sequence
tagcaacagcttcatctggattaatat

SEQ ID NO: 33422 - DNA, 27 bp, Artificial sequence
  SiRNA target sequence
agcaacagcttcatctggattaatatt

SEQ ID NO: 33423 - DNA, 27 bp, Artificial sequence
  SiRNA target sequence
gcaacagcttcatctggattaatattt

SEQ ID NO: 33424 - DNA, 27 bp, Artificial sequence
  SiRNA target sequence
caacagcttcatctggattaatatttg

SEQ ID NO: 33425 - DNA, 27 bp, Artificial sequence
  SiRNA target sequence
aacagcttcatctggattaatatttgt

SEQ ID NO: 33426 - DNA, 27 bp, Artificial sequence
  SiRNA target sequence
acagcttcatctggattaatatttgta

SEQ ID NO: 33427 - DNA, 27 bp, Artificial sequence
  SiRNA target sequence
cagcttcatctggattaatatttgtag

SEQ ID NO: 33428 - DNA, 27 bp, Artificial sequence
  SiRNA target sequence
agcttcatctggattaatatttgtaga

SEQ ID NO: 33429 - DNA, 27 bp, Artificial sequence
  SiRNA target sequence
gcttcatctggattaatatttgtagaa

SEQ ID NO: 33430 - DNA, 27 bp, Artificial sequence
  SiRNA target sequence
cttcatctggattaatatttgtagaag

SEQ ID NO: 33431 - DNA, 27 bp, Artificial sequence
  SiRNA target sequence
ttcatctggattaatatttgtagaagg

SEQ ID NO: 33432 - DNA, 27 bp, Artificial sequence
  SiRNA target sequence
tcatctggattaatatttgtagaaggc

SEQ ID NO: 33433 - DNA, 27 bp, Artificial sequence
  SiRNA target sequence
catctggattaatatttgtagaaggct

SEQ ID NO: 33434 - DNA, 27 bp, Artificial sequence
  SiRNA target sequence
atctggattaatatttgtagaaggctc

SEQ ID NO: 33435 - DNA, 27 bp, Artificial sequence
  SiRNA target sequence
tctggattaatatttgtagaaggctcg

SEQ ID NO: 33436 - DNA, 27 bp, Artificial sequence
  SiRNA target sequence
ctggattaatatttgtagaaggctcga

SEQ ID NO: 33437 - DNA, 27 bp, Artificial sequence
  SiRNA target sequence
tggattaatatttgtagaaggctcgat

SEQ ID NO: 33438 - DNA, 27 bp, Artificial sequence
  SiRNA target sequence
ggattaatatttgtagaaggctcgata

SEQ ID NO: 33439 - DNA, 27 bp, Artificial sequence
  SiRNA target sequence
gattaatatttgtagaaggctcgatac

SEQ ID NO: 33440 - DNA, 27 bp, Artificial sequence
  SiRNA target sequence
attaatatttgtagaaggctcgatacc

SEQ ID NO: 33441 - DNA, 27 bp, Artificial sequence
  SiRNA target sequence
ttaatatttgtagaaggctcgatacca

SEQ ID NO: 33442 - DNA, 27 bp, Artificial sequence
  SiRNA target sequence
taatatttgtagaaggctcgataccaa

SEQ ID NO: 33443 - DNA, 27 bp, Artificial sequence
  SiRNA target sequence
aatatttgtagaaggctcgataccaaa

SEQ ID NO: 33444 - DNA, 27 bp, Artificial sequence
  SiRNA target sequence
atatttgtagaaggctcgataccaaaa

SEQ ID NO: 33445 - DNA, 27 bp, Artificial sequence
  SiRNA target sequence
tatttgtagaaggctcgataccaaaaa

SEQ ID NO: 33446 - DNA, 27 bp, Artificial sequence
  SiRNA target sequence
atttgtagaaggctcgataccaaaaat

SEQ ID NO: 33447 - DNA, 27 bp, Artificial sequence
  SiRNA target sequence
tttgtagaaggctcgataccaaaaatc

SEQ ID NO: 33448 - DNA, 27 bp, Artificial sequence
  SiRNA target sequence
ttgtagaaggctcgataccaaaaatct

SEQ ID NO: 33449 - DNA, 27 bp, Artificial sequence
  SiRNA target sequence
tgtagaaggctcgataccaaaaatctt

SEQ ID NO: 33450 - DNA, 27 bp, Artificial sequence
  SiRNA target sequence
gtagaaggctcgataccaaaaatcttc

SEQ ID NO: 33451 - DNA, 27 bp, Artificial sequence
  SiRNA target sequence
tagaaggctcgataccaaaaatcttct

SEQ ID NO: 33452 - DNA, 27 bp, Artificial sequence
  SiRNA target sequence
agaaggctcgataccaaaaatcttctt

SEQ ID NO: 33453 - DNA, 27 bp, Artificial sequence
  SiRNA target sequence
gaaggctcgataccaaaaatcttctta

SEQ ID NO: 33454 - DNA, 27 bp, Artificial sequence
  SiRNA target sequence
aaggctcgataccaaaaatcttcttaa

SEQ ID NO: 33455 - DNA, 27 bp, Artificial sequence
  SiRNA target sequence
aggctcgataccaaaaatcttcttaac

SEQ ID NO: 33456 - DNA, 27 bp, Artificial sequence
  SiRNA target sequence
ggctcgataccaaaaatcttcttaaca

SEQ ID NO: 33457 - DNA, 27 bp, Artificial sequence
  SiRNA target sequence
gctcgataccaaaaatcttcttaacaa

SEQ ID NO: 33458 - DNA, 27 bp, Artificial sequence
  SiRNA target sequence
ctcgataccaaaaatcttcttaacaag

SEQ ID NO: 33459 - DNA, 27 bp, Artificial sequence
  SiRNA target sequence
tcgataccaaaaatcttcttaacaagt

SEQ ID NO: 33460 - DNA, 27 bp, Artificial sequence
  SiRNA target sequence
cgataccaaaaatcttcttaacaagtt

SEQ ID NO: 33461 - DNA, 27 bp, Artificial sequence
  SiRNA target sequence
gataccaaaaatcttcttaacaagttt

SEQ ID NO: 33462 - DNA, 27 bp, Artificial sequence
  SiRNA target sequence
ataccaaaaatcttcttaacaagtttt

SEQ ID NO: 33463 - DNA, 27 bp, Artificial sequence
  SiRNA target sequence
taccaaaaatcttcttaacaagttttc

SEQ ID NO: 33464 - DNA, 27 bp, Artificial sequence
  SiRNA target sequence
accaaaaatcttcttaacaagttttct

SEQ ID NO: 33465 - DNA, 27 bp, Artificial sequence
  SiRNA target sequence
ccaaaaatcttcttaacaagttttcta

SEQ ID NO: 33466 - DNA, 27 bp, Artificial sequence
  SiRNA target sequence
caaaaatcttcttaacaagttttctaa

SEQ ID NO: 33467 - DNA, 27 bp, Artificial sequence
  SiRNA target sequence
aaaaatcttcttaacaagttttctaac

SEQ ID NO: 33468 - DNA, 27 bp, Artificial sequence
  SiRNA target sequence
aaaatcttcttaacaagttttctaaca

SEQ ID NO: 33469 - DNA, 27 bp, Artificial sequence
  SiRNA target sequence
aaatcttcttaacaagttttctaacat

SEQ ID NO: 33470 - DNA, 27 bp, Artificial sequence
  SiRNA target sequence
aatcttcttaacaagttttctaacata

SEQ ID NO: 33471 - DNA, 27 bp, Artificial sequence
  SiRNA target sequence
atcttcttaacaagttttctaacatac

SEQ ID NO: 33472 - DNA, 27 bp, Artificial sequence
  SiRNA target sequence
tcttcttaacaagttttctaacatacg

SEQ ID NO: 33473 - DNA, 27 bp, Artificial sequence
  SiRNA target sequence
cttcttaacaagttttctaacatacgg

SEQ ID NO: 33474 - DNA, 27 bp, Artificial sequence
  SiRNA target sequence
ttcttaacaagttttctaacatacggc

SEQ ID NO: 33475 - DNA, 27 bp, Artificial sequence
  SiRNA target sequence
tcttaacaagttttctaacatacggca

SEQ ID NO: 33476 - DNA, 27 bp, Artificial sequence
  SiRNA target sequence
cttaacaagttttctaacatacggcat

SEQ ID NO: 33477 - DNA, 27 bp, Artificial sequence
  SiRNA target sequence
ttaacaagttttctaacatacggcatt

SEQ ID NO: 33478 - DNA, 27 bp, Artificial sequence
  SiRNA target sequence
taacaagttttctaacatacggcattc

SEQ ID NO: 33479 - DNA, 27 bp, Artificial sequence
  SiRNA target sequence
aacaagttttctaacatacggcattcg

SEQ ID NO: 33480 - DNA, 27 bp, Artificial sequence
  SiRNA target sequence
acaagttttctaacatacggcattcgt

SEQ ID NO: 33481 - DNA, 27 bp, Artificial sequence
  SiRNA target sequence
caagttttctaacatacggcattcgtg

SEQ ID NO: 33482 - DNA, 27 bp, Artificial sequence
  SiRNA target sequence
aagttttctaacatacggcattcgtgt

SEQ ID NO: 33483 - DNA, 27 bp, Artificial sequence
  SiRNA target sequence
agttttctaacatacggcattcgtgtc

SEQ ID NO: 33484 - DNA, 27 bp, Artificial sequence
  SiRNA target sequence
gttttctaacatacggcattcgtgtca

SEQ ID NO: 33485 - DNA, 27 bp, Artificial sequence
  SiRNA target sequence
ttttctaacatacggcattcgtgtcat

SEQ ID NO: 33486 - DNA, 27 bp, Artificial sequence
  SiRNA target sequence
tttctaacatacggcattcgtgtcatt

SEQ ID NO: 33487 - DNA, 27 bp, Artificial sequence
  SiRNA target sequence
ttctaacatacggcattcgtgtcattc

SEQ ID NO: 33488 - DNA, 27 bp, Artificial sequence
  SiRNA target sequence
tctaacatacggcattcgtgtcattcc

SEQ ID NO: 33489 - DNA, 27 bp, Artificial sequence
  SiRNA target sequence
ctaacatacggcattcgtgtcattcca

SEQ ID NO: 33490 - DNA, 27 bp, Artificial sequence
  SiRNA target sequence
taacatacggcattcgtgtcattccac

SEQ ID NO: 33491 - DNA, 27 bp, Artificial sequence
  SiRNA target sequence
aacatacggcattcgtgtcattccacc

SEQ ID NO: 33492 - DNA, 27 bp, Artificial sequence
  SiRNA target sequence
acatacggcattcgtgtcattccaccc

SEQ ID NO: 33493 - DNA, 27 bp, Artificial sequence
  SiRNA target sequence
catacggcattcgtgtcattccaccca

SEQ ID NO: 33494 - DNA, 27 bp, Artificial sequence
  SiRNA target sequence
atacggcattcgtgtcattccacccac

SEQ ID NO: 33495 - DNA, 27 bp, Artificial sequence
  SiRNA target sequence
tacggcattcgtgtcattccacccaca

SEQ ID NO: 33496 - DNA, 27 bp, Artificial sequence
  SiRNA target sequence
acggcattcgtgtcattccacccacaa

SEQ ID NO: 33497 - DNA, 27 bp, Artificial sequence
  SiRNA target sequence
cggcattcgtgtcattccacccacaag

SEQ ID NO: 33498 - DNA, 27 bp, Artificial sequence
  SiRNA target sequence
ggcattcgtgtcattccacccacaagt

SEQ ID NO: 33499 - DNA, 27 bp, Artificial sequence
  SiRNA target sequence
gcattcgtgtcattccacccacaagta

SEQ ID NO: 33500 - DNA, 27 bp, Artificial sequence
  SiRNA target sequence
cattcgtgtcattccacccacaagtat

SEQ ID NO: 33501 - DNA, 27 bp, Artificial sequence
  SiRNA target sequence
attcgtgtcattccacccacaagtata

SEQ ID NO: 33502 - DNA, 27 bp, Artificial sequence
  SiRNA target sequence
ttcgtgtcattccacccacaagtataa

SEQ ID NO: 33503 - DNA, 27 bp, Artificial sequence
  SiRNA target sequence
tcgtgtcattccacccacaagtataac

SEQ ID NO: 33504 - DNA, 27 bp, Artificial sequence
  SiRNA target sequence
cgtgtcattccacccacaagtataacg

SEQ ID NO: 33505 - DNA, 27 bp, Artificial sequence
  SiRNA target sequence
gtgtcattccacccacaagtataacgt

SEQ ID NO: 33506 - DNA, 27 bp, Artificial sequence
  SiRNA target sequence
tgtcattccacccacaagtataacgtg

SEQ ID NO: 33507 - DNA, 27 bp, Artificial sequence
  SiRNA target sequence
gtcattccacccacaagtataacgtgt

SEQ ID NO: 33508 - DNA, 27 bp, Artificial sequence
  SiRNA target sequence
tcattccacccacaagtataacgtgtt

SEQ ID NO: 33509 - DNA, 27 bp, Artificial sequence
  SiRNA target sequence
cattccacccacaagtataacgtgttt

SEQ ID NO: 33510 - DNA, 27 bp, Artificial sequence
  SiRNA target sequence
attccacccacaagtataacgtgttta

SEQ ID NO: 33511 - DNA, 27 bp, Artificial sequence
  SiRNA target sequence
ttccacccacaagtataacgtgtttaa

SEQ ID NO: 33512 - DNA, 27 bp, Artificial sequence
  SiRNA target sequence
tccacccacaagtataacgtgtttaat

SEQ ID NO: 33513 - DNA, 27 bp, Artificial sequence
  SiRNA target sequence
ccacccacaagtataacgtgtttaata

SEQ ID NO: 33514 - DNA, 27 bp, Artificial sequence
  SiRNA target sequence
cacccacaagtataacgtgtttaatat

SEQ ID NO: 33515 - DNA, 27 bp, Artificial sequence
  SiRNA target sequence
acccacaagtataacgtgtttaatatc

SEQ ID NO: 33516 - DNA, 27 bp, Artificial sequence
  SiRNA target sequence
cccacaagtataacgtgtttaatatca

SEQ ID NO: 33517 - DNA, 27 bp, Artificial sequence
  SiRNA target sequence
ccacaagtataacgtgtttaatatcac

SEQ ID NO: 33518 - DNA, 27 bp, Artificial sequence
  SiRNA target sequence
cacaagtataacgtgtttaatatcact

SEQ ID NO: 33519 - DNA, 27 bp, Artificial sequence
  SiRNA target sequence
acaagtataacgtgtttaatatcactt

SEQ ID NO: 33520 - DNA, 27 bp, Artificial sequence
  SiRNA target sequence
caagtataacgtgtttaatatcacttt

SEQ ID NO: 33521 - DNA, 27 bp, Artificial sequence
  SiRNA target sequence
aagtataacgtgtttaatatcactttt

SEQ ID NO: 33522 - DNA, 27 bp, Artificial sequence
  SiRNA target sequence
agtataacgtgtttaatatcactttta

SEQ ID NO: 33523 - DNA, 27 bp, Artificial sequence
  SiRNA target sequence
gtataacgtgtttaatatcacttttag

SEQ ID NO: 33524 - DNA, 27 bp, Artificial sequence
  SiRNA target sequence
tataacgtgtttaatatcacttttagt

SEQ ID NO: 33525 - DNA, 27 bp, Artificial sequence
  SiRNA target sequence
ataacgtgtttaatatcacttttagtt

SEQ ID NO: 33526 - DNA, 27 bp, Artificial sequence
  SiRNA target sequence
taacgtgtttaatatcacttttagtta

SEQ ID NO: 33527 - DNA, 27 bp, Artificial sequence
  SiRNA target sequence
aacgtgtttaatatcacttttagttat

SEQ ID NO: 33528 - DNA, 27 bp, Artificial sequence
  SiRNA target sequence
acgtgtttaatatcacttttagttata

SEQ ID NO: 33529 - DNA, 27 bp, Artificial sequence
  SiRNA target sequence
cgtgtttaatatcacttttagttatat

SEQ ID NO: 33530 - DNA, 27 bp, Artificial sequence
  SiRNA target sequence
gtgtttaatatcacttttagttatatt

SEQ ID NO: 33531 - DNA, 27 bp, Artificial sequence
  SiRNA target sequence
tgtttaatatcacttttagttatattg

SEQ ID NO: 33532 - DNA, 27 bp, Artificial sequence
  SiRNA target sequence
gtttaatatcacttttagttatattgg

SEQ ID NO: 33533 - DNA, 27 bp, Artificial sequence
  SiRNA target sequence
tttaatatcacttttagttatattggc

SEQ ID NO: 33534 - DNA, 27 bp, Artificial sequence
  SiRNA target sequence
ttaatatcacttttagttatattggca

SEQ ID NO: 33535 - DNA, 27 bp, Artificial sequence
  SiRNA target sequence
taatatcacttttagttatattggcat

SEQ ID NO: 33536 - DNA, 27 bp, Artificial sequence
  SiRNA target sequence
aatatcacttttagttatattggcatc

SEQ ID NO: 33537 - DNA, 27 bp, Artificial sequence
  SiRNA target sequence
atatcacttttagttatattggcatct

SEQ ID NO: 33538 - DNA, 27 bp, Artificial sequence
  SiRNA target sequence
tatcacttttagttatattggcatctc

SEQ ID NO: 33539 - DNA, 27 bp, Artificial sequence
  SiRNA target sequence
atcacttttagttatattggcatctct

SEQ ID NO: 33540 - DNA, 27 bp, Artificial sequence
  SiRNA target sequence
tcacttttagttatattggcatctcta

SEQ ID NO: 33541 - DNA, 27 bp, Artificial sequence
  SiRNA target sequence
cacttttagttatattggcatctctaa

SEQ ID NO: 33542 - DNA, 27 bp, Artificial sequence
  SiRNA target sequence
acttttagttatattggcatctctaat

SEQ ID NO: 33543 - DNA, 27 bp, Artificial sequence
  SiRNA target sequence
cttttagttatattggcatctctaata

SEQ ID NO: 33544 - DNA, 27 bp, Artificial sequence
  SiRNA target sequence
ttttagttatattggcatctctaatag

SEQ ID NO: 33545 - DNA, 27 bp, Artificial sequence
  SiRNA target sequence
tttagttatattggcatctctaatagc

SEQ ID NO: 33546 - DNA, 27 bp, Artificial sequence
  SiRNA target sequence
ttagttatattggcatctctaatagct

SEQ ID NO: 33547 - DNA, 27 bp, Artificial sequence
  SiRNA target sequence
tagttatattggcatctctaatagctt

SEQ ID NO: 33548 - DNA, 27 bp, Artificial sequence
  SiRNA target sequence
agttatattggcatctctaatagcttt

SEQ ID NO: 33549 - DNA, 27 bp, Artificial sequence
  SiRNA target sequence
gttatattggcatctctaatagcttta

SEQ ID NO: 33550 - DNA, 27 bp, Artificial sequence
  SiRNA target sequence
ttatattggcatctctaatagctttaa

SEQ ID NO: 33551 - DNA, 27 bp, Artificial sequence
  SiRNA target sequence
tatattggcatctctaatagctttaag

SEQ ID NO: 33552 - DNA, 27 bp, Artificial sequence
  SiRNA target sequence
atattggcatctctaatagctttaaga

SEQ ID NO: 33553 - DNA, 27 bp, Artificial sequence
  SiRNA target sequence
tattggcatctctaatagctttaagac

SEQ ID NO: 33554 - DNA, 27 bp, Artificial sequence
  SiRNA target sequence
attggcatctctaatagctttaagaca

SEQ ID NO: 33555 - DNA, 27 bp, Artificial sequence
  SiRNA target sequence
ttggcatctctaatagctttaagacag

SEQ ID NO: 33556 - DNA, 27 bp, Artificial sequence
  SiRNA target sequence
tggcatctctaatagctttaagacagg

SEQ ID NO: 33557 - DNA, 27 bp, Artificial sequence
  SiRNA target sequence
ggcatctctaatagctttaagacaggg

SEQ ID NO: 33558 - DNA, 27 bp, Artificial sequence
  SiRNA target sequence
gcatctctaatagctttaagacagggg

SEQ ID NO: 33559 - DNA, 27 bp, Artificial sequence
  SiRNA target sequence
catctctaatagctttaagacaggggt

SEQ ID NO: 33560 - DNA, 27 bp, Artificial sequence
  SiRNA target sequence
atctctaatagctttaagacaggggtt

SEQ ID NO: 33561 - DNA, 27 bp, Artificial sequence
  SiRNA target sequence
tctctaatagctttaagacaggggttt

SEQ ID NO: 33562 - DNA, 27 bp, Artificial sequence
  SiRNA target sequence
ctctaatagctttaagacaggggttta

SEQ ID NO: 33563 - DNA, 27 bp, Artificial sequence
  SiRNA target sequence
tctaatagctttaagacaggggtttat

SEQ ID NO: 33564 - DNA, 27 bp, Artificial sequence
  SiRNA target sequence
ctaatagctttaagacaggggtttatt

SEQ ID NO: 33565 - DNA, 27 bp, Artificial sequence
  SiRNA target sequence
taatagctttaagacaggggtttattg

SEQ ID NO: 33566 - DNA, 27 bp, Artificial sequence
  SiRNA target sequence
aatagctttaagacaggggtttattgt

SEQ ID NO: 33567 - DNA, 27 bp, Artificial sequence
  SiRNA target sequence
atagctttaagacaggggtttattgtt

SEQ ID NO: 33568 - DNA, 27 bp, Artificial sequence
  SiRNA target sequence
tagctttaagacaggggtttattgttt

SEQ ID NO: 33569 - DNA, 27 bp, Artificial sequence
  SiRNA target sequence
agctttaagacaggggtttattgtttt

SEQ ID NO: 33570 - DNA, 27 bp, Artificial sequence
  SiRNA target sequence
gctttaagacaggggtttattgttttg

SEQ ID NO: 33571 - DNA, 27 bp, Artificial sequence
  SiRNA target sequence
ctttaagacaggggtttattgttttgt

SEQ ID NO: 33572 - DNA, 27 bp, Artificial sequence
  SiRNA target sequence
tttaagacaggggtttattgttttgtc

SEQ ID NO: 33573 - DNA, 27 bp, Artificial sequence
  SiRNA target sequence
ttaagacaggggtttattgttttgtct

SEQ ID NO: 33574 - DNA, 27 bp, Artificial sequence
  SiRNA target sequence
taagacaggggtttattgttttgtcta

SEQ ID NO: 33575 - DNA, 27 bp, Artificial sequence
  SiRNA target sequence
aagacaggggtttattgttttgtctat

SEQ ID NO: 33576 - DNA, 27 bp, Artificial sequence
  SiRNA target sequence
agacaggggtttattgttttgtctatt

SEQ ID NO: 33577 - DNA, 27 bp, Artificial sequence
  SiRNA target sequence
gacaggggtttattgttttgtctatta

SEQ ID NO: 33578 - DNA, 27 bp, Artificial sequence
  SiRNA target sequence
acaggggtttattgttttgtctattaa

SEQ ID NO: 33579 - DNA, 27 bp, Artificial sequence
  SiRNA target sequence
caggggtttattgttttgtctattaac

SEQ ID NO: 33580 - DNA, 27 bp, Artificial sequence
  SiRNA target sequence
aggggtttattgttttgtctattaact

SEQ ID NO: 33581 - DNA, 27 bp, Artificial sequence
  SiRNA target sequence
ggggtttattgttttgtctattaactt

SEQ ID NO: 33582 - DNA, 27 bp, Artificial sequence
  SiRNA target sequence
gggtttattgttttgtctattaacttt

SEQ ID NO: 33583 - DNA, 27 bp, Artificial sequence
  SiRNA target sequence
ggtttattgttttgtctattaactttt

SEQ ID NO: 33584 - DNA, 27 bp, Artificial sequence
  SiRNA target sequence
gtttattgttttgtctattaacttttt

SEQ ID NO: 33585 - DNA, 27 bp, Artificial sequence
  SiRNA target sequence
tttattgttttgtctattaactttttt

SEQ ID NO: 33586 - DNA, 27 bp, Artificial sequence
  SiRNA target sequence
ttattgttttgtctattaacttttttg

SEQ ID NO: 33587 - DNA, 27 bp, Artificial sequence
  SiRNA target sequence
tattgttttgtctattaacttttttgt

SEQ ID NO: 33588 - DNA, 27 bp, Artificial sequence
  SiRNA target sequence
attgttttgtctattaacttttttgta

SEQ ID NO: 33589 - DNA, 27 bp, Artificial sequence
  SiRNA target sequence
ttgttttgtctattaacttttttgtaa

SEQ ID NO: 33590 - DNA, 27 bp, Artificial sequence
  SiRNA target sequence
tgttttgtctattaacttttttgtaat

SEQ ID NO: 33591 - DNA, 27 bp, Artificial sequence
  SiRNA target sequence
gttttgtctattaacttttttgtaatt

SEQ ID NO: 33592 - DNA, 27 bp, Artificial sequence
  SiRNA target sequence
ttttgtctattaacttttttgtaattt

SEQ ID NO: 33593 - DNA, 27 bp, Artificial sequence
  SiRNA target sequence
tttgtctattaacttttttgtaatttt

SEQ ID NO: 33594 - DNA, 27 bp, Artificial sequence
  SiRNA target sequence
ttgtctattaacttttttgtaattttt

SEQ ID NO: 33595 - DNA, 27 bp, Artificial sequence
  SiRNA target sequence
tgtctattaacttttttgtaatttttt

SEQ ID NO: 33596 - DNA, 27 bp, Artificial sequence
  SiRNA target sequence
gtctattaacttttttgtaattttttc

SEQ ID NO: 33597 - DNA, 27 bp, Artificial sequence
  SiRNA target sequence
tctattaacttttttgtaattttttca

SEQ ID NO: 33598 - DNA, 27 bp, Artificial sequence
  SiRNA target sequence
ctattaacttttttgtaattttttcaa

SEQ ID NO: 33599 - DNA, 27 bp, Artificial sequence
  SiRNA target sequence
tattaacttttttgtaattttttcaaa

SEQ ID NO: 33600 - DNA, 27 bp, Artificial sequence
  SiRNA target sequence
attaacttttttgtaattttttcaaat

SEQ ID NO: 33601 - DNA, 27 bp, Artificial sequence
  SiRNA target sequence
ttaacttttttgtaattttttcaaatt

SEQ ID NO: 33602 - DNA, 27 bp, Artificial sequence
  SiRNA target sequence
taacttttttgtaattttttcaaattc

SEQ ID NO: 33603 - DNA, 27 bp, Artificial sequence
  SiRNA target sequence
aacttttttgtaattttttcaaattcg

SEQ ID NO: 33604 - DNA, 27 bp, Artificial sequence
  SiRNA target sequence
acttttttgtaattttttcaaattcgt

SEQ ID NO: 33605 - DNA, 27 bp, Artificial sequence
  SiRNA target sequence
cttttttgtaattttttcaaattcgtc

SEQ ID NO: 33606 - DNA, 27 bp, Artificial sequence
  SiRNA target sequence
ttttttgtaattttttcaaattcgtcg

SEQ ID NO: 33607 - DNA, 27 bp, Artificial sequence
  SiRNA target sequence
tttttgtaattttttcaaattcgtcgc

SEQ ID NO: 33608 - DNA, 27 bp, Artificial sequence
  SiRNA target sequence
ttttgtaattttttcaaattcgtcgcg

SEQ ID NO: 33609 - DNA, 27 bp, Artificial sequence
  SiRNA target sequence
tttgtaattttttcaaattcgtcgcgt

SEQ ID NO: 33610 - DNA, 27 bp, Artificial sequence
  SiRNA target sequence
ttgtaattttttcaaattcgtcgcgtg

SEQ ID NO: 33611 - DNA, 27 bp, Artificial sequence
  SiRNA target sequence
tgtaattttttcaaattcgtcgcgtgt

SEQ ID NO: 33612 - DNA, 27 bp, Artificial sequence
  SiRNA target sequence
gtaattttttcaaattcgtcgcgtgta

SEQ ID NO: 33613 - DNA, 27 bp, Artificial sequence
  SiRNA target sequence
taattttttcaaattcgtcgcgtgtaa

SEQ ID NO: 33614 - DNA, 27 bp, Artificial sequence
  SiRNA target sequence
aattttttcaaattcgtcgcgtgtaat

SEQ ID NO: 33615 - DNA, 27 bp, Artificial sequence
  SiRNA target sequence
attttttcaaattcgtcgcgtgtaatt

SEQ ID NO: 33616 - DNA, 27 bp, Artificial sequence
  SiRNA target sequence
ttttttcaaattcgtcgcgtgtaatta

SEQ ID NO: 33617 - DNA, 27 bp, Artificial sequence
  SiRNA target sequence
tttttcaaattcgtcgcgtgtaattac

SEQ ID NO: 33618 - DNA, 27 bp, Artificial sequence
  SiRNA target sequence
ttttcaaattcgtcgcgtgtaattacc

SEQ ID NO: 33619 - DNA, 27 bp, Artificial sequence
  SiRNA target sequence
tttcaaattcgtcgcgtgtaattacct

SEQ ID NO: 33620 - DNA, 27 bp, Artificial sequence
  SiRNA target sequence
ttcaaattcgtcgcgtgtaattacctc

SEQ ID NO: 33621 - DNA, 27 bp, Artificial sequence
  SiRNA target sequence
tcaaattcgtcgcgtgtaattacctct

SEQ ID NO: 33622 - DNA, 27 bp, Artificial sequence
  SiRNA target sequence
caaattcgtcgcgtgtaattacctctt

SEQ ID NO: 33623 - DNA, 27 bp, Artificial sequence
  SiRNA target sequence
aaattcgtcgcgtgtaattacctcttt

SEQ ID NO: 33624 - DNA, 27 bp, Artificial sequence
  SiRNA target sequence
aattcgtcgcgtgtaattacctctttt

SEQ ID NO: 33625 - DNA, 27 bp, Artificial sequence
  SiRNA target sequence
attcgtcgcgtgtaattacctctttta

SEQ ID NO: 33626 - DNA, 27 bp, Artificial sequence
  SiRNA target sequence
ttcgtcgcgtgtaattacctcttttaa

SEQ ID NO: 33627 - DNA, 27 bp, Artificial sequence
  SiRNA target sequence
tcgtcgcgtgtaattacctcttttaag

SEQ ID NO: 33628 - DNA, 27 bp, Artificial sequence
  SiRNA target sequence
cgtcgcgtgtaattacctcttttaagt

SEQ ID NO: 33629 - DNA, 27 bp, Artificial sequence
  SiRNA target sequence
gtcgcgtgtaattacctcttttaagtg

SEQ ID NO: 33630 - DNA, 27 bp, Artificial sequence
  SiRNA target sequence
tcgcgtgtaattacctcttttaagtga

SEQ ID NO: 33631 - DNA, 27 bp, Artificial sequence
  SiRNA target sequence
cgcgtgtaattacctcttttaagtgat

SEQ ID NO: 33632 - DNA, 27 bp, Artificial sequence
  SiRNA target sequence
gcgtgtaattacctcttttaagtgata

SEQ ID NO: 33633 - DNA, 27 bp, Artificial sequence
  SiRNA target sequence
cgtgtaattacctcttttaagtgataa

SEQ ID NO: 33634 - DNA, 27 bp, Artificial sequence
  SiRNA target sequence
gtgtaattacctcttttaagtgataat

SEQ ID NO: 33635 - DNA, 27 bp, Artificial sequence
  SiRNA target sequence
tgtaattacctcttttaagtgataatt

SEQ ID NO: 33636 - DNA, 27 bp, Artificial sequence
  SiRNA target sequence
gtaattacctcttttaagtgataattc

SEQ ID NO: 33637 - DNA, 27 bp, Artificial sequence
  SiRNA target sequence
taattacctcttttaagtgataattct

SEQ ID NO: 33638 - DNA, 27 bp, Artificial sequence
  SiRNA target sequence
aattacctcttttaagtgataattctt

SEQ ID NO: 33639 - DNA, 27 bp, Artificial sequence
  SiRNA target sequence
attacctcttttaagtgataattcttt

SEQ ID NO: 33640 - DNA, 27 bp, Artificial sequence
  SiRNA target sequence
ttacctcttttaagtgataattctttt

SEQ ID NO: 33641 - DNA, 27 bp, Artificial sequence
  SiRNA target sequence
tacctcttttaagtgataattcttttt

SEQ ID NO: 33642 - DNA, 27 bp, Artificial sequence
  SiRNA target sequence
acctcttttaagtgataattcttttta

SEQ ID NO: 33643 - DNA, 27 bp, Artificial sequence
  SiRNA target sequence
cctcttttaagtgataattctttttac

SEQ ID NO: 33644 - DNA, 27 bp, Artificial sequence
  SiRNA target sequence
ctcttttaagtgataattctttttact

SEQ ID NO: 33645 - DNA, 27 bp, Artificial sequence
  SiRNA target sequence
tcttttaagtgataattctttttacta

SEQ ID NO: 33646 - DNA, 27 bp, Artificial sequence
  SiRNA target sequence
cttttaagtgataattctttttactat

SEQ ID NO: 33647 - DNA, 27 bp, Artificial sequence
  SiRNA target sequence
ttttaagtgataattctttttactatc

SEQ ID NO: 33648 - DNA, 27 bp, Artificial sequence
  SiRNA target sequence
tttaagtgataattctttttactatcg

SEQ ID NO: 33649 - DNA, 27 bp, Artificial sequence
  SiRNA target sequence
ttaagtgataattctttttactatcgt

SEQ ID NO: 33650 - DNA, 27 bp, Artificial sequence
  SiRNA target sequence
taagtgataattctttttactatcgtt

SEQ ID NO: 33651 - DNA, 27 bp, Artificial sequence
  SiRNA target sequence
aagtgataattctttttactatcgtta

SEQ ID NO: 33652 - DNA, 27 bp, Artificial sequence
  SiRNA target sequence
agtgataattctttttactatcgttat

SEQ ID NO: 33653 - DNA, 27 bp, Artificial sequence
  SiRNA target sequence
gtgataattctttttactatcgttata

SEQ ID NO: 33654 - DNA, 27 bp, Artificial sequence
  SiRNA target sequence
tgataattctttttactatcgttataa

SEQ ID NO: 33655 - DNA, 27 bp, Artificial sequence
  SiRNA target sequence
gataattctttttactatcgttataaa

SEQ ID NO: 33656 - DNA, 27 bp, Artificial sequence
  SiRNA target sequence
ataattctttttactatcgttataaat

SEQ ID NO: 33657 - DNA, 27 bp, Artificial sequence
  SiRNA target sequence
taattctttttactatcgttataaata

SEQ ID NO: 33658 - DNA, 27 bp, Artificial sequence
  SiRNA target sequence
aattctttttactatcgttataaatat

SEQ ID NO: 33659 - DNA, 27 bp, Artificial sequence
  SiRNA target sequence
attctttttactatcgttataaatata

SEQ ID NO: 33660 - DNA, 27 bp, Artificial sequence
  SiRNA target sequence
ttctttttactatcgttataaatatac

SEQ ID NO: 33661 - DNA, 27 bp, Artificial sequence
  SiRNA target sequence
tctttttactatcgttataaatatacg

SEQ ID NO: 33662 - DNA, 27 bp, Artificial sequence
  SiRNA target sequence
ctttttactatcgttataaatatacgg

SEQ ID NO: 33663 - DNA, 27 bp, Artificial sequence
  SiRNA target sequence
tttttactatcgttataaatatacgga

SEQ ID NO: 33664 - DNA, 27 bp, Artificial sequence
  SiRNA target sequence
ttttactatcgttataaatatacggaa

SEQ ID NO: 33665 - DNA, 27 bp, Artificial sequence
  SiRNA target sequence
tttactatcgttataaatatacggaat

SEQ ID NO: 33666 - DNA, 27 bp, Artificial sequence
  SiRNA target sequence
ttactatcgttataaatatacggaata

SEQ ID NO: 33667 - DNA, 27 bp, Artificial sequence
  SiRNA target sequence
tactatcgttataaatatacggaatat

SEQ ID NO: 33668 - DNA, 27 bp, Artificial sequence
  SiRNA target sequence
actatcgttataaatatacggaatatt

SEQ ID NO: 33669 - DNA, 27 bp, Artificial sequence
  SiRNA target sequence
ctatcgttataaatatacggaatatta

SEQ ID NO: 33670 - DNA, 27 bp, Artificial sequence
  SiRNA target sequence
tatcgttataaatatacggaatattaa

SEQ ID NO: 33671 - DNA, 27 bp, Artificial sequence
  SiRNA target sequence
atcgttataaatatacggaatattaat

SEQ ID NO: 33672 - DNA, 27 bp, Artificial sequence
  SiRNA target sequence
tcgttataaatatacggaatattaatt

SEQ ID NO: 33673 - DNA, 27 bp, Artificial sequence
  SiRNA target sequence
cgttataaatatacggaatattaattt

SEQ ID NO: 33674 - DNA, 27 bp, Artificial sequence
  SiRNA target sequence
gttataaatatacggaatattaatttc

SEQ ID NO: 33675 - DNA, 27 bp, Artificial sequence
  SiRNA target sequence
ttataaatatacggaatattaatttca

SEQ ID NO: 33676 - DNA, 27 bp, Artificial sequence
  SiRNA target sequence
tataaatatacggaatattaatttcag

SEQ ID NO: 33677 - DNA, 27 bp, Artificial sequence
  SiRNA target sequence
ataaatatacggaatattaatttcaga

SEQ ID NO: 33678 - DNA, 27 bp, Artificial sequence
  SiRNA target sequence
taaatatacggaatattaatttcagac

SEQ ID NO: 33679 - DNA, 27 bp, Artificial sequence
  SiRNA target sequence
aaatatacggaatattaatttcagacg

SEQ ID NO: 33680 - DNA, 27 bp, Artificial sequence
  SiRNA target sequence
aatatacggaatattaatttcagacga

SEQ ID NO: 33681 - DNA, 27 bp, Artificial sequence
  SiRNA target sequence
atatacggaatattaatttcagacgaa

SEQ ID NO: 33682 - DNA, 27 bp, Artificial sequence
  SiRNA target sequence
tatacggaatattaatttcagacgaaa

SEQ ID NO: 33683 - DNA, 27 bp, Artificial sequence
  SiRNA target sequence
atacggaatattaatttcagacgaaag

SEQ ID NO: 33684 - DNA, 27 bp, Artificial sequence
  SiRNA target sequence
tacggaatattaatttcagacgaaaga

SEQ ID NO: 33685 - DNA, 27 bp, Artificial sequence
  SiRNA target sequence
acggaatattaatttcagacgaaagat

SEQ ID NO: 33686 - DNA, 27 bp, Artificial sequence
  SiRNA target sequence
cggaatattaatttcagacgaaagatt

SEQ ID NO: 33687 - DNA, 27 bp, Artificial sequence
  SiRNA target sequence
ggaatattaatttcagacgaaagatta

SEQ ID NO: 33688 - DNA, 27 bp, Artificial sequence
  SiRNA target sequence
gaatattaatttcagacgaaagattag

SEQ ID NO: 33689 - DNA, 27 bp, Artificial sequence
  SiRNA target sequence
aatattaatttcagacgaaagattaga

SEQ ID NO: 33690 - DNA, 27 bp, Artificial sequence
  SiRNA target sequence
atattaatttcagacgaaagattagac

SEQ ID NO: 33691 - DNA, 27 bp, Artificial sequence
  SiRNA target sequence
tattaatttcagacgaaagattagacg

SEQ ID NO: 33692 - DNA, 27 bp, Artificial sequence
  SiRNA target sequence
attaatttcagacgaaagattagacga

SEQ ID NO: 33693 - DNA, 27 bp, Artificial sequence
  SiRNA target sequence
ttaatttcagacgaaagattagacgac

SEQ ID NO: 33694 - DNA, 27 bp, Artificial sequence
  SiRNA target sequence
taatttcagacgaaagattagacgaca

SEQ ID NO: 33695 - DNA, 27 bp, Artificial sequence
  SiRNA target sequence
aatttcagacgaaagattagacgacag

SEQ ID NO: 33696 - DNA, 27 bp, Artificial sequence
  SiRNA target sequence
atttcagacgaaagattagacgacagt

SEQ ID NO: 33697 - DNA, 27 bp, Artificial sequence
  SiRNA target sequence
tttcagacgaaagattagacgacagtt

SEQ ID NO: 33698 - DNA, 27 bp, Artificial sequence
  SiRNA target sequence
ttcagacgaaagattagacgacagttc

SEQ ID NO: 33699 - DNA, 27 bp, Artificial sequence
  SiRNA target sequence
tcagacgaaagattagacgacagttct

SEQ ID NO: 33700 - DNA, 27 bp, Artificial sequence
  SiRNA target sequence
cagacgaaagattagacgacagttctt

SEQ ID NO: 33701 - DNA, 27 bp, Artificial sequence
  SiRNA target sequence
agacgaaagattagacgacagttcttt

SEQ ID NO: 33702 - DNA, 27 bp, Artificial sequence
  SiRNA target sequence
gacgaaagattagacgacagttctttt

SEQ ID NO: 33703 - DNA, 27 bp, Artificial sequence
  SiRNA target sequence
acgaaagattagacgacagttcttttt

SEQ ID NO: 33704 - DNA, 27 bp, Artificial sequence
  SiRNA target sequence
cgaaagattagacgacagttctttttt

SEQ ID NO: 33705 - DNA, 27 bp, Artificial sequence
  SiRNA target sequence
gaaagattagacgacagttcttttttc

SEQ ID NO: 33706 - DNA, 27 bp, Artificial sequence
  SiRNA target sequence
aaagattagacgacagttcttttttca

SEQ ID NO: 33707 - DNA, 27 bp, Artificial sequence
  SiRNA target sequence
aagattagacgacagttcttttttcat

SEQ ID NO: 33708 - DNA, 27 bp, Artificial sequence
  SiRNA target sequence
agattagacgacagttcttttttcatt

SEQ ID NO: 33709 - DNA, 27 bp, Artificial sequence
  SiRNA target sequence
gattagacgacagttcttttttcattt

SEQ ID NO: 33710 - DNA, 27 bp, Artificial sequence
  SiRNA target sequence
attagacgacagttcttttttcatttt

SEQ ID NO: 33711 - DNA, 27 bp, Artificial sequence
  SiRNA target sequence
ttagacgacagttcttttttcattttt

SEQ ID NO: 33712 - DNA, 27 bp, Artificial sequence
  SiRNA target sequence
tagacgacagttcttttttcatttttt

SEQ ID NO: 33713 - DNA, 27 bp, Artificial sequence
  SiRNA target sequence
agacgacagttcttttttcattttttc

SEQ ID NO: 33714 - DNA, 27 bp, Artificial sequence
  SiRNA target sequence
gacgacagttcttttttcattttttcc

SEQ ID NO: 33715 - DNA, 27 bp, Artificial sequence
  SiRNA target sequence
acgacagttcttttttcattttttccg

SEQ ID NO: 33716 - DNA, 27 bp, Artificial sequence
  SiRNA target sequence
cgacagttcttttttcattttttccgc

SEQ ID NO: 33717 - DNA, 27 bp, Artificial sequence
  SiRNA target sequence
gacagttcttttttcattttttccgct

SEQ ID NO: 33718 - DNA, 27 bp, Artificial sequence
  SiRNA target sequence
acagttcttttttcattttttccgctg

SEQ ID NO: 33719 - DNA, 27 bp, Artificial sequence
  SiRNA target sequence
cagttcttttttcattttttccgctgc

SEQ ID NO: 33720 - DNA, 27 bp, Artificial sequence
  SiRNA target sequence
agttcttttttcattttttccgctgct

SEQ ID NO: 33721 - DNA, 27 bp, Artificial sequence
  SiRNA target sequence
gttcttttttcattttttccgctgctt

SEQ ID NO: 33722 - DNA, 27 bp, Artificial sequence
  SiRNA target sequence
ttcttttttcattttttccgctgcttc

SEQ ID NO: 33723 - DNA, 27 bp, Artificial sequence
  SiRNA target sequence
tcttttttcattttttccgctgcttct

SEQ ID NO: 33724 - DNA, 27 bp, Artificial sequence
  SiRNA target sequence
cttttttcattttttccgctgcttctt

SEQ ID NO: 33725 - DNA, 27 bp, Artificial sequence
  SiRNA target sequence
ttttttcattttttccgctgcttcttt

SEQ ID NO: 33726 - DNA, 27 bp, Artificial sequence
  SiRNA target sequence
tttttcattttttccgctgcttcttta

SEQ ID NO: 33727 - DNA, 27 bp, Artificial sequence
  SiRNA target sequence
ttttcattttttccgctgcttctttaa

SEQ ID NO: 33728 - DNA, 27 bp, Artificial sequence
  SiRNA target sequence
tttcattttttccgctgcttctttaat

SEQ ID NO: 33729 - DNA, 27 bp, Artificial sequence
  SiRNA target sequence
ttcattttttccgctgcttctttaatt

SEQ ID NO: 33730 - DNA, 27 bp, Artificial sequence
  SiRNA target sequence
tcattttttccgctgcttctttaattc

SEQ ID NO: 33731 - DNA, 27 bp, Artificial sequence
  SiRNA target sequence
cattttttccgctgcttctttaattct

SEQ ID NO: 33732 - DNA, 27 bp, Artificial sequence
  SiRNA target sequence
attttttccgctgcttctttaattcta

SEQ ID NO: 33733 - DNA, 27 bp, Artificial sequence
  SiRNA target sequence
ttttttccgctgcttctttaattctat

SEQ ID NO: 33734 - DNA, 27 bp, Artificial sequence
  SiRNA target sequence
tttttccgctgcttctttaattctatt

SEQ ID NO: 33735 - DNA, 27 bp, Artificial sequence
  SiRNA target sequence
ttttccgctgcttctttaattctatta

SEQ ID NO: 33736 - DNA, 27 bp, Artificial sequence
  SiRNA target sequence
tttccgctgcttctttaattctattat

SEQ ID NO: 33737 - DNA, 27 bp, Artificial sequence
  SiRNA target sequence
ttccgctgcttctttaattctattata

SEQ ID NO: 33738 - DNA, 27 bp, Artificial sequence
  SiRNA target sequence
tccgctgcttctttaattctattataa

SEQ ID NO: 33739 - DNA, 27 bp, Artificial sequence
  SiRNA target sequence
ccgctgcttctttaattctattataac

SEQ ID NO: 33740 - DNA, 27 bp, Artificial sequence
  SiRNA target sequence
cgctgcttctttaattctattataaca

SEQ ID NO: 33741 - DNA, 27 bp, Artificial sequence
  SiRNA target sequence
gctgcttctttaattctattataacaa

SEQ ID NO: 33742 - DNA, 27 bp, Artificial sequence
  SiRNA target sequence
ctgcttctttaattctattataacaag

SEQ ID NO: 33743 - DNA, 27 bp, Artificial sequence
  SiRNA target sequence
tgcttctttaattctattataacaaga

SEQ ID NO: 33744 - DNA, 27 bp, Artificial sequence
  SiRNA target sequence
gcttctttaattctattataacaagaa

SEQ ID NO: 33745 - DNA, 27 bp, Artificial sequence
  SiRNA target sequence
cttctttaattctattataacaagaat

SEQ ID NO: 33746 - DNA, 27 bp, Artificial sequence
  SiRNA target sequence
ttctttaattctattataacaagaatc

SEQ ID NO: 33747 - DNA, 27 bp, Artificial sequence
  SiRNA target sequence
tctttaattctattataacaagaatcg

SEQ ID NO: 33748 - DNA, 27 bp, Artificial sequence
  SiRNA target sequence
ctttaattctattataacaagaatcgt

SEQ ID NO: 33749 - DNA, 27 bp, Artificial sequence
  SiRNA target sequence
tttaattctattataacaagaatcgtg

SEQ ID NO: 33750 - DNA, 27 bp, Artificial sequence
  SiRNA target sequence
ttaattctattataacaagaatcgtgt

SEQ ID NO: 33751 - DNA, 27 bp, Artificial sequence
  SiRNA target sequence
taattctattataacaagaatcgtgtt

SEQ ID NO: 33752 - DNA, 27 bp, Artificial sequence
  SiRNA target sequence
aattctattataacaagaatcgtgttt

SEQ ID NO: 33753 - DNA, 27 bp, Artificial sequence
  SiRNA target sequence
attctattataacaagaatcgtgttta

SEQ ID NO: 33754 - DNA, 27 bp, Artificial sequence
  SiRNA target sequence
ttctattataacaagaatcgtgtttaa

SEQ ID NO: 33755 - DNA, 27 bp, Artificial sequence
  SiRNA target sequence
tctattataacaagaatcgtgtttaag

SEQ ID NO: 33756 - DNA, 27 bp, Artificial sequence
  SiRNA target sequence
ctattataacaagaatcgtgtttaagt

SEQ ID NO: 33757 - DNA, 27 bp, Artificial sequence
  SiRNA target sequence
tattataacaagaatcgtgtttaagta

SEQ ID NO: 33758 - DNA, 27 bp, Artificial sequence
  SiRNA target sequence
attataacaagaatcgtgtttaagtaa

SEQ ID NO: 33759 - DNA, 27 bp, Artificial sequence
  SiRNA target sequence
ttataacaagaatcgtgtttaagtaaa

SEQ ID NO: 33760 - DNA, 27 bp, Artificial sequence
  SiRNA target sequence
tataacaagaatcgtgtttaagtaaat

SEQ ID NO: 33761 - DNA, 27 bp, Artificial sequence
  SiRNA target sequence
ataacaagaatcgtgtttaagtaaatc

SEQ ID NO: 33762 - DNA, 27 bp, Artificial sequence
  SiRNA target sequence
taacaagaatcgtgtttaagtaaatca

SEQ ID NO: 33763 - DNA, 27 bp, Artificial sequence
  SiRNA target sequence
aacaagaatcgtgtttaagtaaatcaa

SEQ ID NO: 33764 - DNA, 27 bp, Artificial sequence
  SiRNA target sequence
acaagaatcgtgtttaagtaaatcaat

SEQ ID NO: 33765 - DNA, 27 bp, Artificial sequence
  SiRNA target sequence
caagaatcgtgtttaagtaaatcaatt

SEQ ID NO: 33766 - DNA, 27 bp, Artificial sequence
  SiRNA target sequence
aagaatcgtgtttaagtaaatcaattc

SEQ ID NO: 33767 - DNA, 27 bp, Artificial sequence
  SiRNA target sequence
agaatcgtgtttaagtaaatcaattcc

SEQ ID NO: 33768 - DNA, 27 bp, Artificial sequence
  SiRNA target sequence
gaatcgtgtttaagtaaatcaattcct

SEQ ID NO: 33769 - DNA, 27 bp, Artificial sequence
  SiRNA target sequence
aatcgtgtttaagtaaatcaattcctg

SEQ ID NO: 33770 - DNA, 27 bp, Artificial sequence
  SiRNA target sequence
atcgtgtttaagtaaatcaattcctgt

SEQ ID NO: 33771 - DNA, 27 bp, Artificial sequence
  SiRNA target sequence
tcgtgtttaagtaaatcaattcctgtt

SEQ ID NO: 33772 - DNA, 27 bp, Artificial sequence
  SiRNA target sequence
cgtgtttaagtaaatcaattcctgttc

SEQ ID NO: 33773 - DNA, 27 bp, Artificial sequence
  SiRNA target sequence
gtgtttaagtaaatcaattcctgttct

SEQ ID NO: 33774 - DNA, 27 bp, Artificial sequence
  SiRNA target sequence
tgtttaagtaaatcaattcctgttcta

SEQ ID NO: 33775 - DNA, 27 bp, Artificial sequence
  SiRNA target sequence
gtttaagtaaatcaattcctgttctac

SEQ ID NO: 33776 - DNA, 27 bp, Artificial sequence
  SiRNA target sequence
tttaagtaaatcaattcctgttctact

SEQ ID NO: 33777 - DNA, 27 bp, Artificial sequence
  SiRNA target sequence
ttaagtaaatcaattcctgttctactt

SEQ ID NO: 33778 - DNA, 27 bp, Artificial sequence
  SiRNA target sequence
taagtaaatcaattcctgttctacttt

SEQ ID NO: 33779 - DNA, 27 bp, Artificial sequence
  SiRNA target sequence
aagtaaatcaattcctgttctactttt

SEQ ID NO: 33780 - DNA, 27 bp, Artificial sequence
  SiRNA target sequence
agtaaatcaattcctgttctactttta

SEQ ID NO: 33781 - DNA, 27 bp, Artificial sequence
  SiRNA target sequence
gtaaatcaattcctgttctacttttaa

SEQ ID NO: 33782 - DNA, 27 bp, Artificial sequence
  SiRNA target sequence
taaatcaattcctgttctacttttaaa

SEQ ID NO: 33783 - DNA, 27 bp, Artificial sequence
  SiRNA target sequence
aaatcaattcctgttctacttttaaat

SEQ ID NO: 33784 - DNA, 27 bp, Artificial sequence
  SiRNA target sequence
aatcaattcctgttctacttttaaatt

SEQ ID NO: 33785 - DNA, 27 bp, Artificial sequence
  SiRNA target sequence
atcaattcctgttctacttttaaattt

SEQ ID NO: 33786 - DNA, 27 bp, Artificial sequence
  SiRNA target sequence
tcaattcctgttctacttttaaatttt

SEQ ID NO: 33787 - DNA, 27 bp, Artificial sequence
  SiRNA target sequence
caattcctgttctacttttaaattttt

SEQ ID NO: 33788 - DNA, 27 bp, Artificial sequence
  SiRNA target sequence
aattcctgttctacttttaaatttttc

SEQ ID NO: 33789 - DNA, 27 bp, Artificial sequence
  SiRNA target sequence
attcctgttctacttttaaatttttca

SEQ ID NO: 33790 - DNA, 27 bp, Artificial sequence
  SiRNA target sequence
ttcctgttctacttttaaatttttcat

SEQ ID NO: 33791 - DNA, 27 bp, Artificial sequence
  SiRNA target sequence
tcctgttctacttttaaatttttcatt

SEQ ID NO: 33792 - DNA, 27 bp, Artificial sequence
  SiRNA target sequence
cctgttctacttttaaatttttcatta

SEQ ID NO: 33793 - DNA, 27 bp, Artificial sequence
  SiRNA target sequence
ctgttctacttttaaatttttcattaa

SEQ ID NO: 33794 - DNA, 27 bp, Artificial sequence
  SiRNA target sequence
tgttctacttttaaatttttcattaat

SEQ ID NO: 33795 - DNA, 27 bp, Artificial sequence
  SiRNA target sequence
gttctacttttaaatttttcattaata

SEQ ID NO: 33796 - DNA, 27 bp, Artificial sequence
  SiRNA target sequence
ttctacttttaaatttttcattaatat

SEQ ID NO: 33797 - DNA, 27 bp, Artificial sequence
  SiRNA target sequence
tctacttttaaatttttcattaatata

SEQ ID NO: 33798 - DNA, 27 bp, Artificial sequence
  SiRNA target sequence
ctacttttaaatttttcattaatataa

SEQ ID NO: 33799 - DNA, 27 bp, Artificial sequence
  SiRNA target sequence
tacttttaaatttttcattaatataat

SEQ ID NO: 33800 - DNA, 27 bp, Artificial sequence
  SiRNA target sequence
acttttaaatttttcattaatataatc

SEQ ID NO: 33801 - DNA, 27 bp, Artificial sequence
  SiRNA target sequence
cttttaaatttttcattaatataatct

SEQ ID NO: 33802 - DNA, 27 bp, Artificial sequence
  SiRNA target sequence
ttttaaatttttcattaatataatcta

SEQ ID NO: 33803 - DNA, 27 bp, Artificial sequence
  SiRNA target sequence
tttaaatttttcattaatataatctac

SEQ ID NO: 33804 - DNA, 27 bp, Artificial sequence
  SiRNA target sequence
ttaaatttttcattaatataatctact

SEQ ID NO: 33805 - DNA, 27 bp, Artificial sequence
  SiRNA target sequence
taaatttttcattaatataatctacta

SEQ ID NO: 33806 - DNA, 27 bp, Artificial sequence
  SiRNA target sequence
aaatttttcattaatataatctactaa

SEQ ID NO: 33807 - DNA, 27 bp, Artificial sequence
  SiRNA target sequence
aatttttcattaatataatctactaaa

SEQ ID NO: 33808 - DNA, 27 bp, Artificial sequence
  SiRNA target sequence
atttttcattaatataatctactaaag

SEQ ID NO: 33809 - DNA, 27 bp, Artificial sequence
  SiRNA target sequence
tttttcattaatataatctactaaagt

SEQ ID NO: 33810 - DNA, 27 bp, Artificial sequence
  SiRNA target sequence
ttttcattaatataatctactaaagta

SEQ ID NO: 33811 - DNA, 27 bp, Artificial sequence
  SiRNA target sequence
tttcattaatataatctactaaagtat

SEQ ID NO: 33812 - DNA, 27 bp, Artificial sequence
  SiRNA target sequence
ttcattaatataatctactaaagtatt

SEQ ID NO: 33813 - DNA, 27 bp, Artificial sequence
  SiRNA target sequence
tcattaatataatctactaaagtatta

SEQ ID NO: 33814 - DNA, 27 bp, Artificial sequence
  SiRNA target sequence
cattaatataatctactaaagtattat

SEQ ID NO: 33815 - DNA, 27 bp, Artificial sequence
  SiRNA target sequence
attaatataatctactaaagtattatc

SEQ ID NO: 33816 - DNA, 27 bp, Artificial sequence
  SiRNA target sequence
ttaatataatctactaaagtattatcc

SEQ ID NO: 33817 - DNA, 27 bp, Artificial sequence
  SiRNA target sequence
taatataatctactaaagtattatcca

SEQ ID NO: 33818 - DNA, 27 bp, Artificial sequence
  SiRNA target sequence
aatataatctactaaagtattatccaa

SEQ ID NO: 33819 - DNA, 27 bp, Artificial sequence
  SiRNA target sequence
atataatctactaaagtattatccaaa

SEQ ID NO: 33820 - DNA, 27 bp, Artificial sequence
  SiRNA target sequence
tataatctactaaagtattatccaaat

SEQ ID NO: 33821 - DNA, 27 bp, Artificial sequence
  SiRNA target sequence
ataatctactaaagtattatccaaatc

SEQ ID NO: 33822 - DNA, 27 bp, Artificial sequence
  SiRNA target sequence
taatctactaaagtattatccaaatct

SEQ ID NO: 33823 - DNA, 27 bp, Artificial sequence
  SiRNA target sequence
aatctactaaagtattatccaaatctt

SEQ ID NO: 33824 - DNA, 27 bp, Artificial sequence
  SiRNA target sequence
atctactaaagtattatccaaatcttc

SEQ ID NO: 33825 - DNA, 27 bp, Artificial sequence
  SiRNA target sequence
tctactaaagtattatccaaatcttct

SEQ ID NO: 33826 - DNA, 27 bp, Artificial sequence
  SiRNA target sequence
ctactaaagtattatccaaatcttctc

SEQ ID NO: 33827 - DNA, 27 bp, Artificial sequence
  SiRNA target sequence
tactaaagtattatccaaatcttctcc

SEQ ID NO: 33828 - DNA, 27 bp, Artificial sequence
  SiRNA target sequence
actaaagtattatccaaatcttctcct

SEQ ID NO: 33829 - DNA, 27 bp, Artificial sequence
  SiRNA target sequence
ctaaagtattatccaaatcttctcctc

SEQ ID NO: 33830 - DNA, 27 bp, Artificial sequence
  SiRNA target sequence
taaagtattatccaaatcttctcctcc

SEQ ID NO: 33831 - DNA, 27 bp, Artificial sequence
  SiRNA target sequence
aaagtattatccaaatcttctcctcct

SEQ ID NO: 33832 - DNA, 27 bp, Artificial sequence
  SiRNA target sequence
aagtattatccaaatcttctcctccta

SEQ ID NO: 33833 - DNA, 27 bp, Artificial sequence
  SiRNA target sequence
agtattatccaaatcttctcctcctaa

SEQ ID NO: 33834 - DNA, 27 bp, Artificial sequence
  SiRNA target sequence
gtattatccaaatcttctcctcctaaa

SEQ ID NO: 33835 - DNA, 27 bp, Artificial sequence
  SiRNA target sequence
tattatccaaatcttctcctcctaaaa

SEQ ID NO: 33836 - DNA, 27 bp, Artificial sequence
  SiRNA target sequence
attatccaaatcttctcctcctaaaaa

SEQ ID NO: 33837 - DNA, 27 bp, Artificial sequence
  SiRNA target sequence
ttatccaaatcttctcctcctaaaaaa

SEQ ID NO: 33838 - DNA, 27 bp, Artificial sequence
  SiRNA target sequence
tatccaaatcttctcctcctaaaaaag

SEQ ID NO: 33839 - DNA, 27 bp, Artificial sequence
  SiRNA target sequence
atccaaatcttctcctcctaaaaaagt

SEQ ID NO: 33840 - DNA, 27 bp, Artificial sequence
  SiRNA target sequence
tccaaatcttctcctcctaaaaaagta

SEQ ID NO: 33841 - DNA, 27 bp, Artificial sequence
  SiRNA target sequence
ccaaatcttctcctcctaaaaaagtat

SEQ ID NO: 33842 - DNA, 27 bp, Artificial sequence
  SiRNA target sequence
caaatcttctcctcctaaaaaagtatt

SEQ ID NO: 33843 - DNA, 27 bp, Artificial sequence
  SiRNA target sequence
aaatcttctcctcctaaaaaagtattt

SEQ ID NO: 33844 - DNA, 27 bp, Artificial sequence
  SiRNA target sequence
aatcttctcctcctaaaaaagtatttc

SEQ ID NO: 33845 - DNA, 27 bp, Artificial sequence
  SiRNA target sequence
atcttctcctcctaaaaaagtatttcc

SEQ ID NO: 33846 - DNA, 27 bp, Artificial sequence
  SiRNA target sequence
tcttctcctcctaaaaaagtatttccg

SEQ ID NO: 33847 - DNA, 27 bp, Artificial sequence
  SiRNA target sequence
cttctcctcctaaaaaagtatttccgt

SEQ ID NO: 33848 - DNA, 27 bp, Artificial sequence
  SiRNA target sequence
ttctcctcctaaaaaagtatttccgtt

SEQ ID NO: 33849 - DNA, 27 bp, Artificial sequence
  SiRNA target sequence
tctcctcctaaaaaagtatttccgtta

SEQ ID NO: 33850 - DNA, 27 bp, Artificial sequence
  SiRNA target sequence
ctcctcctaaaaaagtatttccgttag

SEQ ID NO: 33851 - DNA, 27 bp, Artificial sequence
  SiRNA target sequence
tcctcctaaaaaagtatttccgttagt

SEQ ID NO: 33852 - DNA, 27 bp, Artificial sequence
  SiRNA target sequence
cctcctaaaaaagtatttccgttagta

SEQ ID NO: 33853 - DNA, 27 bp, Artificial sequence
  SiRNA target sequence
ctcctaaaaaagtatttccgttagtag

SEQ ID NO: 33854 - DNA, 27 bp, Artificial sequence
  SiRNA target sequence
tcctaaaaaagtatttccgttagtaga

SEQ ID NO: 33855 - DNA, 27 bp, Artificial sequence
  SiRNA target sequence
cctaaaaaagtatttccgttagtagat

SEQ ID NO: 33856 - DNA, 27 bp, Artificial sequence
  SiRNA target sequence
ctaaaaaagtatttccgttagtagatt

SEQ ID NO: 33857 - DNA, 27 bp, Artificial sequence
  SiRNA target sequence
taaaaaagtatttccgttagtagattt

SEQ ID NO: 33858 - DNA, 27 bp, Artificial sequence
  SiRNA target sequence
aaaaaagtatttccgttagtagatttt

SEQ ID NO: 33859 - DNA, 27 bp, Artificial sequence
  SiRNA target sequence
aaaaagtatttccgttagtagatttta

SEQ ID NO: 33860 - DNA, 27 bp, Artificial sequence
  SiRNA target sequence
aaaagtatttccgttagtagattttac

SEQ ID NO: 33861 - DNA, 27 bp, Artificial sequence
  SiRNA target sequence
aaagtatttccgttagtagattttaca

SEQ ID NO: 33862 - DNA, 27 bp, Artificial sequence
  SiRNA target sequence
aagtatttccgttagtagattttacat

SEQ ID NO: 33863 - DNA, 27 bp, Artificial sequence
  SiRNA target sequence
agtatttccgttagtagattttacatg

SEQ ID NO: 33864 - DNA, 27 bp, Artificial sequence
  SiRNA target sequence
gtatttccgttagtagattttacatga

SEQ ID NO: 33865 - DNA, 27 bp, Artificial sequence
  SiRNA target sequence
tatttccgttagtagattttacatgaa

SEQ ID NO: 33866 - DNA, 27 bp, Artificial sequence
  SiRNA target sequence
atttccgttagtagattttacatgaaa

SEQ ID NO: 33867 - DNA, 27 bp, Artificial sequence
  SiRNA target sequence
tttccgttagtagattttacatgaaaa

SEQ ID NO: 33868 - DNA, 27 bp, Artificial sequence
  SiRNA target sequence
ttccgttagtagattttacatgaaaaa

SEQ ID NO: 33869 - DNA, 27 bp, Artificial sequence
  SiRNA target sequence
tccgttagtagattttacatgaaaaat

SEQ ID NO: 33870 - DNA, 27 bp, Artificial sequence
  SiRNA target sequence
ccgttagtagattttacatgaaaaata

SEQ ID NO: 33871 - DNA, 27 bp, Artificial sequence
  SiRNA target sequence
cgttagtagattttacatgaaaaatac

SEQ ID NO: 33872 - DNA, 27 bp, Artificial sequence
  SiRNA target sequence
gttagtagattttacatgaaaaatacc

SEQ ID NO: 33873 - DNA, 27 bp, Artificial sequence
  SiRNA target sequence
ttagtagattttacatgaaaaatacca

SEQ ID NO: 33874 - DNA, 27 bp, Artificial sequence
  SiRNA target sequence
tagtagattttacatgaaaaataccat

SEQ ID NO: 33875 - DNA, 27 bp, Artificial sequence
  SiRNA target sequence
agtagattttacatgaaaaataccatt

SEQ ID NO: 33876 - DNA, 27 bp, Artificial sequence
  SiRNA target sequence
gtagattttacatgaaaaataccatta

SEQ ID NO: 33877 - DNA, 27 bp, Artificial sequence
  SiRNA target sequence
tagattttacatgaaaaataccattat

SEQ ID NO: 33878 - DNA, 27 bp, Artificial sequence
  SiRNA target sequence
agattttacatgaaaaataccattatc

SEQ ID NO: 33879 - DNA, 27 bp, Artificial sequence
  SiRNA target sequence
gattttacatgaaaaataccattatct

SEQ ID NO: 33880 - DNA, 27 bp, Artificial sequence
  SiRNA target sequence
attttacatgaaaaataccattatcta

SEQ ID NO: 33881 - DNA, 27 bp, Artificial sequence
  SiRNA target sequence
ttttacatgaaaaataccattatctaa

SEQ ID NO: 33882 - DNA, 27 bp, Artificial sequence
  SiRNA target sequence
tttacatgaaaaataccattatctaat

SEQ ID NO: 33883 - DNA, 27 bp, Artificial sequence
  SiRNA target sequence
ttacatgaaaaataccattatctaatt

SEQ ID NO: 33884 - DNA, 27 bp, Artificial sequence
  SiRNA target sequence
tacatgaaaaataccattatctaattc

SEQ ID NO: 33885 - DNA, 27 bp, Artificial sequence
  SiRNA target sequence
acatgaaaaataccattatctaattct

SEQ ID NO: 33886 - DNA, 27 bp, Artificial sequence
  SiRNA target sequence
catgaaaaataccattatctaattcta

SEQ ID NO: 33887 - DNA, 27 bp, Artificial sequence
  SiRNA target sequence
atgaaaaataccattatctaattctaa

SEQ ID NO: 33888 - DNA, 27 bp, Artificial sequence
  SiRNA target sequence
tgaaaaataccattatctaattctaat

SEQ ID NO: 33889 - DNA, 27 bp, Artificial sequence
  SiRNA target sequence
gaaaaataccattatctaattctaata

SEQ ID NO: 33890 - DNA, 27 bp, Artificial sequence
  SiRNA target sequence
aaaaataccattatctaattctaatat

SEQ ID NO: 33891 - DNA, 27 bp, Artificial sequence
  SiRNA target sequence
aaaataccattatctaattctaatata

SEQ ID NO: 33892 - DNA, 27 bp, Artificial sequence
  SiRNA target sequence
aaataccattatctaattctaatatac

SEQ ID NO: 33893 - DNA, 27 bp, Artificial sequence
  SiRNA target sequence
aataccattatctaattctaatatact

SEQ ID NO: 33894 - DNA, 27 bp, Artificial sequence
  SiRNA target sequence
ataccattatctaattctaatatacta

SEQ ID NO: 33895 - DNA, 27 bp, Artificial sequence
  SiRNA target sequence
taccattatctaattctaatatactaa

SEQ ID NO: 33896 - DNA, 27 bp, Artificial sequence
  SiRNA target sequence
accattatctaattctaatatactaat

SEQ ID NO: 33897 - DNA, 27 bp, Artificial sequence
  SiRNA target sequence
ccattatctaattctaatatactaatg

SEQ ID NO: 33898 - DNA, 27 bp, Artificial sequence
  SiRNA target sequence
cattatctaattctaatatactaatgt

SEQ ID NO: 33899 - DNA, 27 bp, Artificial sequence
  SiRNA target sequence
attatctaattctaatatactaatgtc

SEQ ID NO: 33900 - DNA, 27 bp, Artificial sequence
  SiRNA target sequence
ttatctaattctaatatactaatgtca

SEQ ID NO: 33901 - DNA, 27 bp, Artificial sequence
  SiRNA target sequence
tatctaattctaatatactaatgtcaa

SEQ ID NO: 33902 - DNA, 27 bp, Artificial sequence
  SiRNA target sequence
atctaattctaatatactaatgtcaaa

SEQ ID NO: 33903 - DNA, 27 bp, Artificial sequence
  SiRNA target sequence
tctaattctaatatactaatgtcaaaa

SEQ ID NO: 33904 - DNA, 27 bp, Artificial sequence
  SiRNA target sequence
ctaattctaatatactaatgtcaaaag

SEQ ID NO: 33905 - DNA, 27 bp, Artificial sequence
  SiRNA target sequence
taattctaatatactaatgtcaaaagt

SEQ ID NO: 33906 - DNA, 27 bp, Artificial sequence
  SiRNA target sequence
aattctaatatactaatgtcaaaagtt

SEQ ID NO: 33907 - DNA, 27 bp, Artificial sequence
  SiRNA target sequence
attctaatatactaatgtcaaaagttc

SEQ ID NO: 33908 - DNA, 27 bp, Artificial sequence
  SiRNA target sequence
ttctaatatactaatgtcaaaagttcc

SEQ ID NO: 33909 - DNA, 27 bp, Artificial sequence
  SiRNA target sequence
tctaatatactaatgtcaaaagttcct

SEQ ID NO: 33910 - DNA, 27 bp, Artificial sequence
  SiRNA target sequence
ctaatatactaatgtcaaaagttcctc

SEQ ID NO: 33911 - DNA, 27 bp, Artificial sequence
  SiRNA target sequence
taatatactaatgtcaaaagttcctcc

SEQ ID NO: 33912 - DNA, 27 bp, Artificial sequence
  SiRNA target sequence
aatatactaatgtcaaaagttcctcct

SEQ ID NO: 33913 - DNA, 27 bp, Artificial sequence
  SiRNA target sequence
atatactaatgtcaaaagttcctcctc

SEQ ID NO: 33914 - DNA, 27 bp, Artificial sequence
  SiRNA target sequence
tatactaatgtcaaaagttcctcctcc

SEQ ID NO: 33915 - DNA, 27 bp, Artificial sequence
  SiRNA target sequence
atactaatgtcaaaagttcctcctccc

SEQ ID NO: 33916 - DNA, 27 bp, Artificial sequence
  SiRNA target sequence
tactaatgtcaaaagttcctcctccca

SEQ ID NO: 33917 - DNA, 27 bp, Artificial sequence
  SiRNA target sequence
actaatgtcaaaagttcctcctcccag

SEQ ID NO: 33918 - DNA, 27 bp, Artificial sequence
  SiRNA target sequence
ctaatgtcaaaagttcctcctcccaga

SEQ ID NO: 33919 - DNA, 27 bp, Artificial sequence
  SiRNA target sequence
taatgtcaaaagttcctcctcccagat

SEQ ID NO: 33920 - DNA, 27 bp, Artificial sequence
  SiRNA target sequence
aatgtcaaaagttcctcctcccagatc

SEQ ID NO: 33921 - DNA, 27 bp, Artificial sequence
  SiRNA target sequence
atgtcaaaagttcctcctcccagatca

SEQ ID NO: 33922 - DNA, 27 bp, Artificial sequence
  SiRNA target sequence
tgtcaaaagttcctcctcccagatcat

SEQ ID NO: 33923 - DNA, 27 bp, Artificial sequence
  SiRNA target sequence
gtcaaaagttcctcctcccagatcata

SEQ ID NO: 33924 - DNA, 27 bp, Artificial sequence
  SiRNA target sequence
tcaaaagttcctcctcccagatcataa

SEQ ID NO: 33925 - DNA, 27 bp, Artificial sequence
  SiRNA target sequence
caaaagttcctcctcccagatcataaa

SEQ ID NO: 33926 - DNA, 27 bp, Artificial sequence
  SiRNA target sequence
aaaagttcctcctcccagatcataaac

SEQ ID NO: 33927 - DNA, 27 bp, Artificial sequence
  SiRNA target sequence
aaagttcctcctcccagatcataaaca

SEQ ID NO: 33928 - DNA, 27 bp, Artificial sequence
  SiRNA target sequence
aagttcctcctcccagatcataaacag

SEQ ID NO: 33929 - DNA, 27 bp, Artificial sequence
  SiRNA target sequence
agttcctcctcccagatcataaacagc

SEQ ID NO: 33930 - DNA, 27 bp, Artificial sequence
  SiRNA target sequence
gttcctcctcccagatcataaacagct

SEQ ID NO: 33931 - DNA, 27 bp, Artificial sequence
  SiRNA target sequence
ttcctcctcccagatcataaacagcta

SEQ ID NO: 33932 - DNA, 27 bp, Artificial sequence
  SiRNA target sequence
tcctcctcccagatcataaacagctat

SEQ ID NO: 33933 - DNA, 27 bp, Artificial sequence
  SiRNA target sequence
cctcctcccagatcataaacagctata

SEQ ID NO: 33934 - DNA, 27 bp, Artificial sequence
  SiRNA target sequence
ctcctcccagatcataaacagctataa

SEQ ID NO: 33935 - DNA, 27 bp, Artificial sequence
  SiRNA target sequence
tcctcccagatcataaacagctataat

SEQ ID NO: 33936 - DNA, 27 bp, Artificial sequence
  SiRNA target sequence
cctcccagatcataaacagctataata

SEQ ID NO: 33937 - DNA, 27 bp, Artificial sequence
  SiRNA target sequence
ctcccagatcataaacagctataatac

SEQ ID NO: 33938 - DNA, 27 bp, Artificial sequence
  SiRNA target sequence
tcccagatcataaacagctataatacc

SEQ ID NO: 33939 - DNA, 27 bp, Artificial sequence
  SiRNA target sequence
cccagatcataaacagctataataccc

SEQ ID NO: 33940 - DNA, 27 bp, Artificial sequence
  SiRNA target sequence
ccagatcataaacagctataataccct

SEQ ID NO: 33941 - DNA, 27 bp, Artificial sequence
  SiRNA target sequence
cagatcataaacagctataataccctg

SEQ ID NO: 33942 - DNA, 27 bp, Artificial sequence
  SiRNA target sequence
agatcataaacagctataataccctgt

SEQ ID NO: 33943 - DNA, 27 bp, Artificial sequence
  SiRNA target sequence
gatcataaacagctataataccctgtg

SEQ ID NO: 33944 - DNA, 27 bp, Artificial sequence
  SiRNA target sequence
atcataaacagctataataccctgtgc

SEQ ID NO: 33945 - DNA, 27 bp, Artificial sequence
  SiRNA target sequence
tcataaacagctataataccctgtgca

SEQ ID NO: 33946 - DNA, 27 bp, Artificial sequence
  SiRNA target sequence
cataaacagctataataccctgtgcag

SEQ ID NO: 33947 - DNA, 27 bp, Artificial sequence
  SiRNA target sequence
ataaacagctataataccctgtgcaga

SEQ ID NO: 33948 - DNA, 27 bp, Artificial sequence
  SiRNA target sequence
taaacagctataataccctgtgcagac

SEQ ID NO: 33949 - DNA, 27 bp, Artificial sequence
  SiRNA target sequence
aaacagctataataccctgtgcagact

SEQ ID NO: 33950 - DNA, 27 bp, Artificial sequence
  SiRNA target sequence
aacagctataataccctgtgcagactt

SEQ ID NO: 33951 - DNA, 27 bp, Artificial sequence
  SiRNA target sequence
acagctataataccctgtgcagacttg

SEQ ID NO: 33952 - DNA, 27 bp, Artificial sequence
  SiRNA target sequence
cagctataataccctgtgcagacttgt

SEQ ID NO: 33953 - DNA, 27 bp, Artificial sequence
  SiRNA target sequence
agctataataccctgtgcagacttgtc

SEQ ID NO: 33954 - DNA, 27 bp, Artificial sequence
  SiRNA target sequence
gctataataccctgtgcagacttgtca

SEQ ID NO: 33955 - DNA, 27 bp, Artificial sequence
  SiRNA target sequence
ctataataccctgtgcagacttgtcaa

SEQ ID NO: 33956 - DNA, 27 bp, Artificial sequence
  SiRNA target sequence
tataataccctgtgcagacttgtcaag

SEQ ID NO: 33957 - DNA, 27 bp, Artificial sequence
  SiRNA target sequence
ataataccctgtgcagacttgtcaagc

SEQ ID NO: 33958 - DNA, 27 bp, Artificial sequence
  SiRNA target sequence
taataccctgtgcagacttgtcaagcc

SEQ ID NO: 33959 - DNA, 27 bp, Artificial sequence
  SiRNA target sequence
aataccctgtgcagacttgtcaagccc

SEQ ID NO: 33960 - DNA, 27 bp, Artificial sequence
  SiRNA target sequence
ataccctgtgcagacttgtcaagccca

SEQ ID NO: 33961 - DNA, 27 bp, Artificial sequence
  SiRNA target sequence
taccctgtgcagacttgtcaagcccat

SEQ ID NO: 33962 - DNA, 27 bp, Artificial sequence
  SiRNA target sequence
accctgtgcagacttgtcaagcccata

SEQ ID NO: 33963 - DNA, 27 bp, Artificial sequence
  SiRNA target sequence
ccctgtgcagacttgtcaagcccataa

SEQ ID NO: 33964 - DNA, 27 bp, Artificial sequence
  SiRNA target sequence
cctgtgcagacttgtcaagcccataag

SEQ ID NO: 33965 - DNA, 27 bp, Artificial sequence
  SiRNA target sequence
ctgtgcagacttgtcaagcccataagc

SEQ ID NO: 33966 - DNA, 27 bp, Artificial sequence
  SiRNA target sequence
tgtgcagacttgtcaagcccataagca

SEQ ID NO: 33967 - DNA, 27 bp, Artificial sequence
  SiRNA target sequence
gtgcagacttgtcaagcccataagcaa

SEQ ID NO: 33968 - DNA, 27 bp, Artificial sequence
  SiRNA target sequence
tgcagacttgtcaagcccataagcaag

SEQ ID NO: 33969 - DNA, 27 bp, Artificial sequence
  SiRNA target sequence
gcagacttgtcaagcccataagcaagt

SEQ ID NO: 33970 - DNA, 27 bp, Artificial sequence
  SiRNA target sequence
cagacttgtcaagcccataagcaagtg

SEQ ID NO: 33971 - DNA, 27 bp, Artificial sequence
  SiRNA target sequence
agacttgtcaagcccataagcaagtgc

SEQ ID NO: 33972 - DNA, 27 bp, Artificial sequence
  SiRNA target sequence
gacttgtcaagcccataagcaagtgct

SEQ ID NO: 33973 - DNA, 27 bp, Artificial sequence
  SiRNA target sequence
acttgtcaagcccataagcaagtgctg

SEQ ID NO: 33974 - DNA, 27 bp, Artificial sequence
  SiRNA target sequence
cttgtcaagcccataagcaagtgctgc

SEQ ID NO: 33975 - DNA, 27 bp, Artificial sequence
  SiRNA target sequence
ttgtcaagcccataagcaagtgctgcc

SEQ ID NO: 33976 - DNA, 27 bp, Artificial sequence
  SiRNA target sequence
tgtcaagcccataagcaagtgctgccg

SEQ ID NO: 33977 - DNA, 27 bp, Artificial sequence
  SiRNA target sequence
gtcaagcccataagcaagtgctgccgc

SEQ ID NO: 33978 - DNA, 27 bp, Artificial sequence
  SiRNA target sequence
tcaagcccataagcaagtgctgccgca

SEQ ID NO: 33979 - DNA, 27 bp, Artificial sequence
  SiRNA target sequence
caagcccataagcaagtgctgccgcag

SEQ ID NO: 33980 - DNA, 27 bp, Artificial sequence
  SiRNA target sequence
aagcccataagcaagtgctgccgcagt

SEQ ID NO: 33981 - DNA, 27 bp, Artificial sequence
  SiRNA target sequence
agcccataagcaagtgctgccgcagta

SEQ ID NO: 33982 - DNA, 27 bp, Artificial sequence
  SiRNA target sequence
gcccataagcaagtgctgccgcagtag

SEQ ID NO: 33983 - DNA, 27 bp, Artificial sequence
  SiRNA target sequence
cccataagcaagtgctgccgcagtagg

SEQ ID NO: 33984 - DNA, 27 bp, Artificial sequence
  SiRNA target sequence
ccataagcaagtgctgccgcagtaggc

SEQ ID NO: 33985 - DNA, 27 bp, Artificial sequence
  SiRNA target sequence
cataagcaagtgctgccgcagtaggct

SEQ ID NO: 33986 - DNA, 27 bp, Artificial sequence
  SiRNA target sequence
ataagcaagtgctgccgcagtaggctc

SEQ ID NO: 33987 - DNA, 27 bp, Artificial sequence
  SiRNA target sequence
taagcaagtgctgccgcagtaggctca

SEQ ID NO: 33988 - DNA, 27 bp, Artificial sequence
  SiRNA target sequence
aagcaagtgctgccgcagtaggctcat

SEQ ID NO: 33989 - DNA, 27 bp, Artificial sequence
  SiRNA target sequence
agcaagtgctgccgcagtaggctcatt

SEQ ID NO: 33990 - DNA, 27 bp, Artificial sequence
  SiRNA target sequence
gcaagtgctgccgcagtaggctcatta

SEQ ID NO: 33991 - DNA, 27 bp, Artificial sequence
  SiRNA target sequence
caagtgctgccgcagtaggctcattaa

SEQ ID NO: 33992 - DNA, 27 bp, Artificial sequence
  SiRNA target sequence
aagtgctgccgcagtaggctcattaat

SEQ ID NO: 33993 - DNA, 27 bp, Artificial sequence
  SiRNA target sequence
agtgctgccgcagtaggctcattaatc

SEQ ID NO: 33994 - DNA, 27 bp, Artificial sequence
  SiRNA target sequence
gtgctgccgcagtaggctcattaatca

SEQ ID NO: 33995 - DNA, 27 bp, Artificial sequence
  SiRNA target sequence
tgctgccgcagtaggctcattaatcac

SEQ ID NO: 33996 - DNA, 27 bp, Artificial sequence
  SiRNA target sequence
gctgccgcagtaggctcattaatcact

SEQ ID NO: 33997 - DNA, 27 bp, Artificial sequence
  SiRNA target sequence
ctgccgcagtaggctcattaatcactc

SEQ ID NO: 33998 - DNA, 27 bp, Artificial sequence
  SiRNA target sequence
tgccgcagtaggctcattaatcactct

SEQ ID NO: 33999 - DNA, 27 bp, Artificial sequence
  SiRNA target sequence
gccgcagtaggctcattaatcactcta

SEQ ID NO: 34000 - DNA, 27 bp, Artificial sequence
  SiRNA target sequence
ccgcagtaggctcattaatcactctaa

SEQ ID NO: 34001 - DNA, 27 bp, Artificial sequence
  SiRNA target sequence
cgcagtaggctcattaatcactctaag

SEQ ID NO: 34002 - DNA, 27 bp, Artificial sequence
  SiRNA target sequence
gcagtaggctcattaatcactctaagc

SEQ ID NO: 34003 - DNA, 27 bp, Artificial sequence
  SiRNA target sequence
cagtaggctcattaatcactctaagca

SEQ ID NO: 34004 - DNA, 27 bp, Artificial sequence
  SiRNA target sequence
agtaggctcattaatcactctaagcac

SEQ ID NO: 34005 - DNA, 27 bp, Artificial sequence
  SiRNA target sequence
gtaggctcattaatcactctaagcact

SEQ ID NO: 34006 - DNA, 27 bp, Artificial sequence
  SiRNA target sequence
taggctcattaatcactctaagcactt

SEQ ID NO: 34007 - DNA, 27 bp, Artificial sequence
  SiRNA target sequence
aggctcattaatcactctaagcacttg

SEQ ID NO: 34008 - DNA, 27 bp, Artificial sequence
  SiRNA target sequence
ggctcattaatcactctaagcacttgt

SEQ ID NO: 34009 - DNA, 27 bp, Artificial sequence
  SiRNA target sequence
gctcattaatcactctaagcacttgta

SEQ ID NO: 34010 - DNA, 27 bp, Artificial sequence
  SiRNA target sequence
ctcattaatcactctaagcacttgtaa

SEQ ID NO: 34011 - DNA, 27 bp, Artificial sequence
  SiRNA target sequence
tcattaatcactctaagcacttgtaat

SEQ ID NO: 34012 - DNA, 27 bp, Artificial sequence
  SiRNA target sequence
cattaatcactctaagcacttgtaatc

SEQ ID NO: 34013 - DNA, 27 bp, Artificial sequence
  SiRNA target sequence
attaatcactctaagcacttgtaatcc

SEQ ID NO: 34014 - DNA, 27 bp, Artificial sequence
  SiRNA target sequence
ttaatcactctaagcacttgtaatccc

SEQ ID NO: 34015 - DNA, 27 bp, Artificial sequence
  SiRNA target sequence
taatcactctaagcacttgtaatcccg

SEQ ID NO: 34016 - DNA, 27 bp, Artificial sequence
  SiRNA target sequence
aatcactctaagcacttgtaatcccgc

SEQ ID NO: 34017 - DNA, 27 bp, Artificial sequence
  SiRNA target sequence
atcactctaagcacttgtaatcccgca

SEQ ID NO: 34018 - DNA, 27 bp, Artificial sequence
  SiRNA target sequence
tcactctaagcacttgtaatcccgcaa

SEQ ID NO: 34019 - DNA, 27 bp, Artificial sequence
  SiRNA target sequence
cactctaagcacttgtaatcccgcaat

SEQ ID NO: 34020 - DNA, 27 bp, Artificial sequence
  SiRNA target sequence
actctaagcacttgtaatcccgcaatc

SEQ ID NO: 34021 - DNA, 27 bp, Artificial sequence
  SiRNA target sequence
ctctaagcacttgtaatcccgcaatcc

SEQ ID NO: 34022 - DNA, 27 bp, Artificial sequence
  SiRNA target sequence
tctaagcacttgtaatcccgcaatcct

SEQ ID NO: 34023 - DNA, 27 bp, Artificial sequence
  SiRNA target sequence
ctaagcacttgtaatcccgcaatcctt

SEQ ID NO: 34024 - DNA, 27 bp, Artificial sequence
  SiRNA target sequence
taagcacttgtaatcccgcaatccttc

SEQ ID NO: 34025 - DNA, 27 bp, Artificial sequence
  SiRNA target sequence
aagcacttgtaatcccgcaatccttcc

SEQ ID NO: 34026 - DNA, 27 bp, Artificial sequence
  SiRNA target sequence
agcacttgtaatcccgcaatccttccc

SEQ ID NO: 34027 - DNA, 27 bp, Artificial sequence
  SiRNA target sequence
gcacttgtaatcccgcaatccttcccg

SEQ ID NO: 34028 - DNA, 27 bp, Artificial sequence
  SiRNA target sequence
cacttgtaatcccgcaatccttcccgc

SEQ ID NO: 34029 - DNA, 27 bp, Artificial sequence
  SiRNA target sequence
acttgtaatcccgcaatccttcccgca

SEQ ID NO: 34030 - DNA, 27 bp, Artificial sequence
  SiRNA target sequence
cttgtaatcccgcaatccttcccgcat

SEQ ID NO: 34031 - DNA, 27 bp, Artificial sequence
  SiRNA target sequence
ttgtaatcccgcaatccttcccgcatc

SEQ ID NO: 34032 - DNA, 27 bp, Artificial sequence
  SiRNA target sequence
tgtaatcccgcaatccttcccgcatct

SEQ ID NO: 34033 - DNA, 27 bp, Artificial sequence
  SiRNA target sequence
gtaatcccgcaatccttcccgcatctt

SEQ ID NO: 34034 - DNA, 27 bp, Artificial sequence
  SiRNA target sequence
taatcccgcaatccttcccgcatcttt

SEQ ID NO: 34035 - DNA, 27 bp, Artificial sequence
  SiRNA target sequence
aatcccgcaatccttcccgcatcttta

SEQ ID NO: 34036 - DNA, 27 bp, Artificial sequence
  SiRNA target sequence
atcccgcaatccttcccgcatctttag

SEQ ID NO: 34037 - DNA, 27 bp, Artificial sequence
  SiRNA target sequence
tcccgcaatccttcccgcatctttagt

SEQ ID NO: 34038 - DNA, 27 bp, Artificial sequence
  SiRNA target sequence
cccgcaatccttcccgcatctttagta

SEQ ID NO: 34039 - DNA, 27 bp, Artificial sequence
  SiRNA target sequence
ccgcaatccttcccgcatctttagtag

SEQ ID NO: 34040 - DNA, 27 bp, Artificial sequence
  SiRNA target sequence
cgcaatccttcccgcatctttagtagc

SEQ ID NO: 34041 - DNA, 27 bp, Artificial sequence
  SiRNA target sequence
gcaatccttcccgcatctttagtagct

SEQ ID NO: 34042 - DNA, 27 bp, Artificial sequence
  SiRNA target sequence
caatccttcccgcatctttagtagctt

SEQ ID NO: 34043 - DNA, 27 bp, Artificial sequence
  SiRNA target sequence
aatccttcccgcatctttagtagcttg

SEQ ID NO: 34044 - DNA, 27 bp, Artificial sequence
  SiRNA target sequence
atccttcccgcatctttagtagcttgc

SEQ ID NO: 34045 - DNA, 27 bp, Artificial sequence
  SiRNA target sequence
tccttcccgcatctttagtagcttgcc

SEQ ID NO: 34046 - DNA, 27 bp, Artificial sequence
  SiRNA target sequence
ccttcccgcatctttagtagcttgcct

SEQ ID NO: 34047 - DNA, 27 bp, Artificial sequence
  SiRNA target sequence
cttcccgcatctttagtagcttgcctt

SEQ ID NO: 34048 - DNA, 27 bp, Artificial sequence
  SiRNA target sequence
ttcccgcatctttagtagcttgccttt

SEQ ID NO: 34049 - DNA, 27 bp, Artificial sequence
  SiRNA target sequence
tcccgcatctttagtagcttgcctttg

SEQ ID NO: 34050 - DNA, 27 bp, Artificial sequence
  SiRNA target sequence
cccgcatctttagtagcttgcctttgc

SEQ ID NO: 34051 - DNA, 27 bp, Artificial sequence
  SiRNA target sequence
ccgcatctttagtagcttgcctttgca

SEQ ID NO: 34052 - DNA, 27 bp, Artificial sequence
  SiRNA target sequence
cgcatctttagtagcttgcctttgcat

SEQ ID NO: 34053 - DNA, 27 bp, Artificial sequence
  SiRNA target sequence
gcatctttagtagcttgcctttgcatg

SEQ ID NO: 34054 - DNA, 27 bp, Artificial sequence
  SiRNA target sequence
catctttagtagcttgcctttgcatgt

SEQ ID NO: 34055 - DNA, 27 bp, Artificial sequence
  SiRNA target sequence
atctttagtagcttgcctttgcatgtc

SEQ ID NO: 34056 - DNA, 27 bp, Artificial sequence
  SiRNA target sequence
tctttagtagcttgcctttgcatgtca

SEQ ID NO: 34057 - DNA, 27 bp, Artificial sequence
  SiRNA target sequence
ctttagtagcttgcctttgcatgtcat

SEQ ID NO: 34058 - DNA, 27 bp, Artificial sequence
  SiRNA target sequence
tttagtagcttgcctttgcatgtcatc

SEQ ID NO: 34059 - DNA, 27 bp, Artificial sequence
  SiRNA target sequence
ttagtagcttgcctttgcatgtcatca

SEQ ID NO: 34060 - DNA, 27 bp, Artificial sequence
  SiRNA target sequence
tagtagcttgcctttgcatgtcatcaa

SEQ ID NO: 34061 - DNA, 27 bp, Artificial sequence
  SiRNA target sequence
agtagcttgcctttgcatgtcatcaaa

SEQ ID NO: 34062 - DNA, 27 bp, Artificial sequence
  SiRNA target sequence
gtagcttgcctttgcatgtcatcaaaa

SEQ ID NO: 34063 - DNA, 27 bp, Artificial sequence
  SiRNA target sequence
tagcttgcctttgcatgtcatcaaaat

SEQ ID NO: 34064 - DNA, 27 bp, Artificial sequence
  SiRNA target sequence
agcttgcctttgcatgtcatcaaaata

SEQ ID NO: 34065 - DNA, 27 bp, Artificial sequence
  SiRNA target sequence
gcttgcctttgcatgtcatcaaaatat

SEQ ID NO: 34066 - DNA, 27 bp, Artificial sequence
  SiRNA target sequence
cttgcctttgcatgtcatcaaaatatg

SEQ ID NO: 34067 - DNA, 27 bp, Artificial sequence
  SiRNA target sequence
ttgcctttgcatgtcatcaaaatatgc

SEQ ID NO: 34068 - DNA, 27 bp, Artificial sequence
  SiRNA target sequence
tgcctttgcatgtcatcaaaatatgcg

SEQ ID NO: 34069 - DNA, 27 bp, Artificial sequence
  SiRNA target sequence
gcctttgcatgtcatcaaaatatgcgg

SEQ ID NO: 34070 - DNA, 27 bp, Artificial sequence
  SiRNA target sequence
cctttgcatgtcatcaaaatatgcggg

SEQ ID NO: 34071 - DNA, 27 bp, Artificial sequence
  SiRNA target sequence
ctttgcatgtcatcaaaatatgcgggc

SEQ ID NO: 34072 - DNA, 27 bp, Artificial sequence
  SiRNA target sequence
tttgcatgtcatcaaaatatgcgggca

SEQ ID NO: 34073 - DNA, 27 bp, Artificial sequence
  SiRNA target sequence
ttgcatgtcatcaaaatatgcgggcac

SEQ ID NO: 34074 - DNA, 27 bp, Artificial sequence
  SiRNA target sequence
tgcatgtcatcaaaatatgcgggcact

SEQ ID NO: 34075 - DNA, 27 bp, Artificial sequence
  SiRNA target sequence
gcatgtcatcaaaatatgcgggcactg

SEQ ID NO: 34076 - DNA, 27 bp, Artificial sequence
  SiRNA target sequence
catgtcatcaaaatatgcgggcactgt

SEQ ID NO: 34077 - DNA, 27 bp, Artificial sequence
  SiRNA target sequence
atgtcatcaaaatatgcgggcactgtt

SEQ ID NO: 34078 - DNA, 27 bp, Artificial sequence
  SiRNA target sequence
tgtcatcaaaatatgcgggcactgtta

SEQ ID NO: 34079 - DNA, 27 bp, Artificial sequence
  SiRNA target sequence
gtcatcaaaatatgcgggcactgttat

SEQ ID NO: 34080 - DNA, 27 bp, Artificial sequence
  SiRNA target sequence
tcatcaaaatatgcgggcactgttata

SEQ ID NO: 34081 - DNA, 27 bp, Artificial sequence
  SiRNA target sequence
catcaaaatatgcgggcactgttataa

SEQ ID NO: 34082 - DNA, 27 bp, Artificial sequence
  SiRNA target sequence
atcaaaatatgcgggcactgttataac

SEQ ID NO: 34083 - DNA, 27 bp, Artificial sequence
  SiRNA target sequence
tcaaaatatgcgggcactgttataaca

SEQ ID NO: 34084 - DNA, 27 bp, Artificial sequence
  SiRNA target sequence
caaaatatgcgggcactgttataacag

SEQ ID NO: 34085 - DNA, 27 bp, Artificial sequence
  SiRNA target sequence
aaaatatgcgggcactgttataacaga

SEQ ID NO: 34086 - DNA, 27 bp, Artificial sequence
  SiRNA target sequence
aaatatgcgggcactgttataacagat

SEQ ID NO: 34087 - DNA, 27 bp, Artificial sequence
  SiRNA target sequence
aatatgcgggcactgttataacagatc

SEQ ID NO: 34088 - DNA, 27 bp, Artificial sequence
  SiRNA target sequence
atatgcgggcactgttataacagatct

SEQ ID NO: 34089 - DNA, 27 bp, Artificial sequence
  SiRNA target sequence
tatgcgggcactgttataacagatctt

SEQ ID NO: 34090 - DNA, 27 bp, Artificial sequence
  SiRNA target sequence
atgcgggcactgttataacagatctta

SEQ ID NO: 34091 - DNA, 27 bp, Artificial sequence
  SiRNA target sequence
tgcgggcactgttataacagatcttaa

SEQ ID NO: 34092 - DNA, 27 bp, Artificial sequence
  SiRNA target sequence
gcgggcactgttataacagatcttaat

SEQ ID NO: 34093 - DNA, 27 bp, Artificial sequence
  SiRNA target sequence
cgggcactgttataacagatcttaata

SEQ ID NO: 34094 - DNA, 27 bp, Artificial sequence
  SiRNA target sequence
gggcactgttataacagatcttaatac

SEQ ID NO: 34095 - DNA, 27 bp, Artificial sequence
  SiRNA target sequence
ggcactgttataacagatcttaatact

SEQ ID NO: 34096 - DNA, 27 bp, Artificial sequence
  SiRNA target sequence
gcactgttataacagatcttaatactt

SEQ ID NO: 34097 - DNA, 27 bp, Artificial sequence
  SiRNA target sequence
cactgttataacagatcttaatacttt

SEQ ID NO: 34098 - DNA, 27 bp, Artificial sequence
  SiRNA target sequence
actgttataacagatcttaatacttta

SEQ ID NO: 34099 - DNA, 27 bp, Artificial sequence
  SiRNA target sequence
ctgttataacagatcttaatactttag

SEQ ID NO: 34100 - DNA, 27 bp, Artificial sequence
  SiRNA target sequence
tgttataacagatcttaatactttaga

SEQ ID NO: 34101 - DNA, 27 bp, Artificial sequence
  SiRNA target sequence
gttataacagatcttaatactttagaa

SEQ ID NO: 34102 - DNA, 27 bp, Artificial sequence
  SiRNA target sequence
ttataacagatcttaatactttagaat

SEQ ID NO: 34103 - DNA, 27 bp, Artificial sequence
  SiRNA target sequence
tataacagatcttaatactttagaatt

SEQ ID NO: 34104 - DNA, 27 bp, Artificial sequence
  SiRNA target sequence
ataacagatcttaatactttagaattt

SEQ ID NO: 34105 - DNA, 27 bp, Artificial sequence
  SiRNA target sequence
taacagatcttaatactttagaattta

SEQ ID NO: 34106 - DNA, 27 bp, Artificial sequence
  SiRNA target sequence
aacagatcttaatactttagaatttaa

SEQ ID NO: 34107 - DNA, 27 bp, Artificial sequence
  SiRNA target sequence
acagatcttaatactttagaatttaaa

SEQ ID NO: 34108 - DNA, 27 bp, Artificial sequence
  SiRNA target sequence
cagatcttaatactttagaatttaaaa

SEQ ID NO: 34109 - DNA, 27 bp, Artificial sequence
  SiRNA target sequence
agatcttaatactttagaatttaaaaa

SEQ ID NO: 34110 - DNA, 27 bp, Artificial sequence
  SiRNA target sequence
gatcttaatactttagaatttaaaaaa

SEQ ID NO: 34111 - DNA, 27 bp, Artificial sequence
  SiRNA target sequence
atcttaatactttagaatttaaaaaat

SEQ ID NO: 34112 - DNA, 27 bp, Artificial sequence
  SiRNA target sequence
tcttaatactttagaatttaaaaaatt

SEQ ID NO: 34113 - DNA, 27 bp, Artificial sequence
  SiRNA target sequence
cttaatactttagaatttaaaaaattc

SEQ ID NO: 34114 - DNA, 27 bp, Artificial sequence
  SiRNA target sequence
ttaatactttagaatttaaaaaattct

SEQ ID NO: 34115 - DNA, 27 bp, Artificial sequence
  SiRNA target sequence
taatactttagaatttaaaaaattctc

SEQ ID NO: 34116 - DNA, 27 bp, Artificial sequence
  SiRNA target sequence
aatactttagaatttaaaaaattctct

SEQ ID NO: 34117 - DNA, 27 bp, Artificial sequence
  SiRNA target sequence
atactttagaatttaaaaaattctctg

SEQ ID NO: 34118 - DNA, 27 bp, Artificial sequence
  SiRNA target sequence
tactttagaatttaaaaaattctctgc

SEQ ID NO: 34119 - DNA, 27 bp, Artificial sequence
  SiRNA target sequence
actttagaatttaaaaaattctctgcg

SEQ ID NO: 34120 - DNA, 27 bp, Artificial sequence
  SiRNA target sequence
ctttagaatttaaaaaattctctgcgg

SEQ ID NO: 34121 - DNA, 27 bp, Artificial sequence
  SiRNA target sequence
tttagaatttaaaaaattctctgcggc

SEQ ID NO: 34122 - DNA, 27 bp, Artificial sequence
  SiRNA target sequence
ttagaatttaaaaaattctctgcggca

SEQ ID NO: 34123 - DNA, 27 bp, Artificial sequence
  SiRNA target sequence
tagaatttaaaaaattctctgcggcat

SEQ ID NO: 34124 - DNA, 27 bp, Artificial sequence
  SiRNA target sequence
agaatttaaaaaattctctgcggcatt

SEQ ID NO: 34125 - DNA, 27 bp, Artificial sequence
  SiRNA target sequence
gaatttaaaaaattctctgcggcattt

SEQ ID NO: 34126 - DNA, 27 bp, Artificial sequence
  SiRNA target sequence
aatttaaaaaattctctgcggcatttt

SEQ ID NO: 34127 - DNA, 27 bp, Artificial sequence
  SiRNA target sequence
atttaaaaaattctctgcggcattttt

SEQ ID NO: 34128 - DNA, 27 bp, Artificial sequence
  SiRNA target sequence
tttaaaaaattctctgcggcatttttc

SEQ ID NO: 34129 - DNA, 27 bp, Artificial sequence
  SiRNA target sequence
ttaaaaaattctctgcggcatttttca

SEQ ID NO: 34130 - DNA, 27 bp, Artificial sequence
  SiRNA target sequence
taaaaaattctctgcggcatttttcat

SEQ ID NO: 34131 - DNA, 27 bp, Artificial sequence
  SiRNA target sequence
aaaaaattctctgcggcatttttcatt

SEQ ID NO: 34132 - DNA, 27 bp, Artificial sequence
  SiRNA target sequence
aaaaattctctgcggcatttttcattt

SEQ ID NO: 34133 - DNA, 27 bp, Artificial sequence
  SiRNA target sequence
aaaattctctgcggcatttttcatttt

SEQ ID NO: 34134 - DNA, 27 bp, Artificial sequence
  SiRNA target sequence
aaattctctgcggcatttttcattttt

SEQ ID NO: 34135 - DNA, 27 bp, Artificial sequence
  SiRNA target sequence
aattctctgcggcatttttcatttttg

SEQ ID NO: 34136 - DNA, 27 bp, Artificial sequence
  SiRNA target sequence
attctctgcggcatttttcatttttga

SEQ ID NO: 34137 - DNA, 27 bp, Artificial sequence
  SiRNA target sequence
ttctctgcggcatttttcatttttgac

SEQ ID NO: 34138 - DNA, 27 bp, Artificial sequence
  SiRNA target sequence
tctctgcggcatttttcatttttgaca

SEQ ID NO: 34139 - DNA, 27 bp, Artificial sequence
  SiRNA target sequence
ctctgcggcatttttcatttttgacaa

SEQ ID NO: 34140 - DNA, 27 bp, Artificial sequence
  SiRNA target sequence
tctgcggcatttttcatttttgacaaa

SEQ ID NO: 34141 - DNA, 27 bp, Artificial sequence
  SiRNA target sequence
ctgcggcatttttcatttttgacaaaa

SEQ ID NO: 34142 - DNA, 27 bp, Artificial sequence
  SiRNA target sequence
tgcggcatttttcatttttgacaaaat

SEQ ID NO: 34143 - DNA, 27 bp, Artificial sequence
  SiRNA target sequence
gcggcatttttcatttttgacaaaata

SEQ ID NO: 34144 - DNA, 27 bp, Artificial sequence
  SiRNA target sequence
cggcatttttcatttttgacaaaataa

SEQ ID NO: 34145 - DNA, 27 bp, Artificial sequence
  SiRNA target sequence
ggcatttttcatttttgacaaaataaa

SEQ ID NO: 34146 - DNA, 27 bp, Artificial sequence
  SiRNA target sequence
gcatttttcatttttgacaaaataaat

SEQ ID NO: 34147 - DNA, 27 bp, Artificial sequence
  SiRNA target sequence
catttttcatttttgacaaaataaatg

SEQ ID NO: 34148 - DNA, 27 bp, Artificial sequence
  SiRNA target sequence
atttttcatttttgacaaaataaatgc

SEQ ID NO: 34149 - DNA, 27 bp, Artificial sequence
  SiRNA target sequence
tttttcatttttgacaaaataaatgca

SEQ ID NO: 34150 - DNA, 27 bp, Artificial sequence
  SiRNA target sequence
ttttcatttttgacaaaataaatgcac

SEQ ID NO: 34151 - DNA, 27 bp, Artificial sequence
  SiRNA target sequence
tttcatttttgacaaaataaatgcacc

SEQ ID NO: 34152 - DNA, 27 bp, Artificial sequence
  SiRNA target sequence
ttcatttttgacaaaataaatgcacca

SEQ ID NO: 34153 - DNA, 27 bp, Artificial sequence
  SiRNA target sequence
tcatttttgacaaaataaatgcaccaa

SEQ ID NO: 34154 - DNA, 27 bp, Artificial sequence
  SiRNA target sequence
catttttgacaaaataaatgcaccaat

SEQ ID NO: 34155 - DNA, 27 bp, Artificial sequence
  SiRNA target sequence
atttttgacaaaataaatgcaccaatt

SEQ ID NO: 34156 - DNA, 27 bp, Artificial sequence
  SiRNA target sequence
tttttgacaaaataaatgcaccaattt

SEQ ID NO: 34157 - DNA, 27 bp, Artificial sequence
  SiRNA target sequence
ttttgacaaaataaatgcaccaatttg

SEQ ID NO: 34158 - DNA, 27 bp, Artificial sequence
  SiRNA target sequence
tttgacaaaataaatgcaccaatttgt

SEQ ID NO: 34159 - DNA, 27 bp, Artificial sequence
  SiRNA target sequence
ttgacaaaataaatgcaccaatttgtg

SEQ ID NO: 34160 - DNA, 27 bp, Artificial sequence
  SiRNA target sequence
tgacaaaataaatgcaccaatttgtgc

SEQ ID NO: 34161 - DNA, 27 bp, Artificial sequence
  SiRNA target sequence
gacaaaataaatgcaccaatttgtgca

SEQ ID NO: 34162 - DNA, 27 bp, Artificial sequence
  SiRNA target sequence
acaaaataaatgcaccaatttgtgcag

SEQ ID NO: 34163 - DNA, 27 bp, Artificial sequence
  SiRNA target sequence
caaaataaatgcaccaatttgtgcagg

SEQ ID NO: 34164 - DNA, 27 bp, Artificial sequence
  SiRNA target sequence
aaaataaatgcaccaatttgtgcagga

SEQ ID NO: 34165 - DNA, 27 bp, Artificial sequence
  SiRNA target sequence
aaataaatgcaccaatttgtgcaggag

SEQ ID NO: 34166 - DNA, 27 bp, Artificial sequence
  SiRNA target sequence
aataaatgcaccaatttgtgcaggaga

SEQ ID NO: 34167 - DNA, 27 bp, Artificial sequence
  SiRNA target sequence
ataaatgcaccaatttgtgcaggagaa

SEQ ID NO: 34168 - DNA, 27 bp, Artificial sequence
  SiRNA target sequence
taaatgcaccaatttgtgcaggagaat

SEQ ID NO: 34169 - DNA, 27 bp, Artificial sequence
  SiRNA target sequence
aaatgcaccaatttgtgcaggagaata

SEQ ID NO: 34170 - DNA, 27 bp, Artificial sequence
  SiRNA target sequence
aatgcaccaatttgtgcaggagaatat

SEQ ID NO: 34171 - DNA, 27 bp, Artificial sequence
  SiRNA target sequence
atgcaccaatttgtgcaggagaatatt

SEQ ID NO: 34172 - DNA, 27 bp, Artificial sequence
  SiRNA target sequence
tgcaccaatttgtgcaggagaatattt

SEQ ID NO: 34173 - DNA, 27 bp, Artificial sequence
  SiRNA target sequence
gcaccaatttgtgcaggagaatatttc

SEQ ID NO: 34174 - DNA, 27 bp, Artificial sequence
  SiRNA target sequence
caccaatttgtgcaggagaatatttct

SEQ ID NO: 34175 - DNA, 27 bp, Artificial sequence
  SiRNA target sequence
accaatttgtgcaggagaatatttctt

SEQ ID NO: 34176 - DNA, 27 bp, Artificial sequence
  SiRNA target sequence
ccaatttgtgcaggagaatatttctta

SEQ ID NO: 34177 - DNA, 27 bp, Artificial sequence
  SiRNA target sequence
caatttgtgcaggagaatatttcttat

SEQ ID NO: 34178 - DNA, 27 bp, Artificial sequence
  SiRNA target sequence
aatttgtgcaggagaatatttcttatt

SEQ ID NO: 34179 - DNA, 27 bp, Artificial sequence
  SiRNA target sequence
atttgtgcaggagaatatttcttattg

SEQ ID NO: 34180 - DNA, 27 bp, Artificial sequence
  SiRNA target sequence
tttgtgcaggagaatatttcttattgt

SEQ ID NO: 34181 - DNA, 27 bp, Artificial sequence
  SiRNA target sequence
ttgtgcaggagaatatttcttattgtc

SEQ ID NO: 34182 - DNA, 27 bp, Artificial sequence
  SiRNA target sequence
tgtgcaggagaatatttcttattgtca

SEQ ID NO: 34183 - DNA, 27 bp, Artificial sequence
  SiRNA target sequence
gtgcaggagaatatttcttattgtcaa

SEQ ID NO: 34184 - DNA, 27 bp, Artificial sequence
  SiRNA target sequence
tgcaggagaatatttcttattgtcaat

SEQ ID NO: 34185 - DNA, 27 bp, Artificial sequence
  SiRNA target sequence
gcaggagaatatttcttattgtcaatt

SEQ ID NO: 34186 - DNA, 27 bp, Artificial sequence
  SiRNA target sequence
caggagaatatttcttattgtcaattt

SEQ ID NO: 34187 - DNA, 27 bp, Artificial sequence
  SiRNA target sequence
aggagaatatttcttattgtcaatttt

SEQ ID NO: 34188 - DNA, 27 bp, Artificial sequence
  SiRNA target sequence
ggagaatatttcttattgtcaattttt

SEQ ID NO: 34189 - DNA, 27 bp, Artificial sequence
  SiRNA target sequence
gagaatatttcttattgtcaattttta

SEQ ID NO: 34190 - DNA, 27 bp, Artificial sequence
  SiRNA target sequence
agaatatttcttattgtcaatttttat

SEQ ID NO: 34191 - DNA, 27 bp, Artificial sequence
  SiRNA target sequence
gaatatttcttattgtcaatttttatc

SEQ ID NO: 34192 - DNA, 27 bp, Artificial sequence
  SiRNA target sequence
aatatttcttattgtcaatttttatcc

SEQ ID NO: 34193 - DNA, 27 bp, Artificial sequence
  SiRNA target sequence
atatttcttattgtcaatttttatcca

SEQ ID NO: 34194 - DNA, 27 bp, Artificial sequence
  SiRNA target sequence
tatttcttattgtcaatttttatccaa

SEQ ID NO: 34195 - DNA, 27 bp, Artificial sequence
  SiRNA target sequence
atttcttattgtcaatttttatccaaa

SEQ ID NO: 34196 - DNA, 27 bp, Artificial sequence
  SiRNA target sequence
tttcttattgtcaatttttatccaaat

SEQ ID NO: 34197 - DNA, 27 bp, Artificial sequence
  SiRNA target sequence
ttcttattgtcaatttttatccaaata

SEQ ID NO: 34198 - DNA, 27 bp, Artificial sequence
  SiRNA target sequence
tcttattgtcaatttttatccaaatat

SEQ ID NO: 34199 - DNA, 27 bp, Artificial sequence
  SiRNA target sequence
cttattgtcaatttttatccaaatatc

SEQ ID NO: 34200 - DNA, 27 bp, Artificial sequence
  SiRNA target sequence
ttattgtcaatttttatccaaatatcg

SEQ ID NO: 34201 - DNA, 27 bp, Artificial sequence
  SiRNA target sequence
tattgtcaatttttatccaaatatcgc

SEQ ID NO: 34202 - DNA, 27 bp, Artificial sequence
  SiRNA target sequence
attgtcaatttttatccaaatatcgcc

SEQ ID NO: 34203 - DNA, 27 bp, Artificial sequence
  SiRNA target sequence
ttgtcaatttttatccaaatatcgccg

SEQ ID NO: 34204 - DNA, 27 bp, Artificial sequence
  SiRNA target sequence
tgtcaatttttatccaaatatcgccgt

SEQ ID NO: 34205 - DNA, 27 bp, Artificial sequence
  SiRNA target sequence
gtcaatttttatccaaatatcgccgtt

SEQ ID NO: 34206 - DNA, 27 bp, Artificial sequence
  SiRNA target sequence
tcaatttttatccaaatatcgccgtta

SEQ ID NO: 34207 - DNA, 27 bp, Artificial sequence
  SiRNA target sequence
caatttttatccaaatatcgccgttac

SEQ ID NO: 34208 - DNA, 27 bp, Artificial sequence
  SiRNA target sequence
aatttttatccaaatatcgccgttaca

SEQ ID NO: 34209 - DNA, 27 bp, Artificial sequence
  SiRNA target sequence
atttttatccaaatatcgccgttacaa

SEQ ID NO: 34210 - DNA, 27 bp, Artificial sequence
  SiRNA target sequence
tttttatccaaatatcgccgttacaat

SEQ ID NO: 34211 - DNA, 27 bp, Artificial sequence
  SiRNA target sequence
ttttatccaaatatcgccgttacaatg

SEQ ID NO: 34212 - DNA, 27 bp, Artificial sequence
  SiRNA target sequence
tttatccaaatatcgccgttacaatgc

SEQ ID NO: 34213 - DNA, 27 bp, Artificial sequence
  SiRNA target sequence
ttatccaaatatcgccgttacaatgct

SEQ ID NO: 34214 - DNA, 27 bp, Artificial sequence
  SiRNA target sequence
tatccaaatatcgccgttacaatgctt

SEQ ID NO: 34215 - DNA, 27 bp, Artificial sequence
  SiRNA target sequence
atccaaatatcgccgttacaatgctta

SEQ ID NO: 34216 - DNA, 27 bp, Artificial sequence
  SiRNA target sequence
tccaaatatcgccgttacaatgcttag

SEQ ID NO: 34217 - DNA, 27 bp, Artificial sequence
  SiRNA target sequence
ccaaatatcgccgttacaatgcttagt

SEQ ID NO: 34218 - DNA, 27 bp, Artificial sequence
  SiRNA target sequence
caaatatcgccgttacaatgcttagta

SEQ ID NO: 34219 - DNA, 27 bp, Artificial sequence
  SiRNA target sequence
aaatatcgccgttacaatgcttagtag

SEQ ID NO: 34220 - DNA, 27 bp, Artificial sequence
  SiRNA target sequence
aatatcgccgttacaatgcttagtagt

SEQ ID NO: 34221 - DNA, 27 bp, Artificial sequence
  SiRNA target sequence
atatcgccgttacaatgcttagtagtg

SEQ ID NO: 34222 - DNA, 27 bp, Artificial sequence
  SiRNA target sequence
tatcgccgttacaatgcttagtagtgt

SEQ ID NO: 34223 - DNA, 27 bp, Artificial sequence
  SiRNA target sequence
atcgccgttacaatgcttagtagtgtc

SEQ ID NO: 34224 - DNA, 27 bp, Artificial sequence
  SiRNA target sequence
tcgccgttacaatgcttagtagtgtca

SEQ ID NO: 34225 - DNA, 27 bp, Artificial sequence
  SiRNA target sequence
cgccgttacaatgcttagtagtgtcat

SEQ ID NO: 34226 - DNA, 27 bp, Artificial sequence
  SiRNA target sequence
gccgttacaatgcttagtagtgtcata

SEQ ID NO: 34227 - DNA, 27 bp, Artificial sequence
  SiRNA target sequence
ccgttacaatgcttagtagtgtcatat

SEQ ID NO: 34228 - DNA, 27 bp, Artificial sequence
  SiRNA target sequence
cgttacaatgcttagtagtgtcatatg

SEQ ID NO: 34229 - DNA, 27 bp, Artificial sequence
  SiRNA target sequence
gttacaatgcttagtagtgtcatatgg

SEQ ID NO: 34230 - DNA, 27 bp, Artificial sequence
  SiRNA target sequence
ttacaatgcttagtagtgtcatatggt

SEQ ID NO: 34231 - DNA, 27 bp, Artificial sequence
  SiRNA target sequence
tacaatgcttagtagtgtcatatggta

SEQ ID NO: 34232 - DNA, 27 bp, Artificial sequence
  SiRNA target sequence
acaatgcttagtagtgtcatatggtaa

SEQ ID NO: 34233 - DNA, 27 bp, Artificial sequence
  SiRNA target sequence
caatgcttagtagtgtcatatggtaag

SEQ ID NO: 34234 - DNA, 27 bp, Artificial sequence
  SiRNA target sequence
aatgcttagtagtgtcatatggtaagc

SEQ ID NO: 34235 - DNA, 27 bp, Artificial sequence
  SiRNA target sequence
atgcttagtagtgtcatatggtaagct

SEQ ID NO: 34236 - DNA, 27 bp, Artificial sequence
  SiRNA target sequence
tgcttagtagtgtcatatggtaagctt

SEQ ID NO: 34237 - DNA, 27 bp, Artificial sequence
  SiRNA target sequence
gcttagtagtgtcatatggtaagcttt

SEQ ID NO: 34238 - DNA, 27 bp, Artificial sequence
  SiRNA target sequence
cttagtagtgtcatatggtaagctttt

SEQ ID NO: 34239 - DNA, 27 bp, Artificial sequence
  SiRNA target sequence
ttagtagtgtcatatggtaagcttttt

SEQ ID NO: 34240 - DNA, 27 bp, Artificial sequence
  SiRNA target sequence
tagtagtgtcatatggtaagcttttta

SEQ ID NO: 34241 - DNA, 27 bp, Artificial sequence
  SiRNA target sequence
agtagtgtcatatggtaagctttttaa

SEQ ID NO: 34242 - DNA, 27 bp, Artificial sequence
  SiRNA target sequence
gtagtgtcatatggtaagctttttaaa

SEQ ID NO: 34243 - DNA, 27 bp, Artificial sequence
  SiRNA target sequence
tagtgtcatatggtaagctttttaaat

SEQ ID NO: 34244 - DNA, 27 bp, Artificial sequence
  SiRNA target sequence
agtgtcatatggtaagctttttaaata

SEQ ID NO: 34245 - DNA, 27 bp, Artificial sequence
  SiRNA target sequence
gtgtcatatggtaagctttttaaataa

SEQ ID NO: 34246 - DNA, 27 bp, Artificial sequence
  SiRNA target sequence
tgtcatatggtaagctttttaaataat

SEQ ID NO: 34247 - DNA, 27 bp, Artificial sequence
  SiRNA target sequence
gtcatatggtaagctttttaaataatc

SEQ ID NO: 34248 - DNA, 27 bp, Artificial sequence
  SiRNA target sequence
tcatatggtaagctttttaaataatct

SEQ ID NO: 34249 - DNA, 27 bp, Artificial sequence
  SiRNA target sequence
catatggtaagctttttaaataatctt

SEQ ID NO: 34250 - DNA, 27 bp, Artificial sequence
  SiRNA target sequence
atatggtaagctttttaaataatcttt

SEQ ID NO: 34251 - DNA, 27 bp, Artificial sequence
  SiRNA target sequence
tatggtaagctttttaaataatctttt

SEQ ID NO: 34252 - DNA, 27 bp, Artificial sequence
  SiRNA target sequence
atggtaagctttttaaataatctttta

SEQ ID NO: 34253 - DNA, 27 bp, Artificial sequence
  SiRNA target sequence
tggtaagctttttaaataatcttttaa

SEQ ID NO: 34254 - DNA, 27 bp, Artificial sequence
  SiRNA target sequence
ggtaagctttttaaataatcttttaat

SEQ ID NO: 34255 - DNA, 27 bp, Artificial sequence
  SiRNA target sequence
gtaagctttttaaataatcttttaatt

SEQ ID NO: 34256 - DNA, 27 bp, Artificial sequence
  SiRNA target sequence
taagctttttaaataatcttttaattc

SEQ ID NO: 34257 - DNA, 27 bp, Artificial sequence
  SiRNA target sequence
aagctttttaaataatcttttaattct

SEQ ID NO: 34258 - DNA, 27 bp, Artificial sequence
  SiRNA target sequence
agctttttaaataatcttttaattcta

SEQ ID NO: 34259 - DNA, 27 bp, Artificial sequence
  SiRNA target sequence
gctttttaaataatcttttaattctac

SEQ ID NO: 34260 - DNA, 27 bp, Artificial sequence
  SiRNA target sequence
ctttttaaataatcttttaattctaca

SEQ ID NO: 34261 - DNA, 27 bp, Artificial sequence
  SiRNA target sequence
tttttaaataatcttttaattctacat

SEQ ID NO: 34262 - DNA, 27 bp, Artificial sequence
  SiRNA target sequence
ttttaaataatcttttaattctacatc

SEQ ID NO: 34263 - DNA, 27 bp, Artificial sequence
  SiRNA target sequence
tttaaataatcttttaattctacatca

SEQ ID NO: 34264 - DNA, 27 bp, Artificial sequence
  SiRNA target sequence
ttaaataatcttttaattctacatcat

SEQ ID NO: 34265 - DNA, 27 bp, Artificial sequence
  SiRNA target sequence
taaataatcttttaattctacatcatc

SEQ ID NO: 34266 - DNA, 27 bp, Artificial sequence
  SiRNA target sequence
aaataatcttttaattctacatcatca

SEQ ID NO: 34267 - DNA, 27 bp, Artificial sequence
  SiRNA target sequence
aataatcttttaattctacatcatcaa

SEQ ID NO: 34268 - DNA, 27 bp, Artificial sequence
  SiRNA target sequence
ataatcttttaattctacatcatcaaa

SEQ ID NO: 34269 - DNA, 27 bp, Artificial sequence
  SiRNA target sequence
taatcttttaattctacatcatcaaat

SEQ ID NO: 34270 - DNA, 27 bp, Artificial sequence
  SiRNA target sequence
aatcttttaattctacatcatcaaatt

SEQ ID NO: 34271 - DNA, 27 bp, Artificial sequence
  SiRNA target sequence
atcttttaattctacatcatcaaattt

SEQ ID NO: 34272 - DNA, 27 bp, Artificial sequence
  SiRNA target sequence
tcttttaattctacatcatcaaatttt

SEQ ID NO: 34273 - DNA, 27 bp, Artificial sequence
  SiRNA target sequence
cttttaattctacatcatcaaattttc

SEQ ID NO: 34274 - DNA, 27 bp, Artificial sequence
  SiRNA target sequence
ttttaattctacatcatcaaattttcg

SEQ ID NO: 34275 - DNA, 27 bp, Artificial sequence
  SiRNA target sequence
tttaattctacatcatcaaattttcgt

SEQ ID NO: 34276 - DNA, 27 bp, Artificial sequence
  SiRNA target sequence
ttaattctacatcatcaaattttcgtc

SEQ ID NO: 34277 - DNA, 27 bp, Artificial sequence
  SiRNA target sequence
taattctacatcatcaaattttcgtcc

SEQ ID NO: 34278 - DNA, 27 bp, Artificial sequence
  SiRNA target sequence
aattctacatcatcaaattttcgtccc

SEQ ID NO: 34279 - DNA, 27 bp, Artificial sequence
  SiRNA target sequence
attctacatcatcaaattttcgtccca

SEQ ID NO: 34280 - DNA, 27 bp, Artificial sequence
  SiRNA target sequence
ttctacatcatcaaattttcgtcccag

SEQ ID NO: 34281 - DNA, 27 bp, Artificial sequence
  SiRNA target sequence
tctacatcatcaaattttcgtcccagc

SEQ ID NO: 34282 - DNA, 27 bp, Artificial sequence
  SiRNA target sequence
ctacatcatcaaattttcgtcccagca

SEQ ID NO: 34283 - DNA, 27 bp, Artificial sequence
  SiRNA target sequence
tacatcatcaaattttcgtcccagcaa

SEQ ID NO: 34284 - DNA, 27 bp, Artificial sequence
  SiRNA target sequence
acatcatcaaattttcgtcccagcaat

SEQ ID NO: 34285 - DNA, 27 bp, Artificial sequence
  SiRNA target sequence
catcatcaaattttcgtcccagcaatc

SEQ ID NO: 34286 - DNA, 27 bp, Artificial sequence
  SiRNA target sequence
atcatcaaattttcgtcccagcaatct

SEQ ID NO: 34287 - DNA, 27 bp, Artificial sequence
  SiRNA target sequence
tcatcaaattttcgtcccagcaatctc

SEQ ID NO: 34288 - DNA, 27 bp, Artificial sequence
  SiRNA target sequence
catcaaattttcgtcccagcaatctct

SEQ ID NO: 34289 - DNA, 27 bp, Artificial sequence
  SiRNA target sequence
atcaaattttcgtcccagcaatctctt

SEQ ID NO: 34290 - DNA, 27 bp, Artificial sequence
  SiRNA target sequence
tcaaattttcgtcccagcaatctctta

SEQ ID NO: 34291 - DNA, 27 bp, Artificial sequence
  SiRNA target sequence
caaattttcgtcccagcaatctcttag

SEQ ID NO: 34292 - DNA, 27 bp, Artificial sequence
  SiRNA target sequence
aaattttcgtcccagcaatctcttaga

SEQ ID NO: 34293 - DNA, 27 bp, Artificial sequence
  SiRNA target sequence
aattttcgtcccagcaatctcttagac

SEQ ID NO: 34294 - DNA, 27 bp, Artificial sequence
  SiRNA target sequence
attttcgtcccagcaatctcttagacg

SEQ ID NO: 34295 - DNA, 27 bp, Artificial sequence
  SiRNA target sequence
ttttcgtcccagcaatctcttagacgc

SEQ ID NO: 34296 - DNA, 27 bp, Artificial sequence
  SiRNA target sequence
tttcgtcccagcaatctcttagacgca

SEQ ID NO: 34297 - DNA, 27 bp, Artificial sequence
  SiRNA target sequence
ttcgtcccagcaatctcttagacgcaa

SEQ ID NO: 34298 - DNA, 27 bp, Artificial sequence
  SiRNA target sequence
tcgtcccagcaatctcttagacgcaaa

SEQ ID NO: 34299 - DNA, 27 bp, Artificial sequence
  SiRNA target sequence
cgtcccagcaatctcttagacgcaaaa

SEQ ID NO: 34300 - DNA, 27 bp, Artificial sequence
  SiRNA target sequence
gtcccagcaatctcttagacgcaaaaa

SEQ ID NO: 34301 - DNA, 27 bp, Artificial sequence
  SiRNA target sequence
tcccagcaatctcttagacgcaaaaat

SEQ ID NO: 34302 - DNA, 27 bp, Artificial sequence
  SiRNA target sequence
cccagcaatctcttagacgcaaaaatc

SEQ ID NO: 34303 - DNA, 27 bp, Artificial sequence
  SiRNA target sequence
ccagcaatctcttagacgcaaaaatcg

SEQ ID NO: 34304 - DNA, 27 bp, Artificial sequence
  SiRNA target sequence
cagcaatctcttagacgcaaaaatcgt

SEQ ID NO: 34305 - DNA, 27 bp, Artificial sequence
  SiRNA target sequence
agcaatctcttagacgcaaaaatcgta

SEQ ID NO: 34306 - DNA, 27 bp, Artificial sequence
  SiRNA target sequence
gcaatctcttagacgcaaaaatcgtat

SEQ ID NO: 34307 - DNA, 27 bp, Artificial sequence
  SiRNA target sequence
caatctcttagacgcaaaaatcgtatt

SEQ ID NO: 34308 - DNA, 27 bp, Artificial sequence
  SiRNA target sequence
aatctcttagacgcaaaaatcgtattc

SEQ ID NO: 34309 - DNA, 27 bp, Artificial sequence
  SiRNA target sequence
atctcttagacgcaaaaatcgtattct

SEQ ID NO: 34310 - DNA, 27 bp, Artificial sequence
  SiRNA target sequence
tctcttagacgcaaaaatcgtattctt

SEQ ID NO: 34311 - DNA, 27 bp, Artificial sequence
  SiRNA target sequence
ctcttagacgcaaaaatcgtattcttg

SEQ ID NO: 34312 - DNA, 27 bp, Artificial sequence
  SiRNA target sequence
tcttagacgcaaaaatcgtattcttgg

SEQ ID NO: 34313 - DNA, 27 bp, Artificial sequence
  SiRNA target sequence
cttagacgcaaaaatcgtattcttggg

SEQ ID NO: 34314 - DNA, 27 bp, Artificial sequence
  SiRNA target sequence
ttagacgcaaaaatcgtattcttggga

SEQ ID NO: 34315 - DNA, 27 bp, Artificial sequence
  SiRNA target sequence
tagacgcaaaaatcgtattcttgggat

SEQ ID NO: 34316 - DNA, 27 bp, Artificial sequence
  SiRNA target sequence
agacgcaaaaatcgtattcttgggatg

SEQ ID NO: 34317 - DNA, 27 bp, Artificial sequence
  SiRNA target sequence
gacgcaaaaatcgtattcttgggatgt

SEQ ID NO: 34318 - DNA, 27 bp, Artificial sequence
  SiRNA target sequence
acgcaaaaatcgtattcttgggatgta

SEQ ID NO: 34319 - DNA, 27 bp, Artificial sequence
  SiRNA target sequence
cgcaaaaatcgtattcttgggatgtaa

SEQ ID NO: 34320 - DNA, 27 bp, Artificial sequence
  SiRNA target sequence
gcaaaaatcgtattcttgggatgtaat

SEQ ID NO: 34321 - DNA, 27 bp, Artificial sequence
  SiRNA target sequence
caaaaatcgtattcttgggatgtaata

SEQ ID NO: 34322 - DNA, 27 bp, Artificial sequence
  SiRNA target sequence
aaaaatcgtattcttgggatgtaataa

SEQ ID NO: 34323 - DNA, 27 bp, Artificial sequence
  SiRNA target sequence
aaaatcgtattcttgggatgtaataac

SEQ ID NO: 34324 - DNA, 27 bp, Artificial sequence
  SiRNA target sequence
aaatcgtattcttgggatgtaataaca

SEQ ID NO: 34325 - DNA, 27 bp, Artificial sequence
  SiRNA target sequence
aatcgtattcttgggatgtaataacaa

SEQ ID NO: 34326 - DNA, 27 bp, Artificial sequence
  SiRNA target sequence
atcgtattcttgggatgtaataacaag

SEQ ID NO: 34327 - DNA, 27 bp, Artificial sequence
  SiRNA target sequence
tcgtattcttgggatgtaataacaagt

SEQ ID NO: 34328 - DNA, 27 bp, Artificial sequence
  SiRNA target sequence
cgtattcttgggatgtaataacaagtt

SEQ ID NO: 34329 - DNA, 27 bp, Artificial sequence
  SiRNA target sequence
gtattcttgggatgtaataacaagtta

SEQ ID NO: 34330 - DNA, 27 bp, Artificial sequence
  SiRNA target sequence
tattcttgggatgtaataacaagttag

SEQ ID NO: 34331 - DNA, 27 bp, Artificial sequence
  SiRNA target sequence
attcttgggatgtaataacaagttaga

SEQ ID NO: 34332 - DNA, 27 bp, Artificial sequence
  SiRNA target sequence
ttcttgggatgtaataacaagttagac

SEQ ID NO: 34333 - DNA, 27 bp, Artificial sequence
  SiRNA target sequence
tcttgggatgtaataacaagttagact

SEQ ID NO: 34334 - DNA, 27 bp, Artificial sequence
  SiRNA target sequence
cttgggatgtaataacaagttagactt

SEQ ID NO: 34335 - DNA, 27 bp, Artificial sequence
  SiRNA target sequence
ttgggatgtaataacaagttagactta

SEQ ID NO: 34336 - DNA, 27 bp, Artificial sequence
  SiRNA target sequence
tgggatgtaataacaagttagacttag

SEQ ID NO: 34337 - DNA, 27 bp, Artificial sequence
  SiRNA target sequence
gggatgtaataacaagttagacttagc

SEQ ID NO: 34338 - DNA, 27 bp, Artificial sequence
  SiRNA target sequence
ggatgtaataacaagttagacttagct

SEQ ID NO: 34339 - DNA, 27 bp, Artificial sequence
  SiRNA target sequence
gatgtaataacaagttagacttagctt

SEQ ID NO: 34340 - DNA, 27 bp, Artificial sequence
  SiRNA target sequence
atgtaataacaagttagacttagcttg

SEQ ID NO: 34341 - DNA, 27 bp, Artificial sequence
  SiRNA target sequence
tgtaataacaagttagacttagcttgc

SEQ ID NO: 34342 - DNA, 27 bp, Artificial sequence
  SiRNA target sequence
gtaataacaagttagacttagcttgct

SEQ ID NO: 34343 - DNA, 27 bp, Artificial sequence
  SiRNA target sequence
taataacaagttagacttagcttgctc

SEQ ID NO: 34344 - DNA, 27 bp, Artificial sequence
  SiRNA target sequence
aataacaagttagacttagcttgctca

SEQ ID NO: 34345 - DNA, 27 bp, Artificial sequence
  SiRNA target sequence
ataacaagttagacttagcttgctcac

SEQ ID NO: 34346 - DNA, 27 bp, Artificial sequence
  SiRNA target sequence
taacaagttagacttagcttgctcacc

SEQ ID NO: 34347 - DNA, 27 bp, Artificial sequence
  SiRNA target sequence
aacaagttagacttagcttgctcacct

SEQ ID NO: 34348 - DNA, 27 bp, Artificial sequence
  SiRNA target sequence
acaagttagacttagcttgctcacctg

SEQ ID NO: 34349 - DNA, 27 bp, Artificial sequence
  SiRNA target sequence
caagttagacttagcttgctcacctgt

SEQ ID NO: 34350 - DNA, 27 bp, Artificial sequence
  SiRNA target sequence
aagttagacttagcttgctcacctgtt

SEQ ID NO: 34351 - DNA, 27 bp, Artificial sequence
  SiRNA target sequence
agttagacttagcttgctcacctgtta

SEQ ID NO: 34352 - DNA, 27 bp, Artificial sequence
  SiRNA target sequence
gttagacttagcttgctcacctgttaa

SEQ ID NO: 34353 - DNA, 27 bp, Artificial sequence
  SiRNA target sequence
ttagacttagcttgctcacctgttaaa

SEQ ID NO: 34354 - DNA, 27 bp, Artificial sequence
  SiRNA target sequence
tagacttagcttgctcacctgttaaaa

SEQ ID NO: 34355 - DNA, 27 bp, Artificial sequence
  SiRNA target sequence
agacttagcttgctcacctgttaaaat

SEQ ID NO: 34356 - DNA, 27 bp, Artificial sequence
  SiRNA target sequence
gacttagcttgctcacctgttaaaatt

SEQ ID NO: 34357 - DNA, 27 bp, Artificial sequence
  SiRNA target sequence
acttagcttgctcacctgttaaaattt

SEQ ID NO: 34358 - DNA, 27 bp, Artificial sequence
  SiRNA target sequence
cttagcttgctcacctgttaaaatttt

SEQ ID NO: 34359 - DNA, 27 bp, Artificial sequence
  SiRNA target sequence
ttagcttgctcacctgttaaaatttta

SEQ ID NO: 34360 - DNA, 27 bp, Artificial sequence
  SiRNA target sequence
tagcttgctcacctgttaaaattttat

SEQ ID NO: 34361 - DNA, 27 bp, Artificial sequence
  SiRNA target sequence
agcttgctcacctgttaaaattttatc

SEQ ID NO: 34362 - DNA, 27 bp, Artificial sequence
  SiRNA target sequence
gcttgctcacctgttaaaattttatct

SEQ ID NO: 34363 - DNA, 27 bp, Artificial sequence
  SiRNA target sequence
cttgctcacctgttaaaattttatctt

SEQ ID NO: 34364 - DNA, 27 bp, Artificial sequence
  SiRNA target sequence
ttgctcacctgttaaaattttatcttt

SEQ ID NO: 34365 - DNA, 27 bp, Artificial sequence
  SiRNA target sequence
tgctcacctgttaaaattttatcttta

SEQ ID NO: 34366 - DNA, 27 bp, Artificial sequence
  SiRNA target sequence
gctcacctgttaaaattttatctttaa

SEQ ID NO: 34367 - DNA, 27 bp, Artificial sequence
  SiRNA target sequence
ctcacctgttaaaattttatctttaaa

SEQ ID NO: 34368 - DNA, 27 bp, Artificial sequence
  SiRNA target sequence
tcacctgttaaaattttatctttaaaa

SEQ ID NO: 34369 - DNA, 27 bp, Artificial sequence
  SiRNA target sequence
cacctgttaaaattttatctttaaaaa

SEQ ID NO: 34370 - DNA, 27 bp, Artificial sequence
  SiRNA target sequence
acctgttaaaattttatctttaaaaat

SEQ ID NO: 34371 - DNA, 27 bp, Artificial sequence
  SiRNA target sequence
cctgttaaaattttatctttaaaaatt

SEQ ID NO: 34372 - DNA, 27 bp, Artificial sequence
  SiRNA target sequence
ctgttaaaattttatctttaaaaattg

SEQ ID NO: 34373 - DNA, 27 bp, Artificial sequence
  SiRNA target sequence
tgttaaaattttatctttaaaaattga

SEQ ID NO: 34374 - DNA, 27 bp, Artificial sequence
  SiRNA target sequence
gttaaaattttatctttaaaaattgat

SEQ ID NO: 34375 - DNA, 27 bp, Artificial sequence
  SiRNA target sequence
ttaaaattttatctttaaaaattgata

SEQ ID NO: 34376 - DNA, 27 bp, Artificial sequence
  SiRNA target sequence
taaaattttatctttaaaaattgatac

SEQ ID NO: 34377 - DNA, 27 bp, Artificial sequence
  SiRNA target sequence
aaaattttatctttaaaaattgatacc

SEQ ID NO: 34378 - DNA, 27 bp, Artificial sequence
  SiRNA target sequence
aaattttatctttaaaaattgatacca

SEQ ID NO: 34379 - DNA, 27 bp, Artificial sequence
  SiRNA target sequence
aattttatctttaaaaattgataccac

SEQ ID NO: 34380 - DNA, 27 bp, Artificial sequence
  SiRNA target sequence
attttatctttaaaaattgataccacc

SEQ ID NO: 34381 - DNA, 27 bp, Artificial sequence
  SiRNA target sequence
ttttatctttaaaaattgataccaccg

SEQ ID NO: 34382 - DNA, 27 bp, Artificial sequence
  SiRNA target sequence
tttatctttaaaaattgataccaccga

SEQ ID NO: 34383 - DNA, 27 bp, Artificial sequence
  SiRNA target sequence
ttatctttaaaaattgataccaccgat

SEQ ID NO: 34384 - DNA, 27 bp, Artificial sequence
  SiRNA target sequence
tatctttaaaaattgataccaccgatg

SEQ ID NO: 34385 - DNA, 27 bp, Artificial sequence
  SiRNA target sequence
atctttaaaaattgataccaccgatgg

SEQ ID NO: 34386 - DNA, 27 bp, Artificial sequence
  SiRNA target sequence
tctttaaaaattgataccaccgatggt

SEQ ID NO: 34387 - DNA, 27 bp, Artificial sequence
  SiRNA target sequence
ctttaaaaattgataccaccgatggtg

SEQ ID NO: 34388 - DNA, 27 bp, Artificial sequence
  SiRNA target sequence
tttaaaaattgataccaccgatggtgt

SEQ ID NO: 34389 - DNA, 27 bp, Artificial sequence
  SiRNA target sequence
ttaaaaattgataccaccgatggtgta

SEQ ID NO: 34390 - DNA, 27 bp, Artificial sequence
  SiRNA target sequence
taaaaattgataccaccgatggtgtag

SEQ ID NO: 34391 - DNA, 27 bp, Artificial sequence
  SiRNA target sequence
aaaaattgataccaccgatggtgtagt

SEQ ID NO: 34392 - DNA, 27 bp, Artificial sequence
  SiRNA target sequence
aaaattgataccaccgatggtgtagtt

SEQ ID NO: 34393 - DNA, 27 bp, Artificial sequence
  SiRNA target sequence
aaattgataccaccgatggtgtagttc

SEQ ID NO: 34394 - DNA, 27 bp, Artificial sequence
  SiRNA target sequence
aattgataccaccgatggtgtagttct

SEQ ID NO: 34395 - DNA, 27 bp, Artificial sequence
  SiRNA target sequence
attgataccaccgatggtgtagttcta

SEQ ID NO: 34396 - DNA, 27 bp, Artificial sequence
  SiRNA target sequence
ttgataccaccgatggtgtagttctac

SEQ ID NO: 34397 - DNA, 27 bp, Artificial sequence
  SiRNA target sequence
tgataccaccgatggtgtagttctacc

SEQ ID NO: 34398 - DNA, 27 bp, Artificial sequence
  SiRNA target sequence
gataccaccgatggtgtagttctacca

SEQ ID NO: 34399 - DNA, 27 bp, Artificial sequence
  SiRNA target sequence
ataccaccgatggtgtagttctaccac

SEQ ID NO: 34400 - DNA, 27 bp, Artificial sequence
  SiRNA target sequence
taccaccgatggtgtagttctaccacc

SEQ ID NO: 34401 - DNA, 27 bp, Artificial sequence
  SiRNA target sequence
accaccgatggtgtagttctaccacct

SEQ ID NO: 34402 - DNA, 27 bp, Artificial sequence
  SiRNA target sequence
ccaccgatggtgtagttctaccacctt

SEQ ID NO: 34403 - DNA, 27 bp, Artificial sequence
  SiRNA target sequence
caccgatggtgtagttctaccaccttc

SEQ ID NO: 34404 - DNA, 27 bp, Artificial sequence
  SiRNA target sequence
accgatggtgtagttctaccaccttct

SEQ ID NO: 34405 - DNA, 27 bp, Artificial sequence
  SiRNA target sequence
ccgatggtgtagttctaccaccttctt

SEQ ID NO: 34406 - DNA, 27 bp, Artificial sequence
  SiRNA target sequence
cgatggtgtagttctaccaccttcttc

SEQ ID NO: 34407 - DNA, 27 bp, Artificial sequence
  SiRNA target sequence
gatggtgtagttctaccaccttcttcg

SEQ ID NO: 34408 - DNA, 27 bp, Artificial sequence
  SiRNA target sequence
atggtgtagttctaccaccttcttcgt

SEQ ID NO: 34409 - DNA, 27 bp, Artificial sequence
  SiRNA target sequence
tggtgtagttctaccaccttcttcgtt

SEQ ID NO: 34410 - DNA, 27 bp, Artificial sequence
  SiRNA target sequence
ggtgtagttctaccaccttcttcgttt

SEQ ID NO: 34411 - DNA, 27 bp, Artificial sequence
  SiRNA target sequence
gtgtagttctaccaccttcttcgtttt

SEQ ID NO: 34412 - DNA, 27 bp, Artificial sequence
  SiRNA target sequence
tgtagttctaccaccttcttcgttttc

SEQ ID NO: 34413 - DNA, 27 bp, Artificial sequence
  SiRNA target sequence
gtagttctaccaccttcttcgttttca

SEQ ID NO: 34414 - DNA, 27 bp, Artificial sequence
  SiRNA target sequence
tagttctaccaccttcttcgttttcaa

SEQ ID NO: 34415 - DNA, 27 bp, Artificial sequence
  SiRNA target sequence
agttctaccaccttcttcgttttcaat

SEQ ID NO: 34416 - DNA, 27 bp, Artificial sequence
  SiRNA target sequence
gttctaccaccttcttcgttttcaata

SEQ ID NO: 34417 - DNA, 27 bp, Artificial sequence
  SiRNA target sequence
ttctaccaccttcttcgttttcaataa

SEQ ID NO: 34418 - DNA, 27 bp, Artificial sequence
  SiRNA target sequence
tctaccaccttcttcgttttcaataat

SEQ ID NO: 34419 - DNA, 27 bp, Artificial sequence
  SiRNA target sequence
ctaccaccttcttcgttttcaataatt

SEQ ID NO: 34420 - DNA, 27 bp, Artificial sequence
  SiRNA target sequence
taccaccttcttcgttttcaataattt

SEQ ID NO: 34421 - DNA, 27 bp, Artificial sequence
  SiRNA target sequence
accaccttcttcgttttcaataatttg

SEQ ID NO: 34422 - DNA, 27 bp, Artificial sequence
  SiRNA target sequence
ccaccttcttcgttttcaataatttgt

SEQ ID NO: 34423 - DNA, 27 bp, Artificial sequence
  SiRNA target sequence
caccttcttcgttttcaataatttgtg

SEQ ID NO: 34424 - DNA, 27 bp, Artificial sequence
  SiRNA target sequence
accttcttcgttttcaataatttgtgg

SEQ ID NO: 34425 - DNA, 27 bp, Artificial sequence
  SiRNA target sequence
ccttcttcgttttcaataatttgtggg

SEQ ID NO: 34426 - DNA, 27 bp, Artificial sequence
  SiRNA target sequence
cttcttcgttttcaataatttgtggga

SEQ ID NO: 34427 - DNA, 27 bp, Artificial sequence
  SiRNA target sequence
ttcttcgttttcaataatttgtgggat

SEQ ID NO: 34428 - DNA, 27 bp, Artificial sequence
  SiRNA target sequence
tcttcgttttcaataatttgtgggata

SEQ ID NO: 34429 - DNA, 27 bp, Artificial sequence
  SiRNA target sequence
cttcgttttcaataatttgtgggatat

SEQ ID NO: 34430 - DNA, 27 bp, Artificial sequence
  SiRNA target sequence
ttcgttttcaataatttgtgggatatt

SEQ ID NO: 34431 - DNA, 27 bp, Artificial sequence
  SiRNA target sequence
tcgttttcaataatttgtgggatattg

SEQ ID NO: 34432 - DNA, 27 bp, Artificial sequence
  SiRNA target sequence
cgttttcaataatttgtgggatattgt

SEQ ID NO: 34433 - DNA, 27 bp, Artificial sequence
  SiRNA target sequence
gttttcaataatttgtgggatattgtt

SEQ ID NO: 34434 - DNA, 27 bp, Artificial sequence
  SiRNA target sequence
ttttcaataatttgtgggatattgtta

SEQ ID NO: 34435 - DNA, 27 bp, Artificial sequence
  SiRNA target sequence
tttcaataatttgtgggatattgttat

SEQ ID NO: 34436 - DNA, 27 bp, Artificial sequence
  SiRNA target sequence
ttcaataatttgtgggatattgttatg

SEQ ID NO: 34437 - DNA, 27 bp, Artificial sequence
  SiRNA target sequence
tcaataatttgtgggatattgttatgt

SEQ ID NO: 34438 - DNA, 27 bp, Artificial sequence
  SiRNA target sequence
caataatttgtgggatattgttatgta

SEQ ID NO: 34439 - DNA, 27 bp, Artificial sequence
  SiRNA target sequence
aataatttgtgggatattgttatgtat

SEQ ID NO: 34440 - DNA, 27 bp, Artificial sequence
  SiRNA target sequence
ataatttgtgggatattgttatgtata

SEQ ID NO: 34441 - DNA, 27 bp, Artificial sequence
  SiRNA target sequence
taatttgtgggatattgttatgtataa

SEQ ID NO: 34442 - DNA, 27 bp, Artificial sequence
  SiRNA target sequence
aatttgtgggatattgttatgtataag

SEQ ID NO: 34443 - DNA, 27 bp, Artificial sequence
  SiRNA target sequence
atttgtgggatattgttatgtataaga

SEQ ID NO: 34444 - DNA, 27 bp, Artificial sequence
  SiRNA target sequence
tttgtgggatattgttatgtataagag

SEQ ID NO: 34445 - DNA, 27 bp, Artificial sequence
  SiRNA target sequence
ttgtgggatattgttatgtataagaga

SEQ ID NO: 34446 - DNA, 27 bp, Artificial sequence
  SiRNA target sequence
tgtgggatattgttatgtataagagac

SEQ ID NO: 34447 - DNA, 27 bp, Artificial sequence
  SiRNA target sequence
gtgggatattgttatgtataagagaca

SEQ ID NO: 34448 - DNA, 27 bp, Artificial sequence
  SiRNA target sequence
tgggatattgttatgtataagagacac

SEQ ID NO: 34449 - DNA, 27 bp, Artificial sequence
  SiRNA target sequence
gggatattgttatgtataagagacaca

SEQ ID NO: 34450 - DNA, 27 bp, Artificial sequence
  SiRNA target sequence
ggatattgttatgtataagagacacac

SEQ ID NO: 34451 - DNA, 27 bp, Artificial sequence
  SiRNA target sequence
gatattgttatgtataagagacacaca

SEQ ID NO: 34452 - DNA, 27 bp, Artificial sequence
  SiRNA target sequence
atattgttatgtataagagacacacaa

SEQ ID NO: 34453 - DNA, 27 bp, Artificial sequence
  SiRNA target sequence
tattgttatgtataagagacacacaag

SEQ ID NO: 34454 - DNA, 27 bp, Artificial sequence
  SiRNA target sequence
attgttatgtataagagacacacaaga

SEQ ID NO: 34455 - DNA, 27 bp, Artificial sequence
  SiRNA target sequence
ttgttatgtataagagacacacaagaa

SEQ ID NO: 34456 - DNA, 27 bp, Artificial sequence
  SiRNA target sequence
tgttatgtataagagacacacaagaat

SEQ ID NO: 34457 - DNA, 27 bp, Artificial sequence
  SiRNA target sequence
gttatgtataagagacacacaagaatt

SEQ ID NO: 34458 - DNA, 27 bp, Artificial sequence
  SiRNA target sequence
ttatgtataagagacacacaagaattg

SEQ ID NO: 34459 - DNA, 27 bp, Artificial sequence
  SiRNA target sequence
tatgtataagagacacacaagaattgg

SEQ ID NO: 34460 - DNA, 27 bp, Artificial sequence
  SiRNA target sequence
atgtataagagacacacaagaattggt

SEQ ID NO: 34461 - DNA, 27 bp, Artificial sequence
  SiRNA target sequence
tgtataagagacacacaagaattggtt

SEQ ID NO: 34462 - DNA, 27 bp, Artificial sequence
  SiRNA target sequence
gtataagagacacacaagaattggttg

SEQ ID NO: 34463 - DNA, 27 bp, Artificial sequence
  SiRNA target sequence
tataagagacacacaagaattggttgt

SEQ ID NO: 34464 - DNA, 27 bp, Artificial sequence
  SiRNA target sequence
ataagagacacacaagaattggttgtt

SEQ ID NO: 34465 - DNA, 27 bp, Artificial sequence
  SiRNA target sequence
taagagacacacaagaattggttgttc

SEQ ID NO: 34466 - DNA, 27 bp, Artificial sequence
  SiRNA target sequence
aagagacacacaagaattggttgttcc

SEQ ID NO: 34467 - DNA, 27 bp, Artificial sequence
  SiRNA target sequence
agagacacacaagaattggttgttcct

SEQ ID NO: 34468 - DNA, 27 bp, Artificial sequence
  SiRNA target sequence
gagacacacaagaattggttgttccta

SEQ ID NO: 34469 - DNA, 27 bp, Artificial sequence
  SiRNA target sequence
agacacacaagaattggttgttcctag

SEQ ID NO: 34470 - DNA, 27 bp, Artificial sequence
  SiRNA target sequence
gacacacaagaattggttgttcctaga

SEQ ID NO: 34471 - DNA, 27 bp, Artificial sequence
  SiRNA target sequence
acacacaagaattggttgttcctagat

SEQ ID NO: 34472 - DNA, 27 bp, Artificial sequence
  SiRNA target sequence
cacacaagaattggttgttcctagatc

SEQ ID NO: 34473 - DNA, 27 bp, Artificial sequence
  SiRNA target sequence
acacaagaattggttgttcctagatca

SEQ ID NO: 34474 - DNA, 27 bp, Artificial sequence
  SiRNA target sequence
cacaagaattggttgttcctagatcaa

SEQ ID NO: 34475 - DNA, 27 bp, Artificial sequence
  SiRNA target sequence
acaagaattggttgttcctagatcaat

SEQ ID NO: 34476 - DNA, 27 bp, Artificial sequence
  SiRNA target sequence
caagaattggttgttcctagatcaatt

SEQ ID NO: 34477 - DNA, 27 bp, Artificial sequence
  SiRNA target sequence
aagaattggttgttcctagatcaattc

SEQ ID NO: 34478 - DNA, 27 bp, Artificial sequence
  SiRNA target sequence
agaattggttgttcctagatcaattcc

SEQ ID NO: 34479 - DNA, 27 bp, Artificial sequence
  SiRNA target sequence
gaattggttgttcctagatcaattcct

SEQ ID NO: 34480 - DNA, 27 bp, Artificial sequence
  SiRNA target sequence
aattggttgttcctagatcaattccta

SEQ ID NO: 34481 - DNA, 27 bp, Artificial sequence
  SiRNA target sequence
attggttgttcctagatcaattcctat

SEQ ID NO: 34482 - DNA, 27 bp, Artificial sequence
  SiRNA target sequence
ttggttgttcctagatcaattcctatt

SEQ ID NO: 34483 - DNA, 27 bp, Artificial sequence
  SiRNA target sequence
tggttgttcctagatcaattcctatta

SEQ ID NO: 34484 - DNA, 27 bp, Artificial sequence
  SiRNA target sequence
ggttgttcctagatcaattcctattat

SEQ ID NO: 34485 - DNA, 27 bp, Artificial sequence
  SiRNA target sequence
gttgttcctagatcaattcctattatt

SEQ ID NO: 34486 - DNA, 27 bp, Artificial sequence
  SiRNA target sequence
ttgttcctagatcaattcctattattt

SEQ ID NO: 34487 - DNA, 27 bp, Artificial sequence
  SiRNA target sequence
tgttcctagatcaattcctattatttt

SEQ ID NO: 34488 - DNA, 27 bp, Artificial sequence
  SiRNA target sequence
gttcctagatcaattcctattatttta

SEQ ID NO: 34489 - DNA, 27 bp, Artificial sequence
  SiRNA target sequence
ttcctagatcaattcctattattttag

SEQ ID NO: 34490 - DNA, 27 bp, Artificial sequence
  SiRNA target sequence
tcctagatcaattcctattattttaga

SEQ ID NO: 34491 - DNA, 27 bp, Artificial sequence
  SiRNA target sequence
cctagatcaattcctattattttagag

SEQ ID NO: 34492 - DNA, 27 bp, Artificial sequence
  SiRNA target sequence
ctagatcaattcctattattttagagc

SEQ ID NO: 34493 - DNA, 27 bp, Artificial sequence
  SiRNA target sequence
tagatcaattcctattattttagagct

SEQ ID NO: 34494 - DNA, 27 bp, Artificial sequence
  SiRNA target sequence
agatcaattcctattattttagagcta

SEQ ID NO: 34495 - DNA, 27 bp, Artificial sequence
  SiRNA target sequence
gatcaattcctattattttagagctaa

SEQ ID NO: 34496 - DNA, 27 bp, Artificial sequence
  SiRNA target sequence
atcaattcctattattttagagctaat

SEQ ID NO: 34497 - DNA, 27 bp, Artificial sequence
  SiRNA target sequence
tcaattcctattattttagagctaatt

SEQ ID NO: 34498 - DNA, 27 bp, Artificial sequence
  SiRNA target sequence
caattcctattattttagagctaattt

SEQ ID NO: 34499 - DNA, 27 bp, Artificial sequence
  SiRNA target sequence
aattcctattattttagagctaatttc

SEQ ID NO: 34500 - DNA, 27 bp, Artificial sequence
  SiRNA target sequence
attcctattattttagagctaatttct

SEQ ID NO: 34501 - DNA, 27 bp, Artificial sequence
  SiRNA target sequence
ttcctattattttagagctaatttctt

SEQ ID NO: 34502 - DNA, 27 bp, Artificial sequence
  SiRNA target sequence
tcctattattttagagctaatttcttc

SEQ ID NO: 34503 - DNA, 27 bp, Artificial sequence
  SiRNA target sequence
cctattattttagagctaatttcttct

SEQ ID NO: 34504 - DNA, 27 bp, Artificial sequence
  SiRNA target sequence
ctattattttagagctaatttcttctt

SEQ ID NO: 34505 - DNA, 27 bp, Artificial sequence
  SiRNA target sequence
tattattttagagctaatttcttcttt

SEQ ID NO: 34506 - DNA, 27 bp, Artificial sequence
  SiRNA target sequence
attattttagagctaatttcttcttta

SEQ ID NO: 34507 - DNA, 27 bp, Artificial sequence
  SiRNA target sequence
ttattttagagctaatttcttctttag

SEQ ID NO: 34508 - DNA, 27 bp, Artificial sequence
  SiRNA target sequence
tattttagagctaatttcttctttaga

SEQ ID NO: 34509 - DNA, 27 bp, Artificial sequence
  SiRNA target sequence
attttagagctaatttcttctttagac

SEQ ID NO: 34510 - DNA, 27 bp, Artificial sequence
  SiRNA target sequence
ttttagagctaatttcttctttagaca

SEQ ID NO: 34511 - DNA, 27 bp, Artificial sequence
  SiRNA target sequence
tttagagctaatttcttctttagacat

SEQ ID NO: 34512 - DNA, 19 bp, Artificial sequence
  SiRNA target sequence
ttataagtttaatgtagaa

SEQ ID NO: 34513 - DNA, 19 bp, Artificial sequence
  SiRNA target sequence
tataagtttaatgtagaaa

SEQ ID NO: 34514 - DNA, 19 bp, Artificial sequence
  SiRNA target sequence
ataagtttaatgtagaaat

SEQ ID NO: 34515 - DNA, 19 bp, Artificial sequence
  SiRNA target sequence
taagtttaatgtagaaata

SEQ ID NO: 34516 - DNA, 19 bp, Artificial sequence
  SiRNA target sequence
aagtttaatgtagaaataa

SEQ ID NO: 34517 - DNA, 19 bp, Artificial sequence
  SiRNA target sequence
agtttaatgtagaaataat

SEQ ID NO: 34518 - DNA, 19 bp, Artificial sequence
  SiRNA target sequence
gtttaatgtagaaataata

SEQ ID NO: 34519 - DNA, 19 bp, Artificial sequence
  SiRNA target sequence
tttaatgtagaaataatat

SEQ ID NO: 34520 - DNA, 19 bp, Artificial sequence
  SiRNA target sequence
ttaatgtagaaataatatt

SEQ ID NO: 34521 - DNA, 19 bp, Artificial sequence
  SiRNA target sequence
taatgtagaaataatattt

SEQ ID NO: 34522 - DNA, 19 bp, Artificial sequence
  SiRNA target sequence
aatgtagaaataatatttt

SEQ ID NO: 34523 - DNA, 19 bp, Artificial sequence
  SiRNA target sequence
atgtagaaataatattttc

SEQ ID NO: 34524 - DNA, 19 bp, Artificial sequence
  SiRNA target sequence
tgtagaaataatattttct

SEQ ID NO: 34525 - DNA, 19 bp, Artificial sequence
  SiRNA target sequence
gtagaaataatattttctt

SEQ ID NO: 34526 - DNA, 19 bp, Artificial sequence
  SiRNA target sequence
tagaaataatattttcttc

SEQ ID NO: 34527 - DNA, 19 bp, Artificial sequence
  SiRNA target sequence
agaaataatattttcttct

SEQ ID NO: 34528 - DNA, 19 bp, Artificial sequence
  SiRNA target sequence
gaaataatattttcttcta

SEQ ID NO: 34529 - DNA, 19 bp, Artificial sequence
  SiRNA target sequence
aaataatattttcttctat

SEQ ID NO: 34530 - DNA, 19 bp, Artificial sequence
  SiRNA target sequence
aataatattttcttctatc

SEQ ID NO: 34531 - DNA, 19 bp, Artificial sequence
  SiRNA target sequence
ataatattttcttctatct

SEQ ID NO: 34532 - DNA, 19 bp, Artificial sequence
  SiRNA target sequence
taatattttcttctatctt

SEQ ID NO: 34533 - DNA, 19 bp, Artificial sequence
  SiRNA target sequence
aatattttcttctatctta

SEQ ID NO: 34534 - DNA, 19 bp, Artificial sequence
  SiRNA target sequence
atattttcttctatcttat

SEQ ID NO: 34535 - DNA, 19 bp, Artificial sequence
  SiRNA target sequence
tattttcttctatcttatg

SEQ ID NO: 34536 - DNA, 19 bp, Artificial sequence
  SiRNA target sequence
attttcttctatcttatgt

SEQ ID NO: 34537 - DNA, 19 bp, Artificial sequence
  SiRNA target sequence
ttttcttctatcttatgta

SEQ ID NO: 34538 - DNA, 19 bp, Artificial sequence
  SiRNA target sequence
tttcttctatcttatgtaa

SEQ ID NO: 34539 - DNA, 19 bp, Artificial sequence
  SiRNA target sequence
ttcttctatcttatgtaat

SEQ ID NO: 34540 - DNA, 19 bp, Artificial sequence
  SiRNA target sequence
tcttctatcttatgtaatg

SEQ ID NO: 34541 - DNA, 19 bp, Artificial sequence
  SiRNA target sequence
cttctatcttatgtaatga

SEQ ID NO: 34542 - DNA, 19 bp, Artificial sequence
  SiRNA target sequence
ttctatcttatgtaatgat

SEQ ID NO: 34543 - DNA, 19 bp, Artificial sequence
  SiRNA target sequence
tctatcttatgtaatgata

SEQ ID NO: 34544 - DNA, 19 bp, Artificial sequence
  SiRNA target sequence
ctatcttatgtaatgatac

SEQ ID NO: 34545 - DNA, 19 bp, Artificial sequence
  SiRNA target sequence
tatcttatgtaatgataca

SEQ ID NO: 34546 - DNA, 19 bp, Artificial sequence
  SiRNA target sequence
atcttatgtaatgatacag

SEQ ID NO: 34547 - DNA, 19 bp, Artificial sequence
  SiRNA target sequence
tcttatgtaatgatacagt

SEQ ID NO: 34548 - DNA, 19 bp, Artificial sequence
  SiRNA target sequence
cttatgtaatgatacagtt

SEQ ID NO: 34549 - DNA, 19 bp, Artificial sequence
  SiRNA target sequence
ttatgtaatgatacagttt

SEQ ID NO: 34550 - DNA, 19 bp, Artificial sequence
  SiRNA target sequence
tatgtaatgatacagtttt

SEQ ID NO: 34551 - DNA, 19 bp, Artificial sequence
  SiRNA target sequence
atgtaatgatacagttttg

SEQ ID NO: 34552 - DNA, 19 bp, Artificial sequence
  SiRNA target sequence
tgtaatgatacagttttgt

SEQ ID NO: 34553 - DNA, 19 bp, Artificial sequence
  SiRNA target sequence
gtaatgatacagttttgtt

SEQ ID NO: 34554 - DNA, 19 bp, Artificial sequence
  SiRNA target sequence
taatgatacagttttgttt

SEQ ID NO: 34555 - DNA, 19 bp, Artificial sequence
  SiRNA target sequence
aatgatacagttttgtttt

SEQ ID NO: 34556 - DNA, 19 bp, Artificial sequence
  SiRNA target sequence
atgatacagttttgttttt

SEQ ID NO: 34557 - DNA, 19 bp, Artificial sequence
  SiRNA target sequence
tgatacagttttgttttta

SEQ ID NO: 34558 - DNA, 19 bp, Artificial sequence
  SiRNA target sequence
gatacagttttgtttttaa

SEQ ID NO: 34559 - DNA, 19 bp, Artificial sequence
  SiRNA target sequence
atacagttttgtttttaat

SEQ ID NO: 34560 - DNA, 19 bp, Artificial sequence
  SiRNA target sequence
tacagttttgtttttaata

SEQ ID NO: 34561 - DNA, 19 bp, Artificial sequence
  SiRNA target sequence
acagttttgtttttaatac

SEQ ID NO: 34562 - DNA, 19 bp, Artificial sequence
  SiRNA target sequence
cagttttgtttttaatact

SEQ ID NO: 34563 - DNA, 19 bp, Artificial sequence
  SiRNA target sequence
agttttgtttttaatactt

SEQ ID NO: 34564 - DNA, 19 bp, Artificial sequence
  SiRNA target sequence
gttttgtttttaatactta

SEQ ID NO: 34565 - DNA, 19 bp, Artificial sequence
  SiRNA target sequence
ttttgtttttaatacttag

SEQ ID NO: 34566 - DNA, 19 bp, Artificial sequence
  SiRNA target sequence
tttgtttttaatacttagc

SEQ ID NO: 34567 - DNA, 19 bp, Artificial sequence
  SiRNA target sequence
ttgtttttaatacttagca

SEQ ID NO: 34568 - DNA, 19 bp, Artificial sequence
  SiRNA target sequence
tgtttttaatacttagcac

SEQ ID NO: 34569 - DNA, 19 bp, Artificial sequence
  SiRNA target sequence
gtttttaatacttagcact

SEQ ID NO: 34570 - DNA, 19 bp, Artificial sequence
  SiRNA target sequence
tttttaatacttagcactt

SEQ ID NO: 34571 - DNA, 19 bp, Artificial sequence
  SiRNA target sequence
ttttaatacttagcacttt

SEQ ID NO: 34572 - DNA, 19 bp, Artificial sequence
  SiRNA target sequence
tttaatacttagcacttta

SEQ ID NO: 34573 - DNA, 19 bp, Artificial sequence
  SiRNA target sequence
ttaatacttagcactttat

SEQ ID NO: 34574 - DNA, 19 bp, Artificial sequence
  SiRNA target sequence
taatacttagcactttatc

SEQ ID NO: 34575 - DNA, 19 bp, Artificial sequence
  SiRNA target sequence
aatacttagcactttatca

SEQ ID NO: 34576 - DNA, 19 bp, Artificial sequence
  SiRNA target sequence
atacttagcactttatcaa

SEQ ID NO: 34577 - DNA, 19 bp, Artificial sequence
  SiRNA target sequence
tacttagcactttatcaaa

SEQ ID NO: 34578 - DNA, 19 bp, Artificial sequence
  SiRNA target sequence
acttagcactttatcaaat

SEQ ID NO: 34579 - DNA, 19 bp, Artificial sequence
  SiRNA target sequence
cttagcactttatcaaata

SEQ ID NO: 34580 - DNA, 19 bp, Artificial sequence
  SiRNA target sequence
ttagcactttatcaaataa

SEQ ID NO: 34581 - DNA, 19 bp, Artificial sequence
  SiRNA target sequence
tagcactttatcaaataag

SEQ ID NO: 34582 - DNA, 19 bp, Artificial sequence
  SiRNA target sequence
agcactttatcaaataagt

SEQ ID NO: 34583 - DNA, 19 bp, Artificial sequence
  SiRNA target sequence
gcactttatcaaataagtg

SEQ ID NO: 34584 - DNA, 19 bp, Artificial sequence
  SiRNA target sequence
cactttatcaaataagtgg

SEQ ID NO: 34585 - DNA, 19 bp, Artificial sequence
  SiRNA target sequence
actttatcaaataagtgga

SEQ ID NO: 34586 - DNA, 19 bp, Artificial sequence
  SiRNA target sequence
ctttatcaaataagtggag

SEQ ID NO: 34587 - DNA, 19 bp, Artificial sequence
  SiRNA target sequence
tttatcaaataagtggagt

SEQ ID NO: 34588 - DNA, 19 bp, Artificial sequence
  SiRNA target sequence
ttatcaaataagtggagta

SEQ ID NO: 34589 - DNA, 19 bp, Artificial sequence
  SiRNA target sequence
tatcaaataagtggagtaa

SEQ ID NO: 34590 - DNA, 19 bp, Artificial sequence
  SiRNA target sequence
atcaaataagtggagtaaa

SEQ ID NO: 34591 - DNA, 19 bp, Artificial sequence
  SiRNA target sequence
tcaaataagtggagtaaat

SEQ ID NO: 34592 - DNA, 19 bp, Artificial sequence
  SiRNA target sequence
caaataagtggagtaaatc

SEQ ID NO: 34593 - DNA, 19 bp, Artificial sequence
  SiRNA target sequence
aaataagtggagtaaatct

SEQ ID NO: 34594 - DNA, 19 bp, Artificial sequence
  SiRNA target sequence
aataagtggagtaaatcta

SEQ ID NO: 34595 - DNA, 19 bp, Artificial sequence
  SiRNA target sequence
ataagtggagtaaatctaa

SEQ ID NO: 34596 - DNA, 19 bp, Artificial sequence
  SiRNA target sequence
taagtggagtaaatctaaa

SEQ ID NO: 34597 - DNA, 19 bp, Artificial sequence
  SiRNA target sequence
aagtggagtaaatctaaat

SEQ ID NO: 34598 - DNA, 19 bp, Artificial sequence
  SiRNA target sequence
agtggagtaaatctaaatt

SEQ ID NO: 34599 - DNA, 19 bp, Artificial sequence
  SiRNA target sequence
gtggagtaaatctaaatta

SEQ ID NO: 34600 - DNA, 19 bp, Artificial sequence
  SiRNA target sequence
tggagtaaatctaaattat

SEQ ID NO: 34601 - DNA, 19 bp, Artificial sequence
  SiRNA target sequence
ggagtaaatctaaattatg

SEQ ID NO: 34602 - DNA, 19 bp, Artificial sequence
  SiRNA target sequence
gagtaaatctaaattatgt

SEQ ID NO: 34603 - DNA, 19 bp, Artificial sequence
  SiRNA target sequence
agtaaatctaaattatgta

SEQ ID NO: 34604 - DNA, 19 bp, Artificial sequence
  SiRNA target sequence
gtaaatctaaattatgtaa

SEQ ID NO: 34605 - DNA, 19 bp, Artificial sequence
  SiRNA target sequence
taaatctaaattatgtaaa

SEQ ID NO: 34606 - DNA, 19 bp, Artificial sequence
  SiRNA target sequence
aaatctaaattatgtaaaa

SEQ ID NO: 34607 - DNA, 19 bp, Artificial sequence
  SiRNA target sequence
aatctaaattatgtaaaac

SEQ ID NO: 34608 - DNA, 19 bp, Artificial sequence
  SiRNA target sequence
atctaaattatgtaaaaca

SEQ ID NO: 34609 - DNA, 19 bp, Artificial sequence
  SiRNA target sequence
tctaaattatgtaaaacaa

SEQ ID NO: 34610 - DNA, 19 bp, Artificial sequence
  SiRNA target sequence
ctaaattatgtaaaacaat

SEQ ID NO: 34611 - DNA, 19 bp, Artificial sequence
  SiRNA target sequence
taaattatgtaaaacaata

SEQ ID NO: 34612 - DNA, 19 bp, Artificial sequence
  SiRNA target sequence
aaattatgtaaaacaataa

SEQ ID NO: 34613 - DNA, 19 bp, Artificial sequence
  SiRNA target sequence
aattatgtaaaacaataat

SEQ ID NO: 34614 - DNA, 19 bp, Artificial sequence
  SiRNA target sequence
attatgtaaaacaataatt

SEQ ID NO: 34615 - DNA, 19 bp, Artificial sequence
  SiRNA target sequence
ttatgtaaaacaataatta

SEQ ID NO: 34616 - DNA, 19 bp, Artificial sequence
  SiRNA target sequence
tatgtaaaacaataattat

SEQ ID NO: 34617 - DNA, 19 bp, Artificial sequence
  SiRNA target sequence
atgtaaaacaataattatc

SEQ ID NO: 34618 - DNA, 19 bp, Artificial sequence
  SiRNA target sequence
tgtaaaacaataattatcg

SEQ ID NO: 34619 - DNA, 19 bp, Artificial sequence
  SiRNA target sequence
gtaaaacaataattatcgt

SEQ ID NO: 34620 - DNA, 19 bp, Artificial sequence
  SiRNA target sequence
taaaacaataattatcgtc

SEQ ID NO: 34621 - DNA, 19 bp, Artificial sequence
  SiRNA target sequence
aaaacaataattatcgtct

SEQ ID NO: 34622 - DNA, 19 bp, Artificial sequence
  SiRNA target sequence
aaacaataattatcgtctt

SEQ ID NO: 34623 - DNA, 19 bp, Artificial sequence
  SiRNA target sequence
aacaataattatcgtcttc

SEQ ID NO: 34624 - DNA, 19 bp, Artificial sequence
  SiRNA target sequence
acaataattatcgtcttct

SEQ ID NO: 34625 - DNA, 19 bp, Artificial sequence
  SiRNA target sequence
caataattatcgtcttctc

SEQ ID NO: 34626 - DNA, 19 bp, Artificial sequence
  SiRNA target sequence
aataattatcgtcttctct

SEQ ID NO: 34627 - DNA, 19 bp, Artificial sequence
  SiRNA target sequence
ataattatcgtcttctcta

SEQ ID NO: 34628 - DNA, 19 bp, Artificial sequence
  SiRNA target sequence
taattatcgtcttctctaa

SEQ ID NO: 34629 - DNA, 19 bp, Artificial sequence
  SiRNA target sequence
aattatcgtcttctctaag

SEQ ID NO: 34630 - DNA, 19 bp, Artificial sequence
  SiRNA target sequence
attatcgtcttctctaagt

SEQ ID NO: 34631 - DNA, 19 bp, Artificial sequence
  SiRNA target sequence
ttatcgtcttctctaagtt

SEQ ID NO: 34632 - DNA, 19 bp, Artificial sequence
  SiRNA target sequence
tatcgtcttctctaagttg

SEQ ID NO: 34633 - DNA, 19 bp, Artificial sequence
  SiRNA target sequence
atcgtcttctctaagttgt

SEQ ID NO: 34634 - DNA, 19 bp, Artificial sequence
  SiRNA target sequence
tcgtcttctctaagttgtt

SEQ ID NO: 34635 - DNA, 19 bp, Artificial sequence
  SiRNA target sequence
cgtcttctctaagttgttg

SEQ ID NO: 34636 - DNA, 19 bp, Artificial sequence
  SiRNA target sequence
gtcttctctaagttgttgg

SEQ ID NO: 34637 - DNA, 19 bp, Artificial sequence
  SiRNA target sequence
tcttctctaagttgttgga

SEQ ID NO: 34638 - DNA, 19 bp, Artificial sequence
  SiRNA target sequence
cttctctaagttgttggag

SEQ ID NO: 34639 - DNA, 19 bp, Artificial sequence
  SiRNA target sequence
ttctctaagttgttggaga

SEQ ID NO: 34640 - DNA, 19 bp, Artificial sequence
  SiRNA target sequence
tctctaagttgttggagat

SEQ ID NO: 34641 - DNA, 19 bp, Artificial sequence
  SiRNA target sequence
ctctaagttgttggagatt

SEQ ID NO: 34642 - DNA, 19 bp, Artificial sequence
  SiRNA target sequence
tctaagttgttggagatta

SEQ ID NO: 34643 - DNA, 19 bp, Artificial sequence
  SiRNA target sequence
ctaagttgttggagattag

SEQ ID NO: 34644 - DNA, 19 bp, Artificial sequence
  SiRNA target sequence
taagttgttggagattaga

SEQ ID NO: 34645 - DNA, 19 bp, Artificial sequence
  SiRNA target sequence
aagttgttggagattagac

SEQ ID NO: 34646 - DNA, 19 bp, Artificial sequence
  SiRNA target sequence
agttgttggagattagact

SEQ ID NO: 34647 - DNA, 19 bp, Artificial sequence
  SiRNA target sequence
gttgttggagattagactt

SEQ ID NO: 34648 - DNA, 19 bp, Artificial sequence
  SiRNA target sequence
ttgttggagattagacttt

SEQ ID NO: 34649 - DNA, 19 bp, Artificial sequence
  SiRNA target sequence
tgttggagattagactttt

SEQ ID NO: 34650 - DNA, 19 bp, Artificial sequence
  SiRNA target sequence
gttggagattagactttta

SEQ ID NO: 34651 - DNA, 19 bp, Artificial sequence
  SiRNA target sequence
ttggagattagacttttaa

SEQ ID NO: 34652 - DNA, 19 bp, Artificial sequence
  SiRNA target sequence
tggagattagacttttaag

SEQ ID NO: 34653 - DNA, 19 bp, Artificial sequence
  SiRNA target sequence
ggagattagacttttaaga

SEQ ID NO: 34654 - DNA, 19 bp, Artificial sequence
  SiRNA target sequence
gagattagacttttaagaa

SEQ ID NO: 34655 - DNA, 19 bp, Artificial sequence
  SiRNA target sequence
agattagacttttaagaat

SEQ ID NO: 34656 - DNA, 19 bp, Artificial sequence
  SiRNA target sequence
gattagacttttaagaatt

SEQ ID NO: 34657 - DNA, 19 bp, Artificial sequence
  SiRNA target sequence
attagacttttaagaattt

SEQ ID NO: 34658 - DNA, 19 bp, Artificial sequence
  SiRNA target sequence
ttagacttttaagaatttc

SEQ ID NO: 34659 - DNA, 19 bp, Artificial sequence
  SiRNA target sequence
tagacttttaagaatttca

SEQ ID NO: 34660 - DNA, 19 bp, Artificial sequence
  SiRNA target sequence
agacttttaagaatttcat

SEQ ID NO: 34661 - DNA, 19 bp, Artificial sequence
  SiRNA target sequence
gacttttaagaatttcata

SEQ ID NO: 34662 - DNA, 19 bp, Artificial sequence
  SiRNA target sequence
acttttaagaatttcatat

SEQ ID NO: 34663 - DNA, 19 bp, Artificial sequence
  SiRNA target sequence
cttttaagaatttcatatt

SEQ ID NO: 34664 - DNA, 19 bp, Artificial sequence
  SiRNA target sequence
ttttaagaatttcatattc

SEQ ID NO: 34665 - DNA, 19 bp, Artificial sequence
  SiRNA target sequence
tttaagaatttcatattca

SEQ ID NO: 34666 - DNA, 19 bp, Artificial sequence
  SiRNA target sequence
ttaagaatttcatattcag

SEQ ID NO: 34667 - DNA, 19 bp, Artificial sequence
  SiRNA target sequence
taagaatttcatattcagc

SEQ ID NO: 34668 - DNA, 19 bp, Artificial sequence
  SiRNA target sequence
aagaatttcatattcagct

SEQ ID NO: 34669 - DNA, 19 bp, Artificial sequence
  SiRNA target sequence
agaatttcatattcagctt

SEQ ID NO: 34670 - DNA, 19 bp, Artificial sequence
  SiRNA target sequence
gaatttcatattcagcttt

SEQ ID NO: 34671 - DNA, 19 bp, Artificial sequence
  SiRNA target sequence
aatttcatattcagctttt

SEQ ID NO: 34672 - DNA, 19 bp, Artificial sequence
  SiRNA target sequence
atttcatattcagcttttt

SEQ ID NO: 34673 - DNA, 19 bp, Artificial sequence
  SiRNA target sequence
tttcatattcagctttttt

SEQ ID NO: 34674 - DNA, 19 bp, Artificial sequence
  SiRNA target sequence
ttcatattcagcttttttg

SEQ ID NO: 34675 - DNA, 19 bp, Artificial sequence
  SiRNA target sequence
tcatattcagcttttttgt

SEQ ID NO: 34676 - DNA, 19 bp, Artificial sequence
  SiRNA target sequence
catattcagcttttttgtc

SEQ ID NO: 34677 - DNA, 19 bp, Artificial sequence
  SiRNA target sequence
atattcagcttttttgtcc

SEQ ID NO: 34678 - DNA, 19 bp, Artificial sequence
  SiRNA target sequence
tattcagcttttttgtcca

SEQ ID NO: 34679 - DNA, 19 bp, Artificial sequence
  SiRNA target sequence
attcagcttttttgtccaa

SEQ ID NO: 34680 - DNA, 19 bp, Artificial sequence
  SiRNA target sequence
ttcagcttttttgtccaat

SEQ ID NO: 34681 - DNA, 19 bp, Artificial sequence
  SiRNA target sequence
tcagcttttttgtccaatg

SEQ ID NO: 34682 - DNA, 19 bp, Artificial sequence
  SiRNA target sequence
cagcttttttgtccaatgc

SEQ ID NO: 34683 - DNA, 19 bp, Artificial sequence
  SiRNA target sequence
agcttttttgtccaatgcg

SEQ ID NO: 34684 - DNA, 19 bp, Artificial sequence
  SiRNA target sequence
gcttttttgtccaatgcgg

SEQ ID NO: 34685 - DNA, 19 bp, Artificial sequence
  SiRNA target sequence
cttttttgtccaatgcggc

SEQ ID NO: 34686 - DNA, 19 bp, Artificial sequence
  SiRNA target sequence
ttttttgtccaatgcggcc

SEQ ID NO: 34687 - DNA, 19 bp, Artificial sequence
  SiRNA target sequence
tttttgtccaatgcggccg

SEQ ID NO: 34688 - DNA, 19 bp, Artificial sequence
  SiRNA target sequence
ttttgtccaatgcggccgt

SEQ ID NO: 34689 - DNA, 19 bp, Artificial sequence
  SiRNA target sequence
tttgtccaatgcggccgtt

SEQ ID NO: 34690 - DNA, 19 bp, Artificial sequence
  SiRNA target sequence
ttgtccaatgcggccgttg

SEQ ID NO: 34691 - DNA, 19 bp, Artificial sequence
  SiRNA target sequence
tgtccaatgcggccgttgg

SEQ ID NO: 34692 - DNA, 19 bp, Artificial sequence
  SiRNA target sequence
gtccaatgcggccgttggc

SEQ ID NO: 34693 - DNA, 19 bp, Artificial sequence
  SiRNA target sequence
tccaatgcggccgttggct

SEQ ID NO: 34694 - DNA, 19 bp, Artificial sequence
  SiRNA target sequence
ccaatgcggccgttggctc

SEQ ID NO: 34695 - DNA, 19 bp, Artificial sequence
  SiRNA target sequence
caatgcggccgttggctca

SEQ ID NO: 34696 - DNA, 19 bp, Artificial sequence
  SiRNA target sequence
aatgcggccgttggctcat

SEQ ID NO: 34697 - DNA, 19 bp, Artificial sequence
  SiRNA target sequence
atgcggccgttggctcatc

SEQ ID NO: 34698 - DNA, 19 bp, Artificial sequence
  SiRNA target sequence
tgcggccgttggctcatct

SEQ ID NO: 34699 - DNA, 19 bp, Artificial sequence
  SiRNA target sequence
gcggccgttggctcatcta

SEQ ID NO: 34700 - DNA, 19 bp, Artificial sequence
  SiRNA target sequence
cggccgttggctcatctaa

SEQ ID NO: 34701 - DNA, 19 bp, Artificial sequence
  SiRNA target sequence
ggccgttggctcatctaaa

SEQ ID NO: 34702 - DNA, 19 bp, Artificial sequence
  SiRNA target sequence
gccgttggctcatctaaaa

SEQ ID NO: 34703 - DNA, 19 bp, Artificial sequence
  SiRNA target sequence
ccgttggctcatctaaaat

SEQ ID NO: 34704 - DNA, 19 bp, Artificial sequence
  SiRNA target sequence
cgttggctcatctaaaatt

SEQ ID NO: 34705 - DNA, 19 bp, Artificial sequence
  SiRNA target sequence
gttggctcatctaaaatta

SEQ ID NO: 34706 - DNA, 19 bp, Artificial sequence
  SiRNA target sequence
ttggctcatctaaaattat

SEQ ID NO: 34707 - DNA, 19 bp, Artificial sequence
  SiRNA target sequence
tggctcatctaaaattata

SEQ ID NO: 34708 - DNA, 19 bp, Artificial sequence
  SiRNA target sequence
ggctcatctaaaattataa

SEQ ID NO: 34709 - DNA, 19 bp, Artificial sequence
  SiRNA target sequence
gctcatctaaaattataat

SEQ ID NO: 34710 - DNA, 19 bp, Artificial sequence
  SiRNA target sequence
ctcatctaaaattataata

SEQ ID NO: 34711 - DNA, 19 bp, Artificial sequence
  SiRNA target sequence
tcatctaaaattataatag

SEQ ID NO: 34712 - DNA, 19 bp, Artificial sequence
  SiRNA target sequence
catctaaaattataatagg

SEQ ID NO: 34713 - DNA, 19 bp, Artificial sequence
  SiRNA target sequence
atctaaaattataatagga

SEQ ID NO: 34714 - DNA, 19 bp, Artificial sequence
  SiRNA target sequence
tctaaaattataataggag

SEQ ID NO: 34715 - DNA, 19 bp, Artificial sequence
  SiRNA target sequence
ctaaaattataataggaga

SEQ ID NO: 34716 - DNA, 19 bp, Artificial sequence
  SiRNA target sequence
taaaattataataggagaa

SEQ ID NO: 34717 - DNA, 19 bp, Artificial sequence
  SiRNA target sequence
aaaattataataggagaat

SEQ ID NO: 34718 - DNA, 19 bp, Artificial sequence
  SiRNA target sequence
aaattataataggagaatt

SEQ ID NO: 34719 - DNA, 19 bp, Artificial sequence
  SiRNA target sequence
aattataataggagaattt

SEQ ID NO: 34720 - DNA, 19 bp, Artificial sequence
  SiRNA target sequence
attataataggagaatttt

SEQ ID NO: 34721 - DNA, 19 bp, Artificial sequence
  SiRNA target sequence
ttataataggagaattttt

SEQ ID NO: 34722 - DNA, 19 bp, Artificial sequence
  SiRNA target sequence
tataataggagaatttttt

SEQ ID NO: 34723 - DNA, 19 bp, Artificial sequence
  SiRNA target sequence
ataataggagaatttttta

SEQ ID NO: 34724 - DNA, 19 bp, Artificial sequence
  SiRNA target sequence
taataggagaattttttag

SEQ ID NO: 34725 - DNA, 19 bp, Artificial sequence
  SiRNA target sequence
aataggagaattttttagt

SEQ ID NO: 34726 - DNA, 19 bp, Artificial sequence
  SiRNA target sequence
ataggagaattttttagtg

SEQ ID NO: 34727 - DNA, 19 bp, Artificial sequence
  SiRNA target sequence
taggagaattttttagtgc

SEQ ID NO: 34728 - DNA, 19 bp, Artificial sequence
  SiRNA target sequence
aggagaattttttagtgcc

SEQ ID NO: 34729 - DNA, 19 bp, Artificial sequence
  SiRNA target sequence
ggagaattttttagtgccg

SEQ ID NO: 34730 - DNA, 19 bp, Artificial sequence
  SiRNA target sequence
gagaattttttagtgccga

SEQ ID NO: 34731 - DNA, 19 bp, Artificial sequence
  SiRNA target sequence
agaattttttagtgccgac

SEQ ID NO: 34732 - DNA, 19 bp, Artificial sequence
  SiRNA target sequence
gaattttttagtgccgacc

SEQ ID NO: 34733 - DNA, 19 bp, Artificial sequence
  SiRNA target sequence
aattttttagtgccgacct

SEQ ID NO: 34734 - DNA, 19 bp, Artificial sequence
  SiRNA target sequence
attttttagtgccgacctt

SEQ ID NO: 34735 - DNA, 19 bp, Artificial sequence
  SiRNA target sequence
ttttttagtgccgacctta

SEQ ID NO: 34736 - DNA, 19 bp, Artificial sequence
  SiRNA target sequence
tttttagtgccgaccttaa

SEQ ID NO: 34737 - DNA, 19 bp, Artificial sequence
  SiRNA target sequence
ttttagtgccgaccttaac

SEQ ID NO: 34738 - DNA, 19 bp, Artificial sequence
  SiRNA target sequence
tttagtgccgaccttaaca

SEQ ID NO: 34739 - DNA, 19 bp, Artificial sequence
  SiRNA target sequence
ttagtgccgaccttaacaa

SEQ ID NO: 34740 - DNA, 19 bp, Artificial sequence
  SiRNA target sequence
tagtgccgaccttaacaaa

SEQ ID NO: 34741 - DNA, 19 bp, Artificial sequence
  SiRNA target sequence
agtgccgaccttaacaaaa

SEQ ID NO: 34742 - DNA, 19 bp, Artificial sequence
  SiRNA target sequence
gtgccgaccttaacaaaat

SEQ ID NO: 34743 - DNA, 19 bp, Artificial sequence
  SiRNA target sequence
tgccgaccttaacaaaatt

SEQ ID NO: 34744 - DNA, 19 bp, Artificial sequence
  SiRNA target sequence
gccgaccttaacaaaatta

SEQ ID NO: 34745 - DNA, 19 bp, Artificial sequence
  SiRNA target sequence
ccgaccttaacaaaattac

SEQ ID NO: 34746 - DNA, 19 bp, Artificial sequence
  SiRNA target sequence
cgaccttaacaaaattact

SEQ ID NO: 34747 - DNA, 19 bp, Artificial sequence
  SiRNA target sequence
gaccttaacaaaattactt

SEQ ID NO: 34748 - DNA, 19 bp, Artificial sequence
  SiRNA target sequence
accttaacaaaattacttt

SEQ ID NO: 34749 - DNA, 19 bp, Artificial sequence
  SiRNA target sequence
ccttaacaaaattactttt

SEQ ID NO: 34750 - DNA, 19 bp, Artificial sequence
  SiRNA target sequence
cttaacaaaattacttttt

SEQ ID NO: 34751 - DNA, 19 bp, Artificial sequence
  SiRNA target sequence
ttaacaaaattactttttg

SEQ ID NO: 34752 - DNA, 19 bp, Artificial sequence
  SiRNA target sequence
taacaaaattactttttgt

SEQ ID NO: 34753 - DNA, 19 bp, Artificial sequence
  SiRNA target sequence
aacaaaattactttttgtc

SEQ ID NO: 34754 - DNA, 19 bp, Artificial sequence
  SiRNA target sequence
acaaaattactttttgtct

SEQ ID NO: 34755 - DNA, 19 bp, Artificial sequence
  SiRNA target sequence
caaaattactttttgtctt

SEQ ID NO: 34756 - DNA, 19 bp, Artificial sequence
  SiRNA target sequence
aaaattactttttgtcttt

SEQ ID NO: 34757 - DNA, 19 bp, Artificial sequence
  SiRNA target sequence
aaattactttttgtctttc

SEQ ID NO: 34758 - DNA, 19 bp, Artificial sequence
  SiRNA target sequence
aattactttttgtctttct

SEQ ID NO: 34759 - DNA, 19 bp, Artificial sequence
  SiRNA target sequence
attactttttgtctttctc

SEQ ID NO: 34760 - DNA, 19 bp, Artificial sequence
  SiRNA target sequence
ttactttttgtctttctcc

SEQ ID NO: 34761 - DNA, 19 bp, Artificial sequence
  SiRNA target sequence
tactttttgtctttctcca

SEQ ID NO: 34762 - DNA, 19 bp, Artificial sequence
  SiRNA target sequence
actttttgtctttctccac

SEQ ID NO: 34763 - DNA, 19 bp, Artificial sequence
  SiRNA target sequence
ctttttgtctttctccacc

SEQ ID NO: 34764 - DNA, 19 bp, Artificial sequence
  SiRNA target sequence
tttttgtctttctccacca

SEQ ID NO: 34765 - DNA, 19 bp, Artificial sequence
  SiRNA target sequence
ttttgtctttctccaccac

SEQ ID NO: 34766 - DNA, 19 bp, Artificial sequence
  SiRNA target sequence
tttgtctttctccaccact

SEQ ID NO: 34767 - DNA, 19 bp, Artificial sequence
  SiRNA target sequence
ttgtctttctccaccacta

SEQ ID NO: 34768 - DNA, 19 bp, Artificial sequence
  SiRNA target sequence
tgtctttctccaccactaa

SEQ ID NO: 34769 - DNA, 19 bp, Artificial sequence
  SiRNA target sequence
gtctttctccaccactaag

SEQ ID NO: 34770 - DNA, 19 bp, Artificial sequence
  SiRNA target sequence
tctttctccaccactaagc

SEQ ID NO: 34771 - DNA, 19 bp, Artificial sequence
  SiRNA target sequence
ctttctccaccactaagct

SEQ ID NO: 34772 - DNA, 19 bp, Artificial sequence
  SiRNA target sequence
tttctccaccactaagctt

SEQ ID NO: 34773 - DNA, 19 bp, Artificial sequence
  SiRNA target sequence
ttctccaccactaagctta

SEQ ID NO: 34774 - DNA, 19 bp, Artificial sequence
  SiRNA target sequence
tctccaccactaagcttat

SEQ ID NO: 34775 - DNA, 19 bp, Artificial sequence
  SiRNA target sequence
ctccaccactaagcttatg

SEQ ID NO: 34776 - DNA, 19 bp, Artificial sequence
  SiRNA target sequence
tccaccactaagcttatgt

SEQ ID NO: 34777 - DNA, 19 bp, Artificial sequence
  SiRNA target sequence
ccaccactaagcttatgtc

SEQ ID NO: 34778 - DNA, 19 bp, Artificial sequence
  SiRNA target sequence
caccactaagcttatgtcc

SEQ ID NO: 34779 - DNA, 19 bp, Artificial sequence
  SiRNA target sequence
accactaagcttatgtccc

SEQ ID NO: 34780 - DNA, 19 bp, Artificial sequence
  SiRNA target sequence
ccactaagcttatgtccct

SEQ ID NO: 34781 - DNA, 19 bp, Artificial sequence
  SiRNA target sequence
cactaagcttatgtccctt

SEQ ID NO: 34782 - DNA, 19 bp, Artificial sequence
  SiRNA target sequence
actaagcttatgtccctta

SEQ ID NO: 34783 - DNA, 19 bp, Artificial sequence
  SiRNA target sequence
ctaagcttatgtcccttat

SEQ ID NO: 34784 - DNA, 19 bp, Artificial sequence
  SiRNA target sequence
taagcttatgtcccttatc

SEQ ID NO: 34785 - DNA, 19 bp, Artificial sequence
  SiRNA target sequence
aagcttatgtcccttatct

SEQ ID NO: 34786 - DNA, 19 bp, Artificial sequence
  SiRNA target sequence
agcttatgtcccttatctc

SEQ ID NO: 34787 - DNA, 19 bp, Artificial sequence
  SiRNA target sequence
gcttatgtcccttatctcc

SEQ ID NO: 34788 - DNA, 19 bp, Artificial sequence
  SiRNA target sequence
cttatgtcccttatctcca

SEQ ID NO: 34789 - DNA, 19 bp, Artificial sequence
  SiRNA target sequence
ttatgtcccttatctccaa

SEQ ID NO: 34790 - DNA, 19 bp, Artificial sequence
  SiRNA target sequence
tatgtcccttatctccaac

SEQ ID NO: 34791 - DNA, 19 bp, Artificial sequence
  SiRNA target sequence
atgtcccttatctccaaca

SEQ ID NO: 34792 - DNA, 19 bp, Artificial sequence
  SiRNA target sequence
tgtcccttatctccaacat

SEQ ID NO: 34793 - DNA, 19 bp, Artificial sequence
  SiRNA target sequence
gtcccttatctccaacatg

SEQ ID NO: 34794 - DNA, 19 bp, Artificial sequence
  SiRNA target sequence
tcccttatctccaacatgt

SEQ ID NO: 34795 - DNA, 19 bp, Artificial sequence
  SiRNA target sequence
cccttatctccaacatgtg

SEQ ID NO: 34796 - DNA, 19 bp, Artificial sequence
  SiRNA target sequence
ccttatctccaacatgtgt

SEQ ID NO: 34797 - DNA, 19 bp, Artificial sequence
  SiRNA target sequence
cttatctccaacatgtgtg

SEQ ID NO: 34798 - DNA, 19 bp, Artificial sequence
  SiRNA target sequence
ttatctccaacatgtgtgt

SEQ ID NO: 34799 - DNA, 19 bp, Artificial sequence
  SiRNA target sequence
tatctccaacatgtgtgtt

SEQ ID NO: 34800 - DNA, 19 bp, Artificial sequence
  SiRNA target sequence
atctccaacatgtgtgttg

SEQ ID NO: 34801 - DNA, 19 bp, Artificial sequence
  SiRNA target sequence
tctccaacatgtgtgttgt

SEQ ID NO: 34802 - DNA, 19 bp, Artificial sequence
  SiRNA target sequence
ctccaacatgtgtgttgta

SEQ ID NO: 34803 - DNA, 19 bp, Artificial sequence
  SiRNA target sequence
tccaacatgtgtgttgtat

SEQ ID NO: 34804 - DNA, 19 bp, Artificial sequence
  SiRNA target sequence
ccaacatgtgtgttgtatt

SEQ ID NO: 34805 - DNA, 19 bp, Artificial sequence
  SiRNA target sequence
caacatgtgtgttgtattc

SEQ ID NO: 34806 - DNA, 19 bp, Artificial sequence
  SiRNA target sequence
aacatgtgtgttgtattca

SEQ ID NO: 34807 - DNA, 19 bp, Artificial sequence
  SiRNA target sequence
acatgtgtgttgtattcat

SEQ ID NO: 34808 - DNA, 19 bp, Artificial sequence
  SiRNA target sequence
catgtgtgttgtattcatc

SEQ ID NO: 34809 - DNA, 19 bp, Artificial sequence
  SiRNA target sequence
atgtgtgttgtattcatcc

SEQ ID NO: 34810 - DNA, 19 bp, Artificial sequence
  SiRNA target sequence
tgtgtgttgtattcatcct

SEQ ID NO: 34811 - DNA, 19 bp, Artificial sequence
  SiRNA target sequence
gtgtgttgtattcatcctc

SEQ ID NO: 34812 - DNA, 19 bp, Artificial sequence
  SiRNA target sequence
tgtgttgtattcatcctct

SEQ ID NO: 34813 - DNA, 19 bp, Artificial sequence
  SiRNA target sequence
gtgttgtattcatcctcta

SEQ ID NO: 34814 - DNA, 19 bp, Artificial sequence
  SiRNA target sequence
tgttgtattcatcctctag

SEQ ID NO: 34815 - DNA, 19 bp, Artificial sequence
  SiRNA target sequence
gttgtattcatcctctagg

SEQ ID NO: 34816 - DNA, 19 bp, Artificial sequence
  SiRNA target sequence
ttgtattcatcctctaggt

SEQ ID NO: 34817 - DNA, 19 bp, Artificial sequence
  SiRNA target sequence
tgtattcatcctctaggtt

SEQ ID NO: 34818 - DNA, 19 bp, Artificial sequence
  SiRNA target sequence
gtattcatcctctaggttg

SEQ ID NO: 34819 - DNA, 19 bp, Artificial sequence
  SiRNA target sequence
tattcatcctctaggttgt

SEQ ID NO: 34820 - DNA, 19 bp, Artificial sequence
  SiRNA target sequence
attcatcctctaggttgtt

SEQ ID NO: 34821 - DNA, 19 bp, Artificial sequence
  SiRNA target sequence
ttcatcctctaggttgttt

SEQ ID NO: 34822 - DNA, 19 bp, Artificial sequence
  SiRNA target sequence
tcatcctctaggttgttta

SEQ ID NO: 34823 - DNA, 19 bp, Artificial sequence
  SiRNA target sequence
catcctctaggttgtttat

SEQ ID NO: 34824 - DNA, 19 bp, Artificial sequence
  SiRNA target sequence
atcctctaggttgtttata

SEQ ID NO: 34825 - DNA, 19 bp, Artificial sequence
  SiRNA target sequence
tcctctaggttgtttatag

SEQ ID NO: 34826 - DNA, 19 bp, Artificial sequence
  SiRNA target sequence
cctctaggttgtttataga

SEQ ID NO: 34827 - DNA, 19 bp, Artificial sequence
  SiRNA target sequence
ctctaggttgtttatagaa

SEQ ID NO: 34828 - DNA, 19 bp, Artificial sequence
  SiRNA target sequence
tctaggttgtttatagaat

SEQ ID NO: 34829 - DNA, 19 bp, Artificial sequence
  SiRNA target sequence
ctaggttgtttatagaatc

SEQ ID NO: 34830 - DNA, 19 bp, Artificial sequence
  SiRNA target sequence
taggttgtttatagaatcg

SEQ ID NO: 34831 - DNA, 19 bp, Artificial sequence
  SiRNA target sequence
aggttgtttatagaatcgt

SEQ ID NO: 34832 - DNA, 19 bp, Artificial sequence
  SiRNA target sequence
ggttgtttatagaatcgtg

SEQ ID NO: 34833 - DNA, 19 bp, Artificial sequence
  SiRNA target sequence
gttgtttatagaatcgtgt

SEQ ID NO: 34834 - DNA, 19 bp, Artificial sequence
  SiRNA target sequence
ttgtttatagaatcgtgta

SEQ ID NO: 34835 - DNA, 19 bp, Artificial sequence
  SiRNA target sequence
tgtttatagaatcgtgtac

SEQ ID NO: 34836 - DNA, 19 bp, Artificial sequence
  SiRNA target sequence
gtttatagaatcgtgtaca

SEQ ID NO: 34837 - DNA, 19 bp, Artificial sequence
  SiRNA target sequence
tttatagaatcgtgtacac

SEQ ID NO: 34838 - DNA, 19 bp, Artificial sequence
  SiRNA target sequence
ttatagaatcgtgtacaca

SEQ ID NO: 34839 - DNA, 19 bp, Artificial sequence
  SiRNA target sequence
tatagaatcgtgtacacaa

SEQ ID NO: 34840 - DNA, 19 bp, Artificial sequence
  SiRNA target sequence
atagaatcgtgtacacaaa

SEQ ID NO: 34841 - DNA, 19 bp, Artificial sequence
  SiRNA target sequence
tagaatcgtgtacacaaag

SEQ ID NO: 34842 - DNA, 19 bp, Artificial sequence
  SiRNA target sequence
agaatcgtgtacacaaagt

SEQ ID NO: 34843 - DNA, 19 bp, Artificial sequence
  SiRNA target sequence
gaatcgtgtacacaaagtt

SEQ ID NO: 34844 - DNA, 19 bp, Artificial sequence
  SiRNA target sequence
aatcgtgtacacaaagttt

SEQ ID NO: 34845 - DNA, 19 bp, Artificial sequence
  SiRNA target sequence
atcgtgtacacaaagtttt

SEQ ID NO: 34846 - DNA, 19 bp, Artificial sequence
  SiRNA target sequence
tcgtgtacacaaagttttt

SEQ ID NO: 34847 - DNA, 19 bp, Artificial sequence
  SiRNA target sequence
cgtgtacacaaagtttttt

SEQ ID NO: 34848 - DNA, 19 bp, Artificial sequence
  SiRNA target sequence
gtgtacacaaagtttttta

SEQ ID NO: 34849 - DNA, 19 bp, Artificial sequence
  SiRNA target sequence
tgtacacaaagttttttac

SEQ ID NO: 34850 - DNA, 19 bp, Artificial sequence
  SiRNA target sequence
gtacacaaagttttttact

SEQ ID NO: 34851 - DNA, 19 bp, Artificial sequence
  SiRNA target sequence
tacacaaagttttttactg

SEQ ID NO: 34852 - DNA, 19 bp, Artificial sequence
  SiRNA target sequence
acacaaagttttttactga

SEQ ID NO: 34853 - DNA, 19 bp, Artificial sequence
  SiRNA target sequence
cacaaagttttttactgat

SEQ ID NO: 34854 - DNA, 19 bp, Artificial sequence
  SiRNA target sequence
acaaagttttttactgatt

SEQ ID NO: 34855 - DNA, 19 bp, Artificial sequence
  SiRNA target sequence
caaagttttttactgattt

SEQ ID NO: 34856 - DNA, 19 bp, Artificial sequence
  SiRNA target sequence
aaagttttttactgatttt

SEQ ID NO: 34857 - DNA, 19 bp, Artificial sequence
  SiRNA target sequence
aagttttttactgattttt

SEQ ID NO: 34858 - DNA, 19 bp, Artificial sequence
  SiRNA target sequence
agttttttactgattttta

SEQ ID NO: 34859 - DNA, 19 bp, Artificial sequence
  SiRNA target sequence
gttttttactgatttttat

SEQ ID NO: 34860 - DNA, 19 bp, Artificial sequence
  SiRNA target sequence
ttttttactgatttttata

SEQ ID NO: 34861 - DNA, 19 bp, Artificial sequence
  SiRNA target sequence
tttttactgatttttataa

SEQ ID NO: 34862 - DNA, 19 bp, Artificial sequence
  SiRNA target sequence
ttttactgatttttataac

SEQ ID NO: 34863 - DNA, 19 bp, Artificial sequence
  SiRNA target sequence
tttactgatttttataact

SEQ ID NO: 34864 - DNA, 19 bp, Artificial sequence
  SiRNA target sequence
ttactgatttttataactt

SEQ ID NO: 34865 - DNA, 19 bp, Artificial sequence
  SiRNA target sequence
tactgatttttataacttc

SEQ ID NO: 34866 - DNA, 19 bp, Artificial sequence
  SiRNA target sequence
actgatttttataacttct

SEQ ID NO: 34867 - DNA, 19 bp, Artificial sequence
  SiRNA target sequence
ctgatttttataacttctt

SEQ ID NO: 34868 - DNA, 19 bp, Artificial sequence
  SiRNA target sequence
tgatttttataacttcttc

SEQ ID NO: 34869 - DNA, 19 bp, Artificial sequence
  SiRNA target sequence
gatttttataacttcttct

SEQ ID NO: 34870 - DNA, 19 bp, Artificial sequence
  SiRNA target sequence
atttttataacttcttctt

SEQ ID NO: 34871 - DNA, 19 bp, Artificial sequence
  SiRNA target sequence
tttttataacttcttcttt

SEQ ID NO: 34872 - DNA, 19 bp, Artificial sequence
  SiRNA target sequence
ttttataacttcttcttta

SEQ ID NO: 34873 - DNA, 19 bp, Artificial sequence
  SiRNA target sequence
tttataacttcttctttat

SEQ ID NO: 34874 - DNA, 19 bp, Artificial sequence
  SiRNA target sequence
ttataacttcttctttatc

SEQ ID NO: 34875 - DNA, 19 bp, Artificial sequence
  SiRNA target sequence
tataacttcttctttatca

SEQ ID NO: 34876 - DNA, 19 bp, Artificial sequence
  SiRNA target sequence
ataacttcttctttatcaa

SEQ ID NO: 34877 - DNA, 19 bp, Artificial sequence
  SiRNA target sequence
taacttcttctttatcaaa

SEQ ID NO: 34878 - DNA, 19 bp, Artificial sequence
  SiRNA target sequence
aacttcttctttatcaaat

SEQ ID NO: 34879 - DNA, 19 bp, Artificial sequence
  SiRNA target sequence
acttcttctttatcaaata

SEQ ID NO: 34880 - DNA, 19 bp, Artificial sequence
  SiRNA target sequence
cttcttctttatcaaatat

SEQ ID NO: 34881 - DNA, 19 bp, Artificial sequence
  SiRNA target sequence
ttcttctttatcaaatatt

SEQ ID NO: 34882 - DNA, 19 bp, Artificial sequence
  SiRNA target sequence
tcttctttatcaaatattt

SEQ ID NO: 34883 - DNA, 19 bp, Artificial sequence
  SiRNA target sequence
cttctttatcaaatatttc

SEQ ID NO: 34884 - DNA, 19 bp, Artificial sequence
  SiRNA target sequence
ttctttatcaaatatttct

SEQ ID NO: 34885 - DNA, 19 bp, Artificial sequence
  SiRNA target sequence
tctttatcaaatatttctt

SEQ ID NO: 34886 - DNA, 19 bp, Artificial sequence
  SiRNA target sequence
ctttatcaaatatttcttt

SEQ ID NO: 34887 - DNA, 19 bp, Artificial sequence
  SiRNA target sequence
tttatcaaatatttctttt

SEQ ID NO: 34888 - DNA, 19 bp, Artificial sequence
  SiRNA target sequence
ttatcaaatatttcttttc

SEQ ID NO: 34889 - DNA, 19 bp, Artificial sequence
  SiRNA target sequence
tatcaaatatttcttttcc

SEQ ID NO: 34890 - DNA, 19 bp, Artificial sequence
  SiRNA target sequence
atcaaatatttcttttcca

SEQ ID NO: 34891 - DNA, 19 bp, Artificial sequence
  SiRNA target sequence
tcaaatatttcttttccat

SEQ ID NO: 34892 - DNA, 19 bp, Artificial sequence
  SiRNA target sequence
caaatatttcttttccata

SEQ ID NO: 34893 - DNA, 19 bp, Artificial sequence
  SiRNA target sequence
aaatatttcttttccatat

SEQ ID NO: 34894 - DNA, 19 bp, Artificial sequence
  SiRNA target sequence
aatatttcttttccatatg

SEQ ID NO: 34895 - DNA, 19 bp, Artificial sequence
  SiRNA target sequence
atatttcttttccatatgt

SEQ ID NO: 34896 - DNA, 19 bp, Artificial sequence
  SiRNA target sequence
tatttcttttccatatgtt

SEQ ID NO: 34897 - DNA, 19 bp, Artificial sequence
  SiRNA target sequence
atttcttttccatatgtta

SEQ ID NO: 34898 - DNA, 19 bp, Artificial sequence
  SiRNA target sequence
tttcttttccatatgttaa

SEQ ID NO: 34899 - DNA, 19 bp, Artificial sequence
  SiRNA target sequence
ttcttttccatatgttaaa

SEQ ID NO: 34900 - DNA, 19 bp, Artificial sequence
  SiRNA target sequence
tcttttccatatgttaaat

SEQ ID NO: 34901 - DNA, 19 bp, Artificial sequence
  SiRNA target sequence
cttttccatatgttaaatt

SEQ ID NO: 34902 - DNA, 19 bp, Artificial sequence
  SiRNA target sequence
ttttccatatgttaaatta

SEQ ID NO: 34903 - DNA, 19 bp, Artificial sequence
  SiRNA target sequence
tttccatatgttaaattat

SEQ ID NO: 34904 - DNA, 19 bp, Artificial sequence
  SiRNA target sequence
ttccatatgttaaattata

SEQ ID NO: 34905 - DNA, 19 bp, Artificial sequence
  SiRNA target sequence
tccatatgttaaattataa

SEQ ID NO: 34906 - DNA, 19 bp, Artificial sequence
  SiRNA target sequence
ccatatgttaaattataat

SEQ ID NO: 34907 - DNA, 19 bp, Artificial sequence
  SiRNA target sequence
catatgttaaattataata

SEQ ID NO: 34908 - DNA, 19 bp, Artificial sequence
  SiRNA target sequence
atatgttaaattataataa

SEQ ID NO: 34909 - DNA, 19 bp, Artificial sequence
  SiRNA target sequence
tatgttaaattataataaa

SEQ ID NO: 34910 - DNA, 19 bp, Artificial sequence
  SiRNA target sequence
atgttaaattataataaac

SEQ ID NO: 34911 - DNA, 19 bp, Artificial sequence
  SiRNA target sequence
tgttaaattataataaacc

SEQ ID NO: 34912 - DNA, 19 bp, Artificial sequence
  SiRNA target sequence
gttaaattataataaaccg

SEQ ID NO: 34913 - DNA, 19 bp, Artificial sequence
  SiRNA target sequence
ttaaattataataaaccgt

SEQ ID NO: 34914 - DNA, 19 bp, Artificial sequence
  SiRNA target sequence
taaattataataaaccgtt

SEQ ID NO: 34915 - DNA, 19 bp, Artificial sequence
  SiRNA target sequence
aaattataataaaccgttt

SEQ ID NO: 34916 - DNA, 19 bp, Artificial sequence
  SiRNA target sequence
aattataataaaccgtttc

SEQ ID NO: 34917 - DNA, 19 bp, Artificial sequence
  SiRNA target sequence
attataataaaccgtttcg

SEQ ID NO: 34918 - DNA, 19 bp, Artificial sequence
  SiRNA target sequence
ttataataaaccgtttcgt

SEQ ID NO: 34919 - DNA, 19 bp, Artificial sequence
  SiRNA target sequence
tataataaaccgtttcgtt

SEQ ID NO: 34920 - DNA, 19 bp, Artificial sequence
  SiRNA target sequence
ataataaaccgtttcgtta

SEQ ID NO: 34921 - DNA, 19 bp, Artificial sequence
  SiRNA target sequence
taataaaccgtttcgttaa

SEQ ID NO: 34922 - DNA, 19 bp, Artificial sequence
  SiRNA target sequence
aataaaccgtttcgttaaa

SEQ ID NO: 34923 - DNA, 19 bp, Artificial sequence
  SiRNA target sequence
ataaaccgtttcgttaaac

SEQ ID NO: 34924 - DNA, 19 bp, Artificial sequence
  SiRNA target sequence
taaaccgtttcgttaaaca

SEQ ID NO: 34925 - DNA, 19 bp, Artificial sequence
  SiRNA target sequence
aaaccgtttcgttaaacaa

SEQ ID NO: 34926 - DNA, 19 bp, Artificial sequence
  SiRNA target sequence
aaccgtttcgttaaacaaa

SEQ ID NO: 34927 - DNA, 19 bp, Artificial sequence
  SiRNA target sequence
accgtttcgttaaacaaaa

SEQ ID NO: 34928 - DNA, 19 bp, Artificial sequence
  SiRNA target sequence
ccgtttcgttaaacaaaaa

SEQ ID NO: 34929 - DNA, 19 bp, Artificial sequence
  SiRNA target sequence
cgtttcgttaaacaaaaat

SEQ ID NO: 34930 - DNA, 19 bp, Artificial sequence
  SiRNA target sequence
gtttcgttaaacaaaaatg

SEQ ID NO: 34931 - DNA, 19 bp, Artificial sequence
  SiRNA target sequence
tttcgttaaacaaaaatga

SEQ ID NO: 34932 - DNA, 19 bp, Artificial sequence
  SiRNA target sequence
ttcgttaaacaaaaatgag

SEQ ID NO: 34933 - DNA, 19 bp, Artificial sequence
  SiRNA target sequence
tcgttaaacaaaaatgagg

SEQ ID NO: 34934 - DNA, 19 bp, Artificial sequence
  SiRNA target sequence
cgttaaacaaaaatgaggt

SEQ ID NO: 34935 - DNA, 19 bp, Artificial sequence
  SiRNA target sequence
gttaaacaaaaatgaggtt

SEQ ID NO: 34936 - DNA, 19 bp, Artificial sequence
  SiRNA target sequence
ttaaacaaaaatgaggttt

SEQ ID NO: 34937 - DNA, 19 bp, Artificial sequence
  SiRNA target sequence
taaacaaaaatgaggtttg

SEQ ID NO: 34938 - DNA, 19 bp, Artificial sequence
  SiRNA target sequence
aaacaaaaatgaggtttgt

SEQ ID NO: 34939 - DNA, 19 bp, Artificial sequence
  SiRNA target sequence
aacaaaaatgaggtttgtg

SEQ ID NO: 34940 - DNA, 19 bp, Artificial sequence
  SiRNA target sequence
acaaaaatgaggtttgtgg

SEQ ID NO: 34941 - DNA, 19 bp, Artificial sequence
  SiRNA target sequence
caaaaatgaggtttgtggt

SEQ ID NO: 34942 - DNA, 19 bp, Artificial sequence
  SiRNA target sequence
aaaaatgaggtttgtggtg

SEQ ID NO: 34943 - DNA, 19 bp, Artificial sequence
  SiRNA target sequence
aaaatgaggtttgtggtgc

SEQ ID NO: 34944 - DNA, 19 bp, Artificial sequence
  SiRNA target sequence
aaatgaggtttgtggtgca

SEQ ID NO: 34945 - DNA, 19 bp, Artificial sequence
  SiRNA target sequence
aatgaggtttgtggtgcaa

SEQ ID NO: 34946 - DNA, 19 bp, Artificial sequence
  SiRNA target sequence
atgaggtttgtggtgcaaa

SEQ ID NO: 34947 - DNA, 19 bp, Artificial sequence
  SiRNA target sequence
tgaggtttgtggtgcaaat

SEQ ID NO: 34948 - DNA, 19 bp, Artificial sequence
  SiRNA target sequence
gaggtttgtggtgcaaatg

SEQ ID NO: 34949 - DNA, 19 bp, Artificial sequence
  SiRNA target sequence
aggtttgtggtgcaaatga

SEQ ID NO: 34950 - DNA, 19 bp, Artificial sequence
  SiRNA target sequence
ggtttgtggtgcaaatgat

SEQ ID NO: 34951 - DNA, 19 bp, Artificial sequence
  SiRNA target sequence
gtttgtggtgcaaatgata

SEQ ID NO: 34952 - DNA, 19 bp, Artificial sequence
  SiRNA target sequence
tttgtggtgcaaatgatat

SEQ ID NO: 34953 - DNA, 19 bp, Artificial sequence
  SiRNA target sequence
ttgtggtgcaaatgatata

SEQ ID NO: 34954 - DNA, 19 bp, Artificial sequence
  SiRNA target sequence
tgtggtgcaaatgatataa

SEQ ID NO: 34955 - DNA, 19 bp, Artificial sequence
  SiRNA target sequence
gtggtgcaaatgatataag

SEQ ID NO: 34956 - DNA, 19 bp, Artificial sequence
  SiRNA target sequence
tggtgcaaatgatataagt

SEQ ID NO: 34957 - DNA, 19 bp, Artificial sequence
  SiRNA target sequence
ggtgcaaatgatataagtg

SEQ ID NO: 34958 - DNA, 19 bp, Artificial sequence
  SiRNA target sequence
gtgcaaatgatataagtga

SEQ ID NO: 34959 - DNA, 19 bp, Artificial sequence
  SiRNA target sequence
tgcaaatgatataagtgat

SEQ ID NO: 34960 - DNA, 19 bp, Artificial sequence
  SiRNA target sequence
gcaaatgatataagtgatc

SEQ ID NO: 34961 - DNA, 19 bp, Artificial sequence
  SiRNA target sequence
caaatgatataagtgatct

SEQ ID NO: 34962 - DNA, 19 bp, Artificial sequence
  SiRNA target sequence
aaatgatataagtgatcta

SEQ ID NO: 34963 - DNA, 19 bp, Artificial sequence
  SiRNA target sequence
aatgatataagtgatctat

SEQ ID NO: 34964 - DNA, 19 bp, Artificial sequence
  SiRNA target sequence
atgatataagtgatctata

SEQ ID NO: 34965 - DNA, 19 bp, Artificial sequence
  SiRNA target sequence
tgatataagtgatctatat

SEQ ID NO: 34966 - DNA, 19 bp, Artificial sequence
  SiRNA target sequence
gatataagtgatctatatg

SEQ ID NO: 34967 - DNA, 19 bp, Artificial sequence
  SiRNA target sequence
atataagtgatctatatga

SEQ ID NO: 34968 - DNA, 19 bp, Artificial sequence
  SiRNA target sequence
tataagtgatctatatgaa

SEQ ID NO: 34969 - DNA, 19 bp, Artificial sequence
  SiRNA target sequence
ataagtgatctatatgaac

SEQ ID NO: 34970 - DNA, 19 bp, Artificial sequence
  SiRNA target sequence
taagtgatctatatgaact

SEQ ID NO: 34971 - DNA, 19 bp, Artificial sequence
  SiRNA target sequence
aagtgatctatatgaacta

SEQ ID NO: 34972 - DNA, 19 bp, Artificial sequence
  SiRNA target sequence
agtgatctatatgaactat

SEQ ID NO: 34973 - DNA, 19 bp, Artificial sequence
  SiRNA target sequence
gtgatctatatgaactatt

SEQ ID NO: 34974 - DNA, 19 bp, Artificial sequence
  SiRNA target sequence
tgatctatatgaactatta

SEQ ID NO: 34975 - DNA, 19 bp, Artificial sequence
  SiRNA target sequence
gatctatatgaactattag

SEQ ID NO: 34976 - DNA, 19 bp, Artificial sequence
  SiRNA target sequence
atctatatgaactattaga

SEQ ID NO: 34977 - DNA, 19 bp, Artificial sequence
  SiRNA target sequence
tctatatgaactattagaa

SEQ ID NO: 34978 - DNA, 19 bp, Artificial sequence
  SiRNA target sequence
ctatatgaactattagaaa

SEQ ID NO: 34979 - DNA, 19 bp, Artificial sequence
  SiRNA target sequence
tatatgaactattagaaat

SEQ ID NO: 34980 - DNA, 19 bp, Artificial sequence
  SiRNA target sequence
atatgaactattagaaatt

SEQ ID NO: 34981 - DNA, 19 bp, Artificial sequence
  SiRNA target sequence
tatgaactattagaaattt

SEQ ID NO: 34982 - DNA, 19 bp, Artificial sequence
  SiRNA target sequence
atgaactattagaaatttc

SEQ ID NO: 34983 - DNA, 19 bp, Artificial sequence
  SiRNA target sequence
tgaactattagaaatttct

SEQ ID NO: 34984 - DNA, 19 bp, Artificial sequence
  SiRNA target sequence
gaactattagaaatttctt

SEQ ID NO: 34985 - DNA, 19 bp, Artificial sequence
  SiRNA target sequence
aactattagaaatttcttt

SEQ ID NO: 34986 - DNA, 19 bp, Artificial sequence
  SiRNA target sequence
actattagaaatttctttt

SEQ ID NO: 34987 - DNA, 19 bp, Artificial sequence
  SiRNA target sequence
ctattagaaatttctttta

SEQ ID NO: 34988 - DNA, 19 bp, Artificial sequence
  SiRNA target sequence
tattagaaatttcttttat

SEQ ID NO: 34989 - DNA, 19 bp, Artificial sequence
  SiRNA target sequence
attagaaatttcttttata

SEQ ID NO: 34990 - DNA, 19 bp, Artificial sequence
  SiRNA target sequence
ttagaaatttcttttatat

SEQ ID NO: 34991 - DNA, 19 bp, Artificial sequence
  SiRNA target sequence
tagaaatttcttttatatc

SEQ ID NO: 34992 - DNA, 19 bp, Artificial sequence
  SiRNA target sequence
agaaatttcttttatatct

SEQ ID NO: 34993 - DNA, 19 bp, Artificial sequence
  SiRNA target sequence
gaaatttcttttatatctc

SEQ ID NO: 34994 - DNA, 19 bp, Artificial sequence
  SiRNA target sequence
aaatttcttttatatctcg

SEQ ID NO: 34995 - DNA, 19 bp, Artificial sequence
  SiRNA target sequence
aatttcttttatatctcga

SEQ ID NO: 34996 - DNA, 19 bp, Artificial sequence
  SiRNA target sequence
atttcttttatatctcgat

SEQ ID NO: 34997 - DNA, 19 bp, Artificial sequence
  SiRNA target sequence
tttcttttatatctcgatt

SEQ ID NO: 34998 - DNA, 19 bp, Artificial sequence
  SiRNA target sequence
ttcttttatatctcgatta

SEQ ID NO: 34999 - DNA, 19 bp, Artificial sequence
  SiRNA target sequence
tcttttatatctcgattat

SEQ ID NO: 35000 - DNA, 19 bp, Artificial sequence
  SiRNA target sequence
cttttatatctcgattatc

SEQ ID NO: 35001 - DNA, 19 bp, Artificial sequence
  SiRNA target sequence
ttttatatctcgattatct

SEQ ID NO: 35002 - DNA, 19 bp, Artificial sequence
  SiRNA target sequence
tttatatctcgattatcta

SEQ ID NO: 35003 - DNA, 19 bp, Artificial sequence
  SiRNA target sequence
ttatatctcgattatctag

SEQ ID NO: 35004 - DNA, 19 bp, Artificial sequence
  SiRNA target sequence
tatatctcgattatctaga

SEQ ID NO: 35005 - DNA, 19 bp, Artificial sequence
  SiRNA target sequence
atatctcgattatctagat

SEQ ID NO: 35006 - DNA, 19 bp, Artificial sequence
  SiRNA target sequence
tatctcgattatctagata

SEQ ID NO: 35007 - DNA, 19 bp, Artificial sequence
  SiRNA target sequence
atctcgattatctagataa

SEQ ID NO: 35008 - DNA, 19 bp, Artificial sequence
  SiRNA target sequence
tctcgattatctagataaa

SEQ ID NO: 35009 - DNA, 19 bp, Artificial sequence
  SiRNA target sequence
ctcgattatctagataaat

SEQ ID NO: 35010 - DNA, 19 bp, Artificial sequence
  SiRNA target sequence
tcgattatctagataaata

SEQ ID NO: 35011 - DNA, 19 bp, Artificial sequence
  SiRNA target sequence
cgattatctagataaatat

SEQ ID NO: 35012 - DNA, 19 bp, Artificial sequence
  SiRNA target sequence
gattatctagataaatatt

SEQ ID NO: 35013 - DNA, 19 bp, Artificial sequence
  SiRNA target sequence
attatctagataaatattt

SEQ ID NO: 35014 - DNA, 19 bp, Artificial sequence
  SiRNA target sequence
ttatctagataaatatttc

SEQ ID NO: 35015 - DNA, 19 bp, Artificial sequence
  SiRNA target sequence
tatctagataaatatttcc

SEQ ID NO: 35016 - DNA, 19 bp, Artificial sequence
  SiRNA target sequence
atctagataaatatttccc

SEQ ID NO: 35017 - DNA, 19 bp, Artificial sequence
  SiRNA target sequence
tctagataaatatttcccc

SEQ ID NO: 35018 - DNA, 19 bp, Artificial sequence
  SiRNA target sequence
ctagataaatatttccccc

SEQ ID NO: 35019 - DNA, 19 bp, Artificial sequence
  SiRNA target sequence
tagataaatatttccccca

SEQ ID NO: 35020 - DNA, 19 bp, Artificial sequence
  SiRNA target sequence
agataaatatttcccccat

SEQ ID NO: 35021 - DNA, 19 bp, Artificial sequence
  SiRNA target sequence
gataaatatttcccccata

SEQ ID NO: 35022 - DNA, 19 bp, Artificial sequence
  SiRNA target sequence
ataaatatttcccccataa

SEQ ID NO: 35023 - DNA, 19 bp, Artificial sequence
  SiRNA target sequence
taaatatttcccccataat

SEQ ID NO: 35024 - DNA, 19 bp, Artificial sequence
  SiRNA target sequence
aaatatttcccccataatt

SEQ ID NO: 35025 - DNA, 19 bp, Artificial sequence
  SiRNA target sequence
aatatttcccccataattt

SEQ ID NO: 35026 - DNA, 19 bp, Artificial sequence
  SiRNA target sequence
atatttcccccataatttt

SEQ ID NO: 35027 - DNA, 19 bp, Artificial sequence
  SiRNA target sequence
tatttcccccataattttc

SEQ ID NO: 35028 - DNA, 19 bp, Artificial sequence
  SiRNA target sequence
atttcccccataattttca

SEQ ID NO: 35029 - DNA, 19 bp, Artificial sequence
  SiRNA target sequence
tttcccccataattttcaa

SEQ ID NO: 35030 - DNA, 19 bp, Artificial sequence
  SiRNA target sequence
ttcccccataattttcaaa

SEQ ID NO: 35031 - DNA, 19 bp, Artificial sequence
  SiRNA target sequence
tcccccataattttcaaat

SEQ ID NO: 35032 - DNA, 19 bp, Artificial sequence
  SiRNA target sequence
cccccataattttcaaatc

SEQ ID NO: 35033 - DNA, 19 bp, Artificial sequence
  SiRNA target sequence
ccccataattttcaaatct

SEQ ID NO: 35034 - DNA, 19 bp, Artificial sequence
  SiRNA target sequence
cccataattttcaaatctc

SEQ ID NO: 35035 - DNA, 19 bp, Artificial sequence
  SiRNA target sequence
ccataattttcaaatctca

SEQ ID NO: 35036 - DNA, 19 bp, Artificial sequence
  SiRNA target sequence
cataattttcaaatctcat

SEQ ID NO: 35037 - DNA, 19 bp, Artificial sequence
  SiRNA target sequence
ataattttcaaatctcata

SEQ ID NO: 35038 - DNA, 19 bp, Artificial sequence
  SiRNA target sequence
taattttcaaatctcataa

SEQ ID NO: 35039 - DNA, 19 bp, Artificial sequence
  SiRNA target sequence
aattttcaaatctcataat

SEQ ID NO: 35040 - DNA, 19 bp, Artificial sequence
  SiRNA target sequence
attttcaaatctcataatc

SEQ ID NO: 35041 - DNA, 19 bp, Artificial sequence
  SiRNA target sequence
ttttcaaatctcataatca

SEQ ID NO: 35042 - DNA, 19 bp, Artificial sequence
  SiRNA target sequence
tttcaaatctcataatcat

SEQ ID NO: 35043 - DNA, 19 bp, Artificial sequence
  SiRNA target sequence
ttcaaatctcataatcatc

SEQ ID NO: 35044 - DNA, 19 bp, Artificial sequence
  SiRNA target sequence
tcaaatctcataatcatct

SEQ ID NO: 35045 - DNA, 19 bp, Artificial sequence
  SiRNA target sequence
caaatctcataatcatctt

SEQ ID NO: 35046 - DNA, 19 bp, Artificial sequence
  SiRNA target sequence
aaatctcataatcatcttt

SEQ ID NO: 35047 - DNA, 19 bp, Artificial sequence
  SiRNA target sequence
aatctcataatcatcttta

SEQ ID NO: 35048 - DNA, 19 bp, Artificial sequence
  SiRNA target sequence
atctcataatcatctttat

SEQ ID NO: 35049 - DNA, 19 bp, Artificial sequence
  SiRNA target sequence
tctcataatcatctttata

SEQ ID NO: 35050 - DNA, 19 bp, Artificial sequence
  SiRNA target sequence
ctcataatcatctttataa

SEQ ID NO: 35051 - DNA, 19 bp, Artificial sequence
  SiRNA target sequence
tcataatcatctttataag

SEQ ID NO: 35052 - DNA, 19 bp, Artificial sequence
  SiRNA target sequence
cataatcatctttataaga

SEQ ID NO: 35053 - DNA, 19 bp, Artificial sequence
  SiRNA target sequence
ataatcatctttataagag

SEQ ID NO: 35054 - DNA, 19 bp, Artificial sequence
  SiRNA target sequence
taatcatctttataagaga

SEQ ID NO: 35055 - DNA, 19 bp, Artificial sequence
  SiRNA target sequence
aatcatctttataagagat

SEQ ID NO: 35056 - DNA, 19 bp, Artificial sequence
  SiRNA target sequence
atcatctttataagagatg

SEQ ID NO: 35057 - DNA, 19 bp, Artificial sequence
  SiRNA target sequence
tcatctttataagagatgt

SEQ ID NO: 35058 - DNA, 19 bp, Artificial sequence
  SiRNA target sequence
catctttataagagatgtt

SEQ ID NO: 35059 - DNA, 19 bp, Artificial sequence
  SiRNA target sequence
atctttataagagatgttt

SEQ ID NO: 35060 - DNA, 19 bp, Artificial sequence
  SiRNA target sequence
tctttataagagatgtttt

SEQ ID NO: 35061 - DNA, 19 bp, Artificial sequence
  SiRNA target sequence
ctttataagagatgttttt

SEQ ID NO: 35062 - DNA, 19 bp, Artificial sequence
  SiRNA target sequence
tttataagagatgtttttc

SEQ ID NO: 35063 - DNA, 19 bp, Artificial sequence
  SiRNA target sequence
ttataagagatgtttttcc

SEQ ID NO: 35064 - DNA, 19 bp, Artificial sequence
  SiRNA target sequence
tataagagatgtttttccc

SEQ ID NO: 35065 - DNA, 19 bp, Artificial sequence
  SiRNA target sequence
ataagagatgtttttcccg

SEQ ID NO: 35066 - DNA, 19 bp, Artificial sequence
  SiRNA target sequence
taagagatgtttttcccga

SEQ ID NO: 35067 - DNA, 19 bp, Artificial sequence
  SiRNA target sequence
aagagatgtttttcccgat

SEQ ID NO: 35068 - DNA, 19 bp, Artificial sequence
  SiRNA target sequence
agagatgtttttcccgatc

SEQ ID NO: 35069 - DNA, 19 bp, Artificial sequence
  SiRNA target sequence
gagatgtttttcccgatcc

SEQ ID NO: 35070 - DNA, 19 bp, Artificial sequence
  SiRNA target sequence
agatgtttttcccgatcca

SEQ ID NO: 35071 - DNA, 19 bp, Artificial sequence
  SiRNA target sequence
gatgtttttcccgatccat

SEQ ID NO: 35072 - DNA, 19 bp, Artificial sequence
  SiRNA target sequence
atgtttttcccgatccatt

SEQ ID NO: 35073 - DNA, 19 bp, Artificial sequence
  SiRNA target sequence
tgtttttcccgatccattt

SEQ ID NO: 35074 - DNA, 19 bp, Artificial sequence
  SiRNA target sequence
gtttttcccgatccatttt

SEQ ID NO: 35075 - DNA, 19 bp, Artificial sequence
  SiRNA target sequence
tttttcccgatccattttt

SEQ ID NO: 35076 - DNA, 19 bp, Artificial sequence
  SiRNA target sequence
ttttcccgatccatttttt

SEQ ID NO: 35077 - DNA, 19 bp, Artificial sequence
  SiRNA target sequence
tttcccgatccattttttc

SEQ ID NO: 35078 - DNA, 19 bp, Artificial sequence
  SiRNA target sequence
ttcccgatccattttttcc

SEQ ID NO: 35079 - DNA, 19 bp, Artificial sequence
  SiRNA target sequence
tcccgatccattttttcca

SEQ ID NO: 35080 - DNA, 19 bp, Artificial sequence
  SiRNA target sequence
cccgatccattttttccaa

SEQ ID NO: 35081 - DNA, 19 bp, Artificial sequence
  SiRNA target sequence
ccgatccattttttccaat

SEQ ID NO: 35082 - DNA, 19 bp, Artificial sequence
  SiRNA target sequence
cgatccattttttccaata

SEQ ID NO: 35083 - DNA, 19 bp, Artificial sequence
  SiRNA target sequence
gatccattttttccaataa

SEQ ID NO: 35084 - DNA, 19 bp, Artificial sequence
  SiRNA target sequence
atccattttttccaataat

SEQ ID NO: 35085 - DNA, 19 bp, Artificial sequence
  SiRNA target sequence
tccattttttccaataata

SEQ ID NO: 35086 - DNA, 19 bp, Artificial sequence
  SiRNA target sequence
ccattttttccaataatag

SEQ ID NO: 35087 - DNA, 19 bp, Artificial sequence
  SiRNA target sequence
cattttttccaataatagc

SEQ ID NO: 35088 - DNA, 19 bp, Artificial sequence
  SiRNA target sequence
attttttccaataatagct

SEQ ID NO: 35089 - DNA, 19 bp, Artificial sequence
  SiRNA target sequence
ttttttccaataatagcta

SEQ ID NO: 35090 - DNA, 19 bp, Artificial sequence
  SiRNA target sequence
tttttccaataatagctac

SEQ ID NO: 35091 - DNA, 19 bp, Artificial sequence
  SiRNA target sequence
ttttccaataatagctact

SEQ ID NO: 35092 - DNA, 19 bp, Artificial sequence
  SiRNA target sequence
tttccaataatagctactt

SEQ ID NO: 35093 - DNA, 19 bp, Artificial sequence
  SiRNA target sequence
ttccaataatagctacttt

SEQ ID NO: 35094 - DNA, 19 bp, Artificial sequence
  SiRNA target sequence
tccaataatagctactttt

SEQ ID NO: 35095 - DNA, 19 bp, Artificial sequence
  SiRNA target sequence
ccaataatagctacttttt

SEQ ID NO: 35096 - DNA, 19 bp, Artificial sequence
  SiRNA target sequence
caataatagctactttttc

SEQ ID NO: 35097 - DNA, 19 bp, Artificial sequence
  SiRNA target sequence
aataatagctactttttca

SEQ ID NO: 35098 - DNA, 19 bp, Artificial sequence
  SiRNA target sequence
ataatagctactttttcac

SEQ ID NO: 35099 - DNA, 19 bp, Artificial sequence
  SiRNA target sequence
taatagctactttttcacc

SEQ ID NO: 35100 - DNA, 19 bp, Artificial sequence
  SiRNA target sequence
aatagctactttttcacct

SEQ ID NO: 35101 - DNA, 19 bp, Artificial sequence
  SiRNA target sequence
atagctactttttcacctt

SEQ ID NO: 35102 - DNA, 19 bp, Artificial sequence
  SiRNA target sequence
tagctactttttcaccttt

SEQ ID NO: 35103 - DNA, 19 bp, Artificial sequence
  SiRNA target sequence
agctactttttcacctttt

SEQ ID NO: 35104 - DNA, 19 bp, Artificial sequence
  SiRNA target sequence
gctactttttcaccttttt

SEQ ID NO: 35105 - DNA, 19 bp, Artificial sequence
  SiRNA target sequence
ctactttttcacctttttt

SEQ ID NO: 35106 - DNA, 19 bp, Artificial sequence
  SiRNA target sequence
tactttttcacctttttta

SEQ ID NO: 35107 - DNA, 19 bp, Artificial sequence
  SiRNA target sequence
actttttcaccttttttaa

SEQ ID NO: 35108 - DNA, 19 bp, Artificial sequence
  SiRNA target sequence
ctttttcaccttttttaat

SEQ ID NO: 35109 - DNA, 19 bp, Artificial sequence
  SiRNA target sequence
tttttcaccttttttaatt

SEQ ID NO: 35110 - DNA, 19 bp, Artificial sequence
  SiRNA target sequence
ttttcaccttttttaatta

SEQ ID NO: 35111 - DNA, 19 bp, Artificial sequence
  SiRNA target sequence
tttcaccttttttaattaa

SEQ ID NO: 35112 - DNA, 19 bp, Artificial sequence
  SiRNA target sequence
ttcaccttttttaattaaa

SEQ ID NO: 35113 - DNA, 19 bp, Artificial sequence
  SiRNA target sequence
tcaccttttttaattaaaa

SEQ ID NO: 35114 - DNA, 19 bp, Artificial sequence
  SiRNA target sequence
caccttttttaattaaaat

SEQ ID NO: 35115 - DNA, 19 bp, Artificial sequence
  SiRNA target sequence
accttttttaattaaaata

SEQ ID NO: 35116 - DNA, 19 bp, Artificial sequence
  SiRNA target sequence
ccttttttaattaaaatat

SEQ ID NO: 35117 - DNA, 19 bp, Artificial sequence
  SiRNA target sequence
cttttttaattaaaatatt

SEQ ID NO: 35118 - DNA, 19 bp, Artificial sequence
  SiRNA target sequence
ttttttaattaaaatattt

SEQ ID NO: 35119 - DNA, 19 bp, Artificial sequence
  SiRNA target sequence
tttttaattaaaatattta

SEQ ID NO: 35120 - DNA, 19 bp, Artificial sequence
  SiRNA target sequence
ttttaattaaaatatttat

SEQ ID NO: 35121 - DNA, 19 bp, Artificial sequence
  SiRNA target sequence
tttaattaaaatatttatg

SEQ ID NO: 35122 - DNA, 19 bp, Artificial sequence
  SiRNA target sequence
ttaattaaaatatttatgt

SEQ ID NO: 35123 - DNA, 19 bp, Artificial sequence
  SiRNA target sequence
taattaaaatatttatgtc

SEQ ID NO: 35124 - DNA, 19 bp, Artificial sequence
  SiRNA target sequence
aattaaaatatttatgtcc

SEQ ID NO: 35125 - DNA, 19 bp, Artificial sequence
  SiRNA target sequence
attaaaatatttatgtccg

SEQ ID NO: 35126 - DNA, 19 bp, Artificial sequence
  SiRNA target sequence
ttaaaatatttatgtccgt

SEQ ID NO: 35127 - DNA, 19 bp, Artificial sequence
  SiRNA target sequence
taaaatatttatgtccgtt

SEQ ID NO: 35128 - DNA, 19 bp, Artificial sequence
  SiRNA target sequence
aaaatatttatgtccgtta

SEQ ID NO: 35129 - DNA, 19 bp, Artificial sequence
  SiRNA target sequence
aaatatttatgtccgttaa

SEQ ID NO: 35130 - DNA, 19 bp, Artificial sequence
  SiRNA target sequence
aatatttatgtccgttaaa

SEQ ID NO: 35131 - DNA, 19 bp, Artificial sequence
  SiRNA target sequence
atatttatgtccgttaaaa

SEQ ID NO: 35132 - DNA, 19 bp, Artificial sequence
  SiRNA target sequence
tatttatgtccgttaaaat

SEQ ID NO: 35133 - DNA, 19 bp, Artificial sequence
  SiRNA target sequence
atttatgtccgttaaaatt

SEQ ID NO: 35134 - DNA, 19 bp, Artificial sequence
  SiRNA target sequence
tttatgtccgttaaaattt

SEQ ID NO: 35135 - DNA, 19 bp, Artificial sequence
  SiRNA target sequence
ttatgtccgttaaaatttt

SEQ ID NO: 35136 - DNA, 19 bp, Artificial sequence
  SiRNA target sequence
tatgtccgttaaaattttt

SEQ ID NO: 35137 - DNA, 19 bp, Artificial sequence
  SiRNA target sequence
atgtccgttaaaatttttt

SEQ ID NO: 35138 - DNA, 19 bp, Artificial sequence
  SiRNA target sequence
tgtccgttaaaattttttt

SEQ ID NO: 35139 - DNA, 19 bp, Artificial sequence
  SiRNA target sequence
gtccgttaaaatttttttg

SEQ ID NO: 35140 - DNA, 19 bp, Artificial sequence
  SiRNA target sequence
tccgttaaaatttttttgg

SEQ ID NO: 35141 - DNA, 19 bp, Artificial sequence
  SiRNA target sequence
ccgttaaaatttttttgga

SEQ ID NO: 35142 - DNA, 19 bp, Artificial sequence
  SiRNA target sequence
cgttaaaatttttttggag

SEQ ID NO: 35143 - DNA, 19 bp, Artificial sequence
  SiRNA target sequence
gttaaaatttttttggagt

SEQ ID NO: 35144 - DNA, 19 bp, Artificial sequence
  SiRNA target sequence
ttaaaatttttttggagta

SEQ ID NO: 35145 - DNA, 19 bp, Artificial sequence
  SiRNA target sequence
taaaatttttttggagtaa

SEQ ID NO: 35146 - DNA, 19 bp, Artificial sequence
  SiRNA target sequence
aaaatttttttggagtaat

SEQ ID NO: 35147 - DNA, 19 bp, Artificial sequence
  SiRNA target sequence
aaatttttttggagtaata

SEQ ID NO: 35148 - DNA, 19 bp, Artificial sequence
  SiRNA target sequence
aatttttttggagtaataa

SEQ ID NO: 35149 - DNA, 19 bp, Artificial sequence
  SiRNA target sequence
atttttttggagtaataat

SEQ ID NO: 35150 - DNA, 19 bp, Artificial sequence
  SiRNA target sequence
tttttttggagtaataatt

SEQ ID NO: 35151 - DNA, 19 bp, Artificial sequence
  SiRNA target sequence
ttttttggagtaataatta

SEQ ID NO: 35152 - DNA, 19 bp, Artificial sequence
  SiRNA target sequence
tttttggagtaataattaa

SEQ ID NO: 35153 - DNA, 19 bp, Artificial sequence
  SiRNA target sequence
ttttggagtaataattaaa

SEQ ID NO: 35154 - DNA, 19 bp, Artificial sequence
  SiRNA target sequence
tttggagtaataattaaat

SEQ ID NO: 35155 - DNA, 19 bp, Artificial sequence
  SiRNA target sequence
ttggagtaataattaaatg

SEQ ID NO: 35156 - DNA, 19 bp, Artificial sequence
  SiRNA target sequence
tggagtaataattaaatga

SEQ ID NO: 35157 - DNA, 19 bp, Artificial sequence
  SiRNA target sequence
ggagtaataattaaatgat

SEQ ID NO: 35158 - DNA, 19 bp, Artificial sequence
  SiRNA target sequence
gagtaataattaaatgatg

SEQ ID NO: 35159 - DNA, 19 bp, Artificial sequence
  SiRNA target sequence
agtaataattaaatgatgc

SEQ ID NO: 35160 - DNA, 19 bp, Artificial sequence
  SiRNA target sequence
gtaataattaaatgatgca

SEQ ID NO: 35161 - DNA, 19 bp, Artificial sequence
  SiRNA target sequence
taataattaaatgatgcat

SEQ ID NO: 35162 - DNA, 19 bp, Artificial sequence
  SiRNA target sequence
aataattaaatgatgcatt

SEQ ID NO: 35163 - DNA, 19 bp, Artificial sequence
  SiRNA target sequence
ataattaaatgatgcattt

SEQ ID NO: 35164 - DNA, 19 bp, Artificial sequence
  SiRNA target sequence
taattaaatgatgcatttt

SEQ ID NO: 35165 - DNA, 19 bp, Artificial sequence
  SiRNA target sequence
aattaaatgatgcattttc

SEQ ID NO: 35166 - DNA, 19 bp, Artificial sequence
  SiRNA target sequence
attaaatgatgcattttct

SEQ ID NO: 35167 - DNA, 19 bp, Artificial sequence
  SiRNA target sequence
ttaaatgatgcattttcta

SEQ ID NO: 35168 - DNA, 19 bp, Artificial sequence
  SiRNA target sequence
taaatgatgcattttctaa

SEQ ID NO: 35169 - DNA, 19 bp, Artificial sequence
  SiRNA target sequence
aaatgatgcattttctaat

SEQ ID NO: 35170 - DNA, 19 bp, Artificial sequence
  SiRNA target sequence
aatgatgcattttctaatc

SEQ ID NO: 35171 - DNA, 19 bp, Artificial sequence
  SiRNA target sequence
atgatgcattttctaatct

SEQ ID NO: 35172 - DNA, 19 bp, Artificial sequence
  SiRNA target sequence
tgatgcattttctaatctt

SEQ ID NO: 35173 - DNA, 19 bp, Artificial sequence
  SiRNA target sequence
gatgcattttctaatctta

SEQ ID NO: 35174 - DNA, 19 bp, Artificial sequence
  SiRNA target sequence
atgcattttctaatcttat

SEQ ID NO: 35175 - DNA, 19 bp, Artificial sequence
  SiRNA target sequence
tgcattttctaatcttata

SEQ ID NO: 35176 - DNA, 19 bp, Artificial sequence
  SiRNA target sequence
gcattttctaatcttatat

SEQ ID NO: 35177 - DNA, 19 bp, Artificial sequence
  SiRNA target sequence
cattttctaatcttatatc

SEQ ID NO: 35178 - DNA, 19 bp, Artificial sequence
  SiRNA target sequence
attttctaatcttatatca

SEQ ID NO: 35179 - DNA, 19 bp, Artificial sequence
  SiRNA target sequence
ttttctaatcttatatcat

SEQ ID NO: 35180 - DNA, 19 bp, Artificial sequence
  SiRNA target sequence
tttctaatcttatatcatt

SEQ ID NO: 35181 - DNA, 19 bp, Artificial sequence
  SiRNA target sequence
ttctaatcttatatcatta

SEQ ID NO: 35182 - DNA, 19 bp, Artificial sequence
  SiRNA target sequence
tctaatcttatatcattat

SEQ ID NO: 35183 - DNA, 19 bp, Artificial sequence
  SiRNA target sequence
ctaatcttatatcattatt

SEQ ID NO: 35184 - DNA, 19 bp, Artificial sequence
  SiRNA target sequence
taatcttatatcattatta

SEQ ID NO: 35185 - DNA, 19 bp, Artificial sequence
  SiRNA target sequence
aatcttatatcattattaa

SEQ ID NO: 35186 - DNA, 19 bp, Artificial sequence
  SiRNA target sequence
atcttatatcattattaaa

SEQ ID NO: 35187 - DNA, 19 bp, Artificial sequence
  SiRNA target sequence
tcttatatcattattaaat

SEQ ID NO: 35188 - DNA, 19 bp, Artificial sequence
  SiRNA target sequence
cttatatcattattaaatt

SEQ ID NO: 35189 - DNA, 19 bp, Artificial sequence
  SiRNA target sequence
ttatatcattattaaattc

SEQ ID NO: 35190 - DNA, 19 bp, Artificial sequence
  SiRNA target sequence
tatatcattattaaattca

SEQ ID NO: 35191 - DNA, 19 bp, Artificial sequence
  SiRNA target sequence
atatcattattaaattcat

SEQ ID NO: 35192 - DNA, 19 bp, Artificial sequence
  SiRNA target sequence
tatcattattaaattcatt

SEQ ID NO: 35193 - DNA, 19 bp, Artificial sequence
  SiRNA target sequence
atcattattaaattcatta

SEQ ID NO: 35194 - DNA, 19 bp, Artificial sequence
  SiRNA target sequence
tcattattaaattcattaa

SEQ ID NO: 35195 - DNA, 19 bp, Artificial sequence
  SiRNA target sequence
cattattaaattcattaac

SEQ ID NO: 35196 - DNA, 19 bp, Artificial sequence
  SiRNA target sequence
attattaaattcattaaca

SEQ ID NO: 35197 - DNA, 19 bp, Artificial sequence
  SiRNA target sequence
ttattaaattcattaacat

SEQ ID NO: 35198 - DNA, 19 bp, Artificial sequence
  SiRNA target sequence
tattaaattcattaacatc

SEQ ID NO: 35199 - DNA, 19 bp, Artificial sequence
  SiRNA target sequence
attaaattcattaacatct

SEQ ID NO: 35200 - DNA, 19 bp, Artificial sequence
  SiRNA target sequence
ttaaattcattaacatcta

SEQ ID NO: 35201 - DNA, 19 bp, Artificial sequence
  SiRNA target sequence
taaattcattaacatctac

SEQ ID NO: 35202 - DNA, 19 bp, Artificial sequence
  SiRNA target sequence
aaattcattaacatctact

SEQ ID NO: 35203 - DNA, 19 bp, Artificial sequence
  SiRNA target sequence
aattcattaacatctacta

SEQ ID NO: 35204 - DNA, 19 bp, Artificial sequence
  SiRNA target sequence
attcattaacatctactaa

SEQ ID NO: 35205 - DNA, 19 bp, Artificial sequence
  SiRNA target sequence
ttcattaacatctactaaa

SEQ ID NO: 35206 - DNA, 19 bp, Artificial sequence
  SiRNA target sequence
tcattaacatctactaaat

SEQ ID NO: 35207 - DNA, 19 bp, Artificial sequence
  SiRNA target sequence
cattaacatctactaaatt

SEQ ID NO: 35208 - DNA, 19 bp, Artificial sequence
  SiRNA target sequence
attaacatctactaaattt

SEQ ID NO: 35209 - DNA, 19 bp, Artificial sequence
  SiRNA target sequence
ttaacatctactaaatttg

SEQ ID NO: 35210 - DNA, 19 bp, Artificial sequence
  SiRNA target sequence
taacatctactaaatttgg

SEQ ID NO: 35211 - DNA, 19 bp, Artificial sequence
  SiRNA target sequence
aacatctactaaatttggt

SEQ ID NO: 35212 - DNA, 19 bp, Artificial sequence
  SiRNA target sequence
acatctactaaatttggtt

SEQ ID NO: 35213 - DNA, 19 bp, Artificial sequence
  SiRNA target sequence
catctactaaatttggttc

SEQ ID NO: 35214 - DNA, 19 bp, Artificial sequence
  SiRNA target sequence
atctactaaatttggttct

SEQ ID NO: 35215 - DNA, 19 bp, Artificial sequence
  SiRNA target sequence
tctactaaatttggttctt

SEQ ID NO: 35216 - DNA, 19 bp, Artificial sequence
  SiRNA target sequence
ctactaaatttggttcttc

SEQ ID NO: 35217 - DNA, 19 bp, Artificial sequence
  SiRNA target sequence
tactaaatttggttcttct

SEQ ID NO: 35218 - DNA, 19 bp, Artificial sequence
  SiRNA target sequence
actaaatttggttcttctt

SEQ ID NO: 35219 - DNA, 19 bp, Artificial sequence
  SiRNA target sequence
ctaaatttggttcttcttt

SEQ ID NO: 35220 - DNA, 19 bp, Artificial sequence
  SiRNA target sequence
taaatttggttcttctttt

SEQ ID NO: 35221 - DNA, 19 bp, Artificial sequence
  SiRNA target sequence
aaatttggttcttctttta

SEQ ID NO: 35222 - DNA, 19 bp, Artificial sequence
  SiRNA target sequence
aatttggttcttcttttat

SEQ ID NO: 35223 - DNA, 19 bp, Artificial sequence
  SiRNA target sequence
atttggttcttcttttata

SEQ ID NO: 35224 - DNA, 19 bp, Artificial sequence
  SiRNA target sequence
tttggttcttcttttataa

SEQ ID NO: 35225 - DNA, 19 bp, Artificial sequence
  SiRNA target sequence
ttggttcttcttttataag

SEQ ID NO: 35226 - DNA, 19 bp, Artificial sequence
  SiRNA target sequence
tggttcttcttttataagc

SEQ ID NO: 35227 - DNA, 19 bp, Artificial sequence
  SiRNA target sequence
ggttcttcttttataagct

SEQ ID NO: 35228 - DNA, 19 bp, Artificial sequence
  SiRNA target sequence
gttcttcttttataagctc

SEQ ID NO: 35229 - DNA, 19 bp, Artificial sequence
  SiRNA target sequence
ttcttcttttataagctct

SEQ ID NO: 35230 - DNA, 19 bp, Artificial sequence
  SiRNA target sequence
tcttcttttataagctctg

SEQ ID NO: 35231 - DNA, 19 bp, Artificial sequence
  SiRNA target sequence
cttcttttataagctctgg

SEQ ID NO: 35232 - DNA, 19 bp, Artificial sequence
  SiRNA target sequence
ttcttttataagctctggt

SEQ ID NO: 35233 - DNA, 19 bp, Artificial sequence
  SiRNA target sequence
tcttttataagctctggtt

SEQ ID NO: 35234 - DNA, 19 bp, Artificial sequence
  SiRNA target sequence
cttttataagctctggttt

SEQ ID NO: 35235 - DNA, 19 bp, Artificial sequence
  SiRNA target sequence
ttttataagctctggttta

SEQ ID NO: 35236 - DNA, 19 bp, Artificial sequence
  SiRNA target sequence
tttataagctctggtttaa

SEQ ID NO: 35237 - DNA, 19 bp, Artificial sequence
  SiRNA target sequence
ttataagctctggtttaaa

SEQ ID NO: 35238 - DNA, 19 bp, Artificial sequence
  SiRNA target sequence
tataagctctggtttaaaa

SEQ ID NO: 35239 - DNA, 19 bp, Artificial sequence
  SiRNA target sequence
ataagctctggtttaaaag

SEQ ID NO: 35240 - DNA, 19 bp, Artificial sequence
  SiRNA target sequence
taagctctggtttaaaaga

SEQ ID NO: 35241 - DNA, 19 bp, Artificial sequence
  SiRNA target sequence
aagctctggtttaaaagat

SEQ ID NO: 35242 - DNA, 19 bp, Artificial sequence
  SiRNA target sequence
agctctggtttaaaagatg

SEQ ID NO: 35243 - DNA, 19 bp, Artificial sequence
  SiRNA target sequence
gctctggtttaaaagatgt

SEQ ID NO: 35244 - DNA, 19 bp, Artificial sequence
  SiRNA target sequence
ctctggtttaaaagatgtt

SEQ ID NO: 35245 - DNA, 19 bp, Artificial sequence
  SiRNA target sequence
tctggtttaaaagatgttc

SEQ ID NO: 35246 - DNA, 19 bp, Artificial sequence
  SiRNA target sequence
ctggtttaaaagatgttct

SEQ ID NO: 35247 - DNA, 19 bp, Artificial sequence
  SiRNA target sequence
tggtttaaaagatgttctt

SEQ ID NO: 35248 - DNA, 19 bp, Artificial sequence
  SiRNA target sequence
ggtttaaaagatgttctta

SEQ ID NO: 35249 - DNA, 19 bp, Artificial sequence
  SiRNA target sequence
gtttaaaagatgttcttat

SEQ ID NO: 35250 - DNA, 19 bp, Artificial sequence
  SiRNA target sequence
tttaaaagatgttcttata

SEQ ID NO: 35251 - DNA, 19 bp, Artificial sequence
  SiRNA target sequence
ttaaaagatgttcttatat

SEQ ID NO: 35252 - DNA, 19 bp, Artificial sequence
  SiRNA target sequence
taaaagatgttcttatatt

SEQ ID NO: 35253 - DNA, 19 bp, Artificial sequence
  SiRNA target sequence
aaaagatgttcttatattt

SEQ ID NO: 35254 - DNA, 19 bp, Artificial sequence
  SiRNA target sequence
aaagatgttcttatattta

SEQ ID NO: 35255 - DNA, 19 bp, Artificial sequence
  SiRNA target sequence
aagatgttcttatatttaa

SEQ ID NO: 35256 - DNA, 19 bp, Artificial sequence
  SiRNA target sequence
agatgttcttatatttaag

SEQ ID NO: 35257 - DNA, 19 bp, Artificial sequence
  SiRNA target sequence
gatgttcttatatttaaga

SEQ ID NO: 35258 - DNA, 19 bp, Artificial sequence
  SiRNA target sequence
atgttcttatatttaagat

SEQ ID NO: 35259 - DNA, 19 bp, Artificial sequence
  SiRNA target sequence
tgttcttatatttaagatt

SEQ ID NO: 35260 - DNA, 19 bp, Artificial sequence
  SiRNA target sequence
gttcttatatttaagattg

SEQ ID NO: 35261 - DNA, 19 bp, Artificial sequence
  SiRNA target sequence
ttcttatatttaagattgc

SEQ ID NO: 35262 - DNA, 19 bp, Artificial sequence
  SiRNA target sequence
tcttatatttaagattgct

SEQ ID NO: 35263 - DNA, 19 bp, Artificial sequence
  SiRNA target sequence
cttatatttaagattgctt

SEQ ID NO: 35264 - DNA, 19 bp, Artificial sequence
  SiRNA target sequence
ttatatttaagattgcttg

SEQ ID NO: 35265 - DNA, 19 bp, Artificial sequence
  SiRNA target sequence
tatatttaagattgcttgt

SEQ ID NO: 35266 - DNA, 19 bp, Artificial sequence
  SiRNA target sequence
atatttaagattgcttgtg

SEQ ID NO: 35267 - DNA, 19 bp, Artificial sequence
  SiRNA target sequence
tatttaagattgcttgtgt

SEQ ID NO: 35268 - DNA, 19 bp, Artificial sequence
  SiRNA target sequence
atttaagattgcttgtgta

SEQ ID NO: 35269 - DNA, 19 bp, Artificial sequence
  SiRNA target sequence
tttaagattgcttgtgtat

SEQ ID NO: 35270 - DNA, 19 bp, Artificial sequence
  SiRNA target sequence
ttaagattgcttgtgtata

SEQ ID NO: 35271 - DNA, 19 bp, Artificial sequence
  SiRNA target sequence
taagattgcttgtgtatat

SEQ ID NO: 35272 - DNA, 19 bp, Artificial sequence
  SiRNA target sequence
aagattgcttgtgtatatc

SEQ ID NO: 35273 - DNA, 19 bp, Artificial sequence
  SiRNA target sequence
agattgcttgtgtatatcg

SEQ ID NO: 35274 - DNA, 19 bp, Artificial sequence
  SiRNA target sequence
gattgcttgtgtatatcgt

SEQ ID NO: 35275 - DNA, 19 bp, Artificial sequence
  SiRNA target sequence
attgcttgtgtatatcgtg

SEQ ID NO: 35276 - DNA, 19 bp, Artificial sequence
  SiRNA target sequence
ttgcttgtgtatatcgtga

SEQ ID NO: 35277 - DNA, 19 bp, Artificial sequence
  SiRNA target sequence
tgcttgtgtatatcgtgag

SEQ ID NO: 35278 - DNA, 19 bp, Artificial sequence
  SiRNA target sequence
gcttgtgtatatcgtgagt

SEQ ID NO: 35279 - DNA, 19 bp, Artificial sequence
  SiRNA target sequence
cttgtgtatatcgtgagta

SEQ ID NO: 35280 - DNA, 19 bp, Artificial sequence
  SiRNA target sequence
ttgtgtatatcgtgagtaa

SEQ ID NO: 35281 - DNA, 19 bp, Artificial sequence
  SiRNA target sequence
tgtgtatatcgtgagtaaa

SEQ ID NO: 35282 - DNA, 19 bp, Artificial sequence
  SiRNA target sequence
gtgtatatcgtgagtaaaa

SEQ ID NO: 35283 - DNA, 19 bp, Artificial sequence
  SiRNA target sequence
tgtatatcgtgagtaaaag

SEQ ID NO: 35284 - DNA, 19 bp, Artificial sequence
  SiRNA target sequence
gtatatcgtgagtaaaaga

SEQ ID NO: 35285 - DNA, 19 bp, Artificial sequence
  SiRNA target sequence
tatatcgtgagtaaaagaa

SEQ ID NO: 35286 - DNA, 19 bp, Artificial sequence
  SiRNA target sequence
atatcgtgagtaaaagaac

SEQ ID NO: 35287 - DNA, 19 bp, Artificial sequence
  SiRNA target sequence
tatcgtgagtaaaagaacc

SEQ ID NO: 35288 - DNA, 19 bp, Artificial sequence
  SiRNA target sequence
atcgtgagtaaaagaaccc

SEQ ID NO: 35289 - DNA, 19 bp, Artificial sequence
  SiRNA target sequence
tcgtgagtaaaagaaccct

SEQ ID NO: 35290 - DNA, 19 bp, Artificial sequence
  SiRNA target sequence
cgtgagtaaaagaacccta

SEQ ID NO: 35291 - DNA, 19 bp, Artificial sequence
  SiRNA target sequence
gtgagtaaaagaaccctaa

SEQ ID NO: 35292 - DNA, 19 bp, Artificial sequence
  SiRNA target sequence
tgagtaaaagaaccctaat

SEQ ID NO: 35293 - DNA, 19 bp, Artificial sequence
  SiRNA target sequence
gagtaaaagaaccctaatt

SEQ ID NO: 35294 - DNA, 19 bp, Artificial sequence
  SiRNA target sequence
agtaaaagaaccctaattg

SEQ ID NO: 35295 - DNA, 19 bp, Artificial sequence
  SiRNA target sequence
gtaaaagaaccctaattgt

SEQ ID NO: 35296 - DNA, 19 bp, Artificial sequence
  SiRNA target sequence
taaaagaaccctaattgtc

SEQ ID NO: 35297 - DNA, 19 bp, Artificial sequence
  SiRNA target sequence
aaaagaaccctaattgtcc

SEQ ID NO: 35298 - DNA, 19 bp, Artificial sequence
  SiRNA target sequence
aaagaaccctaattgtcca

SEQ ID NO: 35299 - DNA, 19 bp, Artificial sequence
  SiRNA target sequence
aagaaccctaattgtccaa

SEQ ID NO: 35300 - DNA, 19 bp, Artificial sequence
  SiRNA target sequence
agaaccctaattgtccaaa

SEQ ID NO: 35301 - DNA, 19 bp, Artificial sequence
  SiRNA target sequence
gaaccctaattgtccaaaa

SEQ ID NO: 35302 - DNA, 19 bp, Artificial sequence
  SiRNA target sequence
aaccctaattgtccaaaac

SEQ ID NO: 35303 - DNA, 19 bp, Artificial sequence
  SiRNA target sequence
accctaattgtccaaaact

SEQ ID NO: 35304 - DNA, 19 bp, Artificial sequence
  SiRNA target sequence
ccctaattgtccaaaactt

SEQ ID NO: 35305 - DNA, 19 bp, Artificial sequence
  SiRNA target sequence
cctaattgtccaaaacttg

SEQ ID NO: 35306 - DNA, 19 bp, Artificial sequence
  SiRNA target sequence
ctaattgtccaaaacttga

SEQ ID NO: 35307 - DNA, 19 bp, Artificial sequence
  SiRNA target sequence
taattgtccaaaacttgaa

SEQ ID NO: 35308 - DNA, 19 bp, Artificial sequence
  SiRNA target sequence
aattgtccaaaacttgaat

SEQ ID NO: 35309 - DNA, 19 bp, Artificial sequence
  SiRNA target sequence
attgtccaaaacttgaata

SEQ ID NO: 35310 - DNA, 19 bp, Artificial sequence
  SiRNA target sequence
ttgtccaaaacttgaatac

SEQ ID NO: 35311 - DNA, 19 bp, Artificial sequence
  SiRNA target sequence
tgtccaaaacttgaataca

SEQ ID NO: 35312 - DNA, 19 bp, Artificial sequence
  SiRNA target sequence
gtccaaaacttgaatacaa

SEQ ID NO: 35313 - DNA, 19 bp, Artificial sequence
  SiRNA target sequence
tccaaaacttgaatacaat

SEQ ID NO: 35314 - DNA, 19 bp, Artificial sequence
  SiRNA target sequence
ccaaaacttgaatacaatg

SEQ ID NO: 35315 - DNA, 19 bp, Artificial sequence
  SiRNA target sequence
caaaacttgaatacaatgt

SEQ ID NO: 35316 - DNA, 19 bp, Artificial sequence
  SiRNA target sequence
aaaacttgaatacaatgtt

SEQ ID NO: 35317 - DNA, 19 bp, Artificial sequence
  SiRNA target sequence
aaacttgaatacaatgttc

SEQ ID NO: 35318 - DNA, 19 bp, Artificial sequence
  SiRNA target sequence
aacttgaatacaatgttct

SEQ ID NO: 35319 - DNA, 19 bp, Artificial sequence
  SiRNA target sequence
acttgaatacaatgttcta

SEQ ID NO: 35320 - DNA, 19 bp, Artificial sequence
  SiRNA target sequence
cttgaatacaatgttctat

SEQ ID NO: 35321 - DNA, 19 bp, Artificial sequence
  SiRNA target sequence
ttgaatacaatgttctatt

SEQ ID NO: 35322 - DNA, 19 bp, Artificial sequence
  SiRNA target sequence
tgaatacaatgttctatta

SEQ ID NO: 35323 - DNA, 19 bp, Artificial sequence
  SiRNA target sequence
gaatacaatgttctattaa

SEQ ID NO: 35324 - DNA, 19 bp, Artificial sequence
  SiRNA target sequence
aatacaatgttctattaat

SEQ ID NO: 35325 - DNA, 19 bp, Artificial sequence
  SiRNA target sequence
atacaatgttctattaatg

SEQ ID NO: 35326 - DNA, 19 bp, Artificial sequence
  SiRNA target sequence
tacaatgttctattaatgc

SEQ ID NO: 35327 - DNA, 19 bp, Artificial sequence
  SiRNA target sequence
acaatgttctattaatgcc

SEQ ID NO: 35328 - DNA, 19 bp, Artificial sequence
  SiRNA target sequence
caatgttctattaatgcca

SEQ ID NO: 35329 - DNA, 19 bp, Artificial sequence
  SiRNA target sequence
aatgttctattaatgccaa

SEQ ID NO: 35330 - DNA, 19 bp, Artificial sequence
  SiRNA target sequence
atgttctattaatgccaat

SEQ ID NO: 35331 - DNA, 19 bp, Artificial sequence
  SiRNA target sequence
tgttctattaatgccaata

SEQ ID NO: 35332 - DNA, 19 bp, Artificial sequence
  SiRNA target sequence
gttctattaatgccaatat

SEQ ID NO: 35333 - DNA, 19 bp, Artificial sequence
  SiRNA target sequence
ttctattaatgccaatata

SEQ ID NO: 35334 - DNA, 19 bp, Artificial sequence
  SiRNA target sequence
tctattaatgccaatataa

SEQ ID NO: 35335 - DNA, 19 bp, Artificial sequence
  SiRNA target sequence
ctattaatgccaatataaa

SEQ ID NO: 35336 - DNA, 19 bp, Artificial sequence
  SiRNA target sequence
tattaatgccaatataaaa

SEQ ID NO: 35337 - DNA, 19 bp, Artificial sequence
  SiRNA target sequence
attaatgccaatataaaat

SEQ ID NO: 35338 - DNA, 19 bp, Artificial sequence
  SiRNA target sequence
ttaatgccaatataaaata

SEQ ID NO: 35339 - DNA, 19 bp, Artificial sequence
  SiRNA target sequence
taatgccaatataaaatac

SEQ ID NO: 35340 - DNA, 19 bp, Artificial sequence
  SiRNA target sequence
aatgccaatataaaataca

SEQ ID NO: 35341 - DNA, 19 bp, Artificial sequence
  SiRNA target sequence
atgccaatataaaatacaa

SEQ ID NO: 35342 - DNA, 19 bp, Artificial sequence
  SiRNA target sequence
tgccaatataaaatacaac

SEQ ID NO: 35343 - DNA, 19 bp, Artificial sequence
  SiRNA target sequence
gccaatataaaatacaaca

SEQ ID NO: 35344 - DNA, 19 bp, Artificial sequence
  SiRNA target sequence
ccaatataaaatacaacat

SEQ ID NO: 35345 - DNA, 19 bp, Artificial sequence
  SiRNA target sequence
caatataaaatacaacatc

SEQ ID NO: 35346 - DNA, 19 bp, Artificial sequence
  SiRNA target sequence
aatataaaatacaacatcc

SEQ ID NO: 35347 - DNA, 19 bp, Artificial sequence
  SiRNA target sequence
atataaaatacaacatccc

SEQ ID NO: 35348 - DNA, 19 bp, Artificial sequence
  SiRNA target sequence
tataaaatacaacatccct

SEQ ID NO: 35349 - DNA, 19 bp, Artificial sequence
  SiRNA target sequence
ataaaatacaacatccctg

SEQ ID NO: 35350 - DNA, 19 bp, Artificial sequence
  SiRNA target sequence
taaaatacaacatccctgg

SEQ ID NO: 35351 - DNA, 19 bp, Artificial sequence
  SiRNA target sequence
aaaatacaacatccctggc

SEQ ID NO: 35352 - DNA, 19 bp, Artificial sequence
  SiRNA target sequence
aaatacaacatccctggca

SEQ ID NO: 35353 - DNA, 19 bp, Artificial sequence
  SiRNA target sequence
aatacaacatccctggcac

SEQ ID NO: 35354 - DNA, 19 bp, Artificial sequence
  SiRNA target sequence
atacaacatccctggcact

SEQ ID NO: 35355 - DNA, 19 bp, Artificial sequence
  SiRNA target sequence
tacaacatccctggcactt

SEQ ID NO: 35356 - DNA, 19 bp, Artificial sequence
  SiRNA target sequence
acaacatccctggcactta

SEQ ID NO: 35357 - DNA, 19 bp, Artificial sequence
  SiRNA target sequence
caacatccctggcacttag

SEQ ID NO: 35358 - DNA, 19 bp, Artificial sequence
  SiRNA target sequence
aacatccctggcacttagt

SEQ ID NO: 35359 - DNA, 19 bp, Artificial sequence
  SiRNA target sequence
acatccctggcacttagtt

SEQ ID NO: 35360 - DNA, 19 bp, Artificial sequence
  SiRNA target sequence
catccctggcacttagttt

SEQ ID NO: 35361 - DNA, 19 bp, Artificial sequence
  SiRNA target sequence
atccctggcacttagtttt

SEQ ID NO: 35362 - DNA, 19 bp, Artificial sequence
  SiRNA target sequence
tccctggcacttagttttg

SEQ ID NO: 35363 - DNA, 19 bp, Artificial sequence
  SiRNA target sequence
ccctggcacttagttttgc

SEQ ID NO: 35364 - DNA, 19 bp, Artificial sequence
  SiRNA target sequence
cctggcacttagttttgct

SEQ ID NO: 35365 - DNA, 19 bp, Artificial sequence
  SiRNA target sequence
ctggcacttagttttgctg

SEQ ID NO: 35366 - DNA, 19 bp, Artificial sequence
  SiRNA target sequence
tggcacttagttttgctgt

SEQ ID NO: 35367 - DNA, 19 bp, Artificial sequence
  SiRNA target sequence
ggcacttagttttgctgtt

SEQ ID NO: 35368 - DNA, 19 bp, Artificial sequence
  SiRNA target sequence
gcacttagttttgctgtta

SEQ ID NO: 35369 - DNA, 19 bp, Artificial sequence
  SiRNA target sequence
cacttagttttgctgttaa

SEQ ID NO: 35370 - DNA, 19 bp, Artificial sequence
  SiRNA target sequence
acttagttttgctgttaat

SEQ ID NO: 35371 - DNA, 19 bp, Artificial sequence
  SiRNA target sequence
cttagttttgctgttaata

SEQ ID NO: 35372 - DNA, 19 bp, Artificial sequence
  SiRNA target sequence
ttagttttgctgttaatat

SEQ ID NO: 35373 - DNA, 19 bp, Artificial sequence
  SiRNA target sequence
tagttttgctgttaatatt

SEQ ID NO: 35374 - DNA, 19 bp, Artificial sequence
  SiRNA target sequence
agttttgctgttaatattc

SEQ ID NO: 35375 - DNA, 19 bp, Artificial sequence
  SiRNA target sequence
gttttgctgttaatattcc

SEQ ID NO: 35376 - DNA, 19 bp, Artificial sequence
  SiRNA target sequence
ttttgctgttaatattcca

SEQ ID NO: 35377 - DNA, 19 bp, Artificial sequence
  SiRNA target sequence
tttgctgttaatattccat

SEQ ID NO: 35378 - DNA, 19 bp, Artificial sequence
  SiRNA target sequence
ttgctgttaatattccata

SEQ ID NO: 35379 - DNA, 19 bp, Artificial sequence
  SiRNA target sequence
tgctgttaatattccatag

SEQ ID NO: 35380 - DNA, 19 bp, Artificial sequence
  SiRNA target sequence
gctgttaatattccatagt

SEQ ID NO: 35381 - DNA, 19 bp, Artificial sequence
  SiRNA target sequence
ctgttaatattccatagtt

SEQ ID NO: 35382 - DNA, 19 bp, Artificial sequence
  SiRNA target sequence
tgttaatattccatagttt

SEQ ID NO: 35383 - DNA, 19 bp, Artificial sequence
  SiRNA target sequence
gttaatattccatagtttc

SEQ ID NO: 35384 - DNA, 19 bp, Artificial sequence
  SiRNA target sequence
ttaatattccatagtttcc

SEQ ID NO: 35385 - DNA, 19 bp, Artificial sequence
  SiRNA target sequence
taatattccatagtttcct

SEQ ID NO: 35386 - DNA, 19 bp, Artificial sequence
  SiRNA target sequence
aatattccatagtttccta

SEQ ID NO: 35387 - DNA, 19 bp, Artificial sequence
  SiRNA target sequence
atattccatagtttcctaa

SEQ ID NO: 35388 - DNA, 19 bp, Artificial sequence
  SiRNA target sequence
tattccatagtttcctaat

SEQ ID NO: 35389 - DNA, 19 bp, Artificial sequence
  SiRNA target sequence
attccatagtttcctaatg

SEQ ID NO: 35390 - DNA, 19 bp, Artificial sequence
  SiRNA target sequence
ttccatagtttcctaatgt

SEQ ID NO: 35391 - DNA, 19 bp, Artificial sequence
  SiRNA target sequence
tccatagtttcctaatgtt

SEQ ID NO: 35392 - DNA, 19 bp, Artificial sequence
  SiRNA target sequence
ccatagtttcctaatgtta

SEQ ID NO: 35393 - DNA, 19 bp, Artificial sequence
  SiRNA target sequence
catagtttcctaatgttat

SEQ ID NO: 35394 - DNA, 19 bp, Artificial sequence
  SiRNA target sequence
atagtttcctaatgttata

SEQ ID NO: 35395 - DNA, 19 bp, Artificial sequence
  SiRNA target sequence
tagtttcctaatgttataa

SEQ ID NO: 35396 - DNA, 19 bp, Artificial sequence
  SiRNA target sequence
agtttcctaatgttataac

SEQ ID NO: 35397 - DNA, 19 bp, Artificial sequence
  SiRNA target sequence
gtttcctaatgttataact

SEQ ID NO: 35398 - DNA, 19 bp, Artificial sequence
  SiRNA target sequence
tttcctaatgttataacta

SEQ ID NO: 35399 - DNA, 19 bp, Artificial sequence
  SiRNA target sequence
ttcctaatgttataactat

SEQ ID NO: 35400 - DNA, 19 bp, Artificial sequence
  SiRNA target sequence
tcctaatgttataactata

SEQ ID NO: 35401 - DNA, 19 bp, Artificial sequence
  SiRNA target sequence
cctaatgttataactataa

SEQ ID NO: 35402 - DNA, 19 bp, Artificial sequence
  SiRNA target sequence
ctaatgttataactataaa

SEQ ID NO: 35403 - DNA, 19 bp, Artificial sequence
  SiRNA target sequence
taatgttataactataaaa

SEQ ID NO: 35404 - DNA, 19 bp, Artificial sequence
  SiRNA target sequence
aatgttataactataaaac

SEQ ID NO: 35405 - DNA, 19 bp, Artificial sequence
  SiRNA target sequence
atgttataactataaaaca

SEQ ID NO: 35406 - DNA, 19 bp, Artificial sequence
  SiRNA target sequence
tgttataactataaaacac

SEQ ID NO: 35407 - DNA, 19 bp, Artificial sequence
  SiRNA target sequence
gttataactataaaacact

SEQ ID NO: 35408 - DNA, 19 bp, Artificial sequence
  SiRNA target sequence
ttataactataaaacactg

SEQ ID NO: 35409 - DNA, 19 bp, Artificial sequence
  SiRNA target sequence
tataactataaaacactgt

SEQ ID NO: 35410 - DNA, 19 bp, Artificial sequence
  SiRNA target sequence
ataactataaaacactgta

SEQ ID NO: 35411 - DNA, 19 bp, Artificial sequence
  SiRNA target sequence
taactataaaacactgtaa

SEQ ID NO: 35412 - DNA, 19 bp, Artificial sequence
  SiRNA target sequence
aactataaaacactgtaaa

SEQ ID NO: 35413 - DNA, 19 bp, Artificial sequence
  SiRNA target sequence
actataaaacactgtaaag

SEQ ID NO: 35414 - DNA, 19 bp, Artificial sequence
  SiRNA target sequence
ctataaaacactgtaaagc

SEQ ID NO: 35415 - DNA, 19 bp, Artificial sequence
  SiRNA target sequence
tataaaacactgtaaagca

SEQ ID NO: 35416 - DNA, 19 bp, Artificial sequence
  SiRNA target sequence
ataaaacactgtaaagcaa

SEQ ID NO: 35417 - DNA, 19 bp, Artificial sequence
  SiRNA target sequence
taaaacactgtaaagcaaa

SEQ ID NO: 35418 - DNA, 19 bp, Artificial sequence
  SiRNA target sequence
aaaacactgtaaagcaaaa

SEQ ID NO: 35419 - DNA, 19 bp, Artificial sequence
  SiRNA target sequence
aaacactgtaaagcaaaaa

SEQ ID NO: 35420 - DNA, 19 bp, Artificial sequence
  SiRNA target sequence
aacactgtaaagcaaaaat

SEQ ID NO: 35421 - DNA, 19 bp, Artificial sequence
  SiRNA target sequence
acactgtaaagcaaaaatt

SEQ ID NO: 35422 - DNA, 19 bp, Artificial sequence
  SiRNA target sequence
cactgtaaagcaaaaatta

SEQ ID NO: 35423 - DNA, 19 bp, Artificial sequence
  SiRNA target sequence
actgtaaagcaaaaattat

SEQ ID NO: 35424 - DNA, 19 bp, Artificial sequence
  SiRNA target sequence
ctgtaaagcaaaaattatc

SEQ ID NO: 35425 - DNA, 19 bp, Artificial sequence
  SiRNA target sequence
tgtaaagcaaaaattatct

SEQ ID NO: 35426 - DNA, 19 bp, Artificial sequence
  SiRNA target sequence
gtaaagcaaaaattatctt

SEQ ID NO: 35427 - DNA, 19 bp, Artificial sequence
  SiRNA target sequence
taaagcaaaaattatctta

SEQ ID NO: 35428 - DNA, 19 bp, Artificial sequence
  SiRNA target sequence
aaagcaaaaattatcttat

SEQ ID NO: 35429 - DNA, 19 bp, Artificial sequence
  SiRNA target sequence
aagcaaaaattatcttatt

SEQ ID NO: 35430 - DNA, 19 bp, Artificial sequence
  SiRNA target sequence
agcaaaaattatcttattt

SEQ ID NO: 35431 - DNA, 19 bp, Artificial sequence
  SiRNA target sequence
gcaaaaattatcttattta

SEQ ID NO: 35432 - DNA, 19 bp, Artificial sequence
  SiRNA target sequence
caaaaattatcttatttac

SEQ ID NO: 35433 - DNA, 19 bp, Artificial sequence
  SiRNA target sequence
aaaaattatcttatttaca

SEQ ID NO: 35434 - DNA, 19 bp, Artificial sequence
  SiRNA target sequence
aaaattatcttatttacaa

SEQ ID NO: 35435 - DNA, 19 bp, Artificial sequence
  SiRNA target sequence
aaattatcttatttacaag

SEQ ID NO: 35436 - DNA, 19 bp, Artificial sequence
  SiRNA target sequence
aattatcttatttacaagg

SEQ ID NO: 35437 - DNA, 19 bp, Artificial sequence
  SiRNA target sequence
attatcttatttacaaggt

SEQ ID NO: 35438 - DNA, 19 bp, Artificial sequence
  SiRNA target sequence
ttatcttatttacaaggta

SEQ ID NO: 35439 - DNA, 19 bp, Artificial sequence
  SiRNA target sequence
tatcttatttacaaggtat

SEQ ID NO: 35440 - DNA, 19 bp, Artificial sequence
  SiRNA target sequence
atcttatttacaaggtata

SEQ ID NO: 35441 - DNA, 19 bp, Artificial sequence
  SiRNA target sequence
tcttatttacaaggtataa

SEQ ID NO: 35442 - DNA, 19 bp, Artificial sequence
  SiRNA target sequence
cttatttacaaggtataaa

SEQ ID NO: 35443 - DNA, 19 bp, Artificial sequence
  SiRNA target sequence
ttatttacaaggtataaaa

SEQ ID NO: 35444 - DNA, 19 bp, Artificial sequence
  SiRNA target sequence
tatttacaaggtataaaaa

SEQ ID NO: 35445 - DNA, 19 bp, Artificial sequence
  SiRNA target sequence
atttacaaggtataaaaaa

SEQ ID NO: 35446 - DNA, 19 bp, Artificial sequence
  SiRNA target sequence
tttacaaggtataaaaaac

SEQ ID NO: 35447 - DNA, 19 bp, Artificial sequence
  SiRNA target sequence
ttacaaggtataaaaaact

SEQ ID NO: 35448 - DNA, 19 bp, Artificial sequence
  SiRNA target sequence
tacaaggtataaaaaacta

SEQ ID NO: 35449 - DNA, 19 bp, Artificial sequence
  SiRNA target sequence
acaaggtataaaaaactaa

SEQ ID NO: 35450 - DNA, 19 bp, Artificial sequence
  SiRNA target sequence
caaggtataaaaaactaag

SEQ ID NO: 35451 - DNA, 19 bp, Artificial sequence
  SiRNA target sequence
aaggtataaaaaactaaga

SEQ ID NO: 35452 - DNA, 19 bp, Artificial sequence
  SiRNA target sequence
aggtataaaaaactaagag

SEQ ID NO: 35453 - DNA, 19 bp, Artificial sequence
  SiRNA target sequence
ggtataaaaaactaagaga

SEQ ID NO: 35454 - DNA, 19 bp, Artificial sequence
  SiRNA target sequence
gtataaaaaactaagagat

SEQ ID NO: 35455 - DNA, 19 bp, Artificial sequence
  SiRNA target sequence
tataaaaaactaagagatc

SEQ ID NO: 35456 - DNA, 19 bp, Artificial sequence
  SiRNA target sequence
ataaaaaactaagagatct

SEQ ID NO: 35457 - DNA, 19 bp, Artificial sequence
  SiRNA target sequence
taaaaaactaagagatctc

SEQ ID NO: 35458 - DNA, 19 bp, Artificial sequence
  SiRNA target sequence
aaaaaactaagagatctcc

SEQ ID NO: 35459 - DNA, 19 bp, Artificial sequence
  SiRNA target sequence
aaaaactaagagatctcca

SEQ ID NO: 35460 - DNA, 19 bp, Artificial sequence
  SiRNA target sequence
aaaactaagagatctccag

SEQ ID NO: 35461 - DNA, 19 bp, Artificial sequence
  SiRNA target sequence
aaactaagagatctccaga

SEQ ID NO: 35462 - DNA, 19 bp, Artificial sequence
  SiRNA target sequence
aactaagagatctccagat

SEQ ID NO: 35463 - DNA, 19 bp, Artificial sequence
  SiRNA target sequence
actaagagatctccagatt

SEQ ID NO: 35464 - DNA, 19 bp, Artificial sequence
  SiRNA target sequence
ctaagagatctccagattc

SEQ ID NO: 35465 - DNA, 19 bp, Artificial sequence
  SiRNA target sequence
taagagatctccagattct

SEQ ID NO: 35466 - DNA, 19 bp, Artificial sequence
  SiRNA target sequence
aagagatctccagattctg

SEQ ID NO: 35467 - DNA, 19 bp, Artificial sequence
  SiRNA target sequence
agagatctccagattctgt

SEQ ID NO: 35468 - DNA, 19 bp, Artificial sequence
  SiRNA target sequence
gagatctccagattctgtt

SEQ ID NO: 35469 - DNA, 19 bp, Artificial sequence
  SiRNA target sequence
agatctccagattctgtta

SEQ ID NO: 35470 - DNA, 19 bp, Artificial sequence
  SiRNA target sequence
gatctccagattctgttac

SEQ ID NO: 35471 - DNA, 19 bp, Artificial sequence
  SiRNA target sequence
atctccagattctgttaca

SEQ ID NO: 35472 - DNA, 19 bp, Artificial sequence
  SiRNA target sequence
tctccagattctgttacat

SEQ ID NO: 35473 - DNA, 19 bp, Artificial sequence
  SiRNA target sequence
ctccagattctgttacatt

SEQ ID NO: 35474 - DNA, 19 bp, Artificial sequence
  SiRNA target sequence
tccagattctgttacattc

SEQ ID NO: 35475 - DNA, 19 bp, Artificial sequence
  SiRNA target sequence
ccagattctgttacattcc

SEQ ID NO: 35476 - DNA, 19 bp, Artificial sequence
  SiRNA target sequence
cagattctgttacattccg

SEQ ID NO: 35477 - DNA, 19 bp, Artificial sequence
  SiRNA target sequence
agattctgttacattccga

SEQ ID NO: 35478 - DNA, 19 bp, Artificial sequence
  SiRNA target sequence
gattctgttacattccgat

SEQ ID NO: 35479 - DNA, 19 bp, Artificial sequence
  SiRNA target sequence
attctgttacattccgatt

SEQ ID NO: 35480 - DNA, 19 bp, Artificial sequence
  SiRNA target sequence
ttctgttacattccgattc

SEQ ID NO: 35481 - DNA, 19 bp, Artificial sequence
  SiRNA target sequence
tctgttacattccgattct

SEQ ID NO: 35482 - DNA, 19 bp, Artificial sequence
  SiRNA target sequence
ctgttacattccgattcta

SEQ ID NO: 35483 - DNA, 19 bp, Artificial sequence
  SiRNA target sequence
tgttacattccgattctac

SEQ ID NO: 35484 - DNA, 19 bp, Artificial sequence
  SiRNA target sequence
gttacattccgattctact

SEQ ID NO: 35485 - DNA, 19 bp, Artificial sequence
  SiRNA target sequence
ttacattccgattctactt

SEQ ID NO: 35486 - DNA, 19 bp, Artificial sequence
  SiRNA target sequence
tacattccgattctacttc

SEQ ID NO: 35487 - DNA, 19 bp, Artificial sequence
  SiRNA target sequence
acattccgattctacttca

SEQ ID NO: 35488 - DNA, 19 bp, Artificial sequence
  SiRNA target sequence
cattccgattctacttcag

SEQ ID NO: 35489 - DNA, 19 bp, Artificial sequence
  SiRNA target sequence
attccgattctacttcaga

SEQ ID NO: 35490 - DNA, 19 bp, Artificial sequence
  SiRNA target sequence
ttccgattctacttcagaa

SEQ ID NO: 35491 - DNA, 19 bp, Artificial sequence
  SiRNA target sequence
tccgattctacttcagaaa

SEQ ID NO: 35492 - DNA, 19 bp, Artificial sequence
  SiRNA target sequence
ccgattctacttcagaaac

SEQ ID NO: 35493 - DNA, 19 bp, Artificial sequence
  SiRNA target sequence
cgattctacttcagaaaca

SEQ ID NO: 35494 - DNA, 19 bp, Artificial sequence
  SiRNA target sequence
gattctacttcagaaacat

SEQ ID NO: 35495 - DNA, 19 bp, Artificial sequence
  SiRNA target sequence
attctacttcagaaacata

SEQ ID NO: 35496 - DNA, 19 bp, Artificial sequence
  SiRNA target sequence
ttctacttcagaaacatat

SEQ ID NO: 35497 - DNA, 19 bp, Artificial sequence
  SiRNA target sequence
tctacttcagaaacatatt

SEQ ID NO: 35498 - DNA, 19 bp, Artificial sequence
  SiRNA target sequence
ctacttcagaaacatattt

SEQ ID NO: 35499 - DNA, 19 bp, Artificial sequence
  SiRNA target sequence
tacttcagaaacatatttt

SEQ ID NO: 35500 - DNA, 19 bp, Artificial sequence
  SiRNA target sequence
acttcagaaacatattttt

SEQ ID NO: 35501 - DNA, 19 bp, Artificial sequence
  SiRNA target sequence
cttcagaaacatatttttc

SEQ ID NO: 35502 - DNA, 19 bp, Artificial sequence
  SiRNA target sequence
ttcagaaacatatttttca

SEQ ID NO: 35503 - DNA, 19 bp, Artificial sequence
  SiRNA target sequence
tcagaaacatatttttcat

SEQ ID NO: 35504 - DNA, 19 bp, Artificial sequence
  SiRNA target sequence
cagaaacatatttttcata

SEQ ID NO: 35505 - DNA, 19 bp, Artificial sequence
  SiRNA target sequence
agaaacatatttttcatat

SEQ ID NO: 35506 - DNA, 19 bp, Artificial sequence
  SiRNA target sequence
gaaacatatttttcatatt

SEQ ID NO: 35507 - DNA, 19 bp, Artificial sequence
  SiRNA target sequence
aaacatatttttcatattt

SEQ ID NO: 35508 - DNA, 19 bp, Artificial sequence
  SiRNA target sequence
aacatatttttcatattta

SEQ ID NO: 35509 - DNA, 19 bp, Artificial sequence
  SiRNA target sequence
acatatttttcatatttaa

SEQ ID NO: 35510 - DNA, 19 bp, Artificial sequence
  SiRNA target sequence
catatttttcatatttaag

SEQ ID NO: 35511 - DNA, 19 bp, Artificial sequence
  SiRNA target sequence
atatttttcatatttaagc

SEQ ID NO: 35512 - DNA, 19 bp, Artificial sequence
  SiRNA target sequence
tatttttcatatttaagcg

SEQ ID NO: 35513 - DNA, 19 bp, Artificial sequence
  SiRNA target sequence
atttttcatatttaagcga

SEQ ID NO: 35514 - DNA, 19 bp, Artificial sequence
  SiRNA target sequence
tttttcatatttaagcgat

SEQ ID NO: 35515 - DNA, 19 bp, Artificial sequence
  SiRNA target sequence
ttttcatatttaagcgatt

SEQ ID NO: 35516 - DNA, 19 bp, Artificial sequence
  SiRNA target sequence
tttcatatttaagcgattc

SEQ ID NO: 35517 - DNA, 19 bp, Artificial sequence
  SiRNA target sequence
ttcatatttaagcgattct

SEQ ID NO: 35518 - DNA, 19 bp, Artificial sequence
  SiRNA target sequence
tcatatttaagcgattctt

SEQ ID NO: 35519 - DNA, 19 bp, Artificial sequence
  SiRNA target sequence
catatttaagcgattcttc

SEQ ID NO: 35520 - DNA, 19 bp, Artificial sequence
  SiRNA target sequence
atatttaagcgattcttct

SEQ ID NO: 35521 - DNA, 19 bp, Artificial sequence
  SiRNA target sequence
tatttaagcgattcttctt

SEQ ID NO: 35522 - DNA, 19 bp, Artificial sequence
  SiRNA target sequence
atttaagcgattcttcttc

SEQ ID NO: 35523 - DNA, 19 bp, Artificial sequence
  SiRNA target sequence
tttaagcgattcttcttct

SEQ ID NO: 35524 - DNA, 19 bp, Artificial sequence
  SiRNA target sequence
ttaagcgattcttcttctt

SEQ ID NO: 35525 - DNA, 19 bp, Artificial sequence
  SiRNA target sequence
taagcgattcttcttcttc

SEQ ID NO: 35526 - DNA, 19 bp, Artificial sequence
  SiRNA target sequence
aagcgattcttcttcttct

SEQ ID NO: 35527 - DNA, 19 bp, Artificial sequence
  SiRNA target sequence
agcgattcttcttcttctg

SEQ ID NO: 35528 - DNA, 19 bp, Artificial sequence
  SiRNA target sequence
gcgattcttcttcttctgt

SEQ ID NO: 35529 - DNA, 19 bp, Artificial sequence
  SiRNA target sequence
cgattcttcttcttctgtt

SEQ ID NO: 35530 - DNA, 19 bp, Artificial sequence
  SiRNA target sequence
gattcttcttcttctgttt

SEQ ID NO: 35531 - DNA, 19 bp, Artificial sequence
  SiRNA target sequence
attcttcttcttctgtttt

SEQ ID NO: 35532 - DNA, 19 bp, Artificial sequence
  SiRNA target sequence
ttcttcttcttctgtttta

SEQ ID NO: 35533 - DNA, 19 bp, Artificial sequence
  SiRNA target sequence
tcttcttcttctgttttat

SEQ ID NO: 35534 - DNA, 19 bp, Artificial sequence
  SiRNA target sequence
cttcttcttctgttttata

SEQ ID NO: 35535 - DNA, 19 bp, Artificial sequence
  SiRNA target sequence
ttcttcttctgttttatat

SEQ ID NO: 35536 - DNA, 19 bp, Artificial sequence
  SiRNA target sequence
tcttcttctgttttatatg

SEQ ID NO: 35537 - DNA, 19 bp, Artificial sequence
  SiRNA target sequence
cttcttctgttttatatgc

SEQ ID NO: 35538 - DNA, 19 bp, Artificial sequence
  SiRNA target sequence
ttcttctgttttatatgct

SEQ ID NO: 35539 - DNA, 19 bp, Artificial sequence
  SiRNA target sequence
tcttctgttttatatgcta

SEQ ID NO: 35540 - DNA, 19 bp, Artificial sequence
  SiRNA target sequence
cttctgttttatatgctag

SEQ ID NO: 35541 - DNA, 19 bp, Artificial sequence
  SiRNA target sequence
ttctgttttatatgctagt

SEQ ID NO: 35542 - DNA, 19 bp, Artificial sequence
  SiRNA target sequence
tctgttttatatgctagta

SEQ ID NO: 35543 - DNA, 19 bp, Artificial sequence
  SiRNA target sequence
ctgttttatatgctagtat

SEQ ID NO: 35544 - DNA, 19 bp, Artificial sequence
  SiRNA target sequence
tgttttatatgctagtata

SEQ ID NO: 35545 - DNA, 19 bp, Artificial sequence
  SiRNA target sequence
gttttatatgctagtatag

SEQ ID NO: 35546 - DNA, 19 bp, Artificial sequence
  SiRNA target sequence
ttttatatgctagtatagt

SEQ ID NO: 35547 - DNA, 19 bp, Artificial sequence
  SiRNA target sequence
tttatatgctagtatagtc

SEQ ID NO: 35548 - DNA, 19 bp, Artificial sequence
  SiRNA target sequence
ttatatgctagtatagtct

SEQ ID NO: 35549 - DNA, 19 bp, Artificial sequence
  SiRNA target sequence
tatatgctagtatagtctc

SEQ ID NO: 35550 - DNA, 19 bp, Artificial sequence
  SiRNA target sequence
atatgctagtatagtctca

SEQ ID NO: 35551 - DNA, 19 bp, Artificial sequence
  SiRNA target sequence
tatgctagtatagtctcat

SEQ ID NO: 35552 - DNA, 19 bp, Artificial sequence
  SiRNA target sequence
atgctagtatagtctcatg

SEQ ID NO: 35553 - DNA, 19 bp, Artificial sequence
  SiRNA target sequence
tgctagtatagtctcatga

SEQ ID NO: 35554 - DNA, 19 bp, Artificial sequence
  SiRNA target sequence
gctagtatagtctcatgat

SEQ ID NO: 35555 - DNA, 19 bp, Artificial sequence
  SiRNA target sequence
ctagtatagtctcatgatt

SEQ ID NO: 35556 - DNA, 19 bp, Artificial sequence
  SiRNA target sequence
tagtatagtctcatgatta

SEQ ID NO: 35557 - DNA, 19 bp, Artificial sequence
  SiRNA target sequence
agtatagtctcatgattaa

SEQ ID NO: 35558 - DNA, 19 bp, Artificial sequence
  SiRNA target sequence
gtatagtctcatgattaat

SEQ ID NO: 35559 - DNA, 19 bp, Artificial sequence
  SiRNA target sequence
tatagtctcatgattaatt

SEQ ID NO: 35560 - DNA, 19 bp, Artificial sequence
  SiRNA target sequence
atagtctcatgattaatta

SEQ ID NO: 35561 - DNA, 19 bp, Artificial sequence
  SiRNA target sequence
tagtctcatgattaattaa

SEQ ID NO: 35562 - DNA, 19 bp, Artificial sequence
  SiRNA target sequence
agtctcatgattaattaaa

SEQ ID NO: 35563 - DNA, 19 bp, Artificial sequence
  SiRNA target sequence
gtctcatgattaattaaag

SEQ ID NO: 35564 - DNA, 19 bp, Artificial sequence
  SiRNA target sequence
tctcatgattaattaaaga

SEQ ID NO: 35565 - DNA, 19 bp, Artificial sequence
  SiRNA target sequence
ctcatgattaattaaagaa

SEQ ID NO: 35566 - DNA, 19 bp, Artificial sequence
  SiRNA target sequence
tcatgattaattaaagaat

SEQ ID NO: 35567 - DNA, 19 bp, Artificial sequence
  SiRNA target sequence
catgattaattaaagaatc

SEQ ID NO: 35568 - DNA, 19 bp, Artificial sequence
  SiRNA target sequence
atgattaattaaagaatca

SEQ ID NO: 35569 - DNA, 19 bp, Artificial sequence
  SiRNA target sequence
tgattaattaaagaatcat

SEQ ID NO: 35570 - DNA, 19 bp, Artificial sequence
  SiRNA target sequence
gattaattaaagaatcatg

SEQ ID NO: 35571 - DNA, 19 bp, Artificial sequence
  SiRNA target sequence
attaattaaagaatcatgt

SEQ ID NO: 35572 - DNA, 19 bp, Artificial sequence
  SiRNA target sequence
ttaattaaagaatcatgta

SEQ ID NO: 35573 - DNA, 19 bp, Artificial sequence
  SiRNA target sequence
taattaaagaatcatgtaa

SEQ ID NO: 35574 - DNA, 19 bp, Artificial sequence
  SiRNA target sequence
aattaaagaatcatgtaag

SEQ ID NO: 35575 - DNA, 19 bp, Artificial sequence
  SiRNA target sequence
attaaagaatcatgtaagt

SEQ ID NO: 35576 - DNA, 19 bp, Artificial sequence
  SiRNA target sequence
ttaaagaatcatgtaagtg

SEQ ID NO: 35577 - DNA, 19 bp, Artificial sequence
  SiRNA target sequence
taaagaatcatgtaagtga

SEQ ID NO: 35578 - DNA, 19 bp, Artificial sequence
  SiRNA target sequence
aaagaatcatgtaagtgat

SEQ ID NO: 35579 - DNA, 19 bp, Artificial sequence
  SiRNA target sequence
aagaatcatgtaagtgatt

SEQ ID NO: 35580 - DNA, 19 bp, Artificial sequence
  SiRNA target sequence
agaatcatgtaagtgattt

SEQ ID NO: 35581 - DNA, 19 bp, Artificial sequence
  SiRNA target sequence
gaatcatgtaagtgatttg

SEQ ID NO: 35582 - DNA, 19 bp, Artificial sequence
  SiRNA target sequence
aatcatgtaagtgatttga

SEQ ID NO: 35583 - DNA, 19 bp, Artificial sequence
  SiRNA target sequence
atcatgtaagtgatttgag

SEQ ID NO: 35584 - DNA, 19 bp, Artificial sequence
  SiRNA target sequence
tcatgtaagtgatttgagc

SEQ ID NO: 35585 - DNA, 19 bp, Artificial sequence
  SiRNA target sequence
catgtaagtgatttgagca

SEQ ID NO: 35586 - DNA, 19 bp, Artificial sequence
  SiRNA target sequence
atgtaagtgatttgagcat

SEQ ID NO: 35587 - DNA, 19 bp, Artificial sequence
  SiRNA target sequence
tgtaagtgatttgagcatc

SEQ ID NO: 35588 - DNA, 19 bp, Artificial sequence
  SiRNA target sequence
gtaagtgatttgagcatct

SEQ ID NO: 35589 - DNA, 19 bp, Artificial sequence
  SiRNA target sequence
taagtgatttgagcatctt

SEQ ID NO: 35590 - DNA, 19 bp, Artificial sequence
  SiRNA target sequence
aagtgatttgagcatcttt

SEQ ID NO: 35591 - DNA, 19 bp, Artificial sequence
  SiRNA target sequence
agtgatttgagcatctttg

SEQ ID NO: 35592 - DNA, 19 bp, Artificial sequence
  SiRNA target sequence
gtgatttgagcatctttgt

SEQ ID NO: 35593 - DNA, 19 bp, Artificial sequence
  SiRNA target sequence
tgatttgagcatctttgtt

SEQ ID NO: 35594 - DNA, 19 bp, Artificial sequence
  SiRNA target sequence
gatttgagcatctttgttg

SEQ ID NO: 35595 - DNA, 19 bp, Artificial sequence
  SiRNA target sequence
atttgagcatctttgttgt

SEQ ID NO: 35596 - DNA, 19 bp, Artificial sequence
  SiRNA target sequence
tttgagcatctttgttgtg

SEQ ID NO: 35597 - DNA, 19 bp, Artificial sequence
  SiRNA target sequence
ttgagcatctttgttgtgc

SEQ ID NO: 35598 - DNA, 19 bp, Artificial sequence
  SiRNA target sequence
tgagcatctttgttgtgcg

SEQ ID NO: 35599 - DNA, 19 bp, Artificial sequence
  SiRNA target sequence
gagcatctttgttgtgcgc

SEQ ID NO: 35600 - DNA, 19 bp, Artificial sequence
  SiRNA target sequence
agcatctttgttgtgcgca

SEQ ID NO: 35601 - DNA, 19 bp, Artificial sequence
  SiRNA target sequence
gcatctttgttgtgcgcaa

SEQ ID NO: 35602 - DNA, 19 bp, Artificial sequence
  SiRNA target sequence
catctttgttgtgcgcaat

SEQ ID NO: 35603 - DNA, 19 bp, Artificial sequence
  SiRNA target sequence
atctttgttgtgcgcaatt

SEQ ID NO: 35604 - DNA, 19 bp, Artificial sequence
  SiRNA target sequence
tctttgttgtgcgcaatta

SEQ ID NO: 35605 - DNA, 19 bp, Artificial sequence
  SiRNA target sequence
ctttgttgtgcgcaattat

SEQ ID NO: 35606 - DNA, 19 bp, Artificial sequence
  SiRNA target sequence
tttgttgtgcgcaattata

SEQ ID NO: 35607 - DNA, 19 bp, Artificial sequence
  SiRNA target sequence
ttgttgtgcgcaattatat

SEQ ID NO: 35608 - DNA, 19 bp, Artificial sequence
  SiRNA target sequence
tgttgtgcgcaattatatt

SEQ ID NO: 35609 - DNA, 19 bp, Artificial sequence
  SiRNA target sequence
gttgtgcgcaattatattc

SEQ ID NO: 35610 - DNA, 19 bp, Artificial sequence
  SiRNA target sequence
ttgtgcgcaattatattct

SEQ ID NO: 35611 - DNA, 19 bp, Artificial sequence
  SiRNA target sequence
tgtgcgcaattatattctt

SEQ ID NO: 35612 - DNA, 19 bp, Artificial sequence
  SiRNA target sequence
gtgcgcaattatattcttt

SEQ ID NO: 35613 - DNA, 19 bp, Artificial sequence
  SiRNA target sequence
tgcgcaattatattctttt

SEQ ID NO: 35614 - DNA, 19 bp, Artificial sequence
  SiRNA target sequence
gcgcaattatattcttttc

SEQ ID NO: 35615 - DNA, 19 bp, Artificial sequence
  SiRNA target sequence
cgcaattatattcttttct

SEQ ID NO: 35616 - DNA, 19 bp, Artificial sequence
  SiRNA target sequence
gcaattatattcttttctt

SEQ ID NO: 35617 - DNA, 19 bp, Artificial sequence
  SiRNA target sequence
caattatattcttttctta

SEQ ID NO: 35618 - DNA, 19 bp, Artificial sequence
  SiRNA target sequence
aattatattcttttcttat

SEQ ID NO: 35619 - DNA, 19 bp, Artificial sequence
  SiRNA target sequence
attatattcttttcttatt

SEQ ID NO: 35620 - DNA, 19 bp, Artificial sequence
  SiRNA target sequence
ttatattcttttcttattc

SEQ ID NO: 35621 - DNA, 19 bp, Artificial sequence
  SiRNA target sequence
tatattcttttcttattcc

SEQ ID NO: 35622 - DNA, 19 bp, Artificial sequence
  SiRNA target sequence
atattcttttcttattcct

SEQ ID NO: 35623 - DNA, 19 bp, Artificial sequence
  SiRNA target sequence
tattcttttcttattcctg

SEQ ID NO: 35624 - DNA, 19 bp, Artificial sequence
  SiRNA target sequence
attcttttcttattcctgt

SEQ ID NO: 35625 - DNA, 19 bp, Artificial sequence
  SiRNA target sequence
ttcttttcttattcctgta

SEQ ID NO: 35626 - DNA, 19 bp, Artificial sequence
  SiRNA target sequence
tcttttcttattcctgtac

SEQ ID NO: 35627 - DNA, 19 bp, Artificial sequence
  SiRNA target sequence
cttttcttattcctgtacg

SEQ ID NO: 35628 - DNA, 19 bp, Artificial sequence
  SiRNA target sequence
ttttcttattcctgtacgc

SEQ ID NO: 35629 - DNA, 19 bp, Artificial sequence
  SiRNA target sequence
tttcttattcctgtacgcc

SEQ ID NO: 35630 - DNA, 19 bp, Artificial sequence
  SiRNA target sequence
ttcttattcctgtacgcca

SEQ ID NO: 35631 - DNA, 19 bp, Artificial sequence
  SiRNA target sequence
tcttattcctgtacgccaa

SEQ ID NO: 35632 - DNA, 19 bp, Artificial sequence
  SiRNA target sequence
cttattcctgtacgccaat

SEQ ID NO: 35633 - DNA, 19 bp, Artificial sequence
  SiRNA target sequence
ttattcctgtacgccaatg

SEQ ID NO: 35634 - DNA, 19 bp, Artificial sequence
  SiRNA target sequence
tattcctgtacgccaatga

SEQ ID NO: 35635 - DNA, 19 bp, Artificial sequence
  SiRNA target sequence
attcctgtacgccaatgaa

SEQ ID NO: 35636 - DNA, 19 bp, Artificial sequence
  SiRNA target sequence
ttcctgtacgccaatgaac

SEQ ID NO: 35637 - DNA, 19 bp, Artificial sequence
  SiRNA target sequence
tcctgtacgccaatgaact

SEQ ID NO: 35638 - DNA, 19 bp, Artificial sequence
  SiRNA target sequence
cctgtacgccaatgaacta

SEQ ID NO: 35639 - DNA, 19 bp, Artificial sequence
  SiRNA target sequence
ctgtacgccaatgaactat

SEQ ID NO: 35640 - DNA, 19 bp, Artificial sequence
  SiRNA target sequence
tgtacgccaatgaactatt

SEQ ID NO: 35641 - DNA, 19 bp, Artificial sequence
  SiRNA target sequence
gtacgccaatgaactattt

SEQ ID NO: 35642 - DNA, 19 bp, Artificial sequence
  SiRNA target sequence
tacgccaatgaactatttt

SEQ ID NO: 35643 - DNA, 19 bp, Artificial sequence
  SiRNA target sequence
acgccaatgaactattttc

SEQ ID NO: 35644 - DNA, 19 bp, Artificial sequence
  SiRNA target sequence
cgccaatgaactattttcg

SEQ ID NO: 35645 - DNA, 19 bp, Artificial sequence
  SiRNA target sequence
gccaatgaactattttcgc

SEQ ID NO: 35646 - DNA, 19 bp, Artificial sequence
  SiRNA target sequence
ccaatgaactattttcgca

SEQ ID NO: 35647 - DNA, 19 bp, Artificial sequence
  SiRNA target sequence
caatgaactattttcgcag

SEQ ID NO: 35648 - DNA, 19 bp, Artificial sequence
  SiRNA target sequence
aatgaactattttcgcagt

SEQ ID NO: 35649 - DNA, 19 bp, Artificial sequence
  SiRNA target sequence
atgaactattttcgcagtt

SEQ ID NO: 35650 - DNA, 19 bp, Artificial sequence
  SiRNA target sequence
tgaactattttcgcagttg

SEQ ID NO: 35651 - DNA, 19 bp, Artificial sequence
  SiRNA target sequence
gaactattttcgcagttgc

SEQ ID NO: 35652 - DNA, 19 bp, Artificial sequence
  SiRNA target sequence
aactattttcgcagttgca

SEQ ID NO: 35653 - DNA, 19 bp, Artificial sequence
  SiRNA target sequence
actattttcgcagttgcaa

SEQ ID NO: 35654 - DNA, 19 bp, Artificial sequence
  SiRNA target sequence
ctattttcgcagttgcaag

SEQ ID NO: 35655 - DNA, 19 bp, Artificial sequence
  SiRNA target sequence
tattttcgcagttgcaagg

SEQ ID NO: 35656 - DNA, 19 bp, Artificial sequence
  SiRNA target sequence
attttcgcagttgcaagga

SEQ ID NO: 35657 - DNA, 19 bp, Artificial sequence
  SiRNA target sequence
ttttcgcagttgcaaggat

SEQ ID NO: 35658 - DNA, 19 bp, Artificial sequence
  SiRNA target sequence
tttcgcagttgcaaggatg

SEQ ID NO: 35659 - DNA, 19 bp, Artificial sequence
  SiRNA target sequence
ttcgcagttgcaaggatgt

SEQ ID NO: 35660 - DNA, 19 bp, Artificial sequence
  SiRNA target sequence
tcgcagttgcaaggatgta

SEQ ID NO: 35661 - DNA, 19 bp, Artificial sequence
  SiRNA target sequence
cgcagttgcaaggatgtaa

SEQ ID NO: 35662 - DNA, 19 bp, Artificial sequence
  SiRNA target sequence
gcagttgcaaggatgtaaa

SEQ ID NO: 35663 - DNA, 19 bp, Artificial sequence
  SiRNA target sequence
cagttgcaaggatgtaaac

SEQ ID NO: 35664 - DNA, 19 bp, Artificial sequence
  SiRNA target sequence
agttgcaaggatgtaaact

SEQ ID NO: 35665 - DNA, 19 bp, Artificial sequence
  SiRNA target sequence
gttgcaaggatgtaaacta

SEQ ID NO: 35666 - DNA, 19 bp, Artificial sequence
  SiRNA target sequence
ttgcaaggatgtaaactaa

SEQ ID NO: 35667 - DNA, 19 bp, Artificial sequence
  SiRNA target sequence
tgcaaggatgtaaactaat

SEQ ID NO: 35668 - DNA, 19 bp, Artificial sequence
  SiRNA target sequence
gcaaggatgtaaactaata

SEQ ID NO: 35669 - DNA, 19 bp, Artificial sequence
  SiRNA target sequence
caaggatgtaaactaataa

SEQ ID NO: 35670 - DNA, 19 bp, Artificial sequence
  SiRNA target sequence
aaggatgtaaactaataat

SEQ ID NO: 35671 - DNA, 19 bp, Artificial sequence
  SiRNA target sequence
aggatgtaaactaataatg

SEQ ID NO: 35672 - DNA, 19 bp, Artificial sequence
  SiRNA target sequence
ggatgtaaactaataatgt

SEQ ID NO: 35673 - DNA, 19 bp, Artificial sequence
  SiRNA target sequence
gatgtaaactaataatgtg

SEQ ID NO: 35674 - DNA, 19 bp, Artificial sequence
  SiRNA target sequence
atgtaaactaataatgtga

SEQ ID NO: 35675 - DNA, 19 bp, Artificial sequence
  SiRNA target sequence
tgtaaactaataatgtgat

SEQ ID NO: 35676 - DNA, 19 bp, Artificial sequence
  SiRNA target sequence
gtaaactaataatgtgatt

SEQ ID NO: 35677 - DNA, 19 bp, Artificial sequence
  SiRNA target sequence
taaactaataatgtgatta

SEQ ID NO: 35678 - DNA, 19 bp, Artificial sequence
  SiRNA target sequence
aaactaataatgtgattaa

SEQ ID NO: 35679 - DNA, 19 bp, Artificial sequence
  SiRNA target sequence
aactaataatgtgattaaa

SEQ ID NO: 35680 - DNA, 19 bp, Artificial sequence
  SiRNA target sequence
actaataatgtgattaaaa

SEQ ID NO: 35681 - DNA, 19 bp, Artificial sequence
  SiRNA target sequence
ctaataatgtgattaaaat

SEQ ID NO: 35682 - DNA, 19 bp, Artificial sequence
  SiRNA target sequence
taataatgtgattaaaata

SEQ ID NO: 35683 - DNA, 19 bp, Artificial sequence
  SiRNA target sequence
aataatgtgattaaaataa

SEQ ID NO: 35684 - DNA, 19 bp, Artificial sequence
  SiRNA target sequence
ataatgtgattaaaataat

SEQ ID NO: 35685 - DNA, 19 bp, Artificial sequence
  SiRNA target sequence
taatgtgattaaaataata

SEQ ID NO: 35686 - DNA, 19 bp, Artificial sequence
  SiRNA target sequence
aatgtgattaaaataataa

SEQ ID NO: 35687 - DNA, 19 bp, Artificial sequence
  SiRNA target sequence
atgtgattaaaataataaa

SEQ ID NO: 35688 - DNA, 19 bp, Artificial sequence
  SiRNA target sequence
tgtgattaaaataataaac

SEQ ID NO: 35689 - DNA, 19 bp, Artificial sequence
  SiRNA target sequence
gtgattaaaataataaaca

SEQ ID NO: 35690 - DNA, 19 bp, Artificial sequence
  SiRNA target sequence
tgattaaaataataaacat

SEQ ID NO: 35691 - DNA, 19 bp, Artificial sequence
  SiRNA target sequence
gattaaaataataaacata

SEQ ID NO: 35692 - DNA, 19 bp, Artificial sequence
  SiRNA target sequence
attaaaataataaacatat

SEQ ID NO: 35693 - DNA, 19 bp, Artificial sequence
  SiRNA target sequence
ttaaaataataaacatatt

SEQ ID NO: 35694 - DNA, 19 bp, Artificial sequence
  SiRNA target sequence
taaaataataaacatattt

SEQ ID NO: 35695 - DNA, 19 bp, Artificial sequence
  SiRNA target sequence
aaaataataaacatatttg

SEQ ID NO: 35696 - DNA, 19 bp, Artificial sequence
  SiRNA target sequence
aaataataaacatatttgt

SEQ ID NO: 35697 - DNA, 19 bp, Artificial sequence
  SiRNA target sequence
aataataaacatatttgtc

SEQ ID NO: 35698 - DNA, 19 bp, Artificial sequence
  SiRNA target sequence
ataataaacatatttgtca

SEQ ID NO: 35699 - DNA, 19 bp, Artificial sequence
  SiRNA target sequence
taataaacatatttgtcaa

SEQ ID NO: 35700 - DNA, 19 bp, Artificial sequence
  SiRNA target sequence
aataaacatatttgtcaac

SEQ ID NO: 35701 - DNA, 19 bp, Artificial sequence
  SiRNA target sequence
ataaacatatttgtcaacc

SEQ ID NO: 35702 - DNA, 19 bp, Artificial sequence
  SiRNA target sequence
taaacatatttgtcaaccc

SEQ ID NO: 35703 - DNA, 19 bp, Artificial sequence
  SiRNA target sequence
aaacatatttgtcaaccct

SEQ ID NO: 35704 - DNA, 19 bp, Artificial sequence
  SiRNA target sequence
aacatatttgtcaacccta

SEQ ID NO: 35705 - DNA, 19 bp, Artificial sequence
  SiRNA target sequence
acatatttgtcaaccctaa

SEQ ID NO: 35706 - DNA, 19 bp, Artificial sequence
  SiRNA target sequence
catatttgtcaaccctaaa

SEQ ID NO: 35707 - DNA, 19 bp, Artificial sequence
  SiRNA target sequence
atatttgtcaaccctaaat

SEQ ID NO: 35708 - DNA, 19 bp, Artificial sequence
  SiRNA target sequence
tatttgtcaaccctaaatt

SEQ ID NO: 35709 - DNA, 19 bp, Artificial sequence
  SiRNA target sequence
atttgtcaaccctaaattt

SEQ ID NO: 35710 - DNA, 19 bp, Artificial sequence
  SiRNA target sequence
tttgtcaaccctaaatttg

SEQ ID NO: 35711 - DNA, 19 bp, Artificial sequence
  SiRNA target sequence
ttgtcaaccctaaatttgt

SEQ ID NO: 35712 - DNA, 19 bp, Artificial sequence
  SiRNA target sequence
tgtcaaccctaaatttgta

SEQ ID NO: 35713 - DNA, 19 bp, Artificial sequence
  SiRNA target sequence
gtcaaccctaaatttgtat

SEQ ID NO: 35714 - DNA, 19 bp, Artificial sequence
  SiRNA target sequence
tcaaccctaaatttgtata

SEQ ID NO: 35715 - DNA, 19 bp, Artificial sequence
  SiRNA target sequence
caaccctaaatttgtataa

SEQ ID NO: 35716 - DNA, 19 bp, Artificial sequence
  SiRNA target sequence
aaccctaaatttgtataaa

SEQ ID NO: 35717 - DNA, 19 bp, Artificial sequence
  SiRNA target sequence
accctaaatttgtataaat

SEQ ID NO: 35718 - DNA, 19 bp, Artificial sequence
  SiRNA target sequence
ccctaaatttgtataaatt

SEQ ID NO: 35719 - DNA, 19 bp, Artificial sequence
  SiRNA target sequence
cctaaatttgtataaattg

SEQ ID NO: 35720 - DNA, 19 bp, Artificial sequence
  SiRNA target sequence
ctaaatttgtataaattga

SEQ ID NO: 35721 - DNA, 19 bp, Artificial sequence
  SiRNA target sequence
taaatttgtataaattgac

SEQ ID NO: 35722 - DNA, 19 bp, Artificial sequence
  SiRNA target sequence
aaatttgtataaattgacg

SEQ ID NO: 35723 - DNA, 19 bp, Artificial sequence
  SiRNA target sequence
aatttgtataaattgacga

SEQ ID NO: 35724 - DNA, 19 bp, Artificial sequence
  SiRNA target sequence
atttgtataaattgacgaa

SEQ ID NO: 35725 - DNA, 19 bp, Artificial sequence
  SiRNA target sequence
tttgtataaattgacgaac

SEQ ID NO: 35726 - DNA, 19 bp, Artificial sequence
  SiRNA target sequence
ttgtataaattgacgaaca

SEQ ID NO: 35727 - DNA, 19 bp, Artificial sequence
  SiRNA target sequence
tgtataaattgacgaacac

SEQ ID NO: 35728 - DNA, 19 bp, Artificial sequence
  SiRNA target sequence
gtataaattgacgaacacg

SEQ ID NO: 35729 - DNA, 19 bp, Artificial sequence
  SiRNA target sequence
tataaattgacgaacacgc

SEQ ID NO: 35730 - DNA, 19 bp, Artificial sequence
  SiRNA target sequence
ataaattgacgaacacgcc

SEQ ID NO: 35731 - DNA, 19 bp, Artificial sequence
  SiRNA target sequence
taaattgacgaacacgcca

SEQ ID NO: 35732 - DNA, 19 bp, Artificial sequence
  SiRNA target sequence
aaattgacgaacacgccaa

SEQ ID NO: 35733 - DNA, 19 bp, Artificial sequence
  SiRNA target sequence
aattgacgaacacgccaat

SEQ ID NO: 35734 - DNA, 19 bp, Artificial sequence
  SiRNA target sequence
attgacgaacacgccaata

SEQ ID NO: 35735 - DNA, 19 bp, Artificial sequence
  SiRNA target sequence
ttgacgaacacgccaatat

SEQ ID NO: 35736 - DNA, 19 bp, Artificial sequence
  SiRNA target sequence
tgacgaacacgccaatata

SEQ ID NO: 35737 - DNA, 19 bp, Artificial sequence
  SiRNA target sequence
gacgaacacgccaatataa

SEQ ID NO: 35738 - DNA, 19 bp, Artificial sequence
  SiRNA target sequence
acgaacacgccaatataac

SEQ ID NO: 35739 - DNA, 19 bp, Artificial sequence
  SiRNA target sequence
cgaacacgccaatataact

SEQ ID NO: 35740 - DNA, 19 bp, Artificial sequence
  SiRNA target sequence
gaacacgccaatataactg

SEQ ID NO: 35741 - DNA, 19 bp, Artificial sequence
  SiRNA target sequence
aacacgccaatataactgt

SEQ ID NO: 35742 - DNA, 19 bp, Artificial sequence
  SiRNA target sequence
acacgccaatataactgta

SEQ ID NO: 35743 - DNA, 19 bp, Artificial sequence
  SiRNA target sequence
cacgccaatataactgtaa

SEQ ID NO: 35744 - DNA, 19 bp, Artificial sequence
  SiRNA target sequence
acgccaatataactgtaaa

SEQ ID NO: 35745 - DNA, 19 bp, Artificial sequence
  SiRNA target sequence
cgccaatataactgtaaaa

SEQ ID NO: 35746 - DNA, 19 bp, Artificial sequence
  SiRNA target sequence
gccaatataactgtaaaaa

SEQ ID NO: 35747 - DNA, 19 bp, Artificial sequence
  SiRNA target sequence
ccaatataactgtaaaaaa

SEQ ID NO: 35748 - DNA, 19 bp, Artificial sequence
  SiRNA target sequence
caatataactgtaaaaaaa

SEQ ID NO: 35749 - DNA, 19 bp, Artificial sequence
  SiRNA target sequence
aatataactgtaaaaaaaa

SEQ ID NO: 35750 - DNA, 19 bp, Artificial sequence
  SiRNA target sequence
atataactgtaaaaaaaat

SEQ ID NO: 35751 - DNA, 19 bp, Artificial sequence
  SiRNA target sequence
tataactgtaaaaaaaata

SEQ ID NO: 35752 - DNA, 19 bp, Artificial sequence
  SiRNA target sequence
ataactgtaaaaaaaatat

SEQ ID NO: 35753 - DNA, 19 bp, Artificial sequence
  SiRNA target sequence
taactgtaaaaaaaatatt

SEQ ID NO: 35754 - DNA, 19 bp, Artificial sequence
  SiRNA target sequence
aactgtaaaaaaaatattt

SEQ ID NO: 35755 - DNA, 19 bp, Artificial sequence
  SiRNA target sequence
actgtaaaaaaaatattta

SEQ ID NO: 35756 - DNA, 19 bp, Artificial sequence
  SiRNA target sequence
ctgtaaaaaaaatatttat

SEQ ID NO: 35757 - DNA, 19 bp, Artificial sequence
  SiRNA target sequence
tgtaaaaaaaatatttatg

SEQ ID NO: 35758 - DNA, 19 bp, Artificial sequence
  SiRNA target sequence
gtaaaaaaaatatttatga

SEQ ID NO: 35759 - DNA, 19 bp, Artificial sequence
  SiRNA target sequence
taaaaaaaatatttatgat

SEQ ID NO: 35760 - DNA, 19 bp, Artificial sequence
  SiRNA target sequence
aaaaaaaatatttatgata

SEQ ID NO: 35761 - DNA, 19 bp, Artificial sequence
  SiRNA target sequence
aaaaaaatatttatgatat

SEQ ID NO: 35762 - DNA, 19 bp, Artificial sequence
  SiRNA target sequence
aaaaaatatttatgatatt

SEQ ID NO: 35763 - DNA, 19 bp, Artificial sequence
  SiRNA target sequence
aaaaatatttatgatatta

SEQ ID NO: 35764 - DNA, 19 bp, Artificial sequence
  SiRNA target sequence
aaaatatttatgatattaa

SEQ ID NO: 35765 - DNA, 19 bp, Artificial sequence
  SiRNA target sequence
aaatatttatgatattaac

SEQ ID NO: 35766 - DNA, 19 bp, Artificial sequence
  SiRNA target sequence
aatatttatgatattaaca

SEQ ID NO: 35767 - DNA, 19 bp, Artificial sequence
  SiRNA target sequence
atatttatgatattaacaa

SEQ ID NO: 35768 - DNA, 19 bp, Artificial sequence
  SiRNA target sequence
tatttatgatattaacaaa

SEQ ID NO: 35769 - DNA, 19 bp, Artificial sequence
  SiRNA target sequence
atttatgatattaacaaat

SEQ ID NO: 35770 - DNA, 19 bp, Artificial sequence
  SiRNA target sequence
tttatgatattaacaaata

SEQ ID NO: 35771 - DNA, 19 bp, Artificial sequence
  SiRNA target sequence
ttatgatattaacaaataa

SEQ ID NO: 35772 - DNA, 19 bp, Artificial sequence
  SiRNA target sequence
tatgatattaacaaataaa

SEQ ID NO: 35773 - DNA, 19 bp, Artificial sequence
  SiRNA target sequence
atgatattaacaaataaaa

SEQ ID NO: 35774 - DNA, 19 bp, Artificial sequence
  SiRNA target sequence
tgatattaacaaataaaac

SEQ ID NO: 35775 - DNA, 19 bp, Artificial sequence
  SiRNA target sequence
gatattaacaaataaaact

SEQ ID NO: 35776 - DNA, 19 bp, Artificial sequence
  SiRNA target sequence
atattaacaaataaaactt

SEQ ID NO: 35777 - DNA, 19 bp, Artificial sequence
  SiRNA target sequence
tattaacaaataaaacttc

SEQ ID NO: 35778 - DNA, 19 bp, Artificial sequence
  SiRNA target sequence
attaacaaataaaacttcg

SEQ ID NO: 35779 - DNA, 19 bp, Artificial sequence
  SiRNA target sequence
ttaacaaataaaacttcga

SEQ ID NO: 35780 - DNA, 19 bp, Artificial sequence
  SiRNA target sequence
taacaaataaaacttcgat

SEQ ID NO: 35781 - DNA, 19 bp, Artificial sequence
  SiRNA target sequence
aacaaataaaacttcgatc

SEQ ID NO: 35782 - DNA, 19 bp, Artificial sequence
  SiRNA target sequence
acaaataaaacttcgatca

SEQ ID NO: 35783 - DNA, 19 bp, Artificial sequence
  SiRNA target sequence
caaataaaacttcgatcaa

SEQ ID NO: 35784 - DNA, 19 bp, Artificial sequence
  SiRNA target sequence
aaataaaacttcgatcaat

SEQ ID NO: 35785 - DNA, 19 bp, Artificial sequence
  SiRNA target sequence
aataaaacttcgatcaatt

SEQ ID NO: 35786 - DNA, 19 bp, Artificial sequence
  SiRNA target sequence
ataaaacttcgatcaattc

SEQ ID NO: 35787 - DNA, 19 bp, Artificial sequence
  SiRNA target sequence
taaaacttcgatcaattca

SEQ ID NO: 35788 - DNA, 19 bp, Artificial sequence
  SiRNA target sequence
aaaacttcgatcaattcac

SEQ ID NO: 35789 - DNA, 19 bp, Artificial sequence
  SiRNA target sequence
aaacttcgatcaattcact

SEQ ID NO: 35790 - DNA, 19 bp, Artificial sequence
  SiRNA target sequence
aacttcgatcaattcactt

SEQ ID NO: 35791 - DNA, 19 bp, Artificial sequence
  SiRNA target sequence
acttcgatcaattcactta

SEQ ID NO: 35792 - DNA, 19 bp, Artificial sequence
  SiRNA target sequence
cttcgatcaattcacttat

SEQ ID NO: 35793 - DNA, 19 bp, Artificial sequence
  SiRNA target sequence
ttcgatcaattcacttatt

SEQ ID NO: 35794 - DNA, 19 bp, Artificial sequence
  SiRNA target sequence
tcgatcaattcacttattg

SEQ ID NO: 35795 - DNA, 19 bp, Artificial sequence
  SiRNA target sequence
cgatcaattcacttattgc

SEQ ID NO: 35796 - DNA, 19 bp, Artificial sequence
  SiRNA target sequence
gatcaattcacttattgct

SEQ ID NO: 35797 - DNA, 19 bp, Artificial sequence
  SiRNA target sequence
atcaattcacttattgctt

SEQ ID NO: 35798 - DNA, 19 bp, Artificial sequence
  SiRNA target sequence
tcaattcacttattgcttt

SEQ ID NO: 35799 - DNA, 19 bp, Artificial sequence
  SiRNA target sequence
caattcacttattgcttta

SEQ ID NO: 35800 - DNA, 19 bp, Artificial sequence
  SiRNA target sequence
aattcacttattgctttac

SEQ ID NO: 35801 - DNA, 19 bp, Artificial sequence
  SiRNA target sequence
attcacttattgctttact

SEQ ID NO: 35802 - DNA, 19 bp, Artificial sequence
  SiRNA target sequence
ttcacttattgctttactt

SEQ ID NO: 35803 - DNA, 19 bp, Artificial sequence
  SiRNA target sequence
tcacttattgctttacttt

SEQ ID NO: 35804 - DNA, 19 bp, Artificial sequence
  SiRNA target sequence
cacttattgctttactttc

SEQ ID NO: 35805 - DNA, 19 bp, Artificial sequence
  SiRNA target sequence
acttattgctttactttct

SEQ ID NO: 35806 - DNA, 19 bp, Artificial sequence
  SiRNA target sequence
cttattgctttactttctc

SEQ ID NO: 35807 - DNA, 19 bp, Artificial sequence
  SiRNA target sequence
ttattgctttactttctcg

SEQ ID NO: 35808 - DNA, 19 bp, Artificial sequence
  SiRNA target sequence
tattgctttactttctcgg

SEQ ID NO: 35809 - DNA, 19 bp, Artificial sequence
  SiRNA target sequence
attgctttactttctcggt

SEQ ID NO: 35810 - DNA, 19 bp, Artificial sequence
  SiRNA target sequence
ttgctttactttctcggtc

SEQ ID NO: 35811 - DNA, 19 bp, Artificial sequence
  SiRNA target sequence
tgctttactttctcggtct

SEQ ID NO: 35812 - DNA, 19 bp, Artificial sequence
  SiRNA target sequence
gctttactttctcggtcta

SEQ ID NO: 35813 - DNA, 19 bp, Artificial sequence
  SiRNA target sequence
ctttactttctcggtctat

SEQ ID NO: 35814 - DNA, 19 bp, Artificial sequence
  SiRNA target sequence
tttactttctcggtctatt

SEQ ID NO: 35815 - DNA, 19 bp, Artificial sequence
  SiRNA target sequence
ttactttctcggtctatta

SEQ ID NO: 35816 - DNA, 19 bp, Artificial sequence
  SiRNA target sequence
tactttctcggtctattat

SEQ ID NO: 35817 - DNA, 19 bp, Artificial sequence
  SiRNA target sequence
actttctcggtctattatt

SEQ ID NO: 35818 - DNA, 19 bp, Artificial sequence
  SiRNA target sequence
ctttctcggtctattattg

SEQ ID NO: 35819 - DNA, 19 bp, Artificial sequence
  SiRNA target sequence
tttctcggtctattattgt

SEQ ID NO: 35820 - DNA, 19 bp, Artificial sequence
  SiRNA target sequence
ttctcggtctattattgtt

SEQ ID NO: 35821 - DNA, 19 bp, Artificial sequence
  SiRNA target sequence
tctcggtctattattgttt

SEQ ID NO: 35822 - DNA, 19 bp, Artificial sequence
  SiRNA target sequence
ctcggtctattattgtttg

SEQ ID NO: 35823 - DNA, 19 bp, Artificial sequence
  SiRNA target sequence
tcggtctattattgtttgt

SEQ ID NO: 35824 - DNA, 19 bp, Artificial sequence
  SiRNA target sequence
cggtctattattgtttgta

SEQ ID NO: 35825 - DNA, 19 bp, Artificial sequence
  SiRNA target sequence
ggtctattattgtttgtat

SEQ ID NO: 35826 - DNA, 19 bp, Artificial sequence
  SiRNA target sequence
gtctattattgtttgtatt

SEQ ID NO: 35827 - DNA, 19 bp, Artificial sequence
  SiRNA target sequence
tctattattgtttgtattt

SEQ ID NO: 35828 - DNA, 19 bp, Artificial sequence
  SiRNA target sequence
ctattattgtttgtatttc

SEQ ID NO: 35829 - DNA, 19 bp, Artificial sequence
  SiRNA target sequence
tattattgtttgtatttca

SEQ ID NO: 35830 - DNA, 19 bp, Artificial sequence
  SiRNA target sequence
attattgtttgtatttcac

SEQ ID NO: 35831 - DNA, 19 bp, Artificial sequence
  SiRNA target sequence
ttattgtttgtatttcacc

SEQ ID NO: 35832 - DNA, 19 bp, Artificial sequence
  SiRNA target sequence
tattgtttgtatttcaccg

SEQ ID NO: 35833 - DNA, 19 bp, Artificial sequence
  SiRNA target sequence
attgtttgtatttcaccgc

SEQ ID NO: 35834 - DNA, 19 bp, Artificial sequence
  SiRNA target sequence
ttgtttgtatttcaccgca

SEQ ID NO: 35835 - DNA, 19 bp, Artificial sequence
  SiRNA target sequence
tgtttgtatttcaccgcat

SEQ ID NO: 35836 - DNA, 19 bp, Artificial sequence
  SiRNA target sequence
gtttgtatttcaccgcatc

SEQ ID NO: 35837 - DNA, 19 bp, Artificial sequence
  SiRNA target sequence
tttgtatttcaccgcatcc

SEQ ID NO: 35838 - DNA, 19 bp, Artificial sequence
  SiRNA target sequence
ttgtatttcaccgcatcct

SEQ ID NO: 35839 - DNA, 19 bp, Artificial sequence
  SiRNA target sequence
tgtatttcaccgcatccta

SEQ ID NO: 35840 - DNA, 19 bp, Artificial sequence
  SiRNA target sequence
gtatttcaccgcatcctat

SEQ ID NO: 35841 - DNA, 19 bp, Artificial sequence
  SiRNA target sequence
tatttcaccgcatcctatt

SEQ ID NO: 35842 - DNA, 19 bp, Artificial sequence
  SiRNA target sequence
atttcaccgcatcctattt

SEQ ID NO: 35843 - DNA, 19 bp, Artificial sequence
  SiRNA target sequence
tttcaccgcatcctatttt

SEQ ID NO: 35844 - DNA, 19 bp, Artificial sequence
  SiRNA target sequence
ttcaccgcatcctatttta

SEQ ID NO: 35845 - DNA, 19 bp, Artificial sequence
  SiRNA target sequence
tcaccgcatcctattttat

SEQ ID NO: 35846 - DNA, 19 bp, Artificial sequence
  SiRNA target sequence
caccgcatcctattttatt

SEQ ID NO: 35847 - DNA, 19 bp, Artificial sequence
  SiRNA target sequence
accgcatcctattttattg

SEQ ID NO: 35848 - DNA, 19 bp, Artificial sequence
  SiRNA target sequence
ccgcatcctattttattgt

SEQ ID NO: 35849 - DNA, 19 bp, Artificial sequence
  SiRNA target sequence
cgcatcctattttattgta

SEQ ID NO: 35850 - DNA, 19 bp, Artificial sequence
  SiRNA target sequence
gcatcctattttattgtat

SEQ ID NO: 35851 - DNA, 19 bp, Artificial sequence
  SiRNA target sequence
catcctattttattgtatc

SEQ ID NO: 35852 - DNA, 19 bp, Artificial sequence
  SiRNA target sequence
atcctattttattgtatct

SEQ ID NO: 35853 - DNA, 19 bp, Artificial sequence
  SiRNA target sequence
tcctattttattgtatcta

SEQ ID NO: 35854 - DNA, 19 bp, Artificial sequence
  SiRNA target sequence
cctattttattgtatctac

SEQ ID NO: 35855 - DNA, 19 bp, Artificial sequence
  SiRNA target sequence
ctattttattgtatctact

SEQ ID NO: 35856 - DNA, 19 bp, Artificial sequence
  SiRNA target sequence
tattttattgtatctacta

SEQ ID NO: 35857 - DNA, 19 bp, Artificial sequence
  SiRNA target sequence
attttattgtatctactaa

SEQ ID NO: 35858 - DNA, 19 bp, Artificial sequence
  SiRNA target sequence
ttttattgtatctactaag

SEQ ID NO: 35859 - DNA, 19 bp, Artificial sequence
  SiRNA target sequence
tttattgtatctactaagt

SEQ ID NO: 35860 - DNA, 19 bp, Artificial sequence
  SiRNA target sequence
ttattgtatctactaagtt

SEQ ID NO: 35861 - DNA, 19 bp, Artificial sequence
  SiRNA target sequence
tattgtatctactaagttc

SEQ ID NO: 35862 - DNA, 19 bp, Artificial sequence
  SiRNA target sequence
attgtatctactaagttcc

SEQ ID NO: 35863 - DNA, 19 bp, Artificial sequence
  SiRNA target sequence
ttgtatctactaagttcca

SEQ ID NO: 35864 - DNA, 19 bp, Artificial sequence
  SiRNA target sequence
tgtatctactaagttccat

SEQ ID NO: 35865 - DNA, 19 bp, Artificial sequence
  SiRNA target sequence
gtatctactaagttccata

SEQ ID NO: 35866 - DNA, 19 bp, Artificial sequence
  SiRNA target sequence
tatctactaagttccatat

SEQ ID NO: 35867 - DNA, 19 bp, Artificial sequence
  SiRNA target sequence
atctactaagttccatatt

SEQ ID NO: 35868 - DNA, 19 bp, Artificial sequence
  SiRNA target sequence
tctactaagttccatattt

SEQ ID NO: 35869 - DNA, 19 bp, Artificial sequence
  SiRNA target sequence
ctactaagttccatattta

SEQ ID NO: 35870 - DNA, 19 bp, Artificial sequence
  SiRNA target sequence
tactaagttccatatttat

SEQ ID NO: 35871 - DNA, 19 bp, Artificial sequence
  SiRNA target sequence
actaagttccatatttata

SEQ ID NO: 35872 - DNA, 19 bp, Artificial sequence
  SiRNA target sequence
ctaagttccatatttataa

SEQ ID NO: 35873 - DNA, 19 bp, Artificial sequence
  SiRNA target sequence
taagttccatatttataaa

SEQ ID NO: 35874 - DNA, 19 bp, Artificial sequence
  SiRNA target sequence
aagttccatatttataaaa

SEQ ID NO: 35875 - DNA, 19 bp, Artificial sequence
  SiRNA target sequence
agttccatatttataaaat

SEQ ID NO: 35876 - DNA, 19 bp, Artificial sequence
  SiRNA target sequence
gttccatatttataaaatt

SEQ ID NO: 35877 - DNA, 19 bp, Artificial sequence
  SiRNA target sequence
ttccatatttataaaattt

SEQ ID NO: 35878 - DNA, 19 bp, Artificial sequence
  SiRNA target sequence
tccatatttataaaatttt

SEQ ID NO: 35879 - DNA, 19 bp, Artificial sequence
  SiRNA target sequence
ccatatttataaaattttt

SEQ ID NO: 35880 - DNA, 19 bp, Artificial sequence
  SiRNA target sequence
catatttataaaattttta

SEQ ID NO: 35881 - DNA, 19 bp, Artificial sequence
  SiRNA target sequence
atatttataaaatttttaa

SEQ ID NO: 35882 - DNA, 19 bp, Artificial sequence
  SiRNA target sequence
tatttataaaatttttaaa

SEQ ID NO: 35883 - DNA, 19 bp, Artificial sequence
  SiRNA target sequence
atttataaaatttttaaat

SEQ ID NO: 35884 - DNA, 19 bp, Artificial sequence
  SiRNA target sequence
tttataaaatttttaaatg

SEQ ID NO: 35885 - DNA, 19 bp, Artificial sequence
  SiRNA target sequence
ttataaaatttttaaatga

SEQ ID NO: 35886 - DNA, 19 bp, Artificial sequence
  SiRNA target sequence
tataaaatttttaaatgaa

SEQ ID NO: 35887 - DNA, 19 bp, Artificial sequence
  SiRNA target sequence
ataaaatttttaaatgaat

SEQ ID NO: 35888 - DNA, 19 bp, Artificial sequence
  SiRNA target sequence
taaaatttttaaatgaatt

SEQ ID NO: 35889 - DNA, 19 bp, Artificial sequence
  SiRNA target sequence
aaaatttttaaatgaattt

SEQ ID NO: 35890 - DNA, 19 bp, Artificial sequence
  SiRNA target sequence
aaatttttaaatgaatttt

SEQ ID NO: 35891 - DNA, 19 bp, Artificial sequence
  SiRNA target sequence
aatttttaaatgaattttt

SEQ ID NO: 35892 - DNA, 19 bp, Artificial sequence
  SiRNA target sequence
atttttaaatgaatttttt

SEQ ID NO: 35893 - DNA, 19 bp, Artificial sequence
  SiRNA target sequence
tttttaaatgaattttttc

SEQ ID NO: 35894 - DNA, 19 bp, Artificial sequence
  SiRNA target sequence
ttttaaatgaattttttcc

SEQ ID NO: 35895 - DNA, 19 bp, Artificial sequence
  SiRNA target sequence
tttaaatgaattttttcct

SEQ ID NO: 35896 - DNA, 19 bp, Artificial sequence
  SiRNA target sequence
ttaaatgaattttttcctg

SEQ ID NO: 35897 - DNA, 19 bp, Artificial sequence
  SiRNA target sequence
taaatgaattttttcctgt

SEQ ID NO: 35898 - DNA, 19 bp, Artificial sequence
  SiRNA target sequence
aaatgaattttttcctgtc

SEQ ID NO: 35899 - DNA, 19 bp, Artificial sequence
  SiRNA target sequence
aatgaattttttcctgtca

SEQ ID NO: 35900 - DNA, 19 bp, Artificial sequence
  SiRNA target sequence
atgaattttttcctgtcag

SEQ ID NO: 35901 - DNA, 19 bp, Artificial sequence
  SiRNA target sequence
tgaattttttcctgtcagt

SEQ ID NO: 35902 - DNA, 19 bp, Artificial sequence
  SiRNA target sequence
gaattttttcctgtcagtc

SEQ ID NO: 35903 - DNA, 19 bp, Artificial sequence
  SiRNA target sequence
aattttttcctgtcagtct

SEQ ID NO: 35904 - DNA, 19 bp, Artificial sequence
  SiRNA target sequence
attttttcctgtcagtctg

SEQ ID NO: 35905 - DNA, 19 bp, Artificial sequence
  SiRNA target sequence
ttttttcctgtcagtctga

SEQ ID NO: 35906 - DNA, 19 bp, Artificial sequence
  SiRNA target sequence
tttttcctgtcagtctgaa

SEQ ID NO: 35907 - DNA, 19 bp, Artificial sequence
  SiRNA target sequence
ttttcctgtcagtctgaat

SEQ ID NO: 35908 - DNA, 19 bp, Artificial sequence
  SiRNA target sequence
tttcctgtcagtctgaata

SEQ ID NO: 35909 - DNA, 19 bp, Artificial sequence
  SiRNA target sequence
ttcctgtcagtctgaatac

SEQ ID NO: 35910 - DNA, 19 bp, Artificial sequence
  SiRNA target sequence
tcctgtcagtctgaataca

SEQ ID NO: 35911 - DNA, 19 bp, Artificial sequence
  SiRNA target sequence
cctgtcagtctgaatacat

SEQ ID NO: 35912 - DNA, 19 bp, Artificial sequence
  SiRNA target sequence
ctgtcagtctgaatacatg

SEQ ID NO: 35913 - DNA, 19 bp, Artificial sequence
  SiRNA target sequence
tgtcagtctgaatacatgt

SEQ ID NO: 35914 - DNA, 19 bp, Artificial sequence
  SiRNA target sequence
gtcagtctgaatacatgtt

SEQ ID NO: 35915 - DNA, 19 bp, Artificial sequence
  SiRNA target sequence
tcagtctgaatacatgttg

SEQ ID NO: 35916 - DNA, 19 bp, Artificial sequence
  SiRNA target sequence
cagtctgaatacatgttga

SEQ ID NO: 35917 - DNA, 19 bp, Artificial sequence
  SiRNA target sequence
agtctgaatacatgttgaa

SEQ ID NO: 35918 - DNA, 19 bp, Artificial sequence
  SiRNA target sequence
gtctgaatacatgttgaac

SEQ ID NO: 35919 - DNA, 19 bp, Artificial sequence
  SiRNA target sequence
tctgaatacatgttgaacg

SEQ ID NO: 35920 - DNA, 19 bp, Artificial sequence
  SiRNA target sequence
ctgaatacatgttgaacgg

SEQ ID NO: 35921 - DNA, 19 bp, Artificial sequence
  SiRNA target sequence
tgaatacatgttgaacggg

SEQ ID NO: 35922 - DNA, 19 bp, Artificial sequence
  SiRNA target sequence
gaatacatgttgaacgggt

SEQ ID NO: 35923 - DNA, 19 bp, Artificial sequence
  SiRNA target sequence
aatacatgttgaacgggtg

SEQ ID NO: 35924 - DNA, 19 bp, Artificial sequence
  SiRNA target sequence
atacatgttgaacgggtgt

SEQ ID NO: 35925 - DNA, 19 bp, Artificial sequence
  SiRNA target sequence
tacatgttgaacgggtgta

SEQ ID NO: 35926 - DNA, 19 bp, Artificial sequence
  SiRNA target sequence
acatgttgaacgggtgtaa

SEQ ID NO: 35927 - DNA, 19 bp, Artificial sequence
  SiRNA target sequence
catgttgaacgggtgtaac

SEQ ID NO: 35928 - DNA, 19 bp, Artificial sequence
  SiRNA target sequence
atgttgaacgggtgtaaca

SEQ ID NO: 35929 - DNA, 19 bp, Artificial sequence
  SiRNA target sequence
tgttgaacgggtgtaacaa

SEQ ID NO: 35930 - DNA, 19 bp, Artificial sequence
  SiRNA target sequence
gttgaacgggtgtaacaaa

SEQ ID NO: 35931 - DNA, 19 bp, Artificial sequence
  SiRNA target sequence
ttgaacgggtgtaacaaat

SEQ ID NO: 35932 - DNA, 19 bp, Artificial sequence
  SiRNA target sequence
tgaacgggtgtaacaaata

SEQ ID NO: 35933 - DNA, 19 bp, Artificial sequence
  SiRNA target sequence
gaacgggtgtaacaaatat

SEQ ID NO: 35934 - DNA, 19 bp, Artificial sequence
  SiRNA target sequence
aacgggtgtaacaaatata

SEQ ID NO: 35935 - DNA, 19 bp, Artificial sequence
  SiRNA target sequence
acgggtgtaacaaatataa

SEQ ID NO: 35936 - DNA, 19 bp, Artificial sequence
  SiRNA target sequence
cgggtgtaacaaatataaa

SEQ ID NO: 35937 - DNA, 19 bp, Artificial sequence
  SiRNA target sequence
gggtgtaacaaatataaaa

SEQ ID NO: 35938 - DNA, 19 bp, Artificial sequence
  SiRNA target sequence
ggtgtaacaaatataaaat

SEQ ID NO: 35939 - DNA, 19 bp, Artificial sequence
  SiRNA target sequence
gtgtaacaaatataaaatt

SEQ ID NO: 35940 - DNA, 19 bp, Artificial sequence
  SiRNA target sequence
tgtaacaaatataaaattg

SEQ ID NO: 35941 - DNA, 19 bp, Artificial sequence
  SiRNA target sequence
gtaacaaatataaaattgt

SEQ ID NO: 35942 - DNA, 19 bp, Artificial sequence
  SiRNA target sequence
taacaaatataaaattgtt

SEQ ID NO: 35943 - DNA, 19 bp, Artificial sequence
  SiRNA target sequence
aacaaatataaaattgtta

SEQ ID NO: 35944 - DNA, 19 bp, Artificial sequence
  SiRNA target sequence
acaaatataaaattgttaa

SEQ ID NO: 35945 - DNA, 19 bp, Artificial sequence
  SiRNA target sequence
caaatataaaattgttaag

SEQ ID NO: 35946 - DNA, 19 bp, Artificial sequence
  SiRNA target sequence
aaatataaaattgttaagt

SEQ ID NO: 35947 - DNA, 19 bp, Artificial sequence
  SiRNA target sequence
aatataaaattgttaagtt

SEQ ID NO: 35948 - DNA, 19 bp, Artificial sequence
  SiRNA target sequence
atataaaattgttaagttc

SEQ ID NO: 35949 - DNA, 19 bp, Artificial sequence
  SiRNA target sequence
tataaaattgttaagttct

SEQ ID NO: 35950 - DNA, 19 bp, Artificial sequence
  SiRNA target sequence
ataaaattgttaagttctg

SEQ ID NO: 35951 - DNA, 19 bp, Artificial sequence
  SiRNA target sequence
taaaattgttaagttctga

SEQ ID NO: 35952 - DNA, 19 bp, Artificial sequence
  SiRNA target sequence
aaaattgttaagttctgac

SEQ ID NO: 35953 - DNA, 19 bp, Artificial sequence
  SiRNA target sequence
aaattgttaagttctgaca

SEQ ID NO: 35954 - DNA, 19 bp, Artificial sequence
  SiRNA target sequence
aattgttaagttctgacat

SEQ ID NO: 35955 - DNA, 19 bp, Artificial sequence
  SiRNA target sequence
attgttaagttctgacatt

SEQ ID NO: 35956 - DNA, 19 bp, Artificial sequence
  SiRNA target sequence
ttgttaagttctgacattg

SEQ ID NO: 35957 - DNA, 19 bp, Artificial sequence
  SiRNA target sequence
tgttaagttctgacattgt

SEQ ID NO: 35958 - DNA, 19 bp, Artificial sequence
  SiRNA target sequence
gttaagttctgacattgta

SEQ ID NO: 35959 - DNA, 19 bp, Artificial sequence
  SiRNA target sequence
ttaagttctgacattgtaa

SEQ ID NO: 35960 - DNA, 19 bp, Artificial sequence
  SiRNA target sequence
taagttctgacattgtaat

SEQ ID NO: 35961 - DNA, 19 bp, Artificial sequence
  SiRNA target sequence
aagttctgacattgtaatt

SEQ ID NO: 35962 - DNA, 19 bp, Artificial sequence
  SiRNA target sequence
agttctgacattgtaattg

SEQ ID NO: 35963 - DNA, 19 bp, Artificial sequence
  SiRNA target sequence
gttctgacattgtaattga

SEQ ID NO: 35964 - DNA, 19 bp, Artificial sequence
  SiRNA target sequence
ttctgacattgtaattgat

SEQ ID NO: 35965 - DNA, 19 bp, Artificial sequence
  SiRNA target sequence
tctgacattgtaattgata

SEQ ID NO: 35966 - DNA, 19 bp, Artificial sequence
  SiRNA target sequence
ctgacattgtaattgatac

SEQ ID NO: 35967 - DNA, 19 bp, Artificial sequence
  SiRNA target sequence
tgacattgtaattgataca

SEQ ID NO: 35968 - DNA, 19 bp, Artificial sequence
  SiRNA target sequence
gacattgtaattgatacaa

SEQ ID NO: 35969 - DNA, 19 bp, Artificial sequence
  SiRNA target sequence
acattgtaattgatacaat

SEQ ID NO: 35970 - DNA, 19 bp, Artificial sequence
  SiRNA target sequence
cattgtaattgatacaatt

SEQ ID NO: 35971 - DNA, 19 bp, Artificial sequence
  SiRNA target sequence
attgtaattgatacaattg

SEQ ID NO: 35972 - DNA, 19 bp, Artificial sequence
  SiRNA target sequence
ttgtaattgatacaattgt

SEQ ID NO: 35973 - DNA, 19 bp, Artificial sequence
  SiRNA target sequence
tgtaattgatacaattgtc

SEQ ID NO: 35974 - DNA, 19 bp, Artificial sequence
  SiRNA target sequence
gtaattgatacaattgtca

SEQ ID NO: 35975 - DNA, 19 bp, Artificial sequence
  SiRNA target sequence
taattgatacaattgtcaa

SEQ ID NO: 35976 - DNA, 19 bp, Artificial sequence
  SiRNA target sequence
aattgatacaattgtcaaa

SEQ ID NO: 35977 - DNA, 19 bp, Artificial sequence
  SiRNA target sequence
attgatacaattgtcaaaa

SEQ ID NO: 35978 - DNA, 19 bp, Artificial sequence
  SiRNA target sequence
ttgatacaattgtcaaaac

SEQ ID NO: 35979 - DNA, 19 bp, Artificial sequence
  SiRNA target sequence
tgatacaattgtcaaaact

SEQ ID NO: 35980 - DNA, 19 bp, Artificial sequence
  SiRNA target sequence
gatacaattgtcaaaactg

SEQ ID NO: 35981 - DNA, 19 bp, Artificial sequence
  SiRNA target sequence
atacaattgtcaaaactgc

SEQ ID NO: 35982 - DNA, 19 bp, Artificial sequence
  SiRNA target sequence
tacaattgtcaaaactgca

SEQ ID NO: 35983 - DNA, 19 bp, Artificial sequence
  SiRNA target sequence
acaattgtcaaaactgcaa

SEQ ID NO: 35984 - DNA, 19 bp, Artificial sequence
  SiRNA target sequence
caattgtcaaaactgcaaa

SEQ ID NO: 35985 - DNA, 19 bp, Artificial sequence
  SiRNA target sequence
aattgtcaaaactgcaaaa

SEQ ID NO: 35986 - DNA, 19 bp, Artificial sequence
  SiRNA target sequence
attgtcaaaactgcaaaat

SEQ ID NO: 35987 - DNA, 19 bp, Artificial sequence
  SiRNA target sequence
ttgtcaaaactgcaaaata

SEQ ID NO: 35988 - DNA, 19 bp, Artificial sequence
  SiRNA target sequence
tgtcaaaactgcaaaatac

SEQ ID NO: 35989 - DNA, 19 bp, Artificial sequence
  SiRNA target sequence
gtcaaaactgcaaaataca

SEQ ID NO: 35990 - DNA, 19 bp, Artificial sequence
  SiRNA target sequence
tcaaaactgcaaaatacaa

SEQ ID NO: 35991 - DNA, 19 bp, Artificial sequence
  SiRNA target sequence
caaaactgcaaaatacaaa

SEQ ID NO: 35992 - DNA, 19 bp, Artificial sequence
  SiRNA target sequence
aaaactgcaaaatacaaaa

SEQ ID NO: 35993 - DNA, 19 bp, Artificial sequence
  SiRNA target sequence
aaactgcaaaatacaaaag

SEQ ID NO: 35994 - DNA, 19 bp, Artificial sequence
  SiRNA target sequence
aactgcaaaatacaaaaga

SEQ ID NO: 35995 - DNA, 19 bp, Artificial sequence
  SiRNA target sequence
actgcaaaatacaaaagac

SEQ ID NO: 35996 - DNA, 19 bp, Artificial sequence
  SiRNA target sequence
ctgcaaaatacaaaagact

SEQ ID NO: 35997 - DNA, 19 bp, Artificial sequence
  SiRNA target sequence
tgcaaaatacaaaagactt

SEQ ID NO: 35998 - DNA, 19 bp, Artificial sequence
  SiRNA target sequence
gcaaaatacaaaagacttt

SEQ ID NO: 35999 - DNA, 19 bp, Artificial sequence
  SiRNA target sequence
caaaatacaaaagactttg

SEQ ID NO: 36000 - DNA, 19 bp, Artificial sequence
  SiRNA target sequence
aaaatacaaaagactttga

SEQ ID NO: 36001 - DNA, 19 bp, Artificial sequence
  SiRNA target sequence
aaatacaaaagactttgac

SEQ ID NO: 36002 - DNA, 19 bp, Artificial sequence
  SiRNA target sequence
aatacaaaagactttgact

SEQ ID NO: 36003 - DNA, 19 bp, Artificial sequence
  SiRNA target sequence
atacaaaagactttgacta

SEQ ID NO: 36004 - DNA, 19 bp, Artificial sequence
  SiRNA target sequence
tacaaaagactttgactaa

SEQ ID NO: 36005 - DNA, 19 bp, Artificial sequence
  SiRNA target sequence
acaaaagactttgactaag

SEQ ID NO: 36006 - DNA, 19 bp, Artificial sequence
  SiRNA target sequence
caaaagactttgactaaga

SEQ ID NO: 36007 - DNA, 19 bp, Artificial sequence
  SiRNA target sequence
aaaagactttgactaagat

SEQ ID NO: 36008 - DNA, 19 bp, Artificial sequence
  SiRNA target sequence
aaagactttgactaagatc

SEQ ID NO: 36009 - DNA, 19 bp, Artificial sequence
  SiRNA target sequence
aagactttgactaagatct

SEQ ID NO: 36010 - DNA, 19 bp, Artificial sequence
  SiRNA target sequence
agactttgactaagatctt

SEQ ID NO: 36011 - DNA, 19 bp, Artificial sequence
  SiRNA target sequence
gactttgactaagatcttt

SEQ ID NO: 36012 - DNA, 19 bp, Artificial sequence
  SiRNA target sequence
actttgactaagatcttta

SEQ ID NO: 36013 - DNA, 19 bp, Artificial sequence
  SiRNA target sequence
ctttgactaagatctttat

SEQ ID NO: 36014 - DNA, 19 bp, Artificial sequence
  SiRNA target sequence
tttgactaagatctttatt

SEQ ID NO: 36015 - DNA, 19 bp, Artificial sequence
  SiRNA target sequence
ttgactaagatctttatta

SEQ ID NO: 36016 - DNA, 19 bp, Artificial sequence
  SiRNA target sequence
tgactaagatctttattat

SEQ ID NO: 36017 - DNA, 19 bp, Artificial sequence
  SiRNA target sequence
gactaagatctttattatc

SEQ ID NO: 36018 - DNA, 19 bp, Artificial sequence
  SiRNA target sequence
actaagatctttattatct

SEQ ID NO: 36019 - DNA, 19 bp, Artificial sequence
  SiRNA target sequence
ctaagatctttattatctg

SEQ ID NO: 36020 - DNA, 19 bp, Artificial sequence
  SiRNA target sequence
taagatctttattatctgt

SEQ ID NO: 36021 - DNA, 19 bp, Artificial sequence
  SiRNA target sequence
aagatctttattatctgta

SEQ ID NO: 36022 - DNA, 19 bp, Artificial sequence
  SiRNA target sequence
agatctttattatctgtaa

SEQ ID NO: 36023 - DNA, 19 bp, Artificial sequence
  SiRNA target sequence
gatctttattatctgtaat

SEQ ID NO: 36024 - DNA, 19 bp, Artificial sequence
  SiRNA target sequence
atctttattatctgtaata

SEQ ID NO: 36025 - DNA, 19 bp, Artificial sequence
  SiRNA target sequence
tctttattatctgtaatat

SEQ ID NO: 36026 - DNA, 19 bp, Artificial sequence
  SiRNA target sequence
ctttattatctgtaatatc

SEQ ID NO: 36027 - DNA, 19 bp, Artificial sequence
  SiRNA target sequence
tttattatctgtaatatca

SEQ ID NO: 36028 - DNA, 19 bp, Artificial sequence
  SiRNA target sequence
ttattatctgtaatatcac

SEQ ID NO: 36029 - DNA, 19 bp, Artificial sequence
  SiRNA target sequence
tattatctgtaatatcact

SEQ ID NO: 36030 - DNA, 19 bp, Artificial sequence
  SiRNA target sequence
attatctgtaatatcacta

SEQ ID NO: 36031 - DNA, 19 bp, Artificial sequence
  SiRNA target sequence
ttatctgtaatatcactag

SEQ ID NO: 36032 - DNA, 19 bp, Artificial sequence
  SiRNA target sequence
tatctgtaatatcactagt

SEQ ID NO: 36033 - DNA, 19 bp, Artificial sequence
  SiRNA target sequence
atctgtaatatcactagtc

SEQ ID NO: 36034 - DNA, 19 bp, Artificial sequence
  SiRNA target sequence
tctgtaatatcactagtca

SEQ ID NO: 36035 - DNA, 19 bp, Artificial sequence
  SiRNA target sequence
ctgtaatatcactagtcaa

SEQ ID NO: 36036 - DNA, 19 bp, Artificial sequence
  SiRNA target sequence
tgtaatatcactagtcaat

SEQ ID NO: 36037 - DNA, 19 bp, Artificial sequence
  SiRNA target sequence
gtaatatcactagtcaatt

SEQ ID NO: 36038 - DNA, 19 bp, Artificial sequence
  SiRNA target sequence
taatatcactagtcaattt

SEQ ID NO: 36039 - DNA, 19 bp, Artificial sequence
  SiRNA target sequence
aatatcactagtcaatttc

SEQ ID NO: 36040 - DNA, 19 bp, Artificial sequence
  SiRNA target sequence
atatcactagtcaatttcc

SEQ ID NO: 36041 - DNA, 19 bp, Artificial sequence
  SiRNA target sequence
tatcactagtcaatttccg

SEQ ID NO: 36042 - DNA, 19 bp, Artificial sequence
  SiRNA target sequence
atcactagtcaatttccgg

SEQ ID NO: 36043 - DNA, 19 bp, Artificial sequence
  SiRNA target sequence
tcactagtcaatttccggg

SEQ ID NO: 36044 - DNA, 19 bp, Artificial sequence
  SiRNA target sequence
cactagtcaatttccgggt

SEQ ID NO: 36045 - DNA, 19 bp, Artificial sequence
  SiRNA target sequence
actagtcaatttccgggta

SEQ ID NO: 36046 - DNA, 19 bp, Artificial sequence
  SiRNA target sequence
ctagtcaatttccgggtag

SEQ ID NO: 36047 - DNA, 19 bp, Artificial sequence
  SiRNA target sequence
tagtcaatttccgggtagc

SEQ ID NO: 36048 - DNA, 19 bp, Artificial sequence
  SiRNA target sequence
agtcaatttccgggtagct

SEQ ID NO: 36049 - DNA, 19 bp, Artificial sequence
  SiRNA target sequence
gtcaatttccgggtagctt

SEQ ID NO: 36050 - DNA, 19 bp, Artificial sequence
  SiRNA target sequence
tcaatttccgggtagcttc

SEQ ID NO: 36051 - DNA, 19 bp, Artificial sequence
  SiRNA target sequence
caatttccgggtagcttca

SEQ ID NO: 36052 - DNA, 19 bp, Artificial sequence
  SiRNA target sequence
aatttccgggtagcttcaa

SEQ ID NO: 36053 - DNA, 19 bp, Artificial sequence
  SiRNA target sequence
atttccgggtagcttcaac

SEQ ID NO: 36054 - DNA, 19 bp, Artificial sequence
  SiRNA target sequence
tttccgggtagcttcaact

SEQ ID NO: 36055 - DNA, 19 bp, Artificial sequence
  SiRNA target sequence
ttccgggtagcttcaactg

SEQ ID NO: 36056 - DNA, 19 bp, Artificial sequence
  SiRNA target sequence
tccgggtagcttcaactgt

SEQ ID NO: 36057 - DNA, 19 bp, Artificial sequence
  SiRNA target sequence
ccgggtagcttcaactgtt

SEQ ID NO: 36058 - DNA, 19 bp, Artificial sequence
  SiRNA target sequence
cgggtagcttcaactgtta

SEQ ID NO: 36059 - DNA, 19 bp, Artificial sequence
  SiRNA target sequence
gggtagcttcaactgttaa

SEQ ID NO: 36060 - DNA, 19 bp, Artificial sequence
  SiRNA target sequence
ggtagcttcaactgttaaa

SEQ ID NO: 36061 - DNA, 19 bp, Artificial sequence
  SiRNA target sequence
gtagcttcaactgttaaaa

SEQ ID NO: 36062 - DNA, 19 bp, Artificial sequence
  SiRNA target sequence
tagcttcaactgttaaaac

SEQ ID NO: 36063 - DNA, 19 bp, Artificial sequence
  SiRNA target sequence
agcttcaactgttaaaaca

SEQ ID NO: 36064 - DNA, 19 bp, Artificial sequence
  SiRNA target sequence
gcttcaactgttaaaacat

SEQ ID NO: 36065 - DNA, 19 bp, Artificial sequence
  SiRNA target sequence
cttcaactgttaaaacatt

SEQ ID NO: 36066 - DNA, 19 bp, Artificial sequence
  SiRNA target sequence
ttcaactgttaaaacatta

SEQ ID NO: 36067 - DNA, 19 bp, Artificial sequence
  SiRNA target sequence
tcaactgttaaaacattaa

SEQ ID NO: 36068 - DNA, 19 bp, Artificial sequence
  SiRNA target sequence
caactgttaaaacattaaa

SEQ ID NO: 36069 - DNA, 19 bp, Artificial sequence
  SiRNA target sequence
aactgttaaaacattaaat

SEQ ID NO: 36070 - DNA, 19 bp, Artificial sequence
  SiRNA target sequence
actgttaaaacattaaatg

SEQ ID NO: 36071 - DNA, 19 bp, Artificial sequence
  SiRNA target sequence
ctgttaaaacattaaatgt

SEQ ID NO: 36072 - DNA, 19 bp, Artificial sequence
  SiRNA target sequence
tgttaaaacattaaatgta

SEQ ID NO: 36073 - DNA, 19 bp, Artificial sequence
  SiRNA target sequence
gttaaaacattaaatgtac

SEQ ID NO: 36074 - DNA, 19 bp, Artificial sequence
  SiRNA target sequence
ttaaaacattaaatgtaca

SEQ ID NO: 36075 - DNA, 19 bp, Artificial sequence
  SiRNA target sequence
taaaacattaaatgtacaa

SEQ ID NO: 36076 - DNA, 19 bp, Artificial sequence
  SiRNA target sequence
aaaacattaaatgtacaaa

SEQ ID NO: 36077 - DNA, 19 bp, Artificial sequence
  SiRNA target sequence
aaacattaaatgtacaaac

SEQ ID NO: 36078 - DNA, 19 bp, Artificial sequence
  SiRNA target sequence
aacattaaatgtacaaact

SEQ ID NO: 36079 - DNA, 19 bp, Artificial sequence
  SiRNA target sequence
acattaaatgtacaaactg

SEQ ID NO: 36080 - DNA, 19 bp, Artificial sequence
  SiRNA target sequence
cattaaatgtacaaactgc

SEQ ID NO: 36081 - DNA, 19 bp, Artificial sequence
  SiRNA target sequence
attaaatgtacaaactgca

SEQ ID NO: 36082 - DNA, 19 bp, Artificial sequence
  SiRNA target sequence
ttaaatgtacaaactgcaa

SEQ ID NO: 36083 - DNA, 19 bp, Artificial sequence
  SiRNA target sequence
taaatgtacaaactgcaaa

SEQ ID NO: 36084 - DNA, 19 bp, Artificial sequence
  SiRNA target sequence
aaatgtacaaactgcaaat

SEQ ID NO: 36085 - DNA, 19 bp, Artificial sequence
  SiRNA target sequence
aatgtacaaactgcaaatg

SEQ ID NO: 36086 - DNA, 19 bp, Artificial sequence
  SiRNA target sequence
atgtacaaactgcaaatgt

SEQ ID NO: 36087 - DNA, 19 bp, Artificial sequence
  SiRNA target sequence
tgtacaaactgcaaatgtc

SEQ ID NO: 36088 - DNA, 19 bp, Artificial sequence
  SiRNA target sequence
gtacaaactgcaaatgtcc

SEQ ID NO: 36089 - DNA, 19 bp, Artificial sequence
  SiRNA target sequence
tacaaactgcaaatgtccc

SEQ ID NO: 36090 - DNA, 19 bp, Artificial sequence
  SiRNA target sequence
acaaactgcaaatgtccca

SEQ ID NO: 36091 - DNA, 19 bp, Artificial sequence
  SiRNA target sequence
caaactgcaaatgtcccaa

SEQ ID NO: 36092 - DNA, 19 bp, Artificial sequence
  SiRNA target sequence
aaactgcaaatgtcccaaa

SEQ ID NO: 36093 - DNA, 19 bp, Artificial sequence
  SiRNA target sequence
aactgcaaatgtcccaaaa

SEQ ID NO: 36094 - DNA, 19 bp, Artificial sequence
  SiRNA target sequence
actgcaaatgtcccaaaaa

SEQ ID NO: 36095 - DNA, 19 bp, Artificial sequence
  SiRNA target sequence
ctgcaaatgtcccaaaaat

SEQ ID NO: 36096 - DNA, 19 bp, Artificial sequence
  SiRNA target sequence
tgcaaatgtcccaaaaatt

SEQ ID NO: 36097 - DNA, 19 bp, Artificial sequence
  SiRNA target sequence
gcaaatgtcccaaaaatta

SEQ ID NO: 36098 - DNA, 19 bp, Artificial sequence
  SiRNA target sequence
caaatgtcccaaaaattat

SEQ ID NO: 36099 - DNA, 19 bp, Artificial sequence
  SiRNA target sequence
aaatgtcccaaaaattatg

SEQ ID NO: 36100 - DNA, 19 bp, Artificial sequence
  SiRNA target sequence
aatgtcccaaaaattatgt

SEQ ID NO: 36101 - DNA, 19 bp, Artificial sequence
  SiRNA target sequence
atgtcccaaaaattatgta

SEQ ID NO: 36102 - DNA, 19 bp, Artificial sequence
  SiRNA target sequence
tgtcccaaaaattatgtaa

SEQ ID NO: 36103 - DNA, 19 bp, Artificial sequence
  SiRNA target sequence
gtcccaaaaattatgtaaa

SEQ ID NO: 36104 - DNA, 19 bp, Artificial sequence
  SiRNA target sequence
tcccaaaaattatgtaaat

SEQ ID NO: 36105 - DNA, 19 bp, Artificial sequence
  SiRNA target sequence
cccaaaaattatgtaaatg

SEQ ID NO: 36106 - DNA, 19 bp, Artificial sequence
  SiRNA target sequence
ccaaaaattatgtaaatga

SEQ ID NO: 36107 - DNA, 19 bp, Artificial sequence
  SiRNA target sequence
caaaaattatgtaaatgac

SEQ ID NO: 36108 - DNA, 19 bp, Artificial sequence
  SiRNA target sequence
aaaaattatgtaaatgaca

SEQ ID NO: 36109 - DNA, 19 bp, Artificial sequence
  SiRNA target sequence
aaaattatgtaaatgacaa

SEQ ID NO: 36110 - DNA, 19 bp, Artificial sequence
  SiRNA target sequence
aaattatgtaaatgacaaa

SEQ ID NO: 36111 - DNA, 19 bp, Artificial sequence
  SiRNA target sequence
aattatgtaaatgacaaat

SEQ ID NO: 36112 - DNA, 19 bp, Artificial sequence
  SiRNA target sequence
attatgtaaatgacaaatg

SEQ ID NO: 36113 - DNA, 19 bp, Artificial sequence
  SiRNA target sequence
ttatgtaaatgacaaatgt

SEQ ID NO: 36114 - DNA, 19 bp, Artificial sequence
  SiRNA target sequence
tatgtaaatgacaaatgtt

SEQ ID NO: 36115 - DNA, 19 bp, Artificial sequence
  SiRNA target sequence
atgtaaatgacaaatgttc

SEQ ID NO: 36116 - DNA, 19 bp, Artificial sequence
  SiRNA target sequence
tgtaaatgacaaatgttcg

SEQ ID NO: 36117 - DNA, 19 bp, Artificial sequence
  SiRNA target sequence
gtaaatgacaaatgttcga

SEQ ID NO: 36118 - DNA, 19 bp, Artificial sequence
  SiRNA target sequence
taaatgacaaatgttcgaa

SEQ ID NO: 36119 - DNA, 19 bp, Artificial sequence
  SiRNA target sequence
aaatgacaaatgttcgaat

SEQ ID NO: 36120 - DNA, 19 bp, Artificial sequence
  SiRNA target sequence
aatgacaaatgttcgaata

SEQ ID NO: 36121 - DNA, 19 bp, Artificial sequence
  SiRNA target sequence
atgacaaatgttcgaataa

SEQ ID NO: 36122 - DNA, 19 bp, Artificial sequence
  SiRNA target sequence
tgacaaatgttcgaataaa

SEQ ID NO: 36123 - DNA, 19 bp, Artificial sequence
  SiRNA target sequence
gacaaatgttcgaataaag

SEQ ID NO: 36124 - DNA, 19 bp, Artificial sequence
  SiRNA target sequence
acaaatgttcgaataaagg

SEQ ID NO: 36125 - DNA, 19 bp, Artificial sequence
  SiRNA target sequence
caaatgttcgaataaaggg

SEQ ID NO: 36126 - DNA, 19 bp, Artificial sequence
  SiRNA target sequence
aaatgttcgaataaagggc

SEQ ID NO: 36127 - DNA, 19 bp, Artificial sequence
  SiRNA target sequence
aatgttcgaataaagggct

SEQ ID NO: 36128 - DNA, 19 bp, Artificial sequence
  SiRNA target sequence
atgttcgaataaagggctt

SEQ ID NO: 36129 - DNA, 19 bp, Artificial sequence
  SiRNA target sequence
tgttcgaataaagggcttt

SEQ ID NO: 36130 - DNA, 19 bp, Artificial sequence
  SiRNA target sequence
gttcgaataaagggctttg

SEQ ID NO: 36131 - DNA, 19 bp, Artificial sequence
  SiRNA target sequence
ttcgaataaagggctttga

SEQ ID NO: 36132 - DNA, 19 bp, Artificial sequence
  SiRNA target sequence
tcgaataaagggctttgaa

SEQ ID NO: 36133 - DNA, 19 bp, Artificial sequence
  SiRNA target sequence
cgaataaagggctttgaaa

SEQ ID NO: 36134 - DNA, 19 bp, Artificial sequence
  SiRNA target sequence
gaataaagggctttgaaat

SEQ ID NO: 36135 - DNA, 19 bp, Artificial sequence
  SiRNA target sequence
aataaagggctttgaaata

SEQ ID NO: 36136 - DNA, 19 bp, Artificial sequence
  SiRNA target sequence
ataaagggctttgaaataa

SEQ ID NO: 36137 - DNA, 19 bp, Artificial sequence
  SiRNA target sequence
taaagggctttgaaataac

SEQ ID NO: 36138 - DNA, 19 bp, Artificial sequence
  SiRNA target sequence
aaagggctttgaaataaca

SEQ ID NO: 36139 - DNA, 19 bp, Artificial sequence
  SiRNA target sequence
aagggctttgaaataacat

SEQ ID NO: 36140 - DNA, 19 bp, Artificial sequence
  SiRNA target sequence
agggctttgaaataacata

SEQ ID NO: 36141 - DNA, 19 bp, Artificial sequence
  SiRNA target sequence
gggctttgaaataacatat

SEQ ID NO: 36142 - DNA, 19 bp, Artificial sequence
  SiRNA target sequence
ggctttgaaataacatatt

SEQ ID NO: 36143 - DNA, 19 bp, Artificial sequence
  SiRNA target sequence
gctttgaaataacatattc

SEQ ID NO: 36144 - DNA, 19 bp, Artificial sequence
  SiRNA target sequence
ctttgaaataacatattct

SEQ ID NO: 36145 - DNA, 19 bp, Artificial sequence
  SiRNA target sequence
tttgaaataacatattcta

SEQ ID NO: 36146 - DNA, 19 bp, Artificial sequence
  SiRNA target sequence
ttgaaataacatattctac

SEQ ID NO: 36147 - DNA, 19 bp, Artificial sequence
  SiRNA target sequence
tgaaataacatattctaca

SEQ ID NO: 36148 - DNA, 19 bp, Artificial sequence
  SiRNA target sequence
gaaataacatattctacaa

SEQ ID NO: 36149 - DNA, 19 bp, Artificial sequence
  SiRNA target sequence
aaataacatattctacaat

SEQ ID NO: 36150 - DNA, 19 bp, Artificial sequence
  SiRNA target sequence
aataacatattctacaatc

SEQ ID NO: 36151 - DNA, 19 bp, Artificial sequence
  SiRNA target sequence
ataacatattctacaatca

SEQ ID NO: 36152 - DNA, 19 bp, Artificial sequence
  SiRNA target sequence
taacatattctacaatcag

SEQ ID NO: 36153 - DNA, 19 bp, Artificial sequence
  SiRNA target sequence
aacatattctacaatcagg

SEQ ID NO: 36154 - DNA, 19 bp, Artificial sequence
  SiRNA target sequence
acatattctacaatcaggt

SEQ ID NO: 36155 - DNA, 19 bp, Artificial sequence
  SiRNA target sequence
catattctacaatcaggtc

SEQ ID NO: 36156 - DNA, 19 bp, Artificial sequence
  SiRNA target sequence
atattctacaatcaggtct

SEQ ID NO: 36157 - DNA, 19 bp, Artificial sequence
  SiRNA target sequence
tattctacaatcaggtctt

SEQ ID NO: 36158 - DNA, 19 bp, Artificial sequence
  SiRNA target sequence
attctacaatcaggtcttt

SEQ ID NO: 36159 - DNA, 19 bp, Artificial sequence
  SiRNA target sequence
ttctacaatcaggtctttc

SEQ ID NO: 36160 - DNA, 19 bp, Artificial sequence
  SiRNA target sequence
tctacaatcaggtctttca

SEQ ID NO: 36161 - DNA, 19 bp, Artificial sequence
  SiRNA target sequence
ctacaatcaggtctttcat

SEQ ID NO: 36162 - DNA, 19 bp, Artificial sequence
  SiRNA target sequence
tacaatcaggtctttcata

SEQ ID NO: 36163 - DNA, 19 bp, Artificial sequence
  SiRNA target sequence
acaatcaggtctttcataa

SEQ ID NO: 36164 - DNA, 19 bp, Artificial sequence
  SiRNA target sequence
caatcaggtctttcataat

SEQ ID NO: 36165 - DNA, 19 bp, Artificial sequence
  SiRNA target sequence
aatcaggtctttcataata

SEQ ID NO: 36166 - DNA, 19 bp, Artificial sequence
  SiRNA target sequence
atcaggtctttcataatac

SEQ ID NO: 36167 - DNA, 19 bp, Artificial sequence
  SiRNA target sequence
tcaggtctttcataatact

SEQ ID NO: 36168 - DNA, 19 bp, Artificial sequence
  SiRNA target sequence
caggtctttcataatacta

SEQ ID NO: 36169 - DNA, 19 bp, Artificial sequence
  SiRNA target sequence
aggtctttcataatactaa

SEQ ID NO: 36170 - DNA, 19 bp, Artificial sequence
  SiRNA target sequence
ggtctttcataatactaat

SEQ ID NO: 36171 - DNA, 19 bp, Artificial sequence
  SiRNA target sequence
gtctttcataatactaata

SEQ ID NO: 36172 - DNA, 19 bp, Artificial sequence
  SiRNA target sequence
tctttcataatactaatat

SEQ ID NO: 36173 - DNA, 19 bp, Artificial sequence
  SiRNA target sequence
ctttcataatactaatatc

SEQ ID NO: 36174 - DNA, 19 bp, Artificial sequence
  SiRNA target sequence
tttcataatactaatatca

SEQ ID NO: 36175 - DNA, 19 bp, Artificial sequence
  SiRNA target sequence
ttcataatactaatatcac

SEQ ID NO: 36176 - DNA, 19 bp, Artificial sequence
  SiRNA target sequence
tcataatactaatatcact

SEQ ID NO: 36177 - DNA, 19 bp, Artificial sequence
  SiRNA target sequence
cataatactaatatcacta

SEQ ID NO: 36178 - DNA, 19 bp, Artificial sequence
  SiRNA target sequence
ataatactaatatcactac

SEQ ID NO: 36179 - DNA, 19 bp, Artificial sequence
  SiRNA target sequence
taatactaatatcactacc

SEQ ID NO: 36180 - DNA, 19 bp, Artificial sequence
  SiRNA target sequence
aatactaatatcactacca

SEQ ID NO: 36181 - DNA, 19 bp, Artificial sequence
  SiRNA target sequence
atactaatatcactaccat

SEQ ID NO: 36182 - DNA, 19 bp, Artificial sequence
  SiRNA target sequence
tactaatatcactaccata

SEQ ID NO: 36183 - DNA, 19 bp, Artificial sequence
  SiRNA target sequence
actaatatcactaccataa

SEQ ID NO: 36184 - DNA, 19 bp, Artificial sequence
  SiRNA target sequence
ctaatatcactaccataaa

SEQ ID NO: 36185 - DNA, 19 bp, Artificial sequence
  SiRNA target sequence
taatatcactaccataaat

SEQ ID NO: 36186 - DNA, 19 bp, Artificial sequence
  SiRNA target sequence
aatatcactaccataaata

SEQ ID NO: 36187 - DNA, 19 bp, Artificial sequence
  SiRNA target sequence
atatcactaccataaatag

SEQ ID NO: 36188 - DNA, 19 bp, Artificial sequence
  SiRNA target sequence
tatcactaccataaataga

SEQ ID NO: 36189 - DNA, 19 bp, Artificial sequence
  SiRNA target sequence
atcactaccataaatagat

SEQ ID NO: 36190 - DNA, 19 bp, Artificial sequence
  SiRNA target sequence
tcactaccataaatagatt

SEQ ID NO: 36191 - DNA, 19 bp, Artificial sequence
  SiRNA target sequence
cactaccataaatagattt

SEQ ID NO: 36192 - DNA, 19 bp, Artificial sequence
  SiRNA target sequence
actaccataaatagatttt

SEQ ID NO: 36193 - DNA, 19 bp, Artificial sequence
  SiRNA target sequence
ctaccataaatagattttt

SEQ ID NO: 36194 - DNA, 19 bp, Artificial sequence
  SiRNA target sequence
taccataaatagatttttt

SEQ ID NO: 36195 - DNA, 19 bp, Artificial sequence
  SiRNA target sequence
accataaatagattttttt

SEQ ID NO: 36196 - DNA, 19 bp, Artificial sequence
  SiRNA target sequence
ccataaatagatttttttt

SEQ ID NO: 36197 - DNA, 19 bp, Artificial sequence
  SiRNA target sequence
cataaatagattttttttc

SEQ ID NO: 36198 - DNA, 19 bp, Artificial sequence
  SiRNA target sequence
ataaatagattttttttct

SEQ ID NO: 36199 - DNA, 19 bp, Artificial sequence
  SiRNA target sequence
taaatagattttttttcta

SEQ ID NO: 36200 - DNA, 19 bp, Artificial sequence
  SiRNA target sequence
aaatagattttttttctaa

SEQ ID NO: 36201 - DNA, 19 bp, Artificial sequence
  SiRNA target sequence
aatagattttttttctaac

SEQ ID NO: 36202 - DNA, 19 bp, Artificial sequence
  SiRNA target sequence
atagattttttttctaaca

SEQ ID NO: 36203 - DNA, 19 bp, Artificial sequence
  SiRNA target sequence
tagattttttttctaacat

SEQ ID NO: 36204 - DNA, 20 bp, Artificial sequence
  SiRNA target sequence
ttataagtttaatgtagaaa

SEQ ID NO: 36205 - DNA, 20 bp, Artificial sequence
  SiRNA target sequence
tataagtttaatgtagaaat

SEQ ID NO: 36206 - DNA, 20 bp, Artificial sequence
  SiRNA target sequence
ataagtttaatgtagaaata

SEQ ID NO: 36207 - DNA, 20 bp, Artificial sequence
  SiRNA target sequence
taagtttaatgtagaaataa

SEQ ID NO: 36208 - DNA, 20 bp, Artificial sequence
  SiRNA target sequence
aagtttaatgtagaaataat

SEQ ID NO: 36209 - DNA, 20 bp, Artificial sequence
  SiRNA target sequence
agtttaatgtagaaataata

SEQ ID NO: 36210 - DNA, 20 bp, Artificial sequence
  SiRNA target sequence
gtttaatgtagaaataatat

SEQ ID NO: 36211 - DNA, 20 bp, Artificial sequence
  SiRNA target sequence
tttaatgtagaaataatatt

SEQ ID NO: 36212 - DNA, 20 bp, Artificial sequence
  SiRNA target sequence
ttaatgtagaaataatattt

SEQ ID NO: 36213 - DNA, 20 bp, Artificial sequence
  SiRNA target sequence
taatgtagaaataatatttt

SEQ ID NO: 36214 - DNA, 20 bp, Artificial sequence
  SiRNA target sequence
aatgtagaaataatattttc

SEQ ID NO: 36215 - DNA, 20 bp, Artificial sequence
  SiRNA target sequence
atgtagaaataatattttct

SEQ ID NO: 36216 - DNA, 20 bp, Artificial sequence
  SiRNA target sequence
tgtagaaataatattttctt

SEQ ID NO: 36217 - DNA, 20 bp, Artificial sequence
  SiRNA target sequence
gtagaaataatattttcttc

SEQ ID NO: 36218 - DNA, 20 bp, Artificial sequence
  SiRNA target sequence
tagaaataatattttcttct

SEQ ID NO: 36219 - DNA, 20 bp, Artificial sequence
  SiRNA target sequence
agaaataatattttcttcta

SEQ ID NO: 36220 - DNA, 20 bp, Artificial sequence
  SiRNA target sequence
gaaataatattttcttctat

SEQ ID NO: 36221 - DNA, 20 bp, Artificial sequence
  SiRNA target sequence
aaataatattttcttctatc

SEQ ID NO: 36222 - DNA, 20 bp, Artificial sequence
  SiRNA target sequence
aataatattttcttctatct

SEQ ID NO: 36223 - DNA, 20 bp, Artificial sequence
  SiRNA target sequence
ataatattttcttctatctt

SEQ ID NO: 36224 - DNA, 20 bp, Artificial sequence
  SiRNA target sequence
taatattttcttctatctta

SEQ ID NO: 36225 - DNA, 20 bp, Artificial sequence
  SiRNA target sequence
aatattttcttctatcttat

SEQ ID NO: 36226 - DNA, 20 bp, Artificial sequence
  SiRNA target sequence
atattttcttctatcttatg

SEQ ID NO: 36227 - DNA, 20 bp, Artificial sequence
  SiRNA target sequence
tattttcttctatcttatgt

SEQ ID NO: 36228 - DNA, 20 bp, Artificial sequence
  SiRNA target sequence
attttcttctatcttatgta

SEQ ID NO: 36229 - DNA, 20 bp, Artificial sequence
  SiRNA target sequence
ttttcttctatcttatgtaa

SEQ ID NO: 36230 - DNA, 20 bp, Artificial sequence
  SiRNA target sequence
tttcttctatcttatgtaat

SEQ ID NO: 36231 - DNA, 20 bp, Artificial sequence
  SiRNA target sequence
ttcttctatcttatgtaatg

SEQ ID NO: 36232 - DNA, 20 bp, Artificial sequence
  SiRNA target sequence
tcttctatcttatgtaatga

SEQ ID NO: 36233 - DNA, 20 bp, Artificial sequence
  SiRNA target sequence
cttctatcttatgtaatgat

SEQ ID NO: 36234 - DNA, 20 bp, Artificial sequence
  SiRNA target sequence
ttctatcttatgtaatgata

SEQ ID NO: 36235 - DNA, 20 bp, Artificial sequence
  SiRNA target sequence
tctatcttatgtaatgatac

SEQ ID NO: 36236 - DNA, 20 bp, Artificial sequence
  SiRNA target sequence
ctatcttatgtaatgataca

SEQ ID NO: 36237 - DNA, 20 bp, Artificial sequence
  SiRNA target sequence
tatcttatgtaatgatacag

SEQ ID NO: 36238 - DNA, 20 bp, Artificial sequence
  SiRNA target sequence
atcttatgtaatgatacagt

SEQ ID NO: 36239 - DNA, 20 bp, Artificial sequence
  SiRNA target sequence
tcttatgtaatgatacagtt

SEQ ID NO: 36240 - DNA, 20 bp, Artificial sequence
  SiRNA target sequence
cttatgtaatgatacagttt

SEQ ID NO: 36241 - DNA, 20 bp, Artificial sequence
  SiRNA target sequence
ttatgtaatgatacagtttt

SEQ ID NO: 36242 - DNA, 20 bp, Artificial sequence
  SiRNA target sequence
tatgtaatgatacagttttg

SEQ ID NO: 36243 - DNA, 20 bp, Artificial sequence
  SiRNA target sequence
atgtaatgatacagttttgt

SEQ ID NO: 36244 - DNA, 20 bp, Artificial sequence
  SiRNA target sequence
tgtaatgatacagttttgtt

SEQ ID NO: 36245 - DNA, 20 bp, Artificial sequence
  SiRNA target sequence
gtaatgatacagttttgttt

SEQ ID NO: 36246 - DNA, 20 bp, Artificial sequence
  SiRNA target sequence
taatgatacagttttgtttt

SEQ ID NO: 36247 - DNA, 20 bp, Artificial sequence
  SiRNA target sequence
aatgatacagttttgttttt

SEQ ID NO: 36248 - DNA, 20 bp, Artificial sequence
  SiRNA target sequence
atgatacagttttgttttta

SEQ ID NO: 36249 - DNA, 20 bp, Artificial sequence
  SiRNA target sequence
tgatacagttttgtttttaa

SEQ ID NO: 36250 - DNA, 20 bp, Artificial sequence
  SiRNA target sequence
gatacagttttgtttttaat

SEQ ID NO: 36251 - DNA, 20 bp, Artificial sequence
  SiRNA target sequence
atacagttttgtttttaata

SEQ ID NO: 36252 - DNA, 20 bp, Artificial sequence
  SiRNA target sequence
tacagttttgtttttaatac

SEQ ID NO: 36253 - DNA, 20 bp, Artificial sequence
  SiRNA target sequence
acagttttgtttttaatact

SEQ ID NO: 36254 - DNA, 20 bp, Artificial sequence
  SiRNA target sequence
cagttttgtttttaatactt

SEQ ID NO: 36255 - DNA, 20 bp, Artificial sequence
  SiRNA target sequence
agttttgtttttaatactta

SEQ ID NO: 36256 - DNA, 20 bp, Artificial sequence
  SiRNA target sequence
gttttgtttttaatacttag

SEQ ID NO: 36257 - DNA, 20 bp, Artificial sequence
  SiRNA target sequence
ttttgtttttaatacttagc

SEQ ID NO: 36258 - DNA, 20 bp, Artificial sequence
  SiRNA target sequence
tttgtttttaatacttagca

SEQ ID NO: 36259 - DNA, 20 bp, Artificial sequence
  SiRNA target sequence
ttgtttttaatacttagcac

SEQ ID NO: 36260 - DNA, 20 bp, Artificial sequence
  SiRNA target sequence
tgtttttaatacttagcact

SEQ ID NO: 36261 - DNA, 20 bp, Artificial sequence
  SiRNA target sequence
gtttttaatacttagcactt

SEQ ID NO: 36262 - DNA, 20 bp, Artificial sequence
  SiRNA target sequence
tttttaatacttagcacttt

SEQ ID NO: 36263 - DNA, 20 bp, Artificial sequence
  SiRNA target sequence
ttttaatacttagcacttta

SEQ ID NO: 36264 - DNA, 20 bp, Artificial sequence
  SiRNA target sequence
tttaatacttagcactttat

SEQ ID NO: 36265 - DNA, 20 bp, Artificial sequence
  SiRNA target sequence
ttaatacttagcactttatc

SEQ ID NO: 36266 - DNA, 20 bp, Artificial sequence
  SiRNA target sequence
taatacttagcactttatca

SEQ ID NO: 36267 - DNA, 20 bp, Artificial sequence
  SiRNA target sequence
aatacttagcactttatcaa

SEQ ID NO: 36268 - DNA, 20 bp, Artificial sequence
  SiRNA target sequence
atacttagcactttatcaaa

SEQ ID NO: 36269 - DNA, 20 bp, Artificial sequence
  SiRNA target sequence
tacttagcactttatcaaat

SEQ ID NO: 36270 - DNA, 20 bp, Artificial sequence
  SiRNA target sequence
acttagcactttatcaaata

SEQ ID NO: 36271 - DNA, 20 bp, Artificial sequence
  SiRNA target sequence
cttagcactttatcaaataa

SEQ ID NO: 36272 - DNA, 20 bp, Artificial sequence
  SiRNA target sequence
ttagcactttatcaaataag

SEQ ID NO: 36273 - DNA, 20 bp, Artificial sequence
  SiRNA target sequence
tagcactttatcaaataagt

SEQ ID NO: 36274 - DNA, 20 bp, Artificial sequence
  SiRNA target sequence
agcactttatcaaataagtg

SEQ ID NO: 36275 - DNA, 20 bp, Artificial sequence
  SiRNA target sequence
gcactttatcaaataagtgg

SEQ ID NO: 36276 - DNA, 20 bp, Artificial sequence
  SiRNA target sequence
cactttatcaaataagtgga

SEQ ID NO: 36277 - DNA, 20 bp, Artificial sequence
  SiRNA target sequence
actttatcaaataagtggag

SEQ ID NO: 36278 - DNA, 20 bp, Artificial sequence
  SiRNA target sequence
ctttatcaaataagtggagt

SEQ ID NO: 36279 - DNA, 20 bp, Artificial sequence
  SiRNA target sequence
tttatcaaataagtggagta

SEQ ID NO: 36280 - DNA, 20 bp, Artificial sequence
  SiRNA target sequence
ttatcaaataagtggagtaa

SEQ ID NO: 36281 - DNA, 20 bp, Artificial sequence
  SiRNA target sequence
tatcaaataagtggagtaaa

SEQ ID NO: 36282 - DNA, 20 bp, Artificial sequence
  SiRNA target sequence
atcaaataagtggagtaaat

SEQ ID NO: 36283 - DNA, 20 bp, Artificial sequence
  SiRNA target sequence
tcaaataagtggagtaaatc

SEQ ID NO: 36284 - DNA, 20 bp, Artificial sequence
  SiRNA target sequence
caaataagtggagtaaatct

SEQ ID NO: 36285 - DNA, 20 bp, Artificial sequence
  SiRNA target sequence
aaataagtggagtaaatcta

SEQ ID NO: 36286 - DNA, 20 bp, Artificial sequence
  SiRNA target sequence
aataagtggagtaaatctaa

SEQ ID NO: 36287 - DNA, 20 bp, Artificial sequence
  SiRNA target sequence
ataagtggagtaaatctaaa

SEQ ID NO: 36288 - DNA, 20 bp, Artificial sequence
  SiRNA target sequence
taagtggagtaaatctaaat

SEQ ID NO: 36289 - DNA, 20 bp, Artificial sequence
  SiRNA target sequence
aagtggagtaaatctaaatt

SEQ ID NO: 36290 - DNA, 20 bp, Artificial sequence
  SiRNA target sequence
agtggagtaaatctaaatta

SEQ ID NO: 36291 - DNA, 20 bp, Artificial sequence
  SiRNA target sequence
gtggagtaaatctaaattat

SEQ ID NO: 36292 - DNA, 20 bp, Artificial sequence
  SiRNA target sequence
tggagtaaatctaaattatg

SEQ ID NO: 36293 - DNA, 20 bp, Artificial sequence
  SiRNA target sequence
ggagtaaatctaaattatgt

SEQ ID NO: 36294 - DNA, 20 bp, Artificial sequence
  SiRNA target sequence
gagtaaatctaaattatgta

SEQ ID NO: 36295 - DNA, 20 bp, Artificial sequence
  SiRNA target sequence
agtaaatctaaattatgtaa

SEQ ID NO: 36296 - DNA, 20 bp, Artificial sequence
  SiRNA target sequence
gtaaatctaaattatgtaaa

SEQ ID NO: 36297 - DNA, 20 bp, Artificial sequence
  SiRNA target sequence
taaatctaaattatgtaaaa

SEQ ID NO: 36298 - DNA, 20 bp, Artificial sequence
  SiRNA target sequence
aaatctaaattatgtaaaac

SEQ ID NO: 36299 - DNA, 20 bp, Artificial sequence
  SiRNA target sequence
aatctaaattatgtaaaaca

SEQ ID NO: 36300 - DNA, 20 bp, Artificial sequence
  SiRNA target sequence
atctaaattatgtaaaacaa

SEQ ID NO: 36301 - DNA, 20 bp, Artificial sequence
  SiRNA target sequence
tctaaattatgtaaaacaat

SEQ ID NO: 36302 - DNA, 20 bp, Artificial sequence
  SiRNA target sequence
ctaaattatgtaaaacaata

SEQ ID NO: 36303 - DNA, 20 bp, Artificial sequence
  SiRNA target sequence
taaattatgtaaaacaataa

SEQ ID NO: 36304 - DNA, 20 bp, Artificial sequence
  SiRNA target sequence
aaattatgtaaaacaataat

SEQ ID NO: 36305 - DNA, 20 bp, Artificial sequence
  SiRNA target sequence
aattatgtaaaacaataatt

SEQ ID NO: 36306 - DNA, 20 bp, Artificial sequence
  SiRNA target sequence
attatgtaaaacaataatta

SEQ ID NO: 36307 - DNA, 20 bp, Artificial sequence
  SiRNA target sequence
ttatgtaaaacaataattat

SEQ ID NO: 36308 - DNA, 20 bp, Artificial sequence
  SiRNA target sequence
tatgtaaaacaataattatc

SEQ ID NO: 36309 - DNA, 20 bp, Artificial sequence
  SiRNA target sequence
atgtaaaacaataattatcg

SEQ ID NO: 36310 - DNA, 20 bp, Artificial sequence
  SiRNA target sequence
tgtaaaacaataattatcgt

SEQ ID NO: 36311 - DNA, 20 bp, Artificial sequence
  SiRNA target sequence
gtaaaacaataattatcgtc

SEQ ID NO: 36312 - DNA, 20 bp, Artificial sequence
  SiRNA target sequence
taaaacaataattatcgtct

SEQ ID NO: 36313 - DNA, 20 bp, Artificial sequence
  SiRNA target sequence
aaaacaataattatcgtctt

SEQ ID NO: 36314 - DNA, 20 bp, Artificial sequence
  SiRNA target sequence
aaacaataattatcgtcttc

SEQ ID NO: 36315 - DNA, 20 bp, Artificial sequence
  SiRNA target sequence
aacaataattatcgtcttct

SEQ ID NO: 36316 - DNA, 20 bp, Artificial sequence
  SiRNA target sequence
acaataattatcgtcttctc

SEQ ID NO: 36317 - DNA, 20 bp, Artificial sequence
  SiRNA target sequence
caataattatcgtcttctct

SEQ ID NO: 36318 - DNA, 20 bp, Artificial sequence
  SiRNA target sequence
aataattatcgtcttctcta

SEQ ID NO: 36319 - DNA, 20 bp, Artificial sequence
  SiRNA target sequence
ataattatcgtcttctctaa

SEQ ID NO: 36320 - DNA, 20 bp, Artificial sequence
  SiRNA target sequence
taattatcgtcttctctaag

SEQ ID NO: 36321 - DNA, 20 bp, Artificial sequence
  SiRNA target sequence
aattatcgtcttctctaagt

SEQ ID NO: 36322 - DNA, 20 bp, Artificial sequence
  SiRNA target sequence
attatcgtcttctctaagtt

SEQ ID NO: 36323 - DNA, 20 bp, Artificial sequence
  SiRNA target sequence
ttatcgtcttctctaagttg

SEQ ID NO: 36324 - DNA, 20 bp, Artificial sequence
  SiRNA target sequence
tatcgtcttctctaagttgt

SEQ ID NO: 36325 - DNA, 20 bp, Artificial sequence
  SiRNA target sequence
atcgtcttctctaagttgtt

SEQ ID NO: 36326 - DNA, 20 bp, Artificial sequence
  SiRNA target sequence
tcgtcttctctaagttgttg

SEQ ID NO: 36327 - DNA, 20 bp, Artificial sequence
  SiRNA target sequence
cgtcttctctaagttgttgg

SEQ ID NO: 36328 - DNA, 20 bp, Artificial sequence
  SiRNA target sequence
gtcttctctaagttgttgga

SEQ ID NO: 36329 - DNA, 20 bp, Artificial sequence
  SiRNA target sequence
tcttctctaagttgttggag

SEQ ID NO: 36330 - DNA, 20 bp, Artificial sequence
  SiRNA target sequence
cttctctaagttgttggaga

SEQ ID NO: 36331 - DNA, 20 bp, Artificial sequence
  SiRNA target sequence
ttctctaagttgttggagat

SEQ ID NO: 36332 - DNA, 20 bp, Artificial sequence
  SiRNA target sequence
tctctaagttgttggagatt

SEQ ID NO: 36333 - DNA, 20 bp, Artificial sequence
  SiRNA target sequence
ctctaagttgttggagatta

SEQ ID NO: 36334 - DNA, 20 bp, Artificial sequence
  SiRNA target sequence
tctaagttgttggagattag

SEQ ID NO: 36335 - DNA, 20 bp, Artificial sequence
  SiRNA target sequence
ctaagttgttggagattaga

SEQ ID NO: 36336 - DNA, 20 bp, Artificial sequence
  SiRNA target sequence
taagttgttggagattagac

SEQ ID NO: 36337 - DNA, 20 bp, Artificial sequence
  SiRNA target sequence
aagttgttggagattagact

SEQ ID NO: 36338 - DNA, 20 bp, Artificial sequence
  SiRNA target sequence
agttgttggagattagactt

SEQ ID NO: 36339 - DNA, 20 bp, Artificial sequence
  SiRNA target sequence
gttgttggagattagacttt

SEQ ID NO: 36340 - DNA, 20 bp, Artificial sequence
  SiRNA target sequence
ttgttggagattagactttt

SEQ ID NO: 36341 - DNA, 20 bp, Artificial sequence
  SiRNA target sequence
tgttggagattagactttta

SEQ ID NO: 36342 - DNA, 20 bp, Artificial sequence
  SiRNA target sequence
gttggagattagacttttaa

SEQ ID NO: 36343 - DNA, 20 bp, Artificial sequence
  SiRNA target sequence
ttggagattagacttttaag

SEQ ID NO: 36344 - DNA, 20 bp, Artificial sequence
  SiRNA target sequence
tggagattagacttttaaga

SEQ ID NO: 36345 - DNA, 20 bp, Artificial sequence
  SiRNA target sequence
ggagattagacttttaagaa

SEQ ID NO: 36346 - DNA, 20 bp, Artificial sequence
  SiRNA target sequence
gagattagacttttaagaat

SEQ ID NO: 36347 - DNA, 20 bp, Artificial sequence
  SiRNA target sequence
agattagacttttaagaatt

SEQ ID NO: 36348 - DNA, 20 bp, Artificial sequence
  SiRNA target sequence
gattagacttttaagaattt

SEQ ID NO: 36349 - DNA, 20 bp, Artificial sequence
  SiRNA target sequence
attagacttttaagaatttc

SEQ ID NO: 36350 - DNA, 20 bp, Artificial sequence
  SiRNA target sequence
ttagacttttaagaatttca

SEQ ID NO: 36351 - DNA, 20 bp, Artificial sequence
  SiRNA target sequence
tagacttttaagaatttcat

SEQ ID NO: 36352 - DNA, 20 bp, Artificial sequence
  SiRNA target sequence
agacttttaagaatttcata

SEQ ID NO: 36353 - DNA, 20 bp, Artificial sequence
  SiRNA target sequence
gacttttaagaatttcatat

SEQ ID NO: 36354 - DNA, 20 bp, Artificial sequence
  SiRNA target sequence
acttttaagaatttcatatt

SEQ ID NO: 36355 - DNA, 20 bp, Artificial sequence
  SiRNA target sequence
cttttaagaatttcatattc

SEQ ID NO: 36356 - DNA, 20 bp, Artificial sequence
  SiRNA target sequence
ttttaagaatttcatattca

SEQ ID NO: 36357 - DNA, 20 bp, Artificial sequence
  SiRNA target sequence
tttaagaatttcatattcag

SEQ ID NO: 36358 - DNA, 20 bp, Artificial sequence
  SiRNA target sequence
ttaagaatttcatattcagc

SEQ ID NO: 36359 - DNA, 20 bp, Artificial sequence
  SiRNA target sequence
taagaatttcatattcagct

SEQ ID NO: 36360 - DNA, 20 bp, Artificial sequence
  SiRNA target sequence
aagaatttcatattcagctt

SEQ ID NO: 36361 - DNA, 20 bp, Artificial sequence
  SiRNA target sequence
agaatttcatattcagcttt

SEQ ID NO: 36362 - DNA, 20 bp, Artificial sequence
  SiRNA target sequence
gaatttcatattcagctttt

SEQ ID NO: 36363 - DNA, 20 bp, Artificial sequence
  SiRNA target sequence
aatttcatattcagcttttt

SEQ ID NO: 36364 - DNA, 20 bp, Artificial sequence
  SiRNA target sequence
atttcatattcagctttttt

SEQ ID NO: 36365 - DNA, 20 bp, Artificial sequence
  SiRNA target sequence
tttcatattcagcttttttg

SEQ ID NO: 36366 - DNA, 20 bp, Artificial sequence
  SiRNA target sequence
ttcatattcagcttttttgt

SEQ ID NO: 36367 - DNA, 20 bp, Artificial sequence
  SiRNA target sequence
tcatattcagcttttttgtc

SEQ ID NO: 36368 - DNA, 20 bp, Artificial sequence
  SiRNA target sequence
catattcagcttttttgtcc

SEQ ID NO: 36369 - DNA, 20 bp, Artificial sequence
  SiRNA target sequence
atattcagcttttttgtcca

SEQ ID NO: 36370 - DNA, 20 bp, Artificial sequence
  SiRNA target sequence
tattcagcttttttgtccaa

SEQ ID NO: 36371 - DNA, 20 bp, Artificial sequence
  SiRNA target sequence
attcagcttttttgtccaat

SEQ ID NO: 36372 - DNA, 20 bp, Artificial sequence
  SiRNA target sequence
ttcagcttttttgtccaatg

SEQ ID NO: 36373 - DNA, 20 bp, Artificial sequence
  SiRNA target sequence
tcagcttttttgtccaatgc

SEQ ID NO: 36374 - DNA, 20 bp, Artificial sequence
  SiRNA target sequence
cagcttttttgtccaatgcg

SEQ ID NO: 36375 - DNA, 20 bp, Artificial sequence
  SiRNA target sequence
agcttttttgtccaatgcgg

SEQ ID NO: 36376 - DNA, 20 bp, Artificial sequence
  SiRNA target sequence
gcttttttgtccaatgcggc

SEQ ID NO: 36377 - DNA, 20 bp, Artificial sequence
  SiRNA target sequence
cttttttgtccaatgcggcc

SEQ ID NO: 36378 - DNA, 20 bp, Artificial sequence
  SiRNA target sequence
ttttttgtccaatgcggccg

SEQ ID NO: 36379 - DNA, 20 bp, Artificial sequence
  SiRNA target sequence
tttttgtccaatgcggccgt

SEQ ID NO: 36380 - DNA, 20 bp, Artificial sequence
  SiRNA target sequence
ttttgtccaatgcggccgtt

SEQ ID NO: 36381 - DNA, 20 bp, Artificial sequence
  SiRNA target sequence
tttgtccaatgcggccgttg

SEQ ID NO: 36382 - DNA, 20 bp, Artificial sequence
  SiRNA target sequence
ttgtccaatgcggccgttgg

SEQ ID NO: 36383 - DNA, 20 bp, Artificial sequence
  SiRNA target sequence
tgtccaatgcggccgttggc

SEQ ID NO: 36384 - DNA, 20 bp, Artificial sequence
  SiRNA target sequence
gtccaatgcggccgttggct

SEQ ID NO: 36385 - DNA, 20 bp, Artificial sequence
  SiRNA target sequence
tccaatgcggccgttggctc

SEQ ID NO: 36386 - DNA, 20 bp, Artificial sequence
  SiRNA target sequence
ccaatgcggccgttggctca

SEQ ID NO: 36387 - DNA, 20 bp, Artificial sequence
  SiRNA target sequence
caatgcggccgttggctcat

SEQ ID NO: 36388 - DNA, 20 bp, Artificial sequence
  SiRNA target sequence
aatgcggccgttggctcatc

SEQ ID NO: 36389 - DNA, 20 bp, Artificial sequence
  SiRNA target sequence
atgcggccgttggctcatct

SEQ ID NO: 36390 - DNA, 20 bp, Artificial sequence
  SiRNA target sequence
tgcggccgttggctcatcta

SEQ ID NO: 36391 - DNA, 20 bp, Artificial sequence
  SiRNA target sequence
gcggccgttggctcatctaa

SEQ ID NO: 36392 - DNA, 20 bp, Artificial sequence
  SiRNA target sequence
cggccgttggctcatctaaa

SEQ ID NO: 36393 - DNA, 20 bp, Artificial sequence
  SiRNA target sequence
ggccgttggctcatctaaaa

SEQ ID NO: 36394 - DNA, 20 bp, Artificial sequence
  SiRNA target sequence
gccgttggctcatctaaaat

SEQ ID NO: 36395 - DNA, 20 bp, Artificial sequence
  SiRNA target sequence
ccgttggctcatctaaaatt

SEQ ID NO: 36396 - DNA, 20 bp, Artificial sequence
  SiRNA target sequence
cgttggctcatctaaaatta

SEQ ID NO: 36397 - DNA, 20 bp, Artificial sequence
  SiRNA target sequence
gttggctcatctaaaattat

SEQ ID NO: 36398 - DNA, 20 bp, Artificial sequence
  SiRNA target sequence
ttggctcatctaaaattata

SEQ ID NO: 36399 - DNA, 20 bp, Artificial sequence
  SiRNA target sequence
tggctcatctaaaattataa

SEQ ID NO: 36400 - DNA, 20 bp, Artificial sequence
  SiRNA target sequence
ggctcatctaaaattataat

SEQ ID NO: 36401 - DNA, 20 bp, Artificial sequence
  SiRNA target sequence
gctcatctaaaattataata

SEQ ID NO: 36402 - DNA, 20 bp, Artificial sequence
  SiRNA target sequence
ctcatctaaaattataatag

SEQ ID NO: 36403 - DNA, 20 bp, Artificial sequence
  SiRNA target sequence
tcatctaaaattataatagg

SEQ ID NO: 36404 - DNA, 20 bp, Artificial sequence
  SiRNA target sequence
catctaaaattataatagga

SEQ ID NO: 36405 - DNA, 20 bp, Artificial sequence
  SiRNA target sequence
atctaaaattataataggag

SEQ ID NO: 36406 - DNA, 20 bp, Artificial sequence
  SiRNA target sequence
tctaaaattataataggaga

SEQ ID NO: 36407 - DNA, 20 bp, Artificial sequence
  SiRNA target sequence
ctaaaattataataggagaa

SEQ ID NO: 36408 - DNA, 20 bp, Artificial sequence
  SiRNA target sequence
taaaattataataggagaat

SEQ ID NO: 36409 - DNA, 20 bp, Artificial sequence
  SiRNA target sequence
aaaattataataggagaatt

SEQ ID NO: 36410 - DNA, 20 bp, Artificial sequence
  SiRNA target sequence
aaattataataggagaattt

SEQ ID NO: 36411 - DNA, 20 bp, Artificial sequence
  SiRNA target sequence
aattataataggagaatttt

SEQ ID NO: 36412 - DNA, 20 bp, Artificial sequence
  SiRNA target sequence
attataataggagaattttt

SEQ ID NO: 36413 - DNA, 20 bp, Artificial sequence
  SiRNA target sequence
ttataataggagaatttttt

SEQ ID NO: 36414 - DNA, 20 bp, Artificial sequence
  SiRNA target sequence
tataataggagaatttttta

SEQ ID NO: 36415 - DNA, 20 bp, Artificial sequence
  SiRNA target sequence
ataataggagaattttttag

SEQ ID NO: 36416 - DNA, 20 bp, Artificial sequence
  SiRNA target sequence
taataggagaattttttagt

SEQ ID NO: 36417 - DNA, 20 bp, Artificial sequence
  SiRNA target sequence
aataggagaattttttagtg

SEQ ID NO: 36418 - DNA, 20 bp, Artificial sequence
  SiRNA target sequence
ataggagaattttttagtgc

SEQ ID NO: 36419 - DNA, 20 bp, Artificial sequence
  SiRNA target sequence
taggagaattttttagtgcc

SEQ ID NO: 36420 - DNA, 20 bp, Artificial sequence
  SiRNA target sequence
aggagaattttttagtgccg

SEQ ID NO: 36421 - DNA, 20 bp, Artificial sequence
  SiRNA target sequence
ggagaattttttagtgccga

SEQ ID NO: 36422 - DNA, 20 bp, Artificial sequence
  SiRNA target sequence
gagaattttttagtgccgac

SEQ ID NO: 36423 - DNA, 20 bp, Artificial sequence
  SiRNA target sequence
agaattttttagtgccgacc

SEQ ID NO: 36424 - DNA, 20 bp, Artificial sequence
  SiRNA target sequence
gaattttttagtgccgacct

SEQ ID NO: 36425 - DNA, 20 bp, Artificial sequence
  SiRNA target sequence
aattttttagtgccgacctt

SEQ ID NO: 36426 - DNA, 20 bp, Artificial sequence
  SiRNA target sequence
attttttagtgccgacctta

SEQ ID NO: 36427 - DNA, 20 bp, Artificial sequence
  SiRNA target sequence
ttttttagtgccgaccttaa

SEQ ID NO: 36428 - DNA, 20 bp, Artificial sequence
  SiRNA target sequence
tttttagtgccgaccttaac

SEQ ID NO: 36429 - DNA, 20 bp, Artificial sequence
  SiRNA target sequence
ttttagtgccgaccttaaca

SEQ ID NO: 36430 - DNA, 20 bp, Artificial sequence
  SiRNA target sequence
tttagtgccgaccttaacaa

SEQ ID NO: 36431 - DNA, 20 bp, Artificial sequence
  SiRNA target sequence
ttagtgccgaccttaacaaa

SEQ ID NO: 36432 - DNA, 20 bp, Artificial sequence
  SiRNA target sequence
tagtgccgaccttaacaaaa

SEQ ID NO: 36433 - DNA, 20 bp, Artificial sequence
  SiRNA target sequence
agtgccgaccttaacaaaat

SEQ ID NO: 36434 - DNA, 20 bp, Artificial sequence
  SiRNA target sequence
gtgccgaccttaacaaaatt

SEQ ID NO: 36435 - DNA, 20 bp, Artificial sequence
  SiRNA target sequence
tgccgaccttaacaaaatta

SEQ ID NO: 36436 - DNA, 20 bp, Artificial sequence
  SiRNA target sequence
gccgaccttaacaaaattac

SEQ ID NO: 36437 - DNA, 20 bp, Artificial sequence
  SiRNA target sequence
ccgaccttaacaaaattact

SEQ ID NO: 36438 - DNA, 20 bp, Artificial sequence
  SiRNA target sequence
cgaccttaacaaaattactt

SEQ ID NO: 36439 - DNA, 20 bp, Artificial sequence
  SiRNA target sequence
gaccttaacaaaattacttt

SEQ ID NO: 36440 - DNA, 20 bp, Artificial sequence
  SiRNA target sequence
accttaacaaaattactttt

SEQ ID NO: 36441 - DNA, 20 bp, Artificial sequence
  SiRNA target sequence
ccttaacaaaattacttttt

SEQ ID NO: 36442 - DNA, 20 bp, Artificial sequence
  SiRNA target sequence
cttaacaaaattactttttg

SEQ ID NO: 36443 - DNA, 20 bp, Artificial sequence
  SiRNA target sequence
ttaacaaaattactttttgt

SEQ ID NO: 36444 - DNA, 20 bp, Artificial sequence
  SiRNA target sequence
taacaaaattactttttgtc

SEQ ID NO: 36445 - DNA, 20 bp, Artificial sequence
  SiRNA target sequence
aacaaaattactttttgtct

SEQ ID NO: 36446 - DNA, 20 bp, Artificial sequence
  SiRNA target sequence
acaaaattactttttgtctt

SEQ ID NO: 36447 - DNA, 20 bp, Artificial sequence
  SiRNA target sequence
caaaattactttttgtcttt

SEQ ID NO: 36448 - DNA, 20 bp, Artificial sequence
  SiRNA target sequence
aaaattactttttgtctttc

SEQ ID NO: 36449 - DNA, 20 bp, Artificial sequence
  SiRNA target sequence
aaattactttttgtctttct

SEQ ID NO: 36450 - DNA, 20 bp, Artificial sequence
  SiRNA target sequence
aattactttttgtctttctc

SEQ ID NO: 36451 - DNA, 20 bp, Artificial sequence
  SiRNA target sequence
attactttttgtctttctcc

SEQ ID NO: 36452 - DNA, 20 bp, Artificial sequence
  SiRNA target sequence
ttactttttgtctttctcca

SEQ ID NO: 36453 - DNA, 20 bp, Artificial sequence
  SiRNA target sequence
tactttttgtctttctccac

SEQ ID NO: 36454 - DNA, 20 bp, Artificial sequence
  SiRNA target sequence
actttttgtctttctccacc

SEQ ID NO: 36455 - DNA, 20 bp, Artificial sequence
  SiRNA target sequence
ctttttgtctttctccacca

SEQ ID NO: 36456 - DNA, 20 bp, Artificial sequence
  SiRNA target sequence
tttttgtctttctccaccac

SEQ ID NO: 36457 - DNA, 20 bp, Artificial sequence
  SiRNA target sequence
ttttgtctttctccaccact

SEQ ID NO: 36458 - DNA, 20 bp, Artificial sequence
  SiRNA target sequence
tttgtctttctccaccacta

SEQ ID NO: 36459 - DNA, 20 bp, Artificial sequence
  SiRNA target sequence
ttgtctttctccaccactaa

SEQ ID NO: 36460 - DNA, 20 bp, Artificial sequence
  SiRNA target sequence
tgtctttctccaccactaag

SEQ ID NO: 36461 - DNA, 20 bp, Artificial sequence
  SiRNA target sequence
gtctttctccaccactaagc

SEQ ID NO: 36462 - DNA, 20 bp, Artificial sequence
  SiRNA target sequence
tctttctccaccactaagct

SEQ ID NO: 36463 - DNA, 20 bp, Artificial sequence
  SiRNA target sequence
ctttctccaccactaagctt

SEQ ID NO: 36464 - DNA, 20 bp, Artificial sequence
  SiRNA target sequence
tttctccaccactaagctta

SEQ ID NO: 36465 - DNA, 20 bp, Artificial sequence
  SiRNA target sequence
ttctccaccactaagcttat

SEQ ID NO: 36466 - DNA, 20 bp, Artificial sequence
  SiRNA target sequence
tctccaccactaagcttatg

SEQ ID NO: 36467 - DNA, 20 bp, Artificial sequence
  SiRNA target sequence
ctccaccactaagcttatgt

SEQ ID NO: 36468 - DNA, 20 bp, Artificial sequence
  SiRNA target sequence
tccaccactaagcttatgtc

SEQ ID NO: 36469 - DNA, 20 bp, Artificial sequence
  SiRNA target sequence
ccaccactaagcttatgtcc

SEQ ID NO: 36470 - DNA, 20 bp, Artificial sequence
  SiRNA target sequence
caccactaagcttatgtccc

SEQ ID NO: 36471 - DNA, 20 bp, Artificial sequence
  SiRNA target sequence
accactaagcttatgtccct

SEQ ID NO: 36472 - DNA, 20 bp, Artificial sequence
  SiRNA target sequence
ccactaagcttatgtccctt

SEQ ID NO: 36473 - DNA, 20 bp, Artificial sequence
  SiRNA target sequence
cactaagcttatgtccctta

SEQ ID NO: 36474 - DNA, 20 bp, Artificial sequence
  SiRNA target sequence
actaagcttatgtcccttat

SEQ ID NO: 36475 - DNA, 20 bp, Artificial sequence
  SiRNA target sequence
ctaagcttatgtcccttatc

SEQ ID NO: 36476 - DNA, 20 bp, Artificial sequence
  SiRNA target sequence
taagcttatgtcccttatct

SEQ ID NO: 36477 - DNA, 20 bp, Artificial sequence
  SiRNA target sequence
aagcttatgtcccttatctc

SEQ ID NO: 36478 - DNA, 20 bp, Artificial sequence
  SiRNA target sequence
agcttatgtcccttatctcc

SEQ ID NO: 36479 - DNA, 20 bp, Artificial sequence
  SiRNA target sequence
gcttatgtcccttatctcca

SEQ ID NO: 36480 - DNA, 20 bp, Artificial sequence
  SiRNA target sequence
cttatgtcccttatctccaa

SEQ ID NO: 36481 - DNA, 20 bp, Artificial sequence
  SiRNA target sequence
ttatgtcccttatctccaac

SEQ ID NO: 36482 - DNA, 20 bp, Artificial sequence
  SiRNA target sequence
tatgtcccttatctccaaca

SEQ ID NO: 36483 - DNA, 20 bp, Artificial sequence
  SiRNA target sequence
atgtcccttatctccaacat

SEQ ID NO: 36484 - DNA, 20 bp, Artificial sequence
  SiRNA target sequence
tgtcccttatctccaacatg

SEQ ID NO: 36485 - DNA, 20 bp, Artificial sequence
  SiRNA target sequence
gtcccttatctccaacatgt

SEQ ID NO: 36486 - DNA, 20 bp, Artificial sequence
  SiRNA target sequence
tcccttatctccaacatgtg

SEQ ID NO: 36487 - DNA, 20 bp, Artificial sequence
  SiRNA target sequence
cccttatctccaacatgtgt

SEQ ID NO: 36488 - DNA, 20 bp, Artificial sequence
  SiRNA target sequence
ccttatctccaacatgtgtg

SEQ ID NO: 36489 - DNA, 20 bp, Artificial sequence
  SiRNA target sequence
cttatctccaacatgtgtgt

SEQ ID NO: 36490 - DNA, 20 bp, Artificial sequence
  SiRNA target sequence
ttatctccaacatgtgtgtt

SEQ ID NO: 36491 - DNA, 20 bp, Artificial sequence
  SiRNA target sequence
tatctccaacatgtgtgttg

SEQ ID NO: 36492 - DNA, 20 bp, Artificial sequence
  SiRNA target sequence
atctccaacatgtgtgttgt

SEQ ID NO: 36493 - DNA, 20 bp, Artificial sequence
  SiRNA target sequence
tctccaacatgtgtgttgta

SEQ ID NO: 36494 - DNA, 20 bp, Artificial sequence
  SiRNA target sequence
ctccaacatgtgtgttgtat

SEQ ID NO: 36495 - DNA, 20 bp, Artificial sequence
  SiRNA target sequence
tccaacatgtgtgttgtatt

SEQ ID NO: 36496 - DNA, 20 bp, Artificial sequence
  SiRNA target sequence
ccaacatgtgtgttgtattc

SEQ ID NO: 36497 - DNA, 20 bp, Artificial sequence
  SiRNA target sequence
caacatgtgtgttgtattca

SEQ ID NO: 36498 - DNA, 20 bp, Artificial sequence
  SiRNA target sequence
aacatgtgtgttgtattcat

SEQ ID NO: 36499 - DNA, 20 bp, Artificial sequence
  SiRNA target sequence
acatgtgtgttgtattcatc

SEQ ID NO: 36500 - DNA, 20 bp, Artificial sequence
  SiRNA target sequence
catgtgtgttgtattcatcc

SEQ ID NO: 36501 - DNA, 20 bp, Artificial sequence
  SiRNA target sequence
atgtgtgttgtattcatcct

SEQ ID NO: 36502 - DNA, 20 bp, Artificial sequence
  SiRNA target sequence
tgtgtgttgtattcatcctc

SEQ ID NO: 36503 - DNA, 20 bp, Artificial sequence
  SiRNA target sequence
gtgtgttgtattcatcctct

SEQ ID NO: 36504 - DNA, 20 bp, Artificial sequence
  SiRNA target sequence
tgtgttgtattcatcctcta

SEQ ID NO: 36505 - DNA, 20 bp, Artificial sequence
  SiRNA target sequence
gtgttgtattcatcctctag

SEQ ID NO: 36506 - DNA, 20 bp, Artificial sequence
  SiRNA target sequence
tgttgtattcatcctctagg

SEQ ID NO: 36507 - DNA, 20 bp, Artificial sequence
  SiRNA target sequence
gttgtattcatcctctaggt

SEQ ID NO: 36508 - DNA, 20 bp, Artificial sequence
  SiRNA target sequence
ttgtattcatcctctaggtt

SEQ ID NO: 36509 - DNA, 20 bp, Artificial sequence
  SiRNA target sequence
tgtattcatcctctaggttg

SEQ ID NO: 36510 - DNA, 20 bp, Artificial sequence
  SiRNA target sequence
gtattcatcctctaggttgt

SEQ ID NO: 36511 - DNA, 20 bp, Artificial sequence
  SiRNA target sequence
tattcatcctctaggttgtt

SEQ ID NO: 36512 - DNA, 20 bp, Artificial sequence
  SiRNA target sequence
attcatcctctaggttgttt

SEQ ID NO: 36513 - DNA, 20 bp, Artificial sequence
  SiRNA target sequence
ttcatcctctaggttgttta

SEQ ID NO: 36514 - DNA, 20 bp, Artificial sequence
  SiRNA target sequence
tcatcctctaggttgtttat

SEQ ID NO: 36515 - DNA, 20 bp, Artificial sequence
  SiRNA target sequence
catcctctaggttgtttata

SEQ ID NO: 36516 - DNA, 20 bp, Artificial sequence
  SiRNA target sequence
atcctctaggttgtttatag

SEQ ID NO: 36517 - DNA, 20 bp, Artificial sequence
  SiRNA target sequence
tcctctaggttgtttataga

SEQ ID NO: 36518 - DNA, 20 bp, Artificial sequence
  SiRNA target sequence
cctctaggttgtttatagaa

SEQ ID NO: 36519 - DNA, 20 bp, Artificial sequence
  SiRNA target sequence
ctctaggttgtttatagaat

SEQ ID NO: 36520 - DNA, 20 bp, Artificial sequence
  SiRNA target sequence
tctaggttgtttatagaatc

SEQ ID NO: 36521 - DNA, 20 bp, Artificial sequence
  SiRNA target sequence
ctaggttgtttatagaatcg

SEQ ID NO: 36522 - DNA, 20 bp, Artificial sequence
  SiRNA target sequence
taggttgtttatagaatcgt

SEQ ID NO: 36523 - DNA, 20 bp, Artificial sequence
  SiRNA target sequence
aggttgtttatagaatcgtg

SEQ ID NO: 36524 - DNA, 20 bp, Artificial sequence
  SiRNA target sequence
ggttgtttatagaatcgtgt

SEQ ID NO: 36525 - DNA, 20 bp, Artificial sequence
  SiRNA target sequence
gttgtttatagaatcgtgta

SEQ ID NO: 36526 - DNA, 20 bp, Artificial sequence
  SiRNA target sequence
ttgtttatagaatcgtgtac

SEQ ID NO: 36527 - DNA, 20 bp, Artificial sequence
  SiRNA target sequence
tgtttatagaatcgtgtaca

SEQ ID NO: 36528 - DNA, 20 bp, Artificial sequence
  SiRNA target sequence
gtttatagaatcgtgtacac

SEQ ID NO: 36529 - DNA, 20 bp, Artificial sequence
  SiRNA target sequence
tttatagaatcgtgtacaca

SEQ ID NO: 36530 - DNA, 20 bp, Artificial sequence
  SiRNA target sequence
ttatagaatcgtgtacacaa

SEQ ID NO: 36531 - DNA, 20 bp, Artificial sequence
  SiRNA target sequence
tatagaatcgtgtacacaaa

SEQ ID NO: 36532 - DNA, 20 bp, Artificial sequence
  SiRNA target sequence
atagaatcgtgtacacaaag

SEQ ID NO: 36533 - DNA, 20 bp, Artificial sequence
  SiRNA target sequence
tagaatcgtgtacacaaagt

SEQ ID NO: 36534 - DNA, 20 bp, Artificial sequence
  SiRNA target sequence
agaatcgtgtacacaaagtt

SEQ ID NO: 36535 - DNA, 20 bp, Artificial sequence
  SiRNA target sequence
gaatcgtgtacacaaagttt

SEQ ID NO: 36536 - DNA, 20 bp, Artificial sequence
  SiRNA target sequence
aatcgtgtacacaaagtttt

SEQ ID NO: 36537 - DNA, 20 bp, Artificial sequence
  SiRNA target sequence
atcgtgtacacaaagttttt

SEQ ID NO: 36538 - DNA, 20 bp, Artificial sequence
  SiRNA target sequence
tcgtgtacacaaagtttttt

SEQ ID NO: 36539 - DNA, 20 bp, Artificial sequence
  SiRNA target sequence
cgtgtacacaaagtttttta

SEQ ID NO: 36540 - DNA, 20 bp, Artificial sequence
  SiRNA target sequence
gtgtacacaaagttttttac

SEQ ID NO: 36541 - DNA, 20 bp, Artificial sequence
  SiRNA target sequence
tgtacacaaagttttttact

SEQ ID NO: 36542 - DNA, 20 bp, Artificial sequence
  SiRNA target sequence
gtacacaaagttttttactg

SEQ ID NO: 36543 - DNA, 20 bp, Artificial sequence
  SiRNA target sequence
tacacaaagttttttactga

SEQ ID NO: 36544 - DNA, 20 bp, Artificial sequence
  SiRNA target sequence
acacaaagttttttactgat

SEQ ID NO: 36545 - DNA, 20 bp, Artificial sequence
  SiRNA target sequence
cacaaagttttttactgatt

SEQ ID NO: 36546 - DNA, 20 bp, Artificial sequence
  SiRNA target sequence
acaaagttttttactgattt

SEQ ID NO: 36547 - DNA, 20 bp, Artificial sequence
  SiRNA target sequence
caaagttttttactgatttt

SEQ ID NO: 36548 - DNA, 20 bp, Artificial sequence
  SiRNA target sequence
aaagttttttactgattttt

SEQ ID NO: 36549 - DNA, 20 bp, Artificial sequence
  SiRNA target sequence
aagttttttactgattttta

SEQ ID NO: 36550 - DNA, 20 bp, Artificial sequence
  SiRNA target sequence
agttttttactgatttttat

SEQ ID NO: 36551 - DNA, 20 bp, Artificial sequence
  SiRNA target sequence
gttttttactgatttttata

SEQ ID NO: 36552 - DNA, 20 bp, Artificial sequence
  SiRNA target sequence
ttttttactgatttttataa

SEQ ID NO: 36553 - DNA, 20 bp, Artificial sequence
  SiRNA target sequence
tttttactgatttttataac

SEQ ID NO: 36554 - DNA, 20 bp, Artificial sequence
  SiRNA target sequence
ttttactgatttttataact

SEQ ID NO: 36555 - DNA, 20 bp, Artificial sequence
  SiRNA target sequence
tttactgatttttataactt

SEQ ID NO: 36556 - DNA, 20 bp, Artificial sequence
  SiRNA target sequence
ttactgatttttataacttc

SEQ ID NO: 36557 - DNA, 20 bp, Artificial sequence
  SiRNA target sequence
tactgatttttataacttct

SEQ ID NO: 36558 - DNA, 20 bp, Artificial sequence
  SiRNA target sequence
actgatttttataacttctt

SEQ ID NO: 36559 - DNA, 20 bp, Artificial sequence
  SiRNA target sequence
ctgatttttataacttcttc

SEQ ID NO: 36560 - DNA, 20 bp, Artificial sequence
  SiRNA target sequence
tgatttttataacttcttct

SEQ ID NO: 36561 - DNA, 20 bp, Artificial sequence
  SiRNA target sequence
gatttttataacttcttctt

SEQ ID NO: 36562 - DNA, 20 bp, Artificial sequence
  SiRNA target sequence
atttttataacttcttcttt

SEQ ID NO: 36563 - DNA, 20 bp, Artificial sequence
  SiRNA target sequence
tttttataacttcttcttta

SEQ ID NO: 36564 - DNA, 20 bp, Artificial sequence
  SiRNA target sequence
ttttataacttcttctttat

SEQ ID NO: 36565 - DNA, 20 bp, Artificial sequence
  SiRNA target sequence
tttataacttcttctttatc

SEQ ID NO: 36566 - DNA, 20 bp, Artificial sequence
  SiRNA target sequence
ttataacttcttctttatca

SEQ ID NO: 36567 - DNA, 20 bp, Artificial sequence
  SiRNA target sequence
tataacttcttctttatcaa

SEQ ID NO: 36568 - DNA, 20 bp, Artificial sequence
  SiRNA target sequence
ataacttcttctttatcaaa

SEQ ID NO: 36569 - DNA, 20 bp, Artificial sequence
  SiRNA target sequence
taacttcttctttatcaaat

SEQ ID NO: 36570 - DNA, 20 bp, Artificial sequence
  SiRNA target sequence
aacttcttctttatcaaata

SEQ ID NO: 36571 - DNA, 20 bp, Artificial sequence
  SiRNA target sequence
acttcttctttatcaaatat

SEQ ID NO: 36572 - DNA, 20 bp, Artificial sequence
  SiRNA target sequence
cttcttctttatcaaatatt

SEQ ID NO: 36573 - DNA, 20 bp, Artificial sequence
  SiRNA target sequence
ttcttctttatcaaatattt

SEQ ID NO: 36574 - DNA, 20 bp, Artificial sequence
  SiRNA target sequence
tcttctttatcaaatatttc

SEQ ID NO: 36575 - DNA, 20 bp, Artificial sequence
  SiRNA target sequence
cttctttatcaaatatttct

SEQ ID NO: 36576 - DNA, 20 bp, Artificial sequence
  SiRNA target sequence
ttctttatcaaatatttctt

SEQ ID NO: 36577 - DNA, 20 bp, Artificial sequence
  SiRNA target sequence
tctttatcaaatatttcttt

SEQ ID NO: 36578 - DNA, 20 bp, Artificial sequence
  SiRNA target sequence
ctttatcaaatatttctttt

SEQ ID NO: 36579 - DNA, 20 bp, Artificial sequence
  SiRNA target sequence
tttatcaaatatttcttttc

SEQ ID NO: 36580 - DNA, 20 bp, Artificial sequence
  SiRNA target sequence
ttatcaaatatttcttttcc

SEQ ID NO: 36581 - DNA, 20 bp, Artificial sequence
  SiRNA target sequence
tatcaaatatttcttttcca

SEQ ID NO: 36582 - DNA, 20 bp, Artificial sequence
  SiRNA target sequence
atcaaatatttcttttccat

SEQ ID NO: 36583 - DNA, 20 bp, Artificial sequence
  SiRNA target sequence
tcaaatatttcttttccata

SEQ ID NO: 36584 - DNA, 20 bp, Artificial sequence
  SiRNA target sequence
caaatatttcttttccatat

SEQ ID NO: 36585 - DNA, 20 bp, Artificial sequence
  SiRNA target sequence
aaatatttcttttccatatg

SEQ ID NO: 36586 - DNA, 20 bp, Artificial sequence
  SiRNA target sequence
aatatttcttttccatatgt

SEQ ID NO: 36587 - DNA, 20 bp, Artificial sequence
  SiRNA target sequence
atatttcttttccatatgtt

SEQ ID NO: 36588 - DNA, 20 bp, Artificial sequence
  SiRNA target sequence
tatttcttttccatatgtta

SEQ ID NO: 36589 - DNA, 20 bp, Artificial sequence
  SiRNA target sequence
atttcttttccatatgttaa

SEQ ID NO: 36590 - DNA, 20 bp, Artificial sequence
  SiRNA target sequence
tttcttttccatatgttaaa

SEQ ID NO: 36591 - DNA, 20 bp, Artificial sequence
  SiRNA target sequence
ttcttttccatatgttaaat

SEQ ID NO: 36592 - DNA, 20 bp, Artificial sequence
  SiRNA target sequence
tcttttccatatgttaaatt

SEQ ID NO: 36593 - DNA, 20 bp, Artificial sequence
  SiRNA target sequence
cttttccatatgttaaatta

SEQ ID NO: 36594 - DNA, 20 bp, Artificial sequence
  SiRNA target sequence
ttttccatatgttaaattat

SEQ ID NO: 36595 - DNA, 20 bp, Artificial sequence
  SiRNA target sequence
tttccatatgttaaattata

SEQ ID NO: 36596 - DNA, 20 bp, Artificial sequence
  SiRNA target sequence
ttccatatgttaaattataa

SEQ ID NO: 36597 - DNA, 20 bp, Artificial sequence
  SiRNA target sequence
tccatatgttaaattataat

SEQ ID NO: 36598 - DNA, 20 bp, Artificial sequence
  SiRNA target sequence
ccatatgttaaattataata

SEQ ID NO: 36599 - DNA, 20 bp, Artificial sequence
  SiRNA target sequence
catatgttaaattataataa

SEQ ID NO: 36600 - DNA, 20 bp, Artificial sequence
  SiRNA target sequence
atatgttaaattataataaa

SEQ ID NO: 36601 - DNA, 20 bp, Artificial sequence
  SiRNA target sequence
tatgttaaattataataaac

SEQ ID NO: 36602 - DNA, 20 bp, Artificial sequence
  SiRNA target sequence
atgttaaattataataaacc

SEQ ID NO: 36603 - DNA, 20 bp, Artificial sequence
  SiRNA target sequence
tgttaaattataataaaccg

SEQ ID NO: 36604 - DNA, 20 bp, Artificial sequence
  SiRNA target sequence
gttaaattataataaaccgt

SEQ ID NO: 36605 - DNA, 20 bp, Artificial sequence
  SiRNA target sequence
ttaaattataataaaccgtt

SEQ ID NO: 36606 - DNA, 20 bp, Artificial sequence
  SiRNA target sequence
taaattataataaaccgttt

SEQ ID NO: 36607 - DNA, 20 bp, Artificial sequence
  SiRNA target sequence
aaattataataaaccgtttc

SEQ ID NO: 36608 - DNA, 20 bp, Artificial sequence
  SiRNA target sequence
aattataataaaccgtttcg

SEQ ID NO: 36609 - DNA, 20 bp, Artificial sequence
  SiRNA target sequence
attataataaaccgtttcgt

SEQ ID NO: 36610 - DNA, 20 bp, Artificial sequence
  SiRNA target sequence
ttataataaaccgtttcgtt

SEQ ID NO: 36611 - DNA, 20 bp, Artificial sequence
  SiRNA target sequence
tataataaaccgtttcgtta

SEQ ID NO: 36612 - DNA, 20 bp, Artificial sequence
  SiRNA target sequence
ataataaaccgtttcgttaa

SEQ ID NO: 36613 - DNA, 20 bp, Artificial sequence
  SiRNA target sequence
taataaaccgtttcgttaaa

SEQ ID NO: 36614 - DNA, 20 bp, Artificial sequence
  SiRNA target sequence
aataaaccgtttcgttaaac

SEQ ID NO: 36615 - DNA, 20 bp, Artificial sequence
  SiRNA target sequence
ataaaccgtttcgttaaaca

SEQ ID NO: 36616 - DNA, 20 bp, Artificial sequence
  SiRNA target sequence
taaaccgtttcgttaaacaa

SEQ ID NO: 36617 - DNA, 20 bp, Artificial sequence
  SiRNA target sequence
aaaccgtttcgttaaacaaa

SEQ ID NO: 36618 - DNA, 20 bp, Artificial sequence
  SiRNA target sequence
aaccgtttcgttaaacaaaa

SEQ ID NO: 36619 - DNA, 20 bp, Artificial sequence
  SiRNA target sequence
accgtttcgttaaacaaaaa

SEQ ID NO: 36620 - DNA, 20 bp, Artificial sequence
  SiRNA target sequence
ccgtttcgttaaacaaaaat

SEQ ID NO: 36621 - DNA, 20 bp, Artificial sequence
  SiRNA target sequence
cgtttcgttaaacaaaaatg

SEQ ID NO: 36622 - DNA, 20 bp, Artificial sequence
  SiRNA target sequence
gtttcgttaaacaaaaatga

SEQ ID NO: 36623 - DNA, 20 bp, Artificial sequence
  SiRNA target sequence
tttcgttaaacaaaaatgag

SEQ ID NO: 36624 - DNA, 20 bp, Artificial sequence
  SiRNA target sequence
ttcgttaaacaaaaatgagg

SEQ ID NO: 36625 - DNA, 20 bp, Artificial sequence
  SiRNA target sequence
tcgttaaacaaaaatgaggt

SEQ ID NO: 36626 - DNA, 20 bp, Artificial sequence
  SiRNA target sequence
cgttaaacaaaaatgaggtt

SEQ ID NO: 36627 - DNA, 20 bp, Artificial sequence
  SiRNA target sequence
gttaaacaaaaatgaggttt

SEQ ID NO: 36628 - DNA, 20 bp, Artificial sequence
  SiRNA target sequence
ttaaacaaaaatgaggtttg

SEQ ID NO: 36629 - DNA, 20 bp, Artificial sequence
  SiRNA target sequence
taaacaaaaatgaggtttgt

SEQ ID NO: 36630 - DNA, 20 bp, Artificial sequence
  SiRNA target sequence
aaacaaaaatgaggtttgtg

SEQ ID NO: 36631 - DNA, 20 bp, Artificial sequence
  SiRNA target sequence
aacaaaaatgaggtttgtgg

SEQ ID NO: 36632 - DNA, 20 bp, Artificial sequence
  SiRNA target sequence
acaaaaatgaggtttgtggt

SEQ ID NO: 36633 - DNA, 20 bp, Artificial sequence
  SiRNA target sequence
caaaaatgaggtttgtggtg

SEQ ID NO: 36634 - DNA, 20 bp, Artificial sequence
  SiRNA target sequence
aaaaatgaggtttgtggtgc

SEQ ID NO: 36635 - DNA, 20 bp, Artificial sequence
  SiRNA target sequence
aaaatgaggtttgtggtgca

SEQ ID NO: 36636 - DNA, 20 bp, Artificial sequence
  SiRNA target sequence
aaatgaggtttgtggtgcaa

SEQ ID NO: 36637 - DNA, 20 bp, Artificial sequence
  SiRNA target sequence
aatgaggtttgtggtgcaaa

SEQ ID NO: 36638 - DNA, 20 bp, Artificial sequence
  SiRNA target sequence
atgaggtttgtggtgcaaat

SEQ ID NO: 36639 - DNA, 20 bp, Artificial sequence
  SiRNA target sequence
tgaggtttgtggtgcaaatg

SEQ ID NO: 36640 - DNA, 20 bp, Artificial sequence
  SiRNA target sequence
gaggtttgtggtgcaaatga

SEQ ID NO: 36641 - DNA, 20 bp, Artificial sequence
  SiRNA target sequence
aggtttgtggtgcaaatgat

SEQ ID NO: 36642 - DNA, 20 bp, Artificial sequence
  SiRNA target sequence
ggtttgtggtgcaaatgata

SEQ ID NO: 36643 - DNA, 20 bp, Artificial sequence
  SiRNA target sequence
gtttgtggtgcaaatgatat

SEQ ID NO: 36644 - DNA, 20 bp, Artificial sequence
  SiRNA target sequence
tttgtggtgcaaatgatata

SEQ ID NO: 36645 - DNA, 20 bp, Artificial sequence
  SiRNA target sequence
ttgtggtgcaaatgatataa

SEQ ID NO: 36646 - DNA, 20 bp, Artificial sequence
  SiRNA target sequence
tgtggtgcaaatgatataag

SEQ ID NO: 36647 - DNA, 20 bp, Artificial sequence
  SiRNA target sequence
gtggtgcaaatgatataagt

SEQ ID NO: 36648 - DNA, 20 bp, Artificial sequence
  SiRNA target sequence
tggtgcaaatgatataagtg

SEQ ID NO: 36649 - DNA, 20 bp, Artificial sequence
  SiRNA target sequence
ggtgcaaatgatataagtga

SEQ ID NO: 36650 - DNA, 20 bp, Artificial sequence
  SiRNA target sequence
gtgcaaatgatataagtgat

SEQ ID NO: 36651 - DNA, 20 bp, Artificial sequence
  SiRNA target sequence
tgcaaatgatataagtgatc

SEQ ID NO: 36652 - DNA, 20 bp, Artificial sequence
  SiRNA target sequence
gcaaatgatataagtgatct

SEQ ID NO: 36653 - DNA, 20 bp, Artificial sequence
  SiRNA target sequence
caaatgatataagtgatcta

SEQ ID NO: 36654 - DNA, 20 bp, Artificial sequence
  SiRNA target sequence
aaatgatataagtgatctat

SEQ ID NO: 36655 - DNA, 20 bp, Artificial sequence
  SiRNA target sequence
aatgatataagtgatctata

SEQ ID NO: 36656 - DNA, 20 bp, Artificial sequence
  SiRNA target sequence
atgatataagtgatctatat

SEQ ID NO: 36657 - DNA, 20 bp, Artificial sequence
  SiRNA target sequence
tgatataagtgatctatatg

SEQ ID NO: 36658 - DNA, 20 bp, Artificial sequence
  SiRNA target sequence
gatataagtgatctatatga

SEQ ID NO: 36659 - DNA, 20 bp, Artificial sequence
  SiRNA target sequence
atataagtgatctatatgaa

SEQ ID NO: 36660 - DNA, 20 bp, Artificial sequence
  SiRNA target sequence
tataagtgatctatatgaac

SEQ ID NO: 36661 - DNA, 20 bp, Artificial sequence
  SiRNA target sequence
ataagtgatctatatgaact

SEQ ID NO: 36662 - DNA, 20 bp, Artificial sequence
  SiRNA target sequence
taagtgatctatatgaacta

SEQ ID NO: 36663 - DNA, 20 bp, Artificial sequence
  SiRNA target sequence
aagtgatctatatgaactat

SEQ ID NO: 36664 - DNA, 20 bp, Artificial sequence
  SiRNA target sequence
agtgatctatatgaactatt

SEQ ID NO: 36665 - DNA, 20 bp, Artificial sequence
  SiRNA target sequence
gtgatctatatgaactatta

SEQ ID NO: 36666 - DNA, 20 bp, Artificial sequence
  SiRNA target sequence
tgatctatatgaactattag

SEQ ID NO: 36667 - DNA, 20 bp, Artificial sequence
  SiRNA target sequence
gatctatatgaactattaga

SEQ ID NO: 36668 - DNA, 20 bp, Artificial sequence
  SiRNA target sequence
atctatatgaactattagaa

SEQ ID NO: 36669 - DNA, 20 bp, Artificial sequence
  SiRNA target sequence
tctatatgaactattagaaa

SEQ ID NO: 36670 - DNA, 20 bp, Artificial sequence
  SiRNA target sequence
ctatatgaactattagaaat

SEQ ID NO: 36671 - DNA, 20 bp, Artificial sequence
  SiRNA target sequence
tatatgaactattagaaatt

SEQ ID NO: 36672 - DNA, 20 bp, Artificial sequence
  SiRNA target sequence
atatgaactattagaaattt

SEQ ID NO: 36673 - DNA, 20 bp, Artificial sequence
  SiRNA target sequence
tatgaactattagaaatttc

SEQ ID NO: 36674 - DNA, 20 bp, Artificial sequence
  SiRNA target sequence
atgaactattagaaatttct

SEQ ID NO: 36675 - DNA, 20 bp, Artificial sequence
  SiRNA target sequence
tgaactattagaaatttctt

SEQ ID NO: 36676 - DNA, 20 bp, Artificial sequence
  SiRNA target sequence
gaactattagaaatttcttt

SEQ ID NO: 36677 - DNA, 20 bp, Artificial sequence
  SiRNA target sequence
aactattagaaatttctttt

SEQ ID NO: 36678 - DNA, 20 bp, Artificial sequence
  SiRNA target sequence
actattagaaatttctttta

SEQ ID NO: 36679 - DNA, 20 bp, Artificial sequence
  SiRNA target sequence
ctattagaaatttcttttat

SEQ ID NO: 36680 - DNA, 20 bp, Artificial sequence
  SiRNA target sequence
tattagaaatttcttttata

SEQ ID NO: 36681 - DNA, 20 bp, Artificial sequence
  SiRNA target sequence
attagaaatttcttttatat

SEQ ID NO: 36682 - DNA, 20 bp, Artificial sequence
  SiRNA target sequence
ttagaaatttcttttatatc

SEQ ID NO: 36683 - DNA, 20 bp, Artificial sequence
  SiRNA target sequence
tagaaatttcttttatatct

SEQ ID NO: 36684 - DNA, 20 bp, Artificial sequence
  SiRNA target sequence
agaaatttcttttatatctc

SEQ ID NO: 36685 - DNA, 20 bp, Artificial sequence
  SiRNA target sequence
gaaatttcttttatatctcg

SEQ ID NO: 36686 - DNA, 20 bp, Artificial sequence
  SiRNA target sequence
aaatttcttttatatctcga

SEQ ID NO: 36687 - DNA, 20 bp, Artificial sequence
  SiRNA target sequence
aatttcttttatatctcgat

SEQ ID NO: 36688 - DNA, 20 bp, Artificial sequence
  SiRNA target sequence
atttcttttatatctcgatt

SEQ ID NO: 36689 - DNA, 20 bp, Artificial sequence
  SiRNA target sequence
tttcttttatatctcgatta

SEQ ID NO: 36690 - DNA, 20 bp, Artificial sequence
  SiRNA target sequence
ttcttttatatctcgattat

SEQ ID NO: 36691 - DNA, 20 bp, Artificial sequence
  SiRNA target sequence
tcttttatatctcgattatc

SEQ ID NO: 36692 - DNA, 20 bp, Artificial sequence
  SiRNA target sequence
cttttatatctcgattatct

SEQ ID NO: 36693 - DNA, 20 bp, Artificial sequence
  SiRNA target sequence
ttttatatctcgattatcta

SEQ ID NO: 36694 - DNA, 20 bp, Artificial sequence
  SiRNA target sequence
tttatatctcgattatctag

SEQ ID NO: 36695 - DNA, 20 bp, Artificial sequence
  SiRNA target sequence
ttatatctcgattatctaga

SEQ ID NO: 36696 - DNA, 20 bp, Artificial sequence
  SiRNA target sequence
tatatctcgattatctagat

SEQ ID NO: 36697 - DNA, 20 bp, Artificial sequence
  SiRNA target sequence
atatctcgattatctagata

SEQ ID NO: 36698 - DNA, 20 bp, Artificial sequence
  SiRNA target sequence
tatctcgattatctagataa

SEQ ID NO: 36699 - DNA, 20 bp, Artificial sequence
  SiRNA target sequence
atctcgattatctagataaa

SEQ ID NO: 36700 - DNA, 20 bp, Artificial sequence
  SiRNA target sequence
tctcgattatctagataaat

SEQ ID NO: 36701 - DNA, 20 bp, Artificial sequence
  SiRNA target sequence
ctcgattatctagataaata

SEQ ID NO: 36702 - DNA, 20 bp, Artificial sequence
  SiRNA target sequence
tcgattatctagataaatat

SEQ ID NO: 36703 - DNA, 20 bp, Artificial sequence
  SiRNA target sequence
cgattatctagataaatatt

SEQ ID NO: 36704 - DNA, 20 bp, Artificial sequence
  SiRNA target sequence
gattatctagataaatattt

SEQ ID NO: 36705 - DNA, 20 bp, Artificial sequence
  SiRNA target sequence
attatctagataaatatttc

SEQ ID NO: 36706 - DNA, 20 bp, Artificial sequence
  SiRNA target sequence
ttatctagataaatatttcc

SEQ ID NO: 36707 - DNA, 20 bp, Artificial sequence
  SiRNA target sequence
tatctagataaatatttccc

SEQ ID NO: 36708 - DNA, 20 bp, Artificial sequence
  SiRNA target sequence
atctagataaatatttcccc

SEQ ID NO: 36709 - DNA, 20 bp, Artificial sequence
  SiRNA target sequence
tctagataaatatttccccc

SEQ ID NO: 36710 - DNA, 20 bp, Artificial sequence
  SiRNA target sequence
ctagataaatatttccccca

SEQ ID NO: 36711 - DNA, 20 bp, Artificial sequence
  SiRNA target sequence
tagataaatatttcccccat

SEQ ID NO: 36712 - DNA, 20 bp, Artificial sequence
  SiRNA target sequence
agataaatatttcccccata

SEQ ID NO: 36713 - DNA, 20 bp, Artificial sequence
  SiRNA target sequence
gataaatatttcccccataa

SEQ ID NO: 36714 - DNA, 20 bp, Artificial sequence
  SiRNA target sequence
ataaatatttcccccataat

SEQ ID NO: 36715 - DNA, 20 bp, Artificial sequence
  SiRNA target sequence
taaatatttcccccataatt

SEQ ID NO: 36716 - DNA, 20 bp, Artificial sequence
  SiRNA target sequence
aaatatttcccccataattt

SEQ ID NO: 36717 - DNA, 20 bp, Artificial sequence
  SiRNA target sequence
aatatttcccccataatttt

SEQ ID NO: 36718 - DNA, 20 bp, Artificial sequence
  SiRNA target sequence
atatttcccccataattttc

SEQ ID NO: 36719 - DNA, 20 bp, Artificial sequence
  SiRNA target sequence
tatttcccccataattttca

SEQ ID NO: 36720 - DNA, 20 bp, Artificial sequence
  SiRNA target sequence
atttcccccataattttcaa

SEQ ID NO: 36721 - DNA, 20 bp, Artificial sequence
  SiRNA target sequence
tttcccccataattttcaaa

SEQ ID NO: 36722 - DNA, 20 bp, Artificial sequence
  SiRNA target sequence
ttcccccataattttcaaat

SEQ ID NO: 36723 - DNA, 20 bp, Artificial sequence
  SiRNA target sequence
tcccccataattttcaaatc

SEQ ID NO: 36724 - DNA, 20 bp, Artificial sequence
  SiRNA target sequence
cccccataattttcaaatct

SEQ ID NO: 36725 - DNA, 20 bp, Artificial sequence
  SiRNA target sequence
ccccataattttcaaatctc

SEQ ID NO: 36726 - DNA, 20 bp, Artificial sequence
  SiRNA target sequence
cccataattttcaaatctca

SEQ ID NO: 36727 - DNA, 20 bp, Artificial sequence
  SiRNA target sequence
ccataattttcaaatctcat

SEQ ID NO: 36728 - DNA, 20 bp, Artificial sequence
  SiRNA target sequence
cataattttcaaatctcata

SEQ ID NO: 36729 - DNA, 20 bp, Artificial sequence
  SiRNA target sequence
ataattttcaaatctcataa

SEQ ID NO: 36730 - DNA, 20 bp, Artificial sequence
  SiRNA target sequence
taattttcaaatctcataat

SEQ ID NO: 36731 - DNA, 20 bp, Artificial sequence
  SiRNA target sequence
aattttcaaatctcataatc

SEQ ID NO: 36732 - DNA, 20 bp, Artificial sequence
  SiRNA target sequence
attttcaaatctcataatca

SEQ ID NO: 36733 - DNA, 20 bp, Artificial sequence
  SiRNA target sequence
ttttcaaatctcataatcat

SEQ ID NO: 36734 - DNA, 20 bp, Artificial sequence
  SiRNA target sequence
tttcaaatctcataatcatc

SEQ ID NO: 36735 - DNA, 20 bp, Artificial sequence
  SiRNA target sequence
ttcaaatctcataatcatct

SEQ ID NO: 36736 - DNA, 20 bp, Artificial sequence
  SiRNA target sequence
tcaaatctcataatcatctt

SEQ ID NO: 36737 - DNA, 20 bp, Artificial sequence
  SiRNA target sequence
caaatctcataatcatcttt

SEQ ID NO: 36738 - DNA, 20 bp, Artificial sequence
  SiRNA target sequence
aaatctcataatcatcttta

SEQ ID NO: 36739 - DNA, 20 bp, Artificial sequence
  SiRNA target sequence
aatctcataatcatctttat

SEQ ID NO: 36740 - DNA, 20 bp, Artificial sequence
  SiRNA target sequence
atctcataatcatctttata

SEQ ID NO: 36741 - DNA, 20 bp, Artificial sequence
  SiRNA target sequence
tctcataatcatctttataa

SEQ ID NO: 36742 - DNA, 20 bp, Artificial sequence
  SiRNA target sequence
ctcataatcatctttataag

SEQ ID NO: 36743 - DNA, 20 bp, Artificial sequence
  SiRNA target sequence
tcataatcatctttataaga

SEQ ID NO: 36744 - DNA, 20 bp, Artificial sequence
  SiRNA target sequence
cataatcatctttataagag

SEQ ID NO: 36745 - DNA, 20 bp, Artificial sequence
  SiRNA target sequence
ataatcatctttataagaga

SEQ ID NO: 36746 - DNA, 20 bp, Artificial sequence
  SiRNA target sequence
taatcatctttataagagat

SEQ ID NO: 36747 - DNA, 20 bp, Artificial sequence
  SiRNA target sequence
aatcatctttataagagatg

SEQ ID NO: 36748 - DNA, 20 bp, Artificial sequence
  SiRNA target sequence
atcatctttataagagatgt

SEQ ID NO: 36749 - DNA, 20 bp, Artificial sequence
  SiRNA target sequence
tcatctttataagagatgtt

SEQ ID NO: 36750 - DNA, 20 bp, Artificial sequence
  SiRNA target sequence
catctttataagagatgttt

SEQ ID NO: 36751 - DNA, 20 bp, Artificial sequence
  SiRNA target sequence
atctttataagagatgtttt

SEQ ID NO: 36752 - DNA, 20 bp, Artificial sequence
  SiRNA target sequence
tctttataagagatgttttt

SEQ ID NO: 36753 - DNA, 20 bp, Artificial sequence
  SiRNA target sequence
ctttataagagatgtttttc

SEQ ID NO: 36754 - DNA, 20 bp, Artificial sequence
  SiRNA target sequence
tttataagagatgtttttcc

SEQ ID NO: 36755 - DNA, 20 bp, Artificial sequence
  SiRNA target sequence
ttataagagatgtttttccc

SEQ ID NO: 36756 - DNA, 20 bp, Artificial sequence
  SiRNA target sequence
tataagagatgtttttcccg

SEQ ID NO: 36757 - DNA, 20 bp, Artificial sequence
  SiRNA target sequence
ataagagatgtttttcccga

SEQ ID NO: 36758 - DNA, 20 bp, Artificial sequence
  SiRNA target sequence
taagagatgtttttcccgat

SEQ ID NO: 36759 - DNA, 20 bp, Artificial sequence
  SiRNA target sequence
aagagatgtttttcccgatc

SEQ ID NO: 36760 - DNA, 20 bp, Artificial sequence
  SiRNA target sequence
agagatgtttttcccgatcc

SEQ ID NO: 36761 - DNA, 20 bp, Artificial sequence
  SiRNA target sequence
gagatgtttttcccgatcca

SEQ ID NO: 36762 - DNA, 20 bp, Artificial sequence
  SiRNA target sequence
agatgtttttcccgatccat

SEQ ID NO: 36763 - DNA, 20 bp, Artificial sequence
  SiRNA target sequence
gatgtttttcccgatccatt

SEQ ID NO: 36764 - DNA, 20 bp, Artificial sequence
  SiRNA target sequence
atgtttttcccgatccattt

SEQ ID NO: 36765 - DNA, 20 bp, Artificial sequence
  SiRNA target sequence
tgtttttcccgatccatttt

SEQ ID NO: 36766 - DNA, 20 bp, Artificial sequence
  SiRNA target sequence
gtttttcccgatccattttt

SEQ ID NO: 36767 - DNA, 20 bp, Artificial sequence
  SiRNA target sequence
tttttcccgatccatttttt

SEQ ID NO: 36768 - DNA, 20 bp, Artificial sequence
  SiRNA target sequence
ttttcccgatccattttttc

SEQ ID NO: 36769 - DNA, 20 bp, Artificial sequence
  SiRNA target sequence
tttcccgatccattttttcc

SEQ ID NO: 36770 - DNA, 20 bp, Artificial sequence
  SiRNA target sequence
ttcccgatccattttttcca

SEQ ID NO: 36771 - DNA, 20 bp, Artificial sequence
  SiRNA target sequence
tcccgatccattttttccaa

SEQ ID NO: 36772 - DNA, 20 bp, Artificial sequence
  SiRNA target sequence
cccgatccattttttccaat

SEQ ID NO: 36773 - DNA, 20 bp, Artificial sequence
  SiRNA target sequence
ccgatccattttttccaata

SEQ ID NO: 36774 - DNA, 20 bp, Artificial sequence
  SiRNA target sequence
cgatccattttttccaataa

SEQ ID NO: 36775 - DNA, 20 bp, Artificial sequence
  SiRNA target sequence
gatccattttttccaataat

SEQ ID NO: 36776 - DNA, 20 bp, Artificial sequence
  SiRNA target sequence
atccattttttccaataata

SEQ ID NO: 36777 - DNA, 20 bp, Artificial sequence
  SiRNA target sequence
tccattttttccaataatag

SEQ ID NO: 36778 - DNA, 20 bp, Artificial sequence
  SiRNA target sequence
ccattttttccaataatagc

SEQ ID NO: 36779 - DNA, 20 bp, Artificial sequence
  SiRNA target sequence
cattttttccaataatagct

SEQ ID NO: 36780 - DNA, 20 bp, Artificial sequence
  SiRNA target sequence
attttttccaataatagcta

SEQ ID NO: 36781 - DNA, 20 bp, Artificial sequence
  SiRNA target sequence
ttttttccaataatagctac

SEQ ID NO: 36782 - DNA, 20 bp, Artificial sequence
  SiRNA target sequence
tttttccaataatagctact

SEQ ID NO: 36783 - DNA, 20 bp, Artificial sequence
  SiRNA target sequence
ttttccaataatagctactt

SEQ ID NO: 36784 - DNA, 20 bp, Artificial sequence
  SiRNA target sequence
tttccaataatagctacttt

SEQ ID NO: 36785 - DNA, 20 bp, Artificial sequence
  SiRNA target sequence
ttccaataatagctactttt

SEQ ID NO: 36786 - DNA, 20 bp, Artificial sequence
  SiRNA target sequence
tccaataatagctacttttt

SEQ ID NO: 36787 - DNA, 20 bp, Artificial sequence
  SiRNA target sequence
ccaataatagctactttttc

SEQ ID NO: 36788 - DNA, 20 bp, Artificial sequence
  SiRNA target sequence
caataatagctactttttca

SEQ ID NO: 36789 - DNA, 20 bp, Artificial sequence
  SiRNA target sequence
aataatagctactttttcac

SEQ ID NO: 36790 - DNA, 20 bp, Artificial sequence
  SiRNA target sequence
ataatagctactttttcacc

SEQ ID NO: 36791 - DNA, 20 bp, Artificial sequence
  SiRNA target sequence
taatagctactttttcacct

SEQ ID NO: 36792 - DNA, 20 bp, Artificial sequence
  SiRNA target sequence
aatagctactttttcacctt

SEQ ID NO: 36793 - DNA, 20 bp, Artificial sequence
  SiRNA target sequence
atagctactttttcaccttt

SEQ ID NO: 36794 - DNA, 20 bp, Artificial sequence
  SiRNA target sequence
tagctactttttcacctttt

SEQ ID NO: 36795 - DNA, 20 bp, Artificial sequence
  SiRNA target sequence
agctactttttcaccttttt

SEQ ID NO: 36796 - DNA, 20 bp, Artificial sequence
  SiRNA target sequence
gctactttttcacctttttt

SEQ ID NO: 36797 - DNA, 20 bp, Artificial sequence
  SiRNA target sequence
ctactttttcacctttttta

SEQ ID NO: 36798 - DNA, 20 bp, Artificial sequence
  SiRNA target sequence
tactttttcaccttttttaa

SEQ ID NO: 36799 - DNA, 20 bp, Artificial sequence
  SiRNA target sequence
actttttcaccttttttaat

SEQ ID NO: 36800 - DNA, 20 bp, Artificial sequence
  SiRNA target sequence
ctttttcaccttttttaatt

SEQ ID NO: 36801 - DNA, 20 bp, Artificial sequence
  SiRNA target sequence
tttttcaccttttttaatta

SEQ ID NO: 36802 - DNA, 20 bp, Artificial sequence
  SiRNA target sequence
ttttcaccttttttaattaa

SEQ ID NO: 36803 - DNA, 20 bp, Artificial sequence
  SiRNA target sequence
tttcaccttttttaattaaa

SEQ ID NO: 36804 - DNA, 20 bp, Artificial sequence
  SiRNA target sequence
ttcaccttttttaattaaaa

SEQ ID NO: 36805 - DNA, 20 bp, Artificial sequence
  SiRNA target sequence
tcaccttttttaattaaaat

SEQ ID NO: 36806 - DNA, 20 bp, Artificial sequence
  SiRNA target sequence
caccttttttaattaaaata

SEQ ID NO: 36807 - DNA, 20 bp, Artificial sequence
  SiRNA target sequence
accttttttaattaaaatat

SEQ ID NO: 36808 - DNA, 20 bp, Artificial sequence
  SiRNA target sequence
ccttttttaattaaaatatt

SEQ ID NO: 36809 - DNA, 20 bp, Artificial sequence
  SiRNA target sequence
cttttttaattaaaatattt

SEQ ID NO: 36810 - DNA, 20 bp, Artificial sequence
  SiRNA target sequence
ttttttaattaaaatattta

SEQ ID NO: 36811 - DNA, 20 bp, Artificial sequence
  SiRNA target sequence
tttttaattaaaatatttat

SEQ ID NO: 36812 - DNA, 20 bp, Artificial sequence
  SiRNA target sequence
ttttaattaaaatatttatg

SEQ ID NO: 36813 - DNA, 20 bp, Artificial sequence
  SiRNA target sequence
tttaattaaaatatttatgt

SEQ ID NO: 36814 - DNA, 20 bp, Artificial sequence
  SiRNA target sequence
ttaattaaaatatttatgtc

SEQ ID NO: 36815 - DNA, 20 bp, Artificial sequence
  SiRNA target sequence
taattaaaatatttatgtcc

SEQ ID NO: 36816 - DNA, 20 bp, Artificial sequence
  SiRNA target sequence
aattaaaatatttatgtccg

SEQ ID NO: 36817 - DNA, 20 bp, Artificial sequence
  SiRNA target sequence
attaaaatatttatgtccgt

SEQ ID NO: 36818 - DNA, 20 bp, Artificial sequence
  SiRNA target sequence
ttaaaatatttatgtccgtt

SEQ ID NO: 36819 - DNA, 20 bp, Artificial sequence
  SiRNA target sequence
taaaatatttatgtccgtta

SEQ ID NO: 36820 - DNA, 20 bp, Artificial sequence
  SiRNA target sequence
aaaatatttatgtccgttaa

SEQ ID NO: 36821 - DNA, 20 bp, Artificial sequence
  SiRNA target sequence
aaatatttatgtccgttaaa

SEQ ID NO: 36822 - DNA, 20 bp, Artificial sequence
  SiRNA target sequence
aatatttatgtccgttaaaa

SEQ ID NO: 36823 - DNA, 20 bp, Artificial sequence
  SiRNA target sequence
atatttatgtccgttaaaat

SEQ ID NO: 36824 - DNA, 20 bp, Artificial sequence
  SiRNA target sequence
tatttatgtccgttaaaatt

SEQ ID NO: 36825 - DNA, 20 bp, Artificial sequence
  SiRNA target sequence
atttatgtccgttaaaattt

SEQ ID NO: 36826 - DNA, 20 bp, Artificial sequence
  SiRNA target sequence
tttatgtccgttaaaatttt

SEQ ID NO: 36827 - DNA, 20 bp, Artificial sequence
  SiRNA target sequence
ttatgtccgttaaaattttt

SEQ ID NO: 36828 - DNA, 20 bp, Artificial sequence
  SiRNA target sequence
tatgtccgttaaaatttttt

SEQ ID NO: 36829 - DNA, 20 bp, Artificial sequence
  SiRNA target sequence
atgtccgttaaaattttttt

SEQ ID NO: 36830 - DNA, 20 bp, Artificial sequence
  SiRNA target sequence
tgtccgttaaaatttttttg

SEQ ID NO: 36831 - DNA, 20 bp, Artificial sequence
  SiRNA target sequence
gtccgttaaaatttttttgg

SEQ ID NO: 36832 - DNA, 20 bp, Artificial sequence
  SiRNA target sequence
tccgttaaaatttttttgga

SEQ ID NO: 36833 - DNA, 20 bp, Artificial sequence
  SiRNA target sequence
ccgttaaaatttttttggag

SEQ ID NO: 36834 - DNA, 20 bp, Artificial sequence
  SiRNA target sequence
cgttaaaatttttttggagt

SEQ ID NO: 36835 - DNA, 20 bp, Artificial sequence
  SiRNA target sequence
gttaaaatttttttggagta

SEQ ID NO: 36836 - DNA, 20 bp, Artificial sequence
  SiRNA target sequence
ttaaaatttttttggagtaa

SEQ ID NO: 36837 - DNA, 20 bp, Artificial sequence
  SiRNA target sequence
taaaatttttttggagtaat

SEQ ID NO: 36838 - DNA, 20 bp, Artificial sequence
  SiRNA target sequence
aaaatttttttggagtaata

SEQ ID NO: 36839 - DNA, 20 bp, Artificial sequence
  SiRNA target sequence
aaatttttttggagtaataa

SEQ ID NO: 36840 - DNA, 20 bp, Artificial sequence
  SiRNA target sequence
aatttttttggagtaataat

SEQ ID NO: 36841 - DNA, 20 bp, Artificial sequence
  SiRNA target sequence
atttttttggagtaataatt

SEQ ID NO: 36842 - DNA, 20 bp, Artificial sequence
  SiRNA target sequence
tttttttggagtaataatta

SEQ ID NO: 36843 - DNA, 20 bp, Artificial sequence
  SiRNA target sequence
ttttttggagtaataattaa

SEQ ID NO: 36844 - DNA, 20 bp, Artificial sequence
  SiRNA target sequence
tttttggagtaataattaaa

SEQ ID NO: 36845 - DNA, 20 bp, Artificial sequence
  SiRNA target sequence
ttttggagtaataattaaat

SEQ ID NO: 36846 - DNA, 20 bp, Artificial sequence
  SiRNA target sequence
tttggagtaataattaaatg

SEQ ID NO: 36847 - DNA, 20 bp, Artificial sequence
  SiRNA target sequence
ttggagtaataattaaatga

SEQ ID NO: 36848 - DNA, 20 bp, Artificial sequence
  SiRNA target sequence
tggagtaataattaaatgat

SEQ ID NO: 36849 - DNA, 20 bp, Artificial sequence
  SiRNA target sequence
ggagtaataattaaatgatg

SEQ ID NO: 36850 - DNA, 20 bp, Artificial sequence
  SiRNA target sequence
gagtaataattaaatgatgc

SEQ ID NO: 36851 - DNA, 20 bp, Artificial sequence
  SiRNA target sequence
agtaataattaaatgatgca

SEQ ID NO: 36852 - DNA, 20 bp, Artificial sequence
  SiRNA target sequence
gtaataattaaatgatgcat

SEQ ID NO: 36853 - DNA, 20 bp, Artificial sequence
  SiRNA target sequence
taataattaaatgatgcatt

SEQ ID NO: 36854 - DNA, 20 bp, Artificial sequence
  SiRNA target sequence
aataattaaatgatgcattt

SEQ ID NO: 36855 - DNA, 20 bp, Artificial sequence
  SiRNA target sequence
ataattaaatgatgcatttt

SEQ ID NO: 36856 - DNA, 20 bp, Artificial sequence
  SiRNA target sequence
taattaaatgatgcattttc

SEQ ID NO: 36857 - DNA, 20 bp, Artificial sequence
  SiRNA target sequence
aattaaatgatgcattttct

SEQ ID NO: 36858 - DNA, 20 bp, Artificial sequence
  SiRNA target sequence
attaaatgatgcattttcta

SEQ ID NO: 36859 - DNA, 20 bp, Artificial sequence
  SiRNA target sequence
ttaaatgatgcattttctaa

SEQ ID NO: 36860 - DNA, 20 bp, Artificial sequence
  SiRNA target sequence
taaatgatgcattttctaat

SEQ ID NO: 36861 - DNA, 20 bp, Artificial sequence
  SiRNA target sequence
aaatgatgcattttctaatc

SEQ ID NO: 36862 - DNA, 20 bp, Artificial sequence
  SiRNA target sequence
aatgatgcattttctaatct

SEQ ID NO: 36863 - DNA, 20 bp, Artificial sequence
  SiRNA target sequence
atgatgcattttctaatctt

SEQ ID NO: 36864 - DNA, 20 bp, Artificial sequence
  SiRNA target sequence
tgatgcattttctaatctta

SEQ ID NO: 36865 - DNA, 20 bp, Artificial sequence
  SiRNA target sequence
gatgcattttctaatcttat

SEQ ID NO: 36866 - DNA, 20 bp, Artificial sequence
  SiRNA target sequence
atgcattttctaatcttata

SEQ ID NO: 36867 - DNA, 20 bp, Artificial sequence
  SiRNA target sequence
tgcattttctaatcttatat

SEQ ID NO: 36868 - DNA, 20 bp, Artificial sequence
  SiRNA target sequence
gcattttctaatcttatatc

SEQ ID NO: 36869 - DNA, 20 bp, Artificial sequence
  SiRNA target sequence
cattttctaatcttatatca

SEQ ID NO: 36870 - DNA, 20 bp, Artificial sequence
  SiRNA target sequence
attttctaatcttatatcat

SEQ ID NO: 36871 - DNA, 20 bp, Artificial sequence
  SiRNA target sequence
ttttctaatcttatatcatt

SEQ ID NO: 36872 - DNA, 20 bp, Artificial sequence
  SiRNA target sequence
tttctaatcttatatcatta

SEQ ID NO: 36873 - DNA, 20 bp, Artificial sequence
  SiRNA target sequence
ttctaatcttatatcattat

SEQ ID NO: 36874 - DNA, 20 bp, Artificial sequence
  SiRNA target sequence
tctaatcttatatcattatt

SEQ ID NO: 36875 - DNA, 20 bp, Artificial sequence
  SiRNA target sequence
ctaatcttatatcattatta

SEQ ID NO: 36876 - DNA, 20 bp, Artificial sequence
  SiRNA target sequence
taatcttatatcattattaa

SEQ ID NO: 36877 - DNA, 20 bp, Artificial sequence
  SiRNA target sequence
aatcttatatcattattaaa

SEQ ID NO: 36878 - DNA, 20 bp, Artificial sequence
  SiRNA target sequence
atcttatatcattattaaat

SEQ ID NO: 36879 - DNA, 20 bp, Artificial sequence
  SiRNA target sequence
tcttatatcattattaaatt

SEQ ID NO: 36880 - DNA, 20 bp, Artificial sequence
  SiRNA target sequence
cttatatcattattaaattc

SEQ ID NO: 36881 - DNA, 20 bp, Artificial sequence
  SiRNA target sequence
ttatatcattattaaattca

SEQ ID NO: 36882 - DNA, 20 bp, Artificial sequence
  SiRNA target sequence
tatatcattattaaattcat

SEQ ID NO: 36883 - DNA, 20 bp, Artificial sequence
  SiRNA target sequence
atatcattattaaattcatt

SEQ ID NO: 36884 - DNA, 20 bp, Artificial sequence
  SiRNA target sequence
tatcattattaaattcatta

SEQ ID NO: 36885 - DNA, 20 bp, Artificial sequence
  SiRNA target sequence
atcattattaaattcattaa

SEQ ID NO: 36886 - DNA, 20 bp, Artificial sequence
  SiRNA target sequence
tcattattaaattcattaac

SEQ ID NO: 36887 - DNA, 20 bp, Artificial sequence
  SiRNA target sequence
cattattaaattcattaaca

SEQ ID NO: 36888 - DNA, 20 bp, Artificial sequence
  SiRNA target sequence
attattaaattcattaacat

SEQ ID NO: 36889 - DNA, 20 bp, Artificial sequence
  SiRNA target sequence
ttattaaattcattaacatc

SEQ ID NO: 36890 - DNA, 20 bp, Artificial sequence
  SiRNA target sequence
tattaaattcattaacatct

SEQ ID NO: 36891 - DNA, 20 bp, Artificial sequence
  SiRNA target sequence
attaaattcattaacatcta

SEQ ID NO: 36892 - DNA, 20 bp, Artificial sequence
  SiRNA target sequence
ttaaattcattaacatctac

SEQ ID NO: 36893 - DNA, 20 bp, Artificial sequence
  SiRNA target sequence
taaattcattaacatctact

SEQ ID NO: 36894 - DNA, 20 bp, Artificial sequence
  SiRNA target sequence
aaattcattaacatctacta

SEQ ID NO: 36895 - DNA, 20 bp, Artificial sequence
  SiRNA target sequence
aattcattaacatctactaa

SEQ ID NO: 36896 - DNA, 20 bp, Artificial sequence
  SiRNA target sequence
attcattaacatctactaaa

SEQ ID NO: 36897 - DNA, 20 bp, Artificial sequence
  SiRNA target sequence
ttcattaacatctactaaat

SEQ ID NO: 36898 - DNA, 20 bp, Artificial sequence
  SiRNA target sequence
tcattaacatctactaaatt

SEQ ID NO: 36899 - DNA, 20 bp, Artificial sequence
  SiRNA target sequence
cattaacatctactaaattt

SEQ ID NO: 36900 - DNA, 20 bp, Artificial sequence
  SiRNA target sequence
attaacatctactaaatttg

SEQ ID NO: 36901 - DNA, 20 bp, Artificial sequence
  SiRNA target sequence
ttaacatctactaaatttgg

SEQ ID NO: 36902 - DNA, 20 bp, Artificial sequence
  SiRNA target sequence
taacatctactaaatttggt

SEQ ID NO: 36903 - DNA, 20 bp, Artificial sequence
  SiRNA target sequence
aacatctactaaatttggtt

SEQ ID NO: 36904 - DNA, 20 bp, Artificial sequence
  SiRNA target sequence
acatctactaaatttggttc

SEQ ID NO: 36905 - DNA, 20 bp, Artificial sequence
  SiRNA target sequence
catctactaaatttggttct

SEQ ID NO: 36906 - DNA, 20 bp, Artificial sequence
  SiRNA target sequence
atctactaaatttggttctt

SEQ ID NO: 36907 - DNA, 20 bp, Artificial sequence
  SiRNA target sequence
tctactaaatttggttcttc

SEQ ID NO: 36908 - DNA, 20 bp, Artificial sequence
  SiRNA target sequence
ctactaaatttggttcttct

SEQ ID NO: 36909 - DNA, 20 bp, Artificial sequence
  SiRNA target sequence
tactaaatttggttcttctt

SEQ ID NO: 36910 - DNA, 20 bp, Artificial sequence
  SiRNA target sequence
actaaatttggttcttcttt

SEQ ID NO: 36911 - DNA, 20 bp, Artificial sequence
  SiRNA target sequence
ctaaatttggttcttctttt

SEQ ID NO: 36912 - DNA, 20 bp, Artificial sequence
  SiRNA target sequence
taaatttggttcttctttta

SEQ ID NO: 36913 - DNA, 20 bp, Artificial sequence
  SiRNA target sequence
aaatttggttcttcttttat

SEQ ID NO: 36914 - DNA, 20 bp, Artificial sequence
  SiRNA target sequence
aatttggttcttcttttata

SEQ ID NO: 36915 - DNA, 20 bp, Artificial sequence
  SiRNA target sequence
atttggttcttcttttataa

SEQ ID NO: 36916 - DNA, 20 bp, Artificial sequence
  SiRNA target sequence
tttggttcttcttttataag

SEQ ID NO: 36917 - DNA, 20 bp, Artificial sequence
  SiRNA target sequence
ttggttcttcttttataagc

SEQ ID NO: 36918 - DNA, 20 bp, Artificial sequence
  SiRNA target sequence
tggttcttcttttataagct

SEQ ID NO: 36919 - DNA, 20 bp, Artificial sequence
  SiRNA target sequence
ggttcttcttttataagctc

SEQ ID NO: 36920 - DNA, 20 bp, Artificial sequence
  SiRNA target sequence
gttcttcttttataagctct

SEQ ID NO: 36921 - DNA, 20 bp, Artificial sequence
  SiRNA target sequence
ttcttcttttataagctctg

SEQ ID NO: 36922 - DNA, 20 bp, Artificial sequence
  SiRNA target sequence
tcttcttttataagctctgg

SEQ ID NO: 36923 - DNA, 20 bp, Artificial sequence
  SiRNA target sequence
cttcttttataagctctggt

SEQ ID NO: 36924 - DNA, 20 bp, Artificial sequence
  SiRNA target sequence
ttcttttataagctctggtt

SEQ ID NO: 36925 - DNA, 20 bp, Artificial sequence
  SiRNA target sequence
tcttttataagctctggttt

SEQ ID NO: 36926 - DNA, 20 bp, Artificial sequence
  SiRNA target sequence
cttttataagctctggttta

SEQ ID NO: 36927 - DNA, 20 bp, Artificial sequence
  SiRNA target sequence
ttttataagctctggtttaa

SEQ ID NO: 36928 - DNA, 20 bp, Artificial sequence
  SiRNA target sequence
tttataagctctggtttaaa

SEQ ID NO: 36929 - DNA, 20 bp, Artificial sequence
  SiRNA target sequence
ttataagctctggtttaaaa

SEQ ID NO: 36930 - DNA, 20 bp, Artificial sequence
  SiRNA target sequence
tataagctctggtttaaaag

SEQ ID NO: 36931 - DNA, 20 bp, Artificial sequence
  SiRNA target sequence
ataagctctggtttaaaaga

SEQ ID NO: 36932 - DNA, 20 bp, Artificial sequence
  SiRNA target sequence
taagctctggtttaaaagat

SEQ ID NO: 36933 - DNA, 20 bp, Artificial sequence
  SiRNA target sequence
aagctctggtttaaaagatg

SEQ ID NO: 36934 - DNA, 20 bp, Artificial sequence
  SiRNA target sequence
agctctggtttaaaagatgt

SEQ ID NO: 36935 - DNA, 20 bp, Artificial sequence
  SiRNA target sequence
gctctggtttaaaagatgtt

SEQ ID NO: 36936 - DNA, 20 bp, Artificial sequence
  SiRNA target sequence
ctctggtttaaaagatgttc

SEQ ID NO: 36937 - DNA, 20 bp, Artificial sequence
  SiRNA target sequence
tctggtttaaaagatgttct

SEQ ID NO: 36938 - DNA, 20 bp, Artificial sequence
  SiRNA target sequence
ctggtttaaaagatgttctt

SEQ ID NO: 36939 - DNA, 20 bp, Artificial sequence
  SiRNA target sequence
tggtttaaaagatgttctta

SEQ ID NO: 36940 - DNA, 20 bp, Artificial sequence
  SiRNA target sequence
ggtttaaaagatgttcttat

SEQ ID NO: 36941 - DNA, 20 bp, Artificial sequence
  SiRNA target sequence
gtttaaaagatgttcttata

SEQ ID NO: 36942 - DNA, 20 bp, Artificial sequence
  SiRNA target sequence
tttaaaagatgttcttatat

SEQ ID NO: 36943 - DNA, 20 bp, Artificial sequence
  SiRNA target sequence
ttaaaagatgttcttatatt

SEQ ID NO: 36944 - DNA, 20 bp, Artificial sequence
  SiRNA target sequence
taaaagatgttcttatattt

SEQ ID NO: 36945 - DNA, 20 bp, Artificial sequence
  SiRNA target sequence
aaaagatgttcttatattta

SEQ ID NO: 36946 - DNA, 20 bp, Artificial sequence
  SiRNA target sequence
aaagatgttcttatatttaa

SEQ ID NO: 36947 - DNA, 20 bp, Artificial sequence
  SiRNA target sequence
aagatgttcttatatttaag

SEQ ID NO: 36948 - DNA, 20 bp, Artificial sequence
  SiRNA target sequence
agatgttcttatatttaaga

SEQ ID NO: 36949 - DNA, 20 bp, Artificial sequence
  SiRNA target sequence
gatgttcttatatttaagat

SEQ ID NO: 36950 - DNA, 20 bp, Artificial sequence
  SiRNA target sequence
atgttcttatatttaagatt

SEQ ID NO: 36951 - DNA, 20 bp, Artificial sequence
  SiRNA target sequence
tgttcttatatttaagattg

SEQ ID NO: 36952 - DNA, 20 bp, Artificial sequence
  SiRNA target sequence
gttcttatatttaagattgc

SEQ ID NO: 36953 - DNA, 20 bp, Artificial sequence
  SiRNA target sequence
ttcttatatttaagattgct

SEQ ID NO: 36954 - DNA, 20 bp, Artificial sequence
  SiRNA target sequence
tcttatatttaagattgctt

SEQ ID NO: 36955 - DNA, 20 bp, Artificial sequence
  SiRNA target sequence
cttatatttaagattgcttg

SEQ ID NO: 36956 - DNA, 20 bp, Artificial sequence
  SiRNA target sequence
ttatatttaagattgcttgt

SEQ ID NO: 36957 - DNA, 20 bp, Artificial sequence
  SiRNA target sequence
tatatttaagattgcttgtg

SEQ ID NO: 36958 - DNA, 20 bp, Artificial sequence
  SiRNA target sequence
atatttaagattgcttgtgt

SEQ ID NO: 36959 - DNA, 20 bp, Artificial sequence
  SiRNA target sequence
tatttaagattgcttgtgta

SEQ ID NO: 36960 - DNA, 20 bp, Artificial sequence
  SiRNA target sequence
atttaagattgcttgtgtat

SEQ ID NO: 36961 - DNA, 20 bp, Artificial sequence
  SiRNA target sequence
tttaagattgcttgtgtata

SEQ ID NO: 36962 - DNA, 20 bp, Artificial sequence
  SiRNA target sequence
ttaagattgcttgtgtatat

SEQ ID NO: 36963 - DNA, 20 bp, Artificial sequence
  SiRNA target sequence
taagattgcttgtgtatatc

SEQ ID NO: 36964 - DNA, 20 bp, Artificial sequence
  SiRNA target sequence
aagattgcttgtgtatatcg

SEQ ID NO: 36965 - DNA, 20 bp, Artificial sequence
  SiRNA target sequence
agattgcttgtgtatatcgt

SEQ ID NO: 36966 - DNA, 20 bp, Artificial sequence
  SiRNA target sequence
gattgcttgtgtatatcgtg

SEQ ID NO: 36967 - DNA, 20 bp, Artificial sequence
  SiRNA target sequence
attgcttgtgtatatcgtga

SEQ ID NO: 36968 - DNA, 20 bp, Artificial sequence
  SiRNA target sequence
ttgcttgtgtatatcgtgag

SEQ ID NO: 36969 - DNA, 20 bp, Artificial sequence
  SiRNA target sequence
tgcttgtgtatatcgtgagt

SEQ ID NO: 36970 - DNA, 20 bp, Artificial sequence
  SiRNA target sequence
gcttgtgtatatcgtgagta

SEQ ID NO: 36971 - DNA, 20 bp, Artificial sequence
  SiRNA target sequence
cttgtgtatatcgtgagtaa

SEQ ID NO: 36972 - DNA, 20 bp, Artificial sequence
  SiRNA target sequence
ttgtgtatatcgtgagtaaa

SEQ ID NO: 36973 - DNA, 20 bp, Artificial sequence
  SiRNA target sequence
tgtgtatatcgtgagtaaaa

SEQ ID NO: 36974 - DNA, 20 bp, Artificial sequence
  SiRNA target sequence
gtgtatatcgtgagtaaaag

SEQ ID NO: 36975 - DNA, 20 bp, Artificial sequence
  SiRNA target sequence
tgtatatcgtgagtaaaaga

SEQ ID NO: 36976 - DNA, 20 bp, Artificial sequence
  SiRNA target sequence
gtatatcgtgagtaaaagaa

SEQ ID NO: 36977 - DNA, 20 bp, Artificial sequence
  SiRNA target sequence
tatatcgtgagtaaaagaac

SEQ ID NO: 36978 - DNA, 20 bp, Artificial sequence
  SiRNA target sequence
atatcgtgagtaaaagaacc

SEQ ID NO: 36979 - DNA, 20 bp, Artificial sequence
  SiRNA target sequence
tatcgtgagtaaaagaaccc

SEQ ID NO: 36980 - DNA, 20 bp, Artificial sequence
  SiRNA target sequence
atcgtgagtaaaagaaccct

SEQ ID NO: 36981 - DNA, 20 bp, Artificial sequence
  SiRNA target sequence
tcgtgagtaaaagaacccta

SEQ ID NO: 36982 - DNA, 20 bp, Artificial sequence
  SiRNA target sequence
cgtgagtaaaagaaccctaa

SEQ ID NO: 36983 - DNA, 20 bp, Artificial sequence
  SiRNA target sequence
gtgagtaaaagaaccctaat

SEQ ID NO: 36984 - DNA, 20 bp, Artificial sequence
  SiRNA target sequence
tgagtaaaagaaccctaatt

SEQ ID NO: 36985 - DNA, 20 bp, Artificial sequence
  SiRNA target sequence
gagtaaaagaaccctaattg

SEQ ID NO: 36986 - DNA, 20 bp, Artificial sequence
  SiRNA target sequence
agtaaaagaaccctaattgt

SEQ ID NO: 36987 - DNA, 20 bp, Artificial sequence
  SiRNA target sequence
gtaaaagaaccctaattgtc

SEQ ID NO: 36988 - DNA, 20 bp, Artificial sequence
  SiRNA target sequence
taaaagaaccctaattgtcc

SEQ ID NO: 36989 - DNA, 20 bp, Artificial sequence
  SiRNA target sequence
aaaagaaccctaattgtcca

SEQ ID NO: 36990 - DNA, 20 bp, Artificial sequence
  SiRNA target sequence
aaagaaccctaattgtccaa

SEQ ID NO: 36991 - DNA, 20 bp, Artificial sequence
  SiRNA target sequence
aagaaccctaattgtccaaa

SEQ ID NO: 36992 - DNA, 20 bp, Artificial sequence
  SiRNA target sequence
agaaccctaattgtccaaaa

SEQ ID NO: 36993 - DNA, 20 bp, Artificial sequence
  SiRNA target sequence
gaaccctaattgtccaaaac

SEQ ID NO: 36994 - DNA, 20 bp, Artificial sequence
  SiRNA target sequence
aaccctaattgtccaaaact

SEQ ID NO: 36995 - DNA, 20 bp, Artificial sequence
  SiRNA target sequence
accctaattgtccaaaactt

SEQ ID NO: 36996 - DNA, 20 bp, Artificial sequence
  SiRNA target sequence
ccctaattgtccaaaacttg

SEQ ID NO: 36997 - DNA, 20 bp, Artificial sequence
  SiRNA target sequence
cctaattgtccaaaacttga

SEQ ID NO: 36998 - DNA, 20 bp, Artificial sequence
  SiRNA target sequence
ctaattgtccaaaacttgaa

SEQ ID NO: 36999 - DNA, 20 bp, Artificial sequence
  SiRNA target sequence
taattgtccaaaacttgaat

SEQ ID NO: 37000 - DNA, 20 bp, Artificial sequence
  SiRNA target sequence
aattgtccaaaacttgaata

SEQ ID NO: 37001 - DNA, 20 bp, Artificial sequence
  SiRNA target sequence
attgtccaaaacttgaatac

SEQ ID NO: 37002 - DNA, 20 bp, Artificial sequence
  SiRNA target sequence
ttgtccaaaacttgaataca

SEQ ID NO: 37003 - DNA, 20 bp, Artificial sequence
  SiRNA target sequence
tgtccaaaacttgaatacaa

SEQ ID NO: 37004 - DNA, 20 bp, Artificial sequence
  SiRNA target sequence
gtccaaaacttgaatacaat

SEQ ID NO: 37005 - DNA, 20 bp, Artificial sequence
  SiRNA target sequence
tccaaaacttgaatacaatg

SEQ ID NO: 37006 - DNA, 20 bp, Artificial sequence
  SiRNA target sequence
ccaaaacttgaatacaatgt

SEQ ID NO: 37007 - DNA, 20 bp, Artificial sequence
  SiRNA target sequence
caaaacttgaatacaatgtt

SEQ ID NO: 37008 - DNA, 20 bp, Artificial sequence
  SiRNA target sequence
aaaacttgaatacaatgttc

SEQ ID NO: 37009 - DNA, 20 bp, Artificial sequence
  SiRNA target sequence
aaacttgaatacaatgttct

SEQ ID NO: 37010 - DNA, 20 bp, Artificial sequence
  SiRNA target sequence
aacttgaatacaatgttcta

SEQ ID NO: 37011 - DNA, 20 bp, Artificial sequence
  SiRNA target sequence
acttgaatacaatgttctat

SEQ ID NO: 37012 - DNA, 20 bp, Artificial sequence
  SiRNA target sequence
cttgaatacaatgttctatt

SEQ ID NO: 37013 - DNA, 20 bp, Artificial sequence
  SiRNA target sequence
ttgaatacaatgttctatta

SEQ ID NO: 37014 - DNA, 20 bp, Artificial sequence
  SiRNA target sequence
tgaatacaatgttctattaa

SEQ ID NO: 37015 - DNA, 20 bp, Artificial sequence
  SiRNA target sequence
gaatacaatgttctattaat

SEQ ID NO: 37016 - DNA, 20 bp, Artificial sequence
  SiRNA target sequence
aatacaatgttctattaatg

SEQ ID NO: 37017 - DNA, 20 bp, Artificial sequence
  SiRNA target sequence
atacaatgttctattaatgc

SEQ ID NO: 37018 - DNA, 20 bp, Artificial sequence
  SiRNA target sequence
tacaatgttctattaatgcc

SEQ ID NO: 37019 - DNA, 20 bp, Artificial sequence
  SiRNA target sequence
acaatgttctattaatgcca

SEQ ID NO: 37020 - DNA, 20 bp, Artificial sequence
  SiRNA target sequence
caatgttctattaatgccaa

SEQ ID NO: 37021 - DNA, 20 bp, Artificial sequence
  SiRNA target sequence
aatgttctattaatgccaat

SEQ ID NO: 37022 - DNA, 20 bp, Artificial sequence
  SiRNA target sequence
atgttctattaatgccaata

SEQ ID NO: 37023 - DNA, 20 bp, Artificial sequence
  SiRNA target sequence
tgttctattaatgccaatat

SEQ ID NO: 37024 - DNA, 20 bp, Artificial sequence
  SiRNA target sequence
gttctattaatgccaatata

SEQ ID NO: 37025 - DNA, 20 bp, Artificial sequence
  SiRNA target sequence
ttctattaatgccaatataa

SEQ ID NO: 37026 - DNA, 20 bp, Artificial sequence
  SiRNA target sequence
tctattaatgccaatataaa

SEQ ID NO: 37027 - DNA, 20 bp, Artificial sequence
  SiRNA target sequence
ctattaatgccaatataaaa

SEQ ID NO: 37028 - DNA, 20 bp, Artificial sequence
  SiRNA target sequence
tattaatgccaatataaaat

SEQ ID NO: 37029 - DNA, 20 bp, Artificial sequence
  SiRNA target sequence
attaatgccaatataaaata

SEQ ID NO: 37030 - DNA, 20 bp, Artificial sequence
  SiRNA target sequence
ttaatgccaatataaaatac

SEQ ID NO: 37031 - DNA, 20 bp, Artificial sequence
  SiRNA target sequence
taatgccaatataaaataca

SEQ ID NO: 37032 - DNA, 20 bp, Artificial sequence
  SiRNA target sequence
aatgccaatataaaatacaa

SEQ ID NO: 37033 - DNA, 20 bp, Artificial sequence
  SiRNA target sequence
atgccaatataaaatacaac

SEQ ID NO: 37034 - DNA, 20 bp, Artificial sequence
  SiRNA target sequence
tgccaatataaaatacaaca

SEQ ID NO: 37035 - DNA, 20 bp, Artificial sequence
  SiRNA target sequence
gccaatataaaatacaacat

SEQ ID NO: 37036 - DNA, 20 bp, Artificial sequence
  SiRNA target sequence
ccaatataaaatacaacatc

SEQ ID NO: 37037 - DNA, 20 bp, Artificial sequence
  SiRNA target sequence
caatataaaatacaacatcc

SEQ ID NO: 37038 - DNA, 20 bp, Artificial sequence
  SiRNA target sequence
aatataaaatacaacatccc

SEQ ID NO: 37039 - DNA, 20 bp, Artificial sequence
  SiRNA target sequence
atataaaatacaacatccct

SEQ ID NO: 37040 - DNA, 20 bp, Artificial sequence
  SiRNA target sequence
tataaaatacaacatccctg

SEQ ID NO: 37041 - DNA, 20 bp, Artificial sequence
  SiRNA target sequence
ataaaatacaacatccctgg

SEQ ID NO: 37042 - DNA, 20 bp, Artificial sequence
  SiRNA target sequence
taaaatacaacatccctggc

SEQ ID NO: 37043 - DNA, 20 bp, Artificial sequence
  SiRNA target sequence
aaaatacaacatccctggca

SEQ ID NO: 37044 - DNA, 20 bp, Artificial sequence
  SiRNA target sequence
aaatacaacatccctggcac

SEQ ID NO: 37045 - DNA, 20 bp, Artificial sequence
  SiRNA target sequence
aatacaacatccctggcact

SEQ ID NO: 37046 - DNA, 20 bp, Artificial sequence
  SiRNA target sequence
atacaacatccctggcactt

SEQ ID NO: 37047 - DNA, 20 bp, Artificial sequence
  SiRNA target sequence
tacaacatccctggcactta

SEQ ID NO: 37048 - DNA, 20 bp, Artificial sequence
  SiRNA target sequence
acaacatccctggcacttag

SEQ ID NO: 37049 - DNA, 20 bp, Artificial sequence
  SiRNA target sequence
caacatccctggcacttagt

SEQ ID NO: 37050 - DNA, 20 bp, Artificial sequence
  SiRNA target sequence
aacatccctggcacttagtt

SEQ ID NO: 37051 - DNA, 20 bp, Artificial sequence
  SiRNA target sequence
acatccctggcacttagttt

SEQ ID NO: 37052 - DNA, 20 bp, Artificial sequence
  SiRNA target sequence
catccctggcacttagtttt

SEQ ID NO: 37053 - DNA, 20 bp, Artificial sequence
  SiRNA target sequence
atccctggcacttagttttg

SEQ ID NO: 37054 - DNA, 20 bp, Artificial sequence
  SiRNA target sequence
tccctggcacttagttttgc

SEQ ID NO: 37055 - DNA, 20 bp, Artificial sequence
  SiRNA target sequence
ccctggcacttagttttgct

SEQ ID NO: 37056 - DNA, 20 bp, Artificial sequence
  SiRNA target sequence
cctggcacttagttttgctg

SEQ ID NO: 37057 - DNA, 20 bp, Artificial sequence
  SiRNA target sequence
ctggcacttagttttgctgt

SEQ ID NO: 37058 - DNA, 20 bp, Artificial sequence
  SiRNA target sequence
tggcacttagttttgctgtt

SEQ ID NO: 37059 - DNA, 20 bp, Artificial sequence
  SiRNA target sequence
ggcacttagttttgctgtta

SEQ ID NO: 37060 - DNA, 20 bp, Artificial sequence
  SiRNA target sequence
gcacttagttttgctgttaa

SEQ ID NO: 37061 - DNA, 20 bp, Artificial sequence
  SiRNA target sequence
cacttagttttgctgttaat

SEQ ID NO: 37062 - DNA, 20 bp, Artificial sequence
  SiRNA target sequence
acttagttttgctgttaata

SEQ ID NO: 37063 - DNA, 20 bp, Artificial sequence
  SiRNA target sequence
cttagttttgctgttaatat

SEQ ID NO: 37064 - DNA, 20 bp, Artificial sequence
  SiRNA target sequence
ttagttttgctgttaatatt

SEQ ID NO: 37065 - DNA, 20 bp, Artificial sequence
  SiRNA target sequence
tagttttgctgttaatattc

SEQ ID NO: 37066 - DNA, 20 bp, Artificial sequence
  SiRNA target sequence
agttttgctgttaatattcc

SEQ ID NO: 37067 - DNA, 20 bp, Artificial sequence
  SiRNA target sequence
gttttgctgttaatattcca

SEQ ID NO: 37068 - DNA, 20 bp, Artificial sequence
  SiRNA target sequence
ttttgctgttaatattccat

SEQ ID NO: 37069 - DNA, 20 bp, Artificial sequence
  SiRNA target sequence
tttgctgttaatattccata

SEQ ID NO: 37070 - DNA, 20 bp, Artificial sequence
  SiRNA target sequence
ttgctgttaatattccatag

SEQ ID NO: 37071 - DNA, 20 bp, Artificial sequence
  SiRNA target sequence
tgctgttaatattccatagt

SEQ ID NO: 37072 - DNA, 20 bp, Artificial sequence
  SiRNA target sequence
gctgttaatattccatagtt

SEQ ID NO: 37073 - DNA, 20 bp, Artificial sequence
  SiRNA target sequence
ctgttaatattccatagttt

SEQ ID NO: 37074 - DNA, 20 bp, Artificial sequence
  SiRNA target sequence
tgttaatattccatagtttc

SEQ ID NO: 37075 - DNA, 20 bp, Artificial sequence
  SiRNA target sequence
gttaatattccatagtttcc

SEQ ID NO: 37076 - DNA, 20 bp, Artificial sequence
  SiRNA target sequence
ttaatattccatagtttcct

SEQ ID NO: 37077 - DNA, 20 bp, Artificial sequence
  SiRNA target sequence
taatattccatagtttccta

SEQ ID NO: 37078 - DNA, 20 bp, Artificial sequence
  SiRNA target sequence
aatattccatagtttcctaa

SEQ ID NO: 37079 - DNA, 20 bp, Artificial sequence
  SiRNA target sequence
atattccatagtttcctaat

SEQ ID NO: 37080 - DNA, 20 bp, Artificial sequence
  SiRNA target sequence
tattccatagtttcctaatg

SEQ ID NO: 37081 - DNA, 20 bp, Artificial sequence
  SiRNA target sequence
attccatagtttcctaatgt

SEQ ID NO: 37082 - DNA, 20 bp, Artificial sequence
  SiRNA target sequence
ttccatagtttcctaatgtt

SEQ ID NO: 37083 - DNA, 20 bp, Artificial sequence
  SiRNA target sequence
tccatagtttcctaatgtta

SEQ ID NO: 37084 - DNA, 20 bp, Artificial sequence
  SiRNA target sequence
ccatagtttcctaatgttat

SEQ ID NO: 37085 - DNA, 20 bp, Artificial sequence
  SiRNA target sequence
catagtttcctaatgttata

SEQ ID NO: 37086 - DNA, 20 bp, Artificial sequence
  SiRNA target sequence
atagtttcctaatgttataa

SEQ ID NO: 37087 - DNA, 20 bp, Artificial sequence
  SiRNA target sequence
tagtttcctaatgttataac

SEQ ID NO: 37088 - DNA, 20 bp, Artificial sequence
  SiRNA target sequence
agtttcctaatgttataact

SEQ ID NO: 37089 - DNA, 20 bp, Artificial sequence
  SiRNA target sequence
gtttcctaatgttataacta

SEQ ID NO: 37090 - DNA, 20 bp, Artificial sequence
  SiRNA target sequence
tttcctaatgttataactat

SEQ ID NO: 37091 - DNA, 20 bp, Artificial sequence
  SiRNA target sequence
ttcctaatgttataactata

SEQ ID NO: 37092 - DNA, 20 bp, Artificial sequence
  SiRNA target sequence
tcctaatgttataactataa

SEQ ID NO: 37093 - DNA, 20 bp, Artificial sequence
  SiRNA target sequence
cctaatgttataactataaa

SEQ ID NO: 37094 - DNA, 20 bp, Artificial sequence
  SiRNA target sequence
ctaatgttataactataaaa

SEQ ID NO: 37095 - DNA, 20 bp, Artificial sequence
  SiRNA target sequence
taatgttataactataaaac

SEQ ID NO: 37096 - DNA, 20 bp, Artificial sequence
  SiRNA target sequence
aatgttataactataaaaca

SEQ ID NO: 37097 - DNA, 20 bp, Artificial sequence
  SiRNA target sequence
atgttataactataaaacac

SEQ ID NO: 37098 - DNA, 20 bp, Artificial sequence
  SiRNA target sequence
tgttataactataaaacact

SEQ ID NO: 37099 - DNA, 20 bp, Artificial sequence
  SiRNA target sequence
gttataactataaaacactg

SEQ ID NO: 37100 - DNA, 20 bp, Artificial sequence
  SiRNA target sequence
ttataactataaaacactgt

SEQ ID NO: 37101 - DNA, 20 bp, Artificial sequence
  SiRNA target sequence
tataactataaaacactgta

SEQ ID NO: 37102 - DNA, 20 bp, Artificial sequence
  SiRNA target sequence
ataactataaaacactgtaa

SEQ ID NO: 37103 - DNA, 20 bp, Artificial sequence
  SiRNA target sequence
taactataaaacactgtaaa

SEQ ID NO: 37104 - DNA, 20 bp, Artificial sequence
  SiRNA target sequence
aactataaaacactgtaaag

SEQ ID NO: 37105 - DNA, 20 bp, Artificial sequence
  SiRNA target sequence
actataaaacactgtaaagc

SEQ ID NO: 37106 - DNA, 20 bp, Artificial sequence
  SiRNA target sequence
ctataaaacactgtaaagca

SEQ ID NO: 37107 - DNA, 20 bp, Artificial sequence
  SiRNA target sequence
tataaaacactgtaaagcaa

SEQ ID NO: 37108 - DNA, 20 bp, Artificial sequence
  SiRNA target sequence
ataaaacactgtaaagcaaa

SEQ ID NO: 37109 - DNA, 20 bp, Artificial sequence
  SiRNA target sequence
taaaacactgtaaagcaaaa

SEQ ID NO: 37110 - DNA, 20 bp, Artificial sequence
  SiRNA target sequence
aaaacactgtaaagcaaaaa

SEQ ID NO: 37111 - DNA, 20 bp, Artificial sequence
  SiRNA target sequence
aaacactgtaaagcaaaaat

SEQ ID NO: 37112 - DNA, 20 bp, Artificial sequence
  SiRNA target sequence
aacactgtaaagcaaaaatt

SEQ ID NO: 37113 - DNA, 20 bp, Artificial sequence
  SiRNA target sequence
acactgtaaagcaaaaatta

SEQ ID NO: 37114 - DNA, 20 bp, Artificial sequence
  SiRNA target sequence
cactgtaaagcaaaaattat

SEQ ID NO: 37115 - DNA, 20 bp, Artificial sequence
  SiRNA target sequence
actgtaaagcaaaaattatc

SEQ ID NO: 37116 - DNA, 20 bp, Artificial sequence
  SiRNA target sequence
ctgtaaagcaaaaattatct

SEQ ID NO: 37117 - DNA, 20 bp, Artificial sequence
  SiRNA target sequence
tgtaaagcaaaaattatctt

SEQ ID NO: 37118 - DNA, 20 bp, Artificial sequence
  SiRNA target sequence
gtaaagcaaaaattatctta

SEQ ID NO: 37119 - DNA, 20 bp, Artificial sequence
  SiRNA target sequence
taaagcaaaaattatcttat

SEQ ID NO: 37120 - DNA, 20 bp, Artificial sequence
  SiRNA target sequence
aaagcaaaaattatcttatt

SEQ ID NO: 37121 - DNA, 20 bp, Artificial sequence
  SiRNA target sequence
aagcaaaaattatcttattt

SEQ ID NO: 37122 - DNA, 20 bp, Artificial sequence
  SiRNA target sequence
agcaaaaattatcttattta

SEQ ID NO: 37123 - DNA, 20 bp, Artificial sequence
  SiRNA target sequence
gcaaaaattatcttatttac

SEQ ID NO: 37124 - DNA, 20 bp, Artificial sequence
  SiRNA target sequence
caaaaattatcttatttaca

SEQ ID NO: 37125 - DNA, 20 bp, Artificial sequence
  SiRNA target sequence
aaaaattatcttatttacaa

SEQ ID NO: 37126 - DNA, 20 bp, Artificial sequence
  SiRNA target sequence
aaaattatcttatttacaag

SEQ ID NO: 37127 - DNA, 20 bp, Artificial sequence
  SiRNA target sequence
aaattatcttatttacaagg

SEQ ID NO: 37128 - DNA, 20 bp, Artificial sequence
  SiRNA target sequence
aattatcttatttacaaggt

SEQ ID NO: 37129 - DNA, 20 bp, Artificial sequence
  SiRNA target sequence
attatcttatttacaaggta

SEQ ID NO: 37130 - DNA, 20 bp, Artificial sequence
  SiRNA target sequence
ttatcttatttacaaggtat

SEQ ID NO: 37131 - DNA, 20 bp, Artificial sequence
  SiRNA target sequence
tatcttatttacaaggtata

SEQ ID NO: 37132 - DNA, 20 bp, Artificial sequence
  SiRNA target sequence
atcttatttacaaggtataa

SEQ ID NO: 37133 - DNA, 20 bp, Artificial sequence
  SiRNA target sequence
tcttatttacaaggtataaa

SEQ ID NO: 37134 - DNA, 20 bp, Artificial sequence
  SiRNA target sequence
cttatttacaaggtataaaa

SEQ ID NO: 37135 - DNA, 20 bp, Artificial sequence
  SiRNA target sequence
ttatttacaaggtataaaaa

SEQ ID NO: 37136 - DNA, 20 bp, Artificial sequence
  SiRNA target sequence
tatttacaaggtataaaaaa

SEQ ID NO: 37137 - DNA, 20 bp, Artificial sequence
  SiRNA target sequence
atttacaaggtataaaaaac

SEQ ID NO: 37138 - DNA, 20 bp, Artificial sequence
  SiRNA target sequence
tttacaaggtataaaaaact

SEQ ID NO: 37139 - DNA, 20 bp, Artificial sequence
  SiRNA target sequence
ttacaaggtataaaaaacta

SEQ ID NO: 37140 - DNA, 20 bp, Artificial sequence
  SiRNA target sequence
tacaaggtataaaaaactaa

SEQ ID NO: 37141 - DNA, 20 bp, Artificial sequence
  SiRNA target sequence
acaaggtataaaaaactaag

SEQ ID NO: 37142 - DNA, 20 bp, Artificial sequence
  SiRNA target sequence
caaggtataaaaaactaaga

SEQ ID NO: 37143 - DNA, 20 bp, Artificial sequence
  SiRNA target sequence
aaggtataaaaaactaagag

SEQ ID NO: 37144 - DNA, 20 bp, Artificial sequence
  SiRNA target sequence
aggtataaaaaactaagaga

SEQ ID NO: 37145 - DNA, 20 bp, Artificial sequence
  SiRNA target sequence
ggtataaaaaactaagagat

SEQ ID NO: 37146 - DNA, 20 bp, Artificial sequence
  SiRNA target sequence
gtataaaaaactaagagatc

SEQ ID NO: 37147 - DNA, 20 bp, Artificial sequence
  SiRNA target sequence
tataaaaaactaagagatct

SEQ ID NO: 37148 - DNA, 20 bp, Artificial sequence
  SiRNA target sequence
ataaaaaactaagagatctc

SEQ ID NO: 37149 - DNA, 20 bp, Artificial sequence
  SiRNA target sequence
taaaaaactaagagatctcc

SEQ ID NO: 37150 - DNA, 20 bp, Artificial sequence
  SiRNA target sequence
aaaaaactaagagatctcca

SEQ ID NO: 37151 - DNA, 20 bp, Artificial sequence
  SiRNA target sequence
aaaaactaagagatctccag

SEQ ID NO: 37152 - DNA, 20 bp, Artificial sequence
  SiRNA target sequence
aaaactaagagatctccaga

SEQ ID NO: 37153 - DNA, 20 bp, Artificial sequence
  SiRNA target sequence
aaactaagagatctccagat

SEQ ID NO: 37154 - DNA, 20 bp, Artificial sequence
  SiRNA target sequence
aactaagagatctccagatt

SEQ ID NO: 37155 - DNA, 20 bp, Artificial sequence
  SiRNA target sequence
actaagagatctccagattc

SEQ ID NO: 37156 - DNA, 20 bp, Artificial sequence
  SiRNA target sequence
ctaagagatctccagattct

SEQ ID NO: 37157 - DNA, 20 bp, Artificial sequence
  SiRNA target sequence
taagagatctccagattctg

SEQ ID NO: 37158 - DNA, 20 bp, Artificial sequence
  SiRNA target sequence
aagagatctccagattctgt

SEQ ID NO: 37159 - DNA, 20 bp, Artificial sequence
  SiRNA target sequence
agagatctccagattctgtt

SEQ ID NO: 37160 - DNA, 20 bp, Artificial sequence
  SiRNA target sequence
gagatctccagattctgtta

SEQ ID NO: 37161 - DNA, 20 bp, Artificial sequence
  SiRNA target sequence
agatctccagattctgttac

SEQ ID NO: 37162 - DNA, 20 bp, Artificial sequence
  SiRNA target sequence
gatctccagattctgttaca

SEQ ID NO: 37163 - DNA, 20 bp, Artificial sequence
  SiRNA target sequence
atctccagattctgttacat

SEQ ID NO: 37164 - DNA, 20 bp, Artificial sequence
  SiRNA target sequence
tctccagattctgttacatt

SEQ ID NO: 37165 - DNA, 20 bp, Artificial sequence
  SiRNA target sequence
ctccagattctgttacattc

SEQ ID NO: 37166 - DNA, 20 bp, Artificial sequence
  SiRNA target sequence
tccagattctgttacattcc

SEQ ID NO: 37167 - DNA, 20 bp, Artificial sequence
  SiRNA target sequence
ccagattctgttacattccg

SEQ ID NO: 37168 - DNA, 20 bp, Artificial sequence
  SiRNA target sequence
cagattctgttacattccga

SEQ ID NO: 37169 - DNA, 20 bp, Artificial sequence
  SiRNA target sequence
agattctgttacattccgat

SEQ ID NO: 37170 - DNA, 20 bp, Artificial sequence
  SiRNA target sequence
gattctgttacattccgatt

SEQ ID NO: 37171 - DNA, 20 bp, Artificial sequence
  SiRNA target sequence
attctgttacattccgattc

SEQ ID NO: 37172 - DNA, 20 bp, Artificial sequence
  SiRNA target sequence
ttctgttacattccgattct

SEQ ID NO: 37173 - DNA, 20 bp, Artificial sequence
  SiRNA target sequence
tctgttacattccgattcta

SEQ ID NO: 37174 - DNA, 20 bp, Artificial sequence
  SiRNA target sequence
ctgttacattccgattctac

SEQ ID NO: 37175 - DNA, 20 bp, Artificial sequence
  SiRNA target sequence
tgttacattccgattctact

SEQ ID NO: 37176 - DNA, 20 bp, Artificial sequence
  SiRNA target sequence
gttacattccgattctactt

SEQ ID NO: 37177 - DNA, 20 bp, Artificial sequence
  SiRNA target sequence
ttacattccgattctacttc

SEQ ID NO: 37178 - DNA, 20 bp, Artificial sequence
  SiRNA target sequence
tacattccgattctacttca

SEQ ID NO: 37179 - DNA, 20 bp, Artificial sequence
  SiRNA target sequence
acattccgattctacttcag

SEQ ID NO: 37180 - DNA, 20 bp, Artificial sequence
  SiRNA target sequence
cattccgattctacttcaga

SEQ ID NO: 37181 - DNA, 20 bp, Artificial sequence
  SiRNA target sequence
attccgattctacttcagaa

SEQ ID NO: 37182 - DNA, 20 bp, Artificial sequence
  SiRNA target sequence
ttccgattctacttcagaaa

SEQ ID NO: 37183 - DNA, 20 bp, Artificial sequence
  SiRNA target sequence
tccgattctacttcagaaac

SEQ ID NO: 37184 - DNA, 20 bp, Artificial sequence
  SiRNA target sequence
ccgattctacttcagaaaca

SEQ ID NO: 37185 - DNA, 20 bp, Artificial sequence
  SiRNA target sequence
cgattctacttcagaaacat

SEQ ID NO: 37186 - DNA, 20 bp, Artificial sequence
  SiRNA target sequence
gattctacttcagaaacata

SEQ ID NO: 37187 - DNA, 20 bp, Artificial sequence
  SiRNA target sequence
attctacttcagaaacatat

SEQ ID NO: 37188 - DNA, 20 bp, Artificial sequence
  SiRNA target sequence
ttctacttcagaaacatatt

SEQ ID NO: 37189 - DNA, 20 bp, Artificial sequence
  SiRNA target sequence
tctacttcagaaacatattt

SEQ ID NO: 37190 - DNA, 20 bp, Artificial sequence
  SiRNA target sequence
ctacttcagaaacatatttt

SEQ ID NO: 37191 - DNA, 20 bp, Artificial sequence
  SiRNA target sequence
tacttcagaaacatattttt

SEQ ID NO: 37192 - DNA, 20 bp, Artificial sequence
  SiRNA target sequence
acttcagaaacatatttttc

SEQ ID NO: 37193 - DNA, 20 bp, Artificial sequence
  SiRNA target sequence
cttcagaaacatatttttca

SEQ ID NO: 37194 - DNA, 20 bp, Artificial sequence
  SiRNA target sequence
ttcagaaacatatttttcat

SEQ ID NO: 37195 - DNA, 20 bp, Artificial sequence
  SiRNA target sequence
tcagaaacatatttttcata

SEQ ID NO: 37196 - DNA, 20 bp, Artificial sequence
  SiRNA target sequence
cagaaacatatttttcatat

SEQ ID NO: 37197 - DNA, 20 bp, Artificial sequence
  SiRNA target sequence
agaaacatatttttcatatt

SEQ ID NO: 37198 - DNA, 20 bp, Artificial sequence
  SiRNA target sequence
gaaacatatttttcatattt

SEQ ID NO: 37199 - DNA, 20 bp, Artificial sequence
  SiRNA target sequence
aaacatatttttcatattta

SEQ ID NO: 37200 - DNA, 20 bp, Artificial sequence
  SiRNA target sequence
aacatatttttcatatttaa

SEQ ID NO: 37201 - DNA, 20 bp, Artificial sequence
  SiRNA target sequence
acatatttttcatatttaag

SEQ ID NO: 37202 - DNA, 20 bp, Artificial sequence
  SiRNA target sequence
catatttttcatatttaagc

SEQ ID NO: 37203 - DNA, 20 bp, Artificial sequence
  SiRNA target sequence
atatttttcatatttaagcg

SEQ ID NO: 37204 - DNA, 20 bp, Artificial sequence
  SiRNA target sequence
tatttttcatatttaagcga

SEQ ID NO: 37205 - DNA, 20 bp, Artificial sequence
  SiRNA target sequence
atttttcatatttaagcgat

SEQ ID NO: 37206 - DNA, 20 bp, Artificial sequence
  SiRNA target sequence
tttttcatatttaagcgatt

SEQ ID NO: 37207 - DNA, 20 bp, Artificial sequence
  SiRNA target sequence
ttttcatatttaagcgattc

SEQ ID NO: 37208 - DNA, 20 bp, Artificial sequence
  SiRNA target sequence
tttcatatttaagcgattct

SEQ ID NO: 37209 - DNA, 20 bp, Artificial sequence
  SiRNA target sequence
ttcatatttaagcgattctt

SEQ ID NO: 37210 - DNA, 20 bp, Artificial sequence
  SiRNA target sequence
tcatatttaagcgattcttc

SEQ ID NO: 37211 - DNA, 20 bp, Artificial sequence
  SiRNA target sequence
catatttaagcgattcttct

SEQ ID NO: 37212 - DNA, 20 bp, Artificial sequence
  SiRNA target sequence
atatttaagcgattcttctt

SEQ ID NO: 37213 - DNA, 20 bp, Artificial sequence
  SiRNA target sequence
tatttaagcgattcttcttc

SEQ ID NO: 37214 - DNA, 20 bp, Artificial sequence
  SiRNA target sequence
atttaagcgattcttcttct

SEQ ID NO: 37215 - DNA, 20 bp, Artificial sequence
  SiRNA target sequence
tttaagcgattcttcttctt

SEQ ID NO: 37216 - DNA, 20 bp, Artificial sequence
  SiRNA target sequence
ttaagcgattcttcttcttc

SEQ ID NO: 37217 - DNA, 20 bp, Artificial sequence
  SiRNA target sequence
taagcgattcttcttcttct

SEQ ID NO: 37218 - DNA, 20 bp, Artificial sequence
  SiRNA target sequence
aagcgattcttcttcttctg

SEQ ID NO: 37219 - DNA, 20 bp, Artificial sequence
  SiRNA target sequence
agcgattcttcttcttctgt

SEQ ID NO: 37220 - DNA, 20 bp, Artificial sequence
  SiRNA target sequence
gcgattcttcttcttctgtt

SEQ ID NO: 37221 - DNA, 20 bp, Artificial sequence
  SiRNA target sequence
cgattcttcttcttctgttt

SEQ ID NO: 37222 - DNA, 20 bp, Artificial sequence
  SiRNA target sequence
gattcttcttcttctgtttt

SEQ ID NO: 37223 - DNA, 20 bp, Artificial sequence
  SiRNA target sequence
attcttcttcttctgtttta

SEQ ID NO: 37224 - DNA, 20 bp, Artificial sequence
  SiRNA target sequence
ttcttcttcttctgttttat

SEQ ID NO: 37225 - DNA, 20 bp, Artificial sequence
  SiRNA target sequence
tcttcttcttctgttttata

SEQ ID NO: 37226 - DNA, 20 bp, Artificial sequence
  SiRNA target sequence
cttcttcttctgttttatat

SEQ ID NO: 37227 - DNA, 20 bp, Artificial sequence
  SiRNA target sequence
ttcttcttctgttttatatg

SEQ ID NO: 37228 - DNA, 20 bp, Artificial sequence
  SiRNA target sequence
tcttcttctgttttatatgc

SEQ ID NO: 37229 - DNA, 20 bp, Artificial sequence
  SiRNA target sequence
cttcttctgttttatatgct

SEQ ID NO: 37230 - DNA, 20 bp, Artificial sequence
  SiRNA target sequence
ttcttctgttttatatgcta

SEQ ID NO: 37231 - DNA, 20 bp, Artificial sequence
  SiRNA target sequence
tcttctgttttatatgctag

SEQ ID NO: 37232 - DNA, 20 bp, Artificial sequence
  SiRNA target sequence
cttctgttttatatgctagt

SEQ ID NO: 37233 - DNA, 20 bp, Artificial sequence
  SiRNA target sequence
ttctgttttatatgctagta

SEQ ID NO: 37234 - DNA, 20 bp, Artificial sequence
  SiRNA target sequence
tctgttttatatgctagtat

SEQ ID NO: 37235 - DNA, 20 bp, Artificial sequence
  SiRNA target sequence
ctgttttatatgctagtata

SEQ ID NO: 37236 - DNA, 20 bp, Artificial sequence
  SiRNA target sequence
tgttttatatgctagtatag

SEQ ID NO: 37237 - DNA, 20 bp, Artificial sequence
  SiRNA target sequence
gttttatatgctagtatagt

SEQ ID NO: 37238 - DNA, 20 bp, Artificial sequence
  SiRNA target sequence
ttttatatgctagtatagtc

SEQ ID NO: 37239 - DNA, 20 bp, Artificial sequence
  SiRNA target sequence
tttatatgctagtatagtct

SEQ ID NO: 37240 - DNA, 20 bp, Artificial sequence
  SiRNA target sequence
ttatatgctagtatagtctc

SEQ ID NO: 37241 - DNA, 20 bp, Artificial sequence
  SiRNA target sequence
tatatgctagtatagtctca

SEQ ID NO: 37242 - DNA, 20 bp, Artificial sequence
  SiRNA target sequence
atatgctagtatagtctcat

SEQ ID NO: 37243 - DNA, 20 bp, Artificial sequence
  SiRNA target sequence
tatgctagtatagtctcatg

SEQ ID NO: 37244 - DNA, 20 bp, Artificial sequence
  SiRNA target sequence
atgctagtatagtctcatga

SEQ ID NO: 37245 - DNA, 20 bp, Artificial sequence
  SiRNA target sequence
tgctagtatagtctcatgat

SEQ ID NO: 37246 - DNA, 20 bp, Artificial sequence
  SiRNA target sequence
gctagtatagtctcatgatt

SEQ ID NO: 37247 - DNA, 20 bp, Artificial sequence
  SiRNA target sequence
ctagtatagtctcatgatta

SEQ ID NO: 37248 - DNA, 20 bp, Artificial sequence
  SiRNA target sequence
tagtatagtctcatgattaa

SEQ ID NO: 37249 - DNA, 20 bp, Artificial sequence
  SiRNA target sequence
agtatagtctcatgattaat

SEQ ID NO: 37250 - DNA, 20 bp, Artificial sequence
  SiRNA target sequence
gtatagtctcatgattaatt

SEQ ID NO: 37251 - DNA, 20 bp, Artificial sequence
  SiRNA target sequence
tatagtctcatgattaatta

SEQ ID NO: 37252 - DNA, 20 bp, Artificial sequence
  SiRNA target sequence
atagtctcatgattaattaa

SEQ ID NO: 37253 - DNA, 20 bp, Artificial sequence
  SiRNA target sequence
tagtctcatgattaattaaa

SEQ ID NO: 37254 - DNA, 20 bp, Artificial sequence
  SiRNA target sequence
agtctcatgattaattaaag

SEQ ID NO: 37255 - DNA, 20 bp, Artificial sequence
  SiRNA target sequence
gtctcatgattaattaaaga

SEQ ID NO: 37256 - DNA, 20 bp, Artificial sequence
  SiRNA target sequence
tctcatgattaattaaagaa

SEQ ID NO: 37257 - DNA, 20 bp, Artificial sequence
  SiRNA target sequence
ctcatgattaattaaagaat

SEQ ID NO: 37258 - DNA, 20 bp, Artificial sequence
  SiRNA target sequence
tcatgattaattaaagaatc

SEQ ID NO: 37259 - DNA, 20 bp, Artificial sequence
  SiRNA target sequence
catgattaattaaagaatca

SEQ ID NO: 37260 - DNA, 20 bp, Artificial sequence
  SiRNA target sequence
atgattaattaaagaatcat

SEQ ID NO: 37261 - DNA, 20 bp, Artificial sequence
  SiRNA target sequence
tgattaattaaagaatcatg

SEQ ID NO: 37262 - DNA, 20 bp, Artificial sequence
  SiRNA target sequence
gattaattaaagaatcatgt

SEQ ID NO: 37263 - DNA, 20 bp, Artificial sequence
  SiRNA target sequence
attaattaaagaatcatgta

SEQ ID NO: 37264 - DNA, 20 bp, Artificial sequence
  SiRNA target sequence
ttaattaaagaatcatgtaa

SEQ ID NO: 37265 - DNA, 20 bp, Artificial sequence
  SiRNA target sequence
taattaaagaatcatgtaag

SEQ ID NO: 37266 - DNA, 20 bp, Artificial sequence
  SiRNA target sequence
aattaaagaatcatgtaagt

SEQ ID NO: 37267 - DNA, 20 bp, Artificial sequence
  SiRNA target sequence
attaaagaatcatgtaagtg

SEQ ID NO: 37268 - DNA, 20 bp, Artificial sequence
  SiRNA target sequence
ttaaagaatcatgtaagtga

SEQ ID NO: 37269 - DNA, 20 bp, Artificial sequence
  SiRNA target sequence
taaagaatcatgtaagtgat

SEQ ID NO: 37270 - DNA, 20 bp, Artificial sequence
  SiRNA target sequence
aaagaatcatgtaagtgatt

SEQ ID NO: 37271 - DNA, 20 bp, Artificial sequence
  SiRNA target sequence
aagaatcatgtaagtgattt

SEQ ID NO: 37272 - DNA, 20 bp, Artificial sequence
  SiRNA target sequence
agaatcatgtaagtgatttg

SEQ ID NO: 37273 - DNA, 20 bp, Artificial sequence
  SiRNA target sequence
gaatcatgtaagtgatttga

SEQ ID NO: 37274 - DNA, 20 bp, Artificial sequence
  SiRNA target sequence
aatcatgtaagtgatttgag

SEQ ID NO: 37275 - DNA, 20 bp, Artificial sequence
  SiRNA target sequence
atcatgtaagtgatttgagc

SEQ ID NO: 37276 - DNA, 20 bp, Artificial sequence
  SiRNA target sequence
tcatgtaagtgatttgagca

SEQ ID NO: 37277 - DNA, 20 bp, Artificial sequence
  SiRNA target sequence
catgtaagtgatttgagcat

SEQ ID NO: 37278 - DNA, 20 bp, Artificial sequence
  SiRNA target sequence
atgtaagtgatttgagcatc

SEQ ID NO: 37279 - DNA, 20 bp, Artificial sequence
  SiRNA target sequence
tgtaagtgatttgagcatct

SEQ ID NO: 37280 - DNA, 20 bp, Artificial sequence
  SiRNA target sequence
gtaagtgatttgagcatctt

SEQ ID NO: 37281 - DNA, 20 bp, Artificial sequence
  SiRNA target sequence
taagtgatttgagcatcttt

SEQ ID NO: 37282 - DNA, 20 bp, Artificial sequence
  SiRNA target sequence
aagtgatttgagcatctttg

SEQ ID NO: 37283 - DNA, 20 bp, Artificial sequence
  SiRNA target sequence
agtgatttgagcatctttgt

SEQ ID NO: 37284 - DNA, 20 bp, Artificial sequence
  SiRNA target sequence
gtgatttgagcatctttgtt

SEQ ID NO: 37285 - DNA, 20 bp, Artificial sequence
  SiRNA target sequence
tgatttgagcatctttgttg

SEQ ID NO: 37286 - DNA, 20 bp, Artificial sequence
  SiRNA target sequence
gatttgagcatctttgttgt

SEQ ID NO: 37287 - DNA, 20 bp, Artificial sequence
  SiRNA target sequence
atttgagcatctttgttgtg

SEQ ID NO: 37288 - DNA, 20 bp, Artificial sequence
  SiRNA target sequence
tttgagcatctttgttgtgc

SEQ ID NO: 37289 - DNA, 20 bp, Artificial sequence
  SiRNA target sequence
ttgagcatctttgttgtgcg

SEQ ID NO: 37290 - DNA, 20 bp, Artificial sequence
  SiRNA target sequence
tgagcatctttgttgtgcgc

SEQ ID NO: 37291 - DNA, 20 bp, Artificial sequence
  SiRNA target sequence
gagcatctttgttgtgcgca

SEQ ID NO: 37292 - DNA, 20 bp, Artificial sequence
  SiRNA target sequence
agcatctttgttgtgcgcaa

SEQ ID NO: 37293 - DNA, 20 bp, Artificial sequence
  SiRNA target sequence
gcatctttgttgtgcgcaat

SEQ ID NO: 37294 - DNA, 20 bp, Artificial sequence
  SiRNA target sequence
catctttgttgtgcgcaatt

SEQ ID NO: 37295 - DNA, 20 bp, Artificial sequence
  SiRNA target sequence
atctttgttgtgcgcaatta

SEQ ID NO: 37296 - DNA, 20 bp, Artificial sequence
  SiRNA target sequence
tctttgttgtgcgcaattat

SEQ ID NO: 37297 - DNA, 20 bp, Artificial sequence
  SiRNA target sequence
ctttgttgtgcgcaattata

SEQ ID NO: 37298 - DNA, 20 bp, Artificial sequence
  SiRNA target sequence
tttgttgtgcgcaattatat

SEQ ID NO: 37299 - DNA, 20 bp, Artificial sequence
  SiRNA target sequence
ttgttgtgcgcaattatatt

SEQ ID NO: 37300 - DNA, 20 bp, Artificial sequence
  SiRNA target sequence
tgttgtgcgcaattatattc

SEQ ID NO: 37301 - DNA, 20 bp, Artificial sequence
  SiRNA target sequence
gttgtgcgcaattatattct

SEQ ID NO: 37302 - DNA, 20 bp, Artificial sequence
  SiRNA target sequence
ttgtgcgcaattatattctt

SEQ ID NO: 37303 - DNA, 20 bp, Artificial sequence
  SiRNA target sequence
tgtgcgcaattatattcttt

SEQ ID NO: 37304 - DNA, 20 bp, Artificial sequence
  SiRNA target sequence
gtgcgcaattatattctttt

SEQ ID NO: 37305 - DNA, 20 bp, Artificial sequence
  SiRNA target sequence
tgcgcaattatattcttttc

SEQ ID NO: 37306 - DNA, 20 bp, Artificial sequence
  SiRNA target sequence
gcgcaattatattcttttct

SEQ ID NO: 37307 - DNA, 20 bp, Artificial sequence
  SiRNA target sequence
cgcaattatattcttttctt

SEQ ID NO: 37308 - DNA, 20 bp, Artificial sequence
  SiRNA target sequence
gcaattatattcttttctta

SEQ ID NO: 37309 - DNA, 20 bp, Artificial sequence
  SiRNA target sequence
caattatattcttttcttat

SEQ ID NO: 37310 - DNA, 20 bp, Artificial sequence
  SiRNA target sequence
aattatattcttttcttatt

SEQ ID NO: 37311 - DNA, 20 bp, Artificial sequence
  SiRNA target sequence
attatattcttttcttattc

SEQ ID NO: 37312 - DNA, 20 bp, Artificial sequence
  SiRNA target sequence
ttatattcttttcttattcc

SEQ ID NO: 37313 - DNA, 20 bp, Artificial sequence
  SiRNA target sequence
tatattcttttcttattcct

SEQ ID NO: 37314 - DNA, 20 bp, Artificial sequence
  SiRNA target sequence
atattcttttcttattcctg

SEQ ID NO: 37315 - DNA, 20 bp, Artificial sequence
  SiRNA target sequence
tattcttttcttattcctgt

SEQ ID NO: 37316 - DNA, 20 bp, Artificial sequence
  SiRNA target sequence
attcttttcttattcctgta

SEQ ID NO: 37317 - DNA, 20 bp, Artificial sequence
  SiRNA target sequence
ttcttttcttattcctgtac

SEQ ID NO: 37318 - DNA, 20 bp, Artificial sequence
  SiRNA target sequence
tcttttcttattcctgtacg

SEQ ID NO: 37319 - DNA, 20 bp, Artificial sequence
  SiRNA target sequence
cttttcttattcctgtacgc

SEQ ID NO: 37320 - DNA, 20 bp, Artificial sequence
  SiRNA target sequence
ttttcttattcctgtacgcc

SEQ ID NO: 37321 - DNA, 20 bp, Artificial sequence
  SiRNA target sequence
tttcttattcctgtacgcca

SEQ ID NO: 37322 - DNA, 20 bp, Artificial sequence
  SiRNA target sequence
ttcttattcctgtacgccaa

SEQ ID NO: 37323 - DNA, 20 bp, Artificial sequence
  SiRNA target sequence
tcttattcctgtacgccaat

SEQ ID NO: 37324 - DNA, 20 bp, Artificial sequence
  SiRNA target sequence
cttattcctgtacgccaatg

SEQ ID NO: 37325 - DNA, 20 bp, Artificial sequence
  SiRNA target sequence
ttattcctgtacgccaatga

SEQ ID NO: 37326 - DNA, 20 bp, Artificial sequence
  SiRNA target sequence
tattcctgtacgccaatgaa

SEQ ID NO: 37327 - DNA, 20 bp, Artificial sequence
  SiRNA target sequence
attcctgtacgccaatgaac

SEQ ID NO: 37328 - DNA, 20 bp, Artificial sequence
  SiRNA target sequence
ttcctgtacgccaatgaact

SEQ ID NO: 37329 - DNA, 20 bp, Artificial sequence
  SiRNA target sequence
tcctgtacgccaatgaacta

SEQ ID NO: 37330 - DNA, 20 bp, Artificial sequence
  SiRNA target sequence
cctgtacgccaatgaactat

SEQ ID NO: 37331 - DNA, 20 bp, Artificial sequence
  SiRNA target sequence
ctgtacgccaatgaactatt

SEQ ID NO: 37332 - DNA, 20 bp, Artificial sequence
  SiRNA target sequence
tgtacgccaatgaactattt

SEQ ID NO: 37333 - DNA, 20 bp, Artificial sequence
  SiRNA target sequence
gtacgccaatgaactatttt

SEQ ID NO: 37334 - DNA, 20 bp, Artificial sequence
  SiRNA target sequence
tacgccaatgaactattttc

SEQ ID NO: 37335 - DNA, 20 bp, Artificial sequence
  SiRNA target sequence
acgccaatgaactattttcg

SEQ ID NO: 37336 - DNA, 20 bp, Artificial sequence
  SiRNA target sequence
cgccaatgaactattttcgc

SEQ ID NO: 37337 - DNA, 20 bp, Artificial sequence
  SiRNA target sequence
gccaatgaactattttcgca

SEQ ID NO: 37338 - DNA, 20 bp, Artificial sequence
  SiRNA target sequence
ccaatgaactattttcgcag

SEQ ID NO: 37339 - DNA, 20 bp, Artificial sequence
  SiRNA target sequence
caatgaactattttcgcagt

SEQ ID NO: 37340 - DNA, 20 bp, Artificial sequence
  SiRNA target sequence
aatgaactattttcgcagtt

SEQ ID NO: 37341 - DNA, 20 bp, Artificial sequence
  SiRNA target sequence
atgaactattttcgcagttg

SEQ ID NO: 37342 - DNA, 20 bp, Artificial sequence
  SiRNA target sequence
tgaactattttcgcagttgc

SEQ ID NO: 37343 - DNA, 20 bp, Artificial sequence
  SiRNA target sequence
gaactattttcgcagttgca

SEQ ID NO: 37344 - DNA, 20 bp, Artificial sequence
  SiRNA target sequence
aactattttcgcagttgcaa

SEQ ID NO: 37345 - DNA, 20 bp, Artificial sequence
  SiRNA target sequence
actattttcgcagttgcaag

SEQ ID NO: 37346 - DNA, 20 bp, Artificial sequence
  SiRNA target sequence
ctattttcgcagttgcaagg

SEQ ID NO: 37347 - DNA, 20 bp, Artificial sequence
  SiRNA target sequence
tattttcgcagttgcaagga

SEQ ID NO: 37348 - DNA, 20 bp, Artificial sequence
  SiRNA target sequence
attttcgcagttgcaaggat

SEQ ID NO: 37349 - DNA, 20 bp, Artificial sequence
  SiRNA target sequence
ttttcgcagttgcaaggatg

SEQ ID NO: 37350 - DNA, 20 bp, Artificial sequence
  SiRNA target sequence
tttcgcagttgcaaggatgt

SEQ ID NO: 37351 - DNA, 20 bp, Artificial sequence
  SiRNA target sequence
ttcgcagttgcaaggatgta

SEQ ID NO: 37352 - DNA, 20 bp, Artificial sequence
  SiRNA target sequence
tcgcagttgcaaggatgtaa

SEQ ID NO: 37353 - DNA, 20 bp, Artificial sequence
  SiRNA target sequence
cgcagttgcaaggatgtaaa

SEQ ID NO: 37354 - DNA, 20 bp, Artificial sequence
  SiRNA target sequence
gcagttgcaaggatgtaaac

SEQ ID NO: 37355 - DNA, 20 bp, Artificial sequence
  SiRNA target sequence
cagttgcaaggatgtaaact

SEQ ID NO: 37356 - DNA, 20 bp, Artificial sequence
  SiRNA target sequence
agttgcaaggatgtaaacta

SEQ ID NO: 37357 - DNA, 20 bp, Artificial sequence
  SiRNA target sequence
gttgcaaggatgtaaactaa

SEQ ID NO: 37358 - DNA, 20 bp, Artificial sequence
  SiRNA target sequence
ttgcaaggatgtaaactaat

SEQ ID NO: 37359 - DNA, 20 bp, Artificial sequence
  SiRNA target sequence
tgcaaggatgtaaactaata

SEQ ID NO: 37360 - DNA, 20 bp, Artificial sequence
  SiRNA target sequence
gcaaggatgtaaactaataa

SEQ ID NO: 37361 - DNA, 20 bp, Artificial sequence
  SiRNA target sequence
caaggatgtaaactaataat

SEQ ID NO: 37362 - DNA, 20 bp, Artificial sequence
  SiRNA target sequence
aaggatgtaaactaataatg

SEQ ID NO: 37363 - DNA, 20 bp, Artificial sequence
  SiRNA target sequence
aggatgtaaactaataatgt

SEQ ID NO: 37364 - DNA, 20 bp, Artificial sequence
  SiRNA target sequence
ggatgtaaactaataatgtg

SEQ ID NO: 37365 - DNA, 20 bp, Artificial sequence
  SiRNA target sequence
gatgtaaactaataatgtga

SEQ ID NO: 37366 - DNA, 20 bp, Artificial sequence
  SiRNA target sequence
atgtaaactaataatgtgat

SEQ ID NO: 37367 - DNA, 20 bp, Artificial sequence
  SiRNA target sequence
tgtaaactaataatgtgatt

SEQ ID NO: 37368 - DNA, 20 bp, Artificial sequence
  SiRNA target sequence
gtaaactaataatgtgatta

SEQ ID NO: 37369 - DNA, 20 bp, Artificial sequence
  SiRNA target sequence
taaactaataatgtgattaa

SEQ ID NO: 37370 - DNA, 20 bp, Artificial sequence
  SiRNA target sequence
aaactaataatgtgattaaa

SEQ ID NO: 37371 - DNA, 20 bp, Artificial sequence
  SiRNA target sequence
aactaataatgtgattaaaa

SEQ ID NO: 37372 - DNA, 20 bp, Artificial sequence
  SiRNA target sequence
actaataatgtgattaaaat

SEQ ID NO: 37373 - DNA, 20 bp, Artificial sequence
  SiRNA target sequence
ctaataatgtgattaaaata

SEQ ID NO: 37374 - DNA, 20 bp, Artificial sequence
  SiRNA target sequence
taataatgtgattaaaataa

SEQ ID NO: 37375 - DNA, 20 bp, Artificial sequence
  SiRNA target sequence
aataatgtgattaaaataat

SEQ ID NO: 37376 - DNA, 20 bp, Artificial sequence
  SiRNA target sequence
ataatgtgattaaaataata

SEQ ID NO: 37377 - DNA, 20 bp, Artificial sequence
  SiRNA target sequence
taatgtgattaaaataataa

SEQ ID NO: 37378 - DNA, 20 bp, Artificial sequence
  SiRNA target sequence
aatgtgattaaaataataaa

SEQ ID NO: 37379 - DNA, 20 bp, Artificial sequence
  SiRNA target sequence
atgtgattaaaataataaac

SEQ ID NO: 37380 - DNA, 20 bp, Artificial sequence
  SiRNA target sequence
tgtgattaaaataataaaca

SEQ ID NO: 37381 - DNA, 20 bp, Artificial sequence
  SiRNA target sequence
gtgattaaaataataaacat

SEQ ID NO: 37382 - DNA, 20 bp, Artificial sequence
  SiRNA target sequence
tgattaaaataataaacata

SEQ ID NO: 37383 - DNA, 20 bp, Artificial sequence
  SiRNA target sequence
gattaaaataataaacatat

SEQ ID NO: 37384 - DNA, 20 bp, Artificial sequence
  SiRNA target sequence
attaaaataataaacatatt

SEQ ID NO: 37385 - DNA, 20 bp, Artificial sequence
  SiRNA target sequence
ttaaaataataaacatattt

SEQ ID NO: 37386 - DNA, 20 bp, Artificial sequence
  SiRNA target sequence
taaaataataaacatatttg

SEQ ID NO: 37387 - DNA, 20 bp, Artificial sequence
  SiRNA target sequence
aaaataataaacatatttgt

SEQ ID NO: 37388 - DNA, 20 bp, Artificial sequence
  SiRNA target sequence
aaataataaacatatttgtc

SEQ ID NO: 37389 - DNA, 20 bp, Artificial sequence
  SiRNA target sequence
aataataaacatatttgtca

SEQ ID NO: 37390 - DNA, 20 bp, Artificial sequence
  SiRNA target sequence
ataataaacatatttgtcaa

SEQ ID NO: 37391 - DNA, 20 bp, Artificial sequence
  SiRNA target sequence
taataaacatatttgtcaac

SEQ ID NO: 37392 - DNA, 20 bp, Artificial sequence
  SiRNA target sequence
aataaacatatttgtcaacc

SEQ ID NO: 37393 - DNA, 20 bp, Artificial sequence
  SiRNA target sequence
ataaacatatttgtcaaccc

SEQ ID NO: 37394 - DNA, 20 bp, Artificial sequence
  SiRNA target sequence
taaacatatttgtcaaccct

SEQ ID NO: 37395 - DNA, 20 bp, Artificial sequence
  SiRNA target sequence
aaacatatttgtcaacccta

SEQ ID NO: 37396 - DNA, 20 bp, Artificial sequence
  SiRNA target sequence
aacatatttgtcaaccctaa

SEQ ID NO: 37397 - DNA, 20 bp, Artificial sequence
  SiRNA target sequence
acatatttgtcaaccctaaa

SEQ ID NO: 37398 - DNA, 20 bp, Artificial sequence
  SiRNA target sequence
catatttgtcaaccctaaat

SEQ ID NO: 37399 - DNA, 20 bp, Artificial sequence
  SiRNA target sequence
atatttgtcaaccctaaatt

SEQ ID NO: 37400 - DNA, 20 bp, Artificial sequence
  SiRNA target sequence
tatttgtcaaccctaaattt

SEQ ID NO: 37401 - DNA, 20 bp, Artificial sequence
  SiRNA target sequence
atttgtcaaccctaaatttg

SEQ ID NO: 37402 - DNA, 20 bp, Artificial sequence
  SiRNA target sequence
tttgtcaaccctaaatttgt

SEQ ID NO: 37403 - DNA, 20 bp, Artificial sequence
  SiRNA target sequence
ttgtcaaccctaaatttgta

SEQ ID NO: 37404 - DNA, 20 bp, Artificial sequence
  SiRNA target sequence
tgtcaaccctaaatttgtat

SEQ ID NO: 37405 - DNA, 20 bp, Artificial sequence
  SiRNA target sequence
gtcaaccctaaatttgtata

SEQ ID NO: 37406 - DNA, 20 bp, Artificial sequence
  SiRNA target sequence
tcaaccctaaatttgtataa

SEQ ID NO: 37407 - DNA, 20 bp, Artificial sequence
  SiRNA target sequence
caaccctaaatttgtataaa

SEQ ID NO: 37408 - DNA, 20 bp, Artificial sequence
  SiRNA target sequence
aaccctaaatttgtataaat

SEQ ID NO: 37409 - DNA, 20 bp, Artificial sequence
  SiRNA target sequence
accctaaatttgtataaatt

SEQ ID NO: 37410 - DNA, 20 bp, Artificial sequence
  SiRNA target sequence
ccctaaatttgtataaattg

SEQ ID NO: 37411 - DNA, 20 bp, Artificial sequence
  SiRNA target sequence
cctaaatttgtataaattga

SEQ ID NO: 37412 - DNA, 20 bp, Artificial sequence
  SiRNA target sequence
ctaaatttgtataaattgac

SEQ ID NO: 37413 - DNA, 20 bp, Artificial sequence
  SiRNA target sequence
taaatttgtataaattgacg

SEQ ID NO: 37414 - DNA, 20 bp, Artificial sequence
  SiRNA target sequence
aaatttgtataaattgacga

SEQ ID NO: 37415 - DNA, 20 bp, Artificial sequence
  SiRNA target sequence
aatttgtataaattgacgaa

SEQ ID NO: 37416 - DNA, 20 bp, Artificial sequence
  SiRNA target sequence
atttgtataaattgacgaac

SEQ ID NO: 37417 - DNA, 20 bp, Artificial sequence
  SiRNA target sequence
tttgtataaattgacgaaca

SEQ ID NO: 37418 - DNA, 20 bp, Artificial sequence
  SiRNA target sequence
ttgtataaattgacgaacac

SEQ ID NO: 37419 - DNA, 20 bp, Artificial sequence
  SiRNA target sequence
tgtataaattgacgaacacg

SEQ ID NO: 37420 - DNA, 20 bp, Artificial sequence
  SiRNA target sequence
gtataaattgacgaacacgc

SEQ ID NO: 37421 - DNA, 20 bp, Artificial sequence
  SiRNA target sequence
tataaattgacgaacacgcc

SEQ ID NO: 37422 - DNA, 20 bp, Artificial sequence
  SiRNA target sequence
ataaattgacgaacacgcca

SEQ ID NO: 37423 - DNA, 20 bp, Artificial sequence
  SiRNA target sequence
taaattgacgaacacgccaa

SEQ ID NO: 37424 - DNA, 20 bp, Artificial sequence
  SiRNA target sequence
aaattgacgaacacgccaat

SEQ ID NO: 37425 - DNA, 20 bp, Artificial sequence
  SiRNA target sequence
aattgacgaacacgccaata

SEQ ID NO: 37426 - DNA, 20 bp, Artificial sequence
  SiRNA target sequence
attgacgaacacgccaatat

SEQ ID NO: 37427 - DNA, 20 bp, Artificial sequence
  SiRNA target sequence
ttgacgaacacgccaatata

SEQ ID NO: 37428 - DNA, 20 bp, Artificial sequence
  SiRNA target sequence
tgacgaacacgccaatataa

SEQ ID NO: 37429 - DNA, 20 bp, Artificial sequence
  SiRNA target sequence
gacgaacacgccaatataac

SEQ ID NO: 37430 - DNA, 20 bp, Artificial sequence
  SiRNA target sequence
acgaacacgccaatataact

SEQ ID NO: 37431 - DNA, 20 bp, Artificial sequence
  SiRNA target sequence
cgaacacgccaatataactg

SEQ ID NO: 37432 - DNA, 20 bp, Artificial sequence
  SiRNA target sequence
gaacacgccaatataactgt

SEQ ID NO: 37433 - DNA, 20 bp, Artificial sequence
  SiRNA target sequence
aacacgccaatataactgta

SEQ ID NO: 37434 - DNA, 20 bp, Artificial sequence
  SiRNA target sequence
acacgccaatataactgtaa

SEQ ID NO: 37435 - DNA, 20 bp, Artificial sequence
  SiRNA target sequence
cacgccaatataactgtaaa

SEQ ID NO: 37436 - DNA, 20 bp, Artificial sequence
  SiRNA target sequence
acgccaatataactgtaaaa

SEQ ID NO: 37437 - DNA, 20 bp, Artificial sequence
  SiRNA target sequence
cgccaatataactgtaaaaa

SEQ ID NO: 37438 - DNA, 20 bp, Artificial sequence
  SiRNA target sequence
gccaatataactgtaaaaaa

SEQ ID NO: 37439 - DNA, 20 bp, Artificial sequence
  SiRNA target sequence
ccaatataactgtaaaaaaa

SEQ ID NO: 37440 - DNA, 20 bp, Artificial sequence
  SiRNA target sequence
caatataactgtaaaaaaaa

SEQ ID NO: 37441 - DNA, 20 bp, Artificial sequence
  SiRNA target sequence
aatataactgtaaaaaaaat

SEQ ID NO: 37442 - DNA, 20 bp, Artificial sequence
  SiRNA target sequence
atataactgtaaaaaaaata

SEQ ID NO: 37443 - DNA, 20 bp, Artificial sequence
  SiRNA target sequence
tataactgtaaaaaaaatat

SEQ ID NO: 37444 - DNA, 20 bp, Artificial sequence
  SiRNA target sequence
ataactgtaaaaaaaatatt

SEQ ID NO: 37445 - DNA, 20 bp, Artificial sequence
  SiRNA target sequence
taactgtaaaaaaaatattt

SEQ ID NO: 37446 - DNA, 20 bp, Artificial sequence
  SiRNA target sequence
aactgtaaaaaaaatattta

SEQ ID NO: 37447 - DNA, 20 bp, Artificial sequence
  SiRNA target sequence
actgtaaaaaaaatatttat

SEQ ID NO: 37448 - DNA, 20 bp, Artificial sequence
  SiRNA target sequence
ctgtaaaaaaaatatttatg

SEQ ID NO: 37449 - DNA, 20 bp, Artificial sequence
  SiRNA target sequence
tgtaaaaaaaatatttatga

SEQ ID NO: 37450 - DNA, 20 bp, Artificial sequence
  SiRNA target sequence
gtaaaaaaaatatttatgat

SEQ ID NO: 37451 - DNA, 20 bp, Artificial sequence
  SiRNA target sequence
taaaaaaaatatttatgata

SEQ ID NO: 37452 - DNA, 20 bp, Artificial sequence
  SiRNA target sequence
aaaaaaaatatttatgatat

SEQ ID NO: 37453 - DNA, 20 bp, Artificial sequence
  SiRNA target sequence
aaaaaaatatttatgatatt

SEQ ID NO: 37454 - DNA, 20 bp, Artificial sequence
  SiRNA target sequence
aaaaaatatttatgatatta

SEQ ID NO: 37455 - DNA, 20 bp, Artificial sequence
  SiRNA target sequence
aaaaatatttatgatattaa

SEQ ID NO: 37456 - DNA, 20 bp, Artificial sequence
  SiRNA target sequence
aaaatatttatgatattaac

SEQ ID NO: 37457 - DNA, 20 bp, Artificial sequence
  SiRNA target sequence
aaatatttatgatattaaca

SEQ ID NO: 37458 - DNA, 20 bp, Artificial sequence
  SiRNA target sequence
aatatttatgatattaacaa

SEQ ID NO: 37459 - DNA, 20 bp, Artificial sequence
  SiRNA target sequence
atatttatgatattaacaaa

SEQ ID NO: 37460 - DNA, 20 bp, Artificial sequence
  SiRNA target sequence
tatttatgatattaacaaat

SEQ ID NO: 37461 - DNA, 20 bp, Artificial sequence
  SiRNA target sequence
atttatgatattaacaaata

SEQ ID NO: 37462 - DNA, 20 bp, Artificial sequence
  SiRNA target sequence
tttatgatattaacaaataa

SEQ ID NO: 37463 - DNA, 20 bp, Artificial sequence
  SiRNA target sequence
ttatgatattaacaaataaa

SEQ ID NO: 37464 - DNA, 20 bp, Artificial sequence
  SiRNA target sequence
tatgatattaacaaataaaa

SEQ ID NO: 37465 - DNA, 20 bp, Artificial sequence
  SiRNA target sequence
atgatattaacaaataaaac

SEQ ID NO: 37466 - DNA, 20 bp, Artificial sequence
  SiRNA target sequence
tgatattaacaaataaaact

SEQ ID NO: 37467 - DNA, 20 bp, Artificial sequence
  SiRNA target sequence
gatattaacaaataaaactt

SEQ ID NO: 37468 - DNA, 20 bp, Artificial sequence
  SiRNA target sequence
atattaacaaataaaacttc

SEQ ID NO: 37469 - DNA, 20 bp, Artificial sequence
  SiRNA target sequence
tattaacaaataaaacttcg

SEQ ID NO: 37470 - DNA, 20 bp, Artificial sequence
  SiRNA target sequence
attaacaaataaaacttcga

SEQ ID NO: 37471 - DNA, 20 bp, Artificial sequence
  SiRNA target sequence
ttaacaaataaaacttcgat

SEQ ID NO: 37472 - DNA, 20 bp, Artificial sequence
  SiRNA target sequence
taacaaataaaacttcgatc

SEQ ID NO: 37473 - DNA, 20 bp, Artificial sequence
  SiRNA target sequence
aacaaataaaacttcgatca

SEQ ID NO: 37474 - DNA, 20 bp, Artificial sequence
  SiRNA target sequence
acaaataaaacttcgatcaa

SEQ ID NO: 37475 - DNA, 20 bp, Artificial sequence
  SiRNA target sequence
caaataaaacttcgatcaat

SEQ ID NO: 37476 - DNA, 20 bp, Artificial sequence
  SiRNA target sequence
aaataaaacttcgatcaatt

SEQ ID NO: 37477 - DNA, 20 bp, Artificial sequence
  SiRNA target sequence
aataaaacttcgatcaattc

SEQ ID NO: 37478 - DNA, 20 bp, Artificial sequence
  SiRNA target sequence
ataaaacttcgatcaattca

SEQ ID NO: 37479 - DNA, 20 bp, Artificial sequence
  SiRNA target sequence
taaaacttcgatcaattcac

SEQ ID NO: 37480 - DNA, 20 bp, Artificial sequence
  SiRNA target sequence
aaaacttcgatcaattcact

SEQ ID NO: 37481 - DNA, 20 bp, Artificial sequence
  SiRNA target sequence
aaacttcgatcaattcactt

SEQ ID NO: 37482 - DNA, 20 bp, Artificial sequence
  SiRNA target sequence
aacttcgatcaattcactta

SEQ ID NO: 37483 - DNA, 20 bp, Artificial sequence
  SiRNA target sequence
acttcgatcaattcacttat

SEQ ID NO: 37484 - DNA, 20 bp, Artificial sequence
  SiRNA target sequence
cttcgatcaattcacttatt

SEQ ID NO: 37485 - DNA, 20 bp, Artificial sequence
  SiRNA target sequence
ttcgatcaattcacttattg

SEQ ID NO: 37486 - DNA, 20 bp, Artificial sequence
  SiRNA target sequence
tcgatcaattcacttattgc

SEQ ID NO: 37487 - DNA, 20 bp, Artificial sequence
  SiRNA target sequence
cgatcaattcacttattgct

SEQ ID NO: 37488 - DNA, 20 bp, Artificial sequence
  SiRNA target sequence
gatcaattcacttattgctt

SEQ ID NO: 37489 - DNA, 20 bp, Artificial sequence
  SiRNA target sequence
atcaattcacttattgcttt

SEQ ID NO: 37490 - DNA, 20 bp, Artificial sequence
  SiRNA target sequence
tcaattcacttattgcttta

SEQ ID NO: 37491 - DNA, 20 bp, Artificial sequence
  SiRNA target sequence
caattcacttattgctttac

SEQ ID NO: 37492 - DNA, 20 bp, Artificial sequence
  SiRNA target sequence
aattcacttattgctttact

SEQ ID NO: 37493 - DNA, 20 bp, Artificial sequence
  SiRNA target sequence
attcacttattgctttactt

SEQ ID NO: 37494 - DNA, 20 bp, Artificial sequence
  SiRNA target sequence
ttcacttattgctttacttt

SEQ ID NO: 37495 - DNA, 20 bp, Artificial sequence
  SiRNA target sequence
tcacttattgctttactttc

SEQ ID NO: 37496 - DNA, 20 bp, Artificial sequence
  SiRNA target sequence
cacttattgctttactttct

SEQ ID NO: 37497 - DNA, 20 bp, Artificial sequence
  SiRNA target sequence
acttattgctttactttctc

SEQ ID NO: 37498 - DNA, 20 bp, Artificial sequence
  SiRNA target sequence
cttattgctttactttctcg

SEQ ID NO: 37499 - DNA, 20 bp, Artificial sequence
  SiRNA target sequence
ttattgctttactttctcgg

SEQ ID NO: 37500 - DNA, 20 bp, Artificial sequence
  SiRNA target sequence
tattgctttactttctcggt

SEQ ID NO: 37501 - DNA, 20 bp, Artificial sequence
  SiRNA target sequence
attgctttactttctcggtc

SEQ ID NO: 37502 - DNA, 20 bp, Artificial sequence
  SiRNA target sequence
ttgctttactttctcggtct

SEQ ID NO: 37503 - DNA, 20 bp, Artificial sequence
  SiRNA target sequence
tgctttactttctcggtcta

SEQ ID NO: 37504 - DNA, 20 bp, Artificial sequence
  SiRNA target sequence
gctttactttctcggtctat

SEQ ID NO: 37505 - DNA, 20 bp, Artificial sequence
  SiRNA target sequence
ctttactttctcggtctatt

SEQ ID NO: 37506 - DNA, 20 bp, Artificial sequence
  SiRNA target sequence
tttactttctcggtctatta

SEQ ID NO: 37507 - DNA, 20 bp, Artificial sequence
  SiRNA target sequence
ttactttctcggtctattat

SEQ ID NO: 37508 - DNA, 20 bp, Artificial sequence
  SiRNA target sequence
tactttctcggtctattatt

SEQ ID NO: 37509 - DNA, 20 bp, Artificial sequence
  SiRNA target sequence
actttctcggtctattattg

SEQ ID NO: 37510 - DNA, 20 bp, Artificial sequence
  SiRNA target sequence
ctttctcggtctattattgt

SEQ ID NO: 37511 - DNA, 20 bp, Artificial sequence
  SiRNA target sequence
tttctcggtctattattgtt

SEQ ID NO: 37512 - DNA, 20 bp, Artificial sequence
  SiRNA target sequence
ttctcggtctattattgttt

SEQ ID NO: 37513 - DNA, 20 bp, Artificial sequence
  SiRNA target sequence
tctcggtctattattgtttg

SEQ ID NO: 37514 - DNA, 20 bp, Artificial sequence
  SiRNA target sequence
ctcggtctattattgtttgt

SEQ ID NO: 37515 - DNA, 20 bp, Artificial sequence
  SiRNA target sequence
tcggtctattattgtttgta

SEQ ID NO: 37516 - DNA, 20 bp, Artificial sequence
  SiRNA target sequence
cggtctattattgtttgtat

SEQ ID NO: 37517 - DNA, 20 bp, Artificial sequence
  SiRNA target sequence
ggtctattattgtttgtatt

SEQ ID NO: 37518 - DNA, 20 bp, Artificial sequence
  SiRNA target sequence
gtctattattgtttgtattt

SEQ ID NO: 37519 - DNA, 20 bp, Artificial sequence
  SiRNA target sequence
tctattattgtttgtatttc

SEQ ID NO: 37520 - DNA, 20 bp, Artificial sequence
  SiRNA target sequence
ctattattgtttgtatttca

SEQ ID NO: 37521 - DNA, 20 bp, Artificial sequence
  SiRNA target sequence
tattattgtttgtatttcac

SEQ ID NO: 37522 - DNA, 20 bp, Artificial sequence
  SiRNA target sequence
attattgtttgtatttcacc

SEQ ID NO: 37523 - DNA, 20 bp, Artificial sequence
  SiRNA target sequence
ttattgtttgtatttcaccg

SEQ ID NO: 37524 - DNA, 20 bp, Artificial sequence
  SiRNA target sequence
tattgtttgtatttcaccgc

SEQ ID NO: 37525 - DNA, 20 bp, Artificial sequence
  SiRNA target sequence
attgtttgtatttcaccgca

SEQ ID NO: 37526 - DNA, 20 bp, Artificial sequence
  SiRNA target sequence
ttgtttgtatttcaccgcat

SEQ ID NO: 37527 - DNA, 20 bp, Artificial sequence
  SiRNA target sequence
tgtttgtatttcaccgcatc

SEQ ID NO: 37528 - DNA, 20 bp, Artificial sequence
  SiRNA target sequence
gtttgtatttcaccgcatcc

SEQ ID NO: 37529 - DNA, 20 bp, Artificial sequence
  SiRNA target sequence
tttgtatttcaccgcatcct

SEQ ID NO: 37530 - DNA, 20 bp, Artificial sequence
  SiRNA target sequence
ttgtatttcaccgcatccta

SEQ ID NO: 37531 - DNA, 20 bp, Artificial sequence
  SiRNA target sequence
tgtatttcaccgcatcctat

SEQ ID NO: 37532 - DNA, 20 bp, Artificial sequence
  SiRNA target sequence
gtatttcaccgcatcctatt

SEQ ID NO: 37533 - DNA, 20 bp, Artificial sequence
  SiRNA target sequence
tatttcaccgcatcctattt

SEQ ID NO: 37534 - DNA, 20 bp, Artificial sequence
  SiRNA target sequence
atttcaccgcatcctatttt

SEQ ID NO: 37535 - DNA, 20 bp, Artificial sequence
  SiRNA target sequence
tttcaccgcatcctatttta

SEQ ID NO: 37536 - DNA, 20 bp, Artificial sequence
  SiRNA target sequence
ttcaccgcatcctattttat

SEQ ID NO: 37537 - DNA, 20 bp, Artificial sequence
  SiRNA target sequence
tcaccgcatcctattttatt

SEQ ID NO: 37538 - DNA, 20 bp, Artificial sequence
  SiRNA target sequence
caccgcatcctattttattg

SEQ ID NO: 37539 - DNA, 20 bp, Artificial sequence
  SiRNA target sequence
accgcatcctattttattgt

SEQ ID NO: 37540 - DNA, 20 bp, Artificial sequence
  SiRNA target sequence
ccgcatcctattttattgta

SEQ ID NO: 37541 - DNA, 20 bp, Artificial sequence
  SiRNA target sequence
cgcatcctattttattgtat

SEQ ID NO: 37542 - DNA, 20 bp, Artificial sequence
  SiRNA target sequence
gcatcctattttattgtatc

SEQ ID NO: 37543 - DNA, 20 bp, Artificial sequence
  SiRNA target sequence
catcctattttattgtatct

SEQ ID NO: 37544 - DNA, 20 bp, Artificial sequence
  SiRNA target sequence
atcctattttattgtatcta

SEQ ID NO: 37545 - DNA, 20 bp, Artificial sequence
  SiRNA target sequence
tcctattttattgtatctac

SEQ ID NO: 37546 - DNA, 20 bp, Artificial sequence
  SiRNA target sequence
cctattttattgtatctact

SEQ ID NO: 37547 - DNA, 20 bp, Artificial sequence
  SiRNA target sequence
ctattttattgtatctacta

SEQ ID NO: 37548 - DNA, 20 bp, Artificial sequence
  SiRNA target sequence
tattttattgtatctactaa

SEQ ID NO: 37549 - DNA, 20 bp, Artificial sequence
  SiRNA target sequence
attttattgtatctactaag

SEQ ID NO: 37550 - DNA, 20 bp, Artificial sequence
  SiRNA target sequence
ttttattgtatctactaagt

SEQ ID NO: 37551 - DNA, 20 bp, Artificial sequence
  SiRNA target sequence
tttattgtatctactaagtt

SEQ ID NO: 37552 - DNA, 20 bp, Artificial sequence
  SiRNA target sequence
ttattgtatctactaagttc

SEQ ID NO: 37553 - DNA, 20 bp, Artificial sequence
  SiRNA target sequence
tattgtatctactaagttcc

SEQ ID NO: 37554 - DNA, 20 bp, Artificial sequence
  SiRNA target sequence
attgtatctactaagttcca

SEQ ID NO: 37555 - DNA, 20 bp, Artificial sequence
  SiRNA target sequence
ttgtatctactaagttccat

SEQ ID NO: 37556 - DNA, 20 bp, Artificial sequence
  SiRNA target sequence
tgtatctactaagttccata

SEQ ID NO: 37557 - DNA, 20 bp, Artificial sequence
  SiRNA target sequence
gtatctactaagttccatat

SEQ ID NO: 37558 - DNA, 20 bp, Artificial sequence
  SiRNA target sequence
tatctactaagttccatatt

SEQ ID NO: 37559 - DNA, 20 bp, Artificial sequence
  SiRNA target sequence
atctactaagttccatattt

SEQ ID NO: 37560 - DNA, 20 bp, Artificial sequence
  SiRNA target sequence
tctactaagttccatattta

SEQ ID NO: 37561 - DNA, 20 bp, Artificial sequence
  SiRNA target sequence
ctactaagttccatatttat

SEQ ID NO: 37562 - DNA, 20 bp, Artificial sequence
  SiRNA target sequence
tactaagttccatatttata

SEQ ID NO: 37563 - DNA, 20 bp, Artificial sequence
  SiRNA target sequence
actaagttccatatttataa

SEQ ID NO: 37564 - DNA, 20 bp, Artificial sequence
  SiRNA target sequence
ctaagttccatatttataaa

SEQ ID NO: 37565 - DNA, 20 bp, Artificial sequence
  SiRNA target sequence
taagttccatatttataaaa

SEQ ID NO: 37566 - DNA, 20 bp, Artificial sequence
  SiRNA target sequence
aagttccatatttataaaat

SEQ ID NO: 37567 - DNA, 20 bp, Artificial sequence
  SiRNA target sequence
agttccatatttataaaatt

SEQ ID NO: 37568 - DNA, 20 bp, Artificial sequence
  SiRNA target sequence
gttccatatttataaaattt

SEQ ID NO: 37569 - DNA, 20 bp, Artificial sequence
  SiRNA target sequence
ttccatatttataaaatttt

SEQ ID NO: 37570 - DNA, 20 bp, Artificial sequence
  SiRNA target sequence
tccatatttataaaattttt

SEQ ID NO: 37571 - DNA, 20 bp, Artificial sequence
  SiRNA target sequence
ccatatttataaaattttta

SEQ ID NO: 37572 - DNA, 20 bp, Artificial sequence
  SiRNA target sequence
catatttataaaatttttaa

SEQ ID NO: 37573 - DNA, 20 bp, Artificial sequence
  SiRNA target sequence
atatttataaaatttttaaa

SEQ ID NO: 37574 - DNA, 20 bp, Artificial sequence
  SiRNA target sequence
tatttataaaatttttaaat

SEQ ID NO: 37575 - DNA, 20 bp, Artificial sequence
  SiRNA target sequence
atttataaaatttttaaatg

SEQ ID NO: 37576 - DNA, 20 bp, Artificial sequence
  SiRNA target sequence
tttataaaatttttaaatga

SEQ ID NO: 37577 - DNA, 20 bp, Artificial sequence
  SiRNA target sequence
ttataaaatttttaaatgaa

SEQ ID NO: 37578 - DNA, 20 bp, Artificial sequence
  SiRNA target sequence
tataaaatttttaaatgaat

SEQ ID NO: 37579 - DNA, 20 bp, Artificial sequence
  SiRNA target sequence
ataaaatttttaaatgaatt

SEQ ID NO: 37580 - DNA, 20 bp, Artificial sequence
  SiRNA target sequence
taaaatttttaaatgaattt

SEQ ID NO: 37581 - DNA, 20 bp, Artificial sequence
  SiRNA target sequence
aaaatttttaaatgaatttt

SEQ ID NO: 37582 - DNA, 20 bp, Artificial sequence
  SiRNA target sequence
aaatttttaaatgaattttt

SEQ ID NO: 37583 - DNA, 20 bp, Artificial sequence
  SiRNA target sequence
aatttttaaatgaatttttt

SEQ ID NO: 37584 - DNA, 20 bp, Artificial sequence
  SiRNA target sequence
atttttaaatgaattttttc

SEQ ID NO: 37585 - DNA, 20 bp, Artificial sequence
  SiRNA target sequence
tttttaaatgaattttttcc

SEQ ID NO: 37586 - DNA, 20 bp, Artificial sequence
  SiRNA target sequence
ttttaaatgaattttttcct

SEQ ID NO: 37587 - DNA, 20 bp, Artificial sequence
  SiRNA target sequence
tttaaatgaattttttcctg

SEQ ID NO: 37588 - DNA, 20 bp, Artificial sequence
  SiRNA target sequence
ttaaatgaattttttcctgt

SEQ ID NO: 37589 - DNA, 20 bp, Artificial sequence
  SiRNA target sequence
taaatgaattttttcctgtc

SEQ ID NO: 37590 - DNA, 20 bp, Artificial sequence
  SiRNA target sequence
aaatgaattttttcctgtca

SEQ ID NO: 37591 - DNA, 20 bp, Artificial sequence
  SiRNA target sequence
aatgaattttttcctgtcag

SEQ ID NO: 37592 - DNA, 20 bp, Artificial sequence
  SiRNA target sequence
atgaattttttcctgtcagt

SEQ ID NO: 37593 - DNA, 20 bp, Artificial sequence
  SiRNA target sequence
tgaattttttcctgtcagtc

SEQ ID NO: 37594 - DNA, 20 bp, Artificial sequence
  SiRNA target sequence
gaattttttcctgtcagtct

SEQ ID NO: 37595 - DNA, 20 bp, Artificial sequence
  SiRNA target sequence
aattttttcctgtcagtctg

SEQ ID NO: 37596 - DNA, 20 bp, Artificial sequence
  SiRNA target sequence
attttttcctgtcagtctga

SEQ ID NO: 37597 - DNA, 20 bp, Artificial sequence
  SiRNA target sequence
ttttttcctgtcagtctgaa

SEQ ID NO: 37598 - DNA, 20 bp, Artificial sequence
  SiRNA target sequence
tttttcctgtcagtctgaat

SEQ ID NO: 37599 - DNA, 20 bp, Artificial sequence
  SiRNA target sequence
ttttcctgtcagtctgaata

SEQ ID NO: 37600 - DNA, 20 bp, Artificial sequence
  SiRNA target sequence
tttcctgtcagtctgaatac

SEQ ID NO: 37601 - DNA, 20 bp, Artificial sequence
  SiRNA target sequence
ttcctgtcagtctgaataca

SEQ ID NO: 37602 - DNA, 20 bp, Artificial sequence
  SiRNA target sequence
tcctgtcagtctgaatacat

SEQ ID NO: 37603 - DNA, 20 bp, Artificial sequence
  SiRNA target sequence
cctgtcagtctgaatacatg

SEQ ID NO: 37604 - DNA, 20 bp, Artificial sequence
  SiRNA target sequence
ctgtcagtctgaatacatgt

SEQ ID NO: 37605 - DNA, 20 bp, Artificial sequence
  SiRNA target sequence
tgtcagtctgaatacatgtt

SEQ ID NO: 37606 - DNA, 20 bp, Artificial sequence
  SiRNA target sequence
gtcagtctgaatacatgttg

SEQ ID NO: 37607 - DNA, 20 bp, Artificial sequence
  SiRNA target sequence
tcagtctgaatacatgttga

SEQ ID NO: 37608 - DNA, 20 bp, Artificial sequence
  SiRNA target sequence
cagtctgaatacatgttgaa

SEQ ID NO: 37609 - DNA, 20 bp, Artificial sequence
  SiRNA target sequence
agtctgaatacatgttgaac

SEQ ID NO: 37610 - DNA, 20 bp, Artificial sequence
  SiRNA target sequence
gtctgaatacatgttgaacg

SEQ ID NO: 37611 - DNA, 20 bp, Artificial sequence
  SiRNA target sequence
tctgaatacatgttgaacgg

SEQ ID NO: 37612 - DNA, 20 bp, Artificial sequence
  SiRNA target sequence
ctgaatacatgttgaacggg

SEQ ID NO: 37613 - DNA, 20 bp, Artificial sequence
  SiRNA target sequence
tgaatacatgttgaacgggt

SEQ ID NO: 37614 - DNA, 20 bp, Artificial sequence
  SiRNA target sequence
gaatacatgttgaacgggtg

SEQ ID NO: 37615 - DNA, 20 bp, Artificial sequence
  SiRNA target sequence
aatacatgttgaacgggtgt

SEQ ID NO: 37616 - DNA, 20 bp, Artificial sequence
  SiRNA target sequence
atacatgttgaacgggtgta

SEQ ID NO: 37617 - DNA, 20 bp, Artificial sequence
  SiRNA target sequence
tacatgttgaacgggtgtaa

SEQ ID NO: 37618 - DNA, 20 bp, Artificial sequence
  SiRNA target sequence
acatgttgaacgggtgtaac

SEQ ID NO: 37619 - DNA, 20 bp, Artificial sequence
  SiRNA target sequence
catgttgaacgggtgtaaca

SEQ ID NO: 37620 - DNA, 20 bp, Artificial sequence
  SiRNA target sequence
atgttgaacgggtgtaacaa

SEQ ID NO: 37621 - DNA, 20 bp, Artificial sequence
  SiRNA target sequence
tgttgaacgggtgtaacaaa

SEQ ID NO: 37622 - DNA, 20 bp, Artificial sequence
  SiRNA target sequence
gttgaacgggtgtaacaaat

SEQ ID NO: 37623 - DNA, 20 bp, Artificial sequence
  SiRNA target sequence
ttgaacgggtgtaacaaata

SEQ ID NO: 37624 - DNA, 20 bp, Artificial sequence
  SiRNA target sequence
tgaacgggtgtaacaaatat

SEQ ID NO: 37625 - DNA, 20 bp, Artificial sequence
  SiRNA target sequence
gaacgggtgtaacaaatata

SEQ ID NO: 37626 - DNA, 20 bp, Artificial sequence
  SiRNA target sequence
aacgggtgtaacaaatataa

SEQ ID NO: 37627 - DNA, 20 bp, Artificial sequence
  SiRNA target sequence
acgggtgtaacaaatataaa

SEQ ID NO: 37628 - DNA, 20 bp, Artificial sequence
  SiRNA target sequence
cgggtgtaacaaatataaaa

SEQ ID NO: 37629 - DNA, 20 bp, Artificial sequence
  SiRNA target sequence
gggtgtaacaaatataaaat

SEQ ID NO: 37630 - DNA, 20 bp, Artificial sequence
  SiRNA target sequence
ggtgtaacaaatataaaatt

SEQ ID NO: 37631 - DNA, 20 bp, Artificial sequence
  SiRNA target sequence
gtgtaacaaatataaaattg

SEQ ID NO: 37632 - DNA, 20 bp, Artificial sequence
  SiRNA target sequence
tgtaacaaatataaaattgt

SEQ ID NO: 37633 - DNA, 20 bp, Artificial sequence
  SiRNA target sequence
gtaacaaatataaaattgtt

SEQ ID NO: 37634 - DNA, 20 bp, Artificial sequence
  SiRNA target sequence
taacaaatataaaattgtta

SEQ ID NO: 37635 - DNA, 20 bp, Artificial sequence
  SiRNA target sequence
aacaaatataaaattgttaa

SEQ ID NO: 37636 - DNA, 20 bp, Artificial sequence
  SiRNA target sequence
acaaatataaaattgttaag

SEQ ID NO: 37637 - DNA, 20 bp, Artificial sequence
  SiRNA target sequence
caaatataaaattgttaagt

SEQ ID NO: 37638 - DNA, 20 bp, Artificial sequence
  SiRNA target sequence
aaatataaaattgttaagtt

SEQ ID NO: 37639 - DNA, 20 bp, Artificial sequence
  SiRNA target sequence
aatataaaattgttaagttc

SEQ ID NO: 37640 - DNA, 20 bp, Artificial sequence
  SiRNA target sequence
atataaaattgttaagttct

SEQ ID NO: 37641 - DNA, 20 bp, Artificial sequence
  SiRNA target sequence
tataaaattgttaagttctg

SEQ ID NO: 37642 - DNA, 20 bp, Artificial sequence
  SiRNA target sequence
ataaaattgttaagttctga

SEQ ID NO: 37643 - DNA, 20 bp, Artificial sequence
  SiRNA target sequence
taaaattgttaagttctgac

SEQ ID NO: 37644 - DNA, 20 bp, Artificial sequence
  SiRNA target sequence
aaaattgttaagttctgaca

SEQ ID NO: 37645 - DNA, 20 bp, Artificial sequence
  SiRNA target sequence
aaattgttaagttctgacat

SEQ ID NO: 37646 - DNA, 20 bp, Artificial sequence
  SiRNA target sequence
aattgttaagttctgacatt

SEQ ID NO: 37647 - DNA, 20 bp, Artificial sequence
  SiRNA target sequence
attgttaagttctgacattg

SEQ ID NO: 37648 - DNA, 20 bp, Artificial sequence
  SiRNA target sequence
ttgttaagttctgacattgt

SEQ ID NO: 37649 - DNA, 20 bp, Artificial sequence
  SiRNA target sequence
tgttaagttctgacattgta

SEQ ID NO: 37650 - DNA, 20 bp, Artificial sequence
  SiRNA target sequence
gttaagttctgacattgtaa

SEQ ID NO: 37651 - DNA, 20 bp, Artificial sequence
  SiRNA target sequence
ttaagttctgacattgtaat

SEQ ID NO: 37652 - DNA, 20 bp, Artificial sequence
  SiRNA target sequence
taagttctgacattgtaatt

SEQ ID NO: 37653 - DNA, 20 bp, Artificial sequence
  SiRNA target sequence
aagttctgacattgtaattg

SEQ ID NO: 37654 - DNA, 20 bp, Artificial sequence
  SiRNA target sequence
agttctgacattgtaattga

SEQ ID NO: 37655 - DNA, 20 bp, Artificial sequence
  SiRNA target sequence
gttctgacattgtaattgat

SEQ ID NO: 37656 - DNA, 20 bp, Artificial sequence
  SiRNA target sequence
ttctgacattgtaattgata

SEQ ID NO: 37657 - DNA, 20 bp, Artificial sequence
  SiRNA target sequence
tctgacattgtaattgatac

SEQ ID NO: 37658 - DNA, 20 bp, Artificial sequence
  SiRNA target sequence
ctgacattgtaattgataca

SEQ ID NO: 37659 - DNA, 20 bp, Artificial sequence
  SiRNA target sequence
tgacattgtaattgatacaa

SEQ ID NO: 37660 - DNA, 20 bp, Artificial sequence
  SiRNA target sequence
gacattgtaattgatacaat

SEQ ID NO: 37661 - DNA, 20 bp, Artificial sequence
  SiRNA target sequence
acattgtaattgatacaatt

SEQ ID NO: 37662 - DNA, 20 bp, Artificial sequence
  SiRNA target sequence
cattgtaattgatacaattg

SEQ ID NO: 37663 - DNA, 20 bp, Artificial sequence
  SiRNA target sequence
attgtaattgatacaattgt

SEQ ID NO: 37664 - DNA, 20 bp, Artificial sequence
  SiRNA target sequence
ttgtaattgatacaattgtc

SEQ ID NO: 37665 - DNA, 20 bp, Artificial sequence
  SiRNA target sequence
tgtaattgatacaattgtca

SEQ ID NO: 37666 - DNA, 20 bp, Artificial sequence
  SiRNA target sequence
gtaattgatacaattgtcaa

SEQ ID NO: 37667 - DNA, 20 bp, Artificial sequence
  SiRNA target sequence
taattgatacaattgtcaaa

SEQ ID NO: 37668 - DNA, 20 bp, Artificial sequence
  SiRNA target sequence
aattgatacaattgtcaaaa

SEQ ID NO: 37669 - DNA, 20 bp, Artificial sequence
  SiRNA target sequence
attgatacaattgtcaaaac

SEQ ID NO: 37670 - DNA, 20 bp, Artificial sequence
  SiRNA target sequence
ttgatacaattgtcaaaact

SEQ ID NO: 37671 - DNA, 20 bp, Artificial sequence
  SiRNA target sequence
tgatacaattgtcaaaactg

SEQ ID NO: 37672 - DNA, 20 bp, Artificial sequence
  SiRNA target sequence
gatacaattgtcaaaactgc

SEQ ID NO: 37673 - DNA, 20 bp, Artificial sequence
  SiRNA target sequence
atacaattgtcaaaactgca

SEQ ID NO: 37674 - DNA, 20 bp, Artificial sequence
  SiRNA target sequence
tacaattgtcaaaactgcaa

SEQ ID NO: 37675 - DNA, 20 bp, Artificial sequence
  SiRNA target sequence
acaattgtcaaaactgcaaa

SEQ ID NO: 37676 - DNA, 20 bp, Artificial sequence
  SiRNA target sequence
caattgtcaaaactgcaaaa

SEQ ID NO: 37677 - DNA, 20 bp, Artificial sequence
  SiRNA target sequence
aattgtcaaaactgcaaaat

SEQ ID NO: 37678 - DNA, 20 bp, Artificial sequence
  SiRNA target sequence
attgtcaaaactgcaaaata

SEQ ID NO: 37679 - DNA, 20 bp, Artificial sequence
  SiRNA target sequence
ttgtcaaaactgcaaaatac

SEQ ID NO: 37680 - DNA, 20 bp, Artificial sequence
  SiRNA target sequence
tgtcaaaactgcaaaataca

SEQ ID NO: 37681 - DNA, 20 bp, Artificial sequence
  SiRNA target sequence
gtcaaaactgcaaaatacaa

SEQ ID NO: 37682 - DNA, 20 bp, Artificial sequence
  SiRNA target sequence
tcaaaactgcaaaatacaaa

SEQ ID NO: 37683 - DNA, 20 bp, Artificial sequence
  SiRNA target sequence
caaaactgcaaaatacaaaa

SEQ ID NO: 37684 - DNA, 20 bp, Artificial sequence
  SiRNA target sequence
aaaactgcaaaatacaaaag

SEQ ID NO: 37685 - DNA, 20 bp, Artificial sequence
  SiRNA target sequence
aaactgcaaaatacaaaaga

SEQ ID NO: 37686 - DNA, 20 bp, Artificial sequence
  SiRNA target sequence
aactgcaaaatacaaaagac

SEQ ID NO: 37687 - DNA, 20 bp, Artificial sequence
  SiRNA target sequence
actgcaaaatacaaaagact

SEQ ID NO: 37688 - DNA, 20 bp, Artificial sequence
  SiRNA target sequence
ctgcaaaatacaaaagactt

SEQ ID NO: 37689 - DNA, 20 bp, Artificial sequence
  SiRNA target sequence
tgcaaaatacaaaagacttt

SEQ ID NO: 37690 - DNA, 20 bp, Artificial sequence
  SiRNA target sequence
gcaaaatacaaaagactttg

SEQ ID NO: 37691 - DNA, 20 bp, Artificial sequence
  SiRNA target sequence
caaaatacaaaagactttga

SEQ ID NO: 37692 - DNA, 20 bp, Artificial sequence
  SiRNA target sequence
aaaatacaaaagactttgac

SEQ ID NO: 37693 - DNA, 20 bp, Artificial sequence
  SiRNA target sequence
aaatacaaaagactttgact

SEQ ID NO: 37694 - DNA, 20 bp, Artificial sequence
  SiRNA target sequence
aatacaaaagactttgacta

SEQ ID NO: 37695 - DNA, 20 bp, Artificial sequence
  SiRNA target sequence
atacaaaagactttgactaa

SEQ ID NO: 37696 - DNA, 20 bp, Artificial sequence
  SiRNA target sequence
tacaaaagactttgactaag

SEQ ID NO: 37697 - DNA, 20 bp, Artificial sequence
  SiRNA target sequence
acaaaagactttgactaaga

SEQ ID NO: 37698 - DNA, 20 bp, Artificial sequence
  SiRNA target sequence
caaaagactttgactaagat

SEQ ID NO: 37699 - DNA, 20 bp, Artificial sequence
  SiRNA target sequence
aaaagactttgactaagatc

SEQ ID NO: 37700 - DNA, 20 bp, Artificial sequence
  SiRNA target sequence
aaagactttgactaagatct

SEQ ID NO: 37701 - DNA, 20 bp, Artificial sequence
  SiRNA target sequence
aagactttgactaagatctt

SEQ ID NO: 37702 - DNA, 20 bp, Artificial sequence
  SiRNA target sequence
agactttgactaagatcttt

SEQ ID NO: 37703 - DNA, 20 bp, Artificial sequence
  SiRNA target sequence
gactttgactaagatcttta

SEQ ID NO: 37704 - DNA, 20 bp, Artificial sequence
  SiRNA target sequence
actttgactaagatctttat

SEQ ID NO: 37705 - DNA, 20 bp, Artificial sequence
  SiRNA target sequence
ctttgactaagatctttatt

SEQ ID NO: 37706 - DNA, 20 bp, Artificial sequence
  SiRNA target sequence
tttgactaagatctttatta

SEQ ID NO: 37707 - DNA, 20 bp, Artificial sequence
  SiRNA target sequence
ttgactaagatctttattat

SEQ ID NO: 37708 - DNA, 20 bp, Artificial sequence
  SiRNA target sequence
tgactaagatctttattatc

SEQ ID NO: 37709 - DNA, 20 bp, Artificial sequence
  SiRNA target sequence
gactaagatctttattatct

SEQ ID NO: 37710 - DNA, 20 bp, Artificial sequence
  SiRNA target sequence
actaagatctttattatctg

SEQ ID NO: 37711 - DNA, 20 bp, Artificial sequence
  SiRNA target sequence
ctaagatctttattatctgt

SEQ ID NO: 37712 - DNA, 20 bp, Artificial sequence
  SiRNA target sequence
taagatctttattatctgta

SEQ ID NO: 37713 - DNA, 20 bp, Artificial sequence
  SiRNA target sequence
aagatctttattatctgtaa

SEQ ID NO: 37714 - DNA, 20 bp, Artificial sequence
  SiRNA target sequence
agatctttattatctgtaat

SEQ ID NO: 37715 - DNA, 20 bp, Artificial sequence
  SiRNA target sequence
gatctttattatctgtaata

SEQ ID NO: 37716 - DNA, 20 bp, Artificial sequence
  SiRNA target sequence
atctttattatctgtaatat

SEQ ID NO: 37717 - DNA, 20 bp, Artificial sequence
  SiRNA target sequence
tctttattatctgtaatatc

SEQ ID NO: 37718 - DNA, 20 bp, Artificial sequence
  SiRNA target sequence
ctttattatctgtaatatca

SEQ ID NO: 37719 - DNA, 20 bp, Artificial sequence
  SiRNA target sequence
tttattatctgtaatatcac

SEQ ID NO: 37720 - DNA, 20 bp, Artificial sequence
  SiRNA target sequence
ttattatctgtaatatcact

SEQ ID NO: 37721 - DNA, 20 bp, Artificial sequence
  SiRNA target sequence
tattatctgtaatatcacta

SEQ ID NO: 37722 - DNA, 20 bp, Artificial sequence
  SiRNA target sequence
attatctgtaatatcactag

SEQ ID NO: 37723 - DNA, 20 bp, Artificial sequence
  SiRNA target sequence
ttatctgtaatatcactagt

SEQ ID NO: 37724 - DNA, 20 bp, Artificial sequence
  SiRNA target sequence
tatctgtaatatcactagtc

SEQ ID NO: 37725 - DNA, 20 bp, Artificial sequence
  SiRNA target sequence
atctgtaatatcactagtca

SEQ ID NO: 37726 - DNA, 20 bp, Artificial sequence
  SiRNA target sequence
tctgtaatatcactagtcaa

SEQ ID NO: 37727 - DNA, 20 bp, Artificial sequence
  SiRNA target sequence
ctgtaatatcactagtcaat

SEQ ID NO: 37728 - DNA, 20 bp, Artificial sequence
  SiRNA target sequence
tgtaatatcactagtcaatt

SEQ ID NO: 37729 - DNA, 20 bp, Artificial sequence
  SiRNA target sequence
gtaatatcactagtcaattt

SEQ ID NO: 37730 - DNA, 20 bp, Artificial sequence
  SiRNA target sequence
taatatcactagtcaatttc

SEQ ID NO: 37731 - DNA, 20 bp, Artificial sequence
  SiRNA target sequence
aatatcactagtcaatttcc

SEQ ID NO: 37732 - DNA, 20 bp, Artificial sequence
  SiRNA target sequence
atatcactagtcaatttccg

SEQ ID NO: 37733 - DNA, 20 bp, Artificial sequence
  SiRNA target sequence
tatcactagtcaatttccgg

SEQ ID NO: 37734 - DNA, 20 bp, Artificial sequence
  SiRNA target sequence
atcactagtcaatttccggg

SEQ ID NO: 37735 - DNA, 20 bp, Artificial sequence
  SiRNA target sequence
tcactagtcaatttccgggt

SEQ ID NO: 37736 - DNA, 20 bp, Artificial sequence
  SiRNA target sequence
cactagtcaatttccgggta

SEQ ID NO: 37737 - DNA, 20 bp, Artificial sequence
  SiRNA target sequence
actagtcaatttccgggtag

SEQ ID NO: 37738 - DNA, 20 bp, Artificial sequence
  SiRNA target sequence
ctagtcaatttccgggtagc

SEQ ID NO: 37739 - DNA, 20 bp, Artificial sequence
  SiRNA target sequence
tagtcaatttccgggtagct

SEQ ID NO: 37740 - DNA, 20 bp, Artificial sequence
  SiRNA target sequence
agtcaatttccgggtagctt

SEQ ID NO: 37741 - DNA, 20 bp, Artificial sequence
  SiRNA target sequence
gtcaatttccgggtagcttc

SEQ ID NO: 37742 - DNA, 20 bp, Artificial sequence
  SiRNA target sequence
tcaatttccgggtagcttca

SEQ ID NO: 37743 - DNA, 20 bp, Artificial sequence
  SiRNA target sequence
caatttccgggtagcttcaa

SEQ ID NO: 37744 - DNA, 20 bp, Artificial sequence
  SiRNA target sequence
aatttccgggtagcttcaac

SEQ ID NO: 37745 - DNA, 20 bp, Artificial sequence
  SiRNA target sequence
atttccgggtagcttcaact

SEQ ID NO: 37746 - DNA, 20 bp, Artificial sequence
  SiRNA target sequence
tttccgggtagcttcaactg

SEQ ID NO: 37747 - DNA, 20 bp, Artificial sequence
  SiRNA target sequence
ttccgggtagcttcaactgt

SEQ ID NO: 37748 - DNA, 20 bp, Artificial sequence
  SiRNA target sequence
tccgggtagcttcaactgtt

SEQ ID NO: 37749 - DNA, 20 bp, Artificial sequence
  SiRNA target sequence
ccgggtagcttcaactgtta

SEQ ID NO: 37750 - DNA, 20 bp, Artificial sequence
  SiRNA target sequence
cgggtagcttcaactgttaa

SEQ ID NO: 37751 - DNA, 20 bp, Artificial sequence
  SiRNA target sequence
gggtagcttcaactgttaaa

SEQ ID NO: 37752 - DNA, 20 bp, Artificial sequence
  SiRNA target sequence
ggtagcttcaactgttaaaa

SEQ ID NO: 37753 - DNA, 20 bp, Artificial sequence
  SiRNA target sequence
gtagcttcaactgttaaaac

SEQ ID NO: 37754 - DNA, 20 bp, Artificial sequence
  SiRNA target sequence
tagcttcaactgttaaaaca

SEQ ID NO: 37755 - DNA, 20 bp, Artificial sequence
  SiRNA target sequence
agcttcaactgttaaaacat

SEQ ID NO: 37756 - DNA, 20 bp, Artificial sequence
  SiRNA target sequence
gcttcaactgttaaaacatt

SEQ ID NO: 37757 - DNA, 20 bp, Artificial sequence
  SiRNA target sequence
cttcaactgttaaaacatta

SEQ ID NO: 37758 - DNA, 20 bp, Artificial sequence
  SiRNA target sequence
ttcaactgttaaaacattaa

SEQ ID NO: 37759 - DNA, 20 bp, Artificial sequence
  SiRNA target sequence
tcaactgttaaaacattaaa

SEQ ID NO: 37760 - DNA, 20 bp, Artificial sequence
  SiRNA target sequence
caactgttaaaacattaaat

SEQ ID NO: 37761 - DNA, 20 bp, Artificial sequence
  SiRNA target sequence
aactgttaaaacattaaatg

SEQ ID NO: 37762 - DNA, 20 bp, Artificial sequence
  SiRNA target sequence
actgttaaaacattaaatgt

SEQ ID NO: 37763 - DNA, 20 bp, Artificial sequence
  SiRNA target sequence
ctgttaaaacattaaatgta

SEQ ID NO: 37764 - DNA, 20 bp, Artificial sequence
  SiRNA target sequence
tgttaaaacattaaatgtac

SEQ ID NO: 37765 - DNA, 20 bp, Artificial sequence
  SiRNA target sequence
gttaaaacattaaatgtaca

SEQ ID NO: 37766 - DNA, 20 bp, Artificial sequence
  SiRNA target sequence
ttaaaacattaaatgtacaa

SEQ ID NO: 37767 - DNA, 20 bp, Artificial sequence
  SiRNA target sequence
taaaacattaaatgtacaaa

SEQ ID NO: 37768 - DNA, 20 bp, Artificial sequence
  SiRNA target sequence
aaaacattaaatgtacaaac

SEQ ID NO: 37769 - DNA, 20 bp, Artificial sequence
  SiRNA target sequence
aaacattaaatgtacaaact

SEQ ID NO: 37770 - DNA, 20 bp, Artificial sequence
  SiRNA target sequence
aacattaaatgtacaaactg

SEQ ID NO: 37771 - DNA, 20 bp, Artificial sequence
  SiRNA target sequence
acattaaatgtacaaactgc

SEQ ID NO: 37772 - DNA, 20 bp, Artificial sequence
  SiRNA target sequence
cattaaatgtacaaactgca

SEQ ID NO: 37773 - DNA, 20 bp, Artificial sequence
  SiRNA target sequence
attaaatgtacaaactgcaa

SEQ ID NO: 37774 - DNA, 20 bp, Artificial sequence
  SiRNA target sequence
ttaaatgtacaaactgcaaa

SEQ ID NO: 37775 - DNA, 20 bp, Artificial sequence
  SiRNA target sequence
taaatgtacaaactgcaaat

SEQ ID NO: 37776 - DNA, 20 bp, Artificial sequence
  SiRNA target sequence
aaatgtacaaactgcaaatg

SEQ ID NO: 37777 - DNA, 20 bp, Artificial sequence
  SiRNA target sequence
aatgtacaaactgcaaatgt

SEQ ID NO: 37778 - DNA, 20 bp, Artificial sequence
  SiRNA target sequence
atgtacaaactgcaaatgtc

SEQ ID NO: 37779 - DNA, 20 bp, Artificial sequence
  SiRNA target sequence
tgtacaaactgcaaatgtcc

SEQ ID NO: 37780 - DNA, 20 bp, Artificial sequence
  SiRNA target sequence
gtacaaactgcaaatgtccc

SEQ ID NO: 37781 - DNA, 20 bp, Artificial sequence
  SiRNA target sequence
tacaaactgcaaatgtccca

SEQ ID NO: 37782 - DNA, 20 bp, Artificial sequence
  SiRNA target sequence
acaaactgcaaatgtcccaa

SEQ ID NO: 37783 - DNA, 20 bp, Artificial sequence
  SiRNA target sequence
caaactgcaaatgtcccaaa

SEQ ID NO: 37784 - DNA, 20 bp, Artificial sequence
  SiRNA target sequence
aaactgcaaatgtcccaaaa

SEQ ID NO: 37785 - DNA, 20 bp, Artificial sequence
  SiRNA target sequence
aactgcaaatgtcccaaaaa

SEQ ID NO: 37786 - DNA, 20 bp, Artificial sequence
  SiRNA target sequence
actgcaaatgtcccaaaaat

SEQ ID NO: 37787 - DNA, 20 bp, Artificial sequence
  SiRNA target sequence
ctgcaaatgtcccaaaaatt

SEQ ID NO: 37788 - DNA, 20 bp, Artificial sequence
  SiRNA target sequence
tgcaaatgtcccaaaaatta

SEQ ID NO: 37789 - DNA, 20 bp, Artificial sequence
  SiRNA target sequence
gcaaatgtcccaaaaattat

SEQ ID NO: 37790 - DNA, 20 bp, Artificial sequence
  SiRNA target sequence
caaatgtcccaaaaattatg

SEQ ID NO: 37791 - DNA, 20 bp, Artificial sequence
  SiRNA target sequence
aaatgtcccaaaaattatgt

SEQ ID NO: 37792 - DNA, 20 bp, Artificial sequence
  SiRNA target sequence
aatgtcccaaaaattatgta

SEQ ID NO: 37793 - DNA, 20 bp, Artificial sequence
  SiRNA target sequence
atgtcccaaaaattatgtaa

SEQ ID NO: 37794 - DNA, 20 bp, Artificial sequence
  SiRNA target sequence
tgtcccaaaaattatgtaaa

SEQ ID NO: 37795 - DNA, 20 bp, Artificial sequence
  SiRNA target sequence
gtcccaaaaattatgtaaat

SEQ ID NO: 37796 - DNA, 20 bp, Artificial sequence
  SiRNA target sequence
tcccaaaaattatgtaaatg

SEQ ID NO: 37797 - DNA, 20 bp, Artificial sequence
  SiRNA target sequence
cccaaaaattatgtaaatga

SEQ ID NO: 37798 - DNA, 20 bp, Artificial sequence
  SiRNA target sequence
ccaaaaattatgtaaatgac

SEQ ID NO: 37799 - DNA, 20 bp, Artificial sequence
  SiRNA target sequence
caaaaattatgtaaatgaca

SEQ ID NO: 37800 - DNA, 20 bp, Artificial sequence
  SiRNA target sequence
aaaaattatgtaaatgacaa

SEQ ID NO: 37801 - DNA, 20 bp, Artificial sequence
  SiRNA target sequence
aaaattatgtaaatgacaaa

SEQ ID NO: 37802 - DNA, 20 bp, Artificial sequence
  SiRNA target sequence
aaattatgtaaatgacaaat

SEQ ID NO: 37803 - DNA, 20 bp, Artificial sequence
  SiRNA target sequence
aattatgtaaatgacaaatg

SEQ ID NO: 37804 - DNA, 20 bp, Artificial sequence
  SiRNA target sequence
attatgtaaatgacaaatgt

SEQ ID NO: 37805 - DNA, 20 bp, Artificial sequence
  SiRNA target sequence
ttatgtaaatgacaaatgtt

SEQ ID NO: 37806 - DNA, 20 bp, Artificial sequence
  SiRNA target sequence
tatgtaaatgacaaatgttc

SEQ ID NO: 37807 - DNA, 20 bp, Artificial sequence
  SiRNA target sequence
atgtaaatgacaaatgttcg

SEQ ID NO: 37808 - DNA, 20 bp, Artificial sequence
  SiRNA target sequence
tgtaaatgacaaatgttcga

SEQ ID NO: 37809 - DNA, 20 bp, Artificial sequence
  SiRNA target sequence
gtaaatgacaaatgttcgaa

SEQ ID NO: 37810 - DNA, 20 bp, Artificial sequence
  SiRNA target sequence
taaatgacaaatgttcgaat

SEQ ID NO: 37811 - DNA, 20 bp, Artificial sequence
  SiRNA target sequence
aaatgacaaatgttcgaata

SEQ ID NO: 37812 - DNA, 20 bp, Artificial sequence
  SiRNA target sequence
aatgacaaatgttcgaataa

SEQ ID NO: 37813 - DNA, 20 bp, Artificial sequence
  SiRNA target sequence
atgacaaatgttcgaataaa

SEQ ID NO: 37814 - DNA, 20 bp, Artificial sequence
  SiRNA target sequence
tgacaaatgttcgaataaag

SEQ ID NO: 37815 - DNA, 20 bp, Artificial sequence
  SiRNA target sequence
gacaaatgttcgaataaagg

SEQ ID NO: 37816 - DNA, 20 bp, Artificial sequence
  SiRNA target sequence
acaaatgttcgaataaaggg

SEQ ID NO: 37817 - DNA, 20 bp, Artificial sequence
  SiRNA target sequence
caaatgttcgaataaagggc

SEQ ID NO: 37818 - DNA, 20 bp, Artificial sequence
  SiRNA target sequence
aaatgttcgaataaagggct

SEQ ID NO: 37819 - DNA, 20 bp, Artificial sequence
  SiRNA target sequence
aatgttcgaataaagggctt

SEQ ID NO: 37820 - DNA, 20 bp, Artificial sequence
  SiRNA target sequence
atgttcgaataaagggcttt

SEQ ID NO: 37821 - DNA, 20 bp, Artificial sequence
  SiRNA target sequence
tgttcgaataaagggctttg

SEQ ID NO: 37822 - DNA, 20 bp, Artificial sequence
  SiRNA target sequence
gttcgaataaagggctttga

SEQ ID NO: 37823 - DNA, 20 bp, Artificial sequence
  SiRNA target sequence
ttcgaataaagggctttgaa

SEQ ID NO: 37824 - DNA, 20 bp, Artificial sequence
  SiRNA target sequence
tcgaataaagggctttgaaa

SEQ ID NO: 37825 - DNA, 20 bp, Artificial sequence
  SiRNA target sequence
cgaataaagggctttgaaat

SEQ ID NO: 37826 - DNA, 20 bp, Artificial sequence
  SiRNA target sequence
gaataaagggctttgaaata

SEQ ID NO: 37827 - DNA, 20 bp, Artificial sequence
  SiRNA target sequence
aataaagggctttgaaataa

SEQ ID NO: 37828 - DNA, 20 bp, Artificial sequence
  SiRNA target sequence
ataaagggctttgaaataac

SEQ ID NO: 37829 - DNA, 20 bp, Artificial sequence
  SiRNA target sequence
taaagggctttgaaataaca

SEQ ID NO: 37830 - DNA, 20 bp, Artificial sequence
  SiRNA target sequence
aaagggctttgaaataacat

SEQ ID NO: 37831 - DNA, 20 bp, Artificial sequence
  SiRNA target sequence
aagggctttgaaataacata

SEQ ID NO: 37832 - DNA, 20 bp, Artificial sequence
  SiRNA target sequence
agggctttgaaataacatat

SEQ ID NO: 37833 - DNA, 20 bp, Artificial sequence
  SiRNA target sequence
gggctttgaaataacatatt

SEQ ID NO: 37834 - DNA, 20 bp, Artificial sequence
  SiRNA target sequence
ggctttgaaataacatattc

SEQ ID NO: 37835 - DNA, 20 bp, Artificial sequence
  SiRNA target sequence
gctttgaaataacatattct

SEQ ID NO: 37836 - DNA, 20 bp, Artificial sequence
  SiRNA target sequence
ctttgaaataacatattcta

SEQ ID NO: 37837 - DNA, 20 bp, Artificial sequence
  SiRNA target sequence
tttgaaataacatattctac

SEQ ID NO: 37838 - DNA, 20 bp, Artificial sequence
  SiRNA target sequence
ttgaaataacatattctaca

SEQ ID NO: 37839 - DNA, 20 bp, Artificial sequence
  SiRNA target sequence
tgaaataacatattctacaa

SEQ ID NO: 37840 - DNA, 20 bp, Artificial sequence
  SiRNA target sequence
gaaataacatattctacaat

SEQ ID NO: 37841 - DNA, 20 bp, Artificial sequence
  SiRNA target sequence
aaataacatattctacaatc

SEQ ID NO: 37842 - DNA, 20 bp, Artificial sequence
  SiRNA target sequence
aataacatattctacaatca

SEQ ID NO: 37843 - DNA, 20 bp, Artificial sequence
  SiRNA target sequence
ataacatattctacaatcag

SEQ ID NO: 37844 - DNA, 20 bp, Artificial sequence
  SiRNA target sequence
taacatattctacaatcagg

SEQ ID NO: 37845 - DNA, 20 bp, Artificial sequence
  SiRNA target sequence
aacatattctacaatcaggt

SEQ ID NO: 37846 - DNA, 20 bp, Artificial sequence
  SiRNA target sequence
acatattctacaatcaggtc

SEQ ID NO: 37847 - DNA, 20 bp, Artificial sequence
  SiRNA target sequence
catattctacaatcaggtct

SEQ ID NO: 37848 - DNA, 20 bp, Artificial sequence
  SiRNA target sequence
atattctacaatcaggtctt

SEQ ID NO: 37849 - DNA, 20 bp, Artificial sequence
  SiRNA target sequence
tattctacaatcaggtcttt

SEQ ID NO: 37850 - DNA, 20 bp, Artificial sequence
  SiRNA target sequence
attctacaatcaggtctttc

SEQ ID NO: 37851 - DNA, 20 bp, Artificial sequence
  SiRNA target sequence
ttctacaatcaggtctttca

SEQ ID NO: 37852 - DNA, 20 bp, Artificial sequence
  SiRNA target sequence
tctacaatcaggtctttcat

SEQ ID NO: 37853 - DNA, 20 bp, Artificial sequence
  SiRNA target sequence
ctacaatcaggtctttcata

SEQ ID NO: 37854 - DNA, 20 bp, Artificial sequence
  SiRNA target sequence
tacaatcaggtctttcataa

SEQ ID NO: 37855 - DNA, 20 bp, Artificial sequence
  SiRNA target sequence
acaatcaggtctttcataat

SEQ ID NO: 37856 - DNA, 20 bp, Artificial sequence
  SiRNA target sequence
caatcaggtctttcataata

SEQ ID NO: 37857 - DNA, 20 bp, Artificial sequence
  SiRNA target sequence
aatcaggtctttcataatac

SEQ ID NO: 37858 - DNA, 20 bp, Artificial sequence
  SiRNA target sequence
atcaggtctttcataatact

SEQ ID NO: 37859 - DNA, 20 bp, Artificial sequence
  SiRNA target sequence
tcaggtctttcataatacta

SEQ ID NO: 37860 - DNA, 20 bp, Artificial sequence
  SiRNA target sequence
caggtctttcataatactaa

SEQ ID NO: 37861 - DNA, 20 bp, Artificial sequence
  SiRNA target sequence
aggtctttcataatactaat

SEQ ID NO: 37862 - DNA, 20 bp, Artificial sequence
  SiRNA target sequence
ggtctttcataatactaata

SEQ ID NO: 37863 - DNA, 20 bp, Artificial sequence
  SiRNA target sequence
gtctttcataatactaatat

SEQ ID NO: 37864 - DNA, 20 bp, Artificial sequence
  SiRNA target sequence
tctttcataatactaatatc

SEQ ID NO: 37865 - DNA, 20 bp, Artificial sequence
  SiRNA target sequence
ctttcataatactaatatca

SEQ ID NO: 37866 - DNA, 20 bp, Artificial sequence
  SiRNA target sequence
tttcataatactaatatcac

SEQ ID NO: 37867 - DNA, 20 bp, Artificial sequence
  SiRNA target sequence
ttcataatactaatatcact

SEQ ID NO: 37868 - DNA, 20 bp, Artificial sequence
  SiRNA target sequence
tcataatactaatatcacta

SEQ ID NO: 37869 - DNA, 20 bp, Artificial sequence
  SiRNA target sequence
cataatactaatatcactac

SEQ ID NO: 37870 - DNA, 20 bp, Artificial sequence
  SiRNA target sequence
ataatactaatatcactacc

SEQ ID NO: 37871 - DNA, 20 bp, Artificial sequence
  SiRNA target sequence
taatactaatatcactacca

SEQ ID NO: 37872 - DNA, 20 bp, Artificial sequence
  SiRNA target sequence
aatactaatatcactaccat

SEQ ID NO: 37873 - DNA, 20 bp, Artificial sequence
  SiRNA target sequence
atactaatatcactaccata

SEQ ID NO: 37874 - DNA, 20 bp, Artificial sequence
  SiRNA target sequence
tactaatatcactaccataa

SEQ ID NO: 37875 - DNA, 20 bp, Artificial sequence
  SiRNA target sequence
actaatatcactaccataaa

SEQ ID NO: 37876 - DNA, 20 bp, Artificial sequence
  SiRNA target sequence
ctaatatcactaccataaat

SEQ ID NO: 37877 - DNA, 20 bp, Artificial sequence
  SiRNA target sequence
taatatcactaccataaata

SEQ ID NO: 37878 - DNA, 20 bp, Artificial sequence
  SiRNA target sequence
aatatcactaccataaatag

SEQ ID NO: 37879 - DNA, 20 bp, Artificial sequence
  SiRNA target sequence
atatcactaccataaataga

SEQ ID NO: 37880 - DNA, 20 bp, Artificial sequence
  SiRNA target sequence
tatcactaccataaatagat

SEQ ID NO: 37881 - DNA, 20 bp, Artificial sequence
  SiRNA target sequence
atcactaccataaatagatt

SEQ ID NO: 37882 - DNA, 20 bp, Artificial sequence
  SiRNA target sequence
tcactaccataaatagattt

SEQ ID NO: 37883 - DNA, 20 bp, Artificial sequence
  SiRNA target sequence
cactaccataaatagatttt

SEQ ID NO: 37884 - DNA, 20 bp, Artificial sequence
  SiRNA target sequence
actaccataaatagattttt

SEQ ID NO: 37885 - DNA, 20 bp, Artificial sequence
  SiRNA target sequence
ctaccataaatagatttttt

SEQ ID NO: 37886 - DNA, 20 bp, Artificial sequence
  SiRNA target sequence
taccataaatagattttttt

SEQ ID NO: 37887 - DNA, 20 bp, Artificial sequence
  SiRNA target sequence
accataaatagatttttttt

SEQ ID NO: 37888 - DNA, 20 bp, Artificial sequence
  SiRNA target sequence
ccataaatagattttttttc

SEQ ID NO: 37889 - DNA, 20 bp, Artificial sequence
  SiRNA target sequence
cataaatagattttttttct

SEQ ID NO: 37890 - DNA, 20 bp, Artificial sequence
  SiRNA target sequence
ataaatagattttttttcta

SEQ ID NO: 37891 - DNA, 20 bp, Artificial sequence
  SiRNA target sequence
taaatagattttttttctaa

SEQ ID NO: 37892 - DNA, 20 bp, Artificial sequence
  SiRNA target sequence
aaatagattttttttctaac

SEQ ID NO: 37893 - DNA, 20 bp, Artificial sequence
  SiRNA target sequence
aatagattttttttctaaca

SEQ ID NO: 37894 - DNA, 20 bp, Artificial sequence
  SiRNA target sequence
atagattttttttctaacat

SEQ ID NO: 37895 - DNA, 21 bp, Artificial sequence
  SiRNA target sequence
ttataagtttaatgtagaaat

SEQ ID NO: 37896 - DNA, 21 bp, Artificial sequence
  SiRNA target sequence
tataagtttaatgtagaaata

SEQ ID NO: 37897 - DNA, 21 bp, Artificial sequence
  SiRNA target sequence
ataagtttaatgtagaaataa

SEQ ID NO: 37898 - DNA, 21 bp, Artificial sequence
  SiRNA target sequence
taagtttaatgtagaaataat

SEQ ID NO: 37899 - DNA, 21 bp, Artificial sequence
  SiRNA target sequence
aagtttaatgtagaaataata

SEQ ID NO: 37900 - DNA, 21 bp, Artificial sequence
  SiRNA target sequence
agtttaatgtagaaataatat

SEQ ID NO: 37901 - DNA, 21 bp, Artificial sequence
  SiRNA target sequence
gtttaatgtagaaataatatt

SEQ ID NO: 37902 - DNA, 21 bp, Artificial sequence
  SiRNA target sequence
tttaatgtagaaataatattt

SEQ ID NO: 37903 - DNA, 21 bp, Artificial sequence
  SiRNA target sequence
ttaatgtagaaataatatttt

SEQ ID NO: 37904 - DNA, 21 bp, Artificial sequence
  SiRNA target sequence
taatgtagaaataatattttc

SEQ ID NO: 37905 - DNA, 21 bp, Artificial sequence
  SiRNA target sequence
aatgtagaaataatattttct

SEQ ID NO: 37906 - DNA, 21 bp, Artificial sequence
  SiRNA target sequence
atgtagaaataatattttctt

SEQ ID NO: 37907 - DNA, 21 bp, Artificial sequence
  SiRNA target sequence
tgtagaaataatattttcttc

SEQ ID NO: 37908 - DNA, 21 bp, Artificial sequence
  SiRNA target sequence
gtagaaataatattttcttct

SEQ ID NO: 37909 - DNA, 21 bp, Artificial sequence
  SiRNA target sequence
tagaaataatattttcttcta

SEQ ID NO: 37910 - DNA, 21 bp, Artificial sequence
  SiRNA target sequence
agaaataatattttcttctat

SEQ ID NO: 37911 - DNA, 21 bp, Artificial sequence
  SiRNA target sequence
gaaataatattttcttctatc

SEQ ID NO: 37912 - DNA, 21 bp, Artificial sequence
  SiRNA target sequence
aaataatattttcttctatct

SEQ ID NO: 37913 - DNA, 21 bp, Artificial sequence
  SiRNA target sequence
aataatattttcttctatctt

SEQ ID NO: 37914 - DNA, 21 bp, Artificial sequence
  SiRNA target sequence
ataatattttcttctatctta

SEQ ID NO: 37915 - DNA, 21 bp, Artificial sequence
  SiRNA target sequence
taatattttcttctatcttat

SEQ ID NO: 37916 - DNA, 21 bp, Artificial sequence
  SiRNA target sequence
aatattttcttctatcttatg

SEQ ID NO: 37917 - DNA, 21 bp, Artificial sequence
  SiRNA target sequence
atattttcttctatcttatgt

SEQ ID NO: 37918 - DNA, 21 bp, Artificial sequence
  SiRNA target sequence
tattttcttctatcttatgta

SEQ ID NO: 37919 - DNA, 21 bp, Artificial sequence
  SiRNA target sequence
attttcttctatcttatgtaa

SEQ ID NO: 37920 - DNA, 21 bp, Artificial sequence
  SiRNA target sequence
ttttcttctatcttatgtaat

SEQ ID NO: 37921 - DNA, 21 bp, Artificial sequence
  SiRNA target sequence
tttcttctatcttatgtaatg

SEQ ID NO: 37922 - DNA, 21 bp, Artificial sequence
  SiRNA target sequence
ttcttctatcttatgtaatga

SEQ ID NO: 37923 - DNA, 21 bp, Artificial sequence
  SiRNA target sequence
tcttctatcttatgtaatgat

SEQ ID NO: 37924 - DNA, 21 bp, Artificial sequence
  SiRNA target sequence
cttctatcttatgtaatgata

SEQ ID NO: 37925 - DNA, 21 bp, Artificial sequence
  SiRNA target sequence
ttctatcttatgtaatgatac

SEQ ID NO: 37926 - DNA, 21 bp, Artificial sequence
  SiRNA target sequence
tctatcttatgtaatgataca

SEQ ID NO: 37927 - DNA, 21 bp, Artificial sequence
  SiRNA target sequence
ctatcttatgtaatgatacag

SEQ ID NO: 37928 - DNA, 21 bp, Artificial sequence
  SiRNA target sequence
tatcttatgtaatgatacagt

SEQ ID NO: 37929 - DNA, 21 bp, Artificial sequence
  SiRNA target sequence
atcttatgtaatgatacagtt

SEQ ID NO: 37930 - DNA, 21 bp, Artificial sequence
  SiRNA target sequence
tcttatgtaatgatacagttt

SEQ ID NO: 37931 - DNA, 21 bp, Artificial sequence
  SiRNA target sequence
cttatgtaatgatacagtttt

SEQ ID NO: 37932 - DNA, 21 bp, Artificial sequence
  SiRNA target sequence
ttatgtaatgatacagttttg

SEQ ID NO: 37933 - DNA, 21 bp, Artificial sequence
  SiRNA target sequence
tatgtaatgatacagttttgt

SEQ ID NO: 37934 - DNA, 21 bp, Artificial sequence
  SiRNA target sequence
atgtaatgatacagttttgtt

SEQ ID NO: 37935 - DNA, 21 bp, Artificial sequence
  SiRNA target sequence
tgtaatgatacagttttgttt

SEQ ID NO: 37936 - DNA, 21 bp, Artificial sequence
  SiRNA target sequence
gtaatgatacagttttgtttt

SEQ ID NO: 37937 - DNA, 21 bp, Artificial sequence
  SiRNA target sequence
taatgatacagttttgttttt

SEQ ID NO: 37938 - DNA, 21 bp, Artificial sequence
  SiRNA target sequence
aatgatacagttttgttttta

SEQ ID NO: 37939 - DNA, 21 bp, Artificial sequence
  SiRNA target sequence
atgatacagttttgtttttaa

SEQ ID NO: 37940 - DNA, 21 bp, Artificial sequence
  SiRNA target sequence
tgatacagttttgtttttaat

SEQ ID NO: 37941 - DNA, 21 bp, Artificial sequence
  SiRNA target sequence
gatacagttttgtttttaata

SEQ ID NO: 37942 - DNA, 21 bp, Artificial sequence
  SiRNA target sequence
atacagttttgtttttaatac

SEQ ID NO: 37943 - DNA, 21 bp, Artificial sequence
  SiRNA target sequence
tacagttttgtttttaatact

SEQ ID NO: 37944 - DNA, 21 bp, Artificial sequence
  SiRNA target sequence
acagttttgtttttaatactt

SEQ ID NO: 37945 - DNA, 21 bp, Artificial sequence
  SiRNA target sequence
cagttttgtttttaatactta

SEQ ID NO: 37946 - DNA, 21 bp, Artificial sequence
  SiRNA target sequence
agttttgtttttaatacttag

SEQ ID NO: 37947 - DNA, 21 bp, Artificial sequence
  SiRNA target sequence
gttttgtttttaatacttagc

SEQ ID NO: 37948 - DNA, 21 bp, Artificial sequence
  SiRNA target sequence
ttttgtttttaatacttagca

SEQ ID NO: 37949 - DNA, 21 bp, Artificial sequence
  SiRNA target sequence
tttgtttttaatacttagcac

SEQ ID NO: 37950 - DNA, 21 bp, Artificial sequence
  SiRNA target sequence
ttgtttttaatacttagcact

SEQ ID NO: 37951 - DNA, 21 bp, Artificial sequence
  SiRNA target sequence
tgtttttaatacttagcactt

SEQ ID NO: 37952 - DNA, 21 bp, Artificial sequence
  SiRNA target sequence
gtttttaatacttagcacttt

SEQ ID NO: 37953 - DNA, 21 bp, Artificial sequence
  SiRNA target sequence
tttttaatacttagcacttta

SEQ ID NO: 37954 - DNA, 21 bp, Artificial sequence
  SiRNA target sequence
ttttaatacttagcactttat

SEQ ID NO: 37955 - DNA, 21 bp, Artificial sequence
  SiRNA target sequence
tttaatacttagcactttatc

SEQ ID NO: 37956 - DNA, 21 bp, Artificial sequence
  SiRNA target sequence
ttaatacttagcactttatca

SEQ ID NO: 37957 - DNA, 21 bp, Artificial sequence
  SiRNA target sequence
taatacttagcactttatcaa

SEQ ID NO: 37958 - DNA, 21 bp, Artificial sequence
  SiRNA target sequence
aatacttagcactttatcaaa

SEQ ID NO: 37959 - DNA, 21 bp, Artificial sequence
  SiRNA target sequence
atacttagcactttatcaaat

SEQ ID NO: 37960 - DNA, 21 bp, Artificial sequence
  SiRNA target sequence
tacttagcactttatcaaata

SEQ ID NO: 37961 - DNA, 21 bp, Artificial sequence
  SiRNA target sequence
acttagcactttatcaaataa

SEQ ID NO: 37962 - DNA, 21 bp, Artificial sequence
  SiRNA target sequence
cttagcactttatcaaataag

SEQ ID NO: 37963 - DNA, 21 bp, Artificial sequence
  SiRNA target sequence
ttagcactttatcaaataagt

SEQ ID NO: 37964 - DNA, 21 bp, Artificial sequence
  SiRNA target sequence
tagcactttatcaaataagtg

SEQ ID NO: 37965 - DNA, 21 bp, Artificial sequence
  SiRNA target sequence
agcactttatcaaataagtgg

SEQ ID NO: 37966 - DNA, 21 bp, Artificial sequence
  SiRNA target sequence
gcactttatcaaataagtgga

SEQ ID NO: 37967 - DNA, 21 bp, Artificial sequence
  SiRNA target sequence
cactttatcaaataagtggag

SEQ ID NO: 37968 - DNA, 21 bp, Artificial sequence
  SiRNA target sequence
actttatcaaataagtggagt

SEQ ID NO: 37969 - DNA, 21 bp, Artificial sequence
  SiRNA target sequence
ctttatcaaataagtggagta

SEQ ID NO: 37970 - DNA, 21 bp, Artificial sequence
  SiRNA target sequence
tttatcaaataagtggagtaa

SEQ ID NO: 37971 - DNA, 21 bp, Artificial sequence
  SiRNA target sequence
ttatcaaataagtggagtaaa

SEQ ID NO: 37972 - DNA, 21 bp, Artificial sequence
  SiRNA target sequence
tatcaaataagtggagtaaat

SEQ ID NO: 37973 - DNA, 21 bp, Artificial sequence
  SiRNA target sequence
atcaaataagtggagtaaatc

SEQ ID NO: 37974 - DNA, 21 bp, Artificial sequence
  SiRNA target sequence
tcaaataagtggagtaaatct

SEQ ID NO: 37975 - DNA, 21 bp, Artificial sequence
  SiRNA target sequence
caaataagtggagtaaatcta

SEQ ID NO: 37976 - DNA, 21 bp, Artificial sequence
  SiRNA target sequence
aaataagtggagtaaatctaa

SEQ ID NO: 37977 - DNA, 21 bp, Artificial sequence
  SiRNA target sequence
aataagtggagtaaatctaaa

SEQ ID NO: 37978 - DNA, 21 bp, Artificial sequence
  SiRNA target sequence
ataagtggagtaaatctaaat

SEQ ID NO: 37979 - DNA, 21 bp, Artificial sequence
  SiRNA target sequence
taagtggagtaaatctaaatt

SEQ ID NO: 37980 - DNA, 21 bp, Artificial sequence
  SiRNA target sequence
aagtggagtaaatctaaatta

SEQ ID NO: 37981 - DNA, 21 bp, Artificial sequence
  SiRNA target sequence
agtggagtaaatctaaattat

SEQ ID NO: 37982 - DNA, 21 bp, Artificial sequence
  SiRNA target sequence
gtggagtaaatctaaattatg

SEQ ID NO: 37983 - DNA, 21 bp, Artificial sequence
  SiRNA target sequence
tggagtaaatctaaattatgt

SEQ ID NO: 37984 - DNA, 21 bp, Artificial sequence
  SiRNA target sequence
ggagtaaatctaaattatgta

SEQ ID NO: 37985 - DNA, 21 bp, Artificial sequence
  SiRNA target sequence
gagtaaatctaaattatgtaa

SEQ ID NO: 37986 - DNA, 21 bp, Artificial sequence
  SiRNA target sequence
agtaaatctaaattatgtaaa

SEQ ID NO: 37987 - DNA, 21 bp, Artificial sequence
  SiRNA target sequence
gtaaatctaaattatgtaaaa

SEQ ID NO: 37988 - DNA, 21 bp, Artificial sequence
  SiRNA target sequence
taaatctaaattatgtaaaac

SEQ ID NO: 37989 - DNA, 21 bp, Artificial sequence
  SiRNA target sequence
aaatctaaattatgtaaaaca

SEQ ID NO: 37990 - DNA, 21 bp, Artificial sequence
  SiRNA target sequence
aatctaaattatgtaaaacaa

SEQ ID NO: 37991 - DNA, 21 bp, Artificial sequence
  SiRNA target sequence
atctaaattatgtaaaacaat

SEQ ID NO: 37992 - DNA, 21 bp, Artificial sequence
  SiRNA target sequence
tctaaattatgtaaaacaata

SEQ ID NO: 37993 - DNA, 21 bp, Artificial sequence
  SiRNA target sequence
ctaaattatgtaaaacaataa

SEQ ID NO: 37994 - DNA, 21 bp, Artificial sequence
  SiRNA target sequence
taaattatgtaaaacaataat

SEQ ID NO: 37995 - DNA, 21 bp, Artificial sequence
  SiRNA target sequence
aaattatgtaaaacaataatt

SEQ ID NO: 37996 - DNA, 21 bp, Artificial sequence
  SiRNA target sequence
aattatgtaaaacaataatta

SEQ ID NO: 37997 - DNA, 21 bp, Artificial sequence
  SiRNA target sequence
attatgtaaaacaataattat

SEQ ID NO: 37998 - DNA, 21 bp, Artificial sequence
  SiRNA target sequence
ttatgtaaaacaataattatc

SEQ ID NO: 37999 - DNA, 21 bp, Artificial sequence
  SiRNA target sequence
tatgtaaaacaataattatcg

SEQ ID NO: 38000 - DNA, 21 bp, Artificial sequence
  SiRNA target sequence
atgtaaaacaataattatcgt

SEQ ID NO: 38001 - DNA, 21 bp, Artificial sequence
  SiRNA target sequence
tgtaaaacaataattatcgtc

SEQ ID NO: 38002 - DNA, 21 bp, Artificial sequence
  SiRNA target sequence
gtaaaacaataattatcgtct

SEQ ID NO: 38003 - DNA, 21 bp, Artificial sequence
  SiRNA target sequence
taaaacaataattatcgtctt

SEQ ID NO: 38004 - DNA, 21 bp, Artificial sequence
  SiRNA target sequence
aaaacaataattatcgtcttc

SEQ ID NO: 38005 - DNA, 21 bp, Artificial sequence
  SiRNA target sequence
aaacaataattatcgtcttct

SEQ ID NO: 38006 - DNA, 21 bp, Artificial sequence
  SiRNA target sequence
aacaataattatcgtcttctc

SEQ ID NO: 38007 - DNA, 21 bp, Artificial sequence
  SiRNA target sequence
acaataattatcgtcttctct

SEQ ID NO: 38008 - DNA, 21 bp, Artificial sequence
  SiRNA target sequence
caataattatcgtcttctcta

SEQ ID NO: 38009 - DNA, 21 bp, Artificial sequence
  SiRNA target sequence
aataattatcgtcttctctaa

SEQ ID NO: 38010 - DNA, 21 bp, Artificial sequence
  SiRNA target sequence
ataattatcgtcttctctaag

SEQ ID NO: 38011 - DNA, 21 bp, Artificial sequence
  SiRNA target sequence
taattatcgtcttctctaagt

SEQ ID NO: 38012 - DNA, 21 bp, Artificial sequence
  SiRNA target sequence
aattatcgtcttctctaagtt

SEQ ID NO: 38013 - DNA, 21 bp, Artificial sequence
  SiRNA target sequence
attatcgtcttctctaagttg

SEQ ID NO: 38014 - DNA, 21 bp, Artificial sequence
  SiRNA target sequence
ttatcgtcttctctaagttgt

SEQ ID NO: 38015 - DNA, 21 bp, Artificial sequence
  SiRNA target sequence
tatcgtcttctctaagttgtt

SEQ ID NO: 38016 - DNA, 21 bp, Artificial sequence
  SiRNA target sequence
atcgtcttctctaagttgttg

SEQ ID NO: 38017 - DNA, 21 bp, Artificial sequence
  SiRNA target sequence
tcgtcttctctaagttgttgg

SEQ ID NO: 38018 - DNA, 21 bp, Artificial sequence
  SiRNA target sequence
cgtcttctctaagttgttgga

SEQ ID NO: 38019 - DNA, 21 bp, Artificial sequence
  SiRNA target sequence
gtcttctctaagttgttggag

SEQ ID NO: 38020 - DNA, 21 bp, Artificial sequence
  SiRNA target sequence
tcttctctaagttgttggaga

SEQ ID NO: 38021 - DNA, 21 bp, Artificial sequence
  SiRNA target sequence
cttctctaagttgttggagat

SEQ ID NO: 38022 - DNA, 21 bp, Artificial sequence
  SiRNA target sequence
ttctctaagttgttggagatt

SEQ ID NO: 38023 - DNA, 21 bp, Artificial sequence
  SiRNA target sequence
tctctaagttgttggagatta

SEQ ID NO: 38024 - DNA, 21 bp, Artificial sequence
  SiRNA target sequence
ctctaagttgttggagattag

SEQ ID NO: 38025 - DNA, 21 bp, Artificial sequence
  SiRNA target sequence
tctaagttgttggagattaga

SEQ ID NO: 38026 - DNA, 21 bp, Artificial sequence
  SiRNA target sequence
ctaagttgttggagattagac

SEQ ID NO: 38027 - DNA, 21 bp, Artificial sequence
  SiRNA target sequence
taagttgttggagattagact

SEQ ID NO: 38028 - DNA, 21 bp, Artificial sequence
  SiRNA target sequence
aagttgttggagattagactt

SEQ ID NO: 38029 - DNA, 21 bp, Artificial sequence
  SiRNA target sequence
agttgttggagattagacttt

SEQ ID NO: 38030 - DNA, 21 bp, Artificial sequence
  SiRNA target sequence
gttgttggagattagactttt

SEQ ID NO: 38031 - DNA, 21 bp, Artificial sequence
  SiRNA target sequence
ttgttggagattagactttta

SEQ ID NO: 38032 - DNA, 21 bp, Artificial sequence
  SiRNA target sequence
tgttggagattagacttttaa

SEQ ID NO: 38033 - DNA, 21 bp, Artificial sequence
  SiRNA target sequence
gttggagattagacttttaag

SEQ ID NO: 38034 - DNA, 21 bp, Artificial sequence
  SiRNA target sequence
ttggagattagacttttaaga

SEQ ID NO: 38035 - DNA, 21 bp, Artificial sequence
  SiRNA target sequence
tggagattagacttttaagaa

SEQ ID NO: 38036 - DNA, 21 bp, Artificial sequence
  SiRNA target sequence
ggagattagacttttaagaat

SEQ ID NO: 38037 - DNA, 21 bp, Artificial sequence
  SiRNA target sequence
gagattagacttttaagaatt

SEQ ID NO: 38038 - DNA, 21 bp, Artificial sequence
  SiRNA target sequence
agattagacttttaagaattt

SEQ ID NO: 38039 - DNA, 21 bp, Artificial sequence
  SiRNA target sequence
gattagacttttaagaatttc

SEQ ID NO: 38040 - DNA, 21 bp, Artificial sequence
  SiRNA target sequence
attagacttttaagaatttca

SEQ ID NO: 38041 - DNA, 21 bp, Artificial sequence
  SiRNA target sequence
ttagacttttaagaatttcat

SEQ ID NO: 38042 - DNA, 21 bp, Artificial sequence
  SiRNA target sequence
tagacttttaagaatttcata

SEQ ID NO: 38043 - DNA, 21 bp, Artificial sequence
  SiRNA target sequence
agacttttaagaatttcatat

SEQ ID NO: 38044 - DNA, 21 bp, Artificial sequence
  SiRNA target sequence
gacttttaagaatttcatatt

SEQ ID NO: 38045 - DNA, 21 bp, Artificial sequence
  SiRNA target sequence
acttttaagaatttcatattc

SEQ ID NO: 38046 - DNA, 21 bp, Artificial sequence
  SiRNA target sequence
cttttaagaatttcatattca

SEQ ID NO: 38047 - DNA, 21 bp, Artificial sequence
  SiRNA target sequence
ttttaagaatttcatattcag

SEQ ID NO: 38048 - DNA, 21 bp, Artificial sequence
  SiRNA target sequence
tttaagaatttcatattcagc

SEQ ID NO: 38049 - DNA, 21 bp, Artificial sequence
  SiRNA target sequence
ttaagaatttcatattcagct

SEQ ID NO: 38050 - DNA, 21 bp, Artificial sequence
  SiRNA target sequence
taagaatttcatattcagctt

SEQ ID NO: 38051 - DNA, 21 bp, Artificial sequence
  SiRNA target sequence
aagaatttcatattcagcttt

SEQ ID NO: 38052 - DNA, 21 bp, Artificial sequence
  SiRNA target sequence
agaatttcatattcagctttt

SEQ ID NO: 38053 - DNA, 21 bp, Artificial sequence
  SiRNA target sequence
gaatttcatattcagcttttt

SEQ ID NO: 38054 - DNA, 21 bp, Artificial sequence
  SiRNA target sequence
aatttcatattcagctttttt

SEQ ID NO: 38055 - DNA, 21 bp, Artificial sequence
  SiRNA target sequence
atttcatattcagcttttttg

SEQ ID NO: 38056 - DNA, 21 bp, Artificial sequence
  SiRNA target sequence
tttcatattcagcttttttgt

SEQ ID NO: 38057 - DNA, 21 bp, Artificial sequence
  SiRNA target sequence
ttcatattcagcttttttgtc

SEQ ID NO: 38058 - DNA, 21 bp, Artificial sequence
  SiRNA target sequence
tcatattcagcttttttgtcc

SEQ ID NO: 38059 - DNA, 21 bp, Artificial sequence
  SiRNA target sequence
catattcagcttttttgtcca

SEQ ID NO: 38060 - DNA, 21 bp, Artificial sequence
  SiRNA target sequence
atattcagcttttttgtccaa

SEQ ID NO: 38061 - DNA, 21 bp, Artificial sequence
  SiRNA target sequence
tattcagcttttttgtccaat

SEQ ID NO: 38062 - DNA, 21 bp, Artificial sequence
  SiRNA target sequence
attcagcttttttgtccaatg

SEQ ID NO: 38063 - DNA, 21 bp, Artificial sequence
  SiRNA target sequence
ttcagcttttttgtccaatgc

SEQ ID NO: 38064 - DNA, 21 bp, Artificial sequence
  SiRNA target sequence
tcagcttttttgtccaatgcg

SEQ ID NO: 38065 - DNA, 21 bp, Artificial sequence
  SiRNA target sequence
cagcttttttgtccaatgcgg

SEQ ID NO: 38066 - DNA, 21 bp, Artificial sequence
  SiRNA target sequence
agcttttttgtccaatgcggc

SEQ ID NO: 38067 - DNA, 21 bp, Artificial sequence
  SiRNA target sequence
gcttttttgtccaatgcggcc

SEQ ID NO: 38068 - DNA, 21 bp, Artificial sequence
  SiRNA target sequence
cttttttgtccaatgcggccg

SEQ ID NO: 38069 - DNA, 21 bp, Artificial sequence
  SiRNA target sequence
ttttttgtccaatgcggccgt

SEQ ID NO: 38070 - DNA, 21 bp, Artificial sequence
  SiRNA target sequence
tttttgtccaatgcggccgtt

SEQ ID NO: 38071 - DNA, 21 bp, Artificial sequence
  SiRNA target sequence
ttttgtccaatgcggccgttg

SEQ ID NO: 38072 - DNA, 21 bp, Artificial sequence
  SiRNA target sequence
tttgtccaatgcggccgttgg

SEQ ID NO: 38073 - DNA, 21 bp, Artificial sequence
  SiRNA target sequence
ttgtccaatgcggccgttggc

SEQ ID NO: 38074 - DNA, 21 bp, Artificial sequence
  SiRNA target sequence
tgtccaatgcggccgttggct

SEQ ID NO: 38075 - DNA, 21 bp, Artificial sequence
  SiRNA target sequence
gtccaatgcggccgttggctc

SEQ ID NO: 38076 - DNA, 21 bp, Artificial sequence
  SiRNA target sequence
tccaatgcggccgttggctca

SEQ ID NO: 38077 - DNA, 21 bp, Artificial sequence
  SiRNA target sequence
ccaatgcggccgttggctcat

SEQ ID NO: 38078 - DNA, 21 bp, Artificial sequence
  SiRNA target sequence
caatgcggccgttggctcatc

SEQ ID NO: 38079 - DNA, 21 bp, Artificial sequence
  SiRNA target sequence
aatgcggccgttggctcatct

SEQ ID NO: 38080 - DNA, 21 bp, Artificial sequence
  SiRNA target sequence
atgcggccgttggctcatcta

SEQ ID NO: 38081 - DNA, 21 bp, Artificial sequence
  SiRNA target sequence
tgcggccgttggctcatctaa

SEQ ID NO: 38082 - DNA, 21 bp, Artificial sequence
  SiRNA target sequence
gcggccgttggctcatctaaa

SEQ ID NO: 38083 - DNA, 21 bp, Artificial sequence
  SiRNA target sequence
cggccgttggctcatctaaaa

SEQ ID NO: 38084 - DNA, 21 bp, Artificial sequence
  SiRNA target sequence
ggccgttggctcatctaaaat

SEQ ID NO: 38085 - DNA, 21 bp, Artificial sequence
  SiRNA target sequence
gccgttggctcatctaaaatt

SEQ ID NO: 38086 - DNA, 21 bp, Artificial sequence
  SiRNA target sequence
ccgttggctcatctaaaatta

SEQ ID NO: 38087 - DNA, 21 bp, Artificial sequence
  SiRNA target sequence
cgttggctcatctaaaattat

SEQ ID NO: 38088 - DNA, 21 bp, Artificial sequence
  SiRNA target sequence
gttggctcatctaaaattata

SEQ ID NO: 38089 - DNA, 21 bp, Artificial sequence
  SiRNA target sequence
ttggctcatctaaaattataa

SEQ ID NO: 38090 - DNA, 21 bp, Artificial sequence
  SiRNA target sequence
tggctcatctaaaattataat

SEQ ID NO: 38091 - DNA, 21 bp, Artificial sequence
  SiRNA target sequence
ggctcatctaaaattataata

SEQ ID NO: 38092 - DNA, 21 bp, Artificial sequence
  SiRNA target sequence
gctcatctaaaattataatag

SEQ ID NO: 38093 - DNA, 21 bp, Artificial sequence
  SiRNA target sequence
ctcatctaaaattataatagg

SEQ ID NO: 38094 - DNA, 21 bp, Artificial sequence
  SiRNA target sequence
tcatctaaaattataatagga

SEQ ID NO: 38095 - DNA, 21 bp, Artificial sequence
  SiRNA target sequence
catctaaaattataataggag

SEQ ID NO: 38096 - DNA, 21 bp, Artificial sequence
  SiRNA target sequence
atctaaaattataataggaga

SEQ ID NO: 38097 - DNA, 21 bp, Artificial sequence
  SiRNA target sequence
tctaaaattataataggagaa

SEQ ID NO: 38098 - DNA, 21 bp, Artificial sequence
  SiRNA target sequence
ctaaaattataataggagaat

SEQ ID NO: 38099 - DNA, 21 bp, Artificial sequence
  SiRNA target sequence
taaaattataataggagaatt

SEQ ID NO: 38100 - DNA, 21 bp, Artificial sequence
  SiRNA target sequence
aaaattataataggagaattt

SEQ ID NO: 38101 - DNA, 21 bp, Artificial sequence
  SiRNA target sequence
aaattataataggagaatttt

SEQ ID NO: 38102 - DNA, 21 bp, Artificial sequence
  SiRNA target sequence
aattataataggagaattttt

SEQ ID NO: 38103 - DNA, 21 bp, Artificial sequence
  SiRNA target sequence
attataataggagaatttttt

SEQ ID NO: 38104 - DNA, 21 bp, Artificial sequence
  SiRNA target sequence
ttataataggagaatttttta

SEQ ID NO: 38105 - DNA, 21 bp, Artificial sequence
  SiRNA target sequence
tataataggagaattttttag

SEQ ID NO: 38106 - DNA, 21 bp, Artificial sequence
  SiRNA target sequence
ataataggagaattttttagt

SEQ ID NO: 38107 - DNA, 21 bp, Artificial sequence
  SiRNA target sequence
taataggagaattttttagtg

SEQ ID NO: 38108 - DNA, 21 bp, Artificial sequence
  SiRNA target sequence
aataggagaattttttagtgc

SEQ ID NO: 38109 - DNA, 21 bp, Artificial sequence
  SiRNA target sequence
ataggagaattttttagtgcc

SEQ ID NO: 38110 - DNA, 21 bp, Artificial sequence
  SiRNA target sequence
taggagaattttttagtgccg

SEQ ID NO: 38111 - DNA, 21 bp, Artificial sequence
  SiRNA target sequence
aggagaattttttagtgccga

SEQ ID NO: 38112 - DNA, 21 bp, Artificial sequence
  SiRNA target sequence
ggagaattttttagtgccgac

SEQ ID NO: 38113 - DNA, 21 bp, Artificial sequence
  SiRNA target sequence
gagaattttttagtgccgacc

SEQ ID NO: 38114 - DNA, 21 bp, Artificial sequence
  SiRNA target sequence
agaattttttagtgccgacct

SEQ ID NO: 38115 - DNA, 21 bp, Artificial sequence
  SiRNA target sequence
gaattttttagtgccgacctt

SEQ ID NO: 38116 - DNA, 21 bp, Artificial sequence
  SiRNA target sequence
aattttttagtgccgacctta

SEQ ID NO: 38117 - DNA, 21 bp, Artificial sequence
  SiRNA target sequence
attttttagtgccgaccttaa

SEQ ID NO: 38118 - DNA, 21 bp, Artificial sequence
  SiRNA target sequence
ttttttagtgccgaccttaac

SEQ ID NO: 38119 - DNA, 21 bp, Artificial sequence
  SiRNA target sequence
tttttagtgccgaccttaaca

SEQ ID NO: 38120 - DNA, 21 bp, Artificial sequence
  SiRNA target sequence
ttttagtgccgaccttaacaa

SEQ ID NO: 38121 - DNA, 21 bp, Artificial sequence
  SiRNA target sequence
tttagtgccgaccttaacaaa

SEQ ID NO: 38122 - DNA, 21 bp, Artificial sequence
  SiRNA target sequence
ttagtgccgaccttaacaaaa

SEQ ID NO: 38123 - DNA, 21 bp, Artificial sequence
  SiRNA target sequence
tagtgccgaccttaacaaaat

SEQ ID NO: 38124 - DNA, 21 bp, Artificial sequence
  SiRNA target sequence
agtgccgaccttaacaaaatt

SEQ ID NO: 38125 - DNA, 21 bp, Artificial sequence
  SiRNA target sequence
gtgccgaccttaacaaaatta

SEQ ID NO: 38126 - DNA, 21 bp, Artificial sequence
  SiRNA target sequence
tgccgaccttaacaaaattac

SEQ ID NO: 38127 - DNA, 21 bp, Artificial sequence
  SiRNA target sequence
gccgaccttaacaaaattact

SEQ ID NO: 38128 - DNA, 21 bp, Artificial sequence
  SiRNA target sequence
ccgaccttaacaaaattactt

SEQ ID NO: 38129 - DNA, 21 bp, Artificial sequence
  SiRNA target sequence
cgaccttaacaaaattacttt

SEQ ID NO: 38130 - DNA, 21 bp, Artificial sequence
  SiRNA target sequence
gaccttaacaaaattactttt

SEQ ID NO: 38131 - DNA, 21 bp, Artificial sequence
  SiRNA target sequence
accttaacaaaattacttttt

SEQ ID NO: 38132 - DNA, 21 bp, Artificial sequence
  SiRNA target sequence
ccttaacaaaattactttttg

SEQ ID NO: 38133 - DNA, 21 bp, Artificial sequence
  SiRNA target sequence
cttaacaaaattactttttgt

SEQ ID NO: 38134 - DNA, 21 bp, Artificial sequence
  SiRNA target sequence
ttaacaaaattactttttgtc

SEQ ID NO: 38135 - DNA, 21 bp, Artificial sequence
  SiRNA target sequence
taacaaaattactttttgtct

SEQ ID NO: 38136 - DNA, 21 bp, Artificial sequence
  SiRNA target sequence
aacaaaattactttttgtctt

SEQ ID NO: 38137 - DNA, 21 bp, Artificial sequence
  SiRNA target sequence
acaaaattactttttgtcttt

SEQ ID NO: 38138 - DNA, 21 bp, Artificial sequence
  SiRNA target sequence
caaaattactttttgtctttc

SEQ ID NO: 38139 - DNA, 21 bp, Artificial sequence
  SiRNA target sequence
aaaattactttttgtctttct

SEQ ID NO: 38140 - DNA, 21 bp, Artificial sequence
  SiRNA target sequence
aaattactttttgtctttctc

SEQ ID NO: 38141 - DNA, 21 bp, Artificial sequence
  SiRNA target sequence
aattactttttgtctttctcc

SEQ ID NO: 38142 - DNA, 21 bp, Artificial sequence
  SiRNA target sequence
attactttttgtctttctcca

SEQ ID NO: 38143 - DNA, 21 bp, Artificial sequence
  SiRNA target sequence
ttactttttgtctttctccac

SEQ ID NO: 38144 - DNA, 21 bp, Artificial sequence
  SiRNA target sequence
tactttttgtctttctccacc

SEQ ID NO: 38145 - DNA, 21 bp, Artificial sequence
  SiRNA target sequence
actttttgtctttctccacca

SEQ ID NO: 38146 - DNA, 21 bp, Artificial sequence
  SiRNA target sequence
ctttttgtctttctccaccac

SEQ ID NO: 38147 - DNA, 21 bp, Artificial sequence
  SiRNA target sequence
tttttgtctttctccaccact

SEQ ID NO: 38148 - DNA, 21 bp, Artificial sequence
  SiRNA target sequence
ttttgtctttctccaccacta

SEQ ID NO: 38149 - DNA, 21 bp, Artificial sequence
  SiRNA target sequence
tttgtctttctccaccactaa

SEQ ID NO: 38150 - DNA, 21 bp, Artificial sequence
  SiRNA target sequence
ttgtctttctccaccactaag

SEQ ID NO: 38151 - DNA, 21 bp, Artificial sequence
  SiRNA target sequence
tgtctttctccaccactaagc

SEQ ID NO: 38152 - DNA, 21 bp, Artificial sequence
  SiRNA target sequence
gtctttctccaccactaagct

SEQ ID NO: 38153 - DNA, 21 bp, Artificial sequence
  SiRNA target sequence
tctttctccaccactaagctt

SEQ ID NO: 38154 - DNA, 21 bp, Artificial sequence
  SiRNA target sequence
ctttctccaccactaagctta

SEQ ID NO: 38155 - DNA, 21 bp, Artificial sequence
  SiRNA target sequence
tttctccaccactaagcttat

SEQ ID NO: 38156 - DNA, 21 bp, Artificial sequence
  SiRNA target sequence
ttctccaccactaagcttatg

SEQ ID NO: 38157 - DNA, 21 bp, Artificial sequence
  SiRNA target sequence
tctccaccactaagcttatgt

SEQ ID NO: 38158 - DNA, 21 bp, Artificial sequence
  SiRNA target sequence
ctccaccactaagcttatgtc

SEQ ID NO: 38159 - DNA, 21 bp, Artificial sequence
  SiRNA target sequence
tccaccactaagcttatgtcc

SEQ ID NO: 38160 - DNA, 21 bp, Artificial sequence
  SiRNA target sequence
ccaccactaagcttatgtccc

SEQ ID NO: 38161 - DNA, 21 bp, Artificial sequence
  SiRNA target sequence
caccactaagcttatgtccct

SEQ ID NO: 38162 - DNA, 21 bp, Artificial sequence
  SiRNA target sequence
accactaagcttatgtccctt

SEQ ID NO: 38163 - DNA, 21 bp, Artificial sequence
  SiRNA target sequence
ccactaagcttatgtccctta

SEQ ID NO: 38164 - DNA, 21 bp, Artificial sequence
  SiRNA target sequence
cactaagcttatgtcccttat

SEQ ID NO: 38165 - DNA, 21 bp, Artificial sequence
  SiRNA target sequence
actaagcttatgtcccttatc

SEQ ID NO: 38166 - DNA, 21 bp, Artificial sequence
  SiRNA target sequence
ctaagcttatgtcccttatct

SEQ ID NO: 38167 - DNA, 21 bp, Artificial sequence
  SiRNA target sequence
taagcttatgtcccttatctc

SEQ ID NO: 38168 - DNA, 21 bp, Artificial sequence
  SiRNA target sequence
aagcttatgtcccttatctcc

SEQ ID NO: 38169 - DNA, 21 bp, Artificial sequence
  SiRNA target sequence
agcttatgtcccttatctcca

SEQ ID NO: 38170 - DNA, 21 bp, Artificial sequence
  SiRNA target sequence
gcttatgtcccttatctccaa

SEQ ID NO: 38171 - DNA, 21 bp, Artificial sequence
  SiRNA target sequence
cttatgtcccttatctccaac

SEQ ID NO: 38172 - DNA, 21 bp, Artificial sequence
  SiRNA target sequence
ttatgtcccttatctccaaca

SEQ ID NO: 38173 - DNA, 21 bp, Artificial sequence
  SiRNA target sequence
tatgtcccttatctccaacat

SEQ ID NO: 38174 - DNA, 21 bp, Artificial sequence
  SiRNA target sequence
atgtcccttatctccaacatg

SEQ ID NO: 38175 - DNA, 21 bp, Artificial sequence
  SiRNA target sequence
tgtcccttatctccaacatgt

SEQ ID NO: 38176 - DNA, 21 bp, Artificial sequence
  SiRNA target sequence
gtcccttatctccaacatgtg

SEQ ID NO: 38177 - DNA, 21 bp, Artificial sequence
  SiRNA target sequence
tcccttatctccaacatgtgt

SEQ ID NO: 38178 - DNA, 21 bp, Artificial sequence
  SiRNA target sequence
cccttatctccaacatgtgtg

SEQ ID NO: 38179 - DNA, 21 bp, Artificial sequence
  SiRNA target sequence
ccttatctccaacatgtgtgt

SEQ ID NO: 38180 - DNA, 21 bp, Artificial sequence
  SiRNA target sequence
cttatctccaacatgtgtgtt

SEQ ID NO: 38181 - DNA, 21 bp, Artificial sequence
  SiRNA target sequence
ttatctccaacatgtgtgttg

SEQ ID NO: 38182 - DNA, 21 bp, Artificial sequence
  SiRNA target sequence
tatctccaacatgtgtgttgt

SEQ ID NO: 38183 - DNA, 21 bp, Artificial sequence
  SiRNA target sequence
atctccaacatgtgtgttgta

SEQ ID NO: 38184 - DNA, 21 bp, Artificial sequence
  SiRNA target sequence
tctccaacatgtgtgttgtat

SEQ ID NO: 38185 - DNA, 21 bp, Artificial sequence
  SiRNA target sequence
ctccaacatgtgtgttgtatt

SEQ ID NO: 38186 - DNA, 21 bp, Artificial sequence
  SiRNA target sequence
tccaacatgtgtgttgtattc

SEQ ID NO: 38187 - DNA, 21 bp, Artificial sequence
  SiRNA target sequence
ccaacatgtgtgttgtattca

SEQ ID NO: 38188 - DNA, 21 bp, Artificial sequence
  SiRNA target sequence
caacatgtgtgttgtattcat

SEQ ID NO: 38189 - DNA, 21 bp, Artificial sequence
  SiRNA target sequence
aacatgtgtgttgtattcatc

SEQ ID NO: 38190 - DNA, 21 bp, Artificial sequence
  SiRNA target sequence
acatgtgtgttgtattcatcc

SEQ ID NO: 38191 - DNA, 21 bp, Artificial sequence
  SiRNA target sequence
catgtgtgttgtattcatcct

SEQ ID NO: 38192 - DNA, 21 bp, Artificial sequence
  SiRNA target sequence
atgtgtgttgtattcatcctc

SEQ ID NO: 38193 - DNA, 21 bp, Artificial sequence
  SiRNA target sequence
tgtgtgttgtattcatcctct

SEQ ID NO: 38194 - DNA, 21 bp, Artificial sequence
  SiRNA target sequence
gtgtgttgtattcatcctcta

SEQ ID NO: 38195 - DNA, 21 bp, Artificial sequence
  SiRNA target sequence
tgtgttgtattcatcctctag

SEQ ID NO: 38196 - DNA, 21 bp, Artificial sequence
  SiRNA target sequence
gtgttgtattcatcctctagg

SEQ ID NO: 38197 - DNA, 21 bp, Artificial sequence
  SiRNA target sequence
tgttgtattcatcctctaggt

SEQ ID NO: 38198 - DNA, 21 bp, Artificial sequence
  SiRNA target sequence
gttgtattcatcctctaggtt

SEQ ID NO: 38199 - DNA, 21 bp, Artificial sequence
  SiRNA target sequence
ttgtattcatcctctaggttg

SEQ ID NO: 38200 - DNA, 21 bp, Artificial sequence
  SiRNA target sequence
tgtattcatcctctaggttgt

SEQ ID NO: 38201 - DNA, 21 bp, Artificial sequence
  SiRNA target sequence
gtattcatcctctaggttgtt

SEQ ID NO: 38202 - DNA, 21 bp, Artificial sequence
  SiRNA target sequence
tattcatcctctaggttgttt

SEQ ID NO: 38203 - DNA, 21 bp, Artificial sequence
  SiRNA target sequence
attcatcctctaggttgttta

SEQ ID NO: 38204 - DNA, 21 bp, Artificial sequence
  SiRNA target sequence
ttcatcctctaggttgtttat

SEQ ID NO: 38205 - DNA, 21 bp, Artificial sequence
  SiRNA target sequence
tcatcctctaggttgtttata

SEQ ID NO: 38206 - DNA, 21 bp, Artificial sequence
  SiRNA target sequence
catcctctaggttgtttatag

SEQ ID NO: 38207 - DNA, 21 bp, Artificial sequence
  SiRNA target sequence
atcctctaggttgtttataga

SEQ ID NO: 38208 - DNA, 21 bp, Artificial sequence
  SiRNA target sequence
tcctctaggttgtttatagaa

SEQ ID NO: 38209 - DNA, 21 bp, Artificial sequence
  SiRNA target sequence
cctctaggttgtttatagaat

SEQ ID NO: 38210 - DNA, 21 bp, Artificial sequence
  SiRNA target sequence
ctctaggttgtttatagaatc

SEQ ID NO: 38211 - DNA, 21 bp, Artificial sequence
  SiRNA target sequence
tctaggttgtttatagaatcg

SEQ ID NO: 38212 - DNA, 21 bp, Artificial sequence
  SiRNA target sequence
ctaggttgtttatagaatcgt

SEQ ID NO: 38213 - DNA, 21 bp, Artificial sequence
  SiRNA target sequence
taggttgtttatagaatcgtg

SEQ ID NO: 38214 - DNA, 21 bp, Artificial sequence
  SiRNA target sequence
aggttgtttatagaatcgtgt

SEQ ID NO: 38215 - DNA, 21 bp, Artificial sequence
  SiRNA target sequence
ggttgtttatagaatcgtgta

SEQ ID NO: 38216 - DNA, 21 bp, Artificial sequence
  SiRNA target sequence
gttgtttatagaatcgtgtac

SEQ ID NO: 38217 - DNA, 21 bp, Artificial sequence
  SiRNA target sequence
ttgtttatagaatcgtgtaca

SEQ ID NO: 38218 - DNA, 21 bp, Artificial sequence
  SiRNA target sequence
tgtttatagaatcgtgtacac

SEQ ID NO: 38219 - DNA, 21 bp, Artificial sequence
  SiRNA target sequence
gtttatagaatcgtgtacaca

SEQ ID NO: 38220 - DNA, 21 bp, Artificial sequence
  SiRNA target sequence
tttatagaatcgtgtacacaa

SEQ ID NO: 38221 - DNA, 21 bp, Artificial sequence
  SiRNA target sequence
ttatagaatcgtgtacacaaa

SEQ ID NO: 38222 - DNA, 21 bp, Artificial sequence
  SiRNA target sequence
tatagaatcgtgtacacaaag

SEQ ID NO: 38223 - DNA, 21 bp, Artificial sequence
  SiRNA target sequence
atagaatcgtgtacacaaagt

SEQ ID NO: 38224 - DNA, 21 bp, Artificial sequence
  SiRNA target sequence
tagaatcgtgtacacaaagtt

SEQ ID NO: 38225 - DNA, 21 bp, Artificial sequence
  SiRNA target sequence
agaatcgtgtacacaaagttt

SEQ ID NO: 38226 - DNA, 21 bp, Artificial sequence
  SiRNA target sequence
gaatcgtgtacacaaagtttt

SEQ ID NO: 38227 - DNA, 21 bp, Artificial sequence
  SiRNA target sequence
aatcgtgtacacaaagttttt

SEQ ID NO: 38228 - DNA, 21 bp, Artificial sequence
  SiRNA target sequence
atcgtgtacacaaagtttttt

SEQ ID NO: 38229 - DNA, 21 bp, Artificial sequence
  SiRNA target sequence
tcgtgtacacaaagtttttta

SEQ ID NO: 38230 - DNA, 21 bp, Artificial sequence
  SiRNA target sequence
cgtgtacacaaagttttttac

SEQ ID NO: 38231 - DNA, 21 bp, Artificial sequence
  SiRNA target sequence
gtgtacacaaagttttttact

SEQ ID NO: 38232 - DNA, 21 bp, Artificial sequence
  SiRNA target sequence
tgtacacaaagttttttactg

SEQ ID NO: 38233 - DNA, 21 bp, Artificial sequence
  SiRNA target sequence
gtacacaaagttttttactga

SEQ ID NO: 38234 - DNA, 21 bp, Artificial sequence
  SiRNA target sequence
tacacaaagttttttactgat

SEQ ID NO: 38235 - DNA, 21 bp, Artificial sequence
  SiRNA target sequence
acacaaagttttttactgatt

SEQ ID NO: 38236 - DNA, 21 bp, Artificial sequence
  SiRNA target sequence
cacaaagttttttactgattt

SEQ ID NO: 38237 - DNA, 21 bp, Artificial sequence
  SiRNA target sequence
acaaagttttttactgatttt

SEQ ID NO: 38238 - DNA, 21 bp, Artificial sequence
  SiRNA target sequence
caaagttttttactgattttt

SEQ ID NO: 38239 - DNA, 21 bp, Artificial sequence
  SiRNA target sequence
aaagttttttactgattttta

SEQ ID NO: 38240 - DNA, 21 bp, Artificial sequence
  SiRNA target sequence
aagttttttactgatttttat

SEQ ID NO: 38241 - DNA, 21 bp, Artificial sequence
  SiRNA target sequence
agttttttactgatttttata

SEQ ID NO: 38242 - DNA, 21 bp, Artificial sequence
  SiRNA target sequence
gttttttactgatttttataa

SEQ ID NO: 38243 - DNA, 21 bp, Artificial sequence
  SiRNA target sequence
ttttttactgatttttataac

SEQ ID NO: 38244 - DNA, 21 bp, Artificial sequence
  SiRNA target sequence
tttttactgatttttataact

SEQ ID NO: 38245 - DNA, 21 bp, Artificial sequence
  SiRNA target sequence
ttttactgatttttataactt

SEQ ID NO: 38246 - DNA, 21 bp, Artificial sequence
  SiRNA target sequence
tttactgatttttataacttc

SEQ ID NO: 38247 - DNA, 21 bp, Artificial sequence
  SiRNA target sequence
ttactgatttttataacttct

SEQ ID NO: 38248 - DNA, 21 bp, Artificial sequence
  SiRNA target sequence
tactgatttttataacttctt

SEQ ID NO: 38249 - DNA, 21 bp, Artificial sequence
  SiRNA target sequence
actgatttttataacttcttc

SEQ ID NO: 38250 - DNA, 21 bp, Artificial sequence
  SiRNA target sequence
ctgatttttataacttcttct

SEQ ID NO: 38251 - DNA, 21 bp, Artificial sequence
  SiRNA target sequence
tgatttttataacttcttctt

SEQ ID NO: 38252 - DNA, 21 bp, Artificial sequence
  SiRNA target sequence
gatttttataacttcttcttt

SEQ ID NO: 38253 - DNA, 21 bp, Artificial sequence
  SiRNA target sequence
atttttataacttcttcttta

SEQ ID NO: 38254 - DNA, 21 bp, Artificial sequence
  SiRNA target sequence
tttttataacttcttctttat

SEQ ID NO: 38255 - DNA, 21 bp, Artificial sequence
  SiRNA target sequence
ttttataacttcttctttatc

SEQ ID NO: 38256 - DNA, 21 bp, Artificial sequence
  SiRNA target sequence
tttataacttcttctttatca

SEQ ID NO: 38257 - DNA, 21 bp, Artificial sequence
  SiRNA target sequence
ttataacttcttctttatcaa

SEQ ID NO: 38258 - DNA, 21 bp, Artificial sequence
  SiRNA target sequence
tataacttcttctttatcaaa

SEQ ID NO: 38259 - DNA, 21 bp, Artificial sequence
  SiRNA target sequence
ataacttcttctttatcaaat

SEQ ID NO: 38260 - DNA, 21 bp, Artificial sequence
  SiRNA target sequence
taacttcttctttatcaaata

SEQ ID NO: 38261 - DNA, 21 bp, Artificial sequence
  SiRNA target sequence
aacttcttctttatcaaatat

SEQ ID NO: 38262 - DNA, 21 bp, Artificial sequence
  SiRNA target sequence
acttcttctttatcaaatatt

SEQ ID NO: 38263 - DNA, 21 bp, Artificial sequence
  SiRNA target sequence
cttcttctttatcaaatattt

SEQ ID NO: 38264 - DNA, 21 bp, Artificial sequence
  SiRNA target sequence
ttcttctttatcaaatatttc

SEQ ID NO: 38265 - DNA, 21 bp, Artificial sequence
  SiRNA target sequence
tcttctttatcaaatatttct

SEQ ID NO: 38266 - DNA, 21 bp, Artificial sequence
  SiRNA target sequence
cttctttatcaaatatttctt

SEQ ID NO: 38267 - DNA, 21 bp, Artificial sequence
  SiRNA target sequence
ttctttatcaaatatttcttt

SEQ ID NO: 38268 - DNA, 21 bp, Artificial sequence
  SiRNA target sequence
tctttatcaaatatttctttt

SEQ ID NO: 38269 - DNA, 21 bp, Artificial sequence
  SiRNA target sequence
ctttatcaaatatttcttttc

SEQ ID NO: 38270 - DNA, 21 bp, Artificial sequence
  SiRNA target sequence
tttatcaaatatttcttttcc

SEQ ID NO: 38271 - DNA, 21 bp, Artificial sequence
  SiRNA target sequence
ttatcaaatatttcttttcca

SEQ ID NO: 38272 - DNA, 21 bp, Artificial sequence
  SiRNA target sequence
tatcaaatatttcttttccat

SEQ ID NO: 38273 - DNA, 21 bp, Artificial sequence
  SiRNA target sequence
atcaaatatttcttttccata

SEQ ID NO: 38274 - DNA, 21 bp, Artificial sequence
  SiRNA target sequence
tcaaatatttcttttccatat

SEQ ID NO: 38275 - DNA, 21 bp, Artificial sequence
  SiRNA target sequence
caaatatttcttttccatatg

SEQ ID NO: 38276 - DNA, 21 bp, Artificial sequence
  SiRNA target sequence
aaatatttcttttccatatgt

SEQ ID NO: 38277 - DNA, 21 bp, Artificial sequence
  SiRNA target sequence
aatatttcttttccatatgtt

SEQ ID NO: 38278 - DNA, 21 bp, Artificial sequence
  SiRNA target sequence
atatttcttttccatatgtta

SEQ ID NO: 38279 - DNA, 21 bp, Artificial sequence
  SiRNA target sequence
tatttcttttccatatgttaa

SEQ ID NO: 38280 - DNA, 21 bp, Artificial sequence
  SiRNA target sequence
atttcttttccatatgttaaa

SEQ ID NO: 38281 - DNA, 21 bp, Artificial sequence
  SiRNA target sequence
tttcttttccatatgttaaat

SEQ ID NO: 38282 - DNA, 21 bp, Artificial sequence
  SiRNA target sequence
ttcttttccatatgttaaatt

SEQ ID NO: 38283 - DNA, 21 bp, Artificial sequence
  SiRNA target sequence
tcttttccatatgttaaatta

SEQ ID NO: 38284 - DNA, 21 bp, Artificial sequence
  SiRNA target sequence
cttttccatatgttaaattat

SEQ ID NO: 38285 - DNA, 21 bp, Artificial sequence
  SiRNA target sequence
ttttccatatgttaaattata

SEQ ID NO: 38286 - DNA, 21 bp, Artificial sequence
  SiRNA target sequence
tttccatatgttaaattataa

SEQ ID NO: 38287 - DNA, 21 bp, Artificial sequence
  SiRNA target sequence
ttccatatgttaaattataat

SEQ ID NO: 38288 - DNA, 21 bp, Artificial sequence
  SiRNA target sequence
tccatatgttaaattataata

SEQ ID NO: 38289 - DNA, 21 bp, Artificial sequence
  SiRNA target sequence
ccatatgttaaattataataa

SEQ ID NO: 38290 - DNA, 21 bp, Artificial sequence
  SiRNA target sequence
catatgttaaattataataaa

SEQ ID NO: 38291 - DNA, 21 bp, Artificial sequence
  SiRNA target sequence
atatgttaaattataataaac

SEQ ID NO: 38292 - DNA, 21 bp, Artificial sequence
  SiRNA target sequence
tatgttaaattataataaacc

SEQ ID NO: 38293 - DNA, 21 bp, Artificial sequence
  SiRNA target sequence
atgttaaattataataaaccg

SEQ ID NO: 38294 - DNA, 21 bp, Artificial sequence
  SiRNA target sequence
tgttaaattataataaaccgt

SEQ ID NO: 38295 - DNA, 21 bp, Artificial sequence
  SiRNA target sequence
gttaaattataataaaccgtt

SEQ ID NO: 38296 - DNA, 21 bp, Artificial sequence
  SiRNA target sequence
ttaaattataataaaccgttt

SEQ ID NO: 38297 - DNA, 21 bp, Artificial sequence
  SiRNA target sequence
taaattataataaaccgtttc

SEQ ID NO: 38298 - DNA, 21 bp, Artificial sequence
  SiRNA target sequence
aaattataataaaccgtttcg

SEQ ID NO: 38299 - DNA, 21 bp, Artificial sequence
  SiRNA target sequence
aattataataaaccgtttcgt

SEQ ID NO: 38300 - DNA, 21 bp, Artificial sequence
  SiRNA target sequence
attataataaaccgtttcgtt

SEQ ID NO: 38301 - DNA, 21 bp, Artificial sequence
  SiRNA target sequence
ttataataaaccgtttcgtta

SEQ ID NO: 38302 - DNA, 21 bp, Artificial sequence
  SiRNA target sequence
tataataaaccgtttcgttaa

SEQ ID NO: 38303 - DNA, 21 bp, Artificial sequence
  SiRNA target sequence
ataataaaccgtttcgttaaa

SEQ ID NO: 38304 - DNA, 21 bp, Artificial sequence
  SiRNA target sequence
taataaaccgtttcgttaaac

SEQ ID NO: 38305 - DNA, 21 bp, Artificial sequence
  SiRNA target sequence
aataaaccgtttcgttaaaca

SEQ ID NO: 38306 - DNA, 21 bp, Artificial sequence
  SiRNA target sequence
ataaaccgtttcgttaaacaa

SEQ ID NO: 38307 - DNA, 21 bp, Artificial sequence
  SiRNA target sequence
taaaccgtttcgttaaacaaa

SEQ ID NO: 38308 - DNA, 21 bp, Artificial sequence
  SiRNA target sequence
aaaccgtttcgttaaacaaaa

SEQ ID NO: 38309 - DNA, 21 bp, Artificial sequence
  SiRNA target sequence
aaccgtttcgttaaacaaaaa

SEQ ID NO: 38310 - DNA, 21 bp, Artificial sequence
  SiRNA target sequence
accgtttcgttaaacaaaaat

SEQ ID NO: 38311 - DNA, 21 bp, Artificial sequence
  SiRNA target sequence
ccgtttcgttaaacaaaaatg

SEQ ID NO: 38312 - DNA, 21 bp, Artificial sequence
  SiRNA target sequence
cgtttcgttaaacaaaaatga

SEQ ID NO: 38313 - DNA, 21 bp, Artificial sequence
  SiRNA target sequence
gtttcgttaaacaaaaatgag

SEQ ID NO: 38314 - DNA, 21 bp, Artificial sequence
  SiRNA target sequence
tttcgttaaacaaaaatgagg

SEQ ID NO: 38315 - DNA, 21 bp, Artificial sequence
  SiRNA target sequence
ttcgttaaacaaaaatgaggt

SEQ ID NO: 38316 - DNA, 21 bp, Artificial sequence
  SiRNA target sequence
tcgttaaacaaaaatgaggtt

SEQ ID NO: 38317 - DNA, 21 bp, Artificial sequence
  SiRNA target sequence
cgttaaacaaaaatgaggttt

SEQ ID NO: 38318 - DNA, 21 bp, Artificial sequence
  SiRNA target sequence
gttaaacaaaaatgaggtttg

SEQ ID NO: 38319 - DNA, 21 bp, Artificial sequence
  SiRNA target sequence
ttaaacaaaaatgaggtttgt

SEQ ID NO: 38320 - DNA, 21 bp, Artificial sequence
  SiRNA target sequence
taaacaaaaatgaggtttgtg

SEQ ID NO: 38321 - DNA, 21 bp, Artificial sequence
  SiRNA target sequence
aaacaaaaatgaggtttgtgg

SEQ ID NO: 38322 - DNA, 21 bp, Artificial sequence
  SiRNA target sequence
aacaaaaatgaggtttgtggt

SEQ ID NO: 38323 - DNA, 21 bp, Artificial sequence
  SiRNA target sequence
acaaaaatgaggtttgtggtg

SEQ ID NO: 38324 - DNA, 21 bp, Artificial sequence
  SiRNA target sequence
caaaaatgaggtttgtggtgc

SEQ ID NO: 38325 - DNA, 21 bp, Artificial sequence
  SiRNA target sequence
aaaaatgaggtttgtggtgca

SEQ ID NO: 38326 - DNA, 21 bp, Artificial sequence
  SiRNA target sequence
aaaatgaggtttgtggtgcaa

SEQ ID NO: 38327 - DNA, 21 bp, Artificial sequence
  SiRNA target sequence
aaatgaggtttgtggtgcaaa

SEQ ID NO: 38328 - DNA, 21 bp, Artificial sequence
  SiRNA target sequence
aatgaggtttgtggtgcaaat

SEQ ID NO: 38329 - DNA, 21 bp, Artificial sequence
  SiRNA target sequence
atgaggtttgtggtgcaaatg

SEQ ID NO: 38330 - DNA, 21 bp, Artificial sequence
  SiRNA target sequence
tgaggtttgtggtgcaaatga

SEQ ID NO: 38331 - DNA, 21 bp, Artificial sequence
  SiRNA target sequence
gaggtttgtggtgcaaatgat

SEQ ID NO: 38332 - DNA, 21 bp, Artificial sequence
  SiRNA target sequence
aggtttgtggtgcaaatgata

SEQ ID NO: 38333 - DNA, 21 bp, Artificial sequence
  SiRNA target sequence
ggtttgtggtgcaaatgatat

SEQ ID NO: 38334 - DNA, 21 bp, Artificial sequence
  SiRNA target sequence
gtttgtggtgcaaatgatata

SEQ ID NO: 38335 - DNA, 21 bp, Artificial sequence
  SiRNA target sequence
tttgtggtgcaaatgatataa

SEQ ID NO: 38336 - DNA, 21 bp, Artificial sequence
  SiRNA target sequence
ttgtggtgcaaatgatataag

SEQ ID NO: 38337 - DNA, 21 bp, Artificial sequence
  SiRNA target sequence
tgtggtgcaaatgatataagt

SEQ ID NO: 38338 - DNA, 21 bp, Artificial sequence
  SiRNA target sequence
gtggtgcaaatgatataagtg

SEQ ID NO: 38339 - DNA, 21 bp, Artificial sequence
  SiRNA target sequence
tggtgcaaatgatataagtga

SEQ ID NO: 38340 - DNA, 21 bp, Artificial sequence
  SiRNA target sequence
ggtgcaaatgatataagtgat

SEQ ID NO: 38341 - DNA, 21 bp, Artificial sequence
  SiRNA target sequence
gtgcaaatgatataagtgatc

SEQ ID NO: 38342 - DNA, 21 bp, Artificial sequence
  SiRNA target sequence
tgcaaatgatataagtgatct

SEQ ID NO: 38343 - DNA, 21 bp, Artificial sequence
  SiRNA target sequence
gcaaatgatataagtgatcta

SEQ ID NO: 38344 - DNA, 21 bp, Artificial sequence
  SiRNA target sequence
caaatgatataagtgatctat

SEQ ID NO: 38345 - DNA, 21 bp, Artificial sequence
  SiRNA target sequence
aaatgatataagtgatctata

SEQ ID NO: 38346 - DNA, 21 bp, Artificial sequence
  SiRNA target sequence
aatgatataagtgatctatat

SEQ ID NO: 38347 - DNA, 21 bp, Artificial sequence
  SiRNA target sequence
atgatataagtgatctatatg

SEQ ID NO: 38348 - DNA, 21 bp, Artificial sequence
  SiRNA target sequence
tgatataagtgatctatatga

SEQ ID NO: 38349 - DNA, 21 bp, Artificial sequence
  SiRNA target sequence
gatataagtgatctatatgaa

SEQ ID NO: 38350 - DNA, 21 bp, Artificial sequence
  SiRNA target sequence
atataagtgatctatatgaac

SEQ ID NO: 38351 - DNA, 21 bp, Artificial sequence
  SiRNA target sequence
tataagtgatctatatgaact

SEQ ID NO: 38352 - DNA, 21 bp, Artificial sequence
  SiRNA target sequence
ataagtgatctatatgaacta

SEQ ID NO: 38353 - DNA, 21 bp, Artificial sequence
  SiRNA target sequence
taagtgatctatatgaactat

SEQ ID NO: 38354 - DNA, 21 bp, Artificial sequence
  SiRNA target sequence
aagtgatctatatgaactatt

SEQ ID NO: 38355 - DNA, 21 bp, Artificial sequence
  SiRNA target sequence
agtgatctatatgaactatta

SEQ ID NO: 38356 - DNA, 21 bp, Artificial sequence
  SiRNA target sequence
gtgatctatatgaactattag

SEQ ID NO: 38357 - DNA, 21 bp, Artificial sequence
  SiRNA target sequence
tgatctatatgaactattaga

SEQ ID NO: 38358 - DNA, 21 bp, Artificial sequence
  SiRNA target sequence
gatctatatgaactattagaa

SEQ ID NO: 38359 - DNA, 21 bp, Artificial sequence
  SiRNA target sequence
atctatatgaactattagaaa

SEQ ID NO: 38360 - DNA, 21 bp, Artificial sequence
  SiRNA target sequence
tctatatgaactattagaaat

SEQ ID NO: 38361 - DNA, 21 bp, Artificial sequence
  SiRNA target sequence
ctatatgaactattagaaatt

SEQ ID NO: 38362 - DNA, 21 bp, Artificial sequence
  SiRNA target sequence
tatatgaactattagaaattt

SEQ ID NO: 38363 - DNA, 21 bp, Artificial sequence
  SiRNA target sequence
atatgaactattagaaatttc

SEQ ID NO: 38364 - DNA, 21 bp, Artificial sequence
  SiRNA target sequence
tatgaactattagaaatttct

SEQ ID NO: 38365 - DNA, 21 bp, Artificial sequence
  SiRNA target sequence
atgaactattagaaatttctt

SEQ ID NO: 38366 - DNA, 21 bp, Artificial sequence
  SiRNA target sequence
tgaactattagaaatttcttt

SEQ ID NO: 38367 - DNA, 21 bp, Artificial sequence
  SiRNA target sequence
gaactattagaaatttctttt

SEQ ID NO: 38368 - DNA, 21 bp, Artificial sequence
  SiRNA target sequence
aactattagaaatttctttta

SEQ ID NO: 38369 - DNA, 21 bp, Artificial sequence
  SiRNA target sequence
actattagaaatttcttttat

SEQ ID NO: 38370 - DNA, 21 bp, Artificial sequence
  SiRNA target sequence
ctattagaaatttcttttata

SEQ ID NO: 38371 - DNA, 21 bp, Artificial sequence
  SiRNA target sequence
tattagaaatttcttttatat

SEQ ID NO: 38372 - DNA, 21 bp, Artificial sequence
  SiRNA target sequence
attagaaatttcttttatatc

SEQ ID NO: 38373 - DNA, 21 bp, Artificial sequence
  SiRNA target sequence
ttagaaatttcttttatatct

SEQ ID NO: 38374 - DNA, 21 bp, Artificial sequence
  SiRNA target sequence
tagaaatttcttttatatctc

SEQ ID NO: 38375 - DNA, 21 bp, Artificial sequence
  SiRNA target sequence
agaaatttcttttatatctcg

SEQ ID NO: 38376 - DNA, 21 bp, Artificial sequence
  SiRNA target sequence
gaaatttcttttatatctcga

SEQ ID NO: 38377 - DNA, 21 bp, Artificial sequence
  SiRNA target sequence
aaatttcttttatatctcgat

SEQ ID NO: 38378 - DNA, 21 bp, Artificial sequence
  SiRNA target sequence
aatttcttttatatctcgatt

SEQ ID NO: 38379 - DNA, 21 bp, Artificial sequence
  SiRNA target sequence
atttcttttatatctcgatta

SEQ ID NO: 38380 - DNA, 21 bp, Artificial sequence
  SiRNA target sequence
tttcttttatatctcgattat

SEQ ID NO: 38381 - DNA, 21 bp, Artificial sequence
  SiRNA target sequence
ttcttttatatctcgattatc

SEQ ID NO: 38382 - DNA, 21 bp, Artificial sequence
  SiRNA target sequence
tcttttatatctcgattatct

SEQ ID NO: 38383 - DNA, 21 bp, Artificial sequence
  SiRNA target sequence
cttttatatctcgattatcta

SEQ ID NO: 38384 - DNA, 21 bp, Artificial sequence
  SiRNA target sequence
ttttatatctcgattatctag

SEQ ID NO: 38385 - DNA, 21 bp, Artificial sequence
  SiRNA target sequence
tttatatctcgattatctaga

SEQ ID NO: 38386 - DNA, 21 bp, Artificial sequence
  SiRNA target sequence
ttatatctcgattatctagat

SEQ ID NO: 38387 - DNA, 21 bp, Artificial sequence
  SiRNA target sequence
tatatctcgattatctagata

SEQ ID NO: 38388 - DNA, 21 bp, Artificial sequence
  SiRNA target sequence
atatctcgattatctagataa

SEQ ID NO: 38389 - DNA, 21 bp, Artificial sequence
  SiRNA target sequence
tatctcgattatctagataaa

SEQ ID NO: 38390 - DNA, 21 bp, Artificial sequence
  SiRNA target sequence
atctcgattatctagataaat

SEQ ID NO: 38391 - DNA, 21 bp, Artificial sequence
  SiRNA target sequence
tctcgattatctagataaata

SEQ ID NO: 38392 - DNA, 21 bp, Artificial sequence
  SiRNA target sequence
ctcgattatctagataaatat

SEQ ID NO: 38393 - DNA, 21 bp, Artificial sequence
  SiRNA target sequence
tcgattatctagataaatatt

SEQ ID NO: 38394 - DNA, 21 bp, Artificial sequence
  SiRNA target sequence
cgattatctagataaatattt

SEQ ID NO: 38395 - DNA, 21 bp, Artificial sequence
  SiRNA target sequence
gattatctagataaatatttc

SEQ ID NO: 38396 - DNA, 21 bp, Artificial sequence
  SiRNA target sequence
attatctagataaatatttcc

SEQ ID NO: 38397 - DNA, 21 bp, Artificial sequence
  SiRNA target sequence
ttatctagataaatatttccc

SEQ ID NO: 38398 - DNA, 21 bp, Artificial sequence
  SiRNA target sequence
tatctagataaatatttcccc

SEQ ID NO: 38399 - DNA, 21 bp, Artificial sequence
  SiRNA target sequence
atctagataaatatttccccc

SEQ ID NO: 38400 - DNA, 21 bp, Artificial sequence
  SiRNA target sequence
tctagataaatatttccccca

SEQ ID NO: 38401 - DNA, 21 bp, Artificial sequence
  SiRNA target sequence
ctagataaatatttcccccat

SEQ ID NO: 38402 - DNA, 21 bp, Artificial sequence
  SiRNA target sequence
tagataaatatttcccccata

SEQ ID NO: 38403 - DNA, 21 bp, Artificial sequence
  SiRNA target sequence
agataaatatttcccccataa

SEQ ID NO: 38404 - DNA, 21 bp, Artificial sequence
  SiRNA target sequence
gataaatatttcccccataat

SEQ ID NO: 38405 - DNA, 21 bp, Artificial sequence
  SiRNA target sequence
ataaatatttcccccataatt

SEQ ID NO: 38406 - DNA, 21 bp, Artificial sequence
  SiRNA target sequence
taaatatttcccccataattt

SEQ ID NO: 38407 - DNA, 21 bp, Artificial sequence
  SiRNA target sequence
aaatatttcccccataatttt

SEQ ID NO: 38408 - DNA, 21 bp, Artificial sequence
  SiRNA target sequence
aatatttcccccataattttc

SEQ ID NO: 38409 - DNA, 21 bp, Artificial sequence
  SiRNA target sequence
atatttcccccataattttca

SEQ ID NO: 38410 - DNA, 21 bp, Artificial sequence
  SiRNA target sequence
tatttcccccataattttcaa

SEQ ID NO: 38411 - DNA, 21 bp, Artificial sequence
  SiRNA target sequence
atttcccccataattttcaaa

SEQ ID NO: 38412 - DNA, 21 bp, Artificial sequence
  SiRNA target sequence
tttcccccataattttcaaat

SEQ ID NO: 38413 - DNA, 21 bp, Artificial sequence
  SiRNA target sequence
ttcccccataattttcaaatc

SEQ ID NO: 38414 - DNA, 21 bp, Artificial sequence
  SiRNA target sequence
tcccccataattttcaaatct

SEQ ID NO: 38415 - DNA, 21 bp, Artificial sequence
  SiRNA target sequence
cccccataattttcaaatctc

SEQ ID NO: 38416 - DNA, 21 bp, Artificial sequence
  SiRNA target sequence
ccccataattttcaaatctca

SEQ ID NO: 38417 - DNA, 21 bp, Artificial sequence
  SiRNA target sequence
cccataattttcaaatctcat

SEQ ID NO: 38418 - DNA, 21 bp, Artificial sequence
  SiRNA target sequence
ccataattttcaaatctcata

SEQ ID NO: 38419 - DNA, 21 bp, Artificial sequence
  SiRNA target sequence
cataattttcaaatctcataa

SEQ ID NO: 38420 - DNA, 21 bp, Artificial sequence
  SiRNA target sequence
ataattttcaaatctcataat

SEQ ID NO: 38421 - DNA, 21 bp, Artificial sequence
  SiRNA target sequence
taattttcaaatctcataatc

SEQ ID NO: 38422 - DNA, 21 bp, Artificial sequence
  SiRNA target sequence
aattttcaaatctcataatca

SEQ ID NO: 38423 - DNA, 21 bp, Artificial sequence
  SiRNA target sequence
attttcaaatctcataatcat

SEQ ID NO: 38424 - DNA, 21 bp, Artificial sequence
  SiRNA target sequence
ttttcaaatctcataatcatc

SEQ ID NO: 38425 - DNA, 21 bp, Artificial sequence
  SiRNA target sequence
tttcaaatctcataatcatct

SEQ ID NO: 38426 - DNA, 21 bp, Artificial sequence
  SiRNA target sequence
ttcaaatctcataatcatctt

SEQ ID NO: 38427 - DNA, 21 bp, Artificial sequence
  SiRNA target sequence
tcaaatctcataatcatcttt

SEQ ID NO: 38428 - DNA, 21 bp, Artificial sequence
  SiRNA target sequence
caaatctcataatcatcttta

SEQ ID NO: 38429 - DNA, 21 bp, Artificial sequence
  SiRNA target sequence
aaatctcataatcatctttat

SEQ ID NO: 38430 - DNA, 21 bp, Artificial sequence
  SiRNA target sequence
aatctcataatcatctttata

SEQ ID NO: 38431 - DNA, 21 bp, Artificial sequence
  SiRNA target sequence
atctcataatcatctttataa

SEQ ID NO: 38432 - DNA, 21 bp, Artificial sequence
  SiRNA target sequence
tctcataatcatctttataag

SEQ ID NO: 38433 - DNA, 21 bp, Artificial sequence
  SiRNA target sequence
ctcataatcatctttataaga

SEQ ID NO: 38434 - DNA, 21 bp, Artificial sequence
  SiRNA target sequence
tcataatcatctttataagag

SEQ ID NO: 38435 - DNA, 21 bp, Artificial sequence
  SiRNA target sequence
cataatcatctttataagaga

SEQ ID NO: 38436 - DNA, 21 bp, Artificial sequence
  SiRNA target sequence
ataatcatctttataagagat

SEQ ID NO: 38437 - DNA, 21 bp, Artificial sequence
  SiRNA target sequence
taatcatctttataagagatg

SEQ ID NO: 38438 - DNA, 21 bp, Artificial sequence
  SiRNA target sequence
aatcatctttataagagatgt

SEQ ID NO: 38439 - DNA, 21 bp, Artificial sequence
  SiRNA target sequence
atcatctttataagagatgtt

SEQ ID NO: 38440 - DNA, 21 bp, Artificial sequence
  SiRNA target sequence
tcatctttataagagatgttt

SEQ ID NO: 38441 - DNA, 21 bp, Artificial sequence
  SiRNA target sequence
catctttataagagatgtttt

SEQ ID NO: 38442 - DNA, 21 bp, Artificial sequence
  SiRNA target sequence
atctttataagagatgttttt

SEQ ID NO: 38443 - DNA, 21 bp, Artificial sequence
  SiRNA target sequence
tctttataagagatgtttttc

SEQ ID NO: 38444 - DNA, 21 bp, Artificial sequence
  SiRNA target sequence
ctttataagagatgtttttcc

SEQ ID NO: 38445 - DNA, 21 bp, Artificial sequence
  SiRNA target sequence
tttataagagatgtttttccc

SEQ ID NO: 38446 - DNA, 21 bp, Artificial sequence
  SiRNA target sequence
ttataagagatgtttttcccg

SEQ ID NO: 38447 - DNA, 21 bp, Artificial sequence
  SiRNA target sequence
tataagagatgtttttcccga

SEQ ID NO: 38448 - DNA, 21 bp, Artificial sequence
  SiRNA target sequence
ataagagatgtttttcccgat

SEQ ID NO: 38449 - DNA, 21 bp, Artificial sequence
  SiRNA target sequence
taagagatgtttttcccgatc

SEQ ID NO: 38450 - DNA, 21 bp, Artificial sequence
  SiRNA target sequence
aagagatgtttttcccgatcc

SEQ ID NO: 38451 - DNA, 21 bp, Artificial sequence
  SiRNA target sequence
agagatgtttttcccgatcca

SEQ ID NO: 38452 - DNA, 21 bp, Artificial sequence
  SiRNA target sequence
gagatgtttttcccgatccat

SEQ ID NO: 38453 - DNA, 21 bp, Artificial sequence
  SiRNA target sequence
agatgtttttcccgatccatt

SEQ ID NO: 38454 - DNA, 21 bp, Artificial sequence
  SiRNA target sequence
gatgtttttcccgatccattt

SEQ ID NO: 38455 - DNA, 21 bp, Artificial sequence
  SiRNA target sequence
atgtttttcccgatccatttt

SEQ ID NO: 38456 - DNA, 21 bp, Artificial sequence
  SiRNA target sequence
tgtttttcccgatccattttt

SEQ ID NO: 38457 - DNA, 21 bp, Artificial sequence
  SiRNA target sequence
gtttttcccgatccatttttt

SEQ ID NO: 38458 - DNA, 21 bp, Artificial sequence
  SiRNA target sequence
tttttcccgatccattttttc

SEQ ID NO: 38459 - DNA, 21 bp, Artificial sequence
  SiRNA target sequence
ttttcccgatccattttttcc

SEQ ID NO: 38460 - DNA, 21 bp, Artificial sequence
  SiRNA target sequence
tttcccgatccattttttcca

SEQ ID NO: 38461 - DNA, 21 bp, Artificial sequence
  SiRNA target sequence
ttcccgatccattttttccaa

SEQ ID NO: 38462 - DNA, 21 bp, Artificial sequence
  SiRNA target sequence
tcccgatccattttttccaat

SEQ ID NO: 38463 - DNA, 21 bp, Artificial sequence
  SiRNA target sequence
cccgatccattttttccaata

SEQ ID NO: 38464 - DNA, 21 bp, Artificial sequence
  SiRNA target sequence
ccgatccattttttccaataa

SEQ ID NO: 38465 - DNA, 21 bp, Artificial sequence
  SiRNA target sequence
cgatccattttttccaataat

SEQ ID NO: 38466 - DNA, 21 bp, Artificial sequence
  SiRNA target sequence
gatccattttttccaataata

SEQ ID NO: 38467 - DNA, 21 bp, Artificial sequence
  SiRNA target sequence
atccattttttccaataatag

SEQ ID NO: 38468 - DNA, 21 bp, Artificial sequence
  SiRNA target sequence
tccattttttccaataatagc

SEQ ID NO: 38469 - DNA, 21 bp, Artificial sequence
  SiRNA target sequence
ccattttttccaataatagct

SEQ ID NO: 38470 - DNA, 21 bp, Artificial sequence
  SiRNA target sequence
cattttttccaataatagcta

SEQ ID NO: 38471 - DNA, 21 bp, Artificial sequence
  SiRNA target sequence
attttttccaataatagctac

SEQ ID NO: 38472 - DNA, 21 bp, Artificial sequence
  SiRNA target sequence
ttttttccaataatagctact

SEQ ID NO: 38473 - DNA, 21 bp, Artificial sequence
  SiRNA target sequence
tttttccaataatagctactt

SEQ ID NO: 38474 - DNA, 21 bp, Artificial sequence
  SiRNA target sequence
ttttccaataatagctacttt

SEQ ID NO: 38475 - DNA, 21 bp, Artificial sequence
  SiRNA target sequence
tttccaataatagctactttt

SEQ ID NO: 38476 - DNA, 21 bp, Artificial sequence
  SiRNA target sequence
ttccaataatagctacttttt

SEQ ID NO: 38477 - DNA, 21 bp, Artificial sequence
  SiRNA target sequence
tccaataatagctactttttc

SEQ ID NO: 38478 - DNA, 21 bp, Artificial sequence
  SiRNA target sequence
ccaataatagctactttttca

SEQ ID NO: 38479 - DNA, 21 bp, Artificial sequence
  SiRNA target sequence
caataatagctactttttcac

SEQ ID NO: 38480 - DNA, 21 bp, Artificial sequence
  SiRNA target sequence
aataatagctactttttcacc

SEQ ID NO: 38481 - DNA, 21 bp, Artificial sequence
  SiRNA target sequence
ataatagctactttttcacct

SEQ ID NO: 38482 - DNA, 21 bp, Artificial sequence
  SiRNA target sequence
taatagctactttttcacctt

SEQ ID NO: 38483 - DNA, 21 bp, Artificial sequence
  SiRNA target sequence
aatagctactttttcaccttt

SEQ ID NO: 38484 - DNA, 21 bp, Artificial sequence
  SiRNA target sequence
atagctactttttcacctttt

SEQ ID NO: 38485 - DNA, 21 bp, Artificial sequence
  SiRNA target sequence
tagctactttttcaccttttt

SEQ ID NO: 38486 - DNA, 21 bp, Artificial sequence
  SiRNA target sequence
agctactttttcacctttttt

SEQ ID NO: 38487 - DNA, 21 bp, Artificial sequence
  SiRNA target sequence
gctactttttcacctttttta

SEQ ID NO: 38488 - DNA, 21 bp, Artificial sequence
  SiRNA target sequence
ctactttttcaccttttttaa

SEQ ID NO: 38489 - DNA, 21 bp, Artificial sequence
  SiRNA target sequence
tactttttcaccttttttaat

SEQ ID NO: 38490 - DNA, 21 bp, Artificial sequence
  SiRNA target sequence
actttttcaccttttttaatt

SEQ ID NO: 38491 - DNA, 21 bp, Artificial sequence
  SiRNA target sequence
ctttttcaccttttttaatta

SEQ ID NO: 38492 - DNA, 21 bp, Artificial sequence
  SiRNA target sequence
tttttcaccttttttaattaa

SEQ ID NO: 38493 - DNA, 21 bp, Artificial sequence
  SiRNA target sequence
ttttcaccttttttaattaaa

SEQ ID NO: 38494 - DNA, 21 bp, Artificial sequence
  SiRNA target sequence
tttcaccttttttaattaaaa

SEQ ID NO: 38495 - DNA, 21 bp, Artificial sequence
  SiRNA target sequence
ttcaccttttttaattaaaat

SEQ ID NO: 38496 - DNA, 21 bp, Artificial sequence
  SiRNA target sequence
tcaccttttttaattaaaata

SEQ ID NO: 38497 - DNA, 21 bp, Artificial sequence
  SiRNA target sequence
caccttttttaattaaaatat

SEQ ID NO: 38498 - DNA, 21 bp, Artificial sequence
  SiRNA target sequence
accttttttaattaaaatatt

SEQ ID NO: 38499 - DNA, 21 bp, Artificial sequence
  SiRNA target sequence
ccttttttaattaaaatattt

SEQ ID NO: 38500 - DNA, 21 bp, Artificial sequence
  SiRNA target sequence
cttttttaattaaaatattta

SEQ ID NO: 38501 - DNA, 21 bp, Artificial sequence
  SiRNA target sequence
ttttttaattaaaatatttat

SEQ ID NO: 38502 - DNA, 21 bp, Artificial sequence
  SiRNA target sequence
tttttaattaaaatatttatg

SEQ ID NO: 38503 - DNA, 21 bp, Artificial sequence
  SiRNA target sequence
ttttaattaaaatatttatgt

SEQ ID NO: 38504 - DNA, 21 bp, Artificial sequence
  SiRNA target sequence
tttaattaaaatatttatgtc

SEQ ID NO: 38505 - DNA, 21 bp, Artificial sequence
  SiRNA target sequence
ttaattaaaatatttatgtcc

SEQ ID NO: 38506 - DNA, 21 bp, Artificial sequence
  SiRNA target sequence
taattaaaatatttatgtccg

SEQ ID NO: 38507 - DNA, 21 bp, Artificial sequence
  SiRNA target sequence
aattaaaatatttatgtccgt

SEQ ID NO: 38508 - DNA, 21 bp, Artificial sequence
  SiRNA target sequence
attaaaatatttatgtccgtt

SEQ ID NO: 38509 - DNA, 21 bp, Artificial sequence
  SiRNA target sequence
ttaaaatatttatgtccgtta

SEQ ID NO: 38510 - DNA, 21 bp, Artificial sequence
  SiRNA target sequence
taaaatatttatgtccgttaa

SEQ ID NO: 38511 - DNA, 21 bp, Artificial sequence
  SiRNA target sequence
aaaatatttatgtccgttaaa

SEQ ID NO: 38512 - DNA, 21 bp, Artificial sequence
  SiRNA target sequence
aaatatttatgtccgttaaaa

SEQ ID NO: 38513 - DNA, 21 bp, Artificial sequence
  SiRNA target sequence
aatatttatgtccgttaaaat

SEQ ID NO: 38514 - DNA, 21 bp, Artificial sequence
  SiRNA target sequence
atatttatgtccgttaaaatt

SEQ ID NO: 38515 - DNA, 21 bp, Artificial sequence
  SiRNA target sequence
tatttatgtccgttaaaattt

SEQ ID NO: 38516 - DNA, 21 bp, Artificial sequence
  SiRNA target sequence
atttatgtccgttaaaatttt

SEQ ID NO: 38517 - DNA, 21 bp, Artificial sequence
  SiRNA target sequence
tttatgtccgttaaaattttt

SEQ ID NO: 38518 - DNA, 21 bp, Artificial sequence
  SiRNA target sequence
ttatgtccgttaaaatttttt

SEQ ID NO: 38519 - DNA, 21 bp, Artificial sequence
  SiRNA target sequence
tatgtccgttaaaattttttt

SEQ ID NO: 38520 - DNA, 21 bp, Artificial sequence
  SiRNA target sequence
atgtccgttaaaatttttttg

SEQ ID NO: 38521 - DNA, 21 bp, Artificial sequence
  SiRNA target sequence
tgtccgttaaaatttttttgg

SEQ ID NO: 38522 - DNA, 21 bp, Artificial sequence
  SiRNA target sequence
gtccgttaaaatttttttgga

SEQ ID NO: 38523 - DNA, 21 bp, Artificial sequence
  SiRNA target sequence
tccgttaaaatttttttggag

SEQ ID NO: 38524 - DNA, 21 bp, Artificial sequence
  SiRNA target sequence
ccgttaaaatttttttggagt

SEQ ID NO: 38525 - DNA, 21 bp, Artificial sequence
  SiRNA target sequence
cgttaaaatttttttggagta

SEQ ID NO: 38526 - DNA, 21 bp, Artificial sequence
  SiRNA target sequence
gttaaaatttttttggagtaa

SEQ ID NO: 38527 - DNA, 21 bp, Artificial sequence
  SiRNA target sequence
ttaaaatttttttggagtaat

SEQ ID NO: 38528 - DNA, 21 bp, Artificial sequence
  SiRNA target sequence
taaaatttttttggagtaata

SEQ ID NO: 38529 - DNA, 21 bp, Artificial sequence
  SiRNA target sequence
aaaatttttttggagtaataa

SEQ ID NO: 38530 - DNA, 21 bp, Artificial sequence
  SiRNA target sequence
aaatttttttggagtaataat

SEQ ID NO: 38531 - DNA, 21 bp, Artificial sequence
  SiRNA target sequence
aatttttttggagtaataatt

SEQ ID NO: 38532 - DNA, 21 bp, Artificial sequence
  SiRNA target sequence
atttttttggagtaataatta

SEQ ID NO: 38533 - DNA, 21 bp, Artificial sequence
  SiRNA target sequence
tttttttggagtaataattaa

SEQ ID NO: 38534 - DNA, 21 bp, Artificial sequence
  SiRNA target sequence
ttttttggagtaataattaaa

SEQ ID NO: 38535 - DNA, 21 bp, Artificial sequence
  SiRNA target sequence
tttttggagtaataattaaat

SEQ ID NO: 38536 - DNA, 21 bp, Artificial sequence
  SiRNA target sequence
ttttggagtaataattaaatg

SEQ ID NO: 38537 - DNA, 21 bp, Artificial sequence
  SiRNA target sequence
tttggagtaataattaaatga

SEQ ID NO: 38538 - DNA, 21 bp, Artificial sequence
  SiRNA target sequence
ttggagtaataattaaatgat

SEQ ID NO: 38539 - DNA, 21 bp, Artificial sequence
  SiRNA target sequence
tggagtaataattaaatgatg

SEQ ID NO: 38540 - DNA, 21 bp, Artificial sequence
  SiRNA target sequence
ggagtaataattaaatgatgc

SEQ ID NO: 38541 - DNA, 21 bp, Artificial sequence
  SiRNA target sequence
gagtaataattaaatgatgca

SEQ ID NO: 38542 - DNA, 21 bp, Artificial sequence
  SiRNA target sequence
agtaataattaaatgatgcat

SEQ ID NO: 38543 - DNA, 21 bp, Artificial sequence
  SiRNA target sequence
gtaataattaaatgatgcatt

SEQ ID NO: 38544 - DNA, 21 bp, Artificial sequence
  SiRNA target sequence
taataattaaatgatgcattt

SEQ ID NO: 38545 - DNA, 21 bp, Artificial sequence
  SiRNA target sequence
aataattaaatgatgcatttt

SEQ ID NO: 38546 - DNA, 21 bp, Artificial sequence
  SiRNA target sequence
ataattaaatgatgcattttc

SEQ ID NO: 38547 - DNA, 21 bp, Artificial sequence
  SiRNA target sequence
taattaaatgatgcattttct

SEQ ID NO: 38548 - DNA, 21 bp, Artificial sequence
  SiRNA target sequence
aattaaatgatgcattttcta

SEQ ID NO: 38549 - DNA, 21 bp, Artificial sequence
  SiRNA target sequence
attaaatgatgcattttctaa

SEQ ID NO: 38550 - DNA, 21 bp, Artificial sequence
  SiRNA target sequence
ttaaatgatgcattttctaat

SEQ ID NO: 38551 - DNA, 21 bp, Artificial sequence
  SiRNA target sequence
taaatgatgcattttctaatc

SEQ ID NO: 38552 - DNA, 21 bp, Artificial sequence
  SiRNA target sequence
aaatgatgcattttctaatct

SEQ ID NO: 38553 - DNA, 21 bp, Artificial sequence
  SiRNA target sequence
aatgatgcattttctaatctt

SEQ ID NO: 38554 - DNA, 21 bp, Artificial sequence
  SiRNA target sequence
atgatgcattttctaatctta

SEQ ID NO: 38555 - DNA, 21 bp, Artificial sequence
  SiRNA target sequence
tgatgcattttctaatcttat

SEQ ID NO: 38556 - DNA, 21 bp, Artificial sequence
  SiRNA target sequence
gatgcattttctaatcttata

SEQ ID NO: 38557 - DNA, 21 bp, Artificial sequence
  SiRNA target sequence
atgcattttctaatcttatat

SEQ ID NO: 38558 - DNA, 21 bp, Artificial sequence
  SiRNA target sequence
tgcattttctaatcttatatc

SEQ ID NO: 38559 - DNA, 21 bp, Artificial sequence
  SiRNA target sequence
gcattttctaatcttatatca

SEQ ID NO: 38560 - DNA, 21 bp, Artificial sequence
  SiRNA target sequence
cattttctaatcttatatcat

SEQ ID NO: 38561 - DNA, 21 bp, Artificial sequence
  SiRNA target sequence
attttctaatcttatatcatt

SEQ ID NO: 38562 - DNA, 21 bp, Artificial sequence
  SiRNA target sequence
ttttctaatcttatatcatta

SEQ ID NO: 38563 - DNA, 21 bp, Artificial sequence
  SiRNA target sequence
tttctaatcttatatcattat

SEQ ID NO: 38564 - DNA, 21 bp, Artificial sequence
  SiRNA target sequence
ttctaatcttatatcattatt

SEQ ID NO: 38565 - DNA, 21 bp, Artificial sequence
  SiRNA target sequence
tctaatcttatatcattatta

SEQ ID NO: 38566 - DNA, 21 bp, Artificial sequence
  SiRNA target sequence
ctaatcttatatcattattaa

SEQ ID NO: 38567 - DNA, 21 bp, Artificial sequence
  SiRNA target sequence
taatcttatatcattattaaa

SEQ ID NO: 38568 - DNA, 21 bp, Artificial sequence
  SiRNA target sequence
aatcttatatcattattaaat

SEQ ID NO: 38569 - DNA, 21 bp, Artificial sequence
  SiRNA target sequence
atcttatatcattattaaatt

SEQ ID NO: 38570 - DNA, 21 bp, Artificial sequence
  SiRNA target sequence
tcttatatcattattaaattc

SEQ ID NO: 38571 - DNA, 21 bp, Artificial sequence
  SiRNA target sequence
cttatatcattattaaattca

SEQ ID NO: 38572 - DNA, 21 bp, Artificial sequence
  SiRNA target sequence
ttatatcattattaaattcat

SEQ ID NO: 38573 - DNA, 21 bp, Artificial sequence
  SiRNA target sequence
tatatcattattaaattcatt

SEQ ID NO: 38574 - DNA, 21 bp, Artificial sequence
  SiRNA target sequence
atatcattattaaattcatta

SEQ ID NO: 38575 - DNA, 21 bp, Artificial sequence
  SiRNA target sequence
tatcattattaaattcattaa

SEQ ID NO: 38576 - DNA, 21 bp, Artificial sequence
  SiRNA target sequence
atcattattaaattcattaac

SEQ ID NO: 38577 - DNA, 21 bp, Artificial sequence
  SiRNA target sequence
tcattattaaattcattaaca

SEQ ID NO: 38578 - DNA, 21 bp, Artificial sequence
  SiRNA target sequence
cattattaaattcattaacat

SEQ ID NO: 38579 - DNA, 21 bp, Artificial sequence
  SiRNA target sequence
attattaaattcattaacatc

SEQ ID NO: 38580 - DNA, 21 bp, Artificial sequence
  SiRNA target sequence
ttattaaattcattaacatct

SEQ ID NO: 38581 - DNA, 21 bp, Artificial sequence
  SiRNA target sequence
tattaaattcattaacatcta

SEQ ID NO: 38582 - DNA, 21 bp, Artificial sequence
  SiRNA target sequence
attaaattcattaacatctac

SEQ ID NO: 38583 - DNA, 21 bp, Artificial sequence
  SiRNA target sequence
ttaaattcattaacatctact

SEQ ID NO: 38584 - DNA, 21 bp, Artificial sequence
  SiRNA target sequence
taaattcattaacatctacta

SEQ ID NO: 38585 - DNA, 21 bp, Artificial sequence
  SiRNA target sequence
aaattcattaacatctactaa

SEQ ID NO: 38586 - DNA, 21 bp, Artificial sequence
  SiRNA target sequence
aattcattaacatctactaaa

SEQ ID NO: 38587 - DNA, 21 bp, Artificial sequence
  SiRNA target sequence
attcattaacatctactaaat

SEQ ID NO: 38588 - DNA, 21 bp, Artificial sequence
  SiRNA target sequence
ttcattaacatctactaaatt

SEQ ID NO: 38589 - DNA, 21 bp, Artificial sequence
  SiRNA target sequence
tcattaacatctactaaattt

SEQ ID NO: 38590 - DNA, 21 bp, Artificial sequence
  SiRNA target sequence
cattaacatctactaaatttg

SEQ ID NO: 38591 - DNA, 21 bp, Artificial sequence
  SiRNA target sequence
attaacatctactaaatttgg

SEQ ID NO: 38592 - DNA, 21 bp, Artificial sequence
  SiRNA target sequence
ttaacatctactaaatttggt

SEQ ID NO: 38593 - DNA, 21 bp, Artificial sequence
  SiRNA target sequence
taacatctactaaatttggtt

SEQ ID NO: 38594 - DNA, 21 bp, Artificial sequence
  SiRNA target sequence
aacatctactaaatttggttc

SEQ ID NO: 38595 - DNA, 21 bp, Artificial sequence
  SiRNA target sequence
acatctactaaatttggttct

SEQ ID NO: 38596 - DNA, 21 bp, Artificial sequence
  SiRNA target sequence
catctactaaatttggttctt

SEQ ID NO: 38597 - DNA, 21 bp, Artificial sequence
  SiRNA target sequence
atctactaaatttggttcttc

SEQ ID NO: 38598 - DNA, 21 bp, Artificial sequence
  SiRNA target sequence
tctactaaatttggttcttct

SEQ ID NO: 38599 - DNA, 21 bp, Artificial sequence
  SiRNA target sequence
ctactaaatttggttcttctt

SEQ ID NO: 38600 - DNA, 21 bp, Artificial sequence
  SiRNA target sequence
tactaaatttggttcttcttt

SEQ ID NO: 38601 - DNA, 21 bp, Artificial sequence
  SiRNA target sequence
actaaatttggttcttctttt

SEQ ID NO: 38602 - DNA, 21 bp, Artificial sequence
  SiRNA target sequence
ctaaatttggttcttctttta

SEQ ID NO: 38603 - DNA, 21 bp, Artificial sequence
  SiRNA target sequence
taaatttggttcttcttttat

SEQ ID NO: 38604 - DNA, 21 bp, Artificial sequence
  SiRNA target sequence
aaatttggttcttcttttata

SEQ ID NO: 38605 - DNA, 21 bp, Artificial sequence
  SiRNA target sequence
aatttggttcttcttttataa

SEQ ID NO: 38606 - DNA, 21 bp, Artificial sequence
  SiRNA target sequence
atttggttcttcttttataag

SEQ ID NO: 38607 - DNA, 21 bp, Artificial sequence
  SiRNA target sequence
tttggttcttcttttataagc

SEQ ID NO: 38608 - DNA, 21 bp, Artificial sequence
  SiRNA target sequence
ttggttcttcttttataagct

SEQ ID NO: 38609 - DNA, 21 bp, Artificial sequence
  SiRNA target sequence
tggttcttcttttataagctc

SEQ ID NO: 38610 - DNA, 21 bp, Artificial sequence
  SiRNA target sequence
ggttcttcttttataagctct

SEQ ID NO: 38611 - DNA, 21 bp, Artificial sequence
  SiRNA target sequence
gttcttcttttataagctctg

SEQ ID NO: 38612 - DNA, 21 bp, Artificial sequence
  SiRNA target sequence
ttcttcttttataagctctgg

SEQ ID NO: 38613 - DNA, 21 bp, Artificial sequence
  SiRNA target sequence
tcttcttttataagctctggt

SEQ ID NO: 38614 - DNA, 21 bp, Artificial sequence
  SiRNA target sequence
cttcttttataagctctggtt

SEQ ID NO: 38615 - DNA, 21 bp, Artificial sequence
  SiRNA target sequence
ttcttttataagctctggttt

SEQ ID NO: 38616 - DNA, 21 bp, Artificial sequence
  SiRNA target sequence
tcttttataagctctggttta

SEQ ID NO: 38617 - DNA, 21 bp, Artificial sequence
  SiRNA target sequence
cttttataagctctggtttaa

SEQ ID NO: 38618 - DNA, 21 bp, Artificial sequence
  SiRNA target sequence
ttttataagctctggtttaaa

SEQ ID NO: 38619 - DNA, 21 bp, Artificial sequence
  SiRNA target sequence
tttataagctctggtttaaaa

SEQ ID NO: 38620 - DNA, 21 bp, Artificial sequence
  SiRNA target sequence
ttataagctctggtttaaaag

SEQ ID NO: 38621 - DNA, 21 bp, Artificial sequence
  SiRNA target sequence
tataagctctggtttaaaaga

SEQ ID NO: 38622 - DNA, 21 bp, Artificial sequence
  SiRNA target sequence
ataagctctggtttaaaagat

SEQ ID NO: 38623 - DNA, 21 bp, Artificial sequence
  SiRNA target sequence
taagctctggtttaaaagatg

SEQ ID NO: 38624 - DNA, 21 bp, Artificial sequence
  SiRNA target sequence
aagctctggtttaaaagatgt

SEQ ID NO: 38625 - DNA, 21 bp, Artificial sequence
  SiRNA target sequence
agctctggtttaaaagatgtt

SEQ ID NO: 38626 - DNA, 21 bp, Artificial sequence
  SiRNA target sequence
gctctggtttaaaagatgttc

SEQ ID NO: 38627 - DNA, 21 bp, Artificial sequence
  SiRNA target sequence
ctctggtttaaaagatgttct

SEQ ID NO: 38628 - DNA, 21 bp, Artificial sequence
  SiRNA target sequence
tctggtttaaaagatgttctt

SEQ ID NO: 38629 - DNA, 21 bp, Artificial sequence
  SiRNA target sequence
ctggtttaaaagatgttctta

SEQ ID NO: 38630 - DNA, 21 bp, Artificial sequence
  SiRNA target sequence
tggtttaaaagatgttcttat

SEQ ID NO: 38631 - DNA, 21 bp, Artificial sequence
  SiRNA target sequence
ggtttaaaagatgttcttata

SEQ ID NO: 38632 - DNA, 21 bp, Artificial sequence
  SiRNA target sequence
gtttaaaagatgttcttatat

SEQ ID NO: 38633 - DNA, 21 bp, Artificial sequence
  SiRNA target sequence
tttaaaagatgttcttatatt

SEQ ID NO: 38634 - DNA, 21 bp, Artificial sequence
  SiRNA target sequence
ttaaaagatgttcttatattt

SEQ ID NO: 38635 - DNA, 21 bp, Artificial sequence
  SiRNA target sequence
taaaagatgttcttatattta

SEQ ID NO: 38636 - DNA, 21 bp, Artificial sequence
  SiRNA target sequence
aaaagatgttcttatatttaa

SEQ ID NO: 38637 - DNA, 21 bp, Artificial sequence
  SiRNA target sequence
aaagatgttcttatatttaag

SEQ ID NO: 38638 - DNA, 21 bp, Artificial sequence
  SiRNA target sequence
aagatgttcttatatttaaga

SEQ ID NO: 38639 - DNA, 21 bp, Artificial sequence
  SiRNA target sequence
agatgttcttatatttaagat

SEQ ID NO: 38640 - DNA, 21 bp, Artificial sequence
  SiRNA target sequence
gatgttcttatatttaagatt

SEQ ID NO: 38641 - DNA, 21 bp, Artificial sequence
  SiRNA target sequence
atgttcttatatttaagattg

SEQ ID NO: 38642 - DNA, 21 bp, Artificial sequence
  SiRNA target sequence
tgttcttatatttaagattgc

SEQ ID NO: 38643 - DNA, 21 bp, Artificial sequence
  SiRNA target sequence
gttcttatatttaagattgct

SEQ ID NO: 38644 - DNA, 21 bp, Artificial sequence
  SiRNA target sequence
ttcttatatttaagattgctt

SEQ ID NO: 38645 - DNA, 21 bp, Artificial sequence
  SiRNA target sequence
tcttatatttaagattgcttg

SEQ ID NO: 38646 - DNA, 21 bp, Artificial sequence
  SiRNA target sequence
cttatatttaagattgcttgt

SEQ ID NO: 38647 - DNA, 21 bp, Artificial sequence
  SiRNA target sequence
ttatatttaagattgcttgtg

SEQ ID NO: 38648 - DNA, 21 bp, Artificial sequence
  SiRNA target sequence
tatatttaagattgcttgtgt

SEQ ID NO: 38649 - DNA, 21 bp, Artificial sequence
  SiRNA target sequence
atatttaagattgcttgtgta

SEQ ID NO: 38650 - DNA, 21 bp, Artificial sequence
  SiRNA target sequence
tatttaagattgcttgtgtat

SEQ ID NO: 38651 - DNA, 21 bp, Artificial sequence
  SiRNA target sequence
atttaagattgcttgtgtata

SEQ ID NO: 38652 - DNA, 21 bp, Artificial sequence
  SiRNA target sequence
tttaagattgcttgtgtatat

SEQ ID NO: 38653 - DNA, 21 bp, Artificial sequence
  SiRNA target sequence
ttaagattgcttgtgtatatc

SEQ ID NO: 38654 - DNA, 21 bp, Artificial sequence
  SiRNA target sequence
taagattgcttgtgtatatcg

SEQ ID NO: 38655 - DNA, 21 bp, Artificial sequence
  SiRNA target sequence
aagattgcttgtgtatatcgt

SEQ ID NO: 38656 - DNA, 21 bp, Artificial sequence
  SiRNA target sequence
agattgcttgtgtatatcgtg

SEQ ID NO: 38657 - DNA, 21 bp, Artificial sequence
  SiRNA target sequence
gattgcttgtgtatatcgtga

SEQ ID NO: 38658 - DNA, 21 bp, Artificial sequence
  SiRNA target sequence
attgcttgtgtatatcgtgag

SEQ ID NO: 38659 - DNA, 21 bp, Artificial sequence
  SiRNA target sequence
ttgcttgtgtatatcgtgagt

SEQ ID NO: 38660 - DNA, 21 bp, Artificial sequence
  SiRNA target sequence
tgcttgtgtatatcgtgagta

SEQ ID NO: 38661 - DNA, 21 bp, Artificial sequence
  SiRNA target sequence
gcttgtgtatatcgtgagtaa

SEQ ID NO: 38662 - DNA, 21 bp, Artificial sequence
  SiRNA target sequence
cttgtgtatatcgtgagtaaa

SEQ ID NO: 38663 - DNA, 21 bp, Artificial sequence
  SiRNA target sequence
ttgtgtatatcgtgagtaaaa

SEQ ID NO: 38664 - DNA, 21 bp, Artificial sequence
  SiRNA target sequence
tgtgtatatcgtgagtaaaag

SEQ ID NO: 38665 - DNA, 21 bp, Artificial sequence
  SiRNA target sequence
gtgtatatcgtgagtaaaaga

SEQ ID NO: 38666 - DNA, 21 bp, Artificial sequence
  SiRNA target sequence
tgtatatcgtgagtaaaagaa

SEQ ID NO: 38667 - DNA, 21 bp, Artificial sequence
  SiRNA target sequence
gtatatcgtgagtaaaagaac

SEQ ID NO: 38668 - DNA, 21 bp, Artificial sequence
  SiRNA target sequence
tatatcgtgagtaaaagaacc

SEQ ID NO: 38669 - DNA, 21 bp, Artificial sequence
  SiRNA target sequence
atatcgtgagtaaaagaaccc

SEQ ID NO: 38670 - DNA, 21 bp, Artificial sequence
  SiRNA target sequence
tatcgtgagtaaaagaaccct

SEQ ID NO: 38671 - DNA, 21 bp, Artificial sequence
  SiRNA target sequence
atcgtgagtaaaagaacccta

SEQ ID NO: 38672 - DNA, 21 bp, Artificial sequence
  SiRNA target sequence
tcgtgagtaaaagaaccctaa

SEQ ID NO: 38673 - DNA, 21 bp, Artificial sequence
  SiRNA target sequence
cgtgagtaaaagaaccctaat

SEQ ID NO: 38674 - DNA, 21 bp, Artificial sequence
  SiRNA target sequence
gtgagtaaaagaaccctaatt

SEQ ID NO: 38675 - DNA, 21 bp, Artificial sequence
  SiRNA target sequence
tgagtaaaagaaccctaattg

SEQ ID NO: 38676 - DNA, 21 bp, Artificial sequence
  SiRNA target sequence
gagtaaaagaaccctaattgt

SEQ ID NO: 38677 - DNA, 21 bp, Artificial sequence
  SiRNA target sequence
agtaaaagaaccctaattgtc

SEQ ID NO: 38678 - DNA, 21 bp, Artificial sequence
  SiRNA target sequence
gtaaaagaaccctaattgtcc

SEQ ID NO: 38679 - DNA, 21 bp, Artificial sequence
  SiRNA target sequence
taaaagaaccctaattgtcca

SEQ ID NO: 38680 - DNA, 21 bp, Artificial sequence
  SiRNA target sequence
aaaagaaccctaattgtccaa

SEQ ID NO: 38681 - DNA, 21 bp, Artificial sequence
  SiRNA target sequence
aaagaaccctaattgtccaaa

SEQ ID NO: 38682 - DNA, 21 bp, Artificial sequence
  SiRNA target sequence
aagaaccctaattgtccaaaa

SEQ ID NO: 38683 - DNA, 21 bp, Artificial sequence
  SiRNA target sequence
agaaccctaattgtccaaaac

SEQ ID NO: 38684 - DNA, 21 bp, Artificial sequence
  SiRNA target sequence
gaaccctaattgtccaaaact

SEQ ID NO: 38685 - DNA, 21 bp, Artificial sequence
  SiRNA target sequence
aaccctaattgtccaaaactt

SEQ ID NO: 38686 - DNA, 21 bp, Artificial sequence
  SiRNA target sequence
accctaattgtccaaaacttg

SEQ ID NO: 38687 - DNA, 21 bp, Artificial sequence
  SiRNA target sequence
ccctaattgtccaaaacttga

SEQ ID NO: 38688 - DNA, 21 bp, Artificial sequence
  SiRNA target sequence
cctaattgtccaaaacttgaa

SEQ ID NO: 38689 - DNA, 21 bp, Artificial sequence
  SiRNA target sequence
ctaattgtccaaaacttgaat

SEQ ID NO: 38690 - DNA, 21 bp, Artificial sequence
  SiRNA target sequence
taattgtccaaaacttgaata

SEQ ID NO: 38691 - DNA, 21 bp, Artificial sequence
  SiRNA target sequence
aattgtccaaaacttgaatac

SEQ ID NO: 38692 - DNA, 21 bp, Artificial sequence
  SiRNA target sequence
attgtccaaaacttgaataca

SEQ ID NO: 38693 - DNA, 21 bp, Artificial sequence
  SiRNA target sequence
ttgtccaaaacttgaatacaa

SEQ ID NO: 38694 - DNA, 21 bp, Artificial sequence
  SiRNA target sequence
tgtccaaaacttgaatacaat

SEQ ID NO: 38695 - DNA, 21 bp, Artificial sequence
  SiRNA target sequence
gtccaaaacttgaatacaatg

SEQ ID NO: 38696 - DNA, 21 bp, Artificial sequence
  SiRNA target sequence
tccaaaacttgaatacaatgt

SEQ ID NO: 38697 - DNA, 21 bp, Artificial sequence
  SiRNA target sequence
ccaaaacttgaatacaatgtt

SEQ ID NO: 38698 - DNA, 21 bp, Artificial sequence
  SiRNA target sequence
caaaacttgaatacaatgttc

SEQ ID NO: 38699 - DNA, 21 bp, Artificial sequence
  SiRNA target sequence
aaaacttgaatacaatgttct

SEQ ID NO: 38700 - DNA, 21 bp, Artificial sequence
  SiRNA target sequence
aaacttgaatacaatgttcta

SEQ ID NO: 38701 - DNA, 21 bp, Artificial sequence
  SiRNA target sequence
aacttgaatacaatgttctat

SEQ ID NO: 38702 - DNA, 21 bp, Artificial sequence
  SiRNA target sequence
acttgaatacaatgttctatt

SEQ ID NO: 38703 - DNA, 21 bp, Artificial sequence
  SiRNA target sequence
cttgaatacaatgttctatta

SEQ ID NO: 38704 - DNA, 21 bp, Artificial sequence
  SiRNA target sequence
ttgaatacaatgttctattaa

SEQ ID NO: 38705 - DNA, 21 bp, Artificial sequence
  SiRNA target sequence
tgaatacaatgttctattaat

SEQ ID NO: 38706 - DNA, 21 bp, Artificial sequence
  SiRNA target sequence
gaatacaatgttctattaatg

SEQ ID NO: 38707 - DNA, 21 bp, Artificial sequence
  SiRNA target sequence
aatacaatgttctattaatgc

SEQ ID NO: 38708 - DNA, 21 bp, Artificial sequence
  SiRNA target sequence
atacaatgttctattaatgcc

SEQ ID NO: 38709 - DNA, 21 bp, Artificial sequence
  SiRNA target sequence
tacaatgttctattaatgcca

SEQ ID NO: 38710 - DNA, 21 bp, Artificial sequence
  SiRNA target sequence
acaatgttctattaatgccaa

SEQ ID NO: 38711 - DNA, 21 bp, Artificial sequence
  SiRNA target sequence
caatgttctattaatgccaat

SEQ ID NO: 38712 - DNA, 21 bp, Artificial sequence
  SiRNA target sequence
aatgttctattaatgccaata

SEQ ID NO: 38713 - DNA, 21 bp, Artificial sequence
  SiRNA target sequence
atgttctattaatgccaatat

SEQ ID NO: 38714 - DNA, 21 bp, Artificial sequence
  SiRNA target sequence
tgttctattaatgccaatata

SEQ ID NO: 38715 - DNA, 21 bp, Artificial sequence
  SiRNA target sequence
gttctattaatgccaatataa

SEQ ID NO: 38716 - DNA, 21 bp, Artificial sequence
  SiRNA target sequence
ttctattaatgccaatataaa

SEQ ID NO: 38717 - DNA, 21 bp, Artificial sequence
  SiRNA target sequence
tctattaatgccaatataaaa

SEQ ID NO: 38718 - DNA, 21 bp, Artificial sequence
  SiRNA target sequence
ctattaatgccaatataaaat

SEQ ID NO: 38719 - DNA, 21 bp, Artificial sequence
  SiRNA target sequence
tattaatgccaatataaaata

SEQ ID NO: 38720 - DNA, 21 bp, Artificial sequence
  SiRNA target sequence
attaatgccaatataaaatac

SEQ ID NO: 38721 - DNA, 21 bp, Artificial sequence
  SiRNA target sequence
ttaatgccaatataaaataca

SEQ ID NO: 38722 - DNA, 21 bp, Artificial sequence
  SiRNA target sequence
taatgccaatataaaatacaa

SEQ ID NO: 38723 - DNA, 21 bp, Artificial sequence
  SiRNA target sequence
aatgccaatataaaatacaac

SEQ ID NO: 38724 - DNA, 21 bp, Artificial sequence
  SiRNA target sequence
atgccaatataaaatacaaca

SEQ ID NO: 38725 - DNA, 21 bp, Artificial sequence
  SiRNA target sequence
tgccaatataaaatacaacat

SEQ ID NO: 38726 - DNA, 21 bp, Artificial sequence
  SiRNA target sequence
gccaatataaaatacaacatc

SEQ ID NO: 38727 - DNA, 21 bp, Artificial sequence
  SiRNA target sequence
ccaatataaaatacaacatcc

SEQ ID NO: 38728 - DNA, 21 bp, Artificial sequence
  SiRNA target sequence
caatataaaatacaacatccc

SEQ ID NO: 38729 - DNA, 21 bp, Artificial sequence
  SiRNA target sequence
aatataaaatacaacatccct

SEQ ID NO: 38730 - DNA, 21 bp, Artificial sequence
  SiRNA target sequence
atataaaatacaacatccctg

SEQ ID NO: 38731 - DNA, 21 bp, Artificial sequence
  SiRNA target sequence
tataaaatacaacatccctgg

SEQ ID NO: 38732 - DNA, 21 bp, Artificial sequence
  SiRNA target sequence
ataaaatacaacatccctggc

SEQ ID NO: 38733 - DNA, 21 bp, Artificial sequence
  SiRNA target sequence
taaaatacaacatccctggca

SEQ ID NO: 38734 - DNA, 21 bp, Artificial sequence
  SiRNA target sequence
aaaatacaacatccctggcac

SEQ ID NO: 38735 - DNA, 21 bp, Artificial sequence
  SiRNA target sequence
aaatacaacatccctggcact

SEQ ID NO: 38736 - DNA, 21 bp, Artificial sequence
  SiRNA target sequence
aatacaacatccctggcactt

SEQ ID NO: 38737 - DNA, 21 bp, Artificial sequence
  SiRNA target sequence
atacaacatccctggcactta

SEQ ID NO: 38738 - DNA, 21 bp, Artificial sequence
  SiRNA target sequence
tacaacatccctggcacttag

SEQ ID NO: 38739 - DNA, 21 bp, Artificial sequence
  SiRNA target sequence
acaacatccctggcacttagt

SEQ ID NO: 38740 - DNA, 21 bp, Artificial sequence
  SiRNA target sequence
caacatccctggcacttagtt

SEQ ID NO: 38741 - DNA, 21 bp, Artificial sequence
  SiRNA target sequence
aacatccctggcacttagttt

SEQ ID NO: 38742 - DNA, 21 bp, Artificial sequence
  SiRNA target sequence
acatccctggcacttagtttt

SEQ ID NO: 38743 - DNA, 21 bp, Artificial sequence
  SiRNA target sequence
catccctggcacttagttttg

SEQ ID NO: 38744 - DNA, 21 bp, Artificial sequence
  SiRNA target sequence
atccctggcacttagttttgc

SEQ ID NO: 38745 - DNA, 21 bp, Artificial sequence
  SiRNA target sequence
tccctggcacttagttttgct

SEQ ID NO: 38746 - DNA, 21 bp, Artificial sequence
  SiRNA target sequence
ccctggcacttagttttgctg

SEQ ID NO: 38747 - DNA, 21 bp, Artificial sequence
  SiRNA target sequence
cctggcacttagttttgctgt

SEQ ID NO: 38748 - DNA, 21 bp, Artificial sequence
  SiRNA target sequence
ctggcacttagttttgctgtt

SEQ ID NO: 38749 - DNA, 21 bp, Artificial sequence
  SiRNA target sequence
tggcacttagttttgctgtta

SEQ ID NO: 38750 - DNA, 21 bp, Artificial sequence
  SiRNA target sequence
ggcacttagttttgctgttaa

SEQ ID NO: 38751 - DNA, 21 bp, Artificial sequence
  SiRNA target sequence
gcacttagttttgctgttaat

SEQ ID NO: 38752 - DNA, 21 bp, Artificial sequence
  SiRNA target sequence
cacttagttttgctgttaata

SEQ ID NO: 38753 - DNA, 21 bp, Artificial sequence
  SiRNA target sequence
acttagttttgctgttaatat

SEQ ID NO: 38754 - DNA, 21 bp, Artificial sequence
  SiRNA target sequence
cttagttttgctgttaatatt

SEQ ID NO: 38755 - DNA, 21 bp, Artificial sequence
  SiRNA target sequence
ttagttttgctgttaatattc

SEQ ID NO: 38756 - DNA, 21 bp, Artificial sequence
  SiRNA target sequence
tagttttgctgttaatattcc

SEQ ID NO: 38757 - DNA, 21 bp, Artificial sequence
  SiRNA target sequence
agttttgctgttaatattcca

SEQ ID NO: 38758 - DNA, 21 bp, Artificial sequence
  SiRNA target sequence
gttttgctgttaatattccat

SEQ ID NO: 38759 - DNA, 21 bp, Artificial sequence
  SiRNA target sequence
ttttgctgttaatattccata

SEQ ID NO: 38760 - DNA, 21 bp, Artificial sequence
  SiRNA target sequence
tttgctgttaatattccatag

SEQ ID NO: 38761 - DNA, 21 bp, Artificial sequence
  SiRNA target sequence
ttgctgttaatattccatagt

SEQ ID NO: 38762 - DNA, 21 bp, Artificial sequence
  SiRNA target sequence
tgctgttaatattccatagtt

SEQ ID NO: 38763 - DNA, 21 bp, Artificial sequence
  SiRNA target sequence
gctgttaatattccatagttt

SEQ ID NO: 38764 - DNA, 21 bp, Artificial sequence
  SiRNA target sequence
ctgttaatattccatagtttc

SEQ ID NO: 38765 - DNA, 21 bp, Artificial sequence
  SiRNA target sequence
tgttaatattccatagtttcc

SEQ ID NO: 38766 - DNA, 21 bp, Artificial sequence
  SiRNA target sequence
gttaatattccatagtttcct

SEQ ID NO: 38767 - DNA, 21 bp, Artificial sequence
  SiRNA target sequence
ttaatattccatagtttccta

SEQ ID NO: 38768 - DNA, 21 bp, Artificial sequence
  SiRNA target sequence
taatattccatagtttcctaa

SEQ ID NO: 38769 - DNA, 21 bp, Artificial sequence
  SiRNA target sequence
aatattccatagtttcctaat

SEQ ID NO: 38770 - DNA, 21 bp, Artificial sequence
  SiRNA target sequence
atattccatagtttcctaatg

SEQ ID NO: 38771 - DNA, 21 bp, Artificial sequence
  SiRNA target sequence
tattccatagtttcctaatgt

SEQ ID NO: 38772 - DNA, 21 bp, Artificial sequence
  SiRNA target sequence
attccatagtttcctaatgtt

SEQ ID NO: 38773 - DNA, 21 bp, Artificial sequence
  SiRNA target sequence
ttccatagtttcctaatgtta

SEQ ID NO: 38774 - DNA, 21 bp, Artificial sequence
  SiRNA target sequence
tccatagtttcctaatgttat

SEQ ID NO: 38775 - DNA, 21 bp, Artificial sequence
  SiRNA target sequence
ccatagtttcctaatgttata

SEQ ID NO: 38776 - DNA, 21 bp, Artificial sequence
  SiRNA target sequence
catagtttcctaatgttataa

SEQ ID NO: 38777 - DNA, 21 bp, Artificial sequence
  SiRNA target sequence
atagtttcctaatgttataac

SEQ ID NO: 38778 - DNA, 21 bp, Artificial sequence
  SiRNA target sequence
tagtttcctaatgttataact

SEQ ID NO: 38779 - DNA, 21 bp, Artificial sequence
  SiRNA target sequence
agtttcctaatgttataacta

SEQ ID NO: 38780 - DNA, 21 bp, Artificial sequence
  SiRNA target sequence
gtttcctaatgttataactat

SEQ ID NO: 38781 - DNA, 21 bp, Artificial sequence
  SiRNA target sequence
tttcctaatgttataactata

SEQ ID NO: 38782 - DNA, 21 bp, Artificial sequence
  SiRNA target sequence
ttcctaatgttataactataa

SEQ ID NO: 38783 - DNA, 21 bp, Artificial sequence
  SiRNA target sequence
tcctaatgttataactataaa

SEQ ID NO: 38784 - DNA, 21 bp, Artificial sequence
  SiRNA target sequence
cctaatgttataactataaaa

SEQ ID NO: 38785 - DNA, 21 bp, Artificial sequence
  SiRNA target sequence
ctaatgttataactataaaac

SEQ ID NO: 38786 - DNA, 21 bp, Artificial sequence
  SiRNA target sequence
taatgttataactataaaaca

SEQ ID NO: 38787 - DNA, 21 bp, Artificial sequence
  SiRNA target sequence
aatgttataactataaaacac

SEQ ID NO: 38788 - DNA, 21 bp, Artificial sequence
  SiRNA target sequence
atgttataactataaaacact

SEQ ID NO: 38789 - DNA, 21 bp, Artificial sequence
  SiRNA target sequence
tgttataactataaaacactg

SEQ ID NO: 38790 - DNA, 21 bp, Artificial sequence
  SiRNA target sequence
gttataactataaaacactgt

SEQ ID NO: 38791 - DNA, 21 bp, Artificial sequence
  SiRNA target sequence
ttataactataaaacactgta

SEQ ID NO: 38792 - DNA, 21 bp, Artificial sequence
  SiRNA target sequence
tataactataaaacactgtaa

SEQ ID NO: 38793 - DNA, 21 bp, Artificial sequence
  SiRNA target sequence
ataactataaaacactgtaaa

SEQ ID NO: 38794 - DNA, 21 bp, Artificial sequence
  SiRNA target sequence
taactataaaacactgtaaag

SEQ ID NO: 38795 - DNA, 21 bp, Artificial sequence
  SiRNA target sequence
aactataaaacactgtaaagc

SEQ ID NO: 38796 - DNA, 21 bp, Artificial sequence
  SiRNA target sequence
actataaaacactgtaaagca

SEQ ID NO: 38797 - DNA, 21 bp, Artificial sequence
  SiRNA target sequence
ctataaaacactgtaaagcaa

SEQ ID NO: 38798 - DNA, 21 bp, Artificial sequence
  SiRNA target sequence
tataaaacactgtaaagcaaa

SEQ ID NO: 38799 - DNA, 21 bp, Artificial sequence
  SiRNA target sequence
ataaaacactgtaaagcaaaa

SEQ ID NO: 38800 - DNA, 21 bp, Artificial sequence
  SiRNA target sequence
taaaacactgtaaagcaaaaa

SEQ ID NO: 38801 - DNA, 21 bp, Artificial sequence
  SiRNA target sequence
aaaacactgtaaagcaaaaat

SEQ ID NO: 38802 - DNA, 21 bp, Artificial sequence
  SiRNA target sequence
aaacactgtaaagcaaaaatt

SEQ ID NO: 38803 - DNA, 21 bp, Artificial sequence
  SiRNA target sequence
aacactgtaaagcaaaaatta

SEQ ID NO: 38804 - DNA, 21 bp, Artificial sequence
  SiRNA target sequence
acactgtaaagcaaaaattat

SEQ ID NO: 38805 - DNA, 21 bp, Artificial sequence
  SiRNA target sequence
cactgtaaagcaaaaattatc

SEQ ID NO: 38806 - DNA, 21 bp, Artificial sequence
  SiRNA target sequence
actgtaaagcaaaaattatct

SEQ ID NO: 38807 - DNA, 21 bp, Artificial sequence
  SiRNA target sequence
ctgtaaagcaaaaattatctt

SEQ ID NO: 38808 - DNA, 21 bp, Artificial sequence
  SiRNA target sequence
tgtaaagcaaaaattatctta

SEQ ID NO: 38809 - DNA, 21 bp, Artificial sequence
  SiRNA target sequence
gtaaagcaaaaattatcttat

SEQ ID NO: 38810 - DNA, 21 bp, Artificial sequence
  SiRNA target sequence
taaagcaaaaattatcttatt

SEQ ID NO: 38811 - DNA, 21 bp, Artificial sequence
  SiRNA target sequence
aaagcaaaaattatcttattt

SEQ ID NO: 38812 - DNA, 21 bp, Artificial sequence
  SiRNA target sequence
aagcaaaaattatcttattta

SEQ ID NO: 38813 - DNA, 21 bp, Artificial sequence
  SiRNA target sequence
agcaaaaattatcttatttac

SEQ ID NO: 38814 - DNA, 21 bp, Artificial sequence
  SiRNA target sequence
gcaaaaattatcttatttaca

SEQ ID NO: 38815 - DNA, 21 bp, Artificial sequence
  SiRNA target sequence
caaaaattatcttatttacaa

SEQ ID NO: 38816 - DNA, 21 bp, Artificial sequence
  SiRNA target sequence
aaaaattatcttatttacaag

SEQ ID NO: 38817 - DNA, 21 bp, Artificial sequence
  SiRNA target sequence
aaaattatcttatttacaagg

SEQ ID NO: 38818 - DNA, 21 bp, Artificial sequence
  SiRNA target sequence
aaattatcttatttacaaggt

SEQ ID NO: 38819 - DNA, 21 bp, Artificial sequence
  SiRNA target sequence
aattatcttatttacaaggta

SEQ ID NO: 38820 - DNA, 21 bp, Artificial sequence
  SiRNA target sequence
attatcttatttacaaggtat

SEQ ID NO: 38821 - DNA, 21 bp, Artificial sequence
  SiRNA target sequence
ttatcttatttacaaggtata

SEQ ID NO: 38822 - DNA, 21 bp, Artificial sequence
  SiRNA target sequence
tatcttatttacaaggtataa

SEQ ID NO: 38823 - DNA, 21 bp, Artificial sequence
  SiRNA target sequence
atcttatttacaaggtataaa

SEQ ID NO: 38824 - DNA, 21 bp, Artificial sequence
  SiRNA target sequence
tcttatttacaaggtataaaa

SEQ ID NO: 38825 - DNA, 21 bp, Artificial sequence
  SiRNA target sequence
cttatttacaaggtataaaaa

SEQ ID NO: 38826 - DNA, 21 bp, Artificial sequence
  SiRNA target sequence
ttatttacaaggtataaaaaa

SEQ ID NO: 38827 - DNA, 21 bp, Artificial sequence
  SiRNA target sequence
tatttacaaggtataaaaaac

SEQ ID NO: 38828 - DNA, 21 bp, Artificial sequence
  SiRNA target sequence
atttacaaggtataaaaaact

SEQ ID NO: 38829 - DNA, 21 bp, Artificial sequence
  SiRNA target sequence
tttacaaggtataaaaaacta

SEQ ID NO: 38830 - DNA, 21 bp, Artificial sequence
  SiRNA target sequence
ttacaaggtataaaaaactaa

SEQ ID NO: 38831 - DNA, 21 bp, Artificial sequence
  SiRNA target sequence
tacaaggtataaaaaactaag

SEQ ID NO: 38832 - DNA, 21 bp, Artificial sequence
  SiRNA target sequence
acaaggtataaaaaactaaga

SEQ ID NO: 38833 - DNA, 21 bp, Artificial sequence
  SiRNA target sequence
caaggtataaaaaactaagag

SEQ ID NO: 38834 - DNA, 21 bp, Artificial sequence
  SiRNA target sequence
aaggtataaaaaactaagaga

SEQ ID NO: 38835 - DNA, 21 bp, Artificial sequence
  SiRNA target sequence
aggtataaaaaactaagagat

SEQ ID NO: 38836 - DNA, 21 bp, Artificial sequence
  SiRNA target sequence
ggtataaaaaactaagagatc

SEQ ID NO: 38837 - DNA, 21 bp, Artificial sequence
  SiRNA target sequence
gtataaaaaactaagagatct

SEQ ID NO: 38838 - DNA, 21 bp, Artificial sequence
  SiRNA target sequence
tataaaaaactaagagatctc

SEQ ID NO: 38839 - DNA, 21 bp, Artificial sequence
  SiRNA target sequence
ataaaaaactaagagatctcc

SEQ ID NO: 38840 - DNA, 21 bp, Artificial sequence
  SiRNA target sequence
taaaaaactaagagatctcca

SEQ ID NO: 38841 - DNA, 21 bp, Artificial sequence
  SiRNA target sequence
aaaaaactaagagatctccag

SEQ ID NO: 38842 - DNA, 21 bp, Artificial sequence
  SiRNA target sequence
aaaaactaagagatctccaga

SEQ ID NO: 38843 - DNA, 21 bp, Artificial sequence
  SiRNA target sequence
aaaactaagagatctccagat

SEQ ID NO: 38844 - DNA, 21 bp, Artificial sequence
  SiRNA target sequence
aaactaagagatctccagatt

SEQ ID NO: 38845 - DNA, 21 bp, Artificial sequence
  SiRNA target sequence
aactaagagatctccagattc

SEQ ID NO: 38846 - DNA, 21 bp, Artificial sequence
  SiRNA target sequence
actaagagatctccagattct

SEQ ID NO: 38847 - DNA, 21 bp, Artificial sequence
  SiRNA target sequence
ctaagagatctccagattctg

SEQ ID NO: 38848 - DNA, 21 bp, Artificial sequence
  SiRNA target sequence
taagagatctccagattctgt

SEQ ID NO: 38849 - DNA, 21 bp, Artificial sequence
  SiRNA target sequence
aagagatctccagattctgtt

SEQ ID NO: 38850 - DNA, 21 bp, Artificial sequence
  SiRNA target sequence
agagatctccagattctgtta

SEQ ID NO: 38851 - DNA, 21 bp, Artificial sequence
  SiRNA target sequence
gagatctccagattctgttac

SEQ ID NO: 38852 - DNA, 21 bp, Artificial sequence
  SiRNA target sequence
agatctccagattctgttaca

SEQ ID NO: 38853 - DNA, 21 bp, Artificial sequence
  SiRNA target sequence
gatctccagattctgttacat

SEQ ID NO: 38854 - DNA, 21 bp, Artificial sequence
  SiRNA target sequence
atctccagattctgttacatt

SEQ ID NO: 38855 - DNA, 21 bp, Artificial sequence
  SiRNA target sequence
tctccagattctgttacattc

SEQ ID NO: 38856 - DNA, 21 bp, Artificial sequence
  SiRNA target sequence
ctccagattctgttacattcc

SEQ ID NO: 38857 - DNA, 21 bp, Artificial sequence
  SiRNA target sequence
tccagattctgttacattccg

SEQ ID NO: 38858 - DNA, 21 bp, Artificial sequence
  SiRNA target sequence
ccagattctgttacattccga

SEQ ID NO: 38859 - DNA, 21 bp, Artificial sequence
  SiRNA target sequence
cagattctgttacattccgat

SEQ ID NO: 38860 - DNA, 21 bp, Artificial sequence
  SiRNA target sequence
agattctgttacattccgatt

SEQ ID NO: 38861 - DNA, 21 bp, Artificial sequence
  SiRNA target sequence
gattctgttacattccgattc

SEQ ID NO: 38862 - DNA, 21 bp, Artificial sequence
  SiRNA target sequence
attctgttacattccgattct

SEQ ID NO: 38863 - DNA, 21 bp, Artificial sequence
  SiRNA target sequence
ttctgttacattccgattcta

SEQ ID NO: 38864 - DNA, 21 bp, Artificial sequence
  SiRNA target sequence
tctgttacattccgattctac

SEQ ID NO: 38865 - DNA, 21 bp, Artificial sequence
  SiRNA target sequence
ctgttacattccgattctact

SEQ ID NO: 38866 - DNA, 21 bp, Artificial sequence
  SiRNA target sequence
tgttacattccgattctactt

SEQ ID NO: 38867 - DNA, 21 bp, Artificial sequence
  SiRNA target sequence
gttacattccgattctacttc

SEQ ID NO: 38868 - DNA, 21 bp, Artificial sequence
  SiRNA target sequence
ttacattccgattctacttca

SEQ ID NO: 38869 - DNA, 21 bp, Artificial sequence
  SiRNA target sequence
tacattccgattctacttcag

SEQ ID NO: 38870 - DNA, 21 bp, Artificial sequence
  SiRNA target sequence
acattccgattctacttcaga

SEQ ID NO: 38871 - DNA, 21 bp, Artificial sequence
  SiRNA target sequence
cattccgattctacttcagaa

SEQ ID NO: 38872 - DNA, 21 bp, Artificial sequence
  SiRNA target sequence
attccgattctacttcagaaa

SEQ ID NO: 38873 - DNA, 21 bp, Artificial sequence
  SiRNA target sequence
ttccgattctacttcagaaac

SEQ ID NO: 38874 - DNA, 21 bp, Artificial sequence
  SiRNA target sequence
tccgattctacttcagaaaca

SEQ ID NO: 38875 - DNA, 21 bp, Artificial sequence
  SiRNA target sequence
ccgattctacttcagaaacat

SEQ ID NO: 38876 - DNA, 21 bp, Artificial sequence
  SiRNA target sequence
cgattctacttcagaaacata

SEQ ID NO: 38877 - DNA, 21 bp, Artificial sequence
  SiRNA target sequence
gattctacttcagaaacatat

SEQ ID NO: 38878 - DNA, 21 bp, Artificial sequence
  SiRNA target sequence
attctacttcagaaacatatt

SEQ ID NO: 38879 - DNA, 21 bp, Artificial sequence
  SiRNA target sequence
ttctacttcagaaacatattt

SEQ ID NO: 38880 - DNA, 21 bp, Artificial sequence
  SiRNA target sequence
tctacttcagaaacatatttt

SEQ ID NO: 38881 - DNA, 21 bp, Artificial sequence
  SiRNA target sequence
ctacttcagaaacatattttt

SEQ ID NO: 38882 - DNA, 21 bp, Artificial sequence
  SiRNA target sequence
tacttcagaaacatatttttc

SEQ ID NO: 38883 - DNA, 21 bp, Artificial sequence
  SiRNA target sequence
acttcagaaacatatttttca

SEQ ID NO: 38884 - DNA, 21 bp, Artificial sequence
  SiRNA target sequence
cttcagaaacatatttttcat

SEQ ID NO: 38885 - DNA, 21 bp, Artificial sequence
  SiRNA target sequence
ttcagaaacatatttttcata

SEQ ID NO: 38886 - DNA, 21 bp, Artificial sequence
  SiRNA target sequence
tcagaaacatatttttcatat

SEQ ID NO: 38887 - DNA, 21 bp, Artificial sequence
  SiRNA target sequence
cagaaacatatttttcatatt

SEQ ID NO: 38888 - DNA, 21 bp, Artificial sequence
  SiRNA target sequence
agaaacatatttttcatattt

SEQ ID NO: 38889 - DNA, 21 bp, Artificial sequence
  SiRNA target sequence
gaaacatatttttcatattta

SEQ ID NO: 38890 - DNA, 21 bp, Artificial sequence
  SiRNA target sequence
aaacatatttttcatatttaa

SEQ ID NO: 38891 - DNA, 21 bp, Artificial sequence
  SiRNA target sequence
aacatatttttcatatttaag

SEQ ID NO: 38892 - DNA, 21 bp, Artificial sequence
  SiRNA target sequence
acatatttttcatatttaagc

SEQ ID NO: 38893 - DNA, 21 bp, Artificial sequence
  SiRNA target sequence
catatttttcatatttaagcg

SEQ ID NO: 38894 - DNA, 21 bp, Artificial sequence
  SiRNA target sequence
atatttttcatatttaagcga

SEQ ID NO: 38895 - DNA, 21 bp, Artificial sequence
  SiRNA target sequence
tatttttcatatttaagcgat

SEQ ID NO: 38896 - DNA, 21 bp, Artificial sequence
  SiRNA target sequence
atttttcatatttaagcgatt

SEQ ID NO: 38897 - DNA, 21 bp, Artificial sequence
  SiRNA target sequence
tttttcatatttaagcgattc

SEQ ID NO: 38898 - DNA, 21 bp, Artificial sequence
  SiRNA target sequence
ttttcatatttaagcgattct

SEQ ID NO: 38899 - DNA, 21 bp, Artificial sequence
  SiRNA target sequence
tttcatatttaagcgattctt

SEQ ID NO: 38900 - DNA, 21 bp, Artificial sequence
  SiRNA target sequence
ttcatatttaagcgattcttc

SEQ ID NO: 38901 - DNA, 21 bp, Artificial sequence
  SiRNA target sequence
tcatatttaagcgattcttct

SEQ ID NO: 38902 - DNA, 21 bp, Artificial sequence
  SiRNA target sequence
catatttaagcgattcttctt

SEQ ID NO: 38903 - DNA, 21 bp, Artificial sequence
  SiRNA target sequence
atatttaagcgattcttcttc

SEQ ID NO: 38904 - DNA, 21 bp, Artificial sequence
  SiRNA target sequence
tatttaagcgattcttcttct

SEQ ID NO: 38905 - DNA, 21 bp, Artificial sequence
  SiRNA target sequence
atttaagcgattcttcttctt

SEQ ID NO: 38906 - DNA, 21 bp, Artificial sequence
  SiRNA target sequence
tttaagcgattcttcttcttc

SEQ ID NO: 38907 - DNA, 21 bp, Artificial sequence
  SiRNA target sequence
ttaagcgattcttcttcttct

SEQ ID NO: 38908 - DNA, 21 bp, Artificial sequence
  SiRNA target sequence
taagcgattcttcttcttctg

SEQ ID NO: 38909 - DNA, 21 bp, Artificial sequence
  SiRNA target sequence
aagcgattcttcttcttctgt

SEQ ID NO: 38910 - DNA, 21 bp, Artificial sequence
  SiRNA target sequence
agcgattcttcttcttctgtt

SEQ ID NO: 38911 - DNA, 21 bp, Artificial sequence
  SiRNA target sequence
gcgattcttcttcttctgttt

SEQ ID NO: 38912 - DNA, 21 bp, Artificial sequence
  SiRNA target sequence
cgattcttcttcttctgtttt

SEQ ID NO: 38913 - DNA, 21 bp, Artificial sequence
  SiRNA target sequence
gattcttcttcttctgtttta

SEQ ID NO: 38914 - DNA, 21 bp, Artificial sequence
  SiRNA target sequence
attcttcttcttctgttttat

SEQ ID NO: 38915 - DNA, 21 bp, Artificial sequence
  SiRNA target sequence
ttcttcttcttctgttttata

SEQ ID NO: 38916 - DNA, 21 bp, Artificial sequence
  SiRNA target sequence
tcttcttcttctgttttatat

SEQ ID NO: 38917 - DNA, 21 bp, Artificial sequence
  SiRNA target sequence
cttcttcttctgttttatatg

SEQ ID NO: 38918 - DNA, 21 bp, Artificial sequence
  SiRNA target sequence
ttcttcttctgttttatatgc

SEQ ID NO: 38919 - DNA, 21 bp, Artificial sequence
  SiRNA target sequence
tcttcttctgttttatatgct

SEQ ID NO: 38920 - DNA, 21 bp, Artificial sequence
  SiRNA target sequence
cttcttctgttttatatgcta

SEQ ID NO: 38921 - DNA, 21 bp, Artificial sequence
  SiRNA target sequence
ttcttctgttttatatgctag

SEQ ID NO: 38922 - DNA, 21 bp, Artificial sequence
  SiRNA target sequence
tcttctgttttatatgctagt

SEQ ID NO: 38923 - DNA, 21 bp, Artificial sequence
  SiRNA target sequence
cttctgttttatatgctagta

SEQ ID NO: 38924 - DNA, 21 bp, Artificial sequence
  SiRNA target sequence
ttctgttttatatgctagtat

SEQ ID NO: 38925 - DNA, 21 bp, Artificial sequence
  SiRNA target sequence
tctgttttatatgctagtata

SEQ ID NO: 38926 - DNA, 21 bp, Artificial sequence
  SiRNA target sequence
ctgttttatatgctagtatag

SEQ ID NO: 38927 - DNA, 21 bp, Artificial sequence
  SiRNA target sequence
tgttttatatgctagtatagt

SEQ ID NO: 38928 - DNA, 21 bp, Artificial sequence
  SiRNA target sequence
gttttatatgctagtatagtc

SEQ ID NO: 38929 - DNA, 21 bp, Artificial sequence
  SiRNA target sequence
ttttatatgctagtatagtct

SEQ ID NO: 38930 - DNA, 21 bp, Artificial sequence
  SiRNA target sequence
tttatatgctagtatagtctc

SEQ ID NO: 38931 - DNA, 21 bp, Artificial sequence
  SiRNA target sequence
ttatatgctagtatagtctca

SEQ ID NO: 38932 - DNA, 21 bp, Artificial sequence
  SiRNA target sequence
tatatgctagtatagtctcat

SEQ ID NO: 38933 - DNA, 21 bp, Artificial sequence
  SiRNA target sequence
atatgctagtatagtctcatg

SEQ ID NO: 38934 - DNA, 21 bp, Artificial sequence
  SiRNA target sequence
tatgctagtatagtctcatga

SEQ ID NO: 38935 - DNA, 21 bp, Artificial sequence
  SiRNA target sequence
atgctagtatagtctcatgat

SEQ ID NO: 38936 - DNA, 21 bp, Artificial sequence
  SiRNA target sequence
tgctagtatagtctcatgatt

SEQ ID NO: 38937 - DNA, 21 bp, Artificial sequence
  SiRNA target sequence
gctagtatagtctcatgatta

SEQ ID NO: 38938 - DNA, 21 bp, Artificial sequence
  SiRNA target sequence
ctagtatagtctcatgattaa

SEQ ID NO: 38939 - DNA, 21 bp, Artificial sequence
  SiRNA target sequence
tagtatagtctcatgattaat

SEQ ID NO: 38940 - DNA, 21 bp, Artificial sequence
  SiRNA target sequence
agtatagtctcatgattaatt

SEQ ID NO: 38941 - DNA, 21 bp, Artificial sequence
  SiRNA target sequence
gtatagtctcatgattaatta

SEQ ID NO: 38942 - DNA, 21 bp, Artificial sequence
  SiRNA target sequence
tatagtctcatgattaattaa

SEQ ID NO: 38943 - DNA, 21 bp, Artificial sequence
  SiRNA target sequence
atagtctcatgattaattaaa

SEQ ID NO: 38944 - DNA, 21 bp, Artificial sequence
  SiRNA target sequence
tagtctcatgattaattaaag

SEQ ID NO: 38945 - DNA, 21 bp, Artificial sequence
  SiRNA target sequence
agtctcatgattaattaaaga

SEQ ID NO: 38946 - DNA, 21 bp, Artificial sequence
  SiRNA target sequence
gtctcatgattaattaaagaa

SEQ ID NO: 38947 - DNA, 21 bp, Artificial sequence
  SiRNA target sequence
tctcatgattaattaaagaat

SEQ ID NO: 38948 - DNA, 21 bp, Artificial sequence
  SiRNA target sequence
ctcatgattaattaaagaatc

SEQ ID NO: 38949 - DNA, 21 bp, Artificial sequence
  SiRNA target sequence
tcatgattaattaaagaatca

SEQ ID NO: 38950 - DNA, 21 bp, Artificial sequence
  SiRNA target sequence
catgattaattaaagaatcat

SEQ ID NO: 38951 - DNA, 21 bp, Artificial sequence
  SiRNA target sequence
atgattaattaaagaatcatg

SEQ ID NO: 38952 - DNA, 21 bp, Artificial sequence
  SiRNA target sequence
tgattaattaaagaatcatgt

SEQ ID NO: 38953 - DNA, 21 bp, Artificial sequence
  SiRNA target sequence
gattaattaaagaatcatgta

SEQ ID NO: 38954 - DNA, 21 bp, Artificial sequence
  SiRNA target sequence
attaattaaagaatcatgtaa

SEQ ID NO: 38955 - DNA, 21 bp, Artificial sequence
  SiRNA target sequence
ttaattaaagaatcatgtaag

SEQ ID NO: 38956 - DNA, 21 bp, Artificial sequence
  SiRNA target sequence
taattaaagaatcatgtaagt

SEQ ID NO: 38957 - DNA, 21 bp, Artificial sequence
  SiRNA target sequence
aattaaagaatcatgtaagtg

SEQ ID NO: 38958 - DNA, 21 bp, Artificial sequence
  SiRNA target sequence
attaaagaatcatgtaagtga

SEQ ID NO: 38959 - DNA, 21 bp, Artificial sequence
  SiRNA target sequence
ttaaagaatcatgtaagtgat

SEQ ID NO: 38960 - DNA, 21 bp, Artificial sequence
  SiRNA target sequence
taaagaatcatgtaagtgatt

SEQ ID NO: 38961 - DNA, 21 bp, Artificial sequence
  SiRNA target sequence
aaagaatcatgtaagtgattt

SEQ ID NO: 38962 - DNA, 21 bp, Artificial sequence
  SiRNA target sequence
aagaatcatgtaagtgatttg

SEQ ID NO: 38963 - DNA, 21 bp, Artificial sequence
  SiRNA target sequence
agaatcatgtaagtgatttga

SEQ ID NO: 38964 - DNA, 21 bp, Artificial sequence
  SiRNA target sequence
gaatcatgtaagtgatttgag

SEQ ID NO: 38965 - DNA, 21 bp, Artificial sequence
  SiRNA target sequence
aatcatgtaagtgatttgagc

SEQ ID NO: 38966 - DNA, 21 bp, Artificial sequence
  SiRNA target sequence
atcatgtaagtgatttgagca

SEQ ID NO: 38967 - DNA, 21 bp, Artificial sequence
  SiRNA target sequence
tcatgtaagtgatttgagcat

SEQ ID NO: 38968 - DNA, 21 bp, Artificial sequence
  SiRNA target sequence
catgtaagtgatttgagcatc

SEQ ID NO: 38969 - DNA, 21 bp, Artificial sequence
  SiRNA target sequence
atgtaagtgatttgagcatct

SEQ ID NO: 38970 - DNA, 21 bp, Artificial sequence
  SiRNA target sequence
tgtaagtgatttgagcatctt

SEQ ID NO: 38971 - DNA, 21 bp, Artificial sequence
  SiRNA target sequence
gtaagtgatttgagcatcttt

SEQ ID NO: 38972 - DNA, 21 bp, Artificial sequence
  SiRNA target sequence
taagtgatttgagcatctttg

SEQ ID NO: 38973 - DNA, 21 bp, Artificial sequence
  SiRNA target sequence
aagtgatttgagcatctttgt

SEQ ID NO: 38974 - DNA, 21 bp, Artificial sequence
  SiRNA target sequence
agtgatttgagcatctttgtt

SEQ ID NO: 38975 - DNA, 21 bp, Artificial sequence
  SiRNA target sequence
gtgatttgagcatctttgttg

SEQ ID NO: 38976 - DNA, 21 bp, Artificial sequence
  SiRNA target sequence
tgatttgagcatctttgttgt

SEQ ID NO: 38977 - DNA, 21 bp, Artificial sequence
  SiRNA target sequence
gatttgagcatctttgttgtg

SEQ ID NO: 38978 - DNA, 21 bp, Artificial sequence
  SiRNA target sequence
atttgagcatctttgttgtgc

SEQ ID NO: 38979 - DNA, 21 bp, Artificial sequence
  SiRNA target sequence
tttgagcatctttgttgtgcg

SEQ ID NO: 38980 - DNA, 21 bp, Artificial sequence
  SiRNA target sequence
ttgagcatctttgttgtgcgc

SEQ ID NO: 38981 - DNA, 21 bp, Artificial sequence
  SiRNA target sequence
tgagcatctttgttgtgcgca

SEQ ID NO: 38982 - DNA, 21 bp, Artificial sequence
  SiRNA target sequence
gagcatctttgttgtgcgcaa

SEQ ID NO: 38983 - DNA, 21 bp, Artificial sequence
  SiRNA target sequence
agcatctttgttgtgcgcaat

SEQ ID NO: 38984 - DNA, 21 bp, Artificial sequence
  SiRNA target sequence
gcatctttgttgtgcgcaatt

SEQ ID NO: 38985 - DNA, 21 bp, Artificial sequence
  SiRNA target sequence
catctttgttgtgcgcaatta

SEQ ID NO: 38986 - DNA, 21 bp, Artificial sequence
  SiRNA target sequence
atctttgttgtgcgcaattat

SEQ ID NO: 38987 - DNA, 21 bp, Artificial sequence
  SiRNA target sequence
tctttgttgtgcgcaattata

SEQ ID NO: 38988 - DNA, 21 bp, Artificial sequence
  SiRNA target sequence
ctttgttgtgcgcaattatat

SEQ ID NO: 38989 - DNA, 21 bp, Artificial sequence
  SiRNA target sequence
tttgttgtgcgcaattatatt

SEQ ID NO: 38990 - DNA, 21 bp, Artificial sequence
  SiRNA target sequence
ttgttgtgcgcaattatattc

SEQ ID NO: 38991 - DNA, 21 bp, Artificial sequence
  SiRNA target sequence
tgttgtgcgcaattatattct

SEQ ID NO: 38992 - DNA, 21 bp, Artificial sequence
  SiRNA target sequence
gttgtgcgcaattatattctt

SEQ ID NO: 38993 - DNA, 21 bp, Artificial sequence
  SiRNA target sequence
ttgtgcgcaattatattcttt

SEQ ID NO: 38994 - DNA, 21 bp, Artificial sequence
  SiRNA target sequence
tgtgcgcaattatattctttt

SEQ ID NO: 38995 - DNA, 21 bp, Artificial sequence
  SiRNA target sequence
gtgcgcaattatattcttttc

SEQ ID NO: 38996 - DNA, 21 bp, Artificial sequence
  SiRNA target sequence
tgcgcaattatattcttttct

SEQ ID NO: 38997 - DNA, 21 bp, Artificial sequence
  SiRNA target sequence
gcgcaattatattcttttctt

SEQ ID NO: 38998 - DNA, 21 bp, Artificial sequence
  SiRNA target sequence
cgcaattatattcttttctta

SEQ ID NO: 38999 - DNA, 21 bp, Artificial sequence
  SiRNA target sequence
gcaattatattcttttcttat

SEQ ID NO: 39000 - DNA, 21 bp, Artificial sequence
  SiRNA target sequence
caattatattcttttcttatt

SEQ ID NO: 39001 - DNA, 21 bp, Artificial sequence
  SiRNA target sequence
aattatattcttttcttattc

SEQ ID NO: 39002 - DNA, 21 bp, Artificial sequence
  SiRNA target sequence
attatattcttttcttattcc

SEQ ID NO: 39003 - DNA, 21 bp, Artificial sequence
  SiRNA target sequence
ttatattcttttcttattcct

SEQ ID NO: 39004 - DNA, 21 bp, Artificial sequence
  SiRNA target sequence
tatattcttttcttattcctg

SEQ ID NO: 39005 - DNA, 21 bp, Artificial sequence
  SiRNA target sequence
atattcttttcttattcctgt

SEQ ID NO: 39006 - DNA, 21 bp, Artificial sequence
  SiRNA target sequence
tattcttttcttattcctgta

SEQ ID NO: 39007 - DNA, 21 bp, Artificial sequence
  SiRNA target sequence
attcttttcttattcctgtac

SEQ ID NO: 39008 - DNA, 21 bp, Artificial sequence
  SiRNA target sequence
ttcttttcttattcctgtacg

SEQ ID NO: 39009 - DNA, 21 bp, Artificial sequence
  SiRNA target sequence
tcttttcttattcctgtacgc

SEQ ID NO: 39010 - DNA, 21 bp, Artificial sequence
  SiRNA target sequence
cttttcttattcctgtacgcc

SEQ ID NO: 39011 - DNA, 21 bp, Artificial sequence
  SiRNA target sequence
ttttcttattcctgtacgcca

SEQ ID NO: 39012 - DNA, 21 bp, Artificial sequence
  SiRNA target sequence
tttcttattcctgtacgccaa

SEQ ID NO: 39013 - DNA, 21 bp, Artificial sequence
  SiRNA target sequence
ttcttattcctgtacgccaat

SEQ ID NO: 39014 - DNA, 21 bp, Artificial sequence
  SiRNA target sequence
tcttattcctgtacgccaatg

SEQ ID NO: 39015 - DNA, 21 bp, Artificial sequence
  SiRNA target sequence
cttattcctgtacgccaatga

SEQ ID NO: 39016 - DNA, 21 bp, Artificial sequence
  SiRNA target sequence
ttattcctgtacgccaatgaa

SEQ ID NO: 39017 - DNA, 21 bp, Artificial sequence
  SiRNA target sequence
tattcctgtacgccaatgaac

SEQ ID NO: 39018 - DNA, 21 bp, Artificial sequence
  SiRNA target sequence
attcctgtacgccaatgaact

SEQ ID NO: 39019 - DNA, 21 bp, Artificial sequence
  SiRNA target sequence
ttcctgtacgccaatgaacta

SEQ ID NO: 39020 - DNA, 21 bp, Artificial sequence
  SiRNA target sequence
tcctgtacgccaatgaactat

SEQ ID NO: 39021 - DNA, 21 bp, Artificial sequence
  SiRNA target sequence
cctgtacgccaatgaactatt

SEQ ID NO: 39022 - DNA, 21 bp, Artificial sequence
  SiRNA target sequence
ctgtacgccaatgaactattt

SEQ ID NO: 39023 - DNA, 21 bp, Artificial sequence
  SiRNA target sequence
tgtacgccaatgaactatttt

SEQ ID NO: 39024 - DNA, 21 bp, Artificial sequence
  SiRNA target sequence
gtacgccaatgaactattttc

SEQ ID NO: 39025 - DNA, 21 bp, Artificial sequence
  SiRNA target sequence
tacgccaatgaactattttcg

SEQ ID NO: 39026 - DNA, 21 bp, Artificial sequence
  SiRNA target sequence
acgccaatgaactattttcgc

SEQ ID NO: 39027 - DNA, 21 bp, Artificial sequence
  SiRNA target sequence
cgccaatgaactattttcgca

SEQ ID NO: 39028 - DNA, 21 bp, Artificial sequence
  SiRNA target sequence
gccaatgaactattttcgcag

SEQ ID NO: 39029 - DNA, 21 bp, Artificial sequence
  SiRNA target sequence
ccaatgaactattttcgcagt

SEQ ID NO: 39030 - DNA, 21 bp, Artificial sequence
  SiRNA target sequence
caatgaactattttcgcagtt

SEQ ID NO: 39031 - DNA, 21 bp, Artificial sequence
  SiRNA target sequence
aatgaactattttcgcagttg

SEQ ID NO: 39032 - DNA, 21 bp, Artificial sequence
  SiRNA target sequence
atgaactattttcgcagttgc

SEQ ID NO: 39033 - DNA, 21 bp, Artificial sequence
  SiRNA target sequence
tgaactattttcgcagttgca

SEQ ID NO: 39034 - DNA, 21 bp, Artificial sequence
  SiRNA target sequence
gaactattttcgcagttgcaa

SEQ ID NO: 39035 - DNA, 21 bp, Artificial sequence
  SiRNA target sequence
aactattttcgcagttgcaag

SEQ ID NO: 39036 - DNA, 21 bp, Artificial sequence
  SiRNA target sequence
actattttcgcagttgcaagg

SEQ ID NO: 39037 - DNA, 21 bp, Artificial sequence
  SiRNA target sequence
ctattttcgcagttgcaagga

SEQ ID NO: 39038 - DNA, 21 bp, Artificial sequence
  SiRNA target sequence
tattttcgcagttgcaaggat

SEQ ID NO: 39039 - DNA, 21 bp, Artificial sequence
  SiRNA target sequence
attttcgcagttgcaaggatg

SEQ ID NO: 39040 - DNA, 21 bp, Artificial sequence
  SiRNA target sequence
ttttcgcagttgcaaggatgt

SEQ ID NO: 39041 - DNA, 21 bp, Artificial sequence
  SiRNA target sequence
tttcgcagttgcaaggatgta

SEQ ID NO: 39042 - DNA, 21 bp, Artificial sequence
  SiRNA target sequence
ttcgcagttgcaaggatgtaa

SEQ ID NO: 39043 - DNA, 21 bp, Artificial sequence
  SiRNA target sequence
tcgcagttgcaaggatgtaaa

SEQ ID NO: 39044 - DNA, 21 bp, Artificial sequence
  SiRNA target sequence
cgcagttgcaaggatgtaaac

SEQ ID NO: 39045 - DNA, 21 bp, Artificial sequence
  SiRNA target sequence
gcagttgcaaggatgtaaact

SEQ ID NO: 39046 - DNA, 21 bp, Artificial sequence
  SiRNA target sequence
cagttgcaaggatgtaaacta

SEQ ID NO: 39047 - DNA, 21 bp, Artificial sequence
  SiRNA target sequence
agttgcaaggatgtaaactaa

SEQ ID NO: 39048 - DNA, 21 bp, Artificial sequence
  SiRNA target sequence
gttgcaaggatgtaaactaat

SEQ ID NO: 39049 - DNA, 21 bp, Artificial sequence
  SiRNA target sequence
ttgcaaggatgtaaactaata

SEQ ID NO: 39050 - DNA, 21 bp, Artificial sequence
  SiRNA target sequence
tgcaaggatgtaaactaataa

SEQ ID NO: 39051 - DNA, 21 bp, Artificial sequence
  SiRNA target sequence
gcaaggatgtaaactaataat

SEQ ID NO: 39052 - DNA, 21 bp, Artificial sequence
  SiRNA target sequence
caaggatgtaaactaataatg

SEQ ID NO: 39053 - DNA, 21 bp, Artificial sequence
  SiRNA target sequence
aaggatgtaaactaataatgt

SEQ ID NO: 39054 - DNA, 21 bp, Artificial sequence
  SiRNA target sequence
aggatgtaaactaataatgtg

SEQ ID NO: 39055 - DNA, 21 bp, Artificial sequence
  SiRNA target sequence
ggatgtaaactaataatgtga

SEQ ID NO: 39056 - DNA, 21 bp, Artificial sequence
  SiRNA target sequence
gatgtaaactaataatgtgat

SEQ ID NO: 39057 - DNA, 21 bp, Artificial sequence
  SiRNA target sequence
atgtaaactaataatgtgatt

SEQ ID NO: 39058 - DNA, 21 bp, Artificial sequence
  SiRNA target sequence
tgtaaactaataatgtgatta

SEQ ID NO: 39059 - DNA, 21 bp, Artificial sequence
  SiRNA target sequence
gtaaactaataatgtgattaa

SEQ ID NO: 39060 - DNA, 21 bp, Artificial sequence
  SiRNA target sequence
taaactaataatgtgattaaa

SEQ ID NO: 39061 - DNA, 21 bp, Artificial sequence
  SiRNA target sequence
aaactaataatgtgattaaaa

SEQ ID NO: 39062 - DNA, 21 bp, Artificial sequence
  SiRNA target sequence
aactaataatgtgattaaaat

SEQ ID NO: 39063 - DNA, 21 bp, Artificial sequence
  SiRNA target sequence
actaataatgtgattaaaata

SEQ ID NO: 39064 - DNA, 21 bp, Artificial sequence
  SiRNA target sequence
ctaataatgtgattaaaataa

SEQ ID NO: 39065 - DNA, 21 bp, Artificial sequence
  SiRNA target sequence
taataatgtgattaaaataat

SEQ ID NO: 39066 - DNA, 21 bp, Artificial sequence
  SiRNA target sequence
aataatgtgattaaaataata

SEQ ID NO: 39067 - DNA, 21 bp, Artificial sequence
  SiRNA target sequence
ataatgtgattaaaataataa

SEQ ID NO: 39068 - DNA, 21 bp, Artificial sequence
  SiRNA target sequence
taatgtgattaaaataataaa

SEQ ID NO: 39069 - DNA, 21 bp, Artificial sequence
  SiRNA target sequence
aatgtgattaaaataataaac

SEQ ID NO: 39070 - DNA, 21 bp, Artificial sequence
  SiRNA target sequence
atgtgattaaaataataaaca

SEQ ID NO: 39071 - DNA, 21 bp, Artificial sequence
  SiRNA target sequence
tgtgattaaaataataaacat

SEQ ID NO: 39072 - DNA, 21 bp, Artificial sequence
  SiRNA target sequence
gtgattaaaataataaacata

SEQ ID NO: 39073 - DNA, 21 bp, Artificial sequence
  SiRNA target sequence
tgattaaaataataaacatat

SEQ ID NO: 39074 - DNA, 21 bp, Artificial sequence
  SiRNA target sequence
gattaaaataataaacatatt

SEQ ID NO: 39075 - DNA, 21 bp, Artificial sequence
  SiRNA target sequence
attaaaataataaacatattt

SEQ ID NO: 39076 - DNA, 21 bp, Artificial sequence
  SiRNA target sequence
ttaaaataataaacatatttg

SEQ ID NO: 39077 - DNA, 21 bp, Artificial sequence
  SiRNA target sequence
taaaataataaacatatttgt

SEQ ID NO: 39078 - DNA, 21 bp, Artificial sequence
  SiRNA target sequence
aaaataataaacatatttgtc

SEQ ID NO: 39079 - DNA, 21 bp, Artificial sequence
  SiRNA target sequence
aaataataaacatatttgtca

SEQ ID NO: 39080 - DNA, 21 bp, Artificial sequence
  SiRNA target sequence
aataataaacatatttgtcaa

SEQ ID NO: 39081 - DNA, 21 bp, Artificial sequence
  SiRNA target sequence
ataataaacatatttgtcaac

SEQ ID NO: 39082 - DNA, 21 bp, Artificial sequence
  SiRNA target sequence
taataaacatatttgtcaacc

SEQ ID NO: 39083 - DNA, 21 bp, Artificial sequence
  SiRNA target sequence
aataaacatatttgtcaaccc

SEQ ID NO: 39084 - DNA, 21 bp, Artificial sequence
  SiRNA target sequence
ataaacatatttgtcaaccct

SEQ ID NO: 39085 - DNA, 21 bp, Artificial sequence
  SiRNA target sequence
taaacatatttgtcaacccta

SEQ ID NO: 39086 - DNA, 21 bp, Artificial sequence
  SiRNA target sequence
aaacatatttgtcaaccctaa

SEQ ID NO: 39087 - DNA, 21 bp, Artificial sequence
  SiRNA target sequence
aacatatttgtcaaccctaaa

SEQ ID NO: 39088 - DNA, 21 bp, Artificial sequence
  SiRNA target sequence
acatatttgtcaaccctaaat

SEQ ID NO: 39089 - DNA, 21 bp, Artificial sequence
  SiRNA target sequence
catatttgtcaaccctaaatt

SEQ ID NO: 39090 - DNA, 21 bp, Artificial sequence
  SiRNA target sequence
atatttgtcaaccctaaattt

SEQ ID NO: 39091 - DNA, 21 bp, Artificial sequence
  SiRNA target sequence
tatttgtcaaccctaaatttg

SEQ ID NO: 39092 - DNA, 21 bp, Artificial sequence
  SiRNA target sequence
atttgtcaaccctaaatttgt

SEQ ID NO: 39093 - DNA, 21 bp, Artificial sequence
  SiRNA target sequence
tttgtcaaccctaaatttgta

SEQ ID NO: 39094 - DNA, 21 bp, Artificial sequence
  SiRNA target sequence
ttgtcaaccctaaatttgtat

SEQ ID NO: 39095 - DNA, 21 bp, Artificial sequence
  SiRNA target sequence
tgtcaaccctaaatttgtata

SEQ ID NO: 39096 - DNA, 21 bp, Artificial sequence
  SiRNA target sequence
gtcaaccctaaatttgtataa

SEQ ID NO: 39097 - DNA, 21 bp, Artificial sequence
  SiRNA target sequence
tcaaccctaaatttgtataaa

SEQ ID NO: 39098 - DNA, 21 bp, Artificial sequence
  SiRNA target sequence
caaccctaaatttgtataaat

SEQ ID NO: 39099 - DNA, 21 bp, Artificial sequence
  SiRNA target sequence
aaccctaaatttgtataaatt

SEQ ID NO: 39100 - DNA, 21 bp, Artificial sequence
  SiRNA target sequence
accctaaatttgtataaattg

SEQ ID NO: 39101 - DNA, 21 bp, Artificial sequence
  SiRNA target sequence
ccctaaatttgtataaattga

SEQ ID NO: 39102 - DNA, 21 bp, Artificial sequence
  SiRNA target sequence
cctaaatttgtataaattgac

SEQ ID NO: 39103 - DNA, 21 bp, Artificial sequence
  SiRNA target sequence
ctaaatttgtataaattgacg

SEQ ID NO: 39104 - DNA, 21 bp, Artificial sequence
  SiRNA target sequence
taaatttgtataaattgacga

SEQ ID NO: 39105 - DNA, 21 bp, Artificial sequence
  SiRNA target sequence
aaatttgtataaattgacgaa

SEQ ID NO: 39106 - DNA, 21 bp, Artificial sequence
  SiRNA target sequence
aatttgtataaattgacgaac

SEQ ID NO: 39107 - DNA, 21 bp, Artificial sequence
  SiRNA target sequence
atttgtataaattgacgaaca

SEQ ID NO: 39108 - DNA, 21 bp, Artificial sequence
  SiRNA target sequence
tttgtataaattgacgaacac

SEQ ID NO: 39109 - DNA, 21 bp, Artificial sequence
  SiRNA target sequence
ttgtataaattgacgaacacg

SEQ ID NO: 39110 - DNA, 21 bp, Artificial sequence
  SiRNA target sequence
tgtataaattgacgaacacgc

SEQ ID NO: 39111 - DNA, 21 bp, Artificial sequence
  SiRNA target sequence
gtataaattgacgaacacgcc

SEQ ID NO: 39112 - DNA, 21 bp, Artificial sequence
  SiRNA target sequence
tataaattgacgaacacgcca

SEQ ID NO: 39113 - DNA, 21 bp, Artificial sequence
  SiRNA target sequence
ataaattgacgaacacgccaa

SEQ ID NO: 39114 - DNA, 21 bp, Artificial sequence
  SiRNA target sequence
taaattgacgaacacgccaat

SEQ ID NO: 39115 - DNA, 21 bp, Artificial sequence
  SiRNA target sequence
aaattgacgaacacgccaata

SEQ ID NO: 39116 - DNA, 21 bp, Artificial sequence
  SiRNA target sequence
aattgacgaacacgccaatat

SEQ ID NO: 39117 - DNA, 21 bp, Artificial sequence
  SiRNA target sequence
attgacgaacacgccaatata

SEQ ID NO: 39118 - DNA, 21 bp, Artificial sequence
  SiRNA target sequence
ttgacgaacacgccaatataa

SEQ ID NO: 39119 - DNA, 21 bp, Artificial sequence
  SiRNA target sequence
tgacgaacacgccaatataac

SEQ ID NO: 39120 - DNA, 21 bp, Artificial sequence
  SiRNA target sequence
gacgaacacgccaatataact

SEQ ID NO: 39121 - DNA, 21 bp, Artificial sequence
  SiRNA target sequence
acgaacacgccaatataactg

SEQ ID NO: 39122 - DNA, 21 bp, Artificial sequence
  SiRNA target sequence
cgaacacgccaatataactgt

SEQ ID NO: 39123 - DNA, 21 bp, Artificial sequence
  SiRNA target sequence
gaacacgccaatataactgta

SEQ ID NO: 39124 - DNA, 21 bp, Artificial sequence
  SiRNA target sequence
aacacgccaatataactgtaa

SEQ ID NO: 39125 - DNA, 21 bp, Artificial sequence
  SiRNA target sequence
acacgccaatataactgtaaa

SEQ ID NO: 39126 - DNA, 21 bp, Artificial sequence
  SiRNA target sequence
cacgccaatataactgtaaaa

SEQ ID NO: 39127 - DNA, 21 bp, Artificial sequence
  SiRNA target sequence
acgccaatataactgtaaaaa

SEQ ID NO: 39128 - DNA, 21 bp, Artificial sequence
  SiRNA target sequence
cgccaatataactgtaaaaaa

SEQ ID NO: 39129 - DNA, 21 bp, Artificial sequence
  SiRNA target sequence
gccaatataactgtaaaaaaa

SEQ ID NO: 39130 - DNA, 21 bp, Artificial sequence
  SiRNA target sequence
ccaatataactgtaaaaaaaa

SEQ ID NO: 39131 - DNA, 21 bp, Artificial sequence
  SiRNA target sequence
caatataactgtaaaaaaaat

SEQ ID NO: 39132 - DNA, 21 bp, Artificial sequence
  SiRNA target sequence
aatataactgtaaaaaaaata

SEQ ID NO: 39133 - DNA, 21 bp, Artificial sequence
  SiRNA target sequence
atataactgtaaaaaaaatat

SEQ ID NO: 39134 - DNA, 21 bp, Artificial sequence
  SiRNA target sequence
tataactgtaaaaaaaatatt

SEQ ID NO: 39135 - DNA, 21 bp, Artificial sequence
  SiRNA target sequence
ataactgtaaaaaaaatattt

SEQ ID NO: 39136 - DNA, 21 bp, Artificial sequence
  SiRNA target sequence
taactgtaaaaaaaatattta

SEQ ID NO: 39137 - DNA, 21 bp, Artificial sequence
  SiRNA target sequence
aactgtaaaaaaaatatttat

SEQ ID NO: 39138 - DNA, 21 bp, Artificial sequence
  SiRNA target sequence
actgtaaaaaaaatatttatg

SEQ ID NO: 39139 - DNA, 21 bp, Artificial sequence
  SiRNA target sequence
ctgtaaaaaaaatatttatga

SEQ ID NO: 39140 - DNA, 21 bp, Artificial sequence
  SiRNA target sequence
tgtaaaaaaaatatttatgat

SEQ ID NO: 39141 - DNA, 21 bp, Artificial sequence
  SiRNA target sequence
gtaaaaaaaatatttatgata

SEQ ID NO: 39142 - DNA, 21 bp, Artificial sequence
  SiRNA target sequence
taaaaaaaatatttatgatat

SEQ ID NO: 39143 - DNA, 21 bp, Artificial sequence
  SiRNA target sequence
aaaaaaaatatttatgatatt

SEQ ID NO: 39144 - DNA, 21 bp, Artificial sequence
  SiRNA target sequence
aaaaaaatatttatgatatta

SEQ ID NO: 39145 - DNA, 21 bp, Artificial sequence
  SiRNA target sequence
aaaaaatatttatgatattaa

SEQ ID NO: 39146 - DNA, 21 bp, Artificial sequence
  SiRNA target sequence
aaaaatatttatgatattaac

SEQ ID NO: 39147 - DNA, 21 bp, Artificial sequence
  SiRNA target sequence
aaaatatttatgatattaaca

SEQ ID NO: 39148 - DNA, 21 bp, Artificial sequence
  SiRNA target sequence
aaatatttatgatattaacaa

SEQ ID NO: 39149 - DNA, 21 bp, Artificial sequence
  SiRNA target sequence
aatatttatgatattaacaaa

SEQ ID NO: 39150 - DNA, 21 bp, Artificial sequence
  SiRNA target sequence
atatttatgatattaacaaat

SEQ ID NO: 39151 - DNA, 21 bp, Artificial sequence
  SiRNA target sequence
tatttatgatattaacaaata

SEQ ID NO: 39152 - DNA, 21 bp, Artificial sequence
  SiRNA target sequence
atttatgatattaacaaataa

SEQ ID NO: 39153 - DNA, 21 bp, Artificial sequence
  SiRNA target sequence
tttatgatattaacaaataaa

SEQ ID NO: 39154 - DNA, 21 bp, Artificial sequence
  SiRNA target sequence
ttatgatattaacaaataaaa

SEQ ID NO: 39155 - DNA, 21 bp, Artificial sequence
  SiRNA target sequence
tatgatattaacaaataaaac

SEQ ID NO: 39156 - DNA, 21 bp, Artificial sequence
  SiRNA target sequence
atgatattaacaaataaaact

SEQ ID NO: 39157 - DNA, 21 bp, Artificial sequence
  SiRNA target sequence
tgatattaacaaataaaactt

SEQ ID NO: 39158 - DNA, 21 bp, Artificial sequence
  SiRNA target sequence
gatattaacaaataaaacttc

SEQ ID NO: 39159 - DNA, 21 bp, Artificial sequence
  SiRNA target sequence
atattaacaaataaaacttcg

SEQ ID NO: 39160 - DNA, 21 bp, Artificial sequence
  SiRNA target sequence
tattaacaaataaaacttcga

SEQ ID NO: 39161 - DNA, 21 bp, Artificial sequence
  SiRNA target sequence
attaacaaataaaacttcgat

SEQ ID NO: 39162 - DNA, 21 bp, Artificial sequence
  SiRNA target sequence
ttaacaaataaaacttcgatc

SEQ ID NO: 39163 - DNA, 21 bp, Artificial sequence
  SiRNA target sequence
taacaaataaaacttcgatca

SEQ ID NO: 39164 - DNA, 21 bp, Artificial sequence
  SiRNA target sequence
aacaaataaaacttcgatcaa

SEQ ID NO: 39165 - DNA, 21 bp, Artificial sequence
  SiRNA target sequence
acaaataaaacttcgatcaat

SEQ ID NO: 39166 - DNA, 21 bp, Artificial sequence
  SiRNA target sequence
caaataaaacttcgatcaatt

SEQ ID NO: 39167 - DNA, 21 bp, Artificial sequence
  SiRNA target sequence
aaataaaacttcgatcaattc

SEQ ID NO: 39168 - DNA, 21 bp, Artificial sequence
  SiRNA target sequence
aataaaacttcgatcaattca

SEQ ID NO: 39169 - DNA, 21 bp, Artificial sequence
  SiRNA target sequence
ataaaacttcgatcaattcac

SEQ ID NO: 39170 - DNA, 21 bp, Artificial sequence
  SiRNA target sequence
taaaacttcgatcaattcact

SEQ ID NO: 39171 - DNA, 21 bp, Artificial sequence
  SiRNA target sequence
aaaacttcgatcaattcactt

SEQ ID NO: 39172 - DNA, 21 bp, Artificial sequence
  SiRNA target sequence
aaacttcgatcaattcactta

SEQ ID NO: 39173 - DNA, 21 bp, Artificial sequence
  SiRNA target sequence
aacttcgatcaattcacttat

SEQ ID NO: 39174 - DNA, 21 bp, Artificial sequence
  SiRNA target sequence
acttcgatcaattcacttatt

SEQ ID NO: 39175 - DNA, 21 bp, Artificial sequence
  SiRNA target sequence
cttcgatcaattcacttattg

SEQ ID NO: 39176 - DNA, 21 bp, Artificial sequence
  SiRNA target sequence
ttcgatcaattcacttattgc

SEQ ID NO: 39177 - DNA, 21 bp, Artificial sequence
  SiRNA target sequence
tcgatcaattcacttattgct

SEQ ID NO: 39178 - DNA, 21 bp, Artificial sequence
  SiRNA target sequence
cgatcaattcacttattgctt

SEQ ID NO: 39179 - DNA, 21 bp, Artificial sequence
  SiRNA target sequence
gatcaattcacttattgcttt

SEQ ID NO: 39180 - DNA, 21 bp, Artificial sequence
  SiRNA target sequence
atcaattcacttattgcttta

SEQ ID NO: 39181 - DNA, 21 bp, Artificial sequence
  SiRNA target sequence
tcaattcacttattgctttac

SEQ ID NO: 39182 - DNA, 21 bp, Artificial sequence
  SiRNA target sequence
caattcacttattgctttact

SEQ ID NO: 39183 - DNA, 21 bp, Artificial sequence
  SiRNA target sequence
aattcacttattgctttactt

SEQ ID NO: 39184 - DNA, 21 bp, Artificial sequence
  SiRNA target sequence
attcacttattgctttacttt

SEQ ID NO: 39185 - DNA, 21 bp, Artificial sequence
  SiRNA target sequence
ttcacttattgctttactttc

SEQ ID NO: 39186 - DNA, 21 bp, Artificial sequence
  SiRNA target sequence
tcacttattgctttactttct

SEQ ID NO: 39187 - DNA, 21 bp, Artificial sequence
  SiRNA target sequence
cacttattgctttactttctc

SEQ ID NO: 39188 - DNA, 21 bp, Artificial sequence
  SiRNA target sequence
acttattgctttactttctcg

SEQ ID NO: 39189 - DNA, 21 bp, Artificial sequence
  SiRNA target sequence
cttattgctttactttctcgg

SEQ ID NO: 39190 - DNA, 21 bp, Artificial sequence
  SiRNA target sequence
ttattgctttactttctcggt

SEQ ID NO: 39191 - DNA, 21 bp, Artificial sequence
  SiRNA target sequence
tattgctttactttctcggtc

SEQ ID NO: 39192 - DNA, 21 bp, Artificial sequence
  SiRNA target sequence
attgctttactttctcggtct

SEQ ID NO: 39193 - DNA, 21 bp, Artificial sequence
  SiRNA target sequence
ttgctttactttctcggtcta

SEQ ID NO: 39194 - DNA, 21 bp, Artificial sequence
  SiRNA target sequence
tgctttactttctcggtctat

SEQ ID NO: 39195 - DNA, 21 bp, Artificial sequence
  SiRNA target sequence
gctttactttctcggtctatt

SEQ ID NO: 39196 - DNA, 21 bp, Artificial sequence
  SiRNA target sequence
ctttactttctcggtctatta

SEQ ID NO: 39197 - DNA, 21 bp, Artificial sequence
  SiRNA target sequence
tttactttctcggtctattat

SEQ ID NO: 39198 - DNA, 21 bp, Artificial sequence
  SiRNA target sequence
ttactttctcggtctattatt

SEQ ID NO: 39199 - DNA, 21 bp, Artificial sequence
  SiRNA target sequence
tactttctcggtctattattg

SEQ ID NO: 39200 - DNA, 21 bp, Artificial sequence
  SiRNA target sequence
actttctcggtctattattgt

SEQ ID NO: 39201 - DNA, 21 bp, Artificial sequence
  SiRNA target sequence
ctttctcggtctattattgtt

SEQ ID NO: 39202 - DNA, 21 bp, Artificial sequence
  SiRNA target sequence
tttctcggtctattattgttt

SEQ ID NO: 39203 - DNA, 21 bp, Artificial sequence
  SiRNA target sequence
ttctcggtctattattgtttg

SEQ ID NO: 39204 - DNA, 21 bp, Artificial sequence
  SiRNA target sequence
tctcggtctattattgtttgt

SEQ ID NO: 39205 - DNA, 21 bp, Artificial sequence
  SiRNA target sequence
ctcggtctattattgtttgta

SEQ ID NO: 39206 - DNA, 21 bp, Artificial sequence
  SiRNA target sequence
tcggtctattattgtttgtat

SEQ ID NO: 39207 - DNA, 21 bp, Artificial sequence
  SiRNA target sequence
cggtctattattgtttgtatt

SEQ ID NO: 39208 - DNA, 21 bp, Artificial sequence
  SiRNA target sequence
ggtctattattgtttgtattt

SEQ ID NO: 39209 - DNA, 21 bp, Artificial sequence
  SiRNA target sequence
gtctattattgtttgtatttc

SEQ ID NO: 39210 - DNA, 21 bp, Artificial sequence
  SiRNA target sequence
tctattattgtttgtatttca

SEQ ID NO: 39211 - DNA, 21 bp, Artificial sequence
  SiRNA target sequence
ctattattgtttgtatttcac

SEQ ID NO: 39212 - DNA, 21 bp, Artificial sequence
  SiRNA target sequence
tattattgtttgtatttcacc

SEQ ID NO: 39213 - DNA, 21 bp, Artificial sequence
  SiRNA target sequence
attattgtttgtatttcaccg

SEQ ID NO: 39214 - DNA, 21 bp, Artificial sequence
  SiRNA target sequence
ttattgtttgtatttcaccgc

SEQ ID NO: 39215 - DNA, 21 bp, Artificial sequence
  SiRNA target sequence
tattgtttgtatttcaccgca

SEQ ID NO: 39216 - DNA, 21 bp, Artificial sequence
  SiRNA target sequence
attgtttgtatttcaccgcat

SEQ ID NO: 39217 - DNA, 21 bp, Artificial sequence
  SiRNA target sequence
ttgtttgtatttcaccgcatc

SEQ ID NO: 39218 - DNA, 21 bp, Artificial sequence
  SiRNA target sequence
tgtttgtatttcaccgcatcc

SEQ ID NO: 39219 - DNA, 21 bp, Artificial sequence
  SiRNA target sequence
gtttgtatttcaccgcatcct

SEQ ID NO: 39220 - DNA, 21 bp, Artificial sequence
  SiRNA target sequence
tttgtatttcaccgcatccta

SEQ ID NO: 39221 - DNA, 21 bp, Artificial sequence
  SiRNA target sequence
ttgtatttcaccgcatcctat

SEQ ID NO: 39222 - DNA, 21 bp, Artificial sequence
  SiRNA target sequence
tgtatttcaccgcatcctatt

SEQ ID NO: 39223 - DNA, 21 bp, Artificial sequence
  SiRNA target sequence
gtatttcaccgcatcctattt

SEQ ID NO: 39224 - DNA, 21 bp, Artificial sequence
  SiRNA target sequence
tatttcaccgcatcctatttt

SEQ ID NO: 39225 - DNA, 21 bp, Artificial sequence
  SiRNA target sequence
atttcaccgcatcctatttta

SEQ ID NO: 39226 - DNA, 21 bp, Artificial sequence
  SiRNA target sequence
tttcaccgcatcctattttat

SEQ ID NO: 39227 - DNA, 21 bp, Artificial sequence
  SiRNA target sequence
ttcaccgcatcctattttatt

SEQ ID NO: 39228 - DNA, 21 bp, Artificial sequence
  SiRNA target sequence
tcaccgcatcctattttattg

SEQ ID NO: 39229 - DNA, 21 bp, Artificial sequence
  SiRNA target sequence
caccgcatcctattttattgt

SEQ ID NO: 39230 - DNA, 21 bp, Artificial sequence
  SiRNA target sequence
accgcatcctattttattgta

SEQ ID NO: 39231 - DNA, 21 bp, Artificial sequence
  SiRNA target sequence
ccgcatcctattttattgtat

SEQ ID NO: 39232 - DNA, 21 bp, Artificial sequence
  SiRNA target sequence
cgcatcctattttattgtatc

SEQ ID NO: 39233 - DNA, 21 bp, Artificial sequence
  SiRNA target sequence
gcatcctattttattgtatct

SEQ ID NO: 39234 - DNA, 21 bp, Artificial sequence
  SiRNA target sequence
catcctattttattgtatcta

SEQ ID NO: 39235 - DNA, 21 bp, Artificial sequence
  SiRNA target sequence
atcctattttattgtatctac

SEQ ID NO: 39236 - DNA, 21 bp, Artificial sequence
  SiRNA target sequence
tcctattttattgtatctact

SEQ ID NO: 39237 - DNA, 21 bp, Artificial sequence
  SiRNA target sequence
cctattttattgtatctacta

SEQ ID NO: 39238 - DNA, 21 bp, Artificial sequence
  SiRNA target sequence
ctattttattgtatctactaa

SEQ ID NO: 39239 - DNA, 21 bp, Artificial sequence
  SiRNA target sequence
tattttattgtatctactaag

SEQ ID NO: 39240 - DNA, 21 bp, Artificial sequence
  SiRNA target sequence
attttattgtatctactaagt

SEQ ID NO: 39241 - DNA, 21 bp, Artificial sequence
  SiRNA target sequence
ttttattgtatctactaagtt

SEQ ID NO: 39242 - DNA, 21 bp, Artificial sequence
  SiRNA target sequence
tttattgtatctactaagttc

SEQ ID NO: 39243 - DNA, 21 bp, Artificial sequence
  SiRNA target sequence
ttattgtatctactaagttcc

SEQ ID NO: 39244 - DNA, 21 bp, Artificial sequence
  SiRNA target sequence
tattgtatctactaagttcca

SEQ ID NO: 39245 - DNA, 21 bp, Artificial sequence
  SiRNA target sequence
attgtatctactaagttccat

SEQ ID NO: 39246 - DNA, 21 bp, Artificial sequence
  SiRNA target sequence
ttgtatctactaagttccata

SEQ ID NO: 39247 - DNA, 21 bp, Artificial sequence
  SiRNA target sequence
tgtatctactaagttccatat

SEQ ID NO: 39248 - DNA, 21 bp, Artificial sequence
  SiRNA target sequence
gtatctactaagttccatatt

SEQ ID NO: 39249 - DNA, 21 bp, Artificial sequence
  SiRNA target sequence
tatctactaagttccatattt

SEQ ID NO: 39250 - DNA, 21 bp, Artificial sequence
  SiRNA target sequence
atctactaagttccatattta

SEQ ID NO: 39251 - DNA, 21 bp, Artificial sequence
  SiRNA target sequence
tctactaagttccatatttat

SEQ ID NO: 39252 - DNA, 21 bp, Artificial sequence
  SiRNA target sequence
ctactaagttccatatttata

SEQ ID NO: 39253 - DNA, 21 bp, Artificial sequence
  SiRNA target sequence
tactaagttccatatttataa

SEQ ID NO: 39254 - DNA, 21 bp, Artificial sequence
  SiRNA target sequence
actaagttccatatttataaa

SEQ ID NO: 39255 - DNA, 21 bp, Artificial sequence
  SiRNA target sequence
ctaagttccatatttataaaa

SEQ ID NO: 39256 - DNA, 21 bp, Artificial sequence
  SiRNA target sequence
taagttccatatttataaaat

SEQ ID NO: 39257 - DNA, 21 bp, Artificial sequence
  SiRNA target sequence
aagttccatatttataaaatt

SEQ ID NO: 39258 - DNA, 21 bp, Artificial sequence
  SiRNA target sequence
agttccatatttataaaattt

SEQ ID NO: 39259 - DNA, 21 bp, Artificial sequence
  SiRNA target sequence
gttccatatttataaaatttt

SEQ ID NO: 39260 - DNA, 21 bp, Artificial sequence
  SiRNA target sequence
ttccatatttataaaattttt

SEQ ID NO: 39261 - DNA, 21 bp, Artificial sequence
  SiRNA target sequence
tccatatttataaaattttta

SEQ ID NO: 39262 - DNA, 21 bp, Artificial sequence
  SiRNA target sequence
ccatatttataaaatttttaa

SEQ ID NO: 39263 - DNA, 21 bp, Artificial sequence
  SiRNA target sequence
catatttataaaatttttaaa

SEQ ID NO: 39264 - DNA, 21 bp, Artificial sequence
  SiRNA target sequence
atatttataaaatttttaaat

SEQ ID NO: 39265 - DNA, 21 bp, Artificial sequence
  SiRNA target sequence
tatttataaaatttttaaatg

SEQ ID NO: 39266 - DNA, 21 bp, Artificial sequence
  SiRNA target sequence
atttataaaatttttaaatga

SEQ ID NO: 39267 - DNA, 21 bp, Artificial sequence
  SiRNA target sequence
tttataaaatttttaaatgaa

SEQ ID NO: 39268 - DNA, 21 bp, Artificial sequence
  SiRNA target sequence
ttataaaatttttaaatgaat

SEQ ID NO: 39269 - DNA, 21 bp, Artificial sequence
  SiRNA target sequence
tataaaatttttaaatgaatt

SEQ ID NO: 39270 - DNA, 21 bp, Artificial sequence
  SiRNA target sequence
ataaaatttttaaatgaattt

SEQ ID NO: 39271 - DNA, 21 bp, Artificial sequence
  SiRNA target sequence
taaaatttttaaatgaatttt

SEQ ID NO: 39272 - DNA, 21 bp, Artificial sequence
  SiRNA target sequence
aaaatttttaaatgaattttt

SEQ ID NO: 39273 - DNA, 21 bp, Artificial sequence
  SiRNA target sequence
aaatttttaaatgaatttttt

SEQ ID NO: 39274 - DNA, 21 bp, Artificial sequence
  SiRNA target sequence
aatttttaaatgaattttttc

SEQ ID NO: 39275 - DNA, 21 bp, Artificial sequence
  SiRNA target sequence
atttttaaatgaattttttcc

SEQ ID NO: 39276 - DNA, 21 bp, Artificial sequence
  SiRNA target sequence
tttttaaatgaattttttcct

SEQ ID NO: 39277 - DNA, 21 bp, Artificial sequence
  SiRNA target sequence
ttttaaatgaattttttcctg

SEQ ID NO: 39278 - DNA, 21 bp, Artificial sequence
  SiRNA target sequence
tttaaatgaattttttcctgt

SEQ ID NO: 39279 - DNA, 21 bp, Artificial sequence
  SiRNA target sequence
ttaaatgaattttttcctgtc

SEQ ID NO: 39280 - DNA, 21 bp, Artificial sequence
  SiRNA target sequence
taaatgaattttttcctgtca

SEQ ID NO: 39281 - DNA, 21 bp, Artificial sequence
  SiRNA target sequence
aaatgaattttttcctgtcag

SEQ ID NO: 39282 - DNA, 21 bp, Artificial sequence
  SiRNA target sequence
aatgaattttttcctgtcagt

SEQ ID NO: 39283 - DNA, 21 bp, Artificial sequence
  SiRNA target sequence
atgaattttttcctgtcagtc

SEQ ID NO: 39284 - DNA, 21 bp, Artificial sequence
  SiRNA target sequence
tgaattttttcctgtcagtct

SEQ ID NO: 39285 - DNA, 21 bp, Artificial sequence
  SiRNA target sequence
gaattttttcctgtcagtctg

SEQ ID NO: 39286 - DNA, 21 bp, Artificial sequence
  SiRNA target sequence
aattttttcctgtcagtctga

SEQ ID NO: 39287 - DNA, 21 bp, Artificial sequence
  SiRNA target sequence
attttttcctgtcagtctgaa

SEQ ID NO: 39288 - DNA, 21 bp, Artificial sequence
  SiRNA target sequence
ttttttcctgtcagtctgaat

SEQ ID NO: 39289 - DNA, 21 bp, Artificial sequence
  SiRNA target sequence
tttttcctgtcagtctgaata

SEQ ID NO: 39290 - DNA, 21 bp, Artificial sequence
  SiRNA target sequence
ttttcctgtcagtctgaatac

SEQ ID NO: 39291 - DNA, 21 bp, Artificial sequence
  SiRNA target sequence
tttcctgtcagtctgaataca

SEQ ID NO: 39292 - DNA, 21 bp, Artificial sequence
  SiRNA target sequence
ttcctgtcagtctgaatacat

SEQ ID NO: 39293 - DNA, 21 bp, Artificial sequence
  SiRNA target sequence
tcctgtcagtctgaatacatg

SEQ ID NO: 39294 - DNA, 21 bp, Artificial sequence
  SiRNA target sequence
cctgtcagtctgaatacatgt

SEQ ID NO: 39295 - DNA, 21 bp, Artificial sequence
  SiRNA target sequence
ctgtcagtctgaatacatgtt

SEQ ID NO: 39296 - DNA, 21 bp, Artificial sequence
  SiRNA target sequence
tgtcagtctgaatacatgttg

SEQ ID NO: 39297 - DNA, 21 bp, Artificial sequence
  SiRNA target sequence
gtcagtctgaatacatgttga

SEQ ID NO: 39298 - DNA, 21 bp, Artificial sequence
  SiRNA target sequence
tcagtctgaatacatgttgaa

SEQ ID NO: 39299 - DNA, 21 bp, Artificial sequence
  SiRNA target sequence
cagtctgaatacatgttgaac

SEQ ID NO: 39300 - DNA, 21 bp, Artificial sequence
  SiRNA target sequence
agtctgaatacatgttgaacg

SEQ ID NO: 39301 - DNA, 21 bp, Artificial sequence
  SiRNA target sequence
gtctgaatacatgttgaacgg

SEQ ID NO: 39302 - DNA, 21 bp, Artificial sequence
  SiRNA target sequence
tctgaatacatgttgaacggg

SEQ ID NO: 39303 - DNA, 21 bp, Artificial sequence
  SiRNA target sequence
ctgaatacatgttgaacgggt

SEQ ID NO: 39304 - DNA, 21 bp, Artificial sequence
  SiRNA target sequence
tgaatacatgttgaacgggtg

SEQ ID NO: 39305 - DNA, 21 bp, Artificial sequence
  SiRNA target sequence
gaatacatgttgaacgggtgt

SEQ ID NO: 39306 - DNA, 21 bp, Artificial sequence
  SiRNA target sequence
aatacatgttgaacgggtgta

SEQ ID NO: 39307 - DNA, 21 bp, Artificial sequence
  SiRNA target sequence
atacatgttgaacgggtgtaa

SEQ ID NO: 39308 - DNA, 21 bp, Artificial sequence
  SiRNA target sequence
tacatgttgaacgggtgtaac

SEQ ID NO: 39309 - DNA, 21 bp, Artificial sequence
  SiRNA target sequence
acatgttgaacgggtgtaaca

SEQ ID NO: 39310 - DNA, 21 bp, Artificial sequence
  SiRNA target sequence
catgttgaacgggtgtaacaa

SEQ ID NO: 39311 - DNA, 21 bp, Artificial sequence
  SiRNA target sequence
atgttgaacgggtgtaacaaa

SEQ ID NO: 39312 - DNA, 21 bp, Artificial sequence
  SiRNA target sequence
tgttgaacgggtgtaacaaat

SEQ ID NO: 39313 - DNA, 21 bp, Artificial sequence
  SiRNA target sequence
gttgaacgggtgtaacaaata

SEQ ID NO: 39314 - DNA, 21 bp, Artificial sequence
  SiRNA target sequence
ttgaacgggtgtaacaaatat

SEQ ID NO: 39315 - DNA, 21 bp, Artificial sequence
  SiRNA target sequence
tgaacgggtgtaacaaatata

SEQ ID NO: 39316 - DNA, 21 bp, Artificial sequence
  SiRNA target sequence
gaacgggtgtaacaaatataa

SEQ ID NO: 39317 - DNA, 21 bp, Artificial sequence
  SiRNA target sequence
aacgggtgtaacaaatataaa

SEQ ID NO: 39318 - DNA, 21 bp, Artificial sequence
  SiRNA target sequence
acgggtgtaacaaatataaaa

SEQ ID NO: 39319 - DNA, 21 bp, Artificial sequence
  SiRNA target sequence
cgggtgtaacaaatataaaat

SEQ ID NO: 39320 - DNA, 21 bp, Artificial sequence
  SiRNA target sequence
gggtgtaacaaatataaaatt

SEQ ID NO: 39321 - DNA, 21 bp, Artificial sequence
  SiRNA target sequence
ggtgtaacaaatataaaattg

SEQ ID NO: 39322 - DNA, 21 bp, Artificial sequence
  SiRNA target sequence
gtgtaacaaatataaaattgt

SEQ ID NO: 39323 - DNA, 21 bp, Artificial sequence
  SiRNA target sequence
tgtaacaaatataaaattgtt

SEQ ID NO: 39324 - DNA, 21 bp, Artificial sequence
  SiRNA target sequence
gtaacaaatataaaattgtta

SEQ ID NO: 39325 - DNA, 21 bp, Artificial sequence
  SiRNA target sequence
taacaaatataaaattgttaa

SEQ ID NO: 39326 - DNA, 21 bp, Artificial sequence
  SiRNA target sequence
aacaaatataaaattgttaag

SEQ ID NO: 39327 - DNA, 21 bp, Artificial sequence
  SiRNA target sequence
acaaatataaaattgttaagt

SEQ ID NO: 39328 - DNA, 21 bp, Artificial sequence
  SiRNA target sequence
caaatataaaattgttaagtt

SEQ ID NO: 39329 - DNA, 21 bp, Artificial sequence
  SiRNA target sequence
aaatataaaattgttaagttc

SEQ ID NO: 39330 - DNA, 21 bp, Artificial sequence
  SiRNA target sequence
aatataaaattgttaagttct

SEQ ID NO: 39331 - DNA, 21 bp, Artificial sequence
  SiRNA target sequence
atataaaattgttaagttctg

SEQ ID NO: 39332 - DNA, 21 bp, Artificial sequence
  SiRNA target sequence
tataaaattgttaagttctga

SEQ ID NO: 39333 - DNA, 21 bp, Artificial sequence
  SiRNA target sequence
ataaaattgttaagttctgac

SEQ ID NO: 39334 - DNA, 21 bp, Artificial sequence
  SiRNA target sequence
taaaattgttaagttctgaca

SEQ ID NO: 39335 - DNA, 21 bp, Artificial sequence
  SiRNA target sequence
aaaattgttaagttctgacat

SEQ ID NO: 39336 - DNA, 21 bp, Artificial sequence
  SiRNA target sequence
aaattgttaagttctgacatt

SEQ ID NO: 39337 - DNA, 21 bp, Artificial sequence
  SiRNA target sequence
aattgttaagttctgacattg

SEQ ID NO: 39338 - DNA, 21 bp, Artificial sequence
  SiRNA target sequence
attgttaagttctgacattgt

SEQ ID NO: 39339 - DNA, 21 bp, Artificial sequence
  SiRNA target sequence
ttgttaagttctgacattgta

SEQ ID NO: 39340 - DNA, 21 bp, Artificial sequence
  SiRNA target sequence
tgttaagttctgacattgtaa

SEQ ID NO: 39341 - DNA, 21 bp, Artificial sequence
  SiRNA target sequence
gttaagttctgacattgtaat

SEQ ID NO: 39342 - DNA, 21 bp, Artificial sequence
  SiRNA target sequence
ttaagttctgacattgtaatt

SEQ ID NO: 39343 - DNA, 21 bp, Artificial sequence
  SiRNA target sequence
taagttctgacattgtaattg

SEQ ID NO: 39344 - DNA, 21 bp, Artificial sequence
  SiRNA target sequence
aagttctgacattgtaattga

SEQ ID NO: 39345 - DNA, 21 bp, Artificial sequence
  SiRNA target sequence
agttctgacattgtaattgat

SEQ ID NO: 39346 - DNA, 21 bp, Artificial sequence
  SiRNA target sequence
gttctgacattgtaattgata

SEQ ID NO: 39347 - DNA, 21 bp, Artificial sequence
  SiRNA target sequence
ttctgacattgtaattgatac

SEQ ID NO: 39348 - DNA, 21 bp, Artificial sequence
  SiRNA target sequence
tctgacattgtaattgataca

SEQ ID NO: 39349 - DNA, 21 bp, Artificial sequence
  SiRNA target sequence
ctgacattgtaattgatacaa

SEQ ID NO: 39350 - DNA, 21 bp, Artificial sequence
  SiRNA target sequence
tgacattgtaattgatacaat

SEQ ID NO: 39351 - DNA, 21 bp, Artificial sequence
  SiRNA target sequence
gacattgtaattgatacaatt

SEQ ID NO: 39352 - DNA, 21 bp, Artificial sequence
  SiRNA target sequence
acattgtaattgatacaattg

SEQ ID NO: 39353 - DNA, 21 bp, Artificial sequence
  SiRNA target sequence
cattgtaattgatacaattgt

SEQ ID NO: 39354 - DNA, 21 bp, Artificial sequence
  SiRNA target sequence
attgtaattgatacaattgtc

SEQ ID NO: 39355 - DNA, 21 bp, Artificial sequence
  SiRNA target sequence
ttgtaattgatacaattgtca

SEQ ID NO: 39356 - DNA, 21 bp, Artificial sequence
  SiRNA target sequence
tgtaattgatacaattgtcaa

SEQ ID NO: 39357 - DNA, 21 bp, Artificial sequence
  SiRNA target sequence
gtaattgatacaattgtcaaa

SEQ ID NO: 39358 - DNA, 21 bp, Artificial sequence
  SiRNA target sequence
taattgatacaattgtcaaaa

SEQ ID NO: 39359 - DNA, 21 bp, Artificial sequence
  SiRNA target sequence
aattgatacaattgtcaaaac

SEQ ID NO: 39360 - DNA, 21 bp, Artificial sequence
  SiRNA target sequence
attgatacaattgtcaaaact

SEQ ID NO: 39361 - DNA, 21 bp, Artificial sequence
  SiRNA target sequence
ttgatacaattgtcaaaactg

SEQ ID NO: 39362 - DNA, 21 bp, Artificial sequence
  SiRNA target sequence
tgatacaattgtcaaaactgc

SEQ ID NO: 39363 - DNA, 21 bp, Artificial sequence
  SiRNA target sequence
gatacaattgtcaaaactgca

SEQ ID NO: 39364 - DNA, 21 bp, Artificial sequence
  SiRNA target sequence
atacaattgtcaaaactgcaa

SEQ ID NO: 39365 - DNA, 21 bp, Artificial sequence
  SiRNA target sequence
tacaattgtcaaaactgcaaa

SEQ ID NO: 39366 - DNA, 21 bp, Artificial sequence
  SiRNA target sequence
acaattgtcaaaactgcaaaa

SEQ ID NO: 39367 - DNA, 21 bp, Artificial sequence
  SiRNA target sequence
caattgtcaaaactgcaaaat

SEQ ID NO: 39368 - DNA, 21 bp, Artificial sequence
  SiRNA target sequence
aattgtcaaaactgcaaaata

SEQ ID NO: 39369 - DNA, 21 bp, Artificial sequence
  SiRNA target sequence
attgtcaaaactgcaaaatac

SEQ ID NO: 39370 - DNA, 21 bp, Artificial sequence
  SiRNA target sequence
ttgtcaaaactgcaaaataca

SEQ ID NO: 39371 - DNA, 21 bp, Artificial sequence
  SiRNA target sequence
tgtcaaaactgcaaaatacaa

SEQ ID NO: 39372 - DNA, 21 bp, Artificial sequence
  SiRNA target sequence
gtcaaaactgcaaaatacaaa

SEQ ID NO: 39373 - DNA, 21 bp, Artificial sequence
  SiRNA target sequence
tcaaaactgcaaaatacaaaa

SEQ ID NO: 39374 - DNA, 21 bp, Artificial sequence
  SiRNA target sequence
caaaactgcaaaatacaaaag

SEQ ID NO: 39375 - DNA, 21 bp, Artificial sequence
  SiRNA target sequence
aaaactgcaaaatacaaaaga

SEQ ID NO: 39376 - DNA, 21 bp, Artificial sequence
  SiRNA target sequence
aaactgcaaaatacaaaagac

SEQ ID NO: 39377 - DNA, 21 bp, Artificial sequence
  SiRNA target sequence
aactgcaaaatacaaaagact

SEQ ID NO: 39378 - DNA, 21 bp, Artificial sequence
  SiRNA target sequence
actgcaaaatacaaaagactt

SEQ ID NO: 39379 - DNA, 21 bp, Artificial sequence
  SiRNA target sequence
ctgcaaaatacaaaagacttt

SEQ ID NO: 39380 - DNA, 21 bp, Artificial sequence
  SiRNA target sequence
tgcaaaatacaaaagactttg

SEQ ID NO: 39381 - DNA, 21 bp, Artificial sequence
  SiRNA target sequence
gcaaaatacaaaagactttga

SEQ ID NO: 39382 - DNA, 21 bp, Artificial sequence
  SiRNA target sequence
caaaatacaaaagactttgac

SEQ ID NO: 39383 - DNA, 21 bp, Artificial sequence
  SiRNA target sequence
aaaatacaaaagactttgact

SEQ ID NO: 39384 - DNA, 21 bp, Artificial sequence
  SiRNA target sequence
aaatacaaaagactttgacta

SEQ ID NO: 39385 - DNA, 21 bp, Artificial sequence
  SiRNA target sequence
aatacaaaagactttgactaa

SEQ ID NO: 39386 - DNA, 21 bp, Artificial sequence
  SiRNA target sequence
atacaaaagactttgactaag

SEQ ID NO: 39387 - DNA, 21 bp, Artificial sequence
  SiRNA target sequence
tacaaaagactttgactaaga

SEQ ID NO: 39388 - DNA, 21 bp, Artificial sequence
  SiRNA target sequence
acaaaagactttgactaagat

SEQ ID NO: 39389 - DNA, 21 bp, Artificial sequence
  SiRNA target sequence
caaaagactttgactaagatc

SEQ ID NO: 39390 - DNA, 21 bp, Artificial sequence
  SiRNA target sequence
aaaagactttgactaagatct

SEQ ID NO: 39391 - DNA, 21 bp, Artificial sequence
  SiRNA target sequence
aaagactttgactaagatctt

SEQ ID NO: 39392 - DNA, 21 bp, Artificial sequence
  SiRNA target sequence
aagactttgactaagatcttt

SEQ ID NO: 39393 - DNA, 21 bp, Artificial sequence
  SiRNA target sequence
agactttgactaagatcttta

SEQ ID NO: 39394 - DNA, 21 bp, Artificial sequence
  SiRNA target sequence
gactttgactaagatctttat

SEQ ID NO: 39395 - DNA, 21 bp, Artificial sequence
  SiRNA target sequence
actttgactaagatctttatt

SEQ ID NO: 39396 - DNA, 21 bp, Artificial sequence
  SiRNA target sequence
ctttgactaagatctttatta

SEQ ID NO: 39397 - DNA, 21 bp, Artificial sequence
  SiRNA target sequence
tttgactaagatctttattat

SEQ ID NO: 39398 - DNA, 21 bp, Artificial sequence
  SiRNA target sequence
ttgactaagatctttattatc

SEQ ID NO: 39399 - DNA, 21 bp, Artificial sequence
  SiRNA target sequence
tgactaagatctttattatct

SEQ ID NO: 39400 - DNA, 21 bp, Artificial sequence
  SiRNA target sequence
gactaagatctttattatctg

SEQ ID NO: 39401 - DNA, 21 bp, Artificial sequence
  SiRNA target sequence
actaagatctttattatctgt

SEQ ID NO: 39402 - DNA, 21 bp, Artificial sequence
  SiRNA target sequence
ctaagatctttattatctgta

SEQ ID NO: 39403 - DNA, 21 bp, Artificial sequence
  SiRNA target sequence
taagatctttattatctgtaa

SEQ ID NO: 39404 - DNA, 21 bp, Artificial sequence
  SiRNA target sequence
aagatctttattatctgtaat

SEQ ID NO: 39405 - DNA, 21 bp, Artificial sequence
  SiRNA target sequence
agatctttattatctgtaata

SEQ ID NO: 39406 - DNA, 21 bp, Artificial sequence
  SiRNA target sequence
gatctttattatctgtaatat

SEQ ID NO: 39407 - DNA, 21 bp, Artificial sequence
  SiRNA target sequence
atctttattatctgtaatatc

SEQ ID NO: 39408 - DNA, 21 bp, Artificial sequence
  SiRNA target sequence
tctttattatctgtaatatca

SEQ ID NO: 39409 - DNA, 21 bp, Artificial sequence
  SiRNA target sequence
ctttattatctgtaatatcac

SEQ ID NO: 39410 - DNA, 21 bp, Artificial sequence
  SiRNA target sequence
tttattatctgtaatatcact

SEQ ID NO: 39411 - DNA, 21 bp, Artificial sequence
  SiRNA target sequence
ttattatctgtaatatcacta

SEQ ID NO: 39412 - DNA, 21 bp, Artificial sequence
  SiRNA target sequence
tattatctgtaatatcactag

SEQ ID NO: 39413 - DNA, 21 bp, Artificial sequence
  SiRNA target sequence
attatctgtaatatcactagt

SEQ ID NO: 39414 - DNA, 21 bp, Artificial sequence
  SiRNA target sequence
ttatctgtaatatcactagtc

SEQ ID NO: 39415 - DNA, 21 bp, Artificial sequence
  SiRNA target sequence
tatctgtaatatcactagtca

SEQ ID NO: 39416 - DNA, 21 bp, Artificial sequence
  SiRNA target sequence
atctgtaatatcactagtcaa

SEQ ID NO: 39417 - DNA, 21 bp, Artificial sequence
  SiRNA target sequence
tctgtaatatcactagtcaat

SEQ ID NO: 39418 - DNA, 21 bp, Artificial sequence
  SiRNA target sequence
ctgtaatatcactagtcaatt

SEQ ID NO: 39419 - DNA, 21 bp, Artificial sequence
  SiRNA target sequence
tgtaatatcactagtcaattt

SEQ ID NO: 39420 - DNA, 21 bp, Artificial sequence
  SiRNA target sequence
gtaatatcactagtcaatttc

SEQ ID NO: 39421 - DNA, 21 bp, Artificial sequence
  SiRNA target sequence
taatatcactagtcaatttcc

SEQ ID NO: 39422 - DNA, 21 bp, Artificial sequence
  SiRNA target sequence
aatatcactagtcaatttccg

SEQ ID NO: 39423 - DNA, 21 bp, Artificial sequence
  SiRNA target sequence
atatcactagtcaatttccgg

SEQ ID NO: 39424 - DNA, 21 bp, Artificial sequence
  SiRNA target sequence
tatcactagtcaatttccggg

SEQ ID NO: 39425 - DNA, 21 bp, Artificial sequence
  SiRNA target sequence
atcactagtcaatttccgggt

SEQ ID NO: 39426 - DNA, 21 bp, Artificial sequence
  SiRNA target sequence
tcactagtcaatttccgggta

SEQ ID NO: 39427 - DNA, 21 bp, Artificial sequence
  SiRNA target sequence
cactagtcaatttccgggtag

SEQ ID NO: 39428 - DNA, 21 bp, Artificial sequence
  SiRNA target sequence
actagtcaatttccgggtagc

SEQ ID NO: 39429 - DNA, 21 bp, Artificial sequence
  SiRNA target sequence
ctagtcaatttccgggtagct

SEQ ID NO: 39430 - DNA, 21 bp, Artificial sequence
  SiRNA target sequence
tagtcaatttccgggtagctt

SEQ ID NO: 39431 - DNA, 21 bp, Artificial sequence
  SiRNA target sequence
agtcaatttccgggtagcttc

SEQ ID NO: 39432 - DNA, 21 bp, Artificial sequence
  SiRNA target sequence
gtcaatttccgggtagcttca

SEQ ID NO: 39433 - DNA, 21 bp, Artificial sequence
  SiRNA target sequence
tcaatttccgggtagcttcaa

SEQ ID NO: 39434 - DNA, 21 bp, Artificial sequence
  SiRNA target sequence
caatttccgggtagcttcaac

SEQ ID NO: 39435 - DNA, 21 bp, Artificial sequence
  SiRNA target sequence
aatttccgggtagcttcaact

SEQ ID NO: 39436 - DNA, 21 bp, Artificial sequence
  SiRNA target sequence
atttccgggtagcttcaactg

SEQ ID NO: 39437 - DNA, 21 bp, Artificial sequence
  SiRNA target sequence
tttccgggtagcttcaactgt

SEQ ID NO: 39438 - DNA, 21 bp, Artificial sequence
  SiRNA target sequence
ttccgggtagcttcaactgtt

SEQ ID NO: 39439 - DNA, 21 bp, Artificial sequence
  SiRNA target sequence
tccgggtagcttcaactgtta

SEQ ID NO: 39440 - DNA, 21 bp, Artificial sequence
  SiRNA target sequence
ccgggtagcttcaactgttaa

SEQ ID NO: 39441 - DNA, 21 bp, Artificial sequence
  SiRNA target sequence
cgggtagcttcaactgttaaa

SEQ ID NO: 39442 - DNA, 21 bp, Artificial sequence
  SiRNA target sequence
gggtagcttcaactgttaaaa

SEQ ID NO: 39443 - DNA, 21 bp, Artificial sequence
  SiRNA target sequence
ggtagcttcaactgttaaaac

SEQ ID NO: 39444 - DNA, 21 bp, Artificial sequence
  SiRNA target sequence
gtagcttcaactgttaaaaca

SEQ ID NO: 39445 - DNA, 21 bp, Artificial sequence
  SiRNA target sequence
tagcttcaactgttaaaacat

SEQ ID NO: 39446 - DNA, 21 bp, Artificial sequence
  SiRNA target sequence
agcttcaactgttaaaacatt

SEQ ID NO: 39447 - DNA, 21 bp, Artificial sequence
  SiRNA target sequence
gcttcaactgttaaaacatta

SEQ ID NO: 39448 - DNA, 21 bp, Artificial sequence
  SiRNA target sequence
cttcaactgttaaaacattaa

SEQ ID NO: 39449 - DNA, 21 bp, Artificial sequence
  SiRNA target sequence
ttcaactgttaaaacattaaa

SEQ ID NO: 39450 - DNA, 21 bp, Artificial sequence
  SiRNA target sequence
tcaactgttaaaacattaaat

SEQ ID NO: 39451 - DNA, 21 bp, Artificial sequence
  SiRNA target sequence
caactgttaaaacattaaatg

SEQ ID NO: 39452 - DNA, 21 bp, Artificial sequence
  SiRNA target sequence
aactgttaaaacattaaatgt

SEQ ID NO: 39453 - DNA, 21 bp, Artificial sequence
  SiRNA target sequence
actgttaaaacattaaatgta

SEQ ID NO: 39454 - DNA, 21 bp, Artificial sequence
  SiRNA target sequence
ctgttaaaacattaaatgtac

SEQ ID NO: 39455 - DNA, 21 bp, Artificial sequence
  SiRNA target sequence
tgttaaaacattaaatgtaca

SEQ ID NO: 39456 - DNA, 21 bp, Artificial sequence
  SiRNA target sequence
gttaaaacattaaatgtacaa

SEQ ID NO: 39457 - DNA, 21 bp, Artificial sequence
  SiRNA target sequence
ttaaaacattaaatgtacaaa

SEQ ID NO: 39458 - DNA, 21 bp, Artificial sequence
  SiRNA target sequence
taaaacattaaatgtacaaac

SEQ ID NO: 39459 - DNA, 21 bp, Artificial sequence
  SiRNA target sequence
aaaacattaaatgtacaaact

SEQ ID NO: 39460 - DNA, 21 bp, Artificial sequence
  SiRNA target sequence
aaacattaaatgtacaaactg

SEQ ID NO: 39461 - DNA, 21 bp, Artificial sequence
  SiRNA target sequence
aacattaaatgtacaaactgc

SEQ ID NO: 39462 - DNA, 21 bp, Artificial sequence
  SiRNA target sequence
acattaaatgtacaaactgca

SEQ ID NO: 39463 - DNA, 21 bp, Artificial sequence
  SiRNA target sequence
cattaaatgtacaaactgcaa

SEQ ID NO: 39464 - DNA, 21 bp, Artificial sequence
  SiRNA target sequence
attaaatgtacaaactgcaaa

SEQ ID NO: 39465 - DNA, 21 bp, Artificial sequence
  SiRNA target sequence
ttaaatgtacaaactgcaaat

SEQ ID NO: 39466 - DNA, 21 bp, Artificial sequence
  SiRNA target sequence
taaatgtacaaactgcaaatg

SEQ ID NO: 39467 - DNA, 21 bp, Artificial sequence
  SiRNA target sequence
aaatgtacaaactgcaaatgt

SEQ ID NO: 39468 - DNA, 21 bp, Artificial sequence
  SiRNA target sequence
aatgtacaaactgcaaatgtc

SEQ ID NO: 39469 - DNA, 21 bp, Artificial sequence
  SiRNA target sequence
atgtacaaactgcaaatgtcc

SEQ ID NO: 39470 - DNA, 21 bp, Artificial sequence
  SiRNA target sequence
tgtacaaactgcaaatgtccc

SEQ ID NO: 39471 - DNA, 21 bp, Artificial sequence
  SiRNA target sequence
gtacaaactgcaaatgtccca

SEQ ID NO: 39472 - DNA, 21 bp, Artificial sequence
  SiRNA target sequence
tacaaactgcaaatgtcccaa

SEQ ID NO: 39473 - DNA, 21 bp, Artificial sequence
  SiRNA target sequence
acaaactgcaaatgtcccaaa

SEQ ID NO: 39474 - DNA, 21 bp, Artificial sequence
  SiRNA target sequence
caaactgcaaatgtcccaaaa

SEQ ID NO: 39475 - DNA, 21 bp, Artificial sequence
  SiRNA target sequence
aaactgcaaatgtcccaaaaa

SEQ ID NO: 39476 - DNA, 21 bp, Artificial sequence
  SiRNA target sequence
aactgcaaatgtcccaaaaat

SEQ ID NO: 39477 - DNA, 21 bp, Artificial sequence
  SiRNA target sequence
actgcaaatgtcccaaaaatt

SEQ ID NO: 39478 - DNA, 21 bp, Artificial sequence
  SiRNA target sequence
ctgcaaatgtcccaaaaatta

SEQ ID NO: 39479 - DNA, 21 bp, Artificial sequence
  SiRNA target sequence
tgcaaatgtcccaaaaattat

SEQ ID NO: 39480 - DNA, 21 bp, Artificial sequence
  SiRNA target sequence
gcaaatgtcccaaaaattatg

SEQ ID NO: 39481 - DNA, 21 bp, Artificial sequence
  SiRNA target sequence
caaatgtcccaaaaattatgt

SEQ ID NO: 39482 - DNA, 21 bp, Artificial sequence
  SiRNA target sequence
aaatgtcccaaaaattatgta

SEQ ID NO: 39483 - DNA, 21 bp, Artificial sequence
  SiRNA target sequence
aatgtcccaaaaattatgtaa

SEQ ID NO: 39484 - DNA, 21 bp, Artificial sequence
  SiRNA target sequence
atgtcccaaaaattatgtaaa

SEQ ID NO: 39485 - DNA, 21 bp, Artificial sequence
  SiRNA target sequence
tgtcccaaaaattatgtaaat

SEQ ID NO: 39486 - DNA, 21 bp, Artificial sequence
  SiRNA target sequence
gtcccaaaaattatgtaaatg

SEQ ID NO: 39487 - DNA, 21 bp, Artificial sequence
  SiRNA target sequence
tcccaaaaattatgtaaatga

SEQ ID NO: 39488 - DNA, 21 bp, Artificial sequence
  SiRNA target sequence
cccaaaaattatgtaaatgac

SEQ ID NO: 39489 - DNA, 21 bp, Artificial sequence
  SiRNA target sequence
ccaaaaattatgtaaatgaca

SEQ ID NO: 39490 - DNA, 21 bp, Artificial sequence
  SiRNA target sequence
caaaaattatgtaaatgacaa

SEQ ID NO: 39491 - DNA, 21 bp, Artificial sequence
  SiRNA target sequence
aaaaattatgtaaatgacaaa

SEQ ID NO: 39492 - DNA, 21 bp, Artificial sequence
  SiRNA target sequence
aaaattatgtaaatgacaaat

SEQ ID NO: 39493 - DNA, 21 bp, Artificial sequence
  SiRNA target sequence
aaattatgtaaatgacaaatg

SEQ ID NO: 39494 - DNA, 21 bp, Artificial sequence
  SiRNA target sequence
aattatgtaaatgacaaatgt

SEQ ID NO: 39495 - DNA, 21 bp, Artificial sequence
  SiRNA target sequence
attatgtaaatgacaaatgtt

SEQ ID NO: 39496 - DNA, 21 bp, Artificial sequence
  SiRNA target sequence
ttatgtaaatgacaaatgttc

SEQ ID NO: 39497 - DNA, 21 bp, Artificial sequence
  SiRNA target sequence
tatgtaaatgacaaatgttcg

SEQ ID NO: 39498 - DNA, 21 bp, Artificial sequence
  SiRNA target sequence
atgtaaatgacaaatgttcga

SEQ ID NO: 39499 - DNA, 21 bp, Artificial sequence
  SiRNA target sequence
tgtaaatgacaaatgttcgaa

SEQ ID NO: 39500 - DNA, 21 bp, Artificial sequence
  SiRNA target sequence
gtaaatgacaaatgttcgaat

SEQ ID NO: 39501 - DNA, 21 bp, Artificial sequence
  SiRNA target sequence
taaatgacaaatgttcgaata

SEQ ID NO: 39502 - DNA, 21 bp, Artificial sequence
  SiRNA target sequence
aaatgacaaatgttcgaataa

SEQ ID NO: 39503 - DNA, 21 bp, Artificial sequence
  SiRNA target sequence
aatgacaaatgttcgaataaa

SEQ ID NO: 39504 - DNA, 21 bp, Artificial sequence
  SiRNA target sequence
atgacaaatgttcgaataaag

SEQ ID NO: 39505 - DNA, 21 bp, Artificial sequence
  SiRNA target sequence
tgacaaatgttcgaataaagg

SEQ ID NO: 39506 - DNA, 21 bp, Artificial sequence
  SiRNA target sequence
gacaaatgttcgaataaaggg

SEQ ID NO: 39507 - DNA, 21 bp, Artificial sequence
  SiRNA target sequence
acaaatgttcgaataaagggc

SEQ ID NO: 39508 - DNA, 21 bp, Artificial sequence
  SiRNA target sequence
caaatgttcgaataaagggct

SEQ ID NO: 39509 - DNA, 21 bp, Artificial sequence
  SiRNA target sequence
aaatgttcgaataaagggctt

SEQ ID NO: 39510 - DNA, 21 bp, Artificial sequence
  SiRNA target sequence
aatgttcgaataaagggcttt

SEQ ID NO: 39511 - DNA, 21 bp, Artificial sequence
  SiRNA target sequence
atgttcgaataaagggctttg

SEQ ID NO: 39512 - DNA, 21 bp, Artificial sequence
  SiRNA target sequence
tgttcgaataaagggctttga

SEQ ID NO: 39513 - DNA, 21 bp, Artificial sequence
  SiRNA target sequence
gttcgaataaagggctttgaa

SEQ ID NO: 39514 - DNA, 21 bp, Artificial sequence
  SiRNA target sequence
ttcgaataaagggctttgaaa

SEQ ID NO: 39515 - DNA, 21 bp, Artificial sequence
  SiRNA target sequence
tcgaataaagggctttgaaat

SEQ ID NO: 39516 - DNA, 21 bp, Artificial sequence
  SiRNA target sequence
cgaataaagggctttgaaata

SEQ ID NO: 39517 - DNA, 21 bp, Artificial sequence
  SiRNA target sequence
gaataaagggctttgaaataa

SEQ ID NO: 39518 - DNA, 21 bp, Artificial sequence
  SiRNA target sequence
aataaagggctttgaaataac

SEQ ID NO: 39519 - DNA, 21 bp, Artificial sequence
  SiRNA target sequence
ataaagggctttgaaataaca

SEQ ID NO: 39520 - DNA, 21 bp, Artificial sequence
  SiRNA target sequence
taaagggctttgaaataacat

SEQ ID NO: 39521 - DNA, 21 bp, Artificial sequence
  SiRNA target sequence
aaagggctttgaaataacata

SEQ ID NO: 39522 - DNA, 21 bp, Artificial sequence
  SiRNA target sequence
aagggctttgaaataacatat

SEQ ID NO: 39523 - DNA, 21 bp, Artificial sequence
  SiRNA target sequence
agggctttgaaataacatatt

SEQ ID NO: 39524 - DNA, 21 bp, Artificial sequence
  SiRNA target sequence
gggctttgaaataacatattc

SEQ ID NO: 39525 - DNA, 21 bp, Artificial sequence
  SiRNA target sequence
ggctttgaaataacatattct

SEQ ID NO: 39526 - DNA, 21 bp, Artificial sequence
  SiRNA target sequence
gctttgaaataacatattcta

SEQ ID NO: 39527 - DNA, 21 bp, Artificial sequence
  SiRNA target sequence
ctttgaaataacatattctac

SEQ ID NO: 39528 - DNA, 21 bp, Artificial sequence
  SiRNA target sequence
tttgaaataacatattctaca

SEQ ID NO: 39529 - DNA, 21 bp, Artificial sequence
  SiRNA target sequence
ttgaaataacatattctacaa

SEQ ID NO: 39530 - DNA, 21 bp, Artificial sequence
  SiRNA target sequence
tgaaataacatattctacaat

SEQ ID NO: 39531 - DNA, 21 bp, Artificial sequence
  SiRNA target sequence
gaaataacatattctacaatc

SEQ ID NO: 39532 - DNA, 21 bp, Artificial sequence
  SiRNA target sequence
aaataacatattctacaatca

SEQ ID NO: 39533 - DNA, 21 bp, Artificial sequence
  SiRNA target sequence
aataacatattctacaatcag

SEQ ID NO: 39534 - DNA, 21 bp, Artificial sequence
  SiRNA target sequence
ataacatattctacaatcagg

SEQ ID NO: 39535 - DNA, 21 bp, Artificial sequence
  SiRNA target sequence
taacatattctacaatcaggt

SEQ ID NO: 39536 - DNA, 21 bp, Artificial sequence
  SiRNA target sequence
aacatattctacaatcaggtc

SEQ ID NO: 39537 - DNA, 21 bp, Artificial sequence
  SiRNA target sequence
acatattctacaatcaggtct

SEQ ID NO: 39538 - DNA, 21 bp, Artificial sequence
  SiRNA target sequence
catattctacaatcaggtctt

SEQ ID NO: 39539 - DNA, 21 bp, Artificial sequence
  SiRNA target sequence
atattctacaatcaggtcttt

SEQ ID NO: 39540 - DNA, 21 bp, Artificial sequence
  SiRNA target sequence
tattctacaatcaggtctttc

SEQ ID NO: 39541 - DNA, 21 bp, Artificial sequence
  SiRNA target sequence
attctacaatcaggtctttca

SEQ ID NO: 39542 - DNA, 21 bp, Artificial sequence
  SiRNA target sequence
ttctacaatcaggtctttcat

SEQ ID NO: 39543 - DNA, 21 bp, Artificial sequence
  SiRNA target sequence
tctacaatcaggtctttcata

SEQ ID NO: 39544 - DNA, 21 bp, Artificial sequence
  SiRNA target sequence
ctacaatcaggtctttcataa

SEQ ID NO: 39545 - DNA, 21 bp, Artificial sequence
  SiRNA target sequence
tacaatcaggtctttcataat

SEQ ID NO: 39546 - DNA, 21 bp, Artificial sequence
  SiRNA target sequence
acaatcaggtctttcataata

SEQ ID NO: 39547 - DNA, 21 bp, Artificial sequence
  SiRNA target sequence
caatcaggtctttcataatac

SEQ ID NO: 39548 - DNA, 21 bp, Artificial sequence
  SiRNA target sequence
aatcaggtctttcataatact

SEQ ID NO: 39549 - DNA, 21 bp, Artificial sequence
  SiRNA target sequence
atcaggtctttcataatacta

SEQ ID NO: 39550 - DNA, 21 bp, Artificial sequence
  SiRNA target sequence
tcaggtctttcataatactaa

SEQ ID NO: 39551 - DNA, 21 bp, Artificial sequence
  SiRNA target sequence
caggtctttcataatactaat

SEQ ID NO: 39552 - DNA, 21 bp, Artificial sequence
  SiRNA target sequence
aggtctttcataatactaata

SEQ ID NO: 39553 - DNA, 21 bp, Artificial sequence
  SiRNA target sequence
ggtctttcataatactaatat

SEQ ID NO: 39554 - DNA, 21 bp, Artificial sequence
  SiRNA target sequence
gtctttcataatactaatatc

SEQ ID NO: 39555 - DNA, 21 bp, Artificial sequence
  SiRNA target sequence
tctttcataatactaatatca

SEQ ID NO: 39556 - DNA, 21 bp, Artificial sequence
  SiRNA target sequence
ctttcataatactaatatcac

SEQ ID NO: 39557 - DNA, 21 bp, Artificial sequence
  SiRNA target sequence
tttcataatactaatatcact

SEQ ID NO: 39558 - DNA, 21 bp, Artificial sequence
  SiRNA target sequence
ttcataatactaatatcacta

SEQ ID NO: 39559 - DNA, 21 bp, Artificial sequence
  SiRNA target sequence
tcataatactaatatcactac

SEQ ID NO: 39560 - DNA, 21 bp, Artificial sequence
  SiRNA target sequence
cataatactaatatcactacc

SEQ ID NO: 39561 - DNA, 21 bp, Artificial sequence
  SiRNA target sequence
ataatactaatatcactacca

SEQ ID NO: 39562 - DNA, 21 bp, Artificial sequence
  SiRNA target sequence
taatactaatatcactaccat

SEQ ID NO: 39563 - DNA, 21 bp, Artificial sequence
  SiRNA target sequence
aatactaatatcactaccata

SEQ ID NO: 39564 - DNA, 21 bp, Artificial sequence
  SiRNA target sequence
atactaatatcactaccataa

SEQ ID NO: 39565 - DNA, 21 bp, Artificial sequence
  SiRNA target sequence
tactaatatcactaccataaa

SEQ ID NO: 39566 - DNA, 21 bp, Artificial sequence
  SiRNA target sequence
actaatatcactaccataaat

SEQ ID NO: 39567 - DNA, 21 bp, Artificial sequence
  SiRNA target sequence
ctaatatcactaccataaata

SEQ ID NO: 39568 - DNA, 21 bp, Artificial sequence
  SiRNA target sequence
taatatcactaccataaatag

SEQ ID NO: 39569 - DNA, 21 bp, Artificial sequence
  SiRNA target sequence
aatatcactaccataaataga

SEQ ID NO: 39570 - DNA, 21 bp, Artificial sequence
  SiRNA target sequence
atatcactaccataaatagat

SEQ ID NO: 39571 - DNA, 21 bp, Artificial sequence
  SiRNA target sequence
tatcactaccataaatagatt

SEQ ID NO: 39572 - DNA, 21 bp, Artificial sequence
  SiRNA target sequence
atcactaccataaatagattt

SEQ ID NO: 39573 - DNA, 21 bp, Artificial sequence
  SiRNA target sequence
tcactaccataaatagatttt

SEQ ID NO: 39574 - DNA, 21 bp, Artificial sequence
  SiRNA target sequence
cactaccataaatagattttt

SEQ ID NO: 39575 - DNA, 21 bp, Artificial sequence
  SiRNA target sequence
actaccataaatagatttttt

SEQ ID NO: 39576 - DNA, 21 bp, Artificial sequence
  SiRNA target sequence
ctaccataaatagattttttt

SEQ ID NO: 39577 - DNA, 21 bp, Artificial sequence
  SiRNA target sequence
taccataaatagatttttttt

SEQ ID NO: 39578 - DNA, 21 bp, Artificial sequence
  SiRNA target sequence
accataaatagattttttttc

SEQ ID NO: 39579 - DNA, 21 bp, Artificial sequence
  SiRNA target sequence
ccataaatagattttttttct

SEQ ID NO: 39580 - DNA, 21 bp, Artificial sequence
  SiRNA target sequence
cataaatagattttttttcta

SEQ ID NO: 39581 - DNA, 21 bp, Artificial sequence
  SiRNA target sequence
ataaatagattttttttctaa

SEQ ID NO: 39582 - DNA, 21 bp, Artificial sequence
  SiRNA target sequence
taaatagattttttttctaac

SEQ ID NO: 39583 - DNA, 21 bp, Artificial sequence
  SiRNA target sequence
aaatagattttttttctaaca

SEQ ID NO: 39584 - DNA, 21 bp, Artificial sequence
  SiRNA target sequence
aatagattttttttctaacat

SEQ ID NO: 39585 - DNA, 22 bp, Artificial sequence
  SiRNA target sequence
ttataagtttaatgtagaaata

SEQ ID NO: 39586 - DNA, 22 bp, Artificial sequence
  SiRNA target sequence
tataagtttaatgtagaaataa

SEQ ID NO: 39587 - DNA, 22 bp, Artificial sequence
  SiRNA target sequence
ataagtttaatgtagaaataat

SEQ ID NO: 39588 - DNA, 22 bp, Artificial sequence
  SiRNA target sequence
taagtttaatgtagaaataata

SEQ ID NO: 39589 - DNA, 22 bp, Artificial sequence
  SiRNA target sequence
aagtttaatgtagaaataatat

SEQ ID NO: 39590 - DNA, 22 bp, Artificial sequence
  SiRNA target sequence
agtttaatgtagaaataatatt

SEQ ID NO: 39591 - DNA, 22 bp, Artificial sequence
  SiRNA target sequence
gtttaatgtagaaataatattt

SEQ ID NO: 39592 - DNA, 22 bp, Artificial sequence
  SiRNA target sequence
tttaatgtagaaataatatttt

SEQ ID NO: 39593 - DNA, 22 bp, Artificial sequence
  SiRNA target sequence
ttaatgtagaaataatattttc

SEQ ID NO: 39594 - DNA, 22 bp, Artificial sequence
  SiRNA target sequence
taatgtagaaataatattttct

SEQ ID NO: 39595 - DNA, 22 bp, Artificial sequence
  SiRNA target sequence
aatgtagaaataatattttctt

SEQ ID NO: 39596 - DNA, 22 bp, Artificial sequence
  SiRNA target sequence
atgtagaaataatattttcttc

SEQ ID NO: 39597 - DNA, 22 bp, Artificial sequence
  SiRNA target sequence
tgtagaaataatattttcttct

SEQ ID NO: 39598 - DNA, 22 bp, Artificial sequence
  SiRNA target sequence
gtagaaataatattttcttcta

SEQ ID NO: 39599 - DNA, 22 bp, Artificial sequence
  SiRNA target sequence
tagaaataatattttcttctat

SEQ ID NO: 39600 - DNA, 22 bp, Artificial sequence
  SiRNA target sequence
agaaataatattttcttctatc

SEQ ID NO: 39601 - DNA, 22 bp, Artificial sequence
  SiRNA target sequence
gaaataatattttcttctatct

SEQ ID NO: 39602 - DNA, 22 bp, Artificial sequence
  SiRNA target sequence
aaataatattttcttctatctt

SEQ ID NO: 39603 - DNA, 22 bp, Artificial sequence
  SiRNA target sequence
aataatattttcttctatctta

SEQ ID NO: 39604 - DNA, 22 bp, Artificial sequence
  SiRNA target sequence
ataatattttcttctatcttat

SEQ ID NO: 39605 - DNA, 22 bp, Artificial sequence
  SiRNA target sequence
taatattttcttctatcttatg

SEQ ID NO: 39606 - DNA, 22 bp, Artificial sequence
  SiRNA target sequence
aatattttcttctatcttatgt

SEQ ID NO: 39607 - DNA, 22 bp, Artificial sequence
  SiRNA target sequence
atattttcttctatcttatgta

SEQ ID NO: 39608 - DNA, 22 bp, Artificial sequence
  SiRNA target sequence
tattttcttctatcttatgtaa

SEQ ID NO: 39609 - DNA, 22 bp, Artificial sequence
  SiRNA target sequence
attttcttctatcttatgtaat

SEQ ID NO: 39610 - DNA, 22 bp, Artificial sequence
  SiRNA target sequence
ttttcttctatcttatgtaatg

SEQ ID NO: 39611 - DNA, 22 bp, Artificial sequence
  SiRNA target sequence
tttcttctatcttatgtaatga

SEQ ID NO: 39612 - DNA, 22 bp, Artificial sequence
  SiRNA target sequence
ttcttctatcttatgtaatgat

SEQ ID NO: 39613 - DNA, 22 bp, Artificial sequence
  SiRNA target sequence
tcttctatcttatgtaatgata

SEQ ID NO: 39614 - DNA, 22 bp, Artificial sequence
  SiRNA target sequence
cttctatcttatgtaatgatac

SEQ ID NO: 39615 - DNA, 22 bp, Artificial sequence
  SiRNA target sequence
ttctatcttatgtaatgataca

SEQ ID NO: 39616 - DNA, 22 bp, Artificial sequence
  SiRNA target sequence
tctatcttatgtaatgatacag

SEQ ID NO: 39617 - DNA, 22 bp, Artificial sequence
  SiRNA target sequence
ctatcttatgtaatgatacagt

SEQ ID NO: 39618 - DNA, 22 bp, Artificial sequence
  SiRNA target sequence
tatcttatgtaatgatacagtt

SEQ ID NO: 39619 - DNA, 22 bp, Artificial sequence
  SiRNA target sequence
atcttatgtaatgatacagttt

SEQ ID NO: 39620 - DNA, 22 bp, Artificial sequence
  SiRNA target sequence
tcttatgtaatgatacagtttt

SEQ ID NO: 39621 - DNA, 22 bp, Artificial sequence
  SiRNA target sequence
cttatgtaatgatacagttttg

SEQ ID NO: 39622 - DNA, 22 bp, Artificial sequence
  SiRNA target sequence
ttatgtaatgatacagttttgt

SEQ ID NO: 39623 - DNA, 22 bp, Artificial sequence
  SiRNA target sequence
tatgtaatgatacagttttgtt

SEQ ID NO: 39624 - DNA, 22 bp, Artificial sequence
  SiRNA target sequence
atgtaatgatacagttttgttt

SEQ ID NO: 39625 - DNA, 22 bp, Artificial sequence
  SiRNA target sequence
tgtaatgatacagttttgtttt

SEQ ID NO: 39626 - DNA, 22 bp, Artificial sequence
  SiRNA target sequence
gtaatgatacagttttgttttt

SEQ ID NO: 39627 - DNA, 22 bp, Artificial sequence
  SiRNA target sequence
taatgatacagttttgttttta

SEQ ID NO: 39628 - DNA, 22 bp, Artificial sequence
  SiRNA target sequence
aatgatacagttttgtttttaa

SEQ ID NO: 39629 - DNA, 22 bp, Artificial sequence
  SiRNA target sequence
atgatacagttttgtttttaat

SEQ ID NO: 39630 - DNA, 22 bp, Artificial sequence
  SiRNA target sequence
tgatacagttttgtttttaata

SEQ ID NO: 39631 - DNA, 22 bp, Artificial sequence
  SiRNA target sequence
gatacagttttgtttttaatac

SEQ ID NO: 39632 - DNA, 22 bp, Artificial sequence
  SiRNA target sequence
atacagttttgtttttaatact

SEQ ID NO: 39633 - DNA, 22 bp, Artificial sequence
  SiRNA target sequence
tacagttttgtttttaatactt

SEQ ID NO: 39634 - DNA, 22 bp, Artificial sequence
  SiRNA target sequence
acagttttgtttttaatactta

SEQ ID NO: 39635 - DNA, 22 bp, Artificial sequence
  SiRNA target sequence
cagttttgtttttaatacttag

SEQ ID NO: 39636 - DNA, 22 bp, Artificial sequence
  SiRNA target sequence
agttttgtttttaatacttagc

SEQ ID NO: 39637 - DNA, 22 bp, Artificial sequence
  SiRNA target sequence
gttttgtttttaatacttagca

SEQ ID NO: 39638 - DNA, 22 bp, Artificial sequence
  SiRNA target sequence
ttttgtttttaatacttagcac

SEQ ID NO: 39639 - DNA, 22 bp, Artificial sequence
  SiRNA target sequence
tttgtttttaatacttagcact

SEQ ID NO: 39640 - DNA, 22 bp, Artificial sequence
  SiRNA target sequence
ttgtttttaatacttagcactt

SEQ ID NO: 39641 - DNA, 22 bp, Artificial sequence
  SiRNA target sequence
tgtttttaatacttagcacttt

SEQ ID NO: 39642 - DNA, 22 bp, Artificial sequence
  SiRNA target sequence
gtttttaatacttagcacttta

SEQ ID NO: 39643 - DNA, 22 bp, Artificial sequence
  SiRNA target sequence
tttttaatacttagcactttat

SEQ ID NO: 39644 - DNA, 22 bp, Artificial sequence
  SiRNA target sequence
ttttaatacttagcactttatc

SEQ ID NO: 39645 - DNA, 22 bp, Artificial sequence
  SiRNA target sequence
tttaatacttagcactttatca

SEQ ID NO: 39646 - DNA, 22 bp, Artificial sequence
  SiRNA target sequence
ttaatacttagcactttatcaa

SEQ ID NO: 39647 - DNA, 22 bp, Artificial sequence
  SiRNA target sequence
taatacttagcactttatcaaa

SEQ ID NO: 39648 - DNA, 22 bp, Artificial sequence
  SiRNA target sequence
aatacttagcactttatcaaat

SEQ ID NO: 39649 - DNA, 22 bp, Artificial sequence
  SiRNA target sequence
atacttagcactttatcaaata

SEQ ID NO: 39650 - DNA, 22 bp, Artificial sequence
  SiRNA target sequence
tacttagcactttatcaaataa

SEQ ID NO: 39651 - DNA, 22 bp, Artificial sequence
  SiRNA target sequence
acttagcactttatcaaataag

SEQ ID NO: 39652 - DNA, 22 bp, Artificial sequence
  SiRNA target sequence
cttagcactttatcaaataagt

SEQ ID NO: 39653 - DNA, 22 bp, Artificial sequence
  SiRNA target sequence
ttagcactttatcaaataagtg

SEQ ID NO: 39654 - DNA, 22 bp, Artificial sequence
  SiRNA target sequence
tagcactttatcaaataagtgg

SEQ ID NO: 39655 - DNA, 22 bp, Artificial sequence
  SiRNA target sequence
agcactttatcaaataagtgga

SEQ ID NO: 39656 - DNA, 22 bp, Artificial sequence
  SiRNA target sequence
gcactttatcaaataagtggag

SEQ ID NO: 39657 - DNA, 22 bp, Artificial sequence
  SiRNA target sequence
cactttatcaaataagtggagt

SEQ ID NO: 39658 - DNA, 22 bp, Artificial sequence
  SiRNA target sequence
actttatcaaataagtggagta

SEQ ID NO: 39659 - DNA, 22 bp, Artificial sequence
  SiRNA target sequence
ctttatcaaataagtggagtaa

SEQ ID NO: 39660 - DNA, 22 bp, Artificial sequence
  SiRNA target sequence
tttatcaaataagtggagtaaa

SEQ ID NO: 39661 - DNA, 22 bp, Artificial sequence
  SiRNA target sequence
ttatcaaataagtggagtaaat

SEQ ID NO: 39662 - DNA, 22 bp, Artificial sequence
  SiRNA target sequence
tatcaaataagtggagtaaatc

SEQ ID NO: 39663 - DNA, 22 bp, Artificial sequence
  SiRNA target sequence
atcaaataagtggagtaaatct

SEQ ID NO: 39664 - DNA, 22 bp, Artificial sequence
  SiRNA target sequence
tcaaataagtggagtaaatcta

SEQ ID NO: 39665 - DNA, 22 bp, Artificial sequence
  SiRNA target sequence
caaataagtggagtaaatctaa

SEQ ID NO: 39666 - DNA, 22 bp, Artificial sequence
  SiRNA target sequence
aaataagtggagtaaatctaaa

SEQ ID NO: 39667 - DNA, 22 bp, Artificial sequence
  SiRNA target sequence
aataagtggagtaaatctaaat

SEQ ID NO: 39668 - DNA, 22 bp, Artificial sequence
  SiRNA target sequence
ataagtggagtaaatctaaatt

SEQ ID NO: 39669 - DNA, 22 bp, Artificial sequence
  SiRNA target sequence
taagtggagtaaatctaaatta

SEQ ID NO: 39670 - DNA, 22 bp, Artificial sequence
  SiRNA target sequence
aagtggagtaaatctaaattat

SEQ ID NO: 39671 - DNA, 22 bp, Artificial sequence
  SiRNA target sequence
agtggagtaaatctaaattatg

SEQ ID NO: 39672 - DNA, 22 bp, Artificial sequence
  SiRNA target sequence
gtggagtaaatctaaattatgt

SEQ ID NO: 39673 - DNA, 22 bp, Artificial sequence
  SiRNA target sequence
tggagtaaatctaaattatgta

SEQ ID NO: 39674 - DNA, 22 bp, Artificial sequence
  SiRNA target sequence
ggagtaaatctaaattatgtaa

SEQ ID NO: 39675 - DNA, 22 bp, Artificial sequence
  SiRNA target sequence
gagtaaatctaaattatgtaaa

SEQ ID NO: 39676 - DNA, 22 bp, Artificial sequence
  SiRNA target sequence
agtaaatctaaattatgtaaaa

SEQ ID NO: 39677 - DNA, 22 bp, Artificial sequence
  SiRNA target sequence
gtaaatctaaattatgtaaaac

SEQ ID NO: 39678 - DNA, 22 bp, Artificial sequence
  SiRNA target sequence
taaatctaaattatgtaaaaca

SEQ ID NO: 39679 - DNA, 22 bp, Artificial sequence
  SiRNA target sequence
aaatctaaattatgtaaaacaa

SEQ ID NO: 39680 - DNA, 22 bp, Artificial sequence
  SiRNA target sequence
aatctaaattatgtaaaacaat

SEQ ID NO: 39681 - DNA, 22 bp, Artificial sequence
  SiRNA target sequence
atctaaattatgtaaaacaata

SEQ ID NO: 39682 - DNA, 22 bp, Artificial sequence
  SiRNA target sequence
tctaaattatgtaaaacaataa

SEQ ID NO: 39683 - DNA, 22 bp, Artificial sequence
  SiRNA target sequence
ctaaattatgtaaaacaataat

SEQ ID NO: 39684 - DNA, 22 bp, Artificial sequence
  SiRNA target sequence
taaattatgtaaaacaataatt

SEQ ID NO: 39685 - DNA, 22 bp, Artificial sequence
  SiRNA target sequence
aaattatgtaaaacaataatta

SEQ ID NO: 39686 - DNA, 22 bp, Artificial sequence
  SiRNA target sequence
aattatgtaaaacaataattat

SEQ ID NO: 39687 - DNA, 22 bp, Artificial sequence
  SiRNA target sequence
attatgtaaaacaataattatc

SEQ ID NO: 39688 - DNA, 22 bp, Artificial sequence
  SiRNA target sequence
ttatgtaaaacaataattatcg

SEQ ID NO: 39689 - DNA, 22 bp, Artificial sequence
  SiRNA target sequence
tatgtaaaacaataattatcgt

SEQ ID NO: 39690 - DNA, 22 bp, Artificial sequence
  SiRNA target sequence
atgtaaaacaataattatcgtc

SEQ ID NO: 39691 - DNA, 22 bp, Artificial sequence
  SiRNA target sequence
tgtaaaacaataattatcgtct

SEQ ID NO: 39692 - DNA, 22 bp, Artificial sequence
  SiRNA target sequence
gtaaaacaataattatcgtctt

SEQ ID NO: 39693 - DNA, 22 bp, Artificial sequence
  SiRNA target sequence
taaaacaataattatcgtcttc

SEQ ID NO: 39694 - DNA, 22 bp, Artificial sequence
  SiRNA target sequence
aaaacaataattatcgtcttct

SEQ ID NO: 39695 - DNA, 22 bp, Artificial sequence
  SiRNA target sequence
aaacaataattatcgtcttctc

SEQ ID NO: 39696 - DNA, 22 bp, Artificial sequence
  SiRNA target sequence
aacaataattatcgtcttctct

SEQ ID NO: 39697 - DNA, 22 bp, Artificial sequence
  SiRNA target sequence
acaataattatcgtcttctcta

SEQ ID NO: 39698 - DNA, 22 bp, Artificial sequence
  SiRNA target sequence
caataattatcgtcttctctaa

SEQ ID NO: 39699 - DNA, 22 bp, Artificial sequence
  SiRNA target sequence
aataattatcgtcttctctaag

SEQ ID NO: 39700 - DNA, 22 bp, Artificial sequence
  SiRNA target sequence
ataattatcgtcttctctaagt

SEQ ID NO: 39701 - DNA, 22 bp, Artificial sequence
  SiRNA target sequence
taattatcgtcttctctaagtt

SEQ ID NO: 39702 - DNA, 22 bp, Artificial sequence
  SiRNA target sequence
aattatcgtcttctctaagttg

SEQ ID NO: 39703 - DNA, 22 bp, Artificial sequence
  SiRNA target sequence
attatcgtcttctctaagttgt

SEQ ID NO: 39704 - DNA, 22 bp, Artificial sequence
  SiRNA target sequence
ttatcgtcttctctaagttgtt

SEQ ID NO: 39705 - DNA, 22 bp, Artificial sequence
  SiRNA target sequence
tatcgtcttctctaagttgttg

SEQ ID NO: 39706 - DNA, 22 bp, Artificial sequence
  SiRNA target sequence
atcgtcttctctaagttgttgg

SEQ ID NO: 39707 - DNA, 22 bp, Artificial sequence
  SiRNA target sequence
tcgtcttctctaagttgttgga

SEQ ID NO: 39708 - DNA, 22 bp, Artificial sequence
  SiRNA target sequence
cgtcttctctaagttgttggag

SEQ ID NO: 39709 - DNA, 22 bp, Artificial sequence
  SiRNA target sequence
gtcttctctaagttgttggaga

SEQ ID NO: 39710 - DNA, 22 bp, Artificial sequence
  SiRNA target sequence
tcttctctaagttgttggagat

SEQ ID NO: 39711 - DNA, 22 bp, Artificial sequence
  SiRNA target sequence
cttctctaagttgttggagatt

SEQ ID NO: 39712 - DNA, 22 bp, Artificial sequence
  SiRNA target sequence
ttctctaagttgttggagatta

SEQ ID NO: 39713 - DNA, 22 bp, Artificial sequence
  SiRNA target sequence
tctctaagttgttggagattag

SEQ ID NO: 39714 - DNA, 22 bp, Artificial sequence
  SiRNA target sequence
ctctaagttgttggagattaga

SEQ ID NO: 39715 - DNA, 22 bp, Artificial sequence
  SiRNA target sequence
tctaagttgttggagattagac

SEQ ID NO: 39716 - DNA, 22 bp, Artificial sequence
  SiRNA target sequence
ctaagttgttggagattagact

SEQ ID NO: 39717 - DNA, 22 bp, Artificial sequence
  SiRNA target sequence
taagttgttggagattagactt

SEQ ID NO: 39718 - DNA, 22 bp, Artificial sequence
  SiRNA target sequence
aagttgttggagattagacttt

SEQ ID NO: 39719 - DNA, 22 bp, Artificial sequence
  SiRNA target sequence
agttgttggagattagactttt

SEQ ID NO: 39720 - DNA, 22 bp, Artificial sequence
  SiRNA target sequence
gttgttggagattagactttta

SEQ ID NO: 39721 - DNA, 22 bp, Artificial sequence
  SiRNA target sequence
ttgttggagattagacttttaa

SEQ ID NO: 39722 - DNA, 22 bp, Artificial sequence
  SiRNA target sequence
tgttggagattagacttttaag

SEQ ID NO: 39723 - DNA, 22 bp, Artificial sequence
  SiRNA target sequence
gttggagattagacttttaaga

SEQ ID NO: 39724 - DNA, 22 bp, Artificial sequence
  SiRNA target sequence
ttggagattagacttttaagaa

SEQ ID NO: 39725 - DNA, 22 bp, Artificial sequence
  SiRNA target sequence
tggagattagacttttaagaat

SEQ ID NO: 39726 - DNA, 22 bp, Artificial sequence
  SiRNA target sequence
ggagattagacttttaagaatt

SEQ ID NO: 39727 - DNA, 22 bp, Artificial sequence
  SiRNA target sequence
gagattagacttttaagaattt

SEQ ID NO: 39728 - DNA, 22 bp, Artificial sequence
  SiRNA target sequence
agattagacttttaagaatttc

SEQ ID NO: 39729 - DNA, 22 bp, Artificial sequence
  SiRNA target sequence
gattagacttttaagaatttca

SEQ ID NO: 39730 - DNA, 22 bp, Artificial sequence
  SiRNA target sequence
attagacttttaagaatttcat

SEQ ID NO: 39731 - DNA, 22 bp, Artificial sequence
  SiRNA target sequence
ttagacttttaagaatttcata

SEQ ID NO: 39732 - DNA, 22 bp, Artificial sequence
  SiRNA target sequence
tagacttttaagaatttcatat

SEQ ID NO: 39733 - DNA, 22 bp, Artificial sequence
  SiRNA target sequence
agacttttaagaatttcatatt

SEQ ID NO: 39734 - DNA, 22 bp, Artificial sequence
  SiRNA target sequence
gacttttaagaatttcatattc

SEQ ID NO: 39735 - DNA, 22 bp, Artificial sequence
  SiRNA target sequence
acttttaagaatttcatattca

SEQ ID NO: 39736 - DNA, 22 bp, Artificial sequence
  SiRNA target sequence
cttttaagaatttcatattcag

SEQ ID NO: 39737 - DNA, 22 bp, Artificial sequence
  SiRNA target sequence
ttttaagaatttcatattcagc

SEQ ID NO: 39738 - DNA, 22 bp, Artificial sequence
  SiRNA target sequence
tttaagaatttcatattcagct

SEQ ID NO: 39739 - DNA, 22 bp, Artificial sequence
  SiRNA target sequence
ttaagaatttcatattcagctt

SEQ ID NO: 39740 - DNA, 22 bp, Artificial sequence
  SiRNA target sequence
taagaatttcatattcagcttt

SEQ ID NO: 39741 - DNA, 22 bp, Artificial sequence
  SiRNA target sequence
aagaatttcatattcagctttt

SEQ ID NO: 39742 - DNA, 22 bp, Artificial sequence
  SiRNA target sequence
agaatttcatattcagcttttt

SEQ ID NO: 39743 - DNA, 22 bp, Artificial sequence
  SiRNA target sequence
gaatttcatattcagctttttt

SEQ ID NO: 39744 - DNA, 22 bp, Artificial sequence
  SiRNA target sequence
aatttcatattcagcttttttg

SEQ ID NO: 39745 - DNA, 22 bp, Artificial sequence
  SiRNA target sequence
atttcatattcagcttttttgt

SEQ ID NO: 39746 - DNA, 22 bp, Artificial sequence
  SiRNA target sequence
tttcatattcagcttttttgtc

SEQ ID NO: 39747 - DNA, 22 bp, Artificial sequence
  SiRNA target sequence
ttcatattcagcttttttgtcc

SEQ ID NO: 39748 - DNA, 22 bp, Artificial sequence
  SiRNA target sequence
tcatattcagcttttttgtcca

SEQ ID NO: 39749 - DNA, 22 bp, Artificial sequence
  SiRNA target sequence
catattcagcttttttgtccaa

SEQ ID NO: 39750 - DNA, 22 bp, Artificial sequence
  SiRNA target sequence
atattcagcttttttgtccaat

SEQ ID NO: 39751 - DNA, 22 bp, Artificial sequence
  SiRNA target sequence
tattcagcttttttgtccaatg

SEQ ID NO: 39752 - DNA, 22 bp, Artificial sequence
  SiRNA target sequence
attcagcttttttgtccaatgc

SEQ ID NO: 39753 - DNA, 22 bp, Artificial sequence
  SiRNA target sequence
ttcagcttttttgtccaatgcg

SEQ ID NO: 39754 - DNA, 22 bp, Artificial sequence
  SiRNA target sequence
tcagcttttttgtccaatgcgg

SEQ ID NO: 39755 - DNA, 22 bp, Artificial sequence
  SiRNA target sequence
cagcttttttgtccaatgcggc

SEQ ID NO: 39756 - DNA, 22 bp, Artificial sequence
  SiRNA target sequence
agcttttttgtccaatgcggcc

SEQ ID NO: 39757 - DNA, 22 bp, Artificial sequence
  SiRNA target sequence
gcttttttgtccaatgcggccg

SEQ ID NO: 39758 - DNA, 22 bp, Artificial sequence
  SiRNA target sequence
cttttttgtccaatgcggccgt

SEQ ID NO: 39759 - DNA, 22 bp, Artificial sequence
  SiRNA target sequence
ttttttgtccaatgcggccgtt

SEQ ID NO: 39760 - DNA, 22 bp, Artificial sequence
  SiRNA target sequence
tttttgtccaatgcggccgttg

SEQ ID NO: 39761 - DNA, 22 bp, Artificial sequence
  SiRNA target sequence
ttttgtccaatgcggccgttgg

SEQ ID NO: 39762 - DNA, 22 bp, Artificial sequence
  SiRNA target sequence
tttgtccaatgcggccgttggc

SEQ ID NO: 39763 - DNA, 22 bp, Artificial sequence
  SiRNA target sequence
ttgtccaatgcggccgttggct

SEQ ID NO: 39764 - DNA, 22 bp, Artificial sequence
  SiRNA target sequence
tgtccaatgcggccgttggctc

SEQ ID NO: 39765 - DNA, 22 bp, Artificial sequence
  SiRNA target sequence
gtccaatgcggccgttggctca

SEQ ID NO: 39766 - DNA, 22 bp, Artificial sequence
  SiRNA target sequence
tccaatgcggccgttggctcat

SEQ ID NO: 39767 - DNA, 22 bp, Artificial sequence
  SiRNA target sequence
ccaatgcggccgttggctcatc

SEQ ID NO: 39768 - DNA, 22 bp, Artificial sequence
  SiRNA target sequence
caatgcggccgttggctcatct

SEQ ID NO: 39769 - DNA, 22 bp, Artificial sequence
  SiRNA target sequence
aatgcggccgttggctcatcta

SEQ ID NO: 39770 - DNA, 22 bp, Artificial sequence
  SiRNA target sequence
atgcggccgttggctcatctaa

SEQ ID NO: 39771 - DNA, 22 bp, Artificial sequence
  SiRNA target sequence
tgcggccgttggctcatctaaa

SEQ ID NO: 39772 - DNA, 22 bp, Artificial sequence
  SiRNA target sequence
gcggccgttggctcatctaaaa

SEQ ID NO: 39773 - DNA, 22 bp, Artificial sequence
  SiRNA target sequence
cggccgttggctcatctaaaat

SEQ ID NO: 39774 - DNA, 22 bp, Artificial sequence
  SiRNA target sequence
ggccgttggctcatctaaaatt

SEQ ID NO: 39775 - DNA, 22 bp, Artificial sequence
  SiRNA target sequence
gccgttggctcatctaaaatta

SEQ ID NO: 39776 - DNA, 22 bp, Artificial sequence
  SiRNA target sequence
ccgttggctcatctaaaattat

SEQ ID NO: 39777 - DNA, 22 bp, Artificial sequence
  SiRNA target sequence
cgttggctcatctaaaattata

SEQ ID NO: 39778 - DNA, 22 bp, Artificial sequence
  SiRNA target sequence
gttggctcatctaaaattataa

SEQ ID NO: 39779 - DNA, 22 bp, Artificial sequence
  SiRNA target sequence
ttggctcatctaaaattataat

SEQ ID NO: 39780 - DNA, 22 bp, Artificial sequence
  SiRNA target sequence
tggctcatctaaaattataata

SEQ ID NO: 39781 - DNA, 22 bp, Artificial sequence
  SiRNA target sequence
ggctcatctaaaattataatag

SEQ ID NO: 39782 - DNA, 22 bp, Artificial sequence
  SiRNA target sequence
gctcatctaaaattataatagg

SEQ ID NO: 39783 - DNA, 22 bp, Artificial sequence
  SiRNA target sequence
ctcatctaaaattataatagga

SEQ ID NO: 39784 - DNA, 22 bp, Artificial sequence
  SiRNA target sequence
tcatctaaaattataataggag

SEQ ID NO: 39785 - DNA, 22 bp, Artificial sequence
  SiRNA target sequence
catctaaaattataataggaga

SEQ ID NO: 39786 - DNA, 22 bp, Artificial sequence
  SiRNA target sequence
atctaaaattataataggagaa

SEQ ID NO: 39787 - DNA, 22 bp, Artificial sequence
  SiRNA target sequence
tctaaaattataataggagaat

SEQ ID NO: 39788 - DNA, 22 bp, Artificial sequence
  SiRNA target sequence
ctaaaattataataggagaatt

SEQ ID NO: 39789 - DNA, 22 bp, Artificial sequence
  SiRNA target sequence
taaaattataataggagaattt

SEQ ID NO: 39790 - DNA, 22 bp, Artificial sequence
  SiRNA target sequence
aaaattataataggagaatttt

SEQ ID NO: 39791 - DNA, 22 bp, Artificial sequence
  SiRNA target sequence
aaattataataggagaattttt

SEQ ID NO: 39792 - DNA, 22 bp, Artificial sequence
  SiRNA target sequence
aattataataggagaatttttt

SEQ ID NO: 39793 - DNA, 22 bp, Artificial sequence
  SiRNA target sequence
attataataggagaatttttta

SEQ ID NO: 39794 - DNA, 22 bp, Artificial sequence
  SiRNA target sequence
ttataataggagaattttttag

SEQ ID NO: 39795 - DNA, 22 bp, Artificial sequence
  SiRNA target sequence
tataataggagaattttttagt

SEQ ID NO: 39796 - DNA, 22 bp, Artificial sequence
  SiRNA target sequence
ataataggagaattttttagtg

SEQ ID NO: 39797 - DNA, 22 bp, Artificial sequence
  SiRNA target sequence
taataggagaattttttagtgc

SEQ ID NO: 39798 - DNA, 22 bp, Artificial sequence
  SiRNA target sequence
aataggagaattttttagtgcc

SEQ ID NO: 39799 - DNA, 22 bp, Artificial sequence
  SiRNA target sequence
ataggagaattttttagtgccg

SEQ ID NO: 39800 - DNA, 22 bp, Artificial sequence
  SiRNA target sequence
taggagaattttttagtgccga

SEQ ID NO: 39801 - DNA, 22 bp, Artificial sequence
  SiRNA target sequence
aggagaattttttagtgccgac

SEQ ID NO: 39802 - DNA, 22 bp, Artificial sequence
  SiRNA target sequence
ggagaattttttagtgccgacc

SEQ ID NO: 39803 - DNA, 22 bp, Artificial sequence
  SiRNA target sequence
gagaattttttagtgccgacct

SEQ ID NO: 39804 - DNA, 22 bp, Artificial sequence
  SiRNA target sequence
agaattttttagtgccgacctt

SEQ ID NO: 39805 - DNA, 22 bp, Artificial sequence
  SiRNA target sequence
gaattttttagtgccgacctta

SEQ ID NO: 39806 - DNA, 22 bp, Artificial sequence
  SiRNA target sequence
aattttttagtgccgaccttaa

SEQ ID NO: 39807 - DNA, 22 bp, Artificial sequence
  SiRNA target sequence
attttttagtgccgaccttaac

SEQ ID NO: 39808 - DNA, 22 bp, Artificial sequence
  SiRNA target sequence
ttttttagtgccgaccttaaca

SEQ ID NO: 39809 - DNA, 22 bp, Artificial sequence
  SiRNA target sequence
tttttagtgccgaccttaacaa

SEQ ID NO: 39810 - DNA, 22 bp, Artificial sequence
  SiRNA target sequence
ttttagtgccgaccttaacaaa

SEQ ID NO: 39811 - DNA, 22 bp, Artificial sequence
  SiRNA target sequence
tttagtgccgaccttaacaaaa

SEQ ID NO: 39812 - DNA, 22 bp, Artificial sequence
  SiRNA target sequence
ttagtgccgaccttaacaaaat

SEQ ID NO: 39813 - DNA, 22 bp, Artificial sequence
  SiRNA target sequence
tagtgccgaccttaacaaaatt

SEQ ID NO: 39814 - DNA, 22 bp, Artificial sequence
  SiRNA target sequence
agtgccgaccttaacaaaatta

SEQ ID NO: 39815 - DNA, 22 bp, Artificial sequence
  SiRNA target sequence
gtgccgaccttaacaaaattac

SEQ ID NO: 39816 - DNA, 22 bp, Artificial sequence
  SiRNA target sequence
tgccgaccttaacaaaattact

SEQ ID NO: 39817 - DNA, 22 bp, Artificial sequence
  SiRNA target sequence
gccgaccttaacaaaattactt

SEQ ID NO: 39818 - DNA, 22 bp, Artificial sequence
  SiRNA target sequence
ccgaccttaacaaaattacttt

SEQ ID NO: 39819 - DNA, 22 bp, Artificial sequence
  SiRNA target sequence
cgaccttaacaaaattactttt

SEQ ID NO: 39820 - DNA, 22 bp, Artificial sequence
  SiRNA target sequence
gaccttaacaaaattacttttt

SEQ ID NO: 39821 - DNA, 22 bp, Artificial sequence
  SiRNA target sequence
accttaacaaaattactttttg

SEQ ID NO: 39822 - DNA, 22 bp, Artificial sequence
  SiRNA target sequence
ccttaacaaaattactttttgt

SEQ ID NO: 39823 - DNA, 22 bp, Artificial sequence
  SiRNA target sequence
cttaacaaaattactttttgtc

SEQ ID NO: 39824 - DNA, 22 bp, Artificial sequence
  SiRNA target sequence
ttaacaaaattactttttgtct

SEQ ID NO: 39825 - DNA, 22 bp, Artificial sequence
  SiRNA target sequence
taacaaaattactttttgtctt

SEQ ID NO: 39826 - DNA, 22 bp, Artificial sequence
  SiRNA target sequence
aacaaaattactttttgtcttt

SEQ ID NO: 39827 - DNA, 22 bp, Artificial sequence
  SiRNA target sequence
acaaaattactttttgtctttc

SEQ ID NO: 39828 - DNA, 22 bp, Artificial sequence
  SiRNA target sequence
caaaattactttttgtctttct

SEQ ID NO: 39829 - DNA, 22 bp, Artificial sequence
  SiRNA target sequence
aaaattactttttgtctttctc

SEQ ID NO: 39830 - DNA, 22 bp, Artificial sequence
  SiRNA target sequence
aaattactttttgtctttctcc

SEQ ID NO: 39831 - DNA, 22 bp, Artificial sequence
  SiRNA target sequence
aattactttttgtctttctcca

SEQ ID NO: 39832 - DNA, 22 bp, Artificial sequence
  SiRNA target sequence
attactttttgtctttctccac

SEQ ID NO: 39833 - DNA, 22 bp, Artificial sequence
  SiRNA target sequence
ttactttttgtctttctccacc

SEQ ID NO: 39834 - DNA, 22 bp, Artificial sequence
  SiRNA target sequence
tactttttgtctttctccacca

SEQ ID NO: 39835 - DNA, 22 bp, Artificial sequence
  SiRNA target sequence
actttttgtctttctccaccac

SEQ ID NO: 39836 - DNA, 22 bp, Artificial sequence
  SiRNA target sequence
ctttttgtctttctccaccact

SEQ ID NO: 39837 - DNA, 22 bp, Artificial sequence
  SiRNA target sequence
tttttgtctttctccaccacta

SEQ ID NO: 39838 - DNA, 22 bp, Artificial sequence
  SiRNA target sequence
ttttgtctttctccaccactaa

SEQ ID NO: 39839 - DNA, 22 bp, Artificial sequence
  SiRNA target sequence
tttgtctttctccaccactaag

SEQ ID NO: 39840 - DNA, 22 bp, Artificial sequence
  SiRNA target sequence
ttgtctttctccaccactaagc

SEQ ID NO: 39841 - DNA, 22 bp, Artificial sequence
  SiRNA target sequence
tgtctttctccaccactaagct

SEQ ID NO: 39842 - DNA, 22 bp, Artificial sequence
  SiRNA target sequence
gtctttctccaccactaagctt

SEQ ID NO: 39843 - DNA, 22 bp, Artificial sequence
  SiRNA target sequence
tctttctccaccactaagctta

SEQ ID NO: 39844 - DNA, 22 bp, Artificial sequence
  SiRNA target sequence
ctttctccaccactaagcttat

SEQ ID NO: 39845 - DNA, 22 bp, Artificial sequence
  SiRNA target sequence
tttctccaccactaagcttatg

SEQ ID NO: 39846 - DNA, 22 bp, Artificial sequence
  SiRNA target sequence
ttctccaccactaagcttatgt

SEQ ID NO: 39847 - DNA, 22 bp, Artificial sequence
  SiRNA target sequence
tctccaccactaagcttatgtc

SEQ ID NO: 39848 - DNA, 22 bp, Artificial sequence
  SiRNA target sequence
ctccaccactaagcttatgtcc

SEQ ID NO: 39849 - DNA, 22 bp, Artificial sequence
  SiRNA target sequence
tccaccactaagcttatgtccc

SEQ ID NO: 39850 - DNA, 22 bp, Artificial sequence
  SiRNA target sequence
ccaccactaagcttatgtccct

SEQ ID NO: 39851 - DNA, 22 bp, Artificial sequence
  SiRNA target sequence
caccactaagcttatgtccctt

SEQ ID NO: 39852 - DNA, 22 bp, Artificial sequence
  SiRNA target sequence
accactaagcttatgtccctta

SEQ ID NO: 39853 - DNA, 22 bp, Artificial sequence
  SiRNA target sequence
ccactaagcttatgtcccttat

SEQ ID NO: 39854 - DNA, 22 bp, Artificial sequence
  SiRNA target sequence
cactaagcttatgtcccttatc

SEQ ID NO: 39855 - DNA, 22 bp, Artificial sequence
  SiRNA target sequence
actaagcttatgtcccttatct

SEQ ID NO: 39856 - DNA, 22 bp, Artificial sequence
  SiRNA target sequence
ctaagcttatgtcccttatctc

SEQ ID NO: 39857 - DNA, 22 bp, Artificial sequence
  SiRNA target sequence
taagcttatgtcccttatctcc

SEQ ID NO: 39858 - DNA, 22 bp, Artificial sequence
  SiRNA target sequence
aagcttatgtcccttatctcca

SEQ ID NO: 39859 - DNA, 22 bp, Artificial sequence
  SiRNA target sequence
agcttatgtcccttatctccaa

SEQ ID NO: 39860 - DNA, 22 bp, Artificial sequence
  SiRNA target sequence
gcttatgtcccttatctccaac

SEQ ID NO: 39861 - DNA, 22 bp, Artificial sequence
  SiRNA target sequence
cttatgtcccttatctccaaca

SEQ ID NO: 39862 - DNA, 22 bp, Artificial sequence
  SiRNA target sequence
ttatgtcccttatctccaacat

SEQ ID NO: 39863 - DNA, 22 bp, Artificial sequence
  SiRNA target sequence
tatgtcccttatctccaacatg

SEQ ID NO: 39864 - DNA, 22 bp, Artificial sequence
  SiRNA target sequence
atgtcccttatctccaacatgt

SEQ ID NO: 39865 - DNA, 22 bp, Artificial sequence
  SiRNA target sequence
tgtcccttatctccaacatgtg

SEQ ID NO: 39866 - DNA, 22 bp, Artificial sequence
  SiRNA target sequence
gtcccttatctccaacatgtgt

SEQ ID NO: 39867 - DNA, 22 bp, Artificial sequence
  SiRNA target sequence
tcccttatctccaacatgtgtg

SEQ ID NO: 39868 - DNA, 22 bp, Artificial sequence
  SiRNA target sequence
cccttatctccaacatgtgtgt

SEQ ID NO: 39869 - DNA, 22 bp, Artificial sequence
  SiRNA target sequence
ccttatctccaacatgtgtgtt

SEQ ID NO: 39870 - DNA, 22 bp, Artificial sequence
  SiRNA target sequence
cttatctccaacatgtgtgttg

SEQ ID NO: 39871 - DNA, 22 bp, Artificial sequence
  SiRNA target sequence
ttatctccaacatgtgtgttgt

SEQ ID NO: 39872 - DNA, 22 bp, Artificial sequence
  SiRNA target sequence
tatctccaacatgtgtgttgta

SEQ ID NO: 39873 - DNA, 22 bp, Artificial sequence
  SiRNA target sequence
atctccaacatgtgtgttgtat

SEQ ID NO: 39874 - DNA, 22 bp, Artificial sequence
  SiRNA target sequence
tctccaacatgtgtgttgtatt

SEQ ID NO: 39875 - DNA, 22 bp, Artificial sequence
  SiRNA target sequence
ctccaacatgtgtgttgtattc

SEQ ID NO: 39876 - DNA, 22 bp, Artificial sequence
  SiRNA target sequence
tccaacatgtgtgttgtattca

SEQ ID NO: 39877 - DNA, 22 bp, Artificial sequence
  SiRNA target sequence
ccaacatgtgtgttgtattcat

SEQ ID NO: 39878 - DNA, 22 bp, Artificial sequence
  SiRNA target sequence
caacatgtgtgttgtattcatc

SEQ ID NO: 39879 - DNA, 22 bp, Artificial sequence
  SiRNA target sequence
aacatgtgtgttgtattcatcc

SEQ ID NO: 39880 - DNA, 22 bp, Artificial sequence
  SiRNA target sequence
acatgtgtgttgtattcatcct

SEQ ID NO: 39881 - DNA, 22 bp, Artificial sequence
  SiRNA target sequence
catgtgtgttgtattcatcctc

SEQ ID NO: 39882 - DNA, 22 bp, Artificial sequence
  SiRNA target sequence
atgtgtgttgtattcatcctct

SEQ ID NO: 39883 - DNA, 22 bp, Artificial sequence
  SiRNA target sequence
tgtgtgttgtattcatcctcta

SEQ ID NO: 39884 - DNA, 22 bp, Artificial sequence
  SiRNA target sequence
gtgtgttgtattcatcctctag

SEQ ID NO: 39885 - DNA, 22 bp, Artificial sequence
  SiRNA target sequence
tgtgttgtattcatcctctagg

SEQ ID NO: 39886 - DNA, 22 bp, Artificial sequence
  SiRNA target sequence
gtgttgtattcatcctctaggt

SEQ ID NO: 39887 - DNA, 22 bp, Artificial sequence
  SiRNA target sequence
tgttgtattcatcctctaggtt

SEQ ID NO: 39888 - DNA, 22 bp, Artificial sequence
  SiRNA target sequence
gttgtattcatcctctaggttg

SEQ ID NO: 39889 - DNA, 22 bp, Artificial sequence
  SiRNA target sequence
ttgtattcatcctctaggttgt

SEQ ID NO: 39890 - DNA, 22 bp, Artificial sequence
  SiRNA target sequence
tgtattcatcctctaggttgtt

SEQ ID NO: 39891 - DNA, 22 bp, Artificial sequence
  SiRNA target sequence
gtattcatcctctaggttgttt

SEQ ID NO: 39892 - DNA, 22 bp, Artificial sequence
  SiRNA target sequence
tattcatcctctaggttgttta

SEQ ID NO: 39893 - DNA, 22 bp, Artificial sequence
  SiRNA target sequence
attcatcctctaggttgtttat

SEQ ID NO: 39894 - DNA, 22 bp, Artificial sequence
  SiRNA target sequence
ttcatcctctaggttgtttata

SEQ ID NO: 39895 - DNA, 22 bp, Artificial sequence
  SiRNA target sequence
tcatcctctaggttgtttatag

SEQ ID NO: 39896 - DNA, 22 bp, Artificial sequence
  SiRNA target sequence
catcctctaggttgtttataga

SEQ ID NO: 39897 - DNA, 22 bp, Artificial sequence
  SiRNA target sequence
atcctctaggttgtttatagaa

SEQ ID NO: 39898 - DNA, 22 bp, Artificial sequence
  SiRNA target sequence
tcctctaggttgtttatagaat

SEQ ID NO: 39899 - DNA, 22 bp, Artificial sequence
  SiRNA target sequence
cctctaggttgtttatagaatc

SEQ ID NO: 39900 - DNA, 22 bp, Artificial sequence
  SiRNA target sequence
ctctaggttgtttatagaatcg

SEQ ID NO: 39901 - DNA, 22 bp, Artificial sequence
  SiRNA target sequence
tctaggttgtttatagaatcgt

SEQ ID NO: 39902 - DNA, 22 bp, Artificial sequence
  SiRNA target sequence
ctaggttgtttatagaatcgtg

SEQ ID NO: 39903 - DNA, 22 bp, Artificial sequence
  SiRNA target sequence
taggttgtttatagaatcgtgt

SEQ ID NO: 39904 - DNA, 22 bp, Artificial sequence
  SiRNA target sequence
aggttgtttatagaatcgtgta

SEQ ID NO: 39905 - DNA, 22 bp, Artificial sequence
  SiRNA target sequence
ggttgtttatagaatcgtgtac

SEQ ID NO: 39906 - DNA, 22 bp, Artificial sequence
  SiRNA target sequence
gttgtttatagaatcgtgtaca

SEQ ID NO: 39907 - DNA, 22 bp, Artificial sequence
  SiRNA target sequence
ttgtttatagaatcgtgtacac

SEQ ID NO: 39908 - DNA, 22 bp, Artificial sequence
  SiRNA target sequence
tgtttatagaatcgtgtacaca

SEQ ID NO: 39909 - DNA, 22 bp, Artificial sequence
  SiRNA target sequence
gtttatagaatcgtgtacacaa

SEQ ID NO: 39910 - DNA, 22 bp, Artificial sequence
  SiRNA target sequence
tttatagaatcgtgtacacaaa

SEQ ID NO: 39911 - DNA, 22 bp, Artificial sequence
  SiRNA target sequence
ttatagaatcgtgtacacaaag

SEQ ID NO: 39912 - DNA, 22 bp, Artificial sequence
  SiRNA target sequence
tatagaatcgtgtacacaaagt

SEQ ID NO: 39913 - DNA, 22 bp, Artificial sequence
  SiRNA target sequence
atagaatcgtgtacacaaagtt

SEQ ID NO: 39914 - DNA, 22 bp, Artificial sequence
  SiRNA target sequence
tagaatcgtgtacacaaagttt

SEQ ID NO: 39915 - DNA, 22 bp, Artificial sequence
  SiRNA target sequence
agaatcgtgtacacaaagtttt

SEQ ID NO: 39916 - DNA, 22 bp, Artificial sequence
  SiRNA target sequence
gaatcgtgtacacaaagttttt

SEQ ID NO: 39917 - DNA, 22 bp, Artificial sequence
  SiRNA target sequence
aatcgtgtacacaaagtttttt

SEQ ID NO: 39918 - DNA, 22 bp, Artificial sequence
  SiRNA target sequence
atcgtgtacacaaagtttttta

SEQ ID NO: 39919 - DNA, 22 bp, Artificial sequence
  SiRNA target sequence
tcgtgtacacaaagttttttac

SEQ ID NO: 39920 - DNA, 22 bp, Artificial sequence
  SiRNA target sequence
cgtgtacacaaagttttttact

SEQ ID NO: 39921 - DNA, 22 bp, Artificial sequence
  SiRNA target sequence
gtgtacacaaagttttttactg

SEQ ID NO: 39922 - DNA, 22 bp, Artificial sequence
  SiRNA target sequence
tgtacacaaagttttttactga

SEQ ID NO: 39923 - DNA, 22 bp, Artificial sequence
  SiRNA target sequence
gtacacaaagttttttactgat

SEQ ID NO: 39924 - DNA, 22 bp, Artificial sequence
  SiRNA target sequence
tacacaaagttttttactgatt

SEQ ID NO: 39925 - DNA, 22 bp, Artificial sequence
  SiRNA target sequence
acacaaagttttttactgattt

SEQ ID NO: 39926 - DNA, 22 bp, Artificial sequence
  SiRNA target sequence
cacaaagttttttactgatttt

SEQ ID NO: 39927 - DNA, 22 bp, Artificial sequence
  SiRNA target sequence
acaaagttttttactgattttt

SEQ ID NO: 39928 - DNA, 22 bp, Artificial sequence
  SiRNA target sequence
caaagttttttactgattttta

SEQ ID NO: 39929 - DNA, 22 bp, Artificial sequence
  SiRNA target sequence
aaagttttttactgatttttat

SEQ ID NO: 39930 - DNA, 22 bp, Artificial sequence
  SiRNA target sequence
aagttttttactgatttttata

SEQ ID NO: 39931 - DNA, 22 bp, Artificial sequence
  SiRNA target sequence
agttttttactgatttttataa

SEQ ID NO: 39932 - DNA, 22 bp, Artificial sequence
  SiRNA target sequence
gttttttactgatttttataac

SEQ ID NO: 39933 - DNA, 22 bp, Artificial sequence
  SiRNA target sequence
ttttttactgatttttataact

SEQ ID NO: 39934 - DNA, 22 bp, Artificial sequence
  SiRNA target sequence
tttttactgatttttataactt

SEQ ID NO: 39935 - DNA, 22 bp, Artificial sequence
  SiRNA target sequence
ttttactgatttttataacttc

SEQ ID NO: 39936 - DNA, 22 bp, Artificial sequence
  SiRNA target sequence
tttactgatttttataacttct

SEQ ID NO: 39937 - DNA, 22 bp, Artificial sequence
  SiRNA target sequence
ttactgatttttataacttctt

SEQ ID NO: 39938 - DNA, 22 bp, Artificial sequence
  SiRNA target sequence
tactgatttttataacttcttc

SEQ ID NO: 39939 - DNA, 22 bp, Artificial sequence
  SiRNA target sequence
actgatttttataacttcttct

SEQ ID NO: 39940 - DNA, 22 bp, Artificial sequence
  SiRNA target sequence
ctgatttttataacttcttctt

SEQ ID NO: 39941 - DNA, 22 bp, Artificial sequence
  SiRNA target sequence
tgatttttataacttcttcttt

SEQ ID NO: 39942 - DNA, 22 bp, Artificial sequence
  SiRNA target sequence
gatttttataacttcttcttta

SEQ ID NO: 39943 - DNA, 22 bp, Artificial sequence
  SiRNA target sequence
atttttataacttcttctttat

SEQ ID NO: 39944 - DNA, 22 bp, Artificial sequence
  SiRNA target sequence
tttttataacttcttctttatc

SEQ ID NO: 39945 - DNA, 22 bp, Artificial sequence
  SiRNA target sequence
ttttataacttcttctttatca

SEQ ID NO: 39946 - DNA, 22 bp, Artificial sequence
  SiRNA target sequence
tttataacttcttctttatcaa

SEQ ID NO: 39947 - DNA, 22 bp, Artificial sequence
  SiRNA target sequence
ttataacttcttctttatcaaa

SEQ ID NO: 39948 - DNA, 22 bp, Artificial sequence
  SiRNA target sequence
tataacttcttctttatcaaat

SEQ ID NO: 39949 - DNA, 22 bp, Artificial sequence
  SiRNA target sequence
ataacttcttctttatcaaata

SEQ ID NO: 39950 - DNA, 22 bp, Artificial sequence
  SiRNA target sequence
taacttcttctttatcaaatat

SEQ ID NO: 39951 - DNA, 22 bp, Artificial sequence
  SiRNA target sequence
aacttcttctttatcaaatatt

SEQ ID NO: 39952 - DNA, 22 bp, Artificial sequence
  SiRNA target sequence
acttcttctttatcaaatattt

SEQ ID NO: 39953 - DNA, 22 bp, Artificial sequence
  SiRNA target sequence
cttcttctttatcaaatatttc

SEQ ID NO: 39954 - DNA, 22 bp, Artificial sequence
  SiRNA target sequence
ttcttctttatcaaatatttct

SEQ ID NO: 39955 - DNA, 22 bp, Artificial sequence
  SiRNA target sequence
tcttctttatcaaatatttctt

SEQ ID NO: 39956 - DNA, 22 bp, Artificial sequence
  SiRNA target sequence
cttctttatcaaatatttcttt

SEQ ID NO: 39957 - DNA, 22 bp, Artificial sequence
  SiRNA target sequence
ttctttatcaaatatttctttt

SEQ ID NO: 39958 - DNA, 22 bp, Artificial sequence
  SiRNA target sequence
tctttatcaaatatttcttttc

SEQ ID NO: 39959 - DNA, 22 bp, Artificial sequence
  SiRNA target sequence
ctttatcaaatatttcttttcc

SEQ ID NO: 39960 - DNA, 22 bp, Artificial sequence
  SiRNA target sequence
tttatcaaatatttcttttcca

SEQ ID NO: 39961 - DNA, 22 bp, Artificial sequence
  SiRNA target sequence
ttatcaaatatttcttttccat

SEQ ID NO: 39962 - DNA, 22 bp, Artificial sequence
  SiRNA target sequence
tatcaaatatttcttttccata

SEQ ID NO: 39963 - DNA, 22 bp, Artificial sequence
  SiRNA target sequence
atcaaatatttcttttccatat

SEQ ID NO: 39964 - DNA, 22 bp, Artificial sequence
  SiRNA target sequence
tcaaatatttcttttccatatg

SEQ ID NO: 39965 - DNA, 22 bp, Artificial sequence
  SiRNA target sequence
caaatatttcttttccatatgt

SEQ ID NO: 39966 - DNA, 22 bp, Artificial sequence
  SiRNA target sequence
aaatatttcttttccatatgtt

SEQ ID NO: 39967 - DNA, 22 bp, Artificial sequence
  SiRNA target sequence
aatatttcttttccatatgtta

SEQ ID NO: 39968 - DNA, 22 bp, Artificial sequence
  SiRNA target sequence
atatttcttttccatatgttaa

SEQ ID NO: 39969 - DNA, 22 bp, Artificial sequence
  SiRNA target sequence
tatttcttttccatatgttaaa

SEQ ID NO: 39970 - DNA, 22 bp, Artificial sequence
  SiRNA target sequence
atttcttttccatatgttaaat

SEQ ID NO: 39971 - DNA, 22 bp, Artificial sequence
  SiRNA target sequence
tttcttttccatatgttaaatt

SEQ ID NO: 39972 - DNA, 22 bp, Artificial sequence
  SiRNA target sequence
ttcttttccatatgttaaatta

SEQ ID NO: 39973 - DNA, 22 bp, Artificial sequence
  SiRNA target sequence
tcttttccatatgttaaattat

SEQ ID NO: 39974 - DNA, 22 bp, Artificial sequence
  SiRNA target sequence
cttttccatatgttaaattata

SEQ ID NO: 39975 - DNA, 22 bp, Artificial sequence
  SiRNA target sequence
ttttccatatgttaaattataa

SEQ ID NO: 39976 - DNA, 22 bp, Artificial sequence
  SiRNA target sequence
tttccatatgttaaattataat

SEQ ID NO: 39977 - DNA, 22 bp, Artificial sequence
  SiRNA target sequence
ttccatatgttaaattataata

SEQ ID NO: 39978 - DNA, 22 bp, Artificial sequence
  SiRNA target sequence
tccatatgttaaattataataa

SEQ ID NO: 39979 - DNA, 22 bp, Artificial sequence
  SiRNA target sequence
ccatatgttaaattataataaa

SEQ ID NO: 39980 - DNA, 22 bp, Artificial sequence
  SiRNA target sequence
catatgttaaattataataaac

SEQ ID NO: 39981 - DNA, 22 bp, Artificial sequence
  SiRNA target sequence
atatgttaaattataataaacc

SEQ ID NO: 39982 - DNA, 22 bp, Artificial sequence
  SiRNA target sequence
tatgttaaattataataaaccg

SEQ ID NO: 39983 - DNA, 22 bp, Artificial sequence
  SiRNA target sequence
atgttaaattataataaaccgt

SEQ ID NO: 39984 - DNA, 22 bp, Artificial sequence
  SiRNA target sequence
tgttaaattataataaaccgtt

SEQ ID NO: 39985 - DNA, 22 bp, Artificial sequence
  SiRNA target sequence
gttaaattataataaaccgttt

SEQ ID NO: 39986 - DNA, 22 bp, Artificial sequence
  SiRNA target sequence
ttaaattataataaaccgtttc

SEQ ID NO: 39987 - DNA, 22 bp, Artificial sequence
  SiRNA target sequence
taaattataataaaccgtttcg

SEQ ID NO: 39988 - DNA, 22 bp, Artificial sequence
  SiRNA target sequence
aaattataataaaccgtttcgt

SEQ ID NO: 39989 - DNA, 22 bp, Artificial sequence
  SiRNA target sequence
aattataataaaccgtttcgtt

SEQ ID NO: 39990 - DNA, 22 bp, Artificial sequence
  SiRNA target sequence
attataataaaccgtttcgtta

SEQ ID NO: 39991 - DNA, 22 bp, Artificial sequence
  SiRNA target sequence
ttataataaaccgtttcgttaa

SEQ ID NO: 39992 - DNA, 22 bp, Artificial sequence
  SiRNA target sequence
tataataaaccgtttcgttaaa

SEQ ID NO: 39993 - DNA, 22 bp, Artificial sequence
  SiRNA target sequence
ataataaaccgtttcgttaaac

SEQ ID NO: 39994 - DNA, 22 bp, Artificial sequence
  SiRNA target sequence
taataaaccgtttcgttaaaca

SEQ ID NO: 39995 - DNA, 22 bp, Artificial sequence
  SiRNA target sequence
aataaaccgtttcgttaaacaa

SEQ ID NO: 39996 - DNA, 22 bp, Artificial sequence
  SiRNA target sequence
ataaaccgtttcgttaaacaaa

SEQ ID NO: 39997 - DNA, 22 bp, Artificial sequence
  SiRNA target sequence
taaaccgtttcgttaaacaaaa

SEQ ID NO: 39998 - DNA, 22 bp, Artificial sequence
  SiRNA target sequence
aaaccgtttcgttaaacaaaaa

SEQ ID NO: 39999 - DNA, 22 bp, Artificial sequence
  SiRNA target sequence
aaccgtttcgttaaacaaaaat

SEQ ID NO: 40000 - DNA, 22 bp, Artificial sequence
  SiRNA target sequence
accgtttcgttaaacaaaaatg

SEQ ID NO: 40001 - DNA, 22 bp, Artificial sequence
  SiRNA target sequence
ccgtttcgttaaacaaaaatga

SEQ ID NO: 40002 - DNA, 22 bp, Artificial sequence
  SiRNA target sequence
cgtttcgttaaacaaaaatgag

SEQ ID NO: 40003 - DNA, 22 bp, Artificial sequence
  SiRNA target sequence
gtttcgttaaacaaaaatgagg

SEQ ID NO: 40004 - DNA, 22 bp, Artificial sequence
  SiRNA target sequence
tttcgttaaacaaaaatgaggt

SEQ ID NO: 40005 - DNA, 22 bp, Artificial sequence
  SiRNA target sequence
ttcgttaaacaaaaatgaggtt

SEQ ID NO: 40006 - DNA, 22 bp, Artificial sequence
  SiRNA target sequence
tcgttaaacaaaaatgaggttt

SEQ ID NO: 40007 - DNA, 22 bp, Artificial sequence
  SiRNA target sequence
cgttaaacaaaaatgaggtttg

SEQ ID NO: 40008 - DNA, 22 bp, Artificial sequence
  SiRNA target sequence
gttaaacaaaaatgaggtttgt

SEQ ID NO: 40009 - DNA, 22 bp, Artificial sequence
  SiRNA target sequence
ttaaacaaaaatgaggtttgtg

SEQ ID NO: 40010 - DNA, 22 bp, Artificial sequence
  SiRNA target sequence
taaacaaaaatgaggtttgtgg

SEQ ID NO: 40011 - DNA, 22 bp, Artificial sequence
  SiRNA target sequence
aaacaaaaatgaggtttgtggt

SEQ ID NO: 40012 - DNA, 22 bp, Artificial sequence
  SiRNA target sequence
aacaaaaatgaggtttgtggtg

SEQ ID NO: 40013 - DNA, 22 bp, Artificial sequence
  SiRNA target sequence
acaaaaatgaggtttgtggtgc

SEQ ID NO: 40014 - DNA, 22 bp, Artificial sequence
  SiRNA target sequence
caaaaatgaggtttgtggtgca

SEQ ID NO: 40015 - DNA, 22 bp, Artificial sequence
  SiRNA target sequence
aaaaatgaggtttgtggtgcaa

SEQ ID NO: 40016 - DNA, 22 bp, Artificial sequence
  SiRNA target sequence
aaaatgaggtttgtggtgcaaa

SEQ ID NO: 40017 - DNA, 22 bp, Artificial sequence
  SiRNA target sequence
aaatgaggtttgtggtgcaaat

SEQ ID NO: 40018 - DNA, 22 bp, Artificial sequence
  SiRNA target sequence
aatgaggtttgtggtgcaaatg

SEQ ID NO: 40019 - DNA, 22 bp, Artificial sequence
  SiRNA target sequence
atgaggtttgtggtgcaaatga

SEQ ID NO: 40020 - DNA, 22 bp, Artificial sequence
  SiRNA target sequence
tgaggtttgtggtgcaaatgat

SEQ ID NO: 40021 - DNA, 22 bp, Artificial sequence
  SiRNA target sequence
gaggtttgtggtgcaaatgata

SEQ ID NO: 40022 - DNA, 22 bp, Artificial sequence
  SiRNA target sequence
aggtttgtggtgcaaatgatat

SEQ ID NO: 40023 - DNA, 22 bp, Artificial sequence
  SiRNA target sequence
ggtttgtggtgcaaatgatata

SEQ ID NO: 40024 - DNA, 22 bp, Artificial sequence
  SiRNA target sequence
gtttgtggtgcaaatgatataa

SEQ ID NO: 40025 - DNA, 22 bp, Artificial sequence
  SiRNA target sequence
tttgtggtgcaaatgatataag

SEQ ID NO: 40026 - DNA, 22 bp, Artificial sequence
  SiRNA target sequence
ttgtggtgcaaatgatataagt

SEQ ID NO: 40027 - DNA, 22 bp, Artificial sequence
  SiRNA target sequence
tgtggtgcaaatgatataagtg

SEQ ID NO: 40028 - DNA, 22 bp, Artificial sequence
  SiRNA target sequence
gtggtgcaaatgatataagtga

SEQ ID NO: 40029 - DNA, 22 bp, Artificial sequence
  SiRNA target sequence
tggtgcaaatgatataagtgat

SEQ ID NO: 40030 - DNA, 22 bp, Artificial sequence
  SiRNA target sequence
ggtgcaaatgatataagtgatc

SEQ ID NO: 40031 - DNA, 22 bp, Artificial sequence
  SiRNA target sequence
gtgcaaatgatataagtgatct

SEQ ID NO: 40032 - DNA, 22 bp, Artificial sequence
  SiRNA target sequence
tgcaaatgatataagtgatcta

SEQ ID NO: 40033 - DNA, 22 bp, Artificial sequence
  SiRNA target sequence
gcaaatgatataagtgatctat

SEQ ID NO: 40034 - DNA, 22 bp, Artificial sequence
  SiRNA target sequence
caaatgatataagtgatctata

SEQ ID NO: 40035 - DNA, 22 bp, Artificial sequence
  SiRNA target sequence
aaatgatataagtgatctatat

SEQ ID NO: 40036 - DNA, 22 bp, Artificial sequence
  SiRNA target sequence
aatgatataagtgatctatatg

SEQ ID NO: 40037 - DNA, 22 bp, Artificial sequence
  SiRNA target sequence
atgatataagtgatctatatga

SEQ ID NO: 40038 - DNA, 22 bp, Artificial sequence
  SiRNA target sequence
tgatataagtgatctatatgaa

SEQ ID NO: 40039 - DNA, 22 bp, Artificial sequence
  SiRNA target sequence
gatataagtgatctatatgaac

SEQ ID NO: 40040 - DNA, 22 bp, Artificial sequence
  SiRNA target sequence
atataagtgatctatatgaact

SEQ ID NO: 40041 - DNA, 22 bp, Artificial sequence
  SiRNA target sequence
tataagtgatctatatgaacta

SEQ ID NO: 40042 - DNA, 22 bp, Artificial sequence
  SiRNA target sequence
ataagtgatctatatgaactat

SEQ ID NO: 40043 - DNA, 22 bp, Artificial sequence
  SiRNA target sequence
taagtgatctatatgaactatt

SEQ ID NO: 40044 - DNA, 22 bp, Artificial sequence
  SiRNA target sequence
aagtgatctatatgaactatta

SEQ ID NO: 40045 - DNA, 22 bp, Artificial sequence
  SiRNA target sequence
agtgatctatatgaactattag

SEQ ID NO: 40046 - DNA, 22 bp, Artificial sequence
  SiRNA target sequence
gtgatctatatgaactattaga

SEQ ID NO: 40047 - DNA, 22 bp, Artificial sequence
  SiRNA target sequence
tgatctatatgaactattagaa

SEQ ID NO: 40048 - DNA, 22 bp, Artificial sequence
  SiRNA target sequence
gatctatatgaactattagaaa

SEQ ID NO: 40049 - DNA, 22 bp, Artificial sequence
  SiRNA target sequence
atctatatgaactattagaaat

SEQ ID NO: 40050 - DNA, 22 bp, Artificial sequence
  SiRNA target sequence
tctatatgaactattagaaatt

SEQ ID NO: 40051 - DNA, 22 bp, Artificial sequence
  SiRNA target sequence
ctatatgaactattagaaattt

SEQ ID NO: 40052 - DNA, 22 bp, Artificial sequence
  SiRNA target sequence
tatatgaactattagaaatttc

SEQ ID NO: 40053 - DNA, 22 bp, Artificial sequence
  SiRNA target sequence
atatgaactattagaaatttct

SEQ ID NO: 40054 - DNA, 22 bp, Artificial sequence
  SiRNA target sequence
tatgaactattagaaatttctt

SEQ ID NO: 40055 - DNA, 22 bp, Artificial sequence
  SiRNA target sequence
atgaactattagaaatttcttt

SEQ ID NO: 40056 - DNA, 22 bp, Artificial sequence
  SiRNA target sequence
tgaactattagaaatttctttt

SEQ ID NO: 40057 - DNA, 22 bp, Artificial sequence
  SiRNA target sequence
gaactattagaaatttctttta

SEQ ID NO: 40058 - DNA, 22 bp, Artificial sequence
  SiRNA target sequence
aactattagaaatttcttttat

SEQ ID NO: 40059 - DNA, 22 bp, Artificial sequence
  SiRNA target sequence
actattagaaatttcttttata

SEQ ID NO: 40060 - DNA, 22 bp, Artificial sequence
  SiRNA target sequence
ctattagaaatttcttttatat

SEQ ID NO: 40061 - DNA, 22 bp, Artificial sequence
  SiRNA target sequence
tattagaaatttcttttatatc

SEQ ID NO: 40062 - DNA, 22 bp, Artificial sequence
  SiRNA target sequence
attagaaatttcttttatatct

SEQ ID NO: 40063 - DNA, 22 bp, Artificial sequence
  SiRNA target sequence
ttagaaatttcttttatatctc

SEQ ID NO: 40064 - DNA, 22 bp, Artificial sequence
  SiRNA target sequence
tagaaatttcttttatatctcg

SEQ ID NO: 40065 - DNA, 22 bp, Artificial sequence
  SiRNA target sequence
agaaatttcttttatatctcga

SEQ ID NO: 40066 - DNA, 22 bp, Artificial sequence
  SiRNA target sequence
gaaatttcttttatatctcgat

SEQ ID NO: 40067 - DNA, 22 bp, Artificial sequence
  SiRNA target sequence
aaatttcttttatatctcgatt

SEQ ID NO: 40068 - DNA, 22 bp, Artificial sequence
  SiRNA target sequence
aatttcttttatatctcgatta

SEQ ID NO: 40069 - DNA, 22 bp, Artificial sequence
  SiRNA target sequence
atttcttttatatctcgattat

SEQ ID NO: 40070 - DNA, 22 bp, Artificial sequence
  SiRNA target sequence
tttcttttatatctcgattatc

SEQ ID NO: 40071 - DNA, 22 bp, Artificial sequence
  SiRNA target sequence
ttcttttatatctcgattatct

SEQ ID NO: 40072 - DNA, 22 bp, Artificial sequence
  SiRNA target sequence
tcttttatatctcgattatcta

SEQ ID NO: 40073 - DNA, 22 bp, Artificial sequence
  SiRNA target sequence
cttttatatctcgattatctag

SEQ ID NO: 40074 - DNA, 22 bp, Artificial sequence
  SiRNA target sequence
ttttatatctcgattatctaga

SEQ ID NO: 40075 - DNA, 22 bp, Artificial sequence
  SiRNA target sequence
tttatatctcgattatctagat

SEQ ID NO: 40076 - DNA, 22 bp, Artificial sequence
  SiRNA target sequence
ttatatctcgattatctagata

SEQ ID NO: 40077 - DNA, 22 bp, Artificial sequence
  SiRNA target sequence
tatatctcgattatctagataa

SEQ ID NO: 40078 - DNA, 22 bp, Artificial sequence
  SiRNA target sequence
atatctcgattatctagataaa

SEQ ID NO: 40079 - DNA, 22 bp, Artificial sequence
  SiRNA target sequence
tatctcgattatctagataaat

SEQ ID NO: 40080 - DNA, 22 bp, Artificial sequence
  SiRNA target sequence
atctcgattatctagataaata

SEQ ID NO: 40081 - DNA, 22 bp, Artificial sequence
  SiRNA target sequence
tctcgattatctagataaatat

SEQ ID NO: 40082 - DNA, 22 bp, Artificial sequence
  SiRNA target sequence
ctcgattatctagataaatatt

SEQ ID NO: 40083 - DNA, 22 bp, Artificial sequence
  SiRNA target sequence
tcgattatctagataaatattt

SEQ ID NO: 40084 - DNA, 22 bp, Artificial sequence
  SiRNA target sequence
cgattatctagataaatatttc

SEQ ID NO: 40085 - DNA, 22 bp, Artificial sequence
  SiRNA target sequence
gattatctagataaatatttcc

SEQ ID NO: 40086 - DNA, 22 bp, Artificial sequence
  SiRNA target sequence
attatctagataaatatttccc

SEQ ID NO: 40087 - DNA, 22 bp, Artificial sequence
  SiRNA target sequence
ttatctagataaatatttcccc

SEQ ID NO: 40088 - DNA, 22 bp, Artificial sequence
  SiRNA target sequence
tatctagataaatatttccccc

SEQ ID NO: 40089 - DNA, 22 bp, Artificial sequence
  SiRNA target sequence
atctagataaatatttccccca

SEQ ID NO: 40090 - DNA, 22 bp, Artificial sequence
  SiRNA target sequence
tctagataaatatttcccccat

SEQ ID NO: 40091 - DNA, 22 bp, Artificial sequence
  SiRNA target sequence
ctagataaatatttcccccata

SEQ ID NO: 40092 - DNA, 22 bp, Artificial sequence
  SiRNA target sequence
tagataaatatttcccccataa

SEQ ID NO: 40093 - DNA, 22 bp, Artificial sequence
  SiRNA target sequence
agataaatatttcccccataat

SEQ ID NO: 40094 - DNA, 22 bp, Artificial sequence
  SiRNA target sequence
gataaatatttcccccataatt

SEQ ID NO: 40095 - DNA, 22 bp, Artificial sequence
  SiRNA target sequence
ataaatatttcccccataattt

SEQ ID NO: 40096 - DNA, 22 bp, Artificial sequence
  SiRNA target sequence
taaatatttcccccataatttt

SEQ ID NO: 40097 - DNA, 22 bp, Artificial sequence
  SiRNA target sequence
aaatatttcccccataattttc

SEQ ID NO: 40098 - DNA, 22 bp, Artificial sequence
  SiRNA target sequence
aatatttcccccataattttca

SEQ ID NO: 40099 - DNA, 22 bp, Artificial sequence
  SiRNA target sequence
atatttcccccataattttcaa

SEQ ID NO: 40100 - DNA, 22 bp, Artificial sequence
  SiRNA target sequence
tatttcccccataattttcaaa

SEQ ID NO: 40101 - DNA, 22 bp, Artificial sequence
  SiRNA target sequence
atttcccccataattttcaaat

SEQ ID NO: 40102 - DNA, 22 bp, Artificial sequence
  SiRNA target sequence
tttcccccataattttcaaatc

SEQ ID NO: 40103 - DNA, 22 bp, Artificial sequence
  SiRNA target sequence
ttcccccataattttcaaatct

SEQ ID NO: 40104 - DNA, 22 bp, Artificial sequence
  SiRNA target sequence
tcccccataattttcaaatctc

SEQ ID NO: 40105 - DNA, 22 bp, Artificial sequence
  SiRNA target sequence
cccccataattttcaaatctca

SEQ ID NO: 40106 - DNA, 22 bp, Artificial sequence
  SiRNA target sequence
ccccataattttcaaatctcat

SEQ ID NO: 40107 - DNA, 22 bp, Artificial sequence
  SiRNA target sequence
cccataattttcaaatctcata

SEQ ID NO: 40108 - DNA, 22 bp, Artificial sequence
  SiRNA target sequence
ccataattttcaaatctcataa

SEQ ID NO: 40109 - DNA, 22 bp, Artificial sequence
  SiRNA target sequence
cataattttcaaatctcataat

SEQ ID NO: 40110 - DNA, 22 bp, Artificial sequence
  SiRNA target sequence
ataattttcaaatctcataatc

SEQ ID NO: 40111 - DNA, 22 bp, Artificial sequence
  SiRNA target sequence
taattttcaaatctcataatca

SEQ ID NO: 40112 - DNA, 22 bp, Artificial sequence
  SiRNA target sequence
aattttcaaatctcataatcat

SEQ ID NO: 40113 - DNA, 22 bp, Artificial sequence
  SiRNA target sequence
attttcaaatctcataatcatc

SEQ ID NO: 40114 - DNA, 22 bp, Artificial sequence
  SiRNA target sequence
ttttcaaatctcataatcatct

SEQ ID NO: 40115 - DNA, 22 bp, Artificial sequence
  SiRNA target sequence
tttcaaatctcataatcatctt

SEQ ID NO: 40116 - DNA, 22 bp, Artificial sequence
  SiRNA target sequence
ttcaaatctcataatcatcttt

SEQ ID NO: 40117 - DNA, 22 bp, Artificial sequence
  SiRNA target sequence
tcaaatctcataatcatcttta

SEQ ID NO: 40118 - DNA, 22 bp, Artificial sequence
  SiRNA target sequence
caaatctcataatcatctttat

SEQ ID NO: 40119 - DNA, 22 bp, Artificial sequence
  SiRNA target sequence
aaatctcataatcatctttata

SEQ ID NO: 40120 - DNA, 22 bp, Artificial sequence
  SiRNA target sequence
aatctcataatcatctttataa

SEQ ID NO: 40121 - DNA, 22 bp, Artificial sequence
  SiRNA target sequence
atctcataatcatctttataag

SEQ ID NO: 40122 - DNA, 22 bp, Artificial sequence
  SiRNA target sequence
tctcataatcatctttataaga

SEQ ID NO: 40123 - DNA, 22 bp, Artificial sequence
  SiRNA target sequence
ctcataatcatctttataagag

SEQ ID NO: 40124 - DNA, 22 bp, Artificial sequence
  SiRNA target sequence
tcataatcatctttataagaga

SEQ ID NO: 40125 - DNA, 22 bp, Artificial sequence
  SiRNA target sequence
cataatcatctttataagagat

SEQ ID NO: 40126 - DNA, 22 bp, Artificial sequence
  SiRNA target sequence
ataatcatctttataagagatg

SEQ ID NO: 40127 - DNA, 22 bp, Artificial sequence
  SiRNA target sequence
taatcatctttataagagatgt

SEQ ID NO: 40128 - DNA, 22 bp, Artificial sequence
  SiRNA target sequence
aatcatctttataagagatgtt

SEQ ID NO: 40129 - DNA, 22 bp, Artificial sequence
  SiRNA target sequence
atcatctttataagagatgttt

SEQ ID NO: 40130 - DNA, 22 bp, Artificial sequence
  SiRNA target sequence
tcatctttataagagatgtttt

SEQ ID NO: 40131 - DNA, 22 bp, Artificial sequence
  SiRNA target sequence
catctttataagagatgttttt

SEQ ID NO: 40132 - DNA, 22 bp, Artificial sequence
  SiRNA target sequence
atctttataagagatgtttttc

SEQ ID NO: 40133 - DNA, 22 bp, Artificial sequence
  SiRNA target sequence
tctttataagagatgtttttcc

SEQ ID NO: 40134 - DNA, 22 bp, Artificial sequence
  SiRNA target sequence
ctttataagagatgtttttccc

SEQ ID NO: 40135 - DNA, 22 bp, Artificial sequence
  SiRNA target sequence
tttataagagatgtttttcccg

SEQ ID NO: 40136 - DNA, 22 bp, Artificial sequence
  SiRNA target sequence
ttataagagatgtttttcccga

SEQ ID NO: 40137 - DNA, 22 bp, Artificial sequence
  SiRNA target sequence
tataagagatgtttttcccgat

SEQ ID NO: 40138 - DNA, 22 bp, Artificial sequence
  SiRNA target sequence
ataagagatgtttttcccgatc

SEQ ID NO: 40139 - DNA, 22 bp, Artificial sequence
  SiRNA target sequence
taagagatgtttttcccgatcc

SEQ ID NO: 40140 - DNA, 22 bp, Artificial sequence
  SiRNA target sequence
aagagatgtttttcccgatcca

SEQ ID NO: 40141 - DNA, 22 bp, Artificial sequence
  SiRNA target sequence
agagatgtttttcccgatccat

SEQ ID NO: 40142 - DNA, 22 bp, Artificial sequence
  SiRNA target sequence
gagatgtttttcccgatccatt

SEQ ID NO: 40143 - DNA, 22 bp, Artificial sequence
  SiRNA target sequence
agatgtttttcccgatccattt

SEQ ID NO: 40144 - DNA, 22 bp, Artificial sequence
  SiRNA target sequence
gatgtttttcccgatccatttt

SEQ ID NO: 40145 - DNA, 22 bp, Artificial sequence
  SiRNA target sequence
atgtttttcccgatccattttt

SEQ ID NO: 40146 - DNA, 22 bp, Artificial sequence
  SiRNA target sequence
tgtttttcccgatccatttttt

SEQ ID NO: 40147 - DNA, 22 bp, Artificial sequence
  SiRNA target sequence
gtttttcccgatccattttttc

SEQ ID NO: 40148 - DNA, 22 bp, Artificial sequence
  SiRNA target sequence
tttttcccgatccattttttcc

SEQ ID NO: 40149 - DNA, 22 bp, Artificial sequence
  SiRNA target sequence
ttttcccgatccattttttcca

SEQ ID NO: 40150 - DNA, 22 bp, Artificial sequence
  SiRNA target sequence
tttcccgatccattttttccaa

SEQ ID NO: 40151 - DNA, 22 bp, Artificial sequence
  SiRNA target sequence
ttcccgatccattttttccaat

SEQ ID NO: 40152 - DNA, 22 bp, Artificial sequence
  SiRNA target sequence
tcccgatccattttttccaata

SEQ ID NO: 40153 - DNA, 22 bp, Artificial sequence
  SiRNA target sequence
cccgatccattttttccaataa

SEQ ID NO: 40154 - DNA, 22 bp, Artificial sequence
  SiRNA target sequence
ccgatccattttttccaataat

SEQ ID NO: 40155 - DNA, 22 bp, Artificial sequence
  SiRNA target sequence
cgatccattttttccaataata

SEQ ID NO: 40156 - DNA, 22 bp, Artificial sequence
  SiRNA target sequence
gatccattttttccaataatag

SEQ ID NO: 40157 - DNA, 22 bp, Artificial sequence
  SiRNA target sequence
atccattttttccaataatagc

SEQ ID NO: 40158 - DNA, 22 bp, Artificial sequence
  SiRNA target sequence
tccattttttccaataatagct

SEQ ID NO: 40159 - DNA, 22 bp, Artificial sequence
  SiRNA target sequence
ccattttttccaataatagcta

SEQ ID NO: 40160 - DNA, 22 bp, Artificial sequence
  SiRNA target sequence
cattttttccaataatagctac

SEQ ID NO: 40161 - DNA, 22 bp, Artificial sequence
  SiRNA target sequence
attttttccaataatagctact

SEQ ID NO: 40162 - DNA, 22 bp, Artificial sequence
  SiRNA target sequence
ttttttccaataatagctactt

SEQ ID NO: 40163 - DNA, 22 bp, Artificial sequence
  SiRNA target sequence
tttttccaataatagctacttt

SEQ ID NO: 40164 - DNA, 22 bp, Artificial sequence
  SiRNA target sequence
ttttccaataatagctactttt

SEQ ID NO: 40165 - DNA, 22 bp, Artificial sequence
  SiRNA target sequence
tttccaataatagctacttttt

SEQ ID NO: 40166 - DNA, 22 bp, Artificial sequence
  SiRNA target sequence
ttccaataatagctactttttc

SEQ ID NO: 40167 - DNA, 22 bp, Artificial sequence
  SiRNA target sequence
tccaataatagctactttttca

SEQ ID NO: 40168 - DNA, 22 bp, Artificial sequence
  SiRNA target sequence
ccaataatagctactttttcac

SEQ ID NO: 40169 - DNA, 22 bp, Artificial sequence
  SiRNA target sequence
caataatagctactttttcacc

SEQ ID NO: 40170 - DNA, 22 bp, Artificial sequence
  SiRNA target sequence
aataatagctactttttcacct

SEQ ID NO: 40171 - DNA, 22 bp, Artificial sequence
  SiRNA target sequence
ataatagctactttttcacctt

SEQ ID NO: 40172 - DNA, 22 bp, Artificial sequence
  SiRNA target sequence
taatagctactttttcaccttt

SEQ ID NO: 40173 - DNA, 22 bp, Artificial sequence
  SiRNA target sequence
aatagctactttttcacctttt

SEQ ID NO: 40174 - DNA, 22 bp, Artificial sequence
  SiRNA target sequence
atagctactttttcaccttttt

SEQ ID NO: 40175 - DNA, 22 bp, Artificial sequence
  SiRNA target sequence
tagctactttttcacctttttt

SEQ ID NO: 40176 - DNA, 22 bp, Artificial sequence
  SiRNA target sequence
agctactttttcacctttttta

SEQ ID NO: 40177 - DNA, 22 bp, Artificial sequence
  SiRNA target sequence
gctactttttcaccttttttaa

SEQ ID NO: 40178 - DNA, 22 bp, Artificial sequence
  SiRNA target sequence
ctactttttcaccttttttaat

SEQ ID NO: 40179 - DNA, 22 bp, Artificial sequence
  SiRNA target sequence
tactttttcaccttttttaatt

SEQ ID NO: 40180 - DNA, 22 bp, Artificial sequence
  SiRNA target sequence
actttttcaccttttttaatta

SEQ ID NO: 40181 - DNA, 22 bp, Artificial sequence
  SiRNA target sequence
ctttttcaccttttttaattaa

SEQ ID NO: 40182 - DNA, 22 bp, Artificial sequence
  SiRNA target sequence
tttttcaccttttttaattaaa

SEQ ID NO: 40183 - DNA, 22 bp, Artificial sequence
  SiRNA target sequence
ttttcaccttttttaattaaaa

SEQ ID NO: 40184 - DNA, 22 bp, Artificial sequence
  SiRNA target sequence
tttcaccttttttaattaaaat

SEQ ID NO: 40185 - DNA, 22 bp, Artificial sequence
  SiRNA target sequence
ttcaccttttttaattaaaata

SEQ ID NO: 40186 - DNA, 22 bp, Artificial sequence
  SiRNA target sequence
tcaccttttttaattaaaatat

SEQ ID NO: 40187 - DNA, 22 bp, Artificial sequence
  SiRNA target sequence
caccttttttaattaaaatatt

SEQ ID NO: 40188 - DNA, 22 bp, Artificial sequence
  SiRNA target sequence
accttttttaattaaaatattt

SEQ ID NO: 40189 - DNA, 22 bp, Artificial sequence
  SiRNA target sequence
ccttttttaattaaaatattta

SEQ ID NO: 40190 - DNA, 22 bp, Artificial sequence
  SiRNA target sequence
cttttttaattaaaatatttat

SEQ ID NO: 40191 - DNA, 22 bp, Artificial sequence
  SiRNA target sequence
ttttttaattaaaatatttatg

SEQ ID NO: 40192 - DNA, 22 bp, Artificial sequence
  SiRNA target sequence
tttttaattaaaatatttatgt

SEQ ID NO: 40193 - DNA, 22 bp, Artificial sequence
  SiRNA target sequence
ttttaattaaaatatttatgtc

SEQ ID NO: 40194 - DNA, 22 bp, Artificial sequence
  SiRNA target sequence
tttaattaaaatatttatgtcc

SEQ ID NO: 40195 - DNA, 22 bp, Artificial sequence
  SiRNA target sequence
ttaattaaaatatttatgtccg

SEQ ID NO: 40196 - DNA, 22 bp, Artificial sequence
  SiRNA target sequence
taattaaaatatttatgtccgt

SEQ ID NO: 40197 - DNA, 22 bp, Artificial sequence
  SiRNA target sequence
aattaaaatatttatgtccgtt

SEQ ID NO: 40198 - DNA, 22 bp, Artificial sequence
  SiRNA target sequence
attaaaatatttatgtccgtta

SEQ ID NO: 40199 - DNA, 22 bp, Artificial sequence
  SiRNA target sequence
ttaaaatatttatgtccgttaa

SEQ ID NO: 40200 - DNA, 22 bp, Artificial sequence
  SiRNA target sequence
taaaatatttatgtccgttaaa

SEQ ID NO: 40201 - DNA, 22 bp, Artificial sequence
  SiRNA target sequence
aaaatatttatgtccgttaaaa

SEQ ID NO: 40202 - DNA, 22 bp, Artificial sequence
  SiRNA target sequence
aaatatttatgtccgttaaaat

SEQ ID NO: 40203 - DNA, 22 bp, Artificial sequence
  SiRNA target sequence
aatatttatgtccgttaaaatt

SEQ ID NO: 40204 - DNA, 22 bp, Artificial sequence
  SiRNA target sequence
atatttatgtccgttaaaattt

SEQ ID NO: 40205 - DNA, 22 bp, Artificial sequence
  SiRNA target sequence
tatttatgtccgttaaaatttt

SEQ ID NO: 40206 - DNA, 22 bp, Artificial sequence
  SiRNA target sequence
atttatgtccgttaaaattttt

SEQ ID NO: 40207 - DNA, 22 bp, Artificial sequence
  SiRNA target sequence
tttatgtccgttaaaatttttt

SEQ ID NO: 40208 - DNA, 22 bp, Artificial sequence
  SiRNA target sequence
ttatgtccgttaaaattttttt

SEQ ID NO: 40209 - DNA, 22 bp, Artificial sequence
  SiRNA target sequence
tatgtccgttaaaatttttttg

SEQ ID NO: 40210 - DNA, 22 bp, Artificial sequence
  SiRNA target sequence
atgtccgttaaaatttttttgg

SEQ ID NO: 40211 - DNA, 22 bp, Artificial sequence
  SiRNA target sequence
tgtccgttaaaatttttttgga

SEQ ID NO: 40212 - DNA, 22 bp, Artificial sequence
  SiRNA target sequence
gtccgttaaaatttttttggag

SEQ ID NO: 40213 - DNA, 22 bp, Artificial sequence
  SiRNA target sequence
tccgttaaaatttttttggagt

SEQ ID NO: 40214 - DNA, 22 bp, Artificial sequence
  SiRNA target sequence
ccgttaaaatttttttggagta

SEQ ID NO: 40215 - DNA, 22 bp, Artificial sequence
  SiRNA target sequence
cgttaaaatttttttggagtaa

SEQ ID NO: 40216 - DNA, 22 bp, Artificial sequence
  SiRNA target sequence
gttaaaatttttttggagtaat

SEQ ID NO: 40217 - DNA, 22 bp, Artificial sequence
  SiRNA target sequence
ttaaaatttttttggagtaata

SEQ ID NO: 40218 - DNA, 22 bp, Artificial sequence
  SiRNA target sequence
taaaatttttttggagtaataa

SEQ ID NO: 40219 - DNA, 22 bp, Artificial sequence
  SiRNA target sequence
aaaatttttttggagtaataat

SEQ ID NO: 40220 - DNA, 22 bp, Artificial sequence
  SiRNA target sequence
aaatttttttggagtaataatt

SEQ ID NO: 40221 - DNA, 22 bp, Artificial sequence
  SiRNA target sequence
aatttttttggagtaataatta

SEQ ID NO: 40222 - DNA, 22 bp, Artificial sequence
  SiRNA target sequence
atttttttggagtaataattaa

SEQ ID NO: 40223 - DNA, 22 bp, Artificial sequence
  SiRNA target sequence
tttttttggagtaataattaaa

SEQ ID NO: 40224 - DNA, 22 bp, Artificial sequence
  SiRNA target sequence
ttttttggagtaataattaaat

SEQ ID NO: 40225 - DNA, 22 bp, Artificial sequence
  SiRNA target sequence
tttttggagtaataattaaatg

SEQ ID NO: 40226 - DNA, 22 bp, Artificial sequence
  SiRNA target sequence
ttttggagtaataattaaatga

SEQ ID NO: 40227 - DNA, 22 bp, Artificial sequence
  SiRNA target sequence
tttggagtaataattaaatgat

SEQ ID NO: 40228 - DNA, 22 bp, Artificial sequence
  SiRNA target sequence
ttggagtaataattaaatgatg

SEQ ID NO: 40229 - DNA, 22 bp, Artificial sequence
  SiRNA target sequence
tggagtaataattaaatgatgc

SEQ ID NO: 40230 - DNA, 22 bp, Artificial sequence
  SiRNA target sequence
ggagtaataattaaatgatgca

SEQ ID NO: 40231 - DNA, 22 bp, Artificial sequence
  SiRNA target sequence
gagtaataattaaatgatgcat

SEQ ID NO: 40232 - DNA, 22 bp, Artificial sequence
  SiRNA target sequence
agtaataattaaatgatgcatt

SEQ ID NO: 40233 - DNA, 22 bp, Artificial sequence
  SiRNA target sequence
gtaataattaaatgatgcattt

SEQ ID NO: 40234 - DNA, 22 bp, Artificial sequence
  SiRNA target sequence
taataattaaatgatgcatttt

SEQ ID NO: 40235 - DNA, 22 bp, Artificial sequence
  SiRNA target sequence
aataattaaatgatgcattttc

SEQ ID NO: 40236 - DNA, 22 bp, Artificial sequence
  SiRNA target sequence
ataattaaatgatgcattttct

SEQ ID NO: 40237 - DNA, 22 bp, Artificial sequence
  SiRNA target sequence
taattaaatgatgcattttcta

SEQ ID NO: 40238 - DNA, 22 bp, Artificial sequence
  SiRNA target sequence
aattaaatgatgcattttctaa

SEQ ID NO: 40239 - DNA, 22 bp, Artificial sequence
  SiRNA target sequence
attaaatgatgcattttctaat

SEQ ID NO: 40240 - DNA, 22 bp, Artificial sequence
  SiRNA target sequence
ttaaatgatgcattttctaatc

SEQ ID NO: 40241 - DNA, 22 bp, Artificial sequence
  SiRNA target sequence
taaatgatgcattttctaatct

SEQ ID NO: 40242 - DNA, 22 bp, Artificial sequence
  SiRNA target sequence
aaatgatgcattttctaatctt

SEQ ID NO: 40243 - DNA, 22 bp, Artificial sequence
  SiRNA target sequence
aatgatgcattttctaatctta

SEQ ID NO: 40244 - DNA, 22 bp, Artificial sequence
  SiRNA target sequence
atgatgcattttctaatcttat

SEQ ID NO: 40245 - DNA, 22 bp, Artificial sequence
  SiRNA target sequence
tgatgcattttctaatcttata

SEQ ID NO: 40246 - DNA, 22 bp, Artificial sequence
  SiRNA target sequence
gatgcattttctaatcttatat

SEQ ID NO: 40247 - DNA, 22 bp, Artificial sequence
  SiRNA target sequence
atgcattttctaatcttatatc

SEQ ID NO: 40248 - DNA, 22 bp, Artificial sequence
  SiRNA target sequence
tgcattttctaatcttatatca

SEQ ID NO: 40249 - DNA, 22 bp, Artificial sequence
  SiRNA target sequence
gcattttctaatcttatatcat

SEQ ID NO: 40250 - DNA, 22 bp, Artificial sequence
  SiRNA target sequence
cattttctaatcttatatcatt

SEQ ID NO: 40251 - DNA, 22 bp, Artificial sequence
  SiRNA target sequence
attttctaatcttatatcatta

SEQ ID NO: 40252 - DNA, 22 bp, Artificial sequence
  SiRNA target sequence
ttttctaatcttatatcattat

SEQ ID NO: 40253 - DNA, 22 bp, Artificial sequence
  SiRNA target sequence
tttctaatcttatatcattatt

SEQ ID NO: 40254 - DNA, 22 bp, Artificial sequence
  SiRNA target sequence
ttctaatcttatatcattatta

SEQ ID NO: 40255 - DNA, 22 bp, Artificial sequence
  SiRNA target sequence
tctaatcttatatcattattaa

SEQ ID NO: 40256 - DNA, 22 bp, Artificial sequence
  SiRNA target sequence
ctaatcttatatcattattaaa

SEQ ID NO: 40257 - DNA, 22 bp, Artificial sequence
  SiRNA target sequence
taatcttatatcattattaaat

SEQ ID NO: 40258 - DNA, 22 bp, Artificial sequence
  SiRNA target sequence
aatcttatatcattattaaatt

SEQ ID NO: 40259 - DNA, 22 bp, Artificial sequence
  SiRNA target sequence
atcttatatcattattaaattc

SEQ ID NO: 40260 - DNA, 22 bp, Artificial sequence
  SiRNA target sequence
tcttatatcattattaaattca

SEQ ID NO: 40261 - DNA, 22 bp, Artificial sequence
  SiRNA target sequence
cttatatcattattaaattcat

SEQ ID NO: 40262 - DNA, 22 bp, Artificial sequence
  SiRNA target sequence
ttatatcattattaaattcatt

SEQ ID NO: 40263 - DNA, 22 bp, Artificial sequence
  SiRNA target sequence
tatatcattattaaattcatta

SEQ ID NO: 40264 - DNA, 22 bp, Artificial sequence
  SiRNA target sequence
atatcattattaaattcattaa

SEQ ID NO: 40265 - DNA, 22 bp, Artificial sequence
  SiRNA target sequence
tatcattattaaattcattaac

SEQ ID NO: 40266 - DNA, 22 bp, Artificial sequence
  SiRNA target sequence
atcattattaaattcattaaca

SEQ ID NO: 40267 - DNA, 22 bp, Artificial sequence
  SiRNA target sequence
tcattattaaattcattaacat

SEQ ID NO: 40268 - DNA, 22 bp, Artificial sequence
  SiRNA target sequence
cattattaaattcattaacatc

SEQ ID NO: 40269 - DNA, 22 bp, Artificial sequence
  SiRNA target sequence
attattaaattcattaacatct

SEQ ID NO: 40270 - DNA, 22 bp, Artificial sequence
  SiRNA target sequence
ttattaaattcattaacatcta

SEQ ID NO: 40271 - DNA, 22 bp, Artificial sequence
  SiRNA target sequence
tattaaattcattaacatctac

SEQ ID NO: 40272 - DNA, 22 bp, Artificial sequence
  SiRNA target sequence
attaaattcattaacatctact

SEQ ID NO: 40273 - DNA, 22 bp, Artificial sequence
  SiRNA target sequence
ttaaattcattaacatctacta

SEQ ID NO: 40274 - DNA, 22 bp, Artificial sequence
  SiRNA target sequence
taaattcattaacatctactaa

SEQ ID NO: 40275 - DNA, 22 bp, Artificial sequence
  SiRNA target sequence
aaattcattaacatctactaaa

SEQ ID NO: 40276 - DNA, 22 bp, Artificial sequence
  SiRNA target sequence
aattcattaacatctactaaat

SEQ ID NO: 40277 - DNA, 22 bp, Artificial sequence
  SiRNA target sequence
attcattaacatctactaaatt

SEQ ID NO: 40278 - DNA, 22 bp, Artificial sequence
  SiRNA target sequence
ttcattaacatctactaaattt

SEQ ID NO: 40279 - DNA, 22 bp, Artificial sequence
  SiRNA target sequence
tcattaacatctactaaatttg

SEQ ID NO: 40280 - DNA, 22 bp, Artificial sequence
  SiRNA target sequence
cattaacatctactaaatttgg

SEQ ID NO: 40281 - DNA, 22 bp, Artificial sequence
  SiRNA target sequence
attaacatctactaaatttggt

SEQ ID NO: 40282 - DNA, 22 bp, Artificial sequence
  SiRNA target sequence
ttaacatctactaaatttggtt

SEQ ID NO: 40283 - DNA, 22 bp, Artificial sequence
  SiRNA target sequence
taacatctactaaatttggttc

SEQ ID NO: 40284 - DNA, 22 bp, Artificial sequence
  SiRNA target sequence
aacatctactaaatttggttct

SEQ ID NO: 40285 - DNA, 22 bp, Artificial sequence
  SiRNA target sequence
acatctactaaatttggttctt

SEQ ID NO: 40286 - DNA, 22 bp, Artificial sequence
  SiRNA target sequence
catctactaaatttggttcttc

SEQ ID NO: 40287 - DNA, 22 bp, Artificial sequence
  SiRNA target sequence
atctactaaatttggttcttct

SEQ ID NO: 40288 - DNA, 22 bp, Artificial sequence
  SiRNA target sequence
tctactaaatttggttcttctt

SEQ ID NO: 40289 - DNA, 22 bp, Artificial sequence
  SiRNA target sequence
ctactaaatttggttcttcttt

SEQ ID NO: 40290 - DNA, 22 bp, Artificial sequence
  SiRNA target sequence
tactaaatttggttcttctttt

SEQ ID NO: 40291 - DNA, 22 bp, Artificial sequence
  SiRNA target sequence
actaaatttggttcttctttta

SEQ ID NO: 40292 - DNA, 22 bp, Artificial sequence
  SiRNA target sequence
ctaaatttggttcttcttttat

SEQ ID NO: 40293 - DNA, 22 bp, Artificial sequence
  SiRNA target sequence
taaatttggttcttcttttata

SEQ ID NO: 40294 - DNA, 22 bp, Artificial sequence
  SiRNA target sequence
aaatttggttcttcttttataa

SEQ ID NO: 40295 - DNA, 22 bp, Artificial sequence
  SiRNA target sequence
aatttggttcttcttttataag

SEQ ID NO: 40296 - DNA, 22 bp, Artificial sequence
  SiRNA target sequence
atttggttcttcttttataagc

SEQ ID NO: 40297 - DNA, 22 bp, Artificial sequence
  SiRNA target sequence
tttggttcttcttttataagct

SEQ ID NO: 40298 - DNA, 22 bp, Artificial sequence
  SiRNA target sequence
ttggttcttcttttataagctc

SEQ ID NO: 40299 - DNA, 22 bp, Artificial sequence
  SiRNA target sequence
tggttcttcttttataagctct

SEQ ID NO: 40300 - DNA, 22 bp, Artificial sequence
  SiRNA target sequence
ggttcttcttttataagctctg

SEQ ID NO: 40301 - DNA, 22 bp, Artificial sequence
  SiRNA target sequence
gttcttcttttataagctctgg

SEQ ID NO: 40302 - DNA, 22 bp, Artificial sequence
  SiRNA target sequence
ttcttcttttataagctctggt

SEQ ID NO: 40303 - DNA, 22 bp, Artificial sequence
  SiRNA target sequence
tcttcttttataagctctggtt

SEQ ID NO: 40304 - DNA, 22 bp, Artificial sequence
  SiRNA target sequence
cttcttttataagctctggttt

SEQ ID NO: 40305 - DNA, 22 bp, Artificial sequence
  SiRNA target sequence
ttcttttataagctctggttta

SEQ ID NO: 40306 - DNA, 22 bp, Artificial sequence
  SiRNA target sequence
tcttttataagctctggtttaa

SEQ ID NO: 40307 - DNA, 22 bp, Artificial sequence
  SiRNA target sequence
cttttataagctctggtttaaa

SEQ ID NO: 40308 - DNA, 22 bp, Artificial sequence
  SiRNA target sequence
ttttataagctctggtttaaaa

SEQ ID NO: 40309 - DNA, 22 bp, Artificial sequence
  SiRNA target sequence
tttataagctctggtttaaaag

SEQ ID NO: 40310 - DNA, 22 bp, Artificial sequence
  SiRNA target sequence
ttataagctctggtttaaaaga

SEQ ID NO: 40311 - DNA, 22 bp, Artificial sequence
  SiRNA target sequence
tataagctctggtttaaaagat

SEQ ID NO: 40312 - DNA, 22 bp, Artificial sequence
  SiRNA target sequence
ataagctctggtttaaaagatg

SEQ ID NO: 40313 - DNA, 22 bp, Artificial sequence
  SiRNA target sequence
taagctctggtttaaaagatgt

SEQ ID NO: 40314 - DNA, 22 bp, Artificial sequence
  SiRNA target sequence
aagctctggtttaaaagatgtt

SEQ ID NO: 40315 - DNA, 22 bp, Artificial sequence
  SiRNA target sequence
agctctggtttaaaagatgttc

SEQ ID NO: 40316 - DNA, 22 bp, Artificial sequence
  SiRNA target sequence
gctctggtttaaaagatgttct

SEQ ID NO: 40317 - DNA, 22 bp, Artificial sequence
  SiRNA target sequence
ctctggtttaaaagatgttctt

SEQ ID NO: 40318 - DNA, 22 bp, Artificial sequence
  SiRNA target sequence
tctggtttaaaagatgttctta

SEQ ID NO: 40319 - DNA, 22 bp, Artificial sequence
  SiRNA target sequence
ctggtttaaaagatgttcttat

SEQ ID NO: 40320 - DNA, 22 bp, Artificial sequence
  SiRNA target sequence
tggtttaaaagatgttcttata

SEQ ID NO: 40321 - DNA, 22 bp, Artificial sequence
  SiRNA target sequence
ggtttaaaagatgttcttatat

SEQ ID NO: 40322 - DNA, 22 bp, Artificial sequence
  SiRNA target sequence
gtttaaaagatgttcttatatt

SEQ ID NO: 40323 - DNA, 22 bp, Artificial sequence
  SiRNA target sequence
tttaaaagatgttcttatattt

SEQ ID NO: 40324 - DNA, 22 bp, Artificial sequence
  SiRNA target sequence
ttaaaagatgttcttatattta

SEQ ID NO: 40325 - DNA, 22 bp, Artificial sequence
  SiRNA target sequence
taaaagatgttcttatatttaa

SEQ ID NO: 40326 - DNA, 22 bp, Artificial sequence
  SiRNA target sequence
aaaagatgttcttatatttaag

SEQ ID NO: 40327 - DNA, 22 bp, Artificial sequence
  SiRNA target sequence
aaagatgttcttatatttaaga

SEQ ID NO: 40328 - DNA, 22 bp, Artificial sequence
  SiRNA target sequence
aagatgttcttatatttaagat

SEQ ID NO: 40329 - DNA, 22 bp, Artificial sequence
  SiRNA target sequence
agatgttcttatatttaagatt

SEQ ID NO: 40330 - DNA, 22 bp, Artificial sequence
  SiRNA target sequence
gatgttcttatatttaagattg

SEQ ID NO: 40331 - DNA, 22 bp, Artificial sequence
  SiRNA target sequence
atgttcttatatttaagattgc

SEQ ID NO: 40332 - DNA, 22 bp, Artificial sequence
  SiRNA target sequence
tgttcttatatttaagattgct

SEQ ID NO: 40333 - DNA, 22 bp, Artificial sequence
  SiRNA target sequence
gttcttatatttaagattgctt

SEQ ID NO: 40334 - DNA, 22 bp, Artificial sequence
  SiRNA target sequence
ttcttatatttaagattgcttg

SEQ ID NO: 40335 - DNA, 22 bp, Artificial sequence
  SiRNA target sequence
tcttatatttaagattgcttgt

SEQ ID NO: 40336 - DNA, 22 bp, Artificial sequence
  SiRNA target sequence
cttatatttaagattgcttgtg

SEQ ID NO: 40337 - DNA, 22 bp, Artificial sequence
  SiRNA target sequence
ttatatttaagattgcttgtgt

SEQ ID NO: 40338 - DNA, 22 bp, Artificial sequence
  SiRNA target sequence
tatatttaagattgcttgtgta

SEQ ID NO: 40339 - DNA, 22 bp, Artificial sequence
  SiRNA target sequence
atatttaagattgcttgtgtat

SEQ ID NO: 40340 - DNA, 22 bp, Artificial sequence
  SiRNA target sequence
tatttaagattgcttgtgtata

SEQ ID NO: 40341 - DNA, 22 bp, Artificial sequence
  SiRNA target sequence
atttaagattgcttgtgtatat

SEQ ID NO: 40342 - DNA, 22 bp, Artificial sequence
  SiRNA target sequence
tttaagattgcttgtgtatatc

SEQ ID NO: 40343 - DNA, 22 bp, Artificial sequence
  SiRNA target sequence
ttaagattgcttgtgtatatcg

SEQ ID NO: 40344 - DNA, 22 bp, Artificial sequence
  SiRNA target sequence
taagattgcttgtgtatatcgt

SEQ ID NO: 40345 - DNA, 22 bp, Artificial sequence
  SiRNA target sequence
aagattgcttgtgtatatcgtg

SEQ ID NO: 40346 - DNA, 22 bp, Artificial sequence
  SiRNA target sequence
agattgcttgtgtatatcgtga

SEQ ID NO: 40347 - DNA, 22 bp, Artificial sequence
  SiRNA target sequence
gattgcttgtgtatatcgtgag

SEQ ID NO: 40348 - DNA, 22 bp, Artificial sequence
  SiRNA target sequence
attgcttgtgtatatcgtgagt

SEQ ID NO: 40349 - DNA, 22 bp, Artificial sequence
  SiRNA target sequence
ttgcttgtgtatatcgtgagta

SEQ ID NO: 40350 - DNA, 22 bp, Artificial sequence
  SiRNA target sequence
tgcttgtgtatatcgtgagtaa

SEQ ID NO: 40351 - DNA, 22 bp, Artificial sequence
  SiRNA target sequence
gcttgtgtatatcgtgagtaaa

SEQ ID NO: 40352 - DNA, 22 bp, Artificial sequence
  SiRNA target sequence
cttgtgtatatcgtgagtaaaa

SEQ ID NO: 40353 - DNA, 22 bp, Artificial sequence
  SiRNA target sequence
ttgtgtatatcgtgagtaaaag

SEQ ID NO: 40354 - DNA, 22 bp, Artificial sequence
  SiRNA target sequence
tgtgtatatcgtgagtaaaaga

SEQ ID NO: 40355 - DNA, 22 bp, Artificial sequence
  SiRNA target sequence
gtgtatatcgtgagtaaaagaa

SEQ ID NO: 40356 - DNA, 22 bp, Artificial sequence
  SiRNA target sequence
tgtatatcgtgagtaaaagaac

SEQ ID NO: 40357 - DNA, 22 bp, Artificial sequence
  SiRNA target sequence
gtatatcgtgagtaaaagaacc

SEQ ID NO: 40358 - DNA, 22 bp, Artificial sequence
  SiRNA target sequence
tatatcgtgagtaaaagaaccc

SEQ ID NO: 40359 - DNA, 22 bp, Artificial sequence
  SiRNA target sequence
atatcgtgagtaaaagaaccct

SEQ ID NO: 40360 - DNA, 22 bp, Artificial sequence
  SiRNA target sequence
tatcgtgagtaaaagaacccta

SEQ ID NO: 40361 - DNA, 22 bp, Artificial sequence
  SiRNA target sequence
atcgtgagtaaaagaaccctaa

SEQ ID NO: 40362 - DNA, 22 bp, Artificial sequence
  SiRNA target sequence
tcgtgagtaaaagaaccctaat

SEQ ID NO: 40363 - DNA, 22 bp, Artificial sequence
  SiRNA target sequence
cgtgagtaaaagaaccctaatt

SEQ ID NO: 40364 - DNA, 22 bp, Artificial sequence
  SiRNA target sequence
gtgagtaaaagaaccctaattg

SEQ ID NO: 40365 - DNA, 22 bp, Artificial sequence
  SiRNA target sequence
tgagtaaaagaaccctaattgt

SEQ ID NO: 40366 - DNA, 22 bp, Artificial sequence
  SiRNA target sequence
gagtaaaagaaccctaattgtc

SEQ ID NO: 40367 - DNA, 22 bp, Artificial sequence
  SiRNA target sequence
agtaaaagaaccctaattgtcc

SEQ ID NO: 40368 - DNA, 22 bp, Artificial sequence
  SiRNA target sequence
gtaaaagaaccctaattgtcca

SEQ ID NO: 40369 - DNA, 22 bp, Artificial sequence
  SiRNA target sequence
taaaagaaccctaattgtccaa

SEQ ID NO: 40370 - DNA, 22 bp, Artificial sequence
  SiRNA target sequence
aaaagaaccctaattgtccaaa

SEQ ID NO: 40371 - DNA, 22 bp, Artificial sequence
  SiRNA target sequence
aaagaaccctaattgtccaaaa

SEQ ID NO: 40372 - DNA, 22 bp, Artificial sequence
  SiRNA target sequence
aagaaccctaattgtccaaaac

SEQ ID NO: 40373 - DNA, 22 bp, Artificial sequence
  SiRNA target sequence
agaaccctaattgtccaaaact

SEQ ID NO: 40374 - DNA, 22 bp, Artificial sequence
  SiRNA target sequence
gaaccctaattgtccaaaactt

SEQ ID NO: 40375 - DNA, 22 bp, Artificial sequence
  SiRNA target sequence
aaccctaattgtccaaaacttg

SEQ ID NO: 40376 - DNA, 22 bp, Artificial sequence
  SiRNA target sequence
accctaattgtccaaaacttga

SEQ ID NO: 40377 - DNA, 22 bp, Artificial sequence
  SiRNA target sequence
ccctaattgtccaaaacttgaa

SEQ ID NO: 40378 - DNA, 22 bp, Artificial sequence
  SiRNA target sequence
cctaattgtccaaaacttgaat

SEQ ID NO: 40379 - DNA, 22 bp, Artificial sequence
  SiRNA target sequence
ctaattgtccaaaacttgaata

SEQ ID NO: 40380 - DNA, 22 bp, Artificial sequence
  SiRNA target sequence
taattgtccaaaacttgaatac

SEQ ID NO: 40381 - DNA, 22 bp, Artificial sequence
  SiRNA target sequence
aattgtccaaaacttgaataca

SEQ ID NO: 40382 - DNA, 22 bp, Artificial sequence
  SiRNA target sequence
attgtccaaaacttgaatacaa

SEQ ID NO: 40383 - DNA, 22 bp, Artificial sequence
  SiRNA target sequence
ttgtccaaaacttgaatacaat

SEQ ID NO: 40384 - DNA, 22 bp, Artificial sequence
  SiRNA target sequence
tgtccaaaacttgaatacaatg

SEQ ID NO: 40385 - DNA, 22 bp, Artificial sequence
  SiRNA target sequence
gtccaaaacttgaatacaatgt

SEQ ID NO: 40386 - DNA, 22 bp, Artificial sequence
  SiRNA target sequence
tccaaaacttgaatacaatgtt

SEQ ID NO: 40387 - DNA, 22 bp, Artificial sequence
  SiRNA target sequence
ccaaaacttgaatacaatgttc

SEQ ID NO: 40388 - DNA, 22 bp, Artificial sequence
  SiRNA target sequence
caaaacttgaatacaatgttct

SEQ ID NO: 40389 - DNA, 22 bp, Artificial sequence
  SiRNA target sequence
aaaacttgaatacaatgttcta

SEQ ID NO: 40390 - DNA, 22 bp, Artificial sequence
  SiRNA target sequence
aaacttgaatacaatgttctat

SEQ ID NO: 40391 - DNA, 22 bp, Artificial sequence
  SiRNA target sequence
aacttgaatacaatgttctatt

SEQ ID NO: 40392 - DNA, 22 bp, Artificial sequence
  SiRNA target sequence
acttgaatacaatgttctatta

SEQ ID NO: 40393 - DNA, 22 bp, Artificial sequence
  SiRNA target sequence
cttgaatacaatgttctattaa

SEQ ID NO: 40394 - DNA, 22 bp, Artificial sequence
  SiRNA target sequence
ttgaatacaatgttctattaat

SEQ ID NO: 40395 - DNA, 22 bp, Artificial sequence
  SiRNA target sequence
tgaatacaatgttctattaatg

SEQ ID NO: 40396 - DNA, 22 bp, Artificial sequence
  SiRNA target sequence
gaatacaatgttctattaatgc

SEQ ID NO: 40397 - DNA, 22 bp, Artificial sequence
  SiRNA target sequence
aatacaatgttctattaatgcc

SEQ ID NO: 40398 - DNA, 22 bp, Artificial sequence
  SiRNA target sequence
atacaatgttctattaatgcca

SEQ ID NO: 40399 - DNA, 22 bp, Artificial sequence
  SiRNA target sequence
tacaatgttctattaatgccaa

SEQ ID NO: 40400 - DNA, 22 bp, Artificial sequence
  SiRNA target sequence
acaatgttctattaatgccaat

SEQ ID NO: 40401 - DNA, 22 bp, Artificial sequence
  SiRNA target sequence
caatgttctattaatgccaata

SEQ ID NO: 40402 - DNA, 22 bp, Artificial sequence
  SiRNA target sequence
aatgttctattaatgccaatat

SEQ ID NO: 40403 - DNA, 22 bp, Artificial sequence
  SiRNA target sequence
atgttctattaatgccaatata

SEQ ID NO: 40404 - DNA, 22 bp, Artificial sequence
  SiRNA target sequence
tgttctattaatgccaatataa

SEQ ID NO: 40405 - DNA, 22 bp, Artificial sequence
  SiRNA target sequence
gttctattaatgccaatataaa

SEQ ID NO: 40406 - DNA, 22 bp, Artificial sequence
  SiRNA target sequence
ttctattaatgccaatataaaa

SEQ ID NO: 40407 - DNA, 22 bp, Artificial sequence
  SiRNA target sequence
tctattaatgccaatataaaat

SEQ ID NO: 40408 - DNA, 22 bp, Artificial sequence
  SiRNA target sequence
ctattaatgccaatataaaata

SEQ ID NO: 40409 - DNA, 22 bp, Artificial sequence
  SiRNA target sequence
tattaatgccaatataaaatac

SEQ ID NO: 40410 - DNA, 22 bp, Artificial sequence
  SiRNA target sequence
attaatgccaatataaaataca

SEQ ID NO: 40411 - DNA, 22 bp, Artificial sequence
  SiRNA target sequence
ttaatgccaatataaaatacaa

SEQ ID NO: 40412 - DNA, 22 bp, Artificial sequence
  SiRNA target sequence
taatgccaatataaaatacaac

SEQ ID NO: 40413 - DNA, 22 bp, Artificial sequence
  SiRNA target sequence
aatgccaatataaaatacaaca

SEQ ID NO: 40414 - DNA, 22 bp, Artificial sequence
  SiRNA target sequence
atgccaatataaaatacaacat

SEQ ID NO: 40415 - DNA, 22 bp, Artificial sequence
  SiRNA target sequence
tgccaatataaaatacaacatc

SEQ ID NO: 40416 - DNA, 22 bp, Artificial sequence
  SiRNA target sequence
gccaatataaaatacaacatcc

SEQ ID NO: 40417 - DNA, 22 bp, Artificial sequence
  SiRNA target sequence
ccaatataaaatacaacatccc

SEQ ID NO: 40418 - DNA, 22 bp, Artificial sequence
  SiRNA target sequence
caatataaaatacaacatccct

SEQ ID NO: 40419 - DNA, 22 bp, Artificial sequence
  SiRNA target sequence
aatataaaatacaacatccctg

SEQ ID NO: 40420 - DNA, 22 bp, Artificial sequence
  SiRNA target sequence
atataaaatacaacatccctgg

SEQ ID NO: 40421 - DNA, 22 bp, Artificial sequence
  SiRNA target sequence
tataaaatacaacatccctggc

SEQ ID NO: 40422 - DNA, 22 bp, Artificial sequence
  SiRNA target sequence
ataaaatacaacatccctggca

SEQ ID NO: 40423 - DNA, 22 bp, Artificial sequence
  SiRNA target sequence
taaaatacaacatccctggcac

SEQ ID NO: 40424 - DNA, 22 bp, Artificial sequence
  SiRNA target sequence
aaaatacaacatccctggcact

SEQ ID NO: 40425 - DNA, 22 bp, Artificial sequence
  SiRNA target sequence
aaatacaacatccctggcactt

SEQ ID NO: 40426 - DNA, 22 bp, Artificial sequence
  SiRNA target sequence
aatacaacatccctggcactta

SEQ ID NO: 40427 - DNA, 22 bp, Artificial sequence
  SiRNA target sequence
atacaacatccctggcacttag

SEQ ID NO: 40428 - DNA, 22 bp, Artificial sequence
  SiRNA target sequence
tacaacatccctggcacttagt

SEQ ID NO: 40429 - DNA, 22 bp, Artificial sequence
  SiRNA target sequence
acaacatccctggcacttagtt

SEQ ID NO: 40430 - DNA, 22 bp, Artificial sequence
  SiRNA target sequence
caacatccctggcacttagttt

SEQ ID NO: 40431 - DNA, 22 bp, Artificial sequence
  SiRNA target sequence
aacatccctggcacttagtttt

SEQ ID NO: 40432 - DNA, 22 bp, Artificial sequence
  SiRNA target sequence
acatccctggcacttagttttg

SEQ ID NO: 40433 - DNA, 22 bp, Artificial sequence
  SiRNA target sequence
catccctggcacttagttttgc

SEQ ID NO: 40434 - DNA, 22 bp, Artificial sequence
  SiRNA target sequence
atccctggcacttagttttgct

SEQ ID NO: 40435 - DNA, 22 bp, Artificial sequence
  SiRNA target sequence
tccctggcacttagttttgctg

SEQ ID NO: 40436 - DNA, 22 bp, Artificial sequence
  SiRNA target sequence
ccctggcacttagttttgctgt

SEQ ID NO: 40437 - DNA, 22 bp, Artificial sequence
  SiRNA target sequence
cctggcacttagttttgctgtt

SEQ ID NO: 40438 - DNA, 22 bp, Artificial sequence
  SiRNA target sequence
ctggcacttagttttgctgtta

SEQ ID NO: 40439 - DNA, 22 bp, Artificial sequence
  SiRNA target sequence
tggcacttagttttgctgttaa

SEQ ID NO: 40440 - DNA, 22 bp, Artificial sequence
  SiRNA target sequence
ggcacttagttttgctgttaat

SEQ ID NO: 40441 - DNA, 22 bp, Artificial sequence
  SiRNA target sequence
gcacttagttttgctgttaata

SEQ ID NO: 40442 - DNA, 22 bp, Artificial sequence
  SiRNA target sequence
cacttagttttgctgttaatat

SEQ ID NO: 40443 - DNA, 22 bp, Artificial sequence
  SiRNA target sequence
acttagttttgctgttaatatt

SEQ ID NO: 40444 - DNA, 22 bp, Artificial sequence
  SiRNA target sequence
cttagttttgctgttaatattc

SEQ ID NO: 40445 - DNA, 22 bp, Artificial sequence
  SiRNA target sequence
ttagttttgctgttaatattcc

SEQ ID NO: 40446 - DNA, 22 bp, Artificial sequence
  SiRNA target sequence
tagttttgctgttaatattcca

SEQ ID NO: 40447 - DNA, 22 bp, Artificial sequence
  SiRNA target sequence
agttttgctgttaatattccat

SEQ ID NO: 40448 - DNA, 22 bp, Artificial sequence
  SiRNA target sequence
gttttgctgttaatattccata

SEQ ID NO: 40449 - DNA, 22 bp, Artificial sequence
  SiRNA target sequence
ttttgctgttaatattccatag

SEQ ID NO: 40450 - DNA, 22 bp, Artificial sequence
  SiRNA target sequence
tttgctgttaatattccatagt

SEQ ID NO: 40451 - DNA, 22 bp, Artificial sequence
  SiRNA target sequence
ttgctgttaatattccatagtt

SEQ ID NO: 40452 - DNA, 22 bp, Artificial sequence
  SiRNA target sequence
tgctgttaatattccatagttt

SEQ ID NO: 40453 - DNA, 22 bp, Artificial sequence
  SiRNA target sequence
gctgttaatattccatagtttc

SEQ ID NO: 40454 - DNA, 22 bp, Artificial sequence
  SiRNA target sequence
ctgttaatattccatagtttcc

SEQ ID NO: 40455 - DNA, 22 bp, Artificial sequence
  SiRNA target sequence
tgttaatattccatagtttcct

SEQ ID NO: 40456 - DNA, 22 bp, Artificial sequence
  SiRNA target sequence
gttaatattccatagtttccta

SEQ ID NO: 40457 - DNA, 22 bp, Artificial sequence
  SiRNA target sequence
ttaatattccatagtttcctaa

SEQ ID NO: 40458 - DNA, 22 bp, Artificial sequence
  SiRNA target sequence
taatattccatagtttcctaat

SEQ ID NO: 40459 - DNA, 22 bp, Artificial sequence
  SiRNA target sequence
aatattccatagtttcctaatg

SEQ ID NO: 40460 - DNA, 22 bp, Artificial sequence
  SiRNA target sequence
atattccatagtttcctaatgt

SEQ ID NO: 40461 - DNA, 22 bp, Artificial sequence
  SiRNA target sequence
tattccatagtttcctaatgtt

SEQ ID NO: 40462 - DNA, 22 bp, Artificial sequence
  SiRNA target sequence
attccatagtttcctaatgtta

SEQ ID NO: 40463 - DNA, 22 bp, Artificial sequence
  SiRNA target sequence
ttccatagtttcctaatgttat

SEQ ID NO: 40464 - DNA, 22 bp, Artificial sequence
  SiRNA target sequence
tccatagtttcctaatgttata

SEQ ID NO: 40465 - DNA, 22 bp, Artificial sequence
  SiRNA target sequence
ccatagtttcctaatgttataa

SEQ ID NO: 40466 - DNA, 22 bp, Artificial sequence
  SiRNA target sequence
catagtttcctaatgttataac

SEQ ID NO: 40467 - DNA, 22 bp, Artificial sequence
  SiRNA target sequence
atagtttcctaatgttataact

SEQ ID NO: 40468 - DNA, 22 bp, Artificial sequence
  SiRNA target sequence
tagtttcctaatgttataacta

SEQ ID NO: 40469 - DNA, 22 bp, Artificial sequence
  SiRNA target sequence
agtttcctaatgttataactat

SEQ ID NO: 40470 - DNA, 22 bp, Artificial sequence
  SiRNA target sequence
gtttcctaatgttataactata

SEQ ID NO: 40471 - DNA, 22 bp, Artificial sequence
  SiRNA target sequence
tttcctaatgttataactataa

SEQ ID NO: 40472 - DNA, 22 bp, Artificial sequence
  SiRNA target sequence
ttcctaatgttataactataaa

SEQ ID NO: 40473 - DNA, 22 bp, Artificial sequence
  SiRNA target sequence
tcctaatgttataactataaaa

SEQ ID NO: 40474 - DNA, 22 bp, Artificial sequence
  SiRNA target sequence
cctaatgttataactataaaac

SEQ ID NO: 40475 - DNA, 22 bp, Artificial sequence
  SiRNA target sequence
ctaatgttataactataaaaca

SEQ ID NO: 40476 - DNA, 22 bp, Artificial sequence
  SiRNA target sequence
taatgttataactataaaacac

SEQ ID NO: 40477 - DNA, 22 bp, Artificial sequence
  SiRNA target sequence
aatgttataactataaaacact

SEQ ID NO: 40478 - DNA, 22 bp, Artificial sequence
  SiRNA target sequence
atgttataactataaaacactg

SEQ ID NO: 40479 - DNA, 22 bp, Artificial sequence
  SiRNA target sequence
tgttataactataaaacactgt

SEQ ID NO: 40480 - DNA, 22 bp, Artificial sequence
  SiRNA target sequence
gttataactataaaacactgta

SEQ ID NO: 40481 - DNA, 22 bp, Artificial sequence
  SiRNA target sequence
ttataactataaaacactgtaa

SEQ ID NO: 40482 - DNA, 22 bp, Artificial sequence
  SiRNA target sequence
tataactataaaacactgtaaa

SEQ ID NO: 40483 - DNA, 22 bp, Artificial sequence
  SiRNA target sequence
ataactataaaacactgtaaag

SEQ ID NO: 40484 - DNA, 22 bp, Artificial sequence
  SiRNA target sequence
taactataaaacactgtaaagc

SEQ ID NO: 40485 - DNA, 22 bp, Artificial sequence
  SiRNA target sequence
aactataaaacactgtaaagca

SEQ ID NO: 40486 - DNA, 22 bp, Artificial sequence
  SiRNA target sequence
actataaaacactgtaaagcaa

SEQ ID NO: 40487 - DNA, 22 bp, Artificial sequence
  SiRNA target sequence
ctataaaacactgtaaagcaaa

SEQ ID NO: 40488 - DNA, 22 bp, Artificial sequence
  SiRNA target sequence
tataaaacactgtaaagcaaaa

SEQ ID NO: 40489 - DNA, 22 bp, Artificial sequence
  SiRNA target sequence
ataaaacactgtaaagcaaaaa

SEQ ID NO: 40490 - DNA, 22 bp, Artificial sequence
  SiRNA target sequence
taaaacactgtaaagcaaaaat

SEQ ID NO: 40491 - DNA, 22 bp, Artificial sequence
  SiRNA target sequence
aaaacactgtaaagcaaaaatt

SEQ ID NO: 40492 - DNA, 22 bp, Artificial sequence
  SiRNA target sequence
aaacactgtaaagcaaaaatta

SEQ ID NO: 40493 - DNA, 22 bp, Artificial sequence
  SiRNA target sequence
aacactgtaaagcaaaaattat

SEQ ID NO: 40494 - DNA, 22 bp, Artificial sequence
  SiRNA target sequence
acactgtaaagcaaaaattatc

SEQ ID NO: 40495 - DNA, 22 bp, Artificial sequence
  SiRNA target sequence
cactgtaaagcaaaaattatct

SEQ ID NO: 40496 - DNA, 22 bp, Artificial sequence
  SiRNA target sequence
actgtaaagcaaaaattatctt

SEQ ID NO: 40497 - DNA, 22 bp, Artificial sequence
  SiRNA target sequence
ctgtaaagcaaaaattatctta

SEQ ID NO: 40498 - DNA, 22 bp, Artificial sequence
  SiRNA target sequence
tgtaaagcaaaaattatcttat

SEQ ID NO: 40499 - DNA, 22 bp, Artificial sequence
  SiRNA target sequence
gtaaagcaaaaattatcttatt

SEQ ID NO: 40500 - DNA, 22 bp, Artificial sequence
  SiRNA target sequence
taaagcaaaaattatcttattt

SEQ ID NO: 40501 - DNA, 22 bp, Artificial sequence
  SiRNA target sequence
aaagcaaaaattatcttattta

SEQ ID NO: 40502 - DNA, 22 bp, Artificial sequence
  SiRNA target sequence
aagcaaaaattatcttatttac

SEQ ID NO: 40503 - DNA, 22 bp, Artificial sequence
  SiRNA target sequence
agcaaaaattatcttatttaca

SEQ ID NO: 40504 - DNA, 22 bp, Artificial sequence
  SiRNA target sequence
gcaaaaattatcttatttacaa

SEQ ID NO: 40505 - DNA, 22 bp, Artificial sequence
  SiRNA target sequence
caaaaattatcttatttacaag

SEQ ID NO: 40506 - DNA, 22 bp, Artificial sequence
  SiRNA target sequence
aaaaattatcttatttacaagg

SEQ ID NO: 40507 - DNA, 22 bp, Artificial sequence
  SiRNA target sequence
aaaattatcttatttacaaggt

SEQ ID NO: 40508 - DNA, 22 bp, Artificial sequence
  SiRNA target sequence
aaattatcttatttacaaggta

SEQ ID NO: 40509 - DNA, 22 bp, Artificial sequence
  SiRNA target sequence
aattatcttatttacaaggtat

SEQ ID NO: 40510 - DNA, 22 bp, Artificial sequence
  SiRNA target sequence
attatcttatttacaaggtata

SEQ ID NO: 40511 - DNA, 22 bp, Artificial sequence
  SiRNA target sequence
ttatcttatttacaaggtataa

SEQ ID NO: 40512 - DNA, 22 bp, Artificial sequence
  SiRNA target sequence
tatcttatttacaaggtataaa

SEQ ID NO: 40513 - DNA, 22 bp, Artificial sequence
  SiRNA target sequence
atcttatttacaaggtataaaa

SEQ ID NO: 40514 - DNA, 22 bp, Artificial sequence
  SiRNA target sequence
tcttatttacaaggtataaaaa

SEQ ID NO: 40515 - DNA, 22 bp, Artificial sequence
  SiRNA target sequence
cttatttacaaggtataaaaaa

SEQ ID NO: 40516 - DNA, 22 bp, Artificial sequence
  SiRNA target sequence
ttatttacaaggtataaaaaac

SEQ ID NO: 40517 - DNA, 22 bp, Artificial sequence
  SiRNA target sequence
tatttacaaggtataaaaaact

SEQ ID NO: 40518 - DNA, 22 bp, Artificial sequence
  SiRNA target sequence
atttacaaggtataaaaaacta

SEQ ID NO: 40519 - DNA, 22 bp, Artificial sequence
  SiRNA target sequence
tttacaaggtataaaaaactaa

SEQ ID NO: 40520 - DNA, 22 bp, Artificial sequence
  SiRNA target sequence
ttacaaggtataaaaaactaag

SEQ ID NO: 40521 - DNA, 22 bp, Artificial sequence
  SiRNA target sequence
tacaaggtataaaaaactaaga

SEQ ID NO: 40522 - DNA, 22 bp, Artificial sequence
  SiRNA target sequence
acaaggtataaaaaactaagag

SEQ ID NO: 40523 - DNA, 22 bp, Artificial sequence
  SiRNA target sequence
caaggtataaaaaactaagaga

SEQ ID NO: 40524 - DNA, 22 bp, Artificial sequence
  SiRNA target sequence
aaggtataaaaaactaagagat

SEQ ID NO: 40525 - DNA, 22 bp, Artificial sequence
  SiRNA target sequence
aggtataaaaaactaagagatc

SEQ ID NO: 40526 - DNA, 22 bp, Artificial sequence
  SiRNA target sequence
ggtataaaaaactaagagatct

SEQ ID NO: 40527 - DNA, 22 bp, Artificial sequence
  SiRNA target sequence
gtataaaaaactaagagatctc

SEQ ID NO: 40528 - DNA, 22 bp, Artificial sequence
  SiRNA target sequence
tataaaaaactaagagatctcc

SEQ ID NO: 40529 - DNA, 22 bp, Artificial sequence
  SiRNA target sequence
ataaaaaactaagagatctcca

SEQ ID NO: 40530 - DNA, 22 bp, Artificial sequence
  SiRNA target sequence
taaaaaactaagagatctccag

SEQ ID NO: 40531 - DNA, 22 bp, Artificial sequence
  SiRNA target sequence
aaaaaactaagagatctccaga

SEQ ID NO: 40532 - DNA, 22 bp, Artificial sequence
  SiRNA target sequence
aaaaactaagagatctccagat

SEQ ID NO: 40533 - DNA, 22 bp, Artificial sequence
  SiRNA target sequence
aaaactaagagatctccagatt

SEQ ID NO: 40534 - DNA, 22 bp, Artificial sequence
  SiRNA target sequence
aaactaagagatctccagattc

SEQ ID NO: 40535 - DNA, 22 bp, Artificial sequence
  SiRNA target sequence
aactaagagatctccagattct

SEQ ID NO: 40536 - DNA, 22 bp, Artificial sequence
  SiRNA target sequence
actaagagatctccagattctg

SEQ ID NO: 40537 - DNA, 22 bp, Artificial sequence
  SiRNA target sequence
ctaagagatctccagattctgt

SEQ ID NO: 40538 - DNA, 22 bp, Artificial sequence
  SiRNA target sequence
taagagatctccagattctgtt

SEQ ID NO: 40539 - DNA, 22 bp, Artificial sequence
  SiRNA target sequence
aagagatctccagattctgtta

SEQ ID NO: 40540 - DNA, 22 bp, Artificial sequence
  SiRNA target sequence
agagatctccagattctgttac

SEQ ID NO: 40541 - DNA, 22 bp, Artificial sequence
  SiRNA target sequence
gagatctccagattctgttaca

SEQ ID NO: 40542 - DNA, 22 bp, Artificial sequence
  SiRNA target sequence
agatctccagattctgttacat

SEQ ID NO: 40543 - DNA, 22 bp, Artificial sequence
  SiRNA target sequence
gatctccagattctgttacatt

SEQ ID NO: 40544 - DNA, 22 bp, Artificial sequence
  SiRNA target sequence
atctccagattctgttacattc

SEQ ID NO: 40545 - DNA, 22 bp, Artificial sequence
  SiRNA target sequence
tctccagattctgttacattcc

SEQ ID NO: 40546 - DNA, 22 bp, Artificial sequence
  SiRNA target sequence
ctccagattctgttacattccg

SEQ ID NO: 40547 - DNA, 22 bp, Artificial sequence
  SiRNA target sequence
tccagattctgttacattccga

SEQ ID NO: 40548 - DNA, 22 bp, Artificial sequence
  SiRNA target sequence
ccagattctgttacattccgat

SEQ ID NO: 40549 - DNA, 22 bp, Artificial sequence
  SiRNA target sequence
cagattctgttacattccgatt

SEQ ID NO: 40550 - DNA, 22 bp, Artificial sequence
  SiRNA target sequence
agattctgttacattccgattc

SEQ ID NO: 40551 - DNA, 22 bp, Artificial sequence
  SiRNA target sequence
gattctgttacattccgattct

SEQ ID NO: 40552 - DNA, 22 bp, Artificial sequence
  SiRNA target sequence
attctgttacattccgattcta

SEQ ID NO: 40553 - DNA, 22 bp, Artificial sequence
  SiRNA target sequence
ttctgttacattccgattctac

SEQ ID NO: 40554 - DNA, 22 bp, Artificial sequence
  SiRNA target sequence
tctgttacattccgattctact

SEQ ID NO: 40555 - DNA, 22 bp, Artificial sequence
  SiRNA target sequence
ctgttacattccgattctactt

SEQ ID NO: 40556 - DNA, 22 bp, Artificial sequence
  SiRNA target sequence
tgttacattccgattctacttc

SEQ ID NO: 40557 - DNA, 22 bp, Artificial sequence
  SiRNA target sequence
gttacattccgattctacttca

SEQ ID NO: 40558 - DNA, 22 bp, Artificial sequence
  SiRNA target sequence
ttacattccgattctacttcag

SEQ ID NO: 40559 - DNA, 22 bp, Artificial sequence
  SiRNA target sequence
tacattccgattctacttcaga

SEQ ID NO: 40560 - DNA, 22 bp, Artificial sequence
  SiRNA target sequence
acattccgattctacttcagaa

SEQ ID NO: 40561 - DNA, 22 bp, Artificial sequence
  SiRNA target sequence
cattccgattctacttcagaaa

SEQ ID NO: 40562 - DNA, 22 bp, Artificial sequence
  SiRNA target sequence
attccgattctacttcagaaac

SEQ ID NO: 40563 - DNA, 22 bp, Artificial sequence
  SiRNA target sequence
ttccgattctacttcagaaaca

SEQ ID NO: 40564 - DNA, 22 bp, Artificial sequence
  SiRNA target sequence
tccgattctacttcagaaacat

SEQ ID NO: 40565 - DNA, 22 bp, Artificial sequence
  SiRNA target sequence
ccgattctacttcagaaacata

SEQ ID NO: 40566 - DNA, 22 bp, Artificial sequence
  SiRNA target sequence
cgattctacttcagaaacatat

SEQ ID NO: 40567 - DNA, 22 bp, Artificial sequence
  SiRNA target sequence
gattctacttcagaaacatatt

SEQ ID NO: 40568 - DNA, 22 bp, Artificial sequence
  SiRNA target sequence
attctacttcagaaacatattt

SEQ ID NO: 40569 - DNA, 22 bp, Artificial sequence
  SiRNA target sequence
ttctacttcagaaacatatttt

SEQ ID NO: 40570 - DNA, 22 bp, Artificial sequence
  SiRNA target sequence
tctacttcagaaacatattttt

SEQ ID NO: 40571 - DNA, 22 bp, Artificial sequence
  SiRNA target sequence
ctacttcagaaacatatttttc

SEQ ID NO: 40572 - DNA, 22 bp, Artificial sequence
  SiRNA target sequence
tacttcagaaacatatttttca

SEQ ID NO: 40573 - DNA, 22 bp, Artificial sequence
  SiRNA target sequence
acttcagaaacatatttttcat

SEQ ID NO: 40574 - DNA, 22 bp, Artificial sequence
  SiRNA target sequence
cttcagaaacatatttttcata

SEQ ID NO: 40575 - DNA, 22 bp, Artificial sequence
  SiRNA target sequence
ttcagaaacatatttttcatat

SEQ ID NO: 40576 - DNA, 22 bp, Artificial sequence
  SiRNA target sequence
tcagaaacatatttttcatatt

SEQ ID NO: 40577 - DNA, 22 bp, Artificial sequence
  SiRNA target sequence
cagaaacatatttttcatattt

SEQ ID NO: 40578 - DNA, 22 bp, Artificial sequence
  SiRNA target sequence
agaaacatatttttcatattta

SEQ ID NO: 40579 - DNA, 22 bp, Artificial sequence
  SiRNA target sequence
gaaacatatttttcatatttaa

SEQ ID NO: 40580 - DNA, 22 bp, Artificial sequence
  SiRNA target sequence
aaacatatttttcatatttaag

SEQ ID NO: 40581 - DNA, 22 bp, Artificial sequence
  SiRNA target sequence
aacatatttttcatatttaagc

SEQ ID NO: 40582 - DNA, 22 bp, Artificial sequence
  SiRNA target sequence
acatatttttcatatttaagcg

SEQ ID NO: 40583 - DNA, 22 bp, Artificial sequence
  SiRNA target sequence
catatttttcatatttaagcga

SEQ ID NO: 40584 - DNA, 22 bp, Artificial sequence
  SiRNA target sequence
atatttttcatatttaagcgat

SEQ ID NO: 40585 - DNA, 22 bp, Artificial sequence
  SiRNA target sequence
tatttttcatatttaagcgatt

SEQ ID NO: 40586 - DNA, 22 bp, Artificial sequence
  SiRNA target sequence
atttttcatatttaagcgattc

SEQ ID NO: 40587 - DNA, 22 bp, Artificial sequence
  SiRNA target sequence
tttttcatatttaagcgattct

SEQ ID NO: 40588 - DNA, 22 bp, Artificial sequence
  SiRNA target sequence
ttttcatatttaagcgattctt

SEQ ID NO: 40589 - DNA, 22 bp, Artificial sequence
  SiRNA target sequence
tttcatatttaagcgattcttc

SEQ ID NO: 40590 - DNA, 22 bp, Artificial sequence
  SiRNA target sequence
ttcatatttaagcgattcttct

SEQ ID NO: 40591 - DNA, 22 bp, Artificial sequence
  SiRNA target sequence
tcatatttaagcgattcttctt

SEQ ID NO: 40592 - DNA, 22 bp, Artificial sequence
  SiRNA target sequence
catatttaagcgattcttcttc

SEQ ID NO: 40593 - DNA, 22 bp, Artificial sequence
  SiRNA target sequence
atatttaagcgattcttcttct

SEQ ID NO: 40594 - DNA, 22 bp, Artificial sequence
  SiRNA target sequence
tatttaagcgattcttcttctt

SEQ ID NO: 40595 - DNA, 22 bp, Artificial sequence
  SiRNA target sequence
atttaagcgattcttcttcttc

SEQ ID NO: 40596 - DNA, 22 bp, Artificial sequence
  SiRNA target sequence
tttaagcgattcttcttcttct

SEQ ID NO: 40597 - DNA, 22 bp, Artificial sequence
  SiRNA target sequence
ttaagcgattcttcttcttctg

SEQ ID NO: 40598 - DNA, 22 bp, Artificial sequence
  SiRNA target sequence
taagcgattcttcttcttctgt

SEQ ID NO: 40599 - DNA, 22 bp, Artificial sequence
  SiRNA target sequence
aagcgattcttcttcttctgtt

SEQ ID NO: 40600 - DNA, 22 bp, Artificial sequence
  SiRNA target sequence
agcgattcttcttcttctgttt

SEQ ID NO: 40601 - DNA, 22 bp, Artificial sequence
  SiRNA target sequence
gcgattcttcttcttctgtttt

SEQ ID NO: 40602 - DNA, 22 bp, Artificial sequence
  SiRNA target sequence
cgattcttcttcttctgtttta

SEQ ID NO: 40603 - DNA, 22 bp, Artificial sequence
  SiRNA target sequence
gattcttcttcttctgttttat

SEQ ID NO: 40604 - DNA, 22 bp, Artificial sequence
  SiRNA target sequence
attcttcttcttctgttttata

SEQ ID NO: 40605 - DNA, 22 bp, Artificial sequence
  SiRNA target sequence
ttcttcttcttctgttttatat

SEQ ID NO: 40606 - DNA, 22 bp, Artificial sequence
  SiRNA target sequence
tcttcttcttctgttttatatg

SEQ ID NO: 40607 - DNA, 22 bp, Artificial sequence
  SiRNA target sequence
cttcttcttctgttttatatgc

SEQ ID NO: 40608 - DNA, 22 bp, Artificial sequence
  SiRNA target sequence
ttcttcttctgttttatatgct

SEQ ID NO: 40609 - DNA, 22 bp, Artificial sequence
  SiRNA target sequence
tcttcttctgttttatatgcta

SEQ ID NO: 40610 - DNA, 22 bp, Artificial sequence
  SiRNA target sequence
cttcttctgttttatatgctag

SEQ ID NO: 40611 - DNA, 22 bp, Artificial sequence
  SiRNA target sequence
ttcttctgttttatatgctagt

SEQ ID NO: 40612 - DNA, 22 bp, Artificial sequence
  SiRNA target sequence
tcttctgttttatatgctagta

SEQ ID NO: 40613 - DNA, 22 bp, Artificial sequence
  SiRNA target sequence
cttctgttttatatgctagtat

SEQ ID NO: 40614 - DNA, 22 bp, Artificial sequence
  SiRNA target sequence
ttctgttttatatgctagtata

SEQ ID NO: 40615 - DNA, 22 bp, Artificial sequence
  SiRNA target sequence
tctgttttatatgctagtatag

SEQ ID NO: 40616 - DNA, 22 bp, Artificial sequence
  SiRNA target sequence
ctgttttatatgctagtatagt

SEQ ID NO: 40617 - DNA, 22 bp, Artificial sequence
  SiRNA target sequence
tgttttatatgctagtatagtc

SEQ ID NO: 40618 - DNA, 22 bp, Artificial sequence
  SiRNA target sequence
gttttatatgctagtatagtct

SEQ ID NO: 40619 - DNA, 22 bp, Artificial sequence
  SiRNA target sequence
ttttatatgctagtatagtctc

SEQ ID NO: 40620 - DNA, 22 bp, Artificial sequence
  SiRNA target sequence
tttatatgctagtatagtctca

SEQ ID NO: 40621 - DNA, 22 bp, Artificial sequence
  SiRNA target sequence
ttatatgctagtatagtctcat

SEQ ID NO: 40622 - DNA, 22 bp, Artificial sequence
  SiRNA target sequence
tatatgctagtatagtctcatg

SEQ ID NO: 40623 - DNA, 22 bp, Artificial sequence
  SiRNA target sequence
atatgctagtatagtctcatga

SEQ ID NO: 40624 - DNA, 22 bp, Artificial sequence
  SiRNA target sequence
tatgctagtatagtctcatgat

SEQ ID NO: 40625 - DNA, 22 bp, Artificial sequence
  SiRNA target sequence
atgctagtatagtctcatgatt

SEQ ID NO: 40626 - DNA, 22 bp, Artificial sequence
  SiRNA target sequence
tgctagtatagtctcatgatta

SEQ ID NO: 40627 - DNA, 22 bp, Artificial sequence
  SiRNA target sequence
gctagtatagtctcatgattaa

SEQ ID NO: 40628 - DNA, 22 bp, Artificial sequence
  SiRNA target sequence
ctagtatagtctcatgattaat

SEQ ID NO: 40629 - DNA, 22 bp, Artificial sequence
  SiRNA target sequence
tagtatagtctcatgattaatt

SEQ ID NO: 40630 - DNA, 22 bp, Artificial sequence
  SiRNA target sequence
agtatagtctcatgattaatta

SEQ ID NO: 40631 - DNA, 22 bp, Artificial sequence
  SiRNA target sequence
gtatagtctcatgattaattaa

SEQ ID NO: 40632 - DNA, 22 bp, Artificial sequence
  SiRNA target sequence
tatagtctcatgattaattaaa

SEQ ID NO: 40633 - DNA, 22 bp, Artificial sequence
  SiRNA target sequence
atagtctcatgattaattaaag

SEQ ID NO: 40634 - DNA, 22 bp, Artificial sequence
  SiRNA target sequence
tagtctcatgattaattaaaga

SEQ ID NO: 40635 - DNA, 22 bp, Artificial sequence
  SiRNA target sequence
agtctcatgattaattaaagaa

SEQ ID NO: 40636 - DNA, 22 bp, Artificial sequence
  SiRNA target sequence
gtctcatgattaattaaagaat

SEQ ID NO: 40637 - DNA, 22 bp, Artificial sequence
  SiRNA target sequence
tctcatgattaattaaagaatc

SEQ ID NO: 40638 - DNA, 22 bp, Artificial sequence
  SiRNA target sequence
ctcatgattaattaaagaatca

SEQ ID NO: 40639 - DNA, 22 bp, Artificial sequence
  SiRNA target sequence
tcatgattaattaaagaatcat

SEQ ID NO: 40640 - DNA, 22 bp, Artificial sequence
  SiRNA target sequence
catgattaattaaagaatcatg

SEQ ID NO: 40641 - DNA, 22 bp, Artificial sequence
  SiRNA target sequence
atgattaattaaagaatcatgt

SEQ ID NO: 40642 - DNA, 22 bp, Artificial sequence
  SiRNA target sequence
tgattaattaaagaatcatgta

SEQ ID NO: 40643 - DNA, 22 bp, Artificial sequence
  SiRNA target sequence
gattaattaaagaatcatgtaa

SEQ ID NO: 40644 - DNA, 22 bp, Artificial sequence
  SiRNA target sequence
attaattaaagaatcatgtaag

SEQ ID NO: 40645 - DNA, 22 bp, Artificial sequence
  SiRNA target sequence
ttaattaaagaatcatgtaagt

SEQ ID NO: 40646 - DNA, 22 bp, Artificial sequence
  SiRNA target sequence
taattaaagaatcatgtaagtg

SEQ ID NO: 40647 - DNA, 22 bp, Artificial sequence
  SiRNA target sequence
aattaaagaatcatgtaagtga

SEQ ID NO: 40648 - DNA, 22 bp, Artificial sequence
  SiRNA target sequence
attaaagaatcatgtaagtgat

SEQ ID NO: 40649 - DNA, 22 bp, Artificial sequence
  SiRNA target sequence
ttaaagaatcatgtaagtgatt

SEQ ID NO: 40650 - DNA, 22 bp, Artificial sequence
  SiRNA target sequence
taaagaatcatgtaagtgattt

SEQ ID NO: 40651 - DNA, 22 bp, Artificial sequence
  SiRNA target sequence
aaagaatcatgtaagtgatttg

SEQ ID NO: 40652 - DNA, 22 bp, Artificial sequence
  SiRNA target sequence
aagaatcatgtaagtgatttga

SEQ ID NO: 40653 - DNA, 22 bp, Artificial sequence
  SiRNA target sequence
agaatcatgtaagtgatttgag

SEQ ID NO: 40654 - DNA, 22 bp, Artificial sequence
  SiRNA target sequence
gaatcatgtaagtgatttgagc

SEQ ID NO: 40655 - DNA, 22 bp, Artificial sequence
  SiRNA target sequence
aatcatgtaagtgatttgagca

SEQ ID NO: 40656 - DNA, 22 bp, Artificial sequence
  SiRNA target sequence
atcatgtaagtgatttgagcat

SEQ ID NO: 40657 - DNA, 22 bp, Artificial sequence
  SiRNA target sequence
tcatgtaagtgatttgagcatc

SEQ ID NO: 40658 - DNA, 22 bp, Artificial sequence
  SiRNA target sequence
catgtaagtgatttgagcatct

SEQ ID NO: 40659 - DNA, 22 bp, Artificial sequence
  SiRNA target sequence
atgtaagtgatttgagcatctt

SEQ ID NO: 40660 - DNA, 22 bp, Artificial sequence
  SiRNA target sequence
tgtaagtgatttgagcatcttt

SEQ ID NO: 40661 - DNA, 22 bp, Artificial sequence
  SiRNA target sequence
gtaagtgatttgagcatctttg

SEQ ID NO: 40662 - DNA, 22 bp, Artificial sequence
  SiRNA target sequence
taagtgatttgagcatctttgt

SEQ ID NO: 40663 - DNA, 22 bp, Artificial sequence
  SiRNA target sequence
aagtgatttgagcatctttgtt

SEQ ID NO: 40664 - DNA, 22 bp, Artificial sequence
  SiRNA target sequence
agtgatttgagcatctttgttg

SEQ ID NO: 40665 - DNA, 22 bp, Artificial sequence
  SiRNA target sequence
gtgatttgagcatctttgttgt

SEQ ID NO: 40666 - DNA, 22 bp, Artificial sequence
  SiRNA target sequence
tgatttgagcatctttgttgtg

SEQ ID NO: 40667 - DNA, 22 bp, Artificial sequence
  SiRNA target sequence
gatttgagcatctttgttgtgc

SEQ ID NO: 40668 - DNA, 22 bp, Artificial sequence
  SiRNA target sequence
atttgagcatctttgttgtgcg

SEQ ID NO: 40669 - DNA, 22 bp, Artificial sequence
  SiRNA target sequence
tttgagcatctttgttgtgcgc

SEQ ID NO: 40670 - DNA, 22 bp, Artificial sequence
  SiRNA target sequence
ttgagcatctttgttgtgcgca

SEQ ID NO: 40671 - DNA, 22 bp, Artificial sequence
  SiRNA target sequence
tgagcatctttgttgtgcgcaa

SEQ ID NO: 40672 - DNA, 22 bp, Artificial sequence
  SiRNA target sequence
gagcatctttgttgtgcgcaat

SEQ ID NO: 40673 - DNA, 22 bp, Artificial sequence
  SiRNA target sequence
agcatctttgttgtgcgcaatt

SEQ ID NO: 40674 - DNA, 22 bp, Artificial sequence
  SiRNA target sequence
gcatctttgttgtgcgcaatta

SEQ ID NO: 40675 - DNA, 22 bp, Artificial sequence
  SiRNA target sequence
catctttgttgtgcgcaattat

SEQ ID NO: 40676 - DNA, 22 bp, Artificial sequence
  SiRNA target sequence
atctttgttgtgcgcaattata

SEQ ID NO: 40677 - DNA, 22 bp, Artificial sequence
  SiRNA target sequence
tctttgttgtgcgcaattatat

SEQ ID NO: 40678 - DNA, 22 bp, Artificial sequence
  SiRNA target sequence
ctttgttgtgcgcaattatatt

SEQ ID NO: 40679 - DNA, 22 bp, Artificial sequence
  SiRNA target sequence
tttgttgtgcgcaattatattc

SEQ ID NO: 40680 - DNA, 22 bp, Artificial sequence
  SiRNA target sequence
ttgttgtgcgcaattatattct

SEQ ID NO: 40681 - DNA, 22 bp, Artificial sequence
  SiRNA target sequence
tgttgtgcgcaattatattctt

SEQ ID NO: 40682 - DNA, 22 bp, Artificial sequence
  SiRNA target sequence
gttgtgcgcaattatattcttt

SEQ ID NO: 40683 - DNA, 22 bp, Artificial sequence
  SiRNA target sequence
ttgtgcgcaattatattctttt

SEQ ID NO: 40684 - DNA, 22 bp, Artificial sequence
  SiRNA target sequence
tgtgcgcaattatattcttttc

SEQ ID NO: 40685 - DNA, 22 bp, Artificial sequence
  SiRNA target sequence
gtgcgcaattatattcttttct

SEQ ID NO: 40686 - DNA, 22 bp, Artificial sequence
  SiRNA target sequence
tgcgcaattatattcttttctt

SEQ ID NO: 40687 - DNA, 22 bp, Artificial sequence
  SiRNA target sequence
gcgcaattatattcttttctta

SEQ ID NO: 40688 - DNA, 22 bp, Artificial sequence
  SiRNA target sequence
cgcaattatattcttttcttat

SEQ ID NO: 40689 - DNA, 22 bp, Artificial sequence
  SiRNA target sequence
gcaattatattcttttcttatt

SEQ ID NO: 40690 - DNA, 22 bp, Artificial sequence
  SiRNA target sequence
caattatattcttttcttattc

SEQ ID NO: 40691 - DNA, 22 bp, Artificial sequence
  SiRNA target sequence
aattatattcttttcttattcc

SEQ ID NO: 40692 - DNA, 22 bp, Artificial sequence
  SiRNA target sequence
attatattcttttcttattcct

SEQ ID NO: 40693 - DNA, 22 bp, Artificial sequence
  SiRNA target sequence
ttatattcttttcttattcctg

SEQ ID NO: 40694 - DNA, 22 bp, Artificial sequence
  SiRNA target sequence
tatattcttttcttattcctgt

SEQ ID NO: 40695 - DNA, 22 bp, Artificial sequence
  SiRNA target sequence
atattcttttcttattcctgta

SEQ ID NO: 40696 - DNA, 22 bp, Artificial sequence
  SiRNA target sequence
tattcttttcttattcctgtac

SEQ ID NO: 40697 - DNA, 22 bp, Artificial sequence
  SiRNA target sequence
attcttttcttattcctgtacg

SEQ ID NO: 40698 - DNA, 22 bp, Artificial sequence
  SiRNA target sequence
ttcttttcttattcctgtacgc

SEQ ID NO: 40699 - DNA, 22 bp, Artificial sequence
  SiRNA target sequence
tcttttcttattcctgtacgcc

SEQ ID NO: 40700 - DNA, 22 bp, Artificial sequence
  SiRNA target sequence
cttttcttattcctgtacgcca

SEQ ID NO: 40701 - DNA, 22 bp, Artificial sequence
  SiRNA target sequence
ttttcttattcctgtacgccaa

SEQ ID NO: 40702 - DNA, 22 bp, Artificial sequence
  SiRNA target sequence
tttcttattcctgtacgccaat

SEQ ID NO: 40703 - DNA, 22 bp, Artificial sequence
  SiRNA target sequence
ttcttattcctgtacgccaatg

SEQ ID NO: 40704 - DNA, 22 bp, Artificial sequence
  SiRNA target sequence
tcttattcctgtacgccaatga

SEQ ID NO: 40705 - DNA, 22 bp, Artificial sequence
  SiRNA target sequence
cttattcctgtacgccaatgaa

SEQ ID NO: 40706 - DNA, 22 bp, Artificial sequence
  SiRNA target sequence
ttattcctgtacgccaatgaac

SEQ ID NO: 40707 - DNA, 22 bp, Artificial sequence
  SiRNA target sequence
tattcctgtacgccaatgaact

SEQ ID NO: 40708 - DNA, 22 bp, Artificial sequence
  SiRNA target sequence
attcctgtacgccaatgaacta

SEQ ID NO: 40709 - DNA, 22 bp, Artificial sequence
  SiRNA target sequence
ttcctgtacgccaatgaactat

SEQ ID NO: 40710 - DNA, 22 bp, Artificial sequence
  SiRNA target sequence
tcctgtacgccaatgaactatt

SEQ ID NO: 40711 - DNA, 22 bp, Artificial sequence
  SiRNA target sequence
cctgtacgccaatgaactattt

SEQ ID NO: 40712 - DNA, 22 bp, Artificial sequence
  SiRNA target sequence
ctgtacgccaatgaactatttt

SEQ ID NO: 40713 - DNA, 22 bp, Artificial sequence
  SiRNA target sequence
tgtacgccaatgaactattttc

SEQ ID NO: 40714 - DNA, 22 bp, Artificial sequence
  SiRNA target sequence
gtacgccaatgaactattttcg

SEQ ID NO: 40715 - DNA, 22 bp, Artificial sequence
  SiRNA target sequence
tacgccaatgaactattttcgc

SEQ ID NO: 40716 - DNA, 22 bp, Artificial sequence
  SiRNA target sequence
acgccaatgaactattttcgca

SEQ ID NO: 40717 - DNA, 22 bp, Artificial sequence
  SiRNA target sequence
cgccaatgaactattttcgcag

SEQ ID NO: 40718 - DNA, 22 bp, Artificial sequence
  SiRNA target sequence
gccaatgaactattttcgcagt

SEQ ID NO: 40719 - DNA, 22 bp, Artificial sequence
  SiRNA target sequence
ccaatgaactattttcgcagtt

SEQ ID NO: 40720 - DNA, 22 bp, Artificial sequence
  SiRNA target sequence
caatgaactattttcgcagttg

SEQ ID NO: 40721 - DNA, 22 bp, Artificial sequence
  SiRNA target sequence
aatgaactattttcgcagttgc

SEQ ID NO: 40722 - DNA, 22 bp, Artificial sequence
  SiRNA target sequence
atgaactattttcgcagttgca

SEQ ID NO: 40723 - DNA, 22 bp, Artificial sequence
  SiRNA target sequence
tgaactattttcgcagttgcaa

SEQ ID NO: 40724 - DNA, 22 bp, Artificial sequence
  SiRNA target sequence
gaactattttcgcagttgcaag

SEQ ID NO: 40725 - DNA, 22 bp, Artificial sequence
  SiRNA target sequence
aactattttcgcagttgcaagg

SEQ ID NO: 40726 - DNA, 22 bp, Artificial sequence
  SiRNA target sequence
actattttcgcagttgcaagga

SEQ ID NO: 40727 - DNA, 22 bp, Artificial sequence
  SiRNA target sequence
ctattttcgcagttgcaaggat

SEQ ID NO: 40728 - DNA, 22 bp, Artificial sequence
  SiRNA target sequence
tattttcgcagttgcaaggatg

SEQ ID NO: 40729 - DNA, 22 bp, Artificial sequence
  SiRNA target sequence
attttcgcagttgcaaggatgt

SEQ ID NO: 40730 - DNA, 22 bp, Artificial sequence
  SiRNA target sequence
ttttcgcagttgcaaggatgta

SEQ ID NO: 40731 - DNA, 22 bp, Artificial sequence
  SiRNA target sequence
tttcgcagttgcaaggatgtaa

SEQ ID NO: 40732 - DNA, 22 bp, Artificial sequence
  SiRNA target sequence
ttcgcagttgcaaggatgtaaa

SEQ ID NO: 40733 - DNA, 22 bp, Artificial sequence
  SiRNA target sequence
tcgcagttgcaaggatgtaaac

SEQ ID NO: 40734 - DNA, 22 bp, Artificial sequence
  SiRNA target sequence
cgcagttgcaaggatgtaaact

SEQ ID NO: 40735 - DNA, 22 bp, Artificial sequence
  SiRNA target sequence
gcagttgcaaggatgtaaacta

SEQ ID NO: 40736 - DNA, 22 bp, Artificial sequence
  SiRNA target sequence
cagttgcaaggatgtaaactaa

SEQ ID NO: 40737 - DNA, 22 bp, Artificial sequence
  SiRNA target sequence
agttgcaaggatgtaaactaat

SEQ ID NO: 40738 - DNA, 22 bp, Artificial sequence
  SiRNA target sequence
gttgcaaggatgtaaactaata

SEQ ID NO: 40739 - DNA, 22 bp, Artificial sequence
  SiRNA target sequence
ttgcaaggatgtaaactaataa

SEQ ID NO: 40740 - DNA, 22 bp, Artificial sequence
  SiRNA target sequence
tgcaaggatgtaaactaataat

SEQ ID NO: 40741 - DNA, 22 bp, Artificial sequence
  SiRNA target sequence
gcaaggatgtaaactaataatg

SEQ ID NO: 40742 - DNA, 22 bp, Artificial sequence
  SiRNA target sequence
caaggatgtaaactaataatgt

SEQ ID NO: 40743 - DNA, 22 bp, Artificial sequence
  SiRNA target sequence
aaggatgtaaactaataatgtg

SEQ ID NO: 40744 - DNA, 22 bp, Artificial sequence
  SiRNA target sequence
aggatgtaaactaataatgtga

SEQ ID NO: 40745 - DNA, 22 bp, Artificial sequence
  SiRNA target sequence
ggatgtaaactaataatgtgat

SEQ ID NO: 40746 - DNA, 22 bp, Artificial sequence
  SiRNA target sequence
gatgtaaactaataatgtgatt

SEQ ID NO: 40747 - DNA, 22 bp, Artificial sequence
  SiRNA target sequence
atgtaaactaataatgtgatta

SEQ ID NO: 40748 - DNA, 22 bp, Artificial sequence
  SiRNA target sequence
tgtaaactaataatgtgattaa

SEQ ID NO: 40749 - DNA, 22 bp, Artificial sequence
  SiRNA target sequence
gtaaactaataatgtgattaaa

SEQ ID NO: 40750 - DNA, 22 bp, Artificial sequence
  SiRNA target sequence
taaactaataatgtgattaaaa

SEQ ID NO: 40751 - DNA, 22 bp, Artificial sequence
  SiRNA target sequence
aaactaataatgtgattaaaat

SEQ ID NO: 40752 - DNA, 22 bp, Artificial sequence
  SiRNA target sequence
aactaataatgtgattaaaata

SEQ ID NO: 40753 - DNA, 22 bp, Artificial sequence
  SiRNA target sequence
actaataatgtgattaaaataa

SEQ ID NO: 40754 - DNA, 22 bp, Artificial sequence
  SiRNA target sequence
ctaataatgtgattaaaataat

SEQ ID NO: 40755 - DNA, 22 bp, Artificial sequence
  SiRNA target sequence
taataatgtgattaaaataata

SEQ ID NO: 40756 - DNA, 22 bp, Artificial sequence
  SiRNA target sequence
aataatgtgattaaaataataa

SEQ ID NO: 40757 - DNA, 22 bp, Artificial sequence
  SiRNA target sequence
ataatgtgattaaaataataaa

SEQ ID NO: 40758 - DNA, 22 bp, Artificial sequence
  SiRNA target sequence
taatgtgattaaaataataaac

SEQ ID NO: 40759 - DNA, 22 bp, Artificial sequence
  SiRNA target sequence
aatgtgattaaaataataaaca

SEQ ID NO: 40760 - DNA, 22 bp, Artificial sequence
  SiRNA target sequence
atgtgattaaaataataaacat

SEQ ID NO: 40761 - DNA, 22 bp, Artificial sequence
  SiRNA target sequence
tgtgattaaaataataaacata

SEQ ID NO: 40762 - DNA, 22 bp, Artificial sequence
  SiRNA target sequence
gtgattaaaataataaacatat

SEQ ID NO: 40763 - DNA, 22 bp, Artificial sequence
  SiRNA target sequence
tgattaaaataataaacatatt

SEQ ID NO: 40764 - DNA, 22 bp, Artificial sequence
  SiRNA target sequence
gattaaaataataaacatattt

SEQ ID NO: 40765 - DNA, 22 bp, Artificial sequence
  SiRNA target sequence
attaaaataataaacatatttg

SEQ ID NO: 40766 - DNA, 22 bp, Artificial sequence
  SiRNA target sequence
ttaaaataataaacatatttgt

SEQ ID NO: 40767 - DNA, 22 bp, Artificial sequence
  SiRNA target sequence
taaaataataaacatatttgtc

SEQ ID NO: 40768 - DNA, 22 bp, Artificial sequence
  SiRNA target sequence
aaaataataaacatatttgtca

SEQ ID NO: 40769 - DNA, 22 bp, Artificial sequence
  SiRNA target sequence
aaataataaacatatttgtcaa

SEQ ID NO: 40770 - DNA, 22 bp, Artificial sequence
  SiRNA target sequence
aataataaacatatttgtcaac

SEQ ID NO: 40771 - DNA, 22 bp, Artificial sequence
  SiRNA target sequence
ataataaacatatttgtcaacc

SEQ ID NO: 40772 - DNA, 22 bp, Artificial sequence
  SiRNA target sequence
taataaacatatttgtcaaccc

SEQ ID NO: 40773 - DNA, 22 bp, Artificial sequence
  SiRNA target sequence
aataaacatatttgtcaaccct

SEQ ID NO: 40774 - DNA, 22 bp, Artificial sequence
  SiRNA target sequence
ataaacatatttgtcaacccta

SEQ ID NO: 40775 - DNA, 22 bp, Artificial sequence
  SiRNA target sequence
taaacatatttgtcaaccctaa

SEQ ID NO: 40776 - DNA, 22 bp, Artificial sequence
  SiRNA target sequence
aaacatatttgtcaaccctaaa

SEQ ID NO: 40777 - DNA, 22 bp, Artificial sequence
  SiRNA target sequence
aacatatttgtcaaccctaaat

SEQ ID NO: 40778 - DNA, 22 bp, Artificial sequence
  SiRNA target sequence
acatatttgtcaaccctaaatt

SEQ ID NO: 40779 - DNA, 22 bp, Artificial sequence
  SiRNA target sequence
catatttgtcaaccctaaattt

SEQ ID NO: 40780 - DNA, 22 bp, Artificial sequence
  SiRNA target sequence
atatttgtcaaccctaaatttg

SEQ ID NO: 40781 - DNA, 22 bp, Artificial sequence
  SiRNA target sequence
tatttgtcaaccctaaatttgt

SEQ ID NO: 40782 - DNA, 22 bp, Artificial sequence
  SiRNA target sequence
atttgtcaaccctaaatttgta

SEQ ID NO: 40783 - DNA, 22 bp, Artificial sequence
  SiRNA target sequence
tttgtcaaccctaaatttgtat

SEQ ID NO: 40784 - DNA, 22 bp, Artificial sequence
  SiRNA target sequence
ttgtcaaccctaaatttgtata

SEQ ID NO: 40785 - DNA, 22 bp, Artificial sequence
  SiRNA target sequence
tgtcaaccctaaatttgtataa

SEQ ID NO: 40786 - DNA, 22 bp, Artificial sequence
  SiRNA target sequence
gtcaaccctaaatttgtataaa

SEQ ID NO: 40787 - DNA, 22 bp, Artificial sequence
  SiRNA target sequence
tcaaccctaaatttgtataaat

SEQ ID NO: 40788 - DNA, 22 bp, Artificial sequence
  SiRNA target sequence
caaccctaaatttgtataaatt

SEQ ID NO: 40789 - DNA, 22 bp, Artificial sequence
  SiRNA target sequence
aaccctaaatttgtataaattg

SEQ ID NO: 40790 - DNA, 22 bp, Artificial sequence
  SiRNA target sequence
accctaaatttgtataaattga

SEQ ID NO: 40791 - DNA, 22 bp, Artificial sequence
  SiRNA target sequence
ccctaaatttgtataaattgac

SEQ ID NO: 40792 - DNA, 22 bp, Artificial sequence
  SiRNA target sequence
cctaaatttgtataaattgacg

SEQ ID NO: 40793 - DNA, 22 bp, Artificial sequence
  SiRNA target sequence
ctaaatttgtataaattgacga

SEQ ID NO: 40794 - DNA, 22 bp, Artificial sequence
  SiRNA target sequence
taaatttgtataaattgacgaa

SEQ ID NO: 40795 - DNA, 22 bp, Artificial sequence
  SiRNA target sequence
aaatttgtataaattgacgaac

SEQ ID NO: 40796 - DNA, 22 bp, Artificial sequence
  SiRNA target sequence
aatttgtataaattgacgaaca

SEQ ID NO: 40797 - DNA, 22 bp, Artificial sequence
  SiRNA target sequence
atttgtataaattgacgaacac

SEQ ID NO: 40798 - DNA, 22 bp, Artificial sequence
  SiRNA target sequence
tttgtataaattgacgaacacg

SEQ ID NO: 40799 - DNA, 22 bp, Artificial sequence
  SiRNA target sequence
ttgtataaattgacgaacacgc

SEQ ID NO: 40800 - DNA, 22 bp, Artificial sequence
  SiRNA target sequence
tgtataaattgacgaacacgcc

SEQ ID NO: 40801 - DNA, 22 bp, Artificial sequence
  SiRNA target sequence
gtataaattgacgaacacgcca

SEQ ID NO: 40802 - DNA, 22 bp, Artificial sequence
  SiRNA target sequence
tataaattgacgaacacgccaa

SEQ ID NO: 40803 - DNA, 22 bp, Artificial sequence
  SiRNA target sequence
ataaattgacgaacacgccaat

SEQ ID NO: 40804 - DNA, 22 bp, Artificial sequence
  SiRNA target sequence
taaattgacgaacacgccaata

SEQ ID NO: 40805 - DNA, 22 bp, Artificial sequence
  SiRNA target sequence
aaattgacgaacacgccaatat

SEQ ID NO: 40806 - DNA, 22 bp, Artificial sequence
  SiRNA target sequence
aattgacgaacacgccaatata

SEQ ID NO: 40807 - DNA, 22 bp, Artificial sequence
  SiRNA target sequence
attgacgaacacgccaatataa

SEQ ID NO: 40808 - DNA, 22 bp, Artificial sequence
  SiRNA target sequence
ttgacgaacacgccaatataac

SEQ ID NO: 40809 - DNA, 22 bp, Artificial sequence
  SiRNA target sequence
tgacgaacacgccaatataact

SEQ ID NO: 40810 - DNA, 22 bp, Artificial sequence
  SiRNA target sequence
gacgaacacgccaatataactg

SEQ ID NO: 40811 - DNA, 22 bp, Artificial sequence
  SiRNA target sequence
acgaacacgccaatataactgt

SEQ ID NO: 40812 - DNA, 22 bp, Artificial sequence
  SiRNA target sequence
cgaacacgccaatataactgta

SEQ ID NO: 40813 - DNA, 22 bp, Artificial sequence
  SiRNA target sequence
gaacacgccaatataactgtaa

SEQ ID NO: 40814 - DNA, 22 bp, Artificial sequence
  SiRNA target sequence
aacacgccaatataactgtaaa

SEQ ID NO: 40815 - DNA, 22 bp, Artificial sequence
  SiRNA target sequence
acacgccaatataactgtaaaa

SEQ ID NO: 40816 - DNA, 22 bp, Artificial sequence
  SiRNA target sequence
cacgccaatataactgtaaaaa

SEQ ID NO: 40817 - DNA, 22 bp, Artificial sequence
  SiRNA target sequence
acgccaatataactgtaaaaaa

SEQ ID NO: 40818 - DNA, 22 bp, Artificial sequence
  SiRNA target sequence
cgccaatataactgtaaaaaaa

SEQ ID NO: 40819 - DNA, 22 bp, Artificial sequence
  SiRNA target sequence
gccaatataactgtaaaaaaaa

SEQ ID NO: 40820 - DNA, 22 bp, Artificial sequence
  SiRNA target sequence
ccaatataactgtaaaaaaaat

SEQ ID NO: 40821 - DNA, 22 bp, Artificial sequence
  SiRNA target sequence
caatataactgtaaaaaaaata

SEQ ID NO: 40822 - DNA, 22 bp, Artificial sequence
  SiRNA target sequence
aatataactgtaaaaaaaatat

SEQ ID NO: 40823 - DNA, 22 bp, Artificial sequence
  SiRNA target sequence
atataactgtaaaaaaaatatt

SEQ ID NO: 40824 - DNA, 22 bp, Artificial sequence
  SiRNA target sequence
tataactgtaaaaaaaatattt

SEQ ID NO: 40825 - DNA, 22 bp, Artificial sequence
  SiRNA target sequence
ataactgtaaaaaaaatattta

SEQ ID NO: 40826 - DNA, 22 bp, Artificial sequence
  SiRNA target sequence
taactgtaaaaaaaatatttat

SEQ ID NO: 40827 - DNA, 22 bp, Artificial sequence
  SiRNA target sequence
aactgtaaaaaaaatatttatg

SEQ ID NO: 40828 - DNA, 22 bp, Artificial sequence
  SiRNA target sequence
actgtaaaaaaaatatttatga

SEQ ID NO: 40829 - DNA, 22 bp, Artificial sequence
  SiRNA target sequence
ctgtaaaaaaaatatttatgat

SEQ ID NO: 40830 - DNA, 22 bp, Artificial sequence
  SiRNA target sequence
tgtaaaaaaaatatttatgata

SEQ ID NO: 40831 - DNA, 22 bp, Artificial sequence
  SiRNA target sequence
gtaaaaaaaatatttatgatat

SEQ ID NO: 40832 - DNA, 22 bp, Artificial sequence
  SiRNA target sequence
taaaaaaaatatttatgatatt

SEQ ID NO: 40833 - DNA, 22 bp, Artificial sequence
  SiRNA target sequence
aaaaaaaatatttatgatatta

SEQ ID NO: 40834 - DNA, 22 bp, Artificial sequence
  SiRNA target sequence
aaaaaaatatttatgatattaa

SEQ ID NO: 40835 - DNA, 22 bp, Artificial sequence
  SiRNA target sequence
aaaaaatatttatgatattaac

SEQ ID NO: 40836 - DNA, 22 bp, Artificial sequence
  SiRNA target sequence
aaaaatatttatgatattaaca

SEQ ID NO: 40837 - DNA, 22 bp, Artificial sequence
  SiRNA target sequence
aaaatatttatgatattaacaa

SEQ ID NO: 40838 - DNA, 22 bp, Artificial sequence
  SiRNA target sequence
aaatatttatgatattaacaaa

SEQ ID NO: 40839 - DNA, 22 bp, Artificial sequence
  SiRNA target sequence
aatatttatgatattaacaaat

SEQ ID NO: 40840 - DNA, 22 bp, Artificial sequence
  SiRNA target sequence
atatttatgatattaacaaata

SEQ ID NO: 40841 - DNA, 22 bp, Artificial sequence
  SiRNA target sequence
tatttatgatattaacaaataa

SEQ ID NO: 40842 - DNA, 22 bp, Artificial sequence
  SiRNA target sequence
atttatgatattaacaaataaa

SEQ ID NO: 40843 - DNA, 22 bp, Artificial sequence
  SiRNA target sequence
tttatgatattaacaaataaaa

SEQ ID NO: 40844 - DNA, 22 bp, Artificial sequence
  SiRNA target sequence
ttatgatattaacaaataaaac

SEQ ID NO: 40845 - DNA, 22 bp, Artificial sequence
  SiRNA target sequence
tatgatattaacaaataaaact

SEQ ID NO: 40846 - DNA, 22 bp, Artificial sequence
  SiRNA target sequence
atgatattaacaaataaaactt

SEQ ID NO: 40847 - DNA, 22 bp, Artificial sequence
  SiRNA target sequence
tgatattaacaaataaaacttc

SEQ ID NO: 40848 - DNA, 22 bp, Artificial sequence
  SiRNA target sequence
gatattaacaaataaaacttcg

SEQ ID NO: 40849 - DNA, 22 bp, Artificial sequence
  SiRNA target sequence
atattaacaaataaaacttcga

SEQ ID NO: 40850 - DNA, 22 bp, Artificial sequence
  SiRNA target sequence
tattaacaaataaaacttcgat

SEQ ID NO: 40851 - DNA, 22 bp, Artificial sequence
  SiRNA target sequence
attaacaaataaaacttcgatc

SEQ ID NO: 40852 - DNA, 22 bp, Artificial sequence
  SiRNA target sequence
ttaacaaataaaacttcgatca

SEQ ID NO: 40853 - DNA, 22 bp, Artificial sequence
  SiRNA target sequence
taacaaataaaacttcgatcaa

SEQ ID NO: 40854 - DNA, 22 bp, Artificial sequence
  SiRNA target sequence
aacaaataaaacttcgatcaat

SEQ ID NO: 40855 - DNA, 22 bp, Artificial sequence
  SiRNA target sequence
acaaataaaacttcgatcaatt

SEQ ID NO: 40856 - DNA, 22 bp, Artificial sequence
  SiRNA target sequence
caaataaaacttcgatcaattc

SEQ ID NO: 40857 - DNA, 22 bp, Artificial sequence
  SiRNA target sequence
aaataaaacttcgatcaattca

SEQ ID NO: 40858 - DNA, 22 bp, Artificial sequence
  SiRNA target sequence
aataaaacttcgatcaattcac

SEQ ID NO: 40859 - DNA, 22 bp, Artificial sequence
  SiRNA target sequence
ataaaacttcgatcaattcact

SEQ ID NO: 40860 - DNA, 22 bp, Artificial sequence
  SiRNA target sequence
taaaacttcgatcaattcactt

SEQ ID NO: 40861 - DNA, 22 bp, Artificial sequence
  SiRNA target sequence
aaaacttcgatcaattcactta

SEQ ID NO: 40862 - DNA, 22 bp, Artificial sequence
  SiRNA target sequence
aaacttcgatcaattcacttat

SEQ ID NO: 40863 - DNA, 22 bp, Artificial sequence
  SiRNA target sequence
aacttcgatcaattcacttatt

SEQ ID NO: 40864 - DNA, 22 bp, Artificial sequence
  SiRNA target sequence
acttcgatcaattcacttattg

SEQ ID NO: 40865 - DNA, 22 bp, Artificial sequence
  SiRNA target sequence
cttcgatcaattcacttattgc

SEQ ID NO: 40866 - DNA, 22 bp, Artificial sequence
  SiRNA target sequence
ttcgatcaattcacttattgct

SEQ ID NO: 40867 - DNA, 22 bp, Artificial sequence
  SiRNA target sequence
tcgatcaattcacttattgctt

SEQ ID NO: 40868 - DNA, 22 bp, Artificial sequence
  SiRNA target sequence
cgatcaattcacttattgcttt

SEQ ID NO: 40869 - DNA, 22 bp, Artificial sequence
  SiRNA target sequence
gatcaattcacttattgcttta

SEQ ID NO: 40870 - DNA, 22 bp, Artificial sequence
  SiRNA target sequence
atcaattcacttattgctttac

SEQ ID NO: 40871 - DNA, 22 bp, Artificial sequence
  SiRNA target sequence
tcaattcacttattgctttact

SEQ ID NO: 40872 - DNA, 22 bp, Artificial sequence
  SiRNA target sequence
caattcacttattgctttactt

SEQ ID NO: 40873 - DNA, 22 bp, Artificial sequence
  SiRNA target sequence
aattcacttattgctttacttt

SEQ ID NO: 40874 - DNA, 22 bp, Artificial sequence
  SiRNA target sequence
attcacttattgctttactttc

SEQ ID NO: 40875 - DNA, 22 bp, Artificial sequence
  SiRNA target sequence
ttcacttattgctttactttct

SEQ ID NO: 40876 - DNA, 22 bp, Artificial sequence
  SiRNA target sequence
tcacttattgctttactttctc

SEQ ID NO: 40877 - DNA, 22 bp, Artificial sequence
  SiRNA target sequence
cacttattgctttactttctcg

SEQ ID NO: 40878 - DNA, 22 bp, Artificial sequence
  SiRNA target sequence
acttattgctttactttctcgg

SEQ ID NO: 40879 - DNA, 22 bp, Artificial sequence
  SiRNA target sequence
cttattgctttactttctcggt

SEQ ID NO: 40880 - DNA, 22 bp, Artificial sequence
  SiRNA target sequence
ttattgctttactttctcggtc

SEQ ID NO: 40881 - DNA, 22 bp, Artificial sequence
  SiRNA target sequence
tattgctttactttctcggtct

SEQ ID NO: 40882 - DNA, 22 bp, Artificial sequence
  SiRNA target sequence
attgctttactttctcggtcta

SEQ ID NO: 40883 - DNA, 22 bp, Artificial sequence
  SiRNA target sequence
ttgctttactttctcggtctat

SEQ ID NO: 40884 - DNA, 22 bp, Artificial sequence
  SiRNA target sequence
tgctttactttctcggtctatt

SEQ ID NO: 40885 - DNA, 22 bp, Artificial sequence
  SiRNA target sequence
gctttactttctcggtctatta

SEQ ID NO: 40886 - DNA, 22 bp, Artificial sequence
  SiRNA target sequence
ctttactttctcggtctattat

SEQ ID NO: 40887 - DNA, 22 bp, Artificial sequence
  SiRNA target sequence
tttactttctcggtctattatt

SEQ ID NO: 40888 - DNA, 22 bp, Artificial sequence
  SiRNA target sequence
ttactttctcggtctattattg

SEQ ID NO: 40889 - DNA, 22 bp, Artificial sequence
  SiRNA target sequence
tactttctcggtctattattgt

SEQ ID NO: 40890 - DNA, 22 bp, Artificial sequence
  SiRNA target sequence
actttctcggtctattattgtt

SEQ ID NO: 40891 - DNA, 22 bp, Artificial sequence
  SiRNA target sequence
ctttctcggtctattattgttt

SEQ ID NO: 40892 - DNA, 22 bp, Artificial sequence
  SiRNA target sequence
tttctcggtctattattgtttg

SEQ ID NO: 40893 - DNA, 22 bp, Artificial sequence
  SiRNA target sequence
ttctcggtctattattgtttgt

SEQ ID NO: 40894 - DNA, 22 bp, Artificial sequence
  SiRNA target sequence
tctcggtctattattgtttgta

SEQ ID NO: 40895 - DNA, 22 bp, Artificial sequence
  SiRNA target sequence
ctcggtctattattgtttgtat

SEQ ID NO: 40896 - DNA, 22 bp, Artificial sequence
  SiRNA target sequence
tcggtctattattgtttgtatt

SEQ ID NO: 40897 - DNA, 22 bp, Artificial sequence
  SiRNA target sequence
cggtctattattgtttgtattt

SEQ ID NO: 40898 - DNA, 22 bp, Artificial sequence
  SiRNA target sequence
ggtctattattgtttgtatttc

SEQ ID NO: 40899 - DNA, 22 bp, Artificial sequence
  SiRNA target sequence
gtctattattgtttgtatttca

SEQ ID NO: 40900 - DNA, 22 bp, Artificial sequence
  SiRNA target sequence
tctattattgtttgtatttcac

SEQ ID NO: 40901 - DNA, 22 bp, Artificial sequence
  SiRNA target sequence
ctattattgtttgtatttcacc

SEQ ID NO: 40902 - DNA, 22 bp, Artificial sequence
  SiRNA target sequence
tattattgtttgtatttcaccg

SEQ ID NO: 40903 - DNA, 22 bp, Artificial sequence
  SiRNA target sequence
attattgtttgtatttcaccgc

SEQ ID NO: 40904 - DNA, 22 bp, Artificial sequence
  SiRNA target sequence
ttattgtttgtatttcaccgca

SEQ ID NO: 40905 - DNA, 22 bp, Artificial sequence
  SiRNA target sequence
tattgtttgtatttcaccgcat

SEQ ID NO: 40906 - DNA, 22 bp, Artificial sequence
  SiRNA target sequence
attgtttgtatttcaccgcatc

SEQ ID NO: 40907 - DNA, 22 bp, Artificial sequence
  SiRNA target sequence
ttgtttgtatttcaccgcatcc

SEQ ID NO: 40908 - DNA, 22 bp, Artificial sequence
  SiRNA target sequence
tgtttgtatttcaccgcatcct

SEQ ID NO: 40909 - DNA, 22 bp, Artificial sequence
  SiRNA target sequence
gtttgtatttcaccgcatccta

SEQ ID NO: 40910 - DNA, 22 bp, Artificial sequence
  SiRNA target sequence
tttgtatttcaccgcatcctat

SEQ ID NO: 40911 - DNA, 22 bp, Artificial sequence
  SiRNA target sequence
ttgtatttcaccgcatcctatt

SEQ ID NO: 40912 - DNA, 22 bp, Artificial sequence
  SiRNA target sequence
tgtatttcaccgcatcctattt

SEQ ID NO: 40913 - DNA, 22 bp, Artificial sequence
  SiRNA target sequence
gtatttcaccgcatcctatttt

SEQ ID NO: 40914 - DNA, 22 bp, Artificial sequence
  SiRNA target sequence
tatttcaccgcatcctatttta

SEQ ID NO: 40915 - DNA, 22 bp, Artificial sequence
  SiRNA target sequence
atttcaccgcatcctattttat

SEQ ID NO: 40916 - DNA, 22 bp, Artificial sequence
  SiRNA target sequence
tttcaccgcatcctattttatt

SEQ ID NO: 40917 - DNA, 22 bp, Artificial sequence
  SiRNA target sequence
ttcaccgcatcctattttattg

SEQ ID NO: 40918 - DNA, 22 bp, Artificial sequence
  SiRNA target sequence
tcaccgcatcctattttattgt

SEQ ID NO: 40919 - DNA, 22 bp, Artificial sequence
  SiRNA target sequence
caccgcatcctattttattgta

SEQ ID NO: 40920 - DNA, 22 bp, Artificial sequence
  SiRNA target sequence
accgcatcctattttattgtat

SEQ ID NO: 40921 - DNA, 22 bp, Artificial sequence
  SiRNA target sequence
ccgcatcctattttattgtatc

SEQ ID NO: 40922 - DNA, 22 bp, Artificial sequence
  SiRNA target sequence
cgcatcctattttattgtatct

SEQ ID NO: 40923 - DNA, 22 bp, Artificial sequence
  SiRNA target sequence
gcatcctattttattgtatcta

SEQ ID NO: 40924 - DNA, 22 bp, Artificial sequence
  SiRNA target sequence
catcctattttattgtatctac

SEQ ID NO: 40925 - DNA, 22 bp, Artificial sequence
  SiRNA target sequence
atcctattttattgtatctact

SEQ ID NO: 40926 - DNA, 22 bp, Artificial sequence
  SiRNA target sequence
tcctattttattgtatctacta

SEQ ID NO: 40927 - DNA, 22 bp, Artificial sequence
  SiRNA target sequence
cctattttattgtatctactaa

SEQ ID NO: 40928 - DNA, 22 bp, Artificial sequence
  SiRNA target sequence
ctattttattgtatctactaag

SEQ ID NO: 40929 - DNA, 22 bp, Artificial sequence
  SiRNA target sequence
tattttattgtatctactaagt

SEQ ID NO: 40930 - DNA, 22 bp, Artificial sequence
  SiRNA target sequence
attttattgtatctactaagtt

SEQ ID NO: 40931 - DNA, 22 bp, Artificial sequence
  SiRNA target sequence
ttttattgtatctactaagttc

SEQ ID NO: 40932 - DNA, 22 bp, Artificial sequence
  SiRNA target sequence
tttattgtatctactaagttcc

SEQ ID NO: 40933 - DNA, 22 bp, Artificial sequence
  SiRNA target sequence
ttattgtatctactaagttcca

SEQ ID NO: 40934 - DNA, 22 bp, Artificial sequence
  SiRNA target sequence
tattgtatctactaagttccat

SEQ ID NO: 40935 - DNA, 22 bp, Artificial sequence
  SiRNA target sequence
attgtatctactaagttccata

SEQ ID NO: 40936 - DNA, 22 bp, Artificial sequence
  SiRNA target sequence
ttgtatctactaagttccatat

SEQ ID NO: 40937 - DNA, 22 bp, Artificial sequence
  SiRNA target sequence
tgtatctactaagttccatatt

SEQ ID NO: 40938 - DNA, 22 bp, Artificial sequence
  SiRNA target sequence
gtatctactaagttccatattt

SEQ ID NO: 40939 - DNA, 22 bp, Artificial sequence
  SiRNA target sequence
tatctactaagttccatattta

SEQ ID NO: 40940 - DNA, 22 bp, Artificial sequence
  SiRNA target sequence
atctactaagttccatatttat

SEQ ID NO: 40941 - DNA, 22 bp, Artificial sequence
  SiRNA target sequence
tctactaagttccatatttata

SEQ ID NO: 40942 - DNA, 22 bp, Artificial sequence
  SiRNA target sequence
ctactaagttccatatttataa

SEQ ID NO: 40943 - DNA, 22 bp, Artificial sequence
  SiRNA target sequence
tactaagttccatatttataaa

SEQ ID NO: 40944 - DNA, 22 bp, Artificial sequence
  SiRNA target sequence
actaagttccatatttataaaa

SEQ ID NO: 40945 - DNA, 22 bp, Artificial sequence
  SiRNA target sequence
ctaagttccatatttataaaat

SEQ ID NO: 40946 - DNA, 22 bp, Artificial sequence
  SiRNA target sequence
taagttccatatttataaaatt

SEQ ID NO: 40947 - DNA, 22 bp, Artificial sequence
  SiRNA target sequence
aagttccatatttataaaattt

SEQ ID NO: 40948 - DNA, 22 bp, Artificial sequence
  SiRNA target sequence
agttccatatttataaaatttt

SEQ ID NO: 40949 - DNA, 22 bp, Artificial sequence
  SiRNA target sequence
gttccatatttataaaattttt

SEQ ID NO: 40950 - DNA, 22 bp, Artificial sequence
  SiRNA target sequence
ttccatatttataaaattttta

SEQ ID NO: 40951 - DNA, 22 bp, Artificial sequence
  SiRNA target sequence
tccatatttataaaatttttaa

SEQ ID NO: 40952 - DNA, 22 bp, Artificial sequence
  SiRNA target sequence
ccatatttataaaatttttaaa

SEQ ID NO: 40953 - DNA, 22 bp, Artificial sequence
  SiRNA target sequence
catatttataaaatttttaaat

SEQ ID NO: 40954 - DNA, 22 bp, Artificial sequence
  SiRNA target sequence
atatttataaaatttttaaatg

SEQ ID NO: 40955 - DNA, 22 bp, Artificial sequence
  SiRNA target sequence
tatttataaaatttttaaatga

SEQ ID NO: 40956 - DNA, 22 bp, Artificial sequence
  SiRNA target sequence
atttataaaatttttaaatgaa

SEQ ID NO: 40957 - DNA, 22 bp, Artificial sequence
  SiRNA target sequence
tttataaaatttttaaatgaat

SEQ ID NO: 40958 - DNA, 22 bp, Artificial sequence
  SiRNA target sequence
ttataaaatttttaaatgaatt

SEQ ID NO: 40959 - DNA, 22 bp, Artificial sequence
  SiRNA target sequence
tataaaatttttaaatgaattt

SEQ ID NO: 40960 - DNA, 22 bp, Artificial sequence
  SiRNA target sequence
ataaaatttttaaatgaatttt

SEQ ID NO: 40961 - DNA, 22 bp, Artificial sequence
  SiRNA target sequence
taaaatttttaaatgaattttt

SEQ ID NO: 40962 - DNA, 22 bp, Artificial sequence
  SiRNA target sequence
aaaatttttaaatgaatttttt

SEQ ID NO: 40963 - DNA, 22 bp, Artificial sequence
  SiRNA target sequence
aaatttttaaatgaattttttc

SEQ ID NO: 40964 - DNA, 22 bp, Artificial sequence
  SiRNA target sequence
aatttttaaatgaattttttcc

SEQ ID NO: 40965 - DNA, 22 bp, Artificial sequence
  SiRNA target sequence
atttttaaatgaattttttcct

SEQ ID NO: 40966 - DNA, 22 bp, Artificial sequence
  SiRNA target sequence
tttttaaatgaattttttcctg

SEQ ID NO: 40967 - DNA, 22 bp, Artificial sequence
  SiRNA target sequence
ttttaaatgaattttttcctgt

SEQ ID NO: 40968 - DNA, 22 bp, Artificial sequence
  SiRNA target sequence
tttaaatgaattttttcctgtc

SEQ ID NO: 40969 - DNA, 22 bp, Artificial sequence
  SiRNA target sequence
ttaaatgaattttttcctgtca

SEQ ID NO: 40970 - DNA, 22 bp, Artificial sequence
  SiRNA target sequence
taaatgaattttttcctgtcag

SEQ ID NO: 40971 - DNA, 22 bp, Artificial sequence
  SiRNA target sequence
aaatgaattttttcctgtcagt

SEQ ID NO: 40972 - DNA, 22 bp, Artificial sequence
  SiRNA target sequence
aatgaattttttcctgtcagtc

SEQ ID NO: 40973 - DNA, 22 bp, Artificial sequence
  SiRNA target sequence
atgaattttttcctgtcagtct

SEQ ID NO: 40974 - DNA, 22 bp, Artificial sequence
  SiRNA target sequence
tgaattttttcctgtcagtctg

SEQ ID NO: 40975 - DNA, 22 bp, Artificial sequence
  SiRNA target sequence
gaattttttcctgtcagtctga

SEQ ID NO: 40976 - DNA, 22 bp, Artificial sequence
  SiRNA target sequence
aattttttcctgtcagtctgaa

SEQ ID NO: 40977 - DNA, 22 bp, Artificial sequence
  SiRNA target sequence
attttttcctgtcagtctgaat

SEQ ID NO: 40978 - DNA, 22 bp, Artificial sequence
  SiRNA target sequence
ttttttcctgtcagtctgaata

SEQ ID NO: 40979 - DNA, 22 bp, Artificial sequence
  SiRNA target sequence
tttttcctgtcagtctgaatac

SEQ ID NO: 40980 - DNA, 22 bp, Artificial sequence
  SiRNA target sequence
ttttcctgtcagtctgaataca

SEQ ID NO: 40981 - DNA, 22 bp, Artificial sequence
  SiRNA target sequence
tttcctgtcagtctgaatacat

SEQ ID NO: 40982 - DNA, 22 bp, Artificial sequence
  SiRNA target sequence
ttcctgtcagtctgaatacatg

SEQ ID NO: 40983 - DNA, 22 bp, Artificial sequence
  SiRNA target sequence
tcctgtcagtctgaatacatgt

SEQ ID NO: 40984 - DNA, 22 bp, Artificial sequence
  SiRNA target sequence
cctgtcagtctgaatacatgtt

SEQ ID NO: 40985 - DNA, 22 bp, Artificial sequence
  SiRNA target sequence
ctgtcagtctgaatacatgttg

SEQ ID NO: 40986 - DNA, 22 bp, Artificial sequence
  SiRNA target sequence
tgtcagtctgaatacatgttga

SEQ ID NO: 40987 - DNA, 22 bp, Artificial sequence
  SiRNA target sequence
gtcagtctgaatacatgttgaa

SEQ ID NO: 40988 - DNA, 22 bp, Artificial sequence
  SiRNA target sequence
tcagtctgaatacatgttgaac

SEQ ID NO: 40989 - DNA, 22 bp, Artificial sequence
  SiRNA target sequence
cagtctgaatacatgttgaacg

SEQ ID NO: 40990 - DNA, 22 bp, Artificial sequence
  SiRNA target sequence
agtctgaatacatgttgaacgg

SEQ ID NO: 40991 - DNA, 22 bp, Artificial sequence
  SiRNA target sequence
gtctgaatacatgttgaacggg

SEQ ID NO: 40992 - DNA, 22 bp, Artificial sequence
  SiRNA target sequence
tctgaatacatgttgaacgggt

SEQ ID NO: 40993 - DNA, 22 bp, Artificial sequence
  SiRNA target sequence
ctgaatacatgttgaacgggtg

SEQ ID NO: 40994 - DNA, 22 bp, Artificial sequence
  SiRNA target sequence
tgaatacatgttgaacgggtgt

SEQ ID NO: 40995 - DNA, 22 bp, Artificial sequence
  SiRNA target sequence
gaatacatgttgaacgggtgta

SEQ ID NO: 40996 - DNA, 22 bp, Artificial sequence
  SiRNA target sequence
aatacatgttgaacgggtgtaa

SEQ ID NO: 40997 - DNA, 22 bp, Artificial sequence
  SiRNA target sequence
atacatgttgaacgggtgtaac

SEQ ID NO: 40998 - DNA, 22 bp, Artificial sequence
  SiRNA target sequence
tacatgttgaacgggtgtaaca

SEQ ID NO: 40999 - DNA, 22 bp, Artificial sequence
  SiRNA target sequence
acatgttgaacgggtgtaacaa

SEQ ID NO: 41000 - DNA, 22 bp, Artificial sequence
  SiRNA target sequence
catgttgaacgggtgtaacaaa

SEQ ID NO: 41001 - DNA, 22 bp, Artificial sequence
  SiRNA target sequence
atgttgaacgggtgtaacaaat

SEQ ID NO: 41002 - DNA, 22 bp, Artificial sequence
  SiRNA target sequence
tgttgaacgggtgtaacaaata

SEQ ID NO: 41003 - DNA, 22 bp, Artificial sequence
  SiRNA target sequence
gttgaacgggtgtaacaaatat

SEQ ID NO: 41004 - DNA, 22 bp, Artificial sequence
  SiRNA target sequence
ttgaacgggtgtaacaaatata

SEQ ID NO: 41005 - DNA, 22 bp, Artificial sequence
  SiRNA target sequence
tgaacgggtgtaacaaatataa

SEQ ID NO: 41006 - DNA, 22 bp, Artificial sequence
  SiRNA target sequence
gaacgggtgtaacaaatataaa

SEQ ID NO: 41007 - DNA, 22 bp, Artificial sequence
  SiRNA target sequence
aacgggtgtaacaaatataaaa

SEQ ID NO: 41008 - DNA, 22 bp, Artificial sequence
  SiRNA target sequence
acgggtgtaacaaatataaaat

SEQ ID NO: 41009 - DNA, 22 bp, Artificial sequence
  SiRNA target sequence
cgggtgtaacaaatataaaatt

SEQ ID NO: 41010 - DNA, 22 bp, Artificial sequence
  SiRNA target sequence
gggtgtaacaaatataaaattg

SEQ ID NO: 41011 - DNA, 22 bp, Artificial sequence
  SiRNA target sequence
ggtgtaacaaatataaaattgt

SEQ ID NO: 41012 - DNA, 22 bp, Artificial sequence
  SiRNA target sequence
gtgtaacaaatataaaattgtt

SEQ ID NO: 41013 - DNA, 22 bp, Artificial sequence
  SiRNA target sequence
tgtaacaaatataaaattgtta

SEQ ID NO: 41014 - DNA, 22 bp, Artificial sequence
  SiRNA target sequence
gtaacaaatataaaattgttaa

SEQ ID NO: 41015 - DNA, 22 bp, Artificial sequence
  SiRNA target sequence
taacaaatataaaattgttaag

SEQ ID NO: 41016 - DNA, 22 bp, Artificial sequence
  SiRNA target sequence
aacaaatataaaattgttaagt

SEQ ID NO: 41017 - DNA, 22 bp, Artificial sequence
  SiRNA target sequence
acaaatataaaattgttaagtt

SEQ ID NO: 41018 - DNA, 22 bp, Artificial sequence
  SiRNA target sequence
caaatataaaattgttaagttc

SEQ ID NO: 41019 - DNA, 22 bp, Artificial sequence
  SiRNA target sequence
aaatataaaattgttaagttct

SEQ ID NO: 41020 - DNA, 22 bp, Artificial sequence
  SiRNA target sequence
aatataaaattgttaagttctg

SEQ ID NO: 41021 - DNA, 22 bp, Artificial sequence
  SiRNA target sequence
atataaaattgttaagttctga

SEQ ID NO: 41022 - DNA, 22 bp, Artificial sequence
  SiRNA target sequence
tataaaattgttaagttctgac

SEQ ID NO: 41023 - DNA, 22 bp, Artificial sequence
  SiRNA target sequence
ataaaattgttaagttctgaca

SEQ ID NO: 41024 - DNA, 22 bp, Artificial sequence
  SiRNA target sequence
taaaattgttaagttctgacat

SEQ ID NO: 41025 - DNA, 22 bp, Artificial sequence
  SiRNA target sequence
aaaattgttaagttctgacatt

SEQ ID NO: 41026 - DNA, 22 bp, Artificial sequence
  SiRNA target sequence
aaattgttaagttctgacattg

SEQ ID NO: 41027 - DNA, 22 bp, Artificial sequence
  SiRNA target sequence
aattgttaagttctgacattgt

SEQ ID NO: 41028 - DNA, 22 bp, Artificial sequence
  SiRNA target sequence
attgttaagttctgacattgta

SEQ ID NO: 41029 - DNA, 22 bp, Artificial sequence
  SiRNA target sequence
ttgttaagttctgacattgtaa

SEQ ID NO: 41030 - DNA, 22 bp, Artificial sequence
  SiRNA target sequence
tgttaagttctgacattgtaat

SEQ ID NO: 41031 - DNA, 22 bp, Artificial sequence
  SiRNA target sequence
gttaagttctgacattgtaatt

SEQ ID NO: 41032 - DNA, 22 bp, Artificial sequence
  SiRNA target sequence
ttaagttctgacattgtaattg

SEQ ID NO: 41033 - DNA, 22 bp, Artificial sequence
  SiRNA target sequence
taagttctgacattgtaattga

SEQ ID NO: 41034 - DNA, 22 bp, Artificial sequence
  SiRNA target sequence
aagttctgacattgtaattgat

SEQ ID NO: 41035 - DNA, 22 bp, Artificial sequence
  SiRNA target sequence
agttctgacattgtaattgata

SEQ ID NO: 41036 - DNA, 22 bp, Artificial sequence
  SiRNA target sequence
gttctgacattgtaattgatac

SEQ ID NO: 41037 - DNA, 22 bp, Artificial sequence
  SiRNA target sequence
ttctgacattgtaattgataca

SEQ ID NO: 41038 - DNA, 22 bp, Artificial sequence
  SiRNA target sequence
tctgacattgtaattgatacaa

SEQ ID NO: 41039 - DNA, 22 bp, Artificial sequence
  SiRNA target sequence
ctgacattgtaattgatacaat

SEQ ID NO: 41040 - DNA, 22 bp, Artificial sequence
  SiRNA target sequence
tgacattgtaattgatacaatt

SEQ ID NO: 41041 - DNA, 22 bp, Artificial sequence
  SiRNA target sequence
gacattgtaattgatacaattg

SEQ ID NO: 41042 - DNA, 22 bp, Artificial sequence
  SiRNA target sequence
acattgtaattgatacaattgt

SEQ ID NO: 41043 - DNA, 22 bp, Artificial sequence
  SiRNA target sequence
cattgtaattgatacaattgtc

SEQ ID NO: 41044 - DNA, 22 bp, Artificial sequence
  SiRNA target sequence
attgtaattgatacaattgtca

SEQ ID NO: 41045 - DNA, 22 bp, Artificial sequence
  SiRNA target sequence
ttgtaattgatacaattgtcaa

SEQ ID NO: 41046 - DNA, 22 bp, Artificial sequence
  SiRNA target sequence
tgtaattgatacaattgtcaaa

SEQ ID NO: 41047 - DNA, 22 bp, Artificial sequence
  SiRNA target sequence
gtaattgatacaattgtcaaaa

SEQ ID NO: 41048 - DNA, 22 bp, Artificial sequence
  SiRNA target sequence
taattgatacaattgtcaaaac

SEQ ID NO: 41049 - DNA, 22 bp, Artificial sequence
  SiRNA target sequence
aattgatacaattgtcaaaact

SEQ ID NO: 41050 - DNA, 22 bp, Artificial sequence
  SiRNA target sequence
attgatacaattgtcaaaactg

SEQ ID NO: 41051 - DNA, 22 bp, Artificial sequence
  SiRNA target sequence
ttgatacaattgtcaaaactgc

SEQ ID NO: 41052 - DNA, 22 bp, Artificial sequence
  SiRNA target sequence
tgatacaattgtcaaaactgca

SEQ ID NO: 41053 - DNA, 22 bp, Artificial sequence
  SiRNA target sequence
gatacaattgtcaaaactgcaa

SEQ ID NO: 41054 - DNA, 22 bp, Artificial sequence
  SiRNA target sequence
atacaattgtcaaaactgcaaa

SEQ ID NO: 41055 - DNA, 22 bp, Artificial sequence
  SiRNA target sequence
tacaattgtcaaaactgcaaaa

SEQ ID NO: 41056 - DNA, 22 bp, Artificial sequence
  SiRNA target sequence
acaattgtcaaaactgcaaaat

SEQ ID NO: 41057 - DNA, 22 bp, Artificial sequence
  SiRNA target sequence
caattgtcaaaactgcaaaata

SEQ ID NO: 41058 - DNA, 22 bp, Artificial sequence
  SiRNA target sequence
aattgtcaaaactgcaaaatac

SEQ ID NO: 41059 - DNA, 22 bp, Artificial sequence
  SiRNA target sequence
attgtcaaaactgcaaaataca

SEQ ID NO: 41060 - DNA, 22 bp, Artificial sequence
  SiRNA target sequence
ttgtcaaaactgcaaaatacaa

SEQ ID NO: 41061 - DNA, 22 bp, Artificial sequence
  SiRNA target sequence
tgtcaaaactgcaaaatacaaa

SEQ ID NO: 41062 - DNA, 22 bp, Artificial sequence
  SiRNA target sequence
gtcaaaactgcaaaatacaaaa

SEQ ID NO: 41063 - DNA, 22 bp, Artificial sequence
  SiRNA target sequence
tcaaaactgcaaaatacaaaag

SEQ ID NO: 41064 - DNA, 22 bp, Artificial sequence
  SiRNA target sequence
caaaactgcaaaatacaaaaga

SEQ ID NO: 41065 - DNA, 22 bp, Artificial sequence
  SiRNA target sequence
aaaactgcaaaatacaaaagac

SEQ ID NO: 41066 - DNA, 22 bp, Artificial sequence
  SiRNA target sequence
aaactgcaaaatacaaaagact

SEQ ID NO: 41067 - DNA, 22 bp, Artificial sequence
  SiRNA target sequence
aactgcaaaatacaaaagactt

SEQ ID NO: 41068 - DNA, 22 bp, Artificial sequence
  SiRNA target sequence
actgcaaaatacaaaagacttt

SEQ ID NO: 41069 - DNA, 22 bp, Artificial sequence
  SiRNA target sequence
ctgcaaaatacaaaagactttg

SEQ ID NO: 41070 - DNA, 22 bp, Artificial sequence
  SiRNA target sequence
tgcaaaatacaaaagactttga

SEQ ID NO: 41071 - DNA, 22 bp, Artificial sequence
  SiRNA target sequence
gcaaaatacaaaagactttgac

SEQ ID NO: 41072 - DNA, 22 bp, Artificial sequence
  SiRNA target sequence
caaaatacaaaagactttgact

SEQ ID NO: 41073 - DNA, 22 bp, Artificial sequence
  SiRNA target sequence
aaaatacaaaagactttgacta

SEQ ID NO: 41074 - DNA, 22 bp, Artificial sequence
  SiRNA target sequence
aaatacaaaagactttgactaa

SEQ ID NO: 41075 - DNA, 22 bp, Artificial sequence
  SiRNA target sequence
aatacaaaagactttgactaag

SEQ ID NO: 41076 - DNA, 22 bp, Artificial sequence
  SiRNA target sequence
atacaaaagactttgactaaga

SEQ ID NO: 41077 - DNA, 22 bp, Artificial sequence
  SiRNA target sequence
tacaaaagactttgactaagat

SEQ ID NO: 41078 - DNA, 22 bp, Artificial sequence
  SiRNA target sequence
acaaaagactttgactaagatc

SEQ ID NO: 41079 - DNA, 22 bp, Artificial sequence
  SiRNA target sequence
caaaagactttgactaagatct

SEQ ID NO: 41080 - DNA, 22 bp, Artificial sequence
  SiRNA target sequence
aaaagactttgactaagatctt

SEQ ID NO: 41081 - DNA, 22 bp, Artificial sequence
  SiRNA target sequence
aaagactttgactaagatcttt

SEQ ID NO: 41082 - DNA, 22 bp, Artificial sequence
  SiRNA target sequence
aagactttgactaagatcttta

SEQ ID NO: 41083 - DNA, 22 bp, Artificial sequence
  SiRNA target sequence
agactttgactaagatctttat

SEQ ID NO: 41084 - DNA, 22 bp, Artificial sequence
  SiRNA target sequence
gactttgactaagatctttatt

SEQ ID NO: 41085 - DNA, 22 bp, Artificial sequence
  SiRNA target sequence
actttgactaagatctttatta

SEQ ID NO: 41086 - DNA, 22 bp, Artificial sequence
  SiRNA target sequence
ctttgactaagatctttattat

SEQ ID NO: 41087 - DNA, 22 bp, Artificial sequence
  SiRNA target sequence
tttgactaagatctttattatc

SEQ ID NO: 41088 - DNA, 22 bp, Artificial sequence
  SiRNA target sequence
ttgactaagatctttattatct

SEQ ID NO: 41089 - DNA, 22 bp, Artificial sequence
  SiRNA target sequence
tgactaagatctttattatctg

SEQ ID NO: 41090 - DNA, 22 bp, Artificial sequence
  SiRNA target sequence
gactaagatctttattatctgt

SEQ ID NO: 41091 - DNA, 22 bp, Artificial sequence
  SiRNA target sequence
actaagatctttattatctgta

SEQ ID NO: 41092 - DNA, 22 bp, Artificial sequence
  SiRNA target sequence
ctaagatctttattatctgtaa

SEQ ID NO: 41093 - DNA, 22 bp, Artificial sequence
  SiRNA target sequence
taagatctttattatctgtaat

SEQ ID NO: 41094 - DNA, 22 bp, Artificial sequence
  SiRNA target sequence
aagatctttattatctgtaata

SEQ ID NO: 41095 - DNA, 22 bp, Artificial sequence
  SiRNA target sequence
agatctttattatctgtaatat

SEQ ID NO: 41096 - DNA, 22 bp, Artificial sequence
  SiRNA target sequence
gatctttattatctgtaatatc

SEQ ID NO: 41097 - DNA, 22 bp, Artificial sequence
  SiRNA target sequence
atctttattatctgtaatatca

SEQ ID NO: 41098 - DNA, 22 bp, Artificial sequence
  SiRNA target sequence
tctttattatctgtaatatcac

SEQ ID NO: 41099 - DNA, 22 bp, Artificial sequence
  SiRNA target sequence
ctttattatctgtaatatcact

SEQ ID NO: 41100 - DNA, 22 bp, Artificial sequence
  SiRNA target sequence
tttattatctgtaatatcacta

SEQ ID NO: 41101 - DNA, 22 bp, Artificial sequence
  SiRNA target sequence
ttattatctgtaatatcactag

SEQ ID NO: 41102 - DNA, 22 bp, Artificial sequence
  SiRNA target sequence
tattatctgtaatatcactagt

SEQ ID NO: 41103 - DNA, 22 bp, Artificial sequence
  SiRNA target sequence
attatctgtaatatcactagtc

SEQ ID NO: 41104 - DNA, 22 bp, Artificial sequence
  SiRNA target sequence
ttatctgtaatatcactagtca

SEQ ID NO: 41105 - DNA, 22 bp, Artificial sequence
  SiRNA target sequence
tatctgtaatatcactagtcaa

SEQ ID NO: 41106 - DNA, 22 bp, Artificial sequence
  SiRNA target sequence
atctgtaatatcactagtcaat

SEQ ID NO: 41107 - DNA, 22 bp, Artificial sequence
  SiRNA target sequence
tctgtaatatcactagtcaatt

SEQ ID NO: 41108 - DNA, 22 bp, Artificial sequence
  SiRNA target sequence
ctgtaatatcactagtcaattt

SEQ ID NO: 41109 - DNA, 22 bp, Artificial sequence
  SiRNA target sequence
tgtaatatcactagtcaatttc

SEQ ID NO: 41110 - DNA, 22 bp, Artificial sequence
  SiRNA target sequence
gtaatatcactagtcaatttcc

SEQ ID NO: 41111 - DNA, 22 bp, Artificial sequence
  SiRNA target sequence
taatatcactagtcaatttccg

SEQ ID NO: 41112 - DNA, 22 bp, Artificial sequence
  SiRNA target sequence
aatatcactagtcaatttccgg

SEQ ID NO: 41113 - DNA, 22 bp, Artificial sequence
  SiRNA target sequence
atatcactagtcaatttccggg

SEQ ID NO: 41114 - DNA, 22 bp, Artificial sequence
  SiRNA target sequence
tatcactagtcaatttccgggt

SEQ ID NO: 41115 - DNA, 22 bp, Artificial sequence
  SiRNA target sequence
atcactagtcaatttccgggta

SEQ ID NO: 41116 - DNA, 22 bp, Artificial sequence
  SiRNA target sequence
tcactagtcaatttccgggtag

SEQ ID NO: 41117 - DNA, 22 bp, Artificial sequence
  SiRNA target sequence
cactagtcaatttccgggtagc

SEQ ID NO: 41118 - DNA, 22 bp, Artificial sequence
  SiRNA target sequence
actagtcaatttccgggtagct

SEQ ID NO: 41119 - DNA, 22 bp, Artificial sequence
  SiRNA target sequence
ctagtcaatttccgggtagctt

SEQ ID NO: 41120 - DNA, 22 bp, Artificial sequence
  SiRNA target sequence
tagtcaatttccgggtagcttc

SEQ ID NO: 41121 - DNA, 22 bp, Artificial sequence
  SiRNA target sequence
agtcaatttccgggtagcttca

SEQ ID NO: 41122 - DNA, 22 bp, Artificial sequence
  SiRNA target sequence
gtcaatttccgggtagcttcaa

SEQ ID NO: 41123 - DNA, 22 bp, Artificial sequence
  SiRNA target sequence
tcaatttccgggtagcttcaac

SEQ ID NO: 41124 - DNA, 22 bp, Artificial sequence
  SiRNA target sequence
caatttccgggtagcttcaact

SEQ ID NO: 41125 - DNA, 22 bp, Artificial sequence
  SiRNA target sequence
aatttccgggtagcttcaactg

SEQ ID NO: 41126 - DNA, 22 bp, Artificial sequence
  SiRNA target sequence
atttccgggtagcttcaactgt

SEQ ID NO: 41127 - DNA, 22 bp, Artificial sequence
  SiRNA target sequence
tttccgggtagcttcaactgtt

SEQ ID NO: 41128 - DNA, 22 bp, Artificial sequence
  SiRNA target sequence
ttccgggtagcttcaactgtta

SEQ ID NO: 41129 - DNA, 22 bp, Artificial sequence
  SiRNA target sequence
tccgggtagcttcaactgttaa

SEQ ID NO: 41130 - DNA, 22 bp, Artificial sequence
  SiRNA target sequence
ccgggtagcttcaactgttaaa

SEQ ID NO: 41131 - DNA, 22 bp, Artificial sequence
  SiRNA target sequence
cgggtagcttcaactgttaaaa

SEQ ID NO: 41132 - DNA, 22 bp, Artificial sequence
  SiRNA target sequence
gggtagcttcaactgttaaaac

SEQ ID NO: 41133 - DNA, 22 bp, Artificial sequence
  SiRNA target sequence
ggtagcttcaactgttaaaaca

SEQ ID NO: 41134 - DNA, 22 bp, Artificial sequence
  SiRNA target sequence
gtagcttcaactgttaaaacat

SEQ ID NO: 41135 - DNA, 22 bp, Artificial sequence
  SiRNA target sequence
tagcttcaactgttaaaacatt

SEQ ID NO: 41136 - DNA, 22 bp, Artificial sequence
  SiRNA target sequence
agcttcaactgttaaaacatta

SEQ ID NO: 41137 - DNA, 22 bp, Artificial sequence
  SiRNA target sequence
gcttcaactgttaaaacattaa

SEQ ID NO: 41138 - DNA, 22 bp, Artificial sequence
  SiRNA target sequence
cttcaactgttaaaacattaaa

SEQ ID NO: 41139 - DNA, 22 bp, Artificial sequence
  SiRNA target sequence
ttcaactgttaaaacattaaat

SEQ ID NO: 41140 - DNA, 22 bp, Artificial sequence
  SiRNA target sequence
tcaactgttaaaacattaaatg

SEQ ID NO: 41141 - DNA, 22 bp, Artificial sequence
  SiRNA target sequence
caactgttaaaacattaaatgt

SEQ ID NO: 41142 - DNA, 22 bp, Artificial sequence
  SiRNA target sequence
aactgttaaaacattaaatgta

SEQ ID NO: 41143 - DNA, 22 bp, Artificial sequence
  SiRNA target sequence
actgttaaaacattaaatgtac

SEQ ID NO: 41144 - DNA, 22 bp, Artificial sequence
  SiRNA target sequence
ctgttaaaacattaaatgtaca

SEQ ID NO: 41145 - DNA, 22 bp, Artificial sequence
  SiRNA target sequence
tgttaaaacattaaatgtacaa

SEQ ID NO: 41146 - DNA, 22 bp, Artificial sequence
  SiRNA target sequence
gttaaaacattaaatgtacaaa

SEQ ID NO: 41147 - DNA, 22 bp, Artificial sequence
  SiRNA target sequence
ttaaaacattaaatgtacaaac

SEQ ID NO: 41148 - DNA, 22 bp, Artificial sequence
  SiRNA target sequence
taaaacattaaatgtacaaact

SEQ ID NO: 41149 - DNA, 22 bp, Artificial sequence
  SiRNA target sequence
aaaacattaaatgtacaaactg

SEQ ID NO: 41150 - DNA, 22 bp, Artificial sequence
  SiRNA target sequence
aaacattaaatgtacaaactgc

SEQ ID NO: 41151 - DNA, 22 bp, Artificial sequence
  SiRNA target sequence
aacattaaatgtacaaactgca

SEQ ID NO: 41152 - DNA, 22 bp, Artificial sequence
  SiRNA target sequence
acattaaatgtacaaactgcaa

SEQ ID NO: 41153 - DNA, 22 bp, Artificial sequence
  SiRNA target sequence
cattaaatgtacaaactgcaaa

SEQ ID NO: 41154 - DNA, 22 bp, Artificial sequence
  SiRNA target sequence
attaaatgtacaaactgcaaat

SEQ ID NO: 41155 - DNA, 22 bp, Artificial sequence
  SiRNA target sequence
ttaaatgtacaaactgcaaatg

SEQ ID NO: 41156 - DNA, 22 bp, Artificial sequence
  SiRNA target sequence
taaatgtacaaactgcaaatgt

SEQ ID NO: 41157 - DNA, 22 bp, Artificial sequence
  SiRNA target sequence
aaatgtacaaactgcaaatgtc

SEQ ID NO: 41158 - DNA, 22 bp, Artificial sequence
  SiRNA target sequence
aatgtacaaactgcaaatgtcc

SEQ ID NO: 41159 - DNA, 22 bp, Artificial sequence
  SiRNA target sequence
atgtacaaactgcaaatgtccc

SEQ ID NO: 41160 - DNA, 22 bp, Artificial sequence
  SiRNA target sequence
tgtacaaactgcaaatgtccca

SEQ ID NO: 41161 - DNA, 22 bp, Artificial sequence
  SiRNA target sequence
gtacaaactgcaaatgtcccaa

SEQ ID NO: 41162 - DNA, 22 bp, Artificial sequence
  SiRNA target sequence
tacaaactgcaaatgtcccaaa

SEQ ID NO: 41163 - DNA, 22 bp, Artificial sequence
  SiRNA target sequence
acaaactgcaaatgtcccaaaa

SEQ ID NO: 41164 - DNA, 22 bp, Artificial sequence
  SiRNA target sequence
caaactgcaaatgtcccaaaaa

SEQ ID NO: 41165 - DNA, 22 bp, Artificial sequence
  SiRNA target sequence
aaactgcaaatgtcccaaaaat

SEQ ID NO: 41166 - DNA, 22 bp, Artificial sequence
  SiRNA target sequence
aactgcaaatgtcccaaaaatt

SEQ ID NO: 41167 - DNA, 22 bp, Artificial sequence
  SiRNA target sequence
actgcaaatgtcccaaaaatta

SEQ ID NO: 41168 - DNA, 22 bp, Artificial sequence
  SiRNA target sequence
ctgcaaatgtcccaaaaattat

SEQ ID NO: 41169 - DNA, 22 bp, Artificial sequence
  SiRNA target sequence
tgcaaatgtcccaaaaattatg

SEQ ID NO: 41170 - DNA, 22 bp, Artificial sequence
  SiRNA target sequence
gcaaatgtcccaaaaattatgt

SEQ ID NO: 41171 - DNA, 22 bp, Artificial sequence
  SiRNA target sequence
caaatgtcccaaaaattatgta

SEQ ID NO: 41172 - DNA, 22 bp, Artificial sequence
  SiRNA target sequence
aaatgtcccaaaaattatgtaa

SEQ ID NO: 41173 - DNA, 22 bp, Artificial sequence
  SiRNA target sequence
aatgtcccaaaaattatgtaaa

SEQ ID NO: 41174 - DNA, 22 bp, Artificial sequence
  SiRNA target sequence
atgtcccaaaaattatgtaaat

SEQ ID NO: 41175 - DNA, 22 bp, Artificial sequence
  SiRNA target sequence
tgtcccaaaaattatgtaaatg

SEQ ID NO: 41176 - DNA, 22 bp, Artificial sequence
  SiRNA target sequence
gtcccaaaaattatgtaaatga

SEQ ID NO: 41177 - DNA, 22 bp, Artificial sequence
  SiRNA target sequence
tcccaaaaattatgtaaatgac

SEQ ID NO: 41178 - DNA, 22 bp, Artificial sequence
  SiRNA target sequence
cccaaaaattatgtaaatgaca

SEQ ID NO: 41179 - DNA, 22 bp, Artificial sequence
  SiRNA target sequence
ccaaaaattatgtaaatgacaa

SEQ ID NO: 41180 - DNA, 22 bp, Artificial sequence
  SiRNA target sequence
caaaaattatgtaaatgacaaa

SEQ ID NO: 41181 - DNA, 22 bp, Artificial sequence
  SiRNA target sequence
aaaaattatgtaaatgacaaat

SEQ ID NO: 41182 - DNA, 22 bp, Artificial sequence
  SiRNA target sequence
aaaattatgtaaatgacaaatg

SEQ ID NO: 41183 - DNA, 22 bp, Artificial sequence
  SiRNA target sequence
aaattatgtaaatgacaaatgt

SEQ ID NO: 41184 - DNA, 22 bp, Artificial sequence
  SiRNA target sequence
aattatgtaaatgacaaatgtt

SEQ ID NO: 41185 - DNA, 22 bp, Artificial sequence
  SiRNA target sequence
attatgtaaatgacaaatgttc

SEQ ID NO: 41186 - DNA, 22 bp, Artificial sequence
  SiRNA target sequence
ttatgtaaatgacaaatgttcg

SEQ ID NO: 41187 - DNA, 22 bp, Artificial sequence
  SiRNA target sequence
tatgtaaatgacaaatgttcga

SEQ ID NO: 41188 - DNA, 22 bp, Artificial sequence
  SiRNA target sequence
atgtaaatgacaaatgttcgaa

SEQ ID NO: 41189 - DNA, 22 bp, Artificial sequence
  SiRNA target sequence
tgtaaatgacaaatgttcgaat

SEQ ID NO: 41190 - DNA, 22 bp, Artificial sequence
  SiRNA target sequence
gtaaatgacaaatgttcgaata

SEQ ID NO: 41191 - DNA, 22 bp, Artificial sequence
  SiRNA target sequence
taaatgacaaatgttcgaataa

SEQ ID NO: 41192 - DNA, 22 bp, Artificial sequence
  SiRNA target sequence
aaatgacaaatgttcgaataaa

SEQ ID NO: 41193 - DNA, 22 bp, Artificial sequence
  SiRNA target sequence
aatgacaaatgttcgaataaag

SEQ ID NO: 41194 - DNA, 22 bp, Artificial sequence
  SiRNA target sequence
atgacaaatgttcgaataaagg

SEQ ID NO: 41195 - DNA, 22 bp, Artificial sequence
  SiRNA target sequence
tgacaaatgttcgaataaaggg

SEQ ID NO: 41196 - DNA, 22 bp, Artificial sequence
  SiRNA target sequence
gacaaatgttcgaataaagggc

SEQ ID NO: 41197 - DNA, 22 bp, Artificial sequence
  SiRNA target sequence
acaaatgttcgaataaagggct

SEQ ID NO: 41198 - DNA, 22 bp, Artificial sequence
  SiRNA target sequence
caaatgttcgaataaagggctt

SEQ ID NO: 41199 - DNA, 22 bp, Artificial sequence
  SiRNA target sequence
aaatgttcgaataaagggcttt

SEQ ID NO: 41200 - DNA, 22 bp, Artificial sequence
  SiRNA target sequence
aatgttcgaataaagggctttg

SEQ ID NO: 41201 - DNA, 22 bp, Artificial sequence
  SiRNA target sequence
atgttcgaataaagggctttga

SEQ ID NO: 41202 - DNA, 22 bp, Artificial sequence
  SiRNA target sequence
tgttcgaataaagggctttgaa

SEQ ID NO: 41203 - DNA, 22 bp, Artificial sequence
  SiRNA target sequence
gttcgaataaagggctttgaaa

SEQ ID NO: 41204 - DNA, 22 bp, Artificial sequence
  SiRNA target sequence
ttcgaataaagggctttgaaat

SEQ ID NO: 41205 - DNA, 22 bp, Artificial sequence
  SiRNA target sequence
tcgaataaagggctttgaaata

SEQ ID NO: 41206 - DNA, 22 bp, Artificial sequence
  SiRNA target sequence
cgaataaagggctttgaaataa

SEQ ID NO: 41207 - DNA, 22 bp, Artificial sequence
  SiRNA target sequence
gaataaagggctttgaaataac

SEQ ID NO: 41208 - DNA, 22 bp, Artificial sequence
  SiRNA target sequence
aataaagggctttgaaataaca

SEQ ID NO: 41209 - DNA, 22 bp, Artificial sequence
  SiRNA target sequence
ataaagggctttgaaataacat

SEQ ID NO: 41210 - DNA, 22 bp, Artificial sequence
  SiRNA target sequence
taaagggctttgaaataacata

SEQ ID NO: 41211 - DNA, 22 bp, Artificial sequence
  SiRNA target sequence
aaagggctttgaaataacatat

SEQ ID NO: 41212 - DNA, 22 bp, Artificial sequence
  SiRNA target sequence
aagggctttgaaataacatatt

SEQ ID NO: 41213 - DNA, 22 bp, Artificial sequence
  SiRNA target sequence
agggctttgaaataacatattc

SEQ ID NO: 41214 - DNA, 22 bp, Artificial sequence
  SiRNA target sequence
gggctttgaaataacatattct

SEQ ID NO: 41215 - DNA, 22 bp, Artificial sequence
  SiRNA target sequence
ggctttgaaataacatattcta

SEQ ID NO: 41216 - DNA, 22 bp, Artificial sequence
  SiRNA target sequence
gctttgaaataacatattctac

SEQ ID NO: 41217 - DNA, 22 bp, Artificial sequence
  SiRNA target sequence
ctttgaaataacatattctaca

SEQ ID NO: 41218 - DNA, 22 bp, Artificial sequence
  SiRNA target sequence
tttgaaataacatattctacaa

SEQ ID NO: 41219 - DNA, 22 bp, Artificial sequence
  SiRNA target sequence
ttgaaataacatattctacaat

SEQ ID NO: 41220 - DNA, 22 bp, Artificial sequence
  SiRNA target sequence
tgaaataacatattctacaatc

SEQ ID NO: 41221 - DNA, 22 bp, Artificial sequence
  SiRNA target sequence
gaaataacatattctacaatca

SEQ ID NO: 41222 - DNA, 22 bp, Artificial sequence
  SiRNA target sequence
aaataacatattctacaatcag

SEQ ID NO: 41223 - DNA, 22 bp, Artificial sequence
  SiRNA target sequence
aataacatattctacaatcagg

SEQ ID NO: 41224 - DNA, 22 bp, Artificial sequence
  SiRNA target sequence
ataacatattctacaatcaggt

SEQ ID NO: 41225 - DNA, 22 bp, Artificial sequence
  SiRNA target sequence
taacatattctacaatcaggtc

SEQ ID NO: 41226 - DNA, 22 bp, Artificial sequence
  SiRNA target sequence
aacatattctacaatcaggtct

SEQ ID NO: 41227 - DNA, 22 bp, Artificial sequence
  SiRNA target sequence
acatattctacaatcaggtctt

SEQ ID NO: 41228 - DNA, 22 bp, Artificial sequence
  SiRNA target sequence
catattctacaatcaggtcttt

SEQ ID NO: 41229 - DNA, 22 bp, Artificial sequence
  SiRNA target sequence
atattctacaatcaggtctttc

SEQ ID NO: 41230 - DNA, 22 bp, Artificial sequence
  SiRNA target sequence
tattctacaatcaggtctttca

SEQ ID NO: 41231 - DNA, 22 bp, Artificial sequence
  SiRNA target sequence
attctacaatcaggtctttcat

SEQ ID NO: 41232 - DNA, 22 bp, Artificial sequence
  SiRNA target sequence
ttctacaatcaggtctttcata

SEQ ID NO: 41233 - DNA, 22 bp, Artificial sequence
  SiRNA target sequence
tctacaatcaggtctttcataa

SEQ ID NO: 41234 - DNA, 22 bp, Artificial sequence
  SiRNA target sequence
ctacaatcaggtctttcataat

SEQ ID NO: 41235 - DNA, 22 bp, Artificial sequence
  SiRNA target sequence
tacaatcaggtctttcataata

SEQ ID NO: 41236 - DNA, 22 bp, Artificial sequence
  SiRNA target sequence
acaatcaggtctttcataatac

SEQ ID NO: 41237 - DNA, 22 bp, Artificial sequence
  SiRNA target sequence
caatcaggtctttcataatact

SEQ ID NO: 41238 - DNA, 22 bp, Artificial sequence
  SiRNA target sequence
aatcaggtctttcataatacta

SEQ ID NO: 41239 - DNA, 22 bp, Artificial sequence
  SiRNA target sequence
atcaggtctttcataatactaa

SEQ ID NO: 41240 - DNA, 22 bp, Artificial sequence
  SiRNA target sequence
tcaggtctttcataatactaat

SEQ ID NO: 41241 - DNA, 22 bp, Artificial sequence
  SiRNA target sequence
caggtctttcataatactaata

SEQ ID NO: 41242 - DNA, 22 bp, Artificial sequence
  SiRNA target sequence
aggtctttcataatactaatat

SEQ ID NO: 41243 - DNA, 22 bp, Artificial sequence
  SiRNA target sequence
ggtctttcataatactaatatc

SEQ ID NO: 41244 - DNA, 22 bp, Artificial sequence
  SiRNA target sequence
gtctttcataatactaatatca

SEQ ID NO: 41245 - DNA, 22 bp, Artificial sequence
  SiRNA target sequence
tctttcataatactaatatcac

SEQ ID NO: 41246 - DNA, 22 bp, Artificial sequence
  SiRNA target sequence
ctttcataatactaatatcact

SEQ ID NO: 41247 - DNA, 22 bp, Artificial sequence
  SiRNA target sequence
tttcataatactaatatcacta

SEQ ID NO: 41248 - DNA, 22 bp, Artificial sequence
  SiRNA target sequence
ttcataatactaatatcactac

SEQ ID NO: 41249 - DNA, 22 bp, Artificial sequence
  SiRNA target sequence
tcataatactaatatcactacc

SEQ ID NO: 41250 - DNA, 22 bp, Artificial sequence
  SiRNA target sequence
cataatactaatatcactacca

SEQ ID NO: 41251 - DNA, 22 bp, Artificial sequence
  SiRNA target sequence
ataatactaatatcactaccat

SEQ ID NO: 41252 - DNA, 22 bp, Artificial sequence
  SiRNA target sequence
taatactaatatcactaccata

SEQ ID NO: 41253 - DNA, 22 bp, Artificial sequence
  SiRNA target sequence
aatactaatatcactaccataa

SEQ ID NO: 41254 - DNA, 22 bp, Artificial sequence
  SiRNA target sequence
atactaatatcactaccataaa

SEQ ID NO: 41255 - DNA, 22 bp, Artificial sequence
  SiRNA target sequence
tactaatatcactaccataaat

SEQ ID NO: 41256 - DNA, 22 bp, Artificial sequence
  SiRNA target sequence
actaatatcactaccataaata

SEQ ID NO: 41257 - DNA, 22 bp, Artificial sequence
  SiRNA target sequence
ctaatatcactaccataaatag

SEQ ID NO: 41258 - DNA, 22 bp, Artificial sequence
  SiRNA target sequence
taatatcactaccataaataga

SEQ ID NO: 41259 - DNA, 22 bp, Artificial sequence
  SiRNA target sequence
aatatcactaccataaatagat

SEQ ID NO: 41260 - DNA, 22 bp, Artificial sequence
  SiRNA target sequence
atatcactaccataaatagatt

SEQ ID NO: 41261 - DNA, 22 bp, Artificial sequence
  SiRNA target sequence
tatcactaccataaatagattt

SEQ ID NO: 41262 - DNA, 22 bp, Artificial sequence
  SiRNA target sequence
atcactaccataaatagatttt

SEQ ID NO: 41263 - DNA, 22 bp, Artificial sequence
  SiRNA target sequence
tcactaccataaatagattttt

SEQ ID NO: 41264 - DNA, 22 bp, Artificial sequence
  SiRNA target sequence
cactaccataaatagatttttt

SEQ ID NO: 41265 - DNA, 22 bp, Artificial sequence
  SiRNA target sequence
actaccataaatagattttttt

SEQ ID NO: 41266 - DNA, 22 bp, Artificial sequence
  SiRNA target sequence
ctaccataaatagatttttttt

SEQ ID NO: 41267 - DNA, 22 bp, Artificial sequence
  SiRNA target sequence
taccataaatagattttttttc

SEQ ID NO: 41268 - DNA, 22 bp, Artificial sequence
  SiRNA target sequence
accataaatagattttttttct

SEQ ID NO: 41269 - DNA, 22 bp, Artificial sequence
  SiRNA target sequence
ccataaatagattttttttcta

SEQ ID NO: 41270 - DNA, 22 bp, Artificial sequence
  SiRNA target sequence
cataaatagattttttttctaa

SEQ ID NO: 41271 - DNA, 22 bp, Artificial sequence
  SiRNA target sequence
ataaatagattttttttctaac

SEQ ID NO: 41272 - DNA, 22 bp, Artificial sequence
  SiRNA target sequence
taaatagattttttttctaaca

SEQ ID NO: 41273 - DNA, 22 bp, Artificial sequence
  SiRNA target sequence
aaatagattttttttctaacat

SEQ ID NO: 41274 - DNA, 23 bp, Artificial sequence
  SiRNA target sequence
ttataagtttaatgtagaaataa

SEQ ID NO: 41275 - DNA, 23 bp, Artificial sequence
  SiRNA target sequence
tataagtttaatgtagaaataat

SEQ ID NO: 41276 - DNA, 23 bp, Artificial sequence
  SiRNA target sequence
ataagtttaatgtagaaataata

SEQ ID NO: 41277 - DNA, 23 bp, Artificial sequence
  SiRNA target sequence
taagtttaatgtagaaataatat

SEQ ID NO: 41278 - DNA, 23 bp, Artificial sequence
  SiRNA target sequence
aagtttaatgtagaaataatatt

SEQ ID NO: 41279 - DNA, 23 bp, Artificial sequence
  SiRNA target sequence
agtttaatgtagaaataatattt

SEQ ID NO: 41280 - DNA, 23 bp, Artificial sequence
  SiRNA target sequence
gtttaatgtagaaataatatttt

SEQ ID NO: 41281 - DNA, 23 bp, Artificial sequence
  SiRNA target sequence
tttaatgtagaaataatattttc

SEQ ID NO: 41282 - DNA, 23 bp, Artificial sequence
  SiRNA target sequence
ttaatgtagaaataatattttct

SEQ ID NO: 41283 - DNA, 23 bp, Artificial sequence
  SiRNA target sequence
taatgtagaaataatattttctt

SEQ ID NO: 41284 - DNA, 23 bp, Artificial sequence
  SiRNA target sequence
aatgtagaaataatattttcttc

SEQ ID NO: 41285 - DNA, 23 bp, Artificial sequence
  SiRNA target sequence
atgtagaaataatattttcttct

SEQ ID NO: 41286 - DNA, 23 bp, Artificial sequence
  SiRNA target sequence
tgtagaaataatattttcttcta

SEQ ID NO: 41287 - DNA, 23 bp, Artificial sequence
  SiRNA target sequence
gtagaaataatattttcttctat

SEQ ID NO: 41288 - DNA, 23 bp, Artificial sequence
  SiRNA target sequence
tagaaataatattttcttctatc

SEQ ID NO: 41289 - DNA, 23 bp, Artificial sequence
  SiRNA target sequence
agaaataatattttcttctatct

SEQ ID NO: 41290 - DNA, 23 bp, Artificial sequence
  SiRNA target sequence
gaaataatattttcttctatctt

SEQ ID NO: 41291 - DNA, 23 bp, Artificial sequence
  SiRNA target sequence
aaataatattttcttctatctta

SEQ ID NO: 41292 - DNA, 23 bp, Artificial sequence
  SiRNA target sequence
aataatattttcttctatcttat

SEQ ID NO: 41293 - DNA, 23 bp, Artificial sequence
  SiRNA target sequence
ataatattttcttctatcttatg

SEQ ID NO: 41294 - DNA, 23 bp, Artificial sequence
  SiRNA target sequence
taatattttcttctatcttatgt

SEQ ID NO: 41295 - DNA, 23 bp, Artificial sequence
  SiRNA target sequence
aatattttcttctatcttatgta

SEQ ID NO: 41296 - DNA, 23 bp, Artificial sequence
  SiRNA target sequence
atattttcttctatcttatgtaa

SEQ ID NO: 41297 - DNA, 23 bp, Artificial sequence
  SiRNA target sequence
tattttcttctatcttatgtaat

SEQ ID NO: 41298 - DNA, 23 bp, Artificial sequence
  SiRNA target sequence
attttcttctatcttatgtaatg

SEQ ID NO: 41299 - DNA, 23 bp, Artificial sequence
  SiRNA target sequence
ttttcttctatcttatgtaatga

SEQ ID NO: 41300 - DNA, 23 bp, Artificial sequence
  SiRNA target sequence
tttcttctatcttatgtaatgat

SEQ ID NO: 41301 - DNA, 23 bp, Artificial sequence
  SiRNA target sequence
ttcttctatcttatgtaatgata

SEQ ID NO: 41302 - DNA, 23 bp, Artificial sequence
  SiRNA target sequence
tcttctatcttatgtaatgatac

SEQ ID NO: 41303 - DNA, 23 bp, Artificial sequence
  SiRNA target sequence
cttctatcttatgtaatgataca

SEQ ID NO: 41304 - DNA, 23 bp, Artificial sequence
  SiRNA target sequence
ttctatcttatgtaatgatacag

SEQ ID NO: 41305 - DNA, 23 bp, Artificial sequence
  SiRNA target sequence
tctatcttatgtaatgatacagt

SEQ ID NO: 41306 - DNA, 23 bp, Artificial sequence
  SiRNA target sequence
ctatcttatgtaatgatacagtt

SEQ ID NO: 41307 - DNA, 23 bp, Artificial sequence
  SiRNA target sequence
tatcttatgtaatgatacagttt

SEQ ID NO: 41308 - DNA, 23 bp, Artificial sequence
  SiRNA target sequence
atcttatgtaatgatacagtttt

SEQ ID NO: 41309 - DNA, 23 bp, Artificial sequence
  SiRNA target sequence
tcttatgtaatgatacagttttg

SEQ ID NO: 41310 - DNA, 23 bp, Artificial sequence
  SiRNA target sequence
cttatgtaatgatacagttttgt

SEQ ID NO: 41311 - DNA, 23 bp, Artificial sequence
  SiRNA target sequence
ttatgtaatgatacagttttgtt

SEQ ID NO: 41312 - DNA, 23 bp, Artificial sequence
  SiRNA target sequence
tatgtaatgatacagttttgttt

SEQ ID NO: 41313 - DNA, 23 bp, Artificial sequence
  SiRNA target sequence
atgtaatgatacagttttgtttt

SEQ ID NO: 41314 - DNA, 23 bp, Artificial sequence
  SiRNA target sequence
tgtaatgatacagttttgttttt

SEQ ID NO: 41315 - DNA, 23 bp, Artificial sequence
  SiRNA target sequence
gtaatgatacagttttgttttta

SEQ ID NO: 41316 - DNA, 23 bp, Artificial sequence
  SiRNA target sequence
taatgatacagttttgtttttaa

SEQ ID NO: 41317 - DNA, 23 bp, Artificial sequence
  SiRNA target sequence
aatgatacagttttgtttttaat

SEQ ID NO: 41318 - DNA, 23 bp, Artificial sequence
  SiRNA target sequence
atgatacagttttgtttttaata

SEQ ID NO: 41319 - DNA, 23 bp, Artificial sequence
  SiRNA target sequence
tgatacagttttgtttttaatac

SEQ ID NO: 41320 - DNA, 23 bp, Artificial sequence
  SiRNA target sequence
gatacagttttgtttttaatact

SEQ ID NO: 41321 - DNA, 23 bp, Artificial sequence
  SiRNA target sequence
atacagttttgtttttaatactt

SEQ ID NO: 41322 - DNA, 23 bp, Artificial sequence
  SiRNA target sequence
tacagttttgtttttaatactta

SEQ ID NO: 41323 - DNA, 23 bp, Artificial sequence
  SiRNA target sequence
acagttttgtttttaatacttag

SEQ ID NO: 41324 - DNA, 23 bp, Artificial sequence
  SiRNA target sequence
cagttttgtttttaatacttagc

SEQ ID NO: 41325 - DNA, 23 bp, Artificial sequence
  SiRNA target sequence
agttttgtttttaatacttagca

SEQ ID NO: 41326 - DNA, 23 bp, Artificial sequence
  SiRNA target sequence
gttttgtttttaatacttagcac

SEQ ID NO: 41327 - DNA, 23 bp, Artificial sequence
  SiRNA target sequence
ttttgtttttaatacttagcact

SEQ ID NO: 41328 - DNA, 23 bp, Artificial sequence
  SiRNA target sequence
tttgtttttaatacttagcactt

SEQ ID NO: 41329 - DNA, 23 bp, Artificial sequence
  SiRNA target sequence
ttgtttttaatacttagcacttt

SEQ ID NO: 41330 - DNA, 23 bp, Artificial sequence
  SiRNA target sequence
tgtttttaatacttagcacttta

SEQ ID NO: 41331 - DNA, 23 bp, Artificial sequence
  SiRNA target sequence
gtttttaatacttagcactttat

SEQ ID NO: 41332 - DNA, 23 bp, Artificial sequence
  SiRNA target sequence
tttttaatacttagcactttatc

SEQ ID NO: 41333 - DNA, 23 bp, Artificial sequence
  SiRNA target sequence
ttttaatacttagcactttatca

SEQ ID NO: 41334 - DNA, 23 bp, Artificial sequence
  SiRNA target sequence
tttaatacttagcactttatcaa

SEQ ID NO: 41335 - DNA, 23 bp, Artificial sequence
  SiRNA target sequence
ttaatacttagcactttatcaaa

SEQ ID NO: 41336 - DNA, 23 bp, Artificial sequence
  SiRNA target sequence
taatacttagcactttatcaaat

SEQ ID NO: 41337 - DNA, 23 bp, Artificial sequence
  SiRNA target sequence
aatacttagcactttatcaaata

SEQ ID NO: 41338 - DNA, 23 bp, Artificial sequence
  SiRNA target sequence
atacttagcactttatcaaataa

SEQ ID NO: 41339 - DNA, 23 bp, Artificial sequence
  SiRNA target sequence
tacttagcactttatcaaataag

SEQ ID NO: 41340 - DNA, 23 bp, Artificial sequence
  SiRNA target sequence
acttagcactttatcaaataagt

SEQ ID NO: 41341 - DNA, 23 bp, Artificial sequence
  SiRNA target sequence
cttagcactttatcaaataagtg

SEQ ID NO: 41342 - DNA, 23 bp, Artificial sequence
  SiRNA target sequence
ttagcactttatcaaataagtgg

SEQ ID NO: 41343 - DNA, 23 bp, Artificial sequence
  SiRNA target sequence
tagcactttatcaaataagtgga

SEQ ID NO: 41344 - DNA, 23 bp, Artificial sequence
  SiRNA target sequence
agcactttatcaaataagtggag

SEQ ID NO: 41345 - DNA, 23 bp, Artificial sequence
  SiRNA target sequence
gcactttatcaaataagtggagt

SEQ ID NO: 41346 - DNA, 23 bp, Artificial sequence
  SiRNA target sequence
cactttatcaaataagtggagta

SEQ ID NO: 41347 - DNA, 23 bp, Artificial sequence
  SiRNA target sequence
actttatcaaataagtggagtaa

SEQ ID NO: 41348 - DNA, 23 bp, Artificial sequence
  SiRNA target sequence
ctttatcaaataagtggagtaaa

SEQ ID NO: 41349 - DNA, 23 bp, Artificial sequence
  SiRNA target sequence
tttatcaaataagtggagtaaat

SEQ ID NO: 41350 - DNA, 23 bp, Artificial sequence
  SiRNA target sequence
ttatcaaataagtggagtaaatc

SEQ ID NO: 41351 - DNA, 23 bp, Artificial sequence
  SiRNA target sequence
tatcaaataagtggagtaaatct

SEQ ID NO: 41352 - DNA, 23 bp, Artificial sequence
  SiRNA target sequence
atcaaataagtggagtaaatcta

SEQ ID NO: 41353 - DNA, 23 bp, Artificial sequence
  SiRNA target sequence
tcaaataagtggagtaaatctaa

SEQ ID NO: 41354 - DNA, 23 bp, Artificial sequence
  SiRNA target sequence
caaataagtggagtaaatctaaa

SEQ ID NO: 41355 - DNA, 23 bp, Artificial sequence
  SiRNA target sequence
aaataagtggagtaaatctaaat

SEQ ID NO: 41356 - DNA, 23 bp, Artificial sequence
  SiRNA target sequence
aataagtggagtaaatctaaatt

SEQ ID NO: 41357 - DNA, 23 bp, Artificial sequence
  SiRNA target sequence
ataagtggagtaaatctaaatta

SEQ ID NO: 41358 - DNA, 23 bp, Artificial sequence
  SiRNA target sequence
taagtggagtaaatctaaattat

SEQ ID NO: 41359 - DNA, 23 bp, Artificial sequence
  SiRNA target sequence
aagtggagtaaatctaaattatg

SEQ ID NO: 41360 - DNA, 23 bp, Artificial sequence
  SiRNA target sequence
agtggagtaaatctaaattatgt

SEQ ID NO: 41361 - DNA, 23 bp, Artificial sequence
  SiRNA target sequence
gtggagtaaatctaaattatgta

SEQ ID NO: 41362 - DNA, 23 bp, Artificial sequence
  SiRNA target sequence
tggagtaaatctaaattatgtaa

SEQ ID NO: 41363 - DNA, 23 bp, Artificial sequence
  SiRNA target sequence
ggagtaaatctaaattatgtaaa

SEQ ID NO: 41364 - DNA, 23 bp, Artificial sequence
  SiRNA target sequence
gagtaaatctaaattatgtaaaa

SEQ ID NO: 41365 - DNA, 23 bp, Artificial sequence
  SiRNA target sequence
agtaaatctaaattatgtaaaac

SEQ ID NO: 41366 - DNA, 23 bp, Artificial sequence
  SiRNA target sequence
gtaaatctaaattatgtaaaaca

SEQ ID NO: 41367 - DNA, 23 bp, Artificial sequence
  SiRNA target sequence
taaatctaaattatgtaaaacaa

SEQ ID NO: 41368 - DNA, 23 bp, Artificial sequence
  SiRNA target sequence
aaatctaaattatgtaaaacaat

SEQ ID NO: 41369 - DNA, 23 bp, Artificial sequence
  SiRNA target sequence
aatctaaattatgtaaaacaata

SEQ ID NO: 41370 - DNA, 23 bp, Artificial sequence
  SiRNA target sequence
atctaaattatgtaaaacaataa

SEQ ID NO: 41371 - DNA, 23 bp, Artificial sequence
  SiRNA target sequence
tctaaattatgtaaaacaataat

SEQ ID NO: 41372 - DNA, 23 bp, Artificial sequence
  SiRNA target sequence
ctaaattatgtaaaacaataatt

SEQ ID NO: 41373 - DNA, 23 bp, Artificial sequence
  SiRNA target sequence
taaattatgtaaaacaataatta

SEQ ID NO: 41374 - DNA, 23 bp, Artificial sequence
  SiRNA target sequence
aaattatgtaaaacaataattat

SEQ ID NO: 41375 - DNA, 23 bp, Artificial sequence
  SiRNA target sequence
aattatgtaaaacaataattatc

SEQ ID NO: 41376 - DNA, 23 bp, Artificial sequence
  SiRNA target sequence
attatgtaaaacaataattatcg

SEQ ID NO: 41377 - DNA, 23 bp, Artificial sequence
  SiRNA target sequence
ttatgtaaaacaataattatcgt

SEQ ID NO: 41378 - DNA, 23 bp, Artificial sequence
  SiRNA target sequence
tatgtaaaacaataattatcgtc

SEQ ID NO: 41379 - DNA, 23 bp, Artificial sequence
  SiRNA target sequence
atgtaaaacaataattatcgtct

SEQ ID NO: 41380 - DNA, 23 bp, Artificial sequence
  SiRNA target sequence
tgtaaaacaataattatcgtctt

SEQ ID NO: 41381 - DNA, 23 bp, Artificial sequence
  SiRNA target sequence
gtaaaacaataattatcgtcttc

SEQ ID NO: 41382 - DNA, 23 bp, Artificial sequence
  SiRNA target sequence
taaaacaataattatcgtcttct

SEQ ID NO: 41383 - DNA, 23 bp, Artificial sequence
  SiRNA target sequence
aaaacaataattatcgtcttctc

SEQ ID NO: 41384 - DNA, 23 bp, Artificial sequence
  SiRNA target sequence
aaacaataattatcgtcttctct

SEQ ID NO: 41385 - DNA, 23 bp, Artificial sequence
  SiRNA target sequence
aacaataattatcgtcttctcta

SEQ ID NO: 41386 - DNA, 23 bp, Artificial sequence
  SiRNA target sequence
acaataattatcgtcttctctaa

SEQ ID NO: 41387 - DNA, 23 bp, Artificial sequence
  SiRNA target sequence
caataattatcgtcttctctaag

SEQ ID NO: 41388 - DNA, 23 bp, Artificial sequence
  SiRNA target sequence
aataattatcgtcttctctaagt

SEQ ID NO: 41389 - DNA, 23 bp, Artificial sequence
  SiRNA target sequence
ataattatcgtcttctctaagtt

SEQ ID NO: 41390 - DNA, 23 bp, Artificial sequence
  SiRNA target sequence
taattatcgtcttctctaagttg

SEQ ID NO: 41391 - DNA, 23 bp, Artificial sequence
  SiRNA target sequence
aattatcgtcttctctaagttgt

SEQ ID NO: 41392 - DNA, 23 bp, Artificial sequence
  SiRNA target sequence
attatcgtcttctctaagttgtt

SEQ ID NO: 41393 - DNA, 23 bp, Artificial sequence
  SiRNA target sequence
ttatcgtcttctctaagttgttg

SEQ ID NO: 41394 - DNA, 23 bp, Artificial sequence
  SiRNA target sequence
tatcgtcttctctaagttgttgg

SEQ ID NO: 41395 - DNA, 23 bp, Artificial sequence
  SiRNA target sequence
atcgtcttctctaagttgttgga

SEQ ID NO: 41396 - DNA, 23 bp, Artificial sequence
  SiRNA target sequence
tcgtcttctctaagttgttggag

SEQ ID NO: 41397 - DNA, 23 bp, Artificial sequence
  SiRNA target sequence
cgtcttctctaagttgttggaga

SEQ ID NO: 41398 - DNA, 23 bp, Artificial sequence
  SiRNA target sequence
gtcttctctaagttgttggagat

SEQ ID NO: 41399 - DNA, 23 bp, Artificial sequence
  SiRNA target sequence
tcttctctaagttgttggagatt

SEQ ID NO: 41400 - DNA, 23 bp, Artificial sequence
  SiRNA target sequence
cttctctaagttgttggagatta

SEQ ID NO: 41401 - DNA, 23 bp, Artificial sequence
  SiRNA target sequence
ttctctaagttgttggagattag

SEQ ID NO: 41402 - DNA, 23 bp, Artificial sequence
  SiRNA target sequence
tctctaagttgttggagattaga

SEQ ID NO: 41403 - DNA, 23 bp, Artificial sequence
  SiRNA target sequence
ctctaagttgttggagattagac

SEQ ID NO: 41404 - DNA, 23 bp, Artificial sequence
  SiRNA target sequence
tctaagttgttggagattagact

SEQ ID NO: 41405 - DNA, 23 bp, Artificial sequence
  SiRNA target sequence
ctaagttgttggagattagactt

SEQ ID NO: 41406 - DNA, 23 bp, Artificial sequence
  SiRNA target sequence
taagttgttggagattagacttt

SEQ ID NO: 41407 - DNA, 23 bp, Artificial sequence
  SiRNA target sequence
aagttgttggagattagactttt

SEQ ID NO: 41408 - DNA, 23 bp, Artificial sequence
  SiRNA target sequence
agttgttggagattagactttta

SEQ ID NO: 41409 - DNA, 23 bp, Artificial sequence
  SiRNA target sequence
gttgttggagattagacttttaa

SEQ ID NO: 41410 - DNA, 23 bp, Artificial sequence
  SiRNA target sequence
ttgttggagattagacttttaag

SEQ ID NO: 41411 - DNA, 23 bp, Artificial sequence
  SiRNA target sequence
tgttggagattagacttttaaga

SEQ ID NO: 41412 - DNA, 23 bp, Artificial sequence
  SiRNA target sequence
gttggagattagacttttaagaa

SEQ ID NO: 41413 - DNA, 23 bp, Artificial sequence
  SiRNA target sequence
ttggagattagacttttaagaat

SEQ ID NO: 41414 - DNA, 23 bp, Artificial sequence
  SiRNA target sequence
tggagattagacttttaagaatt

SEQ ID NO: 41415 - DNA, 23 bp, Artificial sequence
  SiRNA target sequence
ggagattagacttttaagaattt

SEQ ID NO: 41416 - DNA, 23 bp, Artificial sequence
  SiRNA target sequence
gagattagacttttaagaatttc

SEQ ID NO: 41417 - DNA, 23 bp, Artificial sequence
  SiRNA target sequence
agattagacttttaagaatttca

SEQ ID NO: 41418 - DNA, 23 bp, Artificial sequence
  SiRNA target sequence
gattagacttttaagaatttcat

SEQ ID NO: 41419 - DNA, 23 bp, Artificial sequence
  SiRNA target sequence
attagacttttaagaatttcata

SEQ ID NO: 41420 - DNA, 23 bp, Artificial sequence
  SiRNA target sequence
ttagacttttaagaatttcatat

SEQ ID NO: 41421 - DNA, 23 bp, Artificial sequence
  SiRNA target sequence
tagacttttaagaatttcatatt

SEQ ID NO: 41422 - DNA, 23 bp, Artificial sequence
  SiRNA target sequence
agacttttaagaatttcatattc

SEQ ID NO: 41423 - DNA, 23 bp, Artificial sequence
  SiRNA target sequence
gacttttaagaatttcatattca

SEQ ID NO: 41424 - DNA, 23 bp, Artificial sequence
  SiRNA target sequence
acttttaagaatttcatattcag

SEQ ID NO: 41425 - DNA, 23 bp, Artificial sequence
  SiRNA target sequence
cttttaagaatttcatattcagc

SEQ ID NO: 41426 - DNA, 23 bp, Artificial sequence
  SiRNA target sequence
ttttaagaatttcatattcagct

SEQ ID NO: 41427 - DNA, 23 bp, Artificial sequence
  SiRNA target sequence
tttaagaatttcatattcagctt

SEQ ID NO: 41428 - DNA, 23 bp, Artificial sequence
  SiRNA target sequence
ttaagaatttcatattcagcttt

SEQ ID NO: 41429 - DNA, 23 bp, Artificial sequence
  SiRNA target sequence
taagaatttcatattcagctttt

SEQ ID NO: 41430 - DNA, 23 bp, Artificial sequence
  SiRNA target sequence
aagaatttcatattcagcttttt

SEQ ID NO: 41431 - DNA, 23 bp, Artificial sequence
  SiRNA target sequence
agaatttcatattcagctttttt

SEQ ID NO: 41432 - DNA, 23 bp, Artificial sequence
  SiRNA target sequence
gaatttcatattcagcttttttg

SEQ ID NO: 41433 - DNA, 23 bp, Artificial sequence
  SiRNA target sequence
aatttcatattcagcttttttgt

SEQ ID NO: 41434 - DNA, 23 bp, Artificial sequence
  SiRNA target sequence
atttcatattcagcttttttgtc

SEQ ID NO: 41435 - DNA, 23 bp, Artificial sequence
  SiRNA target sequence
tttcatattcagcttttttgtcc

SEQ ID NO: 41436 - DNA, 23 bp, Artificial sequence
  SiRNA target sequence
ttcatattcagcttttttgtcca

SEQ ID NO: 41437 - DNA, 23 bp, Artificial sequence
  SiRNA target sequence
tcatattcagcttttttgtccaa

SEQ ID NO: 41438 - DNA, 23 bp, Artificial sequence
  SiRNA target sequence
catattcagcttttttgtccaat

SEQ ID NO: 41439 - DNA, 23 bp, Artificial sequence
  SiRNA target sequence
atattcagcttttttgtccaatg

SEQ ID NO: 41440 - DNA, 23 bp, Artificial sequence
  SiRNA target sequence
tattcagcttttttgtccaatgc

SEQ ID NO: 41441 - DNA, 23 bp, Artificial sequence
  SiRNA target sequence
attcagcttttttgtccaatgcg

SEQ ID NO: 41442 - DNA, 23 bp, Artificial sequence
  SiRNA target sequence
ttcagcttttttgtccaatgcgg

SEQ ID NO: 41443 - DNA, 23 bp, Artificial sequence
  SiRNA target sequence
tcagcttttttgtccaatgcggc

SEQ ID NO: 41444 - DNA, 23 bp, Artificial sequence
  SiRNA target sequence
cagcttttttgtccaatgcggcc

SEQ ID NO: 41445 - DNA, 23 bp, Artificial sequence
  SiRNA target sequence
agcttttttgtccaatgcggccg

SEQ ID NO: 41446 - DNA, 23 bp, Artificial sequence
  SiRNA target sequence
gcttttttgtccaatgcggccgt

SEQ ID NO: 41447 - DNA, 23 bp, Artificial sequence
  SiRNA target sequence
cttttttgtccaatgcggccgtt

SEQ ID NO: 41448 - DNA, 23 bp, Artificial sequence
  SiRNA target sequence
ttttttgtccaatgcggccgttg

SEQ ID NO: 41449 - DNA, 23 bp, Artificial sequence
  SiRNA target sequence
tttttgtccaatgcggccgttgg

SEQ ID NO: 41450 - DNA, 23 bp, Artificial sequence
  SiRNA target sequence
ttttgtccaatgcggccgttggc

SEQ ID NO: 41451 - DNA, 23 bp, Artificial sequence
  SiRNA target sequence
tttgtccaatgcggccgttggct

SEQ ID NO: 41452 - DNA, 23 bp, Artificial sequence
  SiRNA target sequence
ttgtccaatgcggccgttggctc

SEQ ID NO: 41453 - DNA, 23 bp, Artificial sequence
  SiRNA target sequence
tgtccaatgcggccgttggctca

SEQ ID NO: 41454 - DNA, 23 bp, Artificial sequence
  SiRNA target sequence
gtccaatgcggccgttggctcat

SEQ ID NO: 41455 - DNA, 23 bp, Artificial sequence
  SiRNA target sequence
tccaatgcggccgttggctcatc

SEQ ID NO: 41456 - DNA, 23 bp, Artificial sequence
  SiRNA target sequence
ccaatgcggccgttggctcatct

SEQ ID NO: 41457 - DNA, 23 bp, Artificial sequence
  SiRNA target sequence
caatgcggccgttggctcatcta

SEQ ID NO: 41458 - DNA, 23 bp, Artificial sequence
  SiRNA target sequence
aatgcggccgttggctcatctaa

SEQ ID NO: 41459 - DNA, 23 bp, Artificial sequence
  SiRNA target sequence
atgcggccgttggctcatctaaa

SEQ ID NO: 41460 - DNA, 23 bp, Artificial sequence
  SiRNA target sequence
tgcggccgttggctcatctaaaa

SEQ ID NO: 41461 - DNA, 23 bp, Artificial sequence
  SiRNA target sequence
gcggccgttggctcatctaaaat

SEQ ID NO: 41462 - DNA, 23 bp, Artificial sequence
  SiRNA target sequence
cggccgttggctcatctaaaatt

SEQ ID NO: 41463 - DNA, 23 bp, Artificial sequence
  SiRNA target sequence
ggccgttggctcatctaaaatta

SEQ ID NO: 41464 - DNA, 23 bp, Artificial sequence
  SiRNA target sequence
gccgttggctcatctaaaattat

SEQ ID NO: 41465 - DNA, 23 bp, Artificial sequence
  SiRNA target sequence
ccgttggctcatctaaaattata

SEQ ID NO: 41466 - DNA, 23 bp, Artificial sequence
  SiRNA target sequence
cgttggctcatctaaaattataa

SEQ ID NO: 41467 - DNA, 23 bp, Artificial sequence
  SiRNA target sequence
gttggctcatctaaaattataat

SEQ ID NO: 41468 - DNA, 23 bp, Artificial sequence
  SiRNA target sequence
ttggctcatctaaaattataata

SEQ ID NO: 41469 - DNA, 23 bp, Artificial sequence
  SiRNA target sequence
tggctcatctaaaattataatag

SEQ ID NO: 41470 - DNA, 23 bp, Artificial sequence
  SiRNA target sequence
ggctcatctaaaattataatagg

SEQ ID NO: 41471 - DNA, 23 bp, Artificial sequence
  SiRNA target sequence
gctcatctaaaattataatagga

SEQ ID NO: 41472 - DNA, 23 bp, Artificial sequence
  SiRNA target sequence
ctcatctaaaattataataggag

SEQ ID NO: 41473 - DNA, 23 bp, Artificial sequence
  SiRNA target sequence
tcatctaaaattataataggaga

SEQ ID NO: 41474 - DNA, 23 bp, Artificial sequence
  SiRNA target sequence
catctaaaattataataggagaa

SEQ ID NO: 41475 - DNA, 23 bp, Artificial sequence
  SiRNA target sequence
atctaaaattataataggagaat

SEQ ID NO: 41476 - DNA, 23 bp, Artificial sequence
  SiRNA target sequence
tctaaaattataataggagaatt

SEQ ID NO: 41477 - DNA, 23 bp, Artificial sequence
  SiRNA target sequence
ctaaaattataataggagaattt

SEQ ID NO: 41478 - DNA, 23 bp, Artificial sequence
  SiRNA target sequence
taaaattataataggagaatttt

SEQ ID NO: 41479 - DNA, 23 bp, Artificial sequence
  SiRNA target sequence
aaaattataataggagaattttt

SEQ ID NO: 41480 - DNA, 23 bp, Artificial sequence
  SiRNA target sequence
aaattataataggagaatttttt

SEQ ID NO: 41481 - DNA, 23 bp, Artificial sequence
  SiRNA target sequence
aattataataggagaatttttta

SEQ ID NO: 41482 - DNA, 23 bp, Artificial sequence
  SiRNA target sequence
attataataggagaattttttag

SEQ ID NO: 41483 - DNA, 23 bp, Artificial sequence
  SiRNA target sequence
ttataataggagaattttttagt

SEQ ID NO: 41484 - DNA, 23 bp, Artificial sequence
  SiRNA target sequence
tataataggagaattttttagtg

SEQ ID NO: 41485 - DNA, 23 bp, Artificial sequence
  SiRNA target sequence
ataataggagaattttttagtgc

SEQ ID NO: 41486 - DNA, 23 bp, Artificial sequence
  SiRNA target sequence
taataggagaattttttagtgcc

SEQ ID NO: 41487 - DNA, 23 bp, Artificial sequence
  SiRNA target sequence
aataggagaattttttagtgccg

SEQ ID NO: 41488 - DNA, 23 bp, Artificial sequence
  SiRNA target sequence
ataggagaattttttagtgccga

SEQ ID NO: 41489 - DNA, 23 bp, Artificial sequence
  SiRNA target sequence
taggagaattttttagtgccgac

SEQ ID NO: 41490 - DNA, 23 bp, Artificial sequence
  SiRNA target sequence
aggagaattttttagtgccgacc

SEQ ID NO: 41491 - DNA, 23 bp, Artificial sequence
  SiRNA target sequence
ggagaattttttagtgccgacct

SEQ ID NO: 41492 - DNA, 23 bp, Artificial sequence
  SiRNA target sequence
gagaattttttagtgccgacctt

SEQ ID NO: 41493 - DNA, 23 bp, Artificial sequence
  SiRNA target sequence
agaattttttagtgccgacctta

SEQ ID NO: 41494 - DNA, 23 bp, Artificial sequence
  SiRNA target sequence
gaattttttagtgccgaccttaa

SEQ ID NO: 41495 - DNA, 23 bp, Artificial sequence
  SiRNA target sequence
aattttttagtgccgaccttaac

SEQ ID NO: 41496 - DNA, 23 bp, Artificial sequence
  SiRNA target sequence
attttttagtgccgaccttaaca

SEQ ID NO: 41497 - DNA, 23 bp, Artificial sequence
  SiRNA target sequence
ttttttagtgccgaccttaacaa

SEQ ID NO: 41498 - DNA, 23 bp, Artificial sequence
  SiRNA target sequence
tttttagtgccgaccttaacaaa

SEQ ID NO: 41499 - DNA, 23 bp, Artificial sequence
  SiRNA target sequence
ttttagtgccgaccttaacaaaa

SEQ ID NO: 41500 - DNA, 23 bp, Artificial sequence
  SiRNA target sequence
tttagtgccgaccttaacaaaat

SEQ ID NO: 41501 - DNA, 23 bp, Artificial sequence
  SiRNA target sequence
ttagtgccgaccttaacaaaatt

SEQ ID NO: 41502 - DNA, 23 bp, Artificial sequence
  SiRNA target sequence
tagtgccgaccttaacaaaatta

SEQ ID NO: 41503 - DNA, 23 bp, Artificial sequence
  SiRNA target sequence
agtgccgaccttaacaaaattac

SEQ ID NO: 41504 - DNA, 23 bp, Artificial sequence
  SiRNA target sequence
gtgccgaccttaacaaaattact

SEQ ID NO: 41505 - DNA, 23 bp, Artificial sequence
  SiRNA target sequence
tgccgaccttaacaaaattactt

SEQ ID NO: 41506 - DNA, 23 bp, Artificial sequence
  SiRNA target sequence
gccgaccttaacaaaattacttt

SEQ ID NO: 41507 - DNA, 23 bp, Artificial sequence
  SiRNA target sequence
ccgaccttaacaaaattactttt

SEQ ID NO: 41508 - DNA, 23 bp, Artificial sequence
  SiRNA target sequence
cgaccttaacaaaattacttttt

SEQ ID NO: 41509 - DNA, 23 bp, Artificial sequence
  SiRNA target sequence
gaccttaacaaaattactttttg

SEQ ID NO: 41510 - DNA, 23 bp, Artificial sequence
  SiRNA target sequence
accttaacaaaattactttttgt

SEQ ID NO: 41511 - DNA, 23 bp, Artificial sequence
  SiRNA target sequence
ccttaacaaaattactttttgtc

SEQ ID NO: 41512 - DNA, 23 bp, Artificial sequence
  SiRNA target sequence
cttaacaaaattactttttgtct

SEQ ID NO: 41513 - DNA, 23 bp, Artificial sequence
  SiRNA target sequence
ttaacaaaattactttttgtctt

SEQ ID NO: 41514 - DNA, 23 bp, Artificial sequence
  SiRNA target sequence
taacaaaattactttttgtcttt

SEQ ID NO: 41515 - DNA, 23 bp, Artificial sequence
  SiRNA target sequence
aacaaaattactttttgtctttc

SEQ ID NO: 41516 - DNA, 23 bp, Artificial sequence
  SiRNA target sequence
acaaaattactttttgtctttct

SEQ ID NO: 41517 - DNA, 23 bp, Artificial sequence
  SiRNA target sequence
caaaattactttttgtctttctc

SEQ ID NO: 41518 - DNA, 23 bp, Artificial sequence
  SiRNA target sequence
aaaattactttttgtctttctcc

SEQ ID NO: 41519 - DNA, 23 bp, Artificial sequence
  SiRNA target sequence
aaattactttttgtctttctcca

SEQ ID NO: 41520 - DNA, 23 bp, Artificial sequence
  SiRNA target sequence
aattactttttgtctttctccac

SEQ ID NO: 41521 - DNA, 23 bp, Artificial sequence
  SiRNA target sequence
attactttttgtctttctccacc

SEQ ID NO: 41522 - DNA, 23 bp, Artificial sequence
  SiRNA target sequence
ttactttttgtctttctccacca

SEQ ID NO: 41523 - DNA, 23 bp, Artificial sequence
  SiRNA target sequence
tactttttgtctttctccaccac

SEQ ID NO: 41524 - DNA, 23 bp, Artificial sequence
  SiRNA target sequence
actttttgtctttctccaccact

SEQ ID NO: 41525 - DNA, 23 bp, Artificial sequence
  SiRNA target sequence
ctttttgtctttctccaccacta

SEQ ID NO: 41526 - DNA, 23 bp, Artificial sequence
  SiRNA target sequence
tttttgtctttctccaccactaa

SEQ ID NO: 41527 - DNA, 23 bp, Artificial sequence
  SiRNA target sequence
ttttgtctttctccaccactaag

SEQ ID NO: 41528 - DNA, 23 bp, Artificial sequence
  SiRNA target sequence
tttgtctttctccaccactaagc

SEQ ID NO: 41529 - DNA, 23 bp, Artificial sequence
  SiRNA target sequence
ttgtctttctccaccactaagct

SEQ ID NO: 41530 - DNA, 23 bp, Artificial sequence
  SiRNA target sequence
tgtctttctccaccactaagctt

SEQ ID NO: 41531 - DNA, 23 bp, Artificial sequence
  SiRNA target sequence
gtctttctccaccactaagctta

SEQ ID NO: 41532 - DNA, 23 bp, Artificial sequence
  SiRNA target sequence
tctttctccaccactaagcttat

SEQ ID NO: 41533 - DNA, 23 bp, Artificial sequence
  SiRNA target sequence
ctttctccaccactaagcttatg

SEQ ID NO: 41534 - DNA, 23 bp, Artificial sequence
  SiRNA target sequence
tttctccaccactaagcttatgt

SEQ ID NO: 41535 - DNA, 23 bp, Artificial sequence
  SiRNA target sequence
ttctccaccactaagcttatgtc

SEQ ID NO: 41536 - DNA, 23 bp, Artificial sequence
  SiRNA target sequence
tctccaccactaagcttatgtcc

SEQ ID NO: 41537 - DNA, 23 bp, Artificial sequence
  SiRNA target sequence
ctccaccactaagcttatgtccc

SEQ ID NO: 41538 - DNA, 23 bp, Artificial sequence
  SiRNA target sequence
tccaccactaagcttatgtccct

SEQ ID NO: 41539 - DNA, 23 bp, Artificial sequence
  SiRNA target sequence
ccaccactaagcttatgtccctt

SEQ ID NO: 41540 - DNA, 23 bp, Artificial sequence
  SiRNA target sequence
caccactaagcttatgtccctta

SEQ ID NO: 41541 - DNA, 23 bp, Artificial sequence
  SiRNA target sequence
accactaagcttatgtcccttat

SEQ ID NO: 41542 - DNA, 23 bp, Artificial sequence
  SiRNA target sequence
ccactaagcttatgtcccttatc

SEQ ID NO: 41543 - DNA, 23 bp, Artificial sequence
  SiRNA target sequence
cactaagcttatgtcccttatct

SEQ ID NO: 41544 - DNA, 23 bp, Artificial sequence
  SiRNA target sequence
actaagcttatgtcccttatctc

SEQ ID NO: 41545 - DNA, 23 bp, Artificial sequence
  SiRNA target sequence
ctaagcttatgtcccttatctcc

SEQ ID NO: 41546 - DNA, 23 bp, Artificial sequence
  SiRNA target sequence
taagcttatgtcccttatctcca

SEQ ID NO: 41547 - DNA, 23 bp, Artificial sequence
  SiRNA target sequence
aagcttatgtcccttatctccaa

SEQ ID NO: 41548 - DNA, 23 bp, Artificial sequence
  SiRNA target sequence
agcttatgtcccttatctccaac

SEQ ID NO: 41549 - DNA, 23 bp, Artificial sequence
  SiRNA target sequence
gcttatgtcccttatctccaaca

SEQ ID NO: 41550 - DNA, 23 bp, Artificial sequence
  SiRNA target sequence
cttatgtcccttatctccaacat

SEQ ID NO: 41551 - DNA, 23 bp, Artificial sequence
  SiRNA target sequence
ttatgtcccttatctccaacatg

SEQ ID NO: 41552 - DNA, 23 bp, Artificial sequence
  SiRNA target sequence
tatgtcccttatctccaacatgt

SEQ ID NO: 41553 - DNA, 23 bp, Artificial sequence
  SiRNA target sequence
atgtcccttatctccaacatgtg

SEQ ID NO: 41554 - DNA, 23 bp, Artificial sequence
  SiRNA target sequence
tgtcccttatctccaacatgtgt

SEQ ID NO: 41555 - DNA, 23 bp, Artificial sequence
  SiRNA target sequence
gtcccttatctccaacatgtgtg

SEQ ID NO: 41556 - DNA, 23 bp, Artificial sequence
  SiRNA target sequence
tcccttatctccaacatgtgtgt

SEQ ID NO: 41557 - DNA, 23 bp, Artificial sequence
  SiRNA target sequence
cccttatctccaacatgtgtgtt

SEQ ID NO: 41558 - DNA, 23 bp, Artificial sequence
  SiRNA target sequence
ccttatctccaacatgtgtgttg

SEQ ID NO: 41559 - DNA, 23 bp, Artificial sequence
  SiRNA target sequence
cttatctccaacatgtgtgttgt

SEQ ID NO: 41560 - DNA, 23 bp, Artificial sequence
  SiRNA target sequence
ttatctccaacatgtgtgttgta

SEQ ID NO: 41561 - DNA, 23 bp, Artificial sequence
  SiRNA target sequence
tatctccaacatgtgtgttgtat

SEQ ID NO: 41562 - DNA, 23 bp, Artificial sequence
  SiRNA target sequence
atctccaacatgtgtgttgtatt

SEQ ID NO: 41563 - DNA, 23 bp, Artificial sequence
  SiRNA target sequence
tctccaacatgtgtgttgtattc

SEQ ID NO: 41564 - DNA, 23 bp, Artificial sequence
  SiRNA target sequence
ctccaacatgtgtgttgtattca

SEQ ID NO: 41565 - DNA, 23 bp, Artificial sequence
  SiRNA target sequence
tccaacatgtgtgttgtattcat

SEQ ID NO: 41566 - DNA, 23 bp, Artificial sequence
  SiRNA target sequence
ccaacatgtgtgttgtattcatc

SEQ ID NO: 41567 - DNA, 23 bp, Artificial sequence
  SiRNA target sequence
caacatgtgtgttgtattcatcc

SEQ ID NO: 41568 - DNA, 23 bp, Artificial sequence
  SiRNA target sequence
aacatgtgtgttgtattcatcct

SEQ ID NO: 41569 - DNA, 23 bp, Artificial sequence
  SiRNA target sequence
acatgtgtgttgtattcatcctc

SEQ ID NO: 41570 - DNA, 23 bp, Artificial sequence
  SiRNA target sequence
catgtgtgttgtattcatcctct

SEQ ID NO: 41571 - DNA, 23 bp, Artificial sequence
  SiRNA target sequence
atgtgtgttgtattcatcctcta

SEQ ID NO: 41572 - DNA, 23 bp, Artificial sequence
  SiRNA target sequence
tgtgtgttgtattcatcctctag

SEQ ID NO: 41573 - DNA, 23 bp, Artificial sequence
  SiRNA target sequence
gtgtgttgtattcatcctctagg

SEQ ID NO: 41574 - DNA, 23 bp, Artificial sequence
  SiRNA target sequence
tgtgttgtattcatcctctaggt

SEQ ID NO: 41575 - DNA, 23 bp, Artificial sequence
  SiRNA target sequence
gtgttgtattcatcctctaggtt

SEQ ID NO: 41576 - DNA, 23 bp, Artificial sequence
  SiRNA target sequence
tgttgtattcatcctctaggttg

SEQ ID NO: 41577 - DNA, 23 bp, Artificial sequence
  SiRNA target sequence
gttgtattcatcctctaggttgt

SEQ ID NO: 41578 - DNA, 23 bp, Artificial sequence
  SiRNA target sequence
ttgtattcatcctctaggttgtt

SEQ ID NO: 41579 - DNA, 23 bp, Artificial sequence
  SiRNA target sequence
tgtattcatcctctaggttgttt

SEQ ID NO: 41580 - DNA, 23 bp, Artificial sequence
  SiRNA target sequence
gtattcatcctctaggttgttta

SEQ ID NO: 41581 - DNA, 23 bp, Artificial sequence
  SiRNA target sequence
tattcatcctctaggttgtttat

SEQ ID NO: 41582 - DNA, 23 bp, Artificial sequence
  SiRNA target sequence
attcatcctctaggttgtttata

SEQ ID NO: 41583 - DNA, 23 bp, Artificial sequence
  SiRNA target sequence
ttcatcctctaggttgtttatag

SEQ ID NO: 41584 - DNA, 23 bp, Artificial sequence
  SiRNA target sequence
tcatcctctaggttgtttataga

SEQ ID NO: 41585 - DNA, 23 bp, Artificial sequence
  SiRNA target sequence
catcctctaggttgtttatagaa

SEQ ID NO: 41586 - DNA, 23 bp, Artificial sequence
  SiRNA target sequence
atcctctaggttgtttatagaat

SEQ ID NO: 41587 - DNA, 23 bp, Artificial sequence
  SiRNA target sequence
tcctctaggttgtttatagaatc

SEQ ID NO: 41588 - DNA, 23 bp, Artificial sequence
  SiRNA target sequence
cctctaggttgtttatagaatcg

SEQ ID NO: 41589 - DNA, 23 bp, Artificial sequence
  SiRNA target sequence
ctctaggttgtttatagaatcgt

SEQ ID NO: 41590 - DNA, 23 bp, Artificial sequence
  SiRNA target sequence
tctaggttgtttatagaatcgtg

SEQ ID NO: 41591 - DNA, 23 bp, Artificial sequence
  SiRNA target sequence
ctaggttgtttatagaatcgtgt

SEQ ID NO: 41592 - DNA, 23 bp, Artificial sequence
  SiRNA target sequence
taggttgtttatagaatcgtgta

SEQ ID NO: 41593 - DNA, 23 bp, Artificial sequence
  SiRNA target sequence
aggttgtttatagaatcgtgtac

SEQ ID NO: 41594 - DNA, 23 bp, Artificial sequence
  SiRNA target sequence
ggttgtttatagaatcgtgtaca

SEQ ID NO: 41595 - DNA, 23 bp, Artificial sequence
  SiRNA target sequence
gttgtttatagaatcgtgtacac

SEQ ID NO: 41596 - DNA, 23 bp, Artificial sequence
  SiRNA target sequence
ttgtttatagaatcgtgtacaca

SEQ ID NO: 41597 - DNA, 23 bp, Artificial sequence
  SiRNA target sequence
tgtttatagaatcgtgtacacaa

SEQ ID NO: 41598 - DNA, 23 bp, Artificial sequence
  SiRNA target sequence
gtttatagaatcgtgtacacaaa

SEQ ID NO: 41599 - DNA, 23 bp, Artificial sequence
  SiRNA target sequence
tttatagaatcgtgtacacaaag

SEQ ID NO: 41600 - DNA, 23 bp, Artificial sequence
  SiRNA target sequence
ttatagaatcgtgtacacaaagt

SEQ ID NO: 41601 - DNA, 23 bp, Artificial sequence
  SiRNA target sequence
tatagaatcgtgtacacaaagtt

SEQ ID NO: 41602 - DNA, 23 bp, Artificial sequence
  SiRNA target sequence
atagaatcgtgtacacaaagttt

SEQ ID NO: 41603 - DNA, 23 bp, Artificial sequence
  SiRNA target sequence
tagaatcgtgtacacaaagtttt

SEQ ID NO: 41604 - DNA, 23 bp, Artificial sequence
  SiRNA target sequence
agaatcgtgtacacaaagttttt

SEQ ID NO: 41605 - DNA, 23 bp, Artificial sequence
  SiRNA target sequence
gaatcgtgtacacaaagtttttt

SEQ ID NO: 41606 - DNA, 23 bp, Artificial sequence
  SiRNA target sequence
aatcgtgtacacaaagtttttta

SEQ ID NO: 41607 - DNA, 23 bp, Artificial sequence
  SiRNA target sequence
atcgtgtacacaaagttttttac

SEQ ID NO: 41608 - DNA, 23 bp, Artificial sequence
  SiRNA target sequence
tcgtgtacacaaagttttttact

SEQ ID NO: 41609 - DNA, 23 bp, Artificial sequence
  SiRNA target sequence
cgtgtacacaaagttttttactg

SEQ ID NO: 41610 - DNA, 23 bp, Artificial sequence
  SiRNA target sequence
gtgtacacaaagttttttactga

SEQ ID NO: 41611 - DNA, 23 bp, Artificial sequence
  SiRNA target sequence
tgtacacaaagttttttactgat

SEQ ID NO: 41612 - DNA, 23 bp, Artificial sequence
  SiRNA target sequence
gtacacaaagttttttactgatt

SEQ ID NO: 41613 - DNA, 23 bp, Artificial sequence
  SiRNA target sequence
tacacaaagttttttactgattt

SEQ ID NO: 41614 - DNA, 23 bp, Artificial sequence
  SiRNA target sequence
acacaaagttttttactgatttt

SEQ ID NO: 41615 - DNA, 23 bp, Artificial sequence
  SiRNA target sequence
cacaaagttttttactgattttt

SEQ ID NO: 41616 - DNA, 23 bp, Artificial sequence
  SiRNA target sequence
acaaagttttttactgattttta

SEQ ID NO: 41617 - DNA, 23 bp, Artificial sequence
  SiRNA target sequence
caaagttttttactgatttttat

SEQ ID NO: 41618 - DNA, 23 bp, Artificial sequence
  SiRNA target sequence
aaagttttttactgatttttata

SEQ ID NO: 41619 - DNA, 23 bp, Artificial sequence
  SiRNA target sequence
aagttttttactgatttttataa

SEQ ID NO: 41620 - DNA, 23 bp, Artificial sequence
  SiRNA target sequence
agttttttactgatttttataac

SEQ ID NO: 41621 - DNA, 23 bp, Artificial sequence
  SiRNA target sequence
gttttttactgatttttataact

SEQ ID NO: 41622 - DNA, 23 bp, Artificial sequence
  SiRNA target sequence
ttttttactgatttttataactt

SEQ ID NO: 41623 - DNA, 23 bp, Artificial sequence
  SiRNA target sequence
tttttactgatttttataacttc

SEQ ID NO: 41624 - DNA, 23 bp, Artificial sequence
  SiRNA target sequence
ttttactgatttttataacttct

SEQ ID NO: 41625 - DNA, 23 bp, Artificial sequence
  SiRNA target sequence
tttactgatttttataacttctt

SEQ ID NO: 41626 - DNA, 23 bp, Artificial sequence
  SiRNA target sequence
ttactgatttttataacttcttc

SEQ ID NO: 41627 - DNA, 23 bp, Artificial sequence
  SiRNA target sequence
tactgatttttataacttcttct

SEQ ID NO: 41628 - DNA, 23 bp, Artificial sequence
  SiRNA target sequence
actgatttttataacttcttctt

SEQ ID NO: 41629 - DNA, 23 bp, Artificial sequence
  SiRNA target sequence
ctgatttttataacttcttcttt

SEQ ID NO: 41630 - DNA, 23 bp, Artificial sequence
  SiRNA target sequence
tgatttttataacttcttcttta

SEQ ID NO: 41631 - DNA, 23 bp, Artificial sequence
  SiRNA target sequence
gatttttataacttcttctttat

SEQ ID NO: 41632 - DNA, 23 bp, Artificial sequence
  SiRNA target sequence
atttttataacttcttctttatc

SEQ ID NO: 41633 - DNA, 23 bp, Artificial sequence
  SiRNA target sequence
tttttataacttcttctttatca

SEQ ID NO: 41634 - DNA, 23 bp, Artificial sequence
  SiRNA target sequence
ttttataacttcttctttatcaa

SEQ ID NO: 41635 - DNA, 23 bp, Artificial sequence
  SiRNA target sequence
tttataacttcttctttatcaaa

SEQ ID NO: 41636 - DNA, 23 bp, Artificial sequence
  SiRNA target sequence
ttataacttcttctttatcaaat

SEQ ID NO: 41637 - DNA, 23 bp, Artificial sequence
  SiRNA target sequence
tataacttcttctttatcaaata

SEQ ID NO: 41638 - DNA, 23 bp, Artificial sequence
  SiRNA target sequence
ataacttcttctttatcaaatat

SEQ ID NO: 41639 - DNA, 23 bp, Artificial sequence
  SiRNA target sequence
taacttcttctttatcaaatatt

SEQ ID NO: 41640 - DNA, 23 bp, Artificial sequence
  SiRNA target sequence
aacttcttctttatcaaatattt

SEQ ID NO: 41641 - DNA, 23 bp, Artificial sequence
  SiRNA target sequence
acttcttctttatcaaatatttc

SEQ ID NO: 41642 - DNA, 23 bp, Artificial sequence
  SiRNA target sequence
cttcttctttatcaaatatttct

SEQ ID NO: 41643 - DNA, 23 bp, Artificial sequence
  SiRNA target sequence
ttcttctttatcaaatatttctt

SEQ ID NO: 41644 - DNA, 23 bp, Artificial sequence
  SiRNA target sequence
tcttctttatcaaatatttcttt

SEQ ID NO: 41645 - DNA, 23 bp, Artificial sequence
  SiRNA target sequence
cttctttatcaaatatttctttt

SEQ ID NO: 41646 - DNA, 23 bp, Artificial sequence
  SiRNA target sequence
ttctttatcaaatatttcttttc

SEQ ID NO: 41647 - DNA, 23 bp, Artificial sequence
  SiRNA target sequence
tctttatcaaatatttcttttcc

SEQ ID NO: 41648 - DNA, 23 bp, Artificial sequence
  SiRNA target sequence
ctttatcaaatatttcttttcca

SEQ ID NO: 41649 - DNA, 23 bp, Artificial sequence
  SiRNA target sequence
tttatcaaatatttcttttccat

SEQ ID NO: 41650 - DNA, 23 bp, Artificial sequence
  SiRNA target sequence
ttatcaaatatttcttttccata

SEQ ID NO: 41651 - DNA, 23 bp, Artificial sequence
  SiRNA target sequence
tatcaaatatttcttttccatat

SEQ ID NO: 41652 - DNA, 23 bp, Artificial sequence
  SiRNA target sequence
atcaaatatttcttttccatatg

SEQ ID NO: 41653 - DNA, 23 bp, Artificial sequence
  SiRNA target sequence
tcaaatatttcttttccatatgt

SEQ ID NO: 41654 - DNA, 23 bp, Artificial sequence
  SiRNA target sequence
caaatatttcttttccatatgtt

SEQ ID NO: 41655 - DNA, 23 bp, Artificial sequence
  SiRNA target sequence
aaatatttcttttccatatgtta

SEQ ID NO: 41656 - DNA, 23 bp, Artificial sequence
  SiRNA target sequence
aatatttcttttccatatgttaa

SEQ ID NO: 41657 - DNA, 23 bp, Artificial sequence
  SiRNA target sequence
atatttcttttccatatgttaaa

SEQ ID NO: 41658 - DNA, 23 bp, Artificial sequence
  SiRNA target sequence
tatttcttttccatatgttaaat

SEQ ID NO: 41659 - DNA, 23 bp, Artificial sequence
  SiRNA target sequence
atttcttttccatatgttaaatt

SEQ ID NO: 41660 - DNA, 23 bp, Artificial sequence
  SiRNA target sequence
tttcttttccatatgttaaatta

SEQ ID NO: 41661 - DNA, 23 bp, Artificial sequence
  SiRNA target sequence
ttcttttccatatgttaaattat

SEQ ID NO: 41662 - DNA, 23 bp, Artificial sequence
  SiRNA target sequence
tcttttccatatgttaaattata

SEQ ID NO: 41663 - DNA, 23 bp, Artificial sequence
  SiRNA target sequence
cttttccatatgttaaattataa

SEQ ID NO: 41664 - DNA, 23 bp, Artificial sequence
  SiRNA target sequence
ttttccatatgttaaattataat

SEQ ID NO: 41665 - DNA, 23 bp, Artificial sequence
  SiRNA target sequence
tttccatatgttaaattataata

SEQ ID NO: 41666 - DNA, 23 bp, Artificial sequence
  SiRNA target sequence
ttccatatgttaaattataataa

SEQ ID NO: 41667 - DNA, 23 bp, Artificial sequence
  SiRNA target sequence
tccatatgttaaattataataaa

SEQ ID NO: 41668 - DNA, 23 bp, Artificial sequence
  SiRNA target sequence
ccatatgttaaattataataaac

SEQ ID NO: 41669 - DNA, 23 bp, Artificial sequence
  SiRNA target sequence
catatgttaaattataataaacc

SEQ ID NO: 41670 - DNA, 23 bp, Artificial sequence
  SiRNA target sequence
atatgttaaattataataaaccg

SEQ ID NO: 41671 - DNA, 23 bp, Artificial sequence
  SiRNA target sequence
tatgttaaattataataaaccgt

SEQ ID NO: 41672 - DNA, 23 bp, Artificial sequence
  SiRNA target sequence
atgttaaattataataaaccgtt

SEQ ID NO: 41673 - DNA, 23 bp, Artificial sequence
  SiRNA target sequence
tgttaaattataataaaccgttt

SEQ ID NO: 41674 - DNA, 23 bp, Artificial sequence
  SiRNA target sequence
gttaaattataataaaccgtttc

SEQ ID NO: 41675 - DNA, 23 bp, Artificial sequence
  SiRNA target sequence
ttaaattataataaaccgtttcg

SEQ ID NO: 41676 - DNA, 23 bp, Artificial sequence
  SiRNA target sequence
taaattataataaaccgtttcgt

SEQ ID NO: 41677 - DNA, 23 bp, Artificial sequence
  SiRNA target sequence
aaattataataaaccgtttcgtt

SEQ ID NO: 41678 - DNA, 23 bp, Artificial sequence
  SiRNA target sequence
aattataataaaccgtttcgtta

SEQ ID NO: 41679 - DNA, 23 bp, Artificial sequence
  SiRNA target sequence
attataataaaccgtttcgttaa

SEQ ID NO: 41680 - DNA, 23 bp, Artificial sequence
  SiRNA target sequence
ttataataaaccgtttcgttaaa

SEQ ID NO: 41681 - DNA, 23 bp, Artificial sequence
  SiRNA target sequence
tataataaaccgtttcgttaaac

SEQ ID NO: 41682 - DNA, 23 bp, Artificial sequence
  SiRNA target sequence
ataataaaccgtttcgttaaaca

SEQ ID NO: 41683 - DNA, 23 bp, Artificial sequence
  SiRNA target sequence
taataaaccgtttcgttaaacaa

SEQ ID NO: 41684 - DNA, 23 bp, Artificial sequence
  SiRNA target sequence
aataaaccgtttcgttaaacaaa

SEQ ID NO: 41685 - DNA, 23 bp, Artificial sequence
  SiRNA target sequence
ataaaccgtttcgttaaacaaaa

SEQ ID NO: 41686 - DNA, 23 bp, Artificial sequence
  SiRNA target sequence
taaaccgtttcgttaaacaaaaa

SEQ ID NO: 41687 - DNA, 23 bp, Artificial sequence
  SiRNA target sequence
aaaccgtttcgttaaacaaaaat

SEQ ID NO: 41688 - DNA, 23 bp, Artificial sequence
  SiRNA target sequence
aaccgtttcgttaaacaaaaatg

SEQ ID NO: 41689 - DNA, 23 bp, Artificial sequence
  SiRNA target sequence
accgtttcgttaaacaaaaatga

SEQ ID NO: 41690 - DNA, 23 bp, Artificial sequence
  SiRNA target sequence
ccgtttcgttaaacaaaaatgag

SEQ ID NO: 41691 - DNA, 23 bp, Artificial sequence
  SiRNA target sequence
cgtttcgttaaacaaaaatgagg

SEQ ID NO: 41692 - DNA, 23 bp, Artificial sequence
  SiRNA target sequence
gtttcgttaaacaaaaatgaggt

SEQ ID NO: 41693 - DNA, 23 bp, Artificial sequence
  SiRNA target sequence
tttcgttaaacaaaaatgaggtt

SEQ ID NO: 41694 - DNA, 23 bp, Artificial sequence
  SiRNA target sequence
ttcgttaaacaaaaatgaggttt

SEQ ID NO: 41695 - DNA, 23 bp, Artificial sequence
  SiRNA target sequence
tcgttaaacaaaaatgaggtttg

SEQ ID NO: 41696 - DNA, 23 bp, Artificial sequence
  SiRNA target sequence
cgttaaacaaaaatgaggtttgt

SEQ ID NO: 41697 - DNA, 23 bp, Artificial sequence
  SiRNA target sequence
gttaaacaaaaatgaggtttgtg

SEQ ID NO: 41698 - DNA, 23 bp, Artificial sequence
  SiRNA target sequence
ttaaacaaaaatgaggtttgtgg

SEQ ID NO: 41699 - DNA, 23 bp, Artificial sequence
  SiRNA target sequence
taaacaaaaatgaggtttgtggt

SEQ ID NO: 41700 - DNA, 23 bp, Artificial sequence
  SiRNA target sequence
aaacaaaaatgaggtttgtggtg

SEQ ID NO: 41701 - DNA, 23 bp, Artificial sequence
  SiRNA target sequence
aacaaaaatgaggtttgtggtgc

SEQ ID NO: 41702 - DNA, 23 bp, Artificial sequence
  SiRNA target sequence
acaaaaatgaggtttgtggtgca

SEQ ID NO: 41703 - DNA, 23 bp, Artificial sequence
  SiRNA target sequence
caaaaatgaggtttgtggtgcaa

SEQ ID NO: 41704 - DNA, 23 bp, Artificial sequence
  SiRNA target sequence
aaaaatgaggtttgtggtgcaaa

SEQ ID NO: 41705 - DNA, 23 bp, Artificial sequence
  SiRNA target sequence
aaaatgaggtttgtggtgcaaat

SEQ ID NO: 41706 - DNA, 23 bp, Artificial sequence
  SiRNA target sequence
aaatgaggtttgtggtgcaaatg

SEQ ID NO: 41707 - DNA, 23 bp, Artificial sequence
  SiRNA target sequence
aatgaggtttgtggtgcaaatga

SEQ ID NO: 41708 - DNA, 23 bp, Artificial sequence
  SiRNA target sequence
atgaggtttgtggtgcaaatgat

SEQ ID NO: 41709 - DNA, 23 bp, Artificial sequence
  SiRNA target sequence
tgaggtttgtggtgcaaatgata

SEQ ID NO: 41710 - DNA, 23 bp, Artificial sequence
  SiRNA target sequence
gaggtttgtggtgcaaatgatat

SEQ ID NO: 41711 - DNA, 23 bp, Artificial sequence
  SiRNA target sequence
aggtttgtggtgcaaatgatata

SEQ ID NO: 41712 - DNA, 23 bp, Artificial sequence
  SiRNA target sequence
ggtttgtggtgcaaatgatataa

SEQ ID NO: 41713 - DNA, 23 bp, Artificial sequence
  SiRNA target sequence
gtttgtggtgcaaatgatataag

SEQ ID NO: 41714 - DNA, 23 bp, Artificial sequence
  SiRNA target sequence
tttgtggtgcaaatgatataagt

SEQ ID NO: 41715 - DNA, 23 bp, Artificial sequence
  SiRNA target sequence
ttgtggtgcaaatgatataagtg

SEQ ID NO: 41716 - DNA, 23 bp, Artificial sequence
  SiRNA target sequence
tgtggtgcaaatgatataagtga

SEQ ID NO: 41717 - DNA, 23 bp, Artificial sequence
  SiRNA target sequence
gtggtgcaaatgatataagtgat

SEQ ID NO: 41718 - DNA, 23 bp, Artificial sequence
  SiRNA target sequence
tggtgcaaatgatataagtgatc

SEQ ID NO: 41719 - DNA, 23 bp, Artificial sequence
  SiRNA target sequence
ggtgcaaatgatataagtgatct

SEQ ID NO: 41720 - DNA, 23 bp, Artificial sequence
  SiRNA target sequence
gtgcaaatgatataagtgatcta

SEQ ID NO: 41721 - DNA, 23 bp, Artificial sequence
  SiRNA target sequence
tgcaaatgatataagtgatctat

SEQ ID NO: 41722 - DNA, 23 bp, Artificial sequence
  SiRNA target sequence
gcaaatgatataagtgatctata

SEQ ID NO: 41723 - DNA, 23 bp, Artificial sequence
  SiRNA target sequence
caaatgatataagtgatctatat

SEQ ID NO: 41724 - DNA, 23 bp, Artificial sequence
  SiRNA target sequence
aaatgatataagtgatctatatg

SEQ ID NO: 41725 - DNA, 23 bp, Artificial sequence
  SiRNA target sequence
aatgatataagtgatctatatga

SEQ ID NO: 41726 - DNA, 23 bp, Artificial sequence
  SiRNA target sequence
atgatataagtgatctatatgaa

SEQ ID NO: 41727 - DNA, 23 bp, Artificial sequence
  SiRNA target sequence
tgatataagtgatctatatgaac

SEQ ID NO: 41728 - DNA, 23 bp, Artificial sequence
  SiRNA target sequence
gatataagtgatctatatgaact

SEQ ID NO: 41729 - DNA, 23 bp, Artificial sequence
  SiRNA target sequence
atataagtgatctatatgaacta

SEQ ID NO: 41730 - DNA, 23 bp, Artificial sequence
  SiRNA target sequence
tataagtgatctatatgaactat

SEQ ID NO: 41731 - DNA, 23 bp, Artificial sequence
  SiRNA target sequence
ataagtgatctatatgaactatt

SEQ ID NO: 41732 - DNA, 23 bp, Artificial sequence
  SiRNA target sequence
taagtgatctatatgaactatta

SEQ ID NO: 41733 - DNA, 23 bp, Artificial sequence
  SiRNA target sequence
aagtgatctatatgaactattag

SEQ ID NO: 41734 - DNA, 23 bp, Artificial sequence
  SiRNA target sequence
agtgatctatatgaactattaga

SEQ ID NO: 41735 - DNA, 23 bp, Artificial sequence
  SiRNA target sequence
gtgatctatatgaactattagaa

SEQ ID NO: 41736 - DNA, 23 bp, Artificial sequence
  SiRNA target sequence
tgatctatatgaactattagaaa

SEQ ID NO: 41737 - DNA, 23 bp, Artificial sequence
  SiRNA target sequence
gatctatatgaactattagaaat

SEQ ID NO: 41738 - DNA, 23 bp, Artificial sequence
  SiRNA target sequence
atctatatgaactattagaaatt

SEQ ID NO: 41739 - DNA, 23 bp, Artificial sequence
  SiRNA target sequence
tctatatgaactattagaaattt

SEQ ID NO: 41740 - DNA, 23 bp, Artificial sequence
  SiRNA target sequence
ctatatgaactattagaaatttc

SEQ ID NO: 41741 - DNA, 23 bp, Artificial sequence
  SiRNA target sequence
tatatgaactattagaaatttct

SEQ ID NO: 41742 - DNA, 23 bp, Artificial sequence
  SiRNA target sequence
atatgaactattagaaatttctt

SEQ ID NO: 41743 - DNA, 23 bp, Artificial sequence
  SiRNA target sequence
tatgaactattagaaatttcttt

SEQ ID NO: 41744 - DNA, 23 bp, Artificial sequence
  SiRNA target sequence
atgaactattagaaatttctttt

SEQ ID NO: 41745 - DNA, 23 bp, Artificial sequence
  SiRNA target sequence
tgaactattagaaatttctttta

SEQ ID NO: 41746 - DNA, 23 bp, Artificial sequence
  SiRNA target sequence
gaactattagaaatttcttttat

SEQ ID NO: 41747 - DNA, 23 bp, Artificial sequence
  SiRNA target sequence
aactattagaaatttcttttata

SEQ ID NO: 41748 - DNA, 23 bp, Artificial sequence
  SiRNA target sequence
actattagaaatttcttttatat

SEQ ID NO: 41749 - DNA, 23 bp, Artificial sequence
  SiRNA target sequence
ctattagaaatttcttttatatc

SEQ ID NO: 41750 - DNA, 23 bp, Artificial sequence
  SiRNA target sequence
tattagaaatttcttttatatct

SEQ ID NO: 41751 - DNA, 23 bp, Artificial sequence
  SiRNA target sequence
attagaaatttcttttatatctc

SEQ ID NO: 41752 - DNA, 23 bp, Artificial sequence
  SiRNA target sequence
ttagaaatttcttttatatctcg

SEQ ID NO: 41753 - DNA, 23 bp, Artificial sequence
  SiRNA target sequence
tagaaatttcttttatatctcga

SEQ ID NO: 41754 - DNA, 23 bp, Artificial sequence
  SiRNA target sequence
agaaatttcttttatatctcgat

SEQ ID NO: 41755 - DNA, 23 bp, Artificial sequence
  SiRNA target sequence
gaaatttcttttatatctcgatt

SEQ ID NO: 41756 - DNA, 23 bp, Artificial sequence
  SiRNA target sequence
aaatttcttttatatctcgatta

SEQ ID NO: 41757 - DNA, 23 bp, Artificial sequence
  SiRNA target sequence
aatttcttttatatctcgattat

SEQ ID NO: 41758 - DNA, 23 bp, Artificial sequence
  SiRNA target sequence
atttcttttatatctcgattatc

SEQ ID NO: 41759 - DNA, 23 bp, Artificial sequence
  SiRNA target sequence
tttcttttatatctcgattatct

SEQ ID NO: 41760 - DNA, 23 bp, Artificial sequence
  SiRNA target sequence
ttcttttatatctcgattatcta

SEQ ID NO: 41761 - DNA, 23 bp, Artificial sequence
  SiRNA target sequence
tcttttatatctcgattatctag

SEQ ID NO: 41762 - DNA, 23 bp, Artificial sequence
  SiRNA target sequence
cttttatatctcgattatctaga

SEQ ID NO: 41763 - DNA, 23 bp, Artificial sequence
  SiRNA target sequence
ttttatatctcgattatctagat

SEQ ID NO: 41764 - DNA, 23 bp, Artificial sequence
  SiRNA target sequence
tttatatctcgattatctagata

SEQ ID NO: 41765 - DNA, 23 bp, Artificial sequence
  SiRNA target sequence
ttatatctcgattatctagataa

SEQ ID NO: 41766 - DNA, 23 bp, Artificial sequence
  SiRNA target sequence
tatatctcgattatctagataaa

SEQ ID NO: 41767 - DNA, 23 bp, Artificial sequence
  SiRNA target sequence
atatctcgattatctagataaat

SEQ ID NO: 41768 - DNA, 23 bp, Artificial sequence
  SiRNA target sequence
tatctcgattatctagataaata

SEQ ID NO: 41769 - DNA, 23 bp, Artificial sequence
  SiRNA target sequence
atctcgattatctagataaatat

SEQ ID NO: 41770 - DNA, 23 bp, Artificial sequence
  SiRNA target sequence
tctcgattatctagataaatatt

SEQ ID NO: 41771 - DNA, 23 bp, Artificial sequence
  SiRNA target sequence
ctcgattatctagataaatattt

SEQ ID NO: 41772 - DNA, 23 bp, Artificial sequence
  SiRNA target sequence
tcgattatctagataaatatttc

SEQ ID NO: 41773 - DNA, 23 bp, Artificial sequence
  SiRNA target sequence
cgattatctagataaatatttcc

SEQ ID NO: 41774 - DNA, 23 bp, Artificial sequence
  SiRNA target sequence
gattatctagataaatatttccc

SEQ ID NO: 41775 - DNA, 23 bp, Artificial sequence
  SiRNA target sequence
attatctagataaatatttcccc

SEQ ID NO: 41776 - DNA, 23 bp, Artificial sequence
  SiRNA target sequence
ttatctagataaatatttccccc

SEQ ID NO: 41777 - DNA, 23 bp, Artificial sequence
  SiRNA target sequence
tatctagataaatatttccccca

SEQ ID NO: 41778 - DNA, 23 bp, Artificial sequence
  SiRNA target sequence
atctagataaatatttcccccat

SEQ ID NO: 41779 - DNA, 23 bp, Artificial sequence
  SiRNA target sequence
tctagataaatatttcccccata

SEQ ID NO: 41780 - DNA, 23 bp, Artificial sequence
  SiRNA target sequence
ctagataaatatttcccccataa

SEQ ID NO: 41781 - DNA, 23 bp, Artificial sequence
  SiRNA target sequence
tagataaatatttcccccataat

SEQ ID NO: 41782 - DNA, 23 bp, Artificial sequence
  SiRNA target sequence
agataaatatttcccccataatt

SEQ ID NO: 41783 - DNA, 23 bp, Artificial sequence
  SiRNA target sequence
gataaatatttcccccataattt

SEQ ID NO: 41784 - DNA, 23 bp, Artificial sequence
  SiRNA target sequence
ataaatatttcccccataatttt

SEQ ID NO: 41785 - DNA, 23 bp, Artificial sequence
  SiRNA target sequence
taaatatttcccccataattttc

SEQ ID NO: 41786 - DNA, 23 bp, Artificial sequence
  SiRNA target sequence
aaatatttcccccataattttca

SEQ ID NO: 41787 - DNA, 23 bp, Artificial sequence
  SiRNA target sequence
aatatttcccccataattttcaa

SEQ ID NO: 41788 - DNA, 23 bp, Artificial sequence
  SiRNA target sequence
atatttcccccataattttcaaa

SEQ ID NO: 41789 - DNA, 23 bp, Artificial sequence
  SiRNA target sequence
tatttcccccataattttcaaat

SEQ ID NO: 41790 - DNA, 23 bp, Artificial sequence
  SiRNA target sequence
atttcccccataattttcaaatc

SEQ ID NO: 41791 - DNA, 23 bp, Artificial sequence
  SiRNA target sequence
tttcccccataattttcaaatct

SEQ ID NO: 41792 - DNA, 23 bp, Artificial sequence
  SiRNA target sequence
ttcccccataattttcaaatctc

SEQ ID NO: 41793 - DNA, 23 bp, Artificial sequence
  SiRNA target sequence
tcccccataattttcaaatctca

SEQ ID NO: 41794 - DNA, 23 bp, Artificial sequence
  SiRNA target sequence
cccccataattttcaaatctcat

SEQ ID NO: 41795 - DNA, 23 bp, Artificial sequence
  SiRNA target sequence
ccccataattttcaaatctcata

SEQ ID NO: 41796 - DNA, 23 bp, Artificial sequence
  SiRNA target sequence
cccataattttcaaatctcataa

SEQ ID NO: 41797 - DNA, 23 bp, Artificial sequence
  SiRNA target sequence
ccataattttcaaatctcataat

SEQ ID NO: 41798 - DNA, 23 bp, Artificial sequence
  SiRNA target sequence
cataattttcaaatctcataatc

SEQ ID NO: 41799 - DNA, 23 bp, Artificial sequence
  SiRNA target sequence
ataattttcaaatctcataatca

SEQ ID NO: 41800 - DNA, 23 bp, Artificial sequence
  SiRNA target sequence
taattttcaaatctcataatcat

SEQ ID NO: 41801 - DNA, 23 bp, Artificial sequence
  SiRNA target sequence
aattttcaaatctcataatcatc

SEQ ID NO: 41802 - DNA, 23 bp, Artificial sequence
  SiRNA target sequence
attttcaaatctcataatcatct

SEQ ID NO: 41803 - DNA, 23 bp, Artificial sequence
  SiRNA target sequence
ttttcaaatctcataatcatctt

SEQ ID NO: 41804 - DNA, 23 bp, Artificial sequence
  SiRNA target sequence
tttcaaatctcataatcatcttt

SEQ ID NO: 41805 - DNA, 23 bp, Artificial sequence
  SiRNA target sequence
ttcaaatctcataatcatcttta

SEQ ID NO: 41806 - DNA, 23 bp, Artificial sequence
  SiRNA target sequence
tcaaatctcataatcatctttat

SEQ ID NO: 41807 - DNA, 23 bp, Artificial sequence
  SiRNA target sequence
caaatctcataatcatctttata

SEQ ID NO: 41808 - DNA, 23 bp, Artificial sequence
  SiRNA target sequence
aaatctcataatcatctttataa

SEQ ID NO: 41809 - DNA, 23 bp, Artificial sequence
  SiRNA target sequence
aatctcataatcatctttataag

SEQ ID NO: 41810 - DNA, 23 bp, Artificial sequence
  SiRNA target sequence
atctcataatcatctttataaga

SEQ ID NO: 41811 - DNA, 23 bp, Artificial sequence
  SiRNA target sequence
tctcataatcatctttataagag

SEQ ID NO: 41812 - DNA, 23 bp, Artificial sequence
  SiRNA target sequence
ctcataatcatctttataagaga

SEQ ID NO: 41813 - DNA, 23 bp, Artificial sequence
  SiRNA target sequence
tcataatcatctttataagagat

SEQ ID NO: 41814 - DNA, 23 bp, Artificial sequence
  SiRNA target sequence
cataatcatctttataagagatg

SEQ ID NO: 41815 - DNA, 23 bp, Artificial sequence
  SiRNA target sequence
ataatcatctttataagagatgt

SEQ ID NO: 41816 - DNA, 23 bp, Artificial sequence
  SiRNA target sequence
taatcatctttataagagatgtt

SEQ ID NO: 41817 - DNA, 23 bp, Artificial sequence
  SiRNA target sequence
aatcatctttataagagatgttt

SEQ ID NO: 41818 - DNA, 23 bp, Artificial sequence
  SiRNA target sequence
atcatctttataagagatgtttt

SEQ ID NO: 41819 - DNA, 23 bp, Artificial sequence
  SiRNA target sequence
tcatctttataagagatgttttt

SEQ ID NO: 41820 - DNA, 23 bp, Artificial sequence
  SiRNA target sequence
catctttataagagatgtttttc

SEQ ID NO: 41821 - DNA, 23 bp, Artificial sequence
  SiRNA target sequence
atctttataagagatgtttttcc

SEQ ID NO: 41822 - DNA, 23 bp, Artificial sequence
  SiRNA target sequence
tctttataagagatgtttttccc

SEQ ID NO: 41823 - DNA, 23 bp, Artificial sequence
  SiRNA target sequence
ctttataagagatgtttttcccg

SEQ ID NO: 41824 - DNA, 23 bp, Artificial sequence
  SiRNA target sequence
tttataagagatgtttttcccga

SEQ ID NO: 41825 - DNA, 23 bp, Artificial sequence
  SiRNA target sequence
ttataagagatgtttttcccgat

SEQ ID NO: 41826 - DNA, 23 bp, Artificial sequence
  SiRNA target sequence
tataagagatgtttttcccgatc

SEQ ID NO: 41827 - DNA, 23 bp, Artificial sequence
  SiRNA target sequence
ataagagatgtttttcccgatcc

SEQ ID NO: 41828 - DNA, 23 bp, Artificial sequence
  SiRNA target sequence
taagagatgtttttcccgatcca

SEQ ID NO: 41829 - DNA, 23 bp, Artificial sequence
  SiRNA target sequence
aagagatgtttttcccgatccat

SEQ ID NO: 41830 - DNA, 23 bp, Artificial sequence
  SiRNA target sequence
agagatgtttttcccgatccatt

SEQ ID NO: 41831 - DNA, 23 bp, Artificial sequence
  SiRNA target sequence
gagatgtttttcccgatccattt

SEQ ID NO: 41832 - DNA, 23 bp, Artificial sequence
  SiRNA target sequence
agatgtttttcccgatccatttt

SEQ ID NO: 41833 - DNA, 23 bp, Artificial sequence
  SiRNA target sequence
gatgtttttcccgatccattttt

SEQ ID NO: 41834 - DNA, 23 bp, Artificial sequence
  SiRNA target sequence
atgtttttcccgatccatttttt

SEQ ID NO: 41835 - DNA, 23 bp, Artificial sequence
  SiRNA target sequence
tgtttttcccgatccattttttc

SEQ ID NO: 41836 - DNA, 23 bp, Artificial sequence
  SiRNA target sequence
gtttttcccgatccattttttcc

SEQ ID NO: 41837 - DNA, 23 bp, Artificial sequence
  SiRNA target sequence
tttttcccgatccattttttcca

SEQ ID NO: 41838 - DNA, 23 bp, Artificial sequence
  SiRNA target sequence
ttttcccgatccattttttccaa

SEQ ID NO: 41839 - DNA, 23 bp, Artificial sequence
  SiRNA target sequence
tttcccgatccattttttccaat

SEQ ID NO: 41840 - DNA, 23 bp, Artificial sequence
  SiRNA target sequence
ttcccgatccattttttccaata

SEQ ID NO: 41841 - DNA, 23 bp, Artificial sequence
  SiRNA target sequence
tcccgatccattttttccaataa

SEQ ID NO: 41842 - DNA, 23 bp, Artificial sequence
  SiRNA target sequence
cccgatccattttttccaataat

SEQ ID NO: 41843 - DNA, 23 bp, Artificial sequence
  SiRNA target sequence
ccgatccattttttccaataata

SEQ ID NO: 41844 - DNA, 23 bp, Artificial sequence
  SiRNA target sequence
cgatccattttttccaataatag

SEQ ID NO: 41845 - DNA, 23 bp, Artificial sequence
  SiRNA target sequence
gatccattttttccaataatagc

SEQ ID NO: 41846 - DNA, 23 bp, Artificial sequence
  SiRNA target sequence
atccattttttccaataatagct

SEQ ID NO: 41847 - DNA, 23 bp, Artificial sequence
  SiRNA target sequence
tccattttttccaataatagcta

SEQ ID NO: 41848 - DNA, 23 bp, Artificial sequence
  SiRNA target sequence
ccattttttccaataatagctac

SEQ ID NO: 41849 - DNA, 23 bp, Artificial sequence
  SiRNA target sequence
cattttttccaataatagctact

SEQ ID NO: 41850 - DNA, 23 bp, Artificial sequence
  SiRNA target sequence
attttttccaataatagctactt

SEQ ID NO: 41851 - DNA, 23 bp, Artificial sequence
  SiRNA target sequence
ttttttccaataatagctacttt

SEQ ID NO: 41852 - DNA, 23 bp, Artificial sequence
  SiRNA target sequence
tttttccaataatagctactttt

SEQ ID NO: 41853 - DNA, 23 bp, Artificial sequence
  SiRNA target sequence
ttttccaataatagctacttttt

SEQ ID NO: 41854 - DNA, 23 bp, Artificial sequence
  SiRNA target sequence
tttccaataatagctactttttc

SEQ ID NO: 41855 - DNA, 23 bp, Artificial sequence
  SiRNA target sequence
ttccaataatagctactttttca

SEQ ID NO: 41856 - DNA, 23 bp, Artificial sequence
  SiRNA target sequence
tccaataatagctactttttcac

SEQ ID NO: 41857 - DNA, 23 bp, Artificial sequence
  SiRNA target sequence
ccaataatagctactttttcacc

SEQ ID NO: 41858 - DNA, 23 bp, Artificial sequence
  SiRNA target sequence
caataatagctactttttcacct

SEQ ID NO: 41859 - DNA, 23 bp, Artificial sequence
  SiRNA target sequence
aataatagctactttttcacctt

SEQ ID NO: 41860 - DNA, 23 bp, Artificial sequence
  SiRNA target sequence
ataatagctactttttcaccttt

SEQ ID NO: 41861 - DNA, 23 bp, Artificial sequence
  SiRNA target sequence
taatagctactttttcacctttt

SEQ ID NO: 41862 - DNA, 23 bp, Artificial sequence
  SiRNA target sequence
aatagctactttttcaccttttt

SEQ ID NO: 41863 - DNA, 23 bp, Artificial sequence
  SiRNA target sequence
atagctactttttcacctttttt

SEQ ID NO: 41864 - DNA, 23 bp, Artificial sequence
  SiRNA target sequence
tagctactttttcacctttttta

SEQ ID NO: 41865 - DNA, 23 bp, Artificial sequence
  SiRNA target sequence
agctactttttcaccttttttaa

SEQ ID NO: 41866 - DNA, 23 bp, Artificial sequence
  SiRNA target sequence
gctactttttcaccttttttaat

SEQ ID NO: 41867 - DNA, 23 bp, Artificial sequence
  SiRNA target sequence
ctactttttcaccttttttaatt

SEQ ID NO: 41868 - DNA, 23 bp, Artificial sequence
  SiRNA target sequence
tactttttcaccttttttaatta

SEQ ID NO: 41869 - DNA, 23 bp, Artificial sequence
  SiRNA target sequence
actttttcaccttttttaattaa

SEQ ID NO: 41870 - DNA, 23 bp, Artificial sequence
  SiRNA target sequence
ctttttcaccttttttaattaaa

SEQ ID NO: 41871 - DNA, 23 bp, Artificial sequence
  SiRNA target sequence
tttttcaccttttttaattaaaa

SEQ ID NO: 41872 - DNA, 23 bp, Artificial sequence
  SiRNA target sequence
ttttcaccttttttaattaaaat

SEQ ID NO: 41873 - DNA, 23 bp, Artificial sequence
  SiRNA target sequence
tttcaccttttttaattaaaata

SEQ ID NO: 41874 - DNA, 23 bp, Artificial sequence
  SiRNA target sequence
ttcaccttttttaattaaaatat

SEQ ID NO: 41875 - DNA, 23 bp, Artificial sequence
  SiRNA target sequence
tcaccttttttaattaaaatatt

SEQ ID NO: 41876 - DNA, 23 bp, Artificial sequence
  SiRNA target sequence
caccttttttaattaaaatattt

SEQ ID NO: 41877 - DNA, 23 bp, Artificial sequence
  SiRNA target sequence
accttttttaattaaaatattta

SEQ ID NO: 41878 - DNA, 23 bp, Artificial sequence
  SiRNA target sequence
ccttttttaattaaaatatttat

SEQ ID NO: 41879 - DNA, 23 bp, Artificial sequence
  SiRNA target sequence
cttttttaattaaaatatttatg

SEQ ID NO: 41880 - DNA, 23 bp, Artificial sequence
  SiRNA target sequence
ttttttaattaaaatatttatgt

SEQ ID NO: 41881 - DNA, 23 bp, Artificial sequence
  SiRNA target sequence
tttttaattaaaatatttatgtc

SEQ ID NO: 41882 - DNA, 23 bp, Artificial sequence
  SiRNA target sequence
ttttaattaaaatatttatgtcc

SEQ ID NO: 41883 - DNA, 23 bp, Artificial sequence
  SiRNA target sequence
tttaattaaaatatttatgtccg

SEQ ID NO: 41884 - DNA, 23 bp, Artificial sequence
  SiRNA target sequence
ttaattaaaatatttatgtccgt

SEQ ID NO: 41885 - DNA, 23 bp, Artificial sequence
  SiRNA target sequence
taattaaaatatttatgtccgtt

SEQ ID NO: 41886 - DNA, 23 bp, Artificial sequence
  SiRNA target sequence
aattaaaatatttatgtccgtta

SEQ ID NO: 41887 - DNA, 23 bp, Artificial sequence
  SiRNA target sequence
attaaaatatttatgtccgttaa

SEQ ID NO: 41888 - DNA, 23 bp, Artificial sequence
  SiRNA target sequence
ttaaaatatttatgtccgttaaa

SEQ ID NO: 41889 - DNA, 23 bp, Artificial sequence
  SiRNA target sequence
taaaatatttatgtccgttaaaa

SEQ ID NO: 41890 - DNA, 23 bp, Artificial sequence
  SiRNA target sequence
aaaatatttatgtccgttaaaat

SEQ ID NO: 41891 - DNA, 23 bp, Artificial sequence
  SiRNA target sequence
aaatatttatgtccgttaaaatt

SEQ ID NO: 41892 - DNA, 23 bp, Artificial sequence
  SiRNA target sequence
aatatttatgtccgttaaaattt

SEQ ID NO: 41893 - DNA, 23 bp, Artificial sequence
  SiRNA target sequence
atatttatgtccgttaaaatttt

SEQ ID NO: 41894 - DNA, 23 bp, Artificial sequence
  SiRNA target sequence
tatttatgtccgttaaaattttt

SEQ ID NO: 41895 - DNA, 23 bp, Artificial sequence
  SiRNA target sequence
atttatgtccgttaaaatttttt

SEQ ID NO: 41896 - DNA, 23 bp, Artificial sequence
  SiRNA target sequence
tttatgtccgttaaaattttttt

SEQ ID NO: 41897 - DNA, 23 bp, Artificial sequence
  SiRNA target sequence
ttatgtccgttaaaatttttttg

SEQ ID NO: 41898 - DNA, 23 bp, Artificial sequence
  SiRNA target sequence
tatgtccgttaaaatttttttgg

SEQ ID NO: 41899 - DNA, 23 bp, Artificial sequence
  SiRNA target sequence
atgtccgttaaaatttttttgga

SEQ ID NO: 41900 - DNA, 23 bp, Artificial sequence
  SiRNA target sequence
tgtccgttaaaatttttttggag

SEQ ID NO: 41901 - DNA, 23 bp, Artificial sequence
  SiRNA target sequence
gtccgttaaaatttttttggagt

SEQ ID NO: 41902 - DNA, 23 bp, Artificial sequence
  SiRNA target sequence
tccgttaaaatttttttggagta

SEQ ID NO: 41903 - DNA, 23 bp, Artificial sequence
  SiRNA target sequence
ccgttaaaatttttttggagtaa

SEQ ID NO: 41904 - DNA, 23 bp, Artificial sequence
  SiRNA target sequence
cgttaaaatttttttggagtaat

SEQ ID NO: 41905 - DNA, 23 bp, Artificial sequence
  SiRNA target sequence
gttaaaatttttttggagtaata

SEQ ID NO: 41906 - DNA, 23 bp, Artificial sequence
  SiRNA target sequence
ttaaaatttttttggagtaataa

SEQ ID NO: 41907 - DNA, 23 bp, Artificial sequence
  SiRNA target sequence
taaaatttttttggagtaataat

SEQ ID NO: 41908 - DNA, 23 bp, Artificial sequence
  SiRNA target sequence
aaaatttttttggagtaataatt

SEQ ID NO: 41909 - DNA, 23 bp, Artificial sequence
  SiRNA target sequence
aaatttttttggagtaataatta

SEQ ID NO: 41910 - DNA, 23 bp, Artificial sequence
  SiRNA target sequence
aatttttttggagtaataattaa

SEQ ID NO: 41911 - DNA, 23 bp, Artificial sequence
  SiRNA target sequence
atttttttggagtaataattaaa

SEQ ID NO: 41912 - DNA, 23 bp, Artificial sequence
  SiRNA target sequence
tttttttggagtaataattaaat

SEQ ID NO: 41913 - DNA, 23 bp, Artificial sequence
  SiRNA target sequence
ttttttggagtaataattaaatg

SEQ ID NO: 41914 - DNA, 23 bp, Artificial sequence
  SiRNA target sequence
tttttggagtaataattaaatga

SEQ ID NO: 41915 - DNA, 23 bp, Artificial sequence
  SiRNA target sequence
ttttggagtaataattaaatgat

SEQ ID NO: 41916 - DNA, 23 bp, Artificial sequence
  SiRNA target sequence
tttggagtaataattaaatgatg

SEQ ID NO: 41917 - DNA, 23 bp, Artificial sequence
  SiRNA target sequence
ttggagtaataattaaatgatgc

SEQ ID NO: 41918 - DNA, 23 bp, Artificial sequence
  SiRNA target sequence
tggagtaataattaaatgatgca

SEQ ID NO: 41919 - DNA, 23 bp, Artificial sequence
  SiRNA target sequence
ggagtaataattaaatgatgcat

SEQ ID NO: 41920 - DNA, 23 bp, Artificial sequence
  SiRNA target sequence
gagtaataattaaatgatgcatt

SEQ ID NO: 41921 - DNA, 23 bp, Artificial sequence
  SiRNA target sequence
agtaataattaaatgatgcattt

SEQ ID NO: 41922 - DNA, 23 bp, Artificial sequence
  SiRNA target sequence
gtaataattaaatgatgcatttt

SEQ ID NO: 41923 - DNA, 23 bp, Artificial sequence
  SiRNA target sequence
taataattaaatgatgcattttc

SEQ ID NO: 41924 - DNA, 23 bp, Artificial sequence
  SiRNA target sequence
aataattaaatgatgcattttct

SEQ ID NO: 41925 - DNA, 23 bp, Artificial sequence
  SiRNA target sequence
ataattaaatgatgcattttcta

SEQ ID NO: 41926 - DNA, 23 bp, Artificial sequence
  SiRNA target sequence
taattaaatgatgcattttctaa

SEQ ID NO: 41927 - DNA, 23 bp, Artificial sequence
  SiRNA target sequence
aattaaatgatgcattttctaat

SEQ ID NO: 41928 - DNA, 23 bp, Artificial sequence
  SiRNA target sequence
attaaatgatgcattttctaatc

SEQ ID NO: 41929 - DNA, 23 bp, Artificial sequence
  SiRNA target sequence
ttaaatgatgcattttctaatct

SEQ ID NO: 41930 - DNA, 23 bp, Artificial sequence
  SiRNA target sequence
taaatgatgcattttctaatctt

SEQ ID NO: 41931 - DNA, 23 bp, Artificial sequence
  SiRNA target sequence
aaatgatgcattttctaatctta

SEQ ID NO: 41932 - DNA, 23 bp, Artificial sequence
  SiRNA target sequence
aatgatgcattttctaatcttat

SEQ ID NO: 41933 - DNA, 23 bp, Artificial sequence
  SiRNA target sequence
atgatgcattttctaatcttata

SEQ ID NO: 41934 - DNA, 23 bp, Artificial sequence
  SiRNA target sequence
tgatgcattttctaatcttatat

SEQ ID NO: 41935 - DNA, 23 bp, Artificial sequence
  SiRNA target sequence
gatgcattttctaatcttatatc

SEQ ID NO: 41936 - DNA, 23 bp, Artificial sequence
  SiRNA target sequence
atgcattttctaatcttatatca

SEQ ID NO: 41937 - DNA, 23 bp, Artificial sequence
  SiRNA target sequence
tgcattttctaatcttatatcat

SEQ ID NO: 41938 - DNA, 23 bp, Artificial sequence
  SiRNA target sequence
gcattttctaatcttatatcatt

SEQ ID NO: 41939 - DNA, 23 bp, Artificial sequence
  SiRNA target sequence
cattttctaatcttatatcatta

SEQ ID NO: 41940 - DNA, 23 bp, Artificial sequence
  SiRNA target sequence
attttctaatcttatatcattat

SEQ ID NO: 41941 - DNA, 23 bp, Artificial sequence
  SiRNA target sequence
ttttctaatcttatatcattatt

SEQ ID NO: 41942 - DNA, 23 bp, Artificial sequence
  SiRNA target sequence
tttctaatcttatatcattatta

SEQ ID NO: 41943 - DNA, 23 bp, Artificial sequence
  SiRNA target sequence
ttctaatcttatatcattattaa

SEQ ID NO: 41944 - DNA, 23 bp, Artificial sequence
  SiRNA target sequence
tctaatcttatatcattattaaa

SEQ ID NO: 41945 - DNA, 23 bp, Artificial sequence
  SiRNA target sequence
ctaatcttatatcattattaaat

SEQ ID NO: 41946 - DNA, 23 bp, Artificial sequence
  SiRNA target sequence
taatcttatatcattattaaatt

SEQ ID NO: 41947 - DNA, 23 bp, Artificial sequence
  SiRNA target sequence
aatcttatatcattattaaattc

SEQ ID NO: 41948 - DNA, 23 bp, Artificial sequence
  SiRNA target sequence
atcttatatcattattaaattca

SEQ ID NO: 41949 - DNA, 23 bp, Artificial sequence
  SiRNA target sequence
tcttatatcattattaaattcat

SEQ ID NO: 41950 - DNA, 23 bp, Artificial sequence
  SiRNA target sequence
cttatatcattattaaattcatt

SEQ ID NO: 41951 - DNA, 23 bp, Artificial sequence
  SiRNA target sequence
ttatatcattattaaattcatta

SEQ ID NO: 41952 - DNA, 23 bp, Artificial sequence
  SiRNA target sequence
tatatcattattaaattcattaa

SEQ ID NO: 41953 - DNA, 23 bp, Artificial sequence
  SiRNA target sequence
atatcattattaaattcattaac

SEQ ID NO: 41954 - DNA, 23 bp, Artificial sequence
  SiRNA target sequence
tatcattattaaattcattaaca

SEQ ID NO: 41955 - DNA, 23 bp, Artificial sequence
  SiRNA target sequence
atcattattaaattcattaacat

SEQ ID NO: 41956 - DNA, 23 bp, Artificial sequence
  SiRNA target sequence
tcattattaaattcattaacatc

SEQ ID NO: 41957 - DNA, 23 bp, Artificial sequence
  SiRNA target sequence
cattattaaattcattaacatct

SEQ ID NO: 41958 - DNA, 23 bp, Artificial sequence
  SiRNA target sequence
attattaaattcattaacatcta

SEQ ID NO: 41959 - DNA, 23 bp, Artificial sequence
  SiRNA target sequence
ttattaaattcattaacatctac

SEQ ID NO: 41960 - DNA, 23 bp, Artificial sequence
  SiRNA target sequence
tattaaattcattaacatctact

SEQ ID NO: 41961 - DNA, 23 bp, Artificial sequence
  SiRNA target sequence
attaaattcattaacatctacta

SEQ ID NO: 41962 - DNA, 23 bp, Artificial sequence
  SiRNA target sequence
ttaaattcattaacatctactaa

SEQ ID NO: 41963 - DNA, 23 bp, Artificial sequence
  SiRNA target sequence
taaattcattaacatctactaaa

SEQ ID NO: 41964 - DNA, 23 bp, Artificial sequence
  SiRNA target sequence
aaattcattaacatctactaaat

SEQ ID NO: 41965 - DNA, 23 bp, Artificial sequence
  SiRNA target sequence
aattcattaacatctactaaatt

SEQ ID NO: 41966 - DNA, 23 bp, Artificial sequence
  SiRNA target sequence
attcattaacatctactaaattt

SEQ ID NO: 41967 - DNA, 23 bp, Artificial sequence
  SiRNA target sequence
ttcattaacatctactaaatttg

SEQ ID NO: 41968 - DNA, 23 bp, Artificial sequence
  SiRNA target sequence
tcattaacatctactaaatttgg

SEQ ID NO: 41969 - DNA, 23 bp, Artificial sequence
  SiRNA target sequence
cattaacatctactaaatttggt

SEQ ID NO: 41970 - DNA, 23 bp, Artificial sequence
  SiRNA target sequence
attaacatctactaaatttggtt

SEQ ID NO: 41971 - DNA, 23 bp, Artificial sequence
  SiRNA target sequence
ttaacatctactaaatttggttc

SEQ ID NO: 41972 - DNA, 23 bp, Artificial sequence
  SiRNA target sequence
taacatctactaaatttggttct

SEQ ID NO: 41973 - DNA, 23 bp, Artificial sequence
  SiRNA target sequence
aacatctactaaatttggttctt

SEQ ID NO: 41974 - DNA, 23 bp, Artificial sequence
  SiRNA target sequence
acatctactaaatttggttcttc

SEQ ID NO: 41975 - DNA, 23 bp, Artificial sequence
  SiRNA target sequence
catctactaaatttggttcttct

SEQ ID NO: 41976 - DNA, 23 bp, Artificial sequence
  SiRNA target sequence
atctactaaatttggttcttctt

SEQ ID NO: 41977 - DNA, 23 bp, Artificial sequence
  SiRNA target sequence
tctactaaatttggttcttcttt

SEQ ID NO: 41978 - DNA, 23 bp, Artificial sequence
  SiRNA target sequence
ctactaaatttggttcttctttt

SEQ ID NO: 41979 - DNA, 23 bp, Artificial sequence
  SiRNA target sequence
tactaaatttggttcttctttta

SEQ ID NO: 41980 - DNA, 23 bp, Artificial sequence
  SiRNA target sequence
actaaatttggttcttcttttat

SEQ ID NO: 41981 - DNA, 23 bp, Artificial sequence
  SiRNA target sequence
ctaaatttggttcttcttttata

SEQ ID NO: 41982 - DNA, 23 bp, Artificial sequence
  SiRNA target sequence
taaatttggttcttcttttataa

SEQ ID NO: 41983 - DNA, 23 bp, Artificial sequence
  SiRNA target sequence
aaatttggttcttcttttataag

SEQ ID NO: 41984 - DNA, 23 bp, Artificial sequence
  SiRNA target sequence
aatttggttcttcttttataagc

SEQ ID NO: 41985 - DNA, 23 bp, Artificial sequence
  SiRNA target sequence
atttggttcttcttttataagct

SEQ ID NO: 41986 - DNA, 23 bp, Artificial sequence
  SiRNA target sequence
tttggttcttcttttataagctc

SEQ ID NO: 41987 - DNA, 23 bp, Artificial sequence
  SiRNA target sequence
ttggttcttcttttataagctct

SEQ ID NO: 41988 - DNA, 23 bp, Artificial sequence
  SiRNA target sequence
tggttcttcttttataagctctg

SEQ ID NO: 41989 - DNA, 23 bp, Artificial sequence
  SiRNA target sequence
ggttcttcttttataagctctgg

SEQ ID NO: 41990 - DNA, 23 bp, Artificial sequence
  SiRNA target sequence
gttcttcttttataagctctggt

SEQ ID NO: 41991 - DNA, 23 bp, Artificial sequence
  SiRNA target sequence
ttcttcttttataagctctggtt

SEQ ID NO: 41992 - DNA, 23 bp, Artificial sequence
  SiRNA target sequence
tcttcttttataagctctggttt

SEQ ID NO: 41993 - DNA, 23 bp, Artificial sequence
  SiRNA target sequence
cttcttttataagctctggttta

SEQ ID NO: 41994 - DNA, 23 bp, Artificial sequence
  SiRNA target sequence
ttcttttataagctctggtttaa

SEQ ID NO: 41995 - DNA, 23 bp, Artificial sequence
  SiRNA target sequence
tcttttataagctctggtttaaa

SEQ ID NO: 41996 - DNA, 23 bp, Artificial sequence
  SiRNA target sequence
cttttataagctctggtttaaaa

SEQ ID NO: 41997 - DNA, 23 bp, Artificial sequence
  SiRNA target sequence
ttttataagctctggtttaaaag

SEQ ID NO: 41998 - DNA, 23 bp, Artificial sequence
  SiRNA target sequence
tttataagctctggtttaaaaga

SEQ ID NO: 41999 - DNA, 23 bp, Artificial sequence
  SiRNA target sequence
ttataagctctggtttaaaagat

SEQ ID NO: 42000 - DNA, 23 bp, Artificial sequence
  SiRNA target sequence
tataagctctggtttaaaagatg

SEQ ID NO: 42001 - DNA, 23 bp, Artificial sequence
  SiRNA target sequence
ataagctctggtttaaaagatgt

SEQ ID NO: 42002 - DNA, 23 bp, Artificial sequence
  SiRNA target sequence
taagctctggtttaaaagatgtt

SEQ ID NO: 42003 - DNA, 23 bp, Artificial sequence
  SiRNA target sequence
aagctctggtttaaaagatgttc

SEQ ID NO: 42004 - DNA, 23 bp, Artificial sequence
  SiRNA target sequence
agctctggtttaaaagatgttct

SEQ ID NO: 42005 - DNA, 23 bp, Artificial sequence
  SiRNA target sequence
gctctggtttaaaagatgttctt

SEQ ID NO: 42006 - DNA, 23 bp, Artificial sequence
  SiRNA target sequence
ctctggtttaaaagatgttctta

SEQ ID NO: 42007 - DNA, 23 bp, Artificial sequence
  SiRNA target sequence
tctggtttaaaagatgttcttat

SEQ ID NO: 42008 - DNA, 23 bp, Artificial sequence
  SiRNA target sequence
ctggtttaaaagatgttcttata

SEQ ID NO: 42009 - DNA, 23 bp, Artificial sequence
  SiRNA target sequence
tggtttaaaagatgttcttatat

SEQ ID NO: 42010 - DNA, 23 bp, Artificial sequence
  SiRNA target sequence
ggtttaaaagatgttcttatatt

SEQ ID NO: 42011 - DNA, 23 bp, Artificial sequence
  SiRNA target sequence
gtttaaaagatgttcttatattt

SEQ ID NO: 42012 - DNA, 23 bp, Artificial sequence
  SiRNA target sequence
tttaaaagatgttcttatattta

SEQ ID NO: 42013 - DNA, 23 bp, Artificial sequence
  SiRNA target sequence
ttaaaagatgttcttatatttaa

SEQ ID NO: 42014 - DNA, 23 bp, Artificial sequence
  SiRNA target sequence
taaaagatgttcttatatttaag

SEQ ID NO: 42015 - DNA, 23 bp, Artificial sequence
  SiRNA target sequence
aaaagatgttcttatatttaaga

SEQ ID NO: 42016 - DNA, 23 bp, Artificial sequence
  SiRNA target sequence
aaagatgttcttatatttaagat

SEQ ID NO: 42017 - DNA, 23 bp, Artificial sequence
  SiRNA target sequence
aagatgttcttatatttaagatt

SEQ ID NO: 42018 - DNA, 23 bp, Artificial sequence
  SiRNA target sequence
agatgttcttatatttaagattg

SEQ ID NO: 42019 - DNA, 23 bp, Artificial sequence
  SiRNA target sequence
gatgttcttatatttaagattgc

SEQ ID NO: 42020 - DNA, 23 bp, Artificial sequence
  SiRNA target sequence
atgttcttatatttaagattgct

SEQ ID NO: 42021 - DNA, 23 bp, Artificial sequence
  SiRNA target sequence
tgttcttatatttaagattgctt

SEQ ID NO: 42022 - DNA, 23 bp, Artificial sequence
  SiRNA target sequence
gttcttatatttaagattgcttg

SEQ ID NO: 42023 - DNA, 23 bp, Artificial sequence
  SiRNA target sequence
ttcttatatttaagattgcttgt

SEQ ID NO: 42024 - DNA, 23 bp, Artificial sequence
  SiRNA target sequence
tcttatatttaagattgcttgtg

SEQ ID NO: 42025 - DNA, 23 bp, Artificial sequence
  SiRNA target sequence
cttatatttaagattgcttgtgt

SEQ ID NO: 42026 - DNA, 23 bp, Artificial sequence
  SiRNA target sequence
ttatatttaagattgcttgtgta

SEQ ID NO: 42027 - DNA, 23 bp, Artificial sequence
  SiRNA target sequence
tatatttaagattgcttgtgtat

SEQ ID NO: 42028 - DNA, 23 bp, Artificial sequence
  SiRNA target sequence
atatttaagattgcttgtgtata

SEQ ID NO: 42029 - DNA, 23 bp, Artificial sequence
  SiRNA target sequence
tatttaagattgcttgtgtatat

SEQ ID NO: 42030 - DNA, 23 bp, Artificial sequence
  SiRNA target sequence
atttaagattgcttgtgtatatc

SEQ ID NO: 42031 - DNA, 23 bp, Artificial sequence
  SiRNA target sequence
tttaagattgcttgtgtatatcg

SEQ ID NO: 42032 - DNA, 23 bp, Artificial sequence
  SiRNA target sequence
ttaagattgcttgtgtatatcgt

SEQ ID NO: 42033 - DNA, 23 bp, Artificial sequence
  SiRNA target sequence
taagattgcttgtgtatatcgtg

SEQ ID NO: 42034 - DNA, 23 bp, Artificial sequence
  SiRNA target sequence
aagattgcttgtgtatatcgtga

SEQ ID NO: 42035 - DNA, 23 bp, Artificial sequence
  SiRNA target sequence
agattgcttgtgtatatcgtgag

SEQ ID NO: 42036 - DNA, 23 bp, Artificial sequence
  SiRNA target sequence
gattgcttgtgtatatcgtgagt

SEQ ID NO: 42037 - DNA, 23 bp, Artificial sequence
  SiRNA target sequence
attgcttgtgtatatcgtgagta

SEQ ID NO: 42038 - DNA, 23 bp, Artificial sequence
  SiRNA target sequence
ttgcttgtgtatatcgtgagtaa

SEQ ID NO: 42039 - DNA, 23 bp, Artificial sequence
  SiRNA target sequence
tgcttgtgtatatcgtgagtaaa

SEQ ID NO: 42040 - DNA, 23 bp, Artificial sequence
  SiRNA target sequence
gcttgtgtatatcgtgagtaaaa

SEQ ID NO: 42041 - DNA, 23 bp, Artificial sequence
  SiRNA target sequence
cttgtgtatatcgtgagtaaaag

SEQ ID NO: 42042 - DNA, 23 bp, Artificial sequence
  SiRNA target sequence
ttgtgtatatcgtgagtaaaaga

SEQ ID NO: 42043 - DNA, 23 bp, Artificial sequence
  SiRNA target sequence
tgtgtatatcgtgagtaaaagaa

SEQ ID NO: 42044 - DNA, 23 bp, Artificial sequence
  SiRNA target sequence
gtgtatatcgtgagtaaaagaac

SEQ ID NO: 42045 - DNA, 23 bp, Artificial sequence
  SiRNA target sequence
tgtatatcgtgagtaaaagaacc

SEQ ID NO: 42046 - DNA, 23 bp, Artificial sequence
  SiRNA target sequence
gtatatcgtgagtaaaagaaccc

SEQ ID NO: 42047 - DNA, 23 bp, Artificial sequence
  SiRNA target sequence
tatatcgtgagtaaaagaaccct

SEQ ID NO: 42048 - DNA, 23 bp, Artificial sequence
  SiRNA target sequence
atatcgtgagtaaaagaacccta

SEQ ID NO: 42049 - DNA, 23 bp, Artificial sequence
  SiRNA target sequence
tatcgtgagtaaaagaaccctaa

SEQ ID NO: 42050 - DNA, 23 bp, Artificial sequence
  SiRNA target sequence
atcgtgagtaaaagaaccctaat

SEQ ID NO: 42051 - DNA, 23 bp, Artificial sequence
  SiRNA target sequence
tcgtgagtaaaagaaccctaatt

SEQ ID NO: 42052 - DNA, 23 bp, Artificial sequence
  SiRNA target sequence
cgtgagtaaaagaaccctaattg

SEQ ID NO: 42053 - DNA, 23 bp, Artificial sequence
  SiRNA target sequence
gtgagtaaaagaaccctaattgt

SEQ ID NO: 42054 - DNA, 23 bp, Artificial sequence
  SiRNA target sequence
tgagtaaaagaaccctaattgtc

SEQ ID NO: 42055 - DNA, 23 bp, Artificial sequence
  SiRNA target sequence
gagtaaaagaaccctaattgtcc

SEQ ID NO: 42056 - DNA, 23 bp, Artificial sequence
  SiRNA target sequence
agtaaaagaaccctaattgtcca

SEQ ID NO: 42057 - DNA, 23 bp, Artificial sequence
  SiRNA target sequence
gtaaaagaaccctaattgtccaa

SEQ ID NO: 42058 - DNA, 23 bp, Artificial sequence
  SiRNA target sequence
taaaagaaccctaattgtccaaa

SEQ ID NO: 42059 - DNA, 23 bp, Artificial sequence
  SiRNA target sequence
aaaagaaccctaattgtccaaaa

SEQ ID NO: 42060 - DNA, 23 bp, Artificial sequence
  SiRNA target sequence
aaagaaccctaattgtccaaaac

SEQ ID NO: 42061 - DNA, 23 bp, Artificial sequence
  SiRNA target sequence
aagaaccctaattgtccaaaact

SEQ ID NO: 42062 - DNA, 23 bp, Artificial sequence
  SiRNA target sequence
agaaccctaattgtccaaaactt

SEQ ID NO: 42063 - DNA, 23 bp, Artificial sequence
  SiRNA target sequence
gaaccctaattgtccaaaacttg

SEQ ID NO: 42064 - DNA, 23 bp, Artificial sequence
  SiRNA target sequence
aaccctaattgtccaaaacttga

SEQ ID NO: 42065 - DNA, 23 bp, Artificial sequence
  SiRNA target sequence
accctaattgtccaaaacttgaa

SEQ ID NO: 42066 - DNA, 23 bp, Artificial sequence
  SiRNA target sequence
ccctaattgtccaaaacttgaat

SEQ ID NO: 42067 - DNA, 23 bp, Artificial sequence
  SiRNA target sequence
cctaattgtccaaaacttgaata

SEQ ID NO: 42068 - DNA, 23 bp, Artificial sequence
  SiRNA target sequence
ctaattgtccaaaacttgaatac

SEQ ID NO: 42069 - DNA, 23 bp, Artificial sequence
  SiRNA target sequence
taattgtccaaaacttgaataca

SEQ ID NO: 42070 - DNA, 23 bp, Artificial sequence
  SiRNA target sequence
aattgtccaaaacttgaatacaa

SEQ ID NO: 42071 - DNA, 23 bp, Artificial sequence
  SiRNA target sequence
attgtccaaaacttgaatacaat

SEQ ID NO: 42072 - DNA, 23 bp, Artificial sequence
  SiRNA target sequence
ttgtccaaaacttgaatacaatg

SEQ ID NO: 42073 - DNA, 23 bp, Artificial sequence
  SiRNA target sequence
tgtccaaaacttgaatacaatgt

SEQ ID NO: 42074 - DNA, 23 bp, Artificial sequence
  SiRNA target sequence
gtccaaaacttgaatacaatgtt

SEQ ID NO: 42075 - DNA, 23 bp, Artificial sequence
  SiRNA target sequence
tccaaaacttgaatacaatgttc

SEQ ID NO: 42076 - DNA, 23 bp, Artificial sequence
  SiRNA target sequence
ccaaaacttgaatacaatgttct

SEQ ID NO: 42077 - DNA, 23 bp, Artificial sequence
  SiRNA target sequence
caaaacttgaatacaatgttcta

SEQ ID NO: 42078 - DNA, 23 bp, Artificial sequence
  SiRNA target sequence
aaaacttgaatacaatgttctat

SEQ ID NO: 42079 - DNA, 23 bp, Artificial sequence
  SiRNA target sequence
aaacttgaatacaatgttctatt

SEQ ID NO: 42080 - DNA, 23 bp, Artificial sequence
  SiRNA target sequence
aacttgaatacaatgttctatta

SEQ ID NO: 42081 - DNA, 23 bp, Artificial sequence
  SiRNA target sequence
acttgaatacaatgttctattaa

SEQ ID NO: 42082 - DNA, 23 bp, Artificial sequence
  SiRNA target sequence
cttgaatacaatgttctattaat

SEQ ID NO: 42083 - DNA, 23 bp, Artificial sequence
  SiRNA target sequence
ttgaatacaatgttctattaatg

SEQ ID NO: 42084 - DNA, 23 bp, Artificial sequence
  SiRNA target sequence
tgaatacaatgttctattaatgc

SEQ ID NO: 42085 - DNA, 23 bp, Artificial sequence
  SiRNA target sequence
gaatacaatgttctattaatgcc

SEQ ID NO: 42086 - DNA, 23 bp, Artificial sequence
  SiRNA target sequence
aatacaatgttctattaatgcca

SEQ ID NO: 42087 - DNA, 23 bp, Artificial sequence
  SiRNA target sequence
atacaatgttctattaatgccaa

SEQ ID NO: 42088 - DNA, 23 bp, Artificial sequence
  SiRNA target sequence
tacaatgttctattaatgccaat

SEQ ID NO: 42089 - DNA, 23 bp, Artificial sequence
  SiRNA target sequence
acaatgttctattaatgccaata

SEQ ID NO: 42090 - DNA, 23 bp, Artificial sequence
  SiRNA target sequence
caatgttctattaatgccaatat

SEQ ID NO: 42091 - DNA, 23 bp, Artificial sequence
  SiRNA target sequence
aatgttctattaatgccaatata

SEQ ID NO: 42092 - DNA, 23 bp, Artificial sequence
  SiRNA target sequence
atgttctattaatgccaatataa

SEQ ID NO: 42093 - DNA, 23 bp, Artificial sequence
  SiRNA target sequence
tgttctattaatgccaatataaa

SEQ ID NO: 42094 - DNA, 23 bp, Artificial sequence
  SiRNA target sequence
gttctattaatgccaatataaaa

SEQ ID NO: 42095 - DNA, 23 bp, Artificial sequence
  SiRNA target sequence
ttctattaatgccaatataaaat

SEQ ID NO: 42096 - DNA, 23 bp, Artificial sequence
  SiRNA target sequence
tctattaatgccaatataaaata

SEQ ID NO: 42097 - DNA, 23 bp, Artificial sequence
  SiRNA target sequence
ctattaatgccaatataaaatac

SEQ ID NO: 42098 - DNA, 23 bp, Artificial sequence
  SiRNA target sequence
tattaatgccaatataaaataca

SEQ ID NO: 42099 - DNA, 23 bp, Artificial sequence
  SiRNA target sequence
attaatgccaatataaaatacaa

SEQ ID NO: 42100 - DNA, 23 bp, Artificial sequence
  SiRNA target sequence
ttaatgccaatataaaatacaac

SEQ ID NO: 42101 - DNA, 23 bp, Artificial sequence
  SiRNA target sequence
taatgccaatataaaatacaaca

SEQ ID NO: 42102 - DNA, 23 bp, Artificial sequence
  SiRNA target sequence
aatgccaatataaaatacaacat

SEQ ID NO: 42103 - DNA, 23 bp, Artificial sequence
  SiRNA target sequence
atgccaatataaaatacaacatc

SEQ ID NO: 42104 - DNA, 23 bp, Artificial sequence
  SiRNA target sequence
tgccaatataaaatacaacatcc

SEQ ID NO: 42105 - DNA, 23 bp, Artificial sequence
  SiRNA target sequence
gccaatataaaatacaacatccc

SEQ ID NO: 42106 - DNA, 23 bp, Artificial sequence
  SiRNA target sequence
ccaatataaaatacaacatccct

SEQ ID NO: 42107 - DNA, 23 bp, Artificial sequence
  SiRNA target sequence
caatataaaatacaacatccctg

SEQ ID NO: 42108 - DNA, 23 bp, Artificial sequence
  SiRNA target sequence
aatataaaatacaacatccctgg

SEQ ID NO: 42109 - DNA, 23 bp, Artificial sequence
  SiRNA target sequence
atataaaatacaacatccctggc

SEQ ID NO: 42110 - DNA, 23 bp, Artificial sequence
  SiRNA target sequence
tataaaatacaacatccctggca

SEQ ID NO: 42111 - DNA, 23 bp, Artificial sequence
  SiRNA target sequence
ataaaatacaacatccctggcac

SEQ ID NO: 42112 - DNA, 23 bp, Artificial sequence
  SiRNA target sequence
taaaatacaacatccctggcact

SEQ ID NO: 42113 - DNA, 23 bp, Artificial sequence
  SiRNA target sequence
aaaatacaacatccctggcactt

SEQ ID NO: 42114 - DNA, 23 bp, Artificial sequence
  SiRNA target sequence
aaatacaacatccctggcactta

SEQ ID NO: 42115 - DNA, 23 bp, Artificial sequence
  SiRNA target sequence
aatacaacatccctggcacttag

SEQ ID NO: 42116 - DNA, 23 bp, Artificial sequence
  SiRNA target sequence
atacaacatccctggcacttagt

SEQ ID NO: 42117 - DNA, 23 bp, Artificial sequence
  SiRNA target sequence
tacaacatccctggcacttagtt

SEQ ID NO: 42118 - DNA, 23 bp, Artificial sequence
  SiRNA target sequence
acaacatccctggcacttagttt

SEQ ID NO: 42119 - DNA, 23 bp, Artificial sequence
  SiRNA target sequence
caacatccctggcacttagtttt

SEQ ID NO: 42120 - DNA, 23 bp, Artificial sequence
  SiRNA target sequence
aacatccctggcacttagttttg

SEQ ID NO: 42121 - DNA, 23 bp, Artificial sequence
  SiRNA target sequence
acatccctggcacttagttttgc

SEQ ID NO: 42122 - DNA, 23 bp, Artificial sequence
  SiRNA target sequence
catccctggcacttagttttgct

SEQ ID NO: 42123 - DNA, 23 bp, Artificial sequence
  SiRNA target sequence
atccctggcacttagttttgctg

SEQ ID NO: 42124 - DNA, 23 bp, Artificial sequence
  SiRNA target sequence
tccctggcacttagttttgctgt

SEQ ID NO: 42125 - DNA, 23 bp, Artificial sequence
  SiRNA target sequence
ccctggcacttagttttgctgtt

SEQ ID NO: 42126 - DNA, 23 bp, Artificial sequence
  SiRNA target sequence
cctggcacttagttttgctgtta

SEQ ID NO: 42127 - DNA, 23 bp, Artificial sequence
  SiRNA target sequence
ctggcacttagttttgctgttaa

SEQ ID NO: 42128 - DNA, 23 bp, Artificial sequence
  SiRNA target sequence
tggcacttagttttgctgttaat

SEQ ID NO: 42129 - DNA, 23 bp, Artificial sequence
  SiRNA target sequence
ggcacttagttttgctgttaata

SEQ ID NO: 42130 - DNA, 23 bp, Artificial sequence
  SiRNA target sequence
gcacttagttttgctgttaatat

SEQ ID NO: 42131 - DNA, 23 bp, Artificial sequence
  SiRNA target sequence
cacttagttttgctgttaatatt

SEQ ID NO: 42132 - DNA, 23 bp, Artificial sequence
  SiRNA target sequence
acttagttttgctgttaatattc

SEQ ID NO: 42133 - DNA, 23 bp, Artificial sequence
  SiRNA target sequence
cttagttttgctgttaatattcc

SEQ ID NO: 42134 - DNA, 23 bp, Artificial sequence
  SiRNA target sequence
ttagttttgctgttaatattcca

SEQ ID NO: 42135 - DNA, 23 bp, Artificial sequence
  SiRNA target sequence
tagttttgctgttaatattccat

SEQ ID NO: 42136 - DNA, 23 bp, Artificial sequence
  SiRNA target sequence
agttttgctgttaatattccata

SEQ ID NO: 42137 - DNA, 23 bp, Artificial sequence
  SiRNA target sequence
gttttgctgttaatattccatag

SEQ ID NO: 42138 - DNA, 23 bp, Artificial sequence
  SiRNA target sequence
ttttgctgttaatattccatagt

SEQ ID NO: 42139 - DNA, 23 bp, Artificial sequence
  SiRNA target sequence
tttgctgttaatattccatagtt

SEQ ID NO: 42140 - DNA, 23 bp, Artificial sequence
  SiRNA target sequence
ttgctgttaatattccatagttt

SEQ ID NO: 42141 - DNA, 23 bp, Artificial sequence
  SiRNA target sequence
tgctgttaatattccatagtttc

SEQ ID NO: 42142 - DNA, 23 bp, Artificial sequence
  SiRNA target sequence
gctgttaatattccatagtttcc

SEQ ID NO: 42143 - DNA, 23 bp, Artificial sequence
  SiRNA target sequence
ctgttaatattccatagtttcct

SEQ ID NO: 42144 - DNA, 23 bp, Artificial sequence
  SiRNA target sequence
tgttaatattccatagtttccta

SEQ ID NO: 42145 - DNA, 23 bp, Artificial sequence
  SiRNA target sequence
gttaatattccatagtttcctaa

SEQ ID NO: 42146 - DNA, 23 bp, Artificial sequence
  SiRNA target sequence
ttaatattccatagtttcctaat

SEQ ID NO: 42147 - DNA, 23 bp, Artificial sequence
  SiRNA target sequence
taatattccatagtttcctaatg

SEQ ID NO: 42148 - DNA, 23 bp, Artificial sequence
  SiRNA target sequence
aatattccatagtttcctaatgt

SEQ ID NO: 42149 - DNA, 23 bp, Artificial sequence
  SiRNA target sequence
atattccatagtttcctaatgtt

SEQ ID NO: 42150 - DNA, 23 bp, Artificial sequence
  SiRNA target sequence
tattccatagtttcctaatgtta

SEQ ID NO: 42151 - DNA, 23 bp, Artificial sequence
  SiRNA target sequence
attccatagtttcctaatgttat

SEQ ID NO: 42152 - DNA, 23 bp, Artificial sequence
  SiRNA target sequence
ttccatagtttcctaatgttata

SEQ ID NO: 42153 - DNA, 23 bp, Artificial sequence
  SiRNA target sequence
tccatagtttcctaatgttataa

SEQ ID NO: 42154 - DNA, 23 bp, Artificial sequence
  SiRNA target sequence
ccatagtttcctaatgttataac

SEQ ID NO: 42155 - DNA, 23 bp, Artificial sequence
  SiRNA target sequence
catagtttcctaatgttataact

SEQ ID NO: 42156 - DNA, 23 bp, Artificial sequence
  SiRNA target sequence
atagtttcctaatgttataacta

SEQ ID NO: 42157 - DNA, 23 bp, Artificial sequence
  SiRNA target sequence
tagtttcctaatgttataactat

SEQ ID NO: 42158 - DNA, 23 bp, Artificial sequence
  SiRNA target sequence
agtttcctaatgttataactata

SEQ ID NO: 42159 - DNA, 23 bp, Artificial sequence
  SiRNA target sequence
gtttcctaatgttataactataa

SEQ ID NO: 42160 - DNA, 23 bp, Artificial sequence
  SiRNA target sequence
tttcctaatgttataactataaa

SEQ ID NO: 42161 - DNA, 23 bp, Artificial sequence
  SiRNA target sequence
ttcctaatgttataactataaaa

SEQ ID NO: 42162 - DNA, 23 bp, Artificial sequence
  SiRNA target sequence
tcctaatgttataactataaaac

SEQ ID NO: 42163 - DNA, 23 bp, Artificial sequence
  SiRNA target sequence
cctaatgttataactataaaaca

SEQ ID NO: 42164 - DNA, 23 bp, Artificial sequence
  SiRNA target sequence
ctaatgttataactataaaacac

SEQ ID NO: 42165 - DNA, 23 bp, Artificial sequence
  SiRNA target sequence
taatgttataactataaaacact

SEQ ID NO: 42166 - DNA, 23 bp, Artificial sequence
  SiRNA target sequence
aatgttataactataaaacactg

SEQ ID NO: 42167 - DNA, 23 bp, Artificial sequence
  SiRNA target sequence
atgttataactataaaacactgt

SEQ ID NO: 42168 - DNA, 23 bp, Artificial sequence
  SiRNA target sequence
tgttataactataaaacactgta

SEQ ID NO: 42169 - DNA, 23 bp, Artificial sequence
  SiRNA target sequence
gttataactataaaacactgtaa

SEQ ID NO: 42170 - DNA, 23 bp, Artificial sequence
  SiRNA target sequence
ttataactataaaacactgtaaa

SEQ ID NO: 42171 - DNA, 23 bp, Artificial sequence
  SiRNA target sequence
tataactataaaacactgtaaag

SEQ ID NO: 42172 - DNA, 23 bp, Artificial sequence
  SiRNA target sequence
ataactataaaacactgtaaagc

SEQ ID NO: 42173 - DNA, 23 bp, Artificial sequence
  SiRNA target sequence
taactataaaacactgtaaagca

SEQ ID NO: 42174 - DNA, 23 bp, Artificial sequence
  SiRNA target sequence
aactataaaacactgtaaagcaa

SEQ ID NO: 42175 - DNA, 23 bp, Artificial sequence
  SiRNA target sequence
actataaaacactgtaaagcaaa

SEQ ID NO: 42176 - DNA, 23 bp, Artificial sequence
  SiRNA target sequence
ctataaaacactgtaaagcaaaa

SEQ ID NO: 42177 - DNA, 23 bp, Artificial sequence
  SiRNA target sequence
tataaaacactgtaaagcaaaaa

SEQ ID NO: 42178 - DNA, 23 bp, Artificial sequence
  SiRNA target sequence
ataaaacactgtaaagcaaaaat

SEQ ID NO: 42179 - DNA, 23 bp, Artificial sequence
  SiRNA target sequence
taaaacactgtaaagcaaaaatt

SEQ ID NO: 42180 - DNA, 23 bp, Artificial sequence
  SiRNA target sequence
aaaacactgtaaagcaaaaatta

SEQ ID NO: 42181 - DNA, 23 bp, Artificial sequence
  SiRNA target sequence
aaacactgtaaagcaaaaattat

SEQ ID NO: 42182 - DNA, 23 bp, Artificial sequence
  SiRNA target sequence
aacactgtaaagcaaaaattatc

SEQ ID NO: 42183 - DNA, 23 bp, Artificial sequence
  SiRNA target sequence
acactgtaaagcaaaaattatct

SEQ ID NO: 42184 - DNA, 23 bp, Artificial sequence
  SiRNA target sequence
cactgtaaagcaaaaattatctt

SEQ ID NO: 42185 - DNA, 23 bp, Artificial sequence
  SiRNA target sequence
actgtaaagcaaaaattatctta

SEQ ID NO: 42186 - DNA, 23 bp, Artificial sequence
  SiRNA target sequence
ctgtaaagcaaaaattatcttat

SEQ ID NO: 42187 - DNA, 23 bp, Artificial sequence
  SiRNA target sequence
tgtaaagcaaaaattatcttatt

SEQ ID NO: 42188 - DNA, 23 bp, Artificial sequence
  SiRNA target sequence
gtaaagcaaaaattatcttattt

SEQ ID NO: 42189 - DNA, 23 bp, Artificial sequence
  SiRNA target sequence
taaagcaaaaattatcttattta

SEQ ID NO: 42190 - DNA, 23 bp, Artificial sequence
  SiRNA target sequence
aaagcaaaaattatcttatttac

SEQ ID NO: 42191 - DNA, 23 bp, Artificial sequence
  SiRNA target sequence
aagcaaaaattatcttatttaca

SEQ ID NO: 42192 - DNA, 23 bp, Artificial sequence
  SiRNA target sequence
agcaaaaattatcttatttacaa

SEQ ID NO: 42193 - DNA, 23 bp, Artificial sequence
  SiRNA target sequence
gcaaaaattatcttatttacaag

SEQ ID NO: 42194 - DNA, 23 bp, Artificial sequence
  SiRNA target sequence
caaaaattatcttatttacaagg

SEQ ID NO: 42195 - DNA, 23 bp, Artificial sequence
  SiRNA target sequence
aaaaattatcttatttacaaggt

SEQ ID NO: 42196 - DNA, 23 bp, Artificial sequence
  SiRNA target sequence
aaaattatcttatttacaaggta

SEQ ID NO: 42197 - DNA, 23 bp, Artificial sequence
  SiRNA target sequence
aaattatcttatttacaaggtat

SEQ ID NO: 42198 - DNA, 23 bp, Artificial sequence
  SiRNA target sequence
aattatcttatttacaaggtata

SEQ ID NO: 42199 - DNA, 23 bp, Artificial sequence
  SiRNA target sequence
attatcttatttacaaggtataa

SEQ ID NO: 42200 - DNA, 23 bp, Artificial sequence
  SiRNA target sequence
ttatcttatttacaaggtataaa

SEQ ID NO: 42201 - DNA, 23 bp, Artificial sequence
  SiRNA target sequence
tatcttatttacaaggtataaaa

SEQ ID NO: 42202 - DNA, 23 bp, Artificial sequence
  SiRNA target sequence
atcttatttacaaggtataaaaa

SEQ ID NO: 42203 - DNA, 23 bp, Artificial sequence
  SiRNA target sequence
tcttatttacaaggtataaaaaa

SEQ ID NO: 42204 - DNA, 23 bp, Artificial sequence
  SiRNA target sequence
cttatttacaaggtataaaaaac

SEQ ID NO: 42205 - DNA, 23 bp, Artificial sequence
  SiRNA target sequence
ttatttacaaggtataaaaaact

SEQ ID NO: 42206 - DNA, 23 bp, Artificial sequence
  SiRNA target sequence
tatttacaaggtataaaaaacta

SEQ ID NO: 42207 - DNA, 23 bp, Artificial sequence
  SiRNA target sequence
atttacaaggtataaaaaactaa

SEQ ID NO: 42208 - DNA, 23 bp, Artificial sequence
  SiRNA target sequence
tttacaaggtataaaaaactaag

SEQ ID NO: 42209 - DNA, 23 bp, Artificial sequence
  SiRNA target sequence
ttacaaggtataaaaaactaaga

SEQ ID NO: 42210 - DNA, 23 bp, Artificial sequence
  SiRNA target sequence
tacaaggtataaaaaactaagag

SEQ ID NO: 42211 - DNA, 23 bp, Artificial sequence
  SiRNA target sequence
acaaggtataaaaaactaagaga

SEQ ID NO: 42212 - DNA, 23 bp, Artificial sequence
  SiRNA target sequence
caaggtataaaaaactaagagat

SEQ ID NO: 42213 - DNA, 23 bp, Artificial sequence
  SiRNA target sequence
aaggtataaaaaactaagagatc

SEQ ID NO: 42214 - DNA, 23 bp, Artificial sequence
  SiRNA target sequence
aggtataaaaaactaagagatct

SEQ ID NO: 42215 - DNA, 23 bp, Artificial sequence
  SiRNA target sequence
ggtataaaaaactaagagatctc

SEQ ID NO: 42216 - DNA, 23 bp, Artificial sequence
  SiRNA target sequence
gtataaaaaactaagagatctcc

SEQ ID NO: 42217 - DNA, 23 bp, Artificial sequence
  SiRNA target sequence
tataaaaaactaagagatctcca

SEQ ID NO: 42218 - DNA, 23 bp, Artificial sequence
  SiRNA target sequence
ataaaaaactaagagatctccag

SEQ ID NO: 42219 - DNA, 23 bp, Artificial sequence
  SiRNA target sequence
taaaaaactaagagatctccaga

SEQ ID NO: 42220 - DNA, 23 bp, Artificial sequence
  SiRNA target sequence
aaaaaactaagagatctccagat

SEQ ID NO: 42221 - DNA, 23 bp, Artificial sequence
  SiRNA target sequence
aaaaactaagagatctccagatt

SEQ ID NO: 42222 - DNA, 23 bp, Artificial sequence
  SiRNA target sequence
aaaactaagagatctccagattc

SEQ ID NO: 42223 - DNA, 23 bp, Artificial sequence
  SiRNA target sequence
aaactaagagatctccagattct

SEQ ID NO: 42224 - DNA, 23 bp, Artificial sequence
  SiRNA target sequence
aactaagagatctccagattctg

SEQ ID NO: 42225 - DNA, 23 bp, Artificial sequence
  SiRNA target sequence
actaagagatctccagattctgt

SEQ ID NO: 42226 - DNA, 23 bp, Artificial sequence
  SiRNA target sequence
ctaagagatctccagattctgtt

SEQ ID NO: 42227 - DNA, 23 bp, Artificial sequence
  SiRNA target sequence
taagagatctccagattctgtta

SEQ ID NO: 42228 - DNA, 23 bp, Artificial sequence
  SiRNA target sequence
aagagatctccagattctgttac

SEQ ID NO: 42229 - DNA, 23 bp, Artificial sequence
  SiRNA target sequence
agagatctccagattctgttaca

SEQ ID NO: 42230 - DNA, 23 bp, Artificial sequence
  SiRNA target sequence
gagatctccagattctgttacat

SEQ ID NO: 42231 - DNA, 23 bp, Artificial sequence
  SiRNA target sequence
agatctccagattctgttacatt

SEQ ID NO: 42232 - DNA, 23 bp, Artificial sequence
  SiRNA target sequence
gatctccagattctgttacattc

SEQ ID NO: 42233 - DNA, 23 bp, Artificial sequence
  SiRNA target sequence
atctccagattctgttacattcc

SEQ ID NO: 42234 - DNA, 23 bp, Artificial sequence
  SiRNA target sequence
tctccagattctgttacattccg

SEQ ID NO: 42235 - DNA, 23 bp, Artificial sequence
  SiRNA target sequence
ctccagattctgttacattccga

SEQ ID NO: 42236 - DNA, 23 bp, Artificial sequence
  SiRNA target sequence
tccagattctgttacattccgat

SEQ ID NO: 42237 - DNA, 23 bp, Artificial sequence
  SiRNA target sequence
ccagattctgttacattccgatt

SEQ ID NO: 42238 - DNA, 23 bp, Artificial sequence
  SiRNA target sequence
cagattctgttacattccgattc

SEQ ID NO: 42239 - DNA, 23 bp, Artificial sequence
  SiRNA target sequence
agattctgttacattccgattct

SEQ ID NO: 42240 - DNA, 23 bp, Artificial sequence
  SiRNA target sequence
gattctgttacattccgattcta

SEQ ID NO: 42241 - DNA, 23 bp, Artificial sequence
  SiRNA target sequence
attctgttacattccgattctac

SEQ ID NO: 42242 - DNA, 23 bp, Artificial sequence
  SiRNA target sequence
ttctgttacattccgattctact

SEQ ID NO: 42243 - DNA, 23 bp, Artificial sequence
  SiRNA target sequence
tctgttacattccgattctactt

SEQ ID NO: 42244 - DNA, 23 bp, Artificial sequence
  SiRNA target sequence
ctgttacattccgattctacttc

SEQ ID NO: 42245 - DNA, 23 bp, Artificial sequence
  SiRNA target sequence
tgttacattccgattctacttca

SEQ ID NO: 42246 - DNA, 23 bp, Artificial sequence
  SiRNA target sequence
gttacattccgattctacttcag

SEQ ID NO: 42247 - DNA, 23 bp, Artificial sequence
  SiRNA target sequence
ttacattccgattctacttcaga

SEQ ID NO: 42248 - DNA, 23 bp, Artificial sequence
  SiRNA target sequence
tacattccgattctacttcagaa

SEQ ID NO: 42249 - DNA, 23 bp, Artificial sequence
  SiRNA target sequence
acattccgattctacttcagaaa

SEQ ID NO: 42250 - DNA, 23 bp, Artificial sequence
  SiRNA target sequence
cattccgattctacttcagaaac

SEQ ID NO: 42251 - DNA, 23 bp, Artificial sequence
  SiRNA target sequence
attccgattctacttcagaaaca

SEQ ID NO: 42252 - DNA, 23 bp, Artificial sequence
  SiRNA target sequence
ttccgattctacttcagaaacat

SEQ ID NO: 42253 - DNA, 23 bp, Artificial sequence
  SiRNA target sequence
tccgattctacttcagaaacata

SEQ ID NO: 42254 - DNA, 23 bp, Artificial sequence
  SiRNA target sequence
ccgattctacttcagaaacatat

SEQ ID NO: 42255 - DNA, 23 bp, Artificial sequence
  SiRNA target sequence
cgattctacttcagaaacatatt

SEQ ID NO: 42256 - DNA, 23 bp, Artificial sequence
  SiRNA target sequence
gattctacttcagaaacatattt

SEQ ID NO: 42257 - DNA, 23 bp, Artificial sequence
  SiRNA target sequence
attctacttcagaaacatatttt

SEQ ID NO: 42258 - DNA, 23 bp, Artificial sequence
  SiRNA target sequence
ttctacttcagaaacatattttt

SEQ ID NO: 42259 - DNA, 23 bp, Artificial sequence
  SiRNA target sequence
tctacttcagaaacatatttttc

SEQ ID NO: 42260 - DNA, 23 bp, Artificial sequence
  SiRNA target sequence
ctacttcagaaacatatttttca

SEQ ID NO: 42261 - DNA, 23 bp, Artificial sequence
  SiRNA target sequence
tacttcagaaacatatttttcat

SEQ ID NO: 42262 - DNA, 23 bp, Artificial sequence
  SiRNA target sequence
acttcagaaacatatttttcata

SEQ ID NO: 42263 - DNA, 23 bp, Artificial sequence
  SiRNA target sequence
cttcagaaacatatttttcatat

SEQ ID NO: 42264 - DNA, 23 bp, Artificial sequence
  SiRNA target sequence
ttcagaaacatatttttcatatt

SEQ ID NO: 42265 - DNA, 23 bp, Artificial sequence
  SiRNA target sequence
tcagaaacatatttttcatattt

SEQ ID NO: 42266 - DNA, 23 bp, Artificial sequence
  SiRNA target sequence
cagaaacatatttttcatattta

SEQ ID NO: 42267 - DNA, 23 bp, Artificial sequence
  SiRNA target sequence
agaaacatatttttcatatttaa

SEQ ID NO: 42268 - DNA, 23 bp, Artificial sequence
  SiRNA target sequence
gaaacatatttttcatatttaag

SEQ ID NO: 42269 - DNA, 23 bp, Artificial sequence
  SiRNA target sequence
aaacatatttttcatatttaagc

SEQ ID NO: 42270 - DNA, 23 bp, Artificial sequence
  SiRNA target sequence
aacatatttttcatatttaagcg

SEQ ID NO: 42271 - DNA, 23 bp, Artificial sequence
  SiRNA target sequence
acatatttttcatatttaagcga

SEQ ID NO: 42272 - DNA, 23 bp, Artificial sequence
  SiRNA target sequence
catatttttcatatttaagcgat

SEQ ID NO: 42273 - DNA, 23 bp, Artificial sequence
  SiRNA target sequence
atatttttcatatttaagcgatt

SEQ ID NO: 42274 - DNA, 23 bp, Artificial sequence
  SiRNA target sequence
tatttttcatatttaagcgattc

SEQ ID NO: 42275 - DNA, 23 bp, Artificial sequence
  SiRNA target sequence
atttttcatatttaagcgattct

SEQ ID NO: 42276 - DNA, 23 bp, Artificial sequence
  SiRNA target sequence
tttttcatatttaagcgattctt

SEQ ID NO: 42277 - DNA, 23 bp, Artificial sequence
  SiRNA target sequence
ttttcatatttaagcgattcttc

SEQ ID NO: 42278 - DNA, 23 bp, Artificial sequence
  SiRNA target sequence
tttcatatttaagcgattcttct

SEQ ID NO: 42279 - DNA, 23 bp, Artificial sequence
  SiRNA target sequence
ttcatatttaagcgattcttctt

SEQ ID NO: 42280 - DNA, 23 bp, Artificial sequence
  SiRNA target sequence
tcatatttaagcgattcttcttc

SEQ ID NO: 42281 - DNA, 23 bp, Artificial sequence
  SiRNA target sequence
catatttaagcgattcttcttct

SEQ ID NO: 42282 - DNA, 23 bp, Artificial sequence
  SiRNA target sequence
atatttaagcgattcttcttctt

SEQ ID NO: 42283 - DNA, 23 bp, Artificial sequence
  SiRNA target sequence
tatttaagcgattcttcttcttc

SEQ ID NO: 42284 - DNA, 23 bp, Artificial sequence
  SiRNA target sequence
atttaagcgattcttcttcttct

SEQ ID NO: 42285 - DNA, 23 bp, Artificial sequence
  SiRNA target sequence
tttaagcgattcttcttcttctg

SEQ ID NO: 42286 - DNA, 23 bp, Artificial sequence
  SiRNA target sequence
ttaagcgattcttcttcttctgt

SEQ ID NO: 42287 - DNA, 23 bp, Artificial sequence
  SiRNA target sequence
taagcgattcttcttcttctgtt

SEQ ID NO: 42288 - DNA, 23 bp, Artificial sequence
  SiRNA target sequence
aagcgattcttcttcttctgttt

SEQ ID NO: 42289 - DNA, 23 bp, Artificial sequence
  SiRNA target sequence
agcgattcttcttcttctgtttt

SEQ ID NO: 42290 - DNA, 23 bp, Artificial sequence
  SiRNA target sequence
gcgattcttcttcttctgtttta

SEQ ID NO: 42291 - DNA, 23 bp, Artificial sequence
  SiRNA target sequence
cgattcttcttcttctgttttat

SEQ ID NO: 42292 - DNA, 23 bp, Artificial sequence
  SiRNA target sequence
gattcttcttcttctgttttata

SEQ ID NO: 42293 - DNA, 23 bp, Artificial sequence
  SiRNA target sequence
attcttcttcttctgttttatat

SEQ ID NO: 42294 - DNA, 23 bp, Artificial sequence
  SiRNA target sequence
ttcttcttcttctgttttatatg

SEQ ID NO: 42295 - DNA, 23 bp, Artificial sequence
  SiRNA target sequence
tcttcttcttctgttttatatgc

SEQ ID NO: 42296 - DNA, 23 bp, Artificial sequence
  SiRNA target sequence
cttcttcttctgttttatatgct

SEQ ID NO: 42297 - DNA, 23 bp, Artificial sequence
  SiRNA target sequence
ttcttcttctgttttatatgcta

SEQ ID NO: 42298 - DNA, 23 bp, Artificial sequence
  SiRNA target sequence
tcttcttctgttttatatgctag

SEQ ID NO: 42299 - DNA, 23 bp, Artificial sequence
  SiRNA target sequence
cttcttctgttttatatgctagt

SEQ ID NO: 42300 - DNA, 23 bp, Artificial sequence
  SiRNA target sequence
ttcttctgttttatatgctagta

SEQ ID NO: 42301 - DNA, 23 bp, Artificial sequence
  SiRNA target sequence
tcttctgttttatatgctagtat

SEQ ID NO: 42302 - DNA, 23 bp, Artificial sequence
  SiRNA target sequence
cttctgttttatatgctagtata

SEQ ID NO: 42303 - DNA, 23 bp, Artificial sequence
  SiRNA target sequence
ttctgttttatatgctagtatag

SEQ ID NO: 42304 - DNA, 23 bp, Artificial sequence
  SiRNA target sequence
tctgttttatatgctagtatagt

SEQ ID NO: 42305 - DNA, 23 bp, Artificial sequence
  SiRNA target sequence
ctgttttatatgctagtatagtc

SEQ ID NO: 42306 - DNA, 23 bp, Artificial sequence
  SiRNA target sequence
tgttttatatgctagtatagtct

SEQ ID NO: 42307 - DNA, 23 bp, Artificial sequence
  SiRNA target sequence
gttttatatgctagtatagtctc

SEQ ID NO: 42308 - DNA, 23 bp, Artificial sequence
  SiRNA target sequence
ttttatatgctagtatagtctca

SEQ ID NO: 42309 - DNA, 23 bp, Artificial sequence
  SiRNA target sequence
tttatatgctagtatagtctcat

SEQ ID NO: 42310 - DNA, 23 bp, Artificial sequence
  SiRNA target sequence
ttatatgctagtatagtctcatg

SEQ ID NO: 42311 - DNA, 23 bp, Artificial sequence
  SiRNA target sequence
tatatgctagtatagtctcatga

SEQ ID NO: 42312 - DNA, 23 bp, Artificial sequence
  SiRNA target sequence
atatgctagtatagtctcatgat

SEQ ID NO: 42313 - DNA, 23 bp, Artificial sequence
  SiRNA target sequence
tatgctagtatagtctcatgatt

SEQ ID NO: 42314 - DNA, 23 bp, Artificial sequence
  SiRNA target sequence
atgctagtatagtctcatgatta

SEQ ID NO: 42315 - DNA, 23 bp, Artificial sequence
  SiRNA target sequence
tgctagtatagtctcatgattaa

SEQ ID NO: 42316 - DNA, 23 bp, Artificial sequence
  SiRNA target sequence
gctagtatagtctcatgattaat

SEQ ID NO: 42317 - DNA, 23 bp, Artificial sequence
  SiRNA target sequence
ctagtatagtctcatgattaatt

SEQ ID NO: 42318 - DNA, 23 bp, Artificial sequence
  SiRNA target sequence
tagtatagtctcatgattaatta

SEQ ID NO: 42319 - DNA, 23 bp, Artificial sequence
  SiRNA target sequence
agtatagtctcatgattaattaa

SEQ ID NO: 42320 - DNA, 23 bp, Artificial sequence
  SiRNA target sequence
gtatagtctcatgattaattaaa

SEQ ID NO: 42321 - DNA, 23 bp, Artificial sequence
  SiRNA target sequence
tatagtctcatgattaattaaag

SEQ ID NO: 42322 - DNA, 23 bp, Artificial sequence
  SiRNA target sequence
atagtctcatgattaattaaaga

SEQ ID NO: 42323 - DNA, 23 bp, Artificial sequence
  SiRNA target sequence
tagtctcatgattaattaaagaa

SEQ ID NO: 42324 - DNA, 23 bp, Artificial sequence
  SiRNA target sequence
agtctcatgattaattaaagaat

SEQ ID NO: 42325 - DNA, 23 bp, Artificial sequence
  SiRNA target sequence
gtctcatgattaattaaagaatc

SEQ ID NO: 42326 - DNA, 23 bp, Artificial sequence
  SiRNA target sequence
tctcatgattaattaaagaatca

SEQ ID NO: 42327 - DNA, 23 bp, Artificial sequence
  SiRNA target sequence
ctcatgattaattaaagaatcat

SEQ ID NO: 42328 - DNA, 23 bp, Artificial sequence
  SiRNA target sequence
tcatgattaattaaagaatcatg

SEQ ID NO: 42329 - DNA, 23 bp, Artificial sequence
  SiRNA target sequence
catgattaattaaagaatcatgt

SEQ ID NO: 42330 - DNA, 23 bp, Artificial sequence
  SiRNA target sequence
atgattaattaaagaatcatgta

SEQ ID NO: 42331 - DNA, 23 bp, Artificial sequence
  SiRNA target sequence
tgattaattaaagaatcatgtaa

SEQ ID NO: 42332 - DNA, 23 bp, Artificial sequence
  SiRNA target sequence
gattaattaaagaatcatgtaag

SEQ ID NO: 42333 - DNA, 23 bp, Artificial sequence
  SiRNA target sequence
attaattaaagaatcatgtaagt

SEQ ID NO: 42334 - DNA, 23 bp, Artificial sequence
  SiRNA target sequence
ttaattaaagaatcatgtaagtg

SEQ ID NO: 42335 - DNA, 23 bp, Artificial sequence
  SiRNA target sequence
taattaaagaatcatgtaagtga

SEQ ID NO: 42336 - DNA, 23 bp, Artificial sequence
  SiRNA target sequence
aattaaagaatcatgtaagtgat

SEQ ID NO: 42337 - DNA, 23 bp, Artificial sequence
  SiRNA target sequence
attaaagaatcatgtaagtgatt

SEQ ID NO: 42338 - DNA, 23 bp, Artificial sequence
  SiRNA target sequence
ttaaagaatcatgtaagtgattt

SEQ ID NO: 42339 - DNA, 23 bp, Artificial sequence
  SiRNA target sequence
taaagaatcatgtaagtgatttg

SEQ ID NO: 42340 - DNA, 23 bp, Artificial sequence
  SiRNA target sequence
aaagaatcatgtaagtgatttga

SEQ ID NO: 42341 - DNA, 23 bp, Artificial sequence
  SiRNA target sequence
aagaatcatgtaagtgatttgag

SEQ ID NO: 42342 - DNA, 23 bp, Artificial sequence
  SiRNA target sequence
agaatcatgtaagtgatttgagc

SEQ ID NO: 42343 - DNA, 23 bp, Artificial sequence
  SiRNA target sequence
gaatcatgtaagtgatttgagca

SEQ ID NO: 42344 - DNA, 23 bp, Artificial sequence
  SiRNA target sequence
aatcatgtaagtgatttgagcat

SEQ ID NO: 42345 - DNA, 23 bp, Artificial sequence
  SiRNA target sequence
atcatgtaagtgatttgagcatc

SEQ ID NO: 42346 - DNA, 23 bp, Artificial sequence
  SiRNA target sequence
tcatgtaagtgatttgagcatct

SEQ ID NO: 42347 - DNA, 23 bp, Artificial sequence
  SiRNA target sequence
catgtaagtgatttgagcatctt

SEQ ID NO: 42348 - DNA, 23 bp, Artificial sequence
  SiRNA target sequence
atgtaagtgatttgagcatcttt

SEQ ID NO: 42349 - DNA, 23 bp, Artificial sequence
  SiRNA target sequence
tgtaagtgatttgagcatctttg

SEQ ID NO: 42350 - DNA, 23 bp, Artificial sequence
  SiRNA target sequence
gtaagtgatttgagcatctttgt

SEQ ID NO: 42351 - DNA, 23 bp, Artificial sequence
  SiRNA target sequence
taagtgatttgagcatctttgtt

SEQ ID NO: 42352 - DNA, 23 bp, Artificial sequence
  SiRNA target sequence
aagtgatttgagcatctttgttg

SEQ ID NO: 42353 - DNA, 23 bp, Artificial sequence
  SiRNA target sequence
agtgatttgagcatctttgttgt

SEQ ID NO: 42354 - DNA, 23 bp, Artificial sequence
  SiRNA target sequence
gtgatttgagcatctttgttgtg

SEQ ID NO: 42355 - DNA, 23 bp, Artificial sequence
  SiRNA target sequence
tgatttgagcatctttgttgtgc

SEQ ID NO: 42356 - DNA, 23 bp, Artificial sequence
  SiRNA target sequence
gatttgagcatctttgttgtgcg

SEQ ID NO: 42357 - DNA, 23 bp, Artificial sequence
  SiRNA target sequence
atttgagcatctttgttgtgcgc

SEQ ID NO: 42358 - DNA, 23 bp, Artificial sequence
  SiRNA target sequence
tttgagcatctttgttgtgcgca

SEQ ID NO: 42359 - DNA, 23 bp, Artificial sequence
  SiRNA target sequence
ttgagcatctttgttgtgcgcaa

SEQ ID NO: 42360 - DNA, 23 bp, Artificial sequence
  SiRNA target sequence
tgagcatctttgttgtgcgcaat

SEQ ID NO: 42361 - DNA, 23 bp, Artificial sequence
  SiRNA target sequence
gagcatctttgttgtgcgcaatt

SEQ ID NO: 42362 - DNA, 23 bp, Artificial sequence
  SiRNA target sequence
agcatctttgttgtgcgcaatta

SEQ ID NO: 42363 - DNA, 23 bp, Artificial sequence
  SiRNA target sequence
gcatctttgttgtgcgcaattat

SEQ ID NO: 42364 - DNA, 23 bp, Artificial sequence
  SiRNA target sequence
catctttgttgtgcgcaattata

SEQ ID NO: 42365 - DNA, 23 bp, Artificial sequence
  SiRNA target sequence
atctttgttgtgcgcaattatat

SEQ ID NO: 42366 - DNA, 23 bp, Artificial sequence
  SiRNA target sequence
tctttgttgtgcgcaattatatt

SEQ ID NO: 42367 - DNA, 23 bp, Artificial sequence
  SiRNA target sequence
ctttgttgtgcgcaattatattc

SEQ ID NO: 42368 - DNA, 23 bp, Artificial sequence
  SiRNA target sequence
tttgttgtgcgcaattatattct

SEQ ID NO: 42369 - DNA, 23 bp, Artificial sequence
  SiRNA target sequence
ttgttgtgcgcaattatattctt

SEQ ID NO: 42370 - DNA, 23 bp, Artificial sequence
  SiRNA target sequence
tgttgtgcgcaattatattcttt

SEQ ID NO: 42371 - DNA, 23 bp, Artificial sequence
  SiRNA target sequence
gttgtgcgcaattatattctttt

SEQ ID NO: 42372 - DNA, 23 bp, Artificial sequence
  SiRNA target sequence
ttgtgcgcaattatattcttttc

SEQ ID NO: 42373 - DNA, 23 bp, Artificial sequence
  SiRNA target sequence
tgtgcgcaattatattcttttct

SEQ ID NO: 42374 - DNA, 23 bp, Artificial sequence
  SiRNA target sequence
gtgcgcaattatattcttttctt

SEQ ID NO: 42375 - DNA, 23 bp, Artificial sequence
  SiRNA target sequence
tgcgcaattatattcttttctta

SEQ ID NO: 42376 - DNA, 23 bp, Artificial sequence
  SiRNA target sequence
gcgcaattatattcttttcttat

SEQ ID NO: 42377 - DNA, 23 bp, Artificial sequence
  SiRNA target sequence
cgcaattatattcttttcttatt

SEQ ID NO: 42378 - DNA, 23 bp, Artificial sequence
  SiRNA target sequence
gcaattatattcttttcttattc

SEQ ID NO: 42379 - DNA, 23 bp, Artificial sequence
  SiRNA target sequence
caattatattcttttcttattcc

SEQ ID NO: 42380 - DNA, 23 bp, Artificial sequence
  SiRNA target sequence
aattatattcttttcttattcct

SEQ ID NO: 42381 - DNA, 23 bp, Artificial sequence
  SiRNA target sequence
attatattcttttcttattcctg

SEQ ID NO: 42382 - DNA, 23 bp, Artificial sequence
  SiRNA target sequence
ttatattcttttcttattcctgt

SEQ ID NO: 42383 - DNA, 23 bp, Artificial sequence
  SiRNA target sequence
tatattcttttcttattcctgta

SEQ ID NO: 42384 - DNA, 23 bp, Artificial sequence
  SiRNA target sequence
atattcttttcttattcctgtac

SEQ ID NO: 42385 - DNA, 23 bp, Artificial sequence
  SiRNA target sequence
tattcttttcttattcctgtacg

SEQ ID NO: 42386 - DNA, 23 bp, Artificial sequence
  SiRNA target sequence
attcttttcttattcctgtacgc

SEQ ID NO: 42387 - DNA, 23 bp, Artificial sequence
  SiRNA target sequence
ttcttttcttattcctgtacgcc

SEQ ID NO: 42388 - DNA, 23 bp, Artificial sequence
  SiRNA target sequence
tcttttcttattcctgtacgcca

SEQ ID NO: 42389 - DNA, 23 bp, Artificial sequence
  SiRNA target sequence
cttttcttattcctgtacgccaa

SEQ ID NO: 42390 - DNA, 23 bp, Artificial sequence
  SiRNA target sequence
ttttcttattcctgtacgccaat

SEQ ID NO: 42391 - DNA, 23 bp, Artificial sequence
  SiRNA target sequence
tttcttattcctgtacgccaatg

SEQ ID NO: 42392 - DNA, 23 bp, Artificial sequence
  SiRNA target sequence
ttcttattcctgtacgccaatga

SEQ ID NO: 42393 - DNA, 23 bp, Artificial sequence
  SiRNA target sequence
tcttattcctgtacgccaatgaa

SEQ ID NO: 42394 - DNA, 23 bp, Artificial sequence
  SiRNA target sequence
cttattcctgtacgccaatgaac

SEQ ID NO: 42395 - DNA, 23 bp, Artificial sequence
  SiRNA target sequence
ttattcctgtacgccaatgaact

SEQ ID NO: 42396 - DNA, 23 bp, Artificial sequence
  SiRNA target sequence
tattcctgtacgccaatgaacta

SEQ ID NO: 42397 - DNA, 23 bp, Artificial sequence
  SiRNA target sequence
attcctgtacgccaatgaactat

SEQ ID NO: 42398 - DNA, 23 bp, Artificial sequence
  SiRNA target sequence
ttcctgtacgccaatgaactatt

SEQ ID NO: 42399 - DNA, 23 bp, Artificial sequence
  SiRNA target sequence
tcctgtacgccaatgaactattt

SEQ ID NO: 42400 - DNA, 23 bp, Artificial sequence
  SiRNA target sequence
cctgtacgccaatgaactatttt

SEQ ID NO: 42401 - DNA, 23 bp, Artificial sequence
  SiRNA target sequence
ctgtacgccaatgaactattttc

SEQ ID NO: 42402 - DNA, 23 bp, Artificial sequence
  SiRNA target sequence
tgtacgccaatgaactattttcg

SEQ ID NO: 42403 - DNA, 23 bp, Artificial sequence
  SiRNA target sequence
gtacgccaatgaactattttcgc

SEQ ID NO: 42404 - DNA, 23 bp, Artificial sequence
  SiRNA target sequence
tacgccaatgaactattttcgca

SEQ ID NO: 42405 - DNA, 23 bp, Artificial sequence
  SiRNA target sequence
acgccaatgaactattttcgcag

SEQ ID NO: 42406 - DNA, 23 bp, Artificial sequence
  SiRNA target sequence
cgccaatgaactattttcgcagt

SEQ ID NO: 42407 - DNA, 23 bp, Artificial sequence
  SiRNA target sequence
gccaatgaactattttcgcagtt

SEQ ID NO: 42408 - DNA, 23 bp, Artificial sequence
  SiRNA target sequence
ccaatgaactattttcgcagttg

SEQ ID NO: 42409 - DNA, 23 bp, Artificial sequence
  SiRNA target sequence
caatgaactattttcgcagttgc

SEQ ID NO: 42410 - DNA, 23 bp, Artificial sequence
  SiRNA target sequence
aatgaactattttcgcagttgca

SEQ ID NO: 42411 - DNA, 23 bp, Artificial sequence
  SiRNA target sequence
atgaactattttcgcagttgcaa

SEQ ID NO: 42412 - DNA, 23 bp, Artificial sequence
  SiRNA target sequence
tgaactattttcgcagttgcaag

SEQ ID NO: 42413 - DNA, 23 bp, Artificial sequence
  SiRNA target sequence
gaactattttcgcagttgcaagg

SEQ ID NO: 42414 - DNA, 23 bp, Artificial sequence
  SiRNA target sequence
aactattttcgcagttgcaagga

SEQ ID NO: 42415 - DNA, 23 bp, Artificial sequence
  SiRNA target sequence
actattttcgcagttgcaaggat

SEQ ID NO: 42416 - DNA, 23 bp, Artificial sequence
  SiRNA target sequence
ctattttcgcagttgcaaggatg

SEQ ID NO: 42417 - DNA, 23 bp, Artificial sequence
  SiRNA target sequence
tattttcgcagttgcaaggatgt

SEQ ID NO: 42418 - DNA, 23 bp, Artificial sequence
  SiRNA target sequence
attttcgcagttgcaaggatgta

SEQ ID NO: 42419 - DNA, 23 bp, Artificial sequence
  SiRNA target sequence
ttttcgcagttgcaaggatgtaa

SEQ ID NO: 42420 - DNA, 23 bp, Artificial sequence
  SiRNA target sequence
tttcgcagttgcaaggatgtaaa

SEQ ID NO: 42421 - DNA, 23 bp, Artificial sequence
  SiRNA target sequence
ttcgcagttgcaaggatgtaaac

SEQ ID NO: 42422 - DNA, 23 bp, Artificial sequence
  SiRNA target sequence
tcgcagttgcaaggatgtaaact

SEQ ID NO: 42423 - DNA, 23 bp, Artificial sequence
  SiRNA target sequence
cgcagttgcaaggatgtaaacta

SEQ ID NO: 42424 - DNA, 23 bp, Artificial sequence
  SiRNA target sequence
gcagttgcaaggatgtaaactaa

SEQ ID NO: 42425 - DNA, 23 bp, Artificial sequence
  SiRNA target sequence
cagttgcaaggatgtaaactaat

SEQ ID NO: 42426 - DNA, 23 bp, Artificial sequence
  SiRNA target sequence
agttgcaaggatgtaaactaata

SEQ ID NO: 42427 - DNA, 23 bp, Artificial sequence
  SiRNA target sequence
gttgcaaggatgtaaactaataa

SEQ ID NO: 42428 - DNA, 23 bp, Artificial sequence
  SiRNA target sequence
ttgcaaggatgtaaactaataat

SEQ ID NO: 42429 - DNA, 23 bp, Artificial sequence
  SiRNA target sequence
tgcaaggatgtaaactaataatg

SEQ ID NO: 42430 - DNA, 23 bp, Artificial sequence
  SiRNA target sequence
gcaaggatgtaaactaataatgt

SEQ ID NO: 42431 - DNA, 23 bp, Artificial sequence
  SiRNA target sequence
caaggatgtaaactaataatgtg

SEQ ID NO: 42432 - DNA, 23 bp, Artificial sequence
  SiRNA target sequence
aaggatgtaaactaataatgtga

SEQ ID NO: 42433 - DNA, 23 bp, Artificial sequence
  SiRNA target sequence
aggatgtaaactaataatgtgat

SEQ ID NO: 42434 - DNA, 23 bp, Artificial sequence
  SiRNA target sequence
ggatgtaaactaataatgtgatt

SEQ ID NO: 42435 - DNA, 23 bp, Artificial sequence
  SiRNA target sequence
gatgtaaactaataatgtgatta

SEQ ID NO: 42436 - DNA, 23 bp, Artificial sequence
  SiRNA target sequence
atgtaaactaataatgtgattaa

SEQ ID NO: 42437 - DNA, 23 bp, Artificial sequence
  SiRNA target sequence
tgtaaactaataatgtgattaaa

SEQ ID NO: 42438 - DNA, 23 bp, Artificial sequence
  SiRNA target sequence
gtaaactaataatgtgattaaaa

SEQ ID NO: 42439 - DNA, 23 bp, Artificial sequence
  SiRNA target sequence
taaactaataatgtgattaaaat

SEQ ID NO: 42440 - DNA, 23 bp, Artificial sequence
  SiRNA target sequence
aaactaataatgtgattaaaata

SEQ ID NO: 42441 - DNA, 23 bp, Artificial sequence
  SiRNA target sequence
aactaataatgtgattaaaataa

SEQ ID NO: 42442 - DNA, 23 bp, Artificial sequence
  SiRNA target sequence
actaataatgtgattaaaataat

SEQ ID NO: 42443 - DNA, 23 bp, Artificial sequence
  SiRNA target sequence
ctaataatgtgattaaaataata

SEQ ID NO: 42444 - DNA, 23 bp, Artificial sequence
  SiRNA target sequence
taataatgtgattaaaataataa

SEQ ID NO: 42445 - DNA, 23 bp, Artificial sequence
  SiRNA target sequence
aataatgtgattaaaataataaa

SEQ ID NO: 42446 - DNA, 23 bp, Artificial sequence
  SiRNA target sequence
ataatgtgattaaaataataaac

SEQ ID NO: 42447 - DNA, 23 bp, Artificial sequence
  SiRNA target sequence
taatgtgattaaaataataaaca

SEQ ID NO: 42448 - DNA, 23 bp, Artificial sequence
  SiRNA target sequence
aatgtgattaaaataataaacat

SEQ ID NO: 42449 - DNA, 23 bp, Artificial sequence
  SiRNA target sequence
atgtgattaaaataataaacata

SEQ ID NO: 42450 - DNA, 23 bp, Artificial sequence
  SiRNA target sequence
tgtgattaaaataataaacatat

SEQ ID NO: 42451 - DNA, 23 bp, Artificial sequence
  SiRNA target sequence
gtgattaaaataataaacatatt

SEQ ID NO: 42452 - DNA, 23 bp, Artificial sequence
  SiRNA target sequence
tgattaaaataataaacatattt

SEQ ID NO: 42453 - DNA, 23 bp, Artificial sequence
  SiRNA target sequence
gattaaaataataaacatatttg

SEQ ID NO: 42454 - DNA, 23 bp, Artificial sequence
  SiRNA target sequence
attaaaataataaacatatttgt

SEQ ID NO: 42455 - DNA, 23 bp, Artificial sequence
  SiRNA target sequence
ttaaaataataaacatatttgtc

SEQ ID NO: 42456 - DNA, 23 bp, Artificial sequence
  SiRNA target sequence
taaaataataaacatatttgtca

SEQ ID NO: 42457 - DNA, 23 bp, Artificial sequence
  SiRNA target sequence
aaaataataaacatatttgtcaa

SEQ ID NO: 42458 - DNA, 23 bp, Artificial sequence
  SiRNA target sequence
aaataataaacatatttgtcaac

SEQ ID NO: 42459 - DNA, 23 bp, Artificial sequence
  SiRNA target sequence
aataataaacatatttgtcaacc

SEQ ID NO: 42460 - DNA, 23 bp, Artificial sequence
  SiRNA target sequence
ataataaacatatttgtcaaccc

SEQ ID NO: 42461 - DNA, 23 bp, Artificial sequence
  SiRNA target sequence
taataaacatatttgtcaaccct

SEQ ID NO: 42462 - DNA, 23 bp, Artificial sequence
  SiRNA target sequence
aataaacatatttgtcaacccta

SEQ ID NO: 42463 - DNA, 23 bp, Artificial sequence
  SiRNA target sequence
ataaacatatttgtcaaccctaa

SEQ ID NO: 42464 - DNA, 23 bp, Artificial sequence
  SiRNA target sequence
taaacatatttgtcaaccctaaa

SEQ ID NO: 42465 - DNA, 23 bp, Artificial sequence
  SiRNA target sequence
aaacatatttgtcaaccctaaat

SEQ ID NO: 42466 - DNA, 23 bp, Artificial sequence
  SiRNA target sequence
aacatatttgtcaaccctaaatt

SEQ ID NO: 42467 - DNA, 23 bp, Artificial sequence
  SiRNA target sequence
acatatttgtcaaccctaaattt

SEQ ID NO: 42468 - DNA, 23 bp, Artificial sequence
  SiRNA target sequence
catatttgtcaaccctaaatttg

SEQ ID NO: 42469 - DNA, 23 bp, Artificial sequence
  SiRNA target sequence
atatttgtcaaccctaaatttgt

SEQ ID NO: 42470 - DNA, 23 bp, Artificial sequence
  SiRNA target sequence
tatttgtcaaccctaaatttgta

SEQ ID NO: 42471 - DNA, 23 bp, Artificial sequence
  SiRNA target sequence
atttgtcaaccctaaatttgtat

SEQ ID NO: 42472 - DNA, 23 bp, Artificial sequence
  SiRNA target sequence
tttgtcaaccctaaatttgtata

SEQ ID NO: 42473 - DNA, 23 bp, Artificial sequence
  SiRNA target sequence
ttgtcaaccctaaatttgtataa

SEQ ID NO: 42474 - DNA, 23 bp, Artificial sequence
  SiRNA target sequence
tgtcaaccctaaatttgtataaa

SEQ ID NO: 42475 - DNA, 23 bp, Artificial sequence
  SiRNA target sequence
gtcaaccctaaatttgtataaat

SEQ ID NO: 42476 - DNA, 23 bp, Artificial sequence
  SiRNA target sequence
tcaaccctaaatttgtataaatt

SEQ ID NO: 42477 - DNA, 23 bp, Artificial sequence
  SiRNA target sequence
caaccctaaatttgtataaattg

SEQ ID NO: 42478 - DNA, 23 bp, Artificial sequence
  SiRNA target sequence
aaccctaaatttgtataaattga

SEQ ID NO: 42479 - DNA, 23 bp, Artificial sequence
  SiRNA target sequence
accctaaatttgtataaattgac

SEQ ID NO: 42480 - DNA, 23 bp, Artificial sequence
  SiRNA target sequence
ccctaaatttgtataaattgacg

SEQ ID NO: 42481 - DNA, 23 bp, Artificial sequence
  SiRNA target sequence
cctaaatttgtataaattgacga

SEQ ID NO: 42482 - DNA, 23 bp, Artificial sequence
  SiRNA target sequence
ctaaatttgtataaattgacgaa

SEQ ID NO: 42483 - DNA, 23 bp, Artificial sequence
  SiRNA target sequence
taaatttgtataaattgacgaac

SEQ ID NO: 42484 - DNA, 23 bp, Artificial sequence
  SiRNA target sequence
aaatttgtataaattgacgaaca

SEQ ID NO: 42485 - DNA, 23 bp, Artificial sequence
  SiRNA target sequence
aatttgtataaattgacgaacac

SEQ ID NO: 42486 - DNA, 23 bp, Artificial sequence
  SiRNA target sequence
atttgtataaattgacgaacacg

SEQ ID NO: 42487 - DNA, 23 bp, Artificial sequence
  SiRNA target sequence
tttgtataaattgacgaacacgc

SEQ ID NO: 42488 - DNA, 23 bp, Artificial sequence
  SiRNA target sequence
ttgtataaattgacgaacacgcc

SEQ ID NO: 42489 - DNA, 23 bp, Artificial sequence
  SiRNA target sequence
tgtataaattgacgaacacgcca

SEQ ID NO: 42490 - DNA, 23 bp, Artificial sequence
  SiRNA target sequence
gtataaattgacgaacacgccaa

SEQ ID NO: 42491 - DNA, 23 bp, Artificial sequence
  SiRNA target sequence
tataaattgacgaacacgccaat

SEQ ID NO: 42492 - DNA, 23 bp, Artificial sequence
  SiRNA target sequence
ataaattgacgaacacgccaata

SEQ ID NO: 42493 - DNA, 23 bp, Artificial sequence
  SiRNA target sequence
taaattgacgaacacgccaatat

SEQ ID NO: 42494 - DNA, 23 bp, Artificial sequence
  SiRNA target sequence
aaattgacgaacacgccaatata

SEQ ID NO: 42495 - DNA, 23 bp, Artificial sequence
  SiRNA target sequence
aattgacgaacacgccaatataa

SEQ ID NO: 42496 - DNA, 23 bp, Artificial sequence
  SiRNA target sequence
attgacgaacacgccaatataac

SEQ ID NO: 42497 - DNA, 23 bp, Artificial sequence
  SiRNA target sequence
ttgacgaacacgccaatataact

SEQ ID NO: 42498 - DNA, 23 bp, Artificial sequence
  SiRNA target sequence
tgacgaacacgccaatataactg

SEQ ID NO: 42499 - DNA, 23 bp, Artificial sequence
  SiRNA target sequence
gacgaacacgccaatataactgt

SEQ ID NO: 42500 - DNA, 23 bp, Artificial sequence
  SiRNA target sequence
acgaacacgccaatataactgta

SEQ ID NO: 42501 - DNA, 23 bp, Artificial sequence
  SiRNA target sequence
cgaacacgccaatataactgtaa

SEQ ID NO: 42502 - DNA, 23 bp, Artificial sequence
  SiRNA target sequence
gaacacgccaatataactgtaaa

SEQ ID NO: 42503 - DNA, 23 bp, Artificial sequence
  SiRNA target sequence
aacacgccaatataactgtaaaa

SEQ ID NO: 42504 - DNA, 23 bp, Artificial sequence
  SiRNA target sequence
acacgccaatataactgtaaaaa

SEQ ID NO: 42505 - DNA, 23 bp, Artificial sequence
  SiRNA target sequence
cacgccaatataactgtaaaaaa

SEQ ID NO: 42506 - DNA, 23 bp, Artificial sequence
  SiRNA target sequence
acgccaatataactgtaaaaaaa

SEQ ID NO: 42507 - DNA, 23 bp, Artificial sequence
  SiRNA target sequence
cgccaatataactgtaaaaaaaa

SEQ ID NO: 42508 - DNA, 23 bp, Artificial sequence
  SiRNA target sequence
gccaatataactgtaaaaaaaat

SEQ ID NO: 42509 - DNA, 23 bp, Artificial sequence
  SiRNA target sequence
ccaatataactgtaaaaaaaata

SEQ ID NO: 42510 - DNA, 23 bp, Artificial sequence
  SiRNA target sequence
caatataactgtaaaaaaaatat

SEQ ID NO: 42511 - DNA, 23 bp, Artificial sequence
  SiRNA target sequence
aatataactgtaaaaaaaatatt

SEQ ID NO: 42512 - DNA, 23 bp, Artificial sequence
  SiRNA target sequence
atataactgtaaaaaaaatattt

SEQ ID NO: 42513 - DNA, 23 bp, Artificial sequence
  SiRNA target sequence
tataactgtaaaaaaaatattta

SEQ ID NO: 42514 - DNA, 23 bp, Artificial sequence
  SiRNA target sequence
ataactgtaaaaaaaatatttat

SEQ ID NO: 42515 - DNA, 23 bp, Artificial sequence
  SiRNA target sequence
taactgtaaaaaaaatatttatg

SEQ ID NO: 42516 - DNA, 23 bp, Artificial sequence
  SiRNA target sequence
aactgtaaaaaaaatatttatga

SEQ ID NO: 42517 - DNA, 23 bp, Artificial sequence
  SiRNA target sequence
actgtaaaaaaaatatttatgat

SEQ ID NO: 42518 - DNA, 23 bp, Artificial sequence
  SiRNA target sequence
ctgtaaaaaaaatatttatgata

SEQ ID NO: 42519 - DNA, 23 bp, Artificial sequence
  SiRNA target sequence
tgtaaaaaaaatatttatgatat

SEQ ID NO: 42520 - DNA, 23 bp, Artificial sequence
  SiRNA target sequence
gtaaaaaaaatatttatgatatt

SEQ ID NO: 42521 - DNA, 23 bp, Artificial sequence
  SiRNA target sequence
taaaaaaaatatttatgatatta

SEQ ID NO: 42522 - DNA, 23 bp, Artificial sequence
  SiRNA target sequence
aaaaaaaatatttatgatattaa

SEQ ID NO: 42523 - DNA, 23 bp, Artificial sequence
  SiRNA target sequence
aaaaaaatatttatgatattaac

SEQ ID NO: 42524 - DNA, 23 bp, Artificial sequence
  SiRNA target sequence
aaaaaatatttatgatattaaca

SEQ ID NO: 42525 - DNA, 23 bp, Artificial sequence
  SiRNA target sequence
aaaaatatttatgatattaacaa

SEQ ID NO: 42526 - DNA, 23 bp, Artificial sequence
  SiRNA target sequence
aaaatatttatgatattaacaaa

SEQ ID NO: 42527 - DNA, 23 bp, Artificial sequence
  SiRNA target sequence
aaatatttatgatattaacaaat

SEQ ID NO: 42528 - DNA, 23 bp, Artificial sequence
  SiRNA target sequence
aatatttatgatattaacaaata

SEQ ID NO: 42529 - DNA, 23 bp, Artificial sequence
  SiRNA target sequence
atatttatgatattaacaaataa

SEQ ID NO: 42530 - DNA, 23 bp, Artificial sequence
  SiRNA target sequence
tatttatgatattaacaaataaa

SEQ ID NO: 42531 - DNA, 23 bp, Artificial sequence
  SiRNA target sequence
atttatgatattaacaaataaaa

SEQ ID NO: 42532 - DNA, 23 bp, Artificial sequence
  SiRNA target sequence
tttatgatattaacaaataaaac

SEQ ID NO: 42533 - DNA, 23 bp, Artificial sequence
  SiRNA target sequence
ttatgatattaacaaataaaact

SEQ ID NO: 42534 - DNA, 23 bp, Artificial sequence
  SiRNA target sequence
tatgatattaacaaataaaactt

SEQ ID NO: 42535 - DNA, 23 bp, Artificial sequence
  SiRNA target sequence
atgatattaacaaataaaacttc

SEQ ID NO: 42536 - DNA, 23 bp, Artificial sequence
  SiRNA target sequence
tgatattaacaaataaaacttcg

SEQ ID NO: 42537 - DNA, 23 bp, Artificial sequence
  SiRNA target sequence
gatattaacaaataaaacttcga

SEQ ID NO: 42538 - DNA, 23 bp, Artificial sequence
  SiRNA target sequence
atattaacaaataaaacttcgat

SEQ ID NO: 42539 - DNA, 23 bp, Artificial sequence
  SiRNA target sequence
tattaacaaataaaacttcgatc

SEQ ID NO: 42540 - DNA, 23 bp, Artificial sequence
  SiRNA target sequence
attaacaaataaaacttcgatca

SEQ ID NO: 42541 - DNA, 23 bp, Artificial sequence
  SiRNA target sequence
ttaacaaataaaacttcgatcaa

SEQ ID NO: 42542 - DNA, 23 bp, Artificial sequence
  SiRNA target sequence
taacaaataaaacttcgatcaat

SEQ ID NO: 42543 - DNA, 23 bp, Artificial sequence
  SiRNA target sequence
aacaaataaaacttcgatcaatt

SEQ ID NO: 42544 - DNA, 23 bp, Artificial sequence
  SiRNA target sequence
acaaataaaacttcgatcaattc

SEQ ID NO: 42545 - DNA, 23 bp, Artificial sequence
  SiRNA target sequence
caaataaaacttcgatcaattca

SEQ ID NO: 42546 - DNA, 23 bp, Artificial sequence
  SiRNA target sequence
aaataaaacttcgatcaattcac

SEQ ID NO: 42547 - DNA, 23 bp, Artificial sequence
  SiRNA target sequence
aataaaacttcgatcaattcact

SEQ ID NO: 42548 - DNA, 23 bp, Artificial sequence
  SiRNA target sequence
ataaaacttcgatcaattcactt

SEQ ID NO: 42549 - DNA, 23 bp, Artificial sequence
  SiRNA target sequence
taaaacttcgatcaattcactta

SEQ ID NO: 42550 - DNA, 23 bp, Artificial sequence
  SiRNA target sequence
aaaacttcgatcaattcacttat

SEQ ID NO: 42551 - DNA, 23 bp, Artificial sequence
  SiRNA target sequence
aaacttcgatcaattcacttatt

SEQ ID NO: 42552 - DNA, 23 bp, Artificial sequence
  SiRNA target sequence
aacttcgatcaattcacttattg

SEQ ID NO: 42553 - DNA, 23 bp, Artificial sequence
  SiRNA target sequence
acttcgatcaattcacttattgc

SEQ ID NO: 42554 - DNA, 23 bp, Artificial sequence
  SiRNA target sequence
cttcgatcaattcacttattgct

SEQ ID NO: 42555 - DNA, 23 bp, Artificial sequence
  SiRNA target sequence
ttcgatcaattcacttattgctt

SEQ ID NO: 42556 - DNA, 23 bp, Artificial sequence
  SiRNA target sequence
tcgatcaattcacttattgcttt

SEQ ID NO: 42557 - DNA, 23 bp, Artificial sequence
  SiRNA target sequence
cgatcaattcacttattgcttta

SEQ ID NO: 42558 - DNA, 23 bp, Artificial sequence
  SiRNA target sequence
gatcaattcacttattgctttac

SEQ ID NO: 42559 - DNA, 23 bp, Artificial sequence
  SiRNA target sequence
atcaattcacttattgctttact

SEQ ID NO: 42560 - DNA, 23 bp, Artificial sequence
  SiRNA target sequence
tcaattcacttattgctttactt

SEQ ID NO: 42561 - DNA, 23 bp, Artificial sequence
  SiRNA target sequence
caattcacttattgctttacttt

SEQ ID NO: 42562 - DNA, 23 bp, Artificial sequence
  SiRNA target sequence
aattcacttattgctttactttc

SEQ ID NO: 42563 - DNA, 23 bp, Artificial sequence
  SiRNA target sequence
attcacttattgctttactttct

SEQ ID NO: 42564 - DNA, 23 bp, Artificial sequence
  SiRNA target sequence
ttcacttattgctttactttctc

SEQ ID NO: 42565 - DNA, 23 bp, Artificial sequence
  SiRNA target sequence
tcacttattgctttactttctcg

SEQ ID NO: 42566 - DNA, 23 bp, Artificial sequence
  SiRNA target sequence
cacttattgctttactttctcgg

SEQ ID NO: 42567 - DNA, 23 bp, Artificial sequence
  SiRNA target sequence
acttattgctttactttctcggt

SEQ ID NO: 42568 - DNA, 23 bp, Artificial sequence
  SiRNA target sequence
cttattgctttactttctcggtc

SEQ ID NO: 42569 - DNA, 23 bp, Artificial sequence
  SiRNA target sequence
ttattgctttactttctcggtct

SEQ ID NO: 42570 - DNA, 23 bp, Artificial sequence
  SiRNA target sequence
tattgctttactttctcggtcta

SEQ ID NO: 42571 - DNA, 23 bp, Artificial sequence
  SiRNA target sequence
attgctttactttctcggtctat

SEQ ID NO: 42572 - DNA, 23 bp, Artificial sequence
  SiRNA target sequence
ttgctttactttctcggtctatt

SEQ ID NO: 42573 - DNA, 23 bp, Artificial sequence
  SiRNA target sequence
tgctttactttctcggtctatta

SEQ ID NO: 42574 - DNA, 23 bp, Artificial sequence
  SiRNA target sequence
gctttactttctcggtctattat

SEQ ID NO: 42575 - DNA, 23 bp, Artificial sequence
  SiRNA target sequence
ctttactttctcggtctattatt

SEQ ID NO: 42576 - DNA, 23 bp, Artificial sequence
  SiRNA target sequence
tttactttctcggtctattattg

SEQ ID NO: 42577 - DNA, 23 bp, Artificial sequence
  SiRNA target sequence
ttactttctcggtctattattgt

SEQ ID NO: 42578 - DNA, 23 bp, Artificial sequence
  SiRNA target sequence
tactttctcggtctattattgtt

SEQ ID NO: 42579 - DNA, 23 bp, Artificial sequence
  SiRNA target sequence
actttctcggtctattattgttt

SEQ ID NO: 42580 - DNA, 23 bp, Artificial sequence
  SiRNA target sequence
ctttctcggtctattattgtttg

SEQ ID NO: 42581 - DNA, 23 bp, Artificial sequence
  SiRNA target sequence
tttctcggtctattattgtttgt

SEQ ID NO: 42582 - DNA, 23 bp, Artificial sequence
  SiRNA target sequence
ttctcggtctattattgtttgta

SEQ ID NO: 42583 - DNA, 23 bp, Artificial sequence
  SiRNA target sequence
tctcggtctattattgtttgtat

SEQ ID NO: 42584 - DNA, 23 bp, Artificial sequence
  SiRNA target sequence
ctcggtctattattgtttgtatt

SEQ ID NO: 42585 - DNA, 23 bp, Artificial sequence
  SiRNA target sequence
tcggtctattattgtttgtattt

SEQ ID NO: 42586 - DNA, 23 bp, Artificial sequence
  SiRNA target sequence
cggtctattattgtttgtatttc

SEQ ID NO: 42587 - DNA, 23 bp, Artificial sequence
  SiRNA target sequence
ggtctattattgtttgtatttca

SEQ ID NO: 42588 - DNA, 23 bp, Artificial sequence
  SiRNA target sequence
gtctattattgtttgtatttcac

SEQ ID NO: 42589 - DNA, 23 bp, Artificial sequence
  SiRNA target sequence
tctattattgtttgtatttcacc

SEQ ID NO: 42590 - DNA, 23 bp, Artificial sequence
  SiRNA target sequence
ctattattgtttgtatttcaccg

SEQ ID NO: 42591 - DNA, 23 bp, Artificial sequence
  SiRNA target sequence
tattattgtttgtatttcaccgc

SEQ ID NO: 42592 - DNA, 23 bp, Artificial sequence
  SiRNA target sequence
attattgtttgtatttcaccgca

SEQ ID NO: 42593 - DNA, 23 bp, Artificial sequence
  SiRNA target sequence
ttattgtttgtatttcaccgcat

SEQ ID NO: 42594 - DNA, 23 bp, Artificial sequence
  SiRNA target sequence
tattgtttgtatttcaccgcatc

SEQ ID NO: 42595 - DNA, 23 bp, Artificial sequence
  SiRNA target sequence
attgtttgtatttcaccgcatcc

SEQ ID NO: 42596 - DNA, 23 bp, Artificial sequence
  SiRNA target sequence
ttgtttgtatttcaccgcatcct

SEQ ID NO: 42597 - DNA, 23 bp, Artificial sequence
  SiRNA target sequence
tgtttgtatttcaccgcatccta

SEQ ID NO: 42598 - DNA, 23 bp, Artificial sequence
  SiRNA target sequence
gtttgtatttcaccgcatcctat

SEQ ID NO: 42599 - DNA, 23 bp, Artificial sequence
  SiRNA target sequence
tttgtatttcaccgcatcctatt

SEQ ID NO: 42600 - DNA, 23 bp, Artificial sequence
  SiRNA target sequence
ttgtatttcaccgcatcctattt

SEQ ID NO: 42601 - DNA, 23 bp, Artificial sequence
  SiRNA target sequence
tgtatttcaccgcatcctatttt

SEQ ID NO: 42602 - DNA, 23 bp, Artificial sequence
  SiRNA target sequence
gtatttcaccgcatcctatttta

SEQ ID NO: 42603 - DNA, 23 bp, Artificial sequence
  SiRNA target sequence
tatttcaccgcatcctattttat

SEQ ID NO: 42604 - DNA, 23 bp, Artificial sequence
  SiRNA target sequence
atttcaccgcatcctattttatt

SEQ ID NO: 42605 - DNA, 23 bp, Artificial sequence
  SiRNA target sequence
tttcaccgcatcctattttattg

SEQ ID NO: 42606 - DNA, 23 bp, Artificial sequence
  SiRNA target sequence
ttcaccgcatcctattttattgt

SEQ ID NO: 42607 - DNA, 23 bp, Artificial sequence
  SiRNA target sequence
tcaccgcatcctattttattgta

SEQ ID NO: 42608 - DNA, 23 bp, Artificial sequence
  SiRNA target sequence
caccgcatcctattttattgtat

SEQ ID NO: 42609 - DNA, 23 bp, Artificial sequence
  SiRNA target sequence
accgcatcctattttattgtatc

SEQ ID NO: 42610 - DNA, 23 bp, Artificial sequence
  SiRNA target sequence
ccgcatcctattttattgtatct

SEQ ID NO: 42611 - DNA, 23 bp, Artificial sequence
  SiRNA target sequence
cgcatcctattttattgtatcta

SEQ ID NO: 42612 - DNA, 23 bp, Artificial sequence
  SiRNA target sequence
gcatcctattttattgtatctac

SEQ ID NO: 42613 - DNA, 23 bp, Artificial sequence
  SiRNA target sequence
catcctattttattgtatctact

SEQ ID NO: 42614 - DNA, 23 bp, Artificial sequence
  SiRNA target sequence
atcctattttattgtatctacta

SEQ ID NO: 42615 - DNA, 23 bp, Artificial sequence
  SiRNA target sequence
tcctattttattgtatctactaa

SEQ ID NO: 42616 - DNA, 23 bp, Artificial sequence
  SiRNA target sequence
cctattttattgtatctactaag

SEQ ID NO: 42617 - DNA, 23 bp, Artificial sequence
  SiRNA target sequence
ctattttattgtatctactaagt

SEQ ID NO: 42618 - DNA, 23 bp, Artificial sequence
  SiRNA target sequence
tattttattgtatctactaagtt

SEQ ID NO: 42619 - DNA, 23 bp, Artificial sequence
  SiRNA target sequence
attttattgtatctactaagttc

SEQ ID NO: 42620 - DNA, 23 bp, Artificial sequence
  SiRNA target sequence
ttttattgtatctactaagttcc

SEQ ID NO: 42621 - DNA, 23 bp, Artificial sequence
  SiRNA target sequence
tttattgtatctactaagttcca

SEQ ID NO: 42622 - DNA, 23 bp, Artificial sequence
  SiRNA target sequence
ttattgtatctactaagttccat

SEQ ID NO: 42623 - DNA, 23 bp, Artificial sequence
  SiRNA target sequence
tattgtatctactaagttccata

SEQ ID NO: 42624 - DNA, 23 bp, Artificial sequence
  SiRNA target sequence
attgtatctactaagttccatat

SEQ ID NO: 42625 - DNA, 23 bp, Artificial sequence
  SiRNA target sequence
ttgtatctactaagttccatatt

SEQ ID NO: 42626 - DNA, 23 bp, Artificial sequence
  SiRNA target sequence
tgtatctactaagttccatattt

SEQ ID NO: 42627 - DNA, 23 bp, Artificial sequence
  SiRNA target sequence
gtatctactaagttccatattta

SEQ ID NO: 42628 - DNA, 23 bp, Artificial sequence
  SiRNA target sequence
tatctactaagttccatatttat

SEQ ID NO: 42629 - DNA, 23 bp, Artificial sequence
  SiRNA target sequence
atctactaagttccatatttata

SEQ ID NO: 42630 - DNA, 23 bp, Artificial sequence
  SiRNA target sequence
tctactaagttccatatttataa

SEQ ID NO: 42631 - DNA, 23 bp, Artificial sequence
  SiRNA target sequence
ctactaagttccatatttataaa

SEQ ID NO: 42632 - DNA, 23 bp, Artificial sequence
  SiRNA target sequence
tactaagttccatatttataaaa

SEQ ID NO: 42633 - DNA, 23 bp, Artificial sequence
  SiRNA target sequence
actaagttccatatttataaaat

SEQ ID NO: 42634 - DNA, 23 bp, Artificial sequence
  SiRNA target sequence
ctaagttccatatttataaaatt

SEQ ID NO: 42635 - DNA, 23 bp, Artificial sequence
  SiRNA target sequence
taagttccatatttataaaattt

SEQ ID NO: 42636 - DNA, 23 bp, Artificial sequence
  SiRNA target sequence
aagttccatatttataaaatttt

SEQ ID NO: 42637 - DNA, 23 bp, Artificial sequence
  SiRNA target sequence
agttccatatttataaaattttt

SEQ ID NO: 42638 - DNA, 23 bp, Artificial sequence
  SiRNA target sequence
gttccatatttataaaattttta

SEQ ID NO: 42639 - DNA, 23 bp, Artificial sequence
  SiRNA target sequence
ttccatatttataaaatttttaa

SEQ ID NO: 42640 - DNA, 23 bp, Artificial sequence
  SiRNA target sequence
tccatatttataaaatttttaaa

SEQ ID NO: 42641 - DNA, 23 bp, Artificial sequence
  SiRNA target sequence
ccatatttataaaatttttaaat

SEQ ID NO: 42642 - DNA, 23 bp, Artificial sequence
  SiRNA target sequence
catatttataaaatttttaaatg

SEQ ID NO: 42643 - DNA, 23 bp, Artificial sequence
  SiRNA target sequence
atatttataaaatttttaaatga

SEQ ID NO: 42644 - DNA, 23 bp, Artificial sequence
  SiRNA target sequence
tatttataaaatttttaaatgaa

SEQ ID NO: 42645 - DNA, 23 bp, Artificial sequence
  SiRNA target sequence
atttataaaatttttaaatgaat

SEQ ID NO: 42646 - DNA, 23 bp, Artificial sequence
  SiRNA target sequence
tttataaaatttttaaatgaatt

SEQ ID NO: 42647 - DNA, 23 bp, Artificial sequence
  SiRNA target sequence
ttataaaatttttaaatgaattt

SEQ ID NO: 42648 - DNA, 23 bp, Artificial sequence
  SiRNA target sequence
tataaaatttttaaatgaatttt

SEQ ID NO: 42649 - DNA, 23 bp, Artificial sequence
  SiRNA target sequence
ataaaatttttaaatgaattttt

SEQ ID NO: 42650 - DNA, 23 bp, Artificial sequence
  SiRNA target sequence
taaaatttttaaatgaatttttt

SEQ ID NO: 42651 - DNA, 23 bp, Artificial sequence
  SiRNA target sequence
aaaatttttaaatgaattttttc

SEQ ID NO: 42652 - DNA, 23 bp, Artificial sequence
  SiRNA target sequence
aaatttttaaatgaattttttcc

SEQ ID NO: 42653 - DNA, 23 bp, Artificial sequence
  SiRNA target sequence
aatttttaaatgaattttttcct

SEQ ID NO: 42654 - DNA, 23 bp, Artificial sequence
  SiRNA target sequence
atttttaaatgaattttttcctg

SEQ ID NO: 42655 - DNA, 23 bp, Artificial sequence
  SiRNA target sequence
tttttaaatgaattttttcctgt

SEQ ID NO: 42656 - DNA, 23 bp, Artificial sequence
  SiRNA target sequence
ttttaaatgaattttttcctgtc

SEQ ID NO: 42657 - DNA, 23 bp, Artificial sequence
  SiRNA target sequence
tttaaatgaattttttcctgtca

SEQ ID NO: 42658 - DNA, 23 bp, Artificial sequence
  SiRNA target sequence
ttaaatgaattttttcctgtcag

SEQ ID NO: 42659 - DNA, 23 bp, Artificial sequence
  SiRNA target sequence
taaatgaattttttcctgtcagt

SEQ ID NO: 42660 - DNA, 23 bp, Artificial sequence
  SiRNA target sequence
aaatgaattttttcctgtcagtc

SEQ ID NO: 42661 - DNA, 23 bp, Artificial sequence
  SiRNA target sequence
aatgaattttttcctgtcagtct

SEQ ID NO: 42662 - DNA, 23 bp, Artificial sequence
  SiRNA target sequence
atgaattttttcctgtcagtctg

SEQ ID NO: 42663 - DNA, 23 bp, Artificial sequence
  SiRNA target sequence
tgaattttttcctgtcagtctga

SEQ ID NO: 42664 - DNA, 23 bp, Artificial sequence
  SiRNA target sequence
gaattttttcctgtcagtctgaa

SEQ ID NO: 42665 - DNA, 23 bp, Artificial sequence
  SiRNA target sequence
aattttttcctgtcagtctgaat

SEQ ID NO: 42666 - DNA, 23 bp, Artificial sequence
  SiRNA target sequence
attttttcctgtcagtctgaata

SEQ ID NO: 42667 - DNA, 23 bp, Artificial sequence
  SiRNA target sequence
ttttttcctgtcagtctgaatac

SEQ ID NO: 42668 - DNA, 23 bp, Artificial sequence
  SiRNA target sequence
tttttcctgtcagtctgaataca

SEQ ID NO: 42669 - DNA, 23 bp, Artificial sequence
  SiRNA target sequence
ttttcctgtcagtctgaatacat

SEQ ID NO: 42670 - DNA, 23 bp, Artificial sequence
  SiRNA target sequence
tttcctgtcagtctgaatacatg

SEQ ID NO: 42671 - DNA, 23 bp, Artificial sequence
  SiRNA target sequence
ttcctgtcagtctgaatacatgt

SEQ ID NO: 42672 - DNA, 23 bp, Artificial sequence
  SiRNA target sequence
tcctgtcagtctgaatacatgtt

SEQ ID NO: 42673 - DNA, 23 bp, Artificial sequence
  SiRNA target sequence
cctgtcagtctgaatacatgttg

SEQ ID NO: 42674 - DNA, 23 bp, Artificial sequence
  SiRNA target sequence
ctgtcagtctgaatacatgttga

SEQ ID NO: 42675 - DNA, 23 bp, Artificial sequence
  SiRNA target sequence
tgtcagtctgaatacatgttgaa

SEQ ID NO: 42676 - DNA, 23 bp, Artificial sequence
  SiRNA target sequence
gtcagtctgaatacatgttgaac

SEQ ID NO: 42677 - DNA, 23 bp, Artificial sequence
  SiRNA target sequence
tcagtctgaatacatgttgaacg

SEQ ID NO: 42678 - DNA, 23 bp, Artificial sequence
  SiRNA target sequence
cagtctgaatacatgttgaacgg

SEQ ID NO: 42679 - DNA, 23 bp, Artificial sequence
  SiRNA target sequence
agtctgaatacatgttgaacggg

SEQ ID NO: 42680 - DNA, 23 bp, Artificial sequence
  SiRNA target sequence
gtctgaatacatgttgaacgggt

SEQ ID NO: 42681 - DNA, 23 bp, Artificial sequence
  SiRNA target sequence
tctgaatacatgttgaacgggtg

SEQ ID NO: 42682 - DNA, 23 bp, Artificial sequence
  SiRNA target sequence
ctgaatacatgttgaacgggtgt

SEQ ID NO: 42683 - DNA, 23 bp, Artificial sequence
  SiRNA target sequence
tgaatacatgttgaacgggtgta

SEQ ID NO: 42684 - DNA, 23 bp, Artificial sequence
  SiRNA target sequence
gaatacatgttgaacgggtgtaa

SEQ ID NO: 42685 - DNA, 23 bp, Artificial sequence
  SiRNA target sequence
aatacatgttgaacgggtgtaac

SEQ ID NO: 42686 - DNA, 23 bp, Artificial sequence
  SiRNA target sequence
atacatgttgaacgggtgtaaca

SEQ ID NO: 42687 - DNA, 23 bp, Artificial sequence
  SiRNA target sequence
tacatgttgaacgggtgtaacaa

SEQ ID NO: 42688 - DNA, 23 bp, Artificial sequence
  SiRNA target sequence
acatgttgaacgggtgtaacaaa

SEQ ID NO: 42689 - DNA, 23 bp, Artificial sequence
  SiRNA target sequence
catgttgaacgggtgtaacaaat

SEQ ID NO: 42690 - DNA, 23 bp, Artificial sequence
  SiRNA target sequence
atgttgaacgggtgtaacaaata

SEQ ID NO: 42691 - DNA, 23 bp, Artificial sequence
  SiRNA target sequence
tgttgaacgggtgtaacaaatat

SEQ ID NO: 42692 - DNA, 23 bp, Artificial sequence
  SiRNA target sequence
gttgaacgggtgtaacaaatata

SEQ ID NO: 42693 - DNA, 23 bp, Artificial sequence
  SiRNA target sequence
ttgaacgggtgtaacaaatataa

SEQ ID NO: 42694 - DNA, 23 bp, Artificial sequence
  SiRNA target sequence
tgaacgggtgtaacaaatataaa

SEQ ID NO: 42695 - DNA, 23 bp, Artificial sequence
  SiRNA target sequence
gaacgggtgtaacaaatataaaa

SEQ ID NO: 42696 - DNA, 23 bp, Artificial sequence
  SiRNA target sequence
aacgggtgtaacaaatataaaat

SEQ ID NO: 42697 - DNA, 23 bp, Artificial sequence
  SiRNA target sequence
acgggtgtaacaaatataaaatt

SEQ ID NO: 42698 - DNA, 23 bp, Artificial sequence
  SiRNA target sequence
cgggtgtaacaaatataaaattg

SEQ ID NO: 42699 - DNA, 23 bp, Artificial sequence
  SiRNA target sequence
gggtgtaacaaatataaaattgt

SEQ ID NO: 42700 - DNA, 23 bp, Artificial sequence
  SiRNA target sequence
ggtgtaacaaatataaaattgtt

SEQ ID NO: 42701 - DNA, 23 bp, Artificial sequence
  SiRNA target sequence
gtgtaacaaatataaaattgtta

SEQ ID NO: 42702 - DNA, 23 bp, Artificial sequence
  SiRNA target sequence
tgtaacaaatataaaattgttaa

SEQ ID NO: 42703 - DNA, 23 bp, Artificial sequence
  SiRNA target sequence
gtaacaaatataaaattgttaag

SEQ ID NO: 42704 - DNA, 23 bp, Artificial sequence
  SiRNA target sequence
taacaaatataaaattgttaagt

SEQ ID NO: 42705 - DNA, 23 bp, Artificial sequence
  SiRNA target sequence
aacaaatataaaattgttaagtt

SEQ ID NO: 42706 - DNA, 23 bp, Artificial sequence
  SiRNA target sequence
acaaatataaaattgttaagttc

SEQ ID NO: 42707 - DNA, 23 bp, Artificial sequence
  SiRNA target sequence
caaatataaaattgttaagttct

SEQ ID NO: 42708 - DNA, 23 bp, Artificial sequence
  SiRNA target sequence
aaatataaaattgttaagttctg

SEQ ID NO: 42709 - DNA, 23 bp, Artificial sequence
  SiRNA target sequence
aatataaaattgttaagttctga

SEQ ID NO: 42710 - DNA, 23 bp, Artificial sequence
  SiRNA target sequence
atataaaattgttaagttctgac

SEQ ID NO: 42711 - DNA, 23 bp, Artificial sequence
  SiRNA target sequence
tataaaattgttaagttctgaca

SEQ ID NO: 42712 - DNA, 23 bp, Artificial sequence
  SiRNA target sequence
ataaaattgttaagttctgacat

SEQ ID NO: 42713 - DNA, 23 bp, Artificial sequence
  SiRNA target sequence
taaaattgttaagttctgacatt

SEQ ID NO: 42714 - DNA, 23 bp, Artificial sequence
  SiRNA target sequence
aaaattgttaagttctgacattg

SEQ ID NO: 42715 - DNA, 23 bp, Artificial sequence
  SiRNA target sequence
aaattgttaagttctgacattgt

SEQ ID NO: 42716 - DNA, 23 bp, Artificial sequence
  SiRNA target sequence
aattgttaagttctgacattgta

SEQ ID NO: 42717 - DNA, 23 bp, Artificial sequence
  SiRNA target sequence
attgttaagttctgacattgtaa

SEQ ID NO: 42718 - DNA, 23 bp, Artificial sequence
  SiRNA target sequence
ttgttaagttctgacattgtaat

SEQ ID NO: 42719 - DNA, 23 bp, Artificial sequence
  SiRNA target sequence
tgttaagttctgacattgtaatt

SEQ ID NO: 42720 - DNA, 23 bp, Artificial sequence
  SiRNA target sequence
gttaagttctgacattgtaattg

SEQ ID NO: 42721 - DNA, 23 bp, Artificial sequence
  SiRNA target sequence
ttaagttctgacattgtaattga

SEQ ID NO: 42722 - DNA, 23 bp, Artificial sequence
  SiRNA target sequence
taagttctgacattgtaattgat

SEQ ID NO: 42723 - DNA, 23 bp, Artificial sequence
  SiRNA target sequence
aagttctgacattgtaattgata

SEQ ID NO: 42724 - DNA, 23 bp, Artificial sequence
  SiRNA target sequence
agttctgacattgtaattgatac

SEQ ID NO: 42725 - DNA, 23 bp, Artificial sequence
  SiRNA target sequence
gttctgacattgtaattgataca

SEQ ID NO: 42726 - DNA, 23 bp, Artificial sequence
  SiRNA target sequence
ttctgacattgtaattgatacaa

SEQ ID NO: 42727 - DNA, 23 bp, Artificial sequence
  SiRNA target sequence
tctgacattgtaattgatacaat

SEQ ID NO: 42728 - DNA, 23 bp, Artificial sequence
  SiRNA target sequence
ctgacattgtaattgatacaatt

SEQ ID NO: 42729 - DNA, 23 bp, Artificial sequence
  SiRNA target sequence
tgacattgtaattgatacaattg

SEQ ID NO: 42730 - DNA, 23 bp, Artificial sequence
  SiRNA target sequence
gacattgtaattgatacaattgt

SEQ ID NO: 42731 - DNA, 23 bp, Artificial sequence
  SiRNA target sequence
acattgtaattgatacaattgtc

SEQ ID NO: 42732 - DNA, 23 bp, Artificial sequence
  SiRNA target sequence
cattgtaattgatacaattgtca

SEQ ID NO: 42733 - DNA, 23 bp, Artificial sequence
  SiRNA target sequence
attgtaattgatacaattgtcaa

SEQ ID NO: 42734 - DNA, 23 bp, Artificial sequence
  SiRNA target sequence
ttgtaattgatacaattgtcaaa

SEQ ID NO: 42735 - DNA, 23 bp, Artificial sequence
  SiRNA target sequence
tgtaattgatacaattgtcaaaa

SEQ ID NO: 42736 - DNA, 23 bp, Artificial sequence
  SiRNA target sequence
gtaattgatacaattgtcaaaac

SEQ ID NO: 42737 - DNA, 23 bp, Artificial sequence
  SiRNA target sequence
taattgatacaattgtcaaaact

SEQ ID NO: 42738 - DNA, 23 bp, Artificial sequence
  SiRNA target sequence
aattgatacaattgtcaaaactg

SEQ ID NO: 42739 - DNA, 23 bp, Artificial sequence
  SiRNA target sequence
attgatacaattgtcaaaactgc

SEQ ID NO: 42740 - DNA, 23 bp, Artificial sequence
  SiRNA target sequence
ttgatacaattgtcaaaactgca

SEQ ID NO: 42741 - DNA, 23 bp, Artificial sequence
  SiRNA target sequence
tgatacaattgtcaaaactgcaa

SEQ ID NO: 42742 - DNA, 23 bp, Artificial sequence
  SiRNA target sequence
gatacaattgtcaaaactgcaaa

SEQ ID NO: 42743 - DNA, 23 bp, Artificial sequence
  SiRNA target sequence
atacaattgtcaaaactgcaaaa

SEQ ID NO: 42744 - DNA, 23 bp, Artificial sequence
  SiRNA target sequence
tacaattgtcaaaactgcaaaat

SEQ ID NO: 42745 - DNA, 23 bp, Artificial sequence
  SiRNA target sequence
acaattgtcaaaactgcaaaata

SEQ ID NO: 42746 - DNA, 23 bp, Artificial sequence
  SiRNA target sequence
caattgtcaaaactgcaaaatac

SEQ ID NO: 42747 - DNA, 23 bp, Artificial sequence
  SiRNA target sequence
aattgtcaaaactgcaaaataca

SEQ ID NO: 42748 - DNA, 23 bp, Artificial sequence
  SiRNA target sequence
attgtcaaaactgcaaaatacaa

SEQ ID NO: 42749 - DNA, 23 bp, Artificial sequence
  SiRNA target sequence
ttgtcaaaactgcaaaatacaaa

SEQ ID NO: 42750 - DNA, 23 bp, Artificial sequence
  SiRNA target sequence
tgtcaaaactgcaaaatacaaaa

SEQ ID NO: 42751 - DNA, 23 bp, Artificial sequence
  SiRNA target sequence
gtcaaaactgcaaaatacaaaag

SEQ ID NO: 42752 - DNA, 23 bp, Artificial sequence
  SiRNA target sequence
tcaaaactgcaaaatacaaaaga

SEQ ID NO: 42753 - DNA, 23 bp, Artificial sequence
  SiRNA target sequence
caaaactgcaaaatacaaaagac

SEQ ID NO: 42754 - DNA, 23 bp, Artificial sequence
  SiRNA target sequence
aaaactgcaaaatacaaaagact

SEQ ID NO: 42755 - DNA, 23 bp, Artificial sequence
  SiRNA target sequence
aaactgcaaaatacaaaagactt

SEQ ID NO: 42756 - DNA, 23 bp, Artificial sequence
  SiRNA target sequence
aactgcaaaatacaaaagacttt

SEQ ID NO: 42757 - DNA, 23 bp, Artificial sequence
  SiRNA target sequence
actgcaaaatacaaaagactttg

SEQ ID NO: 42758 - DNA, 23 bp, Artificial sequence
  SiRNA target sequence
ctgcaaaatacaaaagactttga

SEQ ID NO: 42759 - DNA, 23 bp, Artificial sequence
  SiRNA target sequence
tgcaaaatacaaaagactttgac

SEQ ID NO: 42760 - DNA, 23 bp, Artificial sequence
  SiRNA target sequence
gcaaaatacaaaagactttgact

SEQ ID NO: 42761 - DNA, 23 bp, Artificial sequence
  SiRNA target sequence
caaaatacaaaagactttgacta

SEQ ID NO: 42762 - DNA, 23 bp, Artificial sequence
  SiRNA target sequence
aaaatacaaaagactttgactaa

SEQ ID NO: 42763 - DNA, 23 bp, Artificial sequence
  SiRNA target sequence
aaatacaaaagactttgactaag

SEQ ID NO: 42764 - DNA, 23 bp, Artificial sequence
  SiRNA target sequence
aatacaaaagactttgactaaga

SEQ ID NO: 42765 - DNA, 23 bp, Artificial sequence
  SiRNA target sequence
atacaaaagactttgactaagat

SEQ ID NO: 42766 - DNA, 23 bp, Artificial sequence
  SiRNA target sequence
tacaaaagactttgactaagatc

SEQ ID NO: 42767 - DNA, 23 bp, Artificial sequence
  SiRNA target sequence
acaaaagactttgactaagatct

SEQ ID NO: 42768 - DNA, 23 bp, Artificial sequence
  SiRNA target sequence
caaaagactttgactaagatctt

SEQ ID NO: 42769 - DNA, 23 bp, Artificial sequence
  SiRNA target sequence
aaaagactttgactaagatcttt

SEQ ID NO: 42770 - DNA, 23 bp, Artificial sequence
  SiRNA target sequence
aaagactttgactaagatcttta

SEQ ID NO: 42771 - DNA, 23 bp, Artificial sequence
  SiRNA target sequence
aagactttgactaagatctttat

SEQ ID NO: 42772 - DNA, 23 bp, Artificial sequence
  SiRNA target sequence
agactttgactaagatctttatt

SEQ ID NO: 42773 - DNA, 23 bp, Artificial sequence
  SiRNA target sequence
gactttgactaagatctttatta

SEQ ID NO: 42774 - DNA, 23 bp, Artificial sequence
  SiRNA target sequence
actttgactaagatctttattat

SEQ ID NO: 42775 - DNA, 23 bp, Artificial sequence
  SiRNA target sequence
ctttgactaagatctttattatc

SEQ ID NO: 42776 - DNA, 23 bp, Artificial sequence
  SiRNA target sequence
tttgactaagatctttattatct

SEQ ID NO: 42777 - DNA, 23 bp, Artificial sequence
  SiRNA target sequence
ttgactaagatctttattatctg

SEQ ID NO: 42778 - DNA, 23 bp, Artificial sequence
  SiRNA target sequence
tgactaagatctttattatctgt

SEQ ID NO: 42779 - DNA, 23 bp, Artificial sequence
  SiRNA target sequence
gactaagatctttattatctgta

SEQ ID NO: 42780 - DNA, 23 bp, Artificial sequence
  SiRNA target sequence
actaagatctttattatctgtaa

SEQ ID NO: 42781 - DNA, 23 bp, Artificial sequence
  SiRNA target sequence
ctaagatctttattatctgtaat

SEQ ID NO: 42782 - DNA, 23 bp, Artificial sequence
  SiRNA target sequence
taagatctttattatctgtaata

SEQ ID NO: 42783 - DNA, 23 bp, Artificial sequence
  SiRNA target sequence
aagatctttattatctgtaatat

SEQ ID NO: 42784 - DNA, 23 bp, Artificial sequence
  SiRNA target sequence
agatctttattatctgtaatatc

SEQ ID NO: 42785 - DNA, 23 bp, Artificial sequence
  SiRNA target sequence
gatctttattatctgtaatatca

SEQ ID NO: 42786 - DNA, 23 bp, Artificial sequence
  SiRNA target sequence
atctttattatctgtaatatcac

SEQ ID NO: 42787 - DNA, 23 bp, Artificial sequence
  SiRNA target sequence
tctttattatctgtaatatcact

SEQ ID NO: 42788 - DNA, 23 bp, Artificial sequence
  SiRNA target sequence
ctttattatctgtaatatcacta

SEQ ID NO: 42789 - DNA, 23 bp, Artificial sequence
  SiRNA target sequence
tttattatctgtaatatcactag

SEQ ID NO: 42790 - DNA, 23 bp, Artificial sequence
  SiRNA target sequence
ttattatctgtaatatcactagt

SEQ ID NO: 42791 - DNA, 23 bp, Artificial sequence
  SiRNA target sequence
tattatctgtaatatcactagtc

SEQ ID NO: 42792 - DNA, 23 bp, Artificial sequence
  SiRNA target sequence
attatctgtaatatcactagtca

SEQ ID NO: 42793 - DNA, 23 bp, Artificial sequence
  SiRNA target sequence
ttatctgtaatatcactagtcaa

SEQ ID NO: 42794 - DNA, 23 bp, Artificial sequence
  SiRNA target sequence
tatctgtaatatcactagtcaat

SEQ ID NO: 42795 - DNA, 23 bp, Artificial sequence
  SiRNA target sequence
atctgtaatatcactagtcaatt

SEQ ID NO: 42796 - DNA, 23 bp, Artificial sequence
  SiRNA target sequence
tctgtaatatcactagtcaattt

SEQ ID NO: 42797 - DNA, 23 bp, Artificial sequence
  SiRNA target sequence
ctgtaatatcactagtcaatttc

SEQ ID NO: 42798 - DNA, 23 bp, Artificial sequence
  SiRNA target sequence
tgtaatatcactagtcaatttcc

SEQ ID NO: 42799 - DNA, 23 bp, Artificial sequence
  SiRNA target sequence
gtaatatcactagtcaatttccg

SEQ ID NO: 42800 - DNA, 23 bp, Artificial sequence
  SiRNA target sequence
taatatcactagtcaatttccgg

SEQ ID NO: 42801 - DNA, 23 bp, Artificial sequence
  SiRNA target sequence
aatatcactagtcaatttccggg

SEQ ID NO: 42802 - DNA, 23 bp, Artificial sequence
  SiRNA target sequence
atatcactagtcaatttccgggt

SEQ ID NO: 42803 - DNA, 23 bp, Artificial sequence
  SiRNA target sequence
tatcactagtcaatttccgggta

SEQ ID NO: 42804 - DNA, 23 bp, Artificial sequence
  SiRNA target sequence
atcactagtcaatttccgggtag

SEQ ID NO: 42805 - DNA, 23 bp, Artificial sequence
  SiRNA target sequence
tcactagtcaatttccgggtagc

SEQ ID NO: 42806 - DNA, 23 bp, Artificial sequence
  SiRNA target sequence
cactagtcaatttccgggtagct

SEQ ID NO: 42807 - DNA, 23 bp, Artificial sequence
  SiRNA target sequence
actagtcaatttccgggtagctt

SEQ ID NO: 42808 - DNA, 23 bp, Artificial sequence
  SiRNA target sequence
ctagtcaatttccgggtagcttc

SEQ ID NO: 42809 - DNA, 23 bp, Artificial sequence
  SiRNA target sequence
tagtcaatttccgggtagcttca

SEQ ID NO: 42810 - DNA, 23 bp, Artificial sequence
  SiRNA target sequence
agtcaatttccgggtagcttcaa

SEQ ID NO: 42811 - DNA, 23 bp, Artificial sequence
  SiRNA target sequence
gtcaatttccgggtagcttcaac

SEQ ID NO: 42812 - DNA, 23 bp, Artificial sequence
  SiRNA target sequence
tcaatttccgggtagcttcaact

SEQ ID NO: 42813 - DNA, 23 bp, Artificial sequence
  SiRNA target sequence
caatttccgggtagcttcaactg

SEQ ID NO: 42814 - DNA, 23 bp, Artificial sequence
  SiRNA target sequence
aatttccgggtagcttcaactgt

SEQ ID NO: 42815 - DNA, 23 bp, Artificial sequence
  SiRNA target sequence
atttccgggtagcttcaactgtt

SEQ ID NO: 42816 - DNA, 23 bp, Artificial sequence
  SiRNA target sequence
tttccgggtagcttcaactgtta

SEQ ID NO: 42817 - DNA, 23 bp, Artificial sequence
  SiRNA target sequence
ttccgggtagcttcaactgttaa

SEQ ID NO: 42818 - DNA, 23 bp, Artificial sequence
  SiRNA target sequence
tccgggtagcttcaactgttaaa

SEQ ID NO: 42819 - DNA, 23 bp, Artificial sequence
  SiRNA target sequence
ccgggtagcttcaactgttaaaa

SEQ ID NO: 42820 - DNA, 23 bp, Artificial sequence
  SiRNA target sequence
cgggtagcttcaactgttaaaac

SEQ ID NO: 42821 - DNA, 23 bp, Artificial sequence
  SiRNA target sequence
gggtagcttcaactgttaaaaca

SEQ ID NO: 42822 - DNA, 23 bp, Artificial sequence
  SiRNA target sequence
ggtagcttcaactgttaaaacat

SEQ ID NO: 42823 - DNA, 23 bp, Artificial sequence
  SiRNA target sequence
gtagcttcaactgttaaaacatt

SEQ ID NO: 42824 - DNA, 23 bp, Artificial sequence
  SiRNA target sequence
tagcttcaactgttaaaacatta

SEQ ID NO: 42825 - DNA, 23 bp, Artificial sequence
  SiRNA target sequence
agcttcaactgttaaaacattaa

SEQ ID NO: 42826 - DNA, 23 bp, Artificial sequence
  SiRNA target sequence
gcttcaactgttaaaacattaaa

SEQ ID NO: 42827 - DNA, 23 bp, Artificial sequence
  SiRNA target sequence
cttcaactgttaaaacattaaat

SEQ ID NO: 42828 - DNA, 23 bp, Artificial sequence
  SiRNA target sequence
ttcaactgttaaaacattaaatg

SEQ ID NO: 42829 - DNA, 23 bp, Artificial sequence
  SiRNA target sequence
tcaactgttaaaacattaaatgt

SEQ ID NO: 42830 - DNA, 23 bp, Artificial sequence
  SiRNA target sequence
caactgttaaaacattaaatgta

SEQ ID NO: 42831 - DNA, 23 bp, Artificial sequence
  SiRNA target sequence
aactgttaaaacattaaatgtac

SEQ ID NO: 42832 - DNA, 23 bp, Artificial sequence
  SiRNA target sequence
actgttaaaacattaaatgtaca

SEQ ID NO: 42833 - DNA, 23 bp, Artificial sequence
  SiRNA target sequence
ctgttaaaacattaaatgtacaa

SEQ ID NO: 42834 - DNA, 23 bp, Artificial sequence
  SiRNA target sequence
tgttaaaacattaaatgtacaaa

SEQ ID NO: 42835 - DNA, 23 bp, Artificial sequence
  SiRNA target sequence
gttaaaacattaaatgtacaaac

SEQ ID NO: 42836 - DNA, 23 bp, Artificial sequence
  SiRNA target sequence
ttaaaacattaaatgtacaaact

SEQ ID NO: 42837 - DNA, 23 bp, Artificial sequence
  SiRNA target sequence
taaaacattaaatgtacaaactg

SEQ ID NO: 42838 - DNA, 23 bp, Artificial sequence
  SiRNA target sequence
aaaacattaaatgtacaaactgc

SEQ ID NO: 42839 - DNA, 23 bp, Artificial sequence
  SiRNA target sequence
aaacattaaatgtacaaactgca

SEQ ID NO: 42840 - DNA, 23 bp, Artificial sequence
  SiRNA target sequence
aacattaaatgtacaaactgcaa

SEQ ID NO: 42841 - DNA, 23 bp, Artificial sequence
  SiRNA target sequence
acattaaatgtacaaactgcaaa

SEQ ID NO: 42842 - DNA, 23 bp, Artificial sequence
  SiRNA target sequence
cattaaatgtacaaactgcaaat

SEQ ID NO: 42843 - DNA, 23 bp, Artificial sequence
  SiRNA target sequence
attaaatgtacaaactgcaaatg

SEQ ID NO: 42844 - DNA, 23 bp, Artificial sequence
  SiRNA target sequence
ttaaatgtacaaactgcaaatgt

SEQ ID NO: 42845 - DNA, 23 bp, Artificial sequence
  SiRNA target sequence
taaatgtacaaactgcaaatgtc

SEQ ID NO: 42846 - DNA, 23 bp, Artificial sequence
  SiRNA target sequence
aaatgtacaaactgcaaatgtcc

SEQ ID NO: 42847 - DNA, 23 bp, Artificial sequence
  SiRNA target sequence
aatgtacaaactgcaaatgtccc

SEQ ID NO: 42848 - DNA, 23 bp, Artificial sequence
  SiRNA target sequence
atgtacaaactgcaaatgtccca

SEQ ID NO: 42849 - DNA, 23 bp, Artificial sequence
  SiRNA target sequence
tgtacaaactgcaaatgtcccaa

SEQ ID NO: 42850 - DNA, 23 bp, Artificial sequence
  SiRNA target sequence
gtacaaactgcaaatgtcccaaa

SEQ ID NO: 42851 - DNA, 23 bp, Artificial sequence
  SiRNA target sequence
tacaaactgcaaatgtcccaaaa

SEQ ID NO: 42852 - DNA, 23 bp, Artificial sequence
  SiRNA target sequence
acaaactgcaaatgtcccaaaaa

SEQ ID NO: 42853 - DNA, 23 bp, Artificial sequence
  SiRNA target sequence
caaactgcaaatgtcccaaaaat

SEQ ID NO: 42854 - DNA, 23 bp, Artificial sequence
  SiRNA target sequence
aaactgcaaatgtcccaaaaatt

SEQ ID NO: 42855 - DNA, 23 bp, Artificial sequence
  SiRNA target sequence
aactgcaaatgtcccaaaaatta

SEQ ID NO: 42856 - DNA, 23 bp, Artificial sequence
  SiRNA target sequence
actgcaaatgtcccaaaaattat

SEQ ID NO: 42857 - DNA, 23 bp, Artificial sequence
  SiRNA target sequence
ctgcaaatgtcccaaaaattatg

SEQ ID NO: 42858 - DNA, 23 bp, Artificial sequence
  SiRNA target sequence
tgcaaatgtcccaaaaattatgt

SEQ ID NO: 42859 - DNA, 23 bp, Artificial sequence
  SiRNA target sequence
gcaaatgtcccaaaaattatgta

SEQ ID NO: 42860 - DNA, 23 bp, Artificial sequence
  SiRNA target sequence
caaatgtcccaaaaattatgtaa

SEQ ID NO: 42861 - DNA, 23 bp, Artificial sequence
  SiRNA target sequence
aaatgtcccaaaaattatgtaaa

SEQ ID NO: 42862 - DNA, 23 bp, Artificial sequence
  SiRNA target sequence
aatgtcccaaaaattatgtaaat

SEQ ID NO: 42863 - DNA, 23 bp, Artificial sequence
  SiRNA target sequence
atgtcccaaaaattatgtaaatg

SEQ ID NO: 42864 - DNA, 23 bp, Artificial sequence
  SiRNA target sequence
tgtcccaaaaattatgtaaatga

SEQ ID NO: 42865 - DNA, 23 bp, Artificial sequence
  SiRNA target sequence
gtcccaaaaattatgtaaatgac

SEQ ID NO: 42866 - DNA, 23 bp, Artificial sequence
  SiRNA target sequence
tcccaaaaattatgtaaatgaca

SEQ ID NO: 42867 - DNA, 23 bp, Artificial sequence
  SiRNA target sequence
cccaaaaattatgtaaatgacaa

SEQ ID NO: 42868 - DNA, 23 bp, Artificial sequence
  SiRNA target sequence
ccaaaaattatgtaaatgacaaa

SEQ ID NO: 42869 - DNA, 23 bp, Artificial sequence
  SiRNA target sequence
caaaaattatgtaaatgacaaat

SEQ ID NO: 42870 - DNA, 23 bp, Artificial sequence
  SiRNA target sequence
aaaaattatgtaaatgacaaatg

SEQ ID NO: 42871 - DNA, 23 bp, Artificial sequence
  SiRNA target sequence
aaaattatgtaaatgacaaatgt

SEQ ID NO: 42872 - DNA, 23 bp, Artificial sequence
  SiRNA target sequence
aaattatgtaaatgacaaatgtt

SEQ ID NO: 42873 - DNA, 23 bp, Artificial sequence
  SiRNA target sequence
aattatgtaaatgacaaatgttc

SEQ ID NO: 42874 - DNA, 23 bp, Artificial sequence
  SiRNA target sequence
attatgtaaatgacaaatgttcg

SEQ ID NO: 42875 - DNA, 23 bp, Artificial sequence
  SiRNA target sequence
ttatgtaaatgacaaatgttcga

SEQ ID NO: 42876 - DNA, 23 bp, Artificial sequence
  SiRNA target sequence
tatgtaaatgacaaatgttcgaa

SEQ ID NO: 42877 - DNA, 23 bp, Artificial sequence
  SiRNA target sequence
atgtaaatgacaaatgttcgaat

SEQ ID NO: 42878 - DNA, 23 bp, Artificial sequence
  SiRNA target sequence
tgtaaatgacaaatgttcgaata

SEQ ID NO: 42879 - DNA, 23 bp, Artificial sequence
  SiRNA target sequence
gtaaatgacaaatgttcgaataa

SEQ ID NO: 42880 - DNA, 23 bp, Artificial sequence
  SiRNA target sequence
taaatgacaaatgttcgaataaa

SEQ ID NO: 42881 - DNA, 23 bp, Artificial sequence
  SiRNA target sequence
aaatgacaaatgttcgaataaag

SEQ ID NO: 42882 - DNA, 23 bp, Artificial sequence
  SiRNA target sequence
aatgacaaatgttcgaataaagg

SEQ ID NO: 42883 - DNA, 23 bp, Artificial sequence
  SiRNA target sequence
atgacaaatgttcgaataaaggg

SEQ ID NO: 42884 - DNA, 23 bp, Artificial sequence
  SiRNA target sequence
tgacaaatgttcgaataaagggc

SEQ ID NO: 42885 - DNA, 23 bp, Artificial sequence
  SiRNA target sequence
gacaaatgttcgaataaagggct

SEQ ID NO: 42886 - DNA, 23 bp, Artificial sequence
  SiRNA target sequence
acaaatgttcgaataaagggctt

SEQ ID NO: 42887 - DNA, 23 bp, Artificial sequence
  SiRNA target sequence
caaatgttcgaataaagggcttt

SEQ ID NO: 42888 - DNA, 23 bp, Artificial sequence
  SiRNA target sequence
aaatgttcgaataaagggctttg

SEQ ID NO: 42889 - DNA, 23 bp, Artificial sequence
  SiRNA target sequence
aatgttcgaataaagggctttga

SEQ ID NO: 42890 - DNA, 23 bp, Artificial sequence
  SiRNA target sequence
atgttcgaataaagggctttgaa

SEQ ID NO: 42891 - DNA, 23 bp, Artificial sequence
  SiRNA target sequence
tgttcgaataaagggctttgaaa

SEQ ID NO: 42892 - DNA, 23 bp, Artificial sequence
  SiRNA target sequence
gttcgaataaagggctttgaaat

SEQ ID NO: 42893 - DNA, 23 bp, Artificial sequence
  SiRNA target sequence
ttcgaataaagggctttgaaata

SEQ ID NO: 42894 - DNA, 23 bp, Artificial sequence
  SiRNA target sequence
tcgaataaagggctttgaaataa

SEQ ID NO: 42895 - DNA, 23 bp, Artificial sequence
  SiRNA target sequence
cgaataaagggctttgaaataac

SEQ ID NO: 42896 - DNA, 23 bp, Artificial sequence
  SiRNA target sequence
gaataaagggctttgaaataaca

SEQ ID NO: 42897 - DNA, 23 bp, Artificial sequence
  SiRNA target sequence
aataaagggctttgaaataacat

SEQ ID NO: 42898 - DNA, 23 bp, Artificial sequence
  SiRNA target sequence
ataaagggctttgaaataacata

SEQ ID NO: 42899 - DNA, 23 bp, Artificial sequence
  SiRNA target sequence
taaagggctttgaaataacatat

SEQ ID NO: 42900 - DNA, 23 bp, Artificial sequence
  SiRNA target sequence
aaagggctttgaaataacatatt

SEQ ID NO: 42901 - DNA, 23 bp, Artificial sequence
  SiRNA target sequence
aagggctttgaaataacatattc

SEQ ID NO: 42902 - DNA, 23 bp, Artificial sequence
  SiRNA target sequence
agggctttgaaataacatattct

SEQ ID NO: 42903 - DNA, 23 bp, Artificial sequence
  SiRNA target sequence
gggctttgaaataacatattcta

SEQ ID NO: 42904 - DNA, 23 bp, Artificial sequence
  SiRNA target sequence
ggctttgaaataacatattctac

SEQ ID NO: 42905 - DNA, 23 bp, Artificial sequence
  SiRNA target sequence
gctttgaaataacatattctaca

SEQ ID NO: 42906 - DNA, 23 bp, Artificial sequence
  SiRNA target sequence
ctttgaaataacatattctacaa

SEQ ID NO: 42907 - DNA, 23 bp, Artificial sequence
  SiRNA target sequence
tttgaaataacatattctacaat

SEQ ID NO: 42908 - DNA, 23 bp, Artificial sequence
  SiRNA target sequence
ttgaaataacatattctacaatc

SEQ ID NO: 42909 - DNA, 23 bp, Artificial sequence
  SiRNA target sequence
tgaaataacatattctacaatca

SEQ ID NO: 42910 - DNA, 23 bp, Artificial sequence
  SiRNA target sequence
gaaataacatattctacaatcag

SEQ ID NO: 42911 - DNA, 23 bp, Artificial sequence
  SiRNA target sequence
aaataacatattctacaatcagg

SEQ ID NO: 42912 - DNA, 23 bp, Artificial sequence
  SiRNA target sequence
aataacatattctacaatcaggt

SEQ ID NO: 42913 - DNA, 23 bp, Artificial sequence
  SiRNA target sequence
ataacatattctacaatcaggtc

SEQ ID NO: 42914 - DNA, 23 bp, Artificial sequence
  SiRNA target sequence
taacatattctacaatcaggtct

SEQ ID NO: 42915 - DNA, 23 bp, Artificial sequence
  SiRNA target sequence
aacatattctacaatcaggtctt

SEQ ID NO: 42916 - DNA, 23 bp, Artificial sequence
  SiRNA target sequence
acatattctacaatcaggtcttt

SEQ ID NO: 42917 - DNA, 23 bp, Artificial sequence
  SiRNA target sequence
catattctacaatcaggtctttc

SEQ ID NO: 42918 - DNA, 23 bp, Artificial sequence
  SiRNA target sequence
atattctacaatcaggtctttca

SEQ ID NO: 42919 - DNA, 23 bp, Artificial sequence
  SiRNA target sequence
tattctacaatcaggtctttcat

SEQ ID NO: 42920 - DNA, 23 bp, Artificial sequence
  SiRNA target sequence
attctacaatcaggtctttcata

SEQ ID NO: 42921 - DNA, 23 bp, Artificial sequence
  SiRNA target sequence
ttctacaatcaggtctttcataa

SEQ ID NO: 42922 - DNA, 23 bp, Artificial sequence
  SiRNA target sequence
tctacaatcaggtctttcataat

SEQ ID NO: 42923 - DNA, 23 bp, Artificial sequence
  SiRNA target sequence
ctacaatcaggtctttcataata

SEQ ID NO: 42924 - DNA, 23 bp, Artificial sequence
  SiRNA target sequence
tacaatcaggtctttcataatac

SEQ ID NO: 42925 - DNA, 23 bp, Artificial sequence
  SiRNA target sequence
acaatcaggtctttcataatact

SEQ ID NO: 42926 - DNA, 23 bp, Artificial sequence
  SiRNA target sequence
caatcaggtctttcataatacta

SEQ ID NO: 42927 - DNA, 23 bp, Artificial sequence
  SiRNA target sequence
aatcaggtctttcataatactaa

SEQ ID NO: 42928 - DNA, 23 bp, Artificial sequence
  SiRNA target sequence
atcaggtctttcataatactaat

SEQ ID NO: 42929 - DNA, 23 bp, Artificial sequence
  SiRNA target sequence
tcaggtctttcataatactaata

SEQ ID NO: 42930 - DNA, 23 bp, Artificial sequence
  SiRNA target sequence
caggtctttcataatactaatat

SEQ ID NO: 42931 - DNA, 23 bp, Artificial sequence
  SiRNA target sequence
aggtctttcataatactaatatc

SEQ ID NO: 42932 - DNA, 23 bp, Artificial sequence
  SiRNA target sequence
ggtctttcataatactaatatca

SEQ ID NO: 42933 - DNA, 23 bp, Artificial sequence
  SiRNA target sequence
gtctttcataatactaatatcac

SEQ ID NO: 42934 - DNA, 23 bp, Artificial sequence
  SiRNA target sequence
tctttcataatactaatatcact

SEQ ID NO: 42935 - DNA, 23 bp, Artificial sequence
  SiRNA target sequence
ctttcataatactaatatcacta

SEQ ID NO: 42936 - DNA, 23 bp, Artificial sequence
  SiRNA target sequence
tttcataatactaatatcactac

SEQ ID NO: 42937 - DNA, 23 bp, Artificial sequence
  SiRNA target sequence
ttcataatactaatatcactacc

SEQ ID NO: 42938 - DNA, 23 bp, Artificial sequence
  SiRNA target sequence
tcataatactaatatcactacca

SEQ ID NO: 42939 - DNA, 23 bp, Artificial sequence
  SiRNA target sequence
cataatactaatatcactaccat

SEQ ID NO: 42940 - DNA, 23 bp, Artificial sequence
  SiRNA target sequence
ataatactaatatcactaccata

SEQ ID NO: 42941 - DNA, 23 bp, Artificial sequence
  SiRNA target sequence
taatactaatatcactaccataa

SEQ ID NO: 42942 - DNA, 23 bp, Artificial sequence
  SiRNA target sequence
aatactaatatcactaccataaa

SEQ ID NO: 42943 - DNA, 23 bp, Artificial sequence
  SiRNA target sequence
atactaatatcactaccataaat

SEQ ID NO: 42944 - DNA, 23 bp, Artificial sequence
  SiRNA target sequence
tactaatatcactaccataaata

SEQ ID NO: 42945 - DNA, 23 bp, Artificial sequence
  SiRNA target sequence
actaatatcactaccataaatag

SEQ ID NO: 42946 - DNA, 23 bp, Artificial sequence
  SiRNA target sequence
ctaatatcactaccataaataga

SEQ ID NO: 42947 - DNA, 23 bp, Artificial sequence
  SiRNA target sequence
taatatcactaccataaatagat

SEQ ID NO: 42948 - DNA, 23 bp, Artificial sequence
  SiRNA target sequence
aatatcactaccataaatagatt

SEQ ID NO: 42949 - DNA, 23 bp, Artificial sequence
  SiRNA target sequence
atatcactaccataaatagattt

SEQ ID NO: 42950 - DNA, 23 bp, Artificial sequence
  SiRNA target sequence
tatcactaccataaatagatttt

SEQ ID NO: 42951 - DNA, 23 bp, Artificial sequence
  SiRNA target sequence
atcactaccataaatagattttt

SEQ ID NO: 42952 - DNA, 23 bp, Artificial sequence
  SiRNA target sequence
tcactaccataaatagatttttt

SEQ ID NO: 42953 - DNA, 23 bp, Artificial sequence
  SiRNA target sequence
cactaccataaatagattttttt

SEQ ID NO: 42954 - DNA, 23 bp, Artificial sequence
  SiRNA target sequence
actaccataaatagatttttttt

SEQ ID NO: 42955 - DNA, 23 bp, Artificial sequence
  SiRNA target sequence
ctaccataaatagattttttttc

SEQ ID NO: 42956 - DNA, 23 bp, Artificial sequence
  SiRNA target sequence
taccataaatagattttttttct

SEQ ID NO: 42957 - DNA, 23 bp, Artificial sequence
  SiRNA target sequence
accataaatagattttttttcta

SEQ ID NO: 42958 - DNA, 23 bp, Artificial sequence
  SiRNA target sequence
ccataaatagattttttttctaa

SEQ ID NO: 42959 - DNA, 23 bp, Artificial sequence
  SiRNA target sequence
cataaatagattttttttctaac

SEQ ID NO: 42960 - DNA, 23 bp, Artificial sequence
  SiRNA target sequence
ataaatagattttttttctaaca

SEQ ID NO: 42961 - DNA, 23 bp, Artificial sequence
  SiRNA target sequence
taaatagattttttttctaacat

SEQ ID NO: 42962 - DNA, 24 bp, Artificial sequence
  SiRNA target sequence
ttataagtttaatgtagaaataat

SEQ ID NO: 42963 - DNA, 24 bp, Artificial sequence
  SiRNA target sequence
tataagtttaatgtagaaataata

SEQ ID NO: 42964 - DNA, 24 bp, Artificial sequence
  SiRNA target sequence
ataagtttaatgtagaaataatat

SEQ ID NO: 42965 - DNA, 24 bp, Artificial sequence
  SiRNA target sequence
taagtttaatgtagaaataatatt

SEQ ID NO: 42966 - DNA, 24 bp, Artificial sequence
  SiRNA target sequence
aagtttaatgtagaaataatattt

SEQ ID NO: 42967 - DNA, 24 bp, Artificial sequence
  SiRNA target sequence
agtttaatgtagaaataatatttt

SEQ ID NO: 42968 - DNA, 24 bp, Artificial sequence
  SiRNA target sequence
gtttaatgtagaaataatattttc

SEQ ID NO: 42969 - DNA, 24 bp, Artificial sequence
  SiRNA target sequence
tttaatgtagaaataatattttct

SEQ ID NO: 42970 - DNA, 24 bp, Artificial sequence
  SiRNA target sequence
ttaatgtagaaataatattttctt

SEQ ID NO: 42971 - DNA, 24 bp, Artificial sequence
  SiRNA target sequence
taatgtagaaataatattttcttc

SEQ ID NO: 42972 - DNA, 24 bp, Artificial sequence
  SiRNA target sequence
aatgtagaaataatattttcttct

SEQ ID NO: 42973 - DNA, 24 bp, Artificial sequence
  SiRNA target sequence
atgtagaaataatattttcttcta

SEQ ID NO: 42974 - DNA, 24 bp, Artificial sequence
  SiRNA target sequence
tgtagaaataatattttcttctat

SEQ ID NO: 42975 - DNA, 24 bp, Artificial sequence
  SiRNA target sequence
gtagaaataatattttcttctatc

SEQ ID NO: 42976 - DNA, 24 bp, Artificial sequence
  SiRNA target sequence
tagaaataatattttcttctatct

SEQ ID NO: 42977 - DNA, 24 bp, Artificial sequence
  SiRNA target sequence
agaaataatattttcttctatctt

SEQ ID NO: 42978 - DNA, 24 bp, Artificial sequence
  SiRNA target sequence
gaaataatattttcttctatctta

SEQ ID NO: 42979 - DNA, 24 bp, Artificial sequence
  SiRNA target sequence
aaataatattttcttctatcttat

SEQ ID NO: 42980 - DNA, 24 bp, Artificial sequence
  SiRNA target sequence
aataatattttcttctatcttatg

SEQ ID NO: 42981 - DNA, 24 bp, Artificial sequence
  SiRNA target sequence
ataatattttcttctatcttatgt

SEQ ID NO: 42982 - DNA, 24 bp, Artificial sequence
  SiRNA target sequence
taatattttcttctatcttatgta

SEQ ID NO: 42983 - DNA, 24 bp, Artificial sequence
  SiRNA target sequence
aatattttcttctatcttatgtaa

SEQ ID NO: 42984 - DNA, 24 bp, Artificial sequence
  SiRNA target sequence
atattttcttctatcttatgtaat

SEQ ID NO: 42985 - DNA, 24 bp, Artificial sequence
  SiRNA target sequence
tattttcttctatcttatgtaatg

SEQ ID NO: 42986 - DNA, 24 bp, Artificial sequence
  SiRNA target sequence
attttcttctatcttatgtaatga

SEQ ID NO: 42987 - DNA, 24 bp, Artificial sequence
  SiRNA target sequence
ttttcttctatcttatgtaatgat

SEQ ID NO: 42988 - DNA, 24 bp, Artificial sequence
  SiRNA target sequence
tttcttctatcttatgtaatgata

SEQ ID NO: 42989 - DNA, 24 bp, Artificial sequence
  SiRNA target sequence
ttcttctatcttatgtaatgatac

SEQ ID NO: 42990 - DNA, 24 bp, Artificial sequence
  SiRNA target sequence
tcttctatcttatgtaatgataca

SEQ ID NO: 42991 - DNA, 24 bp, Artificial sequence
  SiRNA target sequence
cttctatcttatgtaatgatacag

SEQ ID NO: 42992 - DNA, 24 bp, Artificial sequence
  SiRNA target sequence
ttctatcttatgtaatgatacagt

SEQ ID NO: 42993 - DNA, 24 bp, Artificial sequence
  SiRNA target sequence
tctatcttatgtaatgatacagtt

SEQ ID NO: 42994 - DNA, 24 bp, Artificial sequence
  SiRNA target sequence
ctatcttatgtaatgatacagttt

SEQ ID NO: 42995 - DNA, 24 bp, Artificial sequence
  SiRNA target sequence
tatcttatgtaatgatacagtttt

SEQ ID NO: 42996 - DNA, 24 bp, Artificial sequence
  SiRNA target sequence
atcttatgtaatgatacagttttg

SEQ ID NO: 42997 - DNA, 24 bp, Artificial sequence
  SiRNA target sequence
tcttatgtaatgatacagttttgt

SEQ ID NO: 42998 - DNA, 24 bp, Artificial sequence
  SiRNA target sequence
cttatgtaatgatacagttttgtt

SEQ ID NO: 42999 - DNA, 24 bp, Artificial sequence
  SiRNA target sequence
ttatgtaatgatacagttttgttt

SEQ ID NO: 43000 - DNA, 24 bp, Artificial sequence
  SiRNA target sequence
tatgtaatgatacagttttgtttt

SEQ ID NO: 43001 - DNA, 24 bp, Artificial sequence
  SiRNA target sequence
atgtaatgatacagttttgttttt

SEQ ID NO: 43002 - DNA, 24 bp, Artificial sequence
  SiRNA target sequence
tgtaatgatacagttttgttttta

SEQ ID NO: 43003 - DNA, 24 bp, Artificial sequence
  SiRNA target sequence
gtaatgatacagttttgtttttaa

SEQ ID NO: 43004 - DNA, 24 bp, Artificial sequence
  SiRNA target sequence
taatgatacagttttgtttttaat

SEQ ID NO: 43005 - DNA, 24 bp, Artificial sequence
  SiRNA target sequence
aatgatacagttttgtttttaata

SEQ ID NO: 43006 - DNA, 24 bp, Artificial sequence
  SiRNA target sequence
atgatacagttttgtttttaatac

SEQ ID NO: 43007 - DNA, 24 bp, Artificial sequence
  SiRNA target sequence
tgatacagttttgtttttaatact

SEQ ID NO: 43008 - DNA, 24 bp, Artificial sequence
  SiRNA target sequence
gatacagttttgtttttaatactt

SEQ ID NO: 43009 - DNA, 24 bp, Artificial sequence
  SiRNA target sequence
atacagttttgtttttaatactta

SEQ ID NO: 43010 - DNA, 24 bp, Artificial sequence
  SiRNA target sequence
tacagttttgtttttaatacttag

SEQ ID NO: 43011 - DNA, 24 bp, Artificial sequence
  SiRNA target sequence
acagttttgtttttaatacttagc

SEQ ID NO: 43012 - DNA, 24 bp, Artificial sequence
  SiRNA target sequence
cagttttgtttttaatacttagca

SEQ ID NO: 43013 - DNA, 24 bp, Artificial sequence
  SiRNA target sequence
agttttgtttttaatacttagcac

SEQ ID NO: 43014 - DNA, 24 bp, Artificial sequence
  SiRNA target sequence
gttttgtttttaatacttagcact

SEQ ID NO: 43015 - DNA, 24 bp, Artificial sequence
  SiRNA target sequence
ttttgtttttaatacttagcactt

SEQ ID NO: 43016 - DNA, 24 bp, Artificial sequence
  SiRNA target sequence
tttgtttttaatacttagcacttt

SEQ ID NO: 43017 - DNA, 24 bp, Artificial sequence
  SiRNA target sequence
ttgtttttaatacttagcacttta

SEQ ID NO: 43018 - DNA, 24 bp, Artificial sequence
  SiRNA target sequence
tgtttttaatacttagcactttat

SEQ ID NO: 43019 - DNA, 24 bp, Artificial sequence
  SiRNA target sequence
gtttttaatacttagcactttatc

SEQ ID NO: 43020 - DNA, 24 bp, Artificial sequence
  SiRNA target sequence
tttttaatacttagcactttatca

SEQ ID NO: 43021 - DNA, 24 bp, Artificial sequence
  SiRNA target sequence
ttttaatacttagcactttatcaa

SEQ ID NO: 43022 - DNA, 24 bp, Artificial sequence
  SiRNA target sequence
tttaatacttagcactttatcaaa

SEQ ID NO: 43023 - DNA, 24 bp, Artificial sequence
  SiRNA target sequence
ttaatacttagcactttatcaaat

SEQ ID NO: 43024 - DNA, 24 bp, Artificial sequence
  SiRNA target sequence
taatacttagcactttatcaaata

SEQ ID NO: 43025 - DNA, 24 bp, Artificial sequence
  SiRNA target sequence
aatacttagcactttatcaaataa

SEQ ID NO: 43026 - DNA, 24 bp, Artificial sequence
  SiRNA target sequence
atacttagcactttatcaaataag

SEQ ID NO: 43027 - DNA, 24 bp, Artificial sequence
  SiRNA target sequence
tacttagcactttatcaaataagt

SEQ ID NO: 43028 - DNA, 24 bp, Artificial sequence
  SiRNA target sequence
acttagcactttatcaaataagtg

SEQ ID NO: 43029 - DNA, 24 bp, Artificial sequence
  SiRNA target sequence
cttagcactttatcaaataagtgg

SEQ ID NO: 43030 - DNA, 24 bp, Artificial sequence
  SiRNA target sequence
ttagcactttatcaaataagtgga

SEQ ID NO: 43031 - DNA, 24 bp, Artificial sequence
  SiRNA target sequence
tagcactttatcaaataagtggag

SEQ ID NO: 43032 - DNA, 24 bp, Artificial sequence
  SiRNA target sequence
agcactttatcaaataagtggagt

SEQ ID NO: 43033 - DNA, 24 bp, Artificial sequence
  SiRNA target sequence
gcactttatcaaataagtggagta

SEQ ID NO: 43034 - DNA, 24 bp, Artificial sequence
  SiRNA target sequence
cactttatcaaataagtggagtaa

SEQ ID NO: 43035 - DNA, 24 bp, Artificial sequence
  SiRNA target sequence
actttatcaaataagtggagtaaa

SEQ ID NO: 43036 - DNA, 24 bp, Artificial sequence
  SiRNA target sequence
ctttatcaaataagtggagtaaat

SEQ ID NO: 43037 - DNA, 24 bp, Artificial sequence
  SiRNA target sequence
tttatcaaataagtggagtaaatc

SEQ ID NO: 43038 - DNA, 24 bp, Artificial sequence
  SiRNA target sequence
ttatcaaataagtggagtaaatct

SEQ ID NO: 43039 - DNA, 24 bp, Artificial sequence
  SiRNA target sequence
tatcaaataagtggagtaaatcta

SEQ ID NO: 43040 - DNA, 24 bp, Artificial sequence
  SiRNA target sequence
atcaaataagtggagtaaatctaa

SEQ ID NO: 43041 - DNA, 24 bp, Artificial sequence
  SiRNA target sequence
tcaaataagtggagtaaatctaaa

SEQ ID NO: 43042 - DNA, 24 bp, Artificial sequence
  SiRNA target sequence
caaataagtggagtaaatctaaat

SEQ ID NO: 43043 - DNA, 24 bp, Artificial sequence
  SiRNA target sequence
aaataagtggagtaaatctaaatt

SEQ ID NO: 43044 - DNA, 24 bp, Artificial sequence
  SiRNA target sequence
aataagtggagtaaatctaaatta

SEQ ID NO: 43045 - DNA, 24 bp, Artificial sequence
  SiRNA target sequence
ataagtggagtaaatctaaattat

SEQ ID NO: 43046 - DNA, 24 bp, Artificial sequence
  SiRNA target sequence
taagtggagtaaatctaaattatg

SEQ ID NO: 43047 - DNA, 24 bp, Artificial sequence
  SiRNA target sequence
aagtggagtaaatctaaattatgt

SEQ ID NO: 43048 - DNA, 24 bp, Artificial sequence
  SiRNA target sequence
agtggagtaaatctaaattatgta

SEQ ID NO: 43049 - DNA, 24 bp, Artificial sequence
  SiRNA target sequence
gtggagtaaatctaaattatgtaa

SEQ ID NO: 43050 - DNA, 24 bp, Artificial sequence
  SiRNA target sequence
tggagtaaatctaaattatgtaaa

SEQ ID NO: 43051 - DNA, 24 bp, Artificial sequence
  SiRNA target sequence
ggagtaaatctaaattatgtaaaa

SEQ ID NO: 43052 - DNA, 24 bp, Artificial sequence
  SiRNA target sequence
gagtaaatctaaattatgtaaaac

SEQ ID NO: 43053 - DNA, 24 bp, Artificial sequence
  SiRNA target sequence
agtaaatctaaattatgtaaaaca

SEQ ID NO: 43054 - DNA, 24 bp, Artificial sequence
  SiRNA target sequence
gtaaatctaaattatgtaaaacaa

SEQ ID NO: 43055 - DNA, 24 bp, Artificial sequence
  SiRNA target sequence
taaatctaaattatgtaaaacaat

SEQ ID NO: 43056 - DNA, 24 bp, Artificial sequence
  SiRNA target sequence
aaatctaaattatgtaaaacaata

SEQ ID NO: 43057 - DNA, 24 bp, Artificial sequence
  SiRNA target sequence
aatctaaattatgtaaaacaataa

SEQ ID NO: 43058 - DNA, 24 bp, Artificial sequence
  SiRNA target sequence
atctaaattatgtaaaacaataat

SEQ ID NO: 43059 - DNA, 24 bp, Artificial sequence
  SiRNA target sequence
tctaaattatgtaaaacaataatt

SEQ ID NO: 43060 - DNA, 24 bp, Artificial sequence
  SiRNA target sequence
ctaaattatgtaaaacaataatta

SEQ ID NO: 43061 - DNA, 24 bp, Artificial sequence
  SiRNA target sequence
taaattatgtaaaacaataattat

SEQ ID NO: 43062 - DNA, 24 bp, Artificial sequence
  SiRNA target sequence
aaattatgtaaaacaataattatc

SEQ ID NO: 43063 - DNA, 24 bp, Artificial sequence
  SiRNA target sequence
aattatgtaaaacaataattatcg

SEQ ID NO: 43064 - DNA, 24 bp, Artificial sequence
  SiRNA target sequence
attatgtaaaacaataattatcgt

SEQ ID NO: 43065 - DNA, 24 bp, Artificial sequence
  SiRNA target sequence
ttatgtaaaacaataattatcgtc

SEQ ID NO: 43066 - DNA, 24 bp, Artificial sequence
  SiRNA target sequence
tatgtaaaacaataattatcgtct

SEQ ID NO: 43067 - DNA, 24 bp, Artificial sequence
  SiRNA target sequence
atgtaaaacaataattatcgtctt

SEQ ID NO: 43068 - DNA, 24 bp, Artificial sequence
  SiRNA target sequence
tgtaaaacaataattatcgtcttc

SEQ ID NO: 43069 - DNA, 24 bp, Artificial sequence
  SiRNA target sequence
gtaaaacaataattatcgtcttct

SEQ ID NO: 43070 - DNA, 24 bp, Artificial sequence
  SiRNA target sequence
taaaacaataattatcgtcttctc

SEQ ID NO: 43071 - DNA, 24 bp, Artificial sequence
  SiRNA target sequence
aaaacaataattatcgtcttctct

SEQ ID NO: 43072 - DNA, 24 bp, Artificial sequence
  SiRNA target sequence
aaacaataattatcgtcttctcta

SEQ ID NO: 43073 - DNA, 24 bp, Artificial sequence
  SiRNA target sequence
aacaataattatcgtcttctctaa

SEQ ID NO: 43074 - DNA, 24 bp, Artificial sequence
  SiRNA target sequence
acaataattatcgtcttctctaag

SEQ ID NO: 43075 - DNA, 24 bp, Artificial sequence
  SiRNA target sequence
caataattatcgtcttctctaagt

SEQ ID NO: 43076 - DNA, 24 bp, Artificial sequence
  SiRNA target sequence
aataattatcgtcttctctaagtt

SEQ ID NO: 43077 - DNA, 24 bp, Artificial sequence
  SiRNA target sequence
ataattatcgtcttctctaagttg

SEQ ID NO: 43078 - DNA, 24 bp, Artificial sequence
  SiRNA target sequence
taattatcgtcttctctaagttgt

SEQ ID NO: 43079 - DNA, 24 bp, Artificial sequence
  SiRNA target sequence
aattatcgtcttctctaagttgtt

SEQ ID NO: 43080 - DNA, 24 bp, Artificial sequence
  SiRNA target sequence
attatcgtcttctctaagttgttg

SEQ ID NO: 43081 - DNA, 24 bp, Artificial sequence
  SiRNA target sequence
ttatcgtcttctctaagttgttgg

SEQ ID NO: 43082 - DNA, 24 bp, Artificial sequence
  SiRNA target sequence
tatcgtcttctctaagttgttgga

SEQ ID NO: 43083 - DNA, 24 bp, Artificial sequence
  SiRNA target sequence
atcgtcttctctaagttgttggag

SEQ ID NO: 43084 - DNA, 24 bp, Artificial sequence
  SiRNA target sequence
tcgtcttctctaagttgttggaga

SEQ ID NO: 43085 - DNA, 24 bp, Artificial sequence
  SiRNA target sequence
cgtcttctctaagttgttggagat

SEQ ID NO: 43086 - DNA, 24 bp, Artificial sequence
  SiRNA target sequence
gtcttctctaagttgttggagatt

SEQ ID NO: 43087 - DNA, 24 bp, Artificial sequence
  SiRNA target sequence
tcttctctaagttgttggagatta

SEQ ID NO: 43088 - DNA, 24 bp, Artificial sequence
  SiRNA target sequence
cttctctaagttgttggagattag

SEQ ID NO: 43089 - DNA, 24 bp, Artificial sequence
  SiRNA target sequence
ttctctaagttgttggagattaga

SEQ ID NO: 43090 - DNA, 24 bp, Artificial sequence
  SiRNA target sequence
tctctaagttgttggagattagac

SEQ ID NO: 43091 - DNA, 24 bp, Artificial sequence
  SiRNA target sequence
ctctaagttgttggagattagact

SEQ ID NO: 43092 - DNA, 24 bp, Artificial sequence
  SiRNA target sequence
tctaagttgttggagattagactt

SEQ ID NO: 43093 - DNA, 24 bp, Artificial sequence
  SiRNA target sequence
ctaagttgttggagattagacttt

SEQ ID NO: 43094 - DNA, 24 bp, Artificial sequence
  SiRNA target sequence
taagttgttggagattagactttt

SEQ ID NO: 43095 - DNA, 24 bp, Artificial sequence
  SiRNA target sequence
aagttgttggagattagactttta

SEQ ID NO: 43096 - DNA, 24 bp, Artificial sequence
  SiRNA target sequence
agttgttggagattagacttttaa

SEQ ID NO: 43097 - DNA, 24 bp, Artificial sequence
  SiRNA target sequence
gttgttggagattagacttttaag

SEQ ID NO: 43098 - DNA, 24 bp, Artificial sequence
  SiRNA target sequence
ttgttggagattagacttttaaga

SEQ ID NO: 43099 - DNA, 24 bp, Artificial sequence
  SiRNA target sequence
tgttggagattagacttttaagaa

SEQ ID NO: 43100 - DNA, 24 bp, Artificial sequence
  SiRNA target sequence
gttggagattagacttttaagaat

SEQ ID NO: 43101 - DNA, 24 bp, Artificial sequence
  SiRNA target sequence
ttggagattagacttttaagaatt

SEQ ID NO: 43102 - DNA, 24 bp, Artificial sequence
  SiRNA target sequence
tggagattagacttttaagaattt

SEQ ID NO: 43103 - DNA, 24 bp, Artificial sequence
  SiRNA target sequence
ggagattagacttttaagaatttc

SEQ ID NO: 43104 - DNA, 24 bp, Artificial sequence
  SiRNA target sequence
gagattagacttttaagaatttca

SEQ ID NO: 43105 - DNA, 24 bp, Artificial sequence
  SiRNA target sequence
agattagacttttaagaatttcat

SEQ ID NO: 43106 - DNA, 24 bp, Artificial sequence
  SiRNA target sequence
gattagacttttaagaatttcata

SEQ ID NO: 43107 - DNA, 24 bp, Artificial sequence
  SiRNA target sequence
attagacttttaagaatttcatat

SEQ ID NO: 43108 - DNA, 24 bp, Artificial sequence
  SiRNA target sequence
ttagacttttaagaatttcatatt

SEQ ID NO: 43109 - DNA, 24 bp, Artificial sequence
  SiRNA target sequence
tagacttttaagaatttcatattc

SEQ ID NO: 43110 - DNA, 24 bp, Artificial sequence
  SiRNA target sequence
agacttttaagaatttcatattca

SEQ ID NO: 43111 - DNA, 24 bp, Artificial sequence
  SiRNA target sequence
gacttttaagaatttcatattcag

SEQ ID NO: 43112 - DNA, 24 bp, Artificial sequence
  SiRNA target sequence
acttttaagaatttcatattcagc

SEQ ID NO: 43113 - DNA, 24 bp, Artificial sequence
  SiRNA target sequence
cttttaagaatttcatattcagct

SEQ ID NO: 43114 - DNA, 24 bp, Artificial sequence
  SiRNA target sequence
ttttaagaatttcatattcagctt

SEQ ID NO: 43115 - DNA, 24 bp, Artificial sequence
  SiRNA target sequence
tttaagaatttcatattcagcttt

SEQ ID NO: 43116 - DNA, 24 bp, Artificial sequence
  SiRNA target sequence
ttaagaatttcatattcagctttt

SEQ ID NO: 43117 - DNA, 24 bp, Artificial sequence
  SiRNA target sequence
taagaatttcatattcagcttttt

SEQ ID NO: 43118 - DNA, 24 bp, Artificial sequence
  SiRNA target sequence
aagaatttcatattcagctttttt

SEQ ID NO: 43119 - DNA, 24 bp, Artificial sequence
  SiRNA target sequence
agaatttcatattcagcttttttg

SEQ ID NO: 43120 - DNA, 24 bp, Artificial sequence
  SiRNA target sequence
gaatttcatattcagcttttttgt

SEQ ID NO: 43121 - DNA, 24 bp, Artificial sequence
  SiRNA target sequence
aatttcatattcagcttttttgtc

SEQ ID NO: 43122 - DNA, 24 bp, Artificial sequence
  SiRNA target sequence
atttcatattcagcttttttgtcc

SEQ ID NO: 43123 - DNA, 24 bp, Artificial sequence
  SiRNA target sequence
tttcatattcagcttttttgtcca

SEQ ID NO: 43124 - DNA, 24 bp, Artificial sequence
  SiRNA target sequence
ttcatattcagcttttttgtccaa

SEQ ID NO: 43125 - DNA, 24 bp, Artificial sequence
  SiRNA target sequence
tcatattcagcttttttgtccaat

SEQ ID NO: 43126 - DNA, 24 bp, Artificial sequence
  SiRNA target sequence
catattcagcttttttgtccaatg

SEQ ID NO: 43127 - DNA, 24 bp, Artificial sequence
  SiRNA target sequence
atattcagcttttttgtccaatgc

SEQ ID NO: 43128 - DNA, 24 bp, Artificial sequence
  SiRNA target sequence
tattcagcttttttgtccaatgcg

SEQ ID NO: 43129 - DNA, 24 bp, Artificial sequence
  SiRNA target sequence
attcagcttttttgtccaatgcgg

SEQ ID NO: 43130 - DNA, 24 bp, Artificial sequence
  SiRNA target sequence
ttcagcttttttgtccaatgcggc

SEQ ID NO: 43131 - DNA, 24 bp, Artificial sequence
  SiRNA target sequence
tcagcttttttgtccaatgcggcc

SEQ ID NO: 43132 - DNA, 24 bp, Artificial sequence
  SiRNA target sequence
cagcttttttgtccaatgcggccg

SEQ ID NO: 43133 - DNA, 24 bp, Artificial sequence
  SiRNA target sequence
agcttttttgtccaatgcggccgt

SEQ ID NO: 43134 - DNA, 24 bp, Artificial sequence
  SiRNA target sequence
gcttttttgtccaatgcggccgtt

SEQ ID NO: 43135 - DNA, 24 bp, Artificial sequence
  SiRNA target sequence
cttttttgtccaatgcggccgttg

SEQ ID NO: 43136 - DNA, 24 bp, Artificial sequence
  SiRNA target sequence
ttttttgtccaatgcggccgttgg

SEQ ID NO: 43137 - DNA, 24 bp, Artificial sequence
  SiRNA target sequence
tttttgtccaatgcggccgttggc

SEQ ID NO: 43138 - DNA, 24 bp, Artificial sequence
  SiRNA target sequence
ttttgtccaatgcggccgttggct

SEQ ID NO: 43139 - DNA, 24 bp, Artificial sequence
  SiRNA target sequence
tttgtccaatgcggccgttggctc

SEQ ID NO: 43140 - DNA, 24 bp, Artificial sequence
  SiRNA target sequence
ttgtccaatgcggccgttggctca

SEQ ID NO: 43141 - DNA, 24 bp, Artificial sequence
  SiRNA target sequence
tgtccaatgcggccgttggctcat

SEQ ID NO: 43142 - DNA, 24 bp, Artificial sequence
  SiRNA target sequence
gtccaatgcggccgttggctcatc

SEQ ID NO: 43143 - DNA, 24 bp, Artificial sequence
  SiRNA target sequence
tccaatgcggccgttggctcatct

SEQ ID NO: 43144 - DNA, 24 bp, Artificial sequence
  SiRNA target sequence
ccaatgcggccgttggctcatcta

SEQ ID NO: 43145 - DNA, 24 bp, Artificial sequence
  SiRNA target sequence
caatgcggccgttggctcatctaa

SEQ ID NO: 43146 - DNA, 24 bp, Artificial sequence
  SiRNA target sequence
aatgcggccgttggctcatctaaa

SEQ ID NO: 43147 - DNA, 24 bp, Artificial sequence
  SiRNA target sequence
atgcggccgttggctcatctaaaa

SEQ ID NO: 43148 - DNA, 24 bp, Artificial sequence
  SiRNA target sequence
tgcggccgttggctcatctaaaat

SEQ ID NO: 43149 - DNA, 24 bp, Artificial sequence
  SiRNA target sequence
gcggccgttggctcatctaaaatt

SEQ ID NO: 43150 - DNA, 24 bp, Artificial sequence
  SiRNA target sequence
cggccgttggctcatctaaaatta

SEQ ID NO: 43151 - DNA, 24 bp, Artificial sequence
  SiRNA target sequence
ggccgttggctcatctaaaattat

SEQ ID NO: 43152 - DNA, 24 bp, Artificial sequence
  SiRNA target sequence
gccgttggctcatctaaaattata

SEQ ID NO: 43153 - DNA, 24 bp, Artificial sequence
  SiRNA target sequence
ccgttggctcatctaaaattataa

SEQ ID NO: 43154 - DNA, 24 bp, Artificial sequence
  SiRNA target sequence
cgttggctcatctaaaattataat

SEQ ID NO: 43155 - DNA, 24 bp, Artificial sequence
  SiRNA target sequence
gttggctcatctaaaattataata

SEQ ID NO: 43156 - DNA, 24 bp, Artificial sequence
  SiRNA target sequence
ttggctcatctaaaattataatag

SEQ ID NO: 43157 - DNA, 24 bp, Artificial sequence
  SiRNA target sequence
tggctcatctaaaattataatagg

SEQ ID NO: 43158 - DNA, 24 bp, Artificial sequence
  SiRNA target sequence
ggctcatctaaaattataatagga

SEQ ID NO: 43159 - DNA, 24 bp, Artificial sequence
  SiRNA target sequence
gctcatctaaaattataataggag

SEQ ID NO: 43160 - DNA, 24 bp, Artificial sequence
  SiRNA target sequence
ctcatctaaaattataataggaga

SEQ ID NO: 43161 - DNA, 24 bp, Artificial sequence
  SiRNA target sequence
tcatctaaaattataataggagaa

SEQ ID NO: 43162 - DNA, 24 bp, Artificial sequence
  SiRNA target sequence
catctaaaattataataggagaat

SEQ ID NO: 43163 - DNA, 24 bp, Artificial sequence
  SiRNA target sequence
atctaaaattataataggagaatt

SEQ ID NO: 43164 - DNA, 24 bp, Artificial sequence
  SiRNA target sequence
tctaaaattataataggagaattt

SEQ ID NO: 43165 - DNA, 24 bp, Artificial sequence
  SiRNA target sequence
ctaaaattataataggagaatttt

SEQ ID NO: 43166 - DNA, 24 bp, Artificial sequence
  SiRNA target sequence
taaaattataataggagaattttt

SEQ ID NO: 43167 - DNA, 24 bp, Artificial sequence
  SiRNA target sequence
aaaattataataggagaatttttt

SEQ ID NO: 43168 - DNA, 24 bp, Artificial sequence
  SiRNA target sequence
aaattataataggagaatttttta

SEQ ID NO: 43169 - DNA, 24 bp, Artificial sequence
  SiRNA target sequence
aattataataggagaattttttag

SEQ ID NO: 43170 - DNA, 24 bp, Artificial sequence
  SiRNA target sequence
attataataggagaattttttagt

SEQ ID NO: 43171 - DNA, 24 bp, Artificial sequence
  SiRNA target sequence
ttataataggagaattttttagtg

SEQ ID NO: 43172 - DNA, 24 bp, Artificial sequence
  SiRNA target sequence
tataataggagaattttttagtgc

SEQ ID NO: 43173 - DNA, 24 bp, Artificial sequence
  SiRNA target sequence
ataataggagaattttttagtgcc

SEQ ID NO: 43174 - DNA, 24 bp, Artificial sequence
  SiRNA target sequence
taataggagaattttttagtgccg

SEQ ID NO: 43175 - DNA, 24 bp, Artificial sequence
  SiRNA target sequence
aataggagaattttttagtgccga

SEQ ID NO: 43176 - DNA, 24 bp, Artificial sequence
  SiRNA target sequence
ataggagaattttttagtgccgac

SEQ ID NO: 43177 - DNA, 24 bp, Artificial sequence
  SiRNA target sequence
taggagaattttttagtgccgacc

SEQ ID NO: 43178 - DNA, 24 bp, Artificial sequence
  SiRNA target sequence
aggagaattttttagtgccgacct

SEQ ID NO: 43179 - DNA, 24 bp, Artificial sequence
  SiRNA target sequence
ggagaattttttagtgccgacctt

SEQ ID NO: 43180 - DNA, 24 bp, Artificial sequence
  SiRNA target sequence
gagaattttttagtgccgacctta

SEQ ID NO: 43181 - DNA, 24 bp, Artificial sequence
  SiRNA target sequence
agaattttttagtgccgaccttaa

SEQ ID NO: 43182 - DNA, 24 bp, Artificial sequence
  SiRNA target sequence
gaattttttagtgccgaccttaac

SEQ ID NO: 43183 - DNA, 24 bp, Artificial sequence
  SiRNA target sequence
aattttttagtgccgaccttaaca

SEQ ID NO: 43184 - DNA, 24 bp, Artificial sequence
  SiRNA target sequence
attttttagtgccgaccttaacaa

SEQ ID NO: 43185 - DNA, 24 bp, Artificial sequence
  SiRNA target sequence
ttttttagtgccgaccttaacaaa

SEQ ID NO: 43186 - DNA, 24 bp, Artificial sequence
  SiRNA target sequence
tttttagtgccgaccttaacaaaa

SEQ ID NO: 43187 - DNA, 24 bp, Artificial sequence
  SiRNA target sequence
ttttagtgccgaccttaacaaaat

SEQ ID NO: 43188 - DNA, 24 bp, Artificial sequence
  SiRNA target sequence
tttagtgccgaccttaacaaaatt

SEQ ID NO: 43189 - DNA, 24 bp, Artificial sequence
  SiRNA target sequence
ttagtgccgaccttaacaaaatta

SEQ ID NO: 43190 - DNA, 24 bp, Artificial sequence
  SiRNA target sequence
tagtgccgaccttaacaaaattac

SEQ ID NO: 43191 - DNA, 24 bp, Artificial sequence
  SiRNA target sequence
agtgccgaccttaacaaaattact

SEQ ID NO: 43192 - DNA, 24 bp, Artificial sequence
  SiRNA target sequence
gtgccgaccttaacaaaattactt

SEQ ID NO: 43193 - DNA, 24 bp, Artificial sequence
  SiRNA target sequence
tgccgaccttaacaaaattacttt

SEQ ID NO: 43194 - DNA, 24 bp, Artificial sequence
  SiRNA target sequence
gccgaccttaacaaaattactttt

SEQ ID NO: 43195 - DNA, 24 bp, Artificial sequence
  SiRNA target sequence
ccgaccttaacaaaattacttttt

SEQ ID NO: 43196 - DNA, 24 bp, Artificial sequence
  SiRNA target sequence
cgaccttaacaaaattactttttg

SEQ ID NO: 43197 - DNA, 24 bp, Artificial sequence
  SiRNA target sequence
gaccttaacaaaattactttttgt

SEQ ID NO: 43198 - DNA, 24 bp, Artificial sequence
  SiRNA target sequence
accttaacaaaattactttttgtc

SEQ ID NO: 43199 - DNA, 24 bp, Artificial sequence
  SiRNA target sequence
ccttaacaaaattactttttgtct

SEQ ID NO: 43200 - DNA, 24 bp, Artificial sequence
  SiRNA target sequence
cttaacaaaattactttttgtctt

SEQ ID NO: 43201 - DNA, 24 bp, Artificial sequence
  SiRNA target sequence
ttaacaaaattactttttgtcttt

SEQ ID NO: 43202 - DNA, 24 bp, Artificial sequence
  SiRNA target sequence
taacaaaattactttttgtctttc

SEQ ID NO: 43203 - DNA, 24 bp, Artificial sequence
  SiRNA target sequence
aacaaaattactttttgtctttct

SEQ ID NO: 43204 - DNA, 24 bp, Artificial sequence
  SiRNA target sequence
acaaaattactttttgtctttctc

SEQ ID NO: 43205 - DNA, 24 bp, Artificial sequence
  SiRNA target sequence
caaaattactttttgtctttctcc

SEQ ID NO: 43206 - DNA, 24 bp, Artificial sequence
  SiRNA target sequence
aaaattactttttgtctttctcca

SEQ ID NO: 43207 - DNA, 24 bp, Artificial sequence
  SiRNA target sequence
aaattactttttgtctttctccac

SEQ ID NO: 43208 - DNA, 24 bp, Artificial sequence
  SiRNA target sequence
aattactttttgtctttctccacc

SEQ ID NO: 43209 - DNA, 24 bp, Artificial sequence
  SiRNA target sequence
attactttttgtctttctccacca

SEQ ID NO: 43210 - DNA, 24 bp, Artificial sequence
  SiRNA target sequence
ttactttttgtctttctccaccac

SEQ ID NO: 43211 - DNA, 24 bp, Artificial sequence
  SiRNA target sequence
tactttttgtctttctccaccact

SEQ ID NO: 43212 - DNA, 24 bp, Artificial sequence
  SiRNA target sequence
actttttgtctttctccaccacta

SEQ ID NO: 43213 - DNA, 24 bp, Artificial sequence
  SiRNA target sequence
ctttttgtctttctccaccactaa

SEQ ID NO: 43214 - DNA, 24 bp, Artificial sequence
  SiRNA target sequence
tttttgtctttctccaccactaag

SEQ ID NO: 43215 - DNA, 24 bp, Artificial sequence
  SiRNA target sequence
ttttgtctttctccaccactaagc

SEQ ID NO: 43216 - DNA, 24 bp, Artificial sequence
  SiRNA target sequence
tttgtctttctccaccactaagct

SEQ ID NO: 43217 - DNA, 24 bp, Artificial sequence
  SiRNA target sequence
ttgtctttctccaccactaagctt

SEQ ID NO: 43218 - DNA, 24 bp, Artificial sequence
  SiRNA target sequence
tgtctttctccaccactaagctta

SEQ ID NO: 43219 - DNA, 24 bp, Artificial sequence
  SiRNA target sequence
gtctttctccaccactaagcttat

SEQ ID NO: 43220 - DNA, 24 bp, Artificial sequence
  SiRNA target sequence
tctttctccaccactaagcttatg

SEQ ID NO: 43221 - DNA, 24 bp, Artificial sequence
  SiRNA target sequence
ctttctccaccactaagcttatgt

SEQ ID NO: 43222 - DNA, 24 bp, Artificial sequence
  SiRNA target sequence
tttctccaccactaagcttatgtc

SEQ ID NO: 43223 - DNA, 24 bp, Artificial sequence
  SiRNA target sequence
ttctccaccactaagcttatgtcc

SEQ ID NO: 43224 - DNA, 24 bp, Artificial sequence
  SiRNA target sequence
tctccaccactaagcttatgtccc

SEQ ID NO: 43225 - DNA, 24 bp, Artificial sequence
  SiRNA target sequence
ctccaccactaagcttatgtccct

SEQ ID NO: 43226 - DNA, 24 bp, Artificial sequence
  SiRNA target sequence
tccaccactaagcttatgtccctt

SEQ ID NO: 43227 - DNA, 24 bp, Artificial sequence
  SiRNA target sequence
ccaccactaagcttatgtccctta

SEQ ID NO: 43228 - DNA, 24 bp, Artificial sequence
  SiRNA target sequence
caccactaagcttatgtcccttat

SEQ ID NO: 43229 - DNA, 24 bp, Artificial sequence
  SiRNA target sequence
accactaagcttatgtcccttatc

SEQ ID NO: 43230 - DNA, 24 bp, Artificial sequence
  SiRNA target sequence
ccactaagcttatgtcccttatct

SEQ ID NO: 43231 - DNA, 24 bp, Artificial sequence
  SiRNA target sequence
cactaagcttatgtcccttatctc

SEQ ID NO: 43232 - DNA, 24 bp, Artificial sequence
  SiRNA target sequence
actaagcttatgtcccttatctcc

SEQ ID NO: 43233 - DNA, 24 bp, Artificial sequence
  SiRNA target sequence
ctaagcttatgtcccttatctcca

SEQ ID NO: 43234 - DNA, 24 bp, Artificial sequence
  SiRNA target sequence
taagcttatgtcccttatctccaa

SEQ ID NO: 43235 - DNA, 24 bp, Artificial sequence
  SiRNA target sequence
aagcttatgtcccttatctccaac

SEQ ID NO: 43236 - DNA, 24 bp, Artificial sequence
  SiRNA target sequence
agcttatgtcccttatctccaaca

SEQ ID NO: 43237 - DNA, 24 bp, Artificial sequence
  SiRNA target sequence
gcttatgtcccttatctccaacat

SEQ ID NO: 43238 - DNA, 24 bp, Artificial sequence
  SiRNA target sequence
cttatgtcccttatctccaacatg

SEQ ID NO: 43239 - DNA, 24 bp, Artificial sequence
  SiRNA target sequence
ttatgtcccttatctccaacatgt

SEQ ID NO: 43240 - DNA, 24 bp, Artificial sequence
  SiRNA target sequence
tatgtcccttatctccaacatgtg

SEQ ID NO: 43241 - DNA, 24 bp, Artificial sequence
  SiRNA target sequence
atgtcccttatctccaacatgtgt

SEQ ID NO: 43242 - DNA, 24 bp, Artificial sequence
  SiRNA target sequence
tgtcccttatctccaacatgtgtg

SEQ ID NO: 43243 - DNA, 24 bp, Artificial sequence
  SiRNA target sequence
gtcccttatctccaacatgtgtgt

SEQ ID NO: 43244 - DNA, 24 bp, Artificial sequence
  SiRNA target sequence
tcccttatctccaacatgtgtgtt

SEQ ID NO: 43245 - DNA, 24 bp, Artificial sequence
  SiRNA target sequence
cccttatctccaacatgtgtgttg

SEQ ID NO: 43246 - DNA, 24 bp, Artificial sequence
  SiRNA target sequence
ccttatctccaacatgtgtgttgt

SEQ ID NO: 43247 - DNA, 24 bp, Artificial sequence
  SiRNA target sequence
cttatctccaacatgtgtgttgta

SEQ ID NO: 43248 - DNA, 24 bp, Artificial sequence
  SiRNA target sequence
ttatctccaacatgtgtgttgtat

SEQ ID NO: 43249 - DNA, 24 bp, Artificial sequence
  SiRNA target sequence
tatctccaacatgtgtgttgtatt

SEQ ID NO: 43250 - DNA, 24 bp, Artificial sequence
  SiRNA target sequence
atctccaacatgtgtgttgtattc

SEQ ID NO: 43251 - DNA, 24 bp, Artificial sequence
  SiRNA target sequence
tctccaacatgtgtgttgtattca

SEQ ID NO: 43252 - DNA, 24 bp, Artificial sequence
  SiRNA target sequence
ctccaacatgtgtgttgtattcat

SEQ ID NO: 43253 - DNA, 24 bp, Artificial sequence
  SiRNA target sequence
tccaacatgtgtgttgtattcatc

SEQ ID NO: 43254 - DNA, 24 bp, Artificial sequence
  SiRNA target sequence
ccaacatgtgtgttgtattcatcc

SEQ ID NO: 43255 - DNA, 24 bp, Artificial sequence
  SiRNA target sequence
caacatgtgtgttgtattcatcct

SEQ ID NO: 43256 - DNA, 24 bp, Artificial sequence
  SiRNA target sequence
aacatgtgtgttgtattcatcctc

SEQ ID NO: 43257 - DNA, 24 bp, Artificial sequence
  SiRNA target sequence
acatgtgtgttgtattcatcctct

SEQ ID NO: 43258 - DNA, 24 bp, Artificial sequence
  SiRNA target sequence
catgtgtgttgtattcatcctcta

SEQ ID NO: 43259 - DNA, 24 bp, Artificial sequence
  SiRNA target sequence
atgtgtgttgtattcatcctctag

SEQ ID NO: 43260 - DNA, 24 bp, Artificial sequence
  SiRNA target sequence
tgtgtgttgtattcatcctctagg

SEQ ID NO: 43261 - DNA, 24 bp, Artificial sequence
  SiRNA target sequence
gtgtgttgtattcatcctctaggt

SEQ ID NO: 43262 - DNA, 24 bp, Artificial sequence
  SiRNA target sequence
tgtgttgtattcatcctctaggtt

SEQ ID NO: 43263 - DNA, 24 bp, Artificial sequence
  SiRNA target sequence
gtgttgtattcatcctctaggttg

SEQ ID NO: 43264 - DNA, 24 bp, Artificial sequence
  SiRNA target sequence
tgttgtattcatcctctaggttgt

SEQ ID NO: 43265 - DNA, 24 bp, Artificial sequence
  SiRNA target sequence
gttgtattcatcctctaggttgtt

SEQ ID NO: 43266 - DNA, 24 bp, Artificial sequence
  SiRNA target sequence
ttgtattcatcctctaggttgttt

SEQ ID NO: 43267 - DNA, 24 bp, Artificial sequence
  SiRNA target sequence
tgtattcatcctctaggttgttta

SEQ ID NO: 43268 - DNA, 24 bp, Artificial sequence
  SiRNA target sequence
gtattcatcctctaggttgtttat

SEQ ID NO: 43269 - DNA, 24 bp, Artificial sequence
  SiRNA target sequence
tattcatcctctaggttgtttata

SEQ ID NO: 43270 - DNA, 24 bp, Artificial sequence
  SiRNA target sequence
attcatcctctaggttgtttatag

SEQ ID NO: 43271 - DNA, 24 bp, Artificial sequence
  SiRNA target sequence
ttcatcctctaggttgtttataga

SEQ ID NO: 43272 - DNA, 24 bp, Artificial sequence
  SiRNA target sequence
tcatcctctaggttgtttatagaa

SEQ ID NO: 43273 - DNA, 24 bp, Artificial sequence
  SiRNA target sequence
catcctctaggttgtttatagaat

SEQ ID NO: 43274 - DNA, 24 bp, Artificial sequence
  SiRNA target sequence
atcctctaggttgtttatagaatc

SEQ ID NO: 43275 - DNA, 24 bp, Artificial sequence
  SiRNA target sequence
tcctctaggttgtttatagaatcg

SEQ ID NO: 43276 - DNA, 24 bp, Artificial sequence
  SiRNA target sequence
cctctaggttgtttatagaatcgt

SEQ ID NO: 43277 - DNA, 24 bp, Artificial sequence
  SiRNA target sequence
ctctaggttgtttatagaatcgtg

SEQ ID NO: 43278 - DNA, 24 bp, Artificial sequence
  SiRNA target sequence
tctaggttgtttatagaatcgtgt

SEQ ID NO: 43279 - DNA, 24 bp, Artificial sequence
  SiRNA target sequence
ctaggttgtttatagaatcgtgta

SEQ ID NO: 43280 - DNA, 24 bp, Artificial sequence
  SiRNA target sequence
taggttgtttatagaatcgtgtac

SEQ ID NO: 43281 - DNA, 24 bp, Artificial sequence
  SiRNA target sequence
aggttgtttatagaatcgtgtaca

SEQ ID NO: 43282 - DNA, 24 bp, Artificial sequence
  SiRNA target sequence
ggttgtttatagaatcgtgtacac

SEQ ID NO: 43283 - DNA, 24 bp, Artificial sequence
  SiRNA target sequence
gttgtttatagaatcgtgtacaca

SEQ ID NO: 43284 - DNA, 24 bp, Artificial sequence
  SiRNA target sequence
ttgtttatagaatcgtgtacacaa

SEQ ID NO: 43285 - DNA, 24 bp, Artificial sequence
  SiRNA target sequence
tgtttatagaatcgtgtacacaaa

SEQ ID NO: 43286 - DNA, 24 bp, Artificial sequence
  SiRNA target sequence
gtttatagaatcgtgtacacaaag

SEQ ID NO: 43287 - DNA, 24 bp, Artificial sequence
  SiRNA target sequence
tttatagaatcgtgtacacaaagt

SEQ ID NO: 43288 - DNA, 24 bp, Artificial sequence
  SiRNA target sequence
ttatagaatcgtgtacacaaagtt

SEQ ID NO: 43289 - DNA, 24 bp, Artificial sequence
  SiRNA target sequence
tatagaatcgtgtacacaaagttt

SEQ ID NO: 43290 - DNA, 24 bp, Artificial sequence
  SiRNA target sequence
atagaatcgtgtacacaaagtttt

SEQ ID NO: 43291 - DNA, 24 bp, Artificial sequence
  SiRNA target sequence
tagaatcgtgtacacaaagttttt

SEQ ID NO: 43292 - DNA, 24 bp, Artificial sequence
  SiRNA target sequence
agaatcgtgtacacaaagtttttt

SEQ ID NO: 43293 - DNA, 24 bp, Artificial sequence
  SiRNA target sequence
gaatcgtgtacacaaagtttttta

SEQ ID NO: 43294 - DNA, 24 bp, Artificial sequence
  SiRNA target sequence
aatcgtgtacacaaagttttttac

SEQ ID NO: 43295 - DNA, 24 bp, Artificial sequence
  SiRNA target sequence
atcgtgtacacaaagttttttact

SEQ ID NO: 43296 - DNA, 24 bp, Artificial sequence
  SiRNA target sequence
tcgtgtacacaaagttttttactg

SEQ ID NO: 43297 - DNA, 24 bp, Artificial sequence
  SiRNA target sequence
cgtgtacacaaagttttttactga

SEQ ID NO: 43298 - DNA, 24 bp, Artificial sequence
  SiRNA target sequence
gtgtacacaaagttttttactgat

SEQ ID NO: 43299 - DNA, 24 bp, Artificial sequence
  SiRNA target sequence
tgtacacaaagttttttactgatt

SEQ ID NO: 43300 - DNA, 24 bp, Artificial sequence
  SiRNA target sequence
gtacacaaagttttttactgattt

SEQ ID NO: 43301 - DNA, 24 bp, Artificial sequence
  SiRNA target sequence
tacacaaagttttttactgatttt

SEQ ID NO: 43302 - DNA, 24 bp, Artificial sequence
  SiRNA target sequence
acacaaagttttttactgattttt

SEQ ID NO: 43303 - DNA, 24 bp, Artificial sequence
  SiRNA target sequence
cacaaagttttttactgattttta

SEQ ID NO: 43304 - DNA, 24 bp, Artificial sequence
  SiRNA target sequence
acaaagttttttactgatttttat

SEQ ID NO: 43305 - DNA, 24 bp, Artificial sequence
  SiRNA target sequence
caaagttttttactgatttttata

SEQ ID NO: 43306 - DNA, 24 bp, Artificial sequence
  SiRNA target sequence
aaagttttttactgatttttataa

SEQ ID NO: 43307 - DNA, 24 bp, Artificial sequence
  SiRNA target sequence
aagttttttactgatttttataac

SEQ ID NO: 43308 - DNA, 24 bp, Artificial sequence
  SiRNA target sequence
agttttttactgatttttataact

SEQ ID NO: 43309 - DNA, 24 bp, Artificial sequence
  SiRNA target sequence
gttttttactgatttttataactt

SEQ ID NO: 43310 - DNA, 24 bp, Artificial sequence
  SiRNA target sequence
ttttttactgatttttataacttc

SEQ ID NO: 43311 - DNA, 24 bp, Artificial sequence
  SiRNA target sequence
tttttactgatttttataacttct

SEQ ID NO: 43312 - DNA, 24 bp, Artificial sequence
  SiRNA target sequence
ttttactgatttttataacttctt

SEQ ID NO: 43313 - DNA, 24 bp, Artificial sequence
  SiRNA target sequence
tttactgatttttataacttcttc

SEQ ID NO: 43314 - DNA, 24 bp, Artificial sequence
  SiRNA target sequence
ttactgatttttataacttcttct

SEQ ID NO: 43315 - DNA, 24 bp, Artificial sequence
  SiRNA target sequence
tactgatttttataacttcttctt

SEQ ID NO: 43316 - DNA, 24 bp, Artificial sequence
  SiRNA target sequence
actgatttttataacttcttcttt

SEQ ID NO: 43317 - DNA, 24 bp, Artificial sequence
  SiRNA target sequence
ctgatttttataacttcttcttta

SEQ ID NO: 43318 - DNA, 24 bp, Artificial sequence
  SiRNA target sequence
tgatttttataacttcttctttat

SEQ ID NO: 43319 - DNA, 24 bp, Artificial sequence
  SiRNA target sequence
gatttttataacttcttctttatc

SEQ ID NO: 43320 - DNA, 24 bp, Artificial sequence
  SiRNA target sequence
atttttataacttcttctttatca

SEQ ID NO: 43321 - DNA, 24 bp, Artificial sequence
  SiRNA target sequence
tttttataacttcttctttatcaa

SEQ ID NO: 43322 - DNA, 24 bp, Artificial sequence
  SiRNA target sequence
ttttataacttcttctttatcaaa

SEQ ID NO: 43323 - DNA, 24 bp, Artificial sequence
  SiRNA target sequence
tttataacttcttctttatcaaat

SEQ ID NO: 43324 - DNA, 24 bp, Artificial sequence
  SiRNA target sequence
ttataacttcttctttatcaaata

SEQ ID NO: 43325 - DNA, 24 bp, Artificial sequence
  SiRNA target sequence
tataacttcttctttatcaaatat

SEQ ID NO: 43326 - DNA, 24 bp, Artificial sequence
  SiRNA target sequence
ataacttcttctttatcaaatatt

SEQ ID NO: 43327 - DNA, 24 bp, Artificial sequence
  SiRNA target sequence
taacttcttctttatcaaatattt

SEQ ID NO: 43328 - DNA, 24 bp, Artificial sequence
  SiRNA target sequence
aacttcttctttatcaaatatttc

SEQ ID NO: 43329 - DNA, 24 bp, Artificial sequence
  SiRNA target sequence
acttcttctttatcaaatatttct

SEQ ID NO: 43330 - DNA, 24 bp, Artificial sequence
  SiRNA target sequence
cttcttctttatcaaatatttctt

SEQ ID NO: 43331 - DNA, 24 bp, Artificial sequence
  SiRNA target sequence
ttcttctttatcaaatatttcttt

SEQ ID NO: 43332 - DNA, 24 bp, Artificial sequence
  SiRNA target sequence
tcttctttatcaaatatttctttt

SEQ ID NO: 43333 - DNA, 24 bp, Artificial sequence
  SiRNA target sequence
cttctttatcaaatatttcttttc

SEQ ID NO: 43334 - DNA, 24 bp, Artificial sequence
  SiRNA target sequence
ttctttatcaaatatttcttttcc

SEQ ID NO: 43335 - DNA, 24 bp, Artificial sequence
  SiRNA target sequence
tctttatcaaatatttcttttcca

SEQ ID NO: 43336 - DNA, 24 bp, Artificial sequence
  SiRNA target sequence
ctttatcaaatatttcttttccat

SEQ ID NO: 43337 - DNA, 24 bp, Artificial sequence
  SiRNA target sequence
tttatcaaatatttcttttccata

SEQ ID NO: 43338 - DNA, 24 bp, Artificial sequence
  SiRNA target sequence
ttatcaaatatttcttttccatat

SEQ ID NO: 43339 - DNA, 24 bp, Artificial sequence
  SiRNA target sequence
tatcaaatatttcttttccatatg

SEQ ID NO: 43340 - DNA, 24 bp, Artificial sequence
  SiRNA target sequence
atcaaatatttcttttccatatgt

SEQ ID NO: 43341 - DNA, 24 bp, Artificial sequence
  SiRNA target sequence
tcaaatatttcttttccatatgtt

SEQ ID NO: 43342 - DNA, 24 bp, Artificial sequence
  SiRNA target sequence
caaatatttcttttccatatgtta

SEQ ID NO: 43343 - DNA, 24 bp, Artificial sequence
  SiRNA target sequence
aaatatttcttttccatatgttaa

SEQ ID NO: 43344 - DNA, 24 bp, Artificial sequence
  SiRNA target sequence
aatatttcttttccatatgttaaa

SEQ ID NO: 43345 - DNA, 24 bp, Artificial sequence
  SiRNA target sequence
atatttcttttccatatgttaaat

SEQ ID NO: 43346 - DNA, 24 bp, Artificial sequence
  SiRNA target sequence
tatttcttttccatatgttaaatt

SEQ ID NO: 43347 - DNA, 24 bp, Artificial sequence
  SiRNA target sequence
atttcttttccatatgttaaatta

SEQ ID NO: 43348 - DNA, 24 bp, Artificial sequence
  SiRNA target sequence
tttcttttccatatgttaaattat

SEQ ID NO: 43349 - DNA, 24 bp, Artificial sequence
  SiRNA target sequence
ttcttttccatatgttaaattata

SEQ ID NO: 43350 - DNA, 24 bp, Artificial sequence
  SiRNA target sequence
tcttttccatatgttaaattataa

SEQ ID NO: 43351 - DNA, 24 bp, Artificial sequence
  SiRNA target sequence
cttttccatatgttaaattataat

SEQ ID NO: 43352 - DNA, 24 bp, Artificial sequence
  SiRNA target sequence
ttttccatatgttaaattataata

SEQ ID NO: 43353 - DNA, 24 bp, Artificial sequence
  SiRNA target sequence
tttccatatgttaaattataataa

SEQ ID NO: 43354 - DNA, 24 bp, Artificial sequence
  SiRNA target sequence
ttccatatgttaaattataataaa

SEQ ID NO: 43355 - DNA, 24 bp, Artificial sequence
  SiRNA target sequence
tccatatgttaaattataataaac

SEQ ID NO: 43356 - DNA, 24 bp, Artificial sequence
  SiRNA target sequence
ccatatgttaaattataataaacc

SEQ ID NO: 43357 - DNA, 24 bp, Artificial sequence
  SiRNA target sequence
catatgttaaattataataaaccg

SEQ ID NO: 43358 - DNA, 24 bp, Artificial sequence
  SiRNA target sequence
atatgttaaattataataaaccgt

SEQ ID NO: 43359 - DNA, 24 bp, Artificial sequence
  SiRNA target sequence
tatgttaaattataataaaccgtt

SEQ ID NO: 43360 - DNA, 24 bp, Artificial sequence
  SiRNA target sequence
atgttaaattataataaaccgttt

SEQ ID NO: 43361 - DNA, 24 bp, Artificial sequence
  SiRNA target sequence
tgttaaattataataaaccgtttc

SEQ ID NO: 43362 - DNA, 24 bp, Artificial sequence
  SiRNA target sequence
gttaaattataataaaccgtttcg

SEQ ID NO: 43363 - DNA, 24 bp, Artificial sequence
  SiRNA target sequence
ttaaattataataaaccgtttcgt

SEQ ID NO: 43364 - DNA, 24 bp, Artificial sequence
  SiRNA target sequence
taaattataataaaccgtttcgtt

SEQ ID NO: 43365 - DNA, 24 bp, Artificial sequence
  SiRNA target sequence
aaattataataaaccgtttcgtta

SEQ ID NO: 43366 - DNA, 24 bp, Artificial sequence
  SiRNA target sequence
aattataataaaccgtttcgttaa

SEQ ID NO: 43367 - DNA, 24 bp, Artificial sequence
  SiRNA target sequence
attataataaaccgtttcgttaaa

SEQ ID NO: 43368 - DNA, 24 bp, Artificial sequence
  SiRNA target sequence
ttataataaaccgtttcgttaaac

SEQ ID NO: 43369 - DNA, 24 bp, Artificial sequence
  SiRNA target sequence
tataataaaccgtttcgttaaaca

SEQ ID NO: 43370 - DNA, 24 bp, Artificial sequence
  SiRNA target sequence
ataataaaccgtttcgttaaacaa

SEQ ID NO: 43371 - DNA, 24 bp, Artificial sequence
  SiRNA target sequence
taataaaccgtttcgttaaacaaa

SEQ ID NO: 43372 - DNA, 24 bp, Artificial sequence
  SiRNA target sequence
aataaaccgtttcgttaaacaaaa

SEQ ID NO: 43373 - DNA, 24 bp, Artificial sequence
  SiRNA target sequence
ataaaccgtttcgttaaacaaaaa

SEQ ID NO: 43374 - DNA, 24 bp, Artificial sequence
  SiRNA target sequence
taaaccgtttcgttaaacaaaaat

SEQ ID NO: 43375 - DNA, 24 bp, Artificial sequence
  SiRNA target sequence
aaaccgtttcgttaaacaaaaatg

SEQ ID NO: 43376 - DNA, 24 bp, Artificial sequence
  SiRNA target sequence
aaccgtttcgttaaacaaaaatga

SEQ ID NO: 43377 - DNA, 24 bp, Artificial sequence
  SiRNA target sequence
accgtttcgttaaacaaaaatgag

SEQ ID NO: 43378 - DNA, 24 bp, Artificial sequence
  SiRNA target sequence
ccgtttcgttaaacaaaaatgagg

SEQ ID NO: 43379 - DNA, 24 bp, Artificial sequence
  SiRNA target sequence
cgtttcgttaaacaaaaatgaggt

SEQ ID NO: 43380 - DNA, 24 bp, Artificial sequence
  SiRNA target sequence
gtttcgttaaacaaaaatgaggtt

SEQ ID NO: 43381 - DNA, 24 bp, Artificial sequence
  SiRNA target sequence
tttcgttaaacaaaaatgaggttt

SEQ ID NO: 43382 - DNA, 24 bp, Artificial sequence
  SiRNA target sequence
ttcgttaaacaaaaatgaggtttg

SEQ ID NO: 43383 - DNA, 24 bp, Artificial sequence
  SiRNA target sequence
tcgttaaacaaaaatgaggtttgt

SEQ ID NO: 43384 - DNA, 24 bp, Artificial sequence
  SiRNA target sequence
cgttaaacaaaaatgaggtttgtg

SEQ ID NO: 43385 - DNA, 24 bp, Artificial sequence
  SiRNA target sequence
gttaaacaaaaatgaggtttgtgg

SEQ ID NO: 43386 - DNA, 24 bp, Artificial sequence
  SiRNA target sequence
ttaaacaaaaatgaggtttgtggt

SEQ ID NO: 43387 - DNA, 24 bp, Artificial sequence
  SiRNA target sequence
taaacaaaaatgaggtttgtggtg

SEQ ID NO: 43388 - DNA, 24 bp, Artificial sequence
  SiRNA target sequence
aaacaaaaatgaggtttgtggtgc

SEQ ID NO: 43389 - DNA, 24 bp, Artificial sequence
  SiRNA target sequence
aacaaaaatgaggtttgtggtgca

SEQ ID NO: 43390 - DNA, 24 bp, Artificial sequence
  SiRNA target sequence
acaaaaatgaggtttgtggtgcaa

SEQ ID NO: 43391 - DNA, 24 bp, Artificial sequence
  SiRNA target sequence
caaaaatgaggtttgtggtgcaaa

SEQ ID NO: 43392 - DNA, 24 bp, Artificial sequence
  SiRNA target sequence
aaaaatgaggtttgtggtgcaaat

SEQ ID NO: 43393 - DNA, 24 bp, Artificial sequence
  SiRNA target sequence
aaaatgaggtttgtggtgcaaatg

SEQ ID NO: 43394 - DNA, 24 bp, Artificial sequence
  SiRNA target sequence
aaatgaggtttgtggtgcaaatga

SEQ ID NO: 43395 - DNA, 24 bp, Artificial sequence
  SiRNA target sequence
aatgaggtttgtggtgcaaatgat

SEQ ID NO: 43396 - DNA, 24 bp, Artificial sequence
  SiRNA target sequence
atgaggtttgtggtgcaaatgata

SEQ ID NO: 43397 - DNA, 24 bp, Artificial sequence
  SiRNA target sequence
tgaggtttgtggtgcaaatgatat

SEQ ID NO: 43398 - DNA, 24 bp, Artificial sequence
  SiRNA target sequence
gaggtttgtggtgcaaatgatata

SEQ ID NO: 43399 - DNA, 24 bp, Artificial sequence
  SiRNA target sequence
aggtttgtggtgcaaatgatataa

SEQ ID NO: 43400 - DNA, 24 bp, Artificial sequence
  SiRNA target sequence
ggtttgtggtgcaaatgatataag

SEQ ID NO: 43401 - DNA, 24 bp, Artificial sequence
  SiRNA target sequence
gtttgtggtgcaaatgatataagt

SEQ ID NO: 43402 - DNA, 24 bp, Artificial sequence
  SiRNA target sequence
tttgtggtgcaaatgatataagtg

SEQ ID NO: 43403 - DNA, 24 bp, Artificial sequence
  SiRNA target sequence
ttgtggtgcaaatgatataagtga

SEQ ID NO: 43404 - DNA, 24 bp, Artificial sequence
  SiRNA target sequence
tgtggtgcaaatgatataagtgat

SEQ ID NO: 43405 - DNA, 24 bp, Artificial sequence
  SiRNA target sequence
gtggtgcaaatgatataagtgatc

SEQ ID NO: 43406 - DNA, 24 bp, Artificial sequence
  SiRNA target sequence
tggtgcaaatgatataagtgatct

SEQ ID NO: 43407 - DNA, 24 bp, Artificial sequence
  SiRNA target sequence
ggtgcaaatgatataagtgatcta

SEQ ID NO: 43408 - DNA, 24 bp, Artificial sequence
  SiRNA target sequence
gtgcaaatgatataagtgatctat

SEQ ID NO: 43409 - DNA, 24 bp, Artificial sequence
  SiRNA target sequence
tgcaaatgatataagtgatctata

SEQ ID NO: 43410 - DNA, 24 bp, Artificial sequence
  SiRNA target sequence
gcaaatgatataagtgatctatat

SEQ ID NO: 43411 - DNA, 24 bp, Artificial sequence
  SiRNA target sequence
caaatgatataagtgatctatatg

SEQ ID NO: 43412 - DNA, 24 bp, Artificial sequence
  SiRNA target sequence
aaatgatataagtgatctatatga

SEQ ID NO: 43413 - DNA, 24 bp, Artificial sequence
  SiRNA target sequence
aatgatataagtgatctatatgaa

SEQ ID NO: 43414 - DNA, 24 bp, Artificial sequence
  SiRNA target sequence
atgatataagtgatctatatgaac

SEQ ID NO: 43415 - DNA, 24 bp, Artificial sequence
  SiRNA target sequence
tgatataagtgatctatatgaact

SEQ ID NO: 43416 - DNA, 24 bp, Artificial sequence
  SiRNA target sequence
gatataagtgatctatatgaacta

SEQ ID NO: 43417 - DNA, 24 bp, Artificial sequence
  SiRNA target sequence
atataagtgatctatatgaactat

SEQ ID NO: 43418 - DNA, 24 bp, Artificial sequence
  SiRNA target sequence
tataagtgatctatatgaactatt

SEQ ID NO: 43419 - DNA, 24 bp, Artificial sequence
  SiRNA target sequence
ataagtgatctatatgaactatta

SEQ ID NO: 43420 - DNA, 24 bp, Artificial sequence
  SiRNA target sequence
taagtgatctatatgaactattag

SEQ ID NO: 43421 - DNA, 24 bp, Artificial sequence
  SiRNA target sequence
aagtgatctatatgaactattaga

SEQ ID NO: 43422 - DNA, 24 bp, Artificial sequence
  SiRNA target sequence
agtgatctatatgaactattagaa

SEQ ID NO: 43423 - DNA, 24 bp, Artificial sequence
  SiRNA target sequence
gtgatctatatgaactattagaaa

SEQ ID NO: 43424 - DNA, 24 bp, Artificial sequence
  SiRNA target sequence
tgatctatatgaactattagaaat

SEQ ID NO: 43425 - DNA, 24 bp, Artificial sequence
  SiRNA target sequence
gatctatatgaactattagaaatt

SEQ ID NO: 43426 - DNA, 24 bp, Artificial sequence
  SiRNA target sequence
atctatatgaactattagaaattt

SEQ ID NO: 43427 - DNA, 24 bp, Artificial sequence
  SiRNA target sequence
tctatatgaactattagaaatttc

SEQ ID NO: 43428 - DNA, 24 bp, Artificial sequence
  SiRNA target sequence
ctatatgaactattagaaatttct

SEQ ID NO: 43429 - DNA, 24 bp, Artificial sequence
  SiRNA target sequence
tatatgaactattagaaatttctt

SEQ ID NO: 43430 - DNA, 24 bp, Artificial sequence
  SiRNA target sequence
atatgaactattagaaatttcttt

SEQ ID NO: 43431 - DNA, 24 bp, Artificial sequence
  SiRNA target sequence
tatgaactattagaaatttctttt

SEQ ID NO: 43432 - DNA, 24 bp, Artificial sequence
  SiRNA target sequence
atgaactattagaaatttctttta

SEQ ID NO: 43433 - DNA, 24 bp, Artificial sequence
  SiRNA target sequence
tgaactattagaaatttcttttat

SEQ ID NO: 43434 - DNA, 24 bp, Artificial sequence
  SiRNA target sequence
gaactattagaaatttcttttata

SEQ ID NO: 43435 - DNA, 24 bp, Artificial sequence
  SiRNA target sequence
aactattagaaatttcttttatat

SEQ ID NO: 43436 - DNA, 24 bp, Artificial sequence
  SiRNA target sequence
actattagaaatttcttttatatc

SEQ ID NO: 43437 - DNA, 24 bp, Artificial sequence
  SiRNA target sequence
ctattagaaatttcttttatatct

SEQ ID NO: 43438 - DNA, 24 bp, Artificial sequence
  SiRNA target sequence
tattagaaatttcttttatatctc

SEQ ID NO: 43439 - DNA, 24 bp, Artificial sequence
  SiRNA target sequence
attagaaatttcttttatatctcg

SEQ ID NO: 43440 - DNA, 24 bp, Artificial sequence
  SiRNA target sequence
ttagaaatttcttttatatctcga

SEQ ID NO: 43441 - DNA, 24 bp, Artificial sequence
  SiRNA target sequence
tagaaatttcttttatatctcgat

SEQ ID NO: 43442 - DNA, 24 bp, Artificial sequence
  SiRNA target sequence
agaaatttcttttatatctcgatt

SEQ ID NO: 43443 - DNA, 24 bp, Artificial sequence
  SiRNA target sequence
gaaatttcttttatatctcgatta

SEQ ID NO: 43444 - DNA, 24 bp, Artificial sequence
  SiRNA target sequence
aaatttcttttatatctcgattat

SEQ ID NO: 43445 - DNA, 24 bp, Artificial sequence
  SiRNA target sequence
aatttcttttatatctcgattatc

SEQ ID NO: 43446 - DNA, 24 bp, Artificial sequence
  SiRNA target sequence
atttcttttatatctcgattatct

SEQ ID NO: 43447 - DNA, 24 bp, Artificial sequence
  SiRNA target sequence
tttcttttatatctcgattatcta

SEQ ID NO: 43448 - DNA, 24 bp, Artificial sequence
  SiRNA target sequence
ttcttttatatctcgattatctag

SEQ ID NO: 43449 - DNA, 24 bp, Artificial sequence
  SiRNA target sequence
tcttttatatctcgattatctaga

SEQ ID NO: 43450 - DNA, 24 bp, Artificial sequence
  SiRNA target sequence
cttttatatctcgattatctagat

SEQ ID NO: 43451 - DNA, 24 bp, Artificial sequence
  SiRNA target sequence
ttttatatctcgattatctagata

SEQ ID NO: 43452 - DNA, 24 bp, Artificial sequence
  SiRNA target sequence
tttatatctcgattatctagataa

SEQ ID NO: 43453 - DNA, 24 bp, Artificial sequence
  SiRNA target sequence
ttatatctcgattatctagataaa

SEQ ID NO: 43454 - DNA, 24 bp, Artificial sequence
  SiRNA target sequence
tatatctcgattatctagataaat

SEQ ID NO: 43455 - DNA, 24 bp, Artificial sequence
  SiRNA target sequence
atatctcgattatctagataaata

SEQ ID NO: 43456 - DNA, 24 bp, Artificial sequence
  SiRNA target sequence
tatctcgattatctagataaatat

SEQ ID NO: 43457 - DNA, 24 bp, Artificial sequence
  SiRNA target sequence
atctcgattatctagataaatatt

SEQ ID NO: 43458 - DNA, 24 bp, Artificial sequence
  SiRNA target sequence
tctcgattatctagataaatattt

SEQ ID NO: 43459 - DNA, 24 bp, Artificial sequence
  SiRNA target sequence
ctcgattatctagataaatatttc

SEQ ID NO: 43460 - DNA, 24 bp, Artificial sequence
  SiRNA target sequence
tcgattatctagataaatatttcc

SEQ ID NO: 43461 - DNA, 24 bp, Artificial sequence
  SiRNA target sequence
cgattatctagataaatatttccc

SEQ ID NO: 43462 - DNA, 24 bp, Artificial sequence
  SiRNA target sequence
gattatctagataaatatttcccc

SEQ ID NO: 43463 - DNA, 24 bp, Artificial sequence
  SiRNA target sequence
attatctagataaatatttccccc

SEQ ID NO: 43464 - DNA, 24 bp, Artificial sequence
  SiRNA target sequence
ttatctagataaatatttccccca

SEQ ID NO: 43465 - DNA, 24 bp, Artificial sequence
  SiRNA target sequence
tatctagataaatatttcccccat

SEQ ID NO: 43466 - DNA, 24 bp, Artificial sequence
  SiRNA target sequence
atctagataaatatttcccccata

SEQ ID NO: 43467 - DNA, 24 bp, Artificial sequence
  SiRNA target sequence
tctagataaatatttcccccataa

SEQ ID NO: 43468 - DNA, 24 bp, Artificial sequence
  SiRNA target sequence
ctagataaatatttcccccataat

SEQ ID NO: 43469 - DNA, 24 bp, Artificial sequence
  SiRNA target sequence
tagataaatatttcccccataatt

SEQ ID NO: 43470 - DNA, 24 bp, Artificial sequence
  SiRNA target sequence
agataaatatttcccccataattt

SEQ ID NO: 43471 - DNA, 24 bp, Artificial sequence
  SiRNA target sequence
gataaatatttcccccataatttt

SEQ ID NO: 43472 - DNA, 24 bp, Artificial sequence
  SiRNA target sequence
ataaatatttcccccataattttc

SEQ ID NO: 43473 - DNA, 24 bp, Artificial sequence
  SiRNA target sequence
taaatatttcccccataattttca

SEQ ID NO: 43474 - DNA, 24 bp, Artificial sequence
  SiRNA target sequence
aaatatttcccccataattttcaa

SEQ ID NO: 43475 - DNA, 24 bp, Artificial sequence
  SiRNA target sequence
aatatttcccccataattttcaaa

SEQ ID NO: 43476 - DNA, 24 bp, Artificial sequence
  SiRNA target sequence
atatttcccccataattttcaaat

SEQ ID NO: 43477 - DNA, 24 bp, Artificial sequence
  SiRNA target sequence
tatttcccccataattttcaaatc

SEQ ID NO: 43478 - DNA, 24 bp, Artificial sequence
  SiRNA target sequence
atttcccccataattttcaaatct

SEQ ID NO: 43479 - DNA, 24 bp, Artificial sequence
  SiRNA target sequence
tttcccccataattttcaaatctc

SEQ ID NO: 43480 - DNA, 24 bp, Artificial sequence
  SiRNA target sequence
ttcccccataattttcaaatctca

SEQ ID NO: 43481 - DNA, 24 bp, Artificial sequence
  SiRNA target sequence
tcccccataattttcaaatctcat

SEQ ID NO: 43482 - DNA, 24 bp, Artificial sequence
  SiRNA target sequence
cccccataattttcaaatctcata

SEQ ID NO: 43483 - DNA, 24 bp, Artificial sequence
  SiRNA target sequence
ccccataattttcaaatctcataa

SEQ ID NO: 43484 - DNA, 24 bp, Artificial sequence
  SiRNA target sequence
cccataattttcaaatctcataat

SEQ ID NO: 43485 - DNA, 24 bp, Artificial sequence
  SiRNA target sequence
ccataattttcaaatctcataatc

SEQ ID NO: 43486 - DNA, 24 bp, Artificial sequence
  SiRNA target sequence
cataattttcaaatctcataatca

SEQ ID NO: 43487 - DNA, 24 bp, Artificial sequence
  SiRNA target sequence
ataattttcaaatctcataatcat

SEQ ID NO: 43488 - DNA, 24 bp, Artificial sequence
  SiRNA target sequence
taattttcaaatctcataatcatc

SEQ ID NO: 43489 - DNA, 24 bp, Artificial sequence
  SiRNA target sequence
aattttcaaatctcataatcatct

SEQ ID NO: 43490 - DNA, 24 bp, Artificial sequence
  SiRNA target sequence
attttcaaatctcataatcatctt

SEQ ID NO: 43491 - DNA, 24 bp, Artificial sequence
  SiRNA target sequence
ttttcaaatctcataatcatcttt

SEQ ID NO: 43492 - DNA, 24 bp, Artificial sequence
  SiRNA target sequence
tttcaaatctcataatcatcttta

SEQ ID NO: 43493 - DNA, 24 bp, Artificial sequence
  SiRNA target sequence
ttcaaatctcataatcatctttat

SEQ ID NO: 43494 - DNA, 24 bp, Artificial sequence
  SiRNA target sequence
tcaaatctcataatcatctttata

SEQ ID NO: 43495 - DNA, 24 bp, Artificial sequence
  SiRNA target sequence
caaatctcataatcatctttataa

SEQ ID NO: 43496 - DNA, 24 bp, Artificial sequence
  SiRNA target sequence
aaatctcataatcatctttataag

SEQ ID NO: 43497 - DNA, 24 bp, Artificial sequence
  SiRNA target sequence
aatctcataatcatctttataaga

SEQ ID NO: 43498 - DNA, 24 bp, Artificial sequence
  SiRNA target sequence
atctcataatcatctttataagag

SEQ ID NO: 43499 - DNA, 24 bp, Artificial sequence
  SiRNA target sequence
tctcataatcatctttataagaga

SEQ ID NO: 43500 - DNA, 24 bp, Artificial sequence
  SiRNA target sequence
ctcataatcatctttataagagat

SEQ ID NO: 43501 - DNA, 24 bp, Artificial sequence
  SiRNA target sequence
tcataatcatctttataagagatg

SEQ ID NO: 43502 - DNA, 24 bp, Artificial sequence
  SiRNA target sequence
cataatcatctttataagagatgt

SEQ ID NO: 43503 - DNA, 24 bp, Artificial sequence
  SiRNA target sequence
ataatcatctttataagagatgtt

SEQ ID NO: 43504 - DNA, 24 bp, Artificial sequence
  SiRNA target sequence
taatcatctttataagagatgttt

SEQ ID NO: 43505 - DNA, 24 bp, Artificial sequence
  SiRNA target sequence
aatcatctttataagagatgtttt

SEQ ID NO: 43506 - DNA, 24 bp, Artificial sequence
  SiRNA target sequence
atcatctttataagagatgttttt

SEQ ID NO: 43507 - DNA, 24 bp, Artificial sequence
  SiRNA target sequence
tcatctttataagagatgtttttc

SEQ ID NO: 43508 - DNA, 24 bp, Artificial sequence
  SiRNA target sequence
catctttataagagatgtttttcc

SEQ ID NO: 43509 - DNA, 24 bp, Artificial sequence
  SiRNA target sequence
atctttataagagatgtttttccc

SEQ ID NO: 43510 - DNA, 24 bp, Artificial sequence
  SiRNA target sequence
tctttataagagatgtttttcccg

SEQ ID NO: 43511 - DNA, 24 bp, Artificial sequence
  SiRNA target sequence
ctttataagagatgtttttcccga

SEQ ID NO: 43512 - DNA, 24 bp, Artificial sequence
  SiRNA target sequence
tttataagagatgtttttcccgat

SEQ ID NO: 43513 - DNA, 24 bp, Artificial sequence
  SiRNA target sequence
ttataagagatgtttttcccgatc

SEQ ID NO: 43514 - DNA, 24 bp, Artificial sequence
  SiRNA target sequence
tataagagatgtttttcccgatcc

SEQ ID NO: 43515 - DNA, 24 bp, Artificial sequence
  SiRNA target sequence
ataagagatgtttttcccgatcca

SEQ ID NO: 43516 - DNA, 24 bp, Artificial sequence
  SiRNA target sequence
taagagatgtttttcccgatccat

SEQ ID NO: 43517 - DNA, 24 bp, Artificial sequence
  SiRNA target sequence
aagagatgtttttcccgatccatt

SEQ ID NO: 43518 - DNA, 24 bp, Artificial sequence
  SiRNA target sequence
agagatgtttttcccgatccattt

SEQ ID NO: 43519 - DNA, 24 bp, Artificial sequence
  SiRNA target sequence
gagatgtttttcccgatccatttt

SEQ ID NO: 43520 - DNA, 24 bp, Artificial sequence
  SiRNA target sequence
agatgtttttcccgatccattttt

SEQ ID NO: 43521 - DNA, 24 bp, Artificial sequence
  SiRNA target sequence
gatgtttttcccgatccatttttt

SEQ ID NO: 43522 - DNA, 24 bp, Artificial sequence
  SiRNA target sequence
atgtttttcccgatccattttttc

SEQ ID NO: 43523 - DNA, 24 bp, Artificial sequence
  SiRNA target sequence
tgtttttcccgatccattttttcc

SEQ ID NO: 43524 - DNA, 24 bp, Artificial sequence
  SiRNA target sequence
gtttttcccgatccattttttcca

SEQ ID NO: 43525 - DNA, 24 bp, Artificial sequence
  SiRNA target sequence
tttttcccgatccattttttccaa

SEQ ID NO: 43526 - DNA, 24 bp, Artificial sequence
  SiRNA target sequence
ttttcccgatccattttttccaat

SEQ ID NO: 43527 - DNA, 24 bp, Artificial sequence
  SiRNA target sequence
tttcccgatccattttttccaata

SEQ ID NO: 43528 - DNA, 24 bp, Artificial sequence
  SiRNA target sequence
ttcccgatccattttttccaataa

SEQ ID NO: 43529 - DNA, 24 bp, Artificial sequence
  SiRNA target sequence
tcccgatccattttttccaataat

SEQ ID NO: 43530 - DNA, 24 bp, Artificial sequence
  SiRNA target sequence
cccgatccattttttccaataata

SEQ ID NO: 43531 - DNA, 24 bp, Artificial sequence
  SiRNA target sequence
ccgatccattttttccaataatag

SEQ ID NO: 43532 - DNA, 24 bp, Artificial sequence
  SiRNA target sequence
cgatccattttttccaataatagc

SEQ ID NO: 43533 - DNA, 24 bp, Artificial sequence
  SiRNA target sequence
gatccattttttccaataatagct

SEQ ID NO: 43534 - DNA, 24 bp, Artificial sequence
  SiRNA target sequence
atccattttttccaataatagcta

SEQ ID NO: 43535 - DNA, 24 bp, Artificial sequence
  SiRNA target sequence
tccattttttccaataatagctac

SEQ ID NO: 43536 - DNA, 24 bp, Artificial sequence
  SiRNA target sequence
ccattttttccaataatagctact

SEQ ID NO: 43537 - DNA, 24 bp, Artificial sequence
  SiRNA target sequence
cattttttccaataatagctactt

SEQ ID NO: 43538 - DNA, 24 bp, Artificial sequence
  SiRNA target sequence
attttttccaataatagctacttt

SEQ ID NO: 43539 - DNA, 24 bp, Artificial sequence
  SiRNA target sequence
ttttttccaataatagctactttt

SEQ ID NO: 43540 - DNA, 24 bp, Artificial sequence
  SiRNA target sequence
tttttccaataatagctacttttt

SEQ ID NO: 43541 - DNA, 24 bp, Artificial sequence
  SiRNA target sequence
ttttccaataatagctactttttc

SEQ ID NO: 43542 - DNA, 24 bp, Artificial sequence
  SiRNA target sequence
tttccaataatagctactttttca

SEQ ID NO: 43543 - DNA, 24 bp, Artificial sequence
  SiRNA target sequence
ttccaataatagctactttttcac

SEQ ID NO: 43544 - DNA, 24 bp, Artificial sequence
  SiRNA target sequence
tccaataatagctactttttcacc

SEQ ID NO: 43545 - DNA, 24 bp, Artificial sequence
  SiRNA target sequence
ccaataatagctactttttcacct

SEQ ID NO: 43546 - DNA, 24 bp, Artificial sequence
  SiRNA target sequence
caataatagctactttttcacctt

SEQ ID NO: 43547 - DNA, 24 bp, Artificial sequence
  SiRNA target sequence
aataatagctactttttcaccttt

SEQ ID NO: 43548 - DNA, 24 bp, Artificial sequence
  SiRNA target sequence
ataatagctactttttcacctttt

SEQ ID NO: 43549 - DNA, 24 bp, Artificial sequence
  SiRNA target sequence
taatagctactttttcaccttttt

SEQ ID NO: 43550 - DNA, 24 bp, Artificial sequence
  SiRNA target sequence
aatagctactttttcacctttttt

SEQ ID NO: 43551 - DNA, 24 bp, Artificial sequence
  SiRNA target sequence
atagctactttttcacctttttta

SEQ ID NO: 43552 - DNA, 24 bp, Artificial sequence
  SiRNA target sequence
tagctactttttcaccttttttaa

SEQ ID NO: 43553 - DNA, 24 bp, Artificial sequence
  SiRNA target sequence
agctactttttcaccttttttaat

SEQ ID NO: 43554 - DNA, 24 bp, Artificial sequence
  SiRNA target sequence
gctactttttcaccttttttaatt

SEQ ID NO: 43555 - DNA, 24 bp, Artificial sequence
  SiRNA target sequence
ctactttttcaccttttttaatta

SEQ ID NO: 43556 - DNA, 24 bp, Artificial sequence
  SiRNA target sequence
tactttttcaccttttttaattaa

SEQ ID NO: 43557 - DNA, 24 bp, Artificial sequence
  SiRNA target sequence
actttttcaccttttttaattaaa

SEQ ID NO: 43558 - DNA, 24 bp, Artificial sequence
  SiRNA target sequence
ctttttcaccttttttaattaaaa

SEQ ID NO: 43559 - DNA, 24 bp, Artificial sequence
  SiRNA target sequence
tttttcaccttttttaattaaaat

SEQ ID NO: 43560 - DNA, 24 bp, Artificial sequence
  SiRNA target sequence
ttttcaccttttttaattaaaata

SEQ ID NO: 43561 - DNA, 24 bp, Artificial sequence
  SiRNA target sequence
tttcaccttttttaattaaaatat

SEQ ID NO: 43562 - DNA, 24 bp, Artificial sequence
  SiRNA target sequence
ttcaccttttttaattaaaatatt

SEQ ID NO: 43563 - DNA, 24 bp, Artificial sequence
  SiRNA target sequence
tcaccttttttaattaaaatattt

SEQ ID NO: 43564 - DNA, 24 bp, Artificial sequence
  SiRNA target sequence
caccttttttaattaaaatattta

SEQ ID NO: 43565 - DNA, 24 bp, Artificial sequence
  SiRNA target sequence
accttttttaattaaaatatttat

SEQ ID NO: 43566 - DNA, 24 bp, Artificial sequence
  SiRNA target sequence
ccttttttaattaaaatatttatg

SEQ ID NO: 43567 - DNA, 24 bp, Artificial sequence
  SiRNA target sequence
cttttttaattaaaatatttatgt

SEQ ID NO: 43568 - DNA, 24 bp, Artificial sequence
  SiRNA target sequence
ttttttaattaaaatatttatgtc

SEQ ID NO: 43569 - DNA, 24 bp, Artificial sequence
  SiRNA target sequence
tttttaattaaaatatttatgtcc

SEQ ID NO: 43570 - DNA, 24 bp, Artificial sequence
  SiRNA target sequence
ttttaattaaaatatttatgtccg

SEQ ID NO: 43571 - DNA, 24 bp, Artificial sequence
  SiRNA target sequence
tttaattaaaatatttatgtccgt

SEQ ID NO: 43572 - DNA, 24 bp, Artificial sequence
  SiRNA target sequence
ttaattaaaatatttatgtccgtt

SEQ ID NO: 43573 - DNA, 24 bp, Artificial sequence
  SiRNA target sequence
taattaaaatatttatgtccgtta

SEQ ID NO: 43574 - DNA, 24 bp, Artificial sequence
  SiRNA target sequence
aattaaaatatttatgtccgttaa

SEQ ID NO: 43575 - DNA, 24 bp, Artificial sequence
  SiRNA target sequence
attaaaatatttatgtccgttaaa

SEQ ID NO: 43576 - DNA, 24 bp, Artificial sequence
  SiRNA target sequence
ttaaaatatttatgtccgttaaaa

SEQ ID NO: 43577 - DNA, 24 bp, Artificial sequence
  SiRNA target sequence
taaaatatttatgtccgttaaaat

SEQ ID NO: 43578 - DNA, 24 bp, Artificial sequence
  SiRNA target sequence
aaaatatttatgtccgttaaaatt

SEQ ID NO: 43579 - DNA, 24 bp, Artificial sequence
  SiRNA target sequence
aaatatttatgtccgttaaaattt

SEQ ID NO: 43580 - DNA, 24 bp, Artificial sequence
  SiRNA target sequence
aatatttatgtccgttaaaatttt

SEQ ID NO: 43581 - DNA, 24 bp, Artificial sequence
  SiRNA target sequence
atatttatgtccgttaaaattttt

SEQ ID NO: 43582 - DNA, 24 bp, Artificial sequence
  SiRNA target sequence
tatttatgtccgttaaaatttttt

SEQ ID NO: 43583 - DNA, 24 bp, Artificial sequence
  SiRNA target sequence
atttatgtccgttaaaattttttt

SEQ ID NO: 43584 - DNA, 24 bp, Artificial sequence
  SiRNA target sequence
tttatgtccgttaaaatttttttg

SEQ ID NO: 43585 - DNA, 24 bp, Artificial sequence
  SiRNA target sequence
ttatgtccgttaaaatttttttgg

SEQ ID NO: 43586 - DNA, 24 bp, Artificial sequence
  SiRNA target sequence
tatgtccgttaaaatttttttgga

SEQ ID NO: 43587 - DNA, 24 bp, Artificial sequence
  SiRNA target sequence
atgtccgttaaaatttttttggag

SEQ ID NO: 43588 - DNA, 24 bp, Artificial sequence
  SiRNA target sequence
tgtccgttaaaatttttttggagt

SEQ ID NO: 43589 - DNA, 24 bp, Artificial sequence
  SiRNA target sequence
gtccgttaaaatttttttggagta

SEQ ID NO: 43590 - DNA, 24 bp, Artificial sequence
  SiRNA target sequence
tccgttaaaatttttttggagtaa

SEQ ID NO: 43591 - DNA, 24 bp, Artificial sequence
  SiRNA target sequence
ccgttaaaatttttttggagtaat

SEQ ID NO: 43592 - DNA, 24 bp, Artificial sequence
  SiRNA target sequence
cgttaaaatttttttggagtaata

SEQ ID NO: 43593 - DNA, 24 bp, Artificial sequence
  SiRNA target sequence
gttaaaatttttttggagtaataa

SEQ ID NO: 43594 - DNA, 24 bp, Artificial sequence
  SiRNA target sequence
ttaaaatttttttggagtaataat

SEQ ID NO: 43595 - DNA, 24 bp, Artificial sequence
  SiRNA target sequence
taaaatttttttggagtaataatt

SEQ ID NO: 43596 - DNA, 24 bp, Artificial sequence
  SiRNA target sequence
aaaatttttttggagtaataatta

SEQ ID NO: 43597 - DNA, 24 bp, Artificial sequence
  SiRNA target sequence
aaatttttttggagtaataattaa

SEQ ID NO: 43598 - DNA, 24 bp, Artificial sequence
  SiRNA target sequence
aatttttttggagtaataattaaa

SEQ ID NO: 43599 - DNA, 24 bp, Artificial sequence
  SiRNA target sequence
atttttttggagtaataattaaat

SEQ ID NO: 43600 - DNA, 24 bp, Artificial sequence
  SiRNA target sequence
tttttttggagtaataattaaatg

SEQ ID NO: 43601 - DNA, 24 bp, Artificial sequence
  SiRNA target sequence
ttttttggagtaataattaaatga

SEQ ID NO: 43602 - DNA, 24 bp, Artificial sequence
  SiRNA target sequence
tttttggagtaataattaaatgat

SEQ ID NO: 43603 - DNA, 24 bp, Artificial sequence
  SiRNA target sequence
ttttggagtaataattaaatgatg

SEQ ID NO: 43604 - DNA, 24 bp, Artificial sequence
  SiRNA target sequence
tttggagtaataattaaatgatgc

SEQ ID NO: 43605 - DNA, 24 bp, Artificial sequence
  SiRNA target sequence
ttggagtaataattaaatgatgca

SEQ ID NO: 43606 - DNA, 24 bp, Artificial sequence
  SiRNA target sequence
tggagtaataattaaatgatgcat

SEQ ID NO: 43607 - DNA, 24 bp, Artificial sequence
  SiRNA target sequence
ggagtaataattaaatgatgcatt

SEQ ID NO: 43608 - DNA, 24 bp, Artificial sequence
  SiRNA target sequence
gagtaataattaaatgatgcattt

SEQ ID NO: 43609 - DNA, 24 bp, Artificial sequence
  SiRNA target sequence
agtaataattaaatgatgcatttt

SEQ ID NO: 43610 - DNA, 24 bp, Artificial sequence
  SiRNA target sequence
gtaataattaaatgatgcattttc

SEQ ID NO: 43611 - DNA, 24 bp, Artificial sequence
  SiRNA target sequence
taataattaaatgatgcattttct

SEQ ID NO: 43612 - DNA, 24 bp, Artificial sequence
  SiRNA target sequence
aataattaaatgatgcattttcta

SEQ ID NO: 43613 - DNA, 24 bp, Artificial sequence
  SiRNA target sequence
ataattaaatgatgcattttctaa

SEQ ID NO: 43614 - DNA, 24 bp, Artificial sequence
  SiRNA target sequence
taattaaatgatgcattttctaat

SEQ ID NO: 43615 - DNA, 24 bp, Artificial sequence
  SiRNA target sequence
aattaaatgatgcattttctaatc

SEQ ID NO: 43616 - DNA, 24 bp, Artificial sequence
  SiRNA target sequence
attaaatgatgcattttctaatct

SEQ ID NO: 43617 - DNA, 24 bp, Artificial sequence
  SiRNA target sequence
ttaaatgatgcattttctaatctt

SEQ ID NO: 43618 - DNA, 24 bp, Artificial sequence
  SiRNA target sequence
taaatgatgcattttctaatctta

SEQ ID NO: 43619 - DNA, 24 bp, Artificial sequence
  SiRNA target sequence
aaatgatgcattttctaatcttat

SEQ ID NO: 43620 - DNA, 24 bp, Artificial sequence
  SiRNA target sequence
aatgatgcattttctaatcttata

SEQ ID NO: 43621 - DNA, 24 bp, Artificial sequence
  SiRNA target sequence
atgatgcattttctaatcttatat

SEQ ID NO: 43622 - DNA, 24 bp, Artificial sequence
  SiRNA target sequence
tgatgcattttctaatcttatatc

SEQ ID NO: 43623 - DNA, 24 bp, Artificial sequence
  SiRNA target sequence
gatgcattttctaatcttatatca

SEQ ID NO: 43624 - DNA, 24 bp, Artificial sequence
  SiRNA target sequence
atgcattttctaatcttatatcat

SEQ ID NO: 43625 - DNA, 24 bp, Artificial sequence
  SiRNA target sequence
tgcattttctaatcttatatcatt

SEQ ID NO: 43626 - DNA, 24 bp, Artificial sequence
  SiRNA target sequence
gcattttctaatcttatatcatta

SEQ ID NO: 43627 - DNA, 24 bp, Artificial sequence
  SiRNA target sequence
cattttctaatcttatatcattat

SEQ ID NO: 43628 - DNA, 24 bp, Artificial sequence
  SiRNA target sequence
attttctaatcttatatcattatt

SEQ ID NO: 43629 - DNA, 24 bp, Artificial sequence
  SiRNA target sequence
ttttctaatcttatatcattatta

SEQ ID NO: 43630 - DNA, 24 bp, Artificial sequence
  SiRNA target sequence
tttctaatcttatatcattattaa

SEQ ID NO: 43631 - DNA, 24 bp, Artificial sequence
  SiRNA target sequence
ttctaatcttatatcattattaaa

SEQ ID NO: 43632 - DNA, 24 bp, Artificial sequence
  SiRNA target sequence
tctaatcttatatcattattaaat

SEQ ID NO: 43633 - DNA, 24 bp, Artificial sequence
  SiRNA target sequence
ctaatcttatatcattattaaatt

SEQ ID NO: 43634 - DNA, 24 bp, Artificial sequence
  SiRNA target sequence
taatcttatatcattattaaattc

SEQ ID NO: 43635 - DNA, 24 bp, Artificial sequence
  SiRNA target sequence
aatcttatatcattattaaattca

SEQ ID NO: 43636 - DNA, 24 bp, Artificial sequence
  SiRNA target sequence
atcttatatcattattaaattcat

SEQ ID NO: 43637 - DNA, 24 bp, Artificial sequence
  SiRNA target sequence
tcttatatcattattaaattcatt

SEQ ID NO: 43638 - DNA, 24 bp, Artificial sequence
  SiRNA target sequence
cttatatcattattaaattcatta

SEQ ID NO: 43639 - DNA, 24 bp, Artificial sequence
  SiRNA target sequence
ttatatcattattaaattcattaa

SEQ ID NO: 43640 - DNA, 24 bp, Artificial sequence
  SiRNA target sequence
tatatcattattaaattcattaac

SEQ ID NO: 43641 - DNA, 24 bp, Artificial sequence
  SiRNA target sequence
atatcattattaaattcattaaca

SEQ ID NO: 43642 - DNA, 24 bp, Artificial sequence
  SiRNA target sequence
tatcattattaaattcattaacat

SEQ ID NO: 43643 - DNA, 24 bp, Artificial sequence
  SiRNA target sequence
atcattattaaattcattaacatc

SEQ ID NO: 43644 - DNA, 24 bp, Artificial sequence
  SiRNA target sequence
tcattattaaattcattaacatct

SEQ ID NO: 43645 - DNA, 24 bp, Artificial sequence
  SiRNA target sequence
cattattaaattcattaacatcta

SEQ ID NO: 43646 - DNA, 24 bp, Artificial sequence
  SiRNA target sequence
attattaaattcattaacatctac

SEQ ID NO: 43647 - DNA, 24 bp, Artificial sequence
  SiRNA target sequence
ttattaaattcattaacatctact

SEQ ID NO: 43648 - DNA, 24 bp, Artificial sequence
  SiRNA target sequence
tattaaattcattaacatctacta

SEQ ID NO: 43649 - DNA, 24 bp, Artificial sequence
  SiRNA target sequence
attaaattcattaacatctactaa

SEQ ID NO: 43650 - DNA, 24 bp, Artificial sequence
  SiRNA target sequence
ttaaattcattaacatctactaaa

SEQ ID NO: 43651 - DNA, 24 bp, Artificial sequence
  SiRNA target sequence
taaattcattaacatctactaaat

SEQ ID NO: 43652 - DNA, 24 bp, Artificial sequence
  SiRNA target sequence
aaattcattaacatctactaaatt

SEQ ID NO: 43653 - DNA, 24 bp, Artificial sequence
  SiRNA target sequence
aattcattaacatctactaaattt

SEQ ID NO: 43654 - DNA, 24 bp, Artificial sequence
  SiRNA target sequence
attcattaacatctactaaatttg

SEQ ID NO: 43655 - DNA, 24 bp, Artificial sequence
  SiRNA target sequence
ttcattaacatctactaaatttgg

SEQ ID NO: 43656 - DNA, 24 bp, Artificial sequence
  SiRNA target sequence
tcattaacatctactaaatttggt

SEQ ID NO: 43657 - DNA, 24 bp, Artificial sequence
  SiRNA target sequence
cattaacatctactaaatttggtt

SEQ ID NO: 43658 - DNA, 24 bp, Artificial sequence
  SiRNA target sequence
attaacatctactaaatttggttc

SEQ ID NO: 43659 - DNA, 24 bp, Artificial sequence
  SiRNA target sequence
ttaacatctactaaatttggttct

SEQ ID NO: 43660 - DNA, 24 bp, Artificial sequence
  SiRNA target sequence
taacatctactaaatttggttctt

SEQ ID NO: 43661 - DNA, 24 bp, Artificial sequence
  SiRNA target sequence
aacatctactaaatttggttcttc

SEQ ID NO: 43662 - DNA, 24 bp, Artificial sequence
  SiRNA target sequence
acatctactaaatttggttcttct

SEQ ID NO: 43663 - DNA, 24 bp, Artificial sequence
  SiRNA target sequence
catctactaaatttggttcttctt

SEQ ID NO: 43664 - DNA, 24 bp, Artificial sequence
  SiRNA target sequence
atctactaaatttggttcttcttt

SEQ ID NO: 43665 - DNA, 24 bp, Artificial sequence
  SiRNA target sequence
tctactaaatttggttcttctttt

SEQ ID NO: 43666 - DNA, 24 bp, Artificial sequence
  SiRNA target sequence
ctactaaatttggttcttctttta

SEQ ID NO: 43667 - DNA, 24 bp, Artificial sequence
  SiRNA target sequence
tactaaatttggttcttcttttat

SEQ ID NO: 43668 - DNA, 24 bp, Artificial sequence
  SiRNA target sequence
actaaatttggttcttcttttata

SEQ ID NO: 43669 - DNA, 24 bp, Artificial sequence
  SiRNA target sequence
ctaaatttggttcttcttttataa

SEQ ID NO: 43670 - DNA, 24 bp, Artificial sequence
  SiRNA target sequence
taaatttggttcttcttttataag

SEQ ID NO: 43671 - DNA, 24 bp, Artificial sequence
  SiRNA target sequence
aaatttggttcttcttttataagc

SEQ ID NO: 43672 - DNA, 24 bp, Artificial sequence
  SiRNA target sequence
aatttggttcttcttttataagct

SEQ ID NO: 43673 - DNA, 24 bp, Artificial sequence
  SiRNA target sequence
atttggttcttcttttataagctc

SEQ ID NO: 43674 - DNA, 24 bp, Artificial sequence
  SiRNA target sequence
tttggttcttcttttataagctct

SEQ ID NO: 43675 - DNA, 24 bp, Artificial sequence
  SiRNA target sequence
ttggttcttcttttataagctctg

SEQ ID NO: 43676 - DNA, 24 bp, Artificial sequence
  SiRNA target sequence
tggttcttcttttataagctctgg

SEQ ID NO: 43677 - DNA, 24 bp, Artificial sequence
  SiRNA target sequence
ggttcttcttttataagctctggt

SEQ ID NO: 43678 - DNA, 24 bp, Artificial sequence
  SiRNA target sequence
gttcttcttttataagctctggtt

SEQ ID NO: 43679 - DNA, 24 bp, Artificial sequence
  SiRNA target sequence
ttcttcttttataagctctggttt

SEQ ID NO: 43680 - DNA, 24 bp, Artificial sequence
  SiRNA target sequence
tcttcttttataagctctggttta

SEQ ID NO: 43681 - DNA, 24 bp, Artificial sequence
  SiRNA target sequence
cttcttttataagctctggtttaa

SEQ ID NO: 43682 - DNA, 24 bp, Artificial sequence
  SiRNA target sequence
ttcttttataagctctggtttaaa

SEQ ID NO: 43683 - DNA, 24 bp, Artificial sequence
  SiRNA target sequence
tcttttataagctctggtttaaaa

SEQ ID NO: 43684 - DNA, 24 bp, Artificial sequence
  SiRNA target sequence
cttttataagctctggtttaaaag

SEQ ID NO: 43685 - DNA, 24 bp, Artificial sequence
  SiRNA target sequence
ttttataagctctggtttaaaaga

SEQ ID NO: 43686 - DNA, 24 bp, Artificial sequence
  SiRNA target sequence
tttataagctctggtttaaaagat

SEQ ID NO: 43687 - DNA, 24 bp, Artificial sequence
  SiRNA target sequence
ttataagctctggtttaaaagatg

SEQ ID NO: 43688 - DNA, 24 bp, Artificial sequence
  SiRNA target sequence
tataagctctggtttaaaagatgt

SEQ ID NO: 43689 - DNA, 24 bp, Artificial sequence
  SiRNA target sequence
ataagctctggtttaaaagatgtt

SEQ ID NO: 43690 - DNA, 24 bp, Artificial sequence
  SiRNA target sequence
taagctctggtttaaaagatgttc

SEQ ID NO: 43691 - DNA, 24 bp, Artificial sequence
  SiRNA target sequence
aagctctggtttaaaagatgttct

SEQ ID NO: 43692 - DNA, 24 bp, Artificial sequence
  SiRNA target sequence
agctctggtttaaaagatgttctt

SEQ ID NO: 43693 - DNA, 24 bp, Artificial sequence
  SiRNA target sequence
gctctggtttaaaagatgttctta

SEQ ID NO: 43694 - DNA, 24 bp, Artificial sequence
  SiRNA target sequence
ctctggtttaaaagatgttcttat

SEQ ID NO: 43695 - DNA, 24 bp, Artificial sequence
  SiRNA target sequence
tctggtttaaaagatgttcttata

SEQ ID NO: 43696 - DNA, 24 bp, Artificial sequence
  SiRNA target sequence
ctggtttaaaagatgttcttatat

SEQ ID NO: 43697 - DNA, 24 bp, Artificial sequence
  SiRNA target sequence
tggtttaaaagatgttcttatatt

SEQ ID NO: 43698 - DNA, 24 bp, Artificial sequence
  SiRNA target sequence
ggtttaaaagatgttcttatattt

SEQ ID NO: 43699 - DNA, 24 bp, Artificial sequence
  SiRNA target sequence
gtttaaaagatgttcttatattta

SEQ ID NO: 43700 - DNA, 24 bp, Artificial sequence
  SiRNA target sequence
tttaaaagatgttcttatatttaa

SEQ ID NO: 43701 - DNA, 24 bp, Artificial sequence
  SiRNA target sequence
ttaaaagatgttcttatatttaag

SEQ ID NO: 43702 - DNA, 24 bp, Artificial sequence
  SiRNA target sequence
taaaagatgttcttatatttaaga

SEQ ID NO: 43703 - DNA, 24 bp, Artificial sequence
  SiRNA target sequence
aaaagatgttcttatatttaagat

SEQ ID NO: 43704 - DNA, 24 bp, Artificial sequence
  SiRNA target sequence
aaagatgttcttatatttaagatt

SEQ ID NO: 43705 - DNA, 24 bp, Artificial sequence
  SiRNA target sequence
aagatgttcttatatttaagattg

SEQ ID NO: 43706 - DNA, 24 bp, Artificial sequence
  SiRNA target sequence
agatgttcttatatttaagattgc

SEQ ID NO: 43707 - DNA, 24 bp, Artificial sequence
  SiRNA target sequence
gatgttcttatatttaagattgct

SEQ ID NO: 43708 - DNA, 24 bp, Artificial sequence
  SiRNA target sequence
atgttcttatatttaagattgctt

SEQ ID NO: 43709 - DNA, 24 bp, Artificial sequence
  SiRNA target sequence
tgttcttatatttaagattgcttg

SEQ ID NO: 43710 - DNA, 24 bp, Artificial sequence
  SiRNA target sequence
gttcttatatttaagattgcttgt

SEQ ID NO: 43711 - DNA, 24 bp, Artificial sequence
  SiRNA target sequence
ttcttatatttaagattgcttgtg

SEQ ID NO: 43712 - DNA, 24 bp, Artificial sequence
  SiRNA target sequence
tcttatatttaagattgcttgtgt

SEQ ID NO: 43713 - DNA, 24 bp, Artificial sequence
  SiRNA target sequence
cttatatttaagattgcttgtgta

SEQ ID NO: 43714 - DNA, 24 bp, Artificial sequence
  SiRNA target sequence
ttatatttaagattgcttgtgtat

SEQ ID NO: 43715 - DNA, 24 bp, Artificial sequence
  SiRNA target sequence
tatatttaagattgcttgtgtata

SEQ ID NO: 43716 - DNA, 24 bp, Artificial sequence
  SiRNA target sequence
atatttaagattgcttgtgtatat

SEQ ID NO: 43717 - DNA, 24 bp, Artificial sequence
  SiRNA target sequence
tatttaagattgcttgtgtatatc

SEQ ID NO: 43718 - DNA, 24 bp, Artificial sequence
  SiRNA target sequence
atttaagattgcttgtgtatatcg

SEQ ID NO: 43719 - DNA, 24 bp, Artificial sequence
  SiRNA target sequence
tttaagattgcttgtgtatatcgt

SEQ ID NO: 43720 - DNA, 24 bp, Artificial sequence
  SiRNA target sequence
ttaagattgcttgtgtatatcgtg

SEQ ID NO: 43721 - DNA, 24 bp, Artificial sequence
  SiRNA target sequence
taagattgcttgtgtatatcgtga

SEQ ID NO: 43722 - DNA, 24 bp, Artificial sequence
  SiRNA target sequence
aagattgcttgtgtatatcgtgag

SEQ ID NO: 43723 - DNA, 24 bp, Artificial sequence
  SiRNA target sequence
agattgcttgtgtatatcgtgagt

SEQ ID NO: 43724 - DNA, 24 bp, Artificial sequence
  SiRNA target sequence
gattgcttgtgtatatcgtgagta

SEQ ID NO: 43725 - DNA, 24 bp, Artificial sequence
  SiRNA target sequence
attgcttgtgtatatcgtgagtaa

SEQ ID NO: 43726 - DNA, 24 bp, Artificial sequence
  SiRNA target sequence
ttgcttgtgtatatcgtgagtaaa

SEQ ID NO: 43727 - DNA, 24 bp, Artificial sequence
  SiRNA target sequence
tgcttgtgtatatcgtgagtaaaa

SEQ ID NO: 43728 - DNA, 24 bp, Artificial sequence
  SiRNA target sequence
gcttgtgtatatcgtgagtaaaag

SEQ ID NO: 43729 - DNA, 24 bp, Artificial sequence
  SiRNA target sequence
cttgtgtatatcgtgagtaaaaga

SEQ ID NO: 43730 - DNA, 24 bp, Artificial sequence
  SiRNA target sequence
ttgtgtatatcgtgagtaaaagaa

SEQ ID NO: 43731 - DNA, 24 bp, Artificial sequence
  SiRNA target sequence
tgtgtatatcgtgagtaaaagaac

SEQ ID NO: 43732 - DNA, 24 bp, Artificial sequence
  SiRNA target sequence
gtgtatatcgtgagtaaaagaacc

SEQ ID NO: 43733 - DNA, 24 bp, Artificial sequence
  SiRNA target sequence
tgtatatcgtgagtaaaagaaccc

SEQ ID NO: 43734 - DNA, 24 bp, Artificial sequence
  SiRNA target sequence
gtatatcgtgagtaaaagaaccct

SEQ ID NO: 43735 - DNA, 24 bp, Artificial sequence
  SiRNA target sequence
tatatcgtgagtaaaagaacccta

SEQ ID NO: 43736 - DNA, 24 bp, Artificial sequence
  SiRNA target sequence
atatcgtgagtaaaagaaccctaa

SEQ ID NO: 43737 - DNA, 24 bp, Artificial sequence
  SiRNA target sequence
tatcgtgagtaaaagaaccctaat

SEQ ID NO: 43738 - DNA, 24 bp, Artificial sequence
  SiRNA target sequence
atcgtgagtaaaagaaccctaatt

SEQ ID NO: 43739 - DNA, 24 bp, Artificial sequence
  SiRNA target sequence
tcgtgagtaaaagaaccctaattg

SEQ ID NO: 43740 - DNA, 24 bp, Artificial sequence
  SiRNA target sequence
cgtgagtaaaagaaccctaattgt

SEQ ID NO: 43741 - DNA, 24 bp, Artificial sequence
  SiRNA target sequence
gtgagtaaaagaaccctaattgtc

SEQ ID NO: 43742 - DNA, 24 bp, Artificial sequence
  SiRNA target sequence
tgagtaaaagaaccctaattgtcc

SEQ ID NO: 43743 - DNA, 24 bp, Artificial sequence
  SiRNA target sequence
gagtaaaagaaccctaattgtcca

SEQ ID NO: 43744 - DNA, 24 bp, Artificial sequence
  SiRNA target sequence
agtaaaagaaccctaattgtccaa

SEQ ID NO: 43745 - DNA, 24 bp, Artificial sequence
  SiRNA target sequence
gtaaaagaaccctaattgtccaaa

SEQ ID NO: 43746 - DNA, 24 bp, Artificial sequence
  SiRNA target sequence
taaaagaaccctaattgtccaaaa

SEQ ID NO: 43747 - DNA, 24 bp, Artificial sequence
  SiRNA target sequence
aaaagaaccctaattgtccaaaac

SEQ ID NO: 43748 - DNA, 24 bp, Artificial sequence
  SiRNA target sequence
aaagaaccctaattgtccaaaact

SEQ ID NO: 43749 - DNA, 24 bp, Artificial sequence
  SiRNA target sequence
aagaaccctaattgtccaaaactt

SEQ ID NO: 43750 - DNA, 24 bp, Artificial sequence
  SiRNA target sequence
agaaccctaattgtccaaaacttg

SEQ ID NO: 43751 - DNA, 24 bp, Artificial sequence
  SiRNA target sequence
gaaccctaattgtccaaaacttga

SEQ ID NO: 43752 - DNA, 24 bp, Artificial sequence
  SiRNA target sequence
aaccctaattgtccaaaacttgaa

SEQ ID NO: 43753 - DNA, 24 bp, Artificial sequence
  SiRNA target sequence
accctaattgtccaaaacttgaat

SEQ ID NO: 43754 - DNA, 24 bp, Artificial sequence
  SiRNA target sequence
ccctaattgtccaaaacttgaata

SEQ ID NO: 43755 - DNA, 24 bp, Artificial sequence
  SiRNA target sequence
cctaattgtccaaaacttgaatac

SEQ ID NO: 43756 - DNA, 24 bp, Artificial sequence
  SiRNA target sequence
ctaattgtccaaaacttgaataca

SEQ ID NO: 43757 - DNA, 24 bp, Artificial sequence
  SiRNA target sequence
taattgtccaaaacttgaatacaa

SEQ ID NO: 43758 - DNA, 24 bp, Artificial sequence
  SiRNA target sequence
aattgtccaaaacttgaatacaat

SEQ ID NO: 43759 - DNA, 24 bp, Artificial sequence
  SiRNA target sequence
attgtccaaaacttgaatacaatg

SEQ ID NO: 43760 - DNA, 24 bp, Artificial sequence
  SiRNA target sequence
ttgtccaaaacttgaatacaatgt

SEQ ID NO: 43761 - DNA, 24 bp, Artificial sequence
  SiRNA target sequence
tgtccaaaacttgaatacaatgtt

SEQ ID NO: 43762 - DNA, 24 bp, Artificial sequence
  SiRNA target sequence
gtccaaaacttgaatacaatgttc

SEQ ID NO: 43763 - DNA, 24 bp, Artificial sequence
  SiRNA target sequence
tccaaaacttgaatacaatgttct

SEQ ID NO: 43764 - DNA, 24 bp, Artificial sequence
  SiRNA target sequence
ccaaaacttgaatacaatgttcta

SEQ ID NO: 43765 - DNA, 24 bp, Artificial sequence
  SiRNA target sequence
caaaacttgaatacaatgttctat

SEQ ID NO: 43766 - DNA, 24 bp, Artificial sequence
  SiRNA target sequence
aaaacttgaatacaatgttctatt

SEQ ID NO: 43767 - DNA, 24 bp, Artificial sequence
  SiRNA target sequence
aaacttgaatacaatgttctatta

SEQ ID NO: 43768 - DNA, 24 bp, Artificial sequence
  SiRNA target sequence
aacttgaatacaatgttctattaa

SEQ ID NO: 43769 - DNA, 24 bp, Artificial sequence
  SiRNA target sequence
acttgaatacaatgttctattaat

SEQ ID NO: 43770 - DNA, 24 bp, Artificial sequence
  SiRNA target sequence
cttgaatacaatgttctattaatg

SEQ ID NO: 43771 - DNA, 24 bp, Artificial sequence
  SiRNA target sequence
ttgaatacaatgttctattaatgc

SEQ ID NO: 43772 - DNA, 24 bp, Artificial sequence
  SiRNA target sequence
tgaatacaatgttctattaatgcc

SEQ ID NO: 43773 - DNA, 24 bp, Artificial sequence
  SiRNA target sequence
gaatacaatgttctattaatgcca

SEQ ID NO: 43774 - DNA, 24 bp, Artificial sequence
  SiRNA target sequence
aatacaatgttctattaatgccaa

SEQ ID NO: 43775 - DNA, 24 bp, Artificial sequence
  SiRNA target sequence
atacaatgttctattaatgccaat

SEQ ID NO: 43776 - DNA, 24 bp, Artificial sequence
  SiRNA target sequence
tacaatgttctattaatgccaata

SEQ ID NO: 43777 - DNA, 24 bp, Artificial sequence
  SiRNA target sequence
acaatgttctattaatgccaatat

SEQ ID NO: 43778 - DNA, 24 bp, Artificial sequence
  SiRNA target sequence
caatgttctattaatgccaatata

SEQ ID NO: 43779 - DNA, 24 bp, Artificial sequence
  SiRNA target sequence
aatgttctattaatgccaatataa

SEQ ID NO: 43780 - DNA, 24 bp, Artificial sequence
  SiRNA target sequence
atgttctattaatgccaatataaa

SEQ ID NO: 43781 - DNA, 24 bp, Artificial sequence
  SiRNA target sequence
tgttctattaatgccaatataaaa

SEQ ID NO: 43782 - DNA, 24 bp, Artificial sequence
  SiRNA target sequence
gttctattaatgccaatataaaat

SEQ ID NO: 43783 - DNA, 24 bp, Artificial sequence
  SiRNA target sequence
ttctattaatgccaatataaaata

SEQ ID NO: 43784 - DNA, 24 bp, Artificial sequence
  SiRNA target sequence
tctattaatgccaatataaaatac

SEQ ID NO: 43785 - DNA, 24 bp, Artificial sequence
  SiRNA target sequence
ctattaatgccaatataaaataca

SEQ ID NO: 43786 - DNA, 24 bp, Artificial sequence
  SiRNA target sequence
tattaatgccaatataaaatacaa

SEQ ID NO: 43787 - DNA, 24 bp, Artificial sequence
  SiRNA target sequence
attaatgccaatataaaatacaac

SEQ ID NO: 43788 - DNA, 24 bp, Artificial sequence
  SiRNA target sequence
ttaatgccaatataaaatacaaca

SEQ ID NO: 43789 - DNA, 24 bp, Artificial sequence
  SiRNA target sequence
taatgccaatataaaatacaacat

SEQ ID NO: 43790 - DNA, 24 bp, Artificial sequence
  SiRNA target sequence
aatgccaatataaaatacaacatc

SEQ ID NO: 43791 - DNA, 24 bp, Artificial sequence
  SiRNA target sequence
atgccaatataaaatacaacatcc

SEQ ID NO: 43792 - DNA, 24 bp, Artificial sequence
  SiRNA target sequence
tgccaatataaaatacaacatccc

SEQ ID NO: 43793 - DNA, 24 bp, Artificial sequence
  SiRNA target sequence
gccaatataaaatacaacatccct

SEQ ID NO: 43794 - DNA, 24 bp, Artificial sequence
  SiRNA target sequence
ccaatataaaatacaacatccctg

SEQ ID NO: 43795 - DNA, 24 bp, Artificial sequence
  SiRNA target sequence
caatataaaatacaacatccctgg

SEQ ID NO: 43796 - DNA, 24 bp, Artificial sequence
  SiRNA target sequence
aatataaaatacaacatccctggc

SEQ ID NO: 43797 - DNA, 24 bp, Artificial sequence
  SiRNA target sequence
atataaaatacaacatccctggca

SEQ ID NO: 43798 - DNA, 24 bp, Artificial sequence
  SiRNA target sequence
tataaaatacaacatccctggcac

SEQ ID NO: 43799 - DNA, 24 bp, Artificial sequence
  SiRNA target sequence
ataaaatacaacatccctggcact

SEQ ID NO: 43800 - DNA, 24 bp, Artificial sequence
  SiRNA target sequence
taaaatacaacatccctggcactt

SEQ ID NO: 43801 - DNA, 24 bp, Artificial sequence
  SiRNA target sequence
aaaatacaacatccctggcactta

SEQ ID NO: 43802 - DNA, 24 bp, Artificial sequence
  SiRNA target sequence
aaatacaacatccctggcacttag

SEQ ID NO: 43803 - DNA, 24 bp, Artificial sequence
  SiRNA target sequence
aatacaacatccctggcacttagt

SEQ ID NO: 43804 - DNA, 24 bp, Artificial sequence
  SiRNA target sequence
atacaacatccctggcacttagtt

SEQ ID NO: 43805 - DNA, 24 bp, Artificial sequence
  SiRNA target sequence
tacaacatccctggcacttagttt

SEQ ID NO: 43806 - DNA, 24 bp, Artificial sequence
  SiRNA target sequence
acaacatccctggcacttagtttt

SEQ ID NO: 43807 - DNA, 24 bp, Artificial sequence
  SiRNA target sequence
caacatccctggcacttagttttg

SEQ ID NO: 43808 - DNA, 24 bp, Artificial sequence
  SiRNA target sequence
aacatccctggcacttagttttgc

SEQ ID NO: 43809 - DNA, 24 bp, Artificial sequence
  SiRNA target sequence
acatccctggcacttagttttgct

SEQ ID NO: 43810 - DNA, 24 bp, Artificial sequence
  SiRNA target sequence
catccctggcacttagttttgctg

SEQ ID NO: 43811 - DNA, 24 bp, Artificial sequence
  SiRNA target sequence
atccctggcacttagttttgctgt

SEQ ID NO: 43812 - DNA, 24 bp, Artificial sequence
  SiRNA target sequence
tccctggcacttagttttgctgtt

SEQ ID NO: 43813 - DNA, 24 bp, Artificial sequence
  SiRNA target sequence
ccctggcacttagttttgctgtta

SEQ ID NO: 43814 - DNA, 24 bp, Artificial sequence
  SiRNA target sequence
cctggcacttagttttgctgttaa

SEQ ID NO: 43815 - DNA, 24 bp, Artificial sequence
  SiRNA target sequence
ctggcacttagttttgctgttaat

SEQ ID NO: 43816 - DNA, 24 bp, Artificial sequence
  SiRNA target sequence
tggcacttagttttgctgttaata

SEQ ID NO: 43817 - DNA, 24 bp, Artificial sequence
  SiRNA target sequence
ggcacttagttttgctgttaatat

SEQ ID NO: 43818 - DNA, 24 bp, Artificial sequence
  SiRNA target sequence
gcacttagttttgctgttaatatt

SEQ ID NO: 43819 - DNA, 24 bp, Artificial sequence
  SiRNA target sequence
cacttagttttgctgttaatattc

SEQ ID NO: 43820 - DNA, 24 bp, Artificial sequence
  SiRNA target sequence
acttagttttgctgttaatattcc

SEQ ID NO: 43821 - DNA, 24 bp, Artificial sequence
  SiRNA target sequence
cttagttttgctgttaatattcca

SEQ ID NO: 43822 - DNA, 24 bp, Artificial sequence
  SiRNA target sequence
ttagttttgctgttaatattccat

SEQ ID NO: 43823 - DNA, 24 bp, Artificial sequence
  SiRNA target sequence
tagttttgctgttaatattccata

SEQ ID NO: 43824 - DNA, 24 bp, Artificial sequence
  SiRNA target sequence
agttttgctgttaatattccatag

SEQ ID NO: 43825 - DNA, 24 bp, Artificial sequence
  SiRNA target sequence
gttttgctgttaatattccatagt

SEQ ID NO: 43826 - DNA, 24 bp, Artificial sequence
  SiRNA target sequence
ttttgctgttaatattccatagtt

SEQ ID NO: 43827 - DNA, 24 bp, Artificial sequence
  SiRNA target sequence
tttgctgttaatattccatagttt

SEQ ID NO: 43828 - DNA, 24 bp, Artificial sequence
  SiRNA target sequence
ttgctgttaatattccatagtttc

SEQ ID NO: 43829 - DNA, 24 bp, Artificial sequence
  SiRNA target sequence
tgctgttaatattccatagtttcc

SEQ ID NO: 43830 - DNA, 24 bp, Artificial sequence
  SiRNA target sequence
gctgttaatattccatagtttcct

SEQ ID NO: 43831 - DNA, 24 bp, Artificial sequence
  SiRNA target sequence
ctgttaatattccatagtttccta

SEQ ID NO: 43832 - DNA, 24 bp, Artificial sequence
  SiRNA target sequence
tgttaatattccatagtttcctaa

SEQ ID NO: 43833 - DNA, 24 bp, Artificial sequence
  SiRNA target sequence
gttaatattccatagtttcctaat

SEQ ID NO: 43834 - DNA, 24 bp, Artificial sequence
  SiRNA target sequence
ttaatattccatagtttcctaatg

SEQ ID NO: 43835 - DNA, 24 bp, Artificial sequence
  SiRNA target sequence
taatattccatagtttcctaatgt

SEQ ID NO: 43836 - DNA, 24 bp, Artificial sequence
  SiRNA target sequence
aatattccatagtttcctaatgtt

SEQ ID NO: 43837 - DNA, 24 bp, Artificial sequence
  SiRNA target sequence
atattccatagtttcctaatgtta

SEQ ID NO: 43838 - DNA, 24 bp, Artificial sequence
  SiRNA target sequence
tattccatagtttcctaatgttat

SEQ ID NO: 43839 - DNA, 24 bp, Artificial sequence
  SiRNA target sequence
attccatagtttcctaatgttata

SEQ ID NO: 43840 - DNA, 24 bp, Artificial sequence
  SiRNA target sequence
ttccatagtttcctaatgttataa

SEQ ID NO: 43841 - DNA, 24 bp, Artificial sequence
  SiRNA target sequence
tccatagtttcctaatgttataac

SEQ ID NO: 43842 - DNA, 24 bp, Artificial sequence
  SiRNA target sequence
ccatagtttcctaatgttataact

SEQ ID NO: 43843 - DNA, 24 bp, Artificial sequence
  SiRNA target sequence
catagtttcctaatgttataacta

SEQ ID NO: 43844 - DNA, 24 bp, Artificial sequence
  SiRNA target sequence
atagtttcctaatgttataactat

SEQ ID NO: 43845 - DNA, 24 bp, Artificial sequence
  SiRNA target sequence
tagtttcctaatgttataactata

SEQ ID NO: 43846 - DNA, 24 bp, Artificial sequence
  SiRNA target sequence
agtttcctaatgttataactataa

SEQ ID NO: 43847 - DNA, 24 bp, Artificial sequence
  SiRNA target sequence
gtttcctaatgttataactataaa

SEQ ID NO: 43848 - DNA, 24 bp, Artificial sequence
  SiRNA target sequence
tttcctaatgttataactataaaa

SEQ ID NO: 43849 - DNA, 24 bp, Artificial sequence
  SiRNA target sequence
ttcctaatgttataactataaaac

SEQ ID NO: 43850 - DNA, 24 bp, Artificial sequence
  SiRNA target sequence
tcctaatgttataactataaaaca

SEQ ID NO: 43851 - DNA, 24 bp, Artificial sequence
  SiRNA target sequence
cctaatgttataactataaaacac

SEQ ID NO: 43852 - DNA, 24 bp, Artificial sequence
  SiRNA target sequence
ctaatgttataactataaaacact

SEQ ID NO: 43853 - DNA, 24 bp, Artificial sequence
  SiRNA target sequence
taatgttataactataaaacactg

SEQ ID NO: 43854 - DNA, 24 bp, Artificial sequence
  SiRNA target sequence
aatgttataactataaaacactgt

SEQ ID NO: 43855 - DNA, 24 bp, Artificial sequence
  SiRNA target sequence
atgttataactataaaacactgta

SEQ ID NO: 43856 - DNA, 24 bp, Artificial sequence
  SiRNA target sequence
tgttataactataaaacactgtaa

SEQ ID NO: 43857 - DNA, 24 bp, Artificial sequence
  SiRNA target sequence
gttataactataaaacactgtaaa

SEQ ID NO: 43858 - DNA, 24 bp, Artificial sequence
  SiRNA target sequence
ttataactataaaacactgtaaag

SEQ ID NO: 43859 - DNA, 24 bp, Artificial sequence
  SiRNA target sequence
tataactataaaacactgtaaagc

SEQ ID NO: 43860 - DNA, 24 bp, Artificial sequence
  SiRNA target sequence
ataactataaaacactgtaaagca

SEQ ID NO: 43861 - DNA, 24 bp, Artificial sequence
  SiRNA target sequence
taactataaaacactgtaaagcaa

SEQ ID NO: 43862 - DNA, 24 bp, Artificial sequence
  SiRNA target sequence
aactataaaacactgtaaagcaaa

SEQ ID NO: 43863 - DNA, 24 bp, Artificial sequence
  SiRNA target sequence
actataaaacactgtaaagcaaaa

SEQ ID NO: 43864 - DNA, 24 bp, Artificial sequence
  SiRNA target sequence
ctataaaacactgtaaagcaaaaa

SEQ ID NO: 43865 - DNA, 24 bp, Artificial sequence
  SiRNA target sequence
tataaaacactgtaaagcaaaaat

SEQ ID NO: 43866 - DNA, 24 bp, Artificial sequence
  SiRNA target sequence
ataaaacactgtaaagcaaaaatt

SEQ ID NO: 43867 - DNA, 24 bp, Artificial sequence
  SiRNA target sequence
taaaacactgtaaagcaaaaatta

SEQ ID NO: 43868 - DNA, 24 bp, Artificial sequence
  SiRNA target sequence
aaaacactgtaaagcaaaaattat

SEQ ID NO: 43869 - DNA, 24 bp, Artificial sequence
  SiRNA target sequence
aaacactgtaaagcaaaaattatc

SEQ ID NO: 43870 - DNA, 24 bp, Artificial sequence
  SiRNA target sequence
aacactgtaaagcaaaaattatct

SEQ ID NO: 43871 - DNA, 24 bp, Artificial sequence
  SiRNA target sequence
acactgtaaagcaaaaattatctt

SEQ ID NO: 43872 - DNA, 24 bp, Artificial sequence
  SiRNA target sequence
cactgtaaagcaaaaattatctta

SEQ ID NO: 43873 - DNA, 24 bp, Artificial sequence
  SiRNA target sequence
actgtaaagcaaaaattatcttat

SEQ ID NO: 43874 - DNA, 24 bp, Artificial sequence
  SiRNA target sequence
ctgtaaagcaaaaattatcttatt

SEQ ID NO: 43875 - DNA, 24 bp, Artificial sequence
  SiRNA target sequence
tgtaaagcaaaaattatcttattt

SEQ ID NO: 43876 - DNA, 24 bp, Artificial sequence
  SiRNA target sequence
gtaaagcaaaaattatcttattta

SEQ ID NO: 43877 - DNA, 24 bp, Artificial sequence
  SiRNA target sequence
taaagcaaaaattatcttatttac

SEQ ID NO: 43878 - DNA, 24 bp, Artificial sequence
  SiRNA target sequence
aaagcaaaaattatcttatttaca

SEQ ID NO: 43879 - DNA, 24 bp, Artificial sequence
  SiRNA target sequence
aagcaaaaattatcttatttacaa

SEQ ID NO: 43880 - DNA, 24 bp, Artificial sequence
  SiRNA target sequence
agcaaaaattatcttatttacaag

SEQ ID NO: 43881 - DNA, 24 bp, Artificial sequence
  SiRNA target sequence
gcaaaaattatcttatttacaagg

SEQ ID NO: 43882 - DNA, 24 bp, Artificial sequence
  SiRNA target sequence
caaaaattatcttatttacaaggt

SEQ ID NO: 43883 - DNA, 24 bp, Artificial sequence
  SiRNA target sequence
aaaaattatcttatttacaaggta

SEQ ID NO: 43884 - DNA, 24 bp, Artificial sequence
  SiRNA target sequence
aaaattatcttatttacaaggtat

SEQ ID NO: 43885 - DNA, 24 bp, Artificial sequence
  SiRNA target sequence
aaattatcttatttacaaggtata

SEQ ID NO: 43886 - DNA, 24 bp, Artificial sequence
  SiRNA target sequence
aattatcttatttacaaggtataa

SEQ ID NO: 43887 - DNA, 24 bp, Artificial sequence
  SiRNA target sequence
attatcttatttacaaggtataaa

SEQ ID NO: 43888 - DNA, 24 bp, Artificial sequence
  SiRNA target sequence
ttatcttatttacaaggtataaaa

SEQ ID NO: 43889 - DNA, 24 bp, Artificial sequence
  SiRNA target sequence
tatcttatttacaaggtataaaaa

SEQ ID NO: 43890 - DNA, 24 bp, Artificial sequence
  SiRNA target sequence
atcttatttacaaggtataaaaaa

SEQ ID NO: 43891 - DNA, 24 bp, Artificial sequence
  SiRNA target sequence
tcttatttacaaggtataaaaaac

SEQ ID NO: 43892 - DNA, 24 bp, Artificial sequence
  SiRNA target sequence
cttatttacaaggtataaaaaact

SEQ ID NO: 43893 - DNA, 24 bp, Artificial sequence
  SiRNA target sequence
ttatttacaaggtataaaaaacta

SEQ ID NO: 43894 - DNA, 24 bp, Artificial sequence
  SiRNA target sequence
tatttacaaggtataaaaaactaa

SEQ ID NO: 43895 - DNA, 24 bp, Artificial sequence
  SiRNA target sequence
atttacaaggtataaaaaactaag

SEQ ID NO: 43896 - DNA, 24 bp, Artificial sequence
  SiRNA target sequence
tttacaaggtataaaaaactaaga

SEQ ID NO: 43897 - DNA, 24 bp, Artificial sequence
  SiRNA target sequence
ttacaaggtataaaaaactaagag

SEQ ID NO: 43898 - DNA, 24 bp, Artificial sequence
  SiRNA target sequence
tacaaggtataaaaaactaagaga

SEQ ID NO: 43899 - DNA, 24 bp, Artificial sequence
  SiRNA target sequence
acaaggtataaaaaactaagagat

SEQ ID NO: 43900 - DNA, 24 bp, Artificial sequence
  SiRNA target sequence
caaggtataaaaaactaagagatc

SEQ ID NO: 43901 - DNA, 24 bp, Artificial sequence
  SiRNA target sequence
aaggtataaaaaactaagagatct

SEQ ID NO: 43902 - DNA, 24 bp, Artificial sequence
  SiRNA target sequence
aggtataaaaaactaagagatctc

SEQ ID NO: 43903 - DNA, 24 bp, Artificial sequence
  SiRNA target sequence
ggtataaaaaactaagagatctcc

SEQ ID NO: 43904 - DNA, 24 bp, Artificial sequence
  SiRNA target sequence
gtataaaaaactaagagatctcca

SEQ ID NO: 43905 - DNA, 24 bp, Artificial sequence
  SiRNA target sequence
tataaaaaactaagagatctccag

SEQ ID NO: 43906 - DNA, 24 bp, Artificial sequence
  SiRNA target sequence
ataaaaaactaagagatctccaga

SEQ ID NO: 43907 - DNA, 24 bp, Artificial sequence
  SiRNA target sequence
taaaaaactaagagatctccagat

SEQ ID NO: 43908 - DNA, 24 bp, Artificial sequence
  SiRNA target sequence
aaaaaactaagagatctccagatt

SEQ ID NO: 43909 - DNA, 24 bp, Artificial sequence
  SiRNA target sequence
aaaaactaagagatctccagattc

SEQ ID NO: 43910 - DNA, 24 bp, Artificial sequence
  SiRNA target sequence
aaaactaagagatctccagattct

SEQ ID NO: 43911 - DNA, 24 bp, Artificial sequence
  SiRNA target sequence
aaactaagagatctccagattctg

SEQ ID NO: 43912 - DNA, 24 bp, Artificial sequence
  SiRNA target sequence
aactaagagatctccagattctgt

SEQ ID NO: 43913 - DNA, 24 bp, Artificial sequence
  SiRNA target sequence
actaagagatctccagattctgtt

SEQ ID NO: 43914 - DNA, 24 bp, Artificial sequence
  SiRNA target sequence
ctaagagatctccagattctgtta

SEQ ID NO: 43915 - DNA, 24 bp, Artificial sequence
  SiRNA target sequence
taagagatctccagattctgttac

SEQ ID NO: 43916 - DNA, 24 bp, Artificial sequence
  SiRNA target sequence
aagagatctccagattctgttaca

SEQ ID NO: 43917 - DNA, 24 bp, Artificial sequence
  SiRNA target sequence
agagatctccagattctgttacat

SEQ ID NO: 43918 - DNA, 24 bp, Artificial sequence
  SiRNA target sequence
gagatctccagattctgttacatt

SEQ ID NO: 43919 - DNA, 24 bp, Artificial sequence
  SiRNA target sequence
agatctccagattctgttacattc

SEQ ID NO: 43920 - DNA, 24 bp, Artificial sequence
  SiRNA target sequence
gatctccagattctgttacattcc

SEQ ID NO: 43921 - DNA, 24 bp, Artificial sequence
  SiRNA target sequence
atctccagattctgttacattccg

SEQ ID NO: 43922 - DNA, 24 bp, Artificial sequence
  SiRNA target sequence
tctccagattctgttacattccga

SEQ ID NO: 43923 - DNA, 24 bp, Artificial sequence
  SiRNA target sequence
ctccagattctgttacattccgat

SEQ ID NO: 43924 - DNA, 24 bp, Artificial sequence
  SiRNA target sequence
tccagattctgttacattccgatt

SEQ ID NO: 43925 - DNA, 24 bp, Artificial sequence
  SiRNA target sequence
ccagattctgttacattccgattc

SEQ ID NO: 43926 - DNA, 24 bp, Artificial sequence
  SiRNA target sequence
cagattctgttacattccgattct

SEQ ID NO: 43927 - DNA, 24 bp, Artificial sequence
  SiRNA target sequence
agattctgttacattccgattcta

SEQ ID NO: 43928 - DNA, 24 bp, Artificial sequence
  SiRNA target sequence
gattctgttacattccgattctac

SEQ ID NO: 43929 - DNA, 24 bp, Artificial sequence
  SiRNA target sequence
attctgttacattccgattctact

SEQ ID NO: 43930 - DNA, 24 bp, Artificial sequence
  SiRNA target sequence
ttctgttacattccgattctactt

SEQ ID NO: 43931 - DNA, 24 bp, Artificial sequence
  SiRNA target sequence
tctgttacattccgattctacttc

SEQ ID NO: 43932 - DNA, 24 bp, Artificial sequence
  SiRNA target sequence
ctgttacattccgattctacttca

SEQ ID NO: 43933 - DNA, 24 bp, Artificial sequence
  SiRNA target sequence
tgttacattccgattctacttcag

SEQ ID NO: 43934 - DNA, 24 bp, Artificial sequence
  SiRNA target sequence
gttacattccgattctacttcaga

SEQ ID NO: 43935 - DNA, 24 bp, Artificial sequence
  SiRNA target sequence
ttacattccgattctacttcagaa

SEQ ID NO: 43936 - DNA, 24 bp, Artificial sequence
  SiRNA target sequence
tacattccgattctacttcagaaa

SEQ ID NO: 43937 - DNA, 24 bp, Artificial sequence
  SiRNA target sequence
acattccgattctacttcagaaac

SEQ ID NO: 43938 - DNA, 24 bp, Artificial sequence
  SiRNA target sequence
cattccgattctacttcagaaaca

SEQ ID NO: 43939 - DNA, 24 bp, Artificial sequence
  SiRNA target sequence
attccgattctacttcagaaacat

SEQ ID NO: 43940 - DNA, 24 bp, Artificial sequence
  SiRNA target sequence
ttccgattctacttcagaaacata

SEQ ID NO: 43941 - DNA, 24 bp, Artificial sequence
  SiRNA target sequence
tccgattctacttcagaaacatat

SEQ ID NO: 43942 - DNA, 24 bp, Artificial sequence
  SiRNA target sequence
ccgattctacttcagaaacatatt

SEQ ID NO: 43943 - DNA, 24 bp, Artificial sequence
  SiRNA target sequence
cgattctacttcagaaacatattt

SEQ ID NO: 43944 - DNA, 24 bp, Artificial sequence
  SiRNA target sequence
gattctacttcagaaacatatttt

SEQ ID NO: 43945 - DNA, 24 bp, Artificial sequence
  SiRNA target sequence
attctacttcagaaacatattttt

SEQ ID NO: 43946 - DNA, 24 bp, Artificial sequence
  SiRNA target sequence
ttctacttcagaaacatatttttc

SEQ ID NO: 43947 - DNA, 24 bp, Artificial sequence
  SiRNA target sequence
tctacttcagaaacatatttttca

SEQ ID NO: 43948 - DNA, 24 bp, Artificial sequence
  SiRNA target sequence
ctacttcagaaacatatttttcat

SEQ ID NO: 43949 - DNA, 24 bp, Artificial sequence
  SiRNA target sequence
tacttcagaaacatatttttcata

SEQ ID NO: 43950 - DNA, 24 bp, Artificial sequence
  SiRNA target sequence
acttcagaaacatatttttcatat

SEQ ID NO: 43951 - DNA, 24 bp, Artificial sequence
  SiRNA target sequence
cttcagaaacatatttttcatatt

SEQ ID NO: 43952 - DNA, 24 bp, Artificial sequence
  SiRNA target sequence
ttcagaaacatatttttcatattt

SEQ ID NO: 43953 - DNA, 24 bp, Artificial sequence
  SiRNA target sequence
tcagaaacatatttttcatattta

SEQ ID NO: 43954 - DNA, 24 bp, Artificial sequence
  SiRNA target sequence
cagaaacatatttttcatatttaa

SEQ ID NO: 43955 - DNA, 24 bp, Artificial sequence
  SiRNA target sequence
agaaacatatttttcatatttaag

SEQ ID NO: 43956 - DNA, 24 bp, Artificial sequence
  SiRNA target sequence
gaaacatatttttcatatttaagc

SEQ ID NO: 43957 - DNA, 24 bp, Artificial sequence
  SiRNA target sequence
aaacatatttttcatatttaagcg

SEQ ID NO: 43958 - DNA, 24 bp, Artificial sequence
  SiRNA target sequence
aacatatttttcatatttaagcga

SEQ ID NO: 43959 - DNA, 24 bp, Artificial sequence
  SiRNA target sequence
acatatttttcatatttaagcgat

SEQ ID NO: 43960 - DNA, 24 bp, Artificial sequence
  SiRNA target sequence
catatttttcatatttaagcgatt

SEQ ID NO: 43961 - DNA, 24 bp, Artificial sequence
  SiRNA target sequence
atatttttcatatttaagcgattc

SEQ ID NO: 43962 - DNA, 24 bp, Artificial sequence
  SiRNA target sequence
tatttttcatatttaagcgattct

SEQ ID NO: 43963 - DNA, 24 bp, Artificial sequence
  SiRNA target sequence
atttttcatatttaagcgattctt

SEQ ID NO: 43964 - DNA, 24 bp, Artificial sequence
  SiRNA target sequence
tttttcatatttaagcgattcttc

SEQ ID NO: 43965 - DNA, 24 bp, Artificial sequence
  SiRNA target sequence
ttttcatatttaagcgattcttct

SEQ ID NO: 43966 - DNA, 24 bp, Artificial sequence
  SiRNA target sequence
tttcatatttaagcgattcttctt

SEQ ID NO: 43967 - DNA, 24 bp, Artificial sequence
  SiRNA target sequence
ttcatatttaagcgattcttcttc

SEQ ID NO: 43968 - DNA, 24 bp, Artificial sequence
  SiRNA target sequence
tcatatttaagcgattcttcttct

SEQ ID NO: 43969 - DNA, 24 bp, Artificial sequence
  SiRNA target sequence
catatttaagcgattcttcttctt

SEQ ID NO: 43970 - DNA, 24 bp, Artificial sequence
  SiRNA target sequence
atatttaagcgattcttcttcttc

SEQ ID NO: 43971 - DNA, 24 bp, Artificial sequence
  SiRNA target sequence
tatttaagcgattcttcttcttct

SEQ ID NO: 43972 - DNA, 24 bp, Artificial sequence
  SiRNA target sequence
atttaagcgattcttcttcttctg

SEQ ID NO: 43973 - DNA, 24 bp, Artificial sequence
  SiRNA target sequence
tttaagcgattcttcttcttctgt

SEQ ID NO: 43974 - DNA, 24 bp, Artificial sequence
  SiRNA target sequence
ttaagcgattcttcttcttctgtt

SEQ ID NO: 43975 - DNA, 24 bp, Artificial sequence
  SiRNA target sequence
taagcgattcttcttcttctgttt

SEQ ID NO: 43976 - DNA, 24 bp, Artificial sequence
  SiRNA target sequence
aagcgattcttcttcttctgtttt

SEQ ID NO: 43977 - DNA, 24 bp, Artificial sequence
  SiRNA target sequence
agcgattcttcttcttctgtttta

SEQ ID NO: 43978 - DNA, 24 bp, Artificial sequence
  SiRNA target sequence
gcgattcttcttcttctgttttat

SEQ ID NO: 43979 - DNA, 24 bp, Artificial sequence
  SiRNA target sequence
cgattcttcttcttctgttttata

SEQ ID NO: 43980 - DNA, 24 bp, Artificial sequence
  SiRNA target sequence
gattcttcttcttctgttttatat

SEQ ID NO: 43981 - DNA, 24 bp, Artificial sequence
  SiRNA target sequence
attcttcttcttctgttttatatg

SEQ ID NO: 43982 - DNA, 24 bp, Artificial sequence
  SiRNA target sequence
ttcttcttcttctgttttatatgc

SEQ ID NO: 43983 - DNA, 24 bp, Artificial sequence
  SiRNA target sequence
tcttcttcttctgttttatatgct

SEQ ID NO: 43984 - DNA, 24 bp, Artificial sequence
  SiRNA target sequence
cttcttcttctgttttatatgcta

SEQ ID NO: 43985 - DNA, 24 bp, Artificial sequence
  SiRNA target sequence
ttcttcttctgttttatatgctag

SEQ ID NO: 43986 - DNA, 24 bp, Artificial sequence
  SiRNA target sequence
tcttcttctgttttatatgctagt

SEQ ID NO: 43987 - DNA, 24 bp, Artificial sequence
  SiRNA target sequence
cttcttctgttttatatgctagta

SEQ ID NO: 43988 - DNA, 24 bp, Artificial sequence
  SiRNA target sequence
ttcttctgttttatatgctagtat

SEQ ID NO: 43989 - DNA, 24 bp, Artificial sequence
  SiRNA target sequence
tcttctgttttatatgctagtata

SEQ ID NO: 43990 - DNA, 24 bp, Artificial sequence
  SiRNA target sequence
cttctgttttatatgctagtatag

SEQ ID NO: 43991 - DNA, 24 bp, Artificial sequence
  SiRNA target sequence
ttctgttttatatgctagtatagt

SEQ ID NO: 43992 - DNA, 24 bp, Artificial sequence
  SiRNA target sequence
tctgttttatatgctagtatagtc

SEQ ID NO: 43993 - DNA, 24 bp, Artificial sequence
  SiRNA target sequence
ctgttttatatgctagtatagtct

SEQ ID NO: 43994 - DNA, 24 bp, Artificial sequence
  SiRNA target sequence
tgttttatatgctagtatagtctc

SEQ ID NO: 43995 - DNA, 24 bp, Artificial sequence
  SiRNA target sequence
gttttatatgctagtatagtctca

SEQ ID NO: 43996 - DNA, 24 bp, Artificial sequence
  SiRNA target sequence
ttttatatgctagtatagtctcat

SEQ ID NO: 43997 - DNA, 24 bp, Artificial sequence
  SiRNA target sequence
tttatatgctagtatagtctcatg

SEQ ID NO: 43998 - DNA, 24 bp, Artificial sequence
  SiRNA target sequence
ttatatgctagtatagtctcatga

SEQ ID NO: 43999 - DNA, 24 bp, Artificial sequence
  SiRNA target sequence
tatatgctagtatagtctcatgat

SEQ ID NO: 44000 - DNA, 24 bp, Artificial sequence
  SiRNA target sequence
atatgctagtatagtctcatgatt

SEQ ID NO: 44001 - DNA, 24 bp, Artificial sequence
  SiRNA target sequence
tatgctagtatagtctcatgatta

SEQ ID NO: 44002 - DNA, 24 bp, Artificial sequence
  SiRNA target sequence
atgctagtatagtctcatgattaa

SEQ ID NO: 44003 - DNA, 24 bp, Artificial sequence
  SiRNA target sequence
tgctagtatagtctcatgattaat

SEQ ID NO: 44004 - DNA, 24 bp, Artificial sequence
  SiRNA target sequence
gctagtatagtctcatgattaatt

SEQ ID NO: 44005 - DNA, 24 bp, Artificial sequence
  SiRNA target sequence
ctagtatagtctcatgattaatta

SEQ ID NO: 44006 - DNA, 24 bp, Artificial sequence
  SiRNA target sequence
tagtatagtctcatgattaattaa

SEQ ID NO: 44007 - DNA, 24 bp, Artificial sequence
  SiRNA target sequence
agtatagtctcatgattaattaaa

SEQ ID NO: 44008 - DNA, 24 bp, Artificial sequence
  SiRNA target sequence
gtatagtctcatgattaattaaag

SEQ ID NO: 44009 - DNA, 24 bp, Artificial sequence
  SiRNA target sequence
tatagtctcatgattaattaaaga

SEQ ID NO: 44010 - DNA, 24 bp, Artificial sequence
  SiRNA target sequence
atagtctcatgattaattaaagaa

SEQ ID NO: 44011 - DNA, 24 bp, Artificial sequence
  SiRNA target sequence
tagtctcatgattaattaaagaat

SEQ ID NO: 44012 - DNA, 24 bp, Artificial sequence
  SiRNA target sequence
agtctcatgattaattaaagaatc

SEQ ID NO: 44013 - DNA, 24 bp, Artificial sequence
  SiRNA target sequence
gtctcatgattaattaaagaatca

SEQ ID NO: 44014 - DNA, 24 bp, Artificial sequence
  SiRNA target sequence
tctcatgattaattaaagaatcat

SEQ ID NO: 44015 - DNA, 24 bp, Artificial sequence
  SiRNA target sequence
ctcatgattaattaaagaatcatg

SEQ ID NO: 44016 - DNA, 24 bp, Artificial sequence
  SiRNA target sequence
tcatgattaattaaagaatcatgt

SEQ ID NO: 44017 - DNA, 24 bp, Artificial sequence
  SiRNA target sequence
catgattaattaaagaatcatgta

SEQ ID NO: 44018 - DNA, 24 bp, Artificial sequence
  SiRNA target sequence
atgattaattaaagaatcatgtaa

SEQ ID NO: 44019 - DNA, 24 bp, Artificial sequence
  SiRNA target sequence
tgattaattaaagaatcatgtaag

SEQ ID NO: 44020 - DNA, 24 bp, Artificial sequence
  SiRNA target sequence
gattaattaaagaatcatgtaagt

SEQ ID NO: 44021 - DNA, 24 bp, Artificial sequence
  SiRNA target sequence
attaattaaagaatcatgtaagtg

SEQ ID NO: 44022 - DNA, 24 bp, Artificial sequence
  SiRNA target sequence
ttaattaaagaatcatgtaagtga

SEQ ID NO: 44023 - DNA, 24 bp, Artificial sequence
  SiRNA target sequence
taattaaagaatcatgtaagtgat

SEQ ID NO: 44024 - DNA, 24 bp, Artificial sequence
  SiRNA target sequence
aattaaagaatcatgtaagtgatt

SEQ ID NO: 44025 - DNA, 24 bp, Artificial sequence
  SiRNA target sequence
attaaagaatcatgtaagtgattt

SEQ ID NO: 44026 - DNA, 24 bp, Artificial sequence
  SiRNA target sequence
ttaaagaatcatgtaagtgatttg

SEQ ID NO: 44027 - DNA, 24 bp, Artificial sequence
  SiRNA target sequence
taaagaatcatgtaagtgatttga

SEQ ID NO: 44028 - DNA, 24 bp, Artificial sequence
  SiRNA target sequence
aaagaatcatgtaagtgatttgag

SEQ ID NO: 44029 - DNA, 24 bp, Artificial sequence
  SiRNA target sequence
aagaatcatgtaagtgatttgagc

SEQ ID NO: 44030 - DNA, 24 bp, Artificial sequence
  SiRNA target sequence
agaatcatgtaagtgatttgagca

SEQ ID NO: 44031 - DNA, 24 bp, Artificial sequence
  SiRNA target sequence
gaatcatgtaagtgatttgagcat

SEQ ID NO: 44032 - DNA, 24 bp, Artificial sequence
  SiRNA target sequence
aatcatgtaagtgatttgagcatc

SEQ ID NO: 44033 - DNA, 24 bp, Artificial sequence
  SiRNA target sequence
atcatgtaagtgatttgagcatct

SEQ ID NO: 44034 - DNA, 24 bp, Artificial sequence
  SiRNA target sequence
tcatgtaagtgatttgagcatctt

SEQ ID NO: 44035 - DNA, 24 bp, Artificial sequence
  SiRNA target sequence
catgtaagtgatttgagcatcttt

SEQ ID NO: 44036 - DNA, 24 bp, Artificial sequence
  SiRNA target sequence
atgtaagtgatttgagcatctttg

SEQ ID NO: 44037 - DNA, 24 bp, Artificial sequence
  SiRNA target sequence
tgtaagtgatttgagcatctttgt

SEQ ID NO: 44038 - DNA, 24 bp, Artificial sequence
  SiRNA target sequence
gtaagtgatttgagcatctttgtt

SEQ ID NO: 44039 - DNA, 24 bp, Artificial sequence
  SiRNA target sequence
taagtgatttgagcatctttgttg

SEQ ID NO: 44040 - DNA, 24 bp, Artificial sequence
  SiRNA target sequence
aagtgatttgagcatctttgttgt

SEQ ID NO: 44041 - DNA, 24 bp, Artificial sequence
  SiRNA target sequence
agtgatttgagcatctttgttgtg

SEQ ID NO: 44042 - DNA, 24 bp, Artificial sequence
  SiRNA target sequence
gtgatttgagcatctttgttgtgc

SEQ ID NO: 44043 - DNA, 24 bp, Artificial sequence
  SiRNA target sequence
tgatttgagcatctttgttgtgcg

SEQ ID NO: 44044 - DNA, 24 bp, Artificial sequence
  SiRNA target sequence
gatttgagcatctttgttgtgcgc

SEQ ID NO: 44045 - DNA, 24 bp, Artificial sequence
  SiRNA target sequence
atttgagcatctttgttgtgcgca

SEQ ID NO: 44046 - DNA, 24 bp, Artificial sequence
  SiRNA target sequence
tttgagcatctttgttgtgcgcaa

SEQ ID NO: 44047 - DNA, 24 bp, Artificial sequence
  SiRNA target sequence
ttgagcatctttgttgtgcgcaat

SEQ ID NO: 44048 - DNA, 24 bp, Artificial sequence
  SiRNA target sequence
tgagcatctttgttgtgcgcaatt

SEQ ID NO: 44049 - DNA, 24 bp, Artificial sequence
  SiRNA target sequence
gagcatctttgttgtgcgcaatta

SEQ ID NO: 44050 - DNA, 24 bp, Artificial sequence
  SiRNA target sequence
agcatctttgttgtgcgcaattat

SEQ ID NO: 44051 - DNA, 24 bp, Artificial sequence
  SiRNA target sequence
gcatctttgttgtgcgcaattata

SEQ ID NO: 44052 - DNA, 24 bp, Artificial sequence
  SiRNA target sequence
catctttgttgtgcgcaattatat

SEQ ID NO: 44053 - DNA, 24 bp, Artificial sequence
  SiRNA target sequence
atctttgttgtgcgcaattatatt

SEQ ID NO: 44054 - DNA, 24 bp, Artificial sequence
  SiRNA target sequence
tctttgttgtgcgcaattatattc

SEQ ID NO: 44055 - DNA, 24 bp, Artificial sequence
  SiRNA target sequence
ctttgttgtgcgcaattatattct

SEQ ID NO: 44056 - DNA, 24 bp, Artificial sequence
  SiRNA target sequence
tttgttgtgcgcaattatattctt

SEQ ID NO: 44057 - DNA, 24 bp, Artificial sequence
  SiRNA target sequence
ttgttgtgcgcaattatattcttt

SEQ ID NO: 44058 - DNA, 24 bp, Artificial sequence
  SiRNA target sequence
tgttgtgcgcaattatattctttt

SEQ ID NO: 44059 - DNA, 24 bp, Artificial sequence
  SiRNA target sequence
gttgtgcgcaattatattcttttc

SEQ ID NO: 44060 - DNA, 24 bp, Artificial sequence
  SiRNA target sequence
ttgtgcgcaattatattcttttct

SEQ ID NO: 44061 - DNA, 24 bp, Artificial sequence
  SiRNA target sequence
tgtgcgcaattatattcttttctt

SEQ ID NO: 44062 - DNA, 24 bp, Artificial sequence
  SiRNA target sequence
gtgcgcaattatattcttttctta

SEQ ID NO: 44063 - DNA, 24 bp, Artificial sequence
  SiRNA target sequence
tgcgcaattatattcttttcttat

SEQ ID NO: 44064 - DNA, 24 bp, Artificial sequence
  SiRNA target sequence
gcgcaattatattcttttcttatt

SEQ ID NO: 44065 - DNA, 24 bp, Artificial sequence
  SiRNA target sequence
cgcaattatattcttttcttattc

SEQ ID NO: 44066 - DNA, 24 bp, Artificial sequence
  SiRNA target sequence
gcaattatattcttttcttattcc

SEQ ID NO: 44067 - DNA, 24 bp, Artificial sequence
  SiRNA target sequence
caattatattcttttcttattcct

SEQ ID NO: 44068 - DNA, 24 bp, Artificial sequence
  SiRNA target sequence
aattatattcttttcttattcctg

SEQ ID NO: 44069 - DNA, 24 bp, Artificial sequence
  SiRNA target sequence
attatattcttttcttattcctgt

SEQ ID NO: 44070 - DNA, 24 bp, Artificial sequence
  SiRNA target sequence
ttatattcttttcttattcctgta

SEQ ID NO: 44071 - DNA, 24 bp, Artificial sequence
  SiRNA target sequence
tatattcttttcttattcctgtac

SEQ ID NO: 44072 - DNA, 24 bp, Artificial sequence
  SiRNA target sequence
atattcttttcttattcctgtacg

SEQ ID NO: 44073 - DNA, 24 bp, Artificial sequence
  SiRNA target sequence
tattcttttcttattcctgtacgc

SEQ ID NO: 44074 - DNA, 24 bp, Artificial sequence
  SiRNA target sequence
attcttttcttattcctgtacgcc

SEQ ID NO: 44075 - DNA, 24 bp, Artificial sequence
  SiRNA target sequence
ttcttttcttattcctgtacgcca

SEQ ID NO: 44076 - DNA, 24 bp, Artificial sequence
  SiRNA target sequence
tcttttcttattcctgtacgccaa

SEQ ID NO: 44077 - DNA, 24 bp, Artificial sequence
  SiRNA target sequence
cttttcttattcctgtacgccaat

SEQ ID NO: 44078 - DNA, 24 bp, Artificial sequence
  SiRNA target sequence
ttttcttattcctgtacgccaatg

SEQ ID NO: 44079 - DNA, 24 bp, Artificial sequence
  SiRNA target sequence
tttcttattcctgtacgccaatga

SEQ ID NO: 44080 - DNA, 24 bp, Artificial sequence
  SiRNA target sequence
ttcttattcctgtacgccaatgaa

SEQ ID NO: 44081 - DNA, 24 bp, Artificial sequence
  SiRNA target sequence
tcttattcctgtacgccaatgaac

SEQ ID NO: 44082 - DNA, 24 bp, Artificial sequence
  SiRNA target sequence
cttattcctgtacgccaatgaact

SEQ ID NO: 44083 - DNA, 24 bp, Artificial sequence
  SiRNA target sequence
ttattcctgtacgccaatgaacta

SEQ ID NO: 44084 - DNA, 24 bp, Artificial sequence
  SiRNA target sequence
tattcctgtacgccaatgaactat

SEQ ID NO: 44085 - DNA, 24 bp, Artificial sequence
  SiRNA target sequence
attcctgtacgccaatgaactatt

SEQ ID NO: 44086 - DNA, 24 bp, Artificial sequence
  SiRNA target sequence
ttcctgtacgccaatgaactattt

SEQ ID NO: 44087 - DNA, 24 bp, Artificial sequence
  SiRNA target sequence
tcctgtacgccaatgaactatttt

SEQ ID NO: 44088 - DNA, 24 bp, Artificial sequence
  SiRNA target sequence
cctgtacgccaatgaactattttc

SEQ ID NO: 44089 - DNA, 24 bp, Artificial sequence
  SiRNA target sequence
ctgtacgccaatgaactattttcg

SEQ ID NO: 44090 - DNA, 24 bp, Artificial sequence
  SiRNA target sequence
tgtacgccaatgaactattttcgc

SEQ ID NO: 44091 - DNA, 24 bp, Artificial sequence
  SiRNA target sequence
gtacgccaatgaactattttcgca

SEQ ID NO: 44092 - DNA, 24 bp, Artificial sequence
  SiRNA target sequence
tacgccaatgaactattttcgcag

SEQ ID NO: 44093 - DNA, 24 bp, Artificial sequence
  SiRNA target sequence
acgccaatgaactattttcgcagt

SEQ ID NO: 44094 - DNA, 24 bp, Artificial sequence
  SiRNA target sequence
cgccaatgaactattttcgcagtt

SEQ ID NO: 44095 - DNA, 24 bp, Artificial sequence
  SiRNA target sequence
gccaatgaactattttcgcagttg

SEQ ID NO: 44096 - DNA, 24 bp, Artificial sequence
  SiRNA target sequence
ccaatgaactattttcgcagttgc

SEQ ID NO: 44097 - DNA, 24 bp, Artificial sequence
  SiRNA target sequence
caatgaactattttcgcagttgca

SEQ ID NO: 44098 - DNA, 24 bp, Artificial sequence
  SiRNA target sequence
aatgaactattttcgcagttgcaa

SEQ ID NO: 44099 - DNA, 24 bp, Artificial sequence
  SiRNA target sequence
atgaactattttcgcagttgcaag

SEQ ID NO: 44100 - DNA, 24 bp, Artificial sequence
  SiRNA target sequence
tgaactattttcgcagttgcaagg

SEQ ID NO: 44101 - DNA, 24 bp, Artificial sequence
  SiRNA target sequence
gaactattttcgcagttgcaagga

SEQ ID NO: 44102 - DNA, 24 bp, Artificial sequence
  SiRNA target sequence
aactattttcgcagttgcaaggat

SEQ ID NO: 44103 - DNA, 24 bp, Artificial sequence
  SiRNA target sequence
actattttcgcagttgcaaggatg

SEQ ID NO: 44104 - DNA, 24 bp, Artificial sequence
  SiRNA target sequence
ctattttcgcagttgcaaggatgt

SEQ ID NO: 44105 - DNA, 24 bp, Artificial sequence
  SiRNA target sequence
tattttcgcagttgcaaggatgta

SEQ ID NO: 44106 - DNA, 24 bp, Artificial sequence
  SiRNA target sequence
attttcgcagttgcaaggatgtaa

SEQ ID NO: 44107 - DNA, 24 bp, Artificial sequence
  SiRNA target sequence
ttttcgcagttgcaaggatgtaaa

SEQ ID NO: 44108 - DNA, 24 bp, Artificial sequence
  SiRNA target sequence
tttcgcagttgcaaggatgtaaac

SEQ ID NO: 44109 - DNA, 24 bp, Artificial sequence
  SiRNA target sequence
ttcgcagttgcaaggatgtaaact

SEQ ID NO: 44110 - DNA, 24 bp, Artificial sequence
  SiRNA target sequence
tcgcagttgcaaggatgtaaacta

SEQ ID NO: 44111 - DNA, 24 bp, Artificial sequence
  SiRNA target sequence
cgcagttgcaaggatgtaaactaa

SEQ ID NO: 44112 - DNA, 24 bp, Artificial sequence
  SiRNA target sequence
gcagttgcaaggatgtaaactaat

SEQ ID NO: 44113 - DNA, 24 bp, Artificial sequence
  SiRNA target sequence
cagttgcaaggatgtaaactaata

SEQ ID NO: 44114 - DNA, 24 bp, Artificial sequence
  SiRNA target sequence
agttgcaaggatgtaaactaataa

SEQ ID NO: 44115 - DNA, 24 bp, Artificial sequence
  SiRNA target sequence
gttgcaaggatgtaaactaataat

SEQ ID NO: 44116 - DNA, 24 bp, Artificial sequence
  SiRNA target sequence
ttgcaaggatgtaaactaataatg

SEQ ID NO: 44117 - DNA, 24 bp, Artificial sequence
  SiRNA target sequence
tgcaaggatgtaaactaataatgt

SEQ ID NO: 44118 - DNA, 24 bp, Artificial sequence
  SiRNA target sequence
gcaaggatgtaaactaataatgtg

SEQ ID NO: 44119 - DNA, 24 bp, Artificial sequence
  SiRNA target sequence
caaggatgtaaactaataatgtga

SEQ ID NO: 44120 - DNA, 24 bp, Artificial sequence
  SiRNA target sequence
aaggatgtaaactaataatgtgat

SEQ ID NO: 44121 - DNA, 24 bp, Artificial sequence
  SiRNA target sequence
aggatgtaaactaataatgtgatt

SEQ ID NO: 44122 - DNA, 24 bp, Artificial sequence
  SiRNA target sequence
ggatgtaaactaataatgtgatta

SEQ ID NO: 44123 - DNA, 24 bp, Artificial sequence
  SiRNA target sequence
gatgtaaactaataatgtgattaa

SEQ ID NO: 44124 - DNA, 24 bp, Artificial sequence
  SiRNA target sequence
atgtaaactaataatgtgattaaa

SEQ ID NO: 44125 - DNA, 24 bp, Artificial sequence
  SiRNA target sequence
tgtaaactaataatgtgattaaaa

SEQ ID NO: 44126 - DNA, 24 bp, Artificial sequence
  SiRNA target sequence
gtaaactaataatgtgattaaaat

SEQ ID NO: 44127 - DNA, 24 bp, Artificial sequence
  SiRNA target sequence
taaactaataatgtgattaaaata

SEQ ID NO: 44128 - DNA, 24 bp, Artificial sequence
  SiRNA target sequence
aaactaataatgtgattaaaataa

SEQ ID NO: 44129 - DNA, 24 bp, Artificial sequence
  SiRNA target sequence
aactaataatgtgattaaaataat

SEQ ID NO: 44130 - DNA, 24 bp, Artificial sequence
  SiRNA target sequence
actaataatgtgattaaaataata

SEQ ID NO: 44131 - DNA, 24 bp, Artificial sequence
  SiRNA target sequence
ctaataatgtgattaaaataataa

SEQ ID NO: 44132 - DNA, 24 bp, Artificial sequence
  SiRNA target sequence
taataatgtgattaaaataataaa

SEQ ID NO: 44133 - DNA, 24 bp, Artificial sequence
  SiRNA target sequence
aataatgtgattaaaataataaac

SEQ ID NO: 44134 - DNA, 24 bp, Artificial sequence
  SiRNA target sequence
ataatgtgattaaaataataaaca

SEQ ID NO: 44135 - DNA, 24 bp, Artificial sequence
  SiRNA target sequence
taatgtgattaaaataataaacat

SEQ ID NO: 44136 - DNA, 24 bp, Artificial sequence
  SiRNA target sequence
aatgtgattaaaataataaacata

SEQ ID NO: 44137 - DNA, 24 bp, Artificial sequence
  SiRNA target sequence
atgtgattaaaataataaacatat

SEQ ID NO: 44138 - DNA, 24 bp, Artificial sequence
  SiRNA target sequence
tgtgattaaaataataaacatatt

SEQ ID NO: 44139 - DNA, 24 bp, Artificial sequence
  SiRNA target sequence
gtgattaaaataataaacatattt

SEQ ID NO: 44140 - DNA, 24 bp, Artificial sequence
  SiRNA target sequence
tgattaaaataataaacatatttg

SEQ ID NO: 44141 - DNA, 24 bp, Artificial sequence
  SiRNA target sequence
gattaaaataataaacatatttgt

SEQ ID NO: 44142 - DNA, 24 bp, Artificial sequence
  SiRNA target sequence
attaaaataataaacatatttgtc

SEQ ID NO: 44143 - DNA, 24 bp, Artificial sequence
  SiRNA target sequence
ttaaaataataaacatatttgtca

SEQ ID NO: 44144 - DNA, 24 bp, Artificial sequence
  SiRNA target sequence
taaaataataaacatatttgtcaa

SEQ ID NO: 44145 - DNA, 24 bp, Artificial sequence
  SiRNA target sequence
aaaataataaacatatttgtcaac

SEQ ID NO: 44146 - DNA, 24 bp, Artificial sequence
  SiRNA target sequence
aaataataaacatatttgtcaacc

SEQ ID NO: 44147 - DNA, 24 bp, Artificial sequence
  SiRNA target sequence
aataataaacatatttgtcaaccc

SEQ ID NO: 44148 - DNA, 24 bp, Artificial sequence
  SiRNA target sequence
ataataaacatatttgtcaaccct

SEQ ID NO: 44149 - DNA, 24 bp, Artificial sequence
  SiRNA target sequence
taataaacatatttgtcaacccta

SEQ ID NO: 44150 - DNA, 24 bp, Artificial sequence
  SiRNA target sequence
aataaacatatttgtcaaccctaa

SEQ ID NO: 44151 - DNA, 24 bp, Artificial sequence
  SiRNA target sequence
ataaacatatttgtcaaccctaaa

SEQ ID NO: 44152 - DNA, 24 bp, Artificial sequence
  SiRNA target sequence
taaacatatttgtcaaccctaaat

SEQ ID NO: 44153 - DNA, 24 bp, Artificial sequence
  SiRNA target sequence
aaacatatttgtcaaccctaaatt

SEQ ID NO: 44154 - DNA, 24 bp, Artificial sequence
  SiRNA target sequence
aacatatttgtcaaccctaaattt

SEQ ID NO: 44155 - DNA, 24 bp, Artificial sequence
  SiRNA target sequence
acatatttgtcaaccctaaatttg

SEQ ID NO: 44156 - DNA, 24 bp, Artificial sequence
  SiRNA target sequence
catatttgtcaaccctaaatttgt

SEQ ID NO: 44157 - DNA, 24 bp, Artificial sequence
  SiRNA target sequence
atatttgtcaaccctaaatttgta

SEQ ID NO: 44158 - DNA, 24 bp, Artificial sequence
  SiRNA target sequence
tatttgtcaaccctaaatttgtat

SEQ ID NO: 44159 - DNA, 24 bp, Artificial sequence
  SiRNA target sequence
atttgtcaaccctaaatttgtata

SEQ ID NO: 44160 - DNA, 24 bp, Artificial sequence
  SiRNA target sequence
tttgtcaaccctaaatttgtataa

SEQ ID NO: 44161 - DNA, 24 bp, Artificial sequence
  SiRNA target sequence
ttgtcaaccctaaatttgtataaa

SEQ ID NO: 44162 - DNA, 24 bp, Artificial sequence
  SiRNA target sequence
tgtcaaccctaaatttgtataaat

SEQ ID NO: 44163 - DNA, 24 bp, Artificial sequence
  SiRNA target sequence
gtcaaccctaaatttgtataaatt

SEQ ID NO: 44164 - DNA, 24 bp, Artificial sequence
  SiRNA target sequence
tcaaccctaaatttgtataaattg

SEQ ID NO: 44165 - DNA, 24 bp, Artificial sequence
  SiRNA target sequence
caaccctaaatttgtataaattga

SEQ ID NO: 44166 - DNA, 24 bp, Artificial sequence
  SiRNA target sequence
aaccctaaatttgtataaattgac

SEQ ID NO: 44167 - DNA, 24 bp, Artificial sequence
  SiRNA target sequence
accctaaatttgtataaattgacg

SEQ ID NO: 44168 - DNA, 24 bp, Artificial sequence
  SiRNA target sequence
ccctaaatttgtataaattgacga

SEQ ID NO: 44169 - DNA, 24 bp, Artificial sequence
  SiRNA target sequence
cctaaatttgtataaattgacgaa

SEQ ID NO: 44170 - DNA, 24 bp, Artificial sequence
  SiRNA target sequence
ctaaatttgtataaattgacgaac

SEQ ID NO: 44171 - DNA, 24 bp, Artificial sequence
  SiRNA target sequence
taaatttgtataaattgacgaaca

SEQ ID NO: 44172 - DNA, 24 bp, Artificial sequence
  SiRNA target sequence
aaatttgtataaattgacgaacac

SEQ ID NO: 44173 - DNA, 24 bp, Artificial sequence
  SiRNA target sequence
aatttgtataaattgacgaacacg

SEQ ID NO: 44174 - DNA, 24 bp, Artificial sequence
  SiRNA target sequence
atttgtataaattgacgaacacgc

SEQ ID NO: 44175 - DNA, 24 bp, Artificial sequence
  SiRNA target sequence
tttgtataaattgacgaacacgcc

SEQ ID NO: 44176 - DNA, 24 bp, Artificial sequence
  SiRNA target sequence
ttgtataaattgacgaacacgcca

SEQ ID NO: 44177 - DNA, 24 bp, Artificial sequence
  SiRNA target sequence
tgtataaattgacgaacacgccaa

SEQ ID NO: 44178 - DNA, 24 bp, Artificial sequence
  SiRNA target sequence
gtataaattgacgaacacgccaat

SEQ ID NO: 44179 - DNA, 24 bp, Artificial sequence
  SiRNA target sequence
tataaattgacgaacacgccaata

SEQ ID NO: 44180 - DNA, 24 bp, Artificial sequence
  SiRNA target sequence
ataaattgacgaacacgccaatat

SEQ ID NO: 44181 - DNA, 24 bp, Artificial sequence
  SiRNA target sequence
taaattgacgaacacgccaatata

SEQ ID NO: 44182 - DNA, 24 bp, Artificial sequence
  SiRNA target sequence
aaattgacgaacacgccaatataa

SEQ ID NO: 44183 - DNA, 24 bp, Artificial sequence
  SiRNA target sequence
aattgacgaacacgccaatataac

SEQ ID NO: 44184 - DNA, 24 bp, Artificial sequence
  SiRNA target sequence
attgacgaacacgccaatataact

SEQ ID NO: 44185 - DNA, 24 bp, Artificial sequence
  SiRNA target sequence
ttgacgaacacgccaatataactg

SEQ ID NO: 44186 - DNA, 24 bp, Artificial sequence
  SiRNA target sequence
tgacgaacacgccaatataactgt

SEQ ID NO: 44187 - DNA, 24 bp, Artificial sequence
  SiRNA target sequence
gacgaacacgccaatataactgta

SEQ ID NO: 44188 - DNA, 24 bp, Artificial sequence
  SiRNA target sequence
acgaacacgccaatataactgtaa

SEQ ID NO: 44189 - DNA, 24 bp, Artificial sequence
  SiRNA target sequence
cgaacacgccaatataactgtaaa

SEQ ID NO: 44190 - DNA, 24 bp, Artificial sequence
  SiRNA target sequence
gaacacgccaatataactgtaaaa

SEQ ID NO: 44191 - DNA, 24 bp, Artificial sequence
  SiRNA target sequence
aacacgccaatataactgtaaaaa

SEQ ID NO: 44192 - DNA, 24 bp, Artificial sequence
  SiRNA target sequence
acacgccaatataactgtaaaaaa

SEQ ID NO: 44193 - DNA, 24 bp, Artificial sequence
  SiRNA target sequence
cacgccaatataactgtaaaaaaa

SEQ ID NO: 44194 - DNA, 24 bp, Artificial sequence
  SiRNA target sequence
acgccaatataactgtaaaaaaaa

SEQ ID NO: 44195 - DNA, 24 bp, Artificial sequence
  SiRNA target sequence
cgccaatataactgtaaaaaaaat

SEQ ID NO: 44196 - DNA, 24 bp, Artificial sequence
  SiRNA target sequence
gccaatataactgtaaaaaaaata

SEQ ID NO: 44197 - DNA, 24 bp, Artificial sequence
  SiRNA target sequence
ccaatataactgtaaaaaaaatat

SEQ ID NO: 44198 - DNA, 24 bp, Artificial sequence
  SiRNA target sequence
caatataactgtaaaaaaaatatt

SEQ ID NO: 44199 - DNA, 24 bp, Artificial sequence
  SiRNA target sequence
aatataactgtaaaaaaaatattt

SEQ ID NO: 44200 - DNA, 24 bp, Artificial sequence
  SiRNA target sequence
atataactgtaaaaaaaatattta

SEQ ID NO: 44201 - DNA, 24 bp, Artificial sequence
  SiRNA target sequence
tataactgtaaaaaaaatatttat

SEQ ID NO: 44202 - DNA, 24 bp, Artificial sequence
  SiRNA target sequence
ataactgtaaaaaaaatatttatg

SEQ ID NO: 44203 - DNA, 24 bp, Artificial sequence
  SiRNA target sequence
taactgtaaaaaaaatatttatga

SEQ ID NO: 44204 - DNA, 24 bp, Artificial sequence
  SiRNA target sequence
aactgtaaaaaaaatatttatgat

SEQ ID NO: 44205 - DNA, 24 bp, Artificial sequence
  SiRNA target sequence
actgtaaaaaaaatatttatgata

SEQ ID NO: 44206 - DNA, 24 bp, Artificial sequence
  SiRNA target sequence
ctgtaaaaaaaatatttatgatat

SEQ ID NO: 44207 - DNA, 24 bp, Artificial sequence
  SiRNA target sequence
tgtaaaaaaaatatttatgatatt

SEQ ID NO: 44208 - DNA, 24 bp, Artificial sequence
  SiRNA target sequence
gtaaaaaaaatatttatgatatta

SEQ ID NO: 44209 - DNA, 24 bp, Artificial sequence
  SiRNA target sequence
taaaaaaaatatttatgatattaa

SEQ ID NO: 44210 - DNA, 24 bp, Artificial sequence
  SiRNA target sequence
aaaaaaaatatttatgatattaac

SEQ ID NO: 44211 - DNA, 24 bp, Artificial sequence
  SiRNA target sequence
aaaaaaatatttatgatattaaca

SEQ ID NO: 44212 - DNA, 24 bp, Artificial sequence
  SiRNA target sequence
aaaaaatatttatgatattaacaa

SEQ ID NO: 44213 - DNA, 24 bp, Artificial sequence
  SiRNA target sequence
aaaaatatttatgatattaacaaa

SEQ ID NO: 44214 - DNA, 24 bp, Artificial sequence
  SiRNA target sequence
aaaatatttatgatattaacaaat

SEQ ID NO: 44215 - DNA, 24 bp, Artificial sequence
  SiRNA target sequence
aaatatttatgatattaacaaata

SEQ ID NO: 44216 - DNA, 24 bp, Artificial sequence
  SiRNA target sequence
aatatttatgatattaacaaataa

SEQ ID NO: 44217 - DNA, 24 bp, Artificial sequence
  SiRNA target sequence
atatttatgatattaacaaataaa

SEQ ID NO: 44218 - DNA, 24 bp, Artificial sequence
  SiRNA target sequence
tatttatgatattaacaaataaaa

SEQ ID NO: 44219 - DNA, 24 bp, Artificial sequence
  SiRNA target sequence
atttatgatattaacaaataaaac

SEQ ID NO: 44220 - DNA, 24 bp, Artificial sequence
  SiRNA target sequence
tttatgatattaacaaataaaact

SEQ ID NO: 44221 - DNA, 24 bp, Artificial sequence
  SiRNA target sequence
ttatgatattaacaaataaaactt

SEQ ID NO: 44222 - DNA, 24 bp, Artificial sequence
  SiRNA target sequence
tatgatattaacaaataaaacttc

SEQ ID NO: 44223 - DNA, 24 bp, Artificial sequence
  SiRNA target sequence
atgatattaacaaataaaacttcg

SEQ ID NO: 44224 - DNA, 24 bp, Artificial sequence
  SiRNA target sequence
tgatattaacaaataaaacttcga

SEQ ID NO: 44225 - DNA, 24 bp, Artificial sequence
  SiRNA target sequence
gatattaacaaataaaacttcgat

SEQ ID NO: 44226 - DNA, 24 bp, Artificial sequence
  SiRNA target sequence
atattaacaaataaaacttcgatc

SEQ ID NO: 44227 - DNA, 24 bp, Artificial sequence
  SiRNA target sequence
tattaacaaataaaacttcgatca

SEQ ID NO: 44228 - DNA, 24 bp, Artificial sequence
  SiRNA target sequence
attaacaaataaaacttcgatcaa

SEQ ID NO: 44229 - DNA, 24 bp, Artificial sequence
  SiRNA target sequence
ttaacaaataaaacttcgatcaat

SEQ ID NO: 44230 - DNA, 24 bp, Artificial sequence
  SiRNA target sequence
taacaaataaaacttcgatcaatt

SEQ ID NO: 44231 - DNA, 24 bp, Artificial sequence
  SiRNA target sequence
aacaaataaaacttcgatcaattc

SEQ ID NO: 44232 - DNA, 24 bp, Artificial sequence
  SiRNA target sequence
acaaataaaacttcgatcaattca

SEQ ID NO: 44233 - DNA, 24 bp, Artificial sequence
  SiRNA target sequence
caaataaaacttcgatcaattcac

SEQ ID NO: 44234 - DNA, 24 bp, Artificial sequence
  SiRNA target sequence
aaataaaacttcgatcaattcact

SEQ ID NO: 44235 - DNA, 24 bp, Artificial sequence
  SiRNA target sequence
aataaaacttcgatcaattcactt

SEQ ID NO: 44236 - DNA, 24 bp, Artificial sequence
  SiRNA target sequence
ataaaacttcgatcaattcactta

SEQ ID NO: 44237 - DNA, 24 bp, Artificial sequence
  SiRNA target sequence
taaaacttcgatcaattcacttat

SEQ ID NO: 44238 - DNA, 24 bp, Artificial sequence
  SiRNA target sequence
aaaacttcgatcaattcacttatt

SEQ ID NO: 44239 - DNA, 24 bp, Artificial sequence
  SiRNA target sequence
aaacttcgatcaattcacttattg

SEQ ID NO: 44240 - DNA, 24 bp, Artificial sequence
  SiRNA target sequence
aacttcgatcaattcacttattgc

SEQ ID NO: 44241 - DNA, 24 bp, Artificial sequence
  SiRNA target sequence
acttcgatcaattcacttattgct

SEQ ID NO: 44242 - DNA, 24 bp, Artificial sequence
  SiRNA target sequence
cttcgatcaattcacttattgctt

SEQ ID NO: 44243 - DNA, 24 bp, Artificial sequence
  SiRNA target sequence
ttcgatcaattcacttattgcttt

SEQ ID NO: 44244 - DNA, 24 bp, Artificial sequence
  SiRNA target sequence
tcgatcaattcacttattgcttta

SEQ ID NO: 44245 - DNA, 24 bp, Artificial sequence
  SiRNA target sequence
cgatcaattcacttattgctttac

SEQ ID NO: 44246 - DNA, 24 bp, Artificial sequence
  SiRNA target sequence
gatcaattcacttattgctttact

SEQ ID NO: 44247 - DNA, 24 bp, Artificial sequence
  SiRNA target sequence
atcaattcacttattgctttactt

SEQ ID NO: 44248 - DNA, 24 bp, Artificial sequence
  SiRNA target sequence
tcaattcacttattgctttacttt

SEQ ID NO: 44249 - DNA, 24 bp, Artificial sequence
  SiRNA target sequence
caattcacttattgctttactttc

SEQ ID NO: 44250 - DNA, 24 bp, Artificial sequence
  SiRNA target sequence
aattcacttattgctttactttct

SEQ ID NO: 44251 - DNA, 24 bp, Artificial sequence
  SiRNA target sequence
attcacttattgctttactttctc

SEQ ID NO: 44252 - DNA, 24 bp, Artificial sequence
  SiRNA target sequence
ttcacttattgctttactttctcg

SEQ ID NO: 44253 - DNA, 24 bp, Artificial sequence
  SiRNA target sequence
tcacttattgctttactttctcgg

SEQ ID NO: 44254 - DNA, 24 bp, Artificial sequence
  SiRNA target sequence
cacttattgctttactttctcggt

SEQ ID NO: 44255 - DNA, 24 bp, Artificial sequence
  SiRNA target sequence
acttattgctttactttctcggtc

SEQ ID NO: 44256 - DNA, 24 bp, Artificial sequence
  SiRNA target sequence
cttattgctttactttctcggtct

SEQ ID NO: 44257 - DNA, 24 bp, Artificial sequence
  SiRNA target sequence
ttattgctttactttctcggtcta

SEQ ID NO: 44258 - DNA, 24 bp, Artificial sequence
  SiRNA target sequence
tattgctttactttctcggtctat

SEQ ID NO: 44259 - DNA, 24 bp, Artificial sequence
  SiRNA target sequence
attgctttactttctcggtctatt

SEQ ID NO: 44260 - DNA, 24 bp, Artificial sequence
  SiRNA target sequence
ttgctttactttctcggtctatta

SEQ ID NO: 44261 - DNA, 24 bp, Artificial sequence
  SiRNA target sequence
tgctttactttctcggtctattat

SEQ ID NO: 44262 - DNA, 24 bp, Artificial sequence
  SiRNA target sequence
gctttactttctcggtctattatt

SEQ ID NO: 44263 - DNA, 24 bp, Artificial sequence
  SiRNA target sequence
ctttactttctcggtctattattg

SEQ ID NO: 44264 - DNA, 24 bp, Artificial sequence
  SiRNA target sequence
tttactttctcggtctattattgt

SEQ ID NO: 44265 - DNA, 24 bp, Artificial sequence
  SiRNA target sequence
ttactttctcggtctattattgtt

SEQ ID NO: 44266 - DNA, 24 bp, Artificial sequence
  SiRNA target sequence
tactttctcggtctattattgttt

SEQ ID NO: 44267 - DNA, 24 bp, Artificial sequence
  SiRNA target sequence
actttctcggtctattattgtttg

SEQ ID NO: 44268 - DNA, 24 bp, Artificial sequence
  SiRNA target sequence
ctttctcggtctattattgtttgt

SEQ ID NO: 44269 - DNA, 24 bp, Artificial sequence
  SiRNA target sequence
tttctcggtctattattgtttgta

SEQ ID NO: 44270 - DNA, 24 bp, Artificial sequence
  SiRNA target sequence
ttctcggtctattattgtttgtat

SEQ ID NO: 44271 - DNA, 24 bp, Artificial sequence
  SiRNA target sequence
tctcggtctattattgtttgtatt

SEQ ID NO: 44272 - DNA, 24 bp, Artificial sequence
  SiRNA target sequence
ctcggtctattattgtttgtattt

SEQ ID NO: 44273 - DNA, 24 bp, Artificial sequence
  SiRNA target sequence
tcggtctattattgtttgtatttc

SEQ ID NO: 44274 - DNA, 24 bp, Artificial sequence
  SiRNA target sequence
cggtctattattgtttgtatttca

SEQ ID NO: 44275 - DNA, 24 bp, Artificial sequence
  SiRNA target sequence
ggtctattattgtttgtatttcac

SEQ ID NO: 44276 - DNA, 24 bp, Artificial sequence
  SiRNA target sequence
gtctattattgtttgtatttcacc

SEQ ID NO: 44277 - DNA, 24 bp, Artificial sequence
  SiRNA target sequence
tctattattgtttgtatttcaccg

SEQ ID NO: 44278 - DNA, 24 bp, Artificial sequence
  SiRNA target sequence
ctattattgtttgtatttcaccgc

SEQ ID NO: 44279 - DNA, 24 bp, Artificial sequence
  SiRNA target sequence
tattattgtttgtatttcaccgca

SEQ ID NO: 44280 - DNA, 24 bp, Artificial sequence
  SiRNA target sequence
attattgtttgtatttcaccgcat

SEQ ID NO: 44281 - DNA, 24 bp, Artificial sequence
  SiRNA target sequence
ttattgtttgtatttcaccgcatc

SEQ ID NO: 44282 - DNA, 24 bp, Artificial sequence
  SiRNA target sequence
tattgtttgtatttcaccgcatcc

SEQ ID NO: 44283 - DNA, 24 bp, Artificial sequence
  SiRNA target sequence
attgtttgtatttcaccgcatcct

SEQ ID NO: 44284 - DNA, 24 bp, Artificial sequence
  SiRNA target sequence
ttgtttgtatttcaccgcatccta

SEQ ID NO: 44285 - DNA, 24 bp, Artificial sequence
  SiRNA target sequence
tgtttgtatttcaccgcatcctat

SEQ ID NO: 44286 - DNA, 24 bp, Artificial sequence
  SiRNA target sequence
gtttgtatttcaccgcatcctatt

SEQ ID NO: 44287 - DNA, 24 bp, Artificial sequence
  SiRNA target sequence
tttgtatttcaccgcatcctattt

SEQ ID NO: 44288 - DNA, 24 bp, Artificial sequence
  SiRNA target sequence
ttgtatttcaccgcatcctatttt

SEQ ID NO: 44289 - DNA, 24 bp, Artificial sequence
  SiRNA target sequence
tgtatttcaccgcatcctatttta

SEQ ID NO: 44290 - DNA, 24 bp, Artificial sequence
  SiRNA target sequence
gtatttcaccgcatcctattttat

SEQ ID NO: 44291 - DNA, 24 bp, Artificial sequence
  SiRNA target sequence
tatttcaccgcatcctattttatt

SEQ ID NO: 44292 - DNA, 24 bp, Artificial sequence
  SiRNA target sequence
atttcaccgcatcctattttattg

SEQ ID NO: 44293 - DNA, 24 bp, Artificial sequence
  SiRNA target sequence
tttcaccgcatcctattttattgt

SEQ ID NO: 44294 - DNA, 24 bp, Artificial sequence
  SiRNA target sequence
ttcaccgcatcctattttattgta

SEQ ID NO: 44295 - DNA, 24 bp, Artificial sequence
  SiRNA target sequence
tcaccgcatcctattttattgtat

SEQ ID NO: 44296 - DNA, 24 bp, Artificial sequence
  SiRNA target sequence
caccgcatcctattttattgtatc

SEQ ID NO: 44297 - DNA, 24 bp, Artificial sequence
  SiRNA target sequence
accgcatcctattttattgtatct

SEQ ID NO: 44298 - DNA, 24 bp, Artificial sequence
  SiRNA target sequence
ccgcatcctattttattgtatcta

SEQ ID NO: 44299 - DNA, 24 bp, Artificial sequence
  SiRNA target sequence
cgcatcctattttattgtatctac

SEQ ID NO: 44300 - DNA, 24 bp, Artificial sequence
  SiRNA target sequence
gcatcctattttattgtatctact

SEQ ID NO: 44301 - DNA, 24 bp, Artificial sequence
  SiRNA target sequence
catcctattttattgtatctacta

SEQ ID NO: 44302 - DNA, 24 bp, Artificial sequence
  SiRNA target sequence
atcctattttattgtatctactaa

SEQ ID NO: 44303 - DNA, 24 bp, Artificial sequence
  SiRNA target sequence
tcctattttattgtatctactaag

SEQ ID NO: 44304 - DNA, 24 bp, Artificial sequence
  SiRNA target sequence
cctattttattgtatctactaagt

SEQ ID NO: 44305 - DNA, 24 bp, Artificial sequence
  SiRNA target sequence
ctattttattgtatctactaagtt

SEQ ID NO: 44306 - DNA, 24 bp, Artificial sequence
  SiRNA target sequence
tattttattgtatctactaagttc

SEQ ID NO: 44307 - DNA, 24 bp, Artificial sequence
  SiRNA target sequence
attttattgtatctactaagttcc

SEQ ID NO: 44308 - DNA, 24 bp, Artificial sequence
  SiRNA target sequence
ttttattgtatctactaagttcca

SEQ ID NO: 44309 - DNA, 24 bp, Artificial sequence
  SiRNA target sequence
tttattgtatctactaagttccat

SEQ ID NO: 44310 - DNA, 24 bp, Artificial sequence
  SiRNA target sequence
ttattgtatctactaagttccata

SEQ ID NO: 44311 - DNA, 24 bp, Artificial sequence
  SiRNA target sequence
tattgtatctactaagttccatat

SEQ ID NO: 44312 - DNA, 24 bp, Artificial sequence
  SiRNA target sequence
attgtatctactaagttccatatt

SEQ ID NO: 44313 - DNA, 24 bp, Artificial sequence
  SiRNA target sequence
ttgtatctactaagttccatattt

SEQ ID NO: 44314 - DNA, 24 bp, Artificial sequence
  SiRNA target sequence
tgtatctactaagttccatattta

SEQ ID NO: 44315 - DNA, 24 bp, Artificial sequence
  SiRNA target sequence
gtatctactaagttccatatttat

SEQ ID NO: 44316 - DNA, 24 bp, Artificial sequence
  SiRNA target sequence
tatctactaagttccatatttata

SEQ ID NO: 44317 - DNA, 24 bp, Artificial sequence
  SiRNA target sequence
atctactaagttccatatttataa

SEQ ID NO: 44318 - DNA, 24 bp, Artificial sequence
  SiRNA target sequence
tctactaagttccatatttataaa

SEQ ID NO: 44319 - DNA, 24 bp, Artificial sequence
  SiRNA target sequence
ctactaagttccatatttataaaa

SEQ ID NO: 44320 - DNA, 24 bp, Artificial sequence
  SiRNA target sequence
tactaagttccatatttataaaat

SEQ ID NO: 44321 - DNA, 24 bp, Artificial sequence
  SiRNA target sequence
actaagttccatatttataaaatt

SEQ ID NO: 44322 - DNA, 24 bp, Artificial sequence
  SiRNA target sequence
ctaagttccatatttataaaattt

SEQ ID NO: 44323 - DNA, 24 bp, Artificial sequence
  SiRNA target sequence
taagttccatatttataaaatttt

SEQ ID NO: 44324 - DNA, 24 bp, Artificial sequence
  SiRNA target sequence
aagttccatatttataaaattttt

SEQ ID NO: 44325 - DNA, 24 bp, Artificial sequence
  SiRNA target sequence
agttccatatttataaaattttta

SEQ ID NO: 44326 - DNA, 24 bp, Artificial sequence
  SiRNA target sequence
gttccatatttataaaatttttaa

SEQ ID NO: 44327 - DNA, 24 bp, Artificial sequence
  SiRNA target sequence
ttccatatttataaaatttttaaa

SEQ ID NO: 44328 - DNA, 24 bp, Artificial sequence
  SiRNA target sequence
tccatatttataaaatttttaaat

SEQ ID NO: 44329 - DNA, 24 bp, Artificial sequence
  SiRNA target sequence
ccatatttataaaatttttaaatg

SEQ ID NO: 44330 - DNA, 24 bp, Artificial sequence
  SiRNA target sequence
catatttataaaatttttaaatga

SEQ ID NO: 44331 - DNA, 24 bp, Artificial sequence
  SiRNA target sequence
atatttataaaatttttaaatgaa

SEQ ID NO: 44332 - DNA, 24 bp, Artificial sequence
  SiRNA target sequence
tatttataaaatttttaaatgaat

SEQ ID NO: 44333 - DNA, 24 bp, Artificial sequence
  SiRNA target sequence
atttataaaatttttaaatgaatt

SEQ ID NO: 44334 - DNA, 24 bp, Artificial sequence
  SiRNA target sequence
tttataaaatttttaaatgaattt

SEQ ID NO: 44335 - DNA, 24 bp, Artificial sequence
  SiRNA target sequence
ttataaaatttttaaatgaatttt

SEQ ID NO: 44336 - DNA, 24 bp, Artificial sequence
  SiRNA target sequence
tataaaatttttaaatgaattttt

SEQ ID NO: 44337 - DNA, 24 bp, Artificial sequence
  SiRNA target sequence
ataaaatttttaaatgaatttttt

SEQ ID NO: 44338 - DNA, 24 bp, Artificial sequence
  SiRNA target sequence
taaaatttttaaatgaattttttc

SEQ ID NO: 44339 - DNA, 24 bp, Artificial sequence
  SiRNA target sequence
aaaatttttaaatgaattttttcc

SEQ ID NO: 44340 - DNA, 24 bp, Artificial sequence
  SiRNA target sequence
aaatttttaaatgaattttttcct

SEQ ID NO: 44341 - DNA, 24 bp, Artificial sequence
  SiRNA target sequence
aatttttaaatgaattttttcctg

SEQ ID NO: 44342 - DNA, 24 bp, Artificial sequence
  SiRNA target sequence
atttttaaatgaattttttcctgt

SEQ ID NO: 44343 - DNA, 24 bp, Artificial sequence
  SiRNA target sequence
tttttaaatgaattttttcctgtc

SEQ ID NO: 44344 - DNA, 24 bp, Artificial sequence
  SiRNA target sequence
ttttaaatgaattttttcctgtca

SEQ ID NO: 44345 - DNA, 24 bp, Artificial sequence
  SiRNA target sequence
tttaaatgaattttttcctgtcag

SEQ ID NO: 44346 - DNA, 24 bp, Artificial sequence
  SiRNA target sequence
ttaaatgaattttttcctgtcagt

SEQ ID NO: 44347 - DNA, 24 bp, Artificial sequence
  SiRNA target sequence
taaatgaattttttcctgtcagtc

SEQ ID NO: 44348 - DNA, 24 bp, Artificial sequence
  SiRNA target sequence
aaatgaattttttcctgtcagtct

SEQ ID NO: 44349 - DNA, 24 bp, Artificial sequence
  SiRNA target sequence
aatgaattttttcctgtcagtctg

SEQ ID NO: 44350 - DNA, 24 bp, Artificial sequence
  SiRNA target sequence
atgaattttttcctgtcagtctga

SEQ ID NO: 44351 - DNA, 24 bp, Artificial sequence
  SiRNA target sequence
tgaattttttcctgtcagtctgaa

SEQ ID NO: 44352 - DNA, 24 bp, Artificial sequence
  SiRNA target sequence
gaattttttcctgtcagtctgaat

SEQ ID NO: 44353 - DNA, 24 bp, Artificial sequence
  SiRNA target sequence
aattttttcctgtcagtctgaata

SEQ ID NO: 44354 - DNA, 24 bp, Artificial sequence
  SiRNA target sequence
attttttcctgtcagtctgaatac

SEQ ID NO: 44355 - DNA, 24 bp, Artificial sequence
  SiRNA target sequence
ttttttcctgtcagtctgaataca

SEQ ID NO: 44356 - DNA, 24 bp, Artificial sequence
  SiRNA target sequence
tttttcctgtcagtctgaatacat

SEQ ID NO: 44357 - DNA, 24 bp, Artificial sequence
  SiRNA target sequence
ttttcctgtcagtctgaatacatg

SEQ ID NO: 44358 - DNA, 24 bp, Artificial sequence
  SiRNA target sequence
tttcctgtcagtctgaatacatgt

SEQ ID NO: 44359 - DNA, 24 bp, Artificial sequence
  SiRNA target sequence
ttcctgtcagtctgaatacatgtt

SEQ ID NO: 44360 - DNA, 24 bp, Artificial sequence
  SiRNA target sequence
tcctgtcagtctgaatacatgttg

SEQ ID NO: 44361 - DNA, 24 bp, Artificial sequence
  SiRNA target sequence
cctgtcagtctgaatacatgttga

SEQ ID NO: 44362 - DNA, 24 bp, Artificial sequence
  SiRNA target sequence
ctgtcagtctgaatacatgttgaa

SEQ ID NO: 44363 - DNA, 24 bp, Artificial sequence
  SiRNA target sequence
tgtcagtctgaatacatgttgaac

SEQ ID NO: 44364 - DNA, 24 bp, Artificial sequence
  SiRNA target sequence
gtcagtctgaatacatgttgaacg

SEQ ID NO: 44365 - DNA, 24 bp, Artificial sequence
  SiRNA target sequence
tcagtctgaatacatgttgaacgg

SEQ ID NO: 44366 - DNA, 24 bp, Artificial sequence
  SiRNA target sequence
cagtctgaatacatgttgaacggg

SEQ ID NO: 44367 - DNA, 24 bp, Artificial sequence
  SiRNA target sequence
agtctgaatacatgttgaacgggt

SEQ ID NO: 44368 - DNA, 24 bp, Artificial sequence
  SiRNA target sequence
gtctgaatacatgttgaacgggtg

SEQ ID NO: 44369 - DNA, 24 bp, Artificial sequence
  SiRNA target sequence
tctgaatacatgttgaacgggtgt

SEQ ID NO: 44370 - DNA, 24 bp, Artificial sequence
  SiRNA target sequence
ctgaatacatgttgaacgggtgta

SEQ ID NO: 44371 - DNA, 24 bp, Artificial sequence
  SiRNA target sequence
tgaatacatgttgaacgggtgtaa

SEQ ID NO: 44372 - DNA, 24 bp, Artificial sequence
  SiRNA target sequence
gaatacatgttgaacgggtgtaac

SEQ ID NO: 44373 - DNA, 24 bp, Artificial sequence
  SiRNA target sequence
aatacatgttgaacgggtgtaaca

SEQ ID NO: 44374 - DNA, 24 bp, Artificial sequence
  SiRNA target sequence
atacatgttgaacgggtgtaacaa

SEQ ID NO: 44375 - DNA, 24 bp, Artificial sequence
  SiRNA target sequence
tacatgttgaacgggtgtaacaaa

SEQ ID NO: 44376 - DNA, 24 bp, Artificial sequence
  SiRNA target sequence
acatgttgaacgggtgtaacaaat

SEQ ID NO: 44377 - DNA, 24 bp, Artificial sequence
  SiRNA target sequence
catgttgaacgggtgtaacaaata

SEQ ID NO: 44378 - DNA, 24 bp, Artificial sequence
  SiRNA target sequence
atgttgaacgggtgtaacaaatat

SEQ ID NO: 44379 - DNA, 24 bp, Artificial sequence
  SiRNA target sequence
tgttgaacgggtgtaacaaatata

SEQ ID NO: 44380 - DNA, 24 bp, Artificial sequence
  SiRNA target sequence
gttgaacgggtgtaacaaatataa

SEQ ID NO: 44381 - DNA, 24 bp, Artificial sequence
  SiRNA target sequence
ttgaacgggtgtaacaaatataaa

SEQ ID NO: 44382 - DNA, 24 bp, Artificial sequence
  SiRNA target sequence
tgaacgggtgtaacaaatataaaa

SEQ ID NO: 44383 - DNA, 24 bp, Artificial sequence
  SiRNA target sequence
gaacgggtgtaacaaatataaaat

SEQ ID NO: 44384 - DNA, 24 bp, Artificial sequence
  SiRNA target sequence
aacgggtgtaacaaatataaaatt

SEQ ID NO: 44385 - DNA, 24 bp, Artificial sequence
  SiRNA target sequence
acgggtgtaacaaatataaaattg

SEQ ID NO: 44386 - DNA, 24 bp, Artificial sequence
  SiRNA target sequence
cgggtgtaacaaatataaaattgt

SEQ ID NO: 44387 - DNA, 24 bp, Artificial sequence
  SiRNA target sequence
gggtgtaacaaatataaaattgtt

SEQ ID NO: 44388 - DNA, 24 bp, Artificial sequence
  SiRNA target sequence
ggtgtaacaaatataaaattgtta

SEQ ID NO: 44389 - DNA, 24 bp, Artificial sequence
  SiRNA target sequence
gtgtaacaaatataaaattgttaa

SEQ ID NO: 44390 - DNA, 24 bp, Artificial sequence
  SiRNA target sequence
tgtaacaaatataaaattgttaag

SEQ ID NO: 44391 - DNA, 24 bp, Artificial sequence
  SiRNA target sequence
gtaacaaatataaaattgttaagt

SEQ ID NO: 44392 - DNA, 24 bp, Artificial sequence
  SiRNA target sequence
taacaaatataaaattgttaagtt

SEQ ID NO: 44393 - DNA, 24 bp, Artificial sequence
  SiRNA target sequence
aacaaatataaaattgttaagttc

SEQ ID NO: 44394 - DNA, 24 bp, Artificial sequence
  SiRNA target sequence
acaaatataaaattgttaagttct

SEQ ID NO: 44395 - DNA, 24 bp, Artificial sequence
  SiRNA target sequence
caaatataaaattgttaagttctg

SEQ ID NO: 44396 - DNA, 24 bp, Artificial sequence
  SiRNA target sequence
aaatataaaattgttaagttctga

SEQ ID NO: 44397 - DNA, 24 bp, Artificial sequence
  SiRNA target sequence
aatataaaattgttaagttctgac

SEQ ID NO: 44398 - DNA, 24 bp, Artificial sequence
  SiRNA target sequence
atataaaattgttaagttctgaca

SEQ ID NO: 44399 - DNA, 24 bp, Artificial sequence
  SiRNA target sequence
tataaaattgttaagttctgacat

SEQ ID NO: 44400 - DNA, 24 bp, Artificial sequence
  SiRNA target sequence
ataaaattgttaagttctgacatt

SEQ ID NO: 44401 - DNA, 24 bp, Artificial sequence
  SiRNA target sequence
taaaattgttaagttctgacattg

SEQ ID NO: 44402 - DNA, 24 bp, Artificial sequence
  SiRNA target sequence
aaaattgttaagttctgacattgt

SEQ ID NO: 44403 - DNA, 24 bp, Artificial sequence
  SiRNA target sequence
aaattgttaagttctgacattgta

SEQ ID NO: 44404 - DNA, 24 bp, Artificial sequence
  SiRNA target sequence
aattgttaagttctgacattgtaa

SEQ ID NO: 44405 - DNA, 24 bp, Artificial sequence
  SiRNA target sequence
attgttaagttctgacattgtaat

SEQ ID NO: 44406 - DNA, 24 bp, Artificial sequence
  SiRNA target sequence
ttgttaagttctgacattgtaatt

SEQ ID NO: 44407 - DNA, 24 bp, Artificial sequence
  SiRNA target sequence
tgttaagttctgacattgtaattg

SEQ ID NO: 44408 - DNA, 24 bp, Artificial sequence
  SiRNA target sequence
gttaagttctgacattgtaattga

SEQ ID NO: 44409 - DNA, 24 bp, Artificial sequence
  SiRNA target sequence
ttaagttctgacattgtaattgat

SEQ ID NO: 44410 - DNA, 24 bp, Artificial sequence
  SiRNA target sequence
taagttctgacattgtaattgata

SEQ ID NO: 44411 - DNA, 24 bp, Artificial sequence
  SiRNA target sequence
aagttctgacattgtaattgatac

SEQ ID NO: 44412 - DNA, 24 bp, Artificial sequence
  SiRNA target sequence
agttctgacattgtaattgataca

SEQ ID NO: 44413 - DNA, 24 bp, Artificial sequence
  SiRNA target sequence
gttctgacattgtaattgatacaa

SEQ ID NO: 44414 - DNA, 24 bp, Artificial sequence
  SiRNA target sequence
ttctgacattgtaattgatacaat

SEQ ID NO: 44415 - DNA, 24 bp, Artificial sequence
  SiRNA target sequence
tctgacattgtaattgatacaatt

SEQ ID NO: 44416 - DNA, 24 bp, Artificial sequence
  SiRNA target sequence
ctgacattgtaattgatacaattg

SEQ ID NO: 44417 - DNA, 24 bp, Artificial sequence
  SiRNA target sequence
tgacattgtaattgatacaattgt

SEQ ID NO: 44418 - DNA, 24 bp, Artificial sequence
  SiRNA target sequence
gacattgtaattgatacaattgtc

SEQ ID NO: 44419 - DNA, 24 bp, Artificial sequence
  SiRNA target sequence
acattgtaattgatacaattgtca

SEQ ID NO: 44420 - DNA, 24 bp, Artificial sequence
  SiRNA target sequence
cattgtaattgatacaattgtcaa

SEQ ID NO: 44421 - DNA, 24 bp, Artificial sequence
  SiRNA target sequence
attgtaattgatacaattgtcaaa

SEQ ID NO: 44422 - DNA, 24 bp, Artificial sequence
  SiRNA target sequence
ttgtaattgatacaattgtcaaaa

SEQ ID NO: 44423 - DNA, 24 bp, Artificial sequence
  SiRNA target sequence
tgtaattgatacaattgtcaaaac

SEQ ID NO: 44424 - DNA, 24 bp, Artificial sequence
  SiRNA target sequence
gtaattgatacaattgtcaaaact

SEQ ID NO: 44425 - DNA, 24 bp, Artificial sequence
  SiRNA target sequence
taattgatacaattgtcaaaactg

SEQ ID NO: 44426 - DNA, 24 bp, Artificial sequence
  SiRNA target sequence
aattgatacaattgtcaaaactgc

SEQ ID NO: 44427 - DNA, 24 bp, Artificial sequence
  SiRNA target sequence
attgatacaattgtcaaaactgca

SEQ ID NO: 44428 - DNA, 24 bp, Artificial sequence
  SiRNA target sequence
ttgatacaattgtcaaaactgcaa

SEQ ID NO: 44429 - DNA, 24 bp, Artificial sequence
  SiRNA target sequence
tgatacaattgtcaaaactgcaaa

SEQ ID NO: 44430 - DNA, 24 bp, Artificial sequence
  SiRNA target sequence
gatacaattgtcaaaactgcaaaa

SEQ ID NO: 44431 - DNA, 24 bp, Artificial sequence
  SiRNA target sequence
atacaattgtcaaaactgcaaaat

SEQ ID NO: 44432 - DNA, 24 bp, Artificial sequence
  SiRNA target sequence
tacaattgtcaaaactgcaaaata

SEQ ID NO: 44433 - DNA, 24 bp, Artificial sequence
  SiRNA target sequence
acaattgtcaaaactgcaaaatac

SEQ ID NO: 44434 - DNA, 24 bp, Artificial sequence
  SiRNA target sequence
caattgtcaaaactgcaaaataca

SEQ ID NO: 44435 - DNA, 24 bp, Artificial sequence
  SiRNA target sequence
aattgtcaaaactgcaaaatacaa

SEQ ID NO: 44436 - DNA, 24 bp, Artificial sequence
  SiRNA target sequence
attgtcaaaactgcaaaatacaaa

SEQ ID NO: 44437 - DNA, 24 bp, Artificial sequence
  SiRNA target sequence
ttgtcaaaactgcaaaatacaaaa

SEQ ID NO: 44438 - DNA, 24 bp, Artificial sequence
  SiRNA target sequence
tgtcaaaactgcaaaatacaaaag

SEQ ID NO: 44439 - DNA, 24 bp, Artificial sequence
  SiRNA target sequence
gtcaaaactgcaaaatacaaaaga

SEQ ID NO: 44440 - DNA, 24 bp, Artificial sequence
  SiRNA target sequence
tcaaaactgcaaaatacaaaagac

SEQ ID NO: 44441 - DNA, 24 bp, Artificial sequence
  SiRNA target sequence
caaaactgcaaaatacaaaagact

SEQ ID NO: 44442 - DNA, 24 bp, Artificial sequence
  SiRNA target sequence
aaaactgcaaaatacaaaagactt

SEQ ID NO: 44443 - DNA, 24 bp, Artificial sequence
  SiRNA target sequence
aaactgcaaaatacaaaagacttt

SEQ ID NO: 44444 - DNA, 24 bp, Artificial sequence
  SiRNA target sequence
aactgcaaaatacaaaagactttg

SEQ ID NO: 44445 - DNA, 24 bp, Artificial sequence
  SiRNA target sequence
actgcaaaatacaaaagactttga

SEQ ID NO: 44446 - DNA, 24 bp, Artificial sequence
  SiRNA target sequence
ctgcaaaatacaaaagactttgac

SEQ ID NO: 44447 - DNA, 24 bp, Artificial sequence
  SiRNA target sequence
tgcaaaatacaaaagactttgact

SEQ ID NO: 44448 - DNA, 24 bp, Artificial sequence
  SiRNA target sequence
gcaaaatacaaaagactttgacta

SEQ ID NO: 44449 - DNA, 24 bp, Artificial sequence
  SiRNA target sequence
caaaatacaaaagactttgactaa

SEQ ID NO: 44450 - DNA, 24 bp, Artificial sequence
  SiRNA target sequence
aaaatacaaaagactttgactaag

SEQ ID NO: 44451 - DNA, 24 bp, Artificial sequence
  SiRNA target sequence
aaatacaaaagactttgactaaga

SEQ ID NO: 44452 - DNA, 24 bp, Artificial sequence
  SiRNA target sequence
aatacaaaagactttgactaagat

SEQ ID NO: 44453 - DNA, 24 bp, Artificial sequence
  SiRNA target sequence
atacaaaagactttgactaagatc

SEQ ID NO: 44454 - DNA, 24 bp, Artificial sequence
  SiRNA target sequence
tacaaaagactttgactaagatct

SEQ ID NO: 44455 - DNA, 24 bp, Artificial sequence
  SiRNA target sequence
acaaaagactttgactaagatctt

SEQ ID NO: 44456 - DNA, 24 bp, Artificial sequence
  SiRNA target sequence
caaaagactttgactaagatcttt

SEQ ID NO: 44457 - DNA, 24 bp, Artificial sequence
  SiRNA target sequence
aaaagactttgactaagatcttta

SEQ ID NO: 44458 - DNA, 24 bp, Artificial sequence
  SiRNA target sequence
aaagactttgactaagatctttat

SEQ ID NO: 44459 - DNA, 24 bp, Artificial sequence
  SiRNA target sequence
aagactttgactaagatctttatt

SEQ ID NO: 44460 - DNA, 24 bp, Artificial sequence
  SiRNA target sequence
agactttgactaagatctttatta

SEQ ID NO: 44461 - DNA, 24 bp, Artificial sequence
  SiRNA target sequence
gactttgactaagatctttattat

SEQ ID NO: 44462 - DNA, 24 bp, Artificial sequence
  SiRNA target sequence
actttgactaagatctttattatc

SEQ ID NO: 44463 - DNA, 24 bp, Artificial sequence
  SiRNA target sequence
ctttgactaagatctttattatct

SEQ ID NO: 44464 - DNA, 24 bp, Artificial sequence
  SiRNA target sequence
tttgactaagatctttattatctg

SEQ ID NO: 44465 - DNA, 24 bp, Artificial sequence
  SiRNA target sequence
ttgactaagatctttattatctgt

SEQ ID NO: 44466 - DNA, 24 bp, Artificial sequence
  SiRNA target sequence
tgactaagatctttattatctgta

SEQ ID NO: 44467 - DNA, 24 bp, Artificial sequence
  SiRNA target sequence
gactaagatctttattatctgtaa

SEQ ID NO: 44468 - DNA, 24 bp, Artificial sequence
  SiRNA target sequence
actaagatctttattatctgtaat

SEQ ID NO: 44469 - DNA, 24 bp, Artificial sequence
  SiRNA target sequence
ctaagatctttattatctgtaata

SEQ ID NO: 44470 - DNA, 24 bp, Artificial sequence
  SiRNA target sequence
taagatctttattatctgtaatat

SEQ ID NO: 44471 - DNA, 24 bp, Artificial sequence
  SiRNA target sequence
aagatctttattatctgtaatatc

SEQ ID NO: 44472 - DNA, 24 bp, Artificial sequence
  SiRNA target sequence
agatctttattatctgtaatatca

SEQ ID NO: 44473 - DNA, 24 bp, Artificial sequence
  SiRNA target sequence
gatctttattatctgtaatatcac

SEQ ID NO: 44474 - DNA, 24 bp, Artificial sequence
  SiRNA target sequence
atctttattatctgtaatatcact

SEQ ID NO: 44475 - DNA, 24 bp, Artificial sequence
  SiRNA target sequence
tctttattatctgtaatatcacta

SEQ ID NO: 44476 - DNA, 24 bp, Artificial sequence
  SiRNA target sequence
ctttattatctgtaatatcactag

SEQ ID NO: 44477 - DNA, 24 bp, Artificial sequence
  SiRNA target sequence
tttattatctgtaatatcactagt

SEQ ID NO: 44478 - DNA, 24 bp, Artificial sequence
  SiRNA target sequence
ttattatctgtaatatcactagtc

SEQ ID NO: 44479 - DNA, 24 bp, Artificial sequence
  SiRNA target sequence
tattatctgtaatatcactagtca

SEQ ID NO: 44480 - DNA, 24 bp, Artificial sequence
  SiRNA target sequence
attatctgtaatatcactagtcaa

SEQ ID NO: 44481 - DNA, 24 bp, Artificial sequence
  SiRNA target sequence
ttatctgtaatatcactagtcaat

SEQ ID NO: 44482 - DNA, 24 bp, Artificial sequence
  SiRNA target sequence
tatctgtaatatcactagtcaatt

SEQ ID NO: 44483 - DNA, 24 bp, Artificial sequence
  SiRNA target sequence
atctgtaatatcactagtcaattt

SEQ ID NO: 44484 - DNA, 24 bp, Artificial sequence
  SiRNA target sequence
tctgtaatatcactagtcaatttc

SEQ ID NO: 44485 - DNA, 24 bp, Artificial sequence
  SiRNA target sequence
ctgtaatatcactagtcaatttcc

SEQ ID NO: 44486 - DNA, 24 bp, Artificial sequence
  SiRNA target sequence
tgtaatatcactagtcaatttccg

SEQ ID NO: 44487 - DNA, 24 bp, Artificial sequence
  SiRNA target sequence
gtaatatcactagtcaatttccgg

SEQ ID NO: 44488 - DNA, 24 bp, Artificial sequence
  SiRNA target sequence
taatatcactagtcaatttccggg

SEQ ID NO: 44489 - DNA, 24 bp, Artificial sequence
  SiRNA target sequence
aatatcactagtcaatttccgggt

SEQ ID NO: 44490 - DNA, 24 bp, Artificial sequence
  SiRNA target sequence
atatcactagtcaatttccgggta

SEQ ID NO: 44491 - DNA, 24 bp, Artificial sequence
  SiRNA target sequence
tatcactagtcaatttccgggtag

SEQ ID NO: 44492 - DNA, 24 bp, Artificial sequence
  SiRNA target sequence
atcactagtcaatttccgggtagc

SEQ ID NO: 44493 - DNA, 24 bp, Artificial sequence
  SiRNA target sequence
tcactagtcaatttccgggtagct

SEQ ID NO: 44494 - DNA, 24 bp, Artificial sequence
  SiRNA target sequence
cactagtcaatttccgggtagctt

SEQ ID NO: 44495 - DNA, 24 bp, Artificial sequence
  SiRNA target sequence
actagtcaatttccgggtagcttc

SEQ ID NO: 44496 - DNA, 24 bp, Artificial sequence
  SiRNA target sequence
ctagtcaatttccgggtagcttca

SEQ ID NO: 44497 - DNA, 24 bp, Artificial sequence
  SiRNA target sequence
tagtcaatttccgggtagcttcaa

SEQ ID NO: 44498 - DNA, 24 bp, Artificial sequence
  SiRNA target sequence
agtcaatttccgggtagcttcaac

SEQ ID NO: 44499 - DNA, 24 bp, Artificial sequence
  SiRNA target sequence
gtcaatttccgggtagcttcaact

SEQ ID NO: 44500 - DNA, 24 bp, Artificial sequence
  SiRNA target sequence
tcaatttccgggtagcttcaactg

SEQ ID NO: 44501 - DNA, 24 bp, Artificial sequence
  SiRNA target sequence
caatttccgggtagcttcaactgt

SEQ ID NO: 44502 - DNA, 24 bp, Artificial sequence
  SiRNA target sequence
aatttccgggtagcttcaactgtt

SEQ ID NO: 44503 - DNA, 24 bp, Artificial sequence
  SiRNA target sequence
atttccgggtagcttcaactgtta

SEQ ID NO: 44504 - DNA, 24 bp, Artificial sequence
  SiRNA target sequence
tttccgggtagcttcaactgttaa

SEQ ID NO: 44505 - DNA, 24 bp, Artificial sequence
  SiRNA target sequence
ttccgggtagcttcaactgttaaa

SEQ ID NO: 44506 - DNA, 24 bp, Artificial sequence
  SiRNA target sequence
tccgggtagcttcaactgttaaaa

SEQ ID NO: 44507 - DNA, 24 bp, Artificial sequence
  SiRNA target sequence
ccgggtagcttcaactgttaaaac

SEQ ID NO: 44508 - DNA, 24 bp, Artificial sequence
  SiRNA target sequence
cgggtagcttcaactgttaaaaca

SEQ ID NO: 44509 - DNA, 24 bp, Artificial sequence
  SiRNA target sequence
gggtagcttcaactgttaaaacat

SEQ ID NO: 44510 - DNA, 24 bp, Artificial sequence
  SiRNA target sequence
ggtagcttcaactgttaaaacatt

SEQ ID NO: 44511 - DNA, 24 bp, Artificial sequence
  SiRNA target sequence
gtagcttcaactgttaaaacatta

SEQ ID NO: 44512 - DNA, 24 bp, Artificial sequence
  SiRNA target sequence
tagcttcaactgttaaaacattaa

SEQ ID NO: 44513 - DNA, 24 bp, Artificial sequence
  SiRNA target sequence
agcttcaactgttaaaacattaaa

SEQ ID NO: 44514 - DNA, 24 bp, Artificial sequence
  SiRNA target sequence
gcttcaactgttaaaacattaaat

SEQ ID NO: 44515 - DNA, 24 bp, Artificial sequence
  SiRNA target sequence
cttcaactgttaaaacattaaatg

SEQ ID NO: 44516 - DNA, 24 bp, Artificial sequence
  SiRNA target sequence
ttcaactgttaaaacattaaatgt

SEQ ID NO: 44517 - DNA, 24 bp, Artificial sequence
  SiRNA target sequence
tcaactgttaaaacattaaatgta

SEQ ID NO: 44518 - DNA, 24 bp, Artificial sequence
  SiRNA target sequence
caactgttaaaacattaaatgtac

SEQ ID NO: 44519 - DNA, 24 bp, Artificial sequence
  SiRNA target sequence
aactgttaaaacattaaatgtaca

SEQ ID NO: 44520 - DNA, 24 bp, Artificial sequence
  SiRNA target sequence
actgttaaaacattaaatgtacaa

SEQ ID NO: 44521 - DNA, 24 bp, Artificial sequence
  SiRNA target sequence
ctgttaaaacattaaatgtacaaa

SEQ ID NO: 44522 - DNA, 24 bp, Artificial sequence
  SiRNA target sequence
tgttaaaacattaaatgtacaaac

SEQ ID NO: 44523 - DNA, 24 bp, Artificial sequence
  SiRNA target sequence
gttaaaacattaaatgtacaaact

SEQ ID NO: 44524 - DNA, 24 bp, Artificial sequence
  SiRNA target sequence
ttaaaacattaaatgtacaaactg

SEQ ID NO: 44525 - DNA, 24 bp, Artificial sequence
  SiRNA target sequence
taaaacattaaatgtacaaactgc

SEQ ID NO: 44526 - DNA, 24 bp, Artificial sequence
  SiRNA target sequence
aaaacattaaatgtacaaactgca

SEQ ID NO: 44527 - DNA, 24 bp, Artificial sequence
  SiRNA target sequence
aaacattaaatgtacaaactgcaa

SEQ ID NO: 44528 - DNA, 24 bp, Artificial sequence
  SiRNA target sequence
aacattaaatgtacaaactgcaaa

SEQ ID NO: 44529 - DNA, 24 bp, Artificial sequence
  SiRNA target sequence
acattaaatgtacaaactgcaaat

SEQ ID NO: 44530 - DNA, 24 bp, Artificial sequence
  SiRNA target sequence
cattaaatgtacaaactgcaaatg

SEQ ID NO: 44531 - DNA, 24 bp, Artificial sequence
  SiRNA target sequence
attaaatgtacaaactgcaaatgt

SEQ ID NO: 44532 - DNA, 24 bp, Artificial sequence
  SiRNA target sequence
ttaaatgtacaaactgcaaatgtc

SEQ ID NO: 44533 - DNA, 24 bp, Artificial sequence
  SiRNA target sequence
taaatgtacaaactgcaaatgtcc

SEQ ID NO: 44534 - DNA, 24 bp, Artificial sequence
  SiRNA target sequence
aaatgtacaaactgcaaatgtccc

SEQ ID NO: 44535 - DNA, 24 bp, Artificial sequence
  SiRNA target sequence
aatgtacaaactgcaaatgtccca

SEQ ID NO: 44536 - DNA, 24 bp, Artificial sequence
  SiRNA target sequence
atgtacaaactgcaaatgtcccaa

SEQ ID NO: 44537 - DNA, 24 bp, Artificial sequence
  SiRNA target sequence
tgtacaaactgcaaatgtcccaaa

SEQ ID NO: 44538 - DNA, 24 bp, Artificial sequence
  SiRNA target sequence
gtacaaactgcaaatgtcccaaaa

SEQ ID NO: 44539 - DNA, 24 bp, Artificial sequence
  SiRNA target sequence
tacaaactgcaaatgtcccaaaaa

SEQ ID NO: 44540 - DNA, 24 bp, Artificial sequence
  SiRNA target sequence
acaaactgcaaatgtcccaaaaat

SEQ ID NO: 44541 - DNA, 24 bp, Artificial sequence
  SiRNA target sequence
caaactgcaaatgtcccaaaaatt

SEQ ID NO: 44542 - DNA, 24 bp, Artificial sequence
  SiRNA target sequence
aaactgcaaatgtcccaaaaatta

SEQ ID NO: 44543 - DNA, 24 bp, Artificial sequence
  SiRNA target sequence
aactgcaaatgtcccaaaaattat

SEQ ID NO: 44544 - DNA, 24 bp, Artificial sequence
  SiRNA target sequence
actgcaaatgtcccaaaaattatg

SEQ ID NO: 44545 - DNA, 24 bp, Artificial sequence
  SiRNA target sequence
ctgcaaatgtcccaaaaattatgt

SEQ ID NO: 44546 - DNA, 24 bp, Artificial sequence
  SiRNA target sequence
tgcaaatgtcccaaaaattatgta

SEQ ID NO: 44547 - DNA, 24 bp, Artificial sequence
  SiRNA target sequence
gcaaatgtcccaaaaattatgtaa

SEQ ID NO: 44548 - DNA, 24 bp, Artificial sequence
  SiRNA target sequence
caaatgtcccaaaaattatgtaaa

SEQ ID NO: 44549 - DNA, 24 bp, Artificial sequence
  SiRNA target sequence
aaatgtcccaaaaattatgtaaat

SEQ ID NO: 44550 - DNA, 24 bp, Artificial sequence
  SiRNA target sequence
aatgtcccaaaaattatgtaaatg

SEQ ID NO: 44551 - DNA, 24 bp, Artificial sequence
  SiRNA target sequence
atgtcccaaaaattatgtaaatga

SEQ ID NO: 44552 - DNA, 24 bp, Artificial sequence
  SiRNA target sequence
tgtcccaaaaattatgtaaatgac

SEQ ID NO: 44553 - DNA, 24 bp, Artificial sequence
  SiRNA target sequence
gtcccaaaaattatgtaaatgaca

SEQ ID NO: 44554 - DNA, 24 bp, Artificial sequence
  SiRNA target sequence
tcccaaaaattatgtaaatgacaa

SEQ ID NO: 44555 - DNA, 24 bp, Artificial sequence
  SiRNA target sequence
cccaaaaattatgtaaatgacaaa

SEQ ID NO: 44556 - DNA, 24 bp, Artificial sequence
  SiRNA target sequence
ccaaaaattatgtaaatgacaaat

SEQ ID NO: 44557 - DNA, 24 bp, Artificial sequence
  SiRNA target sequence
caaaaattatgtaaatgacaaatg

SEQ ID NO: 44558 - DNA, 24 bp, Artificial sequence
  SiRNA target sequence
aaaaattatgtaaatgacaaatgt

SEQ ID NO: 44559 - DNA, 24 bp, Artificial sequence
  SiRNA target sequence
aaaattatgtaaatgacaaatgtt

SEQ ID NO: 44560 - DNA, 24 bp, Artificial sequence
  SiRNA target sequence
aaattatgtaaatgacaaatgttc

SEQ ID NO: 44561 - DNA, 24 bp, Artificial sequence
  SiRNA target sequence
aattatgtaaatgacaaatgttcg

SEQ ID NO: 44562 - DNA, 24 bp, Artificial sequence
  SiRNA target sequence
attatgtaaatgacaaatgttcga

SEQ ID NO: 44563 - DNA, 24 bp, Artificial sequence
  SiRNA target sequence
ttatgtaaatgacaaatgttcgaa

SEQ ID NO: 44564 - DNA, 24 bp, Artificial sequence
  SiRNA target sequence
tatgtaaatgacaaatgttcgaat

SEQ ID NO: 44565 - DNA, 24 bp, Artificial sequence
  SiRNA target sequence
atgtaaatgacaaatgttcgaata

SEQ ID NO: 44566 - DNA, 24 bp, Artificial sequence
  SiRNA target sequence
tgtaaatgacaaatgttcgaataa

SEQ ID NO: 44567 - DNA, 24 bp, Artificial sequence
  SiRNA target sequence
gtaaatgacaaatgttcgaataaa

SEQ ID NO: 44568 - DNA, 24 bp, Artificial sequence
  SiRNA target sequence
taaatgacaaatgttcgaataaag

SEQ ID NO: 44569 - DNA, 24 bp, Artificial sequence
  SiRNA target sequence
aaatgacaaatgttcgaataaagg

SEQ ID NO: 44570 - DNA, 24 bp, Artificial sequence
  SiRNA target sequence
aatgacaaatgttcgaataaaggg

SEQ ID NO: 44571 - DNA, 24 bp, Artificial sequence
  SiRNA target sequence
atgacaaatgttcgaataaagggc

SEQ ID NO: 44572 - DNA, 24 bp, Artificial sequence
  SiRNA target sequence
tgacaaatgttcgaataaagggct

SEQ ID NO: 44573 - DNA, 24 bp, Artificial sequence
  SiRNA target sequence
gacaaatgttcgaataaagggctt

SEQ ID NO: 44574 - DNA, 24 bp, Artificial sequence
  SiRNA target sequence
acaaatgttcgaataaagggcttt

SEQ ID NO: 44575 - DNA, 24 bp, Artificial sequence
  SiRNA target sequence
caaatgttcgaataaagggctttg

SEQ ID NO: 44576 - DNA, 24 bp, Artificial sequence
  SiRNA target sequence
aaatgttcgaataaagggctttga

SEQ ID NO: 44577 - DNA, 24 bp, Artificial sequence
  SiRNA target sequence
aatgttcgaataaagggctttgaa

SEQ ID NO: 44578 - DNA, 24 bp, Artificial sequence
  SiRNA target sequence
atgttcgaataaagggctttgaaa

SEQ ID NO: 44579 - DNA, 24 bp, Artificial sequence
  SiRNA target sequence
tgttcgaataaagggctttgaaat

SEQ ID NO: 44580 - DNA, 24 bp, Artificial sequence
  SiRNA target sequence
gttcgaataaagggctttgaaata

SEQ ID NO: 44581 - DNA, 24 bp, Artificial sequence
  SiRNA target sequence
ttcgaataaagggctttgaaataa

SEQ ID NO: 44582 - DNA, 24 bp, Artificial sequence
  SiRNA target sequence
tcgaataaagggctttgaaataac

SEQ ID NO: 44583 - DNA, 24 bp, Artificial sequence
  SiRNA target sequence
cgaataaagggctttgaaataaca

SEQ ID NO: 44584 - DNA, 24 bp, Artificial sequence
  SiRNA target sequence
gaataaagggctttgaaataacat

SEQ ID NO: 44585 - DNA, 24 bp, Artificial sequence
  SiRNA target sequence
aataaagggctttgaaataacata

SEQ ID NO: 44586 - DNA, 24 bp, Artificial sequence
  SiRNA target sequence
ataaagggctttgaaataacatat

SEQ ID NO: 44587 - DNA, 24 bp, Artificial sequence
  SiRNA target sequence
taaagggctttgaaataacatatt

SEQ ID NO: 44588 - DNA, 24 bp, Artificial sequence
  SiRNA target sequence
aaagggctttgaaataacatattc

SEQ ID NO: 44589 - DNA, 24 bp, Artificial sequence
  SiRNA target sequence
aagggctttgaaataacatattct

SEQ ID NO: 44590 - DNA, 24 bp, Artificial sequence
  SiRNA target sequence
agggctttgaaataacatattcta

SEQ ID NO: 44591 - DNA, 24 bp, Artificial sequence
  SiRNA target sequence
gggctttgaaataacatattctac

SEQ ID NO: 44592 - DNA, 24 bp, Artificial sequence
  SiRNA target sequence
ggctttgaaataacatattctaca

SEQ ID NO: 44593 - DNA, 24 bp, Artificial sequence
  SiRNA target sequence
gctttgaaataacatattctacaa

SEQ ID NO: 44594 - DNA, 24 bp, Artificial sequence
  SiRNA target sequence
ctttgaaataacatattctacaat

SEQ ID NO: 44595 - DNA, 24 bp, Artificial sequence
  SiRNA target sequence
tttgaaataacatattctacaatc

SEQ ID NO: 44596 - DNA, 24 bp, Artificial sequence
  SiRNA target sequence
ttgaaataacatattctacaatca

SEQ ID NO: 44597 - DNA, 24 bp, Artificial sequence
  SiRNA target sequence
tgaaataacatattctacaatcag

SEQ ID NO: 44598 - DNA, 24 bp, Artificial sequence
  SiRNA target sequence
gaaataacatattctacaatcagg

SEQ ID NO: 44599 - DNA, 24 bp, Artificial sequence
  SiRNA target sequence
aaataacatattctacaatcaggt

SEQ ID NO: 44600 - DNA, 24 bp, Artificial sequence
  SiRNA target sequence
aataacatattctacaatcaggtc

SEQ ID NO: 44601 - DNA, 24 bp, Artificial sequence
  SiRNA target sequence
ataacatattctacaatcaggtct

SEQ ID NO: 44602 - DNA, 24 bp, Artificial sequence
  SiRNA target sequence
taacatattctacaatcaggtctt

SEQ ID NO: 44603 - DNA, 24 bp, Artificial sequence
  SiRNA target sequence
aacatattctacaatcaggtcttt

SEQ ID NO: 44604 - DNA, 24 bp, Artificial sequence
  SiRNA target sequence
acatattctacaatcaggtctttc

SEQ ID NO: 44605 - DNA, 24 bp, Artificial sequence
  SiRNA target sequence
catattctacaatcaggtctttca

SEQ ID NO: 44606 - DNA, 24 bp, Artificial sequence
  SiRNA target sequence
atattctacaatcaggtctttcat

SEQ ID NO: 44607 - DNA, 24 bp, Artificial sequence
  SiRNA target sequence
tattctacaatcaggtctttcata

SEQ ID NO: 44608 - DNA, 24 bp, Artificial sequence
  SiRNA target sequence
attctacaatcaggtctttcataa

SEQ ID NO: 44609 - DNA, 24 bp, Artificial sequence
  SiRNA target sequence
ttctacaatcaggtctttcataat

SEQ ID NO: 44610 - DNA, 24 bp, Artificial sequence
  SiRNA target sequence
tctacaatcaggtctttcataata

SEQ ID NO: 44611 - DNA, 24 bp, Artificial sequence
  SiRNA target sequence
ctacaatcaggtctttcataatac

SEQ ID NO: 44612 - DNA, 24 bp, Artificial sequence
  SiRNA target sequence
tacaatcaggtctttcataatact

SEQ ID NO: 44613 - DNA, 24 bp, Artificial sequence
  SiRNA target sequence
acaatcaggtctttcataatacta

SEQ ID NO: 44614 - DNA, 24 bp, Artificial sequence
  SiRNA target sequence
caatcaggtctttcataatactaa

SEQ ID NO: 44615 - DNA, 24 bp, Artificial sequence
  SiRNA target sequence
aatcaggtctttcataatactaat

SEQ ID NO: 44616 - DNA, 24 bp, Artificial sequence
  SiRNA target sequence
atcaggtctttcataatactaata

SEQ ID NO: 44617 - DNA, 24 bp, Artificial sequence
  SiRNA target sequence
tcaggtctttcataatactaatat

SEQ ID NO: 44618 - DNA, 24 bp, Artificial sequence
  SiRNA target sequence
caggtctttcataatactaatatc

SEQ ID NO: 44619 - DNA, 24 bp, Artificial sequence
  SiRNA target sequence
aggtctttcataatactaatatca

SEQ ID NO: 44620 - DNA, 24 bp, Artificial sequence
  SiRNA target sequence
ggtctttcataatactaatatcac

SEQ ID NO: 44621 - DNA, 24 bp, Artificial sequence
  SiRNA target sequence
gtctttcataatactaatatcact

SEQ ID NO: 44622 - DNA, 24 bp, Artificial sequence
  SiRNA target sequence
tctttcataatactaatatcacta

SEQ ID NO: 44623 - DNA, 24 bp, Artificial sequence
  SiRNA target sequence
ctttcataatactaatatcactac

SEQ ID NO: 44624 - DNA, 24 bp, Artificial sequence
  SiRNA target sequence
tttcataatactaatatcactacc

SEQ ID NO: 44625 - DNA, 24 bp, Artificial sequence
  SiRNA target sequence
ttcataatactaatatcactacca

SEQ ID NO: 44626 - DNA, 24 bp, Artificial sequence
  SiRNA target sequence
tcataatactaatatcactaccat

SEQ ID NO: 44627 - DNA, 24 bp, Artificial sequence
  SiRNA target sequence
cataatactaatatcactaccata

SEQ ID NO: 44628 - DNA, 24 bp, Artificial sequence
  SiRNA target sequence
ataatactaatatcactaccataa

SEQ ID NO: 44629 - DNA, 24 bp, Artificial sequence
  SiRNA target sequence
taatactaatatcactaccataaa

SEQ ID NO: 44630 - DNA, 24 bp, Artificial sequence
  SiRNA target sequence
aatactaatatcactaccataaat

SEQ ID NO: 44631 - DNA, 24 bp, Artificial sequence
  SiRNA target sequence
atactaatatcactaccataaata

SEQ ID NO: 44632 - DNA, 24 bp, Artificial sequence
  SiRNA target sequence
tactaatatcactaccataaatag

SEQ ID NO: 44633 - DNA, 24 bp, Artificial sequence
  SiRNA target sequence
actaatatcactaccataaataga

SEQ ID NO: 44634 - DNA, 24 bp, Artificial sequence
  SiRNA target sequence
ctaatatcactaccataaatagat

SEQ ID NO: 44635 - DNA, 24 bp, Artificial sequence
  SiRNA target sequence
taatatcactaccataaatagatt

SEQ ID NO: 44636 - DNA, 24 bp, Artificial sequence
  SiRNA target sequence
aatatcactaccataaatagattt

SEQ ID NO: 44637 - DNA, 24 bp, Artificial sequence
  SiRNA target sequence
atatcactaccataaatagatttt

SEQ ID NO: 44638 - DNA, 24 bp, Artificial sequence
  SiRNA target sequence
tatcactaccataaatagattttt

SEQ ID NO: 44639 - DNA, 24 bp, Artificial sequence
  SiRNA target sequence
atcactaccataaatagatttttt

SEQ ID NO: 44640 - DNA, 24 bp, Artificial sequence
  SiRNA target sequence
tcactaccataaatagattttttt

SEQ ID NO: 44641 - DNA, 24 bp, Artificial sequence
  SiRNA target sequence
cactaccataaatagatttttttt

SEQ ID NO: 44642 - DNA, 24 bp, Artificial sequence
  SiRNA target sequence
actaccataaatagattttttttc

SEQ ID NO: 44643 - DNA, 24 bp, Artificial sequence
  SiRNA target sequence
ctaccataaatagattttttttct

SEQ ID NO: 44644 - DNA, 24 bp, Artificial sequence
  SiRNA target sequence
taccataaatagattttttttcta

SEQ ID NO: 44645 - DNA, 24 bp, Artificial sequence
  SiRNA target sequence
accataaatagattttttttctaa

SEQ ID NO: 44646 - DNA, 24 bp, Artificial sequence
  SiRNA target sequence
ccataaatagattttttttctaac

SEQ ID NO: 44647 - DNA, 24 bp, Artificial sequence
  SiRNA target sequence
cataaatagattttttttctaaca

SEQ ID NO: 44648 - DNA, 24 bp, Artificial sequence
  SiRNA target sequence
ataaatagattttttttctaacat

SEQ ID NO: 44649 - DNA, 25 bp, Artificial sequence
  SiRNA target sequence
ttataagtttaatgtagaaataata

SEQ ID NO: 44650 - DNA, 25 bp, Artificial sequence
  SiRNA target sequence
tataagtttaatgtagaaataatat

SEQ ID NO: 44651 - DNA, 25 bp, Artificial sequence
  SiRNA target sequence
ataagtttaatgtagaaataatatt

SEQ ID NO: 44652 - DNA, 25 bp, Artificial sequence
  SiRNA target sequence
taagtttaatgtagaaataatattt

SEQ ID NO: 44653 - DNA, 25 bp, Artificial sequence
  SiRNA target sequence
aagtttaatgtagaaataatatttt

SEQ ID NO: 44654 - DNA, 25 bp, Artificial sequence
  SiRNA target sequence
agtttaatgtagaaataatattttc

SEQ ID NO: 44655 - DNA, 25 bp, Artificial sequence
  SiRNA target sequence
gtttaatgtagaaataatattttct

SEQ ID NO: 44656 - DNA, 25 bp, Artificial sequence
  SiRNA target sequence
tttaatgtagaaataatattttctt

SEQ ID NO: 44657 - DNA, 25 bp, Artificial sequence
  SiRNA target sequence
ttaatgtagaaataatattttcttc

SEQ ID NO: 44658 - DNA, 25 bp, Artificial sequence
  SiRNA target sequence
taatgtagaaataatattttcttct

SEQ ID NO: 44659 - DNA, 25 bp, Artificial sequence
  SiRNA target sequence
aatgtagaaataatattttcttcta

SEQ ID NO: 44660 - DNA, 25 bp, Artificial sequence
  SiRNA target sequence
atgtagaaataatattttcttctat

SEQ ID NO: 44661 - DNA, 25 bp, Artificial sequence
  SiRNA target sequence
tgtagaaataatattttcttctatc

SEQ ID NO: 44662 - DNA, 25 bp, Artificial sequence
  SiRNA target sequence
gtagaaataatattttcttctatct

SEQ ID NO: 44663 - DNA, 25 bp, Artificial sequence
  SiRNA target sequence
tagaaataatattttcttctatctt

SEQ ID NO: 44664 - DNA, 25 bp, Artificial sequence
  SiRNA target sequence
agaaataatattttcttctatctta

SEQ ID NO: 44665 - DNA, 25 bp, Artificial sequence
  SiRNA target sequence
gaaataatattttcttctatcttat

SEQ ID NO: 44666 - DNA, 25 bp, Artificial sequence
  SiRNA target sequence
aaataatattttcttctatcttatg

SEQ ID NO: 44667 - DNA, 25 bp, Artificial sequence
  SiRNA target sequence
aataatattttcttctatcttatgt

SEQ ID NO: 44668 - DNA, 25 bp, Artificial sequence
  SiRNA target sequence
ataatattttcttctatcttatgta

SEQ ID NO: 44669 - DNA, 25 bp, Artificial sequence
  SiRNA target sequence
taatattttcttctatcttatgtaa

SEQ ID NO: 44670 - DNA, 25 bp, Artificial sequence
  SiRNA target sequence
aatattttcttctatcttatgtaat

SEQ ID NO: 44671 - DNA, 25 bp, Artificial sequence
  SiRNA target sequence
atattttcttctatcttatgtaatg

SEQ ID NO: 44672 - DNA, 25 bp, Artificial sequence
  SiRNA target sequence
tattttcttctatcttatgtaatga

SEQ ID NO: 44673 - DNA, 25 bp, Artificial sequence
  SiRNA target sequence
attttcttctatcttatgtaatgat

SEQ ID NO: 44674 - DNA, 25 bp, Artificial sequence
  SiRNA target sequence
ttttcttctatcttatgtaatgata

SEQ ID NO: 44675 - DNA, 25 bp, Artificial sequence
  SiRNA target sequence
tttcttctatcttatgtaatgatac

SEQ ID NO: 44676 - DNA, 25 bp, Artificial sequence
  SiRNA target sequence
ttcttctatcttatgtaatgataca

SEQ ID NO: 44677 - DNA, 25 bp, Artificial sequence
  SiRNA target sequence
tcttctatcttatgtaatgatacag

SEQ ID NO: 44678 - DNA, 25 bp, Artificial sequence
  SiRNA target sequence
cttctatcttatgtaatgatacagt

SEQ ID NO: 44679 - DNA, 25 bp, Artificial sequence
  SiRNA target sequence
ttctatcttatgtaatgatacagtt

SEQ ID NO: 44680 - DNA, 25 bp, Artificial sequence
  SiRNA target sequence
tctatcttatgtaatgatacagttt

SEQ ID NO: 44681 - DNA, 25 bp, Artificial sequence
  SiRNA target sequence
ctatcttatgtaatgatacagtttt

SEQ ID NO: 44682 - DNA, 25 bp, Artificial sequence
  SiRNA target sequence
tatcttatgtaatgatacagttttg

SEQ ID NO: 44683 - DNA, 25 bp, Artificial sequence
  SiRNA target sequence
atcttatgtaatgatacagttttgt

SEQ ID NO: 44684 - DNA, 25 bp, Artificial sequence
  SiRNA target sequence
tcttatgtaatgatacagttttgtt

SEQ ID NO: 44685 - DNA, 25 bp, Artificial sequence
  SiRNA target sequence
cttatgtaatgatacagttttgttt

SEQ ID NO: 44686 - DNA, 25 bp, Artificial sequence
  SiRNA target sequence
ttatgtaatgatacagttttgtttt

SEQ ID NO: 44687 - DNA, 25 bp, Artificial sequence
  SiRNA target sequence
tatgtaatgatacagttttgttttt

SEQ ID NO: 44688 - DNA, 25 bp, Artificial sequence
  SiRNA target sequence
atgtaatgatacagttttgttttta

SEQ ID NO: 44689 - DNA, 25 bp, Artificial sequence
  SiRNA target sequence
tgtaatgatacagttttgtttttaa

SEQ ID NO: 44690 - DNA, 25 bp, Artificial sequence
  SiRNA target sequence
gtaatgatacagttttgtttttaat

SEQ ID NO: 44691 - DNA, 25 bp, Artificial sequence
  SiRNA target sequence
taatgatacagttttgtttttaata

SEQ ID NO: 44692 - DNA, 25 bp, Artificial sequence
  SiRNA target sequence
aatgatacagttttgtttttaatac

SEQ ID NO: 44693 - DNA, 25 bp, Artificial sequence
  SiRNA target sequence
atgatacagttttgtttttaatact

SEQ ID NO: 44694 - DNA, 25 bp, Artificial sequence
  SiRNA target sequence
tgatacagttttgtttttaatactt

SEQ ID NO: 44695 - DNA, 25 bp, Artificial sequence
  SiRNA target sequence
gatacagttttgtttttaatactta

SEQ ID NO: 44696 - DNA, 25 bp, Artificial sequence
  SiRNA target sequence
atacagttttgtttttaatacttag

SEQ ID NO: 44697 - DNA, 25 bp, Artificial sequence
  SiRNA target sequence
tacagttttgtttttaatacttagc

SEQ ID NO: 44698 - DNA, 25 bp, Artificial sequence
  SiRNA target sequence
acagttttgtttttaatacttagca

SEQ ID NO: 44699 - DNA, 25 bp, Artificial sequence
  SiRNA target sequence
cagttttgtttttaatacttagcac

SEQ ID NO: 44700 - DNA, 25 bp, Artificial sequence
  SiRNA target sequence
agttttgtttttaatacttagcact

SEQ ID NO: 44701 - DNA, 25 bp, Artificial sequence
  SiRNA target sequence
gttttgtttttaatacttagcactt

SEQ ID NO: 44702 - DNA, 25 bp, Artificial sequence
  SiRNA target sequence
ttttgtttttaatacttagcacttt

SEQ ID NO: 44703 - DNA, 25 bp, Artificial sequence
  SiRNA target sequence
tttgtttttaatacttagcacttta

SEQ ID NO: 44704 - DNA, 25 bp, Artificial sequence
  SiRNA target sequence
ttgtttttaatacttagcactttat

SEQ ID NO: 44705 - DNA, 25 bp, Artificial sequence
  SiRNA target sequence
tgtttttaatacttagcactttatc

SEQ ID NO: 44706 - DNA, 25 bp, Artificial sequence
  SiRNA target sequence
gtttttaatacttagcactttatca

SEQ ID NO: 44707 - DNA, 25 bp, Artificial sequence
  SiRNA target sequence
tttttaatacttagcactttatcaa

SEQ ID NO: 44708 - DNA, 25 bp, Artificial sequence
  SiRNA target sequence
ttttaatacttagcactttatcaaa

SEQ ID NO: 44709 - DNA, 25 bp, Artificial sequence
  SiRNA target sequence
tttaatacttagcactttatcaaat

SEQ ID NO: 44710 - DNA, 25 bp, Artificial sequence
  SiRNA target sequence
ttaatacttagcactttatcaaata

SEQ ID NO: 44711 - DNA, 25 bp, Artificial sequence
  SiRNA target sequence
taatacttagcactttatcaaataa

SEQ ID NO: 44712 - DNA, 25 bp, Artificial sequence
  SiRNA target sequence
aatacttagcactttatcaaataag

SEQ ID NO: 44713 - DNA, 25 bp, Artificial sequence
  SiRNA target sequence
atacttagcactttatcaaataagt

SEQ ID NO: 44714 - DNA, 25 bp, Artificial sequence
  SiRNA target sequence
tacttagcactttatcaaataagtg

SEQ ID NO: 44715 - DNA, 25 bp, Artificial sequence
  SiRNA target sequence
acttagcactttatcaaataagtgg

SEQ ID NO: 44716 - DNA, 25 bp, Artificial sequence
  SiRNA target sequence
cttagcactttatcaaataagtgga

SEQ ID NO: 44717 - DNA, 25 bp, Artificial sequence
  SiRNA target sequence
ttagcactttatcaaataagtggag

SEQ ID NO: 44718 - DNA, 25 bp, Artificial sequence
  SiRNA target sequence
tagcactttatcaaataagtggagt

SEQ ID NO: 44719 - DNA, 25 bp, Artificial sequence
  SiRNA target sequence
agcactttatcaaataagtggagta

SEQ ID NO: 44720 - DNA, 25 bp, Artificial sequence
  SiRNA target sequence
gcactttatcaaataagtggagtaa

SEQ ID NO: 44721 - DNA, 25 bp, Artificial sequence
  SiRNA target sequence
cactttatcaaataagtggagtaaa

SEQ ID NO: 44722 - DNA, 25 bp, Artificial sequence
  SiRNA target sequence
actttatcaaataagtggagtaaat

SEQ ID NO: 44723 - DNA, 25 bp, Artificial sequence
  SiRNA target sequence
ctttatcaaataagtggagtaaatc

SEQ ID NO: 44724 - DNA, 25 bp, Artificial sequence
  SiRNA target sequence
tttatcaaataagtggagtaaatct

SEQ ID NO: 44725 - DNA, 25 bp, Artificial sequence
  SiRNA target sequence
ttatcaaataagtggagtaaatcta

SEQ ID NO: 44726 - DNA, 25 bp, Artificial sequence
  SiRNA target sequence
tatcaaataagtggagtaaatctaa

SEQ ID NO: 44727 - DNA, 25 bp, Artificial sequence
  SiRNA target sequence
atcaaataagtggagtaaatctaaa

SEQ ID NO: 44728 - DNA, 25 bp, Artificial sequence
  SiRNA target sequence
tcaaataagtggagtaaatctaaat

SEQ ID NO: 44729 - DNA, 25 bp, Artificial sequence
  SiRNA target sequence
caaataagtggagtaaatctaaatt

SEQ ID NO: 44730 - DNA, 25 bp, Artificial sequence
  SiRNA target sequence
aaataagtggagtaaatctaaatta

SEQ ID NO: 44731 - DNA, 25 bp, Artificial sequence
  SiRNA target sequence
aataagtggagtaaatctaaattat

SEQ ID NO: 44732 - DNA, 25 bp, Artificial sequence
  SiRNA target sequence
ataagtggagtaaatctaaattatg

SEQ ID NO: 44733 - DNA, 25 bp, Artificial sequence
  SiRNA target sequence
taagtggagtaaatctaaattatgt

SEQ ID NO: 44734 - DNA, 25 bp, Artificial sequence
  SiRNA target sequence
aagtggagtaaatctaaattatgta

SEQ ID NO: 44735 - DNA, 25 bp, Artificial sequence
  SiRNA target sequence
agtggagtaaatctaaattatgtaa

SEQ ID NO: 44736 - DNA, 25 bp, Artificial sequence
  SiRNA target sequence
gtggagtaaatctaaattatgtaaa

SEQ ID NO: 44737 - DNA, 25 bp, Artificial sequence
  SiRNA target sequence
tggagtaaatctaaattatgtaaaa

SEQ ID NO: 44738 - DNA, 25 bp, Artificial sequence
  SiRNA target sequence
ggagtaaatctaaattatgtaaaac

SEQ ID NO: 44739 - DNA, 25 bp, Artificial sequence
  SiRNA target sequence
gagtaaatctaaattatgtaaaaca

SEQ ID NO: 44740 - DNA, 25 bp, Artificial sequence
  SiRNA target sequence
agtaaatctaaattatgtaaaacaa

SEQ ID NO: 44741 - DNA, 25 bp, Artificial sequence
  SiRNA target sequence
gtaaatctaaattatgtaaaacaat

SEQ ID NO: 44742 - DNA, 25 bp, Artificial sequence
  SiRNA target sequence
taaatctaaattatgtaaaacaata

SEQ ID NO: 44743 - DNA, 25 bp, Artificial sequence
  SiRNA target sequence
aaatctaaattatgtaaaacaataa

SEQ ID NO: 44744 - DNA, 25 bp, Artificial sequence
  SiRNA target sequence
aatctaaattatgtaaaacaataat

SEQ ID NO: 44745 - DNA, 25 bp, Artificial sequence
  SiRNA target sequence
atctaaattatgtaaaacaataatt

SEQ ID NO: 44746 - DNA, 25 bp, Artificial sequence
  SiRNA target sequence
tctaaattatgtaaaacaataatta

SEQ ID NO: 44747 - DNA, 25 bp, Artificial sequence
  SiRNA target sequence
ctaaattatgtaaaacaataattat

SEQ ID NO: 44748 - DNA, 25 bp, Artificial sequence
  SiRNA target sequence
taaattatgtaaaacaataattatc

SEQ ID NO: 44749 - DNA, 25 bp, Artificial sequence
  SiRNA target sequence
aaattatgtaaaacaataattatcg

SEQ ID NO: 44750 - DNA, 25 bp, Artificial sequence
  SiRNA target sequence
aattatgtaaaacaataattatcgt

SEQ ID NO: 44751 - DNA, 25 bp, Artificial sequence
  SiRNA target sequence
attatgtaaaacaataattatcgtc

SEQ ID NO: 44752 - DNA, 25 bp, Artificial sequence
  SiRNA target sequence
ttatgtaaaacaataattatcgtct

SEQ ID NO: 44753 - DNA, 25 bp, Artificial sequence
  SiRNA target sequence
tatgtaaaacaataattatcgtctt

SEQ ID NO: 44754 - DNA, 25 bp, Artificial sequence
  SiRNA target sequence
atgtaaaacaataattatcgtcttc

SEQ ID NO: 44755 - DNA, 25 bp, Artificial sequence
  SiRNA target sequence
tgtaaaacaataattatcgtcttct

SEQ ID NO: 44756 - DNA, 25 bp, Artificial sequence
  SiRNA target sequence
gtaaaacaataattatcgtcttctc

SEQ ID NO: 44757 - DNA, 25 bp, Artificial sequence
  SiRNA target sequence
taaaacaataattatcgtcttctct

SEQ ID NO: 44758 - DNA, 25 bp, Artificial sequence
  SiRNA target sequence
aaaacaataattatcgtcttctcta

SEQ ID NO: 44759 - DNA, 25 bp, Artificial sequence
  SiRNA target sequence
aaacaataattatcgtcttctctaa

SEQ ID NO: 44760 - DNA, 25 bp, Artificial sequence
  SiRNA target sequence
aacaataattatcgtcttctctaag

SEQ ID NO: 44761 - DNA, 25 bp, Artificial sequence
  SiRNA target sequence
acaataattatcgtcttctctaagt

SEQ ID NO: 44762 - DNA, 25 bp, Artificial sequence
  SiRNA target sequence
caataattatcgtcttctctaagtt

SEQ ID NO: 44763 - DNA, 25 bp, Artificial sequence
  SiRNA target sequence
aataattatcgtcttctctaagttg

SEQ ID NO: 44764 - DNA, 25 bp, Artificial sequence
  SiRNA target sequence
ataattatcgtcttctctaagttgt

SEQ ID NO: 44765 - DNA, 25 bp, Artificial sequence
  SiRNA target sequence
taattatcgtcttctctaagttgtt

SEQ ID NO: 44766 - DNA, 25 bp, Artificial sequence
  SiRNA target sequence
aattatcgtcttctctaagttgttg

SEQ ID NO: 44767 - DNA, 25 bp, Artificial sequence
  SiRNA target sequence
attatcgtcttctctaagttgttgg

SEQ ID NO: 44768 - DNA, 25 bp, Artificial sequence
  SiRNA target sequence
ttatcgtcttctctaagttgttgga

SEQ ID NO: 44769 - DNA, 25 bp, Artificial sequence
  SiRNA target sequence
tatcgtcttctctaagttgttggag

SEQ ID NO: 44770 - DNA, 25 bp, Artificial sequence
  SiRNA target sequence
atcgtcttctctaagttgttggaga

SEQ ID NO: 44771 - DNA, 25 bp, Artificial sequence
  SiRNA target sequence
tcgtcttctctaagttgttggagat

SEQ ID NO: 44772 - DNA, 25 bp, Artificial sequence
  SiRNA target sequence
cgtcttctctaagttgttggagatt

SEQ ID NO: 44773 - DNA, 25 bp, Artificial sequence
  SiRNA target sequence
gtcttctctaagttgttggagatta

SEQ ID NO: 44774 - DNA, 25 bp, Artificial sequence
  SiRNA target sequence
tcttctctaagttgttggagattag

SEQ ID NO: 44775 - DNA, 25 bp, Artificial sequence
  SiRNA target sequence
cttctctaagttgttggagattaga

SEQ ID NO: 44776 - DNA, 25 bp, Artificial sequence
  SiRNA target sequence
ttctctaagttgttggagattagac

SEQ ID NO: 44777 - DNA, 25 bp, Artificial sequence
  SiRNA target sequence
tctctaagttgttggagattagact

SEQ ID NO: 44778 - DNA, 25 bp, Artificial sequence
  SiRNA target sequence
ctctaagttgttggagattagactt

SEQ ID NO: 44779 - DNA, 25 bp, Artificial sequence
  SiRNA target sequence
tctaagttgttggagattagacttt

SEQ ID NO: 44780 - DNA, 25 bp, Artificial sequence
  SiRNA target sequence
ctaagttgttggagattagactttt

SEQ ID NO: 44781 - DNA, 25 bp, Artificial sequence
  SiRNA target sequence
taagttgttggagattagactttta

SEQ ID NO: 44782 - DNA, 25 bp, Artificial sequence
  SiRNA target sequence
aagttgttggagattagacttttaa

SEQ ID NO: 44783 - DNA, 25 bp, Artificial sequence
  SiRNA target sequence
agttgttggagattagacttttaag

SEQ ID NO: 44784 - DNA, 25 bp, Artificial sequence
  SiRNA target sequence
gttgttggagattagacttttaaga

SEQ ID NO: 44785 - DNA, 25 bp, Artificial sequence
  SiRNA target sequence
ttgttggagattagacttttaagaa

SEQ ID NO: 44786 - DNA, 25 bp, Artificial sequence
  SiRNA target sequence
tgttggagattagacttttaagaat

SEQ ID NO: 44787 - DNA, 25 bp, Artificial sequence
  SiRNA target sequence
gttggagattagacttttaagaatt

SEQ ID NO: 44788 - DNA, 25 bp, Artificial sequence
  SiRNA target sequence
ttggagattagacttttaagaattt

SEQ ID NO: 44789 - DNA, 25 bp, Artificial sequence
  SiRNA target sequence
tggagattagacttttaagaatttc

SEQ ID NO: 44790 - DNA, 25 bp, Artificial sequence
  SiRNA target sequence
ggagattagacttttaagaatttca

SEQ ID NO: 44791 - DNA, 25 bp, Artificial sequence
  SiRNA target sequence
gagattagacttttaagaatttcat

SEQ ID NO: 44792 - DNA, 25 bp, Artificial sequence
  SiRNA target sequence
agattagacttttaagaatttcata

SEQ ID NO: 44793 - DNA, 25 bp, Artificial sequence
  SiRNA target sequence
gattagacttttaagaatttcatat

SEQ ID NO: 44794 - DNA, 25 bp, Artificial sequence
  SiRNA target sequence
attagacttttaagaatttcatatt

SEQ ID NO: 44795 - DNA, 25 bp, Artificial sequence
  SiRNA target sequence
ttagacttttaagaatttcatattc

SEQ ID NO: 44796 - DNA, 25 bp, Artificial sequence
  SiRNA target sequence
tagacttttaagaatttcatattca

SEQ ID NO: 44797 - DNA, 25 bp, Artificial sequence
  SiRNA target sequence
agacttttaagaatttcatattcag

SEQ ID NO: 44798 - DNA, 25 bp, Artificial sequence
  SiRNA target sequence
gacttttaagaatttcatattcagc

SEQ ID NO: 44799 - DNA, 25 bp, Artificial sequence
  SiRNA target sequence
acttttaagaatttcatattcagct

SEQ ID NO: 44800 - DNA, 25 bp, Artificial sequence
  SiRNA target sequence
cttttaagaatttcatattcagctt

SEQ ID NO: 44801 - DNA, 25 bp, Artificial sequence
  SiRNA target sequence
ttttaagaatttcatattcagcttt

SEQ ID NO: 44802 - DNA, 25 bp, Artificial sequence
  SiRNA target sequence
tttaagaatttcatattcagctttt

SEQ ID NO: 44803 - DNA, 25 bp, Artificial sequence
  SiRNA target sequence
ttaagaatttcatattcagcttttt

SEQ ID NO: 44804 - DNA, 25 bp, Artificial sequence
  SiRNA target sequence
taagaatttcatattcagctttttt

SEQ ID NO: 44805 - DNA, 25 bp, Artificial sequence
  SiRNA target sequence
aagaatttcatattcagcttttttg

SEQ ID NO: 44806 - DNA, 25 bp, Artificial sequence
  SiRNA target sequence
agaatttcatattcagcttttttgt

SEQ ID NO: 44807 - DNA, 25 bp, Artificial sequence
  SiRNA target sequence
gaatttcatattcagcttttttgtc

SEQ ID NO: 44808 - DNA, 25 bp, Artificial sequence
  SiRNA target sequence
aatttcatattcagcttttttgtcc

SEQ ID NO: 44809 - DNA, 25 bp, Artificial sequence
  SiRNA target sequence
atttcatattcagcttttttgtcca

SEQ ID NO: 44810 - DNA, 25 bp, Artificial sequence
  SiRNA target sequence
tttcatattcagcttttttgtccaa

SEQ ID NO: 44811 - DNA, 25 bp, Artificial sequence
  SiRNA target sequence
ttcatattcagcttttttgtccaat

SEQ ID NO: 44812 - DNA, 25 bp, Artificial sequence
  SiRNA target sequence
tcatattcagcttttttgtccaatg

SEQ ID NO: 44813 - DNA, 25 bp, Artificial sequence
  SiRNA target sequence
catattcagcttttttgtccaatgc

SEQ ID NO: 44814 - DNA, 25 bp, Artificial sequence
  SiRNA target sequence
atattcagcttttttgtccaatgcg

SEQ ID NO: 44815 - DNA, 25 bp, Artificial sequence
  SiRNA target sequence
tattcagcttttttgtccaatgcgg

SEQ ID NO: 44816 - DNA, 25 bp, Artificial sequence
  SiRNA target sequence
attcagcttttttgtccaatgcggc

SEQ ID NO: 44817 - DNA, 25 bp, Artificial sequence
  SiRNA target sequence
ttcagcttttttgtccaatgcggcc

SEQ ID NO: 44818 - DNA, 25 bp, Artificial sequence
  SiRNA target sequence
tcagcttttttgtccaatgcggccg

SEQ ID NO: 44819 - DNA, 25 bp, Artificial sequence
  SiRNA target sequence
cagcttttttgtccaatgcggccgt

SEQ ID NO: 44820 - DNA, 25 bp, Artificial sequence
  SiRNA target sequence
agcttttttgtccaatgcggccgtt

SEQ ID NO: 44821 - DNA, 25 bp, Artificial sequence
  SiRNA target sequence
gcttttttgtccaatgcggccgttg

SEQ ID NO: 44822 - DNA, 25 bp, Artificial sequence
  SiRNA target sequence
cttttttgtccaatgcggccgttgg

SEQ ID NO: 44823 - DNA, 25 bp, Artificial sequence
  SiRNA target sequence
ttttttgtccaatgcggccgttggc

SEQ ID NO: 44824 - DNA, 25 bp, Artificial sequence
  SiRNA target sequence
tttttgtccaatgcggccgttggct

SEQ ID NO: 44825 - DNA, 25 bp, Artificial sequence
  SiRNA target sequence
ttttgtccaatgcggccgttggctc

SEQ ID NO: 44826 - DNA, 25 bp, Artificial sequence
  SiRNA target sequence
tttgtccaatgcggccgttggctca

SEQ ID NO: 44827 - DNA, 25 bp, Artificial sequence
  SiRNA target sequence
ttgtccaatgcggccgttggctcat

SEQ ID NO: 44828 - DNA, 25 bp, Artificial sequence
  SiRNA target sequence
tgtccaatgcggccgttggctcatc

SEQ ID NO: 44829 - DNA, 25 bp, Artificial sequence
  SiRNA target sequence
gtccaatgcggccgttggctcatct

SEQ ID NO: 44830 - DNA, 25 bp, Artificial sequence
  SiRNA target sequence
tccaatgcggccgttggctcatcta

SEQ ID NO: 44831 - DNA, 25 bp, Artificial sequence
  SiRNA target sequence
ccaatgcggccgttggctcatctaa

SEQ ID NO: 44832 - DNA, 25 bp, Artificial sequence
  SiRNA target sequence
caatgcggccgttggctcatctaaa

SEQ ID NO: 44833 - DNA, 25 bp, Artificial sequence
  SiRNA target sequence
aatgcggccgttggctcatctaaaa

SEQ ID NO: 44834 - DNA, 25 bp, Artificial sequence
  SiRNA target sequence
atgcggccgttggctcatctaaaat

SEQ ID NO: 44835 - DNA, 25 bp, Artificial sequence
  SiRNA target sequence
tgcggccgttggctcatctaaaatt

SEQ ID NO: 44836 - DNA, 25 bp, Artificial sequence
  SiRNA target sequence
gcggccgttggctcatctaaaatta

SEQ ID NO: 44837 - DNA, 25 bp, Artificial sequence
  SiRNA target sequence
cggccgttggctcatctaaaattat

SEQ ID NO: 44838 - DNA, 25 bp, Artificial sequence
  SiRNA target sequence
ggccgttggctcatctaaaattata

SEQ ID NO: 44839 - DNA, 25 bp, Artificial sequence
  SiRNA target sequence
gccgttggctcatctaaaattataa

SEQ ID NO: 44840 - DNA, 25 bp, Artificial sequence
  SiRNA target sequence
ccgttggctcatctaaaattataat

SEQ ID NO: 44841 - DNA, 25 bp, Artificial sequence
  SiRNA target sequence
cgttggctcatctaaaattataata

SEQ ID NO: 44842 - DNA, 25 bp, Artificial sequence
  SiRNA target sequence
gttggctcatctaaaattataatag

SEQ ID NO: 44843 - DNA, 25 bp, Artificial sequence
  SiRNA target sequence
ttggctcatctaaaattataatagg

SEQ ID NO: 44844 - DNA, 25 bp, Artificial sequence
  SiRNA target sequence
tggctcatctaaaattataatagga

SEQ ID NO: 44845 - DNA, 25 bp, Artificial sequence
  SiRNA target sequence
ggctcatctaaaattataataggag

SEQ ID NO: 44846 - DNA, 25 bp, Artificial sequence
  SiRNA target sequence
gctcatctaaaattataataggaga

SEQ ID NO: 44847 - DNA, 25 bp, Artificial sequence
  SiRNA target sequence
ctcatctaaaattataataggagaa

SEQ ID NO: 44848 - DNA, 25 bp, Artificial sequence
  SiRNA target sequence
tcatctaaaattataataggagaat

SEQ ID NO: 44849 - DNA, 25 bp, Artificial sequence
  SiRNA target sequence
catctaaaattataataggagaatt

SEQ ID NO: 44850 - DNA, 25 bp, Artificial sequence
  SiRNA target sequence
atctaaaattataataggagaattt

SEQ ID NO: 44851 - DNA, 25 bp, Artificial sequence
  SiRNA target sequence
tctaaaattataataggagaatttt

SEQ ID NO: 44852 - DNA, 25 bp, Artificial sequence
  SiRNA target sequence
ctaaaattataataggagaattttt

SEQ ID NO: 44853 - DNA, 25 bp, Artificial sequence
  SiRNA target sequence
taaaattataataggagaatttttt

SEQ ID NO: 44854 - DNA, 25 bp, Artificial sequence
  SiRNA target sequence
aaaattataataggagaatttttta

SEQ ID NO: 44855 - DNA, 25 bp, Artificial sequence
  SiRNA target sequence
aaattataataggagaattttttag

SEQ ID NO: 44856 - DNA, 25 bp, Artificial sequence
  SiRNA target sequence
aattataataggagaattttttagt

SEQ ID NO: 44857 - DNA, 25 bp, Artificial sequence
  SiRNA target sequence
attataataggagaattttttagtg

SEQ ID NO: 44858 - DNA, 25 bp, Artificial sequence
  SiRNA target sequence
ttataataggagaattttttagtgc

SEQ ID NO: 44859 - DNA, 25 bp, Artificial sequence
  SiRNA target sequence
tataataggagaattttttagtgcc

SEQ ID NO: 44860 - DNA, 25 bp, Artificial sequence
  SiRNA target sequence
ataataggagaattttttagtgccg

SEQ ID NO: 44861 - DNA, 25 bp, Artificial sequence
  SiRNA target sequence
taataggagaattttttagtgccga

SEQ ID NO: 44862 - DNA, 25 bp, Artificial sequence
  SiRNA target sequence
aataggagaattttttagtgccgac

SEQ ID NO: 44863 - DNA, 25 bp, Artificial sequence
  SiRNA target sequence
ataggagaattttttagtgccgacc

SEQ ID NO: 44864 - DNA, 25 bp, Artificial sequence
  SiRNA target sequence
taggagaattttttagtgccgacct

SEQ ID NO: 44865 - DNA, 25 bp, Artificial sequence
  SiRNA target sequence
aggagaattttttagtgccgacctt

SEQ ID NO: 44866 - DNA, 25 bp, Artificial sequence
  SiRNA target sequence
ggagaattttttagtgccgacctta

SEQ ID NO: 44867 - DNA, 25 bp, Artificial sequence
  SiRNA target sequence
gagaattttttagtgccgaccttaa

SEQ ID NO: 44868 - DNA, 25 bp, Artificial sequence
  SiRNA target sequence
agaattttttagtgccgaccttaac

SEQ ID NO: 44869 - DNA, 25 bp, Artificial sequence
  SiRNA target sequence
gaattttttagtgccgaccttaaca

SEQ ID NO: 44870 - DNA, 25 bp, Artificial sequence
  SiRNA target sequence
aattttttagtgccgaccttaacaa

SEQ ID NO: 44871 - DNA, 25 bp, Artificial sequence
  SiRNA target sequence
attttttagtgccgaccttaacaaa

SEQ ID NO: 44872 - DNA, 25 bp, Artificial sequence
  SiRNA target sequence
ttttttagtgccgaccttaacaaaa

SEQ ID NO: 44873 - DNA, 25 bp, Artificial sequence
  SiRNA target sequence
tttttagtgccgaccttaacaaaat

SEQ ID NO: 44874 - DNA, 25 bp, Artificial sequence
  SiRNA target sequence
ttttagtgccgaccttaacaaaatt

SEQ ID NO: 44875 - DNA, 25 bp, Artificial sequence
  SiRNA target sequence
tttagtgccgaccttaacaaaatta

SEQ ID NO: 44876 - DNA, 25 bp, Artificial sequence
  SiRNA target sequence
ttagtgccgaccttaacaaaattac

SEQ ID NO: 44877 - DNA, 25 bp, Artificial sequence
  SiRNA target sequence
tagtgccgaccttaacaaaattact

SEQ ID NO: 44878 - DNA, 25 bp, Artificial sequence
  SiRNA target sequence
agtgccgaccttaacaaaattactt

SEQ ID NO: 44879 - DNA, 25 bp, Artificial sequence
  SiRNA target sequence
gtgccgaccttaacaaaattacttt

SEQ ID NO: 44880 - DNA, 25 bp, Artificial sequence
  SiRNA target sequence
tgccgaccttaacaaaattactttt

SEQ ID NO: 44881 - DNA, 25 bp, Artificial sequence
  SiRNA target sequence
gccgaccttaacaaaattacttttt

SEQ ID NO: 44882 - DNA, 25 bp, Artificial sequence
  SiRNA target sequence
ccgaccttaacaaaattactttttg

SEQ ID NO: 44883 - DNA, 25 bp, Artificial sequence
  SiRNA target sequence
cgaccttaacaaaattactttttgt

SEQ ID NO: 44884 - DNA, 25 bp, Artificial sequence
  SiRNA target sequence
gaccttaacaaaattactttttgtc

SEQ ID NO: 44885 - DNA, 25 bp, Artificial sequence
  SiRNA target sequence
accttaacaaaattactttttgtct

SEQ ID NO: 44886 - DNA, 25 bp, Artificial sequence
  SiRNA target sequence
ccttaacaaaattactttttgtctt

SEQ ID NO: 44887 - DNA, 25 bp, Artificial sequence
  SiRNA target sequence
cttaacaaaattactttttgtcttt

SEQ ID NO: 44888 - DNA, 25 bp, Artificial sequence
  SiRNA target sequence
ttaacaaaattactttttgtctttc

SEQ ID NO: 44889 - DNA, 25 bp, Artificial sequence
  SiRNA target sequence
taacaaaattactttttgtctttct

SEQ ID NO: 44890 - DNA, 25 bp, Artificial sequence
  SiRNA target sequence
aacaaaattactttttgtctttctc

SEQ ID NO: 44891 - DNA, 25 bp, Artificial sequence
  SiRNA target sequence
acaaaattactttttgtctttctcc

SEQ ID NO: 44892 - DNA, 25 bp, Artificial sequence
  SiRNA target sequence
caaaattactttttgtctttctcca

SEQ ID NO: 44893 - DNA, 25 bp, Artificial sequence
  SiRNA target sequence
aaaattactttttgtctttctccac

SEQ ID NO: 44894 - DNA, 25 bp, Artificial sequence
  SiRNA target sequence
aaattactttttgtctttctccacc

SEQ ID NO: 44895 - DNA, 25 bp, Artificial sequence
  SiRNA target sequence
aattactttttgtctttctccacca

SEQ ID NO: 44896 - DNA, 25 bp, Artificial sequence
  SiRNA target sequence
attactttttgtctttctccaccac

SEQ ID NO: 44897 - DNA, 25 bp, Artificial sequence
  SiRNA target sequence
ttactttttgtctttctccaccact

SEQ ID NO: 44898 - DNA, 25 bp, Artificial sequence
  SiRNA target sequence
tactttttgtctttctccaccacta

SEQ ID NO: 44899 - DNA, 25 bp, Artificial sequence
  SiRNA target sequence
actttttgtctttctccaccactaa

SEQ ID NO: 44900 - DNA, 25 bp, Artificial sequence
  SiRNA target sequence
ctttttgtctttctccaccactaag

SEQ ID NO: 44901 - DNA, 25 bp, Artificial sequence
  SiRNA target sequence
tttttgtctttctccaccactaagc

SEQ ID NO: 44902 - DNA, 25 bp, Artificial sequence
  SiRNA target sequence
ttttgtctttctccaccactaagct

SEQ ID NO: 44903 - DNA, 25 bp, Artificial sequence
  SiRNA target sequence
tttgtctttctccaccactaagctt

SEQ ID NO: 44904 - DNA, 25 bp, Artificial sequence
  SiRNA target sequence
ttgtctttctccaccactaagctta

SEQ ID NO: 44905 - DNA, 25 bp, Artificial sequence
  SiRNA target sequence
tgtctttctccaccactaagcttat

SEQ ID NO: 44906 - DNA, 25 bp, Artificial sequence
  SiRNA target sequence
gtctttctccaccactaagcttatg

SEQ ID NO: 44907 - DNA, 25 bp, Artificial sequence
  SiRNA target sequence
tctttctccaccactaagcttatgt

SEQ ID NO: 44908 - DNA, 25 bp, Artificial sequence
  SiRNA target sequence
ctttctccaccactaagcttatgtc

SEQ ID NO: 44909 - DNA, 25 bp, Artificial sequence
  SiRNA target sequence
tttctccaccactaagcttatgtcc

SEQ ID NO: 44910 - DNA, 25 bp, Artificial sequence
  SiRNA target sequence
ttctccaccactaagcttatgtccc

SEQ ID NO: 44911 - DNA, 25 bp, Artificial sequence
  SiRNA target sequence
tctccaccactaagcttatgtccct

SEQ ID NO: 44912 - DNA, 25 bp, Artificial sequence
  SiRNA target sequence
ctccaccactaagcttatgtccctt

SEQ ID NO: 44913 - DNA, 25 bp, Artificial sequence
  SiRNA target sequence
tccaccactaagcttatgtccctta

SEQ ID NO: 44914 - DNA, 25 bp, Artificial sequence
  SiRNA target sequence
ccaccactaagcttatgtcccttat

SEQ ID NO: 44915 - DNA, 25 bp, Artificial sequence
  SiRNA target sequence
caccactaagcttatgtcccttatc

SEQ ID NO: 44916 - DNA, 25 bp, Artificial sequence
  SiRNA target sequence
accactaagcttatgtcccttatct

SEQ ID NO: 44917 - DNA, 25 bp, Artificial sequence
  SiRNA target sequence
ccactaagcttatgtcccttatctc

SEQ ID NO: 44918 - DNA, 25 bp, Artificial sequence
  SiRNA target sequence
cactaagcttatgtcccttatctcc

SEQ ID NO: 44919 - DNA, 25 bp, Artificial sequence
  SiRNA target sequence
actaagcttatgtcccttatctcca

SEQ ID NO: 44920 - DNA, 25 bp, Artificial sequence
  SiRNA target sequence
ctaagcttatgtcccttatctccaa

SEQ ID NO: 44921 - DNA, 25 bp, Artificial sequence
  SiRNA target sequence
taagcttatgtcccttatctccaac

SEQ ID NO: 44922 - DNA, 25 bp, Artificial sequence
  SiRNA target sequence
aagcttatgtcccttatctccaaca

SEQ ID NO: 44923 - DNA, 25 bp, Artificial sequence
  SiRNA target sequence
agcttatgtcccttatctccaacat

SEQ ID NO: 44924 - DNA, 25 bp, Artificial sequence
  SiRNA target sequence
gcttatgtcccttatctccaacatg

SEQ ID NO: 44925 - DNA, 25 bp, Artificial sequence
  SiRNA target sequence
cttatgtcccttatctccaacatgt

SEQ ID NO: 44926 - DNA, 25 bp, Artificial sequence
  SiRNA target sequence
ttatgtcccttatctccaacatgtg

SEQ ID NO: 44927 - DNA, 25 bp, Artificial sequence
  SiRNA target sequence
tatgtcccttatctccaacatgtgt

SEQ ID NO: 44928 - DNA, 25 bp, Artificial sequence
  SiRNA target sequence
atgtcccttatctccaacatgtgtg

SEQ ID NO: 44929 - DNA, 25 bp, Artificial sequence
  SiRNA target sequence
tgtcccttatctccaacatgtgtgt

SEQ ID NO: 44930 - DNA, 25 bp, Artificial sequence
  SiRNA target sequence
gtcccttatctccaacatgtgtgtt

SEQ ID NO: 44931 - DNA, 25 bp, Artificial sequence
  SiRNA target sequence
tcccttatctccaacatgtgtgttg

SEQ ID NO: 44932 - DNA, 25 bp, Artificial sequence
  SiRNA target sequence
cccttatctccaacatgtgtgttgt

SEQ ID NO: 44933 - DNA, 25 bp, Artificial sequence
  SiRNA target sequence
ccttatctccaacatgtgtgttgta

SEQ ID NO: 44934 - DNA, 25 bp, Artificial sequence
  SiRNA target sequence
cttatctccaacatgtgtgttgtat

SEQ ID NO: 44935 - DNA, 25 bp, Artificial sequence
  SiRNA target sequence
ttatctccaacatgtgtgttgtatt

SEQ ID NO: 44936 - DNA, 25 bp, Artificial sequence
  SiRNA target sequence
tatctccaacatgtgtgttgtattc

SEQ ID NO: 44937 - DNA, 25 bp, Artificial sequence
  SiRNA target sequence
atctccaacatgtgtgttgtattca

SEQ ID NO: 44938 - DNA, 25 bp, Artificial sequence
  SiRNA target sequence
tctccaacatgtgtgttgtattcat

SEQ ID NO: 44939 - DNA, 25 bp, Artificial sequence
  SiRNA target sequence
ctccaacatgtgtgttgtattcatc

SEQ ID NO: 44940 - DNA, 25 bp, Artificial sequence
  SiRNA target sequence
tccaacatgtgtgttgtattcatcc

SEQ ID NO: 44941 - DNA, 25 bp, Artificial sequence
  SiRNA target sequence
ccaacatgtgtgttgtattcatcct

SEQ ID NO: 44942 - DNA, 25 bp, Artificial sequence
  SiRNA target sequence
caacatgtgtgttgtattcatcctc

SEQ ID NO: 44943 - DNA, 25 bp, Artificial sequence
  SiRNA target sequence
aacatgtgtgttgtattcatcctct

SEQ ID NO: 44944 - DNA, 25 bp, Artificial sequence
  SiRNA target sequence
acatgtgtgttgtattcatcctcta

SEQ ID NO: 44945 - DNA, 25 bp, Artificial sequence
  SiRNA target sequence
catgtgtgttgtattcatcctctag

SEQ ID NO: 44946 - DNA, 25 bp, Artificial sequence
  SiRNA target sequence
atgtgtgttgtattcatcctctagg

SEQ ID NO: 44947 - DNA, 25 bp, Artificial sequence
  SiRNA target sequence
tgtgtgttgtattcatcctctaggt

SEQ ID NO: 44948 - DNA, 25 bp, Artificial sequence
  SiRNA target sequence
gtgtgttgtattcatcctctaggtt

SEQ ID NO: 44949 - DNA, 25 bp, Artificial sequence
  SiRNA target sequence
tgtgttgtattcatcctctaggttg

SEQ ID NO: 44950 - DNA, 25 bp, Artificial sequence
  SiRNA target sequence
gtgttgtattcatcctctaggttgt

SEQ ID NO: 44951 - DNA, 25 bp, Artificial sequence
  SiRNA target sequence
tgttgtattcatcctctaggttgtt

SEQ ID NO: 44952 - DNA, 25 bp, Artificial sequence
  SiRNA target sequence
gttgtattcatcctctaggttgttt

SEQ ID NO: 44953 - DNA, 25 bp, Artificial sequence
  SiRNA target sequence
ttgtattcatcctctaggttgttta

SEQ ID NO: 44954 - DNA, 25 bp, Artificial sequence
  SiRNA target sequence
tgtattcatcctctaggttgtttat

SEQ ID NO: 44955 - DNA, 25 bp, Artificial sequence
  SiRNA target sequence
gtattcatcctctaggttgtttata

SEQ ID NO: 44956 - DNA, 25 bp, Artificial sequence
  SiRNA target sequence
tattcatcctctaggttgtttatag

SEQ ID NO: 44957 - DNA, 25 bp, Artificial sequence
  SiRNA target sequence
attcatcctctaggttgtttataga

SEQ ID NO: 44958 - DNA, 25 bp, Artificial sequence
  SiRNA target sequence
ttcatcctctaggttgtttatagaa

SEQ ID NO: 44959 - DNA, 25 bp, Artificial sequence
  SiRNA target sequence
tcatcctctaggttgtttatagaat

SEQ ID NO: 44960 - DNA, 25 bp, Artificial sequence
  SiRNA target sequence
catcctctaggttgtttatagaatc

SEQ ID NO: 44961 - DNA, 25 bp, Artificial sequence
  SiRNA target sequence
atcctctaggttgtttatagaatcg

SEQ ID NO: 44962 - DNA, 25 bp, Artificial sequence
  SiRNA target sequence
tcctctaggttgtttatagaatcgt

SEQ ID NO: 44963 - DNA, 25 bp, Artificial sequence
  SiRNA target sequence
cctctaggttgtttatagaatcgtg

SEQ ID NO: 44964 - DNA, 25 bp, Artificial sequence
  SiRNA target sequence
ctctaggttgtttatagaatcgtgt

SEQ ID NO: 44965 - DNA, 25 bp, Artificial sequence
  SiRNA target sequence
tctaggttgtttatagaatcgtgta

SEQ ID NO: 44966 - DNA, 25 bp, Artificial sequence
  SiRNA target sequence
ctaggttgtttatagaatcgtgtac

SEQ ID NO: 44967 - DNA, 25 bp, Artificial sequence
  SiRNA target sequence
taggttgtttatagaatcgtgtaca

SEQ ID NO: 44968 - DNA, 25 bp, Artificial sequence
  SiRNA target sequence
aggttgtttatagaatcgtgtacac

SEQ ID NO: 44969 - DNA, 25 bp, Artificial sequence
  SiRNA target sequence
ggttgtttatagaatcgtgtacaca

SEQ ID NO: 44970 - DNA, 25 bp, Artificial sequence
  SiRNA target sequence
gttgtttatagaatcgtgtacacaa

SEQ ID NO: 44971 - DNA, 25 bp, Artificial sequence
  SiRNA target sequence
ttgtttatagaatcgtgtacacaaa

SEQ ID NO: 44972 - DNA, 25 bp, Artificial sequence
  SiRNA target sequence
tgtttatagaatcgtgtacacaaag

SEQ ID NO: 44973 - DNA, 25 bp, Artificial sequence
  SiRNA target sequence
gtttatagaatcgtgtacacaaagt

SEQ ID NO: 44974 - DNA, 25 bp, Artificial sequence
  SiRNA target sequence
tttatagaatcgtgtacacaaagtt

SEQ ID NO: 44975 - DNA, 25 bp, Artificial sequence
  SiRNA target sequence
ttatagaatcgtgtacacaaagttt

SEQ ID NO: 44976 - DNA, 25 bp, Artificial sequence
  SiRNA target sequence
tatagaatcgtgtacacaaagtttt

SEQ ID NO: 44977 - DNA, 25 bp, Artificial sequence
  SiRNA target sequence
atagaatcgtgtacacaaagttttt

SEQ ID NO: 44978 - DNA, 25 bp, Artificial sequence
  SiRNA target sequence
tagaatcgtgtacacaaagtttttt

SEQ ID NO: 44979 - DNA, 25 bp, Artificial sequence
  SiRNA target sequence
agaatcgtgtacacaaagtttttta

SEQ ID NO: 44980 - DNA, 25 bp, Artificial sequence
  SiRNA target sequence
gaatcgtgtacacaaagttttttac

SEQ ID NO: 44981 - DNA, 25 bp, Artificial sequence
  SiRNA target sequence
aatcgtgtacacaaagttttttact

SEQ ID NO: 44982 - DNA, 25 bp, Artificial sequence
  SiRNA target sequence
atcgtgtacacaaagttttttactg

SEQ ID NO: 44983 - DNA, 25 bp, Artificial sequence
  SiRNA target sequence
tcgtgtacacaaagttttttactga

SEQ ID NO: 44984 - DNA, 25 bp, Artificial sequence
  SiRNA target sequence
cgtgtacacaaagttttttactgat

SEQ ID NO: 44985 - DNA, 25 bp, Artificial sequence
  SiRNA target sequence
gtgtacacaaagttttttactgatt

SEQ ID NO: 44986 - DNA, 25 bp, Artificial sequence
  SiRNA target sequence
tgtacacaaagttttttactgattt

SEQ ID NO: 44987 - DNA, 25 bp, Artificial sequence
  SiRNA target sequence
gtacacaaagttttttactgatttt

SEQ ID NO: 44988 - DNA, 25 bp, Artificial sequence
  SiRNA target sequence
tacacaaagttttttactgattttt

SEQ ID NO: 44989 - DNA, 25 bp, Artificial sequence
  SiRNA target sequence
acacaaagttttttactgattttta

SEQ ID NO: 44990 - DNA, 25 bp, Artificial sequence
  SiRNA target sequence
cacaaagttttttactgatttttat

SEQ ID NO: 44991 - DNA, 25 bp, Artificial sequence
  SiRNA target sequence
acaaagttttttactgatttttata

SEQ ID NO: 44992 - DNA, 25 bp, Artificial sequence
  SiRNA target sequence
caaagttttttactgatttttataa

SEQ ID NO: 44993 - DNA, 25 bp, Artificial sequence
  SiRNA target sequence
aaagttttttactgatttttataac

SEQ ID NO: 44994 - DNA, 25 bp, Artificial sequence
  SiRNA target sequence
aagttttttactgatttttataact

SEQ ID NO: 44995 - DNA, 25 bp, Artificial sequence
  SiRNA target sequence
agttttttactgatttttataactt

SEQ ID NO: 44996 - DNA, 25 bp, Artificial sequence
  SiRNA target sequence
gttttttactgatttttataacttc

SEQ ID NO: 44997 - DNA, 25 bp, Artificial sequence
  SiRNA target sequence
ttttttactgatttttataacttct

SEQ ID NO: 44998 - DNA, 25 bp, Artificial sequence
  SiRNA target sequence
tttttactgatttttataacttctt

SEQ ID NO: 44999 - DNA, 25 bp, Artificial sequence
  SiRNA target sequence
ttttactgatttttataacttcttc

SEQ ID NO: 45000 - DNA, 25 bp, Artificial sequence
  SiRNA target sequence
tttactgatttttataacttcttct

SEQ ID NO: 45001 - DNA, 25 bp, Artificial sequence
  SiRNA target sequence
ttactgatttttataacttcttctt

SEQ ID NO: 45002 - DNA, 25 bp, Artificial sequence
  SiRNA target sequence
tactgatttttataacttcttcttt

SEQ ID NO: 45003 - DNA, 25 bp, Artificial sequence
  SiRNA target sequence
actgatttttataacttcttcttta

SEQ ID NO: 45004 - DNA, 25 bp, Artificial sequence
  SiRNA target sequence
ctgatttttataacttcttctttat

SEQ ID NO: 45005 - DNA, 25 bp, Artificial sequence
  SiRNA target sequence
tgatttttataacttcttctttatc

SEQ ID NO: 45006 - DNA, 25 bp, Artificial sequence
  SiRNA target sequence
gatttttataacttcttctttatca

SEQ ID NO: 45007 - DNA, 25 bp, Artificial sequence
  SiRNA target sequence
atttttataacttcttctttatcaa

SEQ ID NO: 45008 - DNA, 25 bp, Artificial sequence
  SiRNA target sequence
tttttataacttcttctttatcaaa

SEQ ID NO: 45009 - DNA, 25 bp, Artificial sequence
  SiRNA target sequence
ttttataacttcttctttatcaaat

SEQ ID NO: 45010 - DNA, 25 bp, Artificial sequence
  SiRNA target sequence
tttataacttcttctttatcaaata

SEQ ID NO: 45011 - DNA, 25 bp, Artificial sequence
  SiRNA target sequence
ttataacttcttctttatcaaatat

SEQ ID NO: 45012 - DNA, 25 bp, Artificial sequence
  SiRNA target sequence
tataacttcttctttatcaaatatt

SEQ ID NO: 45013 - DNA, 25 bp, Artificial sequence
  SiRNA target sequence
ataacttcttctttatcaaatattt

SEQ ID NO: 45014 - DNA, 25 bp, Artificial sequence
  SiRNA target sequence
taacttcttctttatcaaatatttc

SEQ ID NO: 45015 - DNA, 25 bp, Artificial sequence
  SiRNA target sequence
aacttcttctttatcaaatatttct

SEQ ID NO: 45016 - DNA, 25 bp, Artificial sequence
  SiRNA target sequence
acttcttctttatcaaatatttctt

SEQ ID NO: 45017 - DNA, 25 bp, Artificial sequence
  SiRNA target sequence
cttcttctttatcaaatatttcttt

SEQ ID NO: 45018 - DNA, 25 bp, Artificial sequence
  SiRNA target sequence
ttcttctttatcaaatatttctttt

SEQ ID NO: 45019 - DNA, 25 bp, Artificial sequence
  SiRNA target sequence
tcttctttatcaaatatttcttttc

SEQ ID NO: 45020 - DNA, 25 bp, Artificial sequence
  SiRNA target sequence
cttctttatcaaatatttcttttcc

SEQ ID NO: 45021 - DNA, 25 bp, Artificial sequence
  SiRNA target sequence
ttctttatcaaatatttcttttcca

SEQ ID NO: 45022 - DNA, 25 bp, Artificial sequence
  SiRNA target sequence
tctttatcaaatatttcttttccat

SEQ ID NO: 45023 - DNA, 25 bp, Artificial sequence
  SiRNA target sequence
ctttatcaaatatttcttttccata

SEQ ID NO: 45024 - DNA, 25 bp, Artificial sequence
  SiRNA target sequence
tttatcaaatatttcttttccatat

SEQ ID NO: 45025 - DNA, 25 bp, Artificial sequence
  SiRNA target sequence
ttatcaaatatttcttttccatatg

SEQ ID NO: 45026 - DNA, 25 bp, Artificial sequence
  SiRNA target sequence
tatcaaatatttcttttccatatgt

SEQ ID NO: 45027 - DNA, 25 bp, Artificial sequence
  SiRNA target sequence
atcaaatatttcttttccatatgtt

SEQ ID NO: 45028 - DNA, 25 bp, Artificial sequence
  SiRNA target sequence
tcaaatatttcttttccatatgtta

SEQ ID NO: 45029 - DNA, 25 bp, Artificial sequence
  SiRNA target sequence
caaatatttcttttccatatgttaa

SEQ ID NO: 45030 - DNA, 25 bp, Artificial sequence
  SiRNA target sequence
aaatatttcttttccatatgttaaa

SEQ ID NO: 45031 - DNA, 25 bp, Artificial sequence
  SiRNA target sequence
aatatttcttttccatatgttaaat

SEQ ID NO: 45032 - DNA, 25 bp, Artificial sequence
  SiRNA target sequence
atatttcttttccatatgttaaatt

SEQ ID NO: 45033 - DNA, 25 bp, Artificial sequence
  SiRNA target sequence
tatttcttttccatatgttaaatta

SEQ ID NO: 45034 - DNA, 25 bp, Artificial sequence
  SiRNA target sequence
atttcttttccatatgttaaattat

SEQ ID NO: 45035 - DNA, 25 bp, Artificial sequence
  SiRNA target sequence
tttcttttccatatgttaaattata

SEQ ID NO: 45036 - DNA, 25 bp, Artificial sequence
  SiRNA target sequence
ttcttttccatatgttaaattataa

SEQ ID NO: 45037 - DNA, 25 bp, Artificial sequence
  SiRNA target sequence
tcttttccatatgttaaattataat

SEQ ID NO: 45038 - DNA, 25 bp, Artificial sequence
  SiRNA target sequence
cttttccatatgttaaattataata

SEQ ID NO: 45039 - DNA, 25 bp, Artificial sequence
  SiRNA target sequence
ttttccatatgttaaattataataa

SEQ ID NO: 45040 - DNA, 25 bp, Artificial sequence
  SiRNA target sequence
tttccatatgttaaattataataaa

SEQ ID NO: 45041 - DNA, 25 bp, Artificial sequence
  SiRNA target sequence
ttccatatgttaaattataataaac

SEQ ID NO: 45042 - DNA, 25 bp, Artificial sequence
  SiRNA target sequence
tccatatgttaaattataataaacc

SEQ ID NO: 45043 - DNA, 25 bp, Artificial sequence
  SiRNA target sequence
ccatatgttaaattataataaaccg

SEQ ID NO: 45044 - DNA, 25 bp, Artificial sequence
  SiRNA target sequence
catatgttaaattataataaaccgt

SEQ ID NO: 45045 - DNA, 25 bp, Artificial sequence
  SiRNA target sequence
atatgttaaattataataaaccgtt

SEQ ID NO: 45046 - DNA, 25 bp, Artificial sequence
  SiRNA target sequence
tatgttaaattataataaaccgttt

SEQ ID NO: 45047 - DNA, 25 bp, Artificial sequence
  SiRNA target sequence
atgttaaattataataaaccgtttc

SEQ ID NO: 45048 - DNA, 25 bp, Artificial sequence
  SiRNA target sequence
tgttaaattataataaaccgtttcg

SEQ ID NO: 45049 - DNA, 25 bp, Artificial sequence
  SiRNA target sequence
gttaaattataataaaccgtttcgt

SEQ ID NO: 45050 - DNA, 25 bp, Artificial sequence
  SiRNA target sequence
ttaaattataataaaccgtttcgtt

SEQ ID NO: 45051 - DNA, 25 bp, Artificial sequence
  SiRNA target sequence
taaattataataaaccgtttcgtta

SEQ ID NO: 45052 - DNA, 25 bp, Artificial sequence
  SiRNA target sequence
aaattataataaaccgtttcgttaa

SEQ ID NO: 45053 - DNA, 25 bp, Artificial sequence
  SiRNA target sequence
aattataataaaccgtttcgttaaa

SEQ ID NO: 45054 - DNA, 25 bp, Artificial sequence
  SiRNA target sequence
attataataaaccgtttcgttaaac

SEQ ID NO: 45055 - DNA, 25 bp, Artificial sequence
  SiRNA target sequence
ttataataaaccgtttcgttaaaca

SEQ ID NO: 45056 - DNA, 25 bp, Artificial sequence
  SiRNA target sequence
tataataaaccgtttcgttaaacaa

SEQ ID NO: 45057 - DNA, 25 bp, Artificial sequence
  SiRNA target sequence
ataataaaccgtttcgttaaacaaa

SEQ ID NO: 45058 - DNA, 25 bp, Artificial sequence
  SiRNA target sequence
taataaaccgtttcgttaaacaaaa

SEQ ID NO: 45059 - DNA, 25 bp, Artificial sequence
  SiRNA target sequence
aataaaccgtttcgttaaacaaaaa

SEQ ID NO: 45060 - DNA, 25 bp, Artificial sequence
  SiRNA target sequence
ataaaccgtttcgttaaacaaaaat

SEQ ID NO: 45061 - DNA, 25 bp, Artificial sequence
  SiRNA target sequence
taaaccgtttcgttaaacaaaaatg

SEQ ID NO: 45062 - DNA, 25 bp, Artificial sequence
  SiRNA target sequence
aaaccgtttcgttaaacaaaaatga

SEQ ID NO: 45063 - DNA, 25 bp, Artificial sequence
  SiRNA target sequence
aaccgtttcgttaaacaaaaatgag

SEQ ID NO: 45064 - DNA, 25 bp, Artificial sequence
  SiRNA target sequence
accgtttcgttaaacaaaaatgagg

SEQ ID NO: 45065 - DNA, 25 bp, Artificial sequence
  SiRNA target sequence
ccgtttcgttaaacaaaaatgaggt

SEQ ID NO: 45066 - DNA, 25 bp, Artificial sequence
  SiRNA target sequence
cgtttcgttaaacaaaaatgaggtt

SEQ ID NO: 45067 - DNA, 25 bp, Artificial sequence
  SiRNA target sequence
gtttcgttaaacaaaaatgaggttt

SEQ ID NO: 45068 - DNA, 25 bp, Artificial sequence
  SiRNA target sequence
tttcgttaaacaaaaatgaggtttg

SEQ ID NO: 45069 - DNA, 25 bp, Artificial sequence
  SiRNA target sequence
ttcgttaaacaaaaatgaggtttgt

SEQ ID NO: 45070 - DNA, 25 bp, Artificial sequence
  SiRNA target sequence
tcgttaaacaaaaatgaggtttgtg

SEQ ID NO: 45071 - DNA, 25 bp, Artificial sequence
  SiRNA target sequence
cgttaaacaaaaatgaggtttgtgg

SEQ ID NO: 45072 - DNA, 25 bp, Artificial sequence
  SiRNA target sequence
gttaaacaaaaatgaggtttgtggt

SEQ ID NO: 45073 - DNA, 25 bp, Artificial sequence
  SiRNA target sequence
ttaaacaaaaatgaggtttgtggtg

SEQ ID NO: 45074 - DNA, 25 bp, Artificial sequence
  SiRNA target sequence
taaacaaaaatgaggtttgtggtgc

SEQ ID NO: 45075 - DNA, 25 bp, Artificial sequence
  SiRNA target sequence
aaacaaaaatgaggtttgtggtgca

SEQ ID NO: 45076 - DNA, 25 bp, Artificial sequence
  SiRNA target sequence
aacaaaaatgaggtttgtggtgcaa

SEQ ID NO: 45077 - DNA, 25 bp, Artificial sequence
  SiRNA target sequence
acaaaaatgaggtttgtggtgcaaa

SEQ ID NO: 45078 - DNA, 25 bp, Artificial sequence
  SiRNA target sequence
caaaaatgaggtttgtggtgcaaat

SEQ ID NO: 45079 - DNA, 25 bp, Artificial sequence
  SiRNA target sequence
aaaaatgaggtttgtggtgcaaatg

SEQ ID NO: 45080 - DNA, 25 bp, Artificial sequence
  SiRNA target sequence
aaaatgaggtttgtggtgcaaatga

SEQ ID NO: 45081 - DNA, 25 bp, Artificial sequence
  SiRNA target sequence
aaatgaggtttgtggtgcaaatgat

SEQ ID NO: 45082 - DNA, 25 bp, Artificial sequence
  SiRNA target sequence
aatgaggtttgtggtgcaaatgata

SEQ ID NO: 45083 - DNA, 25 bp, Artificial sequence
  SiRNA target sequence
atgaggtttgtggtgcaaatgatat

SEQ ID NO: 45084 - DNA, 25 bp, Artificial sequence
  SiRNA target sequence
tgaggtttgtggtgcaaatgatata

SEQ ID NO: 45085 - DNA, 25 bp, Artificial sequence
  SiRNA target sequence
gaggtttgtggtgcaaatgatataa

SEQ ID NO: 45086 - DNA, 25 bp, Artificial sequence
  SiRNA target sequence
aggtttgtggtgcaaatgatataag

SEQ ID NO: 45087 - DNA, 25 bp, Artificial sequence
  SiRNA target sequence
ggtttgtggtgcaaatgatataagt

SEQ ID NO: 45088 - DNA, 25 bp, Artificial sequence
  SiRNA target sequence
gtttgtggtgcaaatgatataagtg

SEQ ID NO: 45089 - DNA, 25 bp, Artificial sequence
  SiRNA target sequence
tttgtggtgcaaatgatataagtga

SEQ ID NO: 45090 - DNA, 25 bp, Artificial sequence
  SiRNA target sequence
ttgtggtgcaaatgatataagtgat

SEQ ID NO: 45091 - DNA, 25 bp, Artificial sequence
  SiRNA target sequence
tgtggtgcaaatgatataagtgatc

SEQ ID NO: 45092 - DNA, 25 bp, Artificial sequence
  SiRNA target sequence
gtggtgcaaatgatataagtgatct

SEQ ID NO: 45093 - DNA, 25 bp, Artificial sequence
  SiRNA target sequence
tggtgcaaatgatataagtgatcta

SEQ ID NO: 45094 - DNA, 25 bp, Artificial sequence
  SiRNA target sequence
ggtgcaaatgatataagtgatctat

SEQ ID NO: 45095 - DNA, 25 bp, Artificial sequence
  SiRNA target sequence
gtgcaaatgatataagtgatctata

SEQ ID NO: 45096 - DNA, 25 bp, Artificial sequence
  SiRNA target sequence
tgcaaatgatataagtgatctatat

SEQ ID NO: 45097 - DNA, 25 bp, Artificial sequence
  SiRNA target sequence
gcaaatgatataagtgatctatatg

SEQ ID NO: 45098 - DNA, 25 bp, Artificial sequence
  SiRNA target sequence
caaatgatataagtgatctatatga

SEQ ID NO: 45099 - DNA, 25 bp, Artificial sequence
  SiRNA target sequence
aaatgatataagtgatctatatgaa

SEQ ID NO: 45100 - DNA, 25 bp, Artificial sequence
  SiRNA target sequence
aatgatataagtgatctatatgaac

SEQ ID NO: 45101 - DNA, 25 bp, Artificial sequence
  SiRNA target sequence
atgatataagtgatctatatgaact

SEQ ID NO: 45102 - DNA, 25 bp, Artificial sequence
  SiRNA target sequence
tgatataagtgatctatatgaacta

SEQ ID NO: 45103 - DNA, 25 bp, Artificial sequence
  SiRNA target sequence
gatataagtgatctatatgaactat

SEQ ID NO: 45104 - DNA, 25 bp, Artificial sequence
  SiRNA target sequence
atataagtgatctatatgaactatt

SEQ ID NO: 45105 - DNA, 25 bp, Artificial sequence
  SiRNA target sequence
tataagtgatctatatgaactatta

SEQ ID NO: 45106 - DNA, 25 bp, Artificial sequence
  SiRNA target sequence
ataagtgatctatatgaactattag

SEQ ID NO: 45107 - DNA, 25 bp, Artificial sequence
  SiRNA target sequence
taagtgatctatatgaactattaga

SEQ ID NO: 45108 - DNA, 25 bp, Artificial sequence
  SiRNA target sequence
aagtgatctatatgaactattagaa

SEQ ID NO: 45109 - DNA, 25 bp, Artificial sequence
  SiRNA target sequence
agtgatctatatgaactattagaaa

SEQ ID NO: 45110 - DNA, 25 bp, Artificial sequence
  SiRNA target sequence
gtgatctatatgaactattagaaat

SEQ ID NO: 45111 - DNA, 25 bp, Artificial sequence
  SiRNA target sequence
tgatctatatgaactattagaaatt

SEQ ID NO: 45112 - DNA, 25 bp, Artificial sequence
  SiRNA target sequence
gatctatatgaactattagaaattt

SEQ ID NO: 45113 - DNA, 25 bp, Artificial sequence
  SiRNA target sequence
atctatatgaactattagaaatttc

SEQ ID NO: 45114 - DNA, 25 bp, Artificial sequence
  SiRNA target sequence
tctatatgaactattagaaatttct

SEQ ID NO: 45115 - DNA, 25 bp, Artificial sequence
  SiRNA target sequence
ctatatgaactattagaaatttctt

SEQ ID NO: 45116 - DNA, 25 bp, Artificial sequence
  SiRNA target sequence
tatatgaactattagaaatttcttt

SEQ ID NO: 45117 - DNA, 25 bp, Artificial sequence
  SiRNA target sequence
atatgaactattagaaatttctttt

SEQ ID NO: 45118 - DNA, 25 bp, Artificial sequence
  SiRNA target sequence
tatgaactattagaaatttctttta

SEQ ID NO: 45119 - DNA, 25 bp, Artificial sequence
  SiRNA target sequence
atgaactattagaaatttcttttat

SEQ ID NO: 45120 - DNA, 25 bp, Artificial sequence
  SiRNA target sequence
tgaactattagaaatttcttttata

SEQ ID NO: 45121 - DNA, 25 bp, Artificial sequence
  SiRNA target sequence
gaactattagaaatttcttttatat

SEQ ID NO: 45122 - DNA, 25 bp, Artificial sequence
  SiRNA target sequence
aactattagaaatttcttttatatc

SEQ ID NO: 45123 - DNA, 25 bp, Artificial sequence
  SiRNA target sequence
actattagaaatttcttttatatct

SEQ ID NO: 45124 - DNA, 25 bp, Artificial sequence
  SiRNA target sequence
ctattagaaatttcttttatatctc

SEQ ID NO: 45125 - DNA, 25 bp, Artificial sequence
  SiRNA target sequence
tattagaaatttcttttatatctcg

SEQ ID NO: 45126 - DNA, 25 bp, Artificial sequence
  SiRNA target sequence
attagaaatttcttttatatctcga

SEQ ID NO: 45127 - DNA, 25 bp, Artificial sequence
  SiRNA target sequence
ttagaaatttcttttatatctcgat

SEQ ID NO: 45128 - DNA, 25 bp, Artificial sequence
  SiRNA target sequence
tagaaatttcttttatatctcgatt

SEQ ID NO: 45129 - DNA, 25 bp, Artificial sequence
  SiRNA target sequence
agaaatttcttttatatctcgatta

SEQ ID NO: 45130 - DNA, 25 bp, Artificial sequence
  SiRNA target sequence
gaaatttcttttatatctcgattat

SEQ ID NO: 45131 - DNA, 25 bp, Artificial sequence
  SiRNA target sequence
aaatttcttttatatctcgattatc

SEQ ID NO: 45132 - DNA, 25 bp, Artificial sequence
  SiRNA target sequence
aatttcttttatatctcgattatct

SEQ ID NO: 45133 - DNA, 25 bp, Artificial sequence
  SiRNA target sequence
atttcttttatatctcgattatcta

SEQ ID NO: 45134 - DNA, 25 bp, Artificial sequence
  SiRNA target sequence
tttcttttatatctcgattatctag

SEQ ID NO: 45135 - DNA, 25 bp, Artificial sequence
  SiRNA target sequence
ttcttttatatctcgattatctaga

SEQ ID NO: 45136 - DNA, 25 bp, Artificial sequence
  SiRNA target sequence
tcttttatatctcgattatctagat

SEQ ID NO: 45137 - DNA, 25 bp, Artificial sequence
  SiRNA target sequence
cttttatatctcgattatctagata

SEQ ID NO: 45138 - DNA, 25 bp, Artificial sequence
  SiRNA target sequence
ttttatatctcgattatctagataa

SEQ ID NO: 45139 - DNA, 25 bp, Artificial sequence
  SiRNA target sequence
tttatatctcgattatctagataaa

SEQ ID NO: 45140 - DNA, 25 bp, Artificial sequence
  SiRNA target sequence
ttatatctcgattatctagataaat

SEQ ID NO: 45141 - DNA, 25 bp, Artificial sequence
  SiRNA target sequence
tatatctcgattatctagataaata

SEQ ID NO: 45142 - DNA, 25 bp, Artificial sequence
  SiRNA target sequence
atatctcgattatctagataaatat

SEQ ID NO: 45143 - DNA, 25 bp, Artificial sequence
  SiRNA target sequence
tatctcgattatctagataaatatt

SEQ ID NO: 45144 - DNA, 25 bp, Artificial sequence
  SiRNA target sequence
atctcgattatctagataaatattt

SEQ ID NO: 45145 - DNA, 25 bp, Artificial sequence
  SiRNA target sequence
tctcgattatctagataaatatttc

SEQ ID NO: 45146 - DNA, 25 bp, Artificial sequence
  SiRNA target sequence
ctcgattatctagataaatatttcc

SEQ ID NO: 45147 - DNA, 25 bp, Artificial sequence
  SiRNA target sequence
tcgattatctagataaatatttccc

SEQ ID NO: 45148 - DNA, 25 bp, Artificial sequence
  SiRNA target sequence
cgattatctagataaatatttcccc

SEQ ID NO: 45149 - DNA, 25 bp, Artificial sequence
  SiRNA target sequence
gattatctagataaatatttccccc

SEQ ID NO: 45150 - DNA, 25 bp, Artificial sequence
  SiRNA target sequence
attatctagataaatatttccccca

SEQ ID NO: 45151 - DNA, 25 bp, Artificial sequence
  SiRNA target sequence
ttatctagataaatatttcccccat

SEQ ID NO: 45152 - DNA, 25 bp, Artificial sequence
  SiRNA target sequence
tatctagataaatatttcccccata

SEQ ID NO: 45153 - DNA, 25 bp, Artificial sequence
  SiRNA target sequence
atctagataaatatttcccccataa

SEQ ID NO: 45154 - DNA, 25 bp, Artificial sequence
  SiRNA target sequence
tctagataaatatttcccccataat

SEQ ID NO: 45155 - DNA, 25 bp, Artificial sequence
  SiRNA target sequence
ctagataaatatttcccccataatt

SEQ ID NO: 45156 - DNA, 25 bp, Artificial sequence
  SiRNA target sequence
tagataaatatttcccccataattt

SEQ ID NO: 45157 - DNA, 25 bp, Artificial sequence
  SiRNA target sequence
agataaatatttcccccataatttt

SEQ ID NO: 45158 - DNA, 25 bp, Artificial sequence
  SiRNA target sequence
gataaatatttcccccataattttc

SEQ ID NO: 45159 - DNA, 25 bp, Artificial sequence
  SiRNA target sequence
ataaatatttcccccataattttca

SEQ ID NO: 45160 - DNA, 25 bp, Artificial sequence
  SiRNA target sequence
taaatatttcccccataattttcaa

SEQ ID NO: 45161 - DNA, 25 bp, Artificial sequence
  SiRNA target sequence
aaatatttcccccataattttcaaa

SEQ ID NO: 45162 - DNA, 25 bp, Artificial sequence
  SiRNA target sequence
aatatttcccccataattttcaaat

SEQ ID NO: 45163 - DNA, 25 bp, Artificial sequence
  SiRNA target sequence
atatttcccccataattttcaaatc

SEQ ID NO: 45164 - DNA, 25 bp, Artificial sequence
  SiRNA target sequence
tatttcccccataattttcaaatct

SEQ ID NO: 45165 - DNA, 25 bp, Artificial sequence
  SiRNA target sequence
atttcccccataattttcaaatctc

SEQ ID NO: 45166 - DNA, 25 bp, Artificial sequence
  SiRNA target sequence
tttcccccataattttcaaatctca

SEQ ID NO: 45167 - DNA, 25 bp, Artificial sequence
  SiRNA target sequence
ttcccccataattttcaaatctcat

SEQ ID NO: 45168 - DNA, 25 bp, Artificial sequence
  SiRNA target sequence
tcccccataattttcaaatctcata

SEQ ID NO: 45169 - DNA, 25 bp, Artificial sequence
  SiRNA target sequence
cccccataattttcaaatctcataa

SEQ ID NO: 45170 - DNA, 25 bp, Artificial sequence
  SiRNA target sequence
ccccataattttcaaatctcataat

SEQ ID NO: 45171 - DNA, 25 bp, Artificial sequence
  SiRNA target sequence
cccataattttcaaatctcataatc

SEQ ID NO: 45172 - DNA, 25 bp, Artificial sequence
  SiRNA target sequence
ccataattttcaaatctcataatca

SEQ ID NO: 45173 - DNA, 25 bp, Artificial sequence
  SiRNA target sequence
cataattttcaaatctcataatcat

SEQ ID NO: 45174 - DNA, 25 bp, Artificial sequence
  SiRNA target sequence
ataattttcaaatctcataatcatc

SEQ ID NO: 45175 - DNA, 25 bp, Artificial sequence
  SiRNA target sequence
taattttcaaatctcataatcatct

SEQ ID NO: 45176 - DNA, 25 bp, Artificial sequence
  SiRNA target sequence
aattttcaaatctcataatcatctt

SEQ ID NO: 45177 - DNA, 25 bp, Artificial sequence
  SiRNA target sequence
attttcaaatctcataatcatcttt

SEQ ID NO: 45178 - DNA, 25 bp, Artificial sequence
  SiRNA target sequence
ttttcaaatctcataatcatcttta

SEQ ID NO: 45179 - DNA, 25 bp, Artificial sequence
  SiRNA target sequence
tttcaaatctcataatcatctttat

SEQ ID NO: 45180 - DNA, 25 bp, Artificial sequence
  SiRNA target sequence
ttcaaatctcataatcatctttata

SEQ ID NO: 45181 - DNA, 25 bp, Artificial sequence
  SiRNA target sequence
tcaaatctcataatcatctttataa

SEQ ID NO: 45182 - DNA, 25 bp, Artificial sequence
  SiRNA target sequence
caaatctcataatcatctttataag

SEQ ID NO: 45183 - DNA, 25 bp, Artificial sequence
  SiRNA target sequence
aaatctcataatcatctttataaga

SEQ ID NO: 45184 - DNA, 25 bp, Artificial sequence
  SiRNA target sequence
aatctcataatcatctttataagag

SEQ ID NO: 45185 - DNA, 25 bp, Artificial sequence
  SiRNA target sequence
atctcataatcatctttataagaga

SEQ ID NO: 45186 - DNA, 25 bp, Artificial sequence
  SiRNA target sequence
tctcataatcatctttataagagat

SEQ ID NO: 45187 - DNA, 25 bp, Artificial sequence
  SiRNA target sequence
ctcataatcatctttataagagatg

SEQ ID NO: 45188 - DNA, 25 bp, Artificial sequence
  SiRNA target sequence
tcataatcatctttataagagatgt

SEQ ID NO: 45189 - DNA, 25 bp, Artificial sequence
  SiRNA target sequence
cataatcatctttataagagatgtt

SEQ ID NO: 45190 - DNA, 25 bp, Artificial sequence
  SiRNA target sequence
ataatcatctttataagagatgttt

SEQ ID NO: 45191 - DNA, 25 bp, Artificial sequence
  SiRNA target sequence
taatcatctttataagagatgtttt

SEQ ID NO: 45192 - DNA, 25 bp, Artificial sequence
  SiRNA target sequence
aatcatctttataagagatgttttt

SEQ ID NO: 45193 - DNA, 25 bp, Artificial sequence
  SiRNA target sequence
atcatctttataagagatgtttttc

SEQ ID NO: 45194 - DNA, 25 bp, Artificial sequence
  SiRNA target sequence
tcatctttataagagatgtttttcc

SEQ ID NO: 45195 - DNA, 25 bp, Artificial sequence
  SiRNA target sequence
catctttataagagatgtttttccc

SEQ ID NO: 45196 - DNA, 25 bp, Artificial sequence
  SiRNA target sequence
atctttataagagatgtttttcccg

SEQ ID NO: 45197 - DNA, 25 bp, Artificial sequence
  SiRNA target sequence
tctttataagagatgtttttcccga

SEQ ID NO: 45198 - DNA, 25 bp, Artificial sequence
  SiRNA target sequence
ctttataagagatgtttttcccgat

SEQ ID NO: 45199 - DNA, 25 bp, Artificial sequence
  SiRNA target sequence
tttataagagatgtttttcccgatc

SEQ ID NO: 45200 - DNA, 25 bp, Artificial sequence
  SiRNA target sequence
ttataagagatgtttttcccgatcc

SEQ ID NO: 45201 - DNA, 25 bp, Artificial sequence
  SiRNA target sequence
tataagagatgtttttcccgatcca

SEQ ID NO: 45202 - DNA, 25 bp, Artificial sequence
  SiRNA target sequence
ataagagatgtttttcccgatccat

SEQ ID NO: 45203 - DNA, 25 bp, Artificial sequence
  SiRNA target sequence
taagagatgtttttcccgatccatt

SEQ ID NO: 45204 - DNA, 25 bp, Artificial sequence
  SiRNA target sequence
aagagatgtttttcccgatccattt

SEQ ID NO: 45205 - DNA, 25 bp, Artificial sequence
  SiRNA target sequence
agagatgtttttcccgatccatttt

SEQ ID NO: 45206 - DNA, 25 bp, Artificial sequence
  SiRNA target sequence
gagatgtttttcccgatccattttt

SEQ ID NO: 45207 - DNA, 25 bp, Artificial sequence
  SiRNA target sequence
agatgtttttcccgatccatttttt

SEQ ID NO: 45208 - DNA, 25 bp, Artificial sequence
  SiRNA target sequence
gatgtttttcccgatccattttttc

SEQ ID NO: 45209 - DNA, 25 bp, Artificial sequence
  SiRNA target sequence
atgtttttcccgatccattttttcc

SEQ ID NO: 45210 - DNA, 25 bp, Artificial sequence
  SiRNA target sequence
tgtttttcccgatccattttttcca

SEQ ID NO: 45211 - DNA, 25 bp, Artificial sequence
  SiRNA target sequence
gtttttcccgatccattttttccaa

SEQ ID NO: 45212 - DNA, 25 bp, Artificial sequence
  SiRNA target sequence
tttttcccgatccattttttccaat

SEQ ID NO: 45213 - DNA, 25 bp, Artificial sequence
  SiRNA target sequence
ttttcccgatccattttttccaata

SEQ ID NO: 45214 - DNA, 25 bp, Artificial sequence
  SiRNA target sequence
tttcccgatccattttttccaataa

SEQ ID NO: 45215 - DNA, 25 bp, Artificial sequence
  SiRNA target sequence
ttcccgatccattttttccaataat

SEQ ID NO: 45216 - DNA, 25 bp, Artificial sequence
  SiRNA target sequence
tcccgatccattttttccaataata

SEQ ID NO: 45217 - DNA, 25 bp, Artificial sequence
  SiRNA target sequence
cccgatccattttttccaataatag

SEQ ID NO: 45218 - DNA, 25 bp, Artificial sequence
  SiRNA target sequence
ccgatccattttttccaataatagc

SEQ ID NO: 45219 - DNA, 25 bp, Artificial sequence
  SiRNA target sequence
cgatccattttttccaataatagct

SEQ ID NO: 45220 - DNA, 25 bp, Artificial sequence
  SiRNA target sequence
gatccattttttccaataatagcta

SEQ ID NO: 45221 - DNA, 25 bp, Artificial sequence
  SiRNA target sequence
atccattttttccaataatagctac

SEQ ID NO: 45222 - DNA, 25 bp, Artificial sequence
  SiRNA target sequence
tccattttttccaataatagctact

SEQ ID NO: 45223 - DNA, 25 bp, Artificial sequence
  SiRNA target sequence
ccattttttccaataatagctactt

SEQ ID NO: 45224 - DNA, 25 bp, Artificial sequence
  SiRNA target sequence
cattttttccaataatagctacttt

SEQ ID NO: 45225 - DNA, 25 bp, Artificial sequence
  SiRNA target sequence
attttttccaataatagctactttt

SEQ ID NO: 45226 - DNA, 25 bp, Artificial sequence
  SiRNA target sequence
ttttttccaataatagctacttttt

SEQ ID NO: 45227 - DNA, 25 bp, Artificial sequence
  SiRNA target sequence
tttttccaataatagctactttttc

SEQ ID NO: 45228 - DNA, 25 bp, Artificial sequence
  SiRNA target sequence
ttttccaataatagctactttttca

SEQ ID NO: 45229 - DNA, 25 bp, Artificial sequence
  SiRNA target sequence
tttccaataatagctactttttcac

SEQ ID NO: 45230 - DNA, 25 bp, Artificial sequence
  SiRNA target sequence
ttccaataatagctactttttcacc

SEQ ID NO: 45231 - DNA, 25 bp, Artificial sequence
  SiRNA target sequence
tccaataatagctactttttcacct

SEQ ID NO: 45232 - DNA, 25 bp, Artificial sequence
  SiRNA target sequence
ccaataatagctactttttcacctt

SEQ ID NO: 45233 - DNA, 25 bp, Artificial sequence
  SiRNA target sequence
caataatagctactttttcaccttt

SEQ ID NO: 45234 - DNA, 25 bp, Artificial sequence
  SiRNA target sequence
aataatagctactttttcacctttt

SEQ ID NO: 45235 - DNA, 25 bp, Artificial sequence
  SiRNA target sequence
ataatagctactttttcaccttttt

SEQ ID NO: 45236 - DNA, 25 bp, Artificial sequence
  SiRNA target sequence
taatagctactttttcacctttttt

SEQ ID NO: 45237 - DNA, 25 bp, Artificial sequence
  SiRNA target sequence
aatagctactttttcacctttttta

SEQ ID NO: 45238 - DNA, 25 bp, Artificial sequence
  SiRNA target sequence
atagctactttttcaccttttttaa

SEQ ID NO: 45239 - DNA, 25 bp, Artificial sequence
  SiRNA target sequence
tagctactttttcaccttttttaat

SEQ ID NO: 45240 - DNA, 25 bp, Artificial sequence
  SiRNA target sequence
agctactttttcaccttttttaatt

SEQ ID NO: 45241 - DNA, 25 bp, Artificial sequence
  SiRNA target sequence
gctactttttcaccttttttaatta

SEQ ID NO: 45242 - DNA, 25 bp, Artificial sequence
  SiRNA target sequence
ctactttttcaccttttttaattaa

SEQ ID NO: 45243 - DNA, 25 bp, Artificial sequence
  SiRNA target sequence
tactttttcaccttttttaattaaa

SEQ ID NO: 45244 - DNA, 25 bp, Artificial sequence
  SiRNA target sequence
actttttcaccttttttaattaaaa

SEQ ID NO: 45245 - DNA, 25 bp, Artificial sequence
  SiRNA target sequence
ctttttcaccttttttaattaaaat

SEQ ID NO: 45246 - DNA, 25 bp, Artificial sequence
  SiRNA target sequence
tttttcaccttttttaattaaaata

SEQ ID NO: 45247 - DNA, 25 bp, Artificial sequence
  SiRNA target sequence
ttttcaccttttttaattaaaatat

SEQ ID NO: 45248 - DNA, 25 bp, Artificial sequence
  SiRNA target sequence
tttcaccttttttaattaaaatatt

SEQ ID NO: 45249 - DNA, 25 bp, Artificial sequence
  SiRNA target sequence
ttcaccttttttaattaaaatattt

SEQ ID NO: 45250 - DNA, 25 bp, Artificial sequence
  SiRNA target sequence
tcaccttttttaattaaaatattta

SEQ ID NO: 45251 - DNA, 25 bp, Artificial sequence
  SiRNA target sequence
caccttttttaattaaaatatttat

SEQ ID NO: 45252 - DNA, 25 bp, Artificial sequence
  SiRNA target sequence
accttttttaattaaaatatttatg

SEQ ID NO: 45253 - DNA, 25 bp, Artificial sequence
  SiRNA target sequence
ccttttttaattaaaatatttatgt

SEQ ID NO: 45254 - DNA, 25 bp, Artificial sequence
  SiRNA target sequence
cttttttaattaaaatatttatgtc

SEQ ID NO: 45255 - DNA, 25 bp, Artificial sequence
  SiRNA target sequence
ttttttaattaaaatatttatgtcc

SEQ ID NO: 45256 - DNA, 25 bp, Artificial sequence
  SiRNA target sequence
tttttaattaaaatatttatgtccg

SEQ ID NO: 45257 - DNA, 25 bp, Artificial sequence
  SiRNA target sequence
ttttaattaaaatatttatgtccgt

SEQ ID NO: 45258 - DNA, 25 bp, Artificial sequence
  SiRNA target sequence
tttaattaaaatatttatgtccgtt

SEQ ID NO: 45259 - DNA, 25 bp, Artificial sequence
  SiRNA target sequence
ttaattaaaatatttatgtccgtta

SEQ ID NO: 45260 - DNA, 25 bp, Artificial sequence
  SiRNA target sequence
taattaaaatatttatgtccgttaa

SEQ ID NO: 45261 - DNA, 25 bp, Artificial sequence
  SiRNA target sequence
aattaaaatatttatgtccgttaaa

SEQ ID NO: 45262 - DNA, 25 bp, Artificial sequence
  SiRNA target sequence
attaaaatatttatgtccgttaaaa

SEQ ID NO: 45263 - DNA, 25 bp, Artificial sequence
  SiRNA target sequence
ttaaaatatttatgtccgttaaaat

SEQ ID NO: 45264 - DNA, 25 bp, Artificial sequence
  SiRNA target sequence
taaaatatttatgtccgttaaaatt

SEQ ID NO: 45265 - DNA, 25 bp, Artificial sequence
  SiRNA target sequence
aaaatatttatgtccgttaaaattt

SEQ ID NO: 45266 - DNA, 25 bp, Artificial sequence
  SiRNA target sequence
aaatatttatgtccgttaaaatttt

SEQ ID NO: 45267 - DNA, 25 bp, Artificial sequence
  SiRNA target sequence
aatatttatgtccgttaaaattttt

SEQ ID NO: 45268 - DNA, 25 bp, Artificial sequence
  SiRNA target sequence
atatttatgtccgttaaaatttttt

SEQ ID NO: 45269 - DNA, 25 bp, Artificial sequence
  SiRNA target sequence
tatttatgtccgttaaaattttttt

SEQ ID NO: 45270 - DNA, 25 bp, Artificial sequence
  SiRNA target sequence
atttatgtccgttaaaatttttttg

SEQ ID NO: 45271 - DNA, 25 bp, Artificial sequence
  SiRNA target sequence
tttatgtccgttaaaatttttttgg

SEQ ID NO: 45272 - DNA, 25 bp, Artificial sequence
  SiRNA target sequence
ttatgtccgttaaaatttttttgga

SEQ ID NO: 45273 - DNA, 25 bp, Artificial sequence
  SiRNA target sequence
tatgtccgttaaaatttttttggag

SEQ ID NO: 45274 - DNA, 25 bp, Artificial sequence
  SiRNA target sequence
atgtccgttaaaatttttttggagt

SEQ ID NO: 45275 - DNA, 25 bp, Artificial sequence
  SiRNA target sequence
tgtccgttaaaatttttttggagta

SEQ ID NO: 45276 - DNA, 25 bp, Artificial sequence
  SiRNA target sequence
gtccgttaaaatttttttggagtaa

SEQ ID NO: 45277 - DNA, 25 bp, Artificial sequence
  SiRNA target sequence
tccgttaaaatttttttggagtaat

SEQ ID NO: 45278 - DNA, 25 bp, Artificial sequence
  SiRNA target sequence
ccgttaaaatttttttggagtaata

SEQ ID NO: 45279 - DNA, 25 bp, Artificial sequence
  SiRNA target sequence
cgttaaaatttttttggagtaataa

SEQ ID NO: 45280 - DNA, 25 bp, Artificial sequence
  SiRNA target sequence
gttaaaatttttttggagtaataat

SEQ ID NO: 45281 - DNA, 25 bp, Artificial sequence
  SiRNA target sequence
ttaaaatttttttggagtaataatt

SEQ ID NO: 45282 - DNA, 25 bp, Artificial sequence
  SiRNA target sequence
taaaatttttttggagtaataatta

SEQ ID NO: 45283 - DNA, 25 bp, Artificial sequence
  SiRNA target sequence
aaaatttttttggagtaataattaa

SEQ ID NO: 45284 - DNA, 25 bp, Artificial sequence
  SiRNA target sequence
aaatttttttggagtaataattaaa

SEQ ID NO: 45285 - DNA, 25 bp, Artificial sequence
  SiRNA target sequence
aatttttttggagtaataattaaat

SEQ ID NO: 45286 - DNA, 25 bp, Artificial sequence
  SiRNA target sequence
atttttttggagtaataattaaatg

SEQ ID NO: 45287 - DNA, 25 bp, Artificial sequence
  SiRNA target sequence
tttttttggagtaataattaaatga

SEQ ID NO: 45288 - DNA, 25 bp, Artificial sequence
  SiRNA target sequence
ttttttggagtaataattaaatgat

SEQ ID NO: 45289 - DNA, 25 bp, Artificial sequence
  SiRNA target sequence
tttttggagtaataattaaatgatg

SEQ ID NO: 45290 - DNA, 25 bp, Artificial sequence
  SiRNA target sequence
ttttggagtaataattaaatgatgc

SEQ ID NO: 45291 - DNA, 25 bp, Artificial sequence
  SiRNA target sequence
tttggagtaataattaaatgatgca

SEQ ID NO: 45292 - DNA, 25 bp, Artificial sequence
  SiRNA target sequence
ttggagtaataattaaatgatgcat

SEQ ID NO: 45293 - DNA, 25 bp, Artificial sequence
  SiRNA target sequence
tggagtaataattaaatgatgcatt

SEQ ID NO: 45294 - DNA, 25 bp, Artificial sequence
  SiRNA target sequence
ggagtaataattaaatgatgcattt

SEQ ID NO: 45295 - DNA, 25 bp, Artificial sequence
  SiRNA target sequence
gagtaataattaaatgatgcatttt

SEQ ID NO: 45296 - DNA, 25 bp, Artificial sequence
  SiRNA target sequence
agtaataattaaatgatgcattttc

SEQ ID NO: 45297 - DNA, 25 bp, Artificial sequence
  SiRNA target sequence
gtaataattaaatgatgcattttct

SEQ ID NO: 45298 - DNA, 25 bp, Artificial sequence
  SiRNA target sequence
taataattaaatgatgcattttcta

SEQ ID NO: 45299 - DNA, 25 bp, Artificial sequence
  SiRNA target sequence
aataattaaatgatgcattttctaa

SEQ ID NO: 45300 - DNA, 25 bp, Artificial sequence
  SiRNA target sequence
ataattaaatgatgcattttctaat

SEQ ID NO: 45301 - DNA, 25 bp, Artificial sequence
  SiRNA target sequence
taattaaatgatgcattttctaatc

SEQ ID NO: 45302 - DNA, 25 bp, Artificial sequence
  SiRNA target sequence
aattaaatgatgcattttctaatct

SEQ ID NO: 45303 - DNA, 25 bp, Artificial sequence
  SiRNA target sequence
attaaatgatgcattttctaatctt

SEQ ID NO: 45304 - DNA, 25 bp, Artificial sequence
  SiRNA target sequence
ttaaatgatgcattttctaatctta

SEQ ID NO: 45305 - DNA, 25 bp, Artificial sequence
  SiRNA target sequence
taaatgatgcattttctaatcttat

SEQ ID NO: 45306 - DNA, 25 bp, Artificial sequence
  SiRNA target sequence
aaatgatgcattttctaatcttata

SEQ ID NO: 45307 - DNA, 25 bp, Artificial sequence
  SiRNA target sequence
aatgatgcattttctaatcttatat

SEQ ID NO: 45308 - DNA, 25 bp, Artificial sequence
  SiRNA target sequence
atgatgcattttctaatcttatatc

SEQ ID NO: 45309 - DNA, 25 bp, Artificial sequence
  SiRNA target sequence
tgatgcattttctaatcttatatca

SEQ ID NO: 45310 - DNA, 25 bp, Artificial sequence
  SiRNA target sequence
gatgcattttctaatcttatatcat

SEQ ID NO: 45311 - DNA, 25 bp, Artificial sequence
  SiRNA target sequence
atgcattttctaatcttatatcatt

SEQ ID NO: 45312 - DNA, 25 bp, Artificial sequence
  SiRNA target sequence
tgcattttctaatcttatatcatta

SEQ ID NO: 45313 - DNA, 25 bp, Artificial sequence
  SiRNA target sequence
gcattttctaatcttatatcattat

SEQ ID NO: 45314 - DNA, 25 bp, Artificial sequence
  SiRNA target sequence
cattttctaatcttatatcattatt

SEQ ID NO: 45315 - DNA, 25 bp, Artificial sequence
  SiRNA target sequence
attttctaatcttatatcattatta

SEQ ID NO: 45316 - DNA, 25 bp, Artificial sequence
  SiRNA target sequence
ttttctaatcttatatcattattaa

SEQ ID NO: 45317 - DNA, 25 bp, Artificial sequence
  SiRNA target sequence
tttctaatcttatatcattattaaa

SEQ ID NO: 45318 - DNA, 25 bp, Artificial sequence
  SiRNA target sequence
ttctaatcttatatcattattaaat

SEQ ID NO: 45319 - DNA, 25 bp, Artificial sequence
  SiRNA target sequence
tctaatcttatatcattattaaatt

SEQ ID NO: 45320 - DNA, 25 bp, Artificial sequence
  SiRNA target sequence
ctaatcttatatcattattaaattc

SEQ ID NO: 45321 - DNA, 25 bp, Artificial sequence
  SiRNA target sequence
taatcttatatcattattaaattca

SEQ ID NO: 45322 - DNA, 25 bp, Artificial sequence
  SiRNA target sequence
aatcttatatcattattaaattcat

SEQ ID NO: 45323 - DNA, 25 bp, Artificial sequence
  SiRNA target sequence
atcttatatcattattaaattcatt

SEQ ID NO: 45324 - DNA, 25 bp, Artificial sequence
  SiRNA target sequence
tcttatatcattattaaattcatta

SEQ ID NO: 45325 - DNA, 25 bp, Artificial sequence
  SiRNA target sequence
cttatatcattattaaattcattaa

SEQ ID NO: 45326 - DNA, 25 bp, Artificial sequence
  SiRNA target sequence
ttatatcattattaaattcattaac

SEQ ID NO: 45327 - DNA, 25 bp, Artificial sequence
  SiRNA target sequence
tatatcattattaaattcattaaca

SEQ ID NO: 45328 - DNA, 25 bp, Artificial sequence
  SiRNA target sequence
atatcattattaaattcattaacat

SEQ ID NO: 45329 - DNA, 25 bp, Artificial sequence
  SiRNA target sequence
tatcattattaaattcattaacatc

SEQ ID NO: 45330 - DNA, 25 bp, Artificial sequence
  SiRNA target sequence
atcattattaaattcattaacatct

SEQ ID NO: 45331 - DNA, 25 bp, Artificial sequence
  SiRNA target sequence
tcattattaaattcattaacatcta

SEQ ID NO: 45332 - DNA, 25 bp, Artificial sequence
  SiRNA target sequence
cattattaaattcattaacatctac

SEQ ID NO: 45333 - DNA, 25 bp, Artificial sequence
  SiRNA target sequence
attattaaattcattaacatctact

SEQ ID NO: 45334 - DNA, 25 bp, Artificial sequence
  SiRNA target sequence
ttattaaattcattaacatctacta

SEQ ID NO: 45335 - DNA, 25 bp, Artificial sequence
  SiRNA target sequence
tattaaattcattaacatctactaa

SEQ ID NO: 45336 - DNA, 25 bp, Artificial sequence
  SiRNA target sequence
attaaattcattaacatctactaaa

SEQ ID NO: 45337 - DNA, 25 bp, Artificial sequence
  SiRNA target sequence
ttaaattcattaacatctactaaat

SEQ ID NO: 45338 - DNA, 25 bp, Artificial sequence
  SiRNA target sequence
taaattcattaacatctactaaatt

SEQ ID NO: 45339 - DNA, 25 bp, Artificial sequence
  SiRNA target sequence
aaattcattaacatctactaaattt

SEQ ID NO: 45340 - DNA, 25 bp, Artificial sequence
  SiRNA target sequence
aattcattaacatctactaaatttg

SEQ ID NO: 45341 - DNA, 25 bp, Artificial sequence
  SiRNA target sequence
attcattaacatctactaaatttgg

SEQ ID NO: 45342 - DNA, 25 bp, Artificial sequence
  SiRNA target sequence
ttcattaacatctactaaatttggt

SEQ ID NO: 45343 - DNA, 25 bp, Artificial sequence
  SiRNA target sequence
tcattaacatctactaaatttggtt

SEQ ID NO: 45344 - DNA, 25 bp, Artificial sequence
  SiRNA target sequence
cattaacatctactaaatttggttc

SEQ ID NO: 45345 - DNA, 25 bp, Artificial sequence
  SiRNA target sequence
attaacatctactaaatttggttct

SEQ ID NO: 45346 - DNA, 25 bp, Artificial sequence
  SiRNA target sequence
ttaacatctactaaatttggttctt

SEQ ID NO: 45347 - DNA, 25 bp, Artificial sequence
  SiRNA target sequence
taacatctactaaatttggttcttc

SEQ ID NO: 45348 - DNA, 25 bp, Artificial sequence
  SiRNA target sequence
aacatctactaaatttggttcttct

SEQ ID NO: 45349 - DNA, 25 bp, Artificial sequence
  SiRNA target sequence
acatctactaaatttggttcttctt

SEQ ID NO: 45350 - DNA, 25 bp, Artificial sequence
  SiRNA target sequence
catctactaaatttggttcttcttt

SEQ ID NO: 45351 - DNA, 25 bp, Artificial sequence
  SiRNA target sequence
atctactaaatttggttcttctttt

SEQ ID NO: 45352 - DNA, 25 bp, Artificial sequence
  SiRNA target sequence
tctactaaatttggttcttctttta

SEQ ID NO: 45353 - DNA, 25 bp, Artificial sequence
  SiRNA target sequence
ctactaaatttggttcttcttttat

SEQ ID NO: 45354 - DNA, 25 bp, Artificial sequence
  SiRNA target sequence
tactaaatttggttcttcttttata

SEQ ID NO: 45355 - DNA, 25 bp, Artificial sequence
  SiRNA target sequence
actaaatttggttcttcttttataa

SEQ ID NO: 45356 - DNA, 25 bp, Artificial sequence
  SiRNA target sequence
ctaaatttggttcttcttttataag

SEQ ID NO: 45357 - DNA, 25 bp, Artificial sequence
  SiRNA target sequence
taaatttggttcttcttttataagc

SEQ ID NO: 45358 - DNA, 25 bp, Artificial sequence
  SiRNA target sequence
aaatttggttcttcttttataagct

SEQ ID NO: 45359 - DNA, 25 bp, Artificial sequence
  SiRNA target sequence
aatttggttcttcttttataagctc

SEQ ID NO: 45360 - DNA, 25 bp, Artificial sequence
  SiRNA target sequence
atttggttcttcttttataagctct

SEQ ID NO: 45361 - DNA, 25 bp, Artificial sequence
  SiRNA target sequence
tttggttcttcttttataagctctg

SEQ ID NO: 45362 - DNA, 25 bp, Artificial sequence
  SiRNA target sequence
ttggttcttcttttataagctctgg

SEQ ID NO: 45363 - DNA, 25 bp, Artificial sequence
  SiRNA target sequence
tggttcttcttttataagctctggt

SEQ ID NO: 45364 - DNA, 25 bp, Artificial sequence
  SiRNA target sequence
ggttcttcttttataagctctggtt

SEQ ID NO: 45365 - DNA, 25 bp, Artificial sequence
  SiRNA target sequence
gttcttcttttataagctctggttt

SEQ ID NO: 45366 - DNA, 25 bp, Artificial sequence
  SiRNA target sequence
ttcttcttttataagctctggttta

SEQ ID NO: 45367 - DNA, 25 bp, Artificial sequence
  SiRNA target sequence
tcttcttttataagctctggtttaa

SEQ ID NO: 45368 - DNA, 25 bp, Artificial sequence
  SiRNA target sequence
cttcttttataagctctggtttaaa

SEQ ID NO: 45369 - DNA, 25 bp, Artificial sequence
  SiRNA target sequence
ttcttttataagctctggtttaaaa

SEQ ID NO: 45370 - DNA, 25 bp, Artificial sequence
  SiRNA target sequence
tcttttataagctctggtttaaaag

SEQ ID NO: 45371 - DNA, 25 bp, Artificial sequence
  SiRNA target sequence
cttttataagctctggtttaaaaga

SEQ ID NO: 45372 - DNA, 25 bp, Artificial sequence
  SiRNA target sequence
ttttataagctctggtttaaaagat

SEQ ID NO: 45373 - DNA, 25 bp, Artificial sequence
  SiRNA target sequence
tttataagctctggtttaaaagatg

SEQ ID NO: 45374 - DNA, 25 bp, Artificial sequence
  SiRNA target sequence
ttataagctctggtttaaaagatgt

SEQ ID NO: 45375 - DNA, 25 bp, Artificial sequence
  SiRNA target sequence
tataagctctggtttaaaagatgtt

SEQ ID NO: 45376 - DNA, 25 bp, Artificial sequence
  SiRNA target sequence
ataagctctggtttaaaagatgttc

SEQ ID NO: 45377 - DNA, 25 bp, Artificial sequence
  SiRNA target sequence
taagctctggtttaaaagatgttct

SEQ ID NO: 45378 - DNA, 25 bp, Artificial sequence
  SiRNA target sequence
aagctctggtttaaaagatgttctt

SEQ ID NO: 45379 - DNA, 25 bp, Artificial sequence
  SiRNA target sequence
agctctggtttaaaagatgttctta

SEQ ID NO: 45380 - DNA, 25 bp, Artificial sequence
  SiRNA target sequence
gctctggtttaaaagatgttcttat

SEQ ID NO: 45381 - DNA, 25 bp, Artificial sequence
  SiRNA target sequence
ctctggtttaaaagatgttcttata

SEQ ID NO: 45382 - DNA, 25 bp, Artificial sequence
  SiRNA target sequence
tctggtttaaaagatgttcttatat

SEQ ID NO: 45383 - DNA, 25 bp, Artificial sequence
  SiRNA target sequence
ctggtttaaaagatgttcttatatt

SEQ ID NO: 45384 - DNA, 25 bp, Artificial sequence
  SiRNA target sequence
tggtttaaaagatgttcttatattt

SEQ ID NO: 45385 - DNA, 25 bp, Artificial sequence
  SiRNA target sequence
ggtttaaaagatgttcttatattta

SEQ ID NO: 45386 - DNA, 25 bp, Artificial sequence
  SiRNA target sequence
gtttaaaagatgttcttatatttaa

SEQ ID NO: 45387 - DNA, 25 bp, Artificial sequence
  SiRNA target sequence
tttaaaagatgttcttatatttaag

SEQ ID NO: 45388 - DNA, 25 bp, Artificial sequence
  SiRNA target sequence
ttaaaagatgttcttatatttaaga

SEQ ID NO: 45389 - DNA, 25 bp, Artificial sequence
  SiRNA target sequence
taaaagatgttcttatatttaagat

SEQ ID NO: 45390 - DNA, 25 bp, Artificial sequence
  SiRNA target sequence
aaaagatgttcttatatttaagatt

SEQ ID NO: 45391 - DNA, 25 bp, Artificial sequence
  SiRNA target sequence
aaagatgttcttatatttaagattg

SEQ ID NO: 45392 - DNA, 25 bp, Artificial sequence
  SiRNA target sequence
aagatgttcttatatttaagattgc

SEQ ID NO: 45393 - DNA, 25 bp, Artificial sequence
  SiRNA target sequence
agatgttcttatatttaagattgct

SEQ ID NO: 45394 - DNA, 25 bp, Artificial sequence
  SiRNA target sequence
gatgttcttatatttaagattgctt

SEQ ID NO: 45395 - DNA, 25 bp, Artificial sequence
  SiRNA target sequence
atgttcttatatttaagattgcttg

SEQ ID NO: 45396 - DNA, 25 bp, Artificial sequence
  SiRNA target sequence
tgttcttatatttaagattgcttgt

SEQ ID NO: 45397 - DNA, 25 bp, Artificial sequence
  SiRNA target sequence
gttcttatatttaagattgcttgtg

SEQ ID NO: 45398 - DNA, 25 bp, Artificial sequence
  SiRNA target sequence
ttcttatatttaagattgcttgtgt

SEQ ID NO: 45399 - DNA, 25 bp, Artificial sequence
  SiRNA target sequence
tcttatatttaagattgcttgtgta

SEQ ID NO: 45400 - DNA, 25 bp, Artificial sequence
  SiRNA target sequence
cttatatttaagattgcttgtgtat

SEQ ID NO: 45401 - DNA, 25 bp, Artificial sequence
  SiRNA target sequence
ttatatttaagattgcttgtgtata

SEQ ID NO: 45402 - DNA, 25 bp, Artificial sequence
  SiRNA target sequence
tatatttaagattgcttgtgtatat

SEQ ID NO: 45403 - DNA, 25 bp, Artificial sequence
  SiRNA target sequence
atatttaagattgcttgtgtatatc

SEQ ID NO: 45404 - DNA, 25 bp, Artificial sequence
  SiRNA target sequence
tatttaagattgcttgtgtatatcg

SEQ ID NO: 45405 - DNA, 25 bp, Artificial sequence
  SiRNA target sequence
atttaagattgcttgtgtatatcgt

SEQ ID NO: 45406 - DNA, 25 bp, Artificial sequence
  SiRNA target sequence
tttaagattgcttgtgtatatcgtg

SEQ ID NO: 45407 - DNA, 25 bp, Artificial sequence
  SiRNA target sequence
ttaagattgcttgtgtatatcgtga

SEQ ID NO: 45408 - DNA, 25 bp, Artificial sequence
  SiRNA target sequence
taagattgcttgtgtatatcgtgag

SEQ ID NO: 45409 - DNA, 25 bp, Artificial sequence
  SiRNA target sequence
aagattgcttgtgtatatcgtgagt

SEQ ID NO: 45410 - DNA, 25 bp, Artificial sequence
  SiRNA target sequence
agattgcttgtgtatatcgtgagta

SEQ ID NO: 45411 - DNA, 25 bp, Artificial sequence
  SiRNA target sequence
gattgcttgtgtatatcgtgagtaa

SEQ ID NO: 45412 - DNA, 25 bp, Artificial sequence
  SiRNA target sequence
attgcttgtgtatatcgtgagtaaa

SEQ ID NO: 45413 - DNA, 25 bp, Artificial sequence
  SiRNA target sequence
ttgcttgtgtatatcgtgagtaaaa

SEQ ID NO: 45414 - DNA, 25 bp, Artificial sequence
  SiRNA target sequence
tgcttgtgtatatcgtgagtaaaag

SEQ ID NO: 45415 - DNA, 25 bp, Artificial sequence
  SiRNA target sequence
gcttgtgtatatcgtgagtaaaaga

SEQ ID NO: 45416 - DNA, 25 bp, Artificial sequence
  SiRNA target sequence
cttgtgtatatcgtgagtaaaagaa

SEQ ID NO: 45417 - DNA, 25 bp, Artificial sequence
  SiRNA target sequence
ttgtgtatatcgtgagtaaaagaac

SEQ ID NO: 45418 - DNA, 25 bp, Artificial sequence
  SiRNA target sequence
tgtgtatatcgtgagtaaaagaacc

SEQ ID NO: 45419 - DNA, 25 bp, Artificial sequence
  SiRNA target sequence
gtgtatatcgtgagtaaaagaaccc

SEQ ID NO: 45420 - DNA, 25 bp, Artificial sequence
  SiRNA target sequence
tgtatatcgtgagtaaaagaaccct

SEQ ID NO: 45421 - DNA, 25 bp, Artificial sequence
  SiRNA target sequence
gtatatcgtgagtaaaagaacccta

SEQ ID NO: 45422 - DNA, 25 bp, Artificial sequence
  SiRNA target sequence
tatatcgtgagtaaaagaaccctaa

SEQ ID NO: 45423 - DNA, 25 bp, Artificial sequence
  SiRNA target sequence
atatcgtgagtaaaagaaccctaat

SEQ ID NO: 45424 - DNA, 25 bp, Artificial sequence
  SiRNA target sequence
tatcgtgagtaaaagaaccctaatt

SEQ ID NO: 45425 - DNA, 25 bp, Artificial sequence
  SiRNA target sequence
atcgtgagtaaaagaaccctaattg

SEQ ID NO: 45426 - DNA, 25 bp, Artificial sequence
  SiRNA target sequence
tcgtgagtaaaagaaccctaattgt

SEQ ID NO: 45427 - DNA, 25 bp, Artificial sequence
  SiRNA target sequence
cgtgagtaaaagaaccctaattgtc

SEQ ID NO: 45428 - DNA, 25 bp, Artificial sequence
  SiRNA target sequence
gtgagtaaaagaaccctaattgtcc

SEQ ID NO: 45429 - DNA, 25 bp, Artificial sequence
  SiRNA target sequence
tgagtaaaagaaccctaattgtcca

SEQ ID NO: 45430 - DNA, 25 bp, Artificial sequence
  SiRNA target sequence
gagtaaaagaaccctaattgtccaa

SEQ ID NO: 45431 - DNA, 25 bp, Artificial sequence
  SiRNA target sequence
agtaaaagaaccctaattgtccaaa

SEQ ID NO: 45432 - DNA, 25 bp, Artificial sequence
  SiRNA target sequence
gtaaaagaaccctaattgtccaaaa

SEQ ID NO: 45433 - DNA, 25 bp, Artificial sequence
  SiRNA target sequence
taaaagaaccctaattgtccaaaac

SEQ ID NO: 45434 - DNA, 25 bp, Artificial sequence
  SiRNA target sequence
aaaagaaccctaattgtccaaaact

SEQ ID NO: 45435 - DNA, 25 bp, Artificial sequence
  SiRNA target sequence
aaagaaccctaattgtccaaaactt

SEQ ID NO: 45436 - DNA, 25 bp, Artificial sequence
  SiRNA target sequence
aagaaccctaattgtccaaaacttg

SEQ ID NO: 45437 - DNA, 25 bp, Artificial sequence
  SiRNA target sequence
agaaccctaattgtccaaaacttga

SEQ ID NO: 45438 - DNA, 25 bp, Artificial sequence
  SiRNA target sequence
gaaccctaattgtccaaaacttgaa

SEQ ID NO: 45439 - DNA, 25 bp, Artificial sequence
  SiRNA target sequence
aaccctaattgtccaaaacttgaat

SEQ ID NO: 45440 - DNA, 25 bp, Artificial sequence
  SiRNA target sequence
accctaattgtccaaaacttgaata

SEQ ID NO: 45441 - DNA, 25 bp, Artificial sequence
  SiRNA target sequence
ccctaattgtccaaaacttgaatac

SEQ ID NO: 45442 - DNA, 25 bp, Artificial sequence
  SiRNA target sequence
cctaattgtccaaaacttgaataca

SEQ ID NO: 45443 - DNA, 25 bp, Artificial sequence
  SiRNA target sequence
ctaattgtccaaaacttgaatacaa

SEQ ID NO: 45444 - DNA, 25 bp, Artificial sequence
  SiRNA target sequence
taattgtccaaaacttgaatacaat

SEQ ID NO: 45445 - DNA, 25 bp, Artificial sequence
  SiRNA target sequence
aattgtccaaaacttgaatacaatg

SEQ ID NO: 45446 - DNA, 25 bp, Artificial sequence
  SiRNA target sequence
attgtccaaaacttgaatacaatgt

SEQ ID NO: 45447 - DNA, 25 bp, Artificial sequence
  SiRNA target sequence
ttgtccaaaacttgaatacaatgtt

SEQ ID NO: 45448 - DNA, 25 bp, Artificial sequence
  SiRNA target sequence
tgtccaaaacttgaatacaatgttc

SEQ ID NO: 45449 - DNA, 25 bp, Artificial sequence
  SiRNA target sequence
gtccaaaacttgaatacaatgttct

SEQ ID NO: 45450 - DNA, 25 bp, Artificial sequence
  SiRNA target sequence
tccaaaacttgaatacaatgttcta

SEQ ID NO: 45451 - DNA, 25 bp, Artificial sequence
  SiRNA target sequence
ccaaaacttgaatacaatgttctat

SEQ ID NO: 45452 - DNA, 25 bp, Artificial sequence
  SiRNA target sequence
caaaacttgaatacaatgttctatt

SEQ ID NO: 45453 - DNA, 25 bp, Artificial sequence
  SiRNA target sequence
aaaacttgaatacaatgttctatta

SEQ ID NO: 45454 - DNA, 25 bp, Artificial sequence
  SiRNA target sequence
aaacttgaatacaatgttctattaa

SEQ ID NO: 45455 - DNA, 25 bp, Artificial sequence
  SiRNA target sequence
aacttgaatacaatgttctattaat

SEQ ID NO: 45456 - DNA, 25 bp, Artificial sequence
  SiRNA target sequence
acttgaatacaatgttctattaatg

SEQ ID NO: 45457 - DNA, 25 bp, Artificial sequence
  SiRNA target sequence
cttgaatacaatgttctattaatgc

SEQ ID NO: 45458 - DNA, 25 bp, Artificial sequence
  SiRNA target sequence
ttgaatacaatgttctattaatgcc

SEQ ID NO: 45459 - DNA, 25 bp, Artificial sequence
  SiRNA target sequence
tgaatacaatgttctattaatgcca

SEQ ID NO: 45460 - DNA, 25 bp, Artificial sequence
  SiRNA target sequence
gaatacaatgttctattaatgccaa

SEQ ID NO: 45461 - DNA, 25 bp, Artificial sequence
  SiRNA target sequence
aatacaatgttctattaatgccaat

SEQ ID NO: 45462 - DNA, 25 bp, Artificial sequence
  SiRNA target sequence
atacaatgttctattaatgccaata

SEQ ID NO: 45463 - DNA, 25 bp, Artificial sequence
  SiRNA target sequence
tacaatgttctattaatgccaatat

SEQ ID NO: 45464 - DNA, 25 bp, Artificial sequence
  SiRNA target sequence
acaatgttctattaatgccaatata

SEQ ID NO: 45465 - DNA, 25 bp, Artificial sequence
  SiRNA target sequence
caatgttctattaatgccaatataa

SEQ ID NO: 45466 - DNA, 25 bp, Artificial sequence
  SiRNA target sequence
aatgttctattaatgccaatataaa

SEQ ID NO: 45467 - DNA, 25 bp, Artificial sequence
  SiRNA target sequence
atgttctattaatgccaatataaaa

SEQ ID NO: 45468 - DNA, 25 bp, Artificial sequence
  SiRNA target sequence
tgttctattaatgccaatataaaat

SEQ ID NO: 45469 - DNA, 25 bp, Artificial sequence
  SiRNA target sequence
gttctattaatgccaatataaaata

SEQ ID NO: 45470 - DNA, 25 bp, Artificial sequence
  SiRNA target sequence
ttctattaatgccaatataaaatac

SEQ ID NO: 45471 - DNA, 25 bp, Artificial sequence
  SiRNA target sequence
tctattaatgccaatataaaataca

SEQ ID NO: 45472 - DNA, 25 bp, Artificial sequence
  SiRNA target sequence
ctattaatgccaatataaaatacaa

SEQ ID NO: 45473 - DNA, 25 bp, Artificial sequence
  SiRNA target sequence
tattaatgccaatataaaatacaac

SEQ ID NO: 45474 - DNA, 25 bp, Artificial sequence
  SiRNA target sequence
attaatgccaatataaaatacaaca

SEQ ID NO: 45475 - DNA, 25 bp, Artificial sequence
  SiRNA target sequence
ttaatgccaatataaaatacaacat

SEQ ID NO: 45476 - DNA, 25 bp, Artificial sequence
  SiRNA target sequence
taatgccaatataaaatacaacatc

SEQ ID NO: 45477 - DNA, 25 bp, Artificial sequence
  SiRNA target sequence
aatgccaatataaaatacaacatcc

SEQ ID NO: 45478 - DNA, 25 bp, Artificial sequence
  SiRNA target sequence
atgccaatataaaatacaacatccc

SEQ ID NO: 45479 - DNA, 25 bp, Artificial sequence
  SiRNA target sequence
tgccaatataaaatacaacatccct

SEQ ID NO: 45480 - DNA, 25 bp, Artificial sequence
  SiRNA target sequence
gccaatataaaatacaacatccctg

SEQ ID NO: 45481 - DNA, 25 bp, Artificial sequence
  SiRNA target sequence
ccaatataaaatacaacatccctgg

SEQ ID NO: 45482 - DNA, 25 bp, Artificial sequence
  SiRNA target sequence
caatataaaatacaacatccctggc

SEQ ID NO: 45483 - DNA, 25 bp, Artificial sequence
  SiRNA target sequence
aatataaaatacaacatccctggca

SEQ ID NO: 45484 - DNA, 25 bp, Artificial sequence
  SiRNA target sequence
atataaaatacaacatccctggcac

SEQ ID NO: 45485 - DNA, 25 bp, Artificial sequence
  SiRNA target sequence
tataaaatacaacatccctggcact

SEQ ID NO: 45486 - DNA, 25 bp, Artificial sequence
  SiRNA target sequence
ataaaatacaacatccctggcactt

SEQ ID NO: 45487 - DNA, 25 bp, Artificial sequence
  SiRNA target sequence
taaaatacaacatccctggcactta

SEQ ID NO: 45488 - DNA, 25 bp, Artificial sequence
  SiRNA target sequence
aaaatacaacatccctggcacttag

SEQ ID NO: 45489 - DNA, 25 bp, Artificial sequence
  SiRNA target sequence
aaatacaacatccctggcacttagt

SEQ ID NO: 45490 - DNA, 25 bp, Artificial sequence
  SiRNA target sequence
aatacaacatccctggcacttagtt

SEQ ID NO: 45491 - DNA, 25 bp, Artificial sequence
  SiRNA target sequence
atacaacatccctggcacttagttt

SEQ ID NO: 45492 - DNA, 25 bp, Artificial sequence
  SiRNA target sequence
tacaacatccctggcacttagtttt

SEQ ID NO: 45493 - DNA, 25 bp, Artificial sequence
  SiRNA target sequence
acaacatccctggcacttagttttg

SEQ ID NO: 45494 - DNA, 25 bp, Artificial sequence
  SiRNA target sequence
caacatccctggcacttagttttgc

SEQ ID NO: 45495 - DNA, 25 bp, Artificial sequence
  SiRNA target sequence
aacatccctggcacttagttttgct

SEQ ID NO: 45496 - DNA, 25 bp, Artificial sequence
  SiRNA target sequence
acatccctggcacttagttttgctg

SEQ ID NO: 45497 - DNA, 25 bp, Artificial sequence
  SiRNA target sequence
catccctggcacttagttttgctgt

SEQ ID NO: 45498 - DNA, 25 bp, Artificial sequence
  SiRNA target sequence
atccctggcacttagttttgctgtt

SEQ ID NO: 45499 - DNA, 25 bp, Artificial sequence
  SiRNA target sequence
tccctggcacttagttttgctgtta

SEQ ID NO: 45500 - DNA, 25 bp, Artificial sequence
  SiRNA target sequence
ccctggcacttagttttgctgttaa

SEQ ID NO: 45501 - DNA, 25 bp, Artificial sequence
  SiRNA target sequence
cctggcacttagttttgctgttaat

SEQ ID NO: 45502 - DNA, 25 bp, Artificial sequence
  SiRNA target sequence
ctggcacttagttttgctgttaata

SEQ ID NO: 45503 - DNA, 25 bp, Artificial sequence
  SiRNA target sequence
tggcacttagttttgctgttaatat

SEQ ID NO: 45504 - DNA, 25 bp, Artificial sequence
  SiRNA target sequence
ggcacttagttttgctgttaatatt

SEQ ID NO: 45505 - DNA, 25 bp, Artificial sequence
  SiRNA target sequence
gcacttagttttgctgttaatattc

SEQ ID NO: 45506 - DNA, 25 bp, Artificial sequence
  SiRNA target sequence
cacttagttttgctgttaatattcc

SEQ ID NO: 45507 - DNA, 25 bp, Artificial sequence
  SiRNA target sequence
acttagttttgctgttaatattcca

SEQ ID NO: 45508 - DNA, 25 bp, Artificial sequence
  SiRNA target sequence
cttagttttgctgttaatattccat

SEQ ID NO: 45509 - DNA, 25 bp, Artificial sequence
  SiRNA target sequence
ttagttttgctgttaatattccata

SEQ ID NO: 45510 - DNA, 25 bp, Artificial sequence
  SiRNA target sequence
tagttttgctgttaatattccatag

SEQ ID NO: 45511 - DNA, 25 bp, Artificial sequence
  SiRNA target sequence
agttttgctgttaatattccatagt

SEQ ID NO: 45512 - DNA, 25 bp, Artificial sequence
  SiRNA target sequence
gttttgctgttaatattccatagtt

SEQ ID NO: 45513 - DNA, 25 bp, Artificial sequence
  SiRNA target sequence
ttttgctgttaatattccatagttt

SEQ ID NO: 45514 - DNA, 25 bp, Artificial sequence
  SiRNA target sequence
tttgctgttaatattccatagtttc

SEQ ID NO: 45515 - DNA, 25 bp, Artificial sequence
  SiRNA target sequence
ttgctgttaatattccatagtttcc

SEQ ID NO: 45516 - DNA, 25 bp, Artificial sequence
  SiRNA target sequence
tgctgttaatattccatagtttcct

SEQ ID NO: 45517 - DNA, 25 bp, Artificial sequence
  SiRNA target sequence
gctgttaatattccatagtttccta

SEQ ID NO: 45518 - DNA, 25 bp, Artificial sequence
  SiRNA target sequence
ctgttaatattccatagtttcctaa

SEQ ID NO: 45519 - DNA, 25 bp, Artificial sequence
  SiRNA target sequence
tgttaatattccatagtttcctaat

SEQ ID NO: 45520 - DNA, 25 bp, Artificial sequence
  SiRNA target sequence
gttaatattccatagtttcctaatg

SEQ ID NO: 45521 - DNA, 25 bp, Artificial sequence
  SiRNA target sequence
ttaatattccatagtttcctaatgt

SEQ ID NO: 45522 - DNA, 25 bp, Artificial sequence
  SiRNA target sequence
taatattccatagtttcctaatgtt

SEQ ID NO: 45523 - DNA, 25 bp, Artificial sequence
  SiRNA target sequence
aatattccatagtttcctaatgtta

SEQ ID NO: 45524 - DNA, 25 bp, Artificial sequence
  SiRNA target sequence
atattccatagtttcctaatgttat

SEQ ID NO: 45525 - DNA, 25 bp, Artificial sequence
  SiRNA target sequence
tattccatagtttcctaatgttata

SEQ ID NO: 45526 - DNA, 25 bp, Artificial sequence
  SiRNA target sequence
attccatagtttcctaatgttataa

SEQ ID NO: 45527 - DNA, 25 bp, Artificial sequence
  SiRNA target sequence
ttccatagtttcctaatgttataac

SEQ ID NO: 45528 - DNA, 25 bp, Artificial sequence
  SiRNA target sequence
tccatagtttcctaatgttataact

SEQ ID NO: 45529 - DNA, 25 bp, Artificial sequence
  SiRNA target sequence
ccatagtttcctaatgttataacta

SEQ ID NO: 45530 - DNA, 25 bp, Artificial sequence
  SiRNA target sequence
catagtttcctaatgttataactat

SEQ ID NO: 45531 - DNA, 25 bp, Artificial sequence
  SiRNA target sequence
atagtttcctaatgttataactata

SEQ ID NO: 45532 - DNA, 25 bp, Artificial sequence
  SiRNA target sequence
tagtttcctaatgttataactataa

SEQ ID NO: 45533 - DNA, 25 bp, Artificial sequence
  SiRNA target sequence
agtttcctaatgttataactataaa

SEQ ID NO: 45534 - DNA, 25 bp, Artificial sequence
  SiRNA target sequence
gtttcctaatgttataactataaaa

SEQ ID NO: 45535 - DNA, 25 bp, Artificial sequence
  SiRNA target sequence
tttcctaatgttataactataaaac

SEQ ID NO: 45536 - DNA, 25 bp, Artificial sequence
  SiRNA target sequence
ttcctaatgttataactataaaaca

SEQ ID NO: 45537 - DNA, 25 bp, Artificial sequence
  SiRNA target sequence
tcctaatgttataactataaaacac

SEQ ID NO: 45538 - DNA, 25 bp, Artificial sequence
  SiRNA target sequence
cctaatgttataactataaaacact

SEQ ID NO: 45539 - DNA, 25 bp, Artificial sequence
  SiRNA target sequence
ctaatgttataactataaaacactg

SEQ ID NO: 45540 - DNA, 25 bp, Artificial sequence
  SiRNA target sequence
taatgttataactataaaacactgt

SEQ ID NO: 45541 - DNA, 25 bp, Artificial sequence
  SiRNA target sequence
aatgttataactataaaacactgta

SEQ ID NO: 45542 - DNA, 25 bp, Artificial sequence
  SiRNA target sequence
atgttataactataaaacactgtaa

SEQ ID NO: 45543 - DNA, 25 bp, Artificial sequence
  SiRNA target sequence
tgttataactataaaacactgtaaa

SEQ ID NO: 45544 - DNA, 25 bp, Artificial sequence
  SiRNA target sequence
gttataactataaaacactgtaaag

SEQ ID NO: 45545 - DNA, 25 bp, Artificial sequence
  SiRNA target sequence
ttataactataaaacactgtaaagc

SEQ ID NO: 45546 - DNA, 25 bp, Artificial sequence
  SiRNA target sequence
tataactataaaacactgtaaagca

SEQ ID NO: 45547 - DNA, 25 bp, Artificial sequence
  SiRNA target sequence
ataactataaaacactgtaaagcaa

SEQ ID NO: 45548 - DNA, 25 bp, Artificial sequence
  SiRNA target sequence
taactataaaacactgtaaagcaaa

SEQ ID NO: 45549 - DNA, 25 bp, Artificial sequence
  SiRNA target sequence
aactataaaacactgtaaagcaaaa

SEQ ID NO: 45550 - DNA, 25 bp, Artificial sequence
  SiRNA target sequence
actataaaacactgtaaagcaaaaa

SEQ ID NO: 45551 - DNA, 25 bp, Artificial sequence
  SiRNA target sequence
ctataaaacactgtaaagcaaaaat

SEQ ID NO: 45552 - DNA, 25 bp, Artificial sequence
  SiRNA target sequence
tataaaacactgtaaagcaaaaatt

SEQ ID NO: 45553 - DNA, 25 bp, Artificial sequence
  SiRNA target sequence
ataaaacactgtaaagcaaaaatta

SEQ ID NO: 45554 - DNA, 25 bp, Artificial sequence
  SiRNA target sequence
taaaacactgtaaagcaaaaattat

SEQ ID NO: 45555 - DNA, 25 bp, Artificial sequence
  SiRNA target sequence
aaaacactgtaaagcaaaaattatc

SEQ ID NO: 45556 - DNA, 25 bp, Artificial sequence
  SiRNA target sequence
aaacactgtaaagcaaaaattatct

SEQ ID NO: 45557 - DNA, 25 bp, Artificial sequence
  SiRNA target sequence
aacactgtaaagcaaaaattatctt

SEQ ID NO: 45558 - DNA, 25 bp, Artificial sequence
  SiRNA target sequence
acactgtaaagcaaaaattatctta

SEQ ID NO: 45559 - DNA, 25 bp, Artificial sequence
  SiRNA target sequence
cactgtaaagcaaaaattatcttat

SEQ ID NO: 45560 - DNA, 25 bp, Artificial sequence
  SiRNA target sequence
actgtaaagcaaaaattatcttatt

SEQ ID NO: 45561 - DNA, 25 bp, Artificial sequence
  SiRNA target sequence
ctgtaaagcaaaaattatcttattt

SEQ ID NO: 45562 - DNA, 25 bp, Artificial sequence
  SiRNA target sequence
tgtaaagcaaaaattatcttattta

SEQ ID NO: 45563 - DNA, 25 bp, Artificial sequence
  SiRNA target sequence
gtaaagcaaaaattatcttatttac

SEQ ID NO: 45564 - DNA, 25 bp, Artificial sequence
  SiRNA target sequence
taaagcaaaaattatcttatttaca

SEQ ID NO: 45565 - DNA, 25 bp, Artificial sequence
  SiRNA target sequence
aaagcaaaaattatcttatttacaa

SEQ ID NO: 45566 - DNA, 25 bp, Artificial sequence
  SiRNA target sequence
aagcaaaaattatcttatttacaag

SEQ ID NO: 45567 - DNA, 25 bp, Artificial sequence
  SiRNA target sequence
agcaaaaattatcttatttacaagg

SEQ ID NO: 45568 - DNA, 25 bp, Artificial sequence
  SiRNA target sequence
gcaaaaattatcttatttacaaggt

SEQ ID NO: 45569 - DNA, 25 bp, Artificial sequence
  SiRNA target sequence
caaaaattatcttatttacaaggta

SEQ ID NO: 45570 - DNA, 25 bp, Artificial sequence
  SiRNA target sequence
aaaaattatcttatttacaaggtat

SEQ ID NO: 45571 - DNA, 25 bp, Artificial sequence
  SiRNA target sequence
aaaattatcttatttacaaggtata

SEQ ID NO: 45572 - DNA, 25 bp, Artificial sequence
  SiRNA target sequence
aaattatcttatttacaaggtataa

SEQ ID NO: 45573 - DNA, 25 bp, Artificial sequence
  SiRNA target sequence
aattatcttatttacaaggtataaa

SEQ ID NO: 45574 - DNA, 25 bp, Artificial sequence
  SiRNA target sequence
attatcttatttacaaggtataaaa

SEQ ID NO: 45575 - DNA, 25 bp, Artificial sequence
  SiRNA target sequence
ttatcttatttacaaggtataaaaa

SEQ ID NO: 45576 - DNA, 25 bp, Artificial sequence
  SiRNA target sequence
tatcttatttacaaggtataaaaaa

SEQ ID NO: 45577 - DNA, 25 bp, Artificial sequence
  SiRNA target sequence
atcttatttacaaggtataaaaaac

SEQ ID NO: 45578 - DNA, 25 bp, Artificial sequence
  SiRNA target sequence
tcttatttacaaggtataaaaaact

SEQ ID NO: 45579 - DNA, 25 bp, Artificial sequence
  SiRNA target sequence
cttatttacaaggtataaaaaacta

SEQ ID NO: 45580 - DNA, 25 bp, Artificial sequence
  SiRNA target sequence
ttatttacaaggtataaaaaactaa

SEQ ID NO: 45581 - DNA, 25 bp, Artificial sequence
  SiRNA target sequence
tatttacaaggtataaaaaactaag

SEQ ID NO: 45582 - DNA, 25 bp, Artificial sequence
  SiRNA target sequence
atttacaaggtataaaaaactaaga

SEQ ID NO: 45583 - DNA, 25 bp, Artificial sequence
  SiRNA target sequence
tttacaaggtataaaaaactaagag

SEQ ID NO: 45584 - DNA, 25 bp, Artificial sequence
  SiRNA target sequence
ttacaaggtataaaaaactaagaga

SEQ ID NO: 45585 - DNA, 25 bp, Artificial sequence
  SiRNA target sequence
tacaaggtataaaaaactaagagat

SEQ ID NO: 45586 - DNA, 25 bp, Artificial sequence
  SiRNA target sequence
acaaggtataaaaaactaagagatc

SEQ ID NO: 45587 - DNA, 25 bp, Artificial sequence
  SiRNA target sequence
caaggtataaaaaactaagagatct

SEQ ID NO: 45588 - DNA, 25 bp, Artificial sequence
  SiRNA target sequence
aaggtataaaaaactaagagatctc

SEQ ID NO: 45589 - DNA, 25 bp, Artificial sequence
  SiRNA target sequence
aggtataaaaaactaagagatctcc

SEQ ID NO: 45590 - DNA, 25 bp, Artificial sequence
  SiRNA target sequence
ggtataaaaaactaagagatctcca

SEQ ID NO: 45591 - DNA, 25 bp, Artificial sequence
  SiRNA target sequence
gtataaaaaactaagagatctccag

SEQ ID NO: 45592 - DNA, 25 bp, Artificial sequence
  SiRNA target sequence
tataaaaaactaagagatctccaga

SEQ ID NO: 45593 - DNA, 25 bp, Artificial sequence
  SiRNA target sequence
ataaaaaactaagagatctccagat

SEQ ID NO: 45594 - DNA, 25 bp, Artificial sequence
  SiRNA target sequence
taaaaaactaagagatctccagatt

SEQ ID NO: 45595 - DNA, 25 bp, Artificial sequence
  SiRNA target sequence
aaaaaactaagagatctccagattc

SEQ ID NO: 45596 - DNA, 25 bp, Artificial sequence
  SiRNA target sequence
aaaaactaagagatctccagattct

SEQ ID NO: 45597 - DNA, 25 bp, Artificial sequence
  SiRNA target sequence
aaaactaagagatctccagattctg

SEQ ID NO: 45598 - DNA, 25 bp, Artificial sequence
  SiRNA target sequence
aaactaagagatctccagattctgt

SEQ ID NO: 45599 - DNA, 25 bp, Artificial sequence
  SiRNA target sequence
aactaagagatctccagattctgtt

SEQ ID NO: 45600 - DNA, 25 bp, Artificial sequence
  SiRNA target sequence
actaagagatctccagattctgtta

SEQ ID NO: 45601 - DNA, 25 bp, Artificial sequence
  SiRNA target sequence
ctaagagatctccagattctgttac

SEQ ID NO: 45602 - DNA, 25 bp, Artificial sequence
  SiRNA target sequence
taagagatctccagattctgttaca

SEQ ID NO: 45603 - DNA, 25 bp, Artificial sequence
  SiRNA target sequence
aagagatctccagattctgttacat

SEQ ID NO: 45604 - DNA, 25 bp, Artificial sequence
  SiRNA target sequence
agagatctccagattctgttacatt

SEQ ID NO: 45605 - DNA, 25 bp, Artificial sequence
  SiRNA target sequence
gagatctccagattctgttacattc

SEQ ID NO: 45606 - DNA, 25 bp, Artificial sequence
  SiRNA target sequence
agatctccagattctgttacattcc

SEQ ID NO: 45607 - DNA, 25 bp, Artificial sequence
  SiRNA target sequence
gatctccagattctgttacattccg

SEQ ID NO: 45608 - DNA, 25 bp, Artificial sequence
  SiRNA target sequence
atctccagattctgttacattccga

SEQ ID NO: 45609 - DNA, 25 bp, Artificial sequence
  SiRNA target sequence
tctccagattctgttacattccgat

SEQ ID NO: 45610 - DNA, 25 bp, Artificial sequence
  SiRNA target sequence
ctccagattctgttacattccgatt

SEQ ID NO: 45611 - DNA, 25 bp, Artificial sequence
  SiRNA target sequence
tccagattctgttacattccgattc

SEQ ID NO: 45612 - DNA, 25 bp, Artificial sequence
  SiRNA target sequence
ccagattctgttacattccgattct

SEQ ID NO: 45613 - DNA, 25 bp, Artificial sequence
  SiRNA target sequence
cagattctgttacattccgattcta

SEQ ID NO: 45614 - DNA, 25 bp, Artificial sequence
  SiRNA target sequence
agattctgttacattccgattctac

SEQ ID NO: 45615 - DNA, 25 bp, Artificial sequence
  SiRNA target sequence
gattctgttacattccgattctact

SEQ ID NO: 45616 - DNA, 25 bp, Artificial sequence
  SiRNA target sequence
attctgttacattccgattctactt

SEQ ID NO: 45617 - DNA, 25 bp, Artificial sequence
  SiRNA target sequence
ttctgttacattccgattctacttc

SEQ ID NO: 45618 - DNA, 25 bp, Artificial sequence
  SiRNA target sequence
tctgttacattccgattctacttca

SEQ ID NO: 45619 - DNA, 25 bp, Artificial sequence
  SiRNA target sequence
ctgttacattccgattctacttcag

SEQ ID NO: 45620 - DNA, 25 bp, Artificial sequence
  SiRNA target sequence
tgttacattccgattctacttcaga

SEQ ID NO: 45621 - DNA, 25 bp, Artificial sequence
  SiRNA target sequence
gttacattccgattctacttcagaa

SEQ ID NO: 45622 - DNA, 25 bp, Artificial sequence
  SiRNA target sequence
ttacattccgattctacttcagaaa

SEQ ID NO: 45623 - DNA, 25 bp, Artificial sequence
  SiRNA target sequence
tacattccgattctacttcagaaac

SEQ ID NO: 45624 - DNA, 25 bp, Artificial sequence
  SiRNA target sequence
acattccgattctacttcagaaaca

SEQ ID NO: 45625 - DNA, 25 bp, Artificial sequence
  SiRNA target sequence
cattccgattctacttcagaaacat

SEQ ID NO: 45626 - DNA, 25 bp, Artificial sequence
  SiRNA target sequence
attccgattctacttcagaaacata

SEQ ID NO: 45627 - DNA, 25 bp, Artificial sequence
  SiRNA target sequence
ttccgattctacttcagaaacatat

SEQ ID NO: 45628 - DNA, 25 bp, Artificial sequence
  SiRNA target sequence
tccgattctacttcagaaacatatt

SEQ ID NO: 45629 - DNA, 25 bp, Artificial sequence
  SiRNA target sequence
ccgattctacttcagaaacatattt

SEQ ID NO: 45630 - DNA, 25 bp, Artificial sequence
  SiRNA target sequence
cgattctacttcagaaacatatttt

SEQ ID NO: 45631 - DNA, 25 bp, Artificial sequence
  SiRNA target sequence
gattctacttcagaaacatattttt

SEQ ID NO: 45632 - DNA, 25 bp, Artificial sequence
  SiRNA target sequence
attctacttcagaaacatatttttc

SEQ ID NO: 45633 - DNA, 25 bp, Artificial sequence
  SiRNA target sequence
ttctacttcagaaacatatttttca

SEQ ID NO: 45634 - DNA, 25 bp, Artificial sequence
  SiRNA target sequence
tctacttcagaaacatatttttcat

SEQ ID NO: 45635 - DNA, 25 bp, Artificial sequence
  SiRNA target sequence
ctacttcagaaacatatttttcata

SEQ ID NO: 45636 - DNA, 25 bp, Artificial sequence
  SiRNA target sequence
tacttcagaaacatatttttcatat

SEQ ID NO: 45637 - DNA, 25 bp, Artificial sequence
  SiRNA target sequence
acttcagaaacatatttttcatatt

SEQ ID NO: 45638 - DNA, 25 bp, Artificial sequence
  SiRNA target sequence
cttcagaaacatatttttcatattt

SEQ ID NO: 45639 - DNA, 25 bp, Artificial sequence
  SiRNA target sequence
ttcagaaacatatttttcatattta

SEQ ID NO: 45640 - DNA, 25 bp, Artificial sequence
  SiRNA target sequence
tcagaaacatatttttcatatttaa

SEQ ID NO: 45641 - DNA, 25 bp, Artificial sequence
  SiRNA target sequence
cagaaacatatttttcatatttaag

SEQ ID NO: 45642 - DNA, 25 bp, Artificial sequence
  SiRNA target sequence
agaaacatatttttcatatttaagc

SEQ ID NO: 45643 - DNA, 25 bp, Artificial sequence
  SiRNA target sequence
gaaacatatttttcatatttaagcg

SEQ ID NO: 45644 - DNA, 25 bp, Artificial sequence
  SiRNA target sequence
aaacatatttttcatatttaagcga

SEQ ID NO: 45645 - DNA, 25 bp, Artificial sequence
  SiRNA target sequence
aacatatttttcatatttaagcgat

SEQ ID NO: 45646 - DNA, 25 bp, Artificial sequence
  SiRNA target sequence
acatatttttcatatttaagcgatt

SEQ ID NO: 45647 - DNA, 25 bp, Artificial sequence
  SiRNA target sequence
catatttttcatatttaagcgattc

SEQ ID NO: 45648 - DNA, 25 bp, Artificial sequence
  SiRNA target sequence
atatttttcatatttaagcgattct

SEQ ID NO: 45649 - DNA, 25 bp, Artificial sequence
  SiRNA target sequence
tatttttcatatttaagcgattctt

SEQ ID NO: 45650 - DNA, 25 bp, Artificial sequence
  SiRNA target sequence
atttttcatatttaagcgattcttc

SEQ ID NO: 45651 - DNA, 25 bp, Artificial sequence
  SiRNA target sequence
tttttcatatttaagcgattcttct

SEQ ID NO: 45652 - DNA, 25 bp, Artificial sequence
  SiRNA target sequence
ttttcatatttaagcgattcttctt

SEQ ID NO: 45653 - DNA, 25 bp, Artificial sequence
  SiRNA target sequence
tttcatatttaagcgattcttcttc

SEQ ID NO: 45654 - DNA, 25 bp, Artificial sequence
  SiRNA target sequence
ttcatatttaagcgattcttcttct

SEQ ID NO: 45655 - DNA, 25 bp, Artificial sequence
  SiRNA target sequence
tcatatttaagcgattcttcttctt

SEQ ID NO: 45656 - DNA, 25 bp, Artificial sequence
  SiRNA target sequence
catatttaagcgattcttcttcttc

SEQ ID NO: 45657 - DNA, 25 bp, Artificial sequence
  SiRNA target sequence
atatttaagcgattcttcttcttct

SEQ ID NO: 45658 - DNA, 25 bp, Artificial sequence
  SiRNA target sequence
tatttaagcgattcttcttcttctg

SEQ ID NO: 45659 - DNA, 25 bp, Artificial sequence
  SiRNA target sequence
atttaagcgattcttcttcttctgt

SEQ ID NO: 45660 - DNA, 25 bp, Artificial sequence
  SiRNA target sequence
tttaagcgattcttcttcttctgtt

SEQ ID NO: 45661 - DNA, 25 bp, Artificial sequence
  SiRNA target sequence
ttaagcgattcttcttcttctgttt

SEQ ID NO: 45662 - DNA, 25 bp, Artificial sequence
  SiRNA target sequence
taagcgattcttcttcttctgtttt

SEQ ID NO: 45663 - DNA, 25 bp, Artificial sequence
  SiRNA target sequence
aagcgattcttcttcttctgtttta

SEQ ID NO: 45664 - DNA, 25 bp, Artificial sequence
  SiRNA target sequence
agcgattcttcttcttctgttttat

SEQ ID NO: 45665 - DNA, 25 bp, Artificial sequence
  SiRNA target sequence
gcgattcttcttcttctgttttata

SEQ ID NO: 45666 - DNA, 25 bp, Artificial sequence
  SiRNA target sequence
cgattcttcttcttctgttttatat

SEQ ID NO: 45667 - DNA, 25 bp, Artificial sequence
  SiRNA target sequence
gattcttcttcttctgttttatatg

SEQ ID NO: 45668 - DNA, 25 bp, Artificial sequence
  SiRNA target sequence
attcttcttcttctgttttatatgc

SEQ ID NO: 45669 - DNA, 25 bp, Artificial sequence
  SiRNA target sequence
ttcttcttcttctgttttatatgct

SEQ ID NO: 45670 - DNA, 25 bp, Artificial sequence
  SiRNA target sequence
tcttcttcttctgttttatatgcta

SEQ ID NO: 45671 - DNA, 25 bp, Artificial sequence
  SiRNA target sequence
cttcttcttctgttttatatgctag

SEQ ID NO: 45672 - DNA, 25 bp, Artificial sequence
  SiRNA target sequence
ttcttcttctgttttatatgctagt

SEQ ID NO: 45673 - DNA, 25 bp, Artificial sequence
  SiRNA target sequence
tcttcttctgttttatatgctagta

SEQ ID NO: 45674 - DNA, 25 bp, Artificial sequence
  SiRNA target sequence
cttcttctgttttatatgctagtat

SEQ ID NO: 45675 - DNA, 25 bp, Artificial sequence
  SiRNA target sequence
ttcttctgttttatatgctagtata

SEQ ID NO: 45676 - DNA, 25 bp, Artificial sequence
  SiRNA target sequence
tcttctgttttatatgctagtatag

SEQ ID NO: 45677 - DNA, 25 bp, Artificial sequence
  SiRNA target sequence
cttctgttttatatgctagtatagt

SEQ ID NO: 45678 - DNA, 25 bp, Artificial sequence
  SiRNA target sequence
ttctgttttatatgctagtatagtc

SEQ ID NO: 45679 - DNA, 25 bp, Artificial sequence
  SiRNA target sequence
tctgttttatatgctagtatagtct

SEQ ID NO: 45680 - DNA, 25 bp, Artificial sequence
  SiRNA target sequence
ctgttttatatgctagtatagtctc

SEQ ID NO: 45681 - DNA, 25 bp, Artificial sequence
  SiRNA target sequence
tgttttatatgctagtatagtctca

SEQ ID NO: 45682 - DNA, 25 bp, Artificial sequence
  SiRNA target sequence
gttttatatgctagtatagtctcat

SEQ ID NO: 45683 - DNA, 25 bp, Artificial sequence
  SiRNA target sequence
ttttatatgctagtatagtctcatg

SEQ ID NO: 45684 - DNA, 25 bp, Artificial sequence
  SiRNA target sequence
tttatatgctagtatagtctcatga

SEQ ID NO: 45685 - DNA, 25 bp, Artificial sequence
  SiRNA target sequence
ttatatgctagtatagtctcatgat

SEQ ID NO: 45686 - DNA, 25 bp, Artificial sequence
  SiRNA target sequence
tatatgctagtatagtctcatgatt

SEQ ID NO: 45687 - DNA, 25 bp, Artificial sequence
  SiRNA target sequence
atatgctagtatagtctcatgatta

SEQ ID NO: 45688 - DNA, 25 bp, Artificial sequence
  SiRNA target sequence
tatgctagtatagtctcatgattaa

SEQ ID NO: 45689 - DNA, 25 bp, Artificial sequence
  SiRNA target sequence
atgctagtatagtctcatgattaat

SEQ ID NO: 45690 - DNA, 25 bp, Artificial sequence
  SiRNA target sequence
tgctagtatagtctcatgattaatt

SEQ ID NO: 45691 - DNA, 25 bp, Artificial sequence
  SiRNA target sequence
gctagtatagtctcatgattaatta

SEQ ID NO: 45692 - DNA, 25 bp, Artificial sequence
  SiRNA target sequence
ctagtatagtctcatgattaattaa

SEQ ID NO: 45693 - DNA, 25 bp, Artificial sequence
  SiRNA target sequence
tagtatagtctcatgattaattaaa

SEQ ID NO: 45694 - DNA, 25 bp, Artificial sequence
  SiRNA target sequence
agtatagtctcatgattaattaaag

SEQ ID NO: 45695 - DNA, 25 bp, Artificial sequence
  SiRNA target sequence
gtatagtctcatgattaattaaaga

SEQ ID NO: 45696 - DNA, 25 bp, Artificial sequence
  SiRNA target sequence
tatagtctcatgattaattaaagaa

SEQ ID NO: 45697 - DNA, 25 bp, Artificial sequence
  SiRNA target sequence
atagtctcatgattaattaaagaat

SEQ ID NO: 45698 - DNA, 25 bp, Artificial sequence
  SiRNA target sequence
tagtctcatgattaattaaagaatc

SEQ ID NO: 45699 - DNA, 25 bp, Artificial sequence
  SiRNA target sequence
agtctcatgattaattaaagaatca

SEQ ID NO: 45700 - DNA, 25 bp, Artificial sequence
  SiRNA target sequence
gtctcatgattaattaaagaatcat

SEQ ID NO: 45701 - DNA, 25 bp, Artificial sequence
  SiRNA target sequence
tctcatgattaattaaagaatcatg

SEQ ID NO: 45702 - DNA, 25 bp, Artificial sequence
  SiRNA target sequence
ctcatgattaattaaagaatcatgt

SEQ ID NO: 45703 - DNA, 25 bp, Artificial sequence
  SiRNA target sequence
tcatgattaattaaagaatcatgta

SEQ ID NO: 45704 - DNA, 25 bp, Artificial sequence
  SiRNA target sequence
catgattaattaaagaatcatgtaa

SEQ ID NO: 45705 - DNA, 25 bp, Artificial sequence
  SiRNA target sequence
atgattaattaaagaatcatgtaag

SEQ ID NO: 45706 - DNA, 25 bp, Artificial sequence
  SiRNA target sequence
tgattaattaaagaatcatgtaagt

SEQ ID NO: 45707 - DNA, 25 bp, Artificial sequence
  SiRNA target sequence
gattaattaaagaatcatgtaagtg

SEQ ID NO: 45708 - DNA, 25 bp, Artificial sequence
  SiRNA target sequence
attaattaaagaatcatgtaagtga

SEQ ID NO: 45709 - DNA, 25 bp, Artificial sequence
  SiRNA target sequence
ttaattaaagaatcatgtaagtgat

SEQ ID NO: 45710 - DNA, 25 bp, Artificial sequence
  SiRNA target sequence
taattaaagaatcatgtaagtgatt

SEQ ID NO: 45711 - DNA, 25 bp, Artificial sequence
  SiRNA target sequence
aattaaagaatcatgtaagtgattt

SEQ ID NO: 45712 - DNA, 25 bp, Artificial sequence
  SiRNA target sequence
attaaagaatcatgtaagtgatttg

SEQ ID NO: 45713 - DNA, 25 bp, Artificial sequence
  SiRNA target sequence
ttaaagaatcatgtaagtgatttga

SEQ ID NO: 45714 - DNA, 25 bp, Artificial sequence
  SiRNA target sequence
taaagaatcatgtaagtgatttgag

SEQ ID NO: 45715 - DNA, 25 bp, Artificial sequence
  SiRNA target sequence
aaagaatcatgtaagtgatttgagc

SEQ ID NO: 45716 - DNA, 25 bp, Artificial sequence
  SiRNA target sequence
aagaatcatgtaagtgatttgagca

SEQ ID NO: 45717 - DNA, 25 bp, Artificial sequence
  SiRNA target sequence
agaatcatgtaagtgatttgagcat

SEQ ID NO: 45718 - DNA, 25 bp, Artificial sequence
  SiRNA target sequence
gaatcatgtaagtgatttgagcatc

SEQ ID NO: 45719 - DNA, 25 bp, Artificial sequence
  SiRNA target sequence
aatcatgtaagtgatttgagcatct

SEQ ID NO: 45720 - DNA, 25 bp, Artificial sequence
  SiRNA target sequence
atcatgtaagtgatttgagcatctt

SEQ ID NO: 45721 - DNA, 25 bp, Artificial sequence
  SiRNA target sequence
tcatgtaagtgatttgagcatcttt

SEQ ID NO: 45722 - DNA, 25 bp, Artificial sequence
  SiRNA target sequence
catgtaagtgatttgagcatctttg

SEQ ID NO: 45723 - DNA, 25 bp, Artificial sequence
  SiRNA target sequence
atgtaagtgatttgagcatctttgt

SEQ ID NO: 45724 - DNA, 25 bp, Artificial sequence
  SiRNA target sequence
tgtaagtgatttgagcatctttgtt

SEQ ID NO: 45725 - DNA, 25 bp, Artificial sequence
  SiRNA target sequence
gtaagtgatttgagcatctttgttg

SEQ ID NO: 45726 - DNA, 25 bp, Artificial sequence
  SiRNA target sequence
taagtgatttgagcatctttgttgt

SEQ ID NO: 45727 - DNA, 25 bp, Artificial sequence
  SiRNA target sequence
aagtgatttgagcatctttgttgtg

SEQ ID NO: 45728 - DNA, 25 bp, Artificial sequence
  SiRNA target sequence
agtgatttgagcatctttgttgtgc

SEQ ID NO: 45729 - DNA, 25 bp, Artificial sequence
  SiRNA target sequence
gtgatttgagcatctttgttgtgcg

SEQ ID NO: 45730 - DNA, 25 bp, Artificial sequence
  SiRNA target sequence
tgatttgagcatctttgttgtgcgc

SEQ ID NO: 45731 - DNA, 25 bp, Artificial sequence
  SiRNA target sequence
gatttgagcatctttgttgtgcgca

SEQ ID NO: 45732 - DNA, 25 bp, Artificial sequence
  SiRNA target sequence
atttgagcatctttgttgtgcgcaa

SEQ ID NO: 45733 - DNA, 25 bp, Artificial sequence
  SiRNA target sequence
tttgagcatctttgttgtgcgcaat

SEQ ID NO: 45734 - DNA, 25 bp, Artificial sequence
  SiRNA target sequence
ttgagcatctttgttgtgcgcaatt

SEQ ID NO: 45735 - DNA, 25 bp, Artificial sequence
  SiRNA target sequence
tgagcatctttgttgtgcgcaatta

SEQ ID NO: 45736 - DNA, 25 bp, Artificial sequence
  SiRNA target sequence
gagcatctttgttgtgcgcaattat

SEQ ID NO: 45737 - DNA, 25 bp, Artificial sequence
  SiRNA target sequence
agcatctttgttgtgcgcaattata

SEQ ID NO: 45738 - DNA, 25 bp, Artificial sequence
  SiRNA target sequence
gcatctttgttgtgcgcaattatat

SEQ ID NO: 45739 - DNA, 25 bp, Artificial sequence
  SiRNA target sequence
catctttgttgtgcgcaattatatt

SEQ ID NO: 45740 - DNA, 25 bp, Artificial sequence
  SiRNA target sequence
atctttgttgtgcgcaattatattc

SEQ ID NO: 45741 - DNA, 25 bp, Artificial sequence
  SiRNA target sequence
tctttgttgtgcgcaattatattct

SEQ ID NO: 45742 - DNA, 25 bp, Artificial sequence
  SiRNA target sequence
ctttgttgtgcgcaattatattctt

SEQ ID NO: 45743 - DNA, 25 bp, Artificial sequence
  SiRNA target sequence
tttgttgtgcgcaattatattcttt

SEQ ID NO: 45744 - DNA, 25 bp, Artificial sequence
  SiRNA target sequence
ttgttgtgcgcaattatattctttt

SEQ ID NO: 45745 - DNA, 25 bp, Artificial sequence
  SiRNA target sequence
tgttgtgcgcaattatattcttttc

SEQ ID NO: 45746 - DNA, 25 bp, Artificial sequence
  SiRNA target sequence
gttgtgcgcaattatattcttttct

SEQ ID NO: 45747 - DNA, 25 bp, Artificial sequence
  SiRNA target sequence
ttgtgcgcaattatattcttttctt

SEQ ID NO: 45748 - DNA, 25 bp, Artificial sequence
  SiRNA target sequence
tgtgcgcaattatattcttttctta

SEQ ID NO: 45749 - DNA, 25 bp, Artificial sequence
  SiRNA target sequence
gtgcgcaattatattcttttcttat

SEQ ID NO: 45750 - DNA, 25 bp, Artificial sequence
  SiRNA target sequence
tgcgcaattatattcttttcttatt

SEQ ID NO: 45751 - DNA, 25 bp, Artificial sequence
  SiRNA target sequence
gcgcaattatattcttttcttattc

SEQ ID NO: 45752 - DNA, 25 bp, Artificial sequence
  SiRNA target sequence
cgcaattatattcttttcttattcc

SEQ ID NO: 45753 - DNA, 25 bp, Artificial sequence
  SiRNA target sequence
gcaattatattcttttcttattcct

SEQ ID NO: 45754 - DNA, 25 bp, Artificial sequence
  SiRNA target sequence
caattatattcttttcttattcctg

SEQ ID NO: 45755 - DNA, 25 bp, Artificial sequence
  SiRNA target sequence
aattatattcttttcttattcctgt

SEQ ID NO: 45756 - DNA, 25 bp, Artificial sequence
  SiRNA target sequence
attatattcttttcttattcctgta

SEQ ID NO: 45757 - DNA, 25 bp, Artificial sequence
  SiRNA target sequence
ttatattcttttcttattcctgtac

SEQ ID NO: 45758 - DNA, 25 bp, Artificial sequence
  SiRNA target sequence
tatattcttttcttattcctgtacg

SEQ ID NO: 45759 - DNA, 25 bp, Artificial sequence
  SiRNA target sequence
atattcttttcttattcctgtacgc

SEQ ID NO: 45760 - DNA, 25 bp, Artificial sequence
  SiRNA target sequence
tattcttttcttattcctgtacgcc

SEQ ID NO: 45761 - DNA, 25 bp, Artificial sequence
  SiRNA target sequence
attcttttcttattcctgtacgcca

SEQ ID NO: 45762 - DNA, 25 bp, Artificial sequence
  SiRNA target sequence
ttcttttcttattcctgtacgccaa

SEQ ID NO: 45763 - DNA, 25 bp, Artificial sequence
  SiRNA target sequence
tcttttcttattcctgtacgccaat

SEQ ID NO: 45764 - DNA, 25 bp, Artificial sequence
  SiRNA target sequence
cttttcttattcctgtacgccaatg

SEQ ID NO: 45765 - DNA, 25 bp, Artificial sequence
  SiRNA target sequence
ttttcttattcctgtacgccaatga

SEQ ID NO: 45766 - DNA, 25 bp, Artificial sequence
  SiRNA target sequence
tttcttattcctgtacgccaatgaa

SEQ ID NO: 45767 - DNA, 25 bp, Artificial sequence
  SiRNA target sequence
ttcttattcctgtacgccaatgaac

SEQ ID NO: 45768 - DNA, 25 bp, Artificial sequence
  SiRNA target sequence
tcttattcctgtacgccaatgaact

SEQ ID NO: 45769 - DNA, 25 bp, Artificial sequence
  SiRNA target sequence
cttattcctgtacgccaatgaacta

SEQ ID NO: 45770 - DNA, 25 bp, Artificial sequence
  SiRNA target sequence
ttattcctgtacgccaatgaactat

SEQ ID NO: 45771 - DNA, 25 bp, Artificial sequence
  SiRNA target sequence
tattcctgtacgccaatgaactatt

SEQ ID NO: 45772 - DNA, 25 bp, Artificial sequence
  SiRNA target sequence
attcctgtacgccaatgaactattt

SEQ ID NO: 45773 - DNA, 25 bp, Artificial sequence
  SiRNA target sequence
ttcctgtacgccaatgaactatttt

SEQ ID NO: 45774 - DNA, 25 bp, Artificial sequence
  SiRNA target sequence
tcctgtacgccaatgaactattttc

SEQ ID NO: 45775 - DNA, 25 bp, Artificial sequence
  SiRNA target sequence
cctgtacgccaatgaactattttcg

SEQ ID NO: 45776 - DNA, 25 bp, Artificial sequence
  SiRNA target sequence
ctgtacgccaatgaactattttcgc

SEQ ID NO: 45777 - DNA, 25 bp, Artificial sequence
  SiRNA target sequence
tgtacgccaatgaactattttcgca

SEQ ID NO: 45778 - DNA, 25 bp, Artificial sequence
  SiRNA target sequence
gtacgccaatgaactattttcgcag

SEQ ID NO: 45779 - DNA, 25 bp, Artificial sequence
  SiRNA target sequence
tacgccaatgaactattttcgcagt

SEQ ID NO: 45780 - DNA, 25 bp, Artificial sequence
  SiRNA target sequence
acgccaatgaactattttcgcagtt

SEQ ID NO: 45781 - DNA, 25 bp, Artificial sequence
  SiRNA target sequence
cgccaatgaactattttcgcagttg

SEQ ID NO: 45782 - DNA, 25 bp, Artificial sequence
  SiRNA target sequence
gccaatgaactattttcgcagttgc

SEQ ID NO: 45783 - DNA, 25 bp, Artificial sequence
  SiRNA target sequence
ccaatgaactattttcgcagttgca

SEQ ID NO: 45784 - DNA, 25 bp, Artificial sequence
  SiRNA target sequence
caatgaactattttcgcagttgcaa

SEQ ID NO: 45785 - DNA, 25 bp, Artificial sequence
  SiRNA target sequence
aatgaactattttcgcagttgcaag

SEQ ID NO: 45786 - DNA, 25 bp, Artificial sequence
  SiRNA target sequence
atgaactattttcgcagttgcaagg

SEQ ID NO: 45787 - DNA, 25 bp, Artificial sequence
  SiRNA target sequence
tgaactattttcgcagttgcaagga

SEQ ID NO: 45788 - DNA, 25 bp, Artificial sequence
  SiRNA target sequence
gaactattttcgcagttgcaaggat

SEQ ID NO: 45789 - DNA, 25 bp, Artificial sequence
  SiRNA target sequence
aactattttcgcagttgcaaggatg

SEQ ID NO: 45790 - DNA, 25 bp, Artificial sequence
  SiRNA target sequence
actattttcgcagttgcaaggatgt

SEQ ID NO: 45791 - DNA, 25 bp, Artificial sequence
  SiRNA target sequence
ctattttcgcagttgcaaggatgta

SEQ ID NO: 45792 - DNA, 25 bp, Artificial sequence
  SiRNA target sequence
tattttcgcagttgcaaggatgtaa

SEQ ID NO: 45793 - DNA, 25 bp, Artificial sequence
  SiRNA target sequence
attttcgcagttgcaaggatgtaaa

SEQ ID NO: 45794 - DNA, 25 bp, Artificial sequence
  SiRNA target sequence
ttttcgcagttgcaaggatgtaaac

SEQ ID NO: 45795 - DNA, 25 bp, Artificial sequence
  SiRNA target sequence
tttcgcagttgcaaggatgtaaact

SEQ ID NO: 45796 - DNA, 25 bp, Artificial sequence
  SiRNA target sequence
ttcgcagttgcaaggatgtaaacta

SEQ ID NO: 45797 - DNA, 25 bp, Artificial sequence
  SiRNA target sequence
tcgcagttgcaaggatgtaaactaa

SEQ ID NO: 45798 - DNA, 25 bp, Artificial sequence
  SiRNA target sequence
cgcagttgcaaggatgtaaactaat

SEQ ID NO: 45799 - DNA, 25 bp, Artificial sequence
  SiRNA target sequence
gcagttgcaaggatgtaaactaata

SEQ ID NO: 45800 - DNA, 25 bp, Artificial sequence
  SiRNA target sequence
cagttgcaaggatgtaaactaataa

SEQ ID NO: 45801 - DNA, 25 bp, Artificial sequence
  SiRNA target sequence
agttgcaaggatgtaaactaataat

SEQ ID NO: 45802 - DNA, 25 bp, Artificial sequence
  SiRNA target sequence
gttgcaaggatgtaaactaataatg

SEQ ID NO: 45803 - DNA, 25 bp, Artificial sequence
  SiRNA target sequence
ttgcaaggatgtaaactaataatgt

SEQ ID NO: 45804 - DNA, 25 bp, Artificial sequence
  SiRNA target sequence
tgcaaggatgtaaactaataatgtg

SEQ ID NO: 45805 - DNA, 25 bp, Artificial sequence
  SiRNA target sequence
gcaaggatgtaaactaataatgtga

SEQ ID NO: 45806 - DNA, 25 bp, Artificial sequence
  SiRNA target sequence
caaggatgtaaactaataatgtgat

SEQ ID NO: 45807 - DNA, 25 bp, Artificial sequence
  SiRNA target sequence
aaggatgtaaactaataatgtgatt

SEQ ID NO: 45808 - DNA, 25 bp, Artificial sequence
  SiRNA target sequence
aggatgtaaactaataatgtgatta

SEQ ID NO: 45809 - DNA, 25 bp, Artificial sequence
  SiRNA target sequence
ggatgtaaactaataatgtgattaa

SEQ ID NO: 45810 - DNA, 25 bp, Artificial sequence
  SiRNA target sequence
gatgtaaactaataatgtgattaaa

SEQ ID NO: 45811 - DNA, 25 bp, Artificial sequence
  SiRNA target sequence
atgtaaactaataatgtgattaaaa

SEQ ID NO: 45812 - DNA, 25 bp, Artificial sequence
  SiRNA target sequence
tgtaaactaataatgtgattaaaat

SEQ ID NO: 45813 - DNA, 25 bp, Artificial sequence
  SiRNA target sequence
gtaaactaataatgtgattaaaata

SEQ ID NO: 45814 - DNA, 25 bp, Artificial sequence
  SiRNA target sequence
taaactaataatgtgattaaaataa

SEQ ID NO: 45815 - DNA, 25 bp, Artificial sequence
  SiRNA target sequence
aaactaataatgtgattaaaataat

SEQ ID NO: 45816 - DNA, 25 bp, Artificial sequence
  SiRNA target sequence
aactaataatgtgattaaaataata

SEQ ID NO: 45817 - DNA, 25 bp, Artificial sequence
  SiRNA target sequence
actaataatgtgattaaaataataa

SEQ ID NO: 45818 - DNA, 25 bp, Artificial sequence
  SiRNA target sequence
ctaataatgtgattaaaataataaa

SEQ ID NO: 45819 - DNA, 25 bp, Artificial sequence
  SiRNA target sequence
taataatgtgattaaaataataaac

SEQ ID NO: 45820 - DNA, 25 bp, Artificial sequence
  SiRNA target sequence
aataatgtgattaaaataataaaca

SEQ ID NO: 45821 - DNA, 25 bp, Artificial sequence
  SiRNA target sequence
ataatgtgattaaaataataaacat

SEQ ID NO: 45822 - DNA, 25 bp, Artificial sequence
  SiRNA target sequence
taatgtgattaaaataataaacata

SEQ ID NO: 45823 - DNA, 25 bp, Artificial sequence
  SiRNA target sequence
aatgtgattaaaataataaacatat

SEQ ID NO: 45824 - DNA, 25 bp, Artificial sequence
  SiRNA target sequence
atgtgattaaaataataaacatatt

SEQ ID NO: 45825 - DNA, 25 bp, Artificial sequence
  SiRNA target sequence
tgtgattaaaataataaacatattt

SEQ ID NO: 45826 - DNA, 25 bp, Artificial sequence
  SiRNA target sequence
gtgattaaaataataaacatatttg

SEQ ID NO: 45827 - DNA, 25 bp, Artificial sequence
  SiRNA target sequence
tgattaaaataataaacatatttgt

SEQ ID NO: 45828 - DNA, 25 bp, Artificial sequence
  SiRNA target sequence
gattaaaataataaacatatttgtc

SEQ ID NO: 45829 - DNA, 25 bp, Artificial sequence
  SiRNA target sequence
attaaaataataaacatatttgtca

SEQ ID NO: 45830 - DNA, 25 bp, Artificial sequence
  SiRNA target sequence
ttaaaataataaacatatttgtcaa

SEQ ID NO: 45831 - DNA, 25 bp, Artificial sequence
  SiRNA target sequence
taaaataataaacatatttgtcaac

SEQ ID NO: 45832 - DNA, 25 bp, Artificial sequence
  SiRNA target sequence
aaaataataaacatatttgtcaacc

SEQ ID NO: 45833 - DNA, 25 bp, Artificial sequence
  SiRNA target sequence
aaataataaacatatttgtcaaccc

SEQ ID NO: 45834 - DNA, 25 bp, Artificial sequence
  SiRNA target sequence
aataataaacatatttgtcaaccct

SEQ ID NO: 45835 - DNA, 25 bp, Artificial sequence
  SiRNA target sequence
ataataaacatatttgtcaacccta

SEQ ID NO: 45836 - DNA, 25 bp, Artificial sequence
  SiRNA target sequence
taataaacatatttgtcaaccctaa

SEQ ID NO: 45837 - DNA, 25 bp, Artificial sequence
  SiRNA target sequence
aataaacatatttgtcaaccctaaa

SEQ ID NO: 45838 - DNA, 25 bp, Artificial sequence
  SiRNA target sequence
ataaacatatttgtcaaccctaaat

SEQ ID NO: 45839 - DNA, 25 bp, Artificial sequence
  SiRNA target sequence
taaacatatttgtcaaccctaaatt

SEQ ID NO: 45840 - DNA, 25 bp, Artificial sequence
  SiRNA target sequence
aaacatatttgtcaaccctaaattt

SEQ ID NO: 45841 - DNA, 25 bp, Artificial sequence
  SiRNA target sequence
aacatatttgtcaaccctaaatttg

SEQ ID NO: 45842 - DNA, 25 bp, Artificial sequence
  SiRNA target sequence
acatatttgtcaaccctaaatttgt

SEQ ID NO: 45843 - DNA, 25 bp, Artificial sequence
  SiRNA target sequence
catatttgtcaaccctaaatttgta

SEQ ID NO: 45844 - DNA, 25 bp, Artificial sequence
  SiRNA target sequence
atatttgtcaaccctaaatttgtat

SEQ ID NO: 45845 - DNA, 25 bp, Artificial sequence
  SiRNA target sequence
tatttgtcaaccctaaatttgtata

SEQ ID NO: 45846 - DNA, 25 bp, Artificial sequence
  SiRNA target sequence
atttgtcaaccctaaatttgtataa

SEQ ID NO: 45847 - DNA, 25 bp, Artificial sequence
  SiRNA target sequence
tttgtcaaccctaaatttgtataaa

SEQ ID NO: 45848 - DNA, 25 bp, Artificial sequence
  SiRNA target sequence
ttgtcaaccctaaatttgtataaat

SEQ ID NO: 45849 - DNA, 25 bp, Artificial sequence
  SiRNA target sequence
tgtcaaccctaaatttgtataaatt

SEQ ID NO: 45850 - DNA, 25 bp, Artificial sequence
  SiRNA target sequence
gtcaaccctaaatttgtataaattg

SEQ ID NO: 45851 - DNA, 25 bp, Artificial sequence
  SiRNA target sequence
tcaaccctaaatttgtataaattga

SEQ ID NO: 45852 - DNA, 25 bp, Artificial sequence
  SiRNA target sequence
caaccctaaatttgtataaattgac

SEQ ID NO: 45853 - DNA, 25 bp, Artificial sequence
  SiRNA target sequence
aaccctaaatttgtataaattgacg

SEQ ID NO: 45854 - DNA, 25 bp, Artificial sequence
  SiRNA target sequence
accctaaatttgtataaattgacga

SEQ ID NO: 45855 - DNA, 25 bp, Artificial sequence
  SiRNA target sequence
ccctaaatttgtataaattgacgaa

SEQ ID NO: 45856 - DNA, 25 bp, Artificial sequence
  SiRNA target sequence
cctaaatttgtataaattgacgaac

SEQ ID NO: 45857 - DNA, 25 bp, Artificial sequence
  SiRNA target sequence
ctaaatttgtataaattgacgaaca

SEQ ID NO: 45858 - DNA, 25 bp, Artificial sequence
  SiRNA target sequence
taaatttgtataaattgacgaacac

SEQ ID NO: 45859 - DNA, 25 bp, Artificial sequence
  SiRNA target sequence
aaatttgtataaattgacgaacacg

SEQ ID NO: 45860 - DNA, 25 bp, Artificial sequence
  SiRNA target sequence
aatttgtataaattgacgaacacgc

SEQ ID NO: 45861 - DNA, 25 bp, Artificial sequence
  SiRNA target sequence
atttgtataaattgacgaacacgcc

SEQ ID NO: 45862 - DNA, 25 bp, Artificial sequence
  SiRNA target sequence
tttgtataaattgacgaacacgcca

SEQ ID NO: 45863 - DNA, 25 bp, Artificial sequence
  SiRNA target sequence
ttgtataaattgacgaacacgccaa

SEQ ID NO: 45864 - DNA, 25 bp, Artificial sequence
  SiRNA target sequence
tgtataaattgacgaacacgccaat

SEQ ID NO: 45865 - DNA, 25 bp, Artificial sequence
  SiRNA target sequence
gtataaattgacgaacacgccaata

SEQ ID NO: 45866 - DNA, 25 bp, Artificial sequence
  SiRNA target sequence
tataaattgacgaacacgccaatat

SEQ ID NO: 45867 - DNA, 25 bp, Artificial sequence
  SiRNA target sequence
ataaattgacgaacacgccaatata

SEQ ID NO: 45868 - DNA, 25 bp, Artificial sequence
  SiRNA target sequence
taaattgacgaacacgccaatataa

SEQ ID NO: 45869 - DNA, 25 bp, Artificial sequence
  SiRNA target sequence
aaattgacgaacacgccaatataac

SEQ ID NO: 45870 - DNA, 25 bp, Artificial sequence
  SiRNA target sequence
aattgacgaacacgccaatataact

SEQ ID NO: 45871 - DNA, 25 bp, Artificial sequence
  SiRNA target sequence
attgacgaacacgccaatataactg

SEQ ID NO: 45872 - DNA, 25 bp, Artificial sequence
  SiRNA target sequence
ttgacgaacacgccaatataactgt

SEQ ID NO: 45873 - DNA, 25 bp, Artificial sequence
  SiRNA target sequence
tgacgaacacgccaatataactgta

SEQ ID NO: 45874 - DNA, 25 bp, Artificial sequence
  SiRNA target sequence
gacgaacacgccaatataactgtaa

SEQ ID NO: 45875 - DNA, 25 bp, Artificial sequence
  SiRNA target sequence
acgaacacgccaatataactgtaaa

SEQ ID NO: 45876 - DNA, 25 bp, Artificial sequence
  SiRNA target sequence
cgaacacgccaatataactgtaaaa

SEQ ID NO: 45877 - DNA, 25 bp, Artificial sequence
  SiRNA target sequence
gaacacgccaatataactgtaaaaa

SEQ ID NO: 45878 - DNA, 25 bp, Artificial sequence
  SiRNA target sequence
aacacgccaatataactgtaaaaaa

SEQ ID NO: 45879 - DNA, 25 bp, Artificial sequence
  SiRNA target sequence
acacgccaatataactgtaaaaaaa

SEQ ID NO: 45880 - DNA, 25 bp, Artificial sequence
  SiRNA target sequence
cacgccaatataactgtaaaaaaaa

SEQ ID NO: 45881 - DNA, 25 bp, Artificial sequence
  SiRNA target sequence
acgccaatataactgtaaaaaaaat

SEQ ID NO: 45882 - DNA, 25 bp, Artificial sequence
  SiRNA target sequence
cgccaatataactgtaaaaaaaata

SEQ ID NO: 45883 - DNA, 25 bp, Artificial sequence
  SiRNA target sequence
gccaatataactgtaaaaaaaatat

SEQ ID NO: 45884 - DNA, 25 bp, Artificial sequence
  SiRNA target sequence
ccaatataactgtaaaaaaaatatt

SEQ ID NO: 45885 - DNA, 25 bp, Artificial sequence
  SiRNA target sequence
caatataactgtaaaaaaaatattt

SEQ ID NO: 45886 - DNA, 25 bp, Artificial sequence
  SiRNA target sequence
aatataactgtaaaaaaaatattta

SEQ ID NO: 45887 - DNA, 25 bp, Artificial sequence
  SiRNA target sequence
atataactgtaaaaaaaatatttat

SEQ ID NO: 45888 - DNA, 25 bp, Artificial sequence
  SiRNA target sequence
tataactgtaaaaaaaatatttatg

SEQ ID NO: 45889 - DNA, 25 bp, Artificial sequence
  SiRNA target sequence
ataactgtaaaaaaaatatttatga

SEQ ID NO: 45890 - DNA, 25 bp, Artificial sequence
  SiRNA target sequence
taactgtaaaaaaaatatttatgat

SEQ ID NO: 45891 - DNA, 25 bp, Artificial sequence
  SiRNA target sequence
aactgtaaaaaaaatatttatgata

SEQ ID NO: 45892 - DNA, 25 bp, Artificial sequence
  SiRNA target sequence
actgtaaaaaaaatatttatgatat

SEQ ID NO: 45893 - DNA, 25 bp, Artificial sequence
  SiRNA target sequence
ctgtaaaaaaaatatttatgatatt

SEQ ID NO: 45894 - DNA, 25 bp, Artificial sequence
  SiRNA target sequence
tgtaaaaaaaatatttatgatatta

SEQ ID NO: 45895 - DNA, 25 bp, Artificial sequence
  SiRNA target sequence
gtaaaaaaaatatttatgatattaa

SEQ ID NO: 45896 - DNA, 25 bp, Artificial sequence
  SiRNA target sequence
taaaaaaaatatttatgatattaac

SEQ ID NO: 45897 - DNA, 25 bp, Artificial sequence
  SiRNA target sequence
aaaaaaaatatttatgatattaaca

SEQ ID NO: 45898 - DNA, 25 bp, Artificial sequence
  SiRNA target sequence
aaaaaaatatttatgatattaacaa

SEQ ID NO: 45899 - DNA, 25 bp, Artificial sequence
  SiRNA target sequence
aaaaaatatttatgatattaacaaa

SEQ ID NO: 45900 - DNA, 25 bp, Artificial sequence
  SiRNA target sequence
aaaaatatttatgatattaacaaat

SEQ ID NO: 45901 - DNA, 25 bp, Artificial sequence
  SiRNA target sequence
aaaatatttatgatattaacaaata

SEQ ID NO: 45902 - DNA, 25 bp, Artificial sequence
  SiRNA target sequence
aaatatttatgatattaacaaataa

SEQ ID NO: 45903 - DNA, 25 bp, Artificial sequence
  SiRNA target sequence
aatatttatgatattaacaaataaa

SEQ ID NO: 45904 - DNA, 25 bp, Artificial sequence
  SiRNA target sequence
atatttatgatattaacaaataaaa

SEQ ID NO: 45905 - DNA, 25 bp, Artificial sequence
  SiRNA target sequence
tatttatgatattaacaaataaaac

SEQ ID NO: 45906 - DNA, 25 bp, Artificial sequence
  SiRNA target sequence
atttatgatattaacaaataaaact

SEQ ID NO: 45907 - DNA, 25 bp, Artificial sequence
  SiRNA target sequence
tttatgatattaacaaataaaactt

SEQ ID NO: 45908 - DNA, 25 bp, Artificial sequence
  SiRNA target sequence
ttatgatattaacaaataaaacttc

SEQ ID NO: 45909 - DNA, 25 bp, Artificial sequence
  SiRNA target sequence
tatgatattaacaaataaaacttcg

SEQ ID NO: 45910 - DNA, 25 bp, Artificial sequence
  SiRNA target sequence
atgatattaacaaataaaacttcga

SEQ ID NO: 45911 - DNA, 25 bp, Artificial sequence
  SiRNA target sequence
tgatattaacaaataaaacttcgat

SEQ ID NO: 45912 - DNA, 25 bp, Artificial sequence
  SiRNA target sequence
gatattaacaaataaaacttcgatc

SEQ ID NO: 45913 - DNA, 25 bp, Artificial sequence
  SiRNA target sequence
atattaacaaataaaacttcgatca

SEQ ID NO: 45914 - DNA, 25 bp, Artificial sequence
  SiRNA target sequence
tattaacaaataaaacttcgatcaa

SEQ ID NO: 45915 - DNA, 25 bp, Artificial sequence
  SiRNA target sequence
attaacaaataaaacttcgatcaat

SEQ ID NO: 45916 - DNA, 25 bp, Artificial sequence
  SiRNA target sequence
ttaacaaataaaacttcgatcaatt

SEQ ID NO: 45917 - DNA, 25 bp, Artificial sequence
  SiRNA target sequence
taacaaataaaacttcgatcaattc

SEQ ID NO: 45918 - DNA, 25 bp, Artificial sequence
  SiRNA target sequence
aacaaataaaacttcgatcaattca

SEQ ID NO: 45919 - DNA, 25 bp, Artificial sequence
  SiRNA target sequence
acaaataaaacttcgatcaattcac

SEQ ID NO: 45920 - DNA, 25 bp, Artificial sequence
  SiRNA target sequence
caaataaaacttcgatcaattcact

SEQ ID NO: 45921 - DNA, 25 bp, Artificial sequence
  SiRNA target sequence
aaataaaacttcgatcaattcactt

SEQ ID NO: 45922 - DNA, 25 bp, Artificial sequence
  SiRNA target sequence
aataaaacttcgatcaattcactta

SEQ ID NO: 45923 - DNA, 25 bp, Artificial sequence
  SiRNA target sequence
ataaaacttcgatcaattcacttat

SEQ ID NO: 45924 - DNA, 25 bp, Artificial sequence
  SiRNA target sequence
taaaacttcgatcaattcacttatt

SEQ ID NO: 45925 - DNA, 25 bp, Artificial sequence
  SiRNA target sequence
aaaacttcgatcaattcacttattg

SEQ ID NO: 45926 - DNA, 25 bp, Artificial sequence
  SiRNA target sequence
aaacttcgatcaattcacttattgc

SEQ ID NO: 45927 - DNA, 25 bp, Artificial sequence
  SiRNA target sequence
aacttcgatcaattcacttattgct

SEQ ID NO: 45928 - DNA, 25 bp, Artificial sequence
  SiRNA target sequence
acttcgatcaattcacttattgctt

SEQ ID NO: 45929 - DNA, 25 bp, Artificial sequence
  SiRNA target sequence
cttcgatcaattcacttattgcttt

SEQ ID NO: 45930 - DNA, 25 bp, Artificial sequence
  SiRNA target sequence
ttcgatcaattcacttattgcttta

SEQ ID NO: 45931 - DNA, 25 bp, Artificial sequence
  SiRNA target sequence
tcgatcaattcacttattgctttac

SEQ ID NO: 45932 - DNA, 25 bp, Artificial sequence
  SiRNA target sequence
cgatcaattcacttattgctttact

SEQ ID NO: 45933 - DNA, 25 bp, Artificial sequence
  SiRNA target sequence
gatcaattcacttattgctttactt

SEQ ID NO: 45934 - DNA, 25 bp, Artificial sequence
  SiRNA target sequence
atcaattcacttattgctttacttt

SEQ ID NO: 45935 - DNA, 25 bp, Artificial sequence
  SiRNA target sequence
tcaattcacttattgctttactttc

SEQ ID NO: 45936 - DNA, 25 bp, Artificial sequence
  SiRNA target sequence
caattcacttattgctttactttct

SEQ ID NO: 45937 - DNA, 25 bp, Artificial sequence
  SiRNA target sequence
aattcacttattgctttactttctc

SEQ ID NO: 45938 - DNA, 25 bp, Artificial sequence
  SiRNA target sequence
attcacttattgctttactttctcg

SEQ ID NO: 45939 - DNA, 25 bp, Artificial sequence
  SiRNA target sequence
ttcacttattgctttactttctcgg

SEQ ID NO: 45940 - DNA, 25 bp, Artificial sequence
  SiRNA target sequence
tcacttattgctttactttctcggt

SEQ ID NO: 45941 - DNA, 25 bp, Artificial sequence
  SiRNA target sequence
cacttattgctttactttctcggtc

SEQ ID NO: 45942 - DNA, 25 bp, Artificial sequence
  SiRNA target sequence
acttattgctttactttctcggtct

SEQ ID NO: 45943 - DNA, 25 bp, Artificial sequence
  SiRNA target sequence
cttattgctttactttctcggtcta

SEQ ID NO: 45944 - DNA, 25 bp, Artificial sequence
  SiRNA target sequence
ttattgctttactttctcggtctat

SEQ ID NO: 45945 - DNA, 25 bp, Artificial sequence
  SiRNA target sequence
tattgctttactttctcggtctatt

SEQ ID NO: 45946 - DNA, 25 bp, Artificial sequence
  SiRNA target sequence
attgctttactttctcggtctatta

SEQ ID NO: 45947 - DNA, 25 bp, Artificial sequence
  SiRNA target sequence
ttgctttactttctcggtctattat

SEQ ID NO: 45948 - DNA, 25 bp, Artificial sequence
  SiRNA target sequence
tgctttactttctcggtctattatt

SEQ ID NO: 45949 - DNA, 25 bp, Artificial sequence
  SiRNA target sequence
gctttactttctcggtctattattg

SEQ ID NO: 45950 - DNA, 25 bp, Artificial sequence
  SiRNA target sequence
ctttactttctcggtctattattgt

SEQ ID NO: 45951 - DNA, 25 bp, Artificial sequence
  SiRNA target sequence
tttactttctcggtctattattgtt

SEQ ID NO: 45952 - DNA, 25 bp, Artificial sequence
  SiRNA target sequence
ttactttctcggtctattattgttt

SEQ ID NO: 45953 - DNA, 25 bp, Artificial sequence
  SiRNA target sequence
tactttctcggtctattattgtttg

SEQ ID NO: 45954 - DNA, 25 bp, Artificial sequence
  SiRNA target sequence
actttctcggtctattattgtttgt

SEQ ID NO: 45955 - DNA, 25 bp, Artificial sequence
  SiRNA target sequence
ctttctcggtctattattgtttgta

SEQ ID NO: 45956 - DNA, 25 bp, Artificial sequence
  SiRNA target sequence
tttctcggtctattattgtttgtat

SEQ ID NO: 45957 - DNA, 25 bp, Artificial sequence
  SiRNA target sequence
ttctcggtctattattgtttgtatt

SEQ ID NO: 45958 - DNA, 25 bp, Artificial sequence
  SiRNA target sequence
tctcggtctattattgtttgtattt

SEQ ID NO: 45959 - DNA, 25 bp, Artificial sequence
  SiRNA target sequence
ctcggtctattattgtttgtatttc

SEQ ID NO: 45960 - DNA, 25 bp, Artificial sequence
  SiRNA target sequence
tcggtctattattgtttgtatttca

SEQ ID NO: 45961 - DNA, 25 bp, Artificial sequence
  SiRNA target sequence
cggtctattattgtttgtatttcac

SEQ ID NO: 45962 - DNA, 25 bp, Artificial sequence
  SiRNA target sequence
ggtctattattgtttgtatttcacc

SEQ ID NO: 45963 - DNA, 25 bp, Artificial sequence
  SiRNA target sequence
gtctattattgtttgtatttcaccg

SEQ ID NO: 45964 - DNA, 25 bp, Artificial sequence
  SiRNA target sequence
tctattattgtttgtatttcaccgc

SEQ ID NO: 45965 - DNA, 25 bp, Artificial sequence
  SiRNA target sequence
ctattattgtttgtatttcaccgca

SEQ ID NO: 45966 - DNA, 25 bp, Artificial sequence
  SiRNA target sequence
tattattgtttgtatttcaccgcat

SEQ ID NO: 45967 - DNA, 25 bp, Artificial sequence
  SiRNA target sequence
attattgtttgtatttcaccgcatc

SEQ ID NO: 45968 - DNA, 25 bp, Artificial sequence
  SiRNA target sequence
ttattgtttgtatttcaccgcatcc

SEQ ID NO: 45969 - DNA, 25 bp, Artificial sequence
  SiRNA target sequence
tattgtttgtatttcaccgcatcct

SEQ ID NO: 45970 - DNA, 25 bp, Artificial sequence
  SiRNA target sequence
attgtttgtatttcaccgcatccta

SEQ ID NO: 45971 - DNA, 25 bp, Artificial sequence
  SiRNA target sequence
ttgtttgtatttcaccgcatcctat

SEQ ID NO: 45972 - DNA, 25 bp, Artificial sequence
  SiRNA target sequence
tgtttgtatttcaccgcatcctatt

SEQ ID NO: 45973 - DNA, 25 bp, Artificial sequence
  SiRNA target sequence
gtttgtatttcaccgcatcctattt

SEQ ID NO: 45974 - DNA, 25 bp, Artificial sequence
  SiRNA target sequence
tttgtatttcaccgcatcctatttt

SEQ ID NO: 45975 - DNA, 25 bp, Artificial sequence
  SiRNA target sequence
ttgtatttcaccgcatcctatttta

SEQ ID NO: 45976 - DNA, 25 bp, Artificial sequence
  SiRNA target sequence
tgtatttcaccgcatcctattttat

SEQ ID NO: 45977 - DNA, 25 bp, Artificial sequence
  SiRNA target sequence
gtatttcaccgcatcctattttatt

SEQ ID NO: 45978 - DNA, 25 bp, Artificial sequence
  SiRNA target sequence
tatttcaccgcatcctattttattg

SEQ ID NO: 45979 - DNA, 25 bp, Artificial sequence
  SiRNA target sequence
atttcaccgcatcctattttattgt

SEQ ID NO: 45980 - DNA, 25 bp, Artificial sequence
  SiRNA target sequence
tttcaccgcatcctattttattgta

SEQ ID NO: 45981 - DNA, 25 bp, Artificial sequence
  SiRNA target sequence
ttcaccgcatcctattttattgtat

SEQ ID NO: 45982 - DNA, 25 bp, Artificial sequence
  SiRNA target sequence
tcaccgcatcctattttattgtatc

SEQ ID NO: 45983 - DNA, 25 bp, Artificial sequence
  SiRNA target sequence
caccgcatcctattttattgtatct

SEQ ID NO: 45984 - DNA, 25 bp, Artificial sequence
  SiRNA target sequence
accgcatcctattttattgtatcta

SEQ ID NO: 45985 - DNA, 25 bp, Artificial sequence
  SiRNA target sequence
ccgcatcctattttattgtatctac

SEQ ID NO: 45986 - DNA, 25 bp, Artificial sequence
  SiRNA target sequence
cgcatcctattttattgtatctact

SEQ ID NO: 45987 - DNA, 25 bp, Artificial sequence
  SiRNA target sequence
gcatcctattttattgtatctacta

SEQ ID NO: 45988 - DNA, 25 bp, Artificial sequence
  SiRNA target sequence
catcctattttattgtatctactaa

SEQ ID NO: 45989 - DNA, 25 bp, Artificial sequence
  SiRNA target sequence
atcctattttattgtatctactaag

SEQ ID NO: 45990 - DNA, 25 bp, Artificial sequence
  SiRNA target sequence
tcctattttattgtatctactaagt

SEQ ID NO: 45991 - DNA, 25 bp, Artificial sequence
  SiRNA target sequence
cctattttattgtatctactaagtt

SEQ ID NO: 45992 - DNA, 25 bp, Artificial sequence
  SiRNA target sequence
ctattttattgtatctactaagttc

SEQ ID NO: 45993 - DNA, 25 bp, Artificial sequence
  SiRNA target sequence
tattttattgtatctactaagttcc

SEQ ID NO: 45994 - DNA, 25 bp, Artificial sequence
  SiRNA target sequence
attttattgtatctactaagttcca

SEQ ID NO: 45995 - DNA, 25 bp, Artificial sequence
  SiRNA target sequence
ttttattgtatctactaagttccat

SEQ ID NO: 45996 - DNA, 25 bp, Artificial sequence
  SiRNA target sequence
tttattgtatctactaagttccata

SEQ ID NO: 45997 - DNA, 25 bp, Artificial sequence
  SiRNA target sequence
ttattgtatctactaagttccatat

SEQ ID NO: 45998 - DNA, 25 bp, Artificial sequence
  SiRNA target sequence
tattgtatctactaagttccatatt

SEQ ID NO: 45999 - DNA, 25 bp, Artificial sequence
  SiRNA target sequence
attgtatctactaagttccatattt

SEQ ID NO: 46000 - DNA, 25 bp, Artificial sequence
  SiRNA target sequence
ttgtatctactaagttccatattta

SEQ ID NO: 46001 - DNA, 25 bp, Artificial sequence
  SiRNA target sequence
tgtatctactaagttccatatttat

SEQ ID NO: 46002 - DNA, 25 bp, Artificial sequence
  SiRNA target sequence
gtatctactaagttccatatttata

SEQ ID NO: 46003 - DNA, 25 bp, Artificial sequence
  SiRNA target sequence
tatctactaagttccatatttataa

SEQ ID NO: 46004 - DNA, 25 bp, Artificial sequence
  SiRNA target sequence
atctactaagttccatatttataaa

SEQ ID NO: 46005 - DNA, 25 bp, Artificial sequence
  SiRNA target sequence
tctactaagttccatatttataaaa

SEQ ID NO: 46006 - DNA, 25 bp, Artificial sequence
  SiRNA target sequence
ctactaagttccatatttataaaat

SEQ ID NO: 46007 - DNA, 25 bp, Artificial sequence
  SiRNA target sequence
tactaagttccatatttataaaatt

SEQ ID NO: 46008 - DNA, 25 bp, Artificial sequence
  SiRNA target sequence
actaagttccatatttataaaattt

SEQ ID NO: 46009 - DNA, 25 bp, Artificial sequence
  SiRNA target sequence
ctaagttccatatttataaaatttt

SEQ ID NO: 46010 - DNA, 25 bp, Artificial sequence
  SiRNA target sequence
taagttccatatttataaaattttt

SEQ ID NO: 46011 - DNA, 25 bp, Artificial sequence
  SiRNA target sequence
aagttccatatttataaaattttta

SEQ ID NO: 46012 - DNA, 25 bp, Artificial sequence
  SiRNA target sequence
agttccatatttataaaatttttaa

SEQ ID NO: 46013 - DNA, 25 bp, Artificial sequence
  SiRNA target sequence
gttccatatttataaaatttttaaa

SEQ ID NO: 46014 - DNA, 25 bp, Artificial sequence
  SiRNA target sequence
ttccatatttataaaatttttaaat

SEQ ID NO: 46015 - DNA, 25 bp, Artificial sequence
  SiRNA target sequence
tccatatttataaaatttttaaatg

SEQ ID NO: 46016 - DNA, 25 bp, Artificial sequence
  SiRNA target sequence
ccatatttataaaatttttaaatga

SEQ ID NO: 46017 - DNA, 25 bp, Artificial sequence
  SiRNA target sequence
catatttataaaatttttaaatgaa

SEQ ID NO: 46018 - DNA, 25 bp, Artificial sequence
  SiRNA target sequence
atatttataaaatttttaaatgaat

SEQ ID NO: 46019 - DNA, 25 bp, Artificial sequence
  SiRNA target sequence
tatttataaaatttttaaatgaatt

SEQ ID NO: 46020 - DNA, 25 bp, Artificial sequence
  SiRNA target sequence
atttataaaatttttaaatgaattt

SEQ ID NO: 46021 - DNA, 25 bp, Artificial sequence
  SiRNA target sequence
tttataaaatttttaaatgaatttt

SEQ ID NO: 46022 - DNA, 25 bp, Artificial sequence
  SiRNA target sequence
ttataaaatttttaaatgaattttt

SEQ ID NO: 46023 - DNA, 25 bp, Artificial sequence
  SiRNA target sequence
tataaaatttttaaatgaatttttt

SEQ ID NO: 46024 - DNA, 25 bp, Artificial sequence
  SiRNA target sequence
ataaaatttttaaatgaattttttc

SEQ ID NO: 46025 - DNA, 25 bp, Artificial sequence
  SiRNA target sequence
taaaatttttaaatgaattttttcc

SEQ ID NO: 46026 - DNA, 25 bp, Artificial sequence
  SiRNA target sequence
aaaatttttaaatgaattttttcct

SEQ ID NO: 46027 - DNA, 25 bp, Artificial sequence
  SiRNA target sequence
aaatttttaaatgaattttttcctg

SEQ ID NO: 46028 - DNA, 25 bp, Artificial sequence
  SiRNA target sequence
aatttttaaatgaattttttcctgt

SEQ ID NO: 46029 - DNA, 25 bp, Artificial sequence
  SiRNA target sequence
atttttaaatgaattttttcctgtc

SEQ ID NO: 46030 - DNA, 25 bp, Artificial sequence
  SiRNA target sequence
tttttaaatgaattttttcctgtca

SEQ ID NO: 46031 - DNA, 25 bp, Artificial sequence
  SiRNA target sequence
ttttaaatgaattttttcctgtcag

SEQ ID NO: 46032 - DNA, 25 bp, Artificial sequence
  SiRNA target sequence
tttaaatgaattttttcctgtcagt

SEQ ID NO: 46033 - DNA, 25 bp, Artificial sequence
  SiRNA target sequence
ttaaatgaattttttcctgtcagtc

SEQ ID NO: 46034 - DNA, 25 bp, Artificial sequence
  SiRNA target sequence
taaatgaattttttcctgtcagtct

SEQ ID NO: 46035 - DNA, 25 bp, Artificial sequence
  SiRNA target sequence
aaatgaattttttcctgtcagtctg

SEQ ID NO: 46036 - DNA, 25 bp, Artificial sequence
  SiRNA target sequence
aatgaattttttcctgtcagtctga

SEQ ID NO: 46037 - DNA, 25 bp, Artificial sequence
  SiRNA target sequence
atgaattttttcctgtcagtctgaa

SEQ ID NO: 46038 - DNA, 25 bp, Artificial sequence
  SiRNA target sequence
tgaattttttcctgtcagtctgaat

SEQ ID NO: 46039 - DNA, 25 bp, Artificial sequence
  SiRNA target sequence
gaattttttcctgtcagtctgaata

SEQ ID NO: 46040 - DNA, 25 bp, Artificial sequence
  SiRNA target sequence
aattttttcctgtcagtctgaatac

SEQ ID NO: 46041 - DNA, 25 bp, Artificial sequence
  SiRNA target sequence
attttttcctgtcagtctgaataca

SEQ ID NO: 46042 - DNA, 25 bp, Artificial sequence
  SiRNA target sequence
ttttttcctgtcagtctgaatacat

SEQ ID NO: 46043 - DNA, 25 bp, Artificial sequence
  SiRNA target sequence
tttttcctgtcagtctgaatacatg

SEQ ID NO: 46044 - DNA, 25 bp, Artificial sequence
  SiRNA target sequence
ttttcctgtcagtctgaatacatgt

SEQ ID NO: 46045 - DNA, 25 bp, Artificial sequence
  SiRNA target sequence
tttcctgtcagtctgaatacatgtt

SEQ ID NO: 46046 - DNA, 25 bp, Artificial sequence
  SiRNA target sequence
ttcctgtcagtctgaatacatgttg

SEQ ID NO: 46047 - DNA, 25 bp, Artificial sequence
  SiRNA target sequence
tcctgtcagtctgaatacatgttga

SEQ ID NO: 46048 - DNA, 25 bp, Artificial sequence
  SiRNA target sequence
cctgtcagtctgaatacatgttgaa

SEQ ID NO: 46049 - DNA, 25 bp, Artificial sequence
  SiRNA target sequence
ctgtcagtctgaatacatgttgaac

SEQ ID NO: 46050 - DNA, 25 bp, Artificial sequence
  SiRNA target sequence
tgtcagtctgaatacatgttgaacg

SEQ ID NO: 46051 - DNA, 25 bp, Artificial sequence
  SiRNA target sequence
gtcagtctgaatacatgttgaacgg

SEQ ID NO: 46052 - DNA, 25 bp, Artificial sequence
  SiRNA target sequence
tcagtctgaatacatgttgaacggg

SEQ ID NO: 46053 - DNA, 25 bp, Artificial sequence
  SiRNA target sequence
cagtctgaatacatgttgaacgggt

SEQ ID NO: 46054 - DNA, 25 bp, Artificial sequence
  SiRNA target sequence
agtctgaatacatgttgaacgggtg

SEQ ID NO: 46055 - DNA, 25 bp, Artificial sequence
  SiRNA target sequence
gtctgaatacatgttgaacgggtgt

SEQ ID NO: 46056 - DNA, 25 bp, Artificial sequence
  SiRNA target sequence
tctgaatacatgttgaacgggtgta

SEQ ID NO: 46057 - DNA, 25 bp, Artificial sequence
  SiRNA target sequence
ctgaatacatgttgaacgggtgtaa

SEQ ID NO: 46058 - DNA, 25 bp, Artificial sequence
  SiRNA target sequence
tgaatacatgttgaacgggtgtaac

SEQ ID NO: 46059 - DNA, 25 bp, Artificial sequence
  SiRNA target sequence
gaatacatgttgaacgggtgtaaca

SEQ ID NO: 46060 - DNA, 25 bp, Artificial sequence
  SiRNA target sequence
aatacatgttgaacgggtgtaacaa

SEQ ID NO: 46061 - DNA, 25 bp, Artificial sequence
  SiRNA target sequence
atacatgttgaacgggtgtaacaaa

SEQ ID NO: 46062 - DNA, 25 bp, Artificial sequence
  SiRNA target sequence
tacatgttgaacgggtgtaacaaat

SEQ ID NO: 46063 - DNA, 25 bp, Artificial sequence
  SiRNA target sequence
acatgttgaacgggtgtaacaaata

SEQ ID NO: 46064 - DNA, 25 bp, Artificial sequence
  SiRNA target sequence
catgttgaacgggtgtaacaaatat

SEQ ID NO: 46065 - DNA, 25 bp, Artificial sequence
  SiRNA target sequence
atgttgaacgggtgtaacaaatata

SEQ ID NO: 46066 - DNA, 25 bp, Artificial sequence
  SiRNA target sequence
tgttgaacgggtgtaacaaatataa

SEQ ID NO: 46067 - DNA, 25 bp, Artificial sequence
  SiRNA target sequence
gttgaacgggtgtaacaaatataaa

SEQ ID NO: 46068 - DNA, 25 bp, Artificial sequence
  SiRNA target sequence
ttgaacgggtgtaacaaatataaaa

SEQ ID NO: 46069 - DNA, 25 bp, Artificial sequence
  SiRNA target sequence
tgaacgggtgtaacaaatataaaat

SEQ ID NO: 46070 - DNA, 25 bp, Artificial sequence
  SiRNA target sequence
gaacgggtgtaacaaatataaaatt

SEQ ID NO: 46071 - DNA, 25 bp, Artificial sequence
  SiRNA target sequence
aacgggtgtaacaaatataaaattg

SEQ ID NO: 46072 - DNA, 25 bp, Artificial sequence
  SiRNA target sequence
acgggtgtaacaaatataaaattgt

SEQ ID NO: 46073 - DNA, 25 bp, Artificial sequence
  SiRNA target sequence
cgggtgtaacaaatataaaattgtt

SEQ ID NO: 46074 - DNA, 25 bp, Artificial sequence
  SiRNA target sequence
gggtgtaacaaatataaaattgtta

SEQ ID NO: 46075 - DNA, 25 bp, Artificial sequence
  SiRNA target sequence
ggtgtaacaaatataaaattgttaa

SEQ ID NO: 46076 - DNA, 25 bp, Artificial sequence
  SiRNA target sequence
gtgtaacaaatataaaattgttaag

SEQ ID NO: 46077 - DNA, 25 bp, Artificial sequence
  SiRNA target sequence
tgtaacaaatataaaattgttaagt

SEQ ID NO: 46078 - DNA, 25 bp, Artificial sequence
  SiRNA target sequence
gtaacaaatataaaattgttaagtt

SEQ ID NO: 46079 - DNA, 25 bp, Artificial sequence
  SiRNA target sequence
taacaaatataaaattgttaagttc

SEQ ID NO: 46080 - DNA, 25 bp, Artificial sequence
  SiRNA target sequence
aacaaatataaaattgttaagttct

SEQ ID NO: 46081 - DNA, 25 bp, Artificial sequence
  SiRNA target sequence
acaaatataaaattgttaagttctg

SEQ ID NO: 46082 - DNA, 25 bp, Artificial sequence
  SiRNA target sequence
caaatataaaattgttaagttctga

SEQ ID NO: 46083 - DNA, 25 bp, Artificial sequence
  SiRNA target sequence
aaatataaaattgttaagttctgac

SEQ ID NO: 46084 - DNA, 25 bp, Artificial sequence
  SiRNA target sequence
aatataaaattgttaagttctgaca

SEQ ID NO: 46085 - DNA, 25 bp, Artificial sequence
  SiRNA target sequence
atataaaattgttaagttctgacat

SEQ ID NO: 46086 - DNA, 25 bp, Artificial sequence
  SiRNA target sequence
tataaaattgttaagttctgacatt

SEQ ID NO: 46087 - DNA, 25 bp, Artificial sequence
  SiRNA target sequence
ataaaattgttaagttctgacattg

SEQ ID NO: 46088 - DNA, 25 bp, Artificial sequence
  SiRNA target sequence
taaaattgttaagttctgacattgt

SEQ ID NO: 46089 - DNA, 25 bp, Artificial sequence
  SiRNA target sequence
aaaattgttaagttctgacattgta

SEQ ID NO: 46090 - DNA, 25 bp, Artificial sequence
  SiRNA target sequence
aaattgttaagttctgacattgtaa

SEQ ID NO: 46091 - DNA, 25 bp, Artificial sequence
  SiRNA target sequence
aattgttaagttctgacattgtaat

SEQ ID NO: 46092 - DNA, 25 bp, Artificial sequence
  SiRNA target sequence
attgttaagttctgacattgtaatt

SEQ ID NO: 46093 - DNA, 25 bp, Artificial sequence
  SiRNA target sequence
ttgttaagttctgacattgtaattg

SEQ ID NO: 46094 - DNA, 25 bp, Artificial sequence
  SiRNA target sequence
tgttaagttctgacattgtaattga

SEQ ID NO: 46095 - DNA, 25 bp, Artificial sequence
  SiRNA target sequence
gttaagttctgacattgtaattgat

SEQ ID NO: 46096 - DNA, 25 bp, Artificial sequence
  SiRNA target sequence
ttaagttctgacattgtaattgata

SEQ ID NO: 46097 - DNA, 25 bp, Artificial sequence
  SiRNA target sequence
taagttctgacattgtaattgatac

SEQ ID NO: 46098 - DNA, 25 bp, Artificial sequence
  SiRNA target sequence
aagttctgacattgtaattgataca

SEQ ID NO: 46099 - DNA, 25 bp, Artificial sequence
  SiRNA target sequence
agttctgacattgtaattgatacaa

SEQ ID NO: 46100 - DNA, 25 bp, Artificial sequence
  SiRNA target sequence
gttctgacattgtaattgatacaat

SEQ ID NO: 46101 - DNA, 25 bp, Artificial sequence
  SiRNA target sequence
ttctgacattgtaattgatacaatt

SEQ ID NO: 46102 - DNA, 25 bp, Artificial sequence
  SiRNA target sequence
tctgacattgtaattgatacaattg

SEQ ID NO: 46103 - DNA, 25 bp, Artificial sequence
  SiRNA target sequence
ctgacattgtaattgatacaattgt

SEQ ID NO: 46104 - DNA, 25 bp, Artificial sequence
  SiRNA target sequence
tgacattgtaattgatacaattgtc

SEQ ID NO: 46105 - DNA, 25 bp, Artificial sequence
  SiRNA target sequence
gacattgtaattgatacaattgtca

SEQ ID NO: 46106 - DNA, 25 bp, Artificial sequence
  SiRNA target sequence
acattgtaattgatacaattgtcaa

SEQ ID NO: 46107 - DNA, 25 bp, Artificial sequence
  SiRNA target sequence
cattgtaattgatacaattgtcaaa

SEQ ID NO: 46108 - DNA, 25 bp, Artificial sequence
  SiRNA target sequence
attgtaattgatacaattgtcaaaa

SEQ ID NO: 46109 - DNA, 25 bp, Artificial sequence
  SiRNA target sequence
ttgtaattgatacaattgtcaaaac

SEQ ID NO: 46110 - DNA, 25 bp, Artificial sequence
  SiRNA target sequence
tgtaattgatacaattgtcaaaact

SEQ ID NO: 46111 - DNA, 25 bp, Artificial sequence
  SiRNA target sequence
gtaattgatacaattgtcaaaactg

SEQ ID NO: 46112 - DNA, 25 bp, Artificial sequence
  SiRNA target sequence
taattgatacaattgtcaaaactgc

SEQ ID NO: 46113 - DNA, 25 bp, Artificial sequence
  SiRNA target sequence
aattgatacaattgtcaaaactgca

SEQ ID NO: 46114 - DNA, 25 bp, Artificial sequence
  SiRNA target sequence
attgatacaattgtcaaaactgcaa

SEQ ID NO: 46115 - DNA, 25 bp, Artificial sequence
  SiRNA target sequence
ttgatacaattgtcaaaactgcaaa

SEQ ID NO: 46116 - DNA, 25 bp, Artificial sequence
  SiRNA target sequence
tgatacaattgtcaaaactgcaaaa

SEQ ID NO: 46117 - DNA, 25 bp, Artificial sequence
  SiRNA target sequence
gatacaattgtcaaaactgcaaaat

SEQ ID NO: 46118 - DNA, 25 bp, Artificial sequence
  SiRNA target sequence
atacaattgtcaaaactgcaaaata

SEQ ID NO: 46119 - DNA, 25 bp, Artificial sequence
  SiRNA target sequence
tacaattgtcaaaactgcaaaatac

SEQ ID NO: 46120 - DNA, 25 bp, Artificial sequence
  SiRNA target sequence
acaattgtcaaaactgcaaaataca

SEQ ID NO: 46121 - DNA, 25 bp, Artificial sequence
  SiRNA target sequence
caattgtcaaaactgcaaaatacaa

SEQ ID NO: 46122 - DNA, 25 bp, Artificial sequence
  SiRNA target sequence
aattgtcaaaactgcaaaatacaaa

SEQ ID NO: 46123 - DNA, 25 bp, Artificial sequence
  SiRNA target sequence
attgtcaaaactgcaaaatacaaaa

SEQ ID NO: 46124 - DNA, 25 bp, Artificial sequence
  SiRNA target sequence
ttgtcaaaactgcaaaatacaaaag

SEQ ID NO: 46125 - DNA, 25 bp, Artificial sequence
  SiRNA target sequence
tgtcaaaactgcaaaatacaaaaga

SEQ ID NO: 46126 - DNA, 25 bp, Artificial sequence
  SiRNA target sequence
gtcaaaactgcaaaatacaaaagac

SEQ ID NO: 46127 - DNA, 25 bp, Artificial sequence
  SiRNA target sequence
tcaaaactgcaaaatacaaaagact

SEQ ID NO: 46128 - DNA, 25 bp, Artificial sequence
  SiRNA target sequence
caaaactgcaaaatacaaaagactt

SEQ ID NO: 46129 - DNA, 25 bp, Artificial sequence
  SiRNA target sequence
aaaactgcaaaatacaaaagacttt

SEQ ID NO: 46130 - DNA, 25 bp, Artificial sequence
  SiRNA target sequence
aaactgcaaaatacaaaagactttg

SEQ ID NO: 46131 - DNA, 25 bp, Artificial sequence
  SiRNA target sequence
aactgcaaaatacaaaagactttga

SEQ ID NO: 46132 - DNA, 25 bp, Artificial sequence
  SiRNA target sequence
actgcaaaatacaaaagactttgac

SEQ ID NO: 46133 - DNA, 25 bp, Artificial sequence
  SiRNA target sequence
ctgcaaaatacaaaagactttgact

SEQ ID NO: 46134 - DNA, 25 bp, Artificial sequence
  SiRNA target sequence
tgcaaaatacaaaagactttgacta

SEQ ID NO: 46135 - DNA, 25 bp, Artificial sequence
  SiRNA target sequence
gcaaaatacaaaagactttgactaa

SEQ ID NO: 46136 - DNA, 25 bp, Artificial sequence
  SiRNA target sequence
caaaatacaaaagactttgactaag

SEQ ID NO: 46137 - DNA, 25 bp, Artificial sequence
  SiRNA target sequence
aaaatacaaaagactttgactaaga

SEQ ID NO: 46138 - DNA, 25 bp, Artificial sequence
  SiRNA target sequence
aaatacaaaagactttgactaagat

SEQ ID NO: 46139 - DNA, 25 bp, Artificial sequence
  SiRNA target sequence
aatacaaaagactttgactaagatc

SEQ ID NO: 46140 - DNA, 25 bp, Artificial sequence
  SiRNA target sequence
atacaaaagactttgactaagatct

SEQ ID NO: 46141 - DNA, 25 bp, Artificial sequence
  SiRNA target sequence
tacaaaagactttgactaagatctt

SEQ ID NO: 46142 - DNA, 25 bp, Artificial sequence
  SiRNA target sequence
acaaaagactttgactaagatcttt

SEQ ID NO: 46143 - DNA, 25 bp, Artificial sequence
  SiRNA target sequence
caaaagactttgactaagatcttta

SEQ ID NO: 46144 - DNA, 25 bp, Artificial sequence
  SiRNA target sequence
aaaagactttgactaagatctttat

SEQ ID NO: 46145 - DNA, 25 bp, Artificial sequence
  SiRNA target sequence
aaagactttgactaagatctttatt

SEQ ID NO: 46146 - DNA, 25 bp, Artificial sequence
  SiRNA target sequence
aagactttgactaagatctttatta

SEQ ID NO: 46147 - DNA, 25 bp, Artificial sequence
  SiRNA target sequence
agactttgactaagatctttattat

SEQ ID NO: 46148 - DNA, 25 bp, Artificial sequence
  SiRNA target sequence
gactttgactaagatctttattatc

SEQ ID NO: 46149 - DNA, 25 bp, Artificial sequence
  SiRNA target sequence
actttgactaagatctttattatct

SEQ ID NO: 46150 - DNA, 25 bp, Artificial sequence
  SiRNA target sequence
ctttgactaagatctttattatctg

SEQ ID NO: 46151 - DNA, 25 bp, Artificial sequence
  SiRNA target sequence
tttgactaagatctttattatctgt

SEQ ID NO: 46152 - DNA, 25 bp, Artificial sequence
  SiRNA target sequence
ttgactaagatctttattatctgta

SEQ ID NO: 46153 - DNA, 25 bp, Artificial sequence
  SiRNA target sequence
tgactaagatctttattatctgtaa

SEQ ID NO: 46154 - DNA, 25 bp, Artificial sequence
  SiRNA target sequence
gactaagatctttattatctgtaat

SEQ ID NO: 46155 - DNA, 25 bp, Artificial sequence
  SiRNA target sequence
actaagatctttattatctgtaata

SEQ ID NO: 46156 - DNA, 25 bp, Artificial sequence
  SiRNA target sequence
ctaagatctttattatctgtaatat

SEQ ID NO: 46157 - DNA, 25 bp, Artificial sequence
  SiRNA target sequence
taagatctttattatctgtaatatc

SEQ ID NO: 46158 - DNA, 25 bp, Artificial sequence
  SiRNA target sequence
aagatctttattatctgtaatatca

SEQ ID NO: 46159 - DNA, 25 bp, Artificial sequence
  SiRNA target sequence
agatctttattatctgtaatatcac

SEQ ID NO: 46160 - DNA, 25 bp, Artificial sequence
  SiRNA target sequence
gatctttattatctgtaatatcact

SEQ ID NO: 46161 - DNA, 25 bp, Artificial sequence
  SiRNA target sequence
atctttattatctgtaatatcacta

SEQ ID NO: 46162 - DNA, 25 bp, Artificial sequence
  SiRNA target sequence
tctttattatctgtaatatcactag

SEQ ID NO: 46163 - DNA, 25 bp, Artificial sequence
  SiRNA target sequence
ctttattatctgtaatatcactagt

SEQ ID NO: 46164 - DNA, 25 bp, Artificial sequence
  SiRNA target sequence
tttattatctgtaatatcactagtc

SEQ ID NO: 46165 - DNA, 25 bp, Artificial sequence
  SiRNA target sequence
ttattatctgtaatatcactagtca

SEQ ID NO: 46166 - DNA, 25 bp, Artificial sequence
  SiRNA target sequence
tattatctgtaatatcactagtcaa

SEQ ID NO: 46167 - DNA, 25 bp, Artificial sequence
  SiRNA target sequence
attatctgtaatatcactagtcaat

SEQ ID NO: 46168 - DNA, 25 bp, Artificial sequence
  SiRNA target sequence
ttatctgtaatatcactagtcaatt

SEQ ID NO: 46169 - DNA, 25 bp, Artificial sequence
  SiRNA target sequence
tatctgtaatatcactagtcaattt

SEQ ID NO: 46170 - DNA, 25 bp, Artificial sequence
  SiRNA target sequence
atctgtaatatcactagtcaatttc

SEQ ID NO: 46171 - DNA, 25 bp, Artificial sequence
  SiRNA target sequence
tctgtaatatcactagtcaatttcc

SEQ ID NO: 46172 - DNA, 25 bp, Artificial sequence
  SiRNA target sequence
ctgtaatatcactagtcaatttccg

SEQ ID NO: 46173 - DNA, 25 bp, Artificial sequence
  SiRNA target sequence
tgtaatatcactagtcaatttccgg

SEQ ID NO: 46174 - DNA, 25 bp, Artificial sequence
  SiRNA target sequence
gtaatatcactagtcaatttccggg

SEQ ID NO: 46175 - DNA, 25 bp, Artificial sequence
  SiRNA target sequence
taatatcactagtcaatttccgggt

SEQ ID NO: 46176 - DNA, 25 bp, Artificial sequence
  SiRNA target sequence
aatatcactagtcaatttccgggta

SEQ ID NO: 46177 - DNA, 25 bp, Artificial sequence
  SiRNA target sequence
atatcactagtcaatttccgggtag

SEQ ID NO: 46178 - DNA, 25 bp, Artificial sequence
  SiRNA target sequence
tatcactagtcaatttccgggtagc

SEQ ID NO: 46179 - DNA, 25 bp, Artificial sequence
  SiRNA target sequence
atcactagtcaatttccgggtagct

SEQ ID NO: 46180 - DNA, 25 bp, Artificial sequence
  SiRNA target sequence
tcactagtcaatttccgggtagctt

SEQ ID NO: 46181 - DNA, 25 bp, Artificial sequence
  SiRNA target sequence
cactagtcaatttccgggtagcttc

SEQ ID NO: 46182 - DNA, 25 bp, Artificial sequence
  SiRNA target sequence
actagtcaatttccgggtagcttca

SEQ ID NO: 46183 - DNA, 25 bp, Artificial sequence
  SiRNA target sequence
ctagtcaatttccgggtagcttcaa

SEQ ID NO: 46184 - DNA, 25 bp, Artificial sequence
  SiRNA target sequence
tagtcaatttccgggtagcttcaac

SEQ ID NO: 46185 - DNA, 25 bp, Artificial sequence
  SiRNA target sequence
agtcaatttccgggtagcttcaact

SEQ ID NO: 46186 - DNA, 25 bp, Artificial sequence
  SiRNA target sequence
gtcaatttccgggtagcttcaactg

SEQ ID NO: 46187 - DNA, 25 bp, Artificial sequence
  SiRNA target sequence
tcaatttccgggtagcttcaactgt

SEQ ID NO: 46188 - DNA, 25 bp, Artificial sequence
  SiRNA target sequence
caatttccgggtagcttcaactgtt

SEQ ID NO: 46189 - DNA, 25 bp, Artificial sequence
  SiRNA target sequence
aatttccgggtagcttcaactgtta

SEQ ID NO: 46190 - DNA, 25 bp, Artificial sequence
  SiRNA target sequence
atttccgggtagcttcaactgttaa

SEQ ID NO: 46191 - DNA, 25 bp, Artificial sequence
  SiRNA target sequence
tttccgggtagcttcaactgttaaa

SEQ ID NO: 46192 - DNA, 25 bp, Artificial sequence
  SiRNA target sequence
ttccgggtagcttcaactgttaaaa

SEQ ID NO: 46193 - DNA, 25 bp, Artificial sequence
  SiRNA target sequence
tccgggtagcttcaactgttaaaac

SEQ ID NO: 46194 - DNA, 25 bp, Artificial sequence
  SiRNA target sequence
ccgggtagcttcaactgttaaaaca

SEQ ID NO: 46195 - DNA, 25 bp, Artificial sequence
  SiRNA target sequence
cgggtagcttcaactgttaaaacat

SEQ ID NO: 46196 - DNA, 25 bp, Artificial sequence
  SiRNA target sequence
gggtagcttcaactgttaaaacatt

SEQ ID NO: 46197 - DNA, 25 bp, Artificial sequence
  SiRNA target sequence
ggtagcttcaactgttaaaacatta

SEQ ID NO: 46198 - DNA, 25 bp, Artificial sequence
  SiRNA target sequence
gtagcttcaactgttaaaacattaa

SEQ ID NO: 46199 - DNA, 25 bp, Artificial sequence
  SiRNA target sequence
tagcttcaactgttaaaacattaaa

SEQ ID NO: 46200 - DNA, 25 bp, Artificial sequence
  SiRNA target sequence
agcttcaactgttaaaacattaaat

SEQ ID NO: 46201 - DNA, 25 bp, Artificial sequence
  SiRNA target sequence
gcttcaactgttaaaacattaaatg

SEQ ID NO: 46202 - DNA, 25 bp, Artificial sequence
  SiRNA target sequence
cttcaactgttaaaacattaaatgt

SEQ ID NO: 46203 - DNA, 25 bp, Artificial sequence
  SiRNA target sequence
ttcaactgttaaaacattaaatgta

SEQ ID NO: 46204 - DNA, 25 bp, Artificial sequence
  SiRNA target sequence
tcaactgttaaaacattaaatgtac

SEQ ID NO: 46205 - DNA, 25 bp, Artificial sequence
  SiRNA target sequence
caactgttaaaacattaaatgtaca

SEQ ID NO: 46206 - DNA, 25 bp, Artificial sequence
  SiRNA target sequence
aactgttaaaacattaaatgtacaa

SEQ ID NO: 46207 - DNA, 25 bp, Artificial sequence
  SiRNA target sequence
actgttaaaacattaaatgtacaaa

SEQ ID NO: 46208 - DNA, 25 bp, Artificial sequence
  SiRNA target sequence
ctgttaaaacattaaatgtacaaac

SEQ ID NO: 46209 - DNA, 25 bp, Artificial sequence
  SiRNA target sequence
tgttaaaacattaaatgtacaaact

SEQ ID NO: 46210 - DNA, 25 bp, Artificial sequence
  SiRNA target sequence
gttaaaacattaaatgtacaaactg

SEQ ID NO: 46211 - DNA, 25 bp, Artificial sequence
  SiRNA target sequence
ttaaaacattaaatgtacaaactgc

SEQ ID NO: 46212 - DNA, 25 bp, Artificial sequence
  SiRNA target sequence
taaaacattaaatgtacaaactgca

SEQ ID NO: 46213 - DNA, 25 bp, Artificial sequence
  SiRNA target sequence
aaaacattaaatgtacaaactgcaa

SEQ ID NO: 46214 - DNA, 25 bp, Artificial sequence
  SiRNA target sequence
aaacattaaatgtacaaactgcaaa

SEQ ID NO: 46215 - DNA, 25 bp, Artificial sequence
  SiRNA target sequence
aacattaaatgtacaaactgcaaat

SEQ ID NO: 46216 - DNA, 25 bp, Artificial sequence
  SiRNA target sequence
acattaaatgtacaaactgcaaatg

SEQ ID NO: 46217 - DNA, 25 bp, Artificial sequence
  SiRNA target sequence
cattaaatgtacaaactgcaaatgt

SEQ ID NO: 46218 - DNA, 25 bp, Artificial sequence
  SiRNA target sequence
attaaatgtacaaactgcaaatgtc

SEQ ID NO: 46219 - DNA, 25 bp, Artificial sequence
  SiRNA target sequence
ttaaatgtacaaactgcaaatgtcc

SEQ ID NO: 46220 - DNA, 25 bp, Artificial sequence
  SiRNA target sequence
taaatgtacaaactgcaaatgtccc

SEQ ID NO: 46221 - DNA, 25 bp, Artificial sequence
  SiRNA target sequence
aaatgtacaaactgcaaatgtccca

SEQ ID NO: 46222 - DNA, 25 bp, Artificial sequence
  SiRNA target sequence
aatgtacaaactgcaaatgtcccaa

SEQ ID NO: 46223 - DNA, 25 bp, Artificial sequence
  SiRNA target sequence
atgtacaaactgcaaatgtcccaaa

SEQ ID NO: 46224 - DNA, 25 bp, Artificial sequence
  SiRNA target sequence
tgtacaaactgcaaatgtcccaaaa

SEQ ID NO: 46225 - DNA, 25 bp, Artificial sequence
  SiRNA target sequence
gtacaaactgcaaatgtcccaaaaa

SEQ ID NO: 46226 - DNA, 25 bp, Artificial sequence
  SiRNA target sequence
tacaaactgcaaatgtcccaaaaat

SEQ ID NO: 46227 - DNA, 25 bp, Artificial sequence
  SiRNA target sequence
acaaactgcaaatgtcccaaaaatt

SEQ ID NO: 46228 - DNA, 25 bp, Artificial sequence
  SiRNA target sequence
caaactgcaaatgtcccaaaaatta

SEQ ID NO: 46229 - DNA, 25 bp, Artificial sequence
  SiRNA target sequence
aaactgcaaatgtcccaaaaattat

SEQ ID NO: 46230 - DNA, 25 bp, Artificial sequence
  SiRNA target sequence
aactgcaaatgtcccaaaaattatg

SEQ ID NO: 46231 - DNA, 25 bp, Artificial sequence
  SiRNA target sequence
actgcaaatgtcccaaaaattatgt

SEQ ID NO: 46232 - DNA, 25 bp, Artificial sequence
  SiRNA target sequence
ctgcaaatgtcccaaaaattatgta

SEQ ID NO: 46233 - DNA, 25 bp, Artificial sequence
  SiRNA target sequence
tgcaaatgtcccaaaaattatgtaa

SEQ ID NO: 46234 - DNA, 25 bp, Artificial sequence
  SiRNA target sequence
gcaaatgtcccaaaaattatgtaaa

SEQ ID NO: 46235 - DNA, 25 bp, Artificial sequence
  SiRNA target sequence
caaatgtcccaaaaattatgtaaat

SEQ ID NO: 46236 - DNA, 25 bp, Artificial sequence
  SiRNA target sequence
aaatgtcccaaaaattatgtaaatg

SEQ ID NO: 46237 - DNA, 25 bp, Artificial sequence
  SiRNA target sequence
aatgtcccaaaaattatgtaaatga

SEQ ID NO: 46238 - DNA, 25 bp, Artificial sequence
  SiRNA target sequence
atgtcccaaaaattatgtaaatgac

SEQ ID NO: 46239 - DNA, 25 bp, Artificial sequence
  SiRNA target sequence
tgtcccaaaaattatgtaaatgaca

SEQ ID NO: 46240 - DNA, 25 bp, Artificial sequence
  SiRNA target sequence
gtcccaaaaattatgtaaatgacaa

SEQ ID NO: 46241 - DNA, 25 bp, Artificial sequence
  SiRNA target sequence
tcccaaaaattatgtaaatgacaaa

SEQ ID NO: 46242 - DNA, 25 bp, Artificial sequence
  SiRNA target sequence
cccaaaaattatgtaaatgacaaat

SEQ ID NO: 46243 - DNA, 25 bp, Artificial sequence
  SiRNA target sequence
ccaaaaattatgtaaatgacaaatg

SEQ ID NO: 46244 - DNA, 25 bp, Artificial sequence
  SiRNA target sequence
caaaaattatgtaaatgacaaatgt

SEQ ID NO: 46245 - DNA, 25 bp, Artificial sequence
  SiRNA target sequence
aaaaattatgtaaatgacaaatgtt

SEQ ID NO: 46246 - DNA, 25 bp, Artificial sequence
  SiRNA target sequence
aaaattatgtaaatgacaaatgttc

SEQ ID NO: 46247 - DNA, 25 bp, Artificial sequence
  SiRNA target sequence
aaattatgtaaatgacaaatgttcg

SEQ ID NO: 46248 - DNA, 25 bp, Artificial sequence
  SiRNA target sequence
aattatgtaaatgacaaatgttcga

SEQ ID NO: 46249 - DNA, 25 bp, Artificial sequence
  SiRNA target sequence
attatgtaaatgacaaatgttcgaa

SEQ ID NO: 46250 - DNA, 25 bp, Artificial sequence
  SiRNA target sequence
ttatgtaaatgacaaatgttcgaat

SEQ ID NO: 46251 - DNA, 25 bp, Artificial sequence
  SiRNA target sequence
tatgtaaatgacaaatgttcgaata

SEQ ID NO: 46252 - DNA, 25 bp, Artificial sequence
  SiRNA target sequence
atgtaaatgacaaatgttcgaataa

SEQ ID NO: 46253 - DNA, 25 bp, Artificial sequence
  SiRNA target sequence
tgtaaatgacaaatgttcgaataaa

SEQ ID NO: 46254 - DNA, 25 bp, Artificial sequence
  SiRNA target sequence
gtaaatgacaaatgttcgaataaag

SEQ ID NO: 46255 - DNA, 25 bp, Artificial sequence
  SiRNA target sequence
taaatgacaaatgttcgaataaagg

SEQ ID NO: 46256 - DNA, 25 bp, Artificial sequence
  SiRNA target sequence
aaatgacaaatgttcgaataaaggg

SEQ ID NO: 46257 - DNA, 25 bp, Artificial sequence
  SiRNA target sequence
aatgacaaatgttcgaataaagggc

SEQ ID NO: 46258 - DNA, 25 bp, Artificial sequence
  SiRNA target sequence
atgacaaatgttcgaataaagggct

SEQ ID NO: 46259 - DNA, 25 bp, Artificial sequence
  SiRNA target sequence
tgacaaatgttcgaataaagggctt

SEQ ID NO: 46260 - DNA, 25 bp, Artificial sequence
  SiRNA target sequence
gacaaatgttcgaataaagggcttt

SEQ ID NO: 46261 - DNA, 25 bp, Artificial sequence
  SiRNA target sequence
acaaatgttcgaataaagggctttg

SEQ ID NO: 46262 - DNA, 25 bp, Artificial sequence
  SiRNA target sequence
caaatgttcgaataaagggctttga

SEQ ID NO: 46263 - DNA, 25 bp, Artificial sequence
  SiRNA target sequence
aaatgttcgaataaagggctttgaa

SEQ ID NO: 46264 - DNA, 25 bp, Artificial sequence
  SiRNA target sequence
aatgttcgaataaagggctttgaaa

SEQ ID NO: 46265 - DNA, 25 bp, Artificial sequence
  SiRNA target sequence
atgttcgaataaagggctttgaaat

SEQ ID NO: 46266 - DNA, 25 bp, Artificial sequence
  SiRNA target sequence
tgttcgaataaagggctttgaaata

SEQ ID NO: 46267 - DNA, 25 bp, Artificial sequence
  SiRNA target sequence
gttcgaataaagggctttgaaataa

SEQ ID NO: 46268 - DNA, 25 bp, Artificial sequence
  SiRNA target sequence
ttcgaataaagggctttgaaataac

SEQ ID NO: 46269 - DNA, 25 bp, Artificial sequence
  SiRNA target sequence
tcgaataaagggctttgaaataaca

SEQ ID NO: 46270 - DNA, 25 bp, Artificial sequence
  SiRNA target sequence
cgaataaagggctttgaaataacat

SEQ ID NO: 46271 - DNA, 25 bp, Artificial sequence
  SiRNA target sequence
gaataaagggctttgaaataacata

SEQ ID NO: 46272 - DNA, 25 bp, Artificial sequence
  SiRNA target sequence
aataaagggctttgaaataacatat

SEQ ID NO: 46273 - DNA, 25 bp, Artificial sequence
  SiRNA target sequence
ataaagggctttgaaataacatatt

SEQ ID NO: 46274 - DNA, 25 bp, Artificial sequence
  SiRNA target sequence
taaagggctttgaaataacatattc

SEQ ID NO: 46275 - DNA, 25 bp, Artificial sequence
  SiRNA target sequence
aaagggctttgaaataacatattct

SEQ ID NO: 46276 - DNA, 25 bp, Artificial sequence
  SiRNA target sequence
aagggctttgaaataacatattcta

SEQ ID NO: 46277 - DNA, 25 bp, Artificial sequence
  SiRNA target sequence
agggctttgaaataacatattctac

SEQ ID NO: 46278 - DNA, 25 bp, Artificial sequence
  SiRNA target sequence
gggctttgaaataacatattctaca

SEQ ID NO: 46279 - DNA, 25 bp, Artificial sequence
  SiRNA target sequence
ggctttgaaataacatattctacaa

SEQ ID NO: 46280 - DNA, 25 bp, Artificial sequence
  SiRNA target sequence
gctttgaaataacatattctacaat

SEQ ID NO: 46281 - DNA, 25 bp, Artificial sequence
  SiRNA target sequence
ctttgaaataacatattctacaatc

SEQ ID NO: 46282 - DNA, 25 bp, Artificial sequence
  SiRNA target sequence
tttgaaataacatattctacaatca

SEQ ID NO: 46283 - DNA, 25 bp, Artificial sequence
  SiRNA target sequence
ttgaaataacatattctacaatcag

SEQ ID NO: 46284 - DNA, 25 bp, Artificial sequence
  SiRNA target sequence
tgaaataacatattctacaatcagg

SEQ ID NO: 46285 - DNA, 25 bp, Artificial sequence
  SiRNA target sequence
gaaataacatattctacaatcaggt

SEQ ID NO: 46286 - DNA, 25 bp, Artificial sequence
  SiRNA target sequence
aaataacatattctacaatcaggtc

SEQ ID NO: 46287 - DNA, 25 bp, Artificial sequence
  SiRNA target sequence
aataacatattctacaatcaggtct

SEQ ID NO: 46288 - DNA, 25 bp, Artificial sequence
  SiRNA target sequence
ataacatattctacaatcaggtctt

SEQ ID NO: 46289 - DNA, 25 bp, Artificial sequence
  SiRNA target sequence
taacatattctacaatcaggtcttt

SEQ ID NO: 46290 - DNA, 25 bp, Artificial sequence
  SiRNA target sequence
aacatattctacaatcaggtctttc

SEQ ID NO: 46291 - DNA, 25 bp, Artificial sequence
  SiRNA target sequence
acatattctacaatcaggtctttca

SEQ ID NO: 46292 - DNA, 25 bp, Artificial sequence
  SiRNA target sequence
catattctacaatcaggtctttcat

SEQ ID NO: 46293 - DNA, 25 bp, Artificial sequence
  SiRNA target sequence
atattctacaatcaggtctttcata

SEQ ID NO: 46294 - DNA, 25 bp, Artificial sequence
  SiRNA target sequence
tattctacaatcaggtctttcataa

SEQ ID NO: 46295 - DNA, 25 bp, Artificial sequence
  SiRNA target sequence
attctacaatcaggtctttcataat

SEQ ID NO: 46296 - DNA, 25 bp, Artificial sequence
  SiRNA target sequence
ttctacaatcaggtctttcataata

SEQ ID NO: 46297 - DNA, 25 bp, Artificial sequence
  SiRNA target sequence
tctacaatcaggtctttcataatac

SEQ ID NO: 46298 - DNA, 25 bp, Artificial sequence
  SiRNA target sequence
ctacaatcaggtctttcataatact

SEQ ID NO: 46299 - DNA, 25 bp, Artificial sequence
  SiRNA target sequence
tacaatcaggtctttcataatacta

SEQ ID NO: 46300 - DNA, 25 bp, Artificial sequence
  SiRNA target sequence
acaatcaggtctttcataatactaa

SEQ ID NO: 46301 - DNA, 25 bp, Artificial sequence
  SiRNA target sequence
caatcaggtctttcataatactaat

SEQ ID NO: 46302 - DNA, 25 bp, Artificial sequence
  SiRNA target sequence
aatcaggtctttcataatactaata

SEQ ID NO: 46303 - DNA, 25 bp, Artificial sequence
  SiRNA target sequence
atcaggtctttcataatactaatat

SEQ ID NO: 46304 - DNA, 25 bp, Artificial sequence
  SiRNA target sequence
tcaggtctttcataatactaatatc

SEQ ID NO: 46305 - DNA, 25 bp, Artificial sequence
  SiRNA target sequence
caggtctttcataatactaatatca

SEQ ID NO: 46306 - DNA, 25 bp, Artificial sequence
  SiRNA target sequence
aggtctttcataatactaatatcac

SEQ ID NO: 46307 - DNA, 25 bp, Artificial sequence
  SiRNA target sequence
ggtctttcataatactaatatcact

SEQ ID NO: 46308 - DNA, 25 bp, Artificial sequence
  SiRNA target sequence
gtctttcataatactaatatcacta

SEQ ID NO: 46309 - DNA, 25 bp, Artificial sequence
  SiRNA target sequence
tctttcataatactaatatcactac

SEQ ID NO: 46310 - DNA, 25 bp, Artificial sequence
  SiRNA target sequence
ctttcataatactaatatcactacc

SEQ ID NO: 46311 - DNA, 25 bp, Artificial sequence
  SiRNA target sequence
tttcataatactaatatcactacca

SEQ ID NO: 46312 - DNA, 25 bp, Artificial sequence
  SiRNA target sequence
ttcataatactaatatcactaccat

SEQ ID NO: 46313 - DNA, 25 bp, Artificial sequence
  SiRNA target sequence
tcataatactaatatcactaccata

SEQ ID NO: 46314 - DNA, 25 bp, Artificial sequence
  SiRNA target sequence
cataatactaatatcactaccataa

SEQ ID NO: 46315 - DNA, 25 bp, Artificial sequence
  SiRNA target sequence
ataatactaatatcactaccataaa

SEQ ID NO: 46316 - DNA, 25 bp, Artificial sequence
  SiRNA target sequence
taatactaatatcactaccataaat

SEQ ID NO: 46317 - DNA, 25 bp, Artificial sequence
  SiRNA target sequence
aatactaatatcactaccataaata

SEQ ID NO: 46318 - DNA, 25 bp, Artificial sequence
  SiRNA target sequence
atactaatatcactaccataaatag

SEQ ID NO: 46319 - DNA, 25 bp, Artificial sequence
  SiRNA target sequence
tactaatatcactaccataaataga

SEQ ID NO: 46320 - DNA, 25 bp, Artificial sequence
  SiRNA target sequence
actaatatcactaccataaatagat

SEQ ID NO: 46321 - DNA, 25 bp, Artificial sequence
  SiRNA target sequence
ctaatatcactaccataaatagatt

SEQ ID NO: 46322 - DNA, 25 bp, Artificial sequence
  SiRNA target sequence
taatatcactaccataaatagattt

SEQ ID NO: 46323 - DNA, 25 bp, Artificial sequence
  SiRNA target sequence
aatatcactaccataaatagatttt

SEQ ID NO: 46324 - DNA, 25 bp, Artificial sequence
  SiRNA target sequence
atatcactaccataaatagattttt

SEQ ID NO: 46325 - DNA, 25 bp, Artificial sequence
  SiRNA target sequence
tatcactaccataaatagatttttt

SEQ ID NO: 46326 - DNA, 25 bp, Artificial sequence
  SiRNA target sequence
atcactaccataaatagattttttt

SEQ ID NO: 46327 - DNA, 25 bp, Artificial sequence
  SiRNA target sequence
tcactaccataaatagatttttttt

SEQ ID NO: 46328 - DNA, 25 bp, Artificial sequence
  SiRNA target sequence
cactaccataaatagattttttttc

SEQ ID NO: 46329 - DNA, 25 bp, Artificial sequence
  SiRNA target sequence
actaccataaatagattttttttct

SEQ ID NO: 46330 - DNA, 25 bp, Artificial sequence
  SiRNA target sequence
ctaccataaatagattttttttcta

SEQ ID NO: 46331 - DNA, 25 bp, Artificial sequence
  SiRNA target sequence
taccataaatagattttttttctaa

SEQ ID NO: 46332 - DNA, 25 bp, Artificial sequence
  SiRNA target sequence
accataaatagattttttttctaac

SEQ ID NO: 46333 - DNA, 25 bp, Artificial sequence
  SiRNA target sequence
ccataaatagattttttttctaaca

SEQ ID NO: 46334 - DNA, 25 bp, Artificial sequence
  SiRNA target sequence
cataaatagattttttttctaacat

SEQ ID NO: 46335 - DNA, 26 bp, Artificial sequence
  SiRNA target sequence
ttataagtttaatgtagaaataatat

SEQ ID NO: 46336 - DNA, 26 bp, Artificial sequence
  SiRNA target sequence
tataagtttaatgtagaaataatatt

SEQ ID NO: 46337 - DNA, 26 bp, Artificial sequence
  SiRNA target sequence
ataagtttaatgtagaaataatattt

SEQ ID NO: 46338 - DNA, 26 bp, Artificial sequence
  SiRNA target sequence
taagtttaatgtagaaataatatttt

SEQ ID NO: 46339 - DNA, 26 bp, Artificial sequence
  SiRNA target sequence
aagtttaatgtagaaataatattttc

SEQ ID NO: 46340 - DNA, 26 bp, Artificial sequence
  SiRNA target sequence
agtttaatgtagaaataatattttct

SEQ ID NO: 46341 - DNA, 26 bp, Artificial sequence
  SiRNA target sequence
gtttaatgtagaaataatattttctt

SEQ ID NO: 46342 - DNA, 26 bp, Artificial sequence
  SiRNA target sequence
tttaatgtagaaataatattttcttc

SEQ ID NO: 46343 - DNA, 26 bp, Artificial sequence
  SiRNA target sequence
ttaatgtagaaataatattttcttct

SEQ ID NO: 46344 - DNA, 26 bp, Artificial sequence
  SiRNA target sequence
taatgtagaaataatattttcttcta

SEQ ID NO: 46345 - DNA, 26 bp, Artificial sequence
  SiRNA target sequence
aatgtagaaataatattttcttctat

SEQ ID NO: 46346 - DNA, 26 bp, Artificial sequence
  SiRNA target sequence
atgtagaaataatattttcttctatc

SEQ ID NO: 46347 - DNA, 26 bp, Artificial sequence
  SiRNA target sequence
tgtagaaataatattttcttctatct

SEQ ID NO: 46348 - DNA, 26 bp, Artificial sequence
  SiRNA target sequence
gtagaaataatattttcttctatctt

SEQ ID NO: 46349 - DNA, 26 bp, Artificial sequence
  SiRNA target sequence
tagaaataatattttcttctatctta

SEQ ID NO: 46350 - DNA, 26 bp, Artificial sequence
  SiRNA target sequence
agaaataatattttcttctatcttat

SEQ ID NO: 46351 - DNA, 26 bp, Artificial sequence
  SiRNA target sequence
gaaataatattttcttctatcttatg

SEQ ID NO: 46352 - DNA, 26 bp, Artificial sequence
  SiRNA target sequence
aaataatattttcttctatcttatgt

SEQ ID NO: 46353 - DNA, 26 bp, Artificial sequence
  SiRNA target sequence
aataatattttcttctatcttatgta

SEQ ID NO: 46354 - DNA, 26 bp, Artificial sequence
  SiRNA target sequence
ataatattttcttctatcttatgtaa

SEQ ID NO: 46355 - DNA, 26 bp, Artificial sequence
  SiRNA target sequence
taatattttcttctatcttatgtaat

SEQ ID NO: 46356 - DNA, 26 bp, Artificial sequence
  SiRNA target sequence
aatattttcttctatcttatgtaatg

SEQ ID NO: 46357 - DNA, 26 bp, Artificial sequence
  SiRNA target sequence
atattttcttctatcttatgtaatga

SEQ ID NO: 46358 - DNA, 26 bp, Artificial sequence
  SiRNA target sequence
tattttcttctatcttatgtaatgat

SEQ ID NO: 46359 - DNA, 26 bp, Artificial sequence
  SiRNA target sequence
attttcttctatcttatgtaatgata

SEQ ID NO: 46360 - DNA, 26 bp, Artificial sequence
  SiRNA target sequence
ttttcttctatcttatgtaatgatac

SEQ ID NO: 46361 - DNA, 26 bp, Artificial sequence
  SiRNA target sequence
tttcttctatcttatgtaatgataca

SEQ ID NO: 46362 - DNA, 26 bp, Artificial sequence
  SiRNA target sequence
ttcttctatcttatgtaatgatacag

SEQ ID NO: 46363 - DNA, 26 bp, Artificial sequence
  SiRNA target sequence
tcttctatcttatgtaatgatacagt

SEQ ID NO: 46364 - DNA, 26 bp, Artificial sequence
  SiRNA target sequence
cttctatcttatgtaatgatacagtt

SEQ ID NO: 46365 - DNA, 26 bp, Artificial sequence
  SiRNA target sequence
ttctatcttatgtaatgatacagttt

SEQ ID NO: 46366 - DNA, 26 bp, Artificial sequence
  SiRNA target sequence
tctatcttatgtaatgatacagtttt

SEQ ID NO: 46367 - DNA, 26 bp, Artificial sequence
  SiRNA target sequence
ctatcttatgtaatgatacagttttg

SEQ ID NO: 46368 - DNA, 26 bp, Artificial sequence
  SiRNA target sequence
tatcttatgtaatgatacagttttgt

SEQ ID NO: 46369 - DNA, 26 bp, Artificial sequence
  SiRNA target sequence
atcttatgtaatgatacagttttgtt

SEQ ID NO: 46370 - DNA, 26 bp, Artificial sequence
  SiRNA target sequence
tcttatgtaatgatacagttttgttt

SEQ ID NO: 46371 - DNA, 26 bp, Artificial sequence
  SiRNA target sequence
cttatgtaatgatacagttttgtttt

SEQ ID NO: 46372 - DNA, 26 bp, Artificial sequence
  SiRNA target sequence
ttatgtaatgatacagttttgttttt

SEQ ID NO: 46373 - DNA, 26 bp, Artificial sequence
  SiRNA target sequence
tatgtaatgatacagttttgttttta

SEQ ID NO: 46374 - DNA, 26 bp, Artificial sequence
  SiRNA target sequence
atgtaatgatacagttttgtttttaa

SEQ ID NO: 46375 - DNA, 26 bp, Artificial sequence
  SiRNA target sequence
tgtaatgatacagttttgtttttaat

SEQ ID NO: 46376 - DNA, 26 bp, Artificial sequence
  SiRNA target sequence
gtaatgatacagttttgtttttaata

SEQ ID NO: 46377 - DNA, 26 bp, Artificial sequence
  SiRNA target sequence
taatgatacagttttgtttttaatac

SEQ ID NO: 46378 - DNA, 26 bp, Artificial sequence
  SiRNA target sequence
aatgatacagttttgtttttaatact

SEQ ID NO: 46379 - DNA, 26 bp, Artificial sequence
  SiRNA target sequence
atgatacagttttgtttttaatactt

SEQ ID NO: 46380 - DNA, 26 bp, Artificial sequence
  SiRNA target sequence
tgatacagttttgtttttaatactta

SEQ ID NO: 46381 - DNA, 26 bp, Artificial sequence
  SiRNA target sequence
gatacagttttgtttttaatacttag

SEQ ID NO: 46382 - DNA, 26 bp, Artificial sequence
  SiRNA target sequence
atacagttttgtttttaatacttagc

SEQ ID NO: 46383 - DNA, 26 bp, Artificial sequence
  SiRNA target sequence
tacagttttgtttttaatacttagca

SEQ ID NO: 46384 - DNA, 26 bp, Artificial sequence
  SiRNA target sequence
acagttttgtttttaatacttagcac

SEQ ID NO: 46385 - DNA, 26 bp, Artificial sequence
  SiRNA target sequence
cagttttgtttttaatacttagcact

SEQ ID NO: 46386 - DNA, 26 bp, Artificial sequence
  SiRNA target sequence
agttttgtttttaatacttagcactt

SEQ ID NO: 46387 - DNA, 26 bp, Artificial sequence
  SiRNA target sequence
gttttgtttttaatacttagcacttt

SEQ ID NO: 46388 - DNA, 26 bp, Artificial sequence
  SiRNA target sequence
ttttgtttttaatacttagcacttta

SEQ ID NO: 46389 - DNA, 26 bp, Artificial sequence
  SiRNA target sequence
tttgtttttaatacttagcactttat

SEQ ID NO: 46390 - DNA, 26 bp, Artificial sequence
  SiRNA target sequence
ttgtttttaatacttagcactttatc

SEQ ID NO: 46391 - DNA, 26 bp, Artificial sequence
  SiRNA target sequence
tgtttttaatacttagcactttatca

SEQ ID NO: 46392 - DNA, 26 bp, Artificial sequence
  SiRNA target sequence
gtttttaatacttagcactttatcaa

SEQ ID NO: 46393 - DNA, 26 bp, Artificial sequence
  SiRNA target sequence
tttttaatacttagcactttatcaaa

SEQ ID NO: 46394 - DNA, 26 bp, Artificial sequence
  SiRNA target sequence
ttttaatacttagcactttatcaaat

SEQ ID NO: 46395 - DNA, 26 bp, Artificial sequence
  SiRNA target sequence
tttaatacttagcactttatcaaata

SEQ ID NO: 46396 - DNA, 26 bp, Artificial sequence
  SiRNA target sequence
ttaatacttagcactttatcaaataa

SEQ ID NO: 46397 - DNA, 26 bp, Artificial sequence
  SiRNA target sequence
taatacttagcactttatcaaataag

SEQ ID NO: 46398 - DNA, 26 bp, Artificial sequence
  SiRNA target sequence
aatacttagcactttatcaaataagt

SEQ ID NO: 46399 - DNA, 26 bp, Artificial sequence
  SiRNA target sequence
atacttagcactttatcaaataagtg

SEQ ID NO: 46400 - DNA, 26 bp, Artificial sequence
  SiRNA target sequence
tacttagcactttatcaaataagtgg

SEQ ID NO: 46401 - DNA, 26 bp, Artificial sequence
  SiRNA target sequence
acttagcactttatcaaataagtgga

SEQ ID NO: 46402 - DNA, 26 bp, Artificial sequence
  SiRNA target sequence
cttagcactttatcaaataagtggag

SEQ ID NO: 46403 - DNA, 26 bp, Artificial sequence
  SiRNA target sequence
ttagcactttatcaaataagtggagt

SEQ ID NO: 46404 - DNA, 26 bp, Artificial sequence
  SiRNA target sequence
tagcactttatcaaataagtggagta

SEQ ID NO: 46405 - DNA, 26 bp, Artificial sequence
  SiRNA target sequence
agcactttatcaaataagtggagtaa

SEQ ID NO: 46406 - DNA, 26 bp, Artificial sequence
  SiRNA target sequence
gcactttatcaaataagtggagtaaa

SEQ ID NO: 46407 - DNA, 26 bp, Artificial sequence
  SiRNA target sequence
cactttatcaaataagtggagtaaat

SEQ ID NO: 46408 - DNA, 26 bp, Artificial sequence
  SiRNA target sequence
actttatcaaataagtggagtaaatc

SEQ ID NO: 46409 - DNA, 26 bp, Artificial sequence
  SiRNA target sequence
ctttatcaaataagtggagtaaatct

SEQ ID NO: 46410 - DNA, 26 bp, Artificial sequence
  SiRNA target sequence
tttatcaaataagtggagtaaatcta

SEQ ID NO: 46411 - DNA, 26 bp, Artificial sequence
  SiRNA target sequence
ttatcaaataagtggagtaaatctaa

SEQ ID NO: 46412 - DNA, 26 bp, Artificial sequence
  SiRNA target sequence
tatcaaataagtggagtaaatctaaa

SEQ ID NO: 46413 - DNA, 26 bp, Artificial sequence
  SiRNA target sequence
atcaaataagtggagtaaatctaaat

SEQ ID NO: 46414 - DNA, 26 bp, Artificial sequence
  SiRNA target sequence
tcaaataagtggagtaaatctaaatt

SEQ ID NO: 46415 - DNA, 26 bp, Artificial sequence
  SiRNA target sequence
caaataagtggagtaaatctaaatta

SEQ ID NO: 46416 - DNA, 26 bp, Artificial sequence
  SiRNA target sequence
aaataagtggagtaaatctaaattat

SEQ ID NO: 46417 - DNA, 26 bp, Artificial sequence
  SiRNA target sequence
aataagtggagtaaatctaaattatg

SEQ ID NO: 46418 - DNA, 26 bp, Artificial sequence
  SiRNA target sequence
ataagtggagtaaatctaaattatgt

SEQ ID NO: 46419 - DNA, 26 bp, Artificial sequence
  SiRNA target sequence
taagtggagtaaatctaaattatgta

SEQ ID NO: 46420 - DNA, 26 bp, Artificial sequence
  SiRNA target sequence
aagtggagtaaatctaaattatgtaa

SEQ ID NO: 46421 - DNA, 26 bp, Artificial sequence
  SiRNA target sequence
agtggagtaaatctaaattatgtaaa

SEQ ID NO: 46422 - DNA, 26 bp, Artificial sequence
  SiRNA target sequence
gtggagtaaatctaaattatgtaaaa

SEQ ID NO: 46423 - DNA, 26 bp, Artificial sequence
  SiRNA target sequence
tggagtaaatctaaattatgtaaaac

SEQ ID NO: 46424 - DNA, 26 bp, Artificial sequence
  SiRNA target sequence
ggagtaaatctaaattatgtaaaaca

SEQ ID NO: 46425 - DNA, 26 bp, Artificial sequence
  SiRNA target sequence
gagtaaatctaaattatgtaaaacaa

SEQ ID NO: 46426 - DNA, 26 bp, Artificial sequence
  SiRNA target sequence
agtaaatctaaattatgtaaaacaat

SEQ ID NO: 46427 - DNA, 26 bp, Artificial sequence
  SiRNA target sequence
gtaaatctaaattatgtaaaacaata

SEQ ID NO: 46428 - DNA, 26 bp, Artificial sequence
  SiRNA target sequence
taaatctaaattatgtaaaacaataa

SEQ ID NO: 46429 - DNA, 26 bp, Artificial sequence
  SiRNA target sequence
aaatctaaattatgtaaaacaataat

SEQ ID NO: 46430 - DNA, 26 bp, Artificial sequence
  SiRNA target sequence
aatctaaattatgtaaaacaataatt

SEQ ID NO: 46431 - DNA, 26 bp, Artificial sequence
  SiRNA target sequence
atctaaattatgtaaaacaataatta

SEQ ID NO: 46432 - DNA, 26 bp, Artificial sequence
  SiRNA target sequence
tctaaattatgtaaaacaataattat

SEQ ID NO: 46433 - DNA, 26 bp, Artificial sequence
  SiRNA target sequence
ctaaattatgtaaaacaataattatc

SEQ ID NO: 46434 - DNA, 26 bp, Artificial sequence
  SiRNA target sequence
taaattatgtaaaacaataattatcg

SEQ ID NO: 46435 - DNA, 26 bp, Artificial sequence
  SiRNA target sequence
aaattatgtaaaacaataattatcgt

SEQ ID NO: 46436 - DNA, 26 bp, Artificial sequence
  SiRNA target sequence
aattatgtaaaacaataattatcgtc

SEQ ID NO: 46437 - DNA, 26 bp, Artificial sequence
  SiRNA target sequence
attatgtaaaacaataattatcgtct

SEQ ID NO: 46438 - DNA, 26 bp, Artificial sequence
  SiRNA target sequence
ttatgtaaaacaataattatcgtctt

SEQ ID NO: 46439 - DNA, 26 bp, Artificial sequence
  SiRNA target sequence
tatgtaaaacaataattatcgtcttc

SEQ ID NO: 46440 - DNA, 26 bp, Artificial sequence
  SiRNA target sequence
atgtaaaacaataattatcgtcttct

SEQ ID NO: 46441 - DNA, 26 bp, Artificial sequence
  SiRNA target sequence
tgtaaaacaataattatcgtcttctc

SEQ ID NO: 46442 - DNA, 26 bp, Artificial sequence
  SiRNA target sequence
gtaaaacaataattatcgtcttctct

SEQ ID NO: 46443 - DNA, 26 bp, Artificial sequence
  SiRNA target sequence
taaaacaataattatcgtcttctcta

SEQ ID NO: 46444 - DNA, 26 bp, Artificial sequence
  SiRNA target sequence
aaaacaataattatcgtcttctctaa

SEQ ID NO: 46445 - DNA, 26 bp, Artificial sequence
  SiRNA target sequence
aaacaataattatcgtcttctctaag

SEQ ID NO: 46446 - DNA, 26 bp, Artificial sequence
  SiRNA target sequence
aacaataattatcgtcttctctaagt

SEQ ID NO: 46447 - DNA, 26 bp, Artificial sequence
  SiRNA target sequence
acaataattatcgtcttctctaagtt

SEQ ID NO: 46448 - DNA, 26 bp, Artificial sequence
  SiRNA target sequence
caataattatcgtcttctctaagttg

SEQ ID NO: 46449 - DNA, 26 bp, Artificial sequence
  SiRNA target sequence
aataattatcgtcttctctaagttgt

SEQ ID NO: 46450 - DNA, 26 bp, Artificial sequence
  SiRNA target sequence
ataattatcgtcttctctaagttgtt

SEQ ID NO: 46451 - DNA, 26 bp, Artificial sequence
  SiRNA target sequence
taattatcgtcttctctaagttgttg

SEQ ID NO: 46452 - DNA, 26 bp, Artificial sequence
  SiRNA target sequence
aattatcgtcttctctaagttgttgg

SEQ ID NO: 46453 - DNA, 26 bp, Artificial sequence
  SiRNA target sequence
attatcgtcttctctaagttgttgga

SEQ ID NO: 46454 - DNA, 26 bp, Artificial sequence
  SiRNA target sequence
ttatcgtcttctctaagttgttggag

SEQ ID NO: 46455 - DNA, 26 bp, Artificial sequence
  SiRNA target sequence
tatcgtcttctctaagttgttggaga

SEQ ID NO: 46456 - DNA, 26 bp, Artificial sequence
  SiRNA target sequence
atcgtcttctctaagttgttggagat

SEQ ID NO: 46457 - DNA, 26 bp, Artificial sequence
  SiRNA target sequence
tcgtcttctctaagttgttggagatt

SEQ ID NO: 46458 - DNA, 26 bp, Artificial sequence
  SiRNA target sequence
cgtcttctctaagttgttggagatta

SEQ ID NO: 46459 - DNA, 26 bp, Artificial sequence
  SiRNA target sequence
gtcttctctaagttgttggagattag

SEQ ID NO: 46460 - DNA, 26 bp, Artificial sequence
  SiRNA target sequence
tcttctctaagttgttggagattaga

SEQ ID NO: 46461 - DNA, 26 bp, Artificial sequence
  SiRNA target sequence
cttctctaagttgttggagattagac

SEQ ID NO: 46462 - DNA, 26 bp, Artificial sequence
  SiRNA target sequence
ttctctaagttgttggagattagact

SEQ ID NO: 46463 - DNA, 26 bp, Artificial sequence
  SiRNA target sequence
tctctaagttgttggagattagactt

SEQ ID NO: 46464 - DNA, 26 bp, Artificial sequence
  SiRNA target sequence
ctctaagttgttggagattagacttt

SEQ ID NO: 46465 - DNA, 26 bp, Artificial sequence
  SiRNA target sequence
tctaagttgttggagattagactttt

SEQ ID NO: 46466 - DNA, 26 bp, Artificial sequence
  SiRNA target sequence
ctaagttgttggagattagactttta

SEQ ID NO: 46467 - DNA, 26 bp, Artificial sequence
  SiRNA target sequence
taagttgttggagattagacttttaa

SEQ ID NO: 46468 - DNA, 26 bp, Artificial sequence
  SiRNA target sequence
aagttgttggagattagacttttaag

SEQ ID NO: 46469 - DNA, 26 bp, Artificial sequence
  SiRNA target sequence
agttgttggagattagacttttaaga

SEQ ID NO: 46470 - DNA, 26 bp, Artificial sequence
  SiRNA target sequence
gttgttggagattagacttttaagaa

SEQ ID NO: 46471 - DNA, 26 bp, Artificial sequence
  SiRNA target sequence
ttgttggagattagacttttaagaat

SEQ ID NO: 46472 - DNA, 26 bp, Artificial sequence
  SiRNA target sequence
tgttggagattagacttttaagaatt

SEQ ID NO: 46473 - DNA, 26 bp, Artificial sequence
  SiRNA target sequence
gttggagattagacttttaagaattt

SEQ ID NO: 46474 - DNA, 26 bp, Artificial sequence
  SiRNA target sequence
ttggagattagacttttaagaatttc

SEQ ID NO: 46475 - DNA, 26 bp, Artificial sequence
  SiRNA target sequence
tggagattagacttttaagaatttca

SEQ ID NO: 46476 - DNA, 26 bp, Artificial sequence
  SiRNA target sequence
ggagattagacttttaagaatttcat

SEQ ID NO: 46477 - DNA, 26 bp, Artificial sequence
  SiRNA target sequence
gagattagacttttaagaatttcata

SEQ ID NO: 46478 - DNA, 26 bp, Artificial sequence
  SiRNA target sequence
agattagacttttaagaatttcatat

SEQ ID NO: 46479 - DNA, 26 bp, Artificial sequence
  SiRNA target sequence
gattagacttttaagaatttcatatt

SEQ ID NO: 46480 - DNA, 26 bp, Artificial sequence
  SiRNA target sequence
attagacttttaagaatttcatattc

SEQ ID NO: 46481 - DNA, 26 bp, Artificial sequence
  SiRNA target sequence
ttagacttttaagaatttcatattca

SEQ ID NO: 46482 - DNA, 26 bp, Artificial sequence
  SiRNA target sequence
tagacttttaagaatttcatattcag

SEQ ID NO: 46483 - DNA, 26 bp, Artificial sequence
  SiRNA target sequence
agacttttaagaatttcatattcagc

SEQ ID NO: 46484 - DNA, 26 bp, Artificial sequence
  SiRNA target sequence
gacttttaagaatttcatattcagct

SEQ ID NO: 46485 - DNA, 26 bp, Artificial sequence
  SiRNA target sequence
acttttaagaatttcatattcagctt

SEQ ID NO: 46486 - DNA, 26 bp, Artificial sequence
  SiRNA target sequence
cttttaagaatttcatattcagcttt

SEQ ID NO: 46487 - DNA, 26 bp, Artificial sequence
  SiRNA target sequence
ttttaagaatttcatattcagctttt

SEQ ID NO: 46488 - DNA, 26 bp, Artificial sequence
  SiRNA target sequence
tttaagaatttcatattcagcttttt

SEQ ID NO: 46489 - DNA, 26 bp, Artificial sequence
  SiRNA target sequence
ttaagaatttcatattcagctttttt

SEQ ID NO: 46490 - DNA, 26 bp, Artificial sequence
  SiRNA target sequence
taagaatttcatattcagcttttttg

SEQ ID NO: 46491 - DNA, 26 bp, Artificial sequence
  SiRNA target sequence
aagaatttcatattcagcttttttgt

SEQ ID NO: 46492 - DNA, 26 bp, Artificial sequence
  SiRNA target sequence
agaatttcatattcagcttttttgtc

SEQ ID NO: 46493 - DNA, 26 bp, Artificial sequence
  SiRNA target sequence
gaatttcatattcagcttttttgtcc

SEQ ID NO: 46494 - DNA, 26 bp, Artificial sequence
  SiRNA target sequence
aatttcatattcagcttttttgtcca

SEQ ID NO: 46495 - DNA, 26 bp, Artificial sequence
  SiRNA target sequence
atttcatattcagcttttttgtccaa

SEQ ID NO: 46496 - DNA, 26 bp, Artificial sequence
  SiRNA target sequence
tttcatattcagcttttttgtccaat

SEQ ID NO: 46497 - DNA, 26 bp, Artificial sequence
  SiRNA target sequence
ttcatattcagcttttttgtccaatg

SEQ ID NO: 46498 - DNA, 26 bp, Artificial sequence
  SiRNA target sequence
tcatattcagcttttttgtccaatgc

SEQ ID NO: 46499 - DNA, 26 bp, Artificial sequence
  SiRNA target sequence
catattcagcttttttgtccaatgcg

SEQ ID NO: 46500 - DNA, 26 bp, Artificial sequence
  SiRNA target sequence
atattcagcttttttgtccaatgcgg

SEQ ID NO: 46501 - DNA, 26 bp, Artificial sequence
  SiRNA target sequence
tattcagcttttttgtccaatgcggc

SEQ ID NO: 46502 - DNA, 26 bp, Artificial sequence
  SiRNA target sequence
attcagcttttttgtccaatgcggcc

SEQ ID NO: 46503 - DNA, 26 bp, Artificial sequence
  SiRNA target sequence
ttcagcttttttgtccaatgcggccg

SEQ ID NO: 46504 - DNA, 26 bp, Artificial sequence
  SiRNA target sequence
tcagcttttttgtccaatgcggccgt

SEQ ID NO: 46505 - DNA, 26 bp, Artificial sequence
  SiRNA target sequence
cagcttttttgtccaatgcggccgtt

SEQ ID NO: 46506 - DNA, 26 bp, Artificial sequence
  SiRNA target sequence
agcttttttgtccaatgcggccgttg

SEQ ID NO: 46507 - DNA, 26 bp, Artificial sequence
  SiRNA target sequence
gcttttttgtccaatgcggccgttgg

SEQ ID NO: 46508 - DNA, 26 bp, Artificial sequence
  SiRNA target sequence
cttttttgtccaatgcggccgttggc

SEQ ID NO: 46509 - DNA, 26 bp, Artificial sequence
  SiRNA target sequence
ttttttgtccaatgcggccgttggct

SEQ ID NO: 46510 - DNA, 26 bp, Artificial sequence
  SiRNA target sequence
tttttgtccaatgcggccgttggctc

SEQ ID NO: 46511 - DNA, 26 bp, Artificial sequence
  SiRNA target sequence
ttttgtccaatgcggccgttggctca

SEQ ID NO: 46512 - DNA, 26 bp, Artificial sequence
  SiRNA target sequence
tttgtccaatgcggccgttggctcat

SEQ ID NO: 46513 - DNA, 26 bp, Artificial sequence
  SiRNA target sequence
ttgtccaatgcggccgttggctcatc

SEQ ID NO: 46514 - DNA, 26 bp, Artificial sequence
  SiRNA target sequence
tgtccaatgcggccgttggctcatct

SEQ ID NO: 46515 - DNA, 26 bp, Artificial sequence
  SiRNA target sequence
gtccaatgcggccgttggctcatcta

SEQ ID NO: 46516 - DNA, 26 bp, Artificial sequence
  SiRNA target sequence
tccaatgcggccgttggctcatctaa

SEQ ID NO: 46517 - DNA, 26 bp, Artificial sequence
  SiRNA target sequence
ccaatgcggccgttggctcatctaaa

SEQ ID NO: 46518 - DNA, 26 bp, Artificial sequence
  SiRNA target sequence
caatgcggccgttggctcatctaaaa

SEQ ID NO: 46519 - DNA, 26 bp, Artificial sequence
  SiRNA target sequence
aatgcggccgttggctcatctaaaat

SEQ ID NO: 46520 - DNA, 26 bp, Artificial sequence
  SiRNA target sequence
atgcggccgttggctcatctaaaatt

SEQ ID NO: 46521 - DNA, 26 bp, Artificial sequence
  SiRNA target sequence
tgcggccgttggctcatctaaaatta

SEQ ID NO: 46522 - DNA, 26 bp, Artificial sequence
  SiRNA target sequence
gcggccgttggctcatctaaaattat

SEQ ID NO: 46523 - DNA, 26 bp, Artificial sequence
  SiRNA target sequence
cggccgttggctcatctaaaattata

SEQ ID NO: 46524 - DNA, 26 bp, Artificial sequence
  SiRNA target sequence
ggccgttggctcatctaaaattataa

SEQ ID NO: 46525 - DNA, 26 bp, Artificial sequence
  SiRNA target sequence
gccgttggctcatctaaaattataat

SEQ ID NO: 46526 - DNA, 26 bp, Artificial sequence
  SiRNA target sequence
ccgttggctcatctaaaattataata

SEQ ID NO: 46527 - DNA, 26 bp, Artificial sequence
  SiRNA target sequence
cgttggctcatctaaaattataatag

SEQ ID NO: 46528 - DNA, 26 bp, Artificial sequence
  SiRNA target sequence
gttggctcatctaaaattataatagg

SEQ ID NO: 46529 - DNA, 26 bp, Artificial sequence
  SiRNA target sequence
ttggctcatctaaaattataatagga

SEQ ID NO: 46530 - DNA, 26 bp, Artificial sequence
  SiRNA target sequence
tggctcatctaaaattataataggag

SEQ ID NO: 46531 - DNA, 26 bp, Artificial sequence
  SiRNA target sequence
ggctcatctaaaattataataggaga

SEQ ID NO: 46532 - DNA, 26 bp, Artificial sequence
  SiRNA target sequence
gctcatctaaaattataataggagaa

SEQ ID NO: 46533 - DNA, 26 bp, Artificial sequence
  SiRNA target sequence
ctcatctaaaattataataggagaat

SEQ ID NO: 46534 - DNA, 26 bp, Artificial sequence
  SiRNA target sequence
tcatctaaaattataataggagaatt

SEQ ID NO: 46535 - DNA, 26 bp, Artificial sequence
  SiRNA target sequence
catctaaaattataataggagaattt

SEQ ID NO: 46536 - DNA, 26 bp, Artificial sequence
  SiRNA target sequence
atctaaaattataataggagaatttt

SEQ ID NO: 46537 - DNA, 26 bp, Artificial sequence
  SiRNA target sequence
tctaaaattataataggagaattttt

SEQ ID NO: 46538 - DNA, 26 bp, Artificial sequence
  SiRNA target sequence
ctaaaattataataggagaatttttt

SEQ ID NO: 46539 - DNA, 26 bp, Artificial sequence
  SiRNA target sequence
taaaattataataggagaatttttta

SEQ ID NO: 46540 - DNA, 26 bp, Artificial sequence
  SiRNA target sequence
aaaattataataggagaattttttag

SEQ ID NO: 46541 - DNA, 26 bp, Artificial sequence
  SiRNA target sequence
aaattataataggagaattttttagt

SEQ ID NO: 46542 - DNA, 26 bp, Artificial sequence
  SiRNA target sequence
aattataataggagaattttttagtg

SEQ ID NO: 46543 - DNA, 26 bp, Artificial sequence
  SiRNA target sequence
attataataggagaattttttagtgc

SEQ ID NO: 46544 - DNA, 26 bp, Artificial sequence
  SiRNA target sequence
ttataataggagaattttttagtgcc

SEQ ID NO: 46545 - DNA, 26 bp, Artificial sequence
  SiRNA target sequence
tataataggagaattttttagtgccg

SEQ ID NO: 46546 - DNA, 26 bp, Artificial sequence
  SiRNA target sequence
ataataggagaattttttagtgccga

SEQ ID NO: 46547 - DNA, 26 bp, Artificial sequence
  SiRNA target sequence
taataggagaattttttagtgccgac

SEQ ID NO: 46548 - DNA, 26 bp, Artificial sequence
  SiRNA target sequence
aataggagaattttttagtgccgacc

SEQ ID NO: 46549 - DNA, 26 bp, Artificial sequence
  SiRNA target sequence
ataggagaattttttagtgccgacct

SEQ ID NO: 46550 - DNA, 26 bp, Artificial sequence
  SiRNA target sequence
taggagaattttttagtgccgacctt

SEQ ID NO: 46551 - DNA, 26 bp, Artificial sequence
  SiRNA target sequence
aggagaattttttagtgccgacctta

SEQ ID NO: 46552 - DNA, 26 bp, Artificial sequence
  SiRNA target sequence
ggagaattttttagtgccgaccttaa

SEQ ID NO: 46553 - DNA, 26 bp, Artificial sequence
  SiRNA target sequence
gagaattttttagtgccgaccttaac

SEQ ID NO: 46554 - DNA, 26 bp, Artificial sequence
  SiRNA target sequence
agaattttttagtgccgaccttaaca

SEQ ID NO: 46555 - DNA, 26 bp, Artificial sequence
  SiRNA target sequence
gaattttttagtgccgaccttaacaa

SEQ ID NO: 46556 - DNA, 26 bp, Artificial sequence
  SiRNA target sequence
aattttttagtgccgaccttaacaaa

SEQ ID NO: 46557 - DNA, 26 bp, Artificial sequence
  SiRNA target sequence
attttttagtgccgaccttaacaaaa

SEQ ID NO: 46558 - DNA, 26 bp, Artificial sequence
  SiRNA target sequence
ttttttagtgccgaccttaacaaaat

SEQ ID NO: 46559 - DNA, 26 bp, Artificial sequence
  SiRNA target sequence
tttttagtgccgaccttaacaaaatt

SEQ ID NO: 46560 - DNA, 26 bp, Artificial sequence
  SiRNA target sequence
ttttagtgccgaccttaacaaaatta

SEQ ID NO: 46561 - DNA, 26 bp, Artificial sequence
  SiRNA target sequence
tttagtgccgaccttaacaaaattac

SEQ ID NO: 46562 - DNA, 26 bp, Artificial sequence
  SiRNA target sequence
ttagtgccgaccttaacaaaattact

SEQ ID NO: 46563 - DNA, 26 bp, Artificial sequence
  SiRNA target sequence
tagtgccgaccttaacaaaattactt

SEQ ID NO: 46564 - DNA, 26 bp, Artificial sequence
  SiRNA target sequence
agtgccgaccttaacaaaattacttt

SEQ ID NO: 46565 - DNA, 26 bp, Artificial sequence
  SiRNA target sequence
gtgccgaccttaacaaaattactttt

SEQ ID NO: 46566 - DNA, 26 bp, Artificial sequence
  SiRNA target sequence
tgccgaccttaacaaaattacttttt

SEQ ID NO: 46567 - DNA, 26 bp, Artificial sequence
  SiRNA target sequence
gccgaccttaacaaaattactttttg

SEQ ID NO: 46568 - DNA, 26 bp, Artificial sequence
  SiRNA target sequence
ccgaccttaacaaaattactttttgt

SEQ ID NO: 46569 - DNA, 26 bp, Artificial sequence
  SiRNA target sequence
cgaccttaacaaaattactttttgtc

SEQ ID NO: 46570 - DNA, 26 bp, Artificial sequence
  SiRNA target sequence
gaccttaacaaaattactttttgtct

SEQ ID NO: 46571 - DNA, 26 bp, Artificial sequence
  SiRNA target sequence
accttaacaaaattactttttgtctt

SEQ ID NO: 46572 - DNA, 26 bp, Artificial sequence
  SiRNA target sequence
ccttaacaaaattactttttgtcttt

SEQ ID NO: 46573 - DNA, 26 bp, Artificial sequence
  SiRNA target sequence
cttaacaaaattactttttgtctttc

SEQ ID NO: 46574 - DNA, 26 bp, Artificial sequence
  SiRNA target sequence
ttaacaaaattactttttgtctttct

SEQ ID NO: 46575 - DNA, 26 bp, Artificial sequence
  SiRNA target sequence
taacaaaattactttttgtctttctc

SEQ ID NO: 46576 - DNA, 26 bp, Artificial sequence
  SiRNA target sequence
aacaaaattactttttgtctttctcc

SEQ ID NO: 46577 - DNA, 26 bp, Artificial sequence
  SiRNA target sequence
acaaaattactttttgtctttctcca

SEQ ID NO: 46578 - DNA, 26 bp, Artificial sequence
  SiRNA target sequence
caaaattactttttgtctttctccac

SEQ ID NO: 46579 - DNA, 26 bp, Artificial sequence
  SiRNA target sequence
aaaattactttttgtctttctccacc

SEQ ID NO: 46580 - DNA, 26 bp, Artificial sequence
  SiRNA target sequence
aaattactttttgtctttctccacca

SEQ ID NO: 46581 - DNA, 26 bp, Artificial sequence
  SiRNA target sequence
aattactttttgtctttctccaccac

SEQ ID NO: 46582 - DNA, 26 bp, Artificial sequence
  SiRNA target sequence
attactttttgtctttctccaccact

SEQ ID NO: 46583 - DNA, 26 bp, Artificial sequence
  SiRNA target sequence
ttactttttgtctttctccaccacta

SEQ ID NO: 46584 - DNA, 26 bp, Artificial sequence
  SiRNA target sequence
tactttttgtctttctccaccactaa

SEQ ID NO: 46585 - DNA, 26 bp, Artificial sequence
  SiRNA target sequence
actttttgtctttctccaccactaag

SEQ ID NO: 46586 - DNA, 26 bp, Artificial sequence
  SiRNA target sequence
ctttttgtctttctccaccactaagc

SEQ ID NO: 46587 - DNA, 26 bp, Artificial sequence
  SiRNA target sequence
tttttgtctttctccaccactaagct

SEQ ID NO: 46588 - DNA, 26 bp, Artificial sequence
  SiRNA target sequence
ttttgtctttctccaccactaagctt

SEQ ID NO: 46589 - DNA, 26 bp, Artificial sequence
  SiRNA target sequence
tttgtctttctccaccactaagctta

SEQ ID NO: 46590 - DNA, 26 bp, Artificial sequence
  SiRNA target sequence
ttgtctttctccaccactaagcttat

SEQ ID NO: 46591 - DNA, 26 bp, Artificial sequence
  SiRNA target sequence
tgtctttctccaccactaagcttatg

SEQ ID NO: 46592 - DNA, 26 bp, Artificial sequence
  SiRNA target sequence
gtctttctccaccactaagcttatgt

SEQ ID NO: 46593 - DNA, 26 bp, Artificial sequence
  SiRNA target sequence
tctttctccaccactaagcttatgtc

SEQ ID NO: 46594 - DNA, 26 bp, Artificial sequence
  SiRNA target sequence
ctttctccaccactaagcttatgtcc

SEQ ID NO: 46595 - DNA, 26 bp, Artificial sequence
  SiRNA target sequence
tttctccaccactaagcttatgtccc

SEQ ID NO: 46596 - DNA, 26 bp, Artificial sequence
  SiRNA target sequence
ttctccaccactaagcttatgtccct

SEQ ID NO: 46597 - DNA, 26 bp, Artificial sequence
  SiRNA target sequence
tctccaccactaagcttatgtccctt

SEQ ID NO: 46598 - DNA, 26 bp, Artificial sequence
  SiRNA target sequence
ctccaccactaagcttatgtccctta

SEQ ID NO: 46599 - DNA, 26 bp, Artificial sequence
  SiRNA target sequence
tccaccactaagcttatgtcccttat

SEQ ID NO: 46600 - DNA, 26 bp, Artificial sequence
  SiRNA target sequence
ccaccactaagcttatgtcccttatc

SEQ ID NO: 46601 - DNA, 26 bp, Artificial sequence
  SiRNA target sequence
caccactaagcttatgtcccttatct

SEQ ID NO: 46602 - DNA, 26 bp, Artificial sequence
  SiRNA target sequence
accactaagcttatgtcccttatctc

SEQ ID NO: 46603 - DNA, 26 bp, Artificial sequence
  SiRNA target sequence
ccactaagcttatgtcccttatctcc

SEQ ID NO: 46604 - DNA, 26 bp, Artificial sequence
  SiRNA target sequence
cactaagcttatgtcccttatctcca

SEQ ID NO: 46605 - DNA, 26 bp, Artificial sequence
  SiRNA target sequence
actaagcttatgtcccttatctccaa

SEQ ID NO: 46606 - DNA, 26 bp, Artificial sequence
  SiRNA target sequence
ctaagcttatgtcccttatctccaac

SEQ ID NO: 46607 - DNA, 26 bp, Artificial sequence
  SiRNA target sequence
taagcttatgtcccttatctccaaca

SEQ ID NO: 46608 - DNA, 26 bp, Artificial sequence
  SiRNA target sequence
aagcttatgtcccttatctccaacat

SEQ ID NO: 46609 - DNA, 26 bp, Artificial sequence
  SiRNA target sequence
agcttatgtcccttatctccaacatg

SEQ ID NO: 46610 - DNA, 26 bp, Artificial sequence
  SiRNA target sequence
gcttatgtcccttatctccaacatgt

SEQ ID NO: 46611 - DNA, 26 bp, Artificial sequence
  SiRNA target sequence
cttatgtcccttatctccaacatgtg

SEQ ID NO: 46612 - DNA, 26 bp, Artificial sequence
  SiRNA target sequence
ttatgtcccttatctccaacatgtgt

SEQ ID NO: 46613 - DNA, 26 bp, Artificial sequence
  SiRNA target sequence
tatgtcccttatctccaacatgtgtg

SEQ ID NO: 46614 - DNA, 26 bp, Artificial sequence
  SiRNA target sequence
atgtcccttatctccaacatgtgtgt

SEQ ID NO: 46615 - DNA, 26 bp, Artificial sequence
  SiRNA target sequence
tgtcccttatctccaacatgtgtgtt

SEQ ID NO: 46616 - DNA, 26 bp, Artificial sequence
  SiRNA target sequence
gtcccttatctccaacatgtgtgttg

SEQ ID NO: 46617 - DNA, 26 bp, Artificial sequence
  SiRNA target sequence
tcccttatctccaacatgtgtgttgt

SEQ ID NO: 46618 - DNA, 26 bp, Artificial sequence
  SiRNA target sequence
cccttatctccaacatgtgtgttgta

SEQ ID NO: 46619 - DNA, 26 bp, Artificial sequence
  SiRNA target sequence
ccttatctccaacatgtgtgttgtat

SEQ ID NO: 46620 - DNA, 26 bp, Artificial sequence
  SiRNA target sequence
cttatctccaacatgtgtgttgtatt

SEQ ID NO: 46621 - DNA, 26 bp, Artificial sequence
  SiRNA target sequence
ttatctccaacatgtgtgttgtattc

SEQ ID NO: 46622 - DNA, 26 bp, Artificial sequence
  SiRNA target sequence
tatctccaacatgtgtgttgtattca

SEQ ID NO: 46623 - DNA, 26 bp, Artificial sequence
  SiRNA target sequence
atctccaacatgtgtgttgtattcat

SEQ ID NO: 46624 - DNA, 26 bp, Artificial sequence
  SiRNA target sequence
tctccaacatgtgtgttgtattcatc

SEQ ID NO: 46625 - DNA, 26 bp, Artificial sequence
  SiRNA target sequence
ctccaacatgtgtgttgtattcatcc

SEQ ID NO: 46626 - DNA, 26 bp, Artificial sequence
  SiRNA target sequence
tccaacatgtgtgttgtattcatcct

SEQ ID NO: 46627 - DNA, 26 bp, Artificial sequence
  SiRNA target sequence
ccaacatgtgtgttgtattcatcctc

SEQ ID NO: 46628 - DNA, 26 bp, Artificial sequence
  SiRNA target sequence
caacatgtgtgttgtattcatcctct

SEQ ID NO: 46629 - DNA, 26 bp, Artificial sequence
  SiRNA target sequence
aacatgtgtgttgtattcatcctcta

SEQ ID NO: 46630 - DNA, 26 bp, Artificial sequence
  SiRNA target sequence
acatgtgtgttgtattcatcctctag

SEQ ID NO: 46631 - DNA, 26 bp, Artificial sequence
  SiRNA target sequence
catgtgtgttgtattcatcctctagg

SEQ ID NO: 46632 - DNA, 26 bp, Artificial sequence
  SiRNA target sequence
atgtgtgttgtattcatcctctaggt

SEQ ID NO: 46633 - DNA, 26 bp, Artificial sequence
  SiRNA target sequence
tgtgtgttgtattcatcctctaggtt

SEQ ID NO: 46634 - DNA, 26 bp, Artificial sequence
  SiRNA target sequence
gtgtgttgtattcatcctctaggttg

SEQ ID NO: 46635 - DNA, 26 bp, Artificial sequence
  SiRNA target sequence
tgtgttgtattcatcctctaggttgt

SEQ ID NO: 46636 - DNA, 26 bp, Artificial sequence
  SiRNA target sequence
gtgttgtattcatcctctaggttgtt

SEQ ID NO: 46637 - DNA, 26 bp, Artificial sequence
  SiRNA target sequence
tgttgtattcatcctctaggttgttt

SEQ ID NO: 46638 - DNA, 26 bp, Artificial sequence
  SiRNA target sequence
gttgtattcatcctctaggttgttta

SEQ ID NO: 46639 - DNA, 26 bp, Artificial sequence
  SiRNA target sequence
ttgtattcatcctctaggttgtttat

SEQ ID NO: 46640 - DNA, 26 bp, Artificial sequence
  SiRNA target sequence
tgtattcatcctctaggttgtttata

SEQ ID NO: 46641 - DNA, 26 bp, Artificial sequence
  SiRNA target sequence
gtattcatcctctaggttgtttatag

SEQ ID NO: 46642 - DNA, 26 bp, Artificial sequence
  SiRNA target sequence
tattcatcctctaggttgtttataga

SEQ ID NO: 46643 - DNA, 26 bp, Artificial sequence
  SiRNA target sequence
attcatcctctaggttgtttatagaa

SEQ ID NO: 46644 - DNA, 26 bp, Artificial sequence
  SiRNA target sequence
ttcatcctctaggttgtttatagaat

SEQ ID NO: 46645 - DNA, 26 bp, Artificial sequence
  SiRNA target sequence
tcatcctctaggttgtttatagaatc

SEQ ID NO: 46646 - DNA, 26 bp, Artificial sequence
  SiRNA target sequence
catcctctaggttgtttatagaatcg

SEQ ID NO: 46647 - DNA, 26 bp, Artificial sequence
  SiRNA target sequence
atcctctaggttgtttatagaatcgt

SEQ ID NO: 46648 - DNA, 26 bp, Artificial sequence
  SiRNA target sequence
tcctctaggttgtttatagaatcgtg

SEQ ID NO: 46649 - DNA, 26 bp, Artificial sequence
  SiRNA target sequence
cctctaggttgtttatagaatcgtgt

SEQ ID NO: 46650 - DNA, 26 bp, Artificial sequence
  SiRNA target sequence
ctctaggttgtttatagaatcgtgta

SEQ ID NO: 46651 - DNA, 26 bp, Artificial sequence
  SiRNA target sequence
tctaggttgtttatagaatcgtgtac

SEQ ID NO: 46652 - DNA, 26 bp, Artificial sequence
  SiRNA target sequence
ctaggttgtttatagaatcgtgtaca

SEQ ID NO: 46653 - DNA, 26 bp, Artificial sequence
  SiRNA target sequence
taggttgtttatagaatcgtgtacac

SEQ ID NO: 46654 - DNA, 26 bp, Artificial sequence
  SiRNA target sequence
aggttgtttatagaatcgtgtacaca

SEQ ID NO: 46655 - DNA, 26 bp, Artificial sequence
  SiRNA target sequence
ggttgtttatagaatcgtgtacacaa

SEQ ID NO: 46656 - DNA, 26 bp, Artificial sequence
  SiRNA target sequence
gttgtttatagaatcgtgtacacaaa

SEQ ID NO: 46657 - DNA, 26 bp, Artificial sequence
  SiRNA target sequence
ttgtttatagaatcgtgtacacaaag

SEQ ID NO: 46658 - DNA, 26 bp, Artificial sequence
  SiRNA target sequence
tgtttatagaatcgtgtacacaaagt

SEQ ID NO: 46659 - DNA, 26 bp, Artificial sequence
  SiRNA target sequence
gtttatagaatcgtgtacacaaagtt

SEQ ID NO: 46660 - DNA, 26 bp, Artificial sequence
  SiRNA target sequence
tttatagaatcgtgtacacaaagttt

SEQ ID NO: 46661 - DNA, 26 bp, Artificial sequence
  SiRNA target sequence
ttatagaatcgtgtacacaaagtttt

SEQ ID NO: 46662 - DNA, 26 bp, Artificial sequence
  SiRNA target sequence
tatagaatcgtgtacacaaagttttt

SEQ ID NO: 46663 - DNA, 26 bp, Artificial sequence
  SiRNA target sequence
atagaatcgtgtacacaaagtttttt

SEQ ID NO: 46664 - DNA, 26 bp, Artificial sequence
  SiRNA target sequence
tagaatcgtgtacacaaagtttttta

SEQ ID NO: 46665 - DNA, 26 bp, Artificial sequence
  SiRNA target sequence
agaatcgtgtacacaaagttttttac

SEQ ID NO: 46666 - DNA, 26 bp, Artificial sequence
  SiRNA target sequence
gaatcgtgtacacaaagttttttact

SEQ ID NO: 46667 - DNA, 26 bp, Artificial sequence
  SiRNA target sequence
aatcgtgtacacaaagttttttactg

SEQ ID NO: 46668 - DNA, 26 bp, Artificial sequence
  SiRNA target sequence
atcgtgtacacaaagttttttactga

SEQ ID NO: 46669 - DNA, 26 bp, Artificial sequence
  SiRNA target sequence
tcgtgtacacaaagttttttactgat

SEQ ID NO: 46670 - DNA, 26 bp, Artificial sequence
  SiRNA target sequence
cgtgtacacaaagttttttactgatt

SEQ ID NO: 46671 - DNA, 26 bp, Artificial sequence
  SiRNA target sequence
gtgtacacaaagttttttactgattt

SEQ ID NO: 46672 - DNA, 26 bp, Artificial sequence
  SiRNA target sequence
tgtacacaaagttttttactgatttt

SEQ ID NO: 46673 - DNA, 26 bp, Artificial sequence
  SiRNA target sequence
gtacacaaagttttttactgattttt

SEQ ID NO: 46674 - DNA, 26 bp, Artificial sequence
  SiRNA target sequence
tacacaaagttttttactgattttta

SEQ ID NO: 46675 - DNA, 26 bp, Artificial sequence
  SiRNA target sequence
acacaaagttttttactgatttttat

SEQ ID NO: 46676 - DNA, 26 bp, Artificial sequence
  SiRNA target sequence
cacaaagttttttactgatttttata

SEQ ID NO: 46677 - DNA, 26 bp, Artificial sequence
  SiRNA target sequence
acaaagttttttactgatttttataa

SEQ ID NO: 46678 - DNA, 26 bp, Artificial sequence
  SiRNA target sequence
caaagttttttactgatttttataac

SEQ ID NO: 46679 - DNA, 26 bp, Artificial sequence
  SiRNA target sequence
aaagttttttactgatttttataact

SEQ ID NO: 46680 - DNA, 26 bp, Artificial sequence
  SiRNA target sequence
aagttttttactgatttttataactt

SEQ ID NO: 46681 - DNA, 26 bp, Artificial sequence
  SiRNA target sequence
agttttttactgatttttataacttc

SEQ ID NO: 46682 - DNA, 26 bp, Artificial sequence
  SiRNA target sequence
gttttttactgatttttataacttct

SEQ ID NO: 46683 - DNA, 26 bp, Artificial sequence
  SiRNA target sequence
ttttttactgatttttataacttctt

SEQ ID NO: 46684 - DNA, 26 bp, Artificial sequence
  SiRNA target sequence
tttttactgatttttataacttcttc

SEQ ID NO: 46685 - DNA, 26 bp, Artificial sequence
  SiRNA target sequence
ttttactgatttttataacttcttct

SEQ ID NO: 46686 - DNA, 26 bp, Artificial sequence
  SiRNA target sequence
tttactgatttttataacttcttctt

SEQ ID NO: 46687 - DNA, 26 bp, Artificial sequence
  SiRNA target sequence
ttactgatttttataacttcttcttt

SEQ ID NO: 46688 - DNA, 26 bp, Artificial sequence
  SiRNA target sequence
tactgatttttataacttcttcttta

SEQ ID NO: 46689 - DNA, 26 bp, Artificial sequence
  SiRNA target sequence
actgatttttataacttcttctttat

SEQ ID NO: 46690 - DNA, 26 bp, Artificial sequence
  SiRNA target sequence
ctgatttttataacttcttctttatc

SEQ ID NO: 46691 - DNA, 26 bp, Artificial sequence
  SiRNA target sequence
tgatttttataacttcttctttatca

SEQ ID NO: 46692 - DNA, 26 bp, Artificial sequence
  SiRNA target sequence
gatttttataacttcttctttatcaa

SEQ ID NO: 46693 - DNA, 26 bp, Artificial sequence
  SiRNA target sequence
atttttataacttcttctttatcaaa

SEQ ID NO: 46694 - DNA, 26 bp, Artificial sequence
  SiRNA target sequence
tttttataacttcttctttatcaaat

SEQ ID NO: 46695 - DNA, 26 bp, Artificial sequence
  SiRNA target sequence
ttttataacttcttctttatcaaata

SEQ ID NO: 46696 - DNA, 26 bp, Artificial sequence
  SiRNA target sequence
tttataacttcttctttatcaaatat

SEQ ID NO: 46697 - DNA, 26 bp, Artificial sequence
  SiRNA target sequence
ttataacttcttctttatcaaatatt

SEQ ID NO: 46698 - DNA, 26 bp, Artificial sequence
  SiRNA target sequence
tataacttcttctttatcaaatattt

SEQ ID NO: 46699 - DNA, 26 bp, Artificial sequence
  SiRNA target sequence
ataacttcttctttatcaaatatttc

SEQ ID NO: 46700 - DNA, 26 bp, Artificial sequence
  SiRNA target sequence
taacttcttctttatcaaatatttct

SEQ ID NO: 46701 - DNA, 26 bp, Artificial sequence
  SiRNA target sequence
aacttcttctttatcaaatatttctt

SEQ ID NO: 46702 - DNA, 26 bp, Artificial sequence
  SiRNA target sequence
acttcttctttatcaaatatttcttt

SEQ ID NO: 46703 - DNA, 26 bp, Artificial sequence
  SiRNA target sequence
cttcttctttatcaaatatttctttt

SEQ ID NO: 46704 - DNA, 26 bp, Artificial sequence
  SiRNA target sequence
ttcttctttatcaaatatttcttttc

SEQ ID NO: 46705 - DNA, 26 bp, Artificial sequence
  SiRNA target sequence
tcttctttatcaaatatttcttttcc

SEQ ID NO: 46706 - DNA, 26 bp, Artificial sequence
  SiRNA target sequence
cttctttatcaaatatttcttttcca

SEQ ID NO: 46707 - DNA, 26 bp, Artificial sequence
  SiRNA target sequence
ttctttatcaaatatttcttttccat

SEQ ID NO: 46708 - DNA, 26 bp, Artificial sequence
  SiRNA target sequence
tctttatcaaatatttcttttccata

SEQ ID NO: 46709 - DNA, 26 bp, Artificial sequence
  SiRNA target sequence
ctttatcaaatatttcttttccatat

SEQ ID NO: 46710 - DNA, 26 bp, Artificial sequence
  SiRNA target sequence
tttatcaaatatttcttttccatatg

SEQ ID NO: 46711 - DNA, 26 bp, Artificial sequence
  SiRNA target sequence
ttatcaaatatttcttttccatatgt

SEQ ID NO: 46712 - DNA, 26 bp, Artificial sequence
  SiRNA target sequence
tatcaaatatttcttttccatatgtt

SEQ ID NO: 46713 - DNA, 26 bp, Artificial sequence
  SiRNA target sequence
atcaaatatttcttttccatatgtta

SEQ ID NO: 46714 - DNA, 26 bp, Artificial sequence
  SiRNA target sequence
tcaaatatttcttttccatatgttaa

SEQ ID NO: 46715 - DNA, 26 bp, Artificial sequence
  SiRNA target sequence
caaatatttcttttccatatgttaaa

SEQ ID NO: 46716 - DNA, 26 bp, Artificial sequence
  SiRNA target sequence
aaatatttcttttccatatgttaaat

SEQ ID NO: 46717 - DNA, 26 bp, Artificial sequence
  SiRNA target sequence
aatatttcttttccatatgttaaatt

SEQ ID NO: 46718 - DNA, 26 bp, Artificial sequence
  SiRNA target sequence
atatttcttttccatatgttaaatta

SEQ ID NO: 46719 - DNA, 26 bp, Artificial sequence
  SiRNA target sequence
tatttcttttccatatgttaaattat

SEQ ID NO: 46720 - DNA, 26 bp, Artificial sequence
  SiRNA target sequence
atttcttttccatatgttaaattata

SEQ ID NO: 46721 - DNA, 26 bp, Artificial sequence
  SiRNA target sequence
tttcttttccatatgttaaattataa

SEQ ID NO: 46722 - DNA, 26 bp, Artificial sequence
  SiRNA target sequence
ttcttttccatatgttaaattataat

SEQ ID NO: 46723 - DNA, 26 bp, Artificial sequence
  SiRNA target sequence
tcttttccatatgttaaattataata

SEQ ID NO: 46724 - DNA, 26 bp, Artificial sequence
  SiRNA target sequence
cttttccatatgttaaattataataa

SEQ ID NO: 46725 - DNA, 26 bp, Artificial sequence
  SiRNA target sequence
ttttccatatgttaaattataataaa

SEQ ID NO: 46726 - DNA, 26 bp, Artificial sequence
  SiRNA target sequence
tttccatatgttaaattataataaac

SEQ ID NO: 46727 - DNA, 26 bp, Artificial sequence
  SiRNA target sequence
ttccatatgttaaattataataaacc

SEQ ID NO: 46728 - DNA, 26 bp, Artificial sequence
  SiRNA target sequence
tccatatgttaaattataataaaccg

SEQ ID NO: 46729 - DNA, 26 bp, Artificial sequence
  SiRNA target sequence
ccatatgttaaattataataaaccgt

SEQ ID NO: 46730 - DNA, 26 bp, Artificial sequence
  SiRNA target sequence
catatgttaaattataataaaccgtt

SEQ ID NO: 46731 - DNA, 26 bp, Artificial sequence
  SiRNA target sequence
atatgttaaattataataaaccgttt

SEQ ID NO: 46732 - DNA, 26 bp, Artificial sequence
  SiRNA target sequence
tatgttaaattataataaaccgtttc

SEQ ID NO: 46733 - DNA, 26 bp, Artificial sequence
  SiRNA target sequence
atgttaaattataataaaccgtttcg

SEQ ID NO: 46734 - DNA, 26 bp, Artificial sequence
  SiRNA target sequence
tgttaaattataataaaccgtttcgt

SEQ ID NO: 46735 - DNA, 26 bp, Artificial sequence
  SiRNA target sequence
gttaaattataataaaccgtttcgtt

SEQ ID NO: 46736 - DNA, 26 bp, Artificial sequence
  SiRNA target sequence
ttaaattataataaaccgtttcgtta

SEQ ID NO: 46737 - DNA, 26 bp, Artificial sequence
  SiRNA target sequence
taaattataataaaccgtttcgttaa

SEQ ID NO: 46738 - DNA, 26 bp, Artificial sequence
  SiRNA target sequence
aaattataataaaccgtttcgttaaa

SEQ ID NO: 46739 - DNA, 26 bp, Artificial sequence
  SiRNA target sequence
aattataataaaccgtttcgttaaac

SEQ ID NO: 46740 - DNA, 26 bp, Artificial sequence
  SiRNA target sequence
attataataaaccgtttcgttaaaca

SEQ ID NO: 46741 - DNA, 26 bp, Artificial sequence
  SiRNA target sequence
ttataataaaccgtttcgttaaacaa

SEQ ID NO: 46742 - DNA, 26 bp, Artificial sequence
  SiRNA target sequence
tataataaaccgtttcgttaaacaaa

SEQ ID NO: 46743 - DNA, 26 bp, Artificial sequence
  SiRNA target sequence
ataataaaccgtttcgttaaacaaaa

SEQ ID NO: 46744 - DNA, 26 bp, Artificial sequence
  SiRNA target sequence
taataaaccgtttcgttaaacaaaaa

SEQ ID NO: 46745 - DNA, 26 bp, Artificial sequence
  SiRNA target sequence
aataaaccgtttcgttaaacaaaaat

SEQ ID NO: 46746 - DNA, 26 bp, Artificial sequence
  SiRNA target sequence
ataaaccgtttcgttaaacaaaaatg

SEQ ID NO: 46747 - DNA, 26 bp, Artificial sequence
  SiRNA target sequence
taaaccgtttcgttaaacaaaaatga

SEQ ID NO: 46748 - DNA, 26 bp, Artificial sequence
  SiRNA target sequence
aaaccgtttcgttaaacaaaaatgag

SEQ ID NO: 46749 - DNA, 26 bp, Artificial sequence
  SiRNA target sequence
aaccgtttcgttaaacaaaaatgagg

SEQ ID NO: 46750 - DNA, 26 bp, Artificial sequence
  SiRNA target sequence
accgtttcgttaaacaaaaatgaggt

SEQ ID NO: 46751 - DNA, 26 bp, Artificial sequence
  SiRNA target sequence
ccgtttcgttaaacaaaaatgaggtt

SEQ ID NO: 46752 - DNA, 26 bp, Artificial sequence
  SiRNA target sequence
cgtttcgttaaacaaaaatgaggttt

SEQ ID NO: 46753 - DNA, 26 bp, Artificial sequence
  SiRNA target sequence
gtttcgttaaacaaaaatgaggtttg

SEQ ID NO: 46754 - DNA, 26 bp, Artificial sequence
  SiRNA target sequence
tttcgttaaacaaaaatgaggtttgt

SEQ ID NO: 46755 - DNA, 26 bp, Artificial sequence
  SiRNA target sequence
ttcgttaaacaaaaatgaggtttgtg

SEQ ID NO: 46756 - DNA, 26 bp, Artificial sequence
  SiRNA target sequence
tcgttaaacaaaaatgaggtttgtgg

SEQ ID NO: 46757 - DNA, 26 bp, Artificial sequence
  SiRNA target sequence
cgttaaacaaaaatgaggtttgtggt

SEQ ID NO: 46758 - DNA, 26 bp, Artificial sequence
  SiRNA target sequence
gttaaacaaaaatgaggtttgtggtg

SEQ ID NO: 46759 - DNA, 26 bp, Artificial sequence
  SiRNA target sequence
ttaaacaaaaatgaggtttgtggtgc

SEQ ID NO: 46760 - DNA, 26 bp, Artificial sequence
  SiRNA target sequence
taaacaaaaatgaggtttgtggtgca

SEQ ID NO: 46761 - DNA, 26 bp, Artificial sequence
  SiRNA target sequence
aaacaaaaatgaggtttgtggtgcaa

SEQ ID NO: 46762 - DNA, 26 bp, Artificial sequence
  SiRNA target sequence
aacaaaaatgaggtttgtggtgcaaa

SEQ ID NO: 46763 - DNA, 26 bp, Artificial sequence
  SiRNA target sequence
acaaaaatgaggtttgtggtgcaaat

SEQ ID NO: 46764 - DNA, 26 bp, Artificial sequence
  SiRNA target sequence
caaaaatgaggtttgtggtgcaaatg

SEQ ID NO: 46765 - DNA, 26 bp, Artificial sequence
  SiRNA target sequence
aaaaatgaggtttgtggtgcaaatga

SEQ ID NO: 46766 - DNA, 26 bp, Artificial sequence
  SiRNA target sequence
aaaatgaggtttgtggtgcaaatgat

SEQ ID NO: 46767 - DNA, 26 bp, Artificial sequence
  SiRNA target sequence
aaatgaggtttgtggtgcaaatgata

SEQ ID NO: 46768 - DNA, 26 bp, Artificial sequence
  SiRNA target sequence
aatgaggtttgtggtgcaaatgatat

SEQ ID NO: 46769 - DNA, 26 bp, Artificial sequence
  SiRNA target sequence
atgaggtttgtggtgcaaatgatata

SEQ ID NO: 46770 - DNA, 26 bp, Artificial sequence
  SiRNA target sequence
tgaggtttgtggtgcaaatgatataa

SEQ ID NO: 46771 - DNA, 26 bp, Artificial sequence
  SiRNA target sequence
gaggtttgtggtgcaaatgatataag

SEQ ID NO: 46772 - DNA, 26 bp, Artificial sequence
  SiRNA target sequence
aggtttgtggtgcaaatgatataagt

SEQ ID NO: 46773 - DNA, 26 bp, Artificial sequence
  SiRNA target sequence
ggtttgtggtgcaaatgatataagtg

SEQ ID NO: 46774 - DNA, 26 bp, Artificial sequence
  SiRNA target sequence
gtttgtggtgcaaatgatataagtga

SEQ ID NO: 46775 - DNA, 26 bp, Artificial sequence
  SiRNA target sequence
tttgtggtgcaaatgatataagtgat

SEQ ID NO: 46776 - DNA, 26 bp, Artificial sequence
  SiRNA target sequence
ttgtggtgcaaatgatataagtgatc

SEQ ID NO: 46777 - DNA, 26 bp, Artificial sequence
  SiRNA target sequence
tgtggtgcaaatgatataagtgatct

SEQ ID NO: 46778 - DNA, 26 bp, Artificial sequence
  SiRNA target sequence
gtggtgcaaatgatataagtgatcta

SEQ ID NO: 46779 - DNA, 26 bp, Artificial sequence
  SiRNA target sequence
tggtgcaaatgatataagtgatctat

SEQ ID NO: 46780 - DNA, 26 bp, Artificial sequence
  SiRNA target sequence
ggtgcaaatgatataagtgatctata

SEQ ID NO: 46781 - DNA, 26 bp, Artificial sequence
  SiRNA target sequence
gtgcaaatgatataagtgatctatat

SEQ ID NO: 46782 - DNA, 26 bp, Artificial sequence
  SiRNA target sequence
tgcaaatgatataagtgatctatatg

SEQ ID NO: 46783 - DNA, 26 bp, Artificial sequence
  SiRNA target sequence
gcaaatgatataagtgatctatatga

SEQ ID NO: 46784 - DNA, 26 bp, Artificial sequence
  SiRNA target sequence
caaatgatataagtgatctatatgaa

SEQ ID NO: 46785 - DNA, 26 bp, Artificial sequence
  SiRNA target sequence
aaatgatataagtgatctatatgaac

SEQ ID NO: 46786 - DNA, 26 bp, Artificial sequence
  SiRNA target sequence
aatgatataagtgatctatatgaact

SEQ ID NO: 46787 - DNA, 26 bp, Artificial sequence
  SiRNA target sequence
atgatataagtgatctatatgaacta

SEQ ID NO: 46788 - DNA, 26 bp, Artificial sequence
  SiRNA target sequence
tgatataagtgatctatatgaactat

SEQ ID NO: 46789 - DNA, 26 bp, Artificial sequence
  SiRNA target sequence
gatataagtgatctatatgaactatt

SEQ ID NO: 46790 - DNA, 26 bp, Artificial sequence
  SiRNA target sequence
atataagtgatctatatgaactatta

SEQ ID NO: 46791 - DNA, 26 bp, Artificial sequence
  SiRNA target sequence
tataagtgatctatatgaactattag

SEQ ID NO: 46792 - DNA, 26 bp, Artificial sequence
  SiRNA target sequence
ataagtgatctatatgaactattaga

SEQ ID NO: 46793 - DNA, 26 bp, Artificial sequence
  SiRNA target sequence
taagtgatctatatgaactattagaa

SEQ ID NO: 46794 - DNA, 26 bp, Artificial sequence
  SiRNA target sequence
aagtgatctatatgaactattagaaa

SEQ ID NO: 46795 - DNA, 26 bp, Artificial sequence
  SiRNA target sequence
agtgatctatatgaactattagaaat

SEQ ID NO: 46796 - DNA, 26 bp, Artificial sequence
  SiRNA target sequence
gtgatctatatgaactattagaaatt

SEQ ID NO: 46797 - DNA, 26 bp, Artificial sequence
  SiRNA target sequence
tgatctatatgaactattagaaattt

SEQ ID NO: 46798 - DNA, 26 bp, Artificial sequence
  SiRNA target sequence
gatctatatgaactattagaaatttc

SEQ ID NO: 46799 - DNA, 26 bp, Artificial sequence
  SiRNA target sequence
atctatatgaactattagaaatttct

SEQ ID NO: 46800 - DNA, 26 bp, Artificial sequence
  SiRNA target sequence
tctatatgaactattagaaatttctt

SEQ ID NO: 46801 - DNA, 26 bp, Artificial sequence
  SiRNA target sequence
ctatatgaactattagaaatttcttt

SEQ ID NO: 46802 - DNA, 26 bp, Artificial sequence
  SiRNA target sequence
tatatgaactattagaaatttctttt

SEQ ID NO: 46803 - DNA, 26 bp, Artificial sequence
  SiRNA target sequence
atatgaactattagaaatttctttta

SEQ ID NO: 46804 - DNA, 26 bp, Artificial sequence
  SiRNA target sequence
tatgaactattagaaatttcttttat

SEQ ID NO: 46805 - DNA, 26 bp, Artificial sequence
  SiRNA target sequence
atgaactattagaaatttcttttata

SEQ ID NO: 46806 - DNA, 26 bp, Artificial sequence
  SiRNA target sequence
tgaactattagaaatttcttttatat

SEQ ID NO: 46807 - DNA, 26 bp, Artificial sequence
  SiRNA target sequence
gaactattagaaatttcttttatatc

SEQ ID NO: 46808 - DNA, 26 bp, Artificial sequence
  SiRNA target sequence
aactattagaaatttcttttatatct

SEQ ID NO: 46809 - DNA, 26 bp, Artificial sequence
  SiRNA target sequence
actattagaaatttcttttatatctc

SEQ ID NO: 46810 - DNA, 26 bp, Artificial sequence
  SiRNA target sequence
ctattagaaatttcttttatatctcg

SEQ ID NO: 46811 - DNA, 26 bp, Artificial sequence
  SiRNA target sequence
tattagaaatttcttttatatctcga

SEQ ID NO: 46812 - DNA, 26 bp, Artificial sequence
  SiRNA target sequence
attagaaatttcttttatatctcgat

SEQ ID NO: 46813 - DNA, 26 bp, Artificial sequence
  SiRNA target sequence
ttagaaatttcttttatatctcgatt

SEQ ID NO: 46814 - DNA, 26 bp, Artificial sequence
  SiRNA target sequence
tagaaatttcttttatatctcgatta

SEQ ID NO: 46815 - DNA, 26 bp, Artificial sequence
  SiRNA target sequence
agaaatttcttttatatctcgattat

SEQ ID NO: 46816 - DNA, 26 bp, Artificial sequence
  SiRNA target sequence
gaaatttcttttatatctcgattatc

SEQ ID NO: 46817 - DNA, 26 bp, Artificial sequence
  SiRNA target sequence
aaatttcttttatatctcgattatct

SEQ ID NO: 46818 - DNA, 26 bp, Artificial sequence
  SiRNA target sequence
aatttcttttatatctcgattatcta

SEQ ID NO: 46819 - DNA, 26 bp, Artificial sequence
  SiRNA target sequence
atttcttttatatctcgattatctag

SEQ ID NO: 46820 - DNA, 26 bp, Artificial sequence
  SiRNA target sequence
tttcttttatatctcgattatctaga

SEQ ID NO: 46821 - DNA, 26 bp, Artificial sequence
  SiRNA target sequence
ttcttttatatctcgattatctagat

SEQ ID NO: 46822 - DNA, 26 bp, Artificial sequence
  SiRNA target sequence
tcttttatatctcgattatctagata

SEQ ID NO: 46823 - DNA, 26 bp, Artificial sequence
  SiRNA target sequence
cttttatatctcgattatctagataa

SEQ ID NO: 46824 - DNA, 26 bp, Artificial sequence
  SiRNA target sequence
ttttatatctcgattatctagataaa

SEQ ID NO: 46825 - DNA, 26 bp, Artificial sequence
  SiRNA target sequence
tttatatctcgattatctagataaat

SEQ ID NO: 46826 - DNA, 26 bp, Artificial sequence
  SiRNA target sequence
ttatatctcgattatctagataaata

SEQ ID NO: 46827 - DNA, 26 bp, Artificial sequence
  SiRNA target sequence
tatatctcgattatctagataaatat

SEQ ID NO: 46828 - DNA, 26 bp, Artificial sequence
  SiRNA target sequence
atatctcgattatctagataaatatt

SEQ ID NO: 46829 - DNA, 26 bp, Artificial sequence
  SiRNA target sequence
tatctcgattatctagataaatattt

SEQ ID NO: 46830 - DNA, 26 bp, Artificial sequence
  SiRNA target sequence
atctcgattatctagataaatatttc

SEQ ID NO: 46831 - DNA, 26 bp, Artificial sequence
  SiRNA target sequence
tctcgattatctagataaatatttcc

SEQ ID NO: 46832 - DNA, 26 bp, Artificial sequence
  SiRNA target sequence
ctcgattatctagataaatatttccc

SEQ ID NO: 46833 - DNA, 26 bp, Artificial sequence
  SiRNA target sequence
tcgattatctagataaatatttcccc

SEQ ID NO: 46834 - DNA, 26 bp, Artificial sequence
  SiRNA target sequence
cgattatctagataaatatttccccc

SEQ ID NO: 46835 - DNA, 26 bp, Artificial sequence
  SiRNA target sequence
gattatctagataaatatttccccca

SEQ ID NO: 46836 - DNA, 26 bp, Artificial sequence
  SiRNA target sequence
attatctagataaatatttcccccat

SEQ ID NO: 46837 - DNA, 26 bp, Artificial sequence
  SiRNA target sequence
ttatctagataaatatttcccccata

SEQ ID NO: 46838 - DNA, 26 bp, Artificial sequence
  SiRNA target sequence
tatctagataaatatttcccccataa

SEQ ID NO: 46839 - DNA, 26 bp, Artificial sequence
  SiRNA target sequence
atctagataaatatttcccccataat

SEQ ID NO: 46840 - DNA, 26 bp, Artificial sequence
  SiRNA target sequence
tctagataaatatttcccccataatt

SEQ ID NO: 46841 - DNA, 26 bp, Artificial sequence
  SiRNA target sequence
ctagataaatatttcccccataattt

SEQ ID NO: 46842 - DNA, 26 bp, Artificial sequence
  SiRNA target sequence
tagataaatatttcccccataatttt

SEQ ID NO: 46843 - DNA, 26 bp, Artificial sequence
  SiRNA target sequence
agataaatatttcccccataattttc

SEQ ID NO: 46844 - DNA, 26 bp, Artificial sequence
  SiRNA target sequence
gataaatatttcccccataattttca

SEQ ID NO: 46845 - DNA, 26 bp, Artificial sequence
  SiRNA target sequence
ataaatatttcccccataattttcaa

SEQ ID NO: 46846 - DNA, 26 bp, Artificial sequence
  SiRNA target sequence
taaatatttcccccataattttcaaa

SEQ ID NO: 46847 - DNA, 26 bp, Artificial sequence
  SiRNA target sequence
aaatatttcccccataattttcaaat

SEQ ID NO: 46848 - DNA, 26 bp, Artificial sequence
  SiRNA target sequence
aatatttcccccataattttcaaatc

SEQ ID NO: 46849 - DNA, 26 bp, Artificial sequence
  SiRNA target sequence
atatttcccccataattttcaaatct

SEQ ID NO: 46850 - DNA, 26 bp, Artificial sequence
  SiRNA target sequence
tatttcccccataattttcaaatctc

SEQ ID NO: 46851 - DNA, 26 bp, Artificial sequence
  SiRNA target sequence
atttcccccataattttcaaatctca

SEQ ID NO: 46852 - DNA, 26 bp, Artificial sequence
  SiRNA target sequence
tttcccccataattttcaaatctcat

SEQ ID NO: 46853 - DNA, 26 bp, Artificial sequence
  SiRNA target sequence
ttcccccataattttcaaatctcata

SEQ ID NO: 46854 - DNA, 26 bp, Artificial sequence
  SiRNA target sequence
tcccccataattttcaaatctcataa

SEQ ID NO: 46855 - DNA, 26 bp, Artificial sequence
  SiRNA target sequence
cccccataattttcaaatctcataat

SEQ ID NO: 46856 - DNA, 26 bp, Artificial sequence
  SiRNA target sequence
ccccataattttcaaatctcataatc

SEQ ID NO: 46857 - DNA, 26 bp, Artificial sequence
  SiRNA target sequence
cccataattttcaaatctcataatca

SEQ ID NO: 46858 - DNA, 26 bp, Artificial sequence
  SiRNA target sequence
ccataattttcaaatctcataatcat

SEQ ID NO: 46859 - DNA, 26 bp, Artificial sequence
  SiRNA target sequence
cataattttcaaatctcataatcatc

SEQ ID NO: 46860 - DNA, 26 bp, Artificial sequence
  SiRNA target sequence
ataattttcaaatctcataatcatct

SEQ ID NO: 46861 - DNA, 26 bp, Artificial sequence
  SiRNA target sequence
taattttcaaatctcataatcatctt

SEQ ID NO: 46862 - DNA, 26 bp, Artificial sequence
  SiRNA target sequence
aattttcaaatctcataatcatcttt

SEQ ID NO: 46863 - DNA, 26 bp, Artificial sequence
  SiRNA target sequence
attttcaaatctcataatcatcttta

SEQ ID NO: 46864 - DNA, 26 bp, Artificial sequence
  SiRNA target sequence
ttttcaaatctcataatcatctttat

SEQ ID NO: 46865 - DNA, 26 bp, Artificial sequence
  SiRNA target sequence
tttcaaatctcataatcatctttata

SEQ ID NO: 46866 - DNA, 26 bp, Artificial sequence
  SiRNA target sequence
ttcaaatctcataatcatctttataa

SEQ ID NO: 46867 - DNA, 26 bp, Artificial sequence
  SiRNA target sequence
tcaaatctcataatcatctttataag

SEQ ID NO: 46868 - DNA, 26 bp, Artificial sequence
  SiRNA target sequence
caaatctcataatcatctttataaga

SEQ ID NO: 46869 - DNA, 26 bp, Artificial sequence
  SiRNA target sequence
aaatctcataatcatctttataagag

SEQ ID NO: 46870 - DNA, 26 bp, Artificial sequence
  SiRNA target sequence
aatctcataatcatctttataagaga

SEQ ID NO: 46871 - DNA, 26 bp, Artificial sequence
  SiRNA target sequence
atctcataatcatctttataagagat

SEQ ID NO: 46872 - DNA, 26 bp, Artificial sequence
  SiRNA target sequence
tctcataatcatctttataagagatg

SEQ ID NO: 46873 - DNA, 26 bp, Artificial sequence
  SiRNA target sequence
ctcataatcatctttataagagatgt

SEQ ID NO: 46874 - DNA, 26 bp, Artificial sequence
  SiRNA target sequence
tcataatcatctttataagagatgtt

SEQ ID NO: 46875 - DNA, 26 bp, Artificial sequence
  SiRNA target sequence
cataatcatctttataagagatgttt

SEQ ID NO: 46876 - DNA, 26 bp, Artificial sequence
  SiRNA target sequence
ataatcatctttataagagatgtttt

SEQ ID NO: 46877 - DNA, 26 bp, Artificial sequence
  SiRNA target sequence
taatcatctttataagagatgttttt

SEQ ID NO: 46878 - DNA, 26 bp, Artificial sequence
  SiRNA target sequence
aatcatctttataagagatgtttttc

SEQ ID NO: 46879 - DNA, 26 bp, Artificial sequence
  SiRNA target sequence
atcatctttataagagatgtttttcc

SEQ ID NO: 46880 - DNA, 26 bp, Artificial sequence
  SiRNA target sequence
tcatctttataagagatgtttttccc

SEQ ID NO: 46881 - DNA, 26 bp, Artificial sequence
  SiRNA target sequence
catctttataagagatgtttttcccg

SEQ ID NO: 46882 - DNA, 26 bp, Artificial sequence
  SiRNA target sequence
atctttataagagatgtttttcccga

SEQ ID NO: 46883 - DNA, 26 bp, Artificial sequence
  SiRNA target sequence
tctttataagagatgtttttcccgat

SEQ ID NO: 46884 - DNA, 26 bp, Artificial sequence
  SiRNA target sequence
ctttataagagatgtttttcccgatc

SEQ ID NO: 46885 - DNA, 26 bp, Artificial sequence
  SiRNA target sequence
tttataagagatgtttttcccgatcc

SEQ ID NO: 46886 - DNA, 26 bp, Artificial sequence
  SiRNA target sequence
ttataagagatgtttttcccgatcca

SEQ ID NO: 46887 - DNA, 26 bp, Artificial sequence
  SiRNA target sequence
tataagagatgtttttcccgatccat

SEQ ID NO: 46888 - DNA, 26 bp, Artificial sequence
  SiRNA target sequence
ataagagatgtttttcccgatccatt

SEQ ID NO: 46889 - DNA, 26 bp, Artificial sequence
  SiRNA target sequence
taagagatgtttttcccgatccattt

SEQ ID NO: 46890 - DNA, 26 bp, Artificial sequence
  SiRNA target sequence
aagagatgtttttcccgatccatttt

SEQ ID NO: 46891 - DNA, 26 bp, Artificial sequence
  SiRNA target sequence
agagatgtttttcccgatccattttt

SEQ ID NO: 46892 - DNA, 26 bp, Artificial sequence
  SiRNA target sequence
gagatgtttttcccgatccatttttt

SEQ ID NO: 46893 - DNA, 26 bp, Artificial sequence
  SiRNA target sequence
agatgtttttcccgatccattttttc

SEQ ID NO: 46894 - DNA, 26 bp, Artificial sequence
  SiRNA target sequence
gatgtttttcccgatccattttttcc

SEQ ID NO: 46895 - DNA, 26 bp, Artificial sequence
  SiRNA target sequence
atgtttttcccgatccattttttcca

SEQ ID NO: 46896 - DNA, 26 bp, Artificial sequence
  SiRNA target sequence
tgtttttcccgatccattttttccaa

SEQ ID NO: 46897 - DNA, 26 bp, Artificial sequence
  SiRNA target sequence
gtttttcccgatccattttttccaat

SEQ ID NO: 46898 - DNA, 26 bp, Artificial sequence
  SiRNA target sequence
tttttcccgatccattttttccaata

SEQ ID NO: 46899 - DNA, 26 bp, Artificial sequence
  SiRNA target sequence
ttttcccgatccattttttccaataa

SEQ ID NO: 46900 - DNA, 26 bp, Artificial sequence
  SiRNA target sequence
tttcccgatccattttttccaataat

SEQ ID NO: 46901 - DNA, 26 bp, Artificial sequence
  SiRNA target sequence
ttcccgatccattttttccaataata

SEQ ID NO: 46902 - DNA, 26 bp, Artificial sequence
  SiRNA target sequence
tcccgatccattttttccaataatag

SEQ ID NO: 46903 - DNA, 26 bp, Artificial sequence
  SiRNA target sequence
cccgatccattttttccaataatagc

SEQ ID NO: 46904 - DNA, 26 bp, Artificial sequence
  SiRNA target sequence
ccgatccattttttccaataatagct

SEQ ID NO: 46905 - DNA, 26 bp, Artificial sequence
  SiRNA target sequence
cgatccattttttccaataatagcta

SEQ ID NO: 46906 - DNA, 26 bp, Artificial sequence
  SiRNA target sequence
gatccattttttccaataatagctac

SEQ ID NO: 46907 - DNA, 26 bp, Artificial sequence
  SiRNA target sequence
atccattttttccaataatagctact

SEQ ID NO: 46908 - DNA, 26 bp, Artificial sequence
  SiRNA target sequence
tccattttttccaataatagctactt

SEQ ID NO: 46909 - DNA, 26 bp, Artificial sequence
  SiRNA target sequence
ccattttttccaataatagctacttt

SEQ ID NO: 46910 - DNA, 26 bp, Artificial sequence
  SiRNA target sequence
cattttttccaataatagctactttt

SEQ ID NO: 46911 - DNA, 26 bp, Artificial sequence
  SiRNA target sequence
attttttccaataatagctacttttt

SEQ ID NO: 46912 - DNA, 26 bp, Artificial sequence
  SiRNA target sequence
ttttttccaataatagctactttttc

SEQ ID NO: 46913 - DNA, 26 bp, Artificial sequence
  SiRNA target sequence
tttttccaataatagctactttttca

SEQ ID NO: 46914 - DNA, 26 bp, Artificial sequence
  SiRNA target sequence
ttttccaataatagctactttttcac

SEQ ID NO: 46915 - DNA, 26 bp, Artificial sequence
  SiRNA target sequence
tttccaataatagctactttttcacc

SEQ ID NO: 46916 - DNA, 26 bp, Artificial sequence
  SiRNA target sequence
ttccaataatagctactttttcacct

SEQ ID NO: 46917 - DNA, 26 bp, Artificial sequence
  SiRNA target sequence
tccaataatagctactttttcacctt

SEQ ID NO: 46918 - DNA, 26 bp, Artificial sequence
  SiRNA target sequence
ccaataatagctactttttcaccttt

SEQ ID NO: 46919 - DNA, 26 bp, Artificial sequence
  SiRNA target sequence
caataatagctactttttcacctttt

SEQ ID NO: 46920 - DNA, 26 bp, Artificial sequence
  SiRNA target sequence
aataatagctactttttcaccttttt

SEQ ID NO: 46921 - DNA, 26 bp, Artificial sequence
  SiRNA target sequence
ataatagctactttttcacctttttt

SEQ ID NO: 46922 - DNA, 26 bp, Artificial sequence
  SiRNA target sequence
taatagctactttttcacctttttta

SEQ ID NO: 46923 - DNA, 26 bp, Artificial sequence
  SiRNA target sequence
aatagctactttttcaccttttttaa

SEQ ID NO: 46924 - DNA, 26 bp, Artificial sequence
  SiRNA target sequence
atagctactttttcaccttttttaat

SEQ ID NO: 46925 - DNA, 26 bp, Artificial sequence
  SiRNA target sequence
tagctactttttcaccttttttaatt

SEQ ID NO: 46926 - DNA, 26 bp, Artificial sequence
  SiRNA target sequence
agctactttttcaccttttttaatta

SEQ ID NO: 46927 - DNA, 26 bp, Artificial sequence
  SiRNA target sequence
gctactttttcaccttttttaattaa

SEQ ID NO: 46928 - DNA, 26 bp, Artificial sequence
  SiRNA target sequence
ctactttttcaccttttttaattaaa

SEQ ID NO: 46929 - DNA, 26 bp, Artificial sequence
  SiRNA target sequence
tactttttcaccttttttaattaaaa

SEQ ID NO: 46930 - DNA, 26 bp, Artificial sequence
  SiRNA target sequence
actttttcaccttttttaattaaaat

SEQ ID NO: 46931 - DNA, 26 bp, Artificial sequence
  SiRNA target sequence
ctttttcaccttttttaattaaaata

SEQ ID NO: 46932 - DNA, 26 bp, Artificial sequence
  SiRNA target sequence
tttttcaccttttttaattaaaatat

SEQ ID NO: 46933 - DNA, 26 bp, Artificial sequence
  SiRNA target sequence
ttttcaccttttttaattaaaatatt

SEQ ID NO: 46934 - DNA, 26 bp, Artificial sequence
  SiRNA target sequence
tttcaccttttttaattaaaatattt

SEQ ID NO: 46935 - DNA, 26 bp, Artificial sequence
  SiRNA target sequence
ttcaccttttttaattaaaatattta

SEQ ID NO: 46936 - DNA, 26 bp, Artificial sequence
  SiRNA target sequence
tcaccttttttaattaaaatatttat

SEQ ID NO: 46937 - DNA, 26 bp, Artificial sequence
  SiRNA target sequence
caccttttttaattaaaatatttatg

SEQ ID NO: 46938 - DNA, 26 bp, Artificial sequence
  SiRNA target sequence
accttttttaattaaaatatttatgt

SEQ ID NO: 46939 - DNA, 26 bp, Artificial sequence
  SiRNA target sequence
ccttttttaattaaaatatttatgtc

SEQ ID NO: 46940 - DNA, 26 bp, Artificial sequence
  SiRNA target sequence
cttttttaattaaaatatttatgtcc

SEQ ID NO: 46941 - DNA, 26 bp, Artificial sequence
  SiRNA target sequence
ttttttaattaaaatatttatgtccg

SEQ ID NO: 46942 - DNA, 26 bp, Artificial sequence
  SiRNA target sequence
tttttaattaaaatatttatgtccgt

SEQ ID NO: 46943 - DNA, 26 bp, Artificial sequence
  SiRNA target sequence
ttttaattaaaatatttatgtccgtt

SEQ ID NO: 46944 - DNA, 26 bp, Artificial sequence
  SiRNA target sequence
tttaattaaaatatttatgtccgtta

SEQ ID NO: 46945 - DNA, 26 bp, Artificial sequence
  SiRNA target sequence
ttaattaaaatatttatgtccgttaa

SEQ ID NO: 46946 - DNA, 26 bp, Artificial sequence
  SiRNA target sequence
taattaaaatatttatgtccgttaaa

SEQ ID NO: 46947 - DNA, 26 bp, Artificial sequence
  SiRNA target sequence
aattaaaatatttatgtccgttaaaa

SEQ ID NO: 46948 - DNA, 26 bp, Artificial sequence
  SiRNA target sequence
attaaaatatttatgtccgttaaaat

SEQ ID NO: 46949 - DNA, 26 bp, Artificial sequence
  SiRNA target sequence
ttaaaatatttatgtccgttaaaatt

SEQ ID NO: 46950 - DNA, 26 bp, Artificial sequence
  SiRNA target sequence
taaaatatttatgtccgttaaaattt

SEQ ID NO: 46951 - DNA, 26 bp, Artificial sequence
  SiRNA target sequence
aaaatatttatgtccgttaaaatttt

SEQ ID NO: 46952 - DNA, 26 bp, Artificial sequence
  SiRNA target sequence
aaatatttatgtccgttaaaattttt

SEQ ID NO: 46953 - DNA, 26 bp, Artificial sequence
  SiRNA target sequence
aatatttatgtccgttaaaatttttt

SEQ ID NO: 46954 - DNA, 26 bp, Artificial sequence
  SiRNA target sequence
atatttatgtccgttaaaattttttt

SEQ ID NO: 46955 - DNA, 26 bp, Artificial sequence
  SiRNA target sequence
tatttatgtccgttaaaatttttttg

SEQ ID NO: 46956 - DNA, 26 bp, Artificial sequence
  SiRNA target sequence
atttatgtccgttaaaatttttttgg

SEQ ID NO: 46957 - DNA, 26 bp, Artificial sequence
  SiRNA target sequence
tttatgtccgttaaaatttttttgga

SEQ ID NO: 46958 - DNA, 26 bp, Artificial sequence
  SiRNA target sequence
ttatgtccgttaaaatttttttggag

SEQ ID NO: 46959 - DNA, 26 bp, Artificial sequence
  SiRNA target sequence
tatgtccgttaaaatttttttggagt

SEQ ID NO: 46960 - DNA, 26 bp, Artificial sequence
  SiRNA target sequence
atgtccgttaaaatttttttggagta

SEQ ID NO: 46961 - DNA, 26 bp, Artificial sequence
  SiRNA target sequence
tgtccgttaaaatttttttggagtaa

SEQ ID NO: 46962 - DNA, 26 bp, Artificial sequence
  SiRNA target sequence
gtccgttaaaatttttttggagtaat

SEQ ID NO: 46963 - DNA, 26 bp, Artificial sequence
  SiRNA target sequence
tccgttaaaatttttttggagtaata

SEQ ID NO: 46964 - DNA, 26 bp, Artificial sequence
  SiRNA target sequence
ccgttaaaatttttttggagtaataa

SEQ ID NO: 46965 - DNA, 26 bp, Artificial sequence
  SiRNA target sequence
cgttaaaatttttttggagtaataat

SEQ ID NO: 46966 - DNA, 26 bp, Artificial sequence
  SiRNA target sequence
gttaaaatttttttggagtaataatt

SEQ ID NO: 46967 - DNA, 26 bp, Artificial sequence
  SiRNA target sequence
ttaaaatttttttggagtaataatta

SEQ ID NO: 46968 - DNA, 26 bp, Artificial sequence
  SiRNA target sequence
taaaatttttttggagtaataattaa

SEQ ID NO: 46969 - DNA, 26 bp, Artificial sequence
  SiRNA target sequence
aaaatttttttggagtaataattaaa

SEQ ID NO: 46970 - DNA, 26 bp, Artificial sequence
  SiRNA target sequence
aaatttttttggagtaataattaaat

SEQ ID NO: 46971 - DNA, 26 bp, Artificial sequence
  SiRNA target sequence
aatttttttggagtaataattaaatg

SEQ ID NO: 46972 - DNA, 26 bp, Artificial sequence
  SiRNA target sequence
atttttttggagtaataattaaatga

SEQ ID NO: 46973 - DNA, 26 bp, Artificial sequence
  SiRNA target sequence
tttttttggagtaataattaaatgat

SEQ ID NO: 46974 - DNA, 26 bp, Artificial sequence
  SiRNA target sequence
ttttttggagtaataattaaatgatg

SEQ ID NO: 46975 - DNA, 26 bp, Artificial sequence
  SiRNA target sequence
tttttggagtaataattaaatgatgc

SEQ ID NO: 46976 - DNA, 26 bp, Artificial sequence
  SiRNA target sequence
ttttggagtaataattaaatgatgca

SEQ ID NO: 46977 - DNA, 26 bp, Artificial sequence
  SiRNA target sequence
tttggagtaataattaaatgatgcat

SEQ ID NO: 46978 - DNA, 26 bp, Artificial sequence
  SiRNA target sequence
ttggagtaataattaaatgatgcatt

SEQ ID NO: 46979 - DNA, 26 bp, Artificial sequence
  SiRNA target sequence
tggagtaataattaaatgatgcattt

SEQ ID NO: 46980 - DNA, 26 bp, Artificial sequence
  SiRNA target sequence
ggagtaataattaaatgatgcatttt

SEQ ID NO: 46981 - DNA, 26 bp, Artificial sequence
  SiRNA target sequence
gagtaataattaaatgatgcattttc

SEQ ID NO: 46982 - DNA, 26 bp, Artificial sequence
  SiRNA target sequence
agtaataattaaatgatgcattttct

SEQ ID NO: 46983 - DNA, 26 bp, Artificial sequence
  SiRNA target sequence
gtaataattaaatgatgcattttcta

SEQ ID NO: 46984 - DNA, 26 bp, Artificial sequence
  SiRNA target sequence
taataattaaatgatgcattttctaa

SEQ ID NO: 46985 - DNA, 26 bp, Artificial sequence
  SiRNA target sequence
aataattaaatgatgcattttctaat

SEQ ID NO: 46986 - DNA, 26 bp, Artificial sequence
  SiRNA target sequence
ataattaaatgatgcattttctaatc

SEQ ID NO: 46987 - DNA, 26 bp, Artificial sequence
  SiRNA target sequence
taattaaatgatgcattttctaatct

SEQ ID NO: 46988 - DNA, 26 bp, Artificial sequence
  SiRNA target sequence
aattaaatgatgcattttctaatctt

SEQ ID NO: 46989 - DNA, 26 bp, Artificial sequence
  SiRNA target sequence
attaaatgatgcattttctaatctta

SEQ ID NO: 46990 - DNA, 26 bp, Artificial sequence
  SiRNA target sequence
ttaaatgatgcattttctaatcttat

SEQ ID NO: 46991 - DNA, 26 bp, Artificial sequence
  SiRNA target sequence
taaatgatgcattttctaatcttata

SEQ ID NO: 46992 - DNA, 26 bp, Artificial sequence
  SiRNA target sequence
aaatgatgcattttctaatcttatat

SEQ ID NO: 46993 - DNA, 26 bp, Artificial sequence
  SiRNA target sequence
aatgatgcattttctaatcttatatc

SEQ ID NO: 46994 - DNA, 26 bp, Artificial sequence
  SiRNA target sequence
atgatgcattttctaatcttatatca

SEQ ID NO: 46995 - DNA, 26 bp, Artificial sequence
  SiRNA target sequence
tgatgcattttctaatcttatatcat

SEQ ID NO: 46996 - DNA, 26 bp, Artificial sequence
  SiRNA target sequence
gatgcattttctaatcttatatcatt

SEQ ID NO: 46997 - DNA, 26 bp, Artificial sequence
  SiRNA target sequence
atgcattttctaatcttatatcatta

SEQ ID NO: 46998 - DNA, 26 bp, Artificial sequence
  SiRNA target sequence
tgcattttctaatcttatatcattat

SEQ ID NO: 46999 - DNA, 26 bp, Artificial sequence
  SiRNA target sequence
gcattttctaatcttatatcattatt

SEQ ID NO: 47000 - DNA, 26 bp, Artificial sequence
  SiRNA target sequence
cattttctaatcttatatcattatta

SEQ ID NO: 47001 - DNA, 26 bp, Artificial sequence
  SiRNA target sequence
attttctaatcttatatcattattaa

SEQ ID NO: 47002 - DNA, 26 bp, Artificial sequence
  SiRNA target sequence
ttttctaatcttatatcattattaaa

SEQ ID NO: 47003 - DNA, 26 bp, Artificial sequence
  SiRNA target sequence
tttctaatcttatatcattattaaat

SEQ ID NO: 47004 - DNA, 26 bp, Artificial sequence
  SiRNA target sequence
ttctaatcttatatcattattaaatt

SEQ ID NO: 47005 - DNA, 26 bp, Artificial sequence
  SiRNA target sequence
tctaatcttatatcattattaaattc

SEQ ID NO: 47006 - DNA, 26 bp, Artificial sequence
  SiRNA target sequence
ctaatcttatatcattattaaattca

SEQ ID NO: 47007 - DNA, 26 bp, Artificial sequence
  SiRNA target sequence
taatcttatatcattattaaattcat

SEQ ID NO: 47008 - DNA, 26 bp, Artificial sequence
  SiRNA target sequence
aatcttatatcattattaaattcatt

SEQ ID NO: 47009 - DNA, 26 bp, Artificial sequence
  SiRNA target sequence
atcttatatcattattaaattcatta

SEQ ID NO: 47010 - DNA, 26 bp, Artificial sequence
  SiRNA target sequence
tcttatatcattattaaattcattaa

SEQ ID NO: 47011 - DNA, 26 bp, Artificial sequence
  SiRNA target sequence
cttatatcattattaaattcattaac

SEQ ID NO: 47012 - DNA, 26 bp, Artificial sequence
  SiRNA target sequence
ttatatcattattaaattcattaaca

SEQ ID NO: 47013 - DNA, 26 bp, Artificial sequence
  SiRNA target sequence
tatatcattattaaattcattaacat

SEQ ID NO: 47014 - DNA, 26 bp, Artificial sequence
  SiRNA target sequence
atatcattattaaattcattaacatc

SEQ ID NO: 47015 - DNA, 26 bp, Artificial sequence
  SiRNA target sequence
tatcattattaaattcattaacatct

SEQ ID NO: 47016 - DNA, 26 bp, Artificial sequence
  SiRNA target sequence
atcattattaaattcattaacatcta

SEQ ID NO: 47017 - DNA, 26 bp, Artificial sequence
  SiRNA target sequence
tcattattaaattcattaacatctac

SEQ ID NO: 47018 - DNA, 26 bp, Artificial sequence
  SiRNA target sequence
cattattaaattcattaacatctact

SEQ ID NO: 47019 - DNA, 26 bp, Artificial sequence
  SiRNA target sequence
attattaaattcattaacatctacta

SEQ ID NO: 47020 - DNA, 26 bp, Artificial sequence
  SiRNA target sequence
ttattaaattcattaacatctactaa

SEQ ID NO: 47021 - DNA, 26 bp, Artificial sequence
  SiRNA target sequence
tattaaattcattaacatctactaaa

SEQ ID NO: 47022 - DNA, 26 bp, Artificial sequence
  SiRNA target sequence
attaaattcattaacatctactaaat

SEQ ID NO: 47023 - DNA, 26 bp, Artificial sequence
  SiRNA target sequence
ttaaattcattaacatctactaaatt

SEQ ID NO: 47024 - DNA, 26 bp, Artificial sequence
  SiRNA target sequence
taaattcattaacatctactaaattt

SEQ ID NO: 47025 - DNA, 26 bp, Artificial sequence
  SiRNA target sequence
aaattcattaacatctactaaatttg

SEQ ID NO: 47026 - DNA, 26 bp, Artificial sequence
  SiRNA target sequence
aattcattaacatctactaaatttgg

SEQ ID NO: 47027 - DNA, 26 bp, Artificial sequence
  SiRNA target sequence
attcattaacatctactaaatttggt

SEQ ID NO: 47028 - DNA, 26 bp, Artificial sequence
  SiRNA target sequence
ttcattaacatctactaaatttggtt

SEQ ID NO: 47029 - DNA, 26 bp, Artificial sequence
  SiRNA target sequence
tcattaacatctactaaatttggttc

SEQ ID NO: 47030 - DNA, 26 bp, Artificial sequence
  SiRNA target sequence
cattaacatctactaaatttggttct

SEQ ID NO: 47031 - DNA, 26 bp, Artificial sequence
  SiRNA target sequence
attaacatctactaaatttggttctt

SEQ ID NO: 47032 - DNA, 26 bp, Artificial sequence
  SiRNA target sequence
ttaacatctactaaatttggttcttc

SEQ ID NO: 47033 - DNA, 26 bp, Artificial sequence
  SiRNA target sequence
taacatctactaaatttggttcttct

SEQ ID NO: 47034 - DNA, 26 bp, Artificial sequence
  SiRNA target sequence
aacatctactaaatttggttcttctt

SEQ ID NO: 47035 - DNA, 26 bp, Artificial sequence
  SiRNA target sequence
acatctactaaatttggttcttcttt

SEQ ID NO: 47036 - DNA, 26 bp, Artificial sequence
  SiRNA target sequence
catctactaaatttggttcttctttt

SEQ ID NO: 47037 - DNA, 26 bp, Artificial sequence
  SiRNA target sequence
atctactaaatttggttcttctttta

SEQ ID NO: 47038 - DNA, 26 bp, Artificial sequence
  SiRNA target sequence
tctactaaatttggttcttcttttat

SEQ ID NO: 47039 - DNA, 26 bp, Artificial sequence
  SiRNA target sequence
ctactaaatttggttcttcttttata

SEQ ID NO: 47040 - DNA, 26 bp, Artificial sequence
  SiRNA target sequence
tactaaatttggttcttcttttataa

SEQ ID NO: 47041 - DNA, 26 bp, Artificial sequence
  SiRNA target sequence
actaaatttggttcttcttttataag

SEQ ID NO: 47042 - DNA, 26 bp, Artificial sequence
  SiRNA target sequence
ctaaatttggttcttcttttataagc

SEQ ID NO: 47043 - DNA, 26 bp, Artificial sequence
  SiRNA target sequence
taaatttggttcttcttttataagct

SEQ ID NO: 47044 - DNA, 26 bp, Artificial sequence
  SiRNA target sequence
aaatttggttcttcttttataagctc

SEQ ID NO: 47045 - DNA, 26 bp, Artificial sequence
  SiRNA target sequence
aatttggttcttcttttataagctct

SEQ ID NO: 47046 - DNA, 26 bp, Artificial sequence
  SiRNA target sequence
atttggttcttcttttataagctctg

SEQ ID NO: 47047 - DNA, 26 bp, Artificial sequence
  SiRNA target sequence
tttggttcttcttttataagctctgg

SEQ ID NO: 47048 - DNA, 26 bp, Artificial sequence
  SiRNA target sequence
ttggttcttcttttataagctctggt

SEQ ID NO: 47049 - DNA, 26 bp, Artificial sequence
  SiRNA target sequence
tggttcttcttttataagctctggtt

SEQ ID NO: 47050 - DNA, 26 bp, Artificial sequence
  SiRNA target sequence
ggttcttcttttataagctctggttt

SEQ ID NO: 47051 - DNA, 26 bp, Artificial sequence
  SiRNA target sequence
gttcttcttttataagctctggttta

SEQ ID NO: 47052 - DNA, 26 bp, Artificial sequence
  SiRNA target sequence
ttcttcttttataagctctggtttaa

SEQ ID NO: 47053 - DNA, 26 bp, Artificial sequence
  SiRNA target sequence
tcttcttttataagctctggtttaaa

SEQ ID NO: 47054 - DNA, 26 bp, Artificial sequence
  SiRNA target sequence
cttcttttataagctctggtttaaaa

SEQ ID NO: 47055 - DNA, 26 bp, Artificial sequence
  SiRNA target sequence
ttcttttataagctctggtttaaaag

SEQ ID NO: 47056 - DNA, 26 bp, Artificial sequence
  SiRNA target sequence
tcttttataagctctggtttaaaaga

SEQ ID NO: 47057 - DNA, 26 bp, Artificial sequence
  SiRNA target sequence
cttttataagctctggtttaaaagat

SEQ ID NO: 47058 - DNA, 26 bp, Artificial sequence
  SiRNA target sequence
ttttataagctctggtttaaaagatg

SEQ ID NO: 47059 - DNA, 26 bp, Artificial sequence
  SiRNA target sequence
tttataagctctggtttaaaagatgt

SEQ ID NO: 47060 - DNA, 26 bp, Artificial sequence
  SiRNA target sequence
ttataagctctggtttaaaagatgtt

SEQ ID NO: 47061 - DNA, 26 bp, Artificial sequence
  SiRNA target sequence
tataagctctggtttaaaagatgttc

SEQ ID NO: 47062 - DNA, 26 bp, Artificial sequence
  SiRNA target sequence
ataagctctggtttaaaagatgttct

SEQ ID NO: 47063 - DNA, 26 bp, Artificial sequence
  SiRNA target sequence
taagctctggtttaaaagatgttctt

SEQ ID NO: 47064 - DNA, 26 bp, Artificial sequence
  SiRNA target sequence
aagctctggtttaaaagatgttctta

SEQ ID NO: 47065 - DNA, 26 bp, Artificial sequence
  SiRNA target sequence
agctctggtttaaaagatgttcttat

SEQ ID NO: 47066 - DNA, 26 bp, Artificial sequence
  SiRNA target sequence
gctctggtttaaaagatgttcttata

SEQ ID NO: 47067 - DNA, 26 bp, Artificial sequence
  SiRNA target sequence
ctctggtttaaaagatgttcttatat

SEQ ID NO: 47068 - DNA, 26 bp, Artificial sequence
  SiRNA target sequence
tctggtttaaaagatgttcttatatt

SEQ ID NO: 47069 - DNA, 26 bp, Artificial sequence
  SiRNA target sequence
ctggtttaaaagatgttcttatattt

SEQ ID NO: 47070 - DNA, 26 bp, Artificial sequence
  SiRNA target sequence
tggtttaaaagatgttcttatattta

SEQ ID NO: 47071 - DNA, 26 bp, Artificial sequence
  SiRNA target sequence
ggtttaaaagatgttcttatatttaa

SEQ ID NO: 47072 - DNA, 26 bp, Artificial sequence
  SiRNA target sequence
gtttaaaagatgttcttatatttaag

SEQ ID NO: 47073 - DNA, 26 bp, Artificial sequence
  SiRNA target sequence
tttaaaagatgttcttatatttaaga

SEQ ID NO: 47074 - DNA, 26 bp, Artificial sequence
  SiRNA target sequence
ttaaaagatgttcttatatttaagat

SEQ ID NO: 47075 - DNA, 26 bp, Artificial sequence
  SiRNA target sequence
taaaagatgttcttatatttaagatt

SEQ ID NO: 47076 - DNA, 26 bp, Artificial sequence
  SiRNA target sequence
aaaagatgttcttatatttaagattg

SEQ ID NO: 47077 - DNA, 26 bp, Artificial sequence
  SiRNA target sequence
aaagatgttcttatatttaagattgc

SEQ ID NO: 47078 - DNA, 26 bp, Artificial sequence
  SiRNA target sequence
aagatgttcttatatttaagattgct

SEQ ID NO: 47079 - DNA, 26 bp, Artificial sequence
  SiRNA target sequence
agatgttcttatatttaagattgctt

SEQ ID NO: 47080 - DNA, 26 bp, Artificial sequence
  SiRNA target sequence
gatgttcttatatttaagattgcttg

SEQ ID NO: 47081 - DNA, 26 bp, Artificial sequence
  SiRNA target sequence
atgttcttatatttaagattgcttgt

SEQ ID NO: 47082 - DNA, 26 bp, Artificial sequence
  SiRNA target sequence
tgttcttatatttaagattgcttgtg

SEQ ID NO: 47083 - DNA, 26 bp, Artificial sequence
  SiRNA target sequence
gttcttatatttaagattgcttgtgt

SEQ ID NO: 47084 - DNA, 26 bp, Artificial sequence
  SiRNA target sequence
ttcttatatttaagattgcttgtgta

SEQ ID NO: 47085 - DNA, 26 bp, Artificial sequence
  SiRNA target sequence
tcttatatttaagattgcttgtgtat

SEQ ID NO: 47086 - DNA, 26 bp, Artificial sequence
  SiRNA target sequence
cttatatttaagattgcttgtgtata

SEQ ID NO: 47087 - DNA, 26 bp, Artificial sequence
  SiRNA target sequence
ttatatttaagattgcttgtgtatat

SEQ ID NO: 47088 - DNA, 26 bp, Artificial sequence
  SiRNA target sequence
tatatttaagattgcttgtgtatatc

SEQ ID NO: 47089 - DNA, 26 bp, Artificial sequence
  SiRNA target sequence
atatttaagattgcttgtgtatatcg

SEQ ID NO: 47090 - DNA, 26 bp, Artificial sequence
  SiRNA target sequence
tatttaagattgcttgtgtatatcgt

SEQ ID NO: 47091 - DNA, 26 bp, Artificial sequence
  SiRNA target sequence
atttaagattgcttgtgtatatcgtg

SEQ ID NO: 47092 - DNA, 26 bp, Artificial sequence
  SiRNA target sequence
tttaagattgcttgtgtatatcgtga

SEQ ID NO: 47093 - DNA, 26 bp, Artificial sequence
  SiRNA target sequence
ttaagattgcttgtgtatatcgtgag

SEQ ID NO: 47094 - DNA, 26 bp, Artificial sequence
  SiRNA target sequence
taagattgcttgtgtatatcgtgagt

SEQ ID NO: 47095 - DNA, 26 bp, Artificial sequence
  SiRNA target sequence
aagattgcttgtgtatatcgtgagta

SEQ ID NO: 47096 - DNA, 26 bp, Artificial sequence
  SiRNA target sequence
agattgcttgtgtatatcgtgagtaa

SEQ ID NO: 47097 - DNA, 26 bp, Artificial sequence
  SiRNA target sequence
gattgcttgtgtatatcgtgagtaaa

SEQ ID NO: 47098 - DNA, 26 bp, Artificial sequence
  SiRNA target sequence
attgcttgtgtatatcgtgagtaaaa

SEQ ID NO: 47099 - DNA, 26 bp, Artificial sequence
  SiRNA target sequence
ttgcttgtgtatatcgtgagtaaaag

SEQ ID NO: 47100 - DNA, 26 bp, Artificial sequence
  SiRNA target sequence
tgcttgtgtatatcgtgagtaaaaga

SEQ ID NO: 47101 - DNA, 26 bp, Artificial sequence
  SiRNA target sequence
gcttgtgtatatcgtgagtaaaagaa

SEQ ID NO: 47102 - DNA, 26 bp, Artificial sequence
  SiRNA target sequence
cttgtgtatatcgtgagtaaaagaac

SEQ ID NO: 47103 - DNA, 26 bp, Artificial sequence
  SiRNA target sequence
ttgtgtatatcgtgagtaaaagaacc

SEQ ID NO: 47104 - DNA, 26 bp, Artificial sequence
  SiRNA target sequence
tgtgtatatcgtgagtaaaagaaccc

SEQ ID NO: 47105 - DNA, 26 bp, Artificial sequence
  SiRNA target sequence
gtgtatatcgtgagtaaaagaaccct

SEQ ID NO: 47106 - DNA, 26 bp, Artificial sequence
  SiRNA target sequence
tgtatatcgtgagtaaaagaacccta

SEQ ID NO: 47107 - DNA, 26 bp, Artificial sequence
  SiRNA target sequence
gtatatcgtgagtaaaagaaccctaa

SEQ ID NO: 47108 - DNA, 26 bp, Artificial sequence
  SiRNA target sequence
tatatcgtgagtaaaagaaccctaat

SEQ ID NO: 47109 - DNA, 26 bp, Artificial sequence
  SiRNA target sequence
atatcgtgagtaaaagaaccctaatt

SEQ ID NO: 47110 - DNA, 26 bp, Artificial sequence
  SiRNA target sequence
tatcgtgagtaaaagaaccctaattg

SEQ ID NO: 47111 - DNA, 26 bp, Artificial sequence
  SiRNA target sequence
atcgtgagtaaaagaaccctaattgt

SEQ ID NO: 47112 - DNA, 26 bp, Artificial sequence
  SiRNA target sequence
tcgtgagtaaaagaaccctaattgtc

SEQ ID NO: 47113 - DNA, 26 bp, Artificial sequence
  SiRNA target sequence
cgtgagtaaaagaaccctaattgtcc

SEQ ID NO: 47114 - DNA, 26 bp, Artificial sequence
  SiRNA target sequence
gtgagtaaaagaaccctaattgtcca

SEQ ID NO: 47115 - DNA, 26 bp, Artificial sequence
  SiRNA target sequence
tgagtaaaagaaccctaattgtccaa

SEQ ID NO: 47116 - DNA, 26 bp, Artificial sequence
  SiRNA target sequence
gagtaaaagaaccctaattgtccaaa

SEQ ID NO: 47117 - DNA, 26 bp, Artificial sequence
  SiRNA target sequence
agtaaaagaaccctaattgtccaaaa

SEQ ID NO: 47118 - DNA, 26 bp, Artificial sequence
  SiRNA target sequence
gtaaaagaaccctaattgtccaaaac

SEQ ID NO: 47119 - DNA, 26 bp, Artificial sequence
  SiRNA target sequence
taaaagaaccctaattgtccaaaact

SEQ ID NO: 47120 - DNA, 26 bp, Artificial sequence
  SiRNA target sequence
aaaagaaccctaattgtccaaaactt

SEQ ID NO: 47121 - DNA, 26 bp, Artificial sequence
  SiRNA target sequence
aaagaaccctaattgtccaaaacttg

SEQ ID NO: 47122 - DNA, 26 bp, Artificial sequence
  SiRNA target sequence
aagaaccctaattgtccaaaacttga

SEQ ID NO: 47123 - DNA, 26 bp, Artificial sequence
  SiRNA target sequence
agaaccctaattgtccaaaacttgaa

SEQ ID NO: 47124 - DNA, 26 bp, Artificial sequence
  SiRNA target sequence
gaaccctaattgtccaaaacttgaat

SEQ ID NO: 47125 - DNA, 26 bp, Artificial sequence
  SiRNA target sequence
aaccctaattgtccaaaacttgaata

SEQ ID NO: 47126 - DNA, 26 bp, Artificial sequence
  SiRNA target sequence
accctaattgtccaaaacttgaatac

SEQ ID NO: 47127 - DNA, 26 bp, Artificial sequence
  SiRNA target sequence
ccctaattgtccaaaacttgaataca

SEQ ID NO: 47128 - DNA, 26 bp, Artificial sequence
  SiRNA target sequence
cctaattgtccaaaacttgaatacaa

SEQ ID NO: 47129 - DNA, 26 bp, Artificial sequence
  SiRNA target sequence
ctaattgtccaaaacttgaatacaat

SEQ ID NO: 47130 - DNA, 26 bp, Artificial sequence
  SiRNA target sequence
taattgtccaaaacttgaatacaatg

SEQ ID NO: 47131 - DNA, 26 bp, Artificial sequence
  SiRNA target sequence
aattgtccaaaacttgaatacaatgt

SEQ ID NO: 47132 - DNA, 26 bp, Artificial sequence
  SiRNA target sequence
attgtccaaaacttgaatacaatgtt

SEQ ID NO: 47133 - DNA, 26 bp, Artificial sequence
  SiRNA target sequence
ttgtccaaaacttgaatacaatgttc

SEQ ID NO: 47134 - DNA, 26 bp, Artificial sequence
  SiRNA target sequence
tgtccaaaacttgaatacaatgttct

SEQ ID NO: 47135 - DNA, 26 bp, Artificial sequence
  SiRNA target sequence
gtccaaaacttgaatacaatgttcta

SEQ ID NO: 47136 - DNA, 26 bp, Artificial sequence
  SiRNA target sequence
tccaaaacttgaatacaatgttctat

SEQ ID NO: 47137 - DNA, 26 bp, Artificial sequence
  SiRNA target sequence
ccaaaacttgaatacaatgttctatt

SEQ ID NO: 47138 - DNA, 26 bp, Artificial sequence
  SiRNA target sequence
caaaacttgaatacaatgttctatta

SEQ ID NO: 47139 - DNA, 26 bp, Artificial sequence
  SiRNA target sequence
aaaacttgaatacaatgttctattaa

SEQ ID NO: 47140 - DNA, 26 bp, Artificial sequence
  SiRNA target sequence
aaacttgaatacaatgttctattaat

SEQ ID NO: 47141 - DNA, 26 bp, Artificial sequence
  SiRNA target sequence
aacttgaatacaatgttctattaatg

SEQ ID NO: 47142 - DNA, 26 bp, Artificial sequence
  SiRNA target sequence
acttgaatacaatgttctattaatgc

SEQ ID NO: 47143 - DNA, 26 bp, Artificial sequence
  SiRNA target sequence
cttgaatacaatgttctattaatgcc

SEQ ID NO: 47144 - DNA, 26 bp, Artificial sequence
  SiRNA target sequence
ttgaatacaatgttctattaatgcca

SEQ ID NO: 47145 - DNA, 26 bp, Artificial sequence
  SiRNA target sequence
tgaatacaatgttctattaatgccaa

SEQ ID NO: 47146 - DNA, 26 bp, Artificial sequence
  SiRNA target sequence
gaatacaatgttctattaatgccaat

SEQ ID NO: 47147 - DNA, 26 bp, Artificial sequence
  SiRNA target sequence
aatacaatgttctattaatgccaata

SEQ ID NO: 47148 - DNA, 26 bp, Artificial sequence
  SiRNA target sequence
atacaatgttctattaatgccaatat

SEQ ID NO: 47149 - DNA, 26 bp, Artificial sequence
  SiRNA target sequence
tacaatgttctattaatgccaatata

SEQ ID NO: 47150 - DNA, 26 bp, Artificial sequence
  SiRNA target sequence
acaatgttctattaatgccaatataa

SEQ ID NO: 47151 - DNA, 26 bp, Artificial sequence
  SiRNA target sequence
caatgttctattaatgccaatataaa

SEQ ID NO: 47152 - DNA, 26 bp, Artificial sequence
  SiRNA target sequence
aatgttctattaatgccaatataaaa

SEQ ID NO: 47153 - DNA, 26 bp, Artificial sequence
  SiRNA target sequence
atgttctattaatgccaatataaaat

SEQ ID NO: 47154 - DNA, 26 bp, Artificial sequence
  SiRNA target sequence
tgttctattaatgccaatataaaata

SEQ ID NO: 47155 - DNA, 26 bp, Artificial sequence
  SiRNA target sequence
gttctattaatgccaatataaaatac

SEQ ID NO: 47156 - DNA, 26 bp, Artificial sequence
  SiRNA target sequence
ttctattaatgccaatataaaataca

SEQ ID NO: 47157 - DNA, 26 bp, Artificial sequence
  SiRNA target sequence
tctattaatgccaatataaaatacaa

SEQ ID NO: 47158 - DNA, 26 bp, Artificial sequence
  SiRNA target sequence
ctattaatgccaatataaaatacaac

SEQ ID NO: 47159 - DNA, 26 bp, Artificial sequence
  SiRNA target sequence
tattaatgccaatataaaatacaaca

SEQ ID NO: 47160 - DNA, 26 bp, Artificial sequence
  SiRNA target sequence
attaatgccaatataaaatacaacat

SEQ ID NO: 47161 - DNA, 26 bp, Artificial sequence
  SiRNA target sequence
ttaatgccaatataaaatacaacatc

SEQ ID NO: 47162 - DNA, 26 bp, Artificial sequence
  SiRNA target sequence
taatgccaatataaaatacaacatcc

SEQ ID NO: 47163 - DNA, 26 bp, Artificial sequence
  SiRNA target sequence
aatgccaatataaaatacaacatccc

SEQ ID NO: 47164 - DNA, 26 bp, Artificial sequence
  SiRNA target sequence
atgccaatataaaatacaacatccct

SEQ ID NO: 47165 - DNA, 26 bp, Artificial sequence
  SiRNA target sequence
tgccaatataaaatacaacatccctg

SEQ ID NO: 47166 - DNA, 26 bp, Artificial sequence
  SiRNA target sequence
gccaatataaaatacaacatccctgg

SEQ ID NO: 47167 - DNA, 26 bp, Artificial sequence
  SiRNA target sequence
ccaatataaaatacaacatccctggc

SEQ ID NO: 47168 - DNA, 26 bp, Artificial sequence
  SiRNA target sequence
caatataaaatacaacatccctggca

SEQ ID NO: 47169 - DNA, 26 bp, Artificial sequence
  SiRNA target sequence
aatataaaatacaacatccctggcac

SEQ ID NO: 47170 - DNA, 26 bp, Artificial sequence
  SiRNA target sequence
atataaaatacaacatccctggcact

SEQ ID NO: 47171 - DNA, 26 bp, Artificial sequence
  SiRNA target sequence
tataaaatacaacatccctggcactt

SEQ ID NO: 47172 - DNA, 26 bp, Artificial sequence
  SiRNA target sequence
ataaaatacaacatccctggcactta

SEQ ID NO: 47173 - DNA, 26 bp, Artificial sequence
  SiRNA target sequence
taaaatacaacatccctggcacttag

SEQ ID NO: 47174 - DNA, 26 bp, Artificial sequence
  SiRNA target sequence
aaaatacaacatccctggcacttagt

SEQ ID NO: 47175 - DNA, 26 bp, Artificial sequence
  SiRNA target sequence
aaatacaacatccctggcacttagtt

SEQ ID NO: 47176 - DNA, 26 bp, Artificial sequence
  SiRNA target sequence
aatacaacatccctggcacttagttt

SEQ ID NO: 47177 - DNA, 26 bp, Artificial sequence
  SiRNA target sequence
atacaacatccctggcacttagtttt

SEQ ID NO: 47178 - DNA, 26 bp, Artificial sequence
  SiRNA target sequence
tacaacatccctggcacttagttttg

SEQ ID NO: 47179 - DNA, 26 bp, Artificial sequence
  SiRNA target sequence
acaacatccctggcacttagttttgc

SEQ ID NO: 47180 - DNA, 26 bp, Artificial sequence
  SiRNA target sequence
caacatccctggcacttagttttgct

SEQ ID NO: 47181 - DNA, 26 bp, Artificial sequence
  SiRNA target sequence
aacatccctggcacttagttttgctg

SEQ ID NO: 47182 - DNA, 26 bp, Artificial sequence
  SiRNA target sequence
acatccctggcacttagttttgctgt

SEQ ID NO: 47183 - DNA, 26 bp, Artificial sequence
  SiRNA target sequence
catccctggcacttagttttgctgtt

SEQ ID NO: 47184 - DNA, 26 bp, Artificial sequence
  SiRNA target sequence
atccctggcacttagttttgctgtta

SEQ ID NO: 47185 - DNA, 26 bp, Artificial sequence
  SiRNA target sequence
tccctggcacttagttttgctgttaa

SEQ ID NO: 47186 - DNA, 26 bp, Artificial sequence
  SiRNA target sequence
ccctggcacttagttttgctgttaat

SEQ ID NO: 47187 - DNA, 26 bp, Artificial sequence
  SiRNA target sequence
cctggcacttagttttgctgttaata

SEQ ID NO: 47188 - DNA, 26 bp, Artificial sequence
  SiRNA target sequence
ctggcacttagttttgctgttaatat

SEQ ID NO: 47189 - DNA, 26 bp, Artificial sequence
  SiRNA target sequence
tggcacttagttttgctgttaatatt

SEQ ID NO: 47190 - DNA, 26 bp, Artificial sequence
  SiRNA target sequence
ggcacttagttttgctgttaatattc

SEQ ID NO: 47191 - DNA, 26 bp, Artificial sequence
  SiRNA target sequence
gcacttagttttgctgttaatattcc

SEQ ID NO: 47192 - DNA, 26 bp, Artificial sequence
  SiRNA target sequence
cacttagttttgctgttaatattcca

SEQ ID NO: 47193 - DNA, 26 bp, Artificial sequence
  SiRNA target sequence
acttagttttgctgttaatattccat

SEQ ID NO: 47194 - DNA, 26 bp, Artificial sequence
  SiRNA target sequence
cttagttttgctgttaatattccata

SEQ ID NO: 47195 - DNA, 26 bp, Artificial sequence
  SiRNA target sequence
ttagttttgctgttaatattccatag

SEQ ID NO: 47196 - DNA, 26 bp, Artificial sequence
  SiRNA target sequence
tagttttgctgttaatattccatagt

SEQ ID NO: 47197 - DNA, 26 bp, Artificial sequence
  SiRNA target sequence
agttttgctgttaatattccatagtt

SEQ ID NO: 47198 - DNA, 26 bp, Artificial sequence
  SiRNA target sequence
gttttgctgttaatattccatagttt

SEQ ID NO: 47199 - DNA, 26 bp, Artificial sequence
  SiRNA target sequence
ttttgctgttaatattccatagtttc

SEQ ID NO: 47200 - DNA, 26 bp, Artificial sequence
  SiRNA target sequence
tttgctgttaatattccatagtttcc

SEQ ID NO: 47201 - DNA, 26 bp, Artificial sequence
  SiRNA target sequence
ttgctgttaatattccatagtttcct

SEQ ID NO: 47202 - DNA, 26 bp, Artificial sequence
  SiRNA target sequence
tgctgttaatattccatagtttccta

SEQ ID NO: 47203 - DNA, 26 bp, Artificial sequence
  SiRNA target sequence
gctgttaatattccatagtttcctaa

SEQ ID NO: 47204 - DNA, 26 bp, Artificial sequence
  SiRNA target sequence
ctgttaatattccatagtttcctaat

SEQ ID NO: 47205 - DNA, 26 bp, Artificial sequence
  SiRNA target sequence
tgttaatattccatagtttcctaatg

SEQ ID NO: 47206 - DNA, 26 bp, Artificial sequence
  SiRNA target sequence
gttaatattccatagtttcctaatgt

SEQ ID NO: 47207 - DNA, 26 bp, Artificial sequence
  SiRNA target sequence
ttaatattccatagtttcctaatgtt

SEQ ID NO: 47208 - DNA, 26 bp, Artificial sequence
  SiRNA target sequence
taatattccatagtttcctaatgtta

SEQ ID NO: 47209 - DNA, 26 bp, Artificial sequence
  SiRNA target sequence
aatattccatagtttcctaatgttat

SEQ ID NO: 47210 - DNA, 26 bp, Artificial sequence
  SiRNA target sequence
atattccatagtttcctaatgttata

SEQ ID NO: 47211 - DNA, 26 bp, Artificial sequence
  SiRNA target sequence
tattccatagtttcctaatgttataa

SEQ ID NO: 47212 - DNA, 26 bp, Artificial sequence
  SiRNA target sequence
attccatagtttcctaatgttataac

SEQ ID NO: 47213 - DNA, 26 bp, Artificial sequence
  SiRNA target sequence
ttccatagtttcctaatgttataact

SEQ ID NO: 47214 - DNA, 26 bp, Artificial sequence
  SiRNA target sequence
tccatagtttcctaatgttataacta

SEQ ID NO: 47215 - DNA, 26 bp, Artificial sequence
  SiRNA target sequence
ccatagtttcctaatgttataactat

SEQ ID NO: 47216 - DNA, 26 bp, Artificial sequence
  SiRNA target sequence
catagtttcctaatgttataactata

SEQ ID NO: 47217 - DNA, 26 bp, Artificial sequence
  SiRNA target sequence
atagtttcctaatgttataactataa

SEQ ID NO: 47218 - DNA, 26 bp, Artificial sequence
  SiRNA target sequence
tagtttcctaatgttataactataaa

SEQ ID NO: 47219 - DNA, 26 bp, Artificial sequence
  SiRNA target sequence
agtttcctaatgttataactataaaa

SEQ ID NO: 47220 - DNA, 26 bp, Artificial sequence
  SiRNA target sequence
gtttcctaatgttataactataaaac

SEQ ID NO: 47221 - DNA, 26 bp, Artificial sequence
  SiRNA target sequence
tttcctaatgttataactataaaaca

SEQ ID NO: 47222 - DNA, 26 bp, Artificial sequence
  SiRNA target sequence
ttcctaatgttataactataaaacac

SEQ ID NO: 47223 - DNA, 26 bp, Artificial sequence
  SiRNA target sequence
tcctaatgttataactataaaacact

SEQ ID NO: 47224 - DNA, 26 bp, Artificial sequence
  SiRNA target sequence
cctaatgttataactataaaacactg

SEQ ID NO: 47225 - DNA, 26 bp, Artificial sequence
  SiRNA target sequence
ctaatgttataactataaaacactgt

SEQ ID NO: 47226 - DNA, 26 bp, Artificial sequence
  SiRNA target sequence
taatgttataactataaaacactgta

SEQ ID NO: 47227 - DNA, 26 bp, Artificial sequence
  SiRNA target sequence
aatgttataactataaaacactgtaa

SEQ ID NO: 47228 - DNA, 26 bp, Artificial sequence
  SiRNA target sequence
atgttataactataaaacactgtaaa

SEQ ID NO: 47229 - DNA, 26 bp, Artificial sequence
  SiRNA target sequence
tgttataactataaaacactgtaaag

SEQ ID NO: 47230 - DNA, 26 bp, Artificial sequence
  SiRNA target sequence
gttataactataaaacactgtaaagc

SEQ ID NO: 47231 - DNA, 26 bp, Artificial sequence
  SiRNA target sequence
ttataactataaaacactgtaaagca

SEQ ID NO: 47232 - DNA, 26 bp, Artificial sequence
  SiRNA target sequence
tataactataaaacactgtaaagcaa

SEQ ID NO: 47233 - DNA, 26 bp, Artificial sequence
  SiRNA target sequence
ataactataaaacactgtaaagcaaa

SEQ ID NO: 47234 - DNA, 26 bp, Artificial sequence
  SiRNA target sequence
taactataaaacactgtaaagcaaaa

SEQ ID NO: 47235 - DNA, 26 bp, Artificial sequence
  SiRNA target sequence
aactataaaacactgtaaagcaaaaa

SEQ ID NO: 47236 - DNA, 26 bp, Artificial sequence
  SiRNA target sequence
actataaaacactgtaaagcaaaaat

SEQ ID NO: 47237 - DNA, 26 bp, Artificial sequence
  SiRNA target sequence
ctataaaacactgtaaagcaaaaatt

SEQ ID NO: 47238 - DNA, 26 bp, Artificial sequence
  SiRNA target sequence
tataaaacactgtaaagcaaaaatta

SEQ ID NO: 47239 - DNA, 26 bp, Artificial sequence
  SiRNA target sequence
ataaaacactgtaaagcaaaaattat

SEQ ID NO: 47240 - DNA, 26 bp, Artificial sequence
  SiRNA target sequence
taaaacactgtaaagcaaaaattatc

SEQ ID NO: 47241 - DNA, 26 bp, Artificial sequence
  SiRNA target sequence
aaaacactgtaaagcaaaaattatct

SEQ ID NO: 47242 - DNA, 26 bp, Artificial sequence
  SiRNA target sequence
aaacactgtaaagcaaaaattatctt

SEQ ID NO: 47243 - DNA, 26 bp, Artificial sequence
  SiRNA target sequence
aacactgtaaagcaaaaattatctta

SEQ ID NO: 47244 - DNA, 26 bp, Artificial sequence
  SiRNA target sequence
acactgtaaagcaaaaattatcttat

SEQ ID NO: 47245 - DNA, 26 bp, Artificial sequence
  SiRNA target sequence
cactgtaaagcaaaaattatcttatt

SEQ ID NO: 47246 - DNA, 26 bp, Artificial sequence
  SiRNA target sequence
actgtaaagcaaaaattatcttattt

SEQ ID NO: 47247 - DNA, 26 bp, Artificial sequence
  SiRNA target sequence
ctgtaaagcaaaaattatcttattta

SEQ ID NO: 47248 - DNA, 26 bp, Artificial sequence
  SiRNA target sequence
tgtaaagcaaaaattatcttatttac

SEQ ID NO: 47249 - DNA, 26 bp, Artificial sequence
  SiRNA target sequence
gtaaagcaaaaattatcttatttaca

SEQ ID NO: 47250 - DNA, 26 bp, Artificial sequence
  SiRNA target sequence
taaagcaaaaattatcttatttacaa

SEQ ID NO: 47251 - DNA, 26 bp, Artificial sequence
  SiRNA target sequence
aaagcaaaaattatcttatttacaag

SEQ ID NO: 47252 - DNA, 26 bp, Artificial sequence
  SiRNA target sequence
aagcaaaaattatcttatttacaagg

SEQ ID NO: 47253 - DNA, 26 bp, Artificial sequence
  SiRNA target sequence
agcaaaaattatcttatttacaaggt

SEQ ID NO: 47254 - DNA, 26 bp, Artificial sequence
  SiRNA target sequence
gcaaaaattatcttatttacaaggta

SEQ ID NO: 47255 - DNA, 26 bp, Artificial sequence
  SiRNA target sequence
caaaaattatcttatttacaaggtat

SEQ ID NO: 47256 - DNA, 26 bp, Artificial sequence
  SiRNA target sequence
aaaaattatcttatttacaaggtata

SEQ ID NO: 47257 - DNA, 26 bp, Artificial sequence
  SiRNA target sequence
aaaattatcttatttacaaggtataa

SEQ ID NO: 47258 - DNA, 26 bp, Artificial sequence
  SiRNA target sequence
aaattatcttatttacaaggtataaa

SEQ ID NO: 47259 - DNA, 26 bp, Artificial sequence
  SiRNA target sequence
aattatcttatttacaaggtataaaa

SEQ ID NO: 47260 - DNA, 26 bp, Artificial sequence
  SiRNA target sequence
attatcttatttacaaggtataaaaa

SEQ ID NO: 47261 - DNA, 26 bp, Artificial sequence
  SiRNA target sequence
ttatcttatttacaaggtataaaaaa

SEQ ID NO: 47262 - DNA, 26 bp, Artificial sequence
  SiRNA target sequence
tatcttatttacaaggtataaaaaac

SEQ ID NO: 47263 - DNA, 26 bp, Artificial sequence
  SiRNA target sequence
atcttatttacaaggtataaaaaact

SEQ ID NO: 47264 - DNA, 26 bp, Artificial sequence
  SiRNA target sequence
tcttatttacaaggtataaaaaacta

SEQ ID NO: 47265 - DNA, 26 bp, Artificial sequence
  SiRNA target sequence
cttatttacaaggtataaaaaactaa

SEQ ID NO: 47266 - DNA, 26 bp, Artificial sequence
  SiRNA target sequence
ttatttacaaggtataaaaaactaag

SEQ ID NO: 47267 - DNA, 26 bp, Artificial sequence
  SiRNA target sequence
tatttacaaggtataaaaaactaaga

SEQ ID NO: 47268 - DNA, 26 bp, Artificial sequence
  SiRNA target sequence
atttacaaggtataaaaaactaagag

SEQ ID NO: 47269 - DNA, 26 bp, Artificial sequence
  SiRNA target sequence
tttacaaggtataaaaaactaagaga

SEQ ID NO: 47270 - DNA, 26 bp, Artificial sequence
  SiRNA target sequence
ttacaaggtataaaaaactaagagat

SEQ ID NO: 47271 - DNA, 26 bp, Artificial sequence
  SiRNA target sequence
tacaaggtataaaaaactaagagatc

SEQ ID NO: 47272 - DNA, 26 bp, Artificial sequence
  SiRNA target sequence
acaaggtataaaaaactaagagatct

SEQ ID NO: 47273 - DNA, 26 bp, Artificial sequence
  SiRNA target sequence
caaggtataaaaaactaagagatctc

SEQ ID NO: 47274 - DNA, 26 bp, Artificial sequence
  SiRNA target sequence
aaggtataaaaaactaagagatctcc

SEQ ID NO: 47275 - DNA, 26 bp, Artificial sequence
  SiRNA target sequence
aggtataaaaaactaagagatctcca

SEQ ID NO: 47276 - DNA, 26 bp, Artificial sequence
  SiRNA target sequence
ggtataaaaaactaagagatctccag

SEQ ID NO: 47277 - DNA, 26 bp, Artificial sequence
  SiRNA target sequence
gtataaaaaactaagagatctccaga

SEQ ID NO: 47278 - DNA, 26 bp, Artificial sequence
  SiRNA target sequence
tataaaaaactaagagatctccagat

SEQ ID NO: 47279 - DNA, 26 bp, Artificial sequence
  SiRNA target sequence
ataaaaaactaagagatctccagatt

SEQ ID NO: 47280 - DNA, 26 bp, Artificial sequence
  SiRNA target sequence
taaaaaactaagagatctccagattc

SEQ ID NO: 47281 - DNA, 26 bp, Artificial sequence
  SiRNA target sequence
aaaaaactaagagatctccagattct

SEQ ID NO: 47282 - DNA, 26 bp, Artificial sequence
  SiRNA target sequence
aaaaactaagagatctccagattctg

SEQ ID NO: 47283 - DNA, 26 bp, Artificial sequence
  SiRNA target sequence
aaaactaagagatctccagattctgt

SEQ ID NO: 47284 - DNA, 26 bp, Artificial sequence
  SiRNA target sequence
aaactaagagatctccagattctgtt

SEQ ID NO: 47285 - DNA, 26 bp, Artificial sequence
  SiRNA target sequence
aactaagagatctccagattctgtta

SEQ ID NO: 47286 - DNA, 26 bp, Artificial sequence
  SiRNA target sequence
actaagagatctccagattctgttac

SEQ ID NO: 47287 - DNA, 26 bp, Artificial sequence
  SiRNA target sequence
ctaagagatctccagattctgttaca

SEQ ID NO: 47288 - DNA, 26 bp, Artificial sequence
  SiRNA target sequence
taagagatctccagattctgttacat

SEQ ID NO: 47289 - DNA, 26 bp, Artificial sequence
  SiRNA target sequence
aagagatctccagattctgttacatt

SEQ ID NO: 47290 - DNA, 26 bp, Artificial sequence
  SiRNA target sequence
agagatctccagattctgttacattc

SEQ ID NO: 47291 - DNA, 26 bp, Artificial sequence
  SiRNA target sequence
gagatctccagattctgttacattcc

SEQ ID NO: 47292 - DNA, 26 bp, Artificial sequence
  SiRNA target sequence
agatctccagattctgttacattccg

SEQ ID NO: 47293 - DNA, 26 bp, Artificial sequence
  SiRNA target sequence
gatctccagattctgttacattccga

SEQ ID NO: 47294 - DNA, 26 bp, Artificial sequence
  SiRNA target sequence
atctccagattctgttacattccgat

SEQ ID NO: 47295 - DNA, 26 bp, Artificial sequence
  SiRNA target sequence
tctccagattctgttacattccgatt

SEQ ID NO: 47296 - DNA, 26 bp, Artificial sequence
  SiRNA target sequence
ctccagattctgttacattccgattc

SEQ ID NO: 47297 - DNA, 26 bp, Artificial sequence
  SiRNA target sequence
tccagattctgttacattccgattct

SEQ ID NO: 47298 - DNA, 26 bp, Artificial sequence
  SiRNA target sequence
ccagattctgttacattccgattcta

SEQ ID NO: 47299 - DNA, 26 bp, Artificial sequence
  SiRNA target sequence
cagattctgttacattccgattctac

SEQ ID NO: 47300 - DNA, 26 bp, Artificial sequence
  SiRNA target sequence
agattctgttacattccgattctact

SEQ ID NO: 47301 - DNA, 26 bp, Artificial sequence
  SiRNA target sequence
gattctgttacattccgattctactt

SEQ ID NO: 47302 - DNA, 26 bp, Artificial sequence
  SiRNA target sequence
attctgttacattccgattctacttc

SEQ ID NO: 47303 - DNA, 26 bp, Artificial sequence
  SiRNA target sequence
ttctgttacattccgattctacttca

SEQ ID NO: 47304 - DNA, 26 bp, Artificial sequence
  SiRNA target sequence
tctgttacattccgattctacttcag

SEQ ID NO: 47305 - DNA, 26 bp, Artificial sequence
  SiRNA target sequence
ctgttacattccgattctacttcaga

SEQ ID NO: 47306 - DNA, 26 bp, Artificial sequence
  SiRNA target sequence
tgttacattccgattctacttcagaa

SEQ ID NO: 47307 - DNA, 26 bp, Artificial sequence
  SiRNA target sequence
gttacattccgattctacttcagaaa

SEQ ID NO: 47308 - DNA, 26 bp, Artificial sequence
  SiRNA target sequence
ttacattccgattctacttcagaaac

SEQ ID NO: 47309 - DNA, 26 bp, Artificial sequence
  SiRNA target sequence
tacattccgattctacttcagaaaca

SEQ ID NO: 47310 - DNA, 26 bp, Artificial sequence
  SiRNA target sequence
acattccgattctacttcagaaacat

SEQ ID NO: 47311 - DNA, 26 bp, Artificial sequence
  SiRNA target sequence
cattccgattctacttcagaaacata

SEQ ID NO: 47312 - DNA, 26 bp, Artificial sequence
  SiRNA target sequence
attccgattctacttcagaaacatat

SEQ ID NO: 47313 - DNA, 26 bp, Artificial sequence
  SiRNA target sequence
ttccgattctacttcagaaacatatt

SEQ ID NO: 47314 - DNA, 26 bp, Artificial sequence
  SiRNA target sequence
tccgattctacttcagaaacatattt

SEQ ID NO: 47315 - DNA, 26 bp, Artificial sequence
  SiRNA target sequence
ccgattctacttcagaaacatatttt

SEQ ID NO: 47316 - DNA, 26 bp, Artificial sequence
  SiRNA target sequence
cgattctacttcagaaacatattttt

SEQ ID NO: 47317 - DNA, 26 bp, Artificial sequence
  SiRNA target sequence
gattctacttcagaaacatatttttc

SEQ ID NO: 47318 - DNA, 26 bp, Artificial sequence
  SiRNA target sequence
attctacttcagaaacatatttttca

SEQ ID NO: 47319 - DNA, 26 bp, Artificial sequence
  SiRNA target sequence
ttctacttcagaaacatatttttcat

SEQ ID NO: 47320 - DNA, 26 bp, Artificial sequence
  SiRNA target sequence
tctacttcagaaacatatttttcata

SEQ ID NO: 47321 - DNA, 26 bp, Artificial sequence
  SiRNA target sequence
ctacttcagaaacatatttttcatat

SEQ ID NO: 47322 - DNA, 26 bp, Artificial sequence
  SiRNA target sequence
tacttcagaaacatatttttcatatt

SEQ ID NO: 47323 - DNA, 26 bp, Artificial sequence
  SiRNA target sequence
acttcagaaacatatttttcatattt

SEQ ID NO: 47324 - DNA, 26 bp, Artificial sequence
  SiRNA target sequence
cttcagaaacatatttttcatattta

SEQ ID NO: 47325 - DNA, 26 bp, Artificial sequence
  SiRNA target sequence
ttcagaaacatatttttcatatttaa

SEQ ID NO: 47326 - DNA, 26 bp, Artificial sequence
  SiRNA target sequence
tcagaaacatatttttcatatttaag

SEQ ID NO: 47327 - DNA, 26 bp, Artificial sequence
  SiRNA target sequence
cagaaacatatttttcatatttaagc

SEQ ID NO: 47328 - DNA, 26 bp, Artificial sequence
  SiRNA target sequence
agaaacatatttttcatatttaagcg

SEQ ID NO: 47329 - DNA, 26 bp, Artificial sequence
  SiRNA target sequence
gaaacatatttttcatatttaagcga

SEQ ID NO: 47330 - DNA, 26 bp, Artificial sequence
  SiRNA target sequence
aaacatatttttcatatttaagcgat

SEQ ID NO: 47331 - DNA, 26 bp, Artificial sequence
  SiRNA target sequence
aacatatttttcatatttaagcgatt

SEQ ID NO: 47332 - DNA, 26 bp, Artificial sequence
  SiRNA target sequence
acatatttttcatatttaagcgattc

SEQ ID NO: 47333 - DNA, 26 bp, Artificial sequence
  SiRNA target sequence
catatttttcatatttaagcgattct

SEQ ID NO: 47334 - DNA, 26 bp, Artificial sequence
  SiRNA target sequence
atatttttcatatttaagcgattctt

SEQ ID NO: 47335 - DNA, 26 bp, Artificial sequence
  SiRNA target sequence
tatttttcatatttaagcgattcttc

SEQ ID NO: 47336 - DNA, 26 bp, Artificial sequence
  SiRNA target sequence
atttttcatatttaagcgattcttct

SEQ ID NO: 47337 - DNA, 26 bp, Artificial sequence
  SiRNA target sequence
tttttcatatttaagcgattcttctt

SEQ ID NO: 47338 - DNA, 26 bp, Artificial sequence
  SiRNA target sequence
ttttcatatttaagcgattcttcttc

SEQ ID NO: 47339 - DNA, 26 bp, Artificial sequence
  SiRNA target sequence
tttcatatttaagcgattcttcttct

SEQ ID NO: 47340 - DNA, 26 bp, Artificial sequence
  SiRNA target sequence
ttcatatttaagcgattcttcttctt

SEQ ID NO: 47341 - DNA, 26 bp, Artificial sequence
  SiRNA target sequence
tcatatttaagcgattcttcttcttc

SEQ ID NO: 47342 - DNA, 26 bp, Artificial sequence
  SiRNA target sequence
catatttaagcgattcttcttcttct

SEQ ID NO: 47343 - DNA, 26 bp, Artificial sequence
  SiRNA target sequence
atatttaagcgattcttcttcttctg

SEQ ID NO: 47344 - DNA, 26 bp, Artificial sequence
  SiRNA target sequence
tatttaagcgattcttcttcttctgt

SEQ ID NO: 47345 - DNA, 26 bp, Artificial sequence
  SiRNA target sequence
atttaagcgattcttcttcttctgtt

SEQ ID NO: 47346 - DNA, 26 bp, Artificial sequence
  SiRNA target sequence
tttaagcgattcttcttcttctgttt

SEQ ID NO: 47347 - DNA, 26 bp, Artificial sequence
  SiRNA target sequence
ttaagcgattcttcttcttctgtttt

SEQ ID NO: 47348 - DNA, 26 bp, Artificial sequence
  SiRNA target sequence
taagcgattcttcttcttctgtttta

SEQ ID NO: 47349 - DNA, 26 bp, Artificial sequence
  SiRNA target sequence
aagcgattcttcttcttctgttttat

SEQ ID NO: 47350 - DNA, 26 bp, Artificial sequence
  SiRNA target sequence
agcgattcttcttcttctgttttata

SEQ ID NO: 47351 - DNA, 26 bp, Artificial sequence
  SiRNA target sequence
gcgattcttcttcttctgttttatat

SEQ ID NO: 47352 - DNA, 26 bp, Artificial sequence
  SiRNA target sequence
cgattcttcttcttctgttttatatg

SEQ ID NO: 47353 - DNA, 26 bp, Artificial sequence
  SiRNA target sequence
gattcttcttcttctgttttatatgc

SEQ ID NO: 47354 - DNA, 26 bp, Artificial sequence
  SiRNA target sequence
attcttcttcttctgttttatatgct

SEQ ID NO: 47355 - DNA, 26 bp, Artificial sequence
  SiRNA target sequence
ttcttcttcttctgttttatatgcta

SEQ ID NO: 47356 - DNA, 26 bp, Artificial sequence
  SiRNA target sequence
tcttcttcttctgttttatatgctag

SEQ ID NO: 47357 - DNA, 26 bp, Artificial sequence
  SiRNA target sequence
cttcttcttctgttttatatgctagt

SEQ ID NO: 47358 - DNA, 26 bp, Artificial sequence
  SiRNA target sequence
ttcttcttctgttttatatgctagta

SEQ ID NO: 47359 - DNA, 26 bp, Artificial sequence
  SiRNA target sequence
tcttcttctgttttatatgctagtat

SEQ ID NO: 47360 - DNA, 26 bp, Artificial sequence
  SiRNA target sequence
cttcttctgttttatatgctagtata

SEQ ID NO: 47361 - DNA, 26 bp, Artificial sequence
  SiRNA target sequence
ttcttctgttttatatgctagtatag

SEQ ID NO: 47362 - DNA, 26 bp, Artificial sequence
  SiRNA target sequence
tcttctgttttatatgctagtatagt

SEQ ID NO: 47363 - DNA, 26 bp, Artificial sequence
  SiRNA target sequence
cttctgttttatatgctagtatagtc

SEQ ID NO: 47364 - DNA, 26 bp, Artificial sequence
  SiRNA target sequence
ttctgttttatatgctagtatagtct

SEQ ID NO: 47365 - DNA, 26 bp, Artificial sequence
  SiRNA target sequence
tctgttttatatgctagtatagtctc

SEQ ID NO: 47366 - DNA, 26 bp, Artificial sequence
  SiRNA target sequence
ctgttttatatgctagtatagtctca

SEQ ID NO: 47367 - DNA, 26 bp, Artificial sequence
  SiRNA target sequence
tgttttatatgctagtatagtctcat

SEQ ID NO: 47368 - DNA, 26 bp, Artificial sequence
  SiRNA target sequence
gttttatatgctagtatagtctcatg

SEQ ID NO: 47369 - DNA, 26 bp, Artificial sequence
  SiRNA target sequence
ttttatatgctagtatagtctcatga

SEQ ID NO: 47370 - DNA, 26 bp, Artificial sequence
  SiRNA target sequence
tttatatgctagtatagtctcatgat

SEQ ID NO: 47371 - DNA, 26 bp, Artificial sequence
  SiRNA target sequence
ttatatgctagtatagtctcatgatt

SEQ ID NO: 47372 - DNA, 26 bp, Artificial sequence
  SiRNA target sequence
tatatgctagtatagtctcatgatta

SEQ ID NO: 47373 - DNA, 26 bp, Artificial sequence
  SiRNA target sequence
atatgctagtatagtctcatgattaa

SEQ ID NO: 47374 - DNA, 26 bp, Artificial sequence
  SiRNA target sequence
tatgctagtatagtctcatgattaat

SEQ ID NO: 47375 - DNA, 26 bp, Artificial sequence
  SiRNA target sequence
atgctagtatagtctcatgattaatt

SEQ ID NO: 47376 - DNA, 26 bp, Artificial sequence
  SiRNA target sequence
tgctagtatagtctcatgattaatta

SEQ ID NO: 47377 - DNA, 26 bp, Artificial sequence
  SiRNA target sequence
gctagtatagtctcatgattaattaa

SEQ ID NO: 47378 - DNA, 26 bp, Artificial sequence
  SiRNA target sequence
ctagtatagtctcatgattaattaaa

SEQ ID NO: 47379 - DNA, 26 bp, Artificial sequence
  SiRNA target sequence
tagtatagtctcatgattaattaaag

SEQ ID NO: 47380 - DNA, 26 bp, Artificial sequence
  SiRNA target sequence
agtatagtctcatgattaattaaaga

SEQ ID NO: 47381 - DNA, 26 bp, Artificial sequence
  SiRNA target sequence
gtatagtctcatgattaattaaagaa

SEQ ID NO: 47382 - DNA, 26 bp, Artificial sequence
  SiRNA target sequence
tatagtctcatgattaattaaagaat

SEQ ID NO: 47383 - DNA, 26 bp, Artificial sequence
  SiRNA target sequence
atagtctcatgattaattaaagaatc

SEQ ID NO: 47384 - DNA, 26 bp, Artificial sequence
  SiRNA target sequence
tagtctcatgattaattaaagaatca

SEQ ID NO: 47385 - DNA, 26 bp, Artificial sequence
  SiRNA target sequence
agtctcatgattaattaaagaatcat

SEQ ID NO: 47386 - DNA, 26 bp, Artificial sequence
  SiRNA target sequence
gtctcatgattaattaaagaatcatg

SEQ ID NO: 47387 - DNA, 26 bp, Artificial sequence
  SiRNA target sequence
tctcatgattaattaaagaatcatgt

SEQ ID NO: 47388 - DNA, 26 bp, Artificial sequence
  SiRNA target sequence
ctcatgattaattaaagaatcatgta

SEQ ID NO: 47389 - DNA, 26 bp, Artificial sequence
  SiRNA target sequence
tcatgattaattaaagaatcatgtaa

SEQ ID NO: 47390 - DNA, 26 bp, Artificial sequence
  SiRNA target sequence
catgattaattaaagaatcatgtaag

SEQ ID NO: 47391 - DNA, 26 bp, Artificial sequence
  SiRNA target sequence
atgattaattaaagaatcatgtaagt

SEQ ID NO: 47392 - DNA, 26 bp, Artificial sequence
  SiRNA target sequence
tgattaattaaagaatcatgtaagtg

SEQ ID NO: 47393 - DNA, 26 bp, Artificial sequence
  SiRNA target sequence
gattaattaaagaatcatgtaagtga

SEQ ID NO: 47394 - DNA, 26 bp, Artificial sequence
  SiRNA target sequence
attaattaaagaatcatgtaagtgat

SEQ ID NO: 47395 - DNA, 26 bp, Artificial sequence
  SiRNA target sequence
ttaattaaagaatcatgtaagtgatt

SEQ ID NO: 47396 - DNA, 26 bp, Artificial sequence
  SiRNA target sequence
taattaaagaatcatgtaagtgattt

SEQ ID NO: 47397 - DNA, 26 bp, Artificial sequence
  SiRNA target sequence
aattaaagaatcatgtaagtgatttg

SEQ ID NO: 47398 - DNA, 26 bp, Artificial sequence
  SiRNA target sequence
attaaagaatcatgtaagtgatttga

SEQ ID NO: 47399 - DNA, 26 bp, Artificial sequence
  SiRNA target sequence
ttaaagaatcatgtaagtgatttgag

SEQ ID NO: 47400 - DNA, 26 bp, Artificial sequence
  SiRNA target sequence
taaagaatcatgtaagtgatttgagc

SEQ ID NO: 47401 - DNA, 26 bp, Artificial sequence
  SiRNA target sequence
aaagaatcatgtaagtgatttgagca

SEQ ID NO: 47402 - DNA, 26 bp, Artificial sequence
  SiRNA target sequence
aagaatcatgtaagtgatttgagcat

SEQ ID NO: 47403 - DNA, 26 bp, Artificial sequence
  SiRNA target sequence
agaatcatgtaagtgatttgagcatc

SEQ ID NO: 47404 - DNA, 26 bp, Artificial sequence
  SiRNA target sequence
gaatcatgtaagtgatttgagcatct

SEQ ID NO: 47405 - DNA, 26 bp, Artificial sequence
  SiRNA target sequence
aatcatgtaagtgatttgagcatctt

SEQ ID NO: 47406 - DNA, 26 bp, Artificial sequence
  SiRNA target sequence
atcatgtaagtgatttgagcatcttt

SEQ ID NO: 47407 - DNA, 26 bp, Artificial sequence
  SiRNA target sequence
tcatgtaagtgatttgagcatctttg

SEQ ID NO: 47408 - DNA, 26 bp, Artificial sequence
  SiRNA target sequence
catgtaagtgatttgagcatctttgt

SEQ ID NO: 47409 - DNA, 26 bp, Artificial sequence
  SiRNA target sequence
atgtaagtgatttgagcatctttgtt

SEQ ID NO: 47410 - DNA, 26 bp, Artificial sequence
  SiRNA target sequence
tgtaagtgatttgagcatctttgttg

SEQ ID NO: 47411 - DNA, 26 bp, Artificial sequence
  SiRNA target sequence
gtaagtgatttgagcatctttgttgt

SEQ ID NO: 47412 - DNA, 26 bp, Artificial sequence
  SiRNA target sequence
taagtgatttgagcatctttgttgtg

SEQ ID NO: 47413 - DNA, 26 bp, Artificial sequence
  SiRNA target sequence
aagtgatttgagcatctttgttgtgc

SEQ ID NO: 47414 - DNA, 26 bp, Artificial sequence
  SiRNA target sequence
agtgatttgagcatctttgttgtgcg

SEQ ID NO: 47415 - DNA, 26 bp, Artificial sequence
  SiRNA target sequence
gtgatttgagcatctttgttgtgcgc

SEQ ID NO: 47416 - DNA, 26 bp, Artificial sequence
  SiRNA target sequence
tgatttgagcatctttgttgtgcgca

SEQ ID NO: 47417 - DNA, 26 bp, Artificial sequence
  SiRNA target sequence
gatttgagcatctttgttgtgcgcaa

SEQ ID NO: 47418 - DNA, 26 bp, Artificial sequence
  SiRNA target sequence
atttgagcatctttgttgtgcgcaat

SEQ ID NO: 47419 - DNA, 26 bp, Artificial sequence
  SiRNA target sequence
tttgagcatctttgttgtgcgcaatt

SEQ ID NO: 47420 - DNA, 26 bp, Artificial sequence
  SiRNA target sequence
ttgagcatctttgttgtgcgcaatta

SEQ ID NO: 47421 - DNA, 26 bp, Artificial sequence
  SiRNA target sequence
tgagcatctttgttgtgcgcaattat

SEQ ID NO: 47422 - DNA, 26 bp, Artificial sequence
  SiRNA target sequence
gagcatctttgttgtgcgcaattata

SEQ ID NO: 47423 - DNA, 26 bp, Artificial sequence
  SiRNA target sequence
agcatctttgttgtgcgcaattatat

SEQ ID NO: 47424 - DNA, 26 bp, Artificial sequence
  SiRNA target sequence
gcatctttgttgtgcgcaattatatt

SEQ ID NO: 47425 - DNA, 26 bp, Artificial sequence
  SiRNA target sequence
catctttgttgtgcgcaattatattc

SEQ ID NO: 47426 - DNA, 26 bp, Artificial sequence
  SiRNA target sequence
atctttgttgtgcgcaattatattct

SEQ ID NO: 47427 - DNA, 26 bp, Artificial sequence
  SiRNA target sequence
tctttgttgtgcgcaattatattctt

SEQ ID NO: 47428 - DNA, 26 bp, Artificial sequence
  SiRNA target sequence
ctttgttgtgcgcaattatattcttt

SEQ ID NO: 47429 - DNA, 26 bp, Artificial sequence
  SiRNA target sequence
tttgttgtgcgcaattatattctttt

SEQ ID NO: 47430 - DNA, 26 bp, Artificial sequence
  SiRNA target sequence
ttgttgtgcgcaattatattcttttc

SEQ ID NO: 47431 - DNA, 26 bp, Artificial sequence
  SiRNA target sequence
tgttgtgcgcaattatattcttttct

SEQ ID NO: 47432 - DNA, 26 bp, Artificial sequence
  SiRNA target sequence
gttgtgcgcaattatattcttttctt

SEQ ID NO: 47433 - DNA, 26 bp, Artificial sequence
  SiRNA target sequence
ttgtgcgcaattatattcttttctta

SEQ ID NO: 47434 - DNA, 26 bp, Artificial sequence
  SiRNA target sequence
tgtgcgcaattatattcttttcttat

SEQ ID NO: 47435 - DNA, 26 bp, Artificial sequence
  SiRNA target sequence
gtgcgcaattatattcttttcttatt

SEQ ID NO: 47436 - DNA, 26 bp, Artificial sequence
  SiRNA target sequence
tgcgcaattatattcttttcttattc

SEQ ID NO: 47437 - DNA, 26 bp, Artificial sequence
  SiRNA target sequence
gcgcaattatattcttttcttattcc

SEQ ID NO: 47438 - DNA, 26 bp, Artificial sequence
  SiRNA target sequence
cgcaattatattcttttcttattcct

SEQ ID NO: 47439 - DNA, 26 bp, Artificial sequence
  SiRNA target sequence
gcaattatattcttttcttattcctg

SEQ ID NO: 47440 - DNA, 26 bp, Artificial sequence
  SiRNA target sequence
caattatattcttttcttattcctgt

SEQ ID NO: 47441 - DNA, 26 bp, Artificial sequence
  SiRNA target sequence
aattatattcttttcttattcctgta

SEQ ID NO: 47442 - DNA, 26 bp, Artificial sequence
  SiRNA target sequence
attatattcttttcttattcctgtac

SEQ ID NO: 47443 - DNA, 26 bp, Artificial sequence
  SiRNA target sequence
ttatattcttttcttattcctgtacg

SEQ ID NO: 47444 - DNA, 26 bp, Artificial sequence
  SiRNA target sequence
tatattcttttcttattcctgtacgc

SEQ ID NO: 47445 - DNA, 26 bp, Artificial sequence
  SiRNA target sequence
atattcttttcttattcctgtacgcc

SEQ ID NO: 47446 - DNA, 26 bp, Artificial sequence
  SiRNA target sequence
tattcttttcttattcctgtacgcca

SEQ ID NO: 47447 - DNA, 26 bp, Artificial sequence
  SiRNA target sequence
attcttttcttattcctgtacgccaa

SEQ ID NO: 47448 - DNA, 26 bp, Artificial sequence
  SiRNA target sequence
ttcttttcttattcctgtacgccaat

SEQ ID NO: 47449 - DNA, 26 bp, Artificial sequence
  SiRNA target sequence
tcttttcttattcctgtacgccaatg

SEQ ID NO: 47450 - DNA, 26 bp, Artificial sequence
  SiRNA target sequence
cttttcttattcctgtacgccaatga

SEQ ID NO: 47451 - DNA, 26 bp, Artificial sequence
  SiRNA target sequence
ttttcttattcctgtacgccaatgaa

SEQ ID NO: 47452 - DNA, 26 bp, Artificial sequence
  SiRNA target sequence
tttcttattcctgtacgccaatgaac

SEQ ID NO: 47453 - DNA, 26 bp, Artificial sequence
  SiRNA target sequence
ttcttattcctgtacgccaatgaact

SEQ ID NO: 47454 - DNA, 26 bp, Artificial sequence
  SiRNA target sequence
tcttattcctgtacgccaatgaacta

SEQ ID NO: 47455 - DNA, 26 bp, Artificial sequence
  SiRNA target sequence
cttattcctgtacgccaatgaactat

SEQ ID NO: 47456 - DNA, 26 bp, Artificial sequence
  SiRNA target sequence
ttattcctgtacgccaatgaactatt

SEQ ID NO: 47457 - DNA, 26 bp, Artificial sequence
  SiRNA target sequence
tattcctgtacgccaatgaactattt

SEQ ID NO: 47458 - DNA, 26 bp, Artificial sequence
  SiRNA target sequence
attcctgtacgccaatgaactatttt

SEQ ID NO: 47459 - DNA, 26 bp, Artificial sequence
  SiRNA target sequence
ttcctgtacgccaatgaactattttc

SEQ ID NO: 47460 - DNA, 26 bp, Artificial sequence
  SiRNA target sequence
tcctgtacgccaatgaactattttcg

SEQ ID NO: 47461 - DNA, 26 bp, Artificial sequence
  SiRNA target sequence
cctgtacgccaatgaactattttcgc

SEQ ID NO: 47462 - DNA, 26 bp, Artificial sequence
  SiRNA target sequence
ctgtacgccaatgaactattttcgca

SEQ ID NO: 47463 - DNA, 26 bp, Artificial sequence
  SiRNA target sequence
tgtacgccaatgaactattttcgcag

SEQ ID NO: 47464 - DNA, 26 bp, Artificial sequence
  SiRNA target sequence
gtacgccaatgaactattttcgcagt

SEQ ID NO: 47465 - DNA, 26 bp, Artificial sequence
  SiRNA target sequence
tacgccaatgaactattttcgcagtt

SEQ ID NO: 47466 - DNA, 26 bp, Artificial sequence
  SiRNA target sequence
acgccaatgaactattttcgcagttg

SEQ ID NO: 47467 - DNA, 26 bp, Artificial sequence
  SiRNA target sequence
cgccaatgaactattttcgcagttgc

SEQ ID NO: 47468 - DNA, 26 bp, Artificial sequence
  SiRNA target sequence
gccaatgaactattttcgcagttgca

SEQ ID NO: 47469 - DNA, 26 bp, Artificial sequence
  SiRNA target sequence
ccaatgaactattttcgcagttgcaa

SEQ ID NO: 47470 - DNA, 26 bp, Artificial sequence
  SiRNA target sequence
caatgaactattttcgcagttgcaag

SEQ ID NO: 47471 - DNA, 26 bp, Artificial sequence
  SiRNA target sequence
aatgaactattttcgcagttgcaagg

SEQ ID NO: 47472 - DNA, 26 bp, Artificial sequence
  SiRNA target sequence
atgaactattttcgcagttgcaagga

SEQ ID NO: 47473 - DNA, 26 bp, Artificial sequence
  SiRNA target sequence
tgaactattttcgcagttgcaaggat

SEQ ID NO: 47474 - DNA, 26 bp, Artificial sequence
  SiRNA target sequence
gaactattttcgcagttgcaaggatg

SEQ ID NO: 47475 - DNA, 26 bp, Artificial sequence
  SiRNA target sequence
aactattttcgcagttgcaaggatgt

SEQ ID NO: 47476 - DNA, 26 bp, Artificial sequence
  SiRNA target sequence
actattttcgcagttgcaaggatgta

SEQ ID NO: 47477 - DNA, 26 bp, Artificial sequence
  SiRNA target sequence
ctattttcgcagttgcaaggatgtaa

SEQ ID NO: 47478 - DNA, 26 bp, Artificial sequence
  SiRNA target sequence
tattttcgcagttgcaaggatgtaaa

SEQ ID NO: 47479 - DNA, 26 bp, Artificial sequence
  SiRNA target sequence
attttcgcagttgcaaggatgtaaac

SEQ ID NO: 47480 - DNA, 26 bp, Artificial sequence
  SiRNA target sequence
ttttcgcagttgcaaggatgtaaact

SEQ ID NO: 47481 - DNA, 26 bp, Artificial sequence
  SiRNA target sequence
tttcgcagttgcaaggatgtaaacta

SEQ ID NO: 47482 - DNA, 26 bp, Artificial sequence
  SiRNA target sequence
ttcgcagttgcaaggatgtaaactaa

SEQ ID NO: 47483 - DNA, 26 bp, Artificial sequence
  SiRNA target sequence
tcgcagttgcaaggatgtaaactaat

SEQ ID NO: 47484 - DNA, 26 bp, Artificial sequence
  SiRNA target sequence
cgcagttgcaaggatgtaaactaata

SEQ ID NO: 47485 - DNA, 26 bp, Artificial sequence
  SiRNA target sequence
gcagttgcaaggatgtaaactaataa

SEQ ID NO: 47486 - DNA, 26 bp, Artificial sequence
  SiRNA target sequence
cagttgcaaggatgtaaactaataat

SEQ ID NO: 47487 - DNA, 26 bp, Artificial sequence
  SiRNA target sequence
agttgcaaggatgtaaactaataatg

SEQ ID NO: 47488 - DNA, 26 bp, Artificial sequence
  SiRNA target sequence
gttgcaaggatgtaaactaataatgt

SEQ ID NO: 47489 - DNA, 26 bp, Artificial sequence
  SiRNA target sequence
ttgcaaggatgtaaactaataatgtg

SEQ ID NO: 47490 - DNA, 26 bp, Artificial sequence
  SiRNA target sequence
tgcaaggatgtaaactaataatgtga

SEQ ID NO: 47491 - DNA, 26 bp, Artificial sequence
  SiRNA target sequence
gcaaggatgtaaactaataatgtgat

SEQ ID NO: 47492 - DNA, 26 bp, Artificial sequence
  SiRNA target sequence
caaggatgtaaactaataatgtgatt

SEQ ID NO: 47493 - DNA, 26 bp, Artificial sequence
  SiRNA target sequence
aaggatgtaaactaataatgtgatta

SEQ ID NO: 47494 - DNA, 26 bp, Artificial sequence
  SiRNA target sequence
aggatgtaaactaataatgtgattaa

SEQ ID NO: 47495 - DNA, 26 bp, Artificial sequence
  SiRNA target sequence
ggatgtaaactaataatgtgattaaa

SEQ ID NO: 47496 - DNA, 26 bp, Artificial sequence
  SiRNA target sequence
gatgtaaactaataatgtgattaaaa

SEQ ID NO: 47497 - DNA, 26 bp, Artificial sequence
  SiRNA target sequence
atgtaaactaataatgtgattaaaat

SEQ ID NO: 47498 - DNA, 26 bp, Artificial sequence
  SiRNA target sequence
tgtaaactaataatgtgattaaaata

SEQ ID NO: 47499 - DNA, 26 bp, Artificial sequence
  SiRNA target sequence
gtaaactaataatgtgattaaaataa

SEQ ID NO: 47500 - DNA, 26 bp, Artificial sequence
  SiRNA target sequence
taaactaataatgtgattaaaataat

SEQ ID NO: 47501 - DNA, 26 bp, Artificial sequence
  SiRNA target sequence
aaactaataatgtgattaaaataata

SEQ ID NO: 47502 - DNA, 26 bp, Artificial sequence
  SiRNA target sequence
aactaataatgtgattaaaataataa

SEQ ID NO: 47503 - DNA, 26 bp, Artificial sequence
  SiRNA target sequence
actaataatgtgattaaaataataaa

SEQ ID NO: 47504 - DNA, 26 bp, Artificial sequence
  SiRNA target sequence
ctaataatgtgattaaaataataaac

SEQ ID NO: 47505 - DNA, 26 bp, Artificial sequence
  SiRNA target sequence
taataatgtgattaaaataataaaca

SEQ ID NO: 47506 - DNA, 26 bp, Artificial sequence
  SiRNA target sequence
aataatgtgattaaaataataaacat

SEQ ID NO: 47507 - DNA, 26 bp, Artificial sequence
  SiRNA target sequence
ataatgtgattaaaataataaacata

SEQ ID NO: 47508 - DNA, 26 bp, Artificial sequence
  SiRNA target sequence
taatgtgattaaaataataaacatat

SEQ ID NO: 47509 - DNA, 26 bp, Artificial sequence
  SiRNA target sequence
aatgtgattaaaataataaacatatt

SEQ ID NO: 47510 - DNA, 26 bp, Artificial sequence
  SiRNA target sequence
atgtgattaaaataataaacatattt

SEQ ID NO: 47511 - DNA, 26 bp, Artificial sequence
  SiRNA target sequence
tgtgattaaaataataaacatatttg

SEQ ID NO: 47512 - DNA, 26 bp, Artificial sequence
  SiRNA target sequence
gtgattaaaataataaacatatttgt

SEQ ID NO: 47513 - DNA, 26 bp, Artificial sequence
  SiRNA target sequence
tgattaaaataataaacatatttgtc

SEQ ID NO: 47514 - DNA, 26 bp, Artificial sequence
  SiRNA target sequence
gattaaaataataaacatatttgtca

SEQ ID NO: 47515 - DNA, 26 bp, Artificial sequence
  SiRNA target sequence
attaaaataataaacatatttgtcaa

SEQ ID NO: 47516 - DNA, 26 bp, Artificial sequence
  SiRNA target sequence
ttaaaataataaacatatttgtcaac

SEQ ID NO: 47517 - DNA, 26 bp, Artificial sequence
  SiRNA target sequence
taaaataataaacatatttgtcaacc

SEQ ID NO: 47518 - DNA, 26 bp, Artificial sequence
  SiRNA target sequence
aaaataataaacatatttgtcaaccc

SEQ ID NO: 47519 - DNA, 26 bp, Artificial sequence
  SiRNA target sequence
aaataataaacatatttgtcaaccct

SEQ ID NO: 47520 - DNA, 26 bp, Artificial sequence
  SiRNA target sequence
aataataaacatatttgtcaacccta

SEQ ID NO: 47521 - DNA, 26 bp, Artificial sequence
  SiRNA target sequence
ataataaacatatttgtcaaccctaa

SEQ ID NO: 47522 - DNA, 26 bp, Artificial sequence
  SiRNA target sequence
taataaacatatttgtcaaccctaaa

SEQ ID NO: 47523 - DNA, 26 bp, Artificial sequence
  SiRNA target sequence
aataaacatatttgtcaaccctaaat

SEQ ID NO: 47524 - DNA, 26 bp, Artificial sequence
  SiRNA target sequence
ataaacatatttgtcaaccctaaatt

SEQ ID NO: 47525 - DNA, 26 bp, Artificial sequence
  SiRNA target sequence
taaacatatttgtcaaccctaaattt

SEQ ID NO: 47526 - DNA, 26 bp, Artificial sequence
  SiRNA target sequence
aaacatatttgtcaaccctaaatttg

SEQ ID NO: 47527 - DNA, 26 bp, Artificial sequence
  SiRNA target sequence
aacatatttgtcaaccctaaatttgt

SEQ ID NO: 47528 - DNA, 26 bp, Artificial sequence
  SiRNA target sequence
acatatttgtcaaccctaaatttgta

SEQ ID NO: 47529 - DNA, 26 bp, Artificial sequence
  SiRNA target sequence
catatttgtcaaccctaaatttgtat

SEQ ID NO: 47530 - DNA, 26 bp, Artificial sequence
  SiRNA target sequence
atatttgtcaaccctaaatttgtata

SEQ ID NO: 47531 - DNA, 26 bp, Artificial sequence
  SiRNA target sequence
tatttgtcaaccctaaatttgtataa

SEQ ID NO: 47532 - DNA, 26 bp, Artificial sequence
  SiRNA target sequence
atttgtcaaccctaaatttgtataaa

SEQ ID NO: 47533 - DNA, 26 bp, Artificial sequence
  SiRNA target sequence
tttgtcaaccctaaatttgtataaat

SEQ ID NO: 47534 - DNA, 26 bp, Artificial sequence
  SiRNA target sequence
ttgtcaaccctaaatttgtataaatt

SEQ ID NO: 47535 - DNA, 26 bp, Artificial sequence
  SiRNA target sequence
tgtcaaccctaaatttgtataaattg

SEQ ID NO: 47536 - DNA, 26 bp, Artificial sequence
  SiRNA target sequence
gtcaaccctaaatttgtataaattga

SEQ ID NO: 47537 - DNA, 26 bp, Artificial sequence
  SiRNA target sequence
tcaaccctaaatttgtataaattgac

SEQ ID NO: 47538 - DNA, 26 bp, Artificial sequence
  SiRNA target sequence
caaccctaaatttgtataaattgacg

SEQ ID NO: 47539 - DNA, 26 bp, Artificial sequence
  SiRNA target sequence
aaccctaaatttgtataaattgacga

SEQ ID NO: 47540 - DNA, 26 bp, Artificial sequence
  SiRNA target sequence
accctaaatttgtataaattgacgaa

SEQ ID NO: 47541 - DNA, 26 bp, Artificial sequence
  SiRNA target sequence
ccctaaatttgtataaattgacgaac

SEQ ID NO: 47542 - DNA, 26 bp, Artificial sequence
  SiRNA target sequence
cctaaatttgtataaattgacgaaca

SEQ ID NO: 47543 - DNA, 26 bp, Artificial sequence
  SiRNA target sequence
ctaaatttgtataaattgacgaacac

SEQ ID NO: 47544 - DNA, 26 bp, Artificial sequence
  SiRNA target sequence
taaatttgtataaattgacgaacacg

SEQ ID NO: 47545 - DNA, 26 bp, Artificial sequence
  SiRNA target sequence
aaatttgtataaattgacgaacacgc

SEQ ID NO: 47546 - DNA, 26 bp, Artificial sequence
  SiRNA target sequence
aatttgtataaattgacgaacacgcc

SEQ ID NO: 47547 - DNA, 26 bp, Artificial sequence
  SiRNA target sequence
atttgtataaattgacgaacacgcca

SEQ ID NO: 47548 - DNA, 26 bp, Artificial sequence
  SiRNA target sequence
tttgtataaattgacgaacacgccaa

SEQ ID NO: 47549 - DNA, 26 bp, Artificial sequence
  SiRNA target sequence
ttgtataaattgacgaacacgccaat

SEQ ID NO: 47550 - DNA, 26 bp, Artificial sequence
  SiRNA target sequence
tgtataaattgacgaacacgccaata

SEQ ID NO: 47551 - DNA, 26 bp, Artificial sequence
  SiRNA target sequence
gtataaattgacgaacacgccaatat

SEQ ID NO: 47552 - DNA, 26 bp, Artificial sequence
  SiRNA target sequence
tataaattgacgaacacgccaatata

SEQ ID NO: 47553 - DNA, 26 bp, Artificial sequence
  SiRNA target sequence
ataaattgacgaacacgccaatataa

SEQ ID NO: 47554 - DNA, 26 bp, Artificial sequence
  SiRNA target sequence
taaattgacgaacacgccaatataac

SEQ ID NO: 47555 - DNA, 26 bp, Artificial sequence
  SiRNA target sequence
aaattgacgaacacgccaatataact

SEQ ID NO: 47556 - DNA, 26 bp, Artificial sequence
  SiRNA target sequence
aattgacgaacacgccaatataactg

SEQ ID NO: 47557 - DNA, 26 bp, Artificial sequence
  SiRNA target sequence
attgacgaacacgccaatataactgt

SEQ ID NO: 47558 - DNA, 26 bp, Artificial sequence
  SiRNA target sequence
ttgacgaacacgccaatataactgta

SEQ ID NO: 47559 - DNA, 26 bp, Artificial sequence
  SiRNA target sequence
tgacgaacacgccaatataactgtaa

SEQ ID NO: 47560 - DNA, 26 bp, Artificial sequence
  SiRNA target sequence
gacgaacacgccaatataactgtaaa

SEQ ID NO: 47561 - DNA, 26 bp, Artificial sequence
  SiRNA target sequence
acgaacacgccaatataactgtaaaa

SEQ ID NO: 47562 - DNA, 26 bp, Artificial sequence
  SiRNA target sequence
cgaacacgccaatataactgtaaaaa

SEQ ID NO: 47563 - DNA, 26 bp, Artificial sequence
  SiRNA target sequence
gaacacgccaatataactgtaaaaaa

SEQ ID NO: 47564 - DNA, 26 bp, Artificial sequence
  SiRNA target sequence
aacacgccaatataactgtaaaaaaa

SEQ ID NO: 47565 - DNA, 26 bp, Artificial sequence
  SiRNA target sequence
acacgccaatataactgtaaaaaaaa

SEQ ID NO: 47566 - DNA, 26 bp, Artificial sequence
  SiRNA target sequence
cacgccaatataactgtaaaaaaaat

SEQ ID NO: 47567 - DNA, 26 bp, Artificial sequence
  SiRNA target sequence
acgccaatataactgtaaaaaaaata

SEQ ID NO: 47568 - DNA, 26 bp, Artificial sequence
  SiRNA target sequence
cgccaatataactgtaaaaaaaatat

SEQ ID NO: 47569 - DNA, 26 bp, Artificial sequence
  SiRNA target sequence
gccaatataactgtaaaaaaaatatt

SEQ ID NO: 47570 - DNA, 26 bp, Artificial sequence
  SiRNA target sequence
ccaatataactgtaaaaaaaatattt

SEQ ID NO: 47571 - DNA, 26 bp, Artificial sequence
  SiRNA target sequence
caatataactgtaaaaaaaatattta

SEQ ID NO: 47572 - DNA, 26 bp, Artificial sequence
  SiRNA target sequence
aatataactgtaaaaaaaatatttat

SEQ ID NO: 47573 - DNA, 26 bp, Artificial sequence
  SiRNA target sequence
atataactgtaaaaaaaatatttatg

SEQ ID NO: 47574 - DNA, 26 bp, Artificial sequence
  SiRNA target sequence
tataactgtaaaaaaaatatttatga

SEQ ID NO: 47575 - DNA, 26 bp, Artificial sequence
  SiRNA target sequence
ataactgtaaaaaaaatatttatgat

SEQ ID NO: 47576 - DNA, 26 bp, Artificial sequence
  SiRNA target sequence
taactgtaaaaaaaatatttatgata

SEQ ID NO: 47577 - DNA, 26 bp, Artificial sequence
  SiRNA target sequence
aactgtaaaaaaaatatttatgatat

SEQ ID NO: 47578 - DNA, 26 bp, Artificial sequence
  SiRNA target sequence
actgtaaaaaaaatatttatgatatt

SEQ ID NO: 47579 - DNA, 26 bp, Artificial sequence
  SiRNA target sequence
ctgtaaaaaaaatatttatgatatta

SEQ ID NO: 47580 - DNA, 26 bp, Artificial sequence
  SiRNA target sequence
tgtaaaaaaaatatttatgatattaa

SEQ ID NO: 47581 - DNA, 26 bp, Artificial sequence
  SiRNA target sequence
gtaaaaaaaatatttatgatattaac

SEQ ID NO: 47582 - DNA, 26 bp, Artificial sequence
  SiRNA target sequence
taaaaaaaatatttatgatattaaca

SEQ ID NO: 47583 - DNA, 26 bp, Artificial sequence
  SiRNA target sequence
aaaaaaaatatttatgatattaacaa

SEQ ID NO: 47584 - DNA, 26 bp, Artificial sequence
  SiRNA target sequence
aaaaaaatatttatgatattaacaaa

SEQ ID NO: 47585 - DNA, 26 bp, Artificial sequence
  SiRNA target sequence
aaaaaatatttatgatattaacaaat

SEQ ID NO: 47586 - DNA, 26 bp, Artificial sequence
  SiRNA target sequence
aaaaatatttatgatattaacaaata

SEQ ID NO: 47587 - DNA, 26 bp, Artificial sequence
  SiRNA target sequence
aaaatatttatgatattaacaaataa

SEQ ID NO: 47588 - DNA, 26 bp, Artificial sequence
  SiRNA target sequence
aaatatttatgatattaacaaataaa

SEQ ID NO: 47589 - DNA, 26 bp, Artificial sequence
  SiRNA target sequence
aatatttatgatattaacaaataaaa

SEQ ID NO: 47590 - DNA, 26 bp, Artificial sequence
  SiRNA target sequence
atatttatgatattaacaaataaaac

SEQ ID NO: 47591 - DNA, 26 bp, Artificial sequence
  SiRNA target sequence
tatttatgatattaacaaataaaact

SEQ ID NO: 47592 - DNA, 26 bp, Artificial sequence
  SiRNA target sequence
atttatgatattaacaaataaaactt

SEQ ID NO: 47593 - DNA, 26 bp, Artificial sequence
  SiRNA target sequence
tttatgatattaacaaataaaacttc

SEQ ID NO: 47594 - DNA, 26 bp, Artificial sequence
  SiRNA target sequence
ttatgatattaacaaataaaacttcg

SEQ ID NO: 47595 - DNA, 26 bp, Artificial sequence
  SiRNA target sequence
tatgatattaacaaataaaacttcga

SEQ ID NO: 47596 - DNA, 26 bp, Artificial sequence
  SiRNA target sequence
atgatattaacaaataaaacttcgat

SEQ ID NO: 47597 - DNA, 26 bp, Artificial sequence
  SiRNA target sequence
tgatattaacaaataaaacttcgatc

SEQ ID NO: 47598 - DNA, 26 bp, Artificial sequence
  SiRNA target sequence
gatattaacaaataaaacttcgatca

SEQ ID NO: 47599 - DNA, 26 bp, Artificial sequence
  SiRNA target sequence
atattaacaaataaaacttcgatcaa

SEQ ID NO: 47600 - DNA, 26 bp, Artificial sequence
  SiRNA target sequence
tattaacaaataaaacttcgatcaat

SEQ ID NO: 47601 - DNA, 26 bp, Artificial sequence
  SiRNA target sequence
attaacaaataaaacttcgatcaatt

SEQ ID NO: 47602 - DNA, 26 bp, Artificial sequence
  SiRNA target sequence
ttaacaaataaaacttcgatcaattc

SEQ ID NO: 47603 - DNA, 26 bp, Artificial sequence
  SiRNA target sequence
taacaaataaaacttcgatcaattca

SEQ ID NO: 47604 - DNA, 26 bp, Artificial sequence
  SiRNA target sequence
aacaaataaaacttcgatcaattcac

SEQ ID NO: 47605 - DNA, 26 bp, Artificial sequence
  SiRNA target sequence
acaaataaaacttcgatcaattcact

SEQ ID NO: 47606 - DNA, 26 bp, Artificial sequence
  SiRNA target sequence
caaataaaacttcgatcaattcactt

SEQ ID NO: 47607 - DNA, 26 bp, Artificial sequence
  SiRNA target sequence
aaataaaacttcgatcaattcactta

SEQ ID NO: 47608 - DNA, 26 bp, Artificial sequence
  SiRNA target sequence
aataaaacttcgatcaattcacttat

SEQ ID NO: 47609 - DNA, 26 bp, Artificial sequence
  SiRNA target sequence
ataaaacttcgatcaattcacttatt

SEQ ID NO: 47610 - DNA, 26 bp, Artificial sequence
  SiRNA target sequence
taaaacttcgatcaattcacttattg

SEQ ID NO: 47611 - DNA, 26 bp, Artificial sequence
  SiRNA target sequence
aaaacttcgatcaattcacttattgc

SEQ ID NO: 47612 - DNA, 26 bp, Artificial sequence
  SiRNA target sequence
aaacttcgatcaattcacttattgct

SEQ ID NO: 47613 - DNA, 26 bp, Artificial sequence
  SiRNA target sequence
aacttcgatcaattcacttattgctt

SEQ ID NO: 47614 - DNA, 26 bp, Artificial sequence
  SiRNA target sequence
acttcgatcaattcacttattgcttt

SEQ ID NO: 47615 - DNA, 26 bp, Artificial sequence
  SiRNA target sequence
cttcgatcaattcacttattgcttta

SEQ ID NO: 47616 - DNA, 26 bp, Artificial sequence
  SiRNA target sequence
ttcgatcaattcacttattgctttac

SEQ ID NO: 47617 - DNA, 26 bp, Artificial sequence
  SiRNA target sequence
tcgatcaattcacttattgctttact

SEQ ID NO: 47618 - DNA, 26 bp, Artificial sequence
  SiRNA target sequence
cgatcaattcacttattgctttactt

SEQ ID NO: 47619 - DNA, 26 bp, Artificial sequence
  SiRNA target sequence
gatcaattcacttattgctttacttt

SEQ ID NO: 47620 - DNA, 26 bp, Artificial sequence
  SiRNA target sequence
atcaattcacttattgctttactttc

SEQ ID NO: 47621 - DNA, 26 bp, Artificial sequence
  SiRNA target sequence
tcaattcacttattgctttactttct

SEQ ID NO: 47622 - DNA, 26 bp, Artificial sequence
  SiRNA target sequence
caattcacttattgctttactttctc

SEQ ID NO: 47623 - DNA, 26 bp, Artificial sequence
  SiRNA target sequence
aattcacttattgctttactttctcg

SEQ ID NO: 47624 - DNA, 26 bp, Artificial sequence
  SiRNA target sequence
attcacttattgctttactttctcgg

SEQ ID NO: 47625 - DNA, 26 bp, Artificial sequence
  SiRNA target sequence
ttcacttattgctttactttctcggt

SEQ ID NO: 47626 - DNA, 26 bp, Artificial sequence
  SiRNA target sequence
tcacttattgctttactttctcggtc

SEQ ID NO: 47627 - DNA, 26 bp, Artificial sequence
  SiRNA target sequence
cacttattgctttactttctcggtct

SEQ ID NO: 47628 - DNA, 26 bp, Artificial sequence
  SiRNA target sequence
acttattgctttactttctcggtcta

SEQ ID NO: 47629 - DNA, 26 bp, Artificial sequence
  SiRNA target sequence
cttattgctttactttctcggtctat

SEQ ID NO: 47630 - DNA, 26 bp, Artificial sequence
  SiRNA target sequence
ttattgctttactttctcggtctatt

SEQ ID NO: 47631 - DNA, 26 bp, Artificial sequence
  SiRNA target sequence
tattgctttactttctcggtctatta

SEQ ID NO: 47632 - DNA, 26 bp, Artificial sequence
  SiRNA target sequence
attgctttactttctcggtctattat

SEQ ID NO: 47633 - DNA, 26 bp, Artificial sequence
  SiRNA target sequence
ttgctttactttctcggtctattatt

SEQ ID NO: 47634 - DNA, 26 bp, Artificial sequence
  SiRNA target sequence
tgctttactttctcggtctattattg

SEQ ID NO: 47635 - DNA, 26 bp, Artificial sequence
  SiRNA target sequence
gctttactttctcggtctattattgt

SEQ ID NO: 47636 - DNA, 26 bp, Artificial sequence
  SiRNA target sequence
ctttactttctcggtctattattgtt

SEQ ID NO: 47637 - DNA, 26 bp, Artificial sequence
  SiRNA target sequence
tttactttctcggtctattattgttt

SEQ ID NO: 47638 - DNA, 26 bp, Artificial sequence
  SiRNA target sequence
ttactttctcggtctattattgtttg

SEQ ID NO: 47639 - DNA, 26 bp, Artificial sequence
  SiRNA target sequence
tactttctcggtctattattgtttgt

SEQ ID NO: 47640 - DNA, 26 bp, Artificial sequence
  SiRNA target sequence
actttctcggtctattattgtttgta

SEQ ID NO: 47641 - DNA, 26 bp, Artificial sequence
  SiRNA target sequence
ctttctcggtctattattgtttgtat

SEQ ID NO: 47642 - DNA, 26 bp, Artificial sequence
  SiRNA target sequence
tttctcggtctattattgtttgtatt

SEQ ID NO: 47643 - DNA, 26 bp, Artificial sequence
  SiRNA target sequence
ttctcggtctattattgtttgtattt

SEQ ID NO: 47644 - DNA, 26 bp, Artificial sequence
  SiRNA target sequence
tctcggtctattattgtttgtatttc

SEQ ID NO: 47645 - DNA, 26 bp, Artificial sequence
  SiRNA target sequence
ctcggtctattattgtttgtatttca

SEQ ID NO: 47646 - DNA, 26 bp, Artificial sequence
  SiRNA target sequence
tcggtctattattgtttgtatttcac

SEQ ID NO: 47647 - DNA, 26 bp, Artificial sequence
  SiRNA target sequence
cggtctattattgtttgtatttcacc

SEQ ID NO: 47648 - DNA, 26 bp, Artificial sequence
  SiRNA target sequence
ggtctattattgtttgtatttcaccg

SEQ ID NO: 47649 - DNA, 26 bp, Artificial sequence
  SiRNA target sequence
gtctattattgtttgtatttcaccgc

SEQ ID NO: 47650 - DNA, 26 bp, Artificial sequence
  SiRNA target sequence
tctattattgtttgtatttcaccgca

SEQ ID NO: 47651 - DNA, 26 bp, Artificial sequence
  SiRNA target sequence
ctattattgtttgtatttcaccgcat

SEQ ID NO: 47652 - DNA, 26 bp, Artificial sequence
  SiRNA target sequence
tattattgtttgtatttcaccgcatc

SEQ ID NO: 47653 - DNA, 26 bp, Artificial sequence
  SiRNA target sequence
attattgtttgtatttcaccgcatcc

SEQ ID NO: 47654 - DNA, 26 bp, Artificial sequence
  SiRNA target sequence
ttattgtttgtatttcaccgcatcct

SEQ ID NO: 47655 - DNA, 26 bp, Artificial sequence
  SiRNA target sequence
tattgtttgtatttcaccgcatccta

SEQ ID NO: 47656 - DNA, 26 bp, Artificial sequence
  SiRNA target sequence
attgtttgtatttcaccgcatcctat

SEQ ID NO: 47657 - DNA, 26 bp, Artificial sequence
  SiRNA target sequence
ttgtttgtatttcaccgcatcctatt

SEQ ID NO: 47658 - DNA, 26 bp, Artificial sequence
  SiRNA target sequence
tgtttgtatttcaccgcatcctattt

SEQ ID NO: 47659 - DNA, 26 bp, Artificial sequence
  SiRNA target sequence
gtttgtatttcaccgcatcctatttt

SEQ ID NO: 47660 - DNA, 26 bp, Artificial sequence
  SiRNA target sequence
tttgtatttcaccgcatcctatttta

SEQ ID NO: 47661 - DNA, 26 bp, Artificial sequence
  SiRNA target sequence
ttgtatttcaccgcatcctattttat

SEQ ID NO: 47662 - DNA, 26 bp, Artificial sequence
  SiRNA target sequence
tgtatttcaccgcatcctattttatt

SEQ ID NO: 47663 - DNA, 26 bp, Artificial sequence
  SiRNA target sequence
gtatttcaccgcatcctattttattg

SEQ ID NO: 47664 - DNA, 26 bp, Artificial sequence
  SiRNA target sequence
tatttcaccgcatcctattttattgt

SEQ ID NO: 47665 - DNA, 26 bp, Artificial sequence
  SiRNA target sequence
atttcaccgcatcctattttattgta

SEQ ID NO: 47666 - DNA, 26 bp, Artificial sequence
  SiRNA target sequence
tttcaccgcatcctattttattgtat

SEQ ID NO: 47667 - DNA, 26 bp, Artificial sequence
  SiRNA target sequence
ttcaccgcatcctattttattgtatc

SEQ ID NO: 47668 - DNA, 26 bp, Artificial sequence
  SiRNA target sequence
tcaccgcatcctattttattgtatct

SEQ ID NO: 47669 - DNA, 26 bp, Artificial sequence
  SiRNA target sequence
caccgcatcctattttattgtatcta

SEQ ID NO: 47670 - DNA, 26 bp, Artificial sequence
  SiRNA target sequence
accgcatcctattttattgtatctac

SEQ ID NO: 47671 - DNA, 26 bp, Artificial sequence
  SiRNA target sequence
ccgcatcctattttattgtatctact

SEQ ID NO: 47672 - DNA, 26 bp, Artificial sequence
  SiRNA target sequence
cgcatcctattttattgtatctacta

SEQ ID NO: 47673 - DNA, 26 bp, Artificial sequence
  SiRNA target sequence
gcatcctattttattgtatctactaa

SEQ ID NO: 47674 - DNA, 26 bp, Artificial sequence
  SiRNA target sequence
catcctattttattgtatctactaag

SEQ ID NO: 47675 - DNA, 26 bp, Artificial sequence
  SiRNA target sequence
atcctattttattgtatctactaagt

SEQ ID NO: 47676 - DNA, 26 bp, Artificial sequence
  SiRNA target sequence
tcctattttattgtatctactaagtt

SEQ ID NO: 47677 - DNA, 26 bp, Artificial sequence
  SiRNA target sequence
cctattttattgtatctactaagttc

SEQ ID NO: 47678 - DNA, 26 bp, Artificial sequence
  SiRNA target sequence
ctattttattgtatctactaagttcc

SEQ ID NO: 47679 - DNA, 26 bp, Artificial sequence
  SiRNA target sequence
tattttattgtatctactaagttcca

SEQ ID NO: 47680 - DNA, 26 bp, Artificial sequence
  SiRNA target sequence
attttattgtatctactaagttccat

SEQ ID NO: 47681 - DNA, 26 bp, Artificial sequence
  SiRNA target sequence
ttttattgtatctactaagttccata

SEQ ID NO: 47682 - DNA, 26 bp, Artificial sequence
  SiRNA target sequence
tttattgtatctactaagttccatat

SEQ ID NO: 47683 - DNA, 26 bp, Artificial sequence
  SiRNA target sequence
ttattgtatctactaagttccatatt

SEQ ID NO: 47684 - DNA, 26 bp, Artificial sequence
  SiRNA target sequence
tattgtatctactaagttccatattt

SEQ ID NO: 47685 - DNA, 26 bp, Artificial sequence
  SiRNA target sequence
attgtatctactaagttccatattta

SEQ ID NO: 47686 - DNA, 26 bp, Artificial sequence
  SiRNA target sequence
ttgtatctactaagttccatatttat

SEQ ID NO: 47687 - DNA, 26 bp, Artificial sequence
  SiRNA target sequence
tgtatctactaagttccatatttata

SEQ ID NO: 47688 - DNA, 26 bp, Artificial sequence
  SiRNA target sequence
gtatctactaagttccatatttataa

SEQ ID NO: 47689 - DNA, 26 bp, Artificial sequence
  SiRNA target sequence
tatctactaagttccatatttataaa

SEQ ID NO: 47690 - DNA, 26 bp, Artificial sequence
  SiRNA target sequence
atctactaagttccatatttataaaa

SEQ ID NO: 47691 - DNA, 26 bp, Artificial sequence
  SiRNA target sequence
tctactaagttccatatttataaaat

SEQ ID NO: 47692 - DNA, 26 bp, Artificial sequence
  SiRNA target sequence
ctactaagttccatatttataaaatt

SEQ ID NO: 47693 - DNA, 26 bp, Artificial sequence
  SiRNA target sequence
tactaagttccatatttataaaattt

SEQ ID NO: 47694 - DNA, 26 bp, Artificial sequence
  SiRNA target sequence
actaagttccatatttataaaatttt

SEQ ID NO: 47695 - DNA, 26 bp, Artificial sequence
  SiRNA target sequence
ctaagttccatatttataaaattttt

SEQ ID NO: 47696 - DNA, 26 bp, Artificial sequence
  SiRNA target sequence
taagttccatatttataaaattttta

SEQ ID NO: 47697 - DNA, 26 bp, Artificial sequence
  SiRNA target sequence
aagttccatatttataaaatttttaa

SEQ ID NO: 47698 - DNA, 26 bp, Artificial sequence
  SiRNA target sequence
agttccatatttataaaatttttaaa

SEQ ID NO: 47699 - DNA, 26 bp, Artificial sequence
  SiRNA target sequence
gttccatatttataaaatttttaaat

SEQ ID NO: 47700 - DNA, 26 bp, Artificial sequence
  SiRNA target sequence
ttccatatttataaaatttttaaatg

SEQ ID NO: 47701 - DNA, 26 bp, Artificial sequence
  SiRNA target sequence
tccatatttataaaatttttaaatga

SEQ ID NO: 47702 - DNA, 26 bp, Artificial sequence
  SiRNA target sequence
ccatatttataaaatttttaaatgaa

SEQ ID NO: 47703 - DNA, 26 bp, Artificial sequence
  SiRNA target sequence
catatttataaaatttttaaatgaat

SEQ ID NO: 47704 - DNA, 26 bp, Artificial sequence
  SiRNA target sequence
atatttataaaatttttaaatgaatt

SEQ ID NO: 47705 - DNA, 26 bp, Artificial sequence
  SiRNA target sequence
tatttataaaatttttaaatgaattt

SEQ ID NO: 47706 - DNA, 26 bp, Artificial sequence
  SiRNA target sequence
atttataaaatttttaaatgaatttt

SEQ ID NO: 47707 - DNA, 26 bp, Artificial sequence
  SiRNA target sequence
tttataaaatttttaaatgaattttt

SEQ ID NO: 47708 - DNA, 26 bp, Artificial sequence
  SiRNA target sequence
ttataaaatttttaaatgaatttttt

SEQ ID NO: 47709 - DNA, 26 bp, Artificial sequence
  SiRNA target sequence
tataaaatttttaaatgaattttttc

SEQ ID NO: 47710 - DNA, 26 bp, Artificial sequence
  SiRNA target sequence
ataaaatttttaaatgaattttttcc

SEQ ID NO: 47711 - DNA, 26 bp, Artificial sequence
  SiRNA target sequence
taaaatttttaaatgaattttttcct

SEQ ID NO: 47712 - DNA, 26 bp, Artificial sequence
  SiRNA target sequence
aaaatttttaaatgaattttttcctg

SEQ ID NO: 47713 - DNA, 26 bp, Artificial sequence
  SiRNA target sequence
aaatttttaaatgaattttttcctgt

SEQ ID NO: 47714 - DNA, 26 bp, Artificial sequence
  SiRNA target sequence
aatttttaaatgaattttttcctgtc

SEQ ID NO: 47715 - DNA, 26 bp, Artificial sequence
  SiRNA target sequence
atttttaaatgaattttttcctgtca

SEQ ID NO: 47716 - DNA, 26 bp, Artificial sequence
  SiRNA target sequence
tttttaaatgaattttttcctgtcag

SEQ ID NO: 47717 - DNA, 26 bp, Artificial sequence
  SiRNA target sequence
ttttaaatgaattttttcctgtcagt

SEQ ID NO: 47718 - DNA, 26 bp, Artificial sequence
  SiRNA target sequence
tttaaatgaattttttcctgtcagtc

SEQ ID NO: 47719 - DNA, 26 bp, Artificial sequence
  SiRNA target sequence
ttaaatgaattttttcctgtcagtct

SEQ ID NO: 47720 - DNA, 26 bp, Artificial sequence
  SiRNA target sequence
taaatgaattttttcctgtcagtctg

SEQ ID NO: 47721 - DNA, 26 bp, Artificial sequence
  SiRNA target sequence
aaatgaattttttcctgtcagtctga

SEQ ID NO: 47722 - DNA, 26 bp, Artificial sequence
  SiRNA target sequence
aatgaattttttcctgtcagtctgaa

SEQ ID NO: 47723 - DNA, 26 bp, Artificial sequence
  SiRNA target sequence
atgaattttttcctgtcagtctgaat

SEQ ID NO: 47724 - DNA, 26 bp, Artificial sequence
  SiRNA target sequence
tgaattttttcctgtcagtctgaata

SEQ ID NO: 47725 - DNA, 26 bp, Artificial sequence
  SiRNA target sequence
gaattttttcctgtcagtctgaatac

SEQ ID NO: 47726 - DNA, 26 bp, Artificial sequence
  SiRNA target sequence
aattttttcctgtcagtctgaataca

SEQ ID NO: 47727 - DNA, 26 bp, Artificial sequence
  SiRNA target sequence
attttttcctgtcagtctgaatacat

SEQ ID NO: 47728 - DNA, 26 bp, Artificial sequence
  SiRNA target sequence
ttttttcctgtcagtctgaatacatg

SEQ ID NO: 47729 - DNA, 26 bp, Artificial sequence
  SiRNA target sequence
tttttcctgtcagtctgaatacatgt

SEQ ID NO: 47730 - DNA, 26 bp, Artificial sequence
  SiRNA target sequence
ttttcctgtcagtctgaatacatgtt

SEQ ID NO: 47731 - DNA, 26 bp, Artificial sequence
  SiRNA target sequence
tttcctgtcagtctgaatacatgttg

SEQ ID NO: 47732 - DNA, 26 bp, Artificial sequence
  SiRNA target sequence
ttcctgtcagtctgaatacatgttga

SEQ ID NO: 47733 - DNA, 26 bp, Artificial sequence
  SiRNA target sequence
tcctgtcagtctgaatacatgttgaa

SEQ ID NO: 47734 - DNA, 26 bp, Artificial sequence
  SiRNA target sequence
cctgtcagtctgaatacatgttgaac

SEQ ID NO: 47735 - DNA, 26 bp, Artificial sequence
  SiRNA target sequence
ctgtcagtctgaatacatgttgaacg

SEQ ID NO: 47736 - DNA, 26 bp, Artificial sequence
  SiRNA target sequence
tgtcagtctgaatacatgttgaacgg

SEQ ID NO: 47737 - DNA, 26 bp, Artificial sequence
  SiRNA target sequence
gtcagtctgaatacatgttgaacggg

SEQ ID NO: 47738 - DNA, 26 bp, Artificial sequence
  SiRNA target sequence
tcagtctgaatacatgttgaacgggt

SEQ ID NO: 47739 - DNA, 26 bp, Artificial sequence
  SiRNA target sequence
cagtctgaatacatgttgaacgggtg

SEQ ID NO: 47740 - DNA, 26 bp, Artificial sequence
  SiRNA target sequence
agtctgaatacatgttgaacgggtgt

SEQ ID NO: 47741 - DNA, 26 bp, Artificial sequence
  SiRNA target sequence
gtctgaatacatgttgaacgggtgta

SEQ ID NO: 47742 - DNA, 26 bp, Artificial sequence
  SiRNA target sequence
tctgaatacatgttgaacgggtgtaa

SEQ ID NO: 47743 - DNA, 26 bp, Artificial sequence
  SiRNA target sequence
ctgaatacatgttgaacgggtgtaac

SEQ ID NO: 47744 - DNA, 26 bp, Artificial sequence
  SiRNA target sequence
tgaatacatgttgaacgggtgtaaca

SEQ ID NO: 47745 - DNA, 26 bp, Artificial sequence
  SiRNA target sequence
gaatacatgttgaacgggtgtaacaa

SEQ ID NO: 47746 - DNA, 26 bp, Artificial sequence
  SiRNA target sequence
aatacatgttgaacgggtgtaacaaa

SEQ ID NO: 47747 - DNA, 26 bp, Artificial sequence
  SiRNA target sequence
atacatgttgaacgggtgtaacaaat

SEQ ID NO: 47748 - DNA, 26 bp, Artificial sequence
  SiRNA target sequence
tacatgttgaacgggtgtaacaaata

SEQ ID NO: 47749 - DNA, 26 bp, Artificial sequence
  SiRNA target sequence
acatgttgaacgggtgtaacaaatat

SEQ ID NO: 47750 - DNA, 26 bp, Artificial sequence
  SiRNA target sequence
catgttgaacgggtgtaacaaatata

SEQ ID NO: 47751 - DNA, 26 bp, Artificial sequence
  SiRNA target sequence
atgttgaacgggtgtaacaaatataa

SEQ ID NO: 47752 - DNA, 26 bp, Artificial sequence
  SiRNA target sequence
tgttgaacgggtgtaacaaatataaa

SEQ ID NO: 47753 - DNA, 26 bp, Artificial sequence
  SiRNA target sequence
gttgaacgggtgtaacaaatataaaa

SEQ ID NO: 47754 - DNA, 26 bp, Artificial sequence
  SiRNA target sequence
ttgaacgggtgtaacaaatataaaat

SEQ ID NO: 47755 - DNA, 26 bp, Artificial sequence
  SiRNA target sequence
tgaacgggtgtaacaaatataaaatt

SEQ ID NO: 47756 - DNA, 26 bp, Artificial sequence
  SiRNA target sequence
gaacgggtgtaacaaatataaaattg

SEQ ID NO: 47757 - DNA, 26 bp, Artificial sequence
  SiRNA target sequence
aacgggtgtaacaaatataaaattgt

SEQ ID NO: 47758 - DNA, 26 bp, Artificial sequence
  SiRNA target sequence
acgggtgtaacaaatataaaattgtt

SEQ ID NO: 47759 - DNA, 26 bp, Artificial sequence
  SiRNA target sequence
cgggtgtaacaaatataaaattgtta

SEQ ID NO: 47760 - DNA, 26 bp, Artificial sequence
  SiRNA target sequence
gggtgtaacaaatataaaattgttaa

SEQ ID NO: 47761 - DNA, 26 bp, Artificial sequence
  SiRNA target sequence
ggtgtaacaaatataaaattgttaag

SEQ ID NO: 47762 - DNA, 26 bp, Artificial sequence
  SiRNA target sequence
gtgtaacaaatataaaattgttaagt

SEQ ID NO: 47763 - DNA, 26 bp, Artificial sequence
  SiRNA target sequence
tgtaacaaatataaaattgttaagtt

SEQ ID NO: 47764 - DNA, 26 bp, Artificial sequence
  SiRNA target sequence
gtaacaaatataaaattgttaagttc

SEQ ID NO: 47765 - DNA, 26 bp, Artificial sequence
  SiRNA target sequence
taacaaatataaaattgttaagttct

SEQ ID NO: 47766 - DNA, 26 bp, Artificial sequence
  SiRNA target sequence
aacaaatataaaattgttaagttctg

SEQ ID NO: 47767 - DNA, 26 bp, Artificial sequence
  SiRNA target sequence
acaaatataaaattgttaagttctga

SEQ ID NO: 47768 - DNA, 26 bp, Artificial sequence
  SiRNA target sequence
caaatataaaattgttaagttctgac

SEQ ID NO: 47769 - DNA, 26 bp, Artificial sequence
  SiRNA target sequence
aaatataaaattgttaagttctgaca

SEQ ID NO: 47770 - DNA, 26 bp, Artificial sequence
  SiRNA target sequence
aatataaaattgttaagttctgacat

SEQ ID NO: 47771 - DNA, 26 bp, Artificial sequence
  SiRNA target sequence
atataaaattgttaagttctgacatt

SEQ ID NO: 47772 - DNA, 26 bp, Artificial sequence
  SiRNA target sequence
tataaaattgttaagttctgacattg

SEQ ID NO: 47773 - DNA, 26 bp, Artificial sequence
  SiRNA target sequence
ataaaattgttaagttctgacattgt

SEQ ID NO: 47774 - DNA, 26 bp, Artificial sequence
  SiRNA target sequence
taaaattgttaagttctgacattgta

SEQ ID NO: 47775 - DNA, 26 bp, Artificial sequence
  SiRNA target sequence
aaaattgttaagttctgacattgtaa

SEQ ID NO: 47776 - DNA, 26 bp, Artificial sequence
  SiRNA target sequence
aaattgttaagttctgacattgtaat

SEQ ID NO: 47777 - DNA, 26 bp, Artificial sequence
  SiRNA target sequence
aattgttaagttctgacattgtaatt

SEQ ID NO: 47778 - DNA, 26 bp, Artificial sequence
  SiRNA target sequence
attgttaagttctgacattgtaattg

SEQ ID NO: 47779 - DNA, 26 bp, Artificial sequence
  SiRNA target sequence
ttgttaagttctgacattgtaattga

SEQ ID NO: 47780 - DNA, 26 bp, Artificial sequence
  SiRNA target sequence
tgttaagttctgacattgtaattgat

SEQ ID NO: 47781 - DNA, 26 bp, Artificial sequence
  SiRNA target sequence
gttaagttctgacattgtaattgata

SEQ ID NO: 47782 - DNA, 26 bp, Artificial sequence
  SiRNA target sequence
ttaagttctgacattgtaattgatac

SEQ ID NO: 47783 - DNA, 26 bp, Artificial sequence
  SiRNA target sequence
taagttctgacattgtaattgataca

SEQ ID NO: 47784 - DNA, 26 bp, Artificial sequence
  SiRNA target sequence
aagttctgacattgtaattgatacaa

SEQ ID NO: 47785 - DNA, 26 bp, Artificial sequence
  SiRNA target sequence
agttctgacattgtaattgatacaat

SEQ ID NO: 47786 - DNA, 26 bp, Artificial sequence
  SiRNA target sequence
gttctgacattgtaattgatacaatt

SEQ ID NO: 47787 - DNA, 26 bp, Artificial sequence
  SiRNA target sequence
ttctgacattgtaattgatacaattg

SEQ ID NO: 47788 - DNA, 26 bp, Artificial sequence
  SiRNA target sequence
tctgacattgtaattgatacaattgt

SEQ ID NO: 47789 - DNA, 26 bp, Artificial sequence
  SiRNA target sequence
ctgacattgtaattgatacaattgtc

SEQ ID NO: 47790 - DNA, 26 bp, Artificial sequence
  SiRNA target sequence
tgacattgtaattgatacaattgtca

SEQ ID NO: 47791 - DNA, 26 bp, Artificial sequence
  SiRNA target sequence
gacattgtaattgatacaattgtcaa

SEQ ID NO: 47792 - DNA, 26 bp, Artificial sequence
  SiRNA target sequence
acattgtaattgatacaattgtcaaa

SEQ ID NO: 47793 - DNA, 26 bp, Artificial sequence
  SiRNA target sequence
cattgtaattgatacaattgtcaaaa

SEQ ID NO: 47794 - DNA, 26 bp, Artificial sequence
  SiRNA target sequence
attgtaattgatacaattgtcaaaac

SEQ ID NO: 47795 - DNA, 26 bp, Artificial sequence
  SiRNA target sequence
ttgtaattgatacaattgtcaaaact

SEQ ID NO: 47796 - DNA, 26 bp, Artificial sequence
  SiRNA target sequence
tgtaattgatacaattgtcaaaactg

SEQ ID NO: 47797 - DNA, 26 bp, Artificial sequence
  SiRNA target sequence
gtaattgatacaattgtcaaaactgc

SEQ ID NO: 47798 - DNA, 26 bp, Artificial sequence
  SiRNA target sequence
taattgatacaattgtcaaaactgca

SEQ ID NO: 47799 - DNA, 26 bp, Artificial sequence
  SiRNA target sequence
aattgatacaattgtcaaaactgcaa

SEQ ID NO: 47800 - DNA, 26 bp, Artificial sequence
  SiRNA target sequence
attgatacaattgtcaaaactgcaaa

SEQ ID NO: 47801 - DNA, 26 bp, Artificial sequence
  SiRNA target sequence
ttgatacaattgtcaaaactgcaaaa

SEQ ID NO: 47802 - DNA, 26 bp, Artificial sequence
  SiRNA target sequence
tgatacaattgtcaaaactgcaaaat

SEQ ID NO: 47803 - DNA, 26 bp, Artificial sequence
  SiRNA target sequence
gatacaattgtcaaaactgcaaaata

SEQ ID NO: 47804 - DNA, 26 bp, Artificial sequence
  SiRNA target sequence
atacaattgtcaaaactgcaaaatac

SEQ ID NO: 47805 - DNA, 26 bp, Artificial sequence
  SiRNA target sequence
tacaattgtcaaaactgcaaaataca

SEQ ID NO: 47806 - DNA, 26 bp, Artificial sequence
  SiRNA target sequence
acaattgtcaaaactgcaaaatacaa

SEQ ID NO: 47807 - DNA, 26 bp, Artificial sequence
  SiRNA target sequence
caattgtcaaaactgcaaaatacaaa

SEQ ID NO: 47808 - DNA, 26 bp, Artificial sequence
  SiRNA target sequence
aattgtcaaaactgcaaaatacaaaa

SEQ ID NO: 47809 - DNA, 26 bp, Artificial sequence
  SiRNA target sequence
attgtcaaaactgcaaaatacaaaag

SEQ ID NO: 47810 - DNA, 26 bp, Artificial sequence
  SiRNA target sequence
ttgtcaaaactgcaaaatacaaaaga

SEQ ID NO: 47811 - DNA, 26 bp, Artificial sequence
  SiRNA target sequence
tgtcaaaactgcaaaatacaaaagac

SEQ ID NO: 47812 - DNA, 26 bp, Artificial sequence
  SiRNA target sequence
gtcaaaactgcaaaatacaaaagact

SEQ ID NO: 47813 - DNA, 26 bp, Artificial sequence
  SiRNA target sequence
tcaaaactgcaaaatacaaaagactt

SEQ ID NO: 47814 - DNA, 26 bp, Artificial sequence
  SiRNA target sequence
caaaactgcaaaatacaaaagacttt

SEQ ID NO: 47815 - DNA, 26 bp, Artificial sequence
  SiRNA target sequence
aaaactgcaaaatacaaaagactttg

SEQ ID NO: 47816 - DNA, 26 bp, Artificial sequence
  SiRNA target sequence
aaactgcaaaatacaaaagactttga

SEQ ID NO: 47817 - DNA, 26 bp, Artificial sequence
  SiRNA target sequence
aactgcaaaatacaaaagactttgac

SEQ ID NO: 47818 - DNA, 26 bp, Artificial sequence
  SiRNA target sequence
actgcaaaatacaaaagactttgact

SEQ ID NO: 47819 - DNA, 26 bp, Artificial sequence
  SiRNA target sequence
ctgcaaaatacaaaagactttgacta

SEQ ID NO: 47820 - DNA, 26 bp, Artificial sequence
  SiRNA target sequence
tgcaaaatacaaaagactttgactaa

SEQ ID NO: 47821 - DNA, 26 bp, Artificial sequence
  SiRNA target sequence
gcaaaatacaaaagactttgactaag

SEQ ID NO: 47822 - DNA, 26 bp, Artificial sequence
  SiRNA target sequence
caaaatacaaaagactttgactaaga

SEQ ID NO: 47823 - DNA, 26 bp, Artificial sequence
  SiRNA target sequence
aaaatacaaaagactttgactaagat

SEQ ID NO: 47824 - DNA, 26 bp, Artificial sequence
  SiRNA target sequence
aaatacaaaagactttgactaagatc

SEQ ID NO: 47825 - DNA, 26 bp, Artificial sequence
  SiRNA target sequence
aatacaaaagactttgactaagatct

SEQ ID NO: 47826 - DNA, 26 bp, Artificial sequence
  SiRNA target sequence
atacaaaagactttgactaagatctt

SEQ ID NO: 47827 - DNA, 26 bp, Artificial sequence
  SiRNA target sequence
tacaaaagactttgactaagatcttt

SEQ ID NO: 47828 - DNA, 26 bp, Artificial sequence
  SiRNA target sequence
acaaaagactttgactaagatcttta

SEQ ID NO: 47829 - DNA, 26 bp, Artificial sequence
  SiRNA target sequence
caaaagactttgactaagatctttat

SEQ ID NO: 47830 - DNA, 26 bp, Artificial sequence
  SiRNA target sequence
aaaagactttgactaagatctttatt

SEQ ID NO: 47831 - DNA, 26 bp, Artificial sequence
  SiRNA target sequence
aaagactttgactaagatctttatta

SEQ ID NO: 47832 - DNA, 26 bp, Artificial sequence
  SiRNA target sequence
aagactttgactaagatctttattat

SEQ ID NO: 47833 - DNA, 26 bp, Artificial sequence
  SiRNA target sequence
agactttgactaagatctttattatc

SEQ ID NO: 47834 - DNA, 26 bp, Artificial sequence
  SiRNA target sequence
gactttgactaagatctttattatct

SEQ ID NO: 47835 - DNA, 26 bp, Artificial sequence
  SiRNA target sequence
actttgactaagatctttattatctg

SEQ ID NO: 47836 - DNA, 26 bp, Artificial sequence
  SiRNA target sequence
ctttgactaagatctttattatctgt

SEQ ID NO: 47837 - DNA, 26 bp, Artificial sequence
  SiRNA target sequence
tttgactaagatctttattatctgta

SEQ ID NO: 47838 - DNA, 26 bp, Artificial sequence
  SiRNA target sequence
ttgactaagatctttattatctgtaa

SEQ ID NO: 47839 - DNA, 26 bp, Artificial sequence
  SiRNA target sequence
tgactaagatctttattatctgtaat

SEQ ID NO: 47840 - DNA, 26 bp, Artificial sequence
  SiRNA target sequence
gactaagatctttattatctgtaata

SEQ ID NO: 47841 - DNA, 26 bp, Artificial sequence
  SiRNA target sequence
actaagatctttattatctgtaatat

SEQ ID NO: 47842 - DNA, 26 bp, Artificial sequence
  SiRNA target sequence
ctaagatctttattatctgtaatatc

SEQ ID NO: 47843 - DNA, 26 bp, Artificial sequence
  SiRNA target sequence
taagatctttattatctgtaatatca

SEQ ID NO: 47844 - DNA, 26 bp, Artificial sequence
  SiRNA target sequence
aagatctttattatctgtaatatcac

SEQ ID NO: 47845 - DNA, 26 bp, Artificial sequence
  SiRNA target sequence
agatctttattatctgtaatatcact

SEQ ID NO: 47846 - DNA, 26 bp, Artificial sequence
  SiRNA target sequence
gatctttattatctgtaatatcacta

SEQ ID NO: 47847 - DNA, 26 bp, Artificial sequence
  SiRNA target sequence
atctttattatctgtaatatcactag

SEQ ID NO: 47848 - DNA, 26 bp, Artificial sequence
  SiRNA target sequence
tctttattatctgtaatatcactagt

SEQ ID NO: 47849 - DNA, 26 bp, Artificial sequence
  SiRNA target sequence
ctttattatctgtaatatcactagtc

SEQ ID NO: 47850 - DNA, 26 bp, Artificial sequence
  SiRNA target sequence
tttattatctgtaatatcactagtca

SEQ ID NO: 47851 - DNA, 26 bp, Artificial sequence
  SiRNA target sequence
ttattatctgtaatatcactagtcaa

SEQ ID NO: 47852 - DNA, 26 bp, Artificial sequence
  SiRNA target sequence
tattatctgtaatatcactagtcaat

SEQ ID NO: 47853 - DNA, 26 bp, Artificial sequence
  SiRNA target sequence
attatctgtaatatcactagtcaatt

SEQ ID NO: 47854 - DNA, 26 bp, Artificial sequence
  SiRNA target sequence
ttatctgtaatatcactagtcaattt

SEQ ID NO: 47855 - DNA, 26 bp, Artificial sequence
  SiRNA target sequence
tatctgtaatatcactagtcaatttc

SEQ ID NO: 47856 - DNA, 26 bp, Artificial sequence
  SiRNA target sequence
atctgtaatatcactagtcaatttcc

SEQ ID NO: 47857 - DNA, 26 bp, Artificial sequence
  SiRNA target sequence
tctgtaatatcactagtcaatttccg

SEQ ID NO: 47858 - DNA, 26 bp, Artificial sequence
  SiRNA target sequence
ctgtaatatcactagtcaatttccgg

SEQ ID NO: 47859 - DNA, 26 bp, Artificial sequence
  SiRNA target sequence
tgtaatatcactagtcaatttccggg

SEQ ID NO: 47860 - DNA, 26 bp, Artificial sequence
  SiRNA target sequence
gtaatatcactagtcaatttccgggt

SEQ ID NO: 47861 - DNA, 26 bp, Artificial sequence
  SiRNA target sequence
taatatcactagtcaatttccgggta

SEQ ID NO: 47862 - DNA, 26 bp, Artificial sequence
  SiRNA target sequence
aatatcactagtcaatttccgggtag

SEQ ID NO: 47863 - DNA, 26 bp, Artificial sequence
  SiRNA target sequence
atatcactagtcaatttccgggtagc

SEQ ID NO: 47864 - DNA, 26 bp, Artificial sequence
  SiRNA target sequence
tatcactagtcaatttccgggtagct

SEQ ID NO: 47865 - DNA, 26 bp, Artificial sequence
  SiRNA target sequence
atcactagtcaatttccgggtagctt

SEQ ID NO: 47866 - DNA, 26 bp, Artificial sequence
  SiRNA target sequence
tcactagtcaatttccgggtagcttc

SEQ ID NO: 47867 - DNA, 26 bp, Artificial sequence
  SiRNA target sequence
cactagtcaatttccgggtagcttca

SEQ ID NO: 47868 - DNA, 26 bp, Artificial sequence
  SiRNA target sequence
actagtcaatttccgggtagcttcaa

SEQ ID NO: 47869 - DNA, 26 bp, Artificial sequence
  SiRNA target sequence
ctagtcaatttccgggtagcttcaac

SEQ ID NO: 47870 - DNA, 26 bp, Artificial sequence
  SiRNA target sequence
tagtcaatttccgggtagcttcaact

SEQ ID NO: 47871 - DNA, 26 bp, Artificial sequence
  SiRNA target sequence
agtcaatttccgggtagcttcaactg

SEQ ID NO: 47872 - DNA, 26 bp, Artificial sequence
  SiRNA target sequence
gtcaatttccgggtagcttcaactgt

SEQ ID NO: 47873 - DNA, 26 bp, Artificial sequence
  SiRNA target sequence
tcaatttccgggtagcttcaactgtt

SEQ ID NO: 47874 - DNA, 26 bp, Artificial sequence
  SiRNA target sequence
caatttccgggtagcttcaactgtta

SEQ ID NO: 47875 - DNA, 26 bp, Artificial sequence
  SiRNA target sequence
aatttccgggtagcttcaactgttaa

SEQ ID NO: 47876 - DNA, 26 bp, Artificial sequence
  SiRNA target sequence
atttccgggtagcttcaactgttaaa

SEQ ID NO: 47877 - DNA, 26 bp, Artificial sequence
  SiRNA target sequence
tttccgggtagcttcaactgttaaaa

SEQ ID NO: 47878 - DNA, 26 bp, Artificial sequence
  SiRNA target sequence
ttccgggtagcttcaactgttaaaac

SEQ ID NO: 47879 - DNA, 26 bp, Artificial sequence
  SiRNA target sequence
tccgggtagcttcaactgttaaaaca

SEQ ID NO: 47880 - DNA, 26 bp, Artificial sequence
  SiRNA target sequence
ccgggtagcttcaactgttaaaacat

SEQ ID NO: 47881 - DNA, 26 bp, Artificial sequence
  SiRNA target sequence
cgggtagcttcaactgttaaaacatt

SEQ ID NO: 47882 - DNA, 26 bp, Artificial sequence
  SiRNA target sequence
gggtagcttcaactgttaaaacatta

SEQ ID NO: 47883 - DNA, 26 bp, Artificial sequence
  SiRNA target sequence
ggtagcttcaactgttaaaacattaa

SEQ ID NO: 47884 - DNA, 26 bp, Artificial sequence
  SiRNA target sequence
gtagcttcaactgttaaaacattaaa

SEQ ID NO: 47885 - DNA, 26 bp, Artificial sequence
  SiRNA target sequence
tagcttcaactgttaaaacattaaat

SEQ ID NO: 47886 - DNA, 26 bp, Artificial sequence
  SiRNA target sequence
agcttcaactgttaaaacattaaatg

SEQ ID NO: 47887 - DNA, 26 bp, Artificial sequence
  SiRNA target sequence
gcttcaactgttaaaacattaaatgt

SEQ ID NO: 47888 - DNA, 26 bp, Artificial sequence
  SiRNA target sequence
cttcaactgttaaaacattaaatgta

SEQ ID NO: 47889 - DNA, 26 bp, Artificial sequence
  SiRNA target sequence
ttcaactgttaaaacattaaatgtac

SEQ ID NO: 47890 - DNA, 26 bp, Artificial sequence
  SiRNA target sequence
tcaactgttaaaacattaaatgtaca

SEQ ID NO: 47891 - DNA, 26 bp, Artificial sequence
  SiRNA target sequence
caactgttaaaacattaaatgtacaa

SEQ ID NO: 47892 - DNA, 26 bp, Artificial sequence
  SiRNA target sequence
aactgttaaaacattaaatgtacaaa

SEQ ID NO: 47893 - DNA, 26 bp, Artificial sequence
  SiRNA target sequence
actgttaaaacattaaatgtacaaac

SEQ ID NO: 47894 - DNA, 26 bp, Artificial sequence
  SiRNA target sequence
ctgttaaaacattaaatgtacaaact

SEQ ID NO: 47895 - DNA, 26 bp, Artificial sequence
  SiRNA target sequence
tgttaaaacattaaatgtacaaactg

SEQ ID NO: 47896 - DNA, 26 bp, Artificial sequence
  SiRNA target sequence
gttaaaacattaaatgtacaaactgc

SEQ ID NO: 47897 - DNA, 26 bp, Artificial sequence
  SiRNA target sequence
ttaaaacattaaatgtacaaactgca

SEQ ID NO: 47898 - DNA, 26 bp, Artificial sequence
  SiRNA target sequence
taaaacattaaatgtacaaactgcaa

SEQ ID NO: 47899 - DNA, 26 bp, Artificial sequence
  SiRNA target sequence
aaaacattaaatgtacaaactgcaaa

SEQ ID NO: 47900 - DNA, 26 bp, Artificial sequence
  SiRNA target sequence
aaacattaaatgtacaaactgcaaat

SEQ ID NO: 47901 - DNA, 26 bp, Artificial sequence
  SiRNA target sequence
aacattaaatgtacaaactgcaaatg

SEQ ID NO: 47902 - DNA, 26 bp, Artificial sequence
  SiRNA target sequence
acattaaatgtacaaactgcaaatgt

SEQ ID NO: 47903 - DNA, 26 bp, Artificial sequence
  SiRNA target sequence
cattaaatgtacaaactgcaaatgtc

SEQ ID NO: 47904 - DNA, 26 bp, Artificial sequence
  SiRNA target sequence
attaaatgtacaaactgcaaatgtcc

SEQ ID NO: 47905 - DNA, 26 bp, Artificial sequence
  SiRNA target sequence
ttaaatgtacaaactgcaaatgtccc

SEQ ID NO: 47906 - DNA, 26 bp, Artificial sequence
  SiRNA target sequence
taaatgtacaaactgcaaatgtccca

SEQ ID NO: 47907 - DNA, 26 bp, Artificial sequence
  SiRNA target sequence
aaatgtacaaactgcaaatgtcccaa

SEQ ID NO: 47908 - DNA, 26 bp, Artificial sequence
  SiRNA target sequence
aatgtacaaactgcaaatgtcccaaa

SEQ ID NO: 47909 - DNA, 26 bp, Artificial sequence
  SiRNA target sequence
atgtacaaactgcaaatgtcccaaaa

SEQ ID NO: 47910 - DNA, 26 bp, Artificial sequence
  SiRNA target sequence
tgtacaaactgcaaatgtcccaaaaa

SEQ ID NO: 47911 - DNA, 26 bp, Artificial sequence
  SiRNA target sequence
gtacaaactgcaaatgtcccaaaaat

SEQ ID NO: 47912 - DNA, 26 bp, Artificial sequence
  SiRNA target sequence
tacaaactgcaaatgtcccaaaaatt

SEQ ID NO: 47913 - DNA, 26 bp, Artificial sequence
  SiRNA target sequence
acaaactgcaaatgtcccaaaaatta

SEQ ID NO: 47914 - DNA, 26 bp, Artificial sequence
  SiRNA target sequence
caaactgcaaatgtcccaaaaattat

SEQ ID NO: 47915 - DNA, 26 bp, Artificial sequence
  SiRNA target sequence
aaactgcaaatgtcccaaaaattatg

SEQ ID NO: 47916 - DNA, 26 bp, Artificial sequence
  SiRNA target sequence
aactgcaaatgtcccaaaaattatgt

SEQ ID NO: 47917 - DNA, 26 bp, Artificial sequence
  SiRNA target sequence
actgcaaatgtcccaaaaattatgta

SEQ ID NO: 47918 - DNA, 26 bp, Artificial sequence
  SiRNA target sequence
ctgcaaatgtcccaaaaattatgtaa

SEQ ID NO: 47919 - DNA, 26 bp, Artificial sequence
  SiRNA target sequence
tgcaaatgtcccaaaaattatgtaaa

SEQ ID NO: 47920 - DNA, 26 bp, Artificial sequence
  SiRNA target sequence
gcaaatgtcccaaaaattatgtaaat

SEQ ID NO: 47921 - DNA, 26 bp, Artificial sequence
  SiRNA target sequence
caaatgtcccaaaaattatgtaaatg

SEQ ID NO: 47922 - DNA, 26 bp, Artificial sequence
  SiRNA target sequence
aaatgtcccaaaaattatgtaaatga

SEQ ID NO: 47923 - DNA, 26 bp, Artificial sequence
  SiRNA target sequence
aatgtcccaaaaattatgtaaatgac

SEQ ID NO: 47924 - DNA, 26 bp, Artificial sequence
  SiRNA target sequence
atgtcccaaaaattatgtaaatgaca

SEQ ID NO: 47925 - DNA, 26 bp, Artificial sequence
  SiRNA target sequence
tgtcccaaaaattatgtaaatgacaa

SEQ ID NO: 47926 - DNA, 26 bp, Artificial sequence
  SiRNA target sequence
gtcccaaaaattatgtaaatgacaaa

SEQ ID NO: 47927 - DNA, 26 bp, Artificial sequence
  SiRNA target sequence
tcccaaaaattatgtaaatgacaaat

SEQ ID NO: 47928 - DNA, 26 bp, Artificial sequence
  SiRNA target sequence
cccaaaaattatgtaaatgacaaatg

SEQ ID NO: 47929 - DNA, 26 bp, Artificial sequence
  SiRNA target sequence
ccaaaaattatgtaaatgacaaatgt

SEQ ID NO: 47930 - DNA, 26 bp, Artificial sequence
  SiRNA target sequence
caaaaattatgtaaatgacaaatgtt

SEQ ID NO: 47931 - DNA, 26 bp, Artificial sequence
  SiRNA target sequence
aaaaattatgtaaatgacaaatgttc

SEQ ID NO: 47932 - DNA, 26 bp, Artificial sequence
  SiRNA target sequence
aaaattatgtaaatgacaaatgttcg

SEQ ID NO: 47933 - DNA, 26 bp, Artificial sequence
  SiRNA target sequence
aaattatgtaaatgacaaatgttcga

SEQ ID NO: 47934 - DNA, 26 bp, Artificial sequence
  SiRNA target sequence
aattatgtaaatgacaaatgttcgaa

SEQ ID NO: 47935 - DNA, 26 bp, Artificial sequence
  SiRNA target sequence
attatgtaaatgacaaatgttcgaat

SEQ ID NO: 47936 - DNA, 26 bp, Artificial sequence
  SiRNA target sequence
ttatgtaaatgacaaatgttcgaata

SEQ ID NO: 47937 - DNA, 26 bp, Artificial sequence
  SiRNA target sequence
tatgtaaatgacaaatgttcgaataa

SEQ ID NO: 47938 - DNA, 26 bp, Artificial sequence
  SiRNA target sequence
atgtaaatgacaaatgttcgaataaa

SEQ ID NO: 47939 - DNA, 26 bp, Artificial sequence
  SiRNA target sequence
tgtaaatgacaaatgttcgaataaag

SEQ ID NO: 47940 - DNA, 26 bp, Artificial sequence
  SiRNA target sequence
gtaaatgacaaatgttcgaataaagg

SEQ ID NO: 47941 - DNA, 26 bp, Artificial sequence
  SiRNA target sequence
taaatgacaaatgttcgaataaaggg

SEQ ID NO: 47942 - DNA, 26 bp, Artificial sequence
  SiRNA target sequence
aaatgacaaatgttcgaataaagggc

SEQ ID NO: 47943 - DNA, 26 bp, Artificial sequence
  SiRNA target sequence
aatgacaaatgttcgaataaagggct

SEQ ID NO: 47944 - DNA, 26 bp, Artificial sequence
  SiRNA target sequence
atgacaaatgttcgaataaagggctt

SEQ ID NO: 47945 - DNA, 26 bp, Artificial sequence
  SiRNA target sequence
tgacaaatgttcgaataaagggcttt

SEQ ID NO: 47946 - DNA, 26 bp, Artificial sequence
  SiRNA target sequence
gacaaatgttcgaataaagggctttg

SEQ ID NO: 47947 - DNA, 26 bp, Artificial sequence
  SiRNA target sequence
acaaatgttcgaataaagggctttga

SEQ ID NO: 47948 - DNA, 26 bp, Artificial sequence
  SiRNA target sequence
caaatgttcgaataaagggctttgaa

SEQ ID NO: 47949 - DNA, 26 bp, Artificial sequence
  SiRNA target sequence
aaatgttcgaataaagggctttgaaa

SEQ ID NO: 47950 - DNA, 26 bp, Artificial sequence
  SiRNA target sequence
aatgttcgaataaagggctttgaaat

SEQ ID NO: 47951 - DNA, 26 bp, Artificial sequence
  SiRNA target sequence
atgttcgaataaagggctttgaaata

SEQ ID NO: 47952 - DNA, 26 bp, Artificial sequence
  SiRNA target sequence
tgttcgaataaagggctttgaaataa

SEQ ID NO: 47953 - DNA, 26 bp, Artificial sequence
  SiRNA target sequence
gttcgaataaagggctttgaaataac

SEQ ID NO: 47954 - DNA, 26 bp, Artificial sequence
  SiRNA target sequence
ttcgaataaagggctttgaaataaca

SEQ ID NO: 47955 - DNA, 26 bp, Artificial sequence
  SiRNA target sequence
tcgaataaagggctttgaaataacat

SEQ ID NO: 47956 - DNA, 26 bp, Artificial sequence
  SiRNA target sequence
cgaataaagggctttgaaataacata

SEQ ID NO: 47957 - DNA, 26 bp, Artificial sequence
  SiRNA target sequence
gaataaagggctttgaaataacatat

SEQ ID NO: 47958 - DNA, 26 bp, Artificial sequence
  SiRNA target sequence
aataaagggctttgaaataacatatt

SEQ ID NO: 47959 - DNA, 26 bp, Artificial sequence
  SiRNA target sequence
ataaagggctttgaaataacatattc

SEQ ID NO: 47960 - DNA, 26 bp, Artificial sequence
  SiRNA target sequence
taaagggctttgaaataacatattct

SEQ ID NO: 47961 - DNA, 26 bp, Artificial sequence
  SiRNA target sequence
aaagggctttgaaataacatattcta

SEQ ID NO: 47962 - DNA, 26 bp, Artificial sequence
  SiRNA target sequence
aagggctttgaaataacatattctac

SEQ ID NO: 47963 - DNA, 26 bp, Artificial sequence
  SiRNA target sequence
agggctttgaaataacatattctaca

SEQ ID NO: 47964 - DNA, 26 bp, Artificial sequence
  SiRNA target sequence
gggctttgaaataacatattctacaa

SEQ ID NO: 47965 - DNA, 26 bp, Artificial sequence
  SiRNA target sequence
ggctttgaaataacatattctacaat

SEQ ID NO: 47966 - DNA, 26 bp, Artificial sequence
  SiRNA target sequence
gctttgaaataacatattctacaatc

SEQ ID NO: 47967 - DNA, 26 bp, Artificial sequence
  SiRNA target sequence
ctttgaaataacatattctacaatca

SEQ ID NO: 47968 - DNA, 26 bp, Artificial sequence
  SiRNA target sequence
tttgaaataacatattctacaatcag

SEQ ID NO: 47969 - DNA, 26 bp, Artificial sequence
  SiRNA target sequence
ttgaaataacatattctacaatcagg

SEQ ID NO: 47970 - DNA, 26 bp, Artificial sequence
  SiRNA target sequence
tgaaataacatattctacaatcaggt

SEQ ID NO: 47971 - DNA, 26 bp, Artificial sequence
  SiRNA target sequence
gaaataacatattctacaatcaggtc

SEQ ID NO: 47972 - DNA, 26 bp, Artificial sequence
  SiRNA target sequence
aaataacatattctacaatcaggtct

SEQ ID NO: 47973 - DNA, 26 bp, Artificial sequence
  SiRNA target sequence
aataacatattctacaatcaggtctt

SEQ ID NO: 47974 - DNA, 26 bp, Artificial sequence
  SiRNA target sequence
ataacatattctacaatcaggtcttt

SEQ ID NO: 47975 - DNA, 26 bp, Artificial sequence
  SiRNA target sequence
taacatattctacaatcaggtctttc

SEQ ID NO: 47976 - DNA, 26 bp, Artificial sequence
  SiRNA target sequence
aacatattctacaatcaggtctttca

SEQ ID NO: 47977 - DNA, 26 bp, Artificial sequence
  SiRNA target sequence
acatattctacaatcaggtctttcat

SEQ ID NO: 47978 - DNA, 26 bp, Artificial sequence
  SiRNA target sequence
catattctacaatcaggtctttcata

SEQ ID NO: 47979 - DNA, 26 bp, Artificial sequence
  SiRNA target sequence
atattctacaatcaggtctttcataa

SEQ ID NO: 47980 - DNA, 26 bp, Artificial sequence
  SiRNA target sequence
tattctacaatcaggtctttcataat

SEQ ID NO: 47981 - DNA, 26 bp, Artificial sequence
  SiRNA target sequence
attctacaatcaggtctttcataata

SEQ ID NO: 47982 - DNA, 26 bp, Artificial sequence
  SiRNA target sequence
ttctacaatcaggtctttcataatac

SEQ ID NO: 47983 - DNA, 26 bp, Artificial sequence
  SiRNA target sequence
tctacaatcaggtctttcataatact

SEQ ID NO: 47984 - DNA, 26 bp, Artificial sequence
  SiRNA target sequence
ctacaatcaggtctttcataatacta

SEQ ID NO: 47985 - DNA, 26 bp, Artificial sequence
  SiRNA target sequence
tacaatcaggtctttcataatactaa

SEQ ID NO: 47986 - DNA, 26 bp, Artificial sequence
  SiRNA target sequence
acaatcaggtctttcataatactaat

SEQ ID NO: 47987 - DNA, 26 bp, Artificial sequence
  SiRNA target sequence
caatcaggtctttcataatactaata

SEQ ID NO: 47988 - DNA, 26 bp, Artificial sequence
  SiRNA target sequence
aatcaggtctttcataatactaatat

SEQ ID NO: 47989 - DNA, 26 bp, Artificial sequence
  SiRNA target sequence
atcaggtctttcataatactaatatc

SEQ ID NO: 47990 - DNA, 26 bp, Artificial sequence
  SiRNA target sequence
tcaggtctttcataatactaatatca

SEQ ID NO: 47991 - DNA, 26 bp, Artificial sequence
  SiRNA target sequence
caggtctttcataatactaatatcac

SEQ ID NO: 47992 - DNA, 26 bp, Artificial sequence
  SiRNA target sequence
aggtctttcataatactaatatcact

SEQ ID NO: 47993 - DNA, 26 bp, Artificial sequence
  SiRNA target sequence
ggtctttcataatactaatatcacta

SEQ ID NO: 47994 - DNA, 26 bp, Artificial sequence
  SiRNA target sequence
gtctttcataatactaatatcactac

SEQ ID NO: 47995 - DNA, 26 bp, Artificial sequence
  SiRNA target sequence
tctttcataatactaatatcactacc

SEQ ID NO: 47996 - DNA, 26 bp, Artificial sequence
  SiRNA target sequence
ctttcataatactaatatcactacca

SEQ ID NO: 47997 - DNA, 26 bp, Artificial sequence
  SiRNA target sequence
tttcataatactaatatcactaccat

SEQ ID NO: 47998 - DNA, 26 bp, Artificial sequence
  SiRNA target sequence
ttcataatactaatatcactaccata

SEQ ID NO: 47999 - DNA, 26 bp, Artificial sequence
  SiRNA target sequence
tcataatactaatatcactaccataa

SEQ ID NO: 48000 - DNA, 26 bp, Artificial sequence
  SiRNA target sequence
cataatactaatatcactaccataaa

SEQ ID NO: 48001 - DNA, 26 bp, Artificial sequence
  SiRNA target sequence
ataatactaatatcactaccataaat

SEQ ID NO: 48002 - DNA, 26 bp, Artificial sequence
  SiRNA target sequence
taatactaatatcactaccataaata

SEQ ID NO: 48003 - DNA, 26 bp, Artificial sequence
  SiRNA target sequence
aatactaatatcactaccataaatag

SEQ ID NO: 48004 - DNA, 26 bp, Artificial sequence
  SiRNA target sequence
atactaatatcactaccataaataga

SEQ ID NO: 48005 - DNA, 26 bp, Artificial sequence
  SiRNA target sequence
tactaatatcactaccataaatagat

SEQ ID NO: 48006 - DNA, 26 bp, Artificial sequence
  SiRNA target sequence
actaatatcactaccataaatagatt

SEQ ID NO: 48007 - DNA, 26 bp, Artificial sequence
  SiRNA target sequence
ctaatatcactaccataaatagattt

SEQ ID NO: 48008 - DNA, 26 bp, Artificial sequence
  SiRNA target sequence
taatatcactaccataaatagatttt

SEQ ID NO: 48009 - DNA, 26 bp, Artificial sequence
  SiRNA target sequence
aatatcactaccataaatagattttt

SEQ ID NO: 48010 - DNA, 26 bp, Artificial sequence
  SiRNA target sequence
atatcactaccataaatagatttttt

SEQ ID NO: 48011 - DNA, 26 bp, Artificial sequence
  SiRNA target sequence
tatcactaccataaatagattttttt

SEQ ID NO: 48012 - DNA, 26 bp, Artificial sequence
  SiRNA target sequence
atcactaccataaatagatttttttt

SEQ ID NO: 48013 - DNA, 26 bp, Artificial sequence
  SiRNA target sequence
tcactaccataaatagattttttttc

SEQ ID NO: 48014 - DNA, 26 bp, Artificial sequence
  SiRNA target sequence
cactaccataaatagattttttttct

SEQ ID NO: 48015 - DNA, 26 bp, Artificial sequence
  SiRNA target sequence
actaccataaatagattttttttcta

SEQ ID NO: 48016 - DNA, 26 bp, Artificial sequence
  SiRNA target sequence
ctaccataaatagattttttttctaa

SEQ ID NO: 48017 - DNA, 26 bp, Artificial sequence
  SiRNA target sequence
taccataaatagattttttttctaac

SEQ ID NO: 48018 - DNA, 26 bp, Artificial sequence
  SiRNA target sequence
accataaatagattttttttctaaca

SEQ ID NO: 48019 - DNA, 26 bp, Artificial sequence
  SiRNA target sequence
ccataaatagattttttttctaacat

SEQ ID NO: 48020 - DNA, 27 bp, Artificial sequence
  SiRNA target sequence
ttataagtttaatgtagaaataatatt

SEQ ID NO: 48021 - DNA, 27 bp, Artificial sequence
  SiRNA target sequence
tataagtttaatgtagaaataatattt

SEQ ID NO: 48022 - DNA, 27 bp, Artificial sequence
  SiRNA target sequence
ataagtttaatgtagaaataatatttt

SEQ ID NO: 48023 - DNA, 27 bp, Artificial sequence
  SiRNA target sequence
taagtttaatgtagaaataatattttc

SEQ ID NO: 48024 - DNA, 27 bp, Artificial sequence
  SiRNA target sequence
aagtttaatgtagaaataatattttct

SEQ ID NO: 48025 - DNA, 27 bp, Artificial sequence
  SiRNA target sequence
agtttaatgtagaaataatattttctt

SEQ ID NO: 48026 - DNA, 27 bp, Artificial sequence
  SiRNA target sequence
gtttaatgtagaaataatattttcttc

SEQ ID NO: 48027 - DNA, 27 bp, Artificial sequence
  SiRNA target sequence
tttaatgtagaaataatattttcttct

SEQ ID NO: 48028 - DNA, 27 bp, Artificial sequence
  SiRNA target sequence
ttaatgtagaaataatattttcttcta

SEQ ID NO: 48029 - DNA, 27 bp, Artificial sequence
  SiRNA target sequence
taatgtagaaataatattttcttctat

SEQ ID NO: 48030 - DNA, 27 bp, Artificial sequence
  SiRNA target sequence
aatgtagaaataatattttcttctatc

SEQ ID NO: 48031 - DNA, 27 bp, Artificial sequence
  SiRNA target sequence
atgtagaaataatattttcttctatct

SEQ ID NO: 48032 - DNA, 27 bp, Artificial sequence
  SiRNA target sequence
tgtagaaataatattttcttctatctt

SEQ ID NO: 48033 - DNA, 27 bp, Artificial sequence
  SiRNA target sequence
gtagaaataatattttcttctatctta

SEQ ID NO: 48034 - DNA, 27 bp, Artificial sequence
  SiRNA target sequence
tagaaataatattttcttctatcttat

SEQ ID NO: 48035 - DNA, 27 bp, Artificial sequence
  SiRNA target sequence
agaaataatattttcttctatcttatg

SEQ ID NO: 48036 - DNA, 27 bp, Artificial sequence
  SiRNA target sequence
gaaataatattttcttctatcttatgt

SEQ ID NO: 48037 - DNA, 27 bp, Artificial sequence
  SiRNA target sequence
aaataatattttcttctatcttatgta

SEQ ID NO: 48038 - DNA, 27 bp, Artificial sequence
  SiRNA target sequence
aataatattttcttctatcttatgtaa

SEQ ID NO: 48039 - DNA, 27 bp, Artificial sequence
  SiRNA target sequence
ataatattttcttctatcttatgtaat

SEQ ID NO: 48040 - DNA, 27 bp, Artificial sequence
  SiRNA target sequence
taatattttcttctatcttatgtaatg

SEQ ID NO: 48041 - DNA, 27 bp, Artificial sequence
  SiRNA target sequence
aatattttcttctatcttatgtaatga

SEQ ID NO: 48042 - DNA, 27 bp, Artificial sequence
  SiRNA target sequence
atattttcttctatcttatgtaatgat

SEQ ID NO: 48043 - DNA, 27 bp, Artificial sequence
  SiRNA target sequence
tattttcttctatcttatgtaatgata

SEQ ID NO: 48044 - DNA, 27 bp, Artificial sequence
  SiRNA target sequence
attttcttctatcttatgtaatgatac

SEQ ID NO: 48045 - DNA, 27 bp, Artificial sequence
  SiRNA target sequence
ttttcttctatcttatgtaatgataca

SEQ ID NO: 48046 - DNA, 27 bp, Artificial sequence
  SiRNA target sequence
tttcttctatcttatgtaatgatacag

SEQ ID NO: 48047 - DNA, 27 bp, Artificial sequence
  SiRNA target sequence
ttcttctatcttatgtaatgatacagt

SEQ ID NO: 48048 - DNA, 27 bp, Artificial sequence
  SiRNA target sequence
tcttctatcttatgtaatgatacagtt

SEQ ID NO: 48049 - DNA, 27 bp, Artificial sequence
  SiRNA target sequence
cttctatcttatgtaatgatacagttt

SEQ ID NO: 48050 - DNA, 27 bp, Artificial sequence
  SiRNA target sequence
ttctatcttatgtaatgatacagtttt

SEQ ID NO: 48051 - DNA, 27 bp, Artificial sequence
  SiRNA target sequence
tctatcttatgtaatgatacagttttg

SEQ ID NO: 48052 - DNA, 27 bp, Artificial sequence
  SiRNA target sequence
ctatcttatgtaatgatacagttttgt

SEQ ID NO: 48053 - DNA, 27 bp, Artificial sequence
  SiRNA target sequence
tatcttatgtaatgatacagttttgtt

SEQ ID NO: 48054 - DNA, 27 bp, Artificial sequence
  SiRNA target sequence
atcttatgtaatgatacagttttgttt

SEQ ID NO: 48055 - DNA, 27 bp, Artificial sequence
  SiRNA target sequence
tcttatgtaatgatacagttttgtttt

SEQ ID NO: 48056 - DNA, 27 bp, Artificial sequence
  SiRNA target sequence
cttatgtaatgatacagttttgttttt

SEQ ID NO: 48057 - DNA, 27 bp, Artificial sequence
  SiRNA target sequence
ttatgtaatgatacagttttgttttta

SEQ ID NO: 48058 - DNA, 27 bp, Artificial sequence
  SiRNA target sequence
tatgtaatgatacagttttgtttttaa

SEQ ID NO: 48059 - DNA, 27 bp, Artificial sequence
  SiRNA target sequence
atgtaatgatacagttttgtttttaat

SEQ ID NO: 48060 - DNA, 27 bp, Artificial sequence
  SiRNA target sequence
tgtaatgatacagttttgtttttaata

SEQ ID NO: 48061 - DNA, 27 bp, Artificial sequence
  SiRNA target sequence
gtaatgatacagttttgtttttaatac

SEQ ID NO: 48062 - DNA, 27 bp, Artificial sequence
  SiRNA target sequence
taatgatacagttttgtttttaatact

SEQ ID NO: 48063 - DNA, 27 bp, Artificial sequence
  SiRNA target sequence
aatgatacagttttgtttttaatactt

SEQ ID NO: 48064 - DNA, 27 bp, Artificial sequence
  SiRNA target sequence
atgatacagttttgtttttaatactta

SEQ ID NO: 48065 - DNA, 27 bp, Artificial sequence
  SiRNA target sequence
tgatacagttttgtttttaatacttag

SEQ ID NO: 48066 - DNA, 27 bp, Artificial sequence
  SiRNA target sequence
gatacagttttgtttttaatacttagc

SEQ ID NO: 48067 - DNA, 27 bp, Artificial sequence
  SiRNA target sequence
atacagttttgtttttaatacttagca

SEQ ID NO: 48068 - DNA, 27 bp, Artificial sequence
  SiRNA target sequence
tacagttttgtttttaatacttagcac

SEQ ID NO: 48069 - DNA, 27 bp, Artificial sequence
  SiRNA target sequence
acagttttgtttttaatacttagcact

SEQ ID NO: 48070 - DNA, 27 bp, Artificial sequence
  SiRNA target sequence
cagttttgtttttaatacttagcactt

SEQ ID NO: 48071 - DNA, 27 bp, Artificial sequence
  SiRNA target sequence
agttttgtttttaatacttagcacttt

SEQ ID NO: 48072 - DNA, 27 bp, Artificial sequence
  SiRNA target sequence
gttttgtttttaatacttagcacttta

SEQ ID NO: 48073 - DNA, 27 bp, Artificial sequence
  SiRNA target sequence
ttttgtttttaatacttagcactttat

SEQ ID NO: 48074 - DNA, 27 bp, Artificial sequence
  SiRNA target sequence
tttgtttttaatacttagcactttatc

SEQ ID NO: 48075 - DNA, 27 bp, Artificial sequence
  SiRNA target sequence
ttgtttttaatacttagcactttatca

SEQ ID NO: 48076 - DNA, 27 bp, Artificial sequence
  SiRNA target sequence
tgtttttaatacttagcactttatcaa

SEQ ID NO: 48077 - DNA, 27 bp, Artificial sequence
  SiRNA target sequence
gtttttaatacttagcactttatcaaa

SEQ ID NO: 48078 - DNA, 27 bp, Artificial sequence
  SiRNA target sequence
tttttaatacttagcactttatcaaat

SEQ ID NO: 48079 - DNA, 27 bp, Artificial sequence
  SiRNA target sequence
ttttaatacttagcactttatcaaata

SEQ ID NO: 48080 - DNA, 27 bp, Artificial sequence
  SiRNA target sequence
tttaatacttagcactttatcaaataa

SEQ ID NO: 48081 - DNA, 27 bp, Artificial sequence
  SiRNA target sequence
ttaatacttagcactttatcaaataag

SEQ ID NO: 48082 - DNA, 27 bp, Artificial sequence
  SiRNA target sequence
taatacttagcactttatcaaataagt

SEQ ID NO: 48083 - DNA, 27 bp, Artificial sequence
  SiRNA target sequence
aatacttagcactttatcaaataagtg

SEQ ID NO: 48084 - DNA, 27 bp, Artificial sequence
  SiRNA target sequence
atacttagcactttatcaaataagtgg

SEQ ID NO: 48085 - DNA, 27 bp, Artificial sequence
  SiRNA target sequence
tacttagcactttatcaaataagtgga

SEQ ID NO: 48086 - DNA, 27 bp, Artificial sequence
  SiRNA target sequence
acttagcactttatcaaataagtggag

SEQ ID NO: 48087 - DNA, 27 bp, Artificial sequence
  SiRNA target sequence
cttagcactttatcaaataagtggagt

SEQ ID NO: 48088 - DNA, 27 bp, Artificial sequence
  SiRNA target sequence
ttagcactttatcaaataagtggagta

SEQ ID NO: 48089 - DNA, 27 bp, Artificial sequence
  SiRNA target sequence
tagcactttatcaaataagtggagtaa

SEQ ID NO: 48090 - DNA, 27 bp, Artificial sequence
  SiRNA target sequence
agcactttatcaaataagtggagtaaa

SEQ ID NO: 48091 - DNA, 27 bp, Artificial sequence
  SiRNA target sequence
gcactttatcaaataagtggagtaaat

SEQ ID NO: 48092 - DNA, 27 bp, Artificial sequence
  SiRNA target sequence
cactttatcaaataagtggagtaaatc

SEQ ID NO: 48093 - DNA, 27 bp, Artificial sequence
  SiRNA target sequence
actttatcaaataagtggagtaaatct

SEQ ID NO: 48094 - DNA, 27 bp, Artificial sequence
  SiRNA target sequence
ctttatcaaataagtggagtaaatcta

SEQ ID NO: 48095 - DNA, 27 bp, Artificial sequence
  SiRNA target sequence
tttatcaaataagtggagtaaatctaa

SEQ ID NO: 48096 - DNA, 27 bp, Artificial sequence
  SiRNA target sequence
ttatcaaataagtggagtaaatctaaa

SEQ ID NO: 48097 - DNA, 27 bp, Artificial sequence
  SiRNA target sequence
tatcaaataagtggagtaaatctaaat

SEQ ID NO: 48098 - DNA, 27 bp, Artificial sequence
  SiRNA target sequence
atcaaataagtggagtaaatctaaatt

SEQ ID NO: 48099 - DNA, 27 bp, Artificial sequence
  SiRNA target sequence
tcaaataagtggagtaaatctaaatta

SEQ ID NO: 48100 - DNA, 27 bp, Artificial sequence
  SiRNA target sequence
caaataagtggagtaaatctaaattat

SEQ ID NO: 48101 - DNA, 27 bp, Artificial sequence
  SiRNA target sequence
aaataagtggagtaaatctaaattatg

SEQ ID NO: 48102 - DNA, 27 bp, Artificial sequence
  SiRNA target sequence
aataagtggagtaaatctaaattatgt

SEQ ID NO: 48103 - DNA, 27 bp, Artificial sequence
  SiRNA target sequence
ataagtggagtaaatctaaattatgta

SEQ ID NO: 48104 - DNA, 27 bp, Artificial sequence
  SiRNA target sequence
taagtggagtaaatctaaattatgtaa

SEQ ID NO: 48105 - DNA, 27 bp, Artificial sequence
  SiRNA target sequence
aagtggagtaaatctaaattatgtaaa

SEQ ID NO: 48106 - DNA, 27 bp, Artificial sequence
  SiRNA target sequence
agtggagtaaatctaaattatgtaaaa

SEQ ID NO: 48107 - DNA, 27 bp, Artificial sequence
  SiRNA target sequence
gtggagtaaatctaaattatgtaaaac

SEQ ID NO: 48108 - DNA, 27 bp, Artificial sequence
  SiRNA target sequence
tggagtaaatctaaattatgtaaaaca

SEQ ID NO: 48109 - DNA, 27 bp, Artificial sequence
  SiRNA target sequence
ggagtaaatctaaattatgtaaaacaa

SEQ ID NO: 48110 - DNA, 27 bp, Artificial sequence
  SiRNA target sequence
gagtaaatctaaattatgtaaaacaat

SEQ ID NO: 48111 - DNA, 27 bp, Artificial sequence
  SiRNA target sequence
agtaaatctaaattatgtaaaacaata

SEQ ID NO: 48112 - DNA, 27 bp, Artificial sequence
  SiRNA target sequence
gtaaatctaaattatgtaaaacaataa

SEQ ID NO: 48113 - DNA, 27 bp, Artificial sequence
  SiRNA target sequence
taaatctaaattatgtaaaacaataat

SEQ ID NO: 48114 - DNA, 27 bp, Artificial sequence
  SiRNA target sequence
aaatctaaattatgtaaaacaataatt

SEQ ID NO: 48115 - DNA, 27 bp, Artificial sequence
  SiRNA target sequence
aatctaaattatgtaaaacaataatta

SEQ ID NO: 48116 - DNA, 27 bp, Artificial sequence
  SiRNA target sequence
atctaaattatgtaaaacaataattat

SEQ ID NO: 48117 - DNA, 27 bp, Artificial sequence
  SiRNA target sequence
tctaaattatgtaaaacaataattatc

SEQ ID NO: 48118 - DNA, 27 bp, Artificial sequence
  SiRNA target sequence
ctaaattatgtaaaacaataattatcg

SEQ ID NO: 48119 - DNA, 27 bp, Artificial sequence
  SiRNA target sequence
taaattatgtaaaacaataattatcgt

SEQ ID NO: 48120 - DNA, 27 bp, Artificial sequence
  SiRNA target sequence
aaattatgtaaaacaataattatcgtc

SEQ ID NO: 48121 - DNA, 27 bp, Artificial sequence
  SiRNA target sequence
aattatgtaaaacaataattatcgtct

SEQ ID NO: 48122 - DNA, 27 bp, Artificial sequence
  SiRNA target sequence
attatgtaaaacaataattatcgtctt

SEQ ID NO: 48123 - DNA, 27 bp, Artificial sequence
  SiRNA target sequence
ttatgtaaaacaataattatcgtcttc

SEQ ID NO: 48124 - DNA, 27 bp, Artificial sequence
  SiRNA target sequence
tatgtaaaacaataattatcgtcttct

SEQ ID NO: 48125 - DNA, 27 bp, Artificial sequence
  SiRNA target sequence
atgtaaaacaataattatcgtcttctc

SEQ ID NO: 48126 - DNA, 27 bp, Artificial sequence
  SiRNA target sequence
tgtaaaacaataattatcgtcttctct

SEQ ID NO: 48127 - DNA, 27 bp, Artificial sequence
  SiRNA target sequence
gtaaaacaataattatcgtcttctcta

SEQ ID NO: 48128 - DNA, 27 bp, Artificial sequence
  SiRNA target sequence
taaaacaataattatcgtcttctctaa

SEQ ID NO: 48129 - DNA, 27 bp, Artificial sequence
  SiRNA target sequence
aaaacaataattatcgtcttctctaag

SEQ ID NO: 48130 - DNA, 27 bp, Artificial sequence
  SiRNA target sequence
aaacaataattatcgtcttctctaagt

SEQ ID NO: 48131 - DNA, 27 bp, Artificial sequence
  SiRNA target sequence
aacaataattatcgtcttctctaagtt

SEQ ID NO: 48132 - DNA, 27 bp, Artificial sequence
  SiRNA target sequence
acaataattatcgtcttctctaagttg

SEQ ID NO: 48133 - DNA, 27 bp, Artificial sequence
  SiRNA target sequence
caataattatcgtcttctctaagttgt

SEQ ID NO: 48134 - DNA, 27 bp, Artificial sequence
  SiRNA target sequence
aataattatcgtcttctctaagttgtt

SEQ ID NO: 48135 - DNA, 27 bp, Artificial sequence
  SiRNA target sequence
ataattatcgtcttctctaagttgttg

SEQ ID NO: 48136 - DNA, 27 bp, Artificial sequence
  SiRNA target sequence
taattatcgtcttctctaagttgttgg

SEQ ID NO: 48137 - DNA, 27 bp, Artificial sequence
  SiRNA target sequence
aattatcgtcttctctaagttgttgga

SEQ ID NO: 48138 - DNA, 27 bp, Artificial sequence
  SiRNA target sequence
attatcgtcttctctaagttgttggag

SEQ ID NO: 48139 - DNA, 27 bp, Artificial sequence
  SiRNA target sequence
ttatcgtcttctctaagttgttggaga

SEQ ID NO: 48140 - DNA, 27 bp, Artificial sequence
  SiRNA target sequence
tatcgtcttctctaagttgttggagat

SEQ ID NO: 48141 - DNA, 27 bp, Artificial sequence
  SiRNA target sequence
atcgtcttctctaagttgttggagatt

SEQ ID NO: 48142 - DNA, 27 bp, Artificial sequence
  SiRNA target sequence
tcgtcttctctaagttgttggagatta

SEQ ID NO: 48143 - DNA, 27 bp, Artificial sequence
  SiRNA target sequence
cgtcttctctaagttgttggagattag

SEQ ID NO: 48144 - DNA, 27 bp, Artificial sequence
  SiRNA target sequence
gtcttctctaagttgttggagattaga

SEQ ID NO: 48145 - DNA, 27 bp, Artificial sequence
  SiRNA target sequence
tcttctctaagttgttggagattagac

SEQ ID NO: 48146 - DNA, 27 bp, Artificial sequence
  SiRNA target sequence
cttctctaagttgttggagattagact

SEQ ID NO: 48147 - DNA, 27 bp, Artificial sequence
  SiRNA target sequence
ttctctaagttgttggagattagactt

SEQ ID NO: 48148 - DNA, 27 bp, Artificial sequence
  SiRNA target sequence
tctctaagttgttggagattagacttt

SEQ ID NO: 48149 - DNA, 27 bp, Artificial sequence
  SiRNA target sequence
ctctaagttgttggagattagactttt

SEQ ID NO: 48150 - DNA, 27 bp, Artificial sequence
  SiRNA target sequence
tctaagttgttggagattagactttta

SEQ ID NO: 48151 - DNA, 27 bp, Artificial sequence
  SiRNA target sequence
ctaagttgttggagattagacttttaa

SEQ ID NO: 48152 - DNA, 27 bp, Artificial sequence
  SiRNA target sequence
taagttgttggagattagacttttaag

SEQ ID NO: 48153 - DNA, 27 bp, Artificial sequence
  SiRNA target sequence
aagttgttggagattagacttttaaga

SEQ ID NO: 48154 - DNA, 27 bp, Artificial sequence
  SiRNA target sequence
agttgttggagattagacttttaagaa

SEQ ID NO: 48155 - DNA, 27 bp, Artificial sequence
  SiRNA target sequence
gttgttggagattagacttttaagaat

SEQ ID NO: 48156 - DNA, 27 bp, Artificial sequence
  SiRNA target sequence
ttgttggagattagacttttaagaatt

SEQ ID NO: 48157 - DNA, 27 bp, Artificial sequence
  SiRNA target sequence
tgttggagattagacttttaagaattt

SEQ ID NO: 48158 - DNA, 27 bp, Artificial sequence
  SiRNA target sequence
gttggagattagacttttaagaatttc

SEQ ID NO: 48159 - DNA, 27 bp, Artificial sequence
  SiRNA target sequence
ttggagattagacttttaagaatttca

SEQ ID NO: 48160 - DNA, 27 bp, Artificial sequence
  SiRNA target sequence
tggagattagacttttaagaatttcat

SEQ ID NO: 48161 - DNA, 27 bp, Artificial sequence
  SiRNA target sequence
ggagattagacttttaagaatttcata

SEQ ID NO: 48162 - DNA, 27 bp, Artificial sequence
  SiRNA target sequence
gagattagacttttaagaatttcatat

SEQ ID NO: 48163 - DNA, 27 bp, Artificial sequence
  SiRNA target sequence
agattagacttttaagaatttcatatt

SEQ ID NO: 48164 - DNA, 27 bp, Artificial sequence
  SiRNA target sequence
gattagacttttaagaatttcatattc

SEQ ID NO: 48165 - DNA, 27 bp, Artificial sequence
  SiRNA target sequence
attagacttttaagaatttcatattca

SEQ ID NO: 48166 - DNA, 27 bp, Artificial sequence
  SiRNA target sequence
ttagacttttaagaatttcatattcag

SEQ ID NO: 48167 - DNA, 27 bp, Artificial sequence
  SiRNA target sequence
tagacttttaagaatttcatattcagc

SEQ ID NO: 48168 - DNA, 27 bp, Artificial sequence
  SiRNA target sequence
agacttttaagaatttcatattcagct

SEQ ID NO: 48169 - DNA, 27 bp, Artificial sequence
  SiRNA target sequence
gacttttaagaatttcatattcagctt

SEQ ID NO: 48170 - DNA, 27 bp, Artificial sequence
  SiRNA target sequence
acttttaagaatttcatattcagcttt

SEQ ID NO: 48171 - DNA, 27 bp, Artificial sequence
  SiRNA target sequence
cttttaagaatttcatattcagctttt

SEQ ID NO: 48172 - DNA, 27 bp, Artificial sequence
  SiRNA target sequence
ttttaagaatttcatattcagcttttt

SEQ ID NO: 48173 - DNA, 27 bp, Artificial sequence
  SiRNA target sequence
tttaagaatttcatattcagctttttt

SEQ ID NO: 48174 - DNA, 27 bp, Artificial sequence
  SiRNA target sequence
ttaagaatttcatattcagcttttttg

SEQ ID NO: 48175 - DNA, 27 bp, Artificial sequence
  SiRNA target sequence
taagaatttcatattcagcttttttgt

SEQ ID NO: 48176 - DNA, 27 bp, Artificial sequence
  SiRNA target sequence
aagaatttcatattcagcttttttgtc

SEQ ID NO: 48177 - DNA, 27 bp, Artificial sequence
  SiRNA target sequence
agaatttcatattcagcttttttgtcc

SEQ ID NO: 48178 - DNA, 27 bp, Artificial sequence
  SiRNA target sequence
gaatttcatattcagcttttttgtcca

SEQ ID NO: 48179 - DNA, 27 bp, Artificial sequence
  SiRNA target sequence
aatttcatattcagcttttttgtccaa

SEQ ID NO: 48180 - DNA, 27 bp, Artificial sequence
  SiRNA target sequence
atttcatattcagcttttttgtccaat

SEQ ID NO: 48181 - DNA, 27 bp, Artificial sequence
  SiRNA target sequence
tttcatattcagcttttttgtccaatg

SEQ ID NO: 48182 - DNA, 27 bp, Artificial sequence
  SiRNA target sequence
ttcatattcagcttttttgtccaatgc

SEQ ID NO: 48183 - DNA, 27 bp, Artificial sequence
  SiRNA target sequence
tcatattcagcttttttgtccaatgcg

SEQ ID NO: 48184 - DNA, 27 bp, Artificial sequence
  SiRNA target sequence
catattcagcttttttgtccaatgcgg

SEQ ID NO: 48185 - DNA, 27 bp, Artificial sequence
  SiRNA target sequence
atattcagcttttttgtccaatgcggc

SEQ ID NO: 48186 - DNA, 27 bp, Artificial sequence
  SiRNA target sequence
tattcagcttttttgtccaatgcggcc

SEQ ID NO: 48187 - DNA, 27 bp, Artificial sequence
  SiRNA target sequence
attcagcttttttgtccaatgcggccg

SEQ ID NO: 48188 - DNA, 27 bp, Artificial sequence
  SiRNA target sequence
ttcagcttttttgtccaatgcggccgt

SEQ ID NO: 48189 - DNA, 27 bp, Artificial sequence
  SiRNA target sequence
tcagcttttttgtccaatgcggccgtt

SEQ ID NO: 48190 - DNA, 27 bp, Artificial sequence
  SiRNA target sequence
cagcttttttgtccaatgcggccgttg

SEQ ID NO: 48191 - DNA, 27 bp, Artificial sequence
  SiRNA target sequence
agcttttttgtccaatgcggccgttgg

SEQ ID NO: 48192 - DNA, 27 bp, Artificial sequence
  SiRNA target sequence
gcttttttgtccaatgcggccgttggc

SEQ ID NO: 48193 - DNA, 27 bp, Artificial sequence
  SiRNA target sequence
cttttttgtccaatgcggccgttggct

SEQ ID NO: 48194 - DNA, 27 bp, Artificial sequence
  SiRNA target sequence
ttttttgtccaatgcggccgttggctc

SEQ ID NO: 48195 - DNA, 27 bp, Artificial sequence
  SiRNA target sequence
tttttgtccaatgcggccgttggctca

SEQ ID NO: 48196 - DNA, 27 bp, Artificial sequence
  SiRNA target sequence
ttttgtccaatgcggccgttggctcat

SEQ ID NO: 48197 - DNA, 27 bp, Artificial sequence
  SiRNA target sequence
tttgtccaatgcggccgttggctcatc

SEQ ID NO: 48198 - DNA, 27 bp, Artificial sequence
  SiRNA target sequence
ttgtccaatgcggccgttggctcatct

SEQ ID NO: 48199 - DNA, 27 bp, Artificial sequence
  SiRNA target sequence
tgtccaatgcggccgttggctcatcta

SEQ ID NO: 48200 - DNA, 27 bp, Artificial sequence
  SiRNA target sequence
gtccaatgcggccgttggctcatctaa

SEQ ID NO: 48201 - DNA, 27 bp, Artificial sequence
  SiRNA target sequence
tccaatgcggccgttggctcatctaaa

SEQ ID NO: 48202 - DNA, 27 bp, Artificial sequence
  SiRNA target sequence
ccaatgcggccgttggctcatctaaaa

SEQ ID NO: 48203 - DNA, 27 bp, Artificial sequence
  SiRNA target sequence
caatgcggccgttggctcatctaaaat

SEQ ID NO: 48204 - DNA, 27 bp, Artificial sequence
  SiRNA target sequence
aatgcggccgttggctcatctaaaatt

SEQ ID NO: 48205 - DNA, 27 bp, Artificial sequence
  SiRNA target sequence
atgcggccgttggctcatctaaaatta

SEQ ID NO: 48206 - DNA, 27 bp, Artificial sequence
  SiRNA target sequence
tgcggccgttggctcatctaaaattat

SEQ ID NO: 48207 - DNA, 27 bp, Artificial sequence
  SiRNA target sequence
gcggccgttggctcatctaaaattata

SEQ ID NO: 48208 - DNA, 27 bp, Artificial sequence
  SiRNA target sequence
cggccgttggctcatctaaaattataa

SEQ ID NO: 48209 - DNA, 27 bp, Artificial sequence
  SiRNA target sequence
ggccgttggctcatctaaaattataat

SEQ ID NO: 48210 - DNA, 27 bp, Artificial sequence
  SiRNA target sequence
gccgttggctcatctaaaattataata

SEQ ID NO: 48211 - DNA, 27 bp, Artificial sequence
  SiRNA target sequence
ccgttggctcatctaaaattataatag

SEQ ID NO: 48212 - DNA, 27 bp, Artificial sequence
  SiRNA target sequence
cgttggctcatctaaaattataatagg

SEQ ID NO: 48213 - DNA, 27 bp, Artificial sequence
  SiRNA target sequence
gttggctcatctaaaattataatagga

SEQ ID NO: 48214 - DNA, 27 bp, Artificial sequence
  SiRNA target sequence
ttggctcatctaaaattataataggag

SEQ ID NO: 48215 - DNA, 27 bp, Artificial sequence
  SiRNA target sequence
tggctcatctaaaattataataggaga

SEQ ID NO: 48216 - DNA, 27 bp, Artificial sequence
  SiRNA target sequence
ggctcatctaaaattataataggagaa

SEQ ID NO: 48217 - DNA, 27 bp, Artificial sequence
  SiRNA target sequence
gctcatctaaaattataataggagaat

SEQ ID NO: 48218 - DNA, 27 bp, Artificial sequence
  SiRNA target sequence
ctcatctaaaattataataggagaatt

SEQ ID NO: 48219 - DNA, 27 bp, Artificial sequence
  SiRNA target sequence
tcatctaaaattataataggagaattt

SEQ ID NO: 48220 - DNA, 27 bp, Artificial sequence
  SiRNA target sequence
catctaaaattataataggagaatttt

SEQ ID NO: 48221 - DNA, 27 bp, Artificial sequence
  SiRNA target sequence
atctaaaattataataggagaattttt

SEQ ID NO: 48222 - DNA, 27 bp, Artificial sequence
  SiRNA target sequence
tctaaaattataataggagaatttttt

SEQ ID NO: 48223 - DNA, 27 bp, Artificial sequence
  SiRNA target sequence
ctaaaattataataggagaatttttta

SEQ ID NO: 48224 - DNA, 27 bp, Artificial sequence
  SiRNA target sequence
taaaattataataggagaattttttag

SEQ ID NO: 48225 - DNA, 27 bp, Artificial sequence
  SiRNA target sequence
aaaattataataggagaattttttagt

SEQ ID NO: 48226 - DNA, 27 bp, Artificial sequence
  SiRNA target sequence
aaattataataggagaattttttagtg

SEQ ID NO: 48227 - DNA, 27 bp, Artificial sequence
  SiRNA target sequence
aattataataggagaattttttagtgc

SEQ ID NO: 48228 - DNA, 27 bp, Artificial sequence
  SiRNA target sequence
attataataggagaattttttagtgcc

SEQ ID NO: 48229 - DNA, 27 bp, Artificial sequence
  SiRNA target sequence
ttataataggagaattttttagtgccg

SEQ ID NO: 48230 - DNA, 27 bp, Artificial sequence
  SiRNA target sequence
tataataggagaattttttagtgccga

SEQ ID NO: 48231 - DNA, 27 bp, Artificial sequence
  SiRNA target sequence
ataataggagaattttttagtgccgac

SEQ ID NO: 48232 - DNA, 27 bp, Artificial sequence
  SiRNA target sequence
taataggagaattttttagtgccgacc

SEQ ID NO: 48233 - DNA, 27 bp, Artificial sequence
  SiRNA target sequence
aataggagaattttttagtgccgacct

SEQ ID NO: 48234 - DNA, 27 bp, Artificial sequence
  SiRNA target sequence
ataggagaattttttagtgccgacctt

SEQ ID NO: 48235 - DNA, 27 bp, Artificial sequence
  SiRNA target sequence
taggagaattttttagtgccgacctta

SEQ ID NO: 48236 - DNA, 27 bp, Artificial sequence
  SiRNA target sequence
aggagaattttttagtgccgaccttaa

SEQ ID NO: 48237 - DNA, 27 bp, Artificial sequence
  SiRNA target sequence
ggagaattttttagtgccgaccttaac

SEQ ID NO: 48238 - DNA, 27 bp, Artificial sequence
  SiRNA target sequence
gagaattttttagtgccgaccttaaca

SEQ ID NO: 48239 - DNA, 27 bp, Artificial sequence
  SiRNA target sequence
agaattttttagtgccgaccttaacaa

SEQ ID NO: 48240 - DNA, 27 bp, Artificial sequence
  SiRNA target sequence
gaattttttagtgccgaccttaacaaa

SEQ ID NO: 48241 - DNA, 27 bp, Artificial sequence
  SiRNA target sequence
aattttttagtgccgaccttaacaaaa

SEQ ID NO: 48242 - DNA, 27 bp, Artificial sequence
  SiRNA target sequence
attttttagtgccgaccttaacaaaat

SEQ ID NO: 48243 - DNA, 27 bp, Artificial sequence
  SiRNA target sequence
ttttttagtgccgaccttaacaaaatt

SEQ ID NO: 48244 - DNA, 27 bp, Artificial sequence
  SiRNA target sequence
tttttagtgccgaccttaacaaaatta

SEQ ID NO: 48245 - DNA, 27 bp, Artificial sequence
  SiRNA target sequence
ttttagtgccgaccttaacaaaattac

SEQ ID NO: 48246 - DNA, 27 bp, Artificial sequence
  SiRNA target sequence
tttagtgccgaccttaacaaaattact

SEQ ID NO: 48247 - DNA, 27 bp, Artificial sequence
  SiRNA target sequence
ttagtgccgaccttaacaaaattactt

SEQ ID NO: 48248 - DNA, 27 bp, Artificial sequence
  SiRNA target sequence
tagtgccgaccttaacaaaattacttt

SEQ ID NO: 48249 - DNA, 27 bp, Artificial sequence
  SiRNA target sequence
agtgccgaccttaacaaaattactttt

SEQ ID NO: 48250 - DNA, 27 bp, Artificial sequence
  SiRNA target sequence
gtgccgaccttaacaaaattacttttt

SEQ ID NO: 48251 - DNA, 27 bp, Artificial sequence
  SiRNA target sequence
tgccgaccttaacaaaattactttttg

SEQ ID NO: 48252 - DNA, 27 bp, Artificial sequence
  SiRNA target sequence
gccgaccttaacaaaattactttttgt

SEQ ID NO: 48253 - DNA, 27 bp, Artificial sequence
  SiRNA target sequence
ccgaccttaacaaaattactttttgtc

SEQ ID NO: 48254 - DNA, 27 bp, Artificial sequence
  SiRNA target sequence
cgaccttaacaaaattactttttgtct

SEQ ID NO: 48255 - DNA, 27 bp, Artificial sequence
  SiRNA target sequence
gaccttaacaaaattactttttgtctt

SEQ ID NO: 48256 - DNA, 27 bp, Artificial sequence
  SiRNA target sequence
accttaacaaaattactttttgtcttt

SEQ ID NO: 48257 - DNA, 27 bp, Artificial sequence
  SiRNA target sequence
ccttaacaaaattactttttgtctttc

SEQ ID NO: 48258 - DNA, 27 bp, Artificial sequence
  SiRNA target sequence
cttaacaaaattactttttgtctttct

SEQ ID NO: 48259 - DNA, 27 bp, Artificial sequence
  SiRNA target sequence
ttaacaaaattactttttgtctttctc

SEQ ID NO: 48260 - DNA, 27 bp, Artificial sequence
  SiRNA target sequence
taacaaaattactttttgtctttctcc

SEQ ID NO: 48261 - DNA, 27 bp, Artificial sequence
  SiRNA target sequence
aacaaaattactttttgtctttctcca

SEQ ID NO: 48262 - DNA, 27 bp, Artificial sequence
  SiRNA target sequence
acaaaattactttttgtctttctccac

SEQ ID NO: 48263 - DNA, 27 bp, Artificial sequence
  SiRNA target sequence
caaaattactttttgtctttctccacc

SEQ ID NO: 48264 - DNA, 27 bp, Artificial sequence
  SiRNA target sequence
aaaattactttttgtctttctccacca

SEQ ID NO: 48265 - DNA, 27 bp, Artificial sequence
  SiRNA target sequence
aaattactttttgtctttctccaccac

SEQ ID NO: 48266 - DNA, 27 bp, Artificial sequence
  SiRNA target sequence
aattactttttgtctttctccaccact

SEQ ID NO: 48267 - DNA, 27 bp, Artificial sequence
  SiRNA target sequence
attactttttgtctttctccaccacta

SEQ ID NO: 48268 - DNA, 27 bp, Artificial sequence
  SiRNA target sequence
ttactttttgtctttctccaccactaa

SEQ ID NO: 48269 - DNA, 27 bp, Artificial sequence
  SiRNA target sequence
tactttttgtctttctccaccactaag

SEQ ID NO: 48270 - DNA, 27 bp, Artificial sequence
  SiRNA target sequence
actttttgtctttctccaccactaagc

SEQ ID NO: 48271 - DNA, 27 bp, Artificial sequence
  SiRNA target sequence
ctttttgtctttctccaccactaagct

SEQ ID NO: 48272 - DNA, 27 bp, Artificial sequence
  SiRNA target sequence
tttttgtctttctccaccactaagctt

SEQ ID NO: 48273 - DNA, 27 bp, Artificial sequence
  SiRNA target sequence
ttttgtctttctccaccactaagctta

SEQ ID NO: 48274 - DNA, 27 bp, Artificial sequence
  SiRNA target sequence
tttgtctttctccaccactaagcttat

SEQ ID NO: 48275 - DNA, 27 bp, Artificial sequence
  SiRNA target sequence
ttgtctttctccaccactaagcttatg

SEQ ID NO: 48276 - DNA, 27 bp, Artificial sequence
  SiRNA target sequence
tgtctttctccaccactaagcttatgt

SEQ ID NO: 48277 - DNA, 27 bp, Artificial sequence
  SiRNA target sequence
gtctttctccaccactaagcttatgtc

SEQ ID NO: 48278 - DNA, 27 bp, Artificial sequence
  SiRNA target sequence
tctttctccaccactaagcttatgtcc

SEQ ID NO: 48279 - DNA, 27 bp, Artificial sequence
  SiRNA target sequence
ctttctccaccactaagcttatgtccc

SEQ ID NO: 48280 - DNA, 27 bp, Artificial sequence
  SiRNA target sequence
tttctccaccactaagcttatgtccct

SEQ ID NO: 48281 - DNA, 27 bp, Artificial sequence
  SiRNA target sequence
ttctccaccactaagcttatgtccctt

SEQ ID NO: 48282 - DNA, 27 bp, Artificial sequence
  SiRNA target sequence
tctccaccactaagcttatgtccctta

SEQ ID NO: 48283 - DNA, 27 bp, Artificial sequence
  SiRNA target sequence
ctccaccactaagcttatgtcccttat

SEQ ID NO: 48284 - DNA, 27 bp, Artificial sequence
  SiRNA target sequence
tccaccactaagcttatgtcccttatc

SEQ ID NO: 48285 - DNA, 27 bp, Artificial sequence
  SiRNA target sequence
ccaccactaagcttatgtcccttatct

SEQ ID NO: 48286 - DNA, 27 bp, Artificial sequence
  SiRNA target sequence
caccactaagcttatgtcccttatctc

SEQ ID NO: 48287 - DNA, 27 bp, Artificial sequence
  SiRNA target sequence
accactaagcttatgtcccttatctcc

SEQ ID NO: 48288 - DNA, 27 bp, Artificial sequence
  SiRNA target sequence
ccactaagcttatgtcccttatctcca

SEQ ID NO: 48289 - DNA, 27 bp, Artificial sequence
  SiRNA target sequence
cactaagcttatgtcccttatctccaa

SEQ ID NO: 48290 - DNA, 27 bp, Artificial sequence
  SiRNA target sequence
actaagcttatgtcccttatctccaac

SEQ ID NO: 48291 - DNA, 27 bp, Artificial sequence
  SiRNA target sequence
ctaagcttatgtcccttatctccaaca

SEQ ID NO: 48292 - DNA, 27 bp, Artificial sequence
  SiRNA target sequence
taagcttatgtcccttatctccaacat

SEQ ID NO: 48293 - DNA, 27 bp, Artificial sequence
  SiRNA target sequence
aagcttatgtcccttatctccaacatg

SEQ ID NO: 48294 - DNA, 27 bp, Artificial sequence
  SiRNA target sequence
agcttatgtcccttatctccaacatgt

SEQ ID NO: 48295 - DNA, 27 bp, Artificial sequence
  SiRNA target sequence
gcttatgtcccttatctccaacatgtg

SEQ ID NO: 48296 - DNA, 27 bp, Artificial sequence
  SiRNA target sequence
cttatgtcccttatctccaacatgtgt

SEQ ID NO: 48297 - DNA, 27 bp, Artificial sequence
  SiRNA target sequence
ttatgtcccttatctccaacatgtgtg

SEQ ID NO: 48298 - DNA, 27 bp, Artificial sequence
  SiRNA target sequence
tatgtcccttatctccaacatgtgtgt

SEQ ID NO: 48299 - DNA, 27 bp, Artificial sequence
  SiRNA target sequence
atgtcccttatctccaacatgtgtgtt

SEQ ID NO: 48300 - DNA, 27 bp, Artificial sequence
  SiRNA target sequence
tgtcccttatctccaacatgtgtgttg

SEQ ID NO: 48301 - DNA, 27 bp, Artificial sequence
  SiRNA target sequence
gtcccttatctccaacatgtgtgttgt

SEQ ID NO: 48302 - DNA, 27 bp, Artificial sequence
  SiRNA target sequence
tcccttatctccaacatgtgtgttgta

SEQ ID NO: 48303 - DNA, 27 bp, Artificial sequence
  SiRNA target sequence
cccttatctccaacatgtgtgttgtat

SEQ ID NO: 48304 - DNA, 27 bp, Artificial sequence
  SiRNA target sequence
ccttatctccaacatgtgtgttgtatt

SEQ ID NO: 48305 - DNA, 27 bp, Artificial sequence
  SiRNA target sequence
cttatctccaacatgtgtgttgtattc

SEQ ID NO: 48306 - DNA, 27 bp, Artificial sequence
  SiRNA target sequence
ttatctccaacatgtgtgttgtattca

SEQ ID NO: 48307 - DNA, 27 bp, Artificial sequence
  SiRNA target sequence
tatctccaacatgtgtgttgtattcat

SEQ ID NO: 48308 - DNA, 27 bp, Artificial sequence
  SiRNA target sequence
atctccaacatgtgtgttgtattcatc

SEQ ID NO: 48309 - DNA, 27 bp, Artificial sequence
  SiRNA target sequence
tctccaacatgtgtgttgtattcatcc

SEQ ID NO: 48310 - DNA, 27 bp, Artificial sequence
  SiRNA target sequence
ctccaacatgtgtgttgtattcatcct

SEQ ID NO: 48311 - DNA, 27 bp, Artificial sequence
  SiRNA target sequence
tccaacatgtgtgttgtattcatcctc

SEQ ID NO: 48312 - DNA, 27 bp, Artificial sequence
  SiRNA target sequence
ccaacatgtgtgttgtattcatcctct

SEQ ID NO: 48313 - DNA, 27 bp, Artificial sequence
  SiRNA target sequence
caacatgtgtgttgtattcatcctcta

SEQ ID NO: 48314 - DNA, 27 bp, Artificial sequence
  SiRNA target sequence
aacatgtgtgttgtattcatcctctag

SEQ ID NO: 48315 - DNA, 27 bp, Artificial sequence
  SiRNA target sequence
acatgtgtgttgtattcatcctctagg

SEQ ID NO: 48316 - DNA, 27 bp, Artificial sequence
  SiRNA target sequence
catgtgtgttgtattcatcctctaggt

SEQ ID NO: 48317 - DNA, 27 bp, Artificial sequence
  SiRNA target sequence
atgtgtgttgtattcatcctctaggtt

SEQ ID NO: 48318 - DNA, 27 bp, Artificial sequence
  SiRNA target sequence
tgtgtgttgtattcatcctctaggttg

SEQ ID NO: 48319 - DNA, 27 bp, Artificial sequence
  SiRNA target sequence
gtgtgttgtattcatcctctaggttgt

SEQ ID NO: 48320 - DNA, 27 bp, Artificial sequence
  SiRNA target sequence
tgtgttgtattcatcctctaggttgtt

SEQ ID NO: 48321 - DNA, 27 bp, Artificial sequence
  SiRNA target sequence
gtgttgtattcatcctctaggttgttt

SEQ ID NO: 48322 - DNA, 27 bp, Artificial sequence
  SiRNA target sequence
tgttgtattcatcctctaggttgttta

SEQ ID NO: 48323 - DNA, 27 bp, Artificial sequence
  SiRNA target sequence
gttgtattcatcctctaggttgtttat

SEQ ID NO: 48324 - DNA, 27 bp, Artificial sequence
  SiRNA target sequence
ttgtattcatcctctaggttgtttata

SEQ ID NO: 48325 - DNA, 27 bp, Artificial sequence
  SiRNA target sequence
tgtattcatcctctaggttgtttatag

SEQ ID NO: 48326 - DNA, 27 bp, Artificial sequence
  SiRNA target sequence
gtattcatcctctaggttgtttataga

SEQ ID NO: 48327 - DNA, 27 bp, Artificial sequence
  SiRNA target sequence
tattcatcctctaggttgtttatagaa

SEQ ID NO: 48328 - DNA, 27 bp, Artificial sequence
  SiRNA target sequence
attcatcctctaggttgtttatagaat

SEQ ID NO: 48329 - DNA, 27 bp, Artificial sequence
  SiRNA target sequence
ttcatcctctaggttgtttatagaatc

SEQ ID NO: 48330 - DNA, 27 bp, Artificial sequence
  SiRNA target sequence
tcatcctctaggttgtttatagaatcg

SEQ ID NO: 48331 - DNA, 27 bp, Artificial sequence
  SiRNA target sequence
catcctctaggttgtttatagaatcgt

SEQ ID NO: 48332 - DNA, 27 bp, Artificial sequence
  SiRNA target sequence
atcctctaggttgtttatagaatcgtg

SEQ ID NO: 48333 - DNA, 27 bp, Artificial sequence
  SiRNA target sequence
tcctctaggttgtttatagaatcgtgt

SEQ ID NO: 48334 - DNA, 27 bp, Artificial sequence
  SiRNA target sequence
cctctaggttgtttatagaatcgtgta

SEQ ID NO: 48335 - DNA, 27 bp, Artificial sequence
  SiRNA target sequence
ctctaggttgtttatagaatcgtgtac

SEQ ID NO: 48336 - DNA, 27 bp, Artificial sequence
  SiRNA target sequence
tctaggttgtttatagaatcgtgtaca

SEQ ID NO: 48337 - DNA, 27 bp, Artificial sequence
  SiRNA target sequence
ctaggttgtttatagaatcgtgtacac

SEQ ID NO: 48338 - DNA, 27 bp, Artificial sequence
  SiRNA target sequence
taggttgtttatagaatcgtgtacaca

SEQ ID NO: 48339 - DNA, 27 bp, Artificial sequence
  SiRNA target sequence
aggttgtttatagaatcgtgtacacaa

SEQ ID NO: 48340 - DNA, 27 bp, Artificial sequence
  SiRNA target sequence
ggttgtttatagaatcgtgtacacaaa

SEQ ID NO: 48341 - DNA, 27 bp, Artificial sequence
  SiRNA target sequence
gttgtttatagaatcgtgtacacaaag

SEQ ID NO: 48342 - DNA, 27 bp, Artificial sequence
  SiRNA target sequence
ttgtttatagaatcgtgtacacaaagt

SEQ ID NO: 48343 - DNA, 27 bp, Artificial sequence
  SiRNA target sequence
tgtttatagaatcgtgtacacaaagtt

SEQ ID NO: 48344 - DNA, 27 bp, Artificial sequence
  SiRNA target sequence
gtttatagaatcgtgtacacaaagttt

SEQ ID NO: 48345 - DNA, 27 bp, Artificial sequence
  SiRNA target sequence
tttatagaatcgtgtacacaaagtttt

SEQ ID NO: 48346 - DNA, 27 bp, Artificial sequence
  SiRNA target sequence
ttatagaatcgtgtacacaaagttttt

SEQ ID NO: 48347 - DNA, 27 bp, Artificial sequence
  SiRNA target sequence
tatagaatcgtgtacacaaagtttttt

SEQ ID NO: 48348 - DNA, 27 bp, Artificial sequence
  SiRNA target sequence
atagaatcgtgtacacaaagtttttta

SEQ ID NO: 48349 - DNA, 27 bp, Artificial sequence
  SiRNA target sequence
tagaatcgtgtacacaaagttttttac

SEQ ID NO: 48350 - DNA, 27 bp, Artificial sequence
  SiRNA target sequence
agaatcgtgtacacaaagttttttact

SEQ ID NO: 48351 - DNA, 27 bp, Artificial sequence
  SiRNA target sequence
gaatcgtgtacacaaagttttttactg

SEQ ID NO: 48352 - DNA, 27 bp, Artificial sequence
  SiRNA target sequence
aatcgtgtacacaaagttttttactga

SEQ ID NO: 48353 - DNA, 27 bp, Artificial sequence
  SiRNA target sequence
atcgtgtacacaaagttttttactgat

SEQ ID NO: 48354 - DNA, 27 bp, Artificial sequence
  SiRNA target sequence
tcgtgtacacaaagttttttactgatt

SEQ ID NO: 48355 - DNA, 27 bp, Artificial sequence
  SiRNA target sequence
cgtgtacacaaagttttttactgattt

SEQ ID NO: 48356 - DNA, 27 bp, Artificial sequence
  SiRNA target sequence
gtgtacacaaagttttttactgatttt

SEQ ID NO: 48357 - DNA, 27 bp, Artificial sequence
  SiRNA target sequence
tgtacacaaagttttttactgattttt

SEQ ID NO: 48358 - DNA, 27 bp, Artificial sequence
  SiRNA target sequence
gtacacaaagttttttactgattttta

SEQ ID NO: 48359 - DNA, 27 bp, Artificial sequence
  SiRNA target sequence
tacacaaagttttttactgatttttat

SEQ ID NO: 48360 - DNA, 27 bp, Artificial sequence
  SiRNA target sequence
acacaaagttttttactgatttttata

SEQ ID NO: 48361 - DNA, 27 bp, Artificial sequence
  SiRNA target sequence
cacaaagttttttactgatttttataa

SEQ ID NO: 48362 - DNA, 27 bp, Artificial sequence
  SiRNA target sequence
acaaagttttttactgatttttataac

SEQ ID NO: 48363 - DNA, 27 bp, Artificial sequence
  SiRNA target sequence
caaagttttttactgatttttataact

SEQ ID NO: 48364 - DNA, 27 bp, Artificial sequence
  SiRNA target sequence
aaagttttttactgatttttataactt

SEQ ID NO: 48365 - DNA, 27 bp, Artificial sequence
  SiRNA target sequence
aagttttttactgatttttataacttc

SEQ ID NO: 48366 - DNA, 27 bp, Artificial sequence
  SiRNA target sequence
agttttttactgatttttataacttct

SEQ ID NO: 48367 - DNA, 27 bp, Artificial sequence
  SiRNA target sequence
gttttttactgatttttataacttctt

SEQ ID NO: 48368 - DNA, 27 bp, Artificial sequence
  SiRNA target sequence
ttttttactgatttttataacttcttc

SEQ ID NO: 48369 - DNA, 27 bp, Artificial sequence
  SiRNA target sequence
tttttactgatttttataacttcttct

SEQ ID NO: 48370 - DNA, 27 bp, Artificial sequence
  SiRNA target sequence
ttttactgatttttataacttcttctt

SEQ ID NO: 48371 - DNA, 27 bp, Artificial sequence
  SiRNA target sequence
tttactgatttttataacttcttcttt

SEQ ID NO: 48372 - DNA, 27 bp, Artificial sequence
  SiRNA target sequence
ttactgatttttataacttcttcttta

SEQ ID NO: 48373 - DNA, 27 bp, Artificial sequence
  SiRNA target sequence
tactgatttttataacttcttctttat

SEQ ID NO: 48374 - DNA, 27 bp, Artificial sequence
  SiRNA target sequence
actgatttttataacttcttctttatc

SEQ ID NO: 48375 - DNA, 27 bp, Artificial sequence
  SiRNA target sequence
ctgatttttataacttcttctttatca

SEQ ID NO: 48376 - DNA, 27 bp, Artificial sequence
  SiRNA target sequence
tgatttttataacttcttctttatcaa

SEQ ID NO: 48377 - DNA, 27 bp, Artificial sequence
  SiRNA target sequence
gatttttataacttcttctttatcaaa

SEQ ID NO: 48378 - DNA, 27 bp, Artificial sequence
  SiRNA target sequence
atttttataacttcttctttatcaaat

SEQ ID NO: 48379 - DNA, 27 bp, Artificial sequence
  SiRNA target sequence
tttttataacttcttctttatcaaata

SEQ ID NO: 48380 - DNA, 27 bp, Artificial sequence
  SiRNA target sequence
ttttataacttcttctttatcaaatat

SEQ ID NO: 48381 - DNA, 27 bp, Artificial sequence
  SiRNA target sequence
tttataacttcttctttatcaaatatt

SEQ ID NO: 48382 - DNA, 27 bp, Artificial sequence
  SiRNA target sequence
ttataacttcttctttatcaaatattt

SEQ ID NO: 48383 - DNA, 27 bp, Artificial sequence
  SiRNA target sequence
tataacttcttctttatcaaatatttc

SEQ ID NO: 48384 - DNA, 27 bp, Artificial sequence
  SiRNA target sequence
ataacttcttctttatcaaatatttct

SEQ ID NO: 48385 - DNA, 27 bp, Artificial sequence
  SiRNA target sequence
taacttcttctttatcaaatatttctt

SEQ ID NO: 48386 - DNA, 27 bp, Artificial sequence
  SiRNA target sequence
aacttcttctttatcaaatatttcttt

SEQ ID NO: 48387 - DNA, 27 bp, Artificial sequence
  SiRNA target sequence
acttcttctttatcaaatatttctttt

SEQ ID NO: 48388 - DNA, 27 bp, Artificial sequence
  SiRNA target sequence
cttcttctttatcaaatatttcttttc

SEQ ID NO: 48389 - DNA, 27 bp, Artificial sequence
  SiRNA target sequence
ttcttctttatcaaatatttcttttcc

SEQ ID NO: 48390 - DNA, 27 bp, Artificial sequence
  SiRNA target sequence
tcttctttatcaaatatttcttttcca

SEQ ID NO: 48391 - DNA, 27 bp, Artificial sequence
  SiRNA target sequence
cttctttatcaaatatttcttttccat

SEQ ID NO: 48392 - DNA, 27 bp, Artificial sequence
  SiRNA target sequence
ttctttatcaaatatttcttttccata

SEQ ID NO: 48393 - DNA, 27 bp, Artificial sequence
  SiRNA target sequence
tctttatcaaatatttcttttccatat

SEQ ID NO: 48394 - DNA, 27 bp, Artificial sequence
  SiRNA target sequence
ctttatcaaatatttcttttccatatg

SEQ ID NO: 48395 - DNA, 27 bp, Artificial sequence
  SiRNA target sequence
tttatcaaatatttcttttccatatgt

SEQ ID NO: 48396 - DNA, 27 bp, Artificial sequence
  SiRNA target sequence
ttatcaaatatttcttttccatatgtt

SEQ ID NO: 48397 - DNA, 27 bp, Artificial sequence
  SiRNA target sequence
tatcaaatatttcttttccatatgtta

SEQ ID NO: 48398 - DNA, 27 bp, Artificial sequence
  SiRNA target sequence
atcaaatatttcttttccatatgttaa

SEQ ID NO: 48399 - DNA, 27 bp, Artificial sequence
  SiRNA target sequence
tcaaatatttcttttccatatgttaaa

SEQ ID NO: 48400 - DNA, 27 bp, Artificial sequence
  SiRNA target sequence
caaatatttcttttccatatgttaaat

SEQ ID NO: 48401 - DNA, 27 bp, Artificial sequence
  SiRNA target sequence
aaatatttcttttccatatgttaaatt

SEQ ID NO: 48402 - DNA, 27 bp, Artificial sequence
  SiRNA target sequence
aatatttcttttccatatgttaaatta

SEQ ID NO: 48403 - DNA, 27 bp, Artificial sequence
  SiRNA target sequence
atatttcttttccatatgttaaattat

SEQ ID NO: 48404 - DNA, 27 bp, Artificial sequence
  SiRNA target sequence
tatttcttttccatatgttaaattata

SEQ ID NO: 48405 - DNA, 27 bp, Artificial sequence
  SiRNA target sequence
atttcttttccatatgttaaattataa

SEQ ID NO: 48406 - DNA, 27 bp, Artificial sequence
  SiRNA target sequence
tttcttttccatatgttaaattataat

SEQ ID NO: 48407 - DNA, 27 bp, Artificial sequence
  SiRNA target sequence
ttcttttccatatgttaaattataata

SEQ ID NO: 48408 - DNA, 27 bp, Artificial sequence
  SiRNA target sequence
tcttttccatatgttaaattataataa

SEQ ID NO: 48409 - DNA, 27 bp, Artificial sequence
  SiRNA target sequence
cttttccatatgttaaattataataaa

SEQ ID NO: 48410 - DNA, 27 bp, Artificial sequence
  SiRNA target sequence
ttttccatatgttaaattataataaac

SEQ ID NO: 48411 - DNA, 27 bp, Artificial sequence
  SiRNA target sequence
tttccatatgttaaattataataaacc

SEQ ID NO: 48412 - DNA, 27 bp, Artificial sequence
  SiRNA target sequence
ttccatatgttaaattataataaaccg

SEQ ID NO: 48413 - DNA, 27 bp, Artificial sequence
  SiRNA target sequence
tccatatgttaaattataataaaccgt

SEQ ID NO: 48414 - DNA, 27 bp, Artificial sequence
  SiRNA target sequence
ccatatgttaaattataataaaccgtt

SEQ ID NO: 48415 - DNA, 27 bp, Artificial sequence
  SiRNA target sequence
catatgttaaattataataaaccgttt

SEQ ID NO: 48416 - DNA, 27 bp, Artificial sequence
  SiRNA target sequence
atatgttaaattataataaaccgtttc

SEQ ID NO: 48417 - DNA, 27 bp, Artificial sequence
  SiRNA target sequence
tatgttaaattataataaaccgtttcg

SEQ ID NO: 48418 - DNA, 27 bp, Artificial sequence
  SiRNA target sequence
atgttaaattataataaaccgtttcgt

SEQ ID NO: 48419 - DNA, 27 bp, Artificial sequence
  SiRNA target sequence
tgttaaattataataaaccgtttcgtt

SEQ ID NO: 48420 - DNA, 27 bp, Artificial sequence
  SiRNA target sequence
gttaaattataataaaccgtttcgtta

SEQ ID NO: 48421 - DNA, 27 bp, Artificial sequence
  SiRNA target sequence
ttaaattataataaaccgtttcgttaa

SEQ ID NO: 48422 - DNA, 27 bp, Artificial sequence
  SiRNA target sequence
taaattataataaaccgtttcgttaaa

SEQ ID NO: 48423 - DNA, 27 bp, Artificial sequence
  SiRNA target sequence
aaattataataaaccgtttcgttaaac

SEQ ID NO: 48424 - DNA, 27 bp, Artificial sequence
  SiRNA target sequence
aattataataaaccgtttcgttaaaca

SEQ ID NO: 48425 - DNA, 27 bp, Artificial sequence
  SiRNA target sequence
attataataaaccgtttcgttaaacaa

SEQ ID NO: 48426 - DNA, 27 bp, Artificial sequence
  SiRNA target sequence
ttataataaaccgtttcgttaaacaaa

SEQ ID NO: 48427 - DNA, 27 bp, Artificial sequence
  SiRNA target sequence
tataataaaccgtttcgttaaacaaaa

SEQ ID NO: 48428 - DNA, 27 bp, Artificial sequence
  SiRNA target sequence
ataataaaccgtttcgttaaacaaaaa

SEQ ID NO: 48429 - DNA, 27 bp, Artificial sequence
  SiRNA target sequence
taataaaccgtttcgttaaacaaaaat

SEQ ID NO: 48430 - DNA, 27 bp, Artificial sequence
  SiRNA target sequence
aataaaccgtttcgttaaacaaaaatg

SEQ ID NO: 48431 - DNA, 27 bp, Artificial sequence
  SiRNA target sequence
ataaaccgtttcgttaaacaaaaatga

SEQ ID NO: 48432 - DNA, 27 bp, Artificial sequence
  SiRNA target sequence
taaaccgtttcgttaaacaaaaatgag

SEQ ID NO: 48433 - DNA, 27 bp, Artificial sequence
  SiRNA target sequence
aaaccgtttcgttaaacaaaaatgagg

SEQ ID NO: 48434 - DNA, 27 bp, Artificial sequence
  SiRNA target sequence
aaccgtttcgttaaacaaaaatgaggt

SEQ ID NO: 48435 - DNA, 27 bp, Artificial sequence
  SiRNA target sequence
accgtttcgttaaacaaaaatgaggtt

SEQ ID NO: 48436 - DNA, 27 bp, Artificial sequence
  SiRNA target sequence
ccgtttcgttaaacaaaaatgaggttt

SEQ ID NO: 48437 - DNA, 27 bp, Artificial sequence
  SiRNA target sequence
cgtttcgttaaacaaaaatgaggtttg

SEQ ID NO: 48438 - DNA, 27 bp, Artificial sequence
  SiRNA target sequence
gtttcgttaaacaaaaatgaggtttgt

SEQ ID NO: 48439 - DNA, 27 bp, Artificial sequence
  SiRNA target sequence
tttcgttaaacaaaaatgaggtttgtg

SEQ ID NO: 48440 - DNA, 27 bp, Artificial sequence
  SiRNA target sequence
ttcgttaaacaaaaatgaggtttgtgg

SEQ ID NO: 48441 - DNA, 27 bp, Artificial sequence
  SiRNA target sequence
tcgttaaacaaaaatgaggtttgtggt

SEQ ID NO: 48442 - DNA, 27 bp, Artificial sequence
  SiRNA target sequence
cgttaaacaaaaatgaggtttgtggtg

SEQ ID NO: 48443 - DNA, 27 bp, Artificial sequence
  SiRNA target sequence
gttaaacaaaaatgaggtttgtggtgc

SEQ ID NO: 48444 - DNA, 27 bp, Artificial sequence
  SiRNA target sequence
ttaaacaaaaatgaggtttgtggtgca

SEQ ID NO: 48445 - DNA, 27 bp, Artificial sequence
  SiRNA target sequence
taaacaaaaatgaggtttgtggtgcaa

SEQ ID NO: 48446 - DNA, 27 bp, Artificial sequence
  SiRNA target sequence
aaacaaaaatgaggtttgtggtgcaaa

SEQ ID NO: 48447 - DNA, 27 bp, Artificial sequence
  SiRNA target sequence
aacaaaaatgaggtttgtggtgcaaat

SEQ ID NO: 48448 - DNA, 27 bp, Artificial sequence
  SiRNA target sequence
acaaaaatgaggtttgtggtgcaaatg

SEQ ID NO: 48449 - DNA, 27 bp, Artificial sequence
  SiRNA target sequence
caaaaatgaggtttgtggtgcaaatga

SEQ ID NO: 48450 - DNA, 27 bp, Artificial sequence
  SiRNA target sequence
aaaaatgaggtttgtggtgcaaatgat

SEQ ID NO: 48451 - DNA, 27 bp, Artificial sequence
  SiRNA target sequence
aaaatgaggtttgtggtgcaaatgata

SEQ ID NO: 48452 - DNA, 27 bp, Artificial sequence
  SiRNA target sequence
aaatgaggtttgtggtgcaaatgatat

SEQ ID NO: 48453 - DNA, 27 bp, Artificial sequence
  SiRNA target sequence
aatgaggtttgtggtgcaaatgatata

SEQ ID NO: 48454 - DNA, 27 bp, Artificial sequence
  SiRNA target sequence
atgaggtttgtggtgcaaatgatataa

SEQ ID NO: 48455 - DNA, 27 bp, Artificial sequence
  SiRNA target sequence
tgaggtttgtggtgcaaatgatataag

SEQ ID NO: 48456 - DNA, 27 bp, Artificial sequence
  SiRNA target sequence
gaggtttgtggtgcaaatgatataagt

SEQ ID NO: 48457 - DNA, 27 bp, Artificial sequence
  SiRNA target sequence
aggtttgtggtgcaaatgatataagtg

SEQ ID NO: 48458 - DNA, 27 bp, Artificial sequence
  SiRNA target sequence
ggtttgtggtgcaaatgatataagtga

SEQ ID NO: 48459 - DNA, 27 bp, Artificial sequence
  SiRNA target sequence
gtttgtggtgcaaatgatataagtgat

SEQ ID NO: 48460 - DNA, 27 bp, Artificial sequence
  SiRNA target sequence
tttgtggtgcaaatgatataagtgatc

SEQ ID NO: 48461 - DNA, 27 bp, Artificial sequence
  SiRNA target sequence
ttgtggtgcaaatgatataagtgatct

SEQ ID NO: 48462 - DNA, 27 bp, Artificial sequence
  SiRNA target sequence
tgtggtgcaaatgatataagtgatcta

SEQ ID NO: 48463 - DNA, 27 bp, Artificial sequence
  SiRNA target sequence
gtggtgcaaatgatataagtgatctat

SEQ ID NO: 48464 - DNA, 27 bp, Artificial sequence
  SiRNA target sequence
tggtgcaaatgatataagtgatctata

SEQ ID NO: 48465 - DNA, 27 bp, Artificial sequence
  SiRNA target sequence
ggtgcaaatgatataagtgatctatat

SEQ ID NO: 48466 - DNA, 27 bp, Artificial sequence
  SiRNA target sequence
gtgcaaatgatataagtgatctatatg

SEQ ID NO: 48467 - DNA, 27 bp, Artificial sequence
  SiRNA target sequence
tgcaaatgatataagtgatctatatga

SEQ ID NO: 48468 - DNA, 27 bp, Artificial sequence
  SiRNA target sequence
gcaaatgatataagtgatctatatgaa

SEQ ID NO: 48469 - DNA, 27 bp, Artificial sequence
  SiRNA target sequence
caaatgatataagtgatctatatgaac

SEQ ID NO: 48470 - DNA, 27 bp, Artificial sequence
  SiRNA target sequence
aaatgatataagtgatctatatgaact

SEQ ID NO: 48471 - DNA, 27 bp, Artificial sequence
  SiRNA target sequence
aatgatataagtgatctatatgaacta

SEQ ID NO: 48472 - DNA, 27 bp, Artificial sequence
  SiRNA target sequence
atgatataagtgatctatatgaactat

SEQ ID NO: 48473 - DNA, 27 bp, Artificial sequence
  SiRNA target sequence
tgatataagtgatctatatgaactatt

SEQ ID NO: 48474 - DNA, 27 bp, Artificial sequence
  SiRNA target sequence
gatataagtgatctatatgaactatta

SEQ ID NO: 48475 - DNA, 27 bp, Artificial sequence
  SiRNA target sequence
atataagtgatctatatgaactattag

SEQ ID NO: 48476 - DNA, 27 bp, Artificial sequence
  SiRNA target sequence
tataagtgatctatatgaactattaga

SEQ ID NO: 48477 - DNA, 27 bp, Artificial sequence
  SiRNA target sequence
ataagtgatctatatgaactattagaa

SEQ ID NO: 48478 - DNA, 27 bp, Artificial sequence
  SiRNA target sequence
taagtgatctatatgaactattagaaa

SEQ ID NO: 48479 - DNA, 27 bp, Artificial sequence
  SiRNA target sequence
aagtgatctatatgaactattagaaat

SEQ ID NO: 48480 - DNA, 27 bp, Artificial sequence
  SiRNA target sequence
agtgatctatatgaactattagaaatt

SEQ ID NO: 48481 - DNA, 27 bp, Artificial sequence
  SiRNA target sequence
gtgatctatatgaactattagaaattt

SEQ ID NO: 48482 - DNA, 27 bp, Artificial sequence
  SiRNA target sequence
tgatctatatgaactattagaaatttc

SEQ ID NO: 48483 - DNA, 27 bp, Artificial sequence
  SiRNA target sequence
gatctatatgaactattagaaatttct

SEQ ID NO: 48484 - DNA, 27 bp, Artificial sequence
  SiRNA target sequence
atctatatgaactattagaaatttctt

SEQ ID NO: 48485 - DNA, 27 bp, Artificial sequence
  SiRNA target sequence
tctatatgaactattagaaatttcttt

SEQ ID NO: 48486 - DNA, 27 bp, Artificial sequence
  SiRNA target sequence
ctatatgaactattagaaatttctttt

SEQ ID NO: 48487 - DNA, 27 bp, Artificial sequence
  SiRNA target sequence
tatatgaactattagaaatttctttta

SEQ ID NO: 48488 - DNA, 27 bp, Artificial sequence
  SiRNA target sequence
atatgaactattagaaatttcttttat

SEQ ID NO: 48489 - DNA, 27 bp, Artificial sequence
  SiRNA target sequence
tatgaactattagaaatttcttttata

SEQ ID NO: 48490 - DNA, 27 bp, Artificial sequence
  SiRNA target sequence
atgaactattagaaatttcttttatat

SEQ ID NO: 48491 - DNA, 27 bp, Artificial sequence
  SiRNA target sequence
tgaactattagaaatttcttttatatc

SEQ ID NO: 48492 - DNA, 27 bp, Artificial sequence
  SiRNA target sequence
gaactattagaaatttcttttatatct

SEQ ID NO: 48493 - DNA, 27 bp, Artificial sequence
  SiRNA target sequence
aactattagaaatttcttttatatctc

SEQ ID NO: 48494 - DNA, 27 bp, Artificial sequence
  SiRNA target sequence
actattagaaatttcttttatatctcg

SEQ ID NO: 48495 - DNA, 27 bp, Artificial sequence
  SiRNA target sequence
ctattagaaatttcttttatatctcga

SEQ ID NO: 48496 - DNA, 27 bp, Artificial sequence
  SiRNA target sequence
tattagaaatttcttttatatctcgat

SEQ ID NO: 48497 - DNA, 27 bp, Artificial sequence
  SiRNA target sequence
attagaaatttcttttatatctcgatt

SEQ ID NO: 48498 - DNA, 27 bp, Artificial sequence
  SiRNA target sequence
ttagaaatttcttttatatctcgatta

SEQ ID NO: 48499 - DNA, 27 bp, Artificial sequence
  SiRNA target sequence
tagaaatttcttttatatctcgattat

SEQ ID NO: 48500 - DNA, 27 bp, Artificial sequence
  SiRNA target sequence
agaaatttcttttatatctcgattatc

SEQ ID NO: 48501 - DNA, 27 bp, Artificial sequence
  SiRNA target sequence
gaaatttcttttatatctcgattatct

SEQ ID NO: 48502 - DNA, 27 bp, Artificial sequence
  SiRNA target sequence
aaatttcttttatatctcgattatcta

SEQ ID NO: 48503 - DNA, 27 bp, Artificial sequence
  SiRNA target sequence
aatttcttttatatctcgattatctag

SEQ ID NO: 48504 - DNA, 27 bp, Artificial sequence
  SiRNA target sequence
atttcttttatatctcgattatctaga

SEQ ID NO: 48505 - DNA, 27 bp, Artificial sequence
  SiRNA target sequence
tttcttttatatctcgattatctagat

SEQ ID NO: 48506 - DNA, 27 bp, Artificial sequence
  SiRNA target sequence
ttcttttatatctcgattatctagata

SEQ ID NO: 48507 - DNA, 27 bp, Artificial sequence
  SiRNA target sequence
tcttttatatctcgattatctagataa

SEQ ID NO: 48508 - DNA, 27 bp, Artificial sequence
  SiRNA target sequence
cttttatatctcgattatctagataaa

SEQ ID NO: 48509 - DNA, 27 bp, Artificial sequence
  SiRNA target sequence
ttttatatctcgattatctagataaat

SEQ ID NO: 48510 - DNA, 27 bp, Artificial sequence
  SiRNA target sequence
tttatatctcgattatctagataaata

SEQ ID NO: 48511 - DNA, 27 bp, Artificial sequence
  SiRNA target sequence
ttatatctcgattatctagataaatat

SEQ ID NO: 48512 - DNA, 27 bp, Artificial sequence
  SiRNA target sequence
tatatctcgattatctagataaatatt

SEQ ID NO: 48513 - DNA, 27 bp, Artificial sequence
  SiRNA target sequence
atatctcgattatctagataaatattt

SEQ ID NO: 48514 - DNA, 27 bp, Artificial sequence
  SiRNA target sequence
tatctcgattatctagataaatatttc

SEQ ID NO: 48515 - DNA, 27 bp, Artificial sequence
  SiRNA target sequence
atctcgattatctagataaatatttcc

SEQ ID NO: 48516 - DNA, 27 bp, Artificial sequence
  SiRNA target sequence
tctcgattatctagataaatatttccc

SEQ ID NO: 48517 - DNA, 27 bp, Artificial sequence
  SiRNA target sequence
ctcgattatctagataaatatttcccc

SEQ ID NO: 48518 - DNA, 27 bp, Artificial sequence
  SiRNA target sequence
tcgattatctagataaatatttccccc

SEQ ID NO: 48519 - DNA, 27 bp, Artificial sequence
  SiRNA target sequence
cgattatctagataaatatttccccca

SEQ ID NO: 48520 - DNA, 27 bp, Artificial sequence
  SiRNA target sequence
gattatctagataaatatttcccccat

SEQ ID NO: 48521 - DNA, 27 bp, Artificial sequence
  SiRNA target sequence
attatctagataaatatttcccccata

SEQ ID NO: 48522 - DNA, 27 bp, Artificial sequence
  SiRNA target sequence
ttatctagataaatatttcccccataa

SEQ ID NO: 48523 - DNA, 27 bp, Artificial sequence
  SiRNA target sequence
tatctagataaatatttcccccataat

SEQ ID NO: 48524 - DNA, 27 bp, Artificial sequence
  SiRNA target sequence
atctagataaatatttcccccataatt

SEQ ID NO: 48525 - DNA, 27 bp, Artificial sequence
  SiRNA target sequence
tctagataaatatttcccccataattt

SEQ ID NO: 48526 - DNA, 27 bp, Artificial sequence
  SiRNA target sequence
ctagataaatatttcccccataatttt

SEQ ID NO: 48527 - DNA, 27 bp, Artificial sequence
  SiRNA target sequence
tagataaatatttcccccataattttc

SEQ ID NO: 48528 - DNA, 27 bp, Artificial sequence
  SiRNA target sequence
agataaatatttcccccataattttca

SEQ ID NO: 48529 - DNA, 27 bp, Artificial sequence
  SiRNA target sequence
gataaatatttcccccataattttcaa

SEQ ID NO: 48530 - DNA, 27 bp, Artificial sequence
  SiRNA target sequence
ataaatatttcccccataattttcaaa

SEQ ID NO: 48531 - DNA, 27 bp, Artificial sequence
  SiRNA target sequence
taaatatttcccccataattttcaaat

SEQ ID NO: 48532 - DNA, 27 bp, Artificial sequence
  SiRNA target sequence
aaatatttcccccataattttcaaatc

SEQ ID NO: 48533 - DNA, 27 bp, Artificial sequence
  SiRNA target sequence
aatatttcccccataattttcaaatct

SEQ ID NO: 48534 - DNA, 27 bp, Artificial sequence
  SiRNA target sequence
atatttcccccataattttcaaatctc

SEQ ID NO: 48535 - DNA, 27 bp, Artificial sequence
  SiRNA target sequence
tatttcccccataattttcaaatctca

SEQ ID NO: 48536 - DNA, 27 bp, Artificial sequence
  SiRNA target sequence
atttcccccataattttcaaatctcat

SEQ ID NO: 48537 - DNA, 27 bp, Artificial sequence
  SiRNA target sequence
tttcccccataattttcaaatctcata

SEQ ID NO: 48538 - DNA, 27 bp, Artificial sequence
  SiRNA target sequence
ttcccccataattttcaaatctcataa

SEQ ID NO: 48539 - DNA, 27 bp, Artificial sequence
  SiRNA target sequence
tcccccataattttcaaatctcataat

SEQ ID NO: 48540 - DNA, 27 bp, Artificial sequence
  SiRNA target sequence
cccccataattttcaaatctcataatc

SEQ ID NO: 48541 - DNA, 27 bp, Artificial sequence
  SiRNA target sequence
ccccataattttcaaatctcataatca

SEQ ID NO: 48542 - DNA, 27 bp, Artificial sequence
  SiRNA target sequence
cccataattttcaaatctcataatcat

SEQ ID NO: 48543 - DNA, 27 bp, Artificial sequence
  SiRNA target sequence
ccataattttcaaatctcataatcatc

SEQ ID NO: 48544 - DNA, 27 bp, Artificial sequence
  SiRNA target sequence
cataattttcaaatctcataatcatct

SEQ ID NO: 48545 - DNA, 27 bp, Artificial sequence
  SiRNA target sequence
ataattttcaaatctcataatcatctt

SEQ ID NO: 48546 - DNA, 27 bp, Artificial sequence
  SiRNA target sequence
taattttcaaatctcataatcatcttt

SEQ ID NO: 48547 - DNA, 27 bp, Artificial sequence
  SiRNA target sequence
aattttcaaatctcataatcatcttta

SEQ ID NO: 48548 - DNA, 27 bp, Artificial sequence
  SiRNA target sequence
attttcaaatctcataatcatctttat

SEQ ID NO: 48549 - DNA, 27 bp, Artificial sequence
  SiRNA target sequence
ttttcaaatctcataatcatctttata

SEQ ID NO: 48550 - DNA, 27 bp, Artificial sequence
  SiRNA target sequence
tttcaaatctcataatcatctttataa

SEQ ID NO: 48551 - DNA, 27 bp, Artificial sequence
  SiRNA target sequence
ttcaaatctcataatcatctttataag

SEQ ID NO: 48552 - DNA, 27 bp, Artificial sequence
  SiRNA target sequence
tcaaatctcataatcatctttataaga

SEQ ID NO: 48553 - DNA, 27 bp, Artificial sequence
  SiRNA target sequence
caaatctcataatcatctttataagag

SEQ ID NO: 48554 - DNA, 27 bp, Artificial sequence
  SiRNA target sequence
aaatctcataatcatctttataagaga

SEQ ID NO: 48555 - DNA, 27 bp, Artificial sequence
  SiRNA target sequence
aatctcataatcatctttataagagat

SEQ ID NO: 48556 - DNA, 27 bp, Artificial sequence
  SiRNA target sequence
atctcataatcatctttataagagatg

SEQ ID NO: 48557 - DNA, 27 bp, Artificial sequence
  SiRNA target sequence
tctcataatcatctttataagagatgt

SEQ ID NO: 48558 - DNA, 27 bp, Artificial sequence
  SiRNA target sequence
ctcataatcatctttataagagatgtt

SEQ ID NO: 48559 - DNA, 27 bp, Artificial sequence
  SiRNA target sequence
tcataatcatctttataagagatgttt

SEQ ID NO: 48560 - DNA, 27 bp, Artificial sequence
  SiRNA target sequence
cataatcatctttataagagatgtttt

SEQ ID NO: 48561 - DNA, 27 bp, Artificial sequence
  SiRNA target sequence
ataatcatctttataagagatgttttt

SEQ ID NO: 48562 - DNA, 27 bp, Artificial sequence
  SiRNA target sequence
taatcatctttataagagatgtttttc

SEQ ID NO: 48563 - DNA, 27 bp, Artificial sequence
  SiRNA target sequence
aatcatctttataagagatgtttttcc

SEQ ID NO: 48564 - DNA, 27 bp, Artificial sequence
  SiRNA target sequence
atcatctttataagagatgtttttccc

SEQ ID NO: 48565 - DNA, 27 bp, Artificial sequence
  SiRNA target sequence
tcatctttataagagatgtttttcccg

SEQ ID NO: 48566 - DNA, 27 bp, Artificial sequence
  SiRNA target sequence
catctttataagagatgtttttcccga

SEQ ID NO: 48567 - DNA, 27 bp, Artificial sequence
  SiRNA target sequence
atctttataagagatgtttttcccgat

SEQ ID NO: 48568 - DNA, 27 bp, Artificial sequence
  SiRNA target sequence
tctttataagagatgtttttcccgatc

SEQ ID NO: 48569 - DNA, 27 bp, Artificial sequence
  SiRNA target sequence
ctttataagagatgtttttcccgatcc

SEQ ID NO: 48570 - DNA, 27 bp, Artificial sequence
  SiRNA target sequence
tttataagagatgtttttcccgatcca

SEQ ID NO: 48571 - DNA, 27 bp, Artificial sequence
  SiRNA target sequence
ttataagagatgtttttcccgatccat

SEQ ID NO: 48572 - DNA, 27 bp, Artificial sequence
  SiRNA target sequence
tataagagatgtttttcccgatccatt

SEQ ID NO: 48573 - DNA, 27 bp, Artificial sequence
  SiRNA target sequence
ataagagatgtttttcccgatccattt

SEQ ID NO: 48574 - DNA, 27 bp, Artificial sequence
  SiRNA target sequence
taagagatgtttttcccgatccatttt

SEQ ID NO: 48575 - DNA, 27 bp, Artificial sequence
  SiRNA target sequence
aagagatgtttttcccgatccattttt

SEQ ID NO: 48576 - DNA, 27 bp, Artificial sequence
  SiRNA target sequence
agagatgtttttcccgatccatttttt

SEQ ID NO: 48577 - DNA, 27 bp, Artificial sequence
  SiRNA target sequence
gagatgtttttcccgatccattttttc

SEQ ID NO: 48578 - DNA, 27 bp, Artificial sequence
  SiRNA target sequence
agatgtttttcccgatccattttttcc

SEQ ID NO: 48579 - DNA, 27 bp, Artificial sequence
  SiRNA target sequence
gatgtttttcccgatccattttttcca

SEQ ID NO: 48580 - DNA, 27 bp, Artificial sequence
  SiRNA target sequence
atgtttttcccgatccattttttccaa

SEQ ID NO: 48581 - DNA, 27 bp, Artificial sequence
  SiRNA target sequence
tgtttttcccgatccattttttccaat

SEQ ID NO: 48582 - DNA, 27 bp, Artificial sequence
  SiRNA target sequence
gtttttcccgatccattttttccaata

SEQ ID NO: 48583 - DNA, 27 bp, Artificial sequence
  SiRNA target sequence
tttttcccgatccattttttccaataa

SEQ ID NO: 48584 - DNA, 27 bp, Artificial sequence
  SiRNA target sequence
ttttcccgatccattttttccaataat

SEQ ID NO: 48585 - DNA, 27 bp, Artificial sequence
  SiRNA target sequence
tttcccgatccattttttccaataata

SEQ ID NO: 48586 - DNA, 27 bp, Artificial sequence
  SiRNA target sequence
ttcccgatccattttttccaataatag

SEQ ID NO: 48587 - DNA, 27 bp, Artificial sequence
  SiRNA target sequence
tcccgatccattttttccaataatagc

SEQ ID NO: 48588 - DNA, 27 bp, Artificial sequence
  SiRNA target sequence
cccgatccattttttccaataatagct

SEQ ID NO: 48589 - DNA, 27 bp, Artificial sequence
  SiRNA target sequence
ccgatccattttttccaataatagcta

SEQ ID NO: 48590 - DNA, 27 bp, Artificial sequence
  SiRNA target sequence
cgatccattttttccaataatagctac

SEQ ID NO: 48591 - DNA, 27 bp, Artificial sequence
  SiRNA target sequence
gatccattttttccaataatagctact

SEQ ID NO: 48592 - DNA, 27 bp, Artificial sequence
  SiRNA target sequence
atccattttttccaataatagctactt

SEQ ID NO: 48593 - DNA, 27 bp, Artificial sequence
  SiRNA target sequence
tccattttttccaataatagctacttt

SEQ ID NO: 48594 - DNA, 27 bp, Artificial sequence
  SiRNA target sequence
ccattttttccaataatagctactttt

SEQ ID NO: 48595 - DNA, 27 bp, Artificial sequence
  SiRNA target sequence
cattttttccaataatagctacttttt

SEQ ID NO: 48596 - DNA, 27 bp, Artificial sequence
  SiRNA target sequence
attttttccaataatagctactttttc

SEQ ID NO: 48597 - DNA, 27 bp, Artificial sequence
  SiRNA target sequence
ttttttccaataatagctactttttca

SEQ ID NO: 48598 - DNA, 27 bp, Artificial sequence
  SiRNA target sequence
tttttccaataatagctactttttcac

SEQ ID NO: 48599 - DNA, 27 bp, Artificial sequence
  SiRNA target sequence
ttttccaataatagctactttttcacc

SEQ ID NO: 48600 - DNA, 27 bp, Artificial sequence
  SiRNA target sequence
tttccaataatagctactttttcacct

SEQ ID NO: 48601 - DNA, 27 bp, Artificial sequence
  SiRNA target sequence
ttccaataatagctactttttcacctt

SEQ ID NO: 48602 - DNA, 27 bp, Artificial sequence
  SiRNA target sequence
tccaataatagctactttttcaccttt

SEQ ID NO: 48603 - DNA, 27 bp, Artificial sequence
  SiRNA target sequence
ccaataatagctactttttcacctttt

SEQ ID NO: 48604 - DNA, 27 bp, Artificial sequence
  SiRNA target sequence
caataatagctactttttcaccttttt

SEQ ID NO: 48605 - DNA, 27 bp, Artificial sequence
  SiRNA target sequence
aataatagctactttttcacctttttt

SEQ ID NO: 48606 - DNA, 27 bp, Artificial sequence
  SiRNA target sequence
ataatagctactttttcacctttttta

SEQ ID NO: 48607 - DNA, 27 bp, Artificial sequence
  SiRNA target sequence
taatagctactttttcaccttttttaa

SEQ ID NO: 48608 - DNA, 27 bp, Artificial sequence
  SiRNA target sequence
aatagctactttttcaccttttttaat

SEQ ID NO: 48609 - DNA, 27 bp, Artificial sequence
  SiRNA target sequence
atagctactttttcaccttttttaatt

SEQ ID NO: 48610 - DNA, 27 bp, Artificial sequence
  SiRNA target sequence
tagctactttttcaccttttttaatta

SEQ ID NO: 48611 - DNA, 27 bp, Artificial sequence
  SiRNA target sequence
agctactttttcaccttttttaattaa

SEQ ID NO: 48612 - DNA, 27 bp, Artificial sequence
  SiRNA target sequence
gctactttttcaccttttttaattaaa

SEQ ID NO: 48613 - DNA, 27 bp, Artificial sequence
  SiRNA target sequence
ctactttttcaccttttttaattaaaa

SEQ ID NO: 48614 - DNA, 27 bp, Artificial sequence
  SiRNA target sequence
tactttttcaccttttttaattaaaat

SEQ ID NO: 48615 - DNA, 27 bp, Artificial sequence
  SiRNA target sequence
actttttcaccttttttaattaaaata

SEQ ID NO: 48616 - DNA, 27 bp, Artificial sequence
  SiRNA target sequence
ctttttcaccttttttaattaaaatat

SEQ ID NO: 48617 - DNA, 27 bp, Artificial sequence
  SiRNA target sequence
tttttcaccttttttaattaaaatatt

SEQ ID NO: 48618 - DNA, 27 bp, Artificial sequence
  SiRNA target sequence
ttttcaccttttttaattaaaatattt

SEQ ID NO: 48619 - DNA, 27 bp, Artificial sequence
  SiRNA target sequence
tttcaccttttttaattaaaatattta

SEQ ID NO: 48620 - DNA, 27 bp, Artificial sequence
  SiRNA target sequence
ttcaccttttttaattaaaatatttat

SEQ ID NO: 48621 - DNA, 27 bp, Artificial sequence
  SiRNA target sequence
tcaccttttttaattaaaatatttatg

SEQ ID NO: 48622 - DNA, 27 bp, Artificial sequence
  SiRNA target sequence
caccttttttaattaaaatatttatgt

SEQ ID NO: 48623 - DNA, 27 bp, Artificial sequence
  SiRNA target sequence
accttttttaattaaaatatttatgtc

SEQ ID NO: 48624 - DNA, 27 bp, Artificial sequence
  SiRNA target sequence
ccttttttaattaaaatatttatgtcc

SEQ ID NO: 48625 - DNA, 27 bp, Artificial sequence
  SiRNA target sequence
cttttttaattaaaatatttatgtccg

SEQ ID NO: 48626 - DNA, 27 bp, Artificial sequence
  SiRNA target sequence
ttttttaattaaaatatttatgtccgt

SEQ ID NO: 48627 - DNA, 27 bp, Artificial sequence
  SiRNA target sequence
tttttaattaaaatatttatgtccgtt

SEQ ID NO: 48628 - DNA, 27 bp, Artificial sequence
  SiRNA target sequence
ttttaattaaaatatttatgtccgtta

SEQ ID NO: 48629 - DNA, 27 bp, Artificial sequence
  SiRNA target sequence
tttaattaaaatatttatgtccgttaa

SEQ ID NO: 48630 - DNA, 27 bp, Artificial sequence
  SiRNA target sequence
ttaattaaaatatttatgtccgttaaa

SEQ ID NO: 48631 - DNA, 27 bp, Artificial sequence
  SiRNA target sequence
taattaaaatatttatgtccgttaaaa

SEQ ID NO: 48632 - DNA, 27 bp, Artificial sequence
  SiRNA target sequence
aattaaaatatttatgtccgttaaaat

SEQ ID NO: 48633 - DNA, 27 bp, Artificial sequence
  SiRNA target sequence
attaaaatatttatgtccgttaaaatt

SEQ ID NO: 48634 - DNA, 27 bp, Artificial sequence
  SiRNA target sequence
ttaaaatatttatgtccgttaaaattt

SEQ ID NO: 48635 - DNA, 27 bp, Artificial sequence
  SiRNA target sequence
taaaatatttatgtccgttaaaatttt

SEQ ID NO: 48636 - DNA, 27 bp, Artificial sequence
  SiRNA target sequence
aaaatatttatgtccgttaaaattttt

SEQ ID NO: 48637 - DNA, 27 bp, Artificial sequence
  SiRNA target sequence
aaatatttatgtccgttaaaatttttt

SEQ ID NO: 48638 - DNA, 27 bp, Artificial sequence
  SiRNA target sequence
aatatttatgtccgttaaaattttttt

SEQ ID NO: 48639 - DNA, 27 bp, Artificial sequence
  SiRNA target sequence
atatttatgtccgttaaaatttttttg

SEQ ID NO: 48640 - DNA, 27 bp, Artificial sequence
  SiRNA target sequence
tatttatgtccgttaaaatttttttgg

SEQ ID NO: 48641 - DNA, 27 bp, Artificial sequence
  SiRNA target sequence
atttatgtccgttaaaatttttttgga

SEQ ID NO: 48642 - DNA, 27 bp, Artificial sequence
  SiRNA target sequence
tttatgtccgttaaaatttttttggag

SEQ ID NO: 48643 - DNA, 27 bp, Artificial sequence
  SiRNA target sequence
ttatgtccgttaaaatttttttggagt

SEQ ID NO: 48644 - DNA, 27 bp, Artificial sequence
  SiRNA target sequence
tatgtccgttaaaatttttttggagta

SEQ ID NO: 48645 - DNA, 27 bp, Artificial sequence
  SiRNA target sequence
atgtccgttaaaatttttttggagtaa

SEQ ID NO: 48646 - DNA, 27 bp, Artificial sequence
  SiRNA target sequence
tgtccgttaaaatttttttggagtaat

SEQ ID NO: 48647 - DNA, 27 bp, Artificial sequence
  SiRNA target sequence
gtccgttaaaatttttttggagtaata

SEQ ID NO: 48648 - DNA, 27 bp, Artificial sequence
  SiRNA target sequence
tccgttaaaatttttttggagtaataa

SEQ ID NO: 48649 - DNA, 27 bp, Artificial sequence
  SiRNA target sequence
ccgttaaaatttttttggagtaataat

SEQ ID NO: 48650 - DNA, 27 bp, Artificial sequence
  SiRNA target sequence
cgttaaaatttttttggagtaataatt

SEQ ID NO: 48651 - DNA, 27 bp, Artificial sequence
  SiRNA target sequence
gttaaaatttttttggagtaataatta

SEQ ID NO: 48652 - DNA, 27 bp, Artificial sequence
  SiRNA target sequence
ttaaaatttttttggagtaataattaa

SEQ ID NO: 48653 - DNA, 27 bp, Artificial sequence
  SiRNA target sequence
taaaatttttttggagtaataattaaa

SEQ ID NO: 48654 - DNA, 27 bp, Artificial sequence
  SiRNA target sequence
aaaatttttttggagtaataattaaat

SEQ ID NO: 48655 - DNA, 27 bp, Artificial sequence
  SiRNA target sequence
aaatttttttggagtaataattaaatg

SEQ ID NO: 48656 - DNA, 27 bp, Artificial sequence
  SiRNA target sequence
aatttttttggagtaataattaaatga

SEQ ID NO: 48657 - DNA, 27 bp, Artificial sequence
  SiRNA target sequence
atttttttggagtaataattaaatgat

SEQ ID NO: 48658 - DNA, 27 bp, Artificial sequence
  SiRNA target sequence
tttttttggagtaataattaaatgatg

SEQ ID NO: 48659 - DNA, 27 bp, Artificial sequence
  SiRNA target sequence
ttttttggagtaataattaaatgatgc

SEQ ID NO: 48660 - DNA, 27 bp, Artificial sequence
  SiRNA target sequence
tttttggagtaataattaaatgatgca

SEQ ID NO: 48661 - DNA, 27 bp, Artificial sequence
  SiRNA target sequence
ttttggagtaataattaaatgatgcat

SEQ ID NO: 48662 - DNA, 27 bp, Artificial sequence
  SiRNA target sequence
tttggagtaataattaaatgatgcatt

SEQ ID NO: 48663 - DNA, 27 bp, Artificial sequence
  SiRNA target sequence
ttggagtaataattaaatgatgcattt

SEQ ID NO: 48664 - DNA, 27 bp, Artificial sequence
  SiRNA target sequence
tggagtaataattaaatgatgcatttt

SEQ ID NO: 48665 - DNA, 27 bp, Artificial sequence
  SiRNA target sequence
ggagtaataattaaatgatgcattttc

SEQ ID NO: 48666 - DNA, 27 bp, Artificial sequence
  SiRNA target sequence
gagtaataattaaatgatgcattttct

SEQ ID NO: 48667 - DNA, 27 bp, Artificial sequence
  SiRNA target sequence
agtaataattaaatgatgcattttcta

SEQ ID NO: 48668 - DNA, 27 bp, Artificial sequence
  SiRNA target sequence
gtaataattaaatgatgcattttctaa

SEQ ID NO: 48669 - DNA, 27 bp, Artificial sequence
  SiRNA target sequence
taataattaaatgatgcattttctaat

SEQ ID NO: 48670 - DNA, 27 bp, Artificial sequence
  SiRNA target sequence
aataattaaatgatgcattttctaatc

SEQ ID NO: 48671 - DNA, 27 bp, Artificial sequence
  SiRNA target sequence
ataattaaatgatgcattttctaatct

SEQ ID NO: 48672 - DNA, 27 bp, Artificial sequence
  SiRNA target sequence
taattaaatgatgcattttctaatctt

SEQ ID NO: 48673 - DNA, 27 bp, Artificial sequence
  SiRNA target sequence
aattaaatgatgcattttctaatctta

SEQ ID NO: 48674 - DNA, 27 bp, Artificial sequence
  SiRNA target sequence
attaaatgatgcattttctaatcttat

SEQ ID NO: 48675 - DNA, 27 bp, Artificial sequence
  SiRNA target sequence
ttaaatgatgcattttctaatcttata

SEQ ID NO: 48676 - DNA, 27 bp, Artificial sequence
  SiRNA target sequence
taaatgatgcattttctaatcttatat

SEQ ID NO: 48677 - DNA, 27 bp, Artificial sequence
  SiRNA target sequence
aaatgatgcattttctaatcttatatc

SEQ ID NO: 48678 - DNA, 27 bp, Artificial sequence
  SiRNA target sequence
aatgatgcattttctaatcttatatca

SEQ ID NO: 48679 - DNA, 27 bp, Artificial sequence
  SiRNA target sequence
atgatgcattttctaatcttatatcat

SEQ ID NO: 48680 - DNA, 27 bp, Artificial sequence
  SiRNA target sequence
tgatgcattttctaatcttatatcatt

SEQ ID NO: 48681 - DNA, 27 bp, Artificial sequence
  SiRNA target sequence
gatgcattttctaatcttatatcatta

SEQ ID NO: 48682 - DNA, 27 bp, Artificial sequence
  SiRNA target sequence
atgcattttctaatcttatatcattat

SEQ ID NO: 48683 - DNA, 27 bp, Artificial sequence
  SiRNA target sequence
tgcattttctaatcttatatcattatt

SEQ ID NO: 48684 - DNA, 27 bp, Artificial sequence
  SiRNA target sequence
gcattttctaatcttatatcattatta

SEQ ID NO: 48685 - DNA, 27 bp, Artificial sequence
  SiRNA target sequence
cattttctaatcttatatcattattaa

SEQ ID NO: 48686 - DNA, 27 bp, Artificial sequence
  SiRNA target sequence
attttctaatcttatatcattattaaa

SEQ ID NO: 48687 - DNA, 27 bp, Artificial sequence
  SiRNA target sequence
ttttctaatcttatatcattattaaat

SEQ ID NO: 48688 - DNA, 27 bp, Artificial sequence
  SiRNA target sequence
tttctaatcttatatcattattaaatt

SEQ ID NO: 48689 - DNA, 27 bp, Artificial sequence
  SiRNA target sequence
ttctaatcttatatcattattaaattc

SEQ ID NO: 48690 - DNA, 27 bp, Artificial sequence
  SiRNA target sequence
tctaatcttatatcattattaaattca

SEQ ID NO: 48691 - DNA, 27 bp, Artificial sequence
  SiRNA target sequence
ctaatcttatatcattattaaattcat

SEQ ID NO: 48692 - DNA, 27 bp, Artificial sequence
  SiRNA target sequence
taatcttatatcattattaaattcatt

SEQ ID NO: 48693 - DNA, 27 bp, Artificial sequence
  SiRNA target sequence
aatcttatatcattattaaattcatta

SEQ ID NO: 48694 - DNA, 27 bp, Artificial sequence
  SiRNA target sequence
atcttatatcattattaaattcattaa

SEQ ID NO: 48695 - DNA, 27 bp, Artificial sequence
  SiRNA target sequence
tcttatatcattattaaattcattaac

SEQ ID NO: 48696 - DNA, 27 bp, Artificial sequence
  SiRNA target sequence
cttatatcattattaaattcattaaca

SEQ ID NO: 48697 - DNA, 27 bp, Artificial sequence
  SiRNA target sequence
ttatatcattattaaattcattaacat

SEQ ID NO: 48698 - DNA, 27 bp, Artificial sequence
  SiRNA target sequence
tatatcattattaaattcattaacatc

SEQ ID NO: 48699 - DNA, 27 bp, Artificial sequence
  SiRNA target sequence
atatcattattaaattcattaacatct

SEQ ID NO: 48700 - DNA, 27 bp, Artificial sequence
  SiRNA target sequence
tatcattattaaattcattaacatcta

SEQ ID NO: 48701 - DNA, 27 bp, Artificial sequence
  SiRNA target sequence
atcattattaaattcattaacatctac

SEQ ID NO: 48702 - DNA, 27 bp, Artificial sequence
  SiRNA target sequence
tcattattaaattcattaacatctact

SEQ ID NO: 48703 - DNA, 27 bp, Artificial sequence
  SiRNA target sequence
cattattaaattcattaacatctacta

SEQ ID NO: 48704 - DNA, 27 bp, Artificial sequence
  SiRNA target sequence
attattaaattcattaacatctactaa

SEQ ID NO: 48705 - DNA, 27 bp, Artificial sequence
  SiRNA target sequence
ttattaaattcattaacatctactaaa

SEQ ID NO: 48706 - DNA, 27 bp, Artificial sequence
  SiRNA target sequence
tattaaattcattaacatctactaaat

SEQ ID NO: 48707 - DNA, 27 bp, Artificial sequence
  SiRNA target sequence
attaaattcattaacatctactaaatt

SEQ ID NO: 48708 - DNA, 27 bp, Artificial sequence
  SiRNA target sequence
ttaaattcattaacatctactaaattt

SEQ ID NO: 48709 - DNA, 27 bp, Artificial sequence
  SiRNA target sequence
taaattcattaacatctactaaatttg

SEQ ID NO: 48710 - DNA, 27 bp, Artificial sequence
  SiRNA target sequence
aaattcattaacatctactaaatttgg

SEQ ID NO: 48711 - DNA, 27 bp, Artificial sequence
  SiRNA target sequence
aattcattaacatctactaaatttggt

SEQ ID NO: 48712 - DNA, 27 bp, Artificial sequence
  SiRNA target sequence
attcattaacatctactaaatttggtt

SEQ ID NO: 48713 - DNA, 27 bp, Artificial sequence
  SiRNA target sequence
ttcattaacatctactaaatttggttc

SEQ ID NO: 48714 - DNA, 27 bp, Artificial sequence
  SiRNA target sequence
tcattaacatctactaaatttggttct

SEQ ID NO: 48715 - DNA, 27 bp, Artificial sequence
  SiRNA target sequence
cattaacatctactaaatttggttctt

SEQ ID NO: 48716 - DNA, 27 bp, Artificial sequence
  SiRNA target sequence
attaacatctactaaatttggttcttc

SEQ ID NO: 48717 - DNA, 27 bp, Artificial sequence
  SiRNA target sequence
ttaacatctactaaatttggttcttct

SEQ ID NO: 48718 - DNA, 27 bp, Artificial sequence
  SiRNA target sequence
taacatctactaaatttggttcttctt

SEQ ID NO: 48719 - DNA, 27 bp, Artificial sequence
  SiRNA target sequence
aacatctactaaatttggttcttcttt

SEQ ID NO: 48720 - DNA, 27 bp, Artificial sequence
  SiRNA target sequence
acatctactaaatttggttcttctttt

SEQ ID NO: 48721 - DNA, 27 bp, Artificial sequence
  SiRNA target sequence
catctactaaatttggttcttctttta

SEQ ID NO: 48722 - DNA, 27 bp, Artificial sequence
  SiRNA target sequence
atctactaaatttggttcttcttttat

SEQ ID NO: 48723 - DNA, 27 bp, Artificial sequence
  SiRNA target sequence
tctactaaatttggttcttcttttata

SEQ ID NO: 48724 - DNA, 27 bp, Artificial sequence
  SiRNA target sequence
ctactaaatttggttcttcttttataa

SEQ ID NO: 48725 - DNA, 27 bp, Artificial sequence
  SiRNA target sequence
tactaaatttggttcttcttttataag

SEQ ID NO: 48726 - DNA, 27 bp, Artificial sequence
  SiRNA target sequence
actaaatttggttcttcttttataagc

SEQ ID NO: 48727 - DNA, 27 bp, Artificial sequence
  SiRNA target sequence
ctaaatttggttcttcttttataagct

SEQ ID NO: 48728 - DNA, 27 bp, Artificial sequence
  SiRNA target sequence
taaatttggttcttcttttataagctc

SEQ ID NO: 48729 - DNA, 27 bp, Artificial sequence
  SiRNA target sequence
aaatttggttcttcttttataagctct

SEQ ID NO: 48730 - DNA, 27 bp, Artificial sequence
  SiRNA target sequence
aatttggttcttcttttataagctctg

SEQ ID NO: 48731 - DNA, 27 bp, Artificial sequence
  SiRNA target sequence
atttggttcttcttttataagctctgg

SEQ ID NO: 48732 - DNA, 27 bp, Artificial sequence
  SiRNA target sequence
tttggttcttcttttataagctctggt

SEQ ID NO: 48733 - DNA, 27 bp, Artificial sequence
  SiRNA target sequence
ttggttcttcttttataagctctggtt

SEQ ID NO: 48734 - DNA, 27 bp, Artificial sequence
  SiRNA target sequence
tggttcttcttttataagctctggttt

SEQ ID NO: 48735 - DNA, 27 bp, Artificial sequence
  SiRNA target sequence
ggttcttcttttataagctctggttta

SEQ ID NO: 48736 - DNA, 27 bp, Artificial sequence
  SiRNA target sequence
gttcttcttttataagctctggtttaa

SEQ ID NO: 48737 - DNA, 27 bp, Artificial sequence
  SiRNA target sequence
ttcttcttttataagctctggtttaaa

SEQ ID NO: 48738 - DNA, 27 bp, Artificial sequence
  SiRNA target sequence
tcttcttttataagctctggtttaaaa

SEQ ID NO: 48739 - DNA, 27 bp, Artificial sequence
  SiRNA target sequence
cttcttttataagctctggtttaaaag

SEQ ID NO: 48740 - DNA, 27 bp, Artificial sequence
  SiRNA target sequence
ttcttttataagctctggtttaaaaga

SEQ ID NO: 48741 - DNA, 27 bp, Artificial sequence
  SiRNA target sequence
tcttttataagctctggtttaaaagat

SEQ ID NO: 48742 - DNA, 27 bp, Artificial sequence
  SiRNA target sequence
cttttataagctctggtttaaaagatg

SEQ ID NO: 48743 - DNA, 27 bp, Artificial sequence
  SiRNA target sequence
ttttataagctctggtttaaaagatgt

SEQ ID NO: 48744 - DNA, 27 bp, Artificial sequence
  SiRNA target sequence
tttataagctctggtttaaaagatgtt

SEQ ID NO: 48745 - DNA, 27 bp, Artificial sequence
  SiRNA target sequence
ttataagctctggtttaaaagatgttc

SEQ ID NO: 48746 - DNA, 27 bp, Artificial sequence
  SiRNA target sequence
tataagctctggtttaaaagatgttct

SEQ ID NO: 48747 - DNA, 27 bp, Artificial sequence
  SiRNA target sequence
ataagctctggtttaaaagatgttctt

SEQ ID NO: 48748 - DNA, 27 bp, Artificial sequence
  SiRNA target sequence
taagctctggtttaaaagatgttctta

SEQ ID NO: 48749 - DNA, 27 bp, Artificial sequence
  SiRNA target sequence
aagctctggtttaaaagatgttcttat

SEQ ID NO: 48750 - DNA, 27 bp, Artificial sequence
  SiRNA target sequence
agctctggtttaaaagatgttcttata

SEQ ID NO: 48751 - DNA, 27 bp, Artificial sequence
  SiRNA target sequence
gctctggtttaaaagatgttcttatat

SEQ ID NO: 48752 - DNA, 27 bp, Artificial sequence
  SiRNA target sequence
ctctggtttaaaagatgttcttatatt

SEQ ID NO: 48753 - DNA, 27 bp, Artificial sequence
  SiRNA target sequence
tctggtttaaaagatgttcttatattt

SEQ ID NO: 48754 - DNA, 27 bp, Artificial sequence
  SiRNA target sequence
ctggtttaaaagatgttcttatattta

SEQ ID NO: 48755 - DNA, 27 bp, Artificial sequence
  SiRNA target sequence
tggtttaaaagatgttcttatatttaa

SEQ ID NO: 48756 - DNA, 27 bp, Artificial sequence
  SiRNA target sequence
ggtttaaaagatgttcttatatttaag

SEQ ID NO: 48757 - DNA, 27 bp, Artificial sequence
  SiRNA target sequence
gtttaaaagatgttcttatatttaaga

SEQ ID NO: 48758 - DNA, 27 bp, Artificial sequence
  SiRNA target sequence
tttaaaagatgttcttatatttaagat

SEQ ID NO: 48759 - DNA, 27 bp, Artificial sequence
  SiRNA target sequence
ttaaaagatgttcttatatttaagatt

SEQ ID NO: 48760 - DNA, 27 bp, Artificial sequence
  SiRNA target sequence
taaaagatgttcttatatttaagattg

SEQ ID NO: 48761 - DNA, 27 bp, Artificial sequence
  SiRNA target sequence
aaaagatgttcttatatttaagattgc

SEQ ID NO: 48762 - DNA, 27 bp, Artificial sequence
  SiRNA target sequence
aaagatgttcttatatttaagattgct

SEQ ID NO: 48763 - DNA, 27 bp, Artificial sequence
  SiRNA target sequence
aagatgttcttatatttaagattgctt

SEQ ID NO: 48764 - DNA, 27 bp, Artificial sequence
  SiRNA target sequence
agatgttcttatatttaagattgcttg

SEQ ID NO: 48765 - DNA, 27 bp, Artificial sequence
  SiRNA target sequence
gatgttcttatatttaagattgcttgt

SEQ ID NO: 48766 - DNA, 27 bp, Artificial sequence
  SiRNA target sequence
atgttcttatatttaagattgcttgtg

SEQ ID NO: 48767 - DNA, 27 bp, Artificial sequence
  SiRNA target sequence
tgttcttatatttaagattgcttgtgt

SEQ ID NO: 48768 - DNA, 27 bp, Artificial sequence
  SiRNA target sequence
gttcttatatttaagattgcttgtgta

SEQ ID NO: 48769 - DNA, 27 bp, Artificial sequence
  SiRNA target sequence
ttcttatatttaagattgcttgtgtat

SEQ ID NO: 48770 - DNA, 27 bp, Artificial sequence
  SiRNA target sequence
tcttatatttaagattgcttgtgtata

SEQ ID NO: 48771 - DNA, 27 bp, Artificial sequence
  SiRNA target sequence
cttatatttaagattgcttgtgtatat

SEQ ID NO: 48772 - DNA, 27 bp, Artificial sequence
  SiRNA target sequence
ttatatttaagattgcttgtgtatatc

SEQ ID NO: 48773 - DNA, 27 bp, Artificial sequence
  SiRNA target sequence
tatatttaagattgcttgtgtatatcg

SEQ ID NO: 48774 - DNA, 27 bp, Artificial sequence
  SiRNA target sequence
atatttaagattgcttgtgtatatcgt

SEQ ID NO: 48775 - DNA, 27 bp, Artificial sequence
  SiRNA target sequence
tatttaagattgcttgtgtatatcgtg

SEQ ID NO: 48776 - DNA, 27 bp, Artificial sequence
  SiRNA target sequence
atttaagattgcttgtgtatatcgtga

SEQ ID NO: 48777 - DNA, 27 bp, Artificial sequence
  SiRNA target sequence
tttaagattgcttgtgtatatcgtgag

SEQ ID NO: 48778 - DNA, 27 bp, Artificial sequence
  SiRNA target sequence
ttaagattgcttgtgtatatcgtgagt

SEQ ID NO: 48779 - DNA, 27 bp, Artificial sequence
  SiRNA target sequence
taagattgcttgtgtatatcgtgagta

SEQ ID NO: 48780 - DNA, 27 bp, Artificial sequence
  SiRNA target sequence
aagattgcttgtgtatatcgtgagtaa

SEQ ID NO: 48781 - DNA, 27 bp, Artificial sequence
  SiRNA target sequence
agattgcttgtgtatatcgtgagtaaa

SEQ ID NO: 48782 - DNA, 27 bp, Artificial sequence
  SiRNA target sequence
gattgcttgtgtatatcgtgagtaaaa

SEQ ID NO: 48783 - DNA, 27 bp, Artificial sequence
  SiRNA target sequence
attgcttgtgtatatcgtgagtaaaag

SEQ ID NO: 48784 - DNA, 27 bp, Artificial sequence
  SiRNA target sequence
ttgcttgtgtatatcgtgagtaaaaga

SEQ ID NO: 48785 - DNA, 27 bp, Artificial sequence
  SiRNA target sequence
tgcttgtgtatatcgtgagtaaaagaa

SEQ ID NO: 48786 - DNA, 27 bp, Artificial sequence
  SiRNA target sequence
gcttgtgtatatcgtgagtaaaagaac

SEQ ID NO: 48787 - DNA, 27 bp, Artificial sequence
  SiRNA target sequence
cttgtgtatatcgtgagtaaaagaacc

SEQ ID NO: 48788 - DNA, 27 bp, Artificial sequence
  SiRNA target sequence
ttgtgtatatcgtgagtaaaagaaccc

SEQ ID NO: 48789 - DNA, 27 bp, Artificial sequence
  SiRNA target sequence
tgtgtatatcgtgagtaaaagaaccct

SEQ ID NO: 48790 - DNA, 27 bp, Artificial sequence
  SiRNA target sequence
gtgtatatcgtgagtaaaagaacccta

SEQ ID NO: 48791 - DNA, 27 bp, Artificial sequence
  SiRNA target sequence
tgtatatcgtgagtaaaagaaccctaa

SEQ ID NO: 48792 - DNA, 27 bp, Artificial sequence
  SiRNA target sequence
gtatatcgtgagtaaaagaaccctaat

SEQ ID NO: 48793 - DNA, 27 bp, Artificial sequence
  SiRNA target sequence
tatatcgtgagtaaaagaaccctaatt

SEQ ID NO: 48794 - DNA, 27 bp, Artificial sequence
  SiRNA target sequence
atatcgtgagtaaaagaaccctaattg

SEQ ID NO: 48795 - DNA, 27 bp, Artificial sequence
  SiRNA target sequence
tatcgtgagtaaaagaaccctaattgt

SEQ ID NO: 48796 - DNA, 27 bp, Artificial sequence
  SiRNA target sequence
atcgtgagtaaaagaaccctaattgtc

SEQ ID NO: 48797 - DNA, 27 bp, Artificial sequence
  SiRNA target sequence
tcgtgagtaaaagaaccctaattgtcc

SEQ ID NO: 48798 - DNA, 27 bp, Artificial sequence
  SiRNA target sequence
cgtgagtaaaagaaccctaattgtcca

SEQ ID NO: 48799 - DNA, 27 bp, Artificial sequence
  SiRNA target sequence
gtgagtaaaagaaccctaattgtccaa

SEQ ID NO: 48800 - DNA, 27 bp, Artificial sequence
  SiRNA target sequence
tgagtaaaagaaccctaattgtccaaa

SEQ ID NO: 48801 - DNA, 27 bp, Artificial sequence
  SiRNA target sequence
gagtaaaagaaccctaattgtccaaaa

SEQ ID NO: 48802 - DNA, 27 bp, Artificial sequence
  SiRNA target sequence
agtaaaagaaccctaattgtccaaaac

SEQ ID NO: 48803 - DNA, 27 bp, Artificial sequence
  SiRNA target sequence
gtaaaagaaccctaattgtccaaaact

SEQ ID NO: 48804 - DNA, 27 bp, Artificial sequence
  SiRNA target sequence
taaaagaaccctaattgtccaaaactt

SEQ ID NO: 48805 - DNA, 27 bp, Artificial sequence
  SiRNA target sequence
aaaagaaccctaattgtccaaaacttg

SEQ ID NO: 48806 - DNA, 27 bp, Artificial sequence
  SiRNA target sequence
aaagaaccctaattgtccaaaacttga

SEQ ID NO: 48807 - DNA, 27 bp, Artificial sequence
  SiRNA target sequence
aagaaccctaattgtccaaaacttgaa

SEQ ID NO: 48808 - DNA, 27 bp, Artificial sequence
  SiRNA target sequence
agaaccctaattgtccaaaacttgaat

SEQ ID NO: 48809 - DNA, 27 bp, Artificial sequence
  SiRNA target sequence
gaaccctaattgtccaaaacttgaata

SEQ ID NO: 48810 - DNA, 27 bp, Artificial sequence
  SiRNA target sequence
aaccctaattgtccaaaacttgaatac

SEQ ID NO: 48811 - DNA, 27 bp, Artificial sequence
  SiRNA target sequence
accctaattgtccaaaacttgaataca

SEQ ID NO: 48812 - DNA, 27 bp, Artificial sequence
  SiRNA target sequence
ccctaattgtccaaaacttgaatacaa

SEQ ID NO: 48813 - DNA, 27 bp, Artificial sequence
  SiRNA target sequence
cctaattgtccaaaacttgaatacaat

SEQ ID NO: 48814 - DNA, 27 bp, Artificial sequence
  SiRNA target sequence
ctaattgtccaaaacttgaatacaatg

SEQ ID NO: 48815 - DNA, 27 bp, Artificial sequence
  SiRNA target sequence
taattgtccaaaacttgaatacaatgt

SEQ ID NO: 48816 - DNA, 27 bp, Artificial sequence
  SiRNA target sequence
aattgtccaaaacttgaatacaatgtt

SEQ ID NO: 48817 - DNA, 27 bp, Artificial sequence
  SiRNA target sequence
attgtccaaaacttgaatacaatgttc

SEQ ID NO: 48818 - DNA, 27 bp, Artificial sequence
  SiRNA target sequence
ttgtccaaaacttgaatacaatgttct

SEQ ID NO: 48819 - DNA, 27 bp, Artificial sequence
  SiRNA target sequence
tgtccaaaacttgaatacaatgttcta

SEQ ID NO: 48820 - DNA, 27 bp, Artificial sequence
  SiRNA target sequence
gtccaaaacttgaatacaatgttctat

SEQ ID NO: 48821 - DNA, 27 bp, Artificial sequence
  SiRNA target sequence
tccaaaacttgaatacaatgttctatt

SEQ ID NO: 48822 - DNA, 27 bp, Artificial sequence
  SiRNA target sequence
ccaaaacttgaatacaatgttctatta

SEQ ID NO: 48823 - DNA, 27 bp, Artificial sequence
  SiRNA target sequence
caaaacttgaatacaatgttctattaa

SEQ ID NO: 48824 - DNA, 27 bp, Artificial sequence
  SiRNA target sequence
aaaacttgaatacaatgttctattaat

SEQ ID NO: 48825 - DNA, 27 bp, Artificial sequence
  SiRNA target sequence
aaacttgaatacaatgttctattaatg

SEQ ID NO: 48826 - DNA, 27 bp, Artificial sequence
  SiRNA target sequence
aacttgaatacaatgttctattaatgc

SEQ ID NO: 48827 - DNA, 27 bp, Artificial sequence
  SiRNA target sequence
acttgaatacaatgttctattaatgcc

SEQ ID NO: 48828 - DNA, 27 bp, Artificial sequence
  SiRNA target sequence
cttgaatacaatgttctattaatgcca

SEQ ID NO: 48829 - DNA, 27 bp, Artificial sequence
  SiRNA target sequence
ttgaatacaatgttctattaatgccaa

SEQ ID NO: 48830 - DNA, 27 bp, Artificial sequence
  SiRNA target sequence
tgaatacaatgttctattaatgccaat

SEQ ID NO: 48831 - DNA, 27 bp, Artificial sequence
  SiRNA target sequence
gaatacaatgttctattaatgccaata

SEQ ID NO: 48832 - DNA, 27 bp, Artificial sequence
  SiRNA target sequence
aatacaatgttctattaatgccaatat

SEQ ID NO: 48833 - DNA, 27 bp, Artificial sequence
  SiRNA target sequence
atacaatgttctattaatgccaatata

SEQ ID NO: 48834 - DNA, 27 bp, Artificial sequence
  SiRNA target sequence
tacaatgttctattaatgccaatataa

SEQ ID NO: 48835 - DNA, 27 bp, Artificial sequence
  SiRNA target sequence
acaatgttctattaatgccaatataaa

SEQ ID NO: 48836 - DNA, 27 bp, Artificial sequence
  SiRNA target sequence
caatgttctattaatgccaatataaaa

SEQ ID NO: 48837 - DNA, 27 bp, Artificial sequence
  SiRNA target sequence
aatgttctattaatgccaatataaaat

SEQ ID NO: 48838 - DNA, 27 bp, Artificial sequence
  SiRNA target sequence
atgttctattaatgccaatataaaata

SEQ ID NO: 48839 - DNA, 27 bp, Artificial sequence
  SiRNA target sequence
tgttctattaatgccaatataaaatac

SEQ ID NO: 48840 - DNA, 27 bp, Artificial sequence
  SiRNA target sequence
gttctattaatgccaatataaaataca

SEQ ID NO: 48841 - DNA, 27 bp, Artificial sequence
  SiRNA target sequence
ttctattaatgccaatataaaatacaa

SEQ ID NO: 48842 - DNA, 27 bp, Artificial sequence
  SiRNA target sequence
tctattaatgccaatataaaatacaac

SEQ ID NO: 48843 - DNA, 27 bp, Artificial sequence
  SiRNA target sequence
ctattaatgccaatataaaatacaaca

SEQ ID NO: 48844 - DNA, 27 bp, Artificial sequence
  SiRNA target sequence
tattaatgccaatataaaatacaacat

SEQ ID NO: 48845 - DNA, 27 bp, Artificial sequence
  SiRNA target sequence
attaatgccaatataaaatacaacatc

SEQ ID NO: 48846 - DNA, 27 bp, Artificial sequence
  SiRNA target sequence
ttaatgccaatataaaatacaacatcc

SEQ ID NO: 48847 - DNA, 27 bp, Artificial sequence
  SiRNA target sequence
taatgccaatataaaatacaacatccc

SEQ ID NO: 48848 - DNA, 27 bp, Artificial sequence
  SiRNA target sequence
aatgccaatataaaatacaacatccct

SEQ ID NO: 48849 - DNA, 27 bp, Artificial sequence
  SiRNA target sequence
atgccaatataaaatacaacatccctg

SEQ ID NO: 48850 - DNA, 27 bp, Artificial sequence
  SiRNA target sequence
tgccaatataaaatacaacatccctgg

SEQ ID NO: 48851 - DNA, 27 bp, Artificial sequence
  SiRNA target sequence
gccaatataaaatacaacatccctggc

SEQ ID NO: 48852 - DNA, 27 bp, Artificial sequence
  SiRNA target sequence
ccaatataaaatacaacatccctggca

SEQ ID NO: 48853 - DNA, 27 bp, Artificial sequence
  SiRNA target sequence
caatataaaatacaacatccctggcac

SEQ ID NO: 48854 - DNA, 27 bp, Artificial sequence
  SiRNA target sequence
aatataaaatacaacatccctggcact

SEQ ID NO: 48855 - DNA, 27 bp, Artificial sequence
  SiRNA target sequence
atataaaatacaacatccctggcactt

SEQ ID NO: 48856 - DNA, 27 bp, Artificial sequence
  SiRNA target sequence
tataaaatacaacatccctggcactta

SEQ ID NO: 48857 - DNA, 27 bp, Artificial sequence
  SiRNA target sequence
ataaaatacaacatccctggcacttag

SEQ ID NO: 48858 - DNA, 27 bp, Artificial sequence
  SiRNA target sequence
taaaatacaacatccctggcacttagt

SEQ ID NO: 48859 - DNA, 27 bp, Artificial sequence
  SiRNA target sequence
aaaatacaacatccctggcacttagtt

SEQ ID NO: 48860 - DNA, 27 bp, Artificial sequence
  SiRNA target sequence
aaatacaacatccctggcacttagttt

SEQ ID NO: 48861 - DNA, 27 bp, Artificial sequence
  SiRNA target sequence
aatacaacatccctggcacttagtttt

SEQ ID NO: 48862 - DNA, 27 bp, Artificial sequence
  SiRNA target sequence
atacaacatccctggcacttagttttg

SEQ ID NO: 48863 - DNA, 27 bp, Artificial sequence
  SiRNA target sequence
tacaacatccctggcacttagttttgc

SEQ ID NO: 48864 - DNA, 27 bp, Artificial sequence
  SiRNA target sequence
acaacatccctggcacttagttttgct

SEQ ID NO: 48865 - DNA, 27 bp, Artificial sequence
  SiRNA target sequence
caacatccctggcacttagttttgctg

SEQ ID NO: 48866 - DNA, 27 bp, Artificial sequence
  SiRNA target sequence
aacatccctggcacttagttttgctgt

SEQ ID NO: 48867 - DNA, 27 bp, Artificial sequence
  SiRNA target sequence
acatccctggcacttagttttgctgtt

SEQ ID NO: 48868 - DNA, 27 bp, Artificial sequence
  SiRNA target sequence
catccctggcacttagttttgctgtta

SEQ ID NO: 48869 - DNA, 27 bp, Artificial sequence
  SiRNA target sequence
atccctggcacttagttttgctgttaa

SEQ ID NO: 48870 - DNA, 27 bp, Artificial sequence
  SiRNA target sequence
tccctggcacttagttttgctgttaat

SEQ ID NO: 48871 - DNA, 27 bp, Artificial sequence
  SiRNA target sequence
ccctggcacttagttttgctgttaata

SEQ ID NO: 48872 - DNA, 27 bp, Artificial sequence
  SiRNA target sequence
cctggcacttagttttgctgttaatat

SEQ ID NO: 48873 - DNA, 27 bp, Artificial sequence
  SiRNA target sequence
ctggcacttagttttgctgttaatatt

SEQ ID NO: 48874 - DNA, 27 bp, Artificial sequence
  SiRNA target sequence
tggcacttagttttgctgttaatattc

SEQ ID NO: 48875 - DNA, 27 bp, Artificial sequence
  SiRNA target sequence
ggcacttagttttgctgttaatattcc

SEQ ID NO: 48876 - DNA, 27 bp, Artificial sequence
  SiRNA target sequence
gcacttagttttgctgttaatattcca

SEQ ID NO: 48877 - DNA, 27 bp, Artificial sequence
  SiRNA target sequence
cacttagttttgctgttaatattccat

SEQ ID NO: 48878 - DNA, 27 bp, Artificial sequence
  SiRNA target sequence
acttagttttgctgttaatattccata

SEQ ID NO: 48879 - DNA, 27 bp, Artificial sequence
  SiRNA target sequence
cttagttttgctgttaatattccatag

SEQ ID NO: 48880 - DNA, 27 bp, Artificial sequence
  SiRNA target sequence
ttagttttgctgttaatattccatagt

SEQ ID NO: 48881 - DNA, 27 bp, Artificial sequence
  SiRNA target sequence
tagttttgctgttaatattccatagtt

SEQ ID NO: 48882 - DNA, 27 bp, Artificial sequence
  SiRNA target sequence
agttttgctgttaatattccatagttt

SEQ ID NO: 48883 - DNA, 27 bp, Artificial sequence
  SiRNA target sequence
gttttgctgttaatattccatagtttc

SEQ ID NO: 48884 - DNA, 27 bp, Artificial sequence
  SiRNA target sequence
ttttgctgttaatattccatagtttcc

SEQ ID NO: 48885 - DNA, 27 bp, Artificial sequence
  SiRNA target sequence
tttgctgttaatattccatagtttcct

SEQ ID NO: 48886 - DNA, 27 bp, Artificial sequence
  SiRNA target sequence
ttgctgttaatattccatagtttccta

SEQ ID NO: 48887 - DNA, 27 bp, Artificial sequence
  SiRNA target sequence
tgctgttaatattccatagtttcctaa

SEQ ID NO: 48888 - DNA, 27 bp, Artificial sequence
  SiRNA target sequence
gctgttaatattccatagtttcctaat

SEQ ID NO: 48889 - DNA, 27 bp, Artificial sequence
  SiRNA target sequence
ctgttaatattccatagtttcctaatg

SEQ ID NO: 48890 - DNA, 27 bp, Artificial sequence
  SiRNA target sequence
tgttaatattccatagtttcctaatgt

SEQ ID NO: 48891 - DNA, 27 bp, Artificial sequence
  SiRNA target sequence
gttaatattccatagtttcctaatgtt

SEQ ID NO: 48892 - DNA, 27 bp, Artificial sequence
  SiRNA target sequence
ttaatattccatagtttcctaatgtta

SEQ ID NO: 48893 - DNA, 27 bp, Artificial sequence
  SiRNA target sequence
taatattccatagtttcctaatgttat

SEQ ID NO: 48894 - DNA, 27 bp, Artificial sequence
  SiRNA target sequence
aatattccatagtttcctaatgttata

SEQ ID NO: 48895 - DNA, 27 bp, Artificial sequence
  SiRNA target sequence
atattccatagtttcctaatgttataa

SEQ ID NO: 48896 - DNA, 27 bp, Artificial sequence
  SiRNA target sequence
tattccatagtttcctaatgttataac

SEQ ID NO: 48897 - DNA, 27 bp, Artificial sequence
  SiRNA target sequence
attccatagtttcctaatgttataact

SEQ ID NO: 48898 - DNA, 27 bp, Artificial sequence
  SiRNA target sequence
ttccatagtttcctaatgttataacta

SEQ ID NO: 48899 - DNA, 27 bp, Artificial sequence
  SiRNA target sequence
tccatagtttcctaatgttataactat

SEQ ID NO: 48900 - DNA, 27 bp, Artificial sequence
  SiRNA target sequence
ccatagtttcctaatgttataactata

SEQ ID NO: 48901 - DNA, 27 bp, Artificial sequence
  SiRNA target sequence
catagtttcctaatgttataactataa

SEQ ID NO: 48902 - DNA, 27 bp, Artificial sequence
  SiRNA target sequence
atagtttcctaatgttataactataaa

SEQ ID NO: 48903 - DNA, 27 bp, Artificial sequence
  SiRNA target sequence
tagtttcctaatgttataactataaaa

SEQ ID NO: 48904 - DNA, 27 bp, Artificial sequence
  SiRNA target sequence
agtttcctaatgttataactataaaac

SEQ ID NO: 48905 - DNA, 27 bp, Artificial sequence
  SiRNA target sequence
gtttcctaatgttataactataaaaca

SEQ ID NO: 48906 - DNA, 27 bp, Artificial sequence
  SiRNA target sequence
tttcctaatgttataactataaaacac

SEQ ID NO: 48907 - DNA, 27 bp, Artificial sequence
  SiRNA target sequence
ttcctaatgttataactataaaacact

SEQ ID NO: 48908 - DNA, 27 bp, Artificial sequence
  SiRNA target sequence
tcctaatgttataactataaaacactg

SEQ ID NO: 48909 - DNA, 27 bp, Artificial sequence
  SiRNA target sequence
cctaatgttataactataaaacactgt

SEQ ID NO: 48910 - DNA, 27 bp, Artificial sequence
  SiRNA target sequence
ctaatgttataactataaaacactgta

SEQ ID NO: 48911 - DNA, 27 bp, Artificial sequence
  SiRNA target sequence
taatgttataactataaaacactgtaa

SEQ ID NO: 48912 - DNA, 27 bp, Artificial sequence
  SiRNA target sequence
aatgttataactataaaacactgtaaa

SEQ ID NO: 48913 - DNA, 27 bp, Artificial sequence
  SiRNA target sequence
atgttataactataaaacactgtaaag

SEQ ID NO: 48914 - DNA, 27 bp, Artificial sequence
  SiRNA target sequence
tgttataactataaaacactgtaaagc

SEQ ID NO: 48915 - DNA, 27 bp, Artificial sequence
  SiRNA target sequence
gttataactataaaacactgtaaagca

SEQ ID NO: 48916 - DNA, 27 bp, Artificial sequence
  SiRNA target sequence
ttataactataaaacactgtaaagcaa

SEQ ID NO: 48917 - DNA, 27 bp, Artificial sequence
  SiRNA target sequence
tataactataaaacactgtaaagcaaa

SEQ ID NO: 48918 - DNA, 27 bp, Artificial sequence
  SiRNA target sequence
ataactataaaacactgtaaagcaaaa

SEQ ID NO: 48919 - DNA, 27 bp, Artificial sequence
  SiRNA target sequence
taactataaaacactgtaaagcaaaaa

SEQ ID NO: 48920 - DNA, 27 bp, Artificial sequence
  SiRNA target sequence
aactataaaacactgtaaagcaaaaat

SEQ ID NO: 48921 - DNA, 27 bp, Artificial sequence
  SiRNA target sequence
actataaaacactgtaaagcaaaaatt

SEQ ID NO: 48922 - DNA, 27 bp, Artificial sequence
  SiRNA target sequence
ctataaaacactgtaaagcaaaaatta

SEQ ID NO: 48923 - DNA, 27 bp, Artificial sequence
  SiRNA target sequence
tataaaacactgtaaagcaaaaattat

SEQ ID NO: 48924 - DNA, 27 bp, Artificial sequence
  SiRNA target sequence
ataaaacactgtaaagcaaaaattatc

SEQ ID NO: 48925 - DNA, 27 bp, Artificial sequence
  SiRNA target sequence
taaaacactgtaaagcaaaaattatct

SEQ ID NO: 48926 - DNA, 27 bp, Artificial sequence
  SiRNA target sequence
aaaacactgtaaagcaaaaattatctt

SEQ ID NO: 48927 - DNA, 27 bp, Artificial sequence
  SiRNA target sequence
aaacactgtaaagcaaaaattatctta

SEQ ID NO: 48928 - DNA, 27 bp, Artificial sequence
  SiRNA target sequence
aacactgtaaagcaaaaattatcttat

SEQ ID NO: 48929 - DNA, 27 bp, Artificial sequence
  SiRNA target sequence
acactgtaaagcaaaaattatcttatt

SEQ ID NO: 48930 - DNA, 27 bp, Artificial sequence
  SiRNA target sequence
cactgtaaagcaaaaattatcttattt

SEQ ID NO: 48931 - DNA, 27 bp, Artificial sequence
  SiRNA target sequence
actgtaaagcaaaaattatcttattta

SEQ ID NO: 48932 - DNA, 27 bp, Artificial sequence
  SiRNA target sequence
ctgtaaagcaaaaattatcttatttac

SEQ ID NO: 48933 - DNA, 27 bp, Artificial sequence
  SiRNA target sequence
tgtaaagcaaaaattatcttatttaca

SEQ ID NO: 48934 - DNA, 27 bp, Artificial sequence
  SiRNA target sequence
gtaaagcaaaaattatcttatttacaa

SEQ ID NO: 48935 - DNA, 27 bp, Artificial sequence
  SiRNA target sequence
taaagcaaaaattatcttatttacaag

SEQ ID NO: 48936 - DNA, 27 bp, Artificial sequence
  SiRNA target sequence
aaagcaaaaattatcttatttacaagg

SEQ ID NO: 48937 - DNA, 27 bp, Artificial sequence
  SiRNA target sequence
aagcaaaaattatcttatttacaaggt

SEQ ID NO: 48938 - DNA, 27 bp, Artificial sequence
  SiRNA target sequence
agcaaaaattatcttatttacaaggta

SEQ ID NO: 48939 - DNA, 27 bp, Artificial sequence
  SiRNA target sequence
gcaaaaattatcttatttacaaggtat

SEQ ID NO: 48940 - DNA, 27 bp, Artificial sequence
  SiRNA target sequence
caaaaattatcttatttacaaggtata

SEQ ID NO: 48941 - DNA, 27 bp, Artificial sequence
  SiRNA target sequence
aaaaattatcttatttacaaggtataa

SEQ ID NO: 48942 - DNA, 27 bp, Artificial sequence
  SiRNA target sequence
aaaattatcttatttacaaggtataaa

SEQ ID NO: 48943 - DNA, 27 bp, Artificial sequence
  SiRNA target sequence
aaattatcttatttacaaggtataaaa

SEQ ID NO: 48944 - DNA, 27 bp, Artificial sequence
  SiRNA target sequence
aattatcttatttacaaggtataaaaa

SEQ ID NO: 48945 - DNA, 27 bp, Artificial sequence
  SiRNA target sequence
attatcttatttacaaggtataaaaaa

SEQ ID NO: 48946 - DNA, 27 bp, Artificial sequence
  SiRNA target sequence
ttatcttatttacaaggtataaaaaac

SEQ ID NO: 48947 - DNA, 27 bp, Artificial sequence
  SiRNA target sequence
tatcttatttacaaggtataaaaaact

SEQ ID NO: 48948 - DNA, 27 bp, Artificial sequence
  SiRNA target sequence
atcttatttacaaggtataaaaaacta

SEQ ID NO: 48949 - DNA, 27 bp, Artificial sequence
  SiRNA target sequence
tcttatttacaaggtataaaaaactaa

SEQ ID NO: 48950 - DNA, 27 bp, Artificial sequence
  SiRNA target sequence
cttatttacaaggtataaaaaactaag

SEQ ID NO: 48951 - DNA, 27 bp, Artificial sequence
  SiRNA target sequence
ttatttacaaggtataaaaaactaaga

SEQ ID NO: 48952 - DNA, 27 bp, Artificial sequence
  SiRNA target sequence
tatttacaaggtataaaaaactaagag

SEQ ID NO: 48953 - DNA, 27 bp, Artificial sequence
  SiRNA target sequence
atttacaaggtataaaaaactaagaga

SEQ ID NO: 48954 - DNA, 27 bp, Artificial sequence
  SiRNA target sequence
tttacaaggtataaaaaactaagagat

SEQ ID NO: 48955 - DNA, 27 bp, Artificial sequence
  SiRNA target sequence
ttacaaggtataaaaaactaagagatc

SEQ ID NO: 48956 - DNA, 27 bp, Artificial sequence
  SiRNA target sequence
tacaaggtataaaaaactaagagatct

SEQ ID NO: 48957 - DNA, 27 bp, Artificial sequence
  SiRNA target sequence
acaaggtataaaaaactaagagatctc

SEQ ID NO: 48958 - DNA, 27 bp, Artificial sequence
  SiRNA target sequence
caaggtataaaaaactaagagatctcc

SEQ ID NO: 48959 - DNA, 27 bp, Artificial sequence
  SiRNA target sequence
aaggtataaaaaactaagagatctcca

SEQ ID NO: 48960 - DNA, 27 bp, Artificial sequence
  SiRNA target sequence
aggtataaaaaactaagagatctccag

SEQ ID NO: 48961 - DNA, 27 bp, Artificial sequence
  SiRNA target sequence
ggtataaaaaactaagagatctccaga

SEQ ID NO: 48962 - DNA, 27 bp, Artificial sequence
  SiRNA target sequence
gtataaaaaactaagagatctccagat

SEQ ID NO: 48963 - DNA, 27 bp, Artificial sequence
  SiRNA target sequence
tataaaaaactaagagatctccagatt

SEQ ID NO: 48964 - DNA, 27 bp, Artificial sequence
  SiRNA target sequence
ataaaaaactaagagatctccagattc

SEQ ID NO: 48965 - DNA, 27 bp, Artificial sequence
  SiRNA target sequence
taaaaaactaagagatctccagattct

SEQ ID NO: 48966 - DNA, 27 bp, Artificial sequence
  SiRNA target sequence
aaaaaactaagagatctccagattctg

SEQ ID NO: 48967 - DNA, 27 bp, Artificial sequence
  SiRNA target sequence
aaaaactaagagatctccagattctgt

SEQ ID NO: 48968 - DNA, 27 bp, Artificial sequence
  SiRNA target sequence
aaaactaagagatctccagattctgtt

SEQ ID NO: 48969 - DNA, 27 bp, Artificial sequence
  SiRNA target sequence
aaactaagagatctccagattctgtta

SEQ ID NO: 48970 - DNA, 27 bp, Artificial sequence
  SiRNA target sequence
aactaagagatctccagattctgttac

SEQ ID NO: 48971 - DNA, 27 bp, Artificial sequence
  SiRNA target sequence
actaagagatctccagattctgttaca

SEQ ID NO: 48972 - DNA, 27 bp, Artificial sequence
  SiRNA target sequence
ctaagagatctccagattctgttacat

SEQ ID NO: 48973 - DNA, 27 bp, Artificial sequence
  SiRNA target sequence
taagagatctccagattctgttacatt

SEQ ID NO: 48974 - DNA, 27 bp, Artificial sequence
  SiRNA target sequence
aagagatctccagattctgttacattc

SEQ ID NO: 48975 - DNA, 27 bp, Artificial sequence
  SiRNA target sequence
agagatctccagattctgttacattcc

SEQ ID NO: 48976 - DNA, 27 bp, Artificial sequence
  SiRNA target sequence
gagatctccagattctgttacattccg

SEQ ID NO: 48977 - DNA, 27 bp, Artificial sequence
  SiRNA target sequence
agatctccagattctgttacattccga

SEQ ID NO: 48978 - DNA, 27 bp, Artificial sequence
  SiRNA target sequence
gatctccagattctgttacattccgat

SEQ ID NO: 48979 - DNA, 27 bp, Artificial sequence
  SiRNA target sequence
atctccagattctgttacattccgatt

SEQ ID NO: 48980 - DNA, 27 bp, Artificial sequence
  SiRNA target sequence
tctccagattctgttacattccgattc

SEQ ID NO: 48981 - DNA, 27 bp, Artificial sequence
  SiRNA target sequence
ctccagattctgttacattccgattct

SEQ ID NO: 48982 - DNA, 27 bp, Artificial sequence
  SiRNA target sequence
tccagattctgttacattccgattcta

SEQ ID NO: 48983 - DNA, 27 bp, Artificial sequence
  SiRNA target sequence
ccagattctgttacattccgattctac

SEQ ID NO: 48984 - DNA, 27 bp, Artificial sequence
  SiRNA target sequence
cagattctgttacattccgattctact

SEQ ID NO: 48985 - DNA, 27 bp, Artificial sequence
  SiRNA target sequence
agattctgttacattccgattctactt

SEQ ID NO: 48986 - DNA, 27 bp, Artificial sequence
  SiRNA target sequence
gattctgttacattccgattctacttc

SEQ ID NO: 48987 - DNA, 27 bp, Artificial sequence
  SiRNA target sequence
attctgttacattccgattctacttca

SEQ ID NO: 48988 - DNA, 27 bp, Artificial sequence
  SiRNA target sequence
ttctgttacattccgattctacttcag

SEQ ID NO: 48989 - DNA, 27 bp, Artificial sequence
  SiRNA target sequence
tctgttacattccgattctacttcaga

SEQ ID NO: 48990 - DNA, 27 bp, Artificial sequence
  SiRNA target sequence
ctgttacattccgattctacttcagaa

SEQ ID NO: 48991 - DNA, 27 bp, Artificial sequence
  SiRNA target sequence
tgttacattccgattctacttcagaaa

SEQ ID NO: 48992 - DNA, 27 bp, Artificial sequence
  SiRNA target sequence
gttacattccgattctacttcagaaac

SEQ ID NO: 48993 - DNA, 27 bp, Artificial sequence
  SiRNA target sequence
ttacattccgattctacttcagaaaca

SEQ ID NO: 48994 - DNA, 27 bp, Artificial sequence
  SiRNA target sequence
tacattccgattctacttcagaaacat

SEQ ID NO: 48995 - DNA, 27 bp, Artificial sequence
  SiRNA target sequence
acattccgattctacttcagaaacata

SEQ ID NO: 48996 - DNA, 27 bp, Artificial sequence
  SiRNA target sequence
cattccgattctacttcagaaacatat

SEQ ID NO: 48997 - DNA, 27 bp, Artificial sequence
  SiRNA target sequence
attccgattctacttcagaaacatatt

SEQ ID NO: 48998 - DNA, 27 bp, Artificial sequence
  SiRNA target sequence
ttccgattctacttcagaaacatattt

SEQ ID NO: 48999 - DNA, 27 bp, Artificial sequence
  SiRNA target sequence
tccgattctacttcagaaacatatttt

SEQ ID NO: 49000 - DNA, 27 bp, Artificial sequence
  SiRNA target sequence
ccgattctacttcagaaacatattttt

SEQ ID NO: 49001 - DNA, 27 bp, Artificial sequence
  SiRNA target sequence
cgattctacttcagaaacatatttttc

SEQ ID NO: 49002 - DNA, 27 bp, Artificial sequence
  SiRNA target sequence
gattctacttcagaaacatatttttca

SEQ ID NO: 49003 - DNA, 27 bp, Artificial sequence
  SiRNA target sequence
attctacttcagaaacatatttttcat

SEQ ID NO: 49004 - DNA, 27 bp, Artificial sequence
  SiRNA target sequence
ttctacttcagaaacatatttttcata

SEQ ID NO: 49005 - DNA, 27 bp, Artificial sequence
  SiRNA target sequence
tctacttcagaaacatatttttcatat

SEQ ID NO: 49006 - DNA, 27 bp, Artificial sequence
  SiRNA target sequence
ctacttcagaaacatatttttcatatt

SEQ ID NO: 49007 - DNA, 27 bp, Artificial sequence
  SiRNA target sequence
tacttcagaaacatatttttcatattt

SEQ ID NO: 49008 - DNA, 27 bp, Artificial sequence
  SiRNA target sequence
acttcagaaacatatttttcatattta

SEQ ID NO: 49009 - DNA, 27 bp, Artificial sequence
  SiRNA target sequence
cttcagaaacatatttttcatatttaa

SEQ ID NO: 49010 - DNA, 27 bp, Artificial sequence
  SiRNA target sequence
ttcagaaacatatttttcatatttaag

SEQ ID NO: 49011 - DNA, 27 bp, Artificial sequence
  SiRNA target sequence
tcagaaacatatttttcatatttaagc

SEQ ID NO: 49012 - DNA, 27 bp, Artificial sequence
  SiRNA target sequence
cagaaacatatttttcatatttaagcg

SEQ ID NO: 49013 - DNA, 27 bp, Artificial sequence
  SiRNA target sequence
agaaacatatttttcatatttaagcga

SEQ ID NO: 49014 - DNA, 27 bp, Artificial sequence
  SiRNA target sequence
gaaacatatttttcatatttaagcgat

SEQ ID NO: 49015 - DNA, 27 bp, Artificial sequence
  SiRNA target sequence
aaacatatttttcatatttaagcgatt

SEQ ID NO: 49016 - DNA, 27 bp, Artificial sequence
  SiRNA target sequence
aacatatttttcatatttaagcgattc

SEQ ID NO: 49017 - DNA, 27 bp, Artificial sequence
  SiRNA target sequence
acatatttttcatatttaagcgattct

SEQ ID NO: 49018 - DNA, 27 bp, Artificial sequence
  SiRNA target sequence
catatttttcatatttaagcgattctt

SEQ ID NO: 49019 - DNA, 27 bp, Artificial sequence
  SiRNA target sequence
atatttttcatatttaagcgattcttc

SEQ ID NO: 49020 - DNA, 27 bp, Artificial sequence
  SiRNA target sequence
tatttttcatatttaagcgattcttct

SEQ ID NO: 49021 - DNA, 27 bp, Artificial sequence
  SiRNA target sequence
atttttcatatttaagcgattcttctt

SEQ ID NO: 49022 - DNA, 27 bp, Artificial sequence
  SiRNA target sequence
tttttcatatttaagcgattcttcttc

SEQ ID NO: 49023 - DNA, 27 bp, Artificial sequence
  SiRNA target sequence
ttttcatatttaagcgattcttcttct

SEQ ID NO: 49024 - DNA, 27 bp, Artificial sequence
  SiRNA target sequence
tttcatatttaagcgattcttcttctt

SEQ ID NO: 49025 - DNA, 27 bp, Artificial sequence
  SiRNA target sequence
ttcatatttaagcgattcttcttcttc

SEQ ID NO: 49026 - DNA, 27 bp, Artificial sequence
  SiRNA target sequence
tcatatttaagcgattcttcttcttct

SEQ ID NO: 49027 - DNA, 27 bp, Artificial sequence
  SiRNA target sequence
catatttaagcgattcttcttcttctg

SEQ ID NO: 49028 - DNA, 27 bp, Artificial sequence
  SiRNA target sequence
atatttaagcgattcttcttcttctgt

SEQ ID NO: 49029 - DNA, 27 bp, Artificial sequence
  SiRNA target sequence
tatttaagcgattcttcttcttctgtt

SEQ ID NO: 49030 - DNA, 27 bp, Artificial sequence
  SiRNA target sequence
atttaagcgattcttcttcttctgttt

SEQ ID NO: 49031 - DNA, 27 bp, Artificial sequence
  SiRNA target sequence
tttaagcgattcttcttcttctgtttt

SEQ ID NO: 49032 - DNA, 27 bp, Artificial sequence
  SiRNA target sequence
ttaagcgattcttcttcttctgtttta

SEQ ID NO: 49033 - DNA, 27 bp, Artificial sequence
  SiRNA target sequence
taagcgattcttcttcttctgttttat

SEQ ID NO: 49034 - DNA, 27 bp, Artificial sequence
  SiRNA target sequence
aagcgattcttcttcttctgttttata

SEQ ID NO: 49035 - DNA, 27 bp, Artificial sequence
  SiRNA target sequence
agcgattcttcttcttctgttttatat

SEQ ID NO: 49036 - DNA, 27 bp, Artificial sequence
  SiRNA target sequence
gcgattcttcttcttctgttttatatg

SEQ ID NO: 49037 - DNA, 27 bp, Artificial sequence
  SiRNA target sequence
cgattcttcttcttctgttttatatgc

SEQ ID NO: 49038 - DNA, 27 bp, Artificial sequence
  SiRNA target sequence
gattcttcttcttctgttttatatgct

SEQ ID NO: 49039 - DNA, 27 bp, Artificial sequence
  SiRNA target sequence
attcttcttcttctgttttatatgcta

SEQ ID NO: 49040 - DNA, 27 bp, Artificial sequence
  SiRNA target sequence
ttcttcttcttctgttttatatgctag

SEQ ID NO: 49041 - DNA, 27 bp, Artificial sequence
  SiRNA target sequence
tcttcttcttctgttttatatgctagt

SEQ ID NO: 49042 - DNA, 27 bp, Artificial sequence
  SiRNA target sequence
cttcttcttctgttttatatgctagta

SEQ ID NO: 49043 - DNA, 27 bp, Artificial sequence
  SiRNA target sequence
ttcttcttctgttttatatgctagtat

SEQ ID NO: 49044 - DNA, 27 bp, Artificial sequence
  SiRNA target sequence
tcttcttctgttttatatgctagtata

SEQ ID NO: 49045 - DNA, 27 bp, Artificial sequence
  SiRNA target sequence
cttcttctgttttatatgctagtatag

SEQ ID NO: 49046 - DNA, 27 bp, Artificial sequence
  SiRNA target sequence
ttcttctgttttatatgctagtatagt

SEQ ID NO: 49047 - DNA, 27 bp, Artificial sequence
  SiRNA target sequence
tcttctgttttatatgctagtatagtc

SEQ ID NO: 49048 - DNA, 27 bp, Artificial sequence
  SiRNA target sequence
cttctgttttatatgctagtatagtct

SEQ ID NO: 49049 - DNA, 27 bp, Artificial sequence
  SiRNA target sequence
ttctgttttatatgctagtatagtctc

SEQ ID NO: 49050 - DNA, 27 bp, Artificial sequence
  SiRNA target sequence
tctgttttatatgctagtatagtctca

SEQ ID NO: 49051 - DNA, 27 bp, Artificial sequence
  SiRNA target sequence
ctgttttatatgctagtatagtctcat

SEQ ID NO: 49052 - DNA, 27 bp, Artificial sequence
  SiRNA target sequence
tgttttatatgctagtatagtctcatg

SEQ ID NO: 49053 - DNA, 27 bp, Artificial sequence
  SiRNA target sequence
gttttatatgctagtatagtctcatga

SEQ ID NO: 49054 - DNA, 27 bp, Artificial sequence
  SiRNA target sequence
ttttatatgctagtatagtctcatgat

SEQ ID NO: 49055 - DNA, 27 bp, Artificial sequence
  SiRNA target sequence
tttatatgctagtatagtctcatgatt

SEQ ID NO: 49056 - DNA, 27 bp, Artificial sequence
  SiRNA target sequence
ttatatgctagtatagtctcatgatta

SEQ ID NO: 49057 - DNA, 27 bp, Artificial sequence
  SiRNA target sequence
tatatgctagtatagtctcatgattaa

SEQ ID NO: 49058 - DNA, 27 bp, Artificial sequence
  SiRNA target sequence
atatgctagtatagtctcatgattaat

SEQ ID NO: 49059 - DNA, 27 bp, Artificial sequence
  SiRNA target sequence
tatgctagtatagtctcatgattaatt

SEQ ID NO: 49060 - DNA, 27 bp, Artificial sequence
  SiRNA target sequence
atgctagtatagtctcatgattaatta

SEQ ID NO: 49061 - DNA, 27 bp, Artificial sequence
  SiRNA target sequence
tgctagtatagtctcatgattaattaa

SEQ ID NO: 49062 - DNA, 27 bp, Artificial sequence
  SiRNA target sequence
gctagtatagtctcatgattaattaaa

SEQ ID NO: 49063 - DNA, 27 bp, Artificial sequence
  SiRNA target sequence
ctagtatagtctcatgattaattaaag

SEQ ID NO: 49064 - DNA, 27 bp, Artificial sequence
  SiRNA target sequence
tagtatagtctcatgattaattaaaga

SEQ ID NO: 49065 - DNA, 27 bp, Artificial sequence
  SiRNA target sequence
agtatagtctcatgattaattaaagaa

SEQ ID NO: 49066 - DNA, 27 bp, Artificial sequence
  SiRNA target sequence
gtatagtctcatgattaattaaagaat

SEQ ID NO: 49067 - DNA, 27 bp, Artificial sequence
  SiRNA target sequence
tatagtctcatgattaattaaagaatc

SEQ ID NO: 49068 - DNA, 27 bp, Artificial sequence
  SiRNA target sequence
atagtctcatgattaattaaagaatca

SEQ ID NO: 49069 - DNA, 27 bp, Artificial sequence
  SiRNA target sequence
tagtctcatgattaattaaagaatcat

SEQ ID NO: 49070 - DNA, 27 bp, Artificial sequence
  SiRNA target sequence
agtctcatgattaattaaagaatcatg

SEQ ID NO: 49071 - DNA, 27 bp, Artificial sequence
  SiRNA target sequence
gtctcatgattaattaaagaatcatgt

SEQ ID NO: 49072 - DNA, 27 bp, Artificial sequence
  SiRNA target sequence
tctcatgattaattaaagaatcatgta

SEQ ID NO: 49073 - DNA, 27 bp, Artificial sequence
  SiRNA target sequence
ctcatgattaattaaagaatcatgtaa

SEQ ID NO: 49074 - DNA, 27 bp, Artificial sequence
  SiRNA target sequence
tcatgattaattaaagaatcatgtaag

SEQ ID NO: 49075 - DNA, 27 bp, Artificial sequence
  SiRNA target sequence
catgattaattaaagaatcatgtaagt

SEQ ID NO: 49076 - DNA, 27 bp, Artificial sequence
  SiRNA target sequence
atgattaattaaagaatcatgtaagtg

SEQ ID NO: 49077 - DNA, 27 bp, Artificial sequence
  SiRNA target sequence
tgattaattaaagaatcatgtaagtga

SEQ ID NO: 49078 - DNA, 27 bp, Artificial sequence
  SiRNA target sequence
gattaattaaagaatcatgtaagtgat

SEQ ID NO: 49079 - DNA, 27 bp, Artificial sequence
  SiRNA target sequence
attaattaaagaatcatgtaagtgatt

SEQ ID NO: 49080 - DNA, 27 bp, Artificial sequence
  SiRNA target sequence
ttaattaaagaatcatgtaagtgattt

SEQ ID NO: 49081 - DNA, 27 bp, Artificial sequence
  SiRNA target sequence
taattaaagaatcatgtaagtgatttg

SEQ ID NO: 49082 - DNA, 27 bp, Artificial sequence
  SiRNA target sequence
aattaaagaatcatgtaagtgatttga

SEQ ID NO: 49083 - DNA, 27 bp, Artificial sequence
  SiRNA target sequence
attaaagaatcatgtaagtgatttgag

SEQ ID NO: 49084 - DNA, 27 bp, Artificial sequence
  SiRNA target sequence
ttaaagaatcatgtaagtgatttgagc

SEQ ID NO: 49085 - DNA, 27 bp, Artificial sequence
  SiRNA target sequence
taaagaatcatgtaagtgatttgagca

SEQ ID NO: 49086 - DNA, 27 bp, Artificial sequence
  SiRNA target sequence
aaagaatcatgtaagtgatttgagcat

SEQ ID NO: 49087 - DNA, 27 bp, Artificial sequence
  SiRNA target sequence
aagaatcatgtaagtgatttgagcatc

SEQ ID NO: 49088 - DNA, 27 bp, Artificial sequence
  SiRNA target sequence
agaatcatgtaagtgatttgagcatct

SEQ ID NO: 49089 - DNA, 27 bp, Artificial sequence
  SiRNA target sequence
gaatcatgtaagtgatttgagcatctt

SEQ ID NO: 49090 - DNA, 27 bp, Artificial sequence
  SiRNA target sequence
aatcatgtaagtgatttgagcatcttt

SEQ ID NO: 49091 - DNA, 27 bp, Artificial sequence
  SiRNA target sequence
atcatgtaagtgatttgagcatctttg

SEQ ID NO: 49092 - DNA, 27 bp, Artificial sequence
  SiRNA target sequence
tcatgtaagtgatttgagcatctttgt

SEQ ID NO: 49093 - DNA, 27 bp, Artificial sequence
  SiRNA target sequence
catgtaagtgatttgagcatctttgtt

SEQ ID NO: 49094 - DNA, 27 bp, Artificial sequence
  SiRNA target sequence
atgtaagtgatttgagcatctttgttg

SEQ ID NO: 49095 - DNA, 27 bp, Artificial sequence
  SiRNA target sequence
tgtaagtgatttgagcatctttgttgt

SEQ ID NO: 49096 - DNA, 27 bp, Artificial sequence
  SiRNA target sequence
gtaagtgatttgagcatctttgttgtg

SEQ ID NO: 49097 - DNA, 27 bp, Artificial sequence
  SiRNA target sequence
taagtgatttgagcatctttgttgtgc

SEQ ID NO: 49098 - DNA, 27 bp, Artificial sequence
  SiRNA target sequence
aagtgatttgagcatctttgttgtgcg

SEQ ID NO: 49099 - DNA, 27 bp, Artificial sequence
  SiRNA target sequence
agtgatttgagcatctttgttgtgcgc

SEQ ID NO: 49100 - DNA, 27 bp, Artificial sequence
  SiRNA target sequence
gtgatttgagcatctttgttgtgcgca

SEQ ID NO: 49101 - DNA, 27 bp, Artificial sequence
  SiRNA target sequence
tgatttgagcatctttgttgtgcgcaa

SEQ ID NO: 49102 - DNA, 27 bp, Artificial sequence
  SiRNA target sequence
gatttgagcatctttgttgtgcgcaat

SEQ ID NO: 49103 - DNA, 27 bp, Artificial sequence
  SiRNA target sequence
atttgagcatctttgttgtgcgcaatt

SEQ ID NO: 49104 - DNA, 27 bp, Artificial sequence
  SiRNA target sequence
tttgagcatctttgttgtgcgcaatta

SEQ ID NO: 49105 - DNA, 27 bp, Artificial sequence
  SiRNA target sequence
ttgagcatctttgttgtgcgcaattat

SEQ ID NO: 49106 - DNA, 27 bp, Artificial sequence
  SiRNA target sequence
tgagcatctttgttgtgcgcaattata

SEQ ID NO: 49107 - DNA, 27 bp, Artificial sequence
  SiRNA target sequence
gagcatctttgttgtgcgcaattatat

SEQ ID NO: 49108 - DNA, 27 bp, Artificial sequence
  SiRNA target sequence
agcatctttgttgtgcgcaattatatt

SEQ ID NO: 49109 - DNA, 27 bp, Artificial sequence
  SiRNA target sequence
gcatctttgttgtgcgcaattatattc

SEQ ID NO: 49110 - DNA, 27 bp, Artificial sequence
  SiRNA target sequence
catctttgttgtgcgcaattatattct

SEQ ID NO: 49111 - DNA, 27 bp, Artificial sequence
  SiRNA target sequence
atctttgttgtgcgcaattatattctt

SEQ ID NO: 49112 - DNA, 27 bp, Artificial sequence
  SiRNA target sequence
tctttgttgtgcgcaattatattcttt

SEQ ID NO: 49113 - DNA, 27 bp, Artificial sequence
  SiRNA target sequence
ctttgttgtgcgcaattatattctttt

SEQ ID NO: 49114 - DNA, 27 bp, Artificial sequence
  SiRNA target sequence
tttgttgtgcgcaattatattcttttc

SEQ ID NO: 49115 - DNA, 27 bp, Artificial sequence
  SiRNA target sequence
ttgttgtgcgcaattatattcttttct

SEQ ID NO: 49116 - DNA, 27 bp, Artificial sequence
  SiRNA target sequence
tgttgtgcgcaattatattcttttctt

SEQ ID NO: 49117 - DNA, 27 bp, Artificial sequence
  SiRNA target sequence
gttgtgcgcaattatattcttttctta

SEQ ID NO: 49118 - DNA, 27 bp, Artificial sequence
  SiRNA target sequence
ttgtgcgcaattatattcttttcttat

SEQ ID NO: 49119 - DNA, 27 bp, Artificial sequence
  SiRNA target sequence
tgtgcgcaattatattcttttcttatt

SEQ ID NO: 49120 - DNA, 27 bp, Artificial sequence
  SiRNA target sequence
gtgcgcaattatattcttttcttattc

SEQ ID NO: 49121 - DNA, 27 bp, Artificial sequence
  SiRNA target sequence
tgcgcaattatattcttttcttattcc

SEQ ID NO: 49122 - DNA, 27 bp, Artificial sequence
  SiRNA target sequence
gcgcaattatattcttttcttattcct

SEQ ID NO: 49123 - DNA, 27 bp, Artificial sequence
  SiRNA target sequence
cgcaattatattcttttcttattcctg

SEQ ID NO: 49124 - DNA, 27 bp, Artificial sequence
  SiRNA target sequence
gcaattatattcttttcttattcctgt

SEQ ID NO: 49125 - DNA, 27 bp, Artificial sequence
  SiRNA target sequence
caattatattcttttcttattcctgta

SEQ ID NO: 49126 - DNA, 27 bp, Artificial sequence
  SiRNA target sequence
aattatattcttttcttattcctgtac

SEQ ID NO: 49127 - DNA, 27 bp, Artificial sequence
  SiRNA target sequence
attatattcttttcttattcctgtacg

SEQ ID NO: 49128 - DNA, 27 bp, Artificial sequence
  SiRNA target sequence
ttatattcttttcttattcctgtacgc

SEQ ID NO: 49129 - DNA, 27 bp, Artificial sequence
  SiRNA target sequence
tatattcttttcttattcctgtacgcc

SEQ ID NO: 49130 - DNA, 27 bp, Artificial sequence
  SiRNA target sequence
atattcttttcttattcctgtacgcca

SEQ ID NO: 49131 - DNA, 27 bp, Artificial sequence
  SiRNA target sequence
tattcttttcttattcctgtacgccaa

SEQ ID NO: 49132 - DNA, 27 bp, Artificial sequence
  SiRNA target sequence
attcttttcttattcctgtacgccaat

SEQ ID NO: 49133 - DNA, 27 bp, Artificial sequence
  SiRNA target sequence
ttcttttcttattcctgtacgccaatg

SEQ ID NO: 49134 - DNA, 27 bp, Artificial sequence
  SiRNA target sequence
tcttttcttattcctgtacgccaatga

SEQ ID NO: 49135 - DNA, 27 bp, Artificial sequence
  SiRNA target sequence
cttttcttattcctgtacgccaatgaa

SEQ ID NO: 49136 - DNA, 27 bp, Artificial sequence
  SiRNA target sequence
ttttcttattcctgtacgccaatgaac

SEQ ID NO: 49137 - DNA, 27 bp, Artificial sequence
  SiRNA target sequence
tttcttattcctgtacgccaatgaact

SEQ ID NO: 49138 - DNA, 27 bp, Artificial sequence
  SiRNA target sequence
ttcttattcctgtacgccaatgaacta

SEQ ID NO: 49139 - DNA, 27 bp, Artificial sequence
  SiRNA target sequence
tcttattcctgtacgccaatgaactat

SEQ ID NO: 49140 - DNA, 27 bp, Artificial sequence
  SiRNA target sequence
cttattcctgtacgccaatgaactatt

SEQ ID NO: 49141 - DNA, 27 bp, Artificial sequence
  SiRNA target sequence
ttattcctgtacgccaatgaactattt

SEQ ID NO: 49142 - DNA, 27 bp, Artificial sequence
  SiRNA target sequence
tattcctgtacgccaatgaactatttt

SEQ ID NO: 49143 - DNA, 27 bp, Artificial sequence
  SiRNA target sequence
attcctgtacgccaatgaactattttc

SEQ ID NO: 49144 - DNA, 27 bp, Artificial sequence
  SiRNA target sequence
ttcctgtacgccaatgaactattttcg

SEQ ID NO: 49145 - DNA, 27 bp, Artificial sequence
  SiRNA target sequence
tcctgtacgccaatgaactattttcgc

SEQ ID NO: 49146 - DNA, 27 bp, Artificial sequence
  SiRNA target sequence
cctgtacgccaatgaactattttcgca

SEQ ID NO: 49147 - DNA, 27 bp, Artificial sequence
  SiRNA target sequence
ctgtacgccaatgaactattttcgcag

SEQ ID NO: 49148 - DNA, 27 bp, Artificial sequence
  SiRNA target sequence
tgtacgccaatgaactattttcgcagt

SEQ ID NO: 49149 - DNA, 27 bp, Artificial sequence
  SiRNA target sequence
gtacgccaatgaactattttcgcagtt

SEQ ID NO: 49150 - DNA, 27 bp, Artificial sequence
  SiRNA target sequence
tacgccaatgaactattttcgcagttg

SEQ ID NO: 49151 - DNA, 27 bp, Artificial sequence
  SiRNA target sequence
acgccaatgaactattttcgcagttgc

SEQ ID NO: 49152 - DNA, 27 bp, Artificial sequence
  SiRNA target sequence
cgccaatgaactattttcgcagttgca

SEQ ID NO: 49153 - DNA, 27 bp, Artificial sequence
  SiRNA target sequence
gccaatgaactattttcgcagttgcaa

SEQ ID NO: 49154 - DNA, 27 bp, Artificial sequence
  SiRNA target sequence
ccaatgaactattttcgcagttgcaag

SEQ ID NO: 49155 - DNA, 27 bp, Artificial sequence
  SiRNA target sequence
caatgaactattttcgcagttgcaagg

SEQ ID NO: 49156 - DNA, 27 bp, Artificial sequence
  SiRNA target sequence
aatgaactattttcgcagttgcaagga

SEQ ID NO: 49157 - DNA, 27 bp, Artificial sequence
  SiRNA target sequence
atgaactattttcgcagttgcaaggat

SEQ ID NO: 49158 - DNA, 27 bp, Artificial sequence
  SiRNA target sequence
tgaactattttcgcagttgcaaggatg

SEQ ID NO: 49159 - DNA, 27 bp, Artificial sequence
  SiRNA target sequence
gaactattttcgcagttgcaaggatgt

SEQ ID NO: 49160 - DNA, 27 bp, Artificial sequence
  SiRNA target sequence
aactattttcgcagttgcaaggatgta

SEQ ID NO: 49161 - DNA, 27 bp, Artificial sequence
  SiRNA target sequence
actattttcgcagttgcaaggatgtaa

SEQ ID NO: 49162 - DNA, 27 bp, Artificial sequence
  SiRNA target sequence
ctattttcgcagttgcaaggatgtaaa

SEQ ID NO: 49163 - DNA, 27 bp, Artificial sequence
  SiRNA target sequence
tattttcgcagttgcaaggatgtaaac

SEQ ID NO: 49164 - DNA, 27 bp, Artificial sequence
  SiRNA target sequence
attttcgcagttgcaaggatgtaaact

SEQ ID NO: 49165 - DNA, 27 bp, Artificial sequence
  SiRNA target sequence
ttttcgcagttgcaaggatgtaaacta

SEQ ID NO: 49166 - DNA, 27 bp, Artificial sequence
  SiRNA target sequence
tttcgcagttgcaaggatgtaaactaa

SEQ ID NO: 49167 - DNA, 27 bp, Artificial sequence
  SiRNA target sequence
ttcgcagttgcaaggatgtaaactaat

SEQ ID NO: 49168 - DNA, 27 bp, Artificial sequence
  SiRNA target sequence
tcgcagttgcaaggatgtaaactaata

SEQ ID NO: 49169 - DNA, 27 bp, Artificial sequence
  SiRNA target sequence
cgcagttgcaaggatgtaaactaataa

SEQ ID NO: 49170 - DNA, 27 bp, Artificial sequence
  SiRNA target sequence
gcagttgcaaggatgtaaactaataat

SEQ ID NO: 49171 - DNA, 27 bp, Artificial sequence
  SiRNA target sequence
cagttgcaaggatgtaaactaataatg

SEQ ID NO: 49172 - DNA, 27 bp, Artificial sequence
  SiRNA target sequence
agttgcaaggatgtaaactaataatgt

SEQ ID NO: 49173 - DNA, 27 bp, Artificial sequence
  SiRNA target sequence
gttgcaaggatgtaaactaataatgtg

SEQ ID NO: 49174 - DNA, 27 bp, Artificial sequence
  SiRNA target sequence
ttgcaaggatgtaaactaataatgtga

SEQ ID NO: 49175 - DNA, 27 bp, Artificial sequence
  SiRNA target sequence
tgcaaggatgtaaactaataatgtgat

SEQ ID NO: 49176 - DNA, 27 bp, Artificial sequence
  SiRNA target sequence
gcaaggatgtaaactaataatgtgatt

SEQ ID NO: 49177 - DNA, 27 bp, Artificial sequence
  SiRNA target sequence
caaggatgtaaactaataatgtgatta

SEQ ID NO: 49178 - DNA, 27 bp, Artificial sequence
  SiRNA target sequence
aaggatgtaaactaataatgtgattaa

SEQ ID NO: 49179 - DNA, 27 bp, Artificial sequence
  SiRNA target sequence
aggatgtaaactaataatgtgattaaa

SEQ ID NO: 49180 - DNA, 27 bp, Artificial sequence
  SiRNA target sequence
ggatgtaaactaataatgtgattaaaa

SEQ ID NO: 49181 - DNA, 27 bp, Artificial sequence
  SiRNA target sequence
gatgtaaactaataatgtgattaaaat

SEQ ID NO: 49182 - DNA, 27 bp, Artificial sequence
  SiRNA target sequence
atgtaaactaataatgtgattaaaata

SEQ ID NO: 49183 - DNA, 27 bp, Artificial sequence
  SiRNA target sequence
tgtaaactaataatgtgattaaaataa

SEQ ID NO: 49184 - DNA, 27 bp, Artificial sequence
  SiRNA target sequence
gtaaactaataatgtgattaaaataat

SEQ ID NO: 49185 - DNA, 27 bp, Artificial sequence
  SiRNA target sequence
taaactaataatgtgattaaaataata

SEQ ID NO: 49186 - DNA, 27 bp, Artificial sequence
  SiRNA target sequence
aaactaataatgtgattaaaataataa

SEQ ID NO: 49187 - DNA, 27 bp, Artificial sequence
  SiRNA target sequence
aactaataatgtgattaaaataataaa

SEQ ID NO: 49188 - DNA, 27 bp, Artificial sequence
  SiRNA target sequence
actaataatgtgattaaaataataaac

SEQ ID NO: 49189 - DNA, 27 bp, Artificial sequence
  SiRNA target sequence
ctaataatgtgattaaaataataaaca

SEQ ID NO: 49190 - DNA, 27 bp, Artificial sequence
  SiRNA target sequence
taataatgtgattaaaataataaacat

SEQ ID NO: 49191 - DNA, 27 bp, Artificial sequence
  SiRNA target sequence
aataatgtgattaaaataataaacata

SEQ ID NO: 49192 - DNA, 27 bp, Artificial sequence
  SiRNA target sequence
ataatgtgattaaaataataaacatat

SEQ ID NO: 49193 - DNA, 27 bp, Artificial sequence
  SiRNA target sequence
taatgtgattaaaataataaacatatt

SEQ ID NO: 49194 - DNA, 27 bp, Artificial sequence
  SiRNA target sequence
aatgtgattaaaataataaacatattt

SEQ ID NO: 49195 - DNA, 27 bp, Artificial sequence
  SiRNA target sequence
atgtgattaaaataataaacatatttg

SEQ ID NO: 49196 - DNA, 27 bp, Artificial sequence
  SiRNA target sequence
tgtgattaaaataataaacatatttgt

SEQ ID NO: 49197 - DNA, 27 bp, Artificial sequence
  SiRNA target sequence
gtgattaaaataataaacatatttgtc

SEQ ID NO: 49198 - DNA, 27 bp, Artificial sequence
  SiRNA target sequence
tgattaaaataataaacatatttgtca

SEQ ID NO: 49199 - DNA, 27 bp, Artificial sequence
  SiRNA target sequence
gattaaaataataaacatatttgtcaa

SEQ ID NO: 49200 - DNA, 27 bp, Artificial sequence
  SiRNA target sequence
attaaaataataaacatatttgtcaac

SEQ ID NO: 49201 - DNA, 27 bp, Artificial sequence
  SiRNA target sequence
ttaaaataataaacatatttgtcaacc

SEQ ID NO: 49202 - DNA, 27 bp, Artificial sequence
  SiRNA target sequence
taaaataataaacatatttgtcaaccc

SEQ ID NO: 49203 - DNA, 27 bp, Artificial sequence
  SiRNA target sequence
aaaataataaacatatttgtcaaccct

SEQ ID NO: 49204 - DNA, 27 bp, Artificial sequence
  SiRNA target sequence
aaataataaacatatttgtcaacccta

SEQ ID NO: 49205 - DNA, 27 bp, Artificial sequence
  SiRNA target sequence
aataataaacatatttgtcaaccctaa

SEQ ID NO: 49206 - DNA, 27 bp, Artificial sequence
  SiRNA target sequence
ataataaacatatttgtcaaccctaaa

SEQ ID NO: 49207 - DNA, 27 bp, Artificial sequence
  SiRNA target sequence
taataaacatatttgtcaaccctaaat

SEQ ID NO: 49208 - DNA, 27 bp, Artificial sequence
  SiRNA target sequence
aataaacatatttgtcaaccctaaatt

SEQ ID NO: 49209 - DNA, 27 bp, Artificial sequence
  SiRNA target sequence
ataaacatatttgtcaaccctaaattt

SEQ ID NO: 49210 - DNA, 27 bp, Artificial sequence
  SiRNA target sequence
taaacatatttgtcaaccctaaatttg

SEQ ID NO: 49211 - DNA, 27 bp, Artificial sequence
  SiRNA target sequence
aaacatatttgtcaaccctaaatttgt

SEQ ID NO: 49212 - DNA, 27 bp, Artificial sequence
  SiRNA target sequence
aacatatttgtcaaccctaaatttgta

SEQ ID NO: 49213 - DNA, 27 bp, Artificial sequence
  SiRNA target sequence
acatatttgtcaaccctaaatttgtat

SEQ ID NO: 49214 - DNA, 27 bp, Artificial sequence
  SiRNA target sequence
catatttgtcaaccctaaatttgtata

SEQ ID NO: 49215 - DNA, 27 bp, Artificial sequence
  SiRNA target sequence
atatttgtcaaccctaaatttgtataa

SEQ ID NO: 49216 - DNA, 27 bp, Artificial sequence
  SiRNA target sequence
tatttgtcaaccctaaatttgtataaa

SEQ ID NO: 49217 - DNA, 27 bp, Artificial sequence
  SiRNA target sequence
atttgtcaaccctaaatttgtataaat

SEQ ID NO: 49218 - DNA, 27 bp, Artificial sequence
  SiRNA target sequence
tttgtcaaccctaaatttgtataaatt

SEQ ID NO: 49219 - DNA, 27 bp, Artificial sequence
  SiRNA target sequence
ttgtcaaccctaaatttgtataaattg

SEQ ID NO: 49220 - DNA, 27 bp, Artificial sequence
  SiRNA target sequence
tgtcaaccctaaatttgtataaattga

SEQ ID NO: 49221 - DNA, 27 bp, Artificial sequence
  SiRNA target sequence
gtcaaccctaaatttgtataaattgac

SEQ ID NO: 49222 - DNA, 27 bp, Artificial sequence
  SiRNA target sequence
tcaaccctaaatttgtataaattgacg

SEQ ID NO: 49223 - DNA, 27 bp, Artificial sequence
  SiRNA target sequence
caaccctaaatttgtataaattgacga

SEQ ID NO: 49224 - DNA, 27 bp, Artificial sequence
  SiRNA target sequence
aaccctaaatttgtataaattgacgaa

SEQ ID NO: 49225 - DNA, 27 bp, Artificial sequence
  SiRNA target sequence
accctaaatttgtataaattgacgaac

SEQ ID NO: 49226 - DNA, 27 bp, Artificial sequence
  SiRNA target sequence
ccctaaatttgtataaattgacgaaca

SEQ ID NO: 49227 - DNA, 27 bp, Artificial sequence
  SiRNA target sequence
cctaaatttgtataaattgacgaacac

SEQ ID NO: 49228 - DNA, 27 bp, Artificial sequence
  SiRNA target sequence
ctaaatttgtataaattgacgaacacg

SEQ ID NO: 49229 - DNA, 27 bp, Artificial sequence
  SiRNA target sequence
taaatttgtataaattgacgaacacgc

SEQ ID NO: 49230 - DNA, 27 bp, Artificial sequence
  SiRNA target sequence
aaatttgtataaattgacgaacacgcc

SEQ ID NO: 49231 - DNA, 27 bp, Artificial sequence
  SiRNA target sequence
aatttgtataaattgacgaacacgcca

SEQ ID NO: 49232 - DNA, 27 bp, Artificial sequence
  SiRNA target sequence
atttgtataaattgacgaacacgccaa

SEQ ID NO: 49233 - DNA, 27 bp, Artificial sequence
  SiRNA target sequence
tttgtataaattgacgaacacgccaat

SEQ ID NO: 49234 - DNA, 27 bp, Artificial sequence
  SiRNA target sequence
ttgtataaattgacgaacacgccaata

SEQ ID NO: 49235 - DNA, 27 bp, Artificial sequence
  SiRNA target sequence
tgtataaattgacgaacacgccaatat

SEQ ID NO: 49236 - DNA, 27 bp, Artificial sequence
  SiRNA target sequence
gtataaattgacgaacacgccaatata

SEQ ID NO: 49237 - DNA, 27 bp, Artificial sequence
  SiRNA target sequence
tataaattgacgaacacgccaatataa

SEQ ID NO: 49238 - DNA, 27 bp, Artificial sequence
  SiRNA target sequence
ataaattgacgaacacgccaatataac

SEQ ID NO: 49239 - DNA, 27 bp, Artificial sequence
  SiRNA target sequence
taaattgacgaacacgccaatataact

SEQ ID NO: 49240 - DNA, 27 bp, Artificial sequence
  SiRNA target sequence
aaattgacgaacacgccaatataactg

SEQ ID NO: 49241 - DNA, 27 bp, Artificial sequence
  SiRNA target sequence
aattgacgaacacgccaatataactgt

SEQ ID NO: 49242 - DNA, 27 bp, Artificial sequence
  SiRNA target sequence
attgacgaacacgccaatataactgta

SEQ ID NO: 49243 - DNA, 27 bp, Artificial sequence
  SiRNA target sequence
ttgacgaacacgccaatataactgtaa

SEQ ID NO: 49244 - DNA, 27 bp, Artificial sequence
  SiRNA target sequence
tgacgaacacgccaatataactgtaaa

SEQ ID NO: 49245 - DNA, 27 bp, Artificial sequence
  SiRNA target sequence
gacgaacacgccaatataactgtaaaa

SEQ ID NO: 49246 - DNA, 27 bp, Artificial sequence
  SiRNA target sequence
acgaacacgccaatataactgtaaaaa

SEQ ID NO: 49247 - DNA, 27 bp, Artificial sequence
  SiRNA target sequence
cgaacacgccaatataactgtaaaaaa

SEQ ID NO: 49248 - DNA, 27 bp, Artificial sequence
  SiRNA target sequence
gaacacgccaatataactgtaaaaaaa

SEQ ID NO: 49249 - DNA, 27 bp, Artificial sequence
  SiRNA target sequence
aacacgccaatataactgtaaaaaaaa

SEQ ID NO: 49250 - DNA, 27 bp, Artificial sequence
  SiRNA target sequence
acacgccaatataactgtaaaaaaaat

SEQ ID NO: 49251 - DNA, 27 bp, Artificial sequence
  SiRNA target sequence
cacgccaatataactgtaaaaaaaata

SEQ ID NO: 49252 - DNA, 27 bp, Artificial sequence
  SiRNA target sequence
acgccaatataactgtaaaaaaaatat

SEQ ID NO: 49253 - DNA, 27 bp, Artificial sequence
  SiRNA target sequence
cgccaatataactgtaaaaaaaatatt

SEQ ID NO: 49254 - DNA, 27 bp, Artificial sequence
  SiRNA target sequence
gccaatataactgtaaaaaaaatattt

SEQ ID NO: 49255 - DNA, 27 bp, Artificial sequence
  SiRNA target sequence
ccaatataactgtaaaaaaaatattta

SEQ ID NO: 49256 - DNA, 27 bp, Artificial sequence
  SiRNA target sequence
caatataactgtaaaaaaaatatttat

SEQ ID NO: 49257 - DNA, 27 bp, Artificial sequence
  SiRNA target sequence
aatataactgtaaaaaaaatatttatg

SEQ ID NO: 49258 - DNA, 27 bp, Artificial sequence
  SiRNA target sequence
atataactgtaaaaaaaatatttatga

SEQ ID NO: 49259 - DNA, 27 bp, Artificial sequence
  SiRNA target sequence
tataactgtaaaaaaaatatttatgat

SEQ ID NO: 49260 - DNA, 27 bp, Artificial sequence
  SiRNA target sequence
ataactgtaaaaaaaatatttatgata

SEQ ID NO: 49261 - DNA, 27 bp, Artificial sequence
  SiRNA target sequence
taactgtaaaaaaaatatttatgatat

SEQ ID NO: 49262 - DNA, 27 bp, Artificial sequence
  SiRNA target sequence
aactgtaaaaaaaatatttatgatatt

SEQ ID NO: 49263 - DNA, 27 bp, Artificial sequence
  SiRNA target sequence
actgtaaaaaaaatatttatgatatta

SEQ ID NO: 49264 - DNA, 27 bp, Artificial sequence
  SiRNA target sequence
ctgtaaaaaaaatatttatgatattaa

SEQ ID NO: 49265 - DNA, 27 bp, Artificial sequence
  SiRNA target sequence
tgtaaaaaaaatatttatgatattaac

SEQ ID NO: 49266 - DNA, 27 bp, Artificial sequence
  SiRNA target sequence
gtaaaaaaaatatttatgatattaaca

SEQ ID NO: 49267 - DNA, 27 bp, Artificial sequence
  SiRNA target sequence
taaaaaaaatatttatgatattaacaa

SEQ ID NO: 49268 - DNA, 27 bp, Artificial sequence
  SiRNA target sequence
aaaaaaaatatttatgatattaacaaa

SEQ ID NO: 49269 - DNA, 27 bp, Artificial sequence
  SiRNA target sequence
aaaaaaatatttatgatattaacaaat

SEQ ID NO: 49270 - DNA, 27 bp, Artificial sequence
  SiRNA target sequence
aaaaaatatttatgatattaacaaata

SEQ ID NO: 49271 - DNA, 27 bp, Artificial sequence
  SiRNA target sequence
aaaaatatttatgatattaacaaataa

SEQ ID NO: 49272 - DNA, 27 bp, Artificial sequence
  SiRNA target sequence
aaaatatttatgatattaacaaataaa

SEQ ID NO: 49273 - DNA, 27 bp, Artificial sequence
  SiRNA target sequence
aaatatttatgatattaacaaataaaa

SEQ ID NO: 49274 - DNA, 27 bp, Artificial sequence
  SiRNA target sequence
aatatttatgatattaacaaataaaac

SEQ ID NO: 49275 - DNA, 27 bp, Artificial sequence
  SiRNA target sequence
atatttatgatattaacaaataaaact

SEQ ID NO: 49276 - DNA, 27 bp, Artificial sequence
  SiRNA target sequence
tatttatgatattaacaaataaaactt

SEQ ID NO: 49277 - DNA, 27 bp, Artificial sequence
  SiRNA target sequence
atttatgatattaacaaataaaacttc

SEQ ID NO: 49278 - DNA, 27 bp, Artificial sequence
  SiRNA target sequence
tttatgatattaacaaataaaacttcg

SEQ ID NO: 49279 - DNA, 27 bp, Artificial sequence
  SiRNA target sequence
ttatgatattaacaaataaaacttcga

SEQ ID NO: 49280 - DNA, 27 bp, Artificial sequence
  SiRNA target sequence
tatgatattaacaaataaaacttcgat

SEQ ID NO: 49281 - DNA, 27 bp, Artificial sequence
  SiRNA target sequence
atgatattaacaaataaaacttcgatc

SEQ ID NO: 49282 - DNA, 27 bp, Artificial sequence
  SiRNA target sequence
tgatattaacaaataaaacttcgatca

SEQ ID NO: 49283 - DNA, 27 bp, Artificial sequence
  SiRNA target sequence
gatattaacaaataaaacttcgatcaa

SEQ ID NO: 49284 - DNA, 27 bp, Artificial sequence
  SiRNA target sequence
atattaacaaataaaacttcgatcaat

SEQ ID NO: 49285 - DNA, 27 bp, Artificial sequence
  SiRNA target sequence
tattaacaaataaaacttcgatcaatt

SEQ ID NO: 49286 - DNA, 27 bp, Artificial sequence
  SiRNA target sequence
attaacaaataaaacttcgatcaattc

SEQ ID NO: 49287 - DNA, 27 bp, Artificial sequence
  SiRNA target sequence
ttaacaaataaaacttcgatcaattca

SEQ ID NO: 49288 - DNA, 27 bp, Artificial sequence
  SiRNA target sequence
taacaaataaaacttcgatcaattcac

SEQ ID NO: 49289 - DNA, 27 bp, Artificial sequence
  SiRNA target sequence
aacaaataaaacttcgatcaattcact

SEQ ID NO: 49290 - DNA, 27 bp, Artificial sequence
  SiRNA target sequence
acaaataaaacttcgatcaattcactt

SEQ ID NO: 49291 - DNA, 27 bp, Artificial sequence
  SiRNA target sequence
caaataaaacttcgatcaattcactta

SEQ ID NO: 49292 - DNA, 27 bp, Artificial sequence
  SiRNA target sequence
aaataaaacttcgatcaattcacttat

SEQ ID NO: 49293 - DNA, 27 bp, Artificial sequence
  SiRNA target sequence
aataaaacttcgatcaattcacttatt

SEQ ID NO: 49294 - DNA, 27 bp, Artificial sequence
  SiRNA target sequence
ataaaacttcgatcaattcacttattg

SEQ ID NO: 49295 - DNA, 27 bp, Artificial sequence
  SiRNA target sequence
taaaacttcgatcaattcacttattgc

SEQ ID NO: 49296 - DNA, 27 bp, Artificial sequence
  SiRNA target sequence
aaaacttcgatcaattcacttattgct

SEQ ID NO: 49297 - DNA, 27 bp, Artificial sequence
  SiRNA target sequence
aaacttcgatcaattcacttattgctt

SEQ ID NO: 49298 - DNA, 27 bp, Artificial sequence
  SiRNA target sequence
aacttcgatcaattcacttattgcttt

SEQ ID NO: 49299 - DNA, 27 bp, Artificial sequence
  SiRNA target sequence
acttcgatcaattcacttattgcttta

SEQ ID NO: 49300 - DNA, 27 bp, Artificial sequence
  SiRNA target sequence
cttcgatcaattcacttattgctttac

SEQ ID NO: 49301 - DNA, 27 bp, Artificial sequence
  SiRNA target sequence
ttcgatcaattcacttattgctttact

SEQ ID NO: 49302 - DNA, 27 bp, Artificial sequence
  SiRNA target sequence
tcgatcaattcacttattgctttactt

SEQ ID NO: 49303 - DNA, 27 bp, Artificial sequence
  SiRNA target sequence
cgatcaattcacttattgctttacttt

SEQ ID NO: 49304 - DNA, 27 bp, Artificial sequence
  SiRNA target sequence
gatcaattcacttattgctttactttc

SEQ ID NO: 49305 - DNA, 27 bp, Artificial sequence
  SiRNA target sequence
atcaattcacttattgctttactttct

SEQ ID NO: 49306 - DNA, 27 bp, Artificial sequence
  SiRNA target sequence
tcaattcacttattgctttactttctc

SEQ ID NO: 49307 - DNA, 27 bp, Artificial sequence
  SiRNA target sequence
caattcacttattgctttactttctcg

SEQ ID NO: 49308 - DNA, 27 bp, Artificial sequence
  SiRNA target sequence
aattcacttattgctttactttctcgg

SEQ ID NO: 49309 - DNA, 27 bp, Artificial sequence
  SiRNA target sequence
attcacttattgctttactttctcggt

SEQ ID NO: 49310 - DNA, 27 bp, Artificial sequence
  SiRNA target sequence
ttcacttattgctttactttctcggtc

SEQ ID NO: 49311 - DNA, 27 bp, Artificial sequence
  SiRNA target sequence
tcacttattgctttactttctcggtct

SEQ ID NO: 49312 - DNA, 27 bp, Artificial sequence
  SiRNA target sequence
cacttattgctttactttctcggtcta

SEQ ID NO: 49313 - DNA, 27 bp, Artificial sequence
  SiRNA target sequence
acttattgctttactttctcggtctat

SEQ ID NO: 49314 - DNA, 27 bp, Artificial sequence
  SiRNA target sequence
cttattgctttactttctcggtctatt

SEQ ID NO: 49315 - DNA, 27 bp, Artificial sequence
  SiRNA target sequence
ttattgctttactttctcggtctatta

SEQ ID NO: 49316 - DNA, 27 bp, Artificial sequence
  SiRNA target sequence
tattgctttactttctcggtctattat

SEQ ID NO: 49317 - DNA, 27 bp, Artificial sequence
  SiRNA target sequence
attgctttactttctcggtctattatt

SEQ ID NO: 49318 - DNA, 27 bp, Artificial sequence
  SiRNA target sequence
ttgctttactttctcggtctattattg

SEQ ID NO: 49319 - DNA, 27 bp, Artificial sequence
  SiRNA target sequence
tgctttactttctcggtctattattgt

SEQ ID NO: 49320 - DNA, 27 bp, Artificial sequence
  SiRNA target sequence
gctttactttctcggtctattattgtt

SEQ ID NO: 49321 - DNA, 27 bp, Artificial sequence
  SiRNA target sequence
ctttactttctcggtctattattgttt

SEQ ID NO: 49322 - DNA, 27 bp, Artificial sequence
  SiRNA target sequence
tttactttctcggtctattattgtttg

SEQ ID NO: 49323 - DNA, 27 bp, Artificial sequence
  SiRNA target sequence
ttactttctcggtctattattgtttgt

SEQ ID NO: 49324 - DNA, 27 bp, Artificial sequence
  SiRNA target sequence
tactttctcggtctattattgtttgta

SEQ ID NO: 49325 - DNA, 27 bp, Artificial sequence
  SiRNA target sequence
actttctcggtctattattgtttgtat

SEQ ID NO: 49326 - DNA, 27 bp, Artificial sequence
  SiRNA target sequence
ctttctcggtctattattgtttgtatt

SEQ ID NO: 49327 - DNA, 27 bp, Artificial sequence
  SiRNA target sequence
tttctcggtctattattgtttgtattt

SEQ ID NO: 49328 - DNA, 27 bp, Artificial sequence
  SiRNA target sequence
ttctcggtctattattgtttgtatttc

SEQ ID NO: 49329 - DNA, 27 bp, Artificial sequence
  SiRNA target sequence
tctcggtctattattgtttgtatttca

SEQ ID NO: 49330 - DNA, 27 bp, Artificial sequence
  SiRNA target sequence
ctcggtctattattgtttgtatttcac

SEQ ID NO: 49331 - DNA, 27 bp, Artificial sequence
  SiRNA target sequence
tcggtctattattgtttgtatttcacc

SEQ ID NO: 49332 - DNA, 27 bp, Artificial sequence
  SiRNA target sequence
cggtctattattgtttgtatttcaccg

SEQ ID NO: 49333 - DNA, 27 bp, Artificial sequence
  SiRNA target sequence
ggtctattattgtttgtatttcaccgc

SEQ ID NO: 49334 - DNA, 27 bp, Artificial sequence
  SiRNA target sequence
gtctattattgtttgtatttcaccgca

SEQ ID NO: 49335 - DNA, 27 bp, Artificial sequence
  SiRNA target sequence
tctattattgtttgtatttcaccgcat

SEQ ID NO: 49336 - DNA, 27 bp, Artificial sequence
  SiRNA target sequence
ctattattgtttgtatttcaccgcatc

SEQ ID NO: 49337 - DNA, 27 bp, Artificial sequence
  SiRNA target sequence
tattattgtttgtatttcaccgcatcc

SEQ ID NO: 49338 - DNA, 27 bp, Artificial sequence
  SiRNA target sequence
attattgtttgtatttcaccgcatcct

SEQ ID NO: 49339 - DNA, 27 bp, Artificial sequence
  SiRNA target sequence
ttattgtttgtatttcaccgcatccta

SEQ ID NO: 49340 - DNA, 27 bp, Artificial sequence
  SiRNA target sequence
tattgtttgtatttcaccgcatcctat

SEQ ID NO: 49341 - DNA, 27 bp, Artificial sequence
  SiRNA target sequence
attgtttgtatttcaccgcatcctatt

SEQ ID NO: 49342 - DNA, 27 bp, Artificial sequence
  SiRNA target sequence
ttgtttgtatttcaccgcatcctattt

SEQ ID NO: 49343 - DNA, 27 bp, Artificial sequence
  SiRNA target sequence
tgtttgtatttcaccgcatcctatttt

SEQ ID NO: 49344 - DNA, 27 bp, Artificial sequence
  SiRNA target sequence
gtttgtatttcaccgcatcctatttta

SEQ ID NO: 49345 - DNA, 27 bp, Artificial sequence
  SiRNA target sequence
tttgtatttcaccgcatcctattttat

SEQ ID NO: 49346 - DNA, 27 bp, Artificial sequence
  SiRNA target sequence
ttgtatttcaccgcatcctattttatt

SEQ ID NO: 49347 - DNA, 27 bp, Artificial sequence
  SiRNA target sequence
tgtatttcaccgcatcctattttattg

SEQ ID NO: 49348 - DNA, 27 bp, Artificial sequence
  SiRNA target sequence
gtatttcaccgcatcctattttattgt

SEQ ID NO: 49349 - DNA, 27 bp, Artificial sequence
  SiRNA target sequence
tatttcaccgcatcctattttattgta

SEQ ID NO: 49350 - DNA, 27 bp, Artificial sequence
  SiRNA target sequence
atttcaccgcatcctattttattgtat

SEQ ID NO: 49351 - DNA, 27 bp, Artificial sequence
  SiRNA target sequence
tttcaccgcatcctattttattgtatc

SEQ ID NO: 49352 - DNA, 27 bp, Artificial sequence
  SiRNA target sequence
ttcaccgcatcctattttattgtatct

SEQ ID NO: 49353 - DNA, 27 bp, Artificial sequence
  SiRNA target sequence
tcaccgcatcctattttattgtatcta

SEQ ID NO: 49354 - DNA, 27 bp, Artificial sequence
  SiRNA target sequence
caccgcatcctattttattgtatctac

SEQ ID NO: 49355 - DNA, 27 bp, Artificial sequence
  SiRNA target sequence
accgcatcctattttattgtatctact

SEQ ID NO: 49356 - DNA, 27 bp, Artificial sequence
  SiRNA target sequence
ccgcatcctattttattgtatctacta

SEQ ID NO: 49357 - DNA, 27 bp, Artificial sequence
  SiRNA target sequence
cgcatcctattttattgtatctactaa

SEQ ID NO: 49358 - DNA, 27 bp, Artificial sequence
  SiRNA target sequence
gcatcctattttattgtatctactaag

SEQ ID NO: 49359 - DNA, 27 bp, Artificial sequence
  SiRNA target sequence
catcctattttattgtatctactaagt

SEQ ID NO: 49360 - DNA, 27 bp, Artificial sequence
  SiRNA target sequence
atcctattttattgtatctactaagtt

SEQ ID NO: 49361 - DNA, 27 bp, Artificial sequence
  SiRNA target sequence
tcctattttattgtatctactaagttc

SEQ ID NO: 49362 - DNA, 27 bp, Artificial sequence
  SiRNA target sequence
cctattttattgtatctactaagttcc

SEQ ID NO: 49363 - DNA, 27 bp, Artificial sequence
  SiRNA target sequence
ctattttattgtatctactaagttcca

SEQ ID NO: 49364 - DNA, 27 bp, Artificial sequence
  SiRNA target sequence
tattttattgtatctactaagttccat

SEQ ID NO: 49365 - DNA, 27 bp, Artificial sequence
  SiRNA target sequence
attttattgtatctactaagttccata

SEQ ID NO: 49366 - DNA, 27 bp, Artificial sequence
  SiRNA target sequence
ttttattgtatctactaagttccatat

SEQ ID NO: 49367 - DNA, 27 bp, Artificial sequence
  SiRNA target sequence
tttattgtatctactaagttccatatt

SEQ ID NO: 49368 - DNA, 27 bp, Artificial sequence
  SiRNA target sequence
ttattgtatctactaagttccatattt

SEQ ID NO: 49369 - DNA, 27 bp, Artificial sequence
  SiRNA target sequence
tattgtatctactaagttccatattta

SEQ ID NO: 49370 - DNA, 27 bp, Artificial sequence
  SiRNA target sequence
attgtatctactaagttccatatttat

SEQ ID NO: 49371 - DNA, 27 bp, Artificial sequence
  SiRNA target sequence
ttgtatctactaagttccatatttata

SEQ ID NO: 49372 - DNA, 27 bp, Artificial sequence
  SiRNA target sequence
tgtatctactaagttccatatttataa

SEQ ID NO: 49373 - DNA, 27 bp, Artificial sequence
  SiRNA target sequence
gtatctactaagttccatatttataaa

SEQ ID NO: 49374 - DNA, 27 bp, Artificial sequence
  SiRNA target sequence
tatctactaagttccatatttataaaa

SEQ ID NO: 49375 - DNA, 27 bp, Artificial sequence
  SiRNA target sequence
atctactaagttccatatttataaaat

SEQ ID NO: 49376 - DNA, 27 bp, Artificial sequence
  SiRNA target sequence
tctactaagttccatatttataaaatt

SEQ ID NO: 49377 - DNA, 27 bp, Artificial sequence
  SiRNA target sequence
ctactaagttccatatttataaaattt

SEQ ID NO: 49378 - DNA, 27 bp, Artificial sequence
  SiRNA target sequence
tactaagttccatatttataaaatttt

SEQ ID NO: 49379 - DNA, 27 bp, Artificial sequence
  SiRNA target sequence
actaagttccatatttataaaattttt

SEQ ID NO: 49380 - DNA, 27 bp, Artificial sequence
  SiRNA target sequence
ctaagttccatatttataaaattttta

SEQ ID NO: 49381 - DNA, 27 bp, Artificial sequence
  SiRNA target sequence
taagttccatatttataaaatttttaa

SEQ ID NO: 49382 - DNA, 27 bp, Artificial sequence
  SiRNA target sequence
aagttccatatttataaaatttttaaa

SEQ ID NO: 49383 - DNA, 27 bp, Artificial sequence
  SiRNA target sequence
agttccatatttataaaatttttaaat

SEQ ID NO: 49384 - DNA, 27 bp, Artificial sequence
  SiRNA target sequence
gttccatatttataaaatttttaaatg

SEQ ID NO: 49385 - DNA, 27 bp, Artificial sequence
  SiRNA target sequence
ttccatatttataaaatttttaaatga

SEQ ID NO: 49386 - DNA, 27 bp, Artificial sequence
  SiRNA target sequence
tccatatttataaaatttttaaatgaa

SEQ ID NO: 49387 - DNA, 27 bp, Artificial sequence
  SiRNA target sequence
ccatatttataaaatttttaaatgaat

SEQ ID NO: 49388 - DNA, 27 bp, Artificial sequence
  SiRNA target sequence
catatttataaaatttttaaatgaatt

SEQ ID NO: 49389 - DNA, 27 bp, Artificial sequence
  SiRNA target sequence
atatttataaaatttttaaatgaattt

SEQ ID NO: 49390 - DNA, 27 bp, Artificial sequence
  SiRNA target sequence
tatttataaaatttttaaatgaatttt

SEQ ID NO: 49391 - DNA, 27 bp, Artificial sequence
  SiRNA target sequence
atttataaaatttttaaatgaattttt

SEQ ID NO: 49392 - DNA, 27 bp, Artificial sequence
  SiRNA target sequence
tttataaaatttttaaatgaatttttt

SEQ ID NO: 49393 - DNA, 27 bp, Artificial sequence
  SiRNA target sequence
ttataaaatttttaaatgaattttttc

SEQ ID NO: 49394 - DNA, 27 bp, Artificial sequence
  SiRNA target sequence
tataaaatttttaaatgaattttttcc

SEQ ID NO: 49395 - DNA, 27 bp, Artificial sequence
  SiRNA target sequence
ataaaatttttaaatgaattttttcct

SEQ ID NO: 49396 - DNA, 27 bp, Artificial sequence
  SiRNA target sequence
taaaatttttaaatgaattttttcctg

SEQ ID NO: 49397 - DNA, 27 bp, Artificial sequence
  SiRNA target sequence
aaaatttttaaatgaattttttcctgt

SEQ ID NO: 49398 - DNA, 27 bp, Artificial sequence
  SiRNA target sequence
aaatttttaaatgaattttttcctgtc

SEQ ID NO: 49399 - DNA, 27 bp, Artificial sequence
  SiRNA target sequence
aatttttaaatgaattttttcctgtca

SEQ ID NO: 49400 - DNA, 27 bp, Artificial sequence
  SiRNA target sequence
atttttaaatgaattttttcctgtcag

SEQ ID NO: 49401 - DNA, 27 bp, Artificial sequence
  SiRNA target sequence
tttttaaatgaattttttcctgtcagt

SEQ ID NO: 49402 - DNA, 27 bp, Artificial sequence
  SiRNA target sequence
ttttaaatgaattttttcctgtcagtc

SEQ ID NO: 49403 - DNA, 27 bp, Artificial sequence
  SiRNA target sequence
tttaaatgaattttttcctgtcagtct

SEQ ID NO: 49404 - DNA, 27 bp, Artificial sequence
  SiRNA target sequence
ttaaatgaattttttcctgtcagtctg

SEQ ID NO: 49405 - DNA, 27 bp, Artificial sequence
  SiRNA target sequence
taaatgaattttttcctgtcagtctga

SEQ ID NO: 49406 - DNA, 27 bp, Artificial sequence
  SiRNA target sequence
aaatgaattttttcctgtcagtctgaa

SEQ ID NO: 49407 - DNA, 27 bp, Artificial sequence
  SiRNA target sequence
aatgaattttttcctgtcagtctgaat

SEQ ID NO: 49408 - DNA, 27 bp, Artificial sequence
  SiRNA target sequence
atgaattttttcctgtcagtctgaata

SEQ ID NO: 49409 - DNA, 27 bp, Artificial sequence
  SiRNA target sequence
tgaattttttcctgtcagtctgaatac

SEQ ID NO: 49410 - DNA, 27 bp, Artificial sequence
  SiRNA target sequence
gaattttttcctgtcagtctgaataca

SEQ ID NO: 49411 - DNA, 27 bp, Artificial sequence
  SiRNA target sequence
aattttttcctgtcagtctgaatacat

SEQ ID NO: 49412 - DNA, 27 bp, Artificial sequence
  SiRNA target sequence
attttttcctgtcagtctgaatacatg

SEQ ID NO: 49413 - DNA, 27 bp, Artificial sequence
  SiRNA target sequence
ttttttcctgtcagtctgaatacatgt

SEQ ID NO: 49414 - DNA, 27 bp, Artificial sequence
  SiRNA target sequence
tttttcctgtcagtctgaatacatgtt

SEQ ID NO: 49415 - DNA, 27 bp, Artificial sequence
  SiRNA target sequence
ttttcctgtcagtctgaatacatgttg

SEQ ID NO: 49416 - DNA, 27 bp, Artificial sequence
  SiRNA target sequence
tttcctgtcagtctgaatacatgttga

SEQ ID NO: 49417 - DNA, 27 bp, Artificial sequence
  SiRNA target sequence
ttcctgtcagtctgaatacatgttgaa

SEQ ID NO: 49418 - DNA, 27 bp, Artificial sequence
  SiRNA target sequence
tcctgtcagtctgaatacatgttgaac

SEQ ID NO: 49419 - DNA, 27 bp, Artificial sequence
  SiRNA target sequence
cctgtcagtctgaatacatgttgaacg

SEQ ID NO: 49420 - DNA, 27 bp, Artificial sequence
  SiRNA target sequence
ctgtcagtctgaatacatgttgaacgg

SEQ ID NO: 49421 - DNA, 27 bp, Artificial sequence
  SiRNA target sequence
tgtcagtctgaatacatgttgaacggg

SEQ ID NO: 49422 - DNA, 27 bp, Artificial sequence
  SiRNA target sequence
gtcagtctgaatacatgttgaacgggt

SEQ ID NO: 49423 - DNA, 27 bp, Artificial sequence
  SiRNA target sequence
tcagtctgaatacatgttgaacgggtg

SEQ ID NO: 49424 - DNA, 27 bp, Artificial sequence
  SiRNA target sequence
cagtctgaatacatgttgaacgggtgt

SEQ ID NO: 49425 - DNA, 27 bp, Artificial sequence
  SiRNA target sequence
agtctgaatacatgttgaacgggtgta

SEQ ID NO: 49426 - DNA, 27 bp, Artificial sequence
  SiRNA target sequence
gtctgaatacatgttgaacgggtgtaa

SEQ ID NO: 49427 - DNA, 27 bp, Artificial sequence
  SiRNA target sequence
tctgaatacatgttgaacgggtgtaac

SEQ ID NO: 49428 - DNA, 27 bp, Artificial sequence
  SiRNA target sequence
ctgaatacatgttgaacgggtgtaaca

SEQ ID NO: 49429 - DNA, 27 bp, Artificial sequence
  SiRNA target sequence
tgaatacatgttgaacgggtgtaacaa

SEQ ID NO: 49430 - DNA, 27 bp, Artificial sequence
  SiRNA target sequence
gaatacatgttgaacgggtgtaacaaa

SEQ ID NO: 49431 - DNA, 27 bp, Artificial sequence
  SiRNA target sequence
aatacatgttgaacgggtgtaacaaat

SEQ ID NO: 49432 - DNA, 27 bp, Artificial sequence
  SiRNA target sequence
atacatgttgaacgggtgtaacaaata

SEQ ID NO: 49433 - DNA, 27 bp, Artificial sequence
  SiRNA target sequence
tacatgttgaacgggtgtaacaaatat

SEQ ID NO: 49434 - DNA, 27 bp, Artificial sequence
  SiRNA target sequence
acatgttgaacgggtgtaacaaatata

SEQ ID NO: 49435 - DNA, 27 bp, Artificial sequence
  SiRNA target sequence
catgttgaacgggtgtaacaaatataa

SEQ ID NO: 49436 - DNA, 27 bp, Artificial sequence
  SiRNA target sequence
atgttgaacgggtgtaacaaatataaa

SEQ ID NO: 49437 - DNA, 27 bp, Artificial sequence
  SiRNA target sequence
tgttgaacgggtgtaacaaatataaaa

SEQ ID NO: 49438 - DNA, 27 bp, Artificial sequence
  SiRNA target sequence
gttgaacgggtgtaacaaatataaaat

SEQ ID NO: 49439 - DNA, 27 bp, Artificial sequence
  SiRNA target sequence
ttgaacgggtgtaacaaatataaaatt

SEQ ID NO: 49440 - DNA, 27 bp, Artificial sequence
  SiRNA target sequence
tgaacgggtgtaacaaatataaaattg

SEQ ID NO: 49441 - DNA, 27 bp, Artificial sequence
  SiRNA target sequence
gaacgggtgtaacaaatataaaattgt

SEQ ID NO: 49442 - DNA, 27 bp, Artificial sequence
  SiRNA target sequence
aacgggtgtaacaaatataaaattgtt

SEQ ID NO: 49443 - DNA, 27 bp, Artificial sequence
  SiRNA target sequence
acgggtgtaacaaatataaaattgtta

SEQ ID NO: 49444 - DNA, 27 bp, Artificial sequence
  SiRNA target sequence
cgggtgtaacaaatataaaattgttaa

SEQ ID NO: 49445 - DNA, 27 bp, Artificial sequence
  SiRNA target sequence
gggtgtaacaaatataaaattgttaag

SEQ ID NO: 49446 - DNA, 27 bp, Artificial sequence
  SiRNA target sequence
ggtgtaacaaatataaaattgttaagt

SEQ ID NO: 49447 - DNA, 27 bp, Artificial sequence
  SiRNA target sequence
gtgtaacaaatataaaattgttaagtt

SEQ ID NO: 49448 - DNA, 27 bp, Artificial sequence
  SiRNA target sequence
tgtaacaaatataaaattgttaagttc

SEQ ID NO: 49449 - DNA, 27 bp, Artificial sequence
  SiRNA target sequence
gtaacaaatataaaattgttaagttct

SEQ ID NO: 49450 - DNA, 27 bp, Artificial sequence
  SiRNA target sequence
taacaaatataaaattgttaagttctg

SEQ ID NO: 49451 - DNA, 27 bp, Artificial sequence
  SiRNA target sequence
aacaaatataaaattgttaagttctga

SEQ ID NO: 49452 - DNA, 27 bp, Artificial sequence
  SiRNA target sequence
acaaatataaaattgttaagttctgac

SEQ ID NO: 49453 - DNA, 27 bp, Artificial sequence
  SiRNA target sequence
caaatataaaattgttaagttctgaca

SEQ ID NO: 49454 - DNA, 27 bp, Artificial sequence
  SiRNA target sequence
aaatataaaattgttaagttctgacat

SEQ ID NO: 49455 - DNA, 27 bp, Artificial sequence
  SiRNA target sequence
aatataaaattgttaagttctgacatt

SEQ ID NO: 49456 - DNA, 27 bp, Artificial sequence
  SiRNA target sequence
atataaaattgttaagttctgacattg

SEQ ID NO: 49457 - DNA, 27 bp, Artificial sequence
  SiRNA target sequence
tataaaattgttaagttctgacattgt

SEQ ID NO: 49458 - DNA, 27 bp, Artificial sequence
  SiRNA target sequence
ataaaattgttaagttctgacattgta

SEQ ID NO: 49459 - DNA, 27 bp, Artificial sequence
  SiRNA target sequence
taaaattgttaagttctgacattgtaa

SEQ ID NO: 49460 - DNA, 27 bp, Artificial sequence
  SiRNA target sequence
aaaattgttaagttctgacattgtaat

SEQ ID NO: 49461 - DNA, 27 bp, Artificial sequence
  SiRNA target sequence
aaattgttaagttctgacattgtaatt

SEQ ID NO: 49462 - DNA, 27 bp, Artificial sequence
  SiRNA target sequence
aattgttaagttctgacattgtaattg

SEQ ID NO: 49463 - DNA, 27 bp, Artificial sequence
  SiRNA target sequence
attgttaagttctgacattgtaattga

SEQ ID NO: 49464 - DNA, 27 bp, Artificial sequence
  SiRNA target sequence
ttgttaagttctgacattgtaattgat

SEQ ID NO: 49465 - DNA, 27 bp, Artificial sequence
  SiRNA target sequence
tgttaagttctgacattgtaattgata

SEQ ID NO: 49466 - DNA, 27 bp, Artificial sequence
  SiRNA target sequence
gttaagttctgacattgtaattgatac

SEQ ID NO: 49467 - DNA, 27 bp, Artificial sequence
  SiRNA target sequence
ttaagttctgacattgtaattgataca

SEQ ID NO: 49468 - DNA, 27 bp, Artificial sequence
  SiRNA target sequence
taagttctgacattgtaattgatacaa

SEQ ID NO: 49469 - DNA, 27 bp, Artificial sequence
  SiRNA target sequence
aagttctgacattgtaattgatacaat

SEQ ID NO: 49470 - DNA, 27 bp, Artificial sequence
  SiRNA target sequence
agttctgacattgtaattgatacaatt

SEQ ID NO: 49471 - DNA, 27 bp, Artificial sequence
  SiRNA target sequence
gttctgacattgtaattgatacaattg

SEQ ID NO: 49472 - DNA, 27 bp, Artificial sequence
  SiRNA target sequence
ttctgacattgtaattgatacaattgt

SEQ ID NO: 49473 - DNA, 27 bp, Artificial sequence
  SiRNA target sequence
tctgacattgtaattgatacaattgtc

SEQ ID NO: 49474 - DNA, 27 bp, Artificial sequence
  SiRNA target sequence
ctgacattgtaattgatacaattgtca

SEQ ID NO: 49475 - DNA, 27 bp, Artificial sequence
  SiRNA target sequence
tgacattgtaattgatacaattgtcaa

SEQ ID NO: 49476 - DNA, 27 bp, Artificial sequence
  SiRNA target sequence
gacattgtaattgatacaattgtcaaa

SEQ ID NO: 49477 - DNA, 27 bp, Artificial sequence
  SiRNA target sequence
acattgtaattgatacaattgtcaaaa

SEQ ID NO: 49478 - DNA, 27 bp, Artificial sequence
  SiRNA target sequence
cattgtaattgatacaattgtcaaaac

SEQ ID NO: 49479 - DNA, 27 bp, Artificial sequence
  SiRNA target sequence
attgtaattgatacaattgtcaaaact

SEQ ID NO: 49480 - DNA, 27 bp, Artificial sequence
  SiRNA target sequence
ttgtaattgatacaattgtcaaaactg

SEQ ID NO: 49481 - DNA, 27 bp, Artificial sequence
  SiRNA target sequence
tgtaattgatacaattgtcaaaactgc

SEQ ID NO: 49482 - DNA, 27 bp, Artificial sequence
  SiRNA target sequence
gtaattgatacaattgtcaaaactgca

SEQ ID NO: 49483 - DNA, 27 bp, Artificial sequence
  SiRNA target sequence
taattgatacaattgtcaaaactgcaa

SEQ ID NO: 49484 - DNA, 27 bp, Artificial sequence
  SiRNA target sequence
aattgatacaattgtcaaaactgcaaa

SEQ ID NO: 49485 - DNA, 27 bp, Artificial sequence
  SiRNA target sequence
attgatacaattgtcaaaactgcaaaa

SEQ ID NO: 49486 - DNA, 27 bp, Artificial sequence
  SiRNA target sequence
ttgatacaattgtcaaaactgcaaaat

SEQ ID NO: 49487 - DNA, 27 bp, Artificial sequence
  SiRNA target sequence
tgatacaattgtcaaaactgcaaaata

SEQ ID NO: 49488 - DNA, 27 bp, Artificial sequence
  SiRNA target sequence
gatacaattgtcaaaactgcaaaatac

SEQ ID NO: 49489 - DNA, 27 bp, Artificial sequence
  SiRNA target sequence
atacaattgtcaaaactgcaaaataca

SEQ ID NO: 49490 - DNA, 27 bp, Artificial sequence
  SiRNA target sequence
tacaattgtcaaaactgcaaaatacaa

SEQ ID NO: 49491 - DNA, 27 bp, Artificial sequence
  SiRNA target sequence
acaattgtcaaaactgcaaaatacaaa

SEQ ID NO: 49492 - DNA, 27 bp, Artificial sequence
  SiRNA target sequence
caattgtcaaaactgcaaaatacaaaa

SEQ ID NO: 49493 - DNA, 27 bp, Artificial sequence
  SiRNA target sequence
aattgtcaaaactgcaaaatacaaaag

SEQ ID NO: 49494 - DNA, 27 bp, Artificial sequence
  SiRNA target sequence
attgtcaaaactgcaaaatacaaaaga

SEQ ID NO: 49495 - DNA, 27 bp, Artificial sequence
  SiRNA target sequence
ttgtcaaaactgcaaaatacaaaagac

SEQ ID NO: 49496 - DNA, 27 bp, Artificial sequence
  SiRNA target sequence
tgtcaaaactgcaaaatacaaaagact

SEQ ID NO: 49497 - DNA, 27 bp, Artificial sequence
  SiRNA target sequence
gtcaaaactgcaaaatacaaaagactt

SEQ ID NO: 49498 - DNA, 27 bp, Artificial sequence
  SiRNA target sequence
tcaaaactgcaaaatacaaaagacttt

SEQ ID NO: 49499 - DNA, 27 bp, Artificial sequence
  SiRNA target sequence
caaaactgcaaaatacaaaagactttg

SEQ ID NO: 49500 - DNA, 27 bp, Artificial sequence
  SiRNA target sequence
aaaactgcaaaatacaaaagactttga

SEQ ID NO: 49501 - DNA, 27 bp, Artificial sequence
  SiRNA target sequence
aaactgcaaaatacaaaagactttgac

SEQ ID NO: 49502 - DNA, 27 bp, Artificial sequence
  SiRNA target sequence
aactgcaaaatacaaaagactttgact

SEQ ID NO: 49503 - DNA, 27 bp, Artificial sequence
  SiRNA target sequence
actgcaaaatacaaaagactttgacta

SEQ ID NO: 49504 - DNA, 27 bp, Artificial sequence
  SiRNA target sequence
ctgcaaaatacaaaagactttgactaa

SEQ ID NO: 49505 - DNA, 27 bp, Artificial sequence
  SiRNA target sequence
tgcaaaatacaaaagactttgactaag

SEQ ID NO: 49506 - DNA, 27 bp, Artificial sequence
  SiRNA target sequence
gcaaaatacaaaagactttgactaaga

SEQ ID NO: 49507 - DNA, 27 bp, Artificial sequence
  SiRNA target sequence
caaaatacaaaagactttgactaagat

SEQ ID NO: 49508 - DNA, 27 bp, Artificial sequence
  SiRNA target sequence
aaaatacaaaagactttgactaagatc

SEQ ID NO: 49509 - DNA, 27 bp, Artificial sequence
  SiRNA target sequence
aaatacaaaagactttgactaagatct

SEQ ID NO: 49510 - DNA, 27 bp, Artificial sequence
  SiRNA target sequence
aatacaaaagactttgactaagatctt

SEQ ID NO: 49511 - DNA, 27 bp, Artificial sequence
  SiRNA target sequence
atacaaaagactttgactaagatcttt

SEQ ID NO: 49512 - DNA, 27 bp, Artificial sequence
  SiRNA target sequence
tacaaaagactttgactaagatcttta

SEQ ID NO: 49513 - DNA, 27 bp, Artificial sequence
  SiRNA target sequence
acaaaagactttgactaagatctttat

SEQ ID NO: 49514 - DNA, 27 bp, Artificial sequence
  SiRNA target sequence
caaaagactttgactaagatctttatt

SEQ ID NO: 49515 - DNA, 27 bp, Artificial sequence
  SiRNA target sequence
aaaagactttgactaagatctttatta

SEQ ID NO: 49516 - DNA, 27 bp, Artificial sequence
  SiRNA target sequence
aaagactttgactaagatctttattat

SEQ ID NO: 49517 - DNA, 27 bp, Artificial sequence
  SiRNA target sequence
aagactttgactaagatctttattatc

SEQ ID NO: 49518 - DNA, 27 bp, Artificial sequence
  SiRNA target sequence
agactttgactaagatctttattatct

SEQ ID NO: 49519 - DNA, 27 bp, Artificial sequence
  SiRNA target sequence
gactttgactaagatctttattatctg

SEQ ID NO: 49520 - DNA, 27 bp, Artificial sequence
  SiRNA target sequence
actttgactaagatctttattatctgt

SEQ ID NO: 49521 - DNA, 27 bp, Artificial sequence
  SiRNA target sequence
ctttgactaagatctttattatctgta

SEQ ID NO: 49522 - DNA, 27 bp, Artificial sequence
  SiRNA target sequence
tttgactaagatctttattatctgtaa

SEQ ID NO: 49523 - DNA, 27 bp, Artificial sequence
  SiRNA target sequence
ttgactaagatctttattatctgtaat

SEQ ID NO: 49524 - DNA, 27 bp, Artificial sequence
  SiRNA target sequence
tgactaagatctttattatctgtaata

SEQ ID NO: 49525 - DNA, 27 bp, Artificial sequence
  SiRNA target sequence
gactaagatctttattatctgtaatat

SEQ ID NO: 49526 - DNA, 27 bp, Artificial sequence
  SiRNA target sequence
actaagatctttattatctgtaatatc

SEQ ID NO: 49527 - DNA, 27 bp, Artificial sequence
  SiRNA target sequence
ctaagatctttattatctgtaatatca

SEQ ID NO: 49528 - DNA, 27 bp, Artificial sequence
  SiRNA target sequence
taagatctttattatctgtaatatcac

SEQ ID NO: 49529 - DNA, 27 bp, Artificial sequence
  SiRNA target sequence
aagatctttattatctgtaatatcact

SEQ ID NO: 49530 - DNA, 27 bp, Artificial sequence
  SiRNA target sequence
agatctttattatctgtaatatcacta

SEQ ID NO: 49531 - DNA, 27 bp, Artificial sequence
  SiRNA target sequence
gatctttattatctgtaatatcactag

SEQ ID NO: 49532 - DNA, 27 bp, Artificial sequence
  SiRNA target sequence
atctttattatctgtaatatcactagt

SEQ ID NO: 49533 - DNA, 27 bp, Artificial sequence
  SiRNA target sequence
tctttattatctgtaatatcactagtc

SEQ ID NO: 49534 - DNA, 27 bp, Artificial sequence
  SiRNA target sequence
ctttattatctgtaatatcactagtca

SEQ ID NO: 49535 - DNA, 27 bp, Artificial sequence
  SiRNA target sequence
tttattatctgtaatatcactagtcaa

SEQ ID NO: 49536 - DNA, 27 bp, Artificial sequence
  SiRNA target sequence
ttattatctgtaatatcactagtcaat

SEQ ID NO: 49537 - DNA, 27 bp, Artificial sequence
  SiRNA target sequence
tattatctgtaatatcactagtcaatt

SEQ ID NO: 49538 - DNA, 27 bp, Artificial sequence
  SiRNA target sequence
attatctgtaatatcactagtcaattt

SEQ ID NO: 49539 - DNA, 27 bp, Artificial sequence
  SiRNA target sequence
ttatctgtaatatcactagtcaatttc

SEQ ID NO: 49540 - DNA, 27 bp, Artificial sequence
  SiRNA target sequence
tatctgtaatatcactagtcaatttcc

SEQ ID NO: 49541 - DNA, 27 bp, Artificial sequence
  SiRNA target sequence
atctgtaatatcactagtcaatttccg

SEQ ID NO: 49542 - DNA, 27 bp, Artificial sequence
  SiRNA target sequence
tctgtaatatcactagtcaatttccgg

SEQ ID NO: 49543 - DNA, 27 bp, Artificial sequence
  SiRNA target sequence
ctgtaatatcactagtcaatttccggg

SEQ ID NO: 49544 - DNA, 27 bp, Artificial sequence
  SiRNA target sequence
tgtaatatcactagtcaatttccgggt

SEQ ID NO: 49545 - DNA, 27 bp, Artificial sequence
  SiRNA target sequence
gtaatatcactagtcaatttccgggta

SEQ ID NO: 49546 - DNA, 27 bp, Artificial sequence
  SiRNA target sequence
taatatcactagtcaatttccgggtag

SEQ ID NO: 49547 - DNA, 27 bp, Artificial sequence
  SiRNA target sequence
aatatcactagtcaatttccgggtagc

SEQ ID NO: 49548 - DNA, 27 bp, Artificial sequence
  SiRNA target sequence
atatcactagtcaatttccgggtagct

SEQ ID NO: 49549 - DNA, 27 bp, Artificial sequence
  SiRNA target sequence
tatcactagtcaatttccgggtagctt

SEQ ID NO: 49550 - DNA, 27 bp, Artificial sequence
  SiRNA target sequence
atcactagtcaatttccgggtagcttc

SEQ ID NO: 49551 - DNA, 27 bp, Artificial sequence
  SiRNA target sequence
tcactagtcaatttccgggtagcttca

SEQ ID NO: 49552 - DNA, 27 bp, Artificial sequence
  SiRNA target sequence
cactagtcaatttccgggtagcttcaa

SEQ ID NO: 49553 - DNA, 27 bp, Artificial sequence
  SiRNA target sequence
actagtcaatttccgggtagcttcaac

SEQ ID NO: 49554 - DNA, 27 bp, Artificial sequence
  SiRNA target sequence
ctagtcaatttccgggtagcttcaact

SEQ ID NO: 49555 - DNA, 27 bp, Artificial sequence
  SiRNA target sequence
tagtcaatttccgggtagcttcaactg

SEQ ID NO: 49556 - DNA, 27 bp, Artificial sequence
  SiRNA target sequence
agtcaatttccgggtagcttcaactgt

SEQ ID NO: 49557 - DNA, 27 bp, Artificial sequence
  SiRNA target sequence
gtcaatttccgggtagcttcaactgtt

SEQ ID NO: 49558 - DNA, 27 bp, Artificial sequence
  SiRNA target sequence
tcaatttccgggtagcttcaactgtta

SEQ ID NO: 49559 - DNA, 27 bp, Artificial sequence
  SiRNA target sequence
caatttccgggtagcttcaactgttaa

SEQ ID NO: 49560 - DNA, 27 bp, Artificial sequence
  SiRNA target sequence
aatttccgggtagcttcaactgttaaa

SEQ ID NO: 49561 - DNA, 27 bp, Artificial sequence
  SiRNA target sequence
atttccgggtagcttcaactgttaaaa

SEQ ID NO: 49562 - DNA, 27 bp, Artificial sequence
  SiRNA target sequence
tttccgggtagcttcaactgttaaaac

SEQ ID NO: 49563 - DNA, 27 bp, Artificial sequence
  SiRNA target sequence
ttccgggtagcttcaactgttaaaaca

SEQ ID NO: 49564 - DNA, 27 bp, Artificial sequence
  SiRNA target sequence
tccgggtagcttcaactgttaaaacat

SEQ ID NO: 49565 - DNA, 27 bp, Artificial sequence
  SiRNA target sequence
ccgggtagcttcaactgttaaaacatt

SEQ ID NO: 49566 - DNA, 27 bp, Artificial sequence
  SiRNA target sequence
cgggtagcttcaactgttaaaacatta

SEQ ID NO: 49567 - DNA, 27 bp, Artificial sequence
  SiRNA target sequence
gggtagcttcaactgttaaaacattaa

SEQ ID NO: 49568 - DNA, 27 bp, Artificial sequence
  SiRNA target sequence
ggtagcttcaactgttaaaacattaaa

SEQ ID NO: 49569 - DNA, 27 bp, Artificial sequence
  SiRNA target sequence
gtagcttcaactgttaaaacattaaat

SEQ ID NO: 49570 - DNA, 27 bp, Artificial sequence
  SiRNA target sequence
tagcttcaactgttaaaacattaaatg

SEQ ID NO: 49571 - DNA, 27 bp, Artificial sequence
  SiRNA target sequence
agcttcaactgttaaaacattaaatgt

SEQ ID NO: 49572 - DNA, 27 bp, Artificial sequence
  SiRNA target sequence
gcttcaactgttaaaacattaaatgta

SEQ ID NO: 49573 - DNA, 27 bp, Artificial sequence
  SiRNA target sequence
cttcaactgttaaaacattaaatgtac

SEQ ID NO: 49574 - DNA, 27 bp, Artificial sequence
  SiRNA target sequence
ttcaactgttaaaacattaaatgtaca

SEQ ID NO: 49575 - DNA, 27 bp, Artificial sequence
  SiRNA target sequence
tcaactgttaaaacattaaatgtacaa

SEQ ID NO: 49576 - DNA, 27 bp, Artificial sequence
  SiRNA target sequence
caactgttaaaacattaaatgtacaaa

SEQ ID NO: 49577 - DNA, 27 bp, Artificial sequence
  SiRNA target sequence
aactgttaaaacattaaatgtacaaac

SEQ ID NO: 49578 - DNA, 27 bp, Artificial sequence
  SiRNA target sequence
actgttaaaacattaaatgtacaaact

SEQ ID NO: 49579 - DNA, 27 bp, Artificial sequence
  SiRNA target sequence
ctgttaaaacattaaatgtacaaactg

SEQ ID NO: 49580 - DNA, 27 bp, Artificial sequence
  SiRNA target sequence
tgttaaaacattaaatgtacaaactgc

SEQ ID NO: 49581 - DNA, 27 bp, Artificial sequence
  SiRNA target sequence
gttaaaacattaaatgtacaaactgca

SEQ ID NO: 49582 - DNA, 27 bp, Artificial sequence
  SiRNA target sequence
ttaaaacattaaatgtacaaactgcaa

SEQ ID NO: 49583 - DNA, 27 bp, Artificial sequence
  SiRNA target sequence
taaaacattaaatgtacaaactgcaaa

SEQ ID NO: 49584 - DNA, 27 bp, Artificial sequence
  SiRNA target sequence
aaaacattaaatgtacaaactgcaaat

SEQ ID NO: 49585 - DNA, 27 bp, Artificial sequence
  SiRNA target sequence
aaacattaaatgtacaaactgcaaatg

SEQ ID NO: 49586 - DNA, 27 bp, Artificial sequence
  SiRNA target sequence
aacattaaatgtacaaactgcaaatgt

SEQ ID NO: 49587 - DNA, 27 bp, Artificial sequence
  SiRNA target sequence
acattaaatgtacaaactgcaaatgtc

SEQ ID NO: 49588 - DNA, 27 bp, Artificial sequence
  SiRNA target sequence
cattaaatgtacaaactgcaaatgtcc

SEQ ID NO: 49589 - DNA, 27 bp, Artificial sequence
  SiRNA target sequence
attaaatgtacaaactgcaaatgtccc

SEQ ID NO: 49590 - DNA, 27 bp, Artificial sequence
  SiRNA target sequence
ttaaatgtacaaactgcaaatgtccca

SEQ ID NO: 49591 - DNA, 27 bp, Artificial sequence
  SiRNA target sequence
taaatgtacaaactgcaaatgtcccaa

SEQ ID NO: 49592 - DNA, 27 bp, Artificial sequence
  SiRNA target sequence
aaatgtacaaactgcaaatgtcccaaa

SEQ ID NO: 49593 - DNA, 27 bp, Artificial sequence
  SiRNA target sequence
aatgtacaaactgcaaatgtcccaaaa

SEQ ID NO: 49594 - DNA, 27 bp, Artificial sequence
  SiRNA target sequence
atgtacaaactgcaaatgtcccaaaaa

SEQ ID NO: 49595 - DNA, 27 bp, Artificial sequence
  SiRNA target sequence
tgtacaaactgcaaatgtcccaaaaat

SEQ ID NO: 49596 - DNA, 27 bp, Artificial sequence
  SiRNA target sequence
gtacaaactgcaaatgtcccaaaaatt

SEQ ID NO: 49597 - DNA, 27 bp, Artificial sequence
  SiRNA target sequence
tacaaactgcaaatgtcccaaaaatta

SEQ ID NO: 49598 - DNA, 27 bp, Artificial sequence
  SiRNA target sequence
acaaactgcaaatgtcccaaaaattat

SEQ ID NO: 49599 - DNA, 27 bp, Artificial sequence
  SiRNA target sequence
caaactgcaaatgtcccaaaaattatg

SEQ ID NO: 49600 - DNA, 27 bp, Artificial sequence
  SiRNA target sequence
aaactgcaaatgtcccaaaaattatgt

SEQ ID NO: 49601 - DNA, 27 bp, Artificial sequence
  SiRNA target sequence
aactgcaaatgtcccaaaaattatgta

SEQ ID NO: 49602 - DNA, 27 bp, Artificial sequence
  SiRNA target sequence
actgcaaatgtcccaaaaattatgtaa

SEQ ID NO: 49603 - DNA, 27 bp, Artificial sequence
  SiRNA target sequence
ctgcaaatgtcccaaaaattatgtaaa

SEQ ID NO: 49604 - DNA, 27 bp, Artificial sequence
  SiRNA target sequence
tgcaaatgtcccaaaaattatgtaaat

SEQ ID NO: 49605 - DNA, 27 bp, Artificial sequence
  SiRNA target sequence
gcaaatgtcccaaaaattatgtaaatg

SEQ ID NO: 49606 - DNA, 27 bp, Artificial sequence
  SiRNA target sequence
caaatgtcccaaaaattatgtaaatga

SEQ ID NO: 49607 - DNA, 27 bp, Artificial sequence
  SiRNA target sequence
aaatgtcccaaaaattatgtaaatgac

SEQ ID NO: 49608 - DNA, 27 bp, Artificial sequence
  SiRNA target sequence
aatgtcccaaaaattatgtaaatgaca

SEQ ID NO: 49609 - DNA, 27 bp, Artificial sequence
  SiRNA target sequence
atgtcccaaaaattatgtaaatgacaa

SEQ ID NO: 49610 - DNA, 27 bp, Artificial sequence
  SiRNA target sequence
tgtcccaaaaattatgtaaatgacaaa

SEQ ID NO: 49611 - DNA, 27 bp, Artificial sequence
  SiRNA target sequence
gtcccaaaaattatgtaaatgacaaat

SEQ ID NO: 49612 - DNA, 27 bp, Artificial sequence
  SiRNA target sequence
tcccaaaaattatgtaaatgacaaatg

SEQ ID NO: 49613 - DNA, 27 bp, Artificial sequence
  SiRNA target sequence
cccaaaaattatgtaaatgacaaatgt

SEQ ID NO: 49614 - DNA, 27 bp, Artificial sequence
  SiRNA target sequence
ccaaaaattatgtaaatgacaaatgtt

SEQ ID NO: 49615 - DNA, 27 bp, Artificial sequence
  SiRNA target sequence
caaaaattatgtaaatgacaaatgttc

SEQ ID NO: 49616 - DNA, 27 bp, Artificial sequence
  SiRNA target sequence
aaaaattatgtaaatgacaaatgttcg

SEQ ID NO: 49617 - DNA, 27 bp, Artificial sequence
  SiRNA target sequence
aaaattatgtaaatgacaaatgttcga

SEQ ID NO: 49618 - DNA, 27 bp, Artificial sequence
  SiRNA target sequence
aaattatgtaaatgacaaatgttcgaa

SEQ ID NO: 49619 - DNA, 27 bp, Artificial sequence
  SiRNA target sequence
aattatgtaaatgacaaatgttcgaat

SEQ ID NO: 49620 - DNA, 27 bp, Artificial sequence
  SiRNA target sequence
attatgtaaatgacaaatgttcgaata

SEQ ID NO: 49621 - DNA, 27 bp, Artificial sequence
  SiRNA target sequence
ttatgtaaatgacaaatgttcgaataa

SEQ ID NO: 49622 - DNA, 27 bp, Artificial sequence
  SiRNA target sequence
tatgtaaatgacaaatgttcgaataaa

SEQ ID NO: 49623 - DNA, 27 bp, Artificial sequence
  SiRNA target sequence
atgtaaatgacaaatgttcgaataaag

SEQ ID NO: 49624 - DNA, 27 bp, Artificial sequence
  SiRNA target sequence
tgtaaatgacaaatgttcgaataaagg

SEQ ID NO: 49625 - DNA, 27 bp, Artificial sequence
  SiRNA target sequence
gtaaatgacaaatgttcgaataaaggg

SEQ ID NO: 49626 - DNA, 27 bp, Artificial sequence
  SiRNA target sequence
taaatgacaaatgttcgaataaagggc

SEQ ID NO: 49627 - DNA, 27 bp, Artificial sequence
  SiRNA target sequence
aaatgacaaatgttcgaataaagggct

SEQ ID NO: 49628 - DNA, 27 bp, Artificial sequence
  SiRNA target sequence
aatgacaaatgttcgaataaagggctt

SEQ ID NO: 49629 - DNA, 27 bp, Artificial sequence
  SiRNA target sequence
atgacaaatgttcgaataaagggcttt

SEQ ID NO: 49630 - DNA, 27 bp, Artificial sequence
  SiRNA target sequence
tgacaaatgttcgaataaagggctttg

SEQ ID NO: 49631 - DNA, 27 bp, Artificial sequence
  SiRNA target sequence
gacaaatgttcgaataaagggctttga

SEQ ID NO: 49632 - DNA, 27 bp, Artificial sequence
  SiRNA target sequence
acaaatgttcgaataaagggctttgaa

SEQ ID NO: 49633 - DNA, 27 bp, Artificial sequence
  SiRNA target sequence
caaatgttcgaataaagggctttgaaa

SEQ ID NO: 49634 - DNA, 27 bp, Artificial sequence
  SiRNA target sequence
aaatgttcgaataaagggctttgaaat

SEQ ID NO: 49635 - DNA, 27 bp, Artificial sequence
  SiRNA target sequence
aatgttcgaataaagggctttgaaata

SEQ ID NO: 49636 - DNA, 27 bp, Artificial sequence
  SiRNA target sequence
atgttcgaataaagggctttgaaataa

SEQ ID NO: 49637 - DNA, 27 bp, Artificial sequence
  SiRNA target sequence
tgttcgaataaagggctttgaaataac

SEQ ID NO: 49638 - DNA, 27 bp, Artificial sequence
  SiRNA target sequence
gttcgaataaagggctttgaaataaca

SEQ ID NO: 49639 - DNA, 27 bp, Artificial sequence
  SiRNA target sequence
ttcgaataaagggctttgaaataacat

SEQ ID NO: 49640 - DNA, 27 bp, Artificial sequence
  SiRNA target sequence
tcgaataaagggctttgaaataacata

SEQ ID NO: 49641 - DNA, 27 bp, Artificial sequence
  SiRNA target sequence
cgaataaagggctttgaaataacatat

SEQ ID NO: 49642 - DNA, 27 bp, Artificial sequence
  SiRNA target sequence
gaataaagggctttgaaataacatatt

SEQ ID NO: 49643 - DNA, 27 bp, Artificial sequence
  SiRNA target sequence
aataaagggctttgaaataacatattc

SEQ ID NO: 49644 - DNA, 27 bp, Artificial sequence
  SiRNA target sequence
ataaagggctttgaaataacatattct

SEQ ID NO: 49645 - DNA, 27 bp, Artificial sequence
  SiRNA target sequence
taaagggctttgaaataacatattcta

SEQ ID NO: 49646 - DNA, 27 bp, Artificial sequence
  SiRNA target sequence
aaagggctttgaaataacatattctac

SEQ ID NO: 49647 - DNA, 27 bp, Artificial sequence
  SiRNA target sequence
aagggctttgaaataacatattctaca

SEQ ID NO: 49648 - DNA, 27 bp, Artificial sequence
  SiRNA target sequence
agggctttgaaataacatattctacaa

SEQ ID NO: 49649 - DNA, 27 bp, Artificial sequence
  SiRNA target sequence
gggctttgaaataacatattctacaat

SEQ ID NO: 49650 - DNA, 27 bp, Artificial sequence
  SiRNA target sequence
ggctttgaaataacatattctacaatc

SEQ ID NO: 49651 - DNA, 27 bp, Artificial sequence
  SiRNA target sequence
gctttgaaataacatattctacaatca

SEQ ID NO: 49652 - DNA, 27 bp, Artificial sequence
  SiRNA target sequence
ctttgaaataacatattctacaatcag

SEQ ID NO: 49653 - DNA, 27 bp, Artificial sequence
  SiRNA target sequence
tttgaaataacatattctacaatcagg

SEQ ID NO: 49654 - DNA, 27 bp, Artificial sequence
  SiRNA target sequence
ttgaaataacatattctacaatcaggt

SEQ ID NO: 49655 - DNA, 27 bp, Artificial sequence
  SiRNA target sequence
tgaaataacatattctacaatcaggtc

SEQ ID NO: 49656 - DNA, 27 bp, Artificial sequence
  SiRNA target sequence
gaaataacatattctacaatcaggtct

SEQ ID NO: 49657 - DNA, 27 bp, Artificial sequence
  SiRNA target sequence
aaataacatattctacaatcaggtctt

SEQ ID NO: 49658 - DNA, 27 bp, Artificial sequence
  SiRNA target sequence
aataacatattctacaatcaggtcttt

SEQ ID NO: 49659 - DNA, 27 bp, Artificial sequence
  SiRNA target sequence
ataacatattctacaatcaggtctttc

SEQ ID NO: 49660 - DNA, 27 bp, Artificial sequence
  SiRNA target sequence
taacatattctacaatcaggtctttca

SEQ ID NO: 49661 - DNA, 27 bp, Artificial sequence
  SiRNA target sequence
aacatattctacaatcaggtctttcat

SEQ ID NO: 49662 - DNA, 27 bp, Artificial sequence
  SiRNA target sequence
acatattctacaatcaggtctttcata

SEQ ID NO: 49663 - DNA, 27 bp, Artificial sequence
  SiRNA target sequence
catattctacaatcaggtctttcataa

SEQ ID NO: 49664 - DNA, 27 bp, Artificial sequence
  SiRNA target sequence
atattctacaatcaggtctttcataat

SEQ ID NO: 49665 - DNA, 27 bp, Artificial sequence
  SiRNA target sequence
tattctacaatcaggtctttcataata

SEQ ID NO: 49666 - DNA, 27 bp, Artificial sequence
  SiRNA target sequence
attctacaatcaggtctttcataatac

SEQ ID NO: 49667 - DNA, 27 bp, Artificial sequence
  SiRNA target sequence
ttctacaatcaggtctttcataatact

SEQ ID NO: 49668 - DNA, 27 bp, Artificial sequence
  SiRNA target sequence
tctacaatcaggtctttcataatacta

SEQ ID NO: 49669 - DNA, 27 bp, Artificial sequence
  SiRNA target sequence
ctacaatcaggtctttcataatactaa

SEQ ID NO: 49670 - DNA, 27 bp, Artificial sequence
  SiRNA target sequence
tacaatcaggtctttcataatactaat

SEQ ID NO: 49671 - DNA, 27 bp, Artificial sequence
  SiRNA target sequence
acaatcaggtctttcataatactaata

SEQ ID NO: 49672 - DNA, 27 bp, Artificial sequence
  SiRNA target sequence
caatcaggtctttcataatactaatat

SEQ ID NO: 49673 - DNA, 27 bp, Artificial sequence
  SiRNA target sequence
aatcaggtctttcataatactaatatc

SEQ ID NO: 49674 - DNA, 27 bp, Artificial sequence
  SiRNA target sequence
atcaggtctttcataatactaatatca

SEQ ID NO: 49675 - DNA, 27 bp, Artificial sequence
  SiRNA target sequence
tcaggtctttcataatactaatatcac

SEQ ID NO: 49676 - DNA, 27 bp, Artificial sequence
  SiRNA target sequence
caggtctttcataatactaatatcact

SEQ ID NO: 49677 - DNA, 27 bp, Artificial sequence
  SiRNA target sequence
aggtctttcataatactaatatcacta

SEQ ID NO: 49678 - DNA, 27 bp, Artificial sequence
  SiRNA target sequence
ggtctttcataatactaatatcactac

SEQ ID NO: 49679 - DNA, 27 bp, Artificial sequence
  SiRNA target sequence
gtctttcataatactaatatcactacc

SEQ ID NO: 49680 - DNA, 27 bp, Artificial sequence
  SiRNA target sequence
tctttcataatactaatatcactacca

SEQ ID NO: 49681 - DNA, 27 bp, Artificial sequence
  SiRNA target sequence
ctttcataatactaatatcactaccat

SEQ ID NO: 49682 - DNA, 27 bp, Artificial sequence
  SiRNA target sequence
tttcataatactaatatcactaccata

SEQ ID NO: 49683 - DNA, 27 bp, Artificial sequence
  SiRNA target sequence
ttcataatactaatatcactaccataa

SEQ ID NO: 49684 - DNA, 27 bp, Artificial sequence
  SiRNA target sequence
tcataatactaatatcactaccataaa

SEQ ID NO: 49685 - DNA, 27 bp, Artificial sequence
  SiRNA target sequence
cataatactaatatcactaccataaat

SEQ ID NO: 49686 - DNA, 27 bp, Artificial sequence
  SiRNA target sequence
ataatactaatatcactaccataaata

SEQ ID NO: 49687 - DNA, 27 bp, Artificial sequence
  SiRNA target sequence
taatactaatatcactaccataaatag

SEQ ID NO: 49688 - DNA, 27 bp, Artificial sequence
  SiRNA target sequence
aatactaatatcactaccataaataga

SEQ ID NO: 49689 - DNA, 27 bp, Artificial sequence
  SiRNA target sequence
atactaatatcactaccataaatagat

SEQ ID NO: 49690 - DNA, 27 bp, Artificial sequence
  SiRNA target sequence
tactaatatcactaccataaatagatt

SEQ ID NO: 49691 - DNA, 27 bp, Artificial sequence
  SiRNA target sequence
actaatatcactaccataaatagattt

SEQ ID NO: 49692 - DNA, 27 bp, Artificial sequence
  SiRNA target sequence
ctaatatcactaccataaatagatttt

SEQ ID NO: 49693 - DNA, 27 bp, Artificial sequence
  SiRNA target sequence
taatatcactaccataaatagattttt

SEQ ID NO: 49694 - DNA, 27 bp, Artificial sequence
  SiRNA target sequence
aatatcactaccataaatagatttttt

SEQ ID NO: 49695 - DNA, 27 bp, Artificial sequence
  SiRNA target sequence
atatcactaccataaatagattttttt

SEQ ID NO: 49696 - DNA, 27 bp, Artificial sequence
  SiRNA target sequence
tatcactaccataaatagatttttttt

SEQ ID NO: 49697 - DNA, 27 bp, Artificial sequence
  SiRNA target sequence
atcactaccataaatagattttttttc

SEQ ID NO: 49698 - DNA, 27 bp, Artificial sequence
  SiRNA target sequence
tcactaccataaatagattttttttct

SEQ ID NO: 49699 - DNA, 27 bp, Artificial sequence
  SiRNA target sequence
cactaccataaatagattttttttcta

SEQ ID NO: 49700 - DNA, 27 bp, Artificial sequence
  SiRNA target sequence
actaccataaatagattttttttctaa

SEQ ID NO: 49701 - DNA, 27 bp, Artificial sequence
  SiRNA target sequence
ctaccataaatagattttttttctaac

SEQ ID NO: 49702 - DNA, 27 bp, Artificial sequence
  SiRNA target sequence
taccataaatagattttttttctaaca

SEQ ID NO: 49703 - DNA, 27 bp, Artificial sequence
  SiRNA target sequence
accataaatagattttttttctaacat

SEQ ID NO: 49704 - DNA, 19 bp, Artificial sequence
  SiRNA target sequence
atgaaggaaaaaaccaatt

SEQ ID NO: 49705 - DNA, 19 bp, Artificial sequence
  SiRNA target sequence
tgaaggaaaaaaccaatta

SEQ ID NO: 49706 - DNA, 19 bp, Artificial sequence
  SiRNA target sequence
gaaggaaaaaaccaattat

SEQ ID NO: 49707 - DNA, 19 bp, Artificial sequence
  SiRNA target sequence
aaggaaaaaaccaattatg

SEQ ID NO: 49708 - DNA, 19 bp, Artificial sequence
  SiRNA target sequence
aggaaaaaaccaattatga

SEQ ID NO: 49709 - DNA, 19 bp, Artificial sequence
  SiRNA target sequence
ggaaaaaaccaattatgaa

SEQ ID NO: 49710 - DNA, 19 bp, Artificial sequence
  SiRNA target sequence
gaaaaaaccaattatgaaa

SEQ ID NO: 49711 - DNA, 19 bp, Artificial sequence
  SiRNA target sequence
aaaaaaccaattatgaaat

SEQ ID NO: 49712 - DNA, 19 bp, Artificial sequence
  SiRNA target sequence
aaaaaccaattatgaaatt

SEQ ID NO: 49713 - DNA, 19 bp, Artificial sequence
  SiRNA target sequence
aaaaccaattatgaaattt

SEQ ID NO: 49714 - DNA, 19 bp, Artificial sequence
  SiRNA target sequence
aaaccaattatgaaatttt

SEQ ID NO: 49715 - DNA, 19 bp, Artificial sequence
  SiRNA target sequence
aaccaattatgaaatttta

SEQ ID NO: 49716 - DNA, 19 bp, Artificial sequence
  SiRNA target sequence
accaattatgaaattttat

SEQ ID NO: 49717 - DNA, 19 bp, Artificial sequence
  SiRNA target sequence
ccaattatgaaattttata

SEQ ID NO: 49718 - DNA, 19 bp, Artificial sequence
  SiRNA target sequence
caattatgaaattttatat

SEQ ID NO: 49719 - DNA, 19 bp, Artificial sequence
  SiRNA target sequence
aattatgaaattttatatg

SEQ ID NO: 49720 - DNA, 19 bp, Artificial sequence
  SiRNA target sequence
attatgaaattttatatga

SEQ ID NO: 49721 - DNA, 19 bp, Artificial sequence
  SiRNA target sequence
ttatgaaattttatatgat

SEQ ID NO: 49722 - DNA, 19 bp, Artificial sequence
  SiRNA target sequence
tatgaaattttatatgata

SEQ ID NO: 49723 - DNA, 19 bp, Artificial sequence
  SiRNA target sequence
atgaaattttatatgatac

SEQ ID NO: 49724 - DNA, 19 bp, Artificial sequence
  SiRNA target sequence
tgaaattttatatgataca

SEQ ID NO: 49725 - DNA, 19 bp, Artificial sequence
  SiRNA target sequence
gaaattttatatgatacat

SEQ ID NO: 49726 - DNA, 19 bp, Artificial sequence
  SiRNA target sequence
aaattttatatgatacatt

SEQ ID NO: 49727 - DNA, 19 bp, Artificial sequence
  SiRNA target sequence
aattttatatgatacattt

SEQ ID NO: 49728 - DNA, 19 bp, Artificial sequence
  SiRNA target sequence
attttatatgatacatttg

SEQ ID NO: 49729 - DNA, 19 bp, Artificial sequence
  SiRNA target sequence
ttttatatgatacatttgt

SEQ ID NO: 49730 - DNA, 19 bp, Artificial sequence
  SiRNA target sequence
tttatatgatacatttgta

SEQ ID NO: 49731 - DNA, 19 bp, Artificial sequence
  SiRNA target sequence
ttatatgatacatttgtaa

SEQ ID NO: 49732 - DNA, 19 bp, Artificial sequence
  SiRNA target sequence
tatatgatacatttgtaaa

SEQ ID NO: 49733 - DNA, 19 bp, Artificial sequence
  SiRNA target sequence
atatgatacatttgtaaaa

SEQ ID NO: 49734 - DNA, 19 bp, Artificial sequence
  SiRNA target sequence
tatgatacatttgtaaaat

SEQ ID NO: 49735 - DNA, 19 bp, Artificial sequence
  SiRNA target sequence
atgatacatttgtaaaata

SEQ ID NO: 49736 - DNA, 19 bp, Artificial sequence
  SiRNA target sequence
tgatacatttgtaaaatat

SEQ ID NO: 49737 - DNA, 19 bp, Artificial sequence
  SiRNA target sequence
gatacatttgtaaaatatt

SEQ ID NO: 49738 - DNA, 19 bp, Artificial sequence
  SiRNA target sequence
atacatttgtaaaatattg

SEQ ID NO: 49739 - DNA, 19 bp, Artificial sequence
  SiRNA target sequence
tacatttgtaaaatattgt

SEQ ID NO: 49740 - DNA, 19 bp, Artificial sequence
  SiRNA target sequence
acatttgtaaaatattgtt

SEQ ID NO: 49741 - DNA, 19 bp, Artificial sequence
  SiRNA target sequence
catttgtaaaatattgtta

SEQ ID NO: 49742 - DNA, 19 bp, Artificial sequence
  SiRNA target sequence
atttgtaaaatattgttac

SEQ ID NO: 49743 - DNA, 19 bp, Artificial sequence
  SiRNA target sequence
tttgtaaaatattgttaca

SEQ ID NO: 49744 - DNA, 19 bp, Artificial sequence
  SiRNA target sequence
ttgtaaaatattgttacaa

SEQ ID NO: 49745 - DNA, 19 bp, Artificial sequence
  SiRNA target sequence
tgtaaaatattgttacaat

SEQ ID NO: 49746 - DNA, 19 bp, Artificial sequence
  SiRNA target sequence
gtaaaatattgttacaata

SEQ ID NO: 49747 - DNA, 19 bp, Artificial sequence
  SiRNA target sequence
taaaatattgttacaatat

SEQ ID NO: 49748 - DNA, 19 bp, Artificial sequence
  SiRNA target sequence
aaaatattgttacaatatt

SEQ ID NO: 49749 - DNA, 19 bp, Artificial sequence
  SiRNA target sequence
aaatattgttacaatattt

SEQ ID NO: 49750 - DNA, 19 bp, Artificial sequence
  SiRNA target sequence
aatattgttacaatatttc

SEQ ID NO: 49751 - DNA, 19 bp, Artificial sequence
  SiRNA target sequence
atattgttacaatatttcc

SEQ ID NO: 49752 - DNA, 19 bp, Artificial sequence
  SiRNA target sequence
tattgttacaatatttcct

SEQ ID NO: 49753 - DNA, 19 bp, Artificial sequence
  SiRNA target sequence
attgttacaatatttccta

SEQ ID NO: 49754 - DNA, 19 bp, Artificial sequence
  SiRNA target sequence
ttgttacaatatttcctat

SEQ ID NO: 49755 - DNA, 19 bp, Artificial sequence
  SiRNA target sequence
tgttacaatatttcctata

SEQ ID NO: 49756 - DNA, 19 bp, Artificial sequence
  SiRNA target sequence
gttacaatatttcctatat

SEQ ID NO: 49757 - DNA, 19 bp, Artificial sequence
  SiRNA target sequence
ttacaatatttcctatata

SEQ ID NO: 49758 - DNA, 19 bp, Artificial sequence
  SiRNA target sequence
tacaatatttcctatataa

SEQ ID NO: 49759 - DNA, 19 bp, Artificial sequence
  SiRNA target sequence
acaatatttcctatataag

SEQ ID NO: 49760 - DNA, 19 bp, Artificial sequence
  SiRNA target sequence
caatatttcctatataagg

SEQ ID NO: 49761 - DNA, 19 bp, Artificial sequence
  SiRNA target sequence
aatatttcctatataaggt

SEQ ID NO: 49762 - DNA, 19 bp, Artificial sequence
  SiRNA target sequence
atatttcctatataaggta

SEQ ID NO: 49763 - DNA, 19 bp, Artificial sequence
  SiRNA target sequence
tatttcctatataaggtac

SEQ ID NO: 49764 - DNA, 19 bp, Artificial sequence
  SiRNA target sequence
atttcctatataaggtacg

SEQ ID NO: 49765 - DNA, 19 bp, Artificial sequence
  SiRNA target sequence
tttcctatataaggtacgt

SEQ ID NO: 49766 - DNA, 19 bp, Artificial sequence
  SiRNA target sequence
ttcctatataaggtacgta

SEQ ID NO: 49767 - DNA, 19 bp, Artificial sequence
  SiRNA target sequence
tcctatataaggtacgtaa

SEQ ID NO: 49768 - DNA, 19 bp, Artificial sequence
  SiRNA target sequence
cctatataaggtacgtaat

SEQ ID NO: 49769 - DNA, 19 bp, Artificial sequence
  SiRNA target sequence
ctatataaggtacgtaatg

SEQ ID NO: 49770 - DNA, 19 bp, Artificial sequence
  SiRNA target sequence
tatataaggtacgtaatgt

SEQ ID NO: 49771 - DNA, 19 bp, Artificial sequence
  SiRNA target sequence
atataaggtacgtaatgtt

SEQ ID NO: 49772 - DNA, 19 bp, Artificial sequence
  SiRNA target sequence
tataaggtacgtaatgttt

SEQ ID NO: 49773 - DNA, 19 bp, Artificial sequence
  SiRNA target sequence
ataaggtacgtaatgtttc

SEQ ID NO: 49774 - DNA, 19 bp, Artificial sequence
  SiRNA target sequence
taaggtacgtaatgtttcc

SEQ ID NO: 49775 - DNA, 19 bp, Artificial sequence
  SiRNA target sequence
aaggtacgtaatgtttccc

SEQ ID NO: 49776 - DNA, 19 bp, Artificial sequence
  SiRNA target sequence
aggtacgtaatgtttccca

SEQ ID NO: 49777 - DNA, 19 bp, Artificial sequence
  SiRNA target sequence
ggtacgtaatgtttcccat

SEQ ID NO: 49778 - DNA, 19 bp, Artificial sequence
  SiRNA target sequence
gtacgtaatgtttcccata

SEQ ID NO: 49779 - DNA, 19 bp, Artificial sequence
  SiRNA target sequence
tacgtaatgtttcccatat

SEQ ID NO: 49780 - DNA, 19 bp, Artificial sequence
  SiRNA target sequence
acgtaatgtttcccatatt

SEQ ID NO: 49781 - DNA, 19 bp, Artificial sequence
  SiRNA target sequence
cgtaatgtttcccatatta

SEQ ID NO: 49782 - DNA, 19 bp, Artificial sequence
  SiRNA target sequence
gtaatgtttcccatattac

SEQ ID NO: 49783 - DNA, 19 bp, Artificial sequence
  SiRNA target sequence
taatgtttcccatattact

SEQ ID NO: 49784 - DNA, 19 bp, Artificial sequence
  SiRNA target sequence
aatgtttcccatattactg

SEQ ID NO: 49785 - DNA, 19 bp, Artificial sequence
  SiRNA target sequence
atgtttcccatattactgt

SEQ ID NO: 49786 - DNA, 19 bp, Artificial sequence
  SiRNA target sequence
tgtttcccatattactgtc

SEQ ID NO: 49787 - DNA, 19 bp, Artificial sequence
  SiRNA target sequence
gtttcccatattactgtct

SEQ ID NO: 49788 - DNA, 19 bp, Artificial sequence
  SiRNA target sequence
tttcccatattactgtcta

SEQ ID NO: 49789 - DNA, 19 bp, Artificial sequence
  SiRNA target sequence
ttcccatattactgtctac

SEQ ID NO: 49790 - DNA, 19 bp, Artificial sequence
  SiRNA target sequence
tcccatattactgtctaca

SEQ ID NO: 49791 - DNA, 19 bp, Artificial sequence
  SiRNA target sequence
cccatattactgtctacaa

SEQ ID NO: 49792 - DNA, 19 bp, Artificial sequence
  SiRNA target sequence
ccatattactgtctacaat

SEQ ID NO: 49793 - DNA, 19 bp, Artificial sequence
  SiRNA target sequence
catattactgtctacaatt

SEQ ID NO: 49794 - DNA, 19 bp, Artificial sequence
  SiRNA target sequence
atattactgtctacaatta

SEQ ID NO: 49795 - DNA, 19 bp, Artificial sequence
  SiRNA target sequence
tattactgtctacaattat

SEQ ID NO: 49796 - DNA, 19 bp, Artificial sequence
  SiRNA target sequence
attactgtctacaattata

SEQ ID NO: 49797 - DNA, 19 bp, Artificial sequence
  SiRNA target sequence
ttactgtctacaattatag

SEQ ID NO: 49798 - DNA, 19 bp, Artificial sequence
  SiRNA target sequence
tactgtctacaattatagc

SEQ ID NO: 49799 - DNA, 19 bp, Artificial sequence
  SiRNA target sequence
actgtctacaattatagct

SEQ ID NO: 49800 - DNA, 19 bp, Artificial sequence
  SiRNA target sequence
ctgtctacaattatagctt

SEQ ID NO: 49801 - DNA, 19 bp, Artificial sequence
  SiRNA target sequence
tgtctacaattatagcttg

SEQ ID NO: 49802 - DNA, 19 bp, Artificial sequence
  SiRNA target sequence
gtctacaattatagcttgt

SEQ ID NO: 49803 - DNA, 19 bp, Artificial sequence
  SiRNA target sequence
tctacaattatagcttgtt

SEQ ID NO: 49804 - DNA, 19 bp, Artificial sequence
  SiRNA target sequence
ctacaattatagcttgtta

SEQ ID NO: 49805 - DNA, 19 bp, Artificial sequence
  SiRNA target sequence
tacaattatagcttgttat

SEQ ID NO: 49806 - DNA, 19 bp, Artificial sequence
  SiRNA target sequence
acaattatagcttgttatc

SEQ ID NO: 49807 - DNA, 19 bp, Artificial sequence
  SiRNA target sequence
caattatagcttgttatct

SEQ ID NO: 49808 - DNA, 19 bp, Artificial sequence
  SiRNA target sequence
aattatagcttgttatctc

SEQ ID NO: 49809 - DNA, 19 bp, Artificial sequence
  SiRNA target sequence
attatagcttgttatctcg

SEQ ID NO: 49810 - DNA, 19 bp, Artificial sequence
  SiRNA target sequence
ttatagcttgttatctcga

SEQ ID NO: 49811 - DNA, 19 bp, Artificial sequence
  SiRNA target sequence
tatagcttgttatctcgaa

SEQ ID NO: 49812 - DNA, 19 bp, Artificial sequence
  SiRNA target sequence
atagcttgttatctcgaag

SEQ ID NO: 49813 - DNA, 19 bp, Artificial sequence
  SiRNA target sequence
tagcttgttatctcgaagt

SEQ ID NO: 49814 - DNA, 19 bp, Artificial sequence
  SiRNA target sequence
agcttgttatctcgaagtt

SEQ ID NO: 49815 - DNA, 19 bp, Artificial sequence
  SiRNA target sequence
gcttgttatctcgaagttc

SEQ ID NO: 49816 - DNA, 19 bp, Artificial sequence
  SiRNA target sequence
cttgttatctcgaagttca

SEQ ID NO: 49817 - DNA, 19 bp, Artificial sequence
  SiRNA target sequence
ttgttatctcgaagttcag

SEQ ID NO: 49818 - DNA, 19 bp, Artificial sequence
  SiRNA target sequence
tgttatctcgaagttcagg

SEQ ID NO: 49819 - DNA, 19 bp, Artificial sequence
  SiRNA target sequence
gttatctcgaagttcaggc

SEQ ID NO: 49820 - DNA, 19 bp, Artificial sequence
  SiRNA target sequence
ttatctcgaagttcaggca

SEQ ID NO: 49821 - DNA, 19 bp, Artificial sequence
  SiRNA target sequence
tatctcgaagttcaggcaa

SEQ ID NO: 49822 - DNA, 19 bp, Artificial sequence
  SiRNA target sequence
atctcgaagttcaggcaag

SEQ ID NO: 49823 - DNA, 19 bp, Artificial sequence
  SiRNA target sequence
tctcgaagttcaggcaagt

SEQ ID NO: 49824 - DNA, 19 bp, Artificial sequence
  SiRNA target sequence
ctcgaagttcaggcaagta

SEQ ID NO: 49825 - DNA, 19 bp, Artificial sequence
  SiRNA target sequence
tcgaagttcaggcaagtaa

SEQ ID NO: 49826 - DNA, 19 bp, Artificial sequence
  SiRNA target sequence
cgaagttcaggcaagtaac

SEQ ID NO: 49827 - DNA, 19 bp, Artificial sequence
  SiRNA target sequence
gaagttcaggcaagtaaca

SEQ ID NO: 49828 - DNA, 19 bp, Artificial sequence
  SiRNA target sequence
aagttcaggcaagtaacat

SEQ ID NO: 49829 - DNA, 19 bp, Artificial sequence
  SiRNA target sequence
agttcaggcaagtaacata

SEQ ID NO: 49830 - DNA, 19 bp, Artificial sequence
  SiRNA target sequence
gttcaggcaagtaacatat

SEQ ID NO: 49831 - DNA, 19 bp, Artificial sequence
  SiRNA target sequence
ttcaggcaagtaacatatc

SEQ ID NO: 49832 - DNA, 19 bp, Artificial sequence
  SiRNA target sequence
tcaggcaagtaacatatca

SEQ ID NO: 49833 - DNA, 19 bp, Artificial sequence
  SiRNA target sequence
caggcaagtaacatatcaa

SEQ ID NO: 49834 - DNA, 19 bp, Artificial sequence
  SiRNA target sequence
aggcaagtaacatatcaaa

SEQ ID NO: 49835 - DNA, 19 bp, Artificial sequence
  SiRNA target sequence
ggcaagtaacatatcaaaa

SEQ ID NO: 49836 - DNA, 19 bp, Artificial sequence
  SiRNA target sequence
gcaagtaacatatcaaaaa

SEQ ID NO: 49837 - DNA, 19 bp, Artificial sequence
  SiRNA target sequence
caagtaacatatcaaaaag

SEQ ID NO: 49838 - DNA, 19 bp, Artificial sequence
  SiRNA target sequence
aagtaacatatcaaaaaga

SEQ ID NO: 49839 - DNA, 19 bp, Artificial sequence
  SiRNA target sequence
agtaacatatcaaaaagaa

SEQ ID NO: 49840 - DNA, 19 bp, Artificial sequence
  SiRNA target sequence
gtaacatatcaaaaagaat

SEQ ID NO: 49841 - DNA, 19 bp, Artificial sequence
  SiRNA target sequence
taacatatcaaaaagaatt

SEQ ID NO: 49842 - DNA, 19 bp, Artificial sequence
  SiRNA target sequence
aacatatcaaaaagaattg

SEQ ID NO: 49843 - DNA, 19 bp, Artificial sequence
  SiRNA target sequence
acatatcaaaaagaattgc

SEQ ID NO: 49844 - DNA, 19 bp, Artificial sequence
  SiRNA target sequence
catatcaaaaagaattgca

SEQ ID NO: 49845 - DNA, 19 bp, Artificial sequence
  SiRNA target sequence
atatcaaaaagaattgcag

SEQ ID NO: 49846 - DNA, 19 bp, Artificial sequence
  SiRNA target sequence
tatcaaaaagaattgcaga

SEQ ID NO: 49847 - DNA, 19 bp, Artificial sequence
  SiRNA target sequence
atcaaaaagaattgcagaa

SEQ ID NO: 49848 - DNA, 19 bp, Artificial sequence
  SiRNA target sequence
tcaaaaagaattgcagaag

SEQ ID NO: 49849 - DNA, 19 bp, Artificial sequence
  SiRNA target sequence
caaaaagaattgcagaaga

SEQ ID NO: 49850 - DNA, 19 bp, Artificial sequence
  SiRNA target sequence
aaaaagaattgcagaagat

SEQ ID NO: 49851 - DNA, 19 bp, Artificial sequence
  SiRNA target sequence
aaaagaattgcagaagatt

SEQ ID NO: 49852 - DNA, 19 bp, Artificial sequence
  SiRNA target sequence
aaagaattgcagaagattt

SEQ ID NO: 49853 - DNA, 19 bp, Artificial sequence
  SiRNA target sequence
aagaattgcagaagatttt

SEQ ID NO: 49854 - DNA, 19 bp, Artificial sequence
  SiRNA target sequence
agaattgcagaagattttg

SEQ ID NO: 49855 - DNA, 19 bp, Artificial sequence
  SiRNA target sequence
gaattgcagaagattttga

SEQ ID NO: 49856 - DNA, 19 bp, Artificial sequence
  SiRNA target sequence
aattgcagaagattttgaa

SEQ ID NO: 49857 - DNA, 19 bp, Artificial sequence
  SiRNA target sequence
attgcagaagattttgaaa

SEQ ID NO: 49858 - DNA, 19 bp, Artificial sequence
  SiRNA target sequence
ttgcagaagattttgaaaa

SEQ ID NO: 49859 - DNA, 19 bp, Artificial sequence
  SiRNA target sequence
tgcagaagattttgaaaat

SEQ ID NO: 49860 - DNA, 19 bp, Artificial sequence
  SiRNA target sequence
gcagaagattttgaaaata

SEQ ID NO: 49861 - DNA, 19 bp, Artificial sequence
  SiRNA target sequence
cagaagattttgaaaataa

SEQ ID NO: 49862 - DNA, 19 bp, Artificial sequence
  SiRNA target sequence
agaagattttgaaaataaa

SEQ ID NO: 49863 - DNA, 19 bp, Artificial sequence
  SiRNA target sequence
gaagattttgaaaataaaa

SEQ ID NO: 49864 - DNA, 19 bp, Artificial sequence
  SiRNA target sequence
aagattttgaaaataaaat

SEQ ID NO: 49865 - DNA, 19 bp, Artificial sequence
  SiRNA target sequence
agattttgaaaataaaata

SEQ ID NO: 49866 - DNA, 19 bp, Artificial sequence
  SiRNA target sequence
gattttgaaaataaaataa

SEQ ID NO: 49867 - DNA, 19 bp, Artificial sequence
  SiRNA target sequence
attttgaaaataaaataaa

SEQ ID NO: 49868 - DNA, 19 bp, Artificial sequence
  SiRNA target sequence
ttttgaaaataaaataaat

SEQ ID NO: 49869 - DNA, 19 bp, Artificial sequence
  SiRNA target sequence
tttgaaaataaaataaatg

SEQ ID NO: 49870 - DNA, 19 bp, Artificial sequence
  SiRNA target sequence
ttgaaaataaaataaatgc

SEQ ID NO: 49871 - DNA, 19 bp, Artificial sequence
  SiRNA target sequence
tgaaaataaaataaatgca

SEQ ID NO: 49872 - DNA, 19 bp, Artificial sequence
  SiRNA target sequence
gaaaataaaataaatgcag

SEQ ID NO: 49873 - DNA, 19 bp, Artificial sequence
  SiRNA target sequence
aaaataaaataaatgcagg

SEQ ID NO: 49874 - DNA, 19 bp, Artificial sequence
  SiRNA target sequence
aaataaaataaatgcagga

SEQ ID NO: 49875 - DNA, 19 bp, Artificial sequence
  SiRNA target sequence
aataaaataaatgcaggaa

SEQ ID NO: 49876 - DNA, 19 bp, Artificial sequence
  SiRNA target sequence
ataaaataaatgcaggaaa

SEQ ID NO: 49877 - DNA, 19 bp, Artificial sequence
  SiRNA target sequence
taaaataaatgcaggaaaa

SEQ ID NO: 49878 - DNA, 19 bp, Artificial sequence
  SiRNA target sequence
aaaataaatgcaggaaaaa

SEQ ID NO: 49879 - DNA, 19 bp, Artificial sequence
  SiRNA target sequence
aaataaatgcaggaaaaag

SEQ ID NO: 49880 - DNA, 19 bp, Artificial sequence
  SiRNA target sequence
aataaatgcaggaaaaagt

SEQ ID NO: 49881 - DNA, 19 bp, Artificial sequence
  SiRNA target sequence
ataaatgcaggaaaaagta

SEQ ID NO: 49882 - DNA, 19 bp, Artificial sequence
  SiRNA target sequence
taaatgcaggaaaaagtat

SEQ ID NO: 49883 - DNA, 19 bp, Artificial sequence
  SiRNA target sequence
aaatgcaggaaaaagtata

SEQ ID NO: 49884 - DNA, 19 bp, Artificial sequence
  SiRNA target sequence
aatgcaggaaaaagtatat

SEQ ID NO: 49885 - DNA, 19 bp, Artificial sequence
  SiRNA target sequence
atgcaggaaaaagtatatt

SEQ ID NO: 49886 - DNA, 19 bp, Artificial sequence
  SiRNA target sequence
tgcaggaaaaagtatattt

SEQ ID NO: 49887 - DNA, 19 bp, Artificial sequence
  SiRNA target sequence
gcaggaaaaagtatattta

SEQ ID NO: 49888 - DNA, 19 bp, Artificial sequence
  SiRNA target sequence
caggaaaaagtatatttaa

SEQ ID NO: 49889 - DNA, 19 bp, Artificial sequence
  SiRNA target sequence
aggaaaaagtatatttaaa

SEQ ID NO: 49890 - DNA, 19 bp, Artificial sequence
  SiRNA target sequence
ggaaaaagtatatttaaat

SEQ ID NO: 49891 - DNA, 19 bp, Artificial sequence
  SiRNA target sequence
gaaaaagtatatttaaata

SEQ ID NO: 49892 - DNA, 19 bp, Artificial sequence
  SiRNA target sequence
aaaaagtatatttaaatat

SEQ ID NO: 49893 - DNA, 19 bp, Artificial sequence
  SiRNA target sequence
aaaagtatatttaaatata

SEQ ID NO: 49894 - DNA, 19 bp, Artificial sequence
  SiRNA target sequence
aaagtatatttaaatatat

SEQ ID NO: 49895 - DNA, 19 bp, Artificial sequence
  SiRNA target sequence
aagtatatttaaatatatt

SEQ ID NO: 49896 - DNA, 19 bp, Artificial sequence
  SiRNA target sequence
agtatatttaaatatattt

SEQ ID NO: 49897 - DNA, 19 bp, Artificial sequence
  SiRNA target sequence
gtatatttaaatatatttt

SEQ ID NO: 49898 - DNA, 19 bp, Artificial sequence
  SiRNA target sequence
tatatttaaatatatttta

SEQ ID NO: 49899 - DNA, 19 bp, Artificial sequence
  SiRNA target sequence
atatttaaatatattttat

SEQ ID NO: 49900 - DNA, 19 bp, Artificial sequence
  SiRNA target sequence
tatttaaatatattttatt

SEQ ID NO: 49901 - DNA, 19 bp, Artificial sequence
  SiRNA target sequence
atttaaatatattttattt

SEQ ID NO: 49902 - DNA, 19 bp, Artificial sequence
  SiRNA target sequence
tttaaatatattttatttt

SEQ ID NO: 49903 - DNA, 19 bp, Artificial sequence
  SiRNA target sequence
ttaaatatattttattttt

SEQ ID NO: 49904 - DNA, 19 bp, Artificial sequence
  SiRNA target sequence
taaatatattttattttta

SEQ ID NO: 49905 - DNA, 19 bp, Artificial sequence
  SiRNA target sequence
aaatatattttatttttaa

SEQ ID NO: 49906 - DNA, 19 bp, Artificial sequence
  SiRNA target sequence
aatatattttatttttaac

SEQ ID NO: 49907 - DNA, 19 bp, Artificial sequence
  SiRNA target sequence
atatattttatttttaact

SEQ ID NO: 49908 - DNA, 19 bp, Artificial sequence
  SiRNA target sequence
tatattttatttttaactt

SEQ ID NO: 49909 - DNA, 19 bp, Artificial sequence
  SiRNA target sequence
atattttatttttaacttc

SEQ ID NO: 49910 - DNA, 19 bp, Artificial sequence
  SiRNA target sequence
tattttatttttaacttca

SEQ ID NO: 49911 - DNA, 19 bp, Artificial sequence
  SiRNA target sequence
attttatttttaacttcat

SEQ ID NO: 49912 - DNA, 19 bp, Artificial sequence
  SiRNA target sequence
ttttatttttaacttcatc

SEQ ID NO: 49913 - DNA, 19 bp, Artificial sequence
  SiRNA target sequence
tttatttttaacttcatca

SEQ ID NO: 49914 - DNA, 19 bp, Artificial sequence
  SiRNA target sequence
ttatttttaacttcatcaa

SEQ ID NO: 49915 - DNA, 19 bp, Artificial sequence
  SiRNA target sequence
tatttttaacttcatcaat

SEQ ID NO: 49916 - DNA, 19 bp, Artificial sequence
  SiRNA target sequence
atttttaacttcatcaata

SEQ ID NO: 49917 - DNA, 19 bp, Artificial sequence
  SiRNA target sequence
tttttaacttcatcaatag

SEQ ID NO: 49918 - DNA, 19 bp, Artificial sequence
  SiRNA target sequence
ttttaacttcatcaatagt

SEQ ID NO: 49919 - DNA, 19 bp, Artificial sequence
  SiRNA target sequence
tttaacttcatcaatagta

SEQ ID NO: 49920 - DNA, 19 bp, Artificial sequence
  SiRNA target sequence
ttaacttcatcaatagtat

SEQ ID NO: 49921 - DNA, 19 bp, Artificial sequence
  SiRNA target sequence
taacttcatcaatagtatt

SEQ ID NO: 49922 - DNA, 19 bp, Artificial sequence
  SiRNA target sequence
aacttcatcaatagtatta

SEQ ID NO: 49923 - DNA, 19 bp, Artificial sequence
  SiRNA target sequence
acttcatcaatagtattaa

SEQ ID NO: 49924 - DNA, 19 bp, Artificial sequence
  SiRNA target sequence
cttcatcaatagtattaag

SEQ ID NO: 49925 - DNA, 19 bp, Artificial sequence
  SiRNA target sequence
ttcatcaatagtattaaga

SEQ ID NO: 49926 - DNA, 19 bp, Artificial sequence
  SiRNA target sequence
tcatcaatagtattaagac

SEQ ID NO: 49927 - DNA, 19 bp, Artificial sequence
  SiRNA target sequence
catcaatagtattaagaca

SEQ ID NO: 49928 - DNA, 19 bp, Artificial sequence
  SiRNA target sequence
atcaatagtattaagacaa

SEQ ID NO: 49929 - DNA, 19 bp, Artificial sequence
  SiRNA target sequence
tcaatagtattaagacaaa

SEQ ID NO: 49930 - DNA, 19 bp, Artificial sequence
  SiRNA target sequence
caatagtattaagacaaat

SEQ ID NO: 49931 - DNA, 19 bp, Artificial sequence
  SiRNA target sequence
aatagtattaagacaaatt

SEQ ID NO: 49932 - DNA, 19 bp, Artificial sequence
  SiRNA target sequence
atagtattaagacaaatta

SEQ ID NO: 49933 - DNA, 19 bp, Artificial sequence
  SiRNA target sequence
tagtattaagacaaattaa

SEQ ID NO: 49934 - DNA, 19 bp, Artificial sequence
  SiRNA target sequence
agtattaagacaaattaat

SEQ ID NO: 49935 - DNA, 19 bp, Artificial sequence
  SiRNA target sequence
gtattaagacaaattaatg

SEQ ID NO: 49936 - DNA, 19 bp, Artificial sequence
  SiRNA target sequence
tattaagacaaattaatga

SEQ ID NO: 49937 - DNA, 19 bp, Artificial sequence
  SiRNA target sequence
attaagacaaattaatgat

SEQ ID NO: 49938 - DNA, 19 bp, Artificial sequence
  SiRNA target sequence
ttaagacaaattaatgata

SEQ ID NO: 49939 - DNA, 19 bp, Artificial sequence
  SiRNA target sequence
taagacaaattaatgatat

SEQ ID NO: 49940 - DNA, 19 bp, Artificial sequence
  SiRNA target sequence
aagacaaattaatgatatt

SEQ ID NO: 49941 - DNA, 19 bp, Artificial sequence
  SiRNA target sequence
agacaaattaatgatattg

SEQ ID NO: 49942 - DNA, 19 bp, Artificial sequence
  SiRNA target sequence
gacaaattaatgatattgt

SEQ ID NO: 49943 - DNA, 19 bp, Artificial sequence
  SiRNA target sequence
acaaattaatgatattgtg

SEQ ID NO: 49944 - DNA, 19 bp, Artificial sequence
  SiRNA target sequence
caaattaatgatattgtgt

SEQ ID NO: 49945 - DNA, 19 bp, Artificial sequence
  SiRNA target sequence
aaattaatgatattgtgtt

SEQ ID NO: 49946 - DNA, 19 bp, Artificial sequence
  SiRNA target sequence
aattaatgatattgtgttt

SEQ ID NO: 49947 - DNA, 19 bp, Artificial sequence
  SiRNA target sequence
attaatgatattgtgttta

SEQ ID NO: 49948 - DNA, 19 bp, Artificial sequence
  SiRNA target sequence
ttaatgatattgtgtttag

SEQ ID NO: 49949 - DNA, 19 bp, Artificial sequence
  SiRNA target sequence
taatgatattgtgtttagc

SEQ ID NO: 49950 - DNA, 19 bp, Artificial sequence
  SiRNA target sequence
aatgatattgtgtttagcg

SEQ ID NO: 49951 - DNA, 19 bp, Artificial sequence
  SiRNA target sequence
atgatattgtgtttagcgg

SEQ ID NO: 49952 - DNA, 19 bp, Artificial sequence
  SiRNA target sequence
tgatattgtgtttagcggg

SEQ ID NO: 49953 - DNA, 19 bp, Artificial sequence
  SiRNA target sequence
gatattgtgtttagcgggc

SEQ ID NO: 49954 - DNA, 19 bp, Artificial sequence
  SiRNA target sequence
atattgtgtttagcgggcc

SEQ ID NO: 49955 - DNA, 19 bp, Artificial sequence
  SiRNA target sequence
tattgtgtttagcgggcca

SEQ ID NO: 49956 - DNA, 19 bp, Artificial sequence
  SiRNA target sequence
attgtgtttagcgggccaa

SEQ ID NO: 49957 - DNA, 19 bp, Artificial sequence
  SiRNA target sequence
ttgtgtttagcgggccaat

SEQ ID NO: 49958 - DNA, 19 bp, Artificial sequence
  SiRNA target sequence
tgtgtttagcgggccaata

SEQ ID NO: 49959 - DNA, 19 bp, Artificial sequence
  SiRNA target sequence
gtgtttagcgggccaatac

SEQ ID NO: 49960 - DNA, 19 bp, Artificial sequence
  SiRNA target sequence
tgtttagcgggccaataca

SEQ ID NO: 49961 - DNA, 19 bp, Artificial sequence
  SiRNA target sequence
gtttagcgggccaatacaa

SEQ ID NO: 49962 - DNA, 19 bp, Artificial sequence
  SiRNA target sequence
tttagcgggccaatacaat

SEQ ID NO: 49963 - DNA, 19 bp, Artificial sequence
  SiRNA target sequence
ttagcgggccaatacaatt

SEQ ID NO: 49964 - DNA, 19 bp, Artificial sequence
  SiRNA target sequence
tagcgggccaatacaattt

SEQ ID NO: 49965 - DNA, 19 bp, Artificial sequence
  SiRNA target sequence
agcgggccaatacaatttt

SEQ ID NO: 49966 - DNA, 19 bp, Artificial sequence
  SiRNA target sequence
gcgggccaatacaattttt

SEQ ID NO: 49967 - DNA, 19 bp, Artificial sequence
  SiRNA target sequence
cgggccaatacaattttta

SEQ ID NO: 49968 - DNA, 19 bp, Artificial sequence
  SiRNA target sequence
gggccaatacaatttttat

SEQ ID NO: 49969 - DNA, 19 bp, Artificial sequence
  SiRNA target sequence
ggccaatacaatttttata

SEQ ID NO: 49970 - DNA, 19 bp, Artificial sequence
  SiRNA target sequence
gccaatacaatttttatat

SEQ ID NO: 49971 - DNA, 19 bp, Artificial sequence
  SiRNA target sequence
ccaatacaatttttatata

SEQ ID NO: 49972 - DNA, 19 bp, Artificial sequence
  SiRNA target sequence
caatacaatttttatataa

SEQ ID NO: 49973 - DNA, 19 bp, Artificial sequence
  SiRNA target sequence
aatacaatttttatataaa

SEQ ID NO: 49974 - DNA, 19 bp, Artificial sequence
  SiRNA target sequence
atacaatttttatataaaa

SEQ ID NO: 49975 - DNA, 19 bp, Artificial sequence
  SiRNA target sequence
tacaatttttatataaaat

SEQ ID NO: 49976 - DNA, 19 bp, Artificial sequence
  SiRNA target sequence
acaatttttatataaaatt

SEQ ID NO: 49977 - DNA, 19 bp, Artificial sequence
  SiRNA target sequence
caatttttatataaaattg

SEQ ID NO: 49978 - DNA, 19 bp, Artificial sequence
  SiRNA target sequence
aatttttatataaaattgt

SEQ ID NO: 49979 - DNA, 19 bp, Artificial sequence
  SiRNA target sequence
atttttatataaaattgtt

SEQ ID NO: 49980 - DNA, 19 bp, Artificial sequence
  SiRNA target sequence
tttttatataaaattgttg

SEQ ID NO: 49981 - DNA, 19 bp, Artificial sequence
  SiRNA target sequence
ttttatataaaattgttgg

SEQ ID NO: 49982 - DNA, 19 bp, Artificial sequence
  SiRNA target sequence
tttatataaaattgttgga

SEQ ID NO: 49983 - DNA, 19 bp, Artificial sequence
  SiRNA target sequence
ttatataaaattgttggag

SEQ ID NO: 49984 - DNA, 19 bp, Artificial sequence
  SiRNA target sequence
tatataaaattgttggagt

SEQ ID NO: 49985 - DNA, 19 bp, Artificial sequence
  SiRNA target sequence
atataaaattgttggagtt

SEQ ID NO: 49986 - DNA, 19 bp, Artificial sequence
  SiRNA target sequence
tataaaattgttggagttg

SEQ ID NO: 49987 - DNA, 19 bp, Artificial sequence
  SiRNA target sequence
ataaaattgttggagttga

SEQ ID NO: 49988 - DNA, 19 bp, Artificial sequence
  SiRNA target sequence
taaaattgttggagttgaa

SEQ ID NO: 49989 - DNA, 19 bp, Artificial sequence
  SiRNA target sequence
aaaattgttggagttgaag

SEQ ID NO: 49990 - DNA, 19 bp, Artificial sequence
  SiRNA target sequence
aaattgttggagttgaagc

SEQ ID NO: 49991 - DNA, 19 bp, Artificial sequence
  SiRNA target sequence
aattgttggagttgaagca

SEQ ID NO: 49992 - DNA, 19 bp, Artificial sequence
  SiRNA target sequence
attgttggagttgaagcat

SEQ ID NO: 49993 - DNA, 19 bp, Artificial sequence
  SiRNA target sequence
ttgttggagttgaagcatt

SEQ ID NO: 49994 - DNA, 19 bp, Artificial sequence
  SiRNA target sequence
tgttggagttgaagcattt

SEQ ID NO: 49995 - DNA, 19 bp, Artificial sequence
  SiRNA target sequence
gttggagttgaagcatttt

SEQ ID NO: 49996 - DNA, 19 bp, Artificial sequence
  SiRNA target sequence
ttggagttgaagcatttta

SEQ ID NO: 49997 - DNA, 19 bp, Artificial sequence
  SiRNA target sequence
tggagttgaagcattttat

SEQ ID NO: 49998 - DNA, 19 bp, Artificial sequence
  SiRNA target sequence
ggagttgaagcattttatc

SEQ ID NO: 49999 - DNA, 19 bp, Artificial sequence
  SiRNA target sequence
gagttgaagcattttatca

SEQ ID NO: 50000 - DNA, 19 bp, Artificial sequence
  SiRNA target sequence
agttgaagcattttatcat

SEQ ID NO: 50001 - DNA, 19 bp, Artificial sequence
  SiRNA target sequence
gttgaagcattttatcatt

SEQ ID NO: 50002 - DNA, 19 bp, Artificial sequence
  SiRNA target sequence
ttgaagcattttatcatta

SEQ ID NO: 50003 - DNA, 19 bp, Artificial sequence
  SiRNA target sequence
tgaagcattttatcattac

SEQ ID NO: 50004 - DNA, 19 bp, Artificial sequence
  SiRNA target sequence
gaagcattttatcattaca

SEQ ID NO: 50005 - DNA, 19 bp, Artificial sequence
  SiRNA target sequence
aagcattttatcattacat

SEQ ID NO: 50006 - DNA, 19 bp, Artificial sequence
  SiRNA target sequence
agcattttatcattacatt

SEQ ID NO: 50007 - DNA, 19 bp, Artificial sequence
  SiRNA target sequence
gcattttatcattacattt

SEQ ID NO: 50008 - DNA, 19 bp, Artificial sequence
  SiRNA target sequence
cattttatcattacatttc

SEQ ID NO: 50009 - DNA, 19 bp, Artificial sequence
  SiRNA target sequence
attttatcattacatttca

SEQ ID NO: 50010 - DNA, 19 bp, Artificial sequence
  SiRNA target sequence
ttttatcattacatttcat

SEQ ID NO: 50011 - DNA, 19 bp, Artificial sequence
  SiRNA target sequence
tttatcattacatttcatt

SEQ ID NO: 50012 - DNA, 19 bp, Artificial sequence
  SiRNA target sequence
ttatcattacatttcatta

SEQ ID NO: 50013 - DNA, 19 bp, Artificial sequence
  SiRNA target sequence
tatcattacatttcattaa

SEQ ID NO: 50014 - DNA, 19 bp, Artificial sequence
  SiRNA target sequence
atcattacatttcattaaa

SEQ ID NO: 50015 - DNA, 19 bp, Artificial sequence
  SiRNA target sequence
tcattacatttcattaaac

SEQ ID NO: 50016 - DNA, 19 bp, Artificial sequence
  SiRNA target sequence
cattacatttcattaaact

SEQ ID NO: 50017 - DNA, 19 bp, Artificial sequence
  SiRNA target sequence
attacatttcattaaactt

SEQ ID NO: 50018 - DNA, 19 bp, Artificial sequence
  SiRNA target sequence
ttacatttcattaaactta

SEQ ID NO: 50019 - DNA, 19 bp, Artificial sequence
  SiRNA target sequence
tacatttcattaaacttag

SEQ ID NO: 50020 - DNA, 19 bp, Artificial sequence
  SiRNA target sequence
acatttcattaaacttaga

SEQ ID NO: 50021 - DNA, 19 bp, Artificial sequence
  SiRNA target sequence
catttcattaaacttagaa

SEQ ID NO: 50022 - DNA, 19 bp, Artificial sequence
  SiRNA target sequence
atttcattaaacttagaaa

SEQ ID NO: 50023 - DNA, 19 bp, Artificial sequence
  SiRNA target sequence
tttcattaaacttagaaaa

SEQ ID NO: 50024 - DNA, 19 bp, Artificial sequence
  SiRNA target sequence
ttcattaaacttagaaaat

SEQ ID NO: 50025 - DNA, 19 bp, Artificial sequence
  SiRNA target sequence
tcattaaacttagaaaatt

SEQ ID NO: 50026 - DNA, 19 bp, Artificial sequence
  SiRNA target sequence
cattaaacttagaaaattt

SEQ ID NO: 50027 - DNA, 19 bp, Artificial sequence
  SiRNA target sequence
attaaacttagaaaatttt

SEQ ID NO: 50028 - DNA, 19 bp, Artificial sequence
  SiRNA target sequence
ttaaacttagaaaatttta

SEQ ID NO: 50029 - DNA, 19 bp, Artificial sequence
  SiRNA target sequence
taaacttagaaaattttaa

SEQ ID NO: 50030 - DNA, 19 bp, Artificial sequence
  SiRNA target sequence
aaacttagaaaattttaac

SEQ ID NO: 50031 - DNA, 19 bp, Artificial sequence
  SiRNA target sequence
aacttagaaaattttaaca

SEQ ID NO: 50032 - DNA, 19 bp, Artificial sequence
  SiRNA target sequence
acttagaaaattttaacaa

SEQ ID NO: 50033 - DNA, 19 bp, Artificial sequence
  SiRNA target sequence
cttagaaaattttaacaaa

SEQ ID NO: 50034 - DNA, 19 bp, Artificial sequence
  SiRNA target sequence
ttagaaaattttaacaaaa

SEQ ID NO: 50035 - DNA, 19 bp, Artificial sequence
  SiRNA target sequence
tagaaaattttaacaaaat

SEQ ID NO: 50036 - DNA, 19 bp, Artificial sequence
  SiRNA target sequence
agaaaattttaacaaaata

SEQ ID NO: 50037 - DNA, 19 bp, Artificial sequence
  SiRNA target sequence
gaaaattttaacaaaatag

SEQ ID NO: 50038 - DNA, 19 bp, Artificial sequence
  SiRNA target sequence
aaaattttaacaaaatagg

SEQ ID NO: 50039 - DNA, 19 bp, Artificial sequence
  SiRNA target sequence
aaattttaacaaaatagga

SEQ ID NO: 50040 - DNA, 19 bp, Artificial sequence
  SiRNA target sequence
aattttaacaaaataggaa

SEQ ID NO: 50041 - DNA, 19 bp, Artificial sequence
  SiRNA target sequence
attttaacaaaataggaag

SEQ ID NO: 50042 - DNA, 19 bp, Artificial sequence
  SiRNA target sequence
ttttaacaaaataggaagt

SEQ ID NO: 50043 - DNA, 19 bp, Artificial sequence
  SiRNA target sequence
tttaacaaaataggaagtg

SEQ ID NO: 50044 - DNA, 19 bp, Artificial sequence
  SiRNA target sequence
ttaacaaaataggaagtgg

SEQ ID NO: 50045 - DNA, 19 bp, Artificial sequence
  SiRNA target sequence
taacaaaataggaagtgga

SEQ ID NO: 50046 - DNA, 19 bp, Artificial sequence
  SiRNA target sequence
aacaaaataggaagtggag

SEQ ID NO: 50047 - DNA, 19 bp, Artificial sequence
  SiRNA target sequence
acaaaataggaagtggaga

SEQ ID NO: 50048 - DNA, 19 bp, Artificial sequence
  SiRNA target sequence
caaaataggaagtggagag

SEQ ID NO: 50049 - DNA, 19 bp, Artificial sequence
  SiRNA target sequence
aaaataggaagtggagaga

SEQ ID NO: 50050 - DNA, 19 bp, Artificial sequence
  SiRNA target sequence
aaataggaagtggagagat

SEQ ID NO: 50051 - DNA, 19 bp, Artificial sequence
  SiRNA target sequence
aataggaagtggagagata

SEQ ID NO: 50052 - DNA, 19 bp, Artificial sequence
  SiRNA target sequence
ataggaagtggagagatac

SEQ ID NO: 50053 - DNA, 19 bp, Artificial sequence
  SiRNA target sequence
taggaagtggagagataca

SEQ ID NO: 50054 - DNA, 19 bp, Artificial sequence
  SiRNA target sequence
aggaagtggagagatacaa

SEQ ID NO: 50055 - DNA, 19 bp, Artificial sequence
  SiRNA target sequence
ggaagtggagagatacaaa

SEQ ID NO: 50056 - DNA, 19 bp, Artificial sequence
  SiRNA target sequence
gaagtggagagatacaaat

SEQ ID NO: 50057 - DNA, 19 bp, Artificial sequence
  SiRNA target sequence
aagtggagagatacaaatg

SEQ ID NO: 50058 - DNA, 19 bp, Artificial sequence
  SiRNA target sequence
agtggagagatacaaatga

SEQ ID NO: 50059 - DNA, 19 bp, Artificial sequence
  SiRNA target sequence
gtggagagatacaaatgat

SEQ ID NO: 50060 - DNA, 19 bp, Artificial sequence
  SiRNA target sequence
tggagagatacaaatgatt

SEQ ID NO: 50061 - DNA, 19 bp, Artificial sequence
  SiRNA target sequence
ggagagatacaaatgatta

SEQ ID NO: 50062 - DNA, 19 bp, Artificial sequence
  SiRNA target sequence
gagagatacaaatgattat

SEQ ID NO: 50063 - DNA, 19 bp, Artificial sequence
  SiRNA target sequence
agagatacaaatgattatt

SEQ ID NO: 50064 - DNA, 19 bp, Artificial sequence
  SiRNA target sequence
gagatacaaatgattattg

SEQ ID NO: 50065 - DNA, 19 bp, Artificial sequence
  SiRNA target sequence
agatacaaatgattattga

SEQ ID NO: 50066 - DNA, 19 bp, Artificial sequence
  SiRNA target sequence
gatacaaatgattattgag

SEQ ID NO: 50067 - DNA, 19 bp, Artificial sequence
  SiRNA target sequence
atacaaatgattattgagc

SEQ ID NO: 50068 - DNA, 19 bp, Artificial sequence
  SiRNA target sequence
tacaaatgattattgagcg

SEQ ID NO: 50069 - DNA, 19 bp, Artificial sequence
  SiRNA target sequence
acaaatgattattgagcgg

SEQ ID NO: 50070 - DNA, 19 bp, Artificial sequence
  SiRNA target sequence
caaatgattattgagcgga

SEQ ID NO: 50071 - DNA, 19 bp, Artificial sequence
  SiRNA target sequence
aaatgattattgagcggaa

SEQ ID NO: 50072 - DNA, 19 bp, Artificial sequence
  SiRNA target sequence
aatgattattgagcggaaa

SEQ ID NO: 50073 - DNA, 19 bp, Artificial sequence
  SiRNA target sequence
atgattattgagcggaaaa

SEQ ID NO: 50074 - DNA, 19 bp, Artificial sequence
  SiRNA target sequence
tgattattgagcggaaaag

SEQ ID NO: 50075 - DNA, 19 bp, Artificial sequence
  SiRNA target sequence
gattattgagcggaaaagt

SEQ ID NO: 50076 - DNA, 19 bp, Artificial sequence
  SiRNA target sequence
attattgagcggaaaagta

SEQ ID NO: 50077 - DNA, 19 bp, Artificial sequence
  SiRNA target sequence
ttattgagcggaaaagtag

SEQ ID NO: 50078 - DNA, 19 bp, Artificial sequence
  SiRNA target sequence
tattgagcggaaaagtaga

SEQ ID NO: 50079 - DNA, 19 bp, Artificial sequence
  SiRNA target sequence
attgagcggaaaagtagag

SEQ ID NO: 50080 - DNA, 19 bp, Artificial sequence
  SiRNA target sequence
ttgagcggaaaagtagagc

SEQ ID NO: 50081 - DNA, 19 bp, Artificial sequence
  SiRNA target sequence
tgagcggaaaagtagagca

SEQ ID NO: 50082 - DNA, 19 bp, Artificial sequence
  SiRNA target sequence
gagcggaaaagtagagcat

SEQ ID NO: 50083 - DNA, 19 bp, Artificial sequence
  SiRNA target sequence
agcggaaaagtagagcata

SEQ ID NO: 50084 - DNA, 19 bp, Artificial sequence
  SiRNA target sequence
gcggaaaagtagagcatat

SEQ ID NO: 50085 - DNA, 19 bp, Artificial sequence
  SiRNA target sequence
cggaaaagtagagcatatg

SEQ ID NO: 50086 - DNA, 19 bp, Artificial sequence
  SiRNA target sequence
ggaaaagtagagcatatgg

SEQ ID NO: 50087 - DNA, 19 bp, Artificial sequence
  SiRNA target sequence
gaaaagtagagcatatggt

SEQ ID NO: 50088 - DNA, 19 bp, Artificial sequence
  SiRNA target sequence
aaaagtagagcatatggtg

SEQ ID NO: 50089 - DNA, 19 bp, Artificial sequence
  SiRNA target sequence
aaagtagagcatatggtga

SEQ ID NO: 50090 - DNA, 19 bp, Artificial sequence
  SiRNA target sequence
aagtagagcatatggtgac

SEQ ID NO: 50091 - DNA, 19 bp, Artificial sequence
  SiRNA target sequence
agtagagcatatggtgaca

SEQ ID NO: 50092 - DNA, 19 bp, Artificial sequence
  SiRNA target sequence
gtagagcatatggtgacat

SEQ ID NO: 50093 - DNA, 19 bp, Artificial sequence
  SiRNA target sequence
tagagcatatggtgacata

SEQ ID NO: 50094 - DNA, 19 bp, Artificial sequence
  SiRNA target sequence
agagcatatggtgacatac

SEQ ID NO: 50095 - DNA, 19 bp, Artificial sequence
  SiRNA target sequence
gagcatatggtgacatact

SEQ ID NO: 50096 - DNA, 19 bp, Artificial sequence
  SiRNA target sequence
agcatatggtgacatacta

SEQ ID NO: 50097 - DNA, 19 bp, Artificial sequence
  SiRNA target sequence
gcatatggtgacatactag

SEQ ID NO: 50098 - DNA, 19 bp, Artificial sequence
  SiRNA target sequence
catatggtgacatactaga

SEQ ID NO: 50099 - DNA, 19 bp, Artificial sequence
  SiRNA target sequence
atatggtgacatactagaa

SEQ ID NO: 50100 - DNA, 19 bp, Artificial sequence
  SiRNA target sequence
tatggtgacatactagaac

SEQ ID NO: 50101 - DNA, 19 bp, Artificial sequence
  SiRNA target sequence
atggtgacatactagaact

SEQ ID NO: 50102 - DNA, 19 bp, Artificial sequence
  SiRNA target sequence
tggtgacatactagaacta

SEQ ID NO: 50103 - DNA, 19 bp, Artificial sequence
  SiRNA target sequence
ggtgacatactagaactaa

SEQ ID NO: 50104 - DNA, 19 bp, Artificial sequence
  SiRNA target sequence
gtgacatactagaactaac

SEQ ID NO: 50105 - DNA, 19 bp, Artificial sequence
  SiRNA target sequence
tgacatactagaactaact

SEQ ID NO: 50106 - DNA, 19 bp, Artificial sequence
  SiRNA target sequence
gacatactagaactaacta

SEQ ID NO: 50107 - DNA, 19 bp, Artificial sequence
  SiRNA target sequence
acatactagaactaactac

SEQ ID NO: 50108 - DNA, 19 bp, Artificial sequence
  SiRNA target sequence
catactagaactaactact

SEQ ID NO: 50109 - DNA, 19 bp, Artificial sequence
  SiRNA target sequence
atactagaactaactactc

SEQ ID NO: 50110 - DNA, 19 bp, Artificial sequence
  SiRNA target sequence
tactagaactaactactct

SEQ ID NO: 50111 - DNA, 19 bp, Artificial sequence
  SiRNA target sequence
actagaactaactactctc

SEQ ID NO: 50112 - DNA, 19 bp, Artificial sequence
  SiRNA target sequence
ctagaactaactactctct

SEQ ID NO: 50113 - DNA, 19 bp, Artificial sequence
  SiRNA target sequence
tagaactaactactctctc

SEQ ID NO: 50114 - DNA, 19 bp, Artificial sequence
  SiRNA target sequence
agaactaactactctctcg

SEQ ID NO: 50115 - DNA, 19 bp, Artificial sequence
  SiRNA target sequence
gaactaactactctctcgg

SEQ ID NO: 50116 - DNA, 19 bp, Artificial sequence
  SiRNA target sequence
aactaactactctctcggc

SEQ ID NO: 50117 - DNA, 19 bp, Artificial sequence
  SiRNA target sequence
actaactactctctcggcc

SEQ ID NO: 50118 - DNA, 19 bp, Artificial sequence
  SiRNA target sequence
ctaactactctctcggccg

SEQ ID NO: 50119 - DNA, 19 bp, Artificial sequence
  SiRNA target sequence
taactactctctcggccgt

SEQ ID NO: 50120 - DNA, 19 bp, Artificial sequence
  SiRNA target sequence
aactactctctcggccgta

SEQ ID NO: 50121 - DNA, 19 bp, Artificial sequence
  SiRNA target sequence
actactctctcggccgtac

SEQ ID NO: 50122 - DNA, 19 bp, Artificial sequence
  SiRNA target sequence
ctactctctcggccgtacc

SEQ ID NO: 50123 - DNA, 19 bp, Artificial sequence
  SiRNA target sequence
tactctctcggccgtacca

SEQ ID NO: 50124 - DNA, 19 bp, Artificial sequence
  SiRNA target sequence
actctctcggccgtaccaa

SEQ ID NO: 50125 - DNA, 19 bp, Artificial sequence
  SiRNA target sequence
ctctctcggccgtaccaac

SEQ ID NO: 50126 - DNA, 19 bp, Artificial sequence
  SiRNA target sequence
tctctcggccgtaccaacc

SEQ ID NO: 50127 - DNA, 19 bp, Artificial sequence
  SiRNA target sequence
ctctcggccgtaccaacct

SEQ ID NO: 50128 - DNA, 19 bp, Artificial sequence
  SiRNA target sequence
tctcggccgtaccaacctg

SEQ ID NO: 50129 - DNA, 19 bp, Artificial sequence
  SiRNA target sequence
ctcggccgtaccaacctgt

SEQ ID NO: 50130 - DNA, 19 bp, Artificial sequence
  SiRNA target sequence
tcggccgtaccaacctgta

SEQ ID NO: 50131 - DNA, 19 bp, Artificial sequence
  SiRNA target sequence
cggccgtaccaacctgtat

SEQ ID NO: 50132 - DNA, 19 bp, Artificial sequence
  SiRNA target sequence
ggccgtaccaacctgtatt

SEQ ID NO: 50133 - DNA, 19 bp, Artificial sequence
  SiRNA target sequence
gccgtaccaacctgtattg

SEQ ID NO: 50134 - DNA, 19 bp, Artificial sequence
  SiRNA target sequence
ccgtaccaacctgtattgt

SEQ ID NO: 50135 - DNA, 19 bp, Artificial sequence
  SiRNA target sequence
cgtaccaacctgtattgta

SEQ ID NO: 50136 - DNA, 19 bp, Artificial sequence
  SiRNA target sequence
gtaccaacctgtattgtag

SEQ ID NO: 50137 - DNA, 19 bp, Artificial sequence
  SiRNA target sequence
taccaacctgtattgtagt

SEQ ID NO: 50138 - DNA, 19 bp, Artificial sequence
  SiRNA target sequence
accaacctgtattgtagtt

SEQ ID NO: 50139 - DNA, 19 bp, Artificial sequence
  SiRNA target sequence
ccaacctgtattgtagtta

SEQ ID NO: 50140 - DNA, 19 bp, Artificial sequence
  SiRNA target sequence
caacctgtattgtagttat

SEQ ID NO: 50141 - DNA, 19 bp, Artificial sequence
  SiRNA target sequence
aacctgtattgtagttatt

SEQ ID NO: 50142 - DNA, 19 bp, Artificial sequence
  SiRNA target sequence
acctgtattgtagttatta

SEQ ID NO: 50143 - DNA, 19 bp, Artificial sequence
  SiRNA target sequence
cctgtattgtagttattat

SEQ ID NO: 50144 - DNA, 19 bp, Artificial sequence
  SiRNA target sequence
ctgtattgtagttattatg

SEQ ID NO: 50145 - DNA, 19 bp, Artificial sequence
  SiRNA target sequence
tgtattgtagttattatgt

SEQ ID NO: 50146 - DNA, 19 bp, Artificial sequence
  SiRNA target sequence
gtattgtagttattatgtc

SEQ ID NO: 50147 - DNA, 19 bp, Artificial sequence
  SiRNA target sequence
tattgtagttattatgtcg

SEQ ID NO: 50148 - DNA, 19 bp, Artificial sequence
  SiRNA target sequence
attgtagttattatgtcgt

SEQ ID NO: 50149 - DNA, 19 bp, Artificial sequence
  SiRNA target sequence
ttgtagttattatgtcgtt

SEQ ID NO: 50150 - DNA, 19 bp, Artificial sequence
  SiRNA target sequence
tgtagttattatgtcgttt

SEQ ID NO: 50151 - DNA, 19 bp, Artificial sequence
  SiRNA target sequence
gtagttattatgtcgtttt

SEQ ID NO: 50152 - DNA, 19 bp, Artificial sequence
  SiRNA target sequence
tagttattatgtcgttttt

SEQ ID NO: 50153 - DNA, 19 bp, Artificial sequence
  SiRNA target sequence
agttattatgtcgtttttc

SEQ ID NO: 50154 - DNA, 19 bp, Artificial sequence
  SiRNA target sequence
gttattatgtcgtttttct

SEQ ID NO: 50155 - DNA, 19 bp, Artificial sequence
  SiRNA target sequence
ttattatgtcgtttttctc

SEQ ID NO: 50156 - DNA, 19 bp, Artificial sequence
  SiRNA target sequence
tattatgtcgtttttctca

SEQ ID NO: 50157 - DNA, 19 bp, Artificial sequence
  SiRNA target sequence
attatgtcgtttttctcag

SEQ ID NO: 50158 - DNA, 19 bp, Artificial sequence
  SiRNA target sequence
ttatgtcgtttttctcagt

SEQ ID NO: 50159 - DNA, 19 bp, Artificial sequence
  SiRNA target sequence
tatgtcgtttttctcagta

SEQ ID NO: 50160 - DNA, 19 bp, Artificial sequence
  SiRNA target sequence
atgtcgtttttctcagtat

SEQ ID NO: 50161 - DNA, 19 bp, Artificial sequence
  SiRNA target sequence
tgtcgtttttctcagtata

SEQ ID NO: 50162 - DNA, 19 bp, Artificial sequence
  SiRNA target sequence
gtcgtttttctcagtatat

SEQ ID NO: 50163 - DNA, 19 bp, Artificial sequence
  SiRNA target sequence
tcgtttttctcagtatata

SEQ ID NO: 50164 - DNA, 19 bp, Artificial sequence
  SiRNA target sequence
cgtttttctcagtatataa

SEQ ID NO: 50165 - DNA, 19 bp, Artificial sequence
  SiRNA target sequence
gtttttctcagtatataaa

SEQ ID NO: 50166 - DNA, 19 bp, Artificial sequence
  SiRNA target sequence
tttttctcagtatataaaa

SEQ ID NO: 50167 - DNA, 19 bp, Artificial sequence
  SiRNA target sequence
ttttctcagtatataaaaa

SEQ ID NO: 50168 - DNA, 19 bp, Artificial sequence
  SiRNA target sequence
tttctcagtatataaaaat

SEQ ID NO: 50169 - DNA, 19 bp, Artificial sequence
  SiRNA target sequence
ttctcagtatataaaaatt

SEQ ID NO: 50170 - DNA, 19 bp, Artificial sequence
  SiRNA target sequence
tctcagtatataaaaattt

SEQ ID NO: 50171 - DNA, 19 bp, Artificial sequence
  SiRNA target sequence
ctcagtatataaaaatttg

SEQ ID NO: 50172 - DNA, 19 bp, Artificial sequence
  SiRNA target sequence
tcagtatataaaaatttgg

SEQ ID NO: 50173 - DNA, 19 bp, Artificial sequence
  SiRNA target sequence
cagtatataaaaatttggg

SEQ ID NO: 50174 - DNA, 19 bp, Artificial sequence
  SiRNA target sequence
agtatataaaaatttggga

SEQ ID NO: 50175 - DNA, 19 bp, Artificial sequence
  SiRNA target sequence
gtatataaaaatttgggaa

SEQ ID NO: 50176 - DNA, 19 bp, Artificial sequence
  SiRNA target sequence
tatataaaaatttgggaag

SEQ ID NO: 50177 - DNA, 19 bp, Artificial sequence
  SiRNA target sequence
atataaaaatttgggaaga

SEQ ID NO: 50178 - DNA, 19 bp, Artificial sequence
  SiRNA target sequence
tataaaaatttgggaagag

SEQ ID NO: 50179 - DNA, 19 bp, Artificial sequence
  SiRNA target sequence
ataaaaatttgggaagaga

SEQ ID NO: 50180 - DNA, 19 bp, Artificial sequence
  SiRNA target sequence
taaaaatttgggaagagat

SEQ ID NO: 50181 - DNA, 19 bp, Artificial sequence
  SiRNA target sequence
aaaaatttgggaagagatg

SEQ ID NO: 50182 - DNA, 19 bp, Artificial sequence
  SiRNA target sequence
aaaatttgggaagagatgc

SEQ ID NO: 50183 - DNA, 19 bp, Artificial sequence
  SiRNA target sequence
aaatttgggaagagatgca

SEQ ID NO: 50184 - DNA, 19 bp, Artificial sequence
  SiRNA target sequence
aatttgggaagagatgcac

SEQ ID NO: 50185 - DNA, 19 bp, Artificial sequence
  SiRNA target sequence
atttgggaagagatgcact

SEQ ID NO: 50186 - DNA, 19 bp, Artificial sequence
  SiRNA target sequence
tttgggaagagatgcactc

SEQ ID NO: 50187 - DNA, 19 bp, Artificial sequence
  SiRNA target sequence
ttgggaagagatgcactct

SEQ ID NO: 50188 - DNA, 19 bp, Artificial sequence
  SiRNA target sequence
tgggaagagatgcactcta

SEQ ID NO: 50189 - DNA, 19 bp, Artificial sequence
  SiRNA target sequence
gggaagagatgcactctac

SEQ ID NO: 50190 - DNA, 19 bp, Artificial sequence
  SiRNA target sequence
ggaagagatgcactctacg

SEQ ID NO: 50191 - DNA, 19 bp, Artificial sequence
  SiRNA target sequence
gaagagatgcactctacgt

SEQ ID NO: 50192 - DNA, 19 bp, Artificial sequence
  SiRNA target sequence
aagagatgcactctacgta

SEQ ID NO: 50193 - DNA, 19 bp, Artificial sequence
  SiRNA target sequence
agagatgcactctacgtaa

SEQ ID NO: 50194 - DNA, 19 bp, Artificial sequence
  SiRNA target sequence
gagatgcactctacgtaat

SEQ ID NO: 50195 - DNA, 19 bp, Artificial sequence
  SiRNA target sequence
agatgcactctacgtaatg

SEQ ID NO: 50196 - DNA, 19 bp, Artificial sequence
  SiRNA target sequence
gatgcactctacgtaatgt

SEQ ID NO: 50197 - DNA, 19 bp, Artificial sequence
  SiRNA target sequence
atgcactctacgtaatgtt

SEQ ID NO: 50198 - DNA, 19 bp, Artificial sequence
  SiRNA target sequence
tgcactctacgtaatgttg

SEQ ID NO: 50199 - DNA, 19 bp, Artificial sequence
  SiRNA target sequence
gcactctacgtaatgttgg

SEQ ID NO: 50200 - DNA, 19 bp, Artificial sequence
  SiRNA target sequence
cactctacgtaatgttggc

SEQ ID NO: 50201 - DNA, 19 bp, Artificial sequence
  SiRNA target sequence
actctacgtaatgttggct

SEQ ID NO: 50202 - DNA, 19 bp, Artificial sequence
  SiRNA target sequence
ctctacgtaatgttggcta

SEQ ID NO: 50203 - DNA, 19 bp, Artificial sequence
  SiRNA target sequence
tctacgtaatgttggctac

SEQ ID NO: 50204 - DNA, 19 bp, Artificial sequence
  SiRNA target sequence
ctacgtaatgttggctaca

SEQ ID NO: 50205 - DNA, 19 bp, Artificial sequence
  SiRNA target sequence
tacgtaatgttggctacaa

SEQ ID NO: 50206 - DNA, 19 bp, Artificial sequence
  SiRNA target sequence
acgtaatgttggctacaag

SEQ ID NO: 50207 - DNA, 19 bp, Artificial sequence
  SiRNA target sequence
cgtaatgttggctacaagt

SEQ ID NO: 50208 - DNA, 19 bp, Artificial sequence
  SiRNA target sequence
gtaatgttggctacaagtg

SEQ ID NO: 50209 - DNA, 19 bp, Artificial sequence
  SiRNA target sequence
taatgttggctacaagtgc

SEQ ID NO: 50210 - DNA, 19 bp, Artificial sequence
  SiRNA target sequence
aatgttggctacaagtgcc

SEQ ID NO: 50211 - DNA, 19 bp, Artificial sequence
  SiRNA target sequence
atgttggctacaagtgcct

SEQ ID NO: 50212 - DNA, 19 bp, Artificial sequence
  SiRNA target sequence
tgttggctacaagtgcctt

SEQ ID NO: 50213 - DNA, 19 bp, Artificial sequence
  SiRNA target sequence
gttggctacaagtgccttg

SEQ ID NO: 50214 - DNA, 19 bp, Artificial sequence
  SiRNA target sequence
ttggctacaagtgccttgt

SEQ ID NO: 50215 - DNA, 19 bp, Artificial sequence
  SiRNA target sequence
tggctacaagtgccttgta

SEQ ID NO: 50216 - DNA, 19 bp, Artificial sequence
  SiRNA target sequence
ggctacaagtgccttgtat

SEQ ID NO: 50217 - DNA, 19 bp, Artificial sequence
  SiRNA target sequence
gctacaagtgccttgtatg

SEQ ID NO: 50218 - DNA, 19 bp, Artificial sequence
  SiRNA target sequence
ctacaagtgccttgtatgt

SEQ ID NO: 50219 - DNA, 19 bp, Artificial sequence
  SiRNA target sequence
tacaagtgccttgtatgtg

SEQ ID NO: 50220 - DNA, 19 bp, Artificial sequence
  SiRNA target sequence
acaagtgccttgtatgtgt

SEQ ID NO: 50221 - DNA, 19 bp, Artificial sequence
  SiRNA target sequence
caagtgccttgtatgtgta

SEQ ID NO: 50222 - DNA, 19 bp, Artificial sequence
  SiRNA target sequence
aagtgccttgtatgtgtat

SEQ ID NO: 50223 - DNA, 19 bp, Artificial sequence
  SiRNA target sequence
agtgccttgtatgtgtatt

SEQ ID NO: 50224 - DNA, 19 bp, Artificial sequence
  SiRNA target sequence
gtgccttgtatgtgtattt

SEQ ID NO: 50225 - DNA, 19 bp, Artificial sequence
  SiRNA target sequence
tgccttgtatgtgtatttt

SEQ ID NO: 50226 - DNA, 19 bp, Artificial sequence
  SiRNA target sequence
gccttgtatgtgtatttta

SEQ ID NO: 50227 - DNA, 19 bp, Artificial sequence
  SiRNA target sequence
ccttgtatgtgtattttac

SEQ ID NO: 50228 - DNA, 19 bp, Artificial sequence
  SiRNA target sequence
cttgtatgtgtattttaca

SEQ ID NO: 50229 - DNA, 19 bp, Artificial sequence
  SiRNA target sequence
ttgtatgtgtattttacat

SEQ ID NO: 50230 - DNA, 19 bp, Artificial sequence
  SiRNA target sequence
tgtatgtgtattttacatt

SEQ ID NO: 50231 - DNA, 19 bp, Artificial sequence
  SiRNA target sequence
gtatgtgtattttacattt

SEQ ID NO: 50232 - DNA, 19 bp, Artificial sequence
  SiRNA target sequence
tatgtgtattttacatttg

SEQ ID NO: 50233 - DNA, 19 bp, Artificial sequence
  SiRNA target sequence
atgtgtattttacatttgt

SEQ ID NO: 50234 - DNA, 19 bp, Artificial sequence
  SiRNA target sequence
tgtgtattttacatttgta

SEQ ID NO: 50235 - DNA, 19 bp, Artificial sequence
  SiRNA target sequence
gtgtattttacatttgtat

SEQ ID NO: 50236 - DNA, 19 bp, Artificial sequence
  SiRNA target sequence
tgtattttacatttgtatt

SEQ ID NO: 50237 - DNA, 19 bp, Artificial sequence
  SiRNA target sequence
gtattttacatttgtattt

SEQ ID NO: 50238 - DNA, 19 bp, Artificial sequence
  SiRNA target sequence
tattttacatttgtatttt

SEQ ID NO: 50239 - DNA, 19 bp, Artificial sequence
  SiRNA target sequence
attttacatttgtattttc

SEQ ID NO: 50240 - DNA, 19 bp, Artificial sequence
  SiRNA target sequence
ttttacatttgtattttca

SEQ ID NO: 50241 - DNA, 19 bp, Artificial sequence
  SiRNA target sequence
tttacatttgtattttcaa

SEQ ID NO: 50242 - DNA, 19 bp, Artificial sequence
  SiRNA target sequence
ttacatttgtattttcaat

SEQ ID NO: 50243 - DNA, 19 bp, Artificial sequence
  SiRNA target sequence
tacatttgtattttcaata

SEQ ID NO: 50244 - DNA, 19 bp, Artificial sequence
  SiRNA target sequence
acatttgtattttcaatat

SEQ ID NO: 50245 - DNA, 19 bp, Artificial sequence
  SiRNA target sequence
catttgtattttcaatatg

SEQ ID NO: 50246 - DNA, 19 bp, Artificial sequence
  SiRNA target sequence
atttgtattttcaatatgg

SEQ ID NO: 50247 - DNA, 19 bp, Artificial sequence
  SiRNA target sequence
tttgtattttcaatatgga

SEQ ID NO: 50248 - DNA, 19 bp, Artificial sequence
  SiRNA target sequence
ttgtattttcaatatggag

SEQ ID NO: 50249 - DNA, 19 bp, Artificial sequence
  SiRNA target sequence
tgtattttcaatatggaga

SEQ ID NO: 50250 - DNA, 19 bp, Artificial sequence
  SiRNA target sequence
gtattttcaatatggagaa

SEQ ID NO: 50251 - DNA, 19 bp, Artificial sequence
  SiRNA target sequence
tattttcaatatggagaaa

SEQ ID NO: 50252 - DNA, 19 bp, Artificial sequence
  SiRNA target sequence
attttcaatatggagaaac

SEQ ID NO: 50253 - DNA, 19 bp, Artificial sequence
  SiRNA target sequence
ttttcaatatggagaaaca

SEQ ID NO: 50254 - DNA, 19 bp, Artificial sequence
  SiRNA target sequence
tttcaatatggagaaacaa

SEQ ID NO: 50255 - DNA, 19 bp, Artificial sequence
  SiRNA target sequence
ttcaatatggagaaacaat

SEQ ID NO: 50256 - DNA, 19 bp, Artificial sequence
  SiRNA target sequence
tcaatatggagaaacaata

SEQ ID NO: 50257 - DNA, 19 bp, Artificial sequence
  SiRNA target sequence
caatatggagaaacaatat

SEQ ID NO: 50258 - DNA, 19 bp, Artificial sequence
  SiRNA target sequence
aatatggagaaacaatatt

SEQ ID NO: 50259 - DNA, 19 bp, Artificial sequence
  SiRNA target sequence
atatggagaaacaatatta

SEQ ID NO: 50260 - DNA, 19 bp, Artificial sequence
  SiRNA target sequence
tatggagaaacaatattag

SEQ ID NO: 50261 - DNA, 19 bp, Artificial sequence
  SiRNA target sequence
atggagaaacaatattaga

SEQ ID NO: 50262 - DNA, 19 bp, Artificial sequence
  SiRNA target sequence
tggagaaacaatattagaa

SEQ ID NO: 50263 - DNA, 19 bp, Artificial sequence
  SiRNA target sequence
ggagaaacaatattagaag

SEQ ID NO: 50264 - DNA, 19 bp, Artificial sequence
  SiRNA target sequence
gagaaacaatattagaaga

SEQ ID NO: 50265 - DNA, 19 bp, Artificial sequence
  SiRNA target sequence
agaaacaatattagaagac

SEQ ID NO: 50266 - DNA, 19 bp, Artificial sequence
  SiRNA target sequence
gaaacaatattagaagaca

SEQ ID NO: 50267 - DNA, 19 bp, Artificial sequence
  SiRNA target sequence
aaacaatattagaagacaa

SEQ ID NO: 50268 - DNA, 19 bp, Artificial sequence
  SiRNA target sequence
aacaatattagaagacaat

SEQ ID NO: 50269 - DNA, 19 bp, Artificial sequence
  SiRNA target sequence
acaatattagaagacaata

SEQ ID NO: 50270 - DNA, 19 bp, Artificial sequence
  SiRNA target sequence
caatattagaagacaatat

SEQ ID NO: 50271 - DNA, 19 bp, Artificial sequence
  SiRNA target sequence
aatattagaagacaatata

SEQ ID NO: 50272 - DNA, 19 bp, Artificial sequence
  SiRNA target sequence
atattagaagacaatataa

SEQ ID NO: 50273 - DNA, 19 bp, Artificial sequence
  SiRNA target sequence
tattagaagacaatataat

SEQ ID NO: 50274 - DNA, 19 bp, Artificial sequence
  SiRNA target sequence
attagaagacaatataata

SEQ ID NO: 50275 - DNA, 19 bp, Artificial sequence
  SiRNA target sequence
ttagaagacaatataataa

SEQ ID NO: 50276 - DNA, 19 bp, Artificial sequence
  SiRNA target sequence
tagaagacaatataataag

SEQ ID NO: 50277 - DNA, 19 bp, Artificial sequence
  SiRNA target sequence
agaagacaatataataagt

SEQ ID NO: 50278 - DNA, 19 bp, Artificial sequence
  SiRNA target sequence
gaagacaatataataagtc

SEQ ID NO: 50279 - DNA, 19 bp, Artificial sequence
  SiRNA target sequence
aagacaatataataagtca

SEQ ID NO: 50280 - DNA, 19 bp, Artificial sequence
  SiRNA target sequence
agacaatataataagtcac

SEQ ID NO: 50281 - DNA, 19 bp, Artificial sequence
  SiRNA target sequence
gacaatataataagtcaca

SEQ ID NO: 50282 - DNA, 19 bp, Artificial sequence
  SiRNA target sequence
acaatataataagtcacag

SEQ ID NO: 50283 - DNA, 19 bp, Artificial sequence
  SiRNA target sequence
caatataataagtcacagg

SEQ ID NO: 50284 - DNA, 19 bp, Artificial sequence
  SiRNA target sequence
aatataataagtcacagga

SEQ ID NO: 50285 - DNA, 19 bp, Artificial sequence
  SiRNA target sequence
atataataagtcacaggat

SEQ ID NO: 50286 - DNA, 19 bp, Artificial sequence
  SiRNA target sequence
tataataagtcacaggata

SEQ ID NO: 50287 - DNA, 19 bp, Artificial sequence
  SiRNA target sequence
ataataagtcacaggataa

SEQ ID NO: 50288 - DNA, 19 bp, Artificial sequence
  SiRNA target sequence
taataagtcacaggataaa

SEQ ID NO: 50289 - DNA, 19 bp, Artificial sequence
  SiRNA target sequence
aataagtcacaggataaat

SEQ ID NO: 50290 - DNA, 19 bp, Artificial sequence
  SiRNA target sequence
ataagtcacaggataaatt

SEQ ID NO: 50291 - DNA, 19 bp, Artificial sequence
  SiRNA target sequence
taagtcacaggataaatta

SEQ ID NO: 50292 - DNA, 19 bp, Artificial sequence
  SiRNA target sequence
aagtcacaggataaattat

SEQ ID NO: 50293 - DNA, 19 bp, Artificial sequence
  SiRNA target sequence
agtcacaggataaattatc

SEQ ID NO: 50294 - DNA, 19 bp, Artificial sequence
  SiRNA target sequence
gtcacaggataaattatcg

SEQ ID NO: 50295 - DNA, 19 bp, Artificial sequence
  SiRNA target sequence
tcacaggataaattatcga

SEQ ID NO: 50296 - DNA, 19 bp, Artificial sequence
  SiRNA target sequence
cacaggataaattatcgaa

SEQ ID NO: 50297 - DNA, 19 bp, Artificial sequence
  SiRNA target sequence
acaggataaattatcgaat

SEQ ID NO: 50298 - DNA, 19 bp, Artificial sequence
  SiRNA target sequence
caggataaattatcgaata

SEQ ID NO: 50299 - DNA, 19 bp, Artificial sequence
  SiRNA target sequence
aggataaattatcgaataa

SEQ ID NO: 50300 - DNA, 19 bp, Artificial sequence
  SiRNA target sequence
ggataaattatcgaataaa

SEQ ID NO: 50301 - DNA, 19 bp, Artificial sequence
  SiRNA target sequence
gataaattatcgaataaat

SEQ ID NO: 50302 - DNA, 19 bp, Artificial sequence
  SiRNA target sequence
ataaattatcgaataaatt

SEQ ID NO: 50303 - DNA, 19 bp, Artificial sequence
  SiRNA target sequence
taaattatcgaataaatta

SEQ ID NO: 50304 - DNA, 19 bp, Artificial sequence
  SiRNA target sequence
aaattatcgaataaattac

SEQ ID NO: 50305 - DNA, 19 bp, Artificial sequence
  SiRNA target sequence
aattatcgaataaattaca

SEQ ID NO: 50306 - DNA, 19 bp, Artificial sequence
  SiRNA target sequence
attatcgaataaattacaa

SEQ ID NO: 50307 - DNA, 19 bp, Artificial sequence
  SiRNA target sequence
ttatcgaataaattacaag

SEQ ID NO: 50308 - DNA, 19 bp, Artificial sequence
  SiRNA target sequence
tatcgaataaattacaaga

SEQ ID NO: 50309 - DNA, 19 bp, Artificial sequence
  SiRNA target sequence
atcgaataaattacaagat

SEQ ID NO: 50310 - DNA, 19 bp, Artificial sequence
  SiRNA target sequence
tcgaataaattacaagatt

SEQ ID NO: 50311 - DNA, 19 bp, Artificial sequence
  SiRNA target sequence
cgaataaattacaagattt

SEQ ID NO: 50312 - DNA, 19 bp, Artificial sequence
  SiRNA target sequence
gaataaattacaagatttt

SEQ ID NO: 50313 - DNA, 19 bp, Artificial sequence
  SiRNA target sequence
aataaattacaagattttt

SEQ ID NO: 50314 - DNA, 19 bp, Artificial sequence
  SiRNA target sequence
ataaattacaagatttttt

SEQ ID NO: 50315 - DNA, 19 bp, Artificial sequence
  SiRNA target sequence
taaattacaagatttttta

SEQ ID NO: 50316 - DNA, 19 bp, Artificial sequence
  SiRNA target sequence
aaattacaagattttttag

SEQ ID NO: 50317 - DNA, 19 bp, Artificial sequence
  SiRNA target sequence
aattacaagattttttagc

SEQ ID NO: 50318 - DNA, 19 bp, Artificial sequence
  SiRNA target sequence
attacaagattttttagct

SEQ ID NO: 50319 - DNA, 19 bp, Artificial sequence
  SiRNA target sequence
ttacaagattttttagcta

SEQ ID NO: 50320 - DNA, 19 bp, Artificial sequence
  SiRNA target sequence
tacaagattttttagctaa

SEQ ID NO: 50321 - DNA, 19 bp, Artificial sequence
  SiRNA target sequence
acaagattttttagctaat

SEQ ID NO: 50322 - DNA, 19 bp, Artificial sequence
  SiRNA target sequence
caagattttttagctaatc

SEQ ID NO: 50323 - DNA, 19 bp, Artificial sequence
  SiRNA target sequence
aagattttttagctaatca

SEQ ID NO: 50324 - DNA, 19 bp, Artificial sequence
  SiRNA target sequence
agattttttagctaatcat

SEQ ID NO: 50325 - DNA, 19 bp, Artificial sequence
  SiRNA target sequence
gattttttagctaatcatg

SEQ ID NO: 50326 - DNA, 19 bp, Artificial sequence
  SiRNA target sequence
attttttagctaatcatga

SEQ ID NO: 50327 - DNA, 19 bp, Artificial sequence
  SiRNA target sequence
ttttttagctaatcatgaa

SEQ ID NO: 50328 - DNA, 19 bp, Artificial sequence
  SiRNA target sequence
tttttagctaatcatgaaa

SEQ ID NO: 50329 - DNA, 19 bp, Artificial sequence
  SiRNA target sequence
ttttagctaatcatgaaac

SEQ ID NO: 50330 - DNA, 19 bp, Artificial sequence
  SiRNA target sequence
tttagctaatcatgaaaca

SEQ ID NO: 50331 - DNA, 19 bp, Artificial sequence
  SiRNA target sequence
ttagctaatcatgaaacaa

SEQ ID NO: 50332 - DNA, 19 bp, Artificial sequence
  SiRNA target sequence
tagctaatcatgaaacaat

SEQ ID NO: 50333 - DNA, 19 bp, Artificial sequence
  SiRNA target sequence
agctaatcatgaaacaatt

SEQ ID NO: 50334 - DNA, 19 bp, Artificial sequence
  SiRNA target sequence
gctaatcatgaaacaatta

SEQ ID NO: 50335 - DNA, 19 bp, Artificial sequence
  SiRNA target sequence
ctaatcatgaaacaattaa

SEQ ID NO: 50336 - DNA, 19 bp, Artificial sequence
  SiRNA target sequence
taatcatgaaacaattaaa

SEQ ID NO: 50337 - DNA, 19 bp, Artificial sequence
  SiRNA target sequence
aatcatgaaacaattaaag

SEQ ID NO: 50338 - DNA, 19 bp, Artificial sequence
  SiRNA target sequence
atcatgaaacaattaaagc

SEQ ID NO: 50339 - DNA, 19 bp, Artificial sequence
  SiRNA target sequence
tcatgaaacaattaaagcc

SEQ ID NO: 50340 - DNA, 19 bp, Artificial sequence
  SiRNA target sequence
catgaaacaattaaagcct

SEQ ID NO: 50341 - DNA, 19 bp, Artificial sequence
  SiRNA target sequence
atgaaacaattaaagccta

SEQ ID NO: 50342 - DNA, 19 bp, Artificial sequence
  SiRNA target sequence
tgaaacaattaaagcctat

SEQ ID NO: 50343 - DNA, 19 bp, Artificial sequence
  SiRNA target sequence
gaaacaattaaagcctata

SEQ ID NO: 50344 - DNA, 19 bp, Artificial sequence
  SiRNA target sequence
aaacaattaaagcctataa

SEQ ID NO: 50345 - DNA, 19 bp, Artificial sequence
  SiRNA target sequence
aacaattaaagcctataat

SEQ ID NO: 50346 - DNA, 19 bp, Artificial sequence
  SiRNA target sequence
acaattaaagcctataata

SEQ ID NO: 50347 - DNA, 19 bp, Artificial sequence
  SiRNA target sequence
caattaaagcctataatat

SEQ ID NO: 50348 - DNA, 19 bp, Artificial sequence
  SiRNA target sequence
aattaaagcctataatatg

SEQ ID NO: 50349 - DNA, 19 bp, Artificial sequence
  SiRNA target sequence
attaaagcctataatatgg

SEQ ID NO: 50350 - DNA, 19 bp, Artificial sequence
  SiRNA target sequence
ttaaagcctataatatgga

SEQ ID NO: 50351 - DNA, 19 bp, Artificial sequence
  SiRNA target sequence
taaagcctataatatggaa

SEQ ID NO: 50352 - DNA, 19 bp, Artificial sequence
  SiRNA target sequence
aaagcctataatatggaag

SEQ ID NO: 50353 - DNA, 19 bp, Artificial sequence
  SiRNA target sequence
aagcctataatatggaaga

SEQ ID NO: 50354 - DNA, 19 bp, Artificial sequence
  SiRNA target sequence
agcctataatatggaagaa

SEQ ID NO: 50355 - DNA, 19 bp, Artificial sequence
  SiRNA target sequence
gcctataatatggaagaag

SEQ ID NO: 50356 - DNA, 19 bp, Artificial sequence
  SiRNA target sequence
cctataatatggaagaaga

SEQ ID NO: 50357 - DNA, 19 bp, Artificial sequence
  SiRNA target sequence
ctataatatggaagaagaa

SEQ ID NO: 50358 - DNA, 19 bp, Artificial sequence
  SiRNA target sequence
tataatatggaagaagaaa

SEQ ID NO: 50359 - DNA, 19 bp, Artificial sequence
  SiRNA target sequence
ataatatggaagaagaaac

SEQ ID NO: 50360 - DNA, 19 bp, Artificial sequence
  SiRNA target sequence
taatatggaagaagaaact

SEQ ID NO: 50361 - DNA, 19 bp, Artificial sequence
  SiRNA target sequence
aatatggaagaagaaacta

SEQ ID NO: 50362 - DNA, 19 bp, Artificial sequence
  SiRNA target sequence
atatggaagaagaaactat

SEQ ID NO: 50363 - DNA, 19 bp, Artificial sequence
  SiRNA target sequence
tatggaagaagaaactatt

SEQ ID NO: 50364 - DNA, 19 bp, Artificial sequence
  SiRNA target sequence
atggaagaagaaactatta

SEQ ID NO: 50365 - DNA, 19 bp, Artificial sequence
  SiRNA target sequence
tggaagaagaaactattac

SEQ ID NO: 50366 - DNA, 19 bp, Artificial sequence
  SiRNA target sequence
ggaagaagaaactattaca

SEQ ID NO: 50367 - DNA, 19 bp, Artificial sequence
  SiRNA target sequence
gaagaagaaactattacat

SEQ ID NO: 50368 - DNA, 19 bp, Artificial sequence
  SiRNA target sequence
aagaagaaactattacata

SEQ ID NO: 50369 - DNA, 19 bp, Artificial sequence
  SiRNA target sequence
agaagaaactattacatat

SEQ ID NO: 50370 - DNA, 19 bp, Artificial sequence
  SiRNA target sequence
gaagaaactattacatatt

SEQ ID NO: 50371 - DNA, 19 bp, Artificial sequence
  SiRNA target sequence
aagaaactattacatattt

SEQ ID NO: 50372 - DNA, 19 bp, Artificial sequence
  SiRNA target sequence
agaaactattacatatttt

SEQ ID NO: 50373 - DNA, 19 bp, Artificial sequence
  SiRNA target sequence
gaaactattacatattttg

SEQ ID NO: 50374 - DNA, 19 bp, Artificial sequence
  SiRNA target sequence
aaactattacatattttga

SEQ ID NO: 50375 - DNA, 19 bp, Artificial sequence
  SiRNA target sequence
aactattacatattttgat

SEQ ID NO: 50376 - DNA, 19 bp, Artificial sequence
  SiRNA target sequence
actattacatattttgatg

SEQ ID NO: 50377 - DNA, 19 bp, Artificial sequence
  SiRNA target sequence
ctattacatattttgatga

SEQ ID NO: 50378 - DNA, 19 bp, Artificial sequence
  SiRNA target sequence
tattacatattttgatgaa

SEQ ID NO: 50379 - DNA, 19 bp, Artificial sequence
  SiRNA target sequence
attacatattttgatgaaa

SEQ ID NO: 50380 - DNA, 19 bp, Artificial sequence
  SiRNA target sequence
ttacatattttgatgaaaa

SEQ ID NO: 50381 - DNA, 19 bp, Artificial sequence
  SiRNA target sequence
tacatattttgatgaaaat

SEQ ID NO: 50382 - DNA, 19 bp, Artificial sequence
  SiRNA target sequence
acatattttgatgaaaatc

SEQ ID NO: 50383 - DNA, 19 bp, Artificial sequence
  SiRNA target sequence
catattttgatgaaaatca

SEQ ID NO: 50384 - DNA, 19 bp, Artificial sequence
  SiRNA target sequence
atattttgatgaaaatcaa

SEQ ID NO: 50385 - DNA, 19 bp, Artificial sequence
  SiRNA target sequence
tattttgatgaaaatcaaa

SEQ ID NO: 50386 - DNA, 19 bp, Artificial sequence
  SiRNA target sequence
attttgatgaaaatcaaaa

SEQ ID NO: 50387 - DNA, 19 bp, Artificial sequence
  SiRNA target sequence
ttttgatgaaaatcaaaaa

SEQ ID NO: 50388 - DNA, 19 bp, Artificial sequence
  SiRNA target sequence
tttgatgaaaatcaaaaac

SEQ ID NO: 50389 - DNA, 19 bp, Artificial sequence
  SiRNA target sequence
ttgatgaaaatcaaaaacc

SEQ ID NO: 50390 - DNA, 19 bp, Artificial sequence
  SiRNA target sequence
tgatgaaaatcaaaaaccg

SEQ ID NO: 50391 - DNA, 19 bp, Artificial sequence
  SiRNA target sequence
gatgaaaatcaaaaaccgg

SEQ ID NO: 50392 - DNA, 19 bp, Artificial sequence
  SiRNA target sequence
atgaaaatcaaaaaccggt

SEQ ID NO: 50393 - DNA, 19 bp, Artificial sequence
  SiRNA target sequence
tgaaaatcaaaaaccggta

SEQ ID NO: 50394 - DNA, 19 bp, Artificial sequence
  SiRNA target sequence
gaaaatcaaaaaccggtag

SEQ ID NO: 50395 - DNA, 19 bp, Artificial sequence
  SiRNA target sequence
aaaatcaaaaaccggtaga

SEQ ID NO: 50396 - DNA, 19 bp, Artificial sequence
  SiRNA target sequence
aaatcaaaaaccggtagaa

SEQ ID NO: 50397 - DNA, 19 bp, Artificial sequence
  SiRNA target sequence
aatcaaaaaccggtagaat

SEQ ID NO: 50398 - DNA, 19 bp, Artificial sequence
  SiRNA target sequence
atcaaaaaccggtagaata

SEQ ID NO: 50399 - DNA, 19 bp, Artificial sequence
  SiRNA target sequence
tcaaaaaccggtagaatat

SEQ ID NO: 50400 - DNA, 19 bp, Artificial sequence
  SiRNA target sequence
caaaaaccggtagaatatt

SEQ ID NO: 50401 - DNA, 19 bp, Artificial sequence
  SiRNA target sequence
aaaaaccggtagaatattt

SEQ ID NO: 50402 - DNA, 19 bp, Artificial sequence
  SiRNA target sequence
aaaaccggtagaatatttt

SEQ ID NO: 50403 - DNA, 19 bp, Artificial sequence
  SiRNA target sequence
aaaccggtagaatattttg

SEQ ID NO: 50404 - DNA, 19 bp, Artificial sequence
  SiRNA target sequence
aaccggtagaatattttgg

SEQ ID NO: 50405 - DNA, 19 bp, Artificial sequence
  SiRNA target sequence
accggtagaatattttggg

SEQ ID NO: 50406 - DNA, 19 bp, Artificial sequence
  SiRNA target sequence
ccggtagaatattttgggg

SEQ ID NO: 50407 - DNA, 19 bp, Artificial sequence
  SiRNA target sequence
cggtagaatattttggggt

SEQ ID NO: 50408 - DNA, 19 bp, Artificial sequence
  SiRNA target sequence
ggtagaatattttggggta

SEQ ID NO: 50409 - DNA, 19 bp, Artificial sequence
  SiRNA target sequence
gtagaatattttggggtaa

SEQ ID NO: 50410 - DNA, 19 bp, Artificial sequence
  SiRNA target sequence
tagaatattttggggtaaa

SEQ ID NO: 50411 - DNA, 19 bp, Artificial sequence
  SiRNA target sequence
agaatattttggggtaaag

SEQ ID NO: 50412 - DNA, 19 bp, Artificial sequence
  SiRNA target sequence
gaatattttggggtaaagt

SEQ ID NO: 50413 - DNA, 19 bp, Artificial sequence
  SiRNA target sequence
aatattttggggtaaagtc

SEQ ID NO: 50414 - DNA, 19 bp, Artificial sequence
  SiRNA target sequence
atattttggggtaaagtct

SEQ ID NO: 50415 - DNA, 19 bp, Artificial sequence
  SiRNA target sequence
tattttggggtaaagtctc

SEQ ID NO: 50416 - DNA, 19 bp, Artificial sequence
  SiRNA target sequence
attttggggtaaagtctca

SEQ ID NO: 50417 - DNA, 19 bp, Artificial sequence
  SiRNA target sequence
ttttggggtaaagtctcac

SEQ ID NO: 50418 - DNA, 19 bp, Artificial sequence
  SiRNA target sequence
tttggggtaaagtctcaca

SEQ ID NO: 50419 - DNA, 19 bp, Artificial sequence
  SiRNA target sequence
ttggggtaaagtctcacag

SEQ ID NO: 50420 - DNA, 19 bp, Artificial sequence
  SiRNA target sequence
tggggtaaagtctcacaga

SEQ ID NO: 50421 - DNA, 19 bp, Artificial sequence
  SiRNA target sequence
ggggtaaagtctcacagaa

SEQ ID NO: 50422 - DNA, 19 bp, Artificial sequence
  SiRNA target sequence
gggtaaagtctcacagaat

SEQ ID NO: 50423 - DNA, 19 bp, Artificial sequence
  SiRNA target sequence
ggtaaagtctcacagaatt

SEQ ID NO: 50424 - DNA, 19 bp, Artificial sequence
  SiRNA target sequence
gtaaagtctcacagaattt

SEQ ID NO: 50425 - DNA, 19 bp, Artificial sequence
  SiRNA target sequence
taaagtctcacagaatttt

SEQ ID NO: 50426 - DNA, 19 bp, Artificial sequence
  SiRNA target sequence
aaagtctcacagaattttg

SEQ ID NO: 50427 - DNA, 19 bp, Artificial sequence
  SiRNA target sequence
aagtctcacagaattttgt

SEQ ID NO: 50428 - DNA, 19 bp, Artificial sequence
  SiRNA target sequence
agtctcacagaattttgtt

SEQ ID NO: 50429 - DNA, 19 bp, Artificial sequence
  SiRNA target sequence
gtctcacagaattttgttc

SEQ ID NO: 50430 - DNA, 19 bp, Artificial sequence
  SiRNA target sequence
tctcacagaattttgttct

SEQ ID NO: 50431 - DNA, 19 bp, Artificial sequence
  SiRNA target sequence
ctcacagaattttgttctc

SEQ ID NO: 50432 - DNA, 19 bp, Artificial sequence
  SiRNA target sequence
tcacagaattttgttctct

SEQ ID NO: 50433 - DNA, 19 bp, Artificial sequence
  SiRNA target sequence
cacagaattttgttctctc

SEQ ID NO: 50434 - DNA, 19 bp, Artificial sequence
  SiRNA target sequence
acagaattttgttctctct

SEQ ID NO: 50435 - DNA, 19 bp, Artificial sequence
  SiRNA target sequence
cagaattttgttctctctt

SEQ ID NO: 50436 - DNA, 19 bp, Artificial sequence
  SiRNA target sequence
agaattttgttctctcttt

SEQ ID NO: 50437 - DNA, 19 bp, Artificial sequence
  SiRNA target sequence
gaattttgttctctctttt

SEQ ID NO: 50438 - DNA, 19 bp, Artificial sequence
  SiRNA target sequence
aattttgttctctctttta

SEQ ID NO: 50439 - DNA, 19 bp, Artificial sequence
  SiRNA target sequence
attttgttctctcttttat

SEQ ID NO: 50440 - DNA, 19 bp, Artificial sequence
  SiRNA target sequence
ttttgttctctcttttata

SEQ ID NO: 50441 - DNA, 19 bp, Artificial sequence
  SiRNA target sequence
tttgttctctcttttatat

SEQ ID NO: 50442 - DNA, 19 bp, Artificial sequence
  SiRNA target sequence
ttgttctctcttttatata

SEQ ID NO: 50443 - DNA, 19 bp, Artificial sequence
  SiRNA target sequence
tgttctctcttttatatat

SEQ ID NO: 50444 - DNA, 19 bp, Artificial sequence
  SiRNA target sequence
gttctctcttttatatata

SEQ ID NO: 50445 - DNA, 19 bp, Artificial sequence
  SiRNA target sequence
ttctctcttttatatatac

SEQ ID NO: 50446 - DNA, 19 bp, Artificial sequence
  SiRNA target sequence
tctctcttttatatataca

SEQ ID NO: 50447 - DNA, 19 bp, Artificial sequence
  SiRNA target sequence
ctctcttttatatatacaa

SEQ ID NO: 50448 - DNA, 19 bp, Artificial sequence
  SiRNA target sequence
tctcttttatatatacaaa

SEQ ID NO: 50449 - DNA, 19 bp, Artificial sequence
  SiRNA target sequence
ctcttttatatatacaaaa

SEQ ID NO: 50450 - DNA, 19 bp, Artificial sequence
  SiRNA target sequence
tcttttatatatacaaaaa

SEQ ID NO: 50451 - DNA, 19 bp, Artificial sequence
  SiRNA target sequence
cttttatatatacaaaaaa

SEQ ID NO: 50452 - DNA, 19 bp, Artificial sequence
  SiRNA target sequence
ttttatatatacaaaaaat

SEQ ID NO: 50453 - DNA, 19 bp, Artificial sequence
  SiRNA target sequence
tttatatatacaaaaaatg

SEQ ID NO: 50454 - DNA, 19 bp, Artificial sequence
  SiRNA target sequence
ttatatatacaaaaaatga

SEQ ID NO: 50455 - DNA, 19 bp, Artificial sequence
  SiRNA target sequence
tatatatacaaaaaatgac

SEQ ID NO: 50456 - DNA, 19 bp, Artificial sequence
  SiRNA target sequence
atatatacaaaaaatgaca

SEQ ID NO: 50457 - DNA, 19 bp, Artificial sequence
  SiRNA target sequence
tatatacaaaaaatgacat

SEQ ID NO: 50458 - DNA, 19 bp, Artificial sequence
  SiRNA target sequence
atatacaaaaaatgacatt

SEQ ID NO: 50459 - DNA, 19 bp, Artificial sequence
  SiRNA target sequence
tatacaaaaaatgacattt

SEQ ID NO: 50460 - DNA, 19 bp, Artificial sequence
  SiRNA target sequence
atacaaaaaatgacatttg

SEQ ID NO: 50461 - DNA, 19 bp, Artificial sequence
  SiRNA target sequence
tacaaaaaatgacatttgc

SEQ ID NO: 50462 - DNA, 19 bp, Artificial sequence
  SiRNA target sequence
acaaaaaatgacatttgcg

SEQ ID NO: 50463 - DNA, 19 bp, Artificial sequence
  SiRNA target sequence
caaaaaatgacatttgcga

SEQ ID NO: 50464 - DNA, 19 bp, Artificial sequence
  SiRNA target sequence
aaaaaatgacatttgcgat

SEQ ID NO: 50465 - DNA, 19 bp, Artificial sequence
  SiRNA target sequence
aaaaatgacatttgcgata

SEQ ID NO: 50466 - DNA, 19 bp, Artificial sequence
  SiRNA target sequence
aaaatgacatttgcgatac

SEQ ID NO: 50467 - DNA, 19 bp, Artificial sequence
  SiRNA target sequence
aaatgacatttgcgataca

SEQ ID NO: 50468 - DNA, 19 bp, Artificial sequence
  SiRNA target sequence
aatgacatttgcgatacag

SEQ ID NO: 50469 - DNA, 19 bp, Artificial sequence
  SiRNA target sequence
atgacatttgcgatacagg

SEQ ID NO: 50470 - DNA, 19 bp, Artificial sequence
  SiRNA target sequence
tgacatttgcgatacaggc

SEQ ID NO: 50471 - DNA, 19 bp, Artificial sequence
  SiRNA target sequence
gacatttgcgatacaggca

SEQ ID NO: 50472 - DNA, 19 bp, Artificial sequence
  SiRNA target sequence
acatttgcgatacaggcaa

SEQ ID NO: 50473 - DNA, 19 bp, Artificial sequence
  SiRNA target sequence
catttgcgatacaggcaat

SEQ ID NO: 50474 - DNA, 19 bp, Artificial sequence
  SiRNA target sequence
atttgcgatacaggcaatt

SEQ ID NO: 50475 - DNA, 19 bp, Artificial sequence
  SiRNA target sequence
tttgcgatacaggcaatta

SEQ ID NO: 50476 - DNA, 19 bp, Artificial sequence
  SiRNA target sequence
ttgcgatacaggcaattat

SEQ ID NO: 50477 - DNA, 19 bp, Artificial sequence
  SiRNA target sequence
tgcgatacaggcaattatt

SEQ ID NO: 50478 - DNA, 19 bp, Artificial sequence
  SiRNA target sequence
gcgatacaggcaattatta

SEQ ID NO: 50479 - DNA, 19 bp, Artificial sequence
  SiRNA target sequence
cgatacaggcaattattat

SEQ ID NO: 50480 - DNA, 19 bp, Artificial sequence
  SiRNA target sequence
gatacaggcaattattatt

SEQ ID NO: 50481 - DNA, 19 bp, Artificial sequence
  SiRNA target sequence
atacaggcaattattatta

SEQ ID NO: 50482 - DNA, 19 bp, Artificial sequence
  SiRNA target sequence
tacaggcaattattattat

SEQ ID NO: 50483 - DNA, 19 bp, Artificial sequence
  SiRNA target sequence
acaggcaattattattatc

SEQ ID NO: 50484 - DNA, 19 bp, Artificial sequence
  SiRNA target sequence
caggcaattattattatca

SEQ ID NO: 50485 - DNA, 19 bp, Artificial sequence
  SiRNA target sequence
aggcaattattattatcac

SEQ ID NO: 50486 - DNA, 19 bp, Artificial sequence
  SiRNA target sequence
ggcaattattattatcaca

SEQ ID NO: 50487 - DNA, 19 bp, Artificial sequence
  SiRNA target sequence
gcaattattattatcacat

SEQ ID NO: 50488 - DNA, 19 bp, Artificial sequence
  SiRNA target sequence
caattattattatcacatt

SEQ ID NO: 50489 - DNA, 19 bp, Artificial sequence
  SiRNA target sequence
aattattattatcacatta

SEQ ID NO: 50490 - DNA, 19 bp, Artificial sequence
  SiRNA target sequence
attattattatcacattag

SEQ ID NO: 50491 - DNA, 19 bp, Artificial sequence
  SiRNA target sequence
ttattattatcacattagg

SEQ ID NO: 50492 - DNA, 19 bp, Artificial sequence
  SiRNA target sequence
tattattatcacattagga

SEQ ID NO: 50493 - DNA, 19 bp, Artificial sequence
  SiRNA target sequence
attattatcacattaggat

SEQ ID NO: 50494 - DNA, 19 bp, Artificial sequence
  SiRNA target sequence
ttattatcacattaggatc

SEQ ID NO: 50495 - DNA, 19 bp, Artificial sequence
  SiRNA target sequence
tattatcacattaggatct

SEQ ID NO: 50496 - DNA, 19 bp, Artificial sequence
  SiRNA target sequence
attatcacattaggatctt

SEQ ID NO: 50497 - DNA, 19 bp, Artificial sequence
  SiRNA target sequence
ttatcacattaggatcttt

SEQ ID NO: 50498 - DNA, 19 bp, Artificial sequence
  SiRNA target sequence
tatcacattaggatctttt

SEQ ID NO: 50499 - DNA, 19 bp, Artificial sequence
  SiRNA target sequence
atcacattaggatcttttg

SEQ ID NO: 50500 - DNA, 19 bp, Artificial sequence
  SiRNA target sequence
tcacattaggatcttttgg

SEQ ID NO: 50501 - DNA, 19 bp, Artificial sequence
  SiRNA target sequence
cacattaggatcttttgga

SEQ ID NO: 50502 - DNA, 19 bp, Artificial sequence
  SiRNA target sequence
acattaggatcttttggat

SEQ ID NO: 50503 - DNA, 19 bp, Artificial sequence
  SiRNA target sequence
cattaggatcttttggata

SEQ ID NO: 50504 - DNA, 19 bp, Artificial sequence
  SiRNA target sequence
attaggatcttttggatat

SEQ ID NO: 50505 - DNA, 19 bp, Artificial sequence
  SiRNA target sequence
ttaggatcttttggatatt

SEQ ID NO: 50506 - DNA, 19 bp, Artificial sequence
  SiRNA target sequence
taggatcttttggatattt

SEQ ID NO: 50507 - DNA, 19 bp, Artificial sequence
  SiRNA target sequence
aggatcttttggatatttt

SEQ ID NO: 50508 - DNA, 19 bp, Artificial sequence
  SiRNA target sequence
ggatcttttggatattttc

SEQ ID NO: 50509 - DNA, 19 bp, Artificial sequence
  SiRNA target sequence
gatcttttggatattttcc

SEQ ID NO: 50510 - DNA, 19 bp, Artificial sequence
  SiRNA target sequence
atcttttggatattttccg

SEQ ID NO: 50511 - DNA, 19 bp, Artificial sequence
  SiRNA target sequence
tcttttggatattttccga

SEQ ID NO: 50512 - DNA, 19 bp, Artificial sequence
  SiRNA target sequence
cttttggatattttccgat

SEQ ID NO: 50513 - DNA, 19 bp, Artificial sequence
  SiRNA target sequence
ttttggatattttccgatt

SEQ ID NO: 50514 - DNA, 19 bp, Artificial sequence
  SiRNA target sequence
tttggatattttccgatta

SEQ ID NO: 50515 - DNA, 19 bp, Artificial sequence
  SiRNA target sequence
ttggatattttccgattaa

SEQ ID NO: 50516 - DNA, 19 bp, Artificial sequence
  SiRNA target sequence
tggatattttccgattaaa

SEQ ID NO: 50517 - DNA, 19 bp, Artificial sequence
  SiRNA target sequence
ggatattttccgattaaat

SEQ ID NO: 50518 - DNA, 19 bp, Artificial sequence
  SiRNA target sequence
gatattttccgattaaatt

SEQ ID NO: 50519 - DNA, 19 bp, Artificial sequence
  SiRNA target sequence
atattttccgattaaatta

SEQ ID NO: 50520 - DNA, 19 bp, Artificial sequence
  SiRNA target sequence
tattttccgattaaattat

SEQ ID NO: 50521 - DNA, 19 bp, Artificial sequence
  SiRNA target sequence
attttccgattaaattatc

SEQ ID NO: 50522 - DNA, 19 bp, Artificial sequence
  SiRNA target sequence
ttttccgattaaattatcc

SEQ ID NO: 50523 - DNA, 19 bp, Artificial sequence
  SiRNA target sequence
tttccgattaaattatcct

SEQ ID NO: 50524 - DNA, 19 bp, Artificial sequence
  SiRNA target sequence
ttccgattaaattatcctc

SEQ ID NO: 50525 - DNA, 19 bp, Artificial sequence
  SiRNA target sequence
tccgattaaattatcctct

SEQ ID NO: 50526 - DNA, 19 bp, Artificial sequence
  SiRNA target sequence
ccgattaaattatcctctc

SEQ ID NO: 50527 - DNA, 19 bp, Artificial sequence
  SiRNA target sequence
cgattaaattatcctctca

SEQ ID NO: 50528 - DNA, 19 bp, Artificial sequence
  SiRNA target sequence
gattaaattatcctctcaa

SEQ ID NO: 50529 - DNA, 19 bp, Artificial sequence
  SiRNA target sequence
attaaattatcctctcaac

SEQ ID NO: 50530 - DNA, 19 bp, Artificial sequence
  SiRNA target sequence
ttaaattatcctctcaaca

SEQ ID NO: 50531 - DNA, 19 bp, Artificial sequence
  SiRNA target sequence
taaattatcctctcaacag

SEQ ID NO: 50532 - DNA, 19 bp, Artificial sequence
  SiRNA target sequence
aaattatcctctcaacagt

SEQ ID NO: 50533 - DNA, 19 bp, Artificial sequence
  SiRNA target sequence
aattatcctctcaacagtt

SEQ ID NO: 50534 - DNA, 19 bp, Artificial sequence
  SiRNA target sequence
attatcctctcaacagtta

SEQ ID NO: 50535 - DNA, 19 bp, Artificial sequence
  SiRNA target sequence
ttatcctctcaacagttag

SEQ ID NO: 50536 - DNA, 19 bp, Artificial sequence
  SiRNA target sequence
tatcctctcaacagttagt

SEQ ID NO: 50537 - DNA, 19 bp, Artificial sequence
  SiRNA target sequence
atcctctcaacagttagtc

SEQ ID NO: 50538 - DNA, 19 bp, Artificial sequence
  SiRNA target sequence
tcctctcaacagttagtct

SEQ ID NO: 50539 - DNA, 19 bp, Artificial sequence
  SiRNA target sequence
cctctcaacagttagtctt

SEQ ID NO: 50540 - DNA, 19 bp, Artificial sequence
  SiRNA target sequence
ctctcaacagttagtcttt

SEQ ID NO: 50541 - DNA, 19 bp, Artificial sequence
  SiRNA target sequence
tctcaacagttagtctttt

SEQ ID NO: 50542 - DNA, 19 bp, Artificial sequence
  SiRNA target sequence
ctcaacagttagtctttta

SEQ ID NO: 50543 - DNA, 19 bp, Artificial sequence
  SiRNA target sequence
tcaacagttagtcttttat

SEQ ID NO: 50544 - DNA, 19 bp, Artificial sequence
  SiRNA target sequence
caacagttagtcttttata

SEQ ID NO: 50545 - DNA, 19 bp, Artificial sequence
  SiRNA target sequence
aacagttagtcttttatat

SEQ ID NO: 50546 - DNA, 19 bp, Artificial sequence
  SiRNA target sequence
acagttagtcttttatatt

SEQ ID NO: 50547 - DNA, 19 bp, Artificial sequence
  SiRNA target sequence
cagttagtcttttatattt

SEQ ID NO: 50548 - DNA, 19 bp, Artificial sequence
  SiRNA target sequence
agttagtcttttatatttc

SEQ ID NO: 50549 - DNA, 19 bp, Artificial sequence
  SiRNA target sequence
gttagtcttttatatttcg

SEQ ID NO: 50550 - DNA, 19 bp, Artificial sequence
  SiRNA target sequence
ttagtcttttatatttcga

SEQ ID NO: 50551 - DNA, 19 bp, Artificial sequence
  SiRNA target sequence
tagtcttttatatttcgat

SEQ ID NO: 50552 - DNA, 19 bp, Artificial sequence
  SiRNA target sequence
agtcttttatatttcgatt

SEQ ID NO: 50553 - DNA, 19 bp, Artificial sequence
  SiRNA target sequence
gtcttttatatttcgatta

SEQ ID NO: 50554 - DNA, 19 bp, Artificial sequence
  SiRNA target sequence
tcttttatatttcgattag

SEQ ID NO: 50555 - DNA, 19 bp, Artificial sequence
  SiRNA target sequence
cttttatatttcgattagt

SEQ ID NO: 50556 - DNA, 19 bp, Artificial sequence
  SiRNA target sequence
ttttatatttcgattagta

SEQ ID NO: 50557 - DNA, 19 bp, Artificial sequence
  SiRNA target sequence
tttatatttcgattagtaa

SEQ ID NO: 50558 - DNA, 19 bp, Artificial sequence
  SiRNA target sequence
ttatatttcgattagtaaa

SEQ ID NO: 50559 - DNA, 19 bp, Artificial sequence
  SiRNA target sequence
tatatttcgattagtaaaa

SEQ ID NO: 50560 - DNA, 19 bp, Artificial sequence
  SiRNA target sequence
atatttcgattagtaaaac

SEQ ID NO: 50561 - DNA, 19 bp, Artificial sequence
  SiRNA target sequence
tatttcgattagtaaaacg

SEQ ID NO: 50562 - DNA, 19 bp, Artificial sequence
  SiRNA target sequence
atttcgattagtaaaacgt

SEQ ID NO: 50563 - DNA, 19 bp, Artificial sequence
  SiRNA target sequence
tttcgattagtaaaacgtt

SEQ ID NO: 50564 - DNA, 19 bp, Artificial sequence
  SiRNA target sequence
ttcgattagtaaaacgttg

SEQ ID NO: 50565 - DNA, 19 bp, Artificial sequence
  SiRNA target sequence
tcgattagtaaaacgttga

SEQ ID NO: 50566 - DNA, 19 bp, Artificial sequence
  SiRNA target sequence
cgattagtaaaacgttgac

SEQ ID NO: 50567 - DNA, 19 bp, Artificial sequence
  SiRNA target sequence
gattagtaaaacgttgaca

SEQ ID NO: 50568 - DNA, 19 bp, Artificial sequence
  SiRNA target sequence
attagtaaaacgttgacaa

SEQ ID NO: 50569 - DNA, 19 bp, Artificial sequence
  SiRNA target sequence
ttagtaaaacgttgacaaa

SEQ ID NO: 50570 - DNA, 19 bp, Artificial sequence
  SiRNA target sequence
tagtaaaacgttgacaaat

SEQ ID NO: 50571 - DNA, 19 bp, Artificial sequence
  SiRNA target sequence
agtaaaacgttgacaaatt

SEQ ID NO: 50572 - DNA, 19 bp, Artificial sequence
  SiRNA target sequence
gtaaaacgttgacaaattc

SEQ ID NO: 50573 - DNA, 19 bp, Artificial sequence
  SiRNA target sequence
taaaacgttgacaaattcg

SEQ ID NO: 50574 - DNA, 19 bp, Artificial sequence
  SiRNA target sequence
aaaacgttgacaaattcgt

SEQ ID NO: 50575 - DNA, 19 bp, Artificial sequence
  SiRNA target sequence
aaacgttgacaaattcgtt

SEQ ID NO: 50576 - DNA, 19 bp, Artificial sequence
  SiRNA target sequence
aacgttgacaaattcgttg

SEQ ID NO: 50577 - DNA, 19 bp, Artificial sequence
  SiRNA target sequence
acgttgacaaattcgttga

SEQ ID NO: 50578 - DNA, 19 bp, Artificial sequence
  SiRNA target sequence
cgttgacaaattcgttgag

SEQ ID NO: 50579 - DNA, 19 bp, Artificial sequence
  SiRNA target sequence
gttgacaaattcgttgagc

SEQ ID NO: 50580 - DNA, 19 bp, Artificial sequence
  SiRNA target sequence
ttgacaaattcgttgagcg

SEQ ID NO: 50581 - DNA, 19 bp, Artificial sequence
  SiRNA target sequence
tgacaaattcgttgagcga

SEQ ID NO: 50582 - DNA, 19 bp, Artificial sequence
  SiRNA target sequence
gacaaattcgttgagcgaa

SEQ ID NO: 50583 - DNA, 19 bp, Artificial sequence
  SiRNA target sequence
acaaattcgttgagcgaaa

SEQ ID NO: 50584 - DNA, 19 bp, Artificial sequence
  SiRNA target sequence
caaattcgttgagcgaaat

SEQ ID NO: 50585 - DNA, 19 bp, Artificial sequence
  SiRNA target sequence
aaattcgttgagcgaaatg

SEQ ID NO: 50586 - DNA, 19 bp, Artificial sequence
  SiRNA target sequence
aattcgttgagcgaaatgg

SEQ ID NO: 50587 - DNA, 19 bp, Artificial sequence
  SiRNA target sequence
attcgttgagcgaaatggg

SEQ ID NO: 50588 - DNA, 19 bp, Artificial sequence
  SiRNA target sequence
ttcgttgagcgaaatggga

SEQ ID NO: 50589 - DNA, 19 bp, Artificial sequence
  SiRNA target sequence
tcgttgagcgaaatgggaa

SEQ ID NO: 50590 - DNA, 19 bp, Artificial sequence
  SiRNA target sequence
cgttgagcgaaatgggaat

SEQ ID NO: 50591 - DNA, 19 bp, Artificial sequence
  SiRNA target sequence
gttgagcgaaatgggaatg

SEQ ID NO: 50592 - DNA, 19 bp, Artificial sequence
  SiRNA target sequence
ttgagcgaaatgggaatgc

SEQ ID NO: 50593 - DNA, 19 bp, Artificial sequence
  SiRNA target sequence
tgagcgaaatgggaatgct

SEQ ID NO: 50594 - DNA, 19 bp, Artificial sequence
  SiRNA target sequence
gagcgaaatgggaatgcta

SEQ ID NO: 50595 - DNA, 19 bp, Artificial sequence
  SiRNA target sequence
agcgaaatgggaatgctat

SEQ ID NO: 50596 - DNA, 19 bp, Artificial sequence
  SiRNA target sequence
gcgaaatgggaatgctata

SEQ ID NO: 50597 - DNA, 19 bp, Artificial sequence
  SiRNA target sequence
cgaaatgggaatgctatac

SEQ ID NO: 50598 - DNA, 19 bp, Artificial sequence
  SiRNA target sequence
gaaatgggaatgctataca

SEQ ID NO: 50599 - DNA, 19 bp, Artificial sequence
  SiRNA target sequence
aaatgggaatgctatacac

SEQ ID NO: 50600 - DNA, 19 bp, Artificial sequence
  SiRNA target sequence
aatgggaatgctatacaca

SEQ ID NO: 50601 - DNA, 19 bp, Artificial sequence
  SiRNA target sequence
atgggaatgctatacacaa

SEQ ID NO: 50602 - DNA, 19 bp, Artificial sequence
  SiRNA target sequence
tgggaatgctatacacaag

SEQ ID NO: 50603 - DNA, 19 bp, Artificial sequence
  SiRNA target sequence
gggaatgctatacacaaga

SEQ ID NO: 50604 - DNA, 19 bp, Artificial sequence
  SiRNA target sequence
ggaatgctatacacaagat

SEQ ID NO: 50605 - DNA, 19 bp, Artificial sequence
  SiRNA target sequence
gaatgctatacacaagata

SEQ ID NO: 50606 - DNA, 19 bp, Artificial sequence
  SiRNA target sequence
aatgctatacacaagatat

SEQ ID NO: 50607 - DNA, 19 bp, Artificial sequence
  SiRNA target sequence
atgctatacacaagatatg

SEQ ID NO: 50608 - DNA, 19 bp, Artificial sequence
  SiRNA target sequence
tgctatacacaagatatgt

SEQ ID NO: 50609 - DNA, 19 bp, Artificial sequence
  SiRNA target sequence
gctatacacaagatatgta

SEQ ID NO: 50610 - DNA, 19 bp, Artificial sequence
  SiRNA target sequence
ctatacacaagatatgtac

SEQ ID NO: 50611 - DNA, 19 bp, Artificial sequence
  SiRNA target sequence
tatacacaagatatgtaca

SEQ ID NO: 50612 - DNA, 19 bp, Artificial sequence
  SiRNA target sequence
atacacaagatatgtacaa

SEQ ID NO: 50613 - DNA, 19 bp, Artificial sequence
  SiRNA target sequence
tacacaagatatgtacaag

SEQ ID NO: 50614 - DNA, 19 bp, Artificial sequence
  SiRNA target sequence
acacaagatatgtacaagg

SEQ ID NO: 50615 - DNA, 19 bp, Artificial sequence
  SiRNA target sequence
cacaagatatgtacaagga

SEQ ID NO: 50616 - DNA, 19 bp, Artificial sequence
  SiRNA target sequence
acaagatatgtacaaggat

SEQ ID NO: 50617 - DNA, 19 bp, Artificial sequence
  SiRNA target sequence
caagatatgtacaaggatt

SEQ ID NO: 50618 - DNA, 19 bp, Artificial sequence
  SiRNA target sequence
aagatatgtacaaggattt

SEQ ID NO: 50619 - DNA, 19 bp, Artificial sequence
  SiRNA target sequence
agatatgtacaaggatttt

SEQ ID NO: 50620 - DNA, 19 bp, Artificial sequence
  SiRNA target sequence
gatatgtacaaggattttt

SEQ ID NO: 50621 - DNA, 19 bp, Artificial sequence
  SiRNA target sequence
atatgtacaaggattttta

SEQ ID NO: 50622 - DNA, 19 bp, Artificial sequence
  SiRNA target sequence
tatgtacaaggatttttaa

SEQ ID NO: 50623 - DNA, 19 bp, Artificial sequence
  SiRNA target sequence
atgtacaaggatttttaaa

SEQ ID NO: 50624 - DNA, 19 bp, Artificial sequence
  SiRNA target sequence
tgtacaaggatttttaaat

SEQ ID NO: 50625 - DNA, 19 bp, Artificial sequence
  SiRNA target sequence
gtacaaggatttttaaatg

SEQ ID NO: 50626 - DNA, 19 bp, Artificial sequence
  SiRNA target sequence
tacaaggatttttaaatgc

SEQ ID NO: 50627 - DNA, 19 bp, Artificial sequence
  SiRNA target sequence
acaaggatttttaaatgca

SEQ ID NO: 50628 - DNA, 19 bp, Artificial sequence
  SiRNA target sequence
caaggatttttaaatgcaa

SEQ ID NO: 50629 - DNA, 19 bp, Artificial sequence
  SiRNA target sequence
aaggatttttaaatgcaaa

SEQ ID NO: 50630 - DNA, 19 bp, Artificial sequence
  SiRNA target sequence
aggatttttaaatgcaaag

SEQ ID NO: 50631 - DNA, 19 bp, Artificial sequence
  SiRNA target sequence
ggatttttaaatgcaaagt

SEQ ID NO: 50632 - DNA, 19 bp, Artificial sequence
  SiRNA target sequence
gatttttaaatgcaaagtc

SEQ ID NO: 50633 - DNA, 19 bp, Artificial sequence
  SiRNA target sequence
atttttaaatgcaaagtct

SEQ ID NO: 50634 - DNA, 19 bp, Artificial sequence
  SiRNA target sequence
tttttaaatgcaaagtctg

SEQ ID NO: 50635 - DNA, 19 bp, Artificial sequence
  SiRNA target sequence
ttttaaatgcaaagtctgg

SEQ ID NO: 50636 - DNA, 19 bp, Artificial sequence
  SiRNA target sequence
tttaaatgcaaagtctgga

SEQ ID NO: 50637 - DNA, 19 bp, Artificial sequence
  SiRNA target sequence
ttaaatgcaaagtctggat

SEQ ID NO: 50638 - DNA, 19 bp, Artificial sequence
  SiRNA target sequence
taaatgcaaagtctggata

SEQ ID NO: 50639 - DNA, 19 bp, Artificial sequence
  SiRNA target sequence
aaatgcaaagtctggatat

SEQ ID NO: 50640 - DNA, 19 bp, Artificial sequence
  SiRNA target sequence
aatgcaaagtctggatatt

SEQ ID NO: 50641 - DNA, 19 bp, Artificial sequence
  SiRNA target sequence
atgcaaagtctggatatta

SEQ ID NO: 50642 - DNA, 19 bp, Artificial sequence
  SiRNA target sequence
tgcaaagtctggatattac

SEQ ID NO: 50643 - DNA, 19 bp, Artificial sequence
  SiRNA target sequence
gcaaagtctggatattacg

SEQ ID NO: 50644 - DNA, 19 bp, Artificial sequence
  SiRNA target sequence
caaagtctggatattacga

SEQ ID NO: 50645 - DNA, 19 bp, Artificial sequence
  SiRNA target sequence
aaagtctggatattacgag

SEQ ID NO: 50646 - DNA, 19 bp, Artificial sequence
  SiRNA target sequence
aagtctggatattacgagt

SEQ ID NO: 50647 - DNA, 19 bp, Artificial sequence
  SiRNA target sequence
agtctggatattacgagtt

SEQ ID NO: 50648 - DNA, 19 bp, Artificial sequence
  SiRNA target sequence
gtctggatattacgagttt

SEQ ID NO: 50649 - DNA, 19 bp, Artificial sequence
  SiRNA target sequence
tctggatattacgagttta

SEQ ID NO: 50650 - DNA, 19 bp, Artificial sequence
  SiRNA target sequence
ctggatattacgagtttaa

SEQ ID NO: 50651 - DNA, 19 bp, Artificial sequence
  SiRNA target sequence
tggatattacgagtttaaa

SEQ ID NO: 50652 - DNA, 19 bp, Artificial sequence
  SiRNA target sequence
ggatattacgagtttaaag

SEQ ID NO: 50653 - DNA, 19 bp, Artificial sequence
  SiRNA target sequence
gatattacgagtttaaaga

SEQ ID NO: 50654 - DNA, 19 bp, Artificial sequence
  SiRNA target sequence
atattacgagtttaaagag

SEQ ID NO: 50655 - DNA, 19 bp, Artificial sequence
  SiRNA target sequence
tattacgagtttaaagagg

SEQ ID NO: 50656 - DNA, 19 bp, Artificial sequence
  SiRNA target sequence
attacgagtttaaagagga

SEQ ID NO: 50657 - DNA, 19 bp, Artificial sequence
  SiRNA target sequence
ttacgagtttaaagaggat

SEQ ID NO: 50658 - DNA, 19 bp, Artificial sequence
  SiRNA target sequence
tacgagtttaaagaggata

SEQ ID NO: 50659 - DNA, 19 bp, Artificial sequence
  SiRNA target sequence
acgagtttaaagaggatac

SEQ ID NO: 50660 - DNA, 19 bp, Artificial sequence
  SiRNA target sequence
cgagtttaaagaggataca

SEQ ID NO: 50661 - DNA, 19 bp, Artificial sequence
  SiRNA target sequence
gagtttaaagaggatacac

SEQ ID NO: 50662 - DNA, 19 bp, Artificial sequence
  SiRNA target sequence
agtttaaagaggatacaca

SEQ ID NO: 50663 - DNA, 19 bp, Artificial sequence
  SiRNA target sequence
gtttaaagaggatacacaa

SEQ ID NO: 50664 - DNA, 19 bp, Artificial sequence
  SiRNA target sequence
tttaaagaggatacacaaa

SEQ ID NO: 50665 - DNA, 19 bp, Artificial sequence
  SiRNA target sequence
ttaaagaggatacacaaac

SEQ ID NO: 50666 - DNA, 19 bp, Artificial sequence
  SiRNA target sequence
taaagaggatacacaaact

SEQ ID NO: 50667 - DNA, 19 bp, Artificial sequence
  SiRNA target sequence
aaagaggatacacaaactg

SEQ ID NO: 50668 - DNA, 19 bp, Artificial sequence
  SiRNA target sequence
aagaggatacacaaactga

SEQ ID NO: 50669 - DNA, 19 bp, Artificial sequence
  SiRNA target sequence
agaggatacacaaactgat

SEQ ID NO: 50670 - DNA, 19 bp, Artificial sequence
  SiRNA target sequence
gaggatacacaaactgata

SEQ ID NO: 50671 - DNA, 19 bp, Artificial sequence
  SiRNA target sequence
aggatacacaaactgataa

SEQ ID NO: 50672 - DNA, 19 bp, Artificial sequence
  SiRNA target sequence
ggatacacaaactgataaa

SEQ ID NO: 50673 - DNA, 19 bp, Artificial sequence
  SiRNA target sequence
gatacacaaactgataaaa

SEQ ID NO: 50674 - DNA, 19 bp, Artificial sequence
  SiRNA target sequence
atacacaaactgataaaat

SEQ ID NO: 50675 - DNA, 19 bp, Artificial sequence
  SiRNA target sequence
tacacaaactgataaaata

SEQ ID NO: 50676 - DNA, 19 bp, Artificial sequence
  SiRNA target sequence
acacaaactgataaaataa

SEQ ID NO: 50677 - DNA, 19 bp, Artificial sequence
  SiRNA target sequence
cacaaactgataaaataag

SEQ ID NO: 50678 - DNA, 19 bp, Artificial sequence
  SiRNA target sequence
acaaactgataaaataaga

SEQ ID NO: 50679 - DNA, 19 bp, Artificial sequence
  SiRNA target sequence
caaactgataaaataagac

SEQ ID NO: 50680 - DNA, 19 bp, Artificial sequence
  SiRNA target sequence
aaactgataaaataagact

SEQ ID NO: 50681 - DNA, 19 bp, Artificial sequence
  SiRNA target sequence
aactgataaaataagactg

SEQ ID NO: 50682 - DNA, 19 bp, Artificial sequence
  SiRNA target sequence
actgataaaataagactga

SEQ ID NO: 50683 - DNA, 19 bp, Artificial sequence
  SiRNA target sequence
ctgataaaataagactgat

SEQ ID NO: 50684 - DNA, 19 bp, Artificial sequence
  SiRNA target sequence
tgataaaataagactgata

SEQ ID NO: 50685 - DNA, 19 bp, Artificial sequence
  SiRNA target sequence
gataaaataagactgatag

SEQ ID NO: 50686 - DNA, 19 bp, Artificial sequence
  SiRNA target sequence
ataaaataagactgataga

SEQ ID NO: 50687 - DNA, 19 bp, Artificial sequence
  SiRNA target sequence
taaaataagactgatagat

SEQ ID NO: 50688 - DNA, 19 bp, Artificial sequence
  SiRNA target sequence
aaaataagactgatagatt

SEQ ID NO: 50689 - DNA, 19 bp, Artificial sequence
  SiRNA target sequence
aaataagactgatagattt

SEQ ID NO: 50690 - DNA, 19 bp, Artificial sequence
  SiRNA target sequence
aataagactgatagatttt

SEQ ID NO: 50691 - DNA, 19 bp, Artificial sequence
  SiRNA target sequence
ataagactgatagatttta

SEQ ID NO: 50692 - DNA, 19 bp, Artificial sequence
  SiRNA target sequence
taagactgatagattttaa

SEQ ID NO: 50693 - DNA, 19 bp, Artificial sequence
  SiRNA target sequence
aagactgatagattttaat

SEQ ID NO: 50694 - DNA, 19 bp, Artificial sequence
  SiRNA target sequence
agactgatagattttaatg

SEQ ID NO: 50695 - DNA, 19 bp, Artificial sequence
  SiRNA target sequence
gactgatagattttaatga

SEQ ID NO: 50696 - DNA, 19 bp, Artificial sequence
  SiRNA target sequence
actgatagattttaatgaa

SEQ ID NO: 50697 - DNA, 19 bp, Artificial sequence
  SiRNA target sequence
ctgatagattttaatgaaa

SEQ ID NO: 50698 - DNA, 19 bp, Artificial sequence
  SiRNA target sequence
tgatagattttaatgaaaa

SEQ ID NO: 50699 - DNA, 19 bp, Artificial sequence
  SiRNA target sequence
gatagattttaatgaaaag

SEQ ID NO: 50700 - DNA, 19 bp, Artificial sequence
  SiRNA target sequence
atagattttaatgaaaagc

SEQ ID NO: 50701 - DNA, 19 bp, Artificial sequence
  SiRNA target sequence
tagattttaatgaaaagct

SEQ ID NO: 50702 - DNA, 19 bp, Artificial sequence
  SiRNA target sequence
agattttaatgaaaagcta

SEQ ID NO: 50703 - DNA, 19 bp, Artificial sequence
  SiRNA target sequence
gattttaatgaaaagctag

SEQ ID NO: 50704 - DNA, 19 bp, Artificial sequence
  SiRNA target sequence
attttaatgaaaagctaga

SEQ ID NO: 50705 - DNA, 19 bp, Artificial sequence
  SiRNA target sequence
ttttaatgaaaagctagaa

SEQ ID NO: 50706 - DNA, 19 bp, Artificial sequence
  SiRNA target sequence
tttaatgaaaagctagaat

SEQ ID NO: 50707 - DNA, 19 bp, Artificial sequence
  SiRNA target sequence
ttaatgaaaagctagaatt

SEQ ID NO: 50708 - DNA, 19 bp, Artificial sequence
  SiRNA target sequence
taatgaaaagctagaattt

SEQ ID NO: 50709 - DNA, 19 bp, Artificial sequence
  SiRNA target sequence
aatgaaaagctagaattta

SEQ ID NO: 50710 - DNA, 19 bp, Artificial sequence
  SiRNA target sequence
atgaaaagctagaatttag

SEQ ID NO: 50711 - DNA, 19 bp, Artificial sequence
  SiRNA target sequence
tgaaaagctagaatttaga

SEQ ID NO: 50712 - DNA, 19 bp, Artificial sequence
  SiRNA target sequence
gaaaagctagaatttagaa

SEQ ID NO: 50713 - DNA, 19 bp, Artificial sequence
  SiRNA target sequence
aaaagctagaatttagaaa

SEQ ID NO: 50714 - DNA, 19 bp, Artificial sequence
  SiRNA target sequence
aaagctagaatttagaaat

SEQ ID NO: 50715 - DNA, 19 bp, Artificial sequence
  SiRNA target sequence
aagctagaatttagaaatg

SEQ ID NO: 50716 - DNA, 19 bp, Artificial sequence
  SiRNA target sequence
agctagaatttagaaatgt

SEQ ID NO: 50717 - DNA, 19 bp, Artificial sequence
  SiRNA target sequence
gctagaatttagaaatgta

SEQ ID NO: 50718 - DNA, 19 bp, Artificial sequence
  SiRNA target sequence
ctagaatttagaaatgtat

SEQ ID NO: 50719 - DNA, 19 bp, Artificial sequence
  SiRNA target sequence
tagaatttagaaatgtatc

SEQ ID NO: 50720 - DNA, 19 bp, Artificial sequence
  SiRNA target sequence
agaatttagaaatgtatct

SEQ ID NO: 50721 - DNA, 19 bp, Artificial sequence
  SiRNA target sequence
gaatttagaaatgtatctt

SEQ ID NO: 50722 - DNA, 19 bp, Artificial sequence
  SiRNA target sequence
aatttagaaatgtatcttt

SEQ ID NO: 50723 - DNA, 19 bp, Artificial sequence
  SiRNA target sequence
atttagaaatgtatctttt

SEQ ID NO: 50724 - DNA, 19 bp, Artificial sequence
  SiRNA target sequence
tttagaaatgtatctttta

SEQ ID NO: 50725 - DNA, 19 bp, Artificial sequence
  SiRNA target sequence
ttagaaatgtatcttttag

SEQ ID NO: 50726 - DNA, 19 bp, Artificial sequence
  SiRNA target sequence
tagaaatgtatcttttagt

SEQ ID NO: 50727 - DNA, 19 bp, Artificial sequence
  SiRNA target sequence
agaaatgtatcttttagtt

SEQ ID NO: 50728 - DNA, 19 bp, Artificial sequence
  SiRNA target sequence
gaaatgtatcttttagtta

SEQ ID NO: 50729 - DNA, 19 bp, Artificial sequence
  SiRNA target sequence
aaatgtatcttttagttat

SEQ ID NO: 50730 - DNA, 19 bp, Artificial sequence
  SiRNA target sequence
aatgtatcttttagttatt

SEQ ID NO: 50731 - DNA, 19 bp, Artificial sequence
  SiRNA target sequence
atgtatcttttagttattt

SEQ ID NO: 50732 - DNA, 19 bp, Artificial sequence
  SiRNA target sequence
tgtatcttttagttattta

SEQ ID NO: 50733 - DNA, 19 bp, Artificial sequence
  SiRNA target sequence
gtatcttttagttatttaa

SEQ ID NO: 50734 - DNA, 19 bp, Artificial sequence
  SiRNA target sequence
tatcttttagttatttaaa

SEQ ID NO: 50735 - DNA, 19 bp, Artificial sequence
  SiRNA target sequence
atcttttagttatttaaat

SEQ ID NO: 50736 - DNA, 19 bp, Artificial sequence
  SiRNA target sequence
tcttttagttatttaaata

SEQ ID NO: 50737 - DNA, 19 bp, Artificial sequence
  SiRNA target sequence
cttttagttatttaaataa

SEQ ID NO: 50738 - DNA, 19 bp, Artificial sequence
  SiRNA target sequence
ttttagttatttaaataag

SEQ ID NO: 50739 - DNA, 19 bp, Artificial sequence
  SiRNA target sequence
tttagttatttaaataagc

SEQ ID NO: 50740 - DNA, 19 bp, Artificial sequence
  SiRNA target sequence
ttagttatttaaataagcc

SEQ ID NO: 50741 - DNA, 19 bp, Artificial sequence
  SiRNA target sequence
tagttatttaaataagcct

SEQ ID NO: 50742 - DNA, 19 bp, Artificial sequence
  SiRNA target sequence
agttatttaaataagccta

SEQ ID NO: 50743 - DNA, 19 bp, Artificial sequence
  SiRNA target sequence
gttatttaaataagcctat

SEQ ID NO: 50744 - DNA, 19 bp, Artificial sequence
  SiRNA target sequence
ttatttaaataagcctatt

SEQ ID NO: 50745 - DNA, 19 bp, Artificial sequence
  SiRNA target sequence
tatttaaataagcctattt

SEQ ID NO: 50746 - DNA, 19 bp, Artificial sequence
  SiRNA target sequence
atttaaataagcctatttt

SEQ ID NO: 50747 - DNA, 19 bp, Artificial sequence
  SiRNA target sequence
tttaaataagcctatttta

SEQ ID NO: 50748 - DNA, 19 bp, Artificial sequence
  SiRNA target sequence
ttaaataagcctattttag

SEQ ID NO: 50749 - DNA, 19 bp, Artificial sequence
  SiRNA target sequence
taaataagcctattttagt

SEQ ID NO: 50750 - DNA, 19 bp, Artificial sequence
  SiRNA target sequence
aaataagcctattttagtg

SEQ ID NO: 50751 - DNA, 19 bp, Artificial sequence
  SiRNA target sequence
aataagcctattttagtga

SEQ ID NO: 50752 - DNA, 19 bp, Artificial sequence
  SiRNA target sequence
ataagcctattttagtgaa

SEQ ID NO: 50753 - DNA, 19 bp, Artificial sequence
  SiRNA target sequence
taagcctattttagtgaat

SEQ ID NO: 50754 - DNA, 19 bp, Artificial sequence
  SiRNA target sequence
aagcctattttagtgaatg

SEQ ID NO: 50755 - DNA, 19 bp, Artificial sequence
  SiRNA target sequence
agcctattttagtgaatgc

SEQ ID NO: 50756 - DNA, 19 bp, Artificial sequence
  SiRNA target sequence
gcctattttagtgaatgct

SEQ ID NO: 50757 - DNA, 19 bp, Artificial sequence
  SiRNA target sequence
cctattttagtgaatgcta

SEQ ID NO: 50758 - DNA, 19 bp, Artificial sequence
  SiRNA target sequence
ctattttagtgaatgctaa

SEQ ID NO: 50759 - DNA, 19 bp, Artificial sequence
  SiRNA target sequence
tattttagtgaatgctaat

SEQ ID NO: 50760 - DNA, 19 bp, Artificial sequence
  SiRNA target sequence
attttagtgaatgctaatt

SEQ ID NO: 50761 - DNA, 19 bp, Artificial sequence
  SiRNA target sequence
ttttagtgaatgctaattt

SEQ ID NO: 50762 - DNA, 19 bp, Artificial sequence
  SiRNA target sequence
tttagtgaatgctaatttc

SEQ ID NO: 50763 - DNA, 19 bp, Artificial sequence
  SiRNA target sequence
ttagtgaatgctaatttcg

SEQ ID NO: 50764 - DNA, 19 bp, Artificial sequence
  SiRNA target sequence
tagtgaatgctaatttcgt

SEQ ID NO: 50765 - DNA, 19 bp, Artificial sequence
  SiRNA target sequence
agtgaatgctaatttcgtt

SEQ ID NO: 50766 - DNA, 19 bp, Artificial sequence
  SiRNA target sequence
gtgaatgctaatttcgtta

SEQ ID NO: 50767 - DNA, 19 bp, Artificial sequence
  SiRNA target sequence
tgaatgctaatttcgttat

SEQ ID NO: 50768 - DNA, 19 bp, Artificial sequence
  SiRNA target sequence
gaatgctaatttcgttatt

SEQ ID NO: 50769 - DNA, 19 bp, Artificial sequence
  SiRNA target sequence
aatgctaatttcgttatta

SEQ ID NO: 50770 - DNA, 19 bp, Artificial sequence
  SiRNA target sequence
atgctaatttcgttattaa

SEQ ID NO: 50771 - DNA, 19 bp, Artificial sequence
  SiRNA target sequence
tgctaatttcgttattaat

SEQ ID NO: 50772 - DNA, 19 bp, Artificial sequence
  SiRNA target sequence
gctaatttcgttattaata

SEQ ID NO: 50773 - DNA, 19 bp, Artificial sequence
  SiRNA target sequence
ctaatttcgttattaataa

SEQ ID NO: 50774 - DNA, 19 bp, Artificial sequence
  SiRNA target sequence
taatttcgttattaataaa

SEQ ID NO: 50775 - DNA, 19 bp, Artificial sequence
  SiRNA target sequence
aatttcgttattaataaag

SEQ ID NO: 50776 - DNA, 19 bp, Artificial sequence
  SiRNA target sequence
atttcgttattaataaagg

SEQ ID NO: 50777 - DNA, 19 bp, Artificial sequence
  SiRNA target sequence
tttcgttattaataaaggg

SEQ ID NO: 50778 - DNA, 19 bp, Artificial sequence
  SiRNA target sequence
ttcgttattaataaagggg

SEQ ID NO: 50779 - DNA, 19 bp, Artificial sequence
  SiRNA target sequence
tcgttattaataaagggga

SEQ ID NO: 50780 - DNA, 19 bp, Artificial sequence
  SiRNA target sequence
cgttattaataaaggggag

SEQ ID NO: 50781 - DNA, 19 bp, Artificial sequence
  SiRNA target sequence
gttattaataaaggggagc

SEQ ID NO: 50782 - DNA, 19 bp, Artificial sequence
  SiRNA target sequence
ttattaataaaggggagcg

SEQ ID NO: 50783 - DNA, 19 bp, Artificial sequence
  SiRNA target sequence
tattaataaaggggagcgt

SEQ ID NO: 50784 - DNA, 19 bp, Artificial sequence
  SiRNA target sequence
attaataaaggggagcgtg

SEQ ID NO: 50785 - DNA, 19 bp, Artificial sequence
  SiRNA target sequence
ttaataaaggggagcgtgt

SEQ ID NO: 50786 - DNA, 19 bp, Artificial sequence
  SiRNA target sequence
taataaaggggagcgtgtt

SEQ ID NO: 50787 - DNA, 19 bp, Artificial sequence
  SiRNA target sequence
aataaaggggagcgtgttg

SEQ ID NO: 50788 - DNA, 19 bp, Artificial sequence
  SiRNA target sequence
ataaaggggagcgtgttgc

SEQ ID NO: 50789 - DNA, 19 bp, Artificial sequence
  SiRNA target sequence
taaaggggagcgtgttgct

SEQ ID NO: 50790 - DNA, 19 bp, Artificial sequence
  SiRNA target sequence
aaaggggagcgtgttgcta

SEQ ID NO: 50791 - DNA, 19 bp, Artificial sequence
  SiRNA target sequence
aaggggagcgtgttgctat

SEQ ID NO: 50792 - DNA, 19 bp, Artificial sequence
  SiRNA target sequence
aggggagcgtgttgctatt

SEQ ID NO: 50793 - DNA, 19 bp, Artificial sequence
  SiRNA target sequence
ggggagcgtgttgctatta

SEQ ID NO: 50794 - DNA, 19 bp, Artificial sequence
  SiRNA target sequence
gggagcgtgttgctattat

SEQ ID NO: 50795 - DNA, 19 bp, Artificial sequence
  SiRNA target sequence
ggagcgtgttgctattata

SEQ ID NO: 50796 - DNA, 19 bp, Artificial sequence
  SiRNA target sequence
gagcgtgttgctattatag

SEQ ID NO: 50797 - DNA, 19 bp, Artificial sequence
  SiRNA target sequence
agcgtgttgctattatagg

SEQ ID NO: 50798 - DNA, 19 bp, Artificial sequence
  SiRNA target sequence
gcgtgttgctattatagga

SEQ ID NO: 50799 - DNA, 19 bp, Artificial sequence
  SiRNA target sequence
cgtgttgctattataggaa

SEQ ID NO: 50800 - DNA, 19 bp, Artificial sequence
  SiRNA target sequence
gtgttgctattataggaaa

SEQ ID NO: 50801 - DNA, 19 bp, Artificial sequence
  SiRNA target sequence
tgttgctattataggaaaa

SEQ ID NO: 50802 - DNA, 19 bp, Artificial sequence
  SiRNA target sequence
gttgctattataggaaaaa

SEQ ID NO: 50803 - DNA, 19 bp, Artificial sequence
  SiRNA target sequence
ttgctattataggaaaaaa

SEQ ID NO: 50804 - DNA, 19 bp, Artificial sequence
  SiRNA target sequence
tgctattataggaaaaaat

SEQ ID NO: 50805 - DNA, 19 bp, Artificial sequence
  SiRNA target sequence
gctattataggaaaaaatg

SEQ ID NO: 50806 - DNA, 19 bp, Artificial sequence
  SiRNA target sequence
ctattataggaaaaaatgg

SEQ ID NO: 50807 - DNA, 19 bp, Artificial sequence
  SiRNA target sequence
tattataggaaaaaatgga

SEQ ID NO: 50808 - DNA, 19 bp, Artificial sequence
  SiRNA target sequence
attataggaaaaaatggaa

SEQ ID NO: 50809 - DNA, 19 bp, Artificial sequence
  SiRNA target sequence
ttataggaaaaaatggaac

SEQ ID NO: 50810 - DNA, 19 bp, Artificial sequence
  SiRNA target sequence
tataggaaaaaatggaaca

SEQ ID NO: 50811 - DNA, 19 bp, Artificial sequence
  SiRNA target sequence
ataggaaaaaatggaacag

SEQ ID NO: 50812 - DNA, 19 bp, Artificial sequence
  SiRNA target sequence
taggaaaaaatggaacagg

SEQ ID NO: 50813 - DNA, 19 bp, Artificial sequence
  SiRNA target sequence
aggaaaaaatggaacaggt

SEQ ID NO: 50814 - DNA, 19 bp, Artificial sequence
  SiRNA target sequence
ggaaaaaatggaacaggta

SEQ ID NO: 50815 - DNA, 19 bp, Artificial sequence
  SiRNA target sequence
gaaaaaatggaacaggtaa

SEQ ID NO: 50816 - DNA, 19 bp, Artificial sequence
  SiRNA target sequence
aaaaaatggaacaggtaaa

SEQ ID NO: 50817 - DNA, 19 bp, Artificial sequence
  SiRNA target sequence
aaaaatggaacaggtaaaa

SEQ ID NO: 50818 - DNA, 19 bp, Artificial sequence
  SiRNA target sequence
aaaatggaacaggtaaaag

SEQ ID NO: 50819 - DNA, 19 bp, Artificial sequence
  SiRNA target sequence
aaatggaacaggtaaaagt

SEQ ID NO: 50820 - DNA, 19 bp, Artificial sequence
  SiRNA target sequence
aatggaacaggtaaaagta

SEQ ID NO: 50821 - DNA, 19 bp, Artificial sequence
  SiRNA target sequence
atggaacaggtaaaagtac

SEQ ID NO: 50822 - DNA, 19 bp, Artificial sequence
  SiRNA target sequence
tggaacaggtaaaagtaca

SEQ ID NO: 50823 - DNA, 19 bp, Artificial sequence
  SiRNA target sequence
ggaacaggtaaaagtacaa

SEQ ID NO: 50824 - DNA, 19 bp, Artificial sequence
  SiRNA target sequence
gaacaggtaaaagtacaat

SEQ ID NO: 50825 - DNA, 19 bp, Artificial sequence
  SiRNA target sequence
aacaggtaaaagtacaata

SEQ ID NO: 50826 - DNA, 19 bp, Artificial sequence
  SiRNA target sequence
acaggtaaaagtacaataa

SEQ ID NO: 50827 - DNA, 19 bp, Artificial sequence
  SiRNA target sequence
caggtaaaagtacaataat

SEQ ID NO: 50828 - DNA, 19 bp, Artificial sequence
  SiRNA target sequence
aggtaaaagtacaataata

SEQ ID NO: 50829 - DNA, 19 bp, Artificial sequence
  SiRNA target sequence
ggtaaaagtacaataataa

SEQ ID NO: 50830 - DNA, 19 bp, Artificial sequence
  SiRNA target sequence
gtaaaagtacaataataaa

SEQ ID NO: 50831 - DNA, 19 bp, Artificial sequence
  SiRNA target sequence
taaaagtacaataataaaa

SEQ ID NO: 50832 - DNA, 19 bp, Artificial sequence
  SiRNA target sequence
aaaagtacaataataaaat

SEQ ID NO: 50833 - DNA, 19 bp, Artificial sequence
  SiRNA target sequence
aaagtacaataataaaatt

SEQ ID NO: 50834 - DNA, 19 bp, Artificial sequence
  SiRNA target sequence
aagtacaataataaaattg

SEQ ID NO: 50835 - DNA, 19 bp, Artificial sequence
  SiRNA target sequence
agtacaataataaaattgt

SEQ ID NO: 50836 - DNA, 19 bp, Artificial sequence
  SiRNA target sequence
gtacaataataaaattgtt

SEQ ID NO: 50837 - DNA, 19 bp, Artificial sequence
  SiRNA target sequence
tacaataataaaattgtta

SEQ ID NO: 50838 - DNA, 19 bp, Artificial sequence
  SiRNA target sequence
acaataataaaattgttaa

SEQ ID NO: 50839 - DNA, 19 bp, Artificial sequence
  SiRNA target sequence
caataataaaattgttaat

SEQ ID NO: 50840 - DNA, 19 bp, Artificial sequence
  SiRNA target sequence
aataataaaattgttaatg

SEQ ID NO: 50841 - DNA, 19 bp, Artificial sequence
  SiRNA target sequence
ataataaaattgttaatga

SEQ ID NO: 50842 - DNA, 19 bp, Artificial sequence
  SiRNA target sequence
taataaaattgttaatgaa

SEQ ID NO: 50843 - DNA, 19 bp, Artificial sequence
  SiRNA target sequence
aataaaattgttaatgaaa

SEQ ID NO: 50844 - DNA, 19 bp, Artificial sequence
  SiRNA target sequence
ataaaattgttaatgaaat

SEQ ID NO: 50845 - DNA, 19 bp, Artificial sequence
  SiRNA target sequence
taaaattgttaatgaaatt

SEQ ID NO: 50846 - DNA, 19 bp, Artificial sequence
  SiRNA target sequence
aaaattgttaatgaaattt

SEQ ID NO: 50847 - DNA, 19 bp, Artificial sequence
  SiRNA target sequence
aaattgttaatgaaatttt

SEQ ID NO: 50848 - DNA, 19 bp, Artificial sequence
  SiRNA target sequence
aattgttaatgaaatttta

SEQ ID NO: 50849 - DNA, 19 bp, Artificial sequence
  SiRNA target sequence
attgttaatgaaattttat

SEQ ID NO: 50850 - DNA, 19 bp, Artificial sequence
  SiRNA target sequence
ttgttaatgaaattttata

SEQ ID NO: 50851 - DNA, 19 bp, Artificial sequence
  SiRNA target sequence
tgttaatgaaattttataa

SEQ ID NO: 50852 - DNA, 19 bp, Artificial sequence
  SiRNA target sequence
gttaatgaaattttataaa

SEQ ID NO: 50853 - DNA, 19 bp, Artificial sequence
  SiRNA target sequence
ttaatgaaattttataaat

SEQ ID NO: 50854 - DNA, 19 bp, Artificial sequence
  SiRNA target sequence
taatgaaattttataaata

SEQ ID NO: 50855 - DNA, 19 bp, Artificial sequence
  SiRNA target sequence
aatgaaattttataaatat

SEQ ID NO: 50856 - DNA, 19 bp, Artificial sequence
  SiRNA target sequence
atgaaattttataaatatg

SEQ ID NO: 50857 - DNA, 19 bp, Artificial sequence
  SiRNA target sequence
tgaaattttataaatatga

SEQ ID NO: 50858 - DNA, 19 bp, Artificial sequence
  SiRNA target sequence
gaaattttataaatatgat

SEQ ID NO: 50859 - DNA, 19 bp, Artificial sequence
  SiRNA target sequence
aaattttataaatatgatg

SEQ ID NO: 50860 - DNA, 19 bp, Artificial sequence
  SiRNA target sequence
aattttataaatatgatgg

SEQ ID NO: 50861 - DNA, 19 bp, Artificial sequence
  SiRNA target sequence
attttataaatatgatgga

SEQ ID NO: 50862 - DNA, 19 bp, Artificial sequence
  SiRNA target sequence
ttttataaatatgatggag

SEQ ID NO: 50863 - DNA, 19 bp, Artificial sequence
  SiRNA target sequence
tttataaatatgatggaga

SEQ ID NO: 50864 - DNA, 19 bp, Artificial sequence
  SiRNA target sequence
ttataaatatgatggagat

SEQ ID NO: 50865 - DNA, 19 bp, Artificial sequence
  SiRNA target sequence
tataaatatgatggagata

SEQ ID NO: 50866 - DNA, 19 bp, Artificial sequence
  SiRNA target sequence
ataaatatgatggagatat

SEQ ID NO: 50867 - DNA, 19 bp, Artificial sequence
  SiRNA target sequence
taaatatgatggagatata

SEQ ID NO: 50868 - DNA, 19 bp, Artificial sequence
  SiRNA target sequence
aaatatgatggagatatat

SEQ ID NO: 50869 - DNA, 19 bp, Artificial sequence
  SiRNA target sequence
aatatgatggagatatatt

SEQ ID NO: 50870 - DNA, 19 bp, Artificial sequence
  SiRNA target sequence
atatgatggagatatatta

SEQ ID NO: 50871 - DNA, 19 bp, Artificial sequence
  SiRNA target sequence
tatgatggagatatattaa

SEQ ID NO: 50872 - DNA, 19 bp, Artificial sequence
  SiRNA target sequence
atgatggagatatattaat

SEQ ID NO: 50873 - DNA, 19 bp, Artificial sequence
  SiRNA target sequence
tgatggagatatattaatt

SEQ ID NO: 50874 - DNA, 19 bp, Artificial sequence
  SiRNA target sequence
gatggagatatattaattg

SEQ ID NO: 50875 - DNA, 19 bp, Artificial sequence
  SiRNA target sequence
atggagatatattaattga

SEQ ID NO: 50876 - DNA, 19 bp, Artificial sequence
  SiRNA target sequence
tggagatatattaattgat

SEQ ID NO: 50877 - DNA, 19 bp, Artificial sequence
  SiRNA target sequence
ggagatatattaattgatg

SEQ ID NO: 50878 - DNA, 19 bp, Artificial sequence
  SiRNA target sequence
gagatatattaattgatga

SEQ ID NO: 50879 - DNA, 19 bp, Artificial sequence
  SiRNA target sequence
agatatattaattgatgat

SEQ ID NO: 50880 - DNA, 19 bp, Artificial sequence
  SiRNA target sequence
gatatattaattgatgata

SEQ ID NO: 50881 - DNA, 19 bp, Artificial sequence
  SiRNA target sequence
atatattaattgatgatac

SEQ ID NO: 50882 - DNA, 19 bp, Artificial sequence
  SiRNA target sequence
tatattaattgatgataca

SEQ ID NO: 50883 - DNA, 19 bp, Artificial sequence
  SiRNA target sequence
atattaattgatgatacag

SEQ ID NO: 50884 - DNA, 19 bp, Artificial sequence
  SiRNA target sequence
tattaattgatgatacaga

SEQ ID NO: 50885 - DNA, 19 bp, Artificial sequence
  SiRNA target sequence
attaattgatgatacagaa

SEQ ID NO: 50886 - DNA, 19 bp, Artificial sequence
  SiRNA target sequence
ttaattgatgatacagaaa

SEQ ID NO: 50887 - DNA, 19 bp, Artificial sequence
  SiRNA target sequence
taattgatgatacagaaat

SEQ ID NO: 50888 - DNA, 19 bp, Artificial sequence
  SiRNA target sequence
aattgatgatacagaaata

SEQ ID NO: 50889 - DNA, 19 bp, Artificial sequence
  SiRNA target sequence
attgatgatacagaaatag

SEQ ID NO: 50890 - DNA, 19 bp, Artificial sequence
  SiRNA target sequence
ttgatgatacagaaataga

SEQ ID NO: 50891 - DNA, 19 bp, Artificial sequence
  SiRNA target sequence
tgatgatacagaaatagat

SEQ ID NO: 50892 - DNA, 19 bp, Artificial sequence
  SiRNA target sequence
gatgatacagaaatagata

SEQ ID NO: 50893 - DNA, 19 bp, Artificial sequence
  SiRNA target sequence
atgatacagaaatagataa

SEQ ID NO: 50894 - DNA, 19 bp, Artificial sequence
  SiRNA target sequence
tgatacagaaatagataat

SEQ ID NO: 50895 - DNA, 19 bp, Artificial sequence
  SiRNA target sequence
gatacagaaatagataata

SEQ ID NO: 50896 - DNA, 19 bp, Artificial sequence
  SiRNA target sequence
atacagaaatagataatat

SEQ ID NO: 50897 - DNA, 19 bp, Artificial sequence
  SiRNA target sequence
tacagaaatagataatatt

SEQ ID NO: 50898 - DNA, 19 bp, Artificial sequence
  SiRNA target sequence
acagaaatagataatattt

SEQ ID NO: 50899 - DNA, 19 bp, Artificial sequence
  SiRNA target sequence
cagaaatagataatatttc

SEQ ID NO: 50900 - DNA, 19 bp, Artificial sequence
  SiRNA target sequence
agaaatagataatatttcg

SEQ ID NO: 50901 - DNA, 19 bp, Artificial sequence
  SiRNA target sequence
gaaatagataatatttcgg

SEQ ID NO: 50902 - DNA, 19 bp, Artificial sequence
  SiRNA target sequence
aaatagataatatttcgga

SEQ ID NO: 50903 - DNA, 19 bp, Artificial sequence
  SiRNA target sequence
aatagataatatttcggat

SEQ ID NO: 50904 - DNA, 19 bp, Artificial sequence
  SiRNA target sequence
atagataatatttcggata

SEQ ID NO: 50905 - DNA, 19 bp, Artificial sequence
  SiRNA target sequence
tagataatatttcggatag

SEQ ID NO: 50906 - DNA, 19 bp, Artificial sequence
  SiRNA target sequence
agataatatttcggataga

SEQ ID NO: 50907 - DNA, 19 bp, Artificial sequence
  SiRNA target sequence
gataatatttcggatagaa

SEQ ID NO: 50908 - DNA, 19 bp, Artificial sequence
  SiRNA target sequence
ataatatttcggatagaag

SEQ ID NO: 50909 - DNA, 19 bp, Artificial sequence
  SiRNA target sequence
taatatttcggatagaagt

SEQ ID NO: 50910 - DNA, 19 bp, Artificial sequence
  SiRNA target sequence
aatatttcggatagaagtt

SEQ ID NO: 50911 - DNA, 19 bp, Artificial sequence
  SiRNA target sequence
atatttcggatagaagtta

SEQ ID NO: 50912 - DNA, 19 bp, Artificial sequence
  SiRNA target sequence
tatttcggatagaagttac

SEQ ID NO: 50913 - DNA, 19 bp, Artificial sequence
  SiRNA target sequence
atttcggatagaagttaca

SEQ ID NO: 50914 - DNA, 19 bp, Artificial sequence
  SiRNA target sequence
tttcggatagaagttacag

SEQ ID NO: 50915 - DNA, 19 bp, Artificial sequence
  SiRNA target sequence
ttcggatagaagttacaga

SEQ ID NO: 50916 - DNA, 19 bp, Artificial sequence
  SiRNA target sequence
tcggatagaagttacagaa

SEQ ID NO: 50917 - DNA, 19 bp, Artificial sequence
  SiRNA target sequence
cggatagaagttacagaag

SEQ ID NO: 50918 - DNA, 19 bp, Artificial sequence
  SiRNA target sequence
ggatagaagttacagaagt

SEQ ID NO: 50919 - DNA, 19 bp, Artificial sequence
  SiRNA target sequence
gatagaagttacagaagtt

SEQ ID NO: 50920 - DNA, 19 bp, Artificial sequence
  SiRNA target sequence
atagaagttacagaagttt

SEQ ID NO: 50921 - DNA, 19 bp, Artificial sequence
  SiRNA target sequence
tagaagttacagaagttta

SEQ ID NO: 50922 - DNA, 19 bp, Artificial sequence
  SiRNA target sequence
agaagttacagaagtttaa

SEQ ID NO: 50923 - DNA, 19 bp, Artificial sequence
  SiRNA target sequence
gaagttacagaagtttaat

SEQ ID NO: 50924 - DNA, 19 bp, Artificial sequence
  SiRNA target sequence
aagttacagaagtttaata

SEQ ID NO: 50925 - DNA, 19 bp, Artificial sequence
  SiRNA target sequence
agttacagaagtttaatat

SEQ ID NO: 50926 - DNA, 19 bp, Artificial sequence
  SiRNA target sequence
gttacagaagtttaatatc

SEQ ID NO: 50927 - DNA, 19 bp, Artificial sequence
  SiRNA target sequence
ttacagaagtttaatatca

SEQ ID NO: 50928 - DNA, 19 bp, Artificial sequence
  SiRNA target sequence
tacagaagtttaatatcat

SEQ ID NO: 50929 - DNA, 19 bp, Artificial sequence
  SiRNA target sequence
acagaagtttaatatcata

SEQ ID NO: 50930 - DNA, 19 bp, Artificial sequence
  SiRNA target sequence
cagaagtttaatatcatat

SEQ ID NO: 50931 - DNA, 19 bp, Artificial sequence
  SiRNA target sequence
agaagtttaatatcatatg

SEQ ID NO: 50932 - DNA, 19 bp, Artificial sequence
  SiRNA target sequence
gaagtttaatatcatatgc

SEQ ID NO: 50933 - DNA, 19 bp, Artificial sequence
  SiRNA target sequence
aagtttaatatcatatgca

SEQ ID NO: 50934 - DNA, 19 bp, Artificial sequence
  SiRNA target sequence
agtttaatatcatatgcaa

SEQ ID NO: 50935 - DNA, 19 bp, Artificial sequence
  SiRNA target sequence
gtttaatatcatatgcaac

SEQ ID NO: 50936 - DNA, 19 bp, Artificial sequence
  SiRNA target sequence
tttaatatcatatgcaaca

SEQ ID NO: 50937 - DNA, 19 bp, Artificial sequence
  SiRNA target sequence
ttaatatcatatgcaacac

SEQ ID NO: 50938 - DNA, 19 bp, Artificial sequence
  SiRNA target sequence
taatatcatatgcaacaca

SEQ ID NO: 50939 - DNA, 19 bp, Artificial sequence
  SiRNA target sequence
aatatcatatgcaacacaa

SEQ ID NO: 50940 - DNA, 19 bp, Artificial sequence
  SiRNA target sequence
atatcatatgcaacacaaa

SEQ ID NO: 50941 - DNA, 19 bp, Artificial sequence
  SiRNA target sequence
tatcatatgcaacacaaaa

SEQ ID NO: 50942 - DNA, 19 bp, Artificial sequence
  SiRNA target sequence
atcatatgcaacacaaaac

SEQ ID NO: 50943 - DNA, 19 bp, Artificial sequence
  SiRNA target sequence
tcatatgcaacacaaaaca

SEQ ID NO: 50944 - DNA, 19 bp, Artificial sequence
  SiRNA target sequence
catatgcaacacaaaacac

SEQ ID NO: 50945 - DNA, 19 bp, Artificial sequence
  SiRNA target sequence
atatgcaacacaaaacacg

SEQ ID NO: 50946 - DNA, 19 bp, Artificial sequence
  SiRNA target sequence
tatgcaacacaaaacacgt

SEQ ID NO: 50947 - DNA, 19 bp, Artificial sequence
  SiRNA target sequence
atgcaacacaaaacacgtt

SEQ ID NO: 50948 - DNA, 19 bp, Artificial sequence
  SiRNA target sequence
tgcaacacaaaacacgttc

SEQ ID NO: 50949 - DNA, 19 bp, Artificial sequence
  SiRNA target sequence
gcaacacaaaacacgttct

SEQ ID NO: 50950 - DNA, 19 bp, Artificial sequence
  SiRNA target sequence
caacacaaaacacgttctt

SEQ ID NO: 50951 - DNA, 19 bp, Artificial sequence
  SiRNA target sequence
aacacaaaacacgttctta

SEQ ID NO: 50952 - DNA, 19 bp, Artificial sequence
  SiRNA target sequence
acacaaaacacgttcttat

SEQ ID NO: 50953 - DNA, 19 bp, Artificial sequence
  SiRNA target sequence
cacaaaacacgttcttatt

SEQ ID NO: 50954 - DNA, 19 bp, Artificial sequence
  SiRNA target sequence
acaaaacacgttcttattc

SEQ ID NO: 50955 - DNA, 19 bp, Artificial sequence
  SiRNA target sequence
caaaacacgttcttattcg

SEQ ID NO: 50956 - DNA, 19 bp, Artificial sequence
  SiRNA target sequence
aaaacacgttcttattcga

SEQ ID NO: 50957 - DNA, 19 bp, Artificial sequence
  SiRNA target sequence
aaacacgttcttattcgat

SEQ ID NO: 50958 - DNA, 19 bp, Artificial sequence
  SiRNA target sequence
aacacgttcttattcgata

SEQ ID NO: 50959 - DNA, 19 bp, Artificial sequence
  SiRNA target sequence
acacgttcttattcgataa

SEQ ID NO: 50960 - DNA, 19 bp, Artificial sequence
  SiRNA target sequence
cacgttcttattcgataat

SEQ ID NO: 50961 - DNA, 19 bp, Artificial sequence
  SiRNA target sequence
acgttcttattcgataata

SEQ ID NO: 50962 - DNA, 19 bp, Artificial sequence
  SiRNA target sequence
cgttcttattcgataatac

SEQ ID NO: 50963 - DNA, 19 bp, Artificial sequence
  SiRNA target sequence
gttcttattcgataatact

SEQ ID NO: 50964 - DNA, 19 bp, Artificial sequence
  SiRNA target sequence
ttcttattcgataatactg

SEQ ID NO: 50965 - DNA, 19 bp, Artificial sequence
  SiRNA target sequence
tcttattcgataatactgt

SEQ ID NO: 50966 - DNA, 19 bp, Artificial sequence
  SiRNA target sequence
cttattcgataatactgtg

SEQ ID NO: 50967 - DNA, 19 bp, Artificial sequence
  SiRNA target sequence
ttattcgataatactgtga

SEQ ID NO: 50968 - DNA, 19 bp, Artificial sequence
  SiRNA target sequence
tattcgataatactgtgac

SEQ ID NO: 50969 - DNA, 19 bp, Artificial sequence
  SiRNA target sequence
attcgataatactgtgaca

SEQ ID NO: 50970 - DNA, 19 bp, Artificial sequence
  SiRNA target sequence
ttcgataatactgtgacat

SEQ ID NO: 50971 - DNA, 19 bp, Artificial sequence
  SiRNA target sequence
tcgataatactgtgacata

SEQ ID NO: 50972 - DNA, 19 bp, Artificial sequence
  SiRNA target sequence
cgataatactgtgacatac

SEQ ID NO: 50973 - DNA, 19 bp, Artificial sequence
  SiRNA target sequence
gataatactgtgacataca

SEQ ID NO: 50974 - DNA, 19 bp, Artificial sequence
  SiRNA target sequence
ataatactgtgacatacaa

SEQ ID NO: 50975 - DNA, 19 bp, Artificial sequence
  SiRNA target sequence
taatactgtgacatacaat

SEQ ID NO: 50976 - DNA, 19 bp, Artificial sequence
  SiRNA target sequence
aatactgtgacatacaata

SEQ ID NO: 50977 - DNA, 19 bp, Artificial sequence
  SiRNA target sequence
atactgtgacatacaatat

SEQ ID NO: 50978 - DNA, 19 bp, Artificial sequence
  SiRNA target sequence
tactgtgacatacaatata

SEQ ID NO: 50979 - DNA, 19 bp, Artificial sequence
  SiRNA target sequence
actgtgacatacaatatat

SEQ ID NO: 50980 - DNA, 19 bp, Artificial sequence
  SiRNA target sequence
ctgtgacatacaatatatt

SEQ ID NO: 50981 - DNA, 19 bp, Artificial sequence
  SiRNA target sequence
tgtgacatacaatatattt

SEQ ID NO: 50982 - DNA, 19 bp, Artificial sequence
  SiRNA target sequence
gtgacatacaatatatttt

SEQ ID NO: 50983 - DNA, 19 bp, Artificial sequence
  SiRNA target sequence
tgacatacaatatatttta

SEQ ID NO: 50984 - DNA, 19 bp, Artificial sequence
  SiRNA target sequence
gacatacaatatattttac

SEQ ID NO: 50985 - DNA, 19 bp, Artificial sequence
  SiRNA target sequence
acatacaatatattttacg

SEQ ID NO: 50986 - DNA, 19 bp, Artificial sequence
  SiRNA target sequence
catacaatatattttacgg

SEQ ID NO: 50987 - DNA, 19 bp, Artificial sequence
  SiRNA target sequence
atacaatatattttacggg

SEQ ID NO: 50988 - DNA, 19 bp, Artificial sequence
  SiRNA target sequence
tacaatatattttacggga

SEQ ID NO: 50989 - DNA, 19 bp, Artificial sequence
  SiRNA target sequence
acaatatattttacgggac

SEQ ID NO: 50990 - DNA, 19 bp, Artificial sequence
  SiRNA target sequence
caatatattttacgggact

SEQ ID NO: 50991 - DNA, 19 bp, Artificial sequence
  SiRNA target sequence
aatatattttacgggacta

SEQ ID NO: 50992 - DNA, 19 bp, Artificial sequence
  SiRNA target sequence
atatattttacgggactaa

SEQ ID NO: 50993 - DNA, 19 bp, Artificial sequence
  SiRNA target sequence
tatattttacgggactaaa

SEQ ID NO: 50994 - DNA, 19 bp, Artificial sequence
  SiRNA target sequence
atattttacgggactaaaa

SEQ ID NO: 50995 - DNA, 19 bp, Artificial sequence
  SiRNA target sequence
tattttacgggactaaaaa

SEQ ID NO: 50996 - DNA, 19 bp, Artificial sequence
  SiRNA target sequence
attttacgggactaaaaac

SEQ ID NO: 50997 - DNA, 19 bp, Artificial sequence
  SiRNA target sequence
ttttacgggactaaaaacg

SEQ ID NO: 50998 - DNA, 19 bp, Artificial sequence
  SiRNA target sequence
tttacgggactaaaaacgt

SEQ ID NO: 50999 - DNA, 19 bp, Artificial sequence
  SiRNA target sequence
ttacgggactaaaaacgta

SEQ ID NO: 51000 - DNA, 19 bp, Artificial sequence
  SiRNA target sequence
tacgggactaaaaacgtaa

SEQ ID NO: 51001 - DNA, 19 bp, Artificial sequence
  SiRNA target sequence
acgggactaaaaacgtaac

SEQ ID NO: 51002 - DNA, 19 bp, Artificial sequence
  SiRNA target sequence
cgggactaaaaacgtaaca

SEQ ID NO: 51003 - DNA, 19 bp, Artificial sequence
  SiRNA target sequence
gggactaaaaacgtaacag

SEQ ID NO: 51004 - DNA, 19 bp, Artificial sequence
  SiRNA target sequence
ggactaaaaacgtaacaga

SEQ ID NO: 51005 - DNA, 19 bp, Artificial sequence
  SiRNA target sequence
gactaaaaacgtaacagaa

SEQ ID NO: 51006 - DNA, 19 bp, Artificial sequence
  SiRNA target sequence
actaaaaacgtaacagaaa

SEQ ID NO: 51007 - DNA, 19 bp, Artificial sequence
  SiRNA target sequence
ctaaaaacgtaacagaaaa

SEQ ID NO: 51008 - DNA, 19 bp, Artificial sequence
  SiRNA target sequence
taaaaacgtaacagaaaaa

SEQ ID NO: 51009 - DNA, 19 bp, Artificial sequence
  SiRNA target sequence
aaaaacgtaacagaaaaag

SEQ ID NO: 51010 - DNA, 19 bp, Artificial sequence
  SiRNA target sequence
aaaacgtaacagaaaaaga

SEQ ID NO: 51011 - DNA, 19 bp, Artificial sequence
  SiRNA target sequence
aaacgtaacagaaaaagaa

SEQ ID NO: 51012 - DNA, 19 bp, Artificial sequence
  SiRNA target sequence
aacgtaacagaaaaagaag

SEQ ID NO: 51013 - DNA, 19 bp, Artificial sequence
  SiRNA target sequence
acgtaacagaaaaagaagt

SEQ ID NO: 51014 - DNA, 19 bp, Artificial sequence
  SiRNA target sequence
cgtaacagaaaaagaagtt

SEQ ID NO: 51015 - DNA, 19 bp, Artificial sequence
  SiRNA target sequence
gtaacagaaaaagaagttt

SEQ ID NO: 51016 - DNA, 19 bp, Artificial sequence
  SiRNA target sequence
taacagaaaaagaagtttt

SEQ ID NO: 51017 - DNA, 19 bp, Artificial sequence
  SiRNA target sequence
aacagaaaaagaagtttta

SEQ ID NO: 51018 - DNA, 19 bp, Artificial sequence
  SiRNA target sequence
acagaaaaagaagttttag

SEQ ID NO: 51019 - DNA, 19 bp, Artificial sequence
  SiRNA target sequence
cagaaaaagaagttttaga

SEQ ID NO: 51020 - DNA, 19 bp, Artificial sequence
  SiRNA target sequence
agaaaaagaagttttagaa

SEQ ID NO: 51021 - DNA, 19 bp, Artificial sequence
  SiRNA target sequence
gaaaaagaagttttagaat

SEQ ID NO: 51022 - DNA, 19 bp, Artificial sequence
  SiRNA target sequence
aaaaagaagttttagaatt

SEQ ID NO: 51023 - DNA, 19 bp, Artificial sequence
  SiRNA target sequence
aaaagaagttttagaatta

SEQ ID NO: 51024 - DNA, 19 bp, Artificial sequence
  SiRNA target sequence
aaagaagttttagaattag

SEQ ID NO: 51025 - DNA, 19 bp, Artificial sequence
  SiRNA target sequence
aagaagttttagaattagc

SEQ ID NO: 51026 - DNA, 19 bp, Artificial sequence
  SiRNA target sequence
agaagttttagaattagcc

SEQ ID NO: 51027 - DNA, 19 bp, Artificial sequence
  SiRNA target sequence
gaagttttagaattagcca

SEQ ID NO: 51028 - DNA, 19 bp, Artificial sequence
  SiRNA target sequence
aagttttagaattagccaa

SEQ ID NO: 51029 - DNA, 19 bp, Artificial sequence
  SiRNA target sequence
agttttagaattagccaaa

SEQ ID NO: 51030 - DNA, 19 bp, Artificial sequence
  SiRNA target sequence
gttttagaattagccaaaa

SEQ ID NO: 51031 - DNA, 19 bp, Artificial sequence
  SiRNA target sequence
ttttagaattagccaaaaa

SEQ ID NO: 51032 - DNA, 19 bp, Artificial sequence
  SiRNA target sequence
tttagaattagccaaaaaa

SEQ ID NO: 51033 - DNA, 19 bp, Artificial sequence
  SiRNA target sequence
ttagaattagccaaaaaaa

SEQ ID NO: 51034 - DNA, 19 bp, Artificial sequence
  SiRNA target sequence
tagaattagccaaaaaaat

SEQ ID NO: 51035 - DNA, 19 bp, Artificial sequence
  SiRNA target sequence
agaattagccaaaaaaata

SEQ ID NO: 51036 - DNA, 19 bp, Artificial sequence
  SiRNA target sequence
gaattagccaaaaaaatag

SEQ ID NO: 51037 - DNA, 19 bp, Artificial sequence
  SiRNA target sequence
aattagccaaaaaaatagg

SEQ ID NO: 51038 - DNA, 19 bp, Artificial sequence
  SiRNA target sequence
attagccaaaaaaataggt

SEQ ID NO: 51039 - DNA, 19 bp, Artificial sequence
  SiRNA target sequence
ttagccaaaaaaataggtg

SEQ ID NO: 51040 - DNA, 19 bp, Artificial sequence
  SiRNA target sequence
tagccaaaaaaataggtgt

SEQ ID NO: 51041 - DNA, 19 bp, Artificial sequence
  SiRNA target sequence
agccaaaaaaataggtgta

SEQ ID NO: 51042 - DNA, 19 bp, Artificial sequence
  SiRNA target sequence
gccaaaaaaataggtgtat

SEQ ID NO: 51043 - DNA, 19 bp, Artificial sequence
  SiRNA target sequence
ccaaaaaaataggtgtatt

SEQ ID NO: 51044 - DNA, 19 bp, Artificial sequence
  SiRNA target sequence
caaaaaaataggtgtatta

SEQ ID NO: 51045 - DNA, 19 bp, Artificial sequence
  SiRNA target sequence
aaaaaaataggtgtattag

SEQ ID NO: 51046 - DNA, 19 bp, Artificial sequence
  SiRNA target sequence
aaaaaataggtgtattaga

SEQ ID NO: 51047 - DNA, 19 bp, Artificial sequence
  SiRNA target sequence
aaaaataggtgtattagag

SEQ ID NO: 51048 - DNA, 19 bp, Artificial sequence
  SiRNA target sequence
aaaataggtgtattagagt

SEQ ID NO: 51049 - DNA, 19 bp, Artificial sequence
  SiRNA target sequence
aaataggtgtattagagtc

SEQ ID NO: 51050 - DNA, 19 bp, Artificial sequence
  SiRNA target sequence
aataggtgtattagagtct

SEQ ID NO: 51051 - DNA, 19 bp, Artificial sequence
  SiRNA target sequence
ataggtgtattagagtcta

SEQ ID NO: 51052 - DNA, 19 bp, Artificial sequence
  SiRNA target sequence
taggtgtattagagtctat

SEQ ID NO: 51053 - DNA, 19 bp, Artificial sequence
  SiRNA target sequence
aggtgtattagagtctata

SEQ ID NO: 51054 - DNA, 19 bp, Artificial sequence
  SiRNA target sequence
ggtgtattagagtctatac

SEQ ID NO: 51055 - DNA, 19 bp, Artificial sequence
  SiRNA target sequence
gtgtattagagtctataca

SEQ ID NO: 51056 - DNA, 19 bp, Artificial sequence
  SiRNA target sequence
tgtattagagtctatacag

SEQ ID NO: 51057 - DNA, 19 bp, Artificial sequence
  SiRNA target sequence
gtattagagtctatacagg

SEQ ID NO: 51058 - DNA, 19 bp, Artificial sequence
  SiRNA target sequence
tattagagtctatacagga

SEQ ID NO: 51059 - DNA, 19 bp, Artificial sequence
  SiRNA target sequence
attagagtctatacaggaa

SEQ ID NO: 51060 - DNA, 19 bp, Artificial sequence
  SiRNA target sequence
ttagagtctatacaggaat

SEQ ID NO: 51061 - DNA, 19 bp, Artificial sequence
  SiRNA target sequence
tagagtctatacaggaatt

SEQ ID NO: 51062 - DNA, 19 bp, Artificial sequence
  SiRNA target sequence
agagtctatacaggaattt

SEQ ID NO: 51063 - DNA, 19 bp, Artificial sequence
  SiRNA target sequence
gagtctatacaggaattta

SEQ ID NO: 51064 - DNA, 19 bp, Artificial sequence
  SiRNA target sequence
agtctatacaggaatttaa

SEQ ID NO: 51065 - DNA, 19 bp, Artificial sequence
  SiRNA target sequence
gtctatacaggaatttaaa

SEQ ID NO: 51066 - DNA, 19 bp, Artificial sequence
  SiRNA target sequence
tctatacaggaatttaaag

SEQ ID NO: 51067 - DNA, 19 bp, Artificial sequence
  SiRNA target sequence
ctatacaggaatttaaaga

SEQ ID NO: 51068 - DNA, 19 bp, Artificial sequence
  SiRNA target sequence
tatacaggaatttaaagat

SEQ ID NO: 51069 - DNA, 19 bp, Artificial sequence
  SiRNA target sequence
atacaggaatttaaagatg

SEQ ID NO: 51070 - DNA, 19 bp, Artificial sequence
  SiRNA target sequence
tacaggaatttaaagatgg

SEQ ID NO: 51071 - DNA, 19 bp, Artificial sequence
  SiRNA target sequence
acaggaatttaaagatggg

SEQ ID NO: 51072 - DNA, 19 bp, Artificial sequence
  SiRNA target sequence
caggaatttaaagatgggt

SEQ ID NO: 51073 - DNA, 19 bp, Artificial sequence
  SiRNA target sequence
aggaatttaaagatgggtt

SEQ ID NO: 51074 - DNA, 19 bp, Artificial sequence
  SiRNA target sequence
ggaatttaaagatgggttt

SEQ ID NO: 51075 - DNA, 19 bp, Artificial sequence
  SiRNA target sequence
gaatttaaagatgggttta

SEQ ID NO: 51076 - DNA, 19 bp, Artificial sequence
  SiRNA target sequence
aatttaaagatgggtttag

SEQ ID NO: 51077 - DNA, 19 bp, Artificial sequence
  SiRNA target sequence
atttaaagatgggtttagc

SEQ ID NO: 51078 - DNA, 19 bp, Artificial sequence
  SiRNA target sequence
tttaaagatgggtttagca

SEQ ID NO: 51079 - DNA, 19 bp, Artificial sequence
  SiRNA target sequence
ttaaagatgggtttagcac

SEQ ID NO: 51080 - DNA, 19 bp, Artificial sequence
  SiRNA target sequence
taaagatgggtttagcaca

SEQ ID NO: 51081 - DNA, 19 bp, Artificial sequence
  SiRNA target sequence
aaagatgggtttagcacat

SEQ ID NO: 51082 - DNA, 19 bp, Artificial sequence
  SiRNA target sequence
aagatgggtttagcacatc

SEQ ID NO: 51083 - DNA, 19 bp, Artificial sequence
  SiRNA target sequence
agatgggtttagcacatcg

SEQ ID NO: 51084 - DNA, 19 bp, Artificial sequence
  SiRNA target sequence
gatgggtttagcacatcgg

SEQ ID NO: 51085 - DNA, 19 bp, Artificial sequence
  SiRNA target sequence
atgggtttagcacatcggt

SEQ ID NO: 51086 - DNA, 19 bp, Artificial sequence
  SiRNA target sequence
tgggtttagcacatcggtc

SEQ ID NO: 51087 - DNA, 19 bp, Artificial sequence
  SiRNA target sequence
gggtttagcacatcggtcg

SEQ ID NO: 51088 - DNA, 19 bp, Artificial sequence
  SiRNA target sequence
ggtttagcacatcggtcgg

SEQ ID NO: 51089 - DNA, 19 bp, Artificial sequence
  SiRNA target sequence
gtttagcacatcggtcggt

SEQ ID NO: 51090 - DNA, 19 bp, Artificial sequence
  SiRNA target sequence
tttagcacatcggtcggtg

SEQ ID NO: 51091 - DNA, 19 bp, Artificial sequence
  SiRNA target sequence
ttagcacatcggtcggtga

SEQ ID NO: 51092 - DNA, 19 bp, Artificial sequence
  SiRNA target sequence
tagcacatcggtcggtgaa

SEQ ID NO: 51093 - DNA, 19 bp, Artificial sequence
  SiRNA target sequence
agcacatcggtcggtgaac

SEQ ID NO: 51094 - DNA, 19 bp, Artificial sequence
  SiRNA target sequence
gcacatcggtcggtgaacg

SEQ ID NO: 51095 - DNA, 19 bp, Artificial sequence
  SiRNA target sequence
cacatcggtcggtgaacgc

SEQ ID NO: 51096 - DNA, 19 bp, Artificial sequence
  SiRNA target sequence
acatcggtcggtgaacgcg

SEQ ID NO: 51097 - DNA, 19 bp, Artificial sequence
  SiRNA target sequence
catcggtcggtgaacgcgg

SEQ ID NO: 51098 - DNA, 19 bp, Artificial sequence
  SiRNA target sequence
atcggtcggtgaacgcgga

SEQ ID NO: 51099 - DNA, 19 bp, Artificial sequence
  SiRNA target sequence
tcggtcggtgaacgcggaa

SEQ ID NO: 51100 - DNA, 19 bp, Artificial sequence
  SiRNA target sequence
cggtcggtgaacgcggaag

SEQ ID NO: 51101 - DNA, 19 bp, Artificial sequence
  SiRNA target sequence
ggtcggtgaacgcggaaga

SEQ ID NO: 51102 - DNA, 19 bp, Artificial sequence
  SiRNA target sequence
gtcggtgaacgcggaagat

SEQ ID NO: 51103 - DNA, 19 bp, Artificial sequence
  SiRNA target sequence
tcggtgaacgcggaagatt

SEQ ID NO: 51104 - DNA, 19 bp, Artificial sequence
  SiRNA target sequence
cggtgaacgcggaagattt

SEQ ID NO: 51105 - DNA, 19 bp, Artificial sequence
  SiRNA target sequence
ggtgaacgcggaagatttt

SEQ ID NO: 51106 - DNA, 19 bp, Artificial sequence
  SiRNA target sequence
gtgaacgcggaagattttt

SEQ ID NO: 51107 - DNA, 19 bp, Artificial sequence
  SiRNA target sequence
tgaacgcggaagattttta

SEQ ID NO: 51108 - DNA, 19 bp, Artificial sequence
  SiRNA target sequence
gaacgcggaagatttttat

SEQ ID NO: 51109 - DNA, 19 bp, Artificial sequence
  SiRNA target sequence
aacgcggaagatttttatc

SEQ ID NO: 51110 - DNA, 19 bp, Artificial sequence
  SiRNA target sequence
acgcggaagatttttatct

SEQ ID NO: 51111 - DNA, 19 bp, Artificial sequence
  SiRNA target sequence
cgcggaagatttttatctg

SEQ ID NO: 51112 - DNA, 19 bp, Artificial sequence
  SiRNA target sequence
gcggaagatttttatctgg

SEQ ID NO: 51113 - DNA, 19 bp, Artificial sequence
  SiRNA target sequence
cggaagatttttatctggt

SEQ ID NO: 51114 - DNA, 19 bp, Artificial sequence
  SiRNA target sequence
ggaagatttttatctggtg

SEQ ID NO: 51115 - DNA, 19 bp, Artificial sequence
  SiRNA target sequence
gaagatttttatctggtgg

SEQ ID NO: 51116 - DNA, 19 bp, Artificial sequence
  SiRNA target sequence
aagatttttatctggtggt

SEQ ID NO: 51117 - DNA, 19 bp, Artificial sequence
  SiRNA target sequence
agatttttatctggtggtg

SEQ ID NO: 51118 - DNA, 19 bp, Artificial sequence
  SiRNA target sequence
gatttttatctggtggtga

SEQ ID NO: 51119 - DNA, 19 bp, Artificial sequence
  SiRNA target sequence
atttttatctggtggtgaa

SEQ ID NO: 51120 - DNA, 19 bp, Artificial sequence
  SiRNA target sequence
tttttatctggtggtgaaa

SEQ ID NO: 51121 - DNA, 19 bp, Artificial sequence
  SiRNA target sequence
ttttatctggtggtgaaag

SEQ ID NO: 51122 - DNA, 19 bp, Artificial sequence
  SiRNA target sequence
tttatctggtggtgaaagg

SEQ ID NO: 51123 - DNA, 19 bp, Artificial sequence
  SiRNA target sequence
ttatctggtggtgaaaggc

SEQ ID NO: 51124 - DNA, 19 bp, Artificial sequence
  SiRNA target sequence
tatctggtggtgaaaggca

SEQ ID NO: 51125 - DNA, 19 bp, Artificial sequence
  SiRNA target sequence
atctggtggtgaaaggcaa

SEQ ID NO: 51126 - DNA, 19 bp, Artificial sequence
  SiRNA target sequence
tctggtggtgaaaggcaaa

SEQ ID NO: 51127 - DNA, 19 bp, Artificial sequence
  SiRNA target sequence
ctggtggtgaaaggcaaaa

SEQ ID NO: 51128 - DNA, 19 bp, Artificial sequence
  SiRNA target sequence
tggtggtgaaaggcaaaaa

SEQ ID NO: 51129 - DNA, 19 bp, Artificial sequence
  SiRNA target sequence
ggtggtgaaaggcaaaaaa

SEQ ID NO: 51130 - DNA, 19 bp, Artificial sequence
  SiRNA target sequence
gtggtgaaaggcaaaaaat

SEQ ID NO: 51131 - DNA, 19 bp, Artificial sequence
  SiRNA target sequence
tggtgaaaggcaaaaaatt

SEQ ID NO: 51132 - DNA, 19 bp, Artificial sequence
  SiRNA target sequence
ggtgaaaggcaaaaaatta

SEQ ID NO: 51133 - DNA, 19 bp, Artificial sequence
  SiRNA target sequence
gtgaaaggcaaaaaattat

SEQ ID NO: 51134 - DNA, 19 bp, Artificial sequence
  SiRNA target sequence
tgaaaggcaaaaaattatg

SEQ ID NO: 51135 - DNA, 19 bp, Artificial sequence
  SiRNA target sequence
gaaaggcaaaaaattatgc

SEQ ID NO: 51136 - DNA, 19 bp, Artificial sequence
  SiRNA target sequence
aaaggcaaaaaattatgct

SEQ ID NO: 51137 - DNA, 19 bp, Artificial sequence
  SiRNA target sequence
aaggcaaaaaattatgctg

SEQ ID NO: 51138 - DNA, 19 bp, Artificial sequence
  SiRNA target sequence
aggcaaaaaattatgctga

SEQ ID NO: 51139 - DNA, 19 bp, Artificial sequence
  SiRNA target sequence
ggcaaaaaattatgctgat

SEQ ID NO: 51140 - DNA, 19 bp, Artificial sequence
  SiRNA target sequence
gcaaaaaattatgctgatg

SEQ ID NO: 51141 - DNA, 19 bp, Artificial sequence
  SiRNA target sequence
caaaaaattatgctgatgc

SEQ ID NO: 51142 - DNA, 19 bp, Artificial sequence
  SiRNA target sequence
aaaaaattatgctgatgcg

SEQ ID NO: 51143 - DNA, 19 bp, Artificial sequence
  SiRNA target sequence
aaaaattatgctgatgcgt

SEQ ID NO: 51144 - DNA, 19 bp, Artificial sequence
  SiRNA target sequence
aaaattatgctgatgcgtg

SEQ ID NO: 51145 - DNA, 19 bp, Artificial sequence
  SiRNA target sequence
aaattatgctgatgcgtgc

SEQ ID NO: 51146 - DNA, 19 bp, Artificial sequence
  SiRNA target sequence
aattatgctgatgcgtgca

SEQ ID NO: 51147 - DNA, 19 bp, Artificial sequence
  SiRNA target sequence
attatgctgatgcgtgcat

SEQ ID NO: 51148 - DNA, 19 bp, Artificial sequence
  SiRNA target sequence
ttatgctgatgcgtgcatt

SEQ ID NO: 51149 - DNA, 19 bp, Artificial sequence
  SiRNA target sequence
tatgctgatgcgtgcattg

SEQ ID NO: 51150 - DNA, 19 bp, Artificial sequence
  SiRNA target sequence
atgctgatgcgtgcattgc

SEQ ID NO: 51151 - DNA, 19 bp, Artificial sequence
  SiRNA target sequence
tgctgatgcgtgcattgct

SEQ ID NO: 51152 - DNA, 19 bp, Artificial sequence
  SiRNA target sequence
gctgatgcgtgcattgctt

SEQ ID NO: 51153 - DNA, 19 bp, Artificial sequence
  SiRNA target sequence
ctgatgcgtgcattgctta

SEQ ID NO: 51154 - DNA, 19 bp, Artificial sequence
  SiRNA target sequence
tgatgcgtgcattgcttaa

SEQ ID NO: 51155 - DNA, 19 bp, Artificial sequence
  SiRNA target sequence
gatgcgtgcattgcttaaa

SEQ ID NO: 51156 - DNA, 19 bp, Artificial sequence
  SiRNA target sequence
atgcgtgcattgcttaaaa

SEQ ID NO: 51157 - DNA, 19 bp, Artificial sequence
  SiRNA target sequence
tgcgtgcattgcttaaaaa

SEQ ID NO: 51158 - DNA, 19 bp, Artificial sequence
  SiRNA target sequence
gcgtgcattgcttaaaaat

SEQ ID NO: 51159 - DNA, 19 bp, Artificial sequence
  SiRNA target sequence
cgtgcattgcttaaaaatt

SEQ ID NO: 51160 - DNA, 19 bp, Artificial sequence
  SiRNA target sequence
gtgcattgcttaaaaattc

SEQ ID NO: 51161 - DNA, 19 bp, Artificial sequence
  SiRNA target sequence
tgcattgcttaaaaattca

SEQ ID NO: 51162 - DNA, 19 bp, Artificial sequence
  SiRNA target sequence
gcattgcttaaaaattcag

SEQ ID NO: 51163 - DNA, 19 bp, Artificial sequence
  SiRNA target sequence
cattgcttaaaaattcaga

SEQ ID NO: 51164 - DNA, 19 bp, Artificial sequence
  SiRNA target sequence
attgcttaaaaattcagag

SEQ ID NO: 51165 - DNA, 19 bp, Artificial sequence
  SiRNA target sequence
ttgcttaaaaattcagaga

SEQ ID NO: 51166 - DNA, 19 bp, Artificial sequence
  SiRNA target sequence
tgcttaaaaattcagagat

SEQ ID NO: 51167 - DNA, 19 bp, Artificial sequence
  SiRNA target sequence
gcttaaaaattcagagatc

SEQ ID NO: 51168 - DNA, 19 bp, Artificial sequence
  SiRNA target sequence
cttaaaaattcagagatcg

SEQ ID NO: 51169 - DNA, 19 bp, Artificial sequence
  SiRNA target sequence
ttaaaaattcagagatcgt

SEQ ID NO: 51170 - DNA, 19 bp, Artificial sequence
  SiRNA target sequence
taaaaattcagagatcgtt

SEQ ID NO: 51171 - DNA, 19 bp, Artificial sequence
  SiRNA target sequence
aaaaattcagagatcgttt

SEQ ID NO: 51172 - DNA, 19 bp, Artificial sequence
  SiRNA target sequence
aaaattcagagatcgtttt

SEQ ID NO: 51173 - DNA, 19 bp, Artificial sequence
  SiRNA target sequence
aaattcagagatcgtttta

SEQ ID NO: 51174 - DNA, 19 bp, Artificial sequence
  SiRNA target sequence
aattcagagatcgttttat

SEQ ID NO: 51175 - DNA, 19 bp, Artificial sequence
  SiRNA target sequence
attcagagatcgttttatt

SEQ ID NO: 51176 - DNA, 19 bp, Artificial sequence
  SiRNA target sequence
ttcagagatcgttttatta

SEQ ID NO: 51177 - DNA, 19 bp, Artificial sequence
  SiRNA target sequence
tcagagatcgttttattag

SEQ ID NO: 51178 - DNA, 19 bp, Artificial sequence
  SiRNA target sequence
cagagatcgttttattaga

SEQ ID NO: 51179 - DNA, 19 bp, Artificial sequence
  SiRNA target sequence
agagatcgttttattagac

SEQ ID NO: 51180 - DNA, 19 bp, Artificial sequence
  SiRNA target sequence
gagatcgttttattagacg

SEQ ID NO: 51181 - DNA, 19 bp, Artificial sequence
  SiRNA target sequence
agatcgttttattagacga

SEQ ID NO: 51182 - DNA, 19 bp, Artificial sequence
  SiRNA target sequence
gatcgttttattagacgag

SEQ ID NO: 51183 - DNA, 19 bp, Artificial sequence
  SiRNA target sequence
atcgttttattagacgagc

SEQ ID NO: 51184 - DNA, 19 bp, Artificial sequence
  SiRNA target sequence
tcgttttattagacgagcc

SEQ ID NO: 51185 - DNA, 19 bp, Artificial sequence
  SiRNA target sequence
cgttttattagacgagcca

SEQ ID NO: 51186 - DNA, 19 bp, Artificial sequence
  SiRNA target sequence
gttttattagacgagccaa

SEQ ID NO: 51187 - DNA, 19 bp, Artificial sequence
  SiRNA target sequence
ttttattagacgagccaac

SEQ ID NO: 51188 - DNA, 19 bp, Artificial sequence
  SiRNA target sequence
tttattagacgagccaacc

SEQ ID NO: 51189 - DNA, 19 bp, Artificial sequence
  SiRNA target sequence
ttattagacgagccaacct

SEQ ID NO: 51190 - DNA, 19 bp, Artificial sequence
  SiRNA target sequence
tattagacgagccaacctc

SEQ ID NO: 51191 - DNA, 19 bp, Artificial sequence
  SiRNA target sequence
attagacgagccaacctca

SEQ ID NO: 51192 - DNA, 19 bp, Artificial sequence
  SiRNA target sequence
ttagacgagccaacctcag

SEQ ID NO: 51193 - DNA, 19 bp, Artificial sequence
  SiRNA target sequence
tagacgagccaacctcagc

SEQ ID NO: 51194 - DNA, 19 bp, Artificial sequence
  SiRNA target sequence
agacgagccaacctcagca

SEQ ID NO: 51195 - DNA, 19 bp, Artificial sequence
  SiRNA target sequence
gacgagccaacctcagcac

SEQ ID NO: 51196 - DNA, 19 bp, Artificial sequence
  SiRNA target sequence
acgagccaacctcagcact

SEQ ID NO: 51197 - DNA, 19 bp, Artificial sequence
  SiRNA target sequence
cgagccaacctcagcacta

SEQ ID NO: 51198 - DNA, 19 bp, Artificial sequence
  SiRNA target sequence
gagccaacctcagcactag

SEQ ID NO: 51199 - DNA, 19 bp, Artificial sequence
  SiRNA target sequence
agccaacctcagcactaga

SEQ ID NO: 51200 - DNA, 19 bp, Artificial sequence
  SiRNA target sequence
gccaacctcagcactagat

SEQ ID NO: 51201 - DNA, 19 bp, Artificial sequence
  SiRNA target sequence
ccaacctcagcactagata

SEQ ID NO: 51202 - DNA, 19 bp, Artificial sequence
  SiRNA target sequence
caacctcagcactagataa

SEQ ID NO: 51203 - DNA, 19 bp, Artificial sequence
  SiRNA target sequence
aacctcagcactagataaa

SEQ ID NO: 51204 - DNA, 19 bp, Artificial sequence
  SiRNA target sequence
acctcagcactagataaaa

SEQ ID NO: 51205 - DNA, 19 bp, Artificial sequence
  SiRNA target sequence
cctcagcactagataaaaa

SEQ ID NO: 51206 - DNA, 19 bp, Artificial sequence
  SiRNA target sequence
ctcagcactagataaaaag

SEQ ID NO: 51207 - DNA, 19 bp, Artificial sequence
  SiRNA target sequence
tcagcactagataaaaaga

SEQ ID NO: 51208 - DNA, 19 bp, Artificial sequence
  SiRNA target sequence
cagcactagataaaaagag

SEQ ID NO: 51209 - DNA, 19 bp, Artificial sequence
  SiRNA target sequence
agcactagataaaaagagt

SEQ ID NO: 51210 - DNA, 19 bp, Artificial sequence
  SiRNA target sequence
gcactagataaaaagagtg

SEQ ID NO: 51211 - DNA, 19 bp, Artificial sequence
  SiRNA target sequence
cactagataaaaagagtga

SEQ ID NO: 51212 - DNA, 19 bp, Artificial sequence
  SiRNA target sequence
actagataaaaagagtgaa

SEQ ID NO: 51213 - DNA, 19 bp, Artificial sequence
  SiRNA target sequence
ctagataaaaagagtgaac

SEQ ID NO: 51214 - DNA, 19 bp, Artificial sequence
  SiRNA target sequence
tagataaaaagagtgaact

SEQ ID NO: 51215 - DNA, 19 bp, Artificial sequence
  SiRNA target sequence
agataaaaagagtgaacta

SEQ ID NO: 51216 - DNA, 19 bp, Artificial sequence
  SiRNA target sequence
gataaaaagagtgaactag

SEQ ID NO: 51217 - DNA, 19 bp, Artificial sequence
  SiRNA target sequence
ataaaaagagtgaactaga

SEQ ID NO: 51218 - DNA, 19 bp, Artificial sequence
  SiRNA target sequence
taaaaagagtgaactagaa

SEQ ID NO: 51219 - DNA, 19 bp, Artificial sequence
  SiRNA target sequence
aaaaagagtgaactagaaa

SEQ ID NO: 51220 - DNA, 19 bp, Artificial sequence
  SiRNA target sequence
aaaagagtgaactagaaac

SEQ ID NO: 51221 - DNA, 19 bp, Artificial sequence
  SiRNA target sequence
aaagagtgaactagaaact

SEQ ID NO: 51222 - DNA, 19 bp, Artificial sequence
  SiRNA target sequence
aagagtgaactagaaacta

SEQ ID NO: 51223 - DNA, 19 bp, Artificial sequence
  SiRNA target sequence
agagtgaactagaaactat

SEQ ID NO: 51224 - DNA, 19 bp, Artificial sequence
  SiRNA target sequence
gagtgaactagaaactatg

SEQ ID NO: 51225 - DNA, 19 bp, Artificial sequence
  SiRNA target sequence
agtgaactagaaactatga

SEQ ID NO: 51226 - DNA, 19 bp, Artificial sequence
  SiRNA target sequence
gtgaactagaaactatgac

SEQ ID NO: 51227 - DNA, 19 bp, Artificial sequence
  SiRNA target sequence
tgaactagaaactatgaca

SEQ ID NO: 51228 - DNA, 19 bp, Artificial sequence
  SiRNA target sequence
gaactagaaactatgacat

SEQ ID NO: 51229 - DNA, 19 bp, Artificial sequence
  SiRNA target sequence
aactagaaactatgacata

SEQ ID NO: 51230 - DNA, 19 bp, Artificial sequence
  SiRNA target sequence
actagaaactatgacatat

SEQ ID NO: 51231 - DNA, 19 bp, Artificial sequence
  SiRNA target sequence
ctagaaactatgacatata

SEQ ID NO: 51232 - DNA, 19 bp, Artificial sequence
  SiRNA target sequence
tagaaactatgacatatat

SEQ ID NO: 51233 - DNA, 19 bp, Artificial sequence
  SiRNA target sequence
agaaactatgacatatatt

SEQ ID NO: 51234 - DNA, 19 bp, Artificial sequence
  SiRNA target sequence
gaaactatgacatatattt

SEQ ID NO: 51235 - DNA, 19 bp, Artificial sequence
  SiRNA target sequence
aaactatgacatatatttt

SEQ ID NO: 51236 - DNA, 19 bp, Artificial sequence
  SiRNA target sequence
aactatgacatatattttt

SEQ ID NO: 51237 - DNA, 19 bp, Artificial sequence
  SiRNA target sequence
actatgacatatattttta

SEQ ID NO: 51238 - DNA, 19 bp, Artificial sequence
  SiRNA target sequence
ctatgacatatatttttaa

SEQ ID NO: 51239 - DNA, 19 bp, Artificial sequence
  SiRNA target sequence
tatgacatatatttttaat

SEQ ID NO: 51240 - DNA, 19 bp, Artificial sequence
  SiRNA target sequence
atgacatatatttttaatg

SEQ ID NO: 51241 - DNA, 19 bp, Artificial sequence
  SiRNA target sequence
tgacatatatttttaatga

SEQ ID NO: 51242 - DNA, 19 bp, Artificial sequence
  SiRNA target sequence
gacatatatttttaatgaa

SEQ ID NO: 51243 - DNA, 19 bp, Artificial sequence
  SiRNA target sequence
acatatatttttaatgaat

SEQ ID NO: 51244 - DNA, 19 bp, Artificial sequence
  SiRNA target sequence
catatatttttaatgaatt

SEQ ID NO: 51245 - DNA, 19 bp, Artificial sequence
  SiRNA target sequence
atatatttttaatgaattt

SEQ ID NO: 51246 - DNA, 19 bp, Artificial sequence
  SiRNA target sequence
tatatttttaatgaattta

SEQ ID NO: 51247 - DNA, 19 bp, Artificial sequence
  SiRNA target sequence
atatttttaatgaatttaa

SEQ ID NO: 51248 - DNA, 19 bp, Artificial sequence
  SiRNA target sequence
tatttttaatgaatttaag

SEQ ID NO: 51249 - DNA, 19 bp, Artificial sequence
  SiRNA target sequence
atttttaatgaatttaagt

SEQ ID NO: 51250 - DNA, 19 bp, Artificial sequence
  SiRNA target sequence
tttttaatgaatttaagta

SEQ ID NO: 51251 - DNA, 19 bp, Artificial sequence
  SiRNA target sequence
ttttaatgaatttaagtac

SEQ ID NO: 51252 - DNA, 19 bp, Artificial sequence
  SiRNA target sequence
tttaatgaatttaagtacc

SEQ ID NO: 51253 - DNA, 19 bp, Artificial sequence
  SiRNA target sequence
ttaatgaatttaagtacca

SEQ ID NO: 51254 - DNA, 19 bp, Artificial sequence
  SiRNA target sequence
taatgaatttaagtaccat

SEQ ID NO: 51255 - DNA, 19 bp, Artificial sequence
  SiRNA target sequence
aatgaatttaagtaccata

SEQ ID NO: 51256 - DNA, 19 bp, Artificial sequence
  SiRNA target sequence
atgaatttaagtaccatac

SEQ ID NO: 51257 - DNA, 19 bp, Artificial sequence
  SiRNA target sequence
tgaatttaagtaccatact

SEQ ID NO: 51258 - DNA, 19 bp, Artificial sequence
  SiRNA target sequence
gaatttaagtaccatactt

SEQ ID NO: 51259 - DNA, 19 bp, Artificial sequence
  SiRNA target sequence
aatttaagtaccatacttt

SEQ ID NO: 51260 - DNA, 19 bp, Artificial sequence
  SiRNA target sequence
atttaagtaccatactttt

SEQ ID NO: 51261 - DNA, 19 bp, Artificial sequence
  SiRNA target sequence
tttaagtaccatacttttg

SEQ ID NO: 51262 - DNA, 19 bp, Artificial sequence
  SiRNA target sequence
ttaagtaccatacttttgt

SEQ ID NO: 51263 - DNA, 19 bp, Artificial sequence
  SiRNA target sequence
taagtaccatacttttgta

SEQ ID NO: 51264 - DNA, 19 bp, Artificial sequence
  SiRNA target sequence
aagtaccatacttttgtaa

SEQ ID NO: 51265 - DNA, 19 bp, Artificial sequence
  SiRNA target sequence
agtaccatacttttgtaat

SEQ ID NO: 51266 - DNA, 19 bp, Artificial sequence
  SiRNA target sequence
gtaccatacttttgtaata

SEQ ID NO: 51267 - DNA, 19 bp, Artificial sequence
  SiRNA target sequence
taccatacttttgtaataa

SEQ ID NO: 51268 - DNA, 19 bp, Artificial sequence
  SiRNA target sequence
accatacttttgtaataat

SEQ ID NO: 51269 - DNA, 19 bp, Artificial sequence
  SiRNA target sequence
ccatacttttgtaataatt

SEQ ID NO: 51270 - DNA, 19 bp, Artificial sequence
  SiRNA target sequence
catacttttgtaataattg

SEQ ID NO: 51271 - DNA, 19 bp, Artificial sequence
  SiRNA target sequence
atacttttgtaataattgt

SEQ ID NO: 51272 - DNA, 19 bp, Artificial sequence
  SiRNA target sequence
tacttttgtaataattgta

SEQ ID NO: 51273 - DNA, 19 bp, Artificial sequence
  SiRNA target sequence
acttttgtaataattgtac

SEQ ID NO: 51274 - DNA, 19 bp, Artificial sequence
  SiRNA target sequence
cttttgtaataattgtaca

SEQ ID NO: 51275 - DNA, 19 bp, Artificial sequence
  SiRNA target sequence
ttttgtaataattgtacac

SEQ ID NO: 51276 - DNA, 19 bp, Artificial sequence
  SiRNA target sequence
tttgtaataattgtacaca

SEQ ID NO: 51277 - DNA, 19 bp, Artificial sequence
  SiRNA target sequence
ttgtaataattgtacacaa

SEQ ID NO: 51278 - DNA, 19 bp, Artificial sequence
  SiRNA target sequence
tgtaataattgtacacaat

SEQ ID NO: 51279 - DNA, 19 bp, Artificial sequence
  SiRNA target sequence
gtaataattgtacacaatc

SEQ ID NO: 51280 - DNA, 19 bp, Artificial sequence
  SiRNA target sequence
taataattgtacacaatct

SEQ ID NO: 51281 - DNA, 19 bp, Artificial sequence
  SiRNA target sequence
aataattgtacacaatcta

SEQ ID NO: 51282 - DNA, 19 bp, Artificial sequence
  SiRNA target sequence
ataattgtacacaatctag

SEQ ID NO: 51283 - DNA, 19 bp, Artificial sequence
  SiRNA target sequence
taattgtacacaatctaga

SEQ ID NO: 51284 - DNA, 19 bp, Artificial sequence
  SiRNA target sequence
aattgtacacaatctagaa

SEQ ID NO: 51285 - DNA, 19 bp, Artificial sequence
  SiRNA target sequence
attgtacacaatctagaat

SEQ ID NO: 51286 - DNA, 19 bp, Artificial sequence
  SiRNA target sequence
ttgtacacaatctagaatt

SEQ ID NO: 51287 - DNA, 19 bp, Artificial sequence
  SiRNA target sequence
tgtacacaatctagaatta

SEQ ID NO: 51288 - DNA, 19 bp, Artificial sequence
  SiRNA target sequence
gtacacaatctagaattat

SEQ ID NO: 51289 - DNA, 19 bp, Artificial sequence
  SiRNA target sequence
tacacaatctagaattatt

SEQ ID NO: 51290 - DNA, 19 bp, Artificial sequence
  SiRNA target sequence
acacaatctagaattattg

SEQ ID NO: 51291 - DNA, 19 bp, Artificial sequence
  SiRNA target sequence
cacaatctagaattattgg

SEQ ID NO: 51292 - DNA, 19 bp, Artificial sequence
  SiRNA target sequence
acaatctagaattattggc

SEQ ID NO: 51293 - DNA, 19 bp, Artificial sequence
  SiRNA target sequence
caatctagaattattggct

SEQ ID NO: 51294 - DNA, 19 bp, Artificial sequence
  SiRNA target sequence
aatctagaattattggctt

SEQ ID NO: 51295 - DNA, 19 bp, Artificial sequence
  SiRNA target sequence
atctagaattattggcttt

SEQ ID NO: 51296 - DNA, 19 bp, Artificial sequence
  SiRNA target sequence
tctagaattattggctttg

SEQ ID NO: 51297 - DNA, 19 bp, Artificial sequence
  SiRNA target sequence
ctagaattattggctttgt

SEQ ID NO: 51298 - DNA, 19 bp, Artificial sequence
  SiRNA target sequence
tagaattattggctttgtt

SEQ ID NO: 51299 - DNA, 19 bp, Artificial sequence
  SiRNA target sequence
agaattattggctttgttt

SEQ ID NO: 51300 - DNA, 19 bp, Artificial sequence
  SiRNA target sequence
gaattattggctttgtttg

SEQ ID NO: 51301 - DNA, 19 bp, Artificial sequence
  SiRNA target sequence
aattattggctttgtttga

SEQ ID NO: 51302 - DNA, 19 bp, Artificial sequence
  SiRNA target sequence
attattggctttgtttgat

SEQ ID NO: 51303 - DNA, 19 bp, Artificial sequence
  SiRNA target sequence
ttattggctttgtttgata

SEQ ID NO: 51304 - DNA, 19 bp, Artificial sequence
  SiRNA target sequence
tattggctttgtttgataa

SEQ ID NO: 51305 - DNA, 19 bp, Artificial sequence
  SiRNA target sequence
attggctttgtttgataaa

SEQ ID NO: 51306 - DNA, 19 bp, Artificial sequence
  SiRNA target sequence
ttggctttgtttgataaaa

SEQ ID NO: 51307 - DNA, 19 bp, Artificial sequence
  SiRNA target sequence
tggctttgtttgataaaat

SEQ ID NO: 51308 - DNA, 19 bp, Artificial sequence
  SiRNA target sequence
ggctttgtttgataaaatt

SEQ ID NO: 51309 - DNA, 19 bp, Artificial sequence
  SiRNA target sequence
gctttgtttgataaaattt

SEQ ID NO: 51310 - DNA, 19 bp, Artificial sequence
  SiRNA target sequence
ctttgtttgataaaatttt

SEQ ID NO: 51311 - DNA, 19 bp, Artificial sequence
  SiRNA target sequence
tttgtttgataaaatttta

SEQ ID NO: 51312 - DNA, 19 bp, Artificial sequence
  SiRNA target sequence
ttgtttgataaaattttat

SEQ ID NO: 51313 - DNA, 19 bp, Artificial sequence
  SiRNA target sequence
tgtttgataaaattttatt

SEQ ID NO: 51314 - DNA, 19 bp, Artificial sequence
  SiRNA target sequence
gtttgataaaattttattt

SEQ ID NO: 51315 - DNA, 19 bp, Artificial sequence
  SiRNA target sequence
tttgataaaattttatttg

SEQ ID NO: 51316 - DNA, 19 bp, Artificial sequence
  SiRNA target sequence
ttgataaaattttatttgt

SEQ ID NO: 51317 - DNA, 19 bp, Artificial sequence
  SiRNA target sequence
tgataaaattttatttgta

SEQ ID NO: 51318 - DNA, 19 bp, Artificial sequence
  SiRNA target sequence
gataaaattttatttgtaa

SEQ ID NO: 51319 - DNA, 19 bp, Artificial sequence
  SiRNA target sequence
ataaaattttatttgtaaa

SEQ ID NO: 51320 - DNA, 19 bp, Artificial sequence
  SiRNA target sequence
taaaattttatttgtaaat

SEQ ID NO: 51321 - DNA, 19 bp, Artificial sequence
  SiRNA target sequence
aaaattttatttgtaaatg

SEQ ID NO: 51322 - DNA, 19 bp, Artificial sequence
  SiRNA target sequence
aaattttatttgtaaatgg

SEQ ID NO: 51323 - DNA, 19 bp, Artificial sequence
  SiRNA target sequence
aattttatttgtaaatggt

SEQ ID NO: 51324 - DNA, 19 bp, Artificial sequence
  SiRNA target sequence
attttatttgtaaatggta

SEQ ID NO: 51325 - DNA, 19 bp, Artificial sequence
  SiRNA target sequence
ttttatttgtaaatggtaa

SEQ ID NO: 51326 - DNA, 19 bp, Artificial sequence
  SiRNA target sequence
tttatttgtaaatggtaat

SEQ ID NO: 51327 - DNA, 19 bp, Artificial sequence
  SiRNA target sequence
ttatttgtaaatggtaatg

SEQ ID NO: 51328 - DNA, 19 bp, Artificial sequence
  SiRNA target sequence
tatttgtaaatggtaatga

SEQ ID NO: 51329 - DNA, 19 bp, Artificial sequence
  SiRNA target sequence
atttgtaaatggtaatgag

SEQ ID NO: 51330 - DNA, 19 bp, Artificial sequence
  SiRNA target sequence
tttgtaaatggtaatgagg

SEQ ID NO: 51331 - DNA, 19 bp, Artificial sequence
  SiRNA target sequence
ttgtaaatggtaatgaggt

SEQ ID NO: 51332 - DNA, 19 bp, Artificial sequence
  SiRNA target sequence
tgtaaatggtaatgaggta

SEQ ID NO: 51333 - DNA, 19 bp, Artificial sequence
  SiRNA target sequence
gtaaatggtaatgaggtaa

SEQ ID NO: 51334 - DNA, 19 bp, Artificial sequence
  SiRNA target sequence
taaatggtaatgaggtaac

SEQ ID NO: 51335 - DNA, 19 bp, Artificial sequence
  SiRNA target sequence
aaatggtaatgaggtaaca

SEQ ID NO: 51336 - DNA, 19 bp, Artificial sequence
  SiRNA target sequence
aatggtaatgaggtaacaa

SEQ ID NO: 51337 - DNA, 19 bp, Artificial sequence
  SiRNA target sequence
atggtaatgaggtaacaat

SEQ ID NO: 51338 - DNA, 19 bp, Artificial sequence
  SiRNA target sequence
tggtaatgaggtaacaatg

SEQ ID NO: 51339 - DNA, 19 bp, Artificial sequence
  SiRNA target sequence
ggtaatgaggtaacaatga

SEQ ID NO: 51340 - DNA, 19 bp, Artificial sequence
  SiRNA target sequence
gtaatgaggtaacaatgat

SEQ ID NO: 51341 - DNA, 19 bp, Artificial sequence
  SiRNA target sequence
taatgaggtaacaatgata

SEQ ID NO: 51342 - DNA, 19 bp, Artificial sequence
  SiRNA target sequence
aatgaggtaacaatgatag

SEQ ID NO: 51343 - DNA, 19 bp, Artificial sequence
  SiRNA target sequence
atgaggtaacaatgataga

SEQ ID NO: 51344 - DNA, 19 bp, Artificial sequence
  SiRNA target sequence
tgaggtaacaatgatagaa

SEQ ID NO: 51345 - DNA, 19 bp, Artificial sequence
  SiRNA target sequence
gaggtaacaatgatagaag

SEQ ID NO: 51346 - DNA, 19 bp, Artificial sequence
  SiRNA target sequence
aggtaacaatgatagaaga

SEQ ID NO: 51347 - DNA, 19 bp, Artificial sequence
  SiRNA target sequence
ggtaacaatgatagaagac

SEQ ID NO: 51348 - DNA, 19 bp, Artificial sequence
  SiRNA target sequence
gtaacaatgatagaagaca

SEQ ID NO: 51349 - DNA, 19 bp, Artificial sequence
  SiRNA target sequence
taacaatgatagaagacat

SEQ ID NO: 51350 - DNA, 19 bp, Artificial sequence
  SiRNA target sequence
aacaatgatagaagacatt

SEQ ID NO: 51351 - DNA, 19 bp, Artificial sequence
  SiRNA target sequence
acaatgatagaagacatta

SEQ ID NO: 51352 - DNA, 19 bp, Artificial sequence
  SiRNA target sequence
caatgatagaagacattaa

SEQ ID NO: 51353 - DNA, 19 bp, Artificial sequence
  SiRNA target sequence
aatgatagaagacattaac

SEQ ID NO: 51354 - DNA, 19 bp, Artificial sequence
  SiRNA target sequence
atgatagaagacattaaca

SEQ ID NO: 51355 - DNA, 19 bp, Artificial sequence
  SiRNA target sequence
tgatagaagacattaacaa

SEQ ID NO: 51356 - DNA, 19 bp, Artificial sequence
  SiRNA target sequence
gatagaagacattaacaaa

SEQ ID NO: 51357 - DNA, 19 bp, Artificial sequence
  SiRNA target sequence
atagaagacattaacaaaa

SEQ ID NO: 51358 - DNA, 19 bp, Artificial sequence
  SiRNA target sequence
tagaagacattaacaaaaa

SEQ ID NO: 51359 - DNA, 19 bp, Artificial sequence
  SiRNA target sequence
agaagacattaacaaaaaa

SEQ ID NO: 51360 - DNA, 19 bp, Artificial sequence
  SiRNA target sequence
gaagacattaacaaaaaac

SEQ ID NO: 51361 - DNA, 19 bp, Artificial sequence
  SiRNA target sequence
aagacattaacaaaaaact

SEQ ID NO: 51362 - DNA, 19 bp, Artificial sequence
  SiRNA target sequence
agacattaacaaaaaactt

SEQ ID NO: 51363 - DNA, 19 bp, Artificial sequence
  SiRNA target sequence
gacattaacaaaaaacttg

SEQ ID NO: 51364 - DNA, 19 bp, Artificial sequence
  SiRNA target sequence
acattaacaaaaaacttga

SEQ ID NO: 51365 - DNA, 19 bp, Artificial sequence
  SiRNA target sequence
cattaacaaaaaacttgaa

SEQ ID NO: 51366 - DNA, 19 bp, Artificial sequence
  SiRNA target sequence
attaacaaaaaacttgaag

SEQ ID NO: 51367 - DNA, 19 bp, Artificial sequence
  SiRNA target sequence
ttaacaaaaaacttgaaga

SEQ ID NO: 51368 - DNA, 19 bp, Artificial sequence
  SiRNA target sequence
taacaaaaaacttgaagaa

SEQ ID NO: 51369 - DNA, 19 bp, Artificial sequence
  SiRNA target sequence
aacaaaaaacttgaagaaa

SEQ ID NO: 51370 - DNA, 19 bp, Artificial sequence
  SiRNA target sequence
acaaaaaacttgaagaaaa

SEQ ID NO: 51371 - DNA, 19 bp, Artificial sequence
  SiRNA target sequence
caaaaaacttgaagaaaat

SEQ ID NO: 51372 - DNA, 19 bp, Artificial sequence
  SiRNA target sequence
aaaaaacttgaagaaaatt

SEQ ID NO: 51373 - DNA, 19 bp, Artificial sequence
  SiRNA target sequence
aaaaacttgaagaaaattc

SEQ ID NO: 51374 - DNA, 19 bp, Artificial sequence
  SiRNA target sequence
aaaacttgaagaaaattca

SEQ ID NO: 51375 - DNA, 19 bp, Artificial sequence
  SiRNA target sequence
aaacttgaagaaaattcaa

SEQ ID NO: 51376 - DNA, 19 bp, Artificial sequence
  SiRNA target sequence
aacttgaagaaaattcaaa

SEQ ID NO: 51377 - DNA, 19 bp, Artificial sequence
  SiRNA target sequence
acttgaagaaaattcaaag

SEQ ID NO: 51378 - DNA, 19 bp, Artificial sequence
  SiRNA target sequence
cttgaagaaaattcaaagt

SEQ ID NO: 51379 - DNA, 19 bp, Artificial sequence
  SiRNA target sequence
ttgaagaaaattcaaagta

SEQ ID NO: 51380 - DNA, 19 bp, Artificial sequence
  SiRNA target sequence
tgaagaaaattcaaagtat

SEQ ID NO: 51381 - DNA, 19 bp, Artificial sequence
  SiRNA target sequence
gaagaaaattcaaagtatt

SEQ ID NO: 51382 - DNA, 19 bp, Artificial sequence
  SiRNA target sequence
aagaaaattcaaagtattt

SEQ ID NO: 51383 - DNA, 19 bp, Artificial sequence
  SiRNA target sequence
agaaaattcaaagtatttt

SEQ ID NO: 51384 - DNA, 19 bp, Artificial sequence
  SiRNA target sequence
gaaaattcaaagtattttg

SEQ ID NO: 51385 - DNA, 19 bp, Artificial sequence
  SiRNA target sequence
aaaattcaaagtattttgc

SEQ ID NO: 51386 - DNA, 19 bp, Artificial sequence
  SiRNA target sequence
aaattcaaagtattttgca

SEQ ID NO: 51387 - DNA, 19 bp, Artificial sequence
  SiRNA target sequence
aattcaaagtattttgcag

SEQ ID NO: 51388 - DNA, 19 bp, Artificial sequence
  SiRNA target sequence
attcaaagtattttgcaga

SEQ ID NO: 51389 - DNA, 19 bp, Artificial sequence
  SiRNA target sequence
ttcaaagtattttgcagat

SEQ ID NO: 51390 - DNA, 19 bp, Artificial sequence
  SiRNA target sequence
tcaaagtattttgcagata

SEQ ID NO: 51391 - DNA, 19 bp, Artificial sequence
  SiRNA target sequence
caaagtattttgcagatat

SEQ ID NO: 51392 - DNA, 19 bp, Artificial sequence
  SiRNA target sequence
aaagtattttgcagatatt

SEQ ID NO: 51393 - DNA, 19 bp, Artificial sequence
  SiRNA target sequence
aagtattttgcagatattt

SEQ ID NO: 51394 - DNA, 19 bp, Artificial sequence
  SiRNA target sequence
agtattttgcagatatttt

SEQ ID NO: 51395 - DNA, 19 bp, Artificial sequence
  SiRNA target sequence
gtattttgcagatatttta

SEQ ID NO: 51396 - DNA, 19 bp, Artificial sequence
  SiRNA target sequence
tattttgcagatattttaa

SEQ ID NO: 51397 - DNA, 19 bp, Artificial sequence
  SiRNA target sequence
attttgcagatattttaaa

SEQ ID NO: 51398 - DNA, 19 bp, Artificial sequence
  SiRNA target sequence
ttttgcagatattttaaac

SEQ ID NO: 51399 - DNA, 19 bp, Artificial sequence
  SiRNA target sequence
tttgcagatattttaaaca

SEQ ID NO: 51400 - DNA, 19 bp, Artificial sequence
  SiRNA target sequence
ttgcagatattttaaacaa

SEQ ID NO: 51401 - DNA, 19 bp, Artificial sequence
  SiRNA target sequence
tgcagatattttaaacaac

SEQ ID NO: 51402 - DNA, 19 bp, Artificial sequence
  SiRNA target sequence
gcagatattttaaacaacg

SEQ ID NO: 51403 - DNA, 19 bp, Artificial sequence
  SiRNA target sequence
cagatattttaaacaacga

SEQ ID NO: 51404 - DNA, 19 bp, Artificial sequence
  SiRNA target sequence
agatattttaaacaacgaa

SEQ ID NO: 51405 - DNA, 19 bp, Artificial sequence
  SiRNA target sequence
gatattttaaacaacgaat

SEQ ID NO: 51406 - DNA, 19 bp, Artificial sequence
  SiRNA target sequence
atattttaaacaacgaata

SEQ ID NO: 51407 - DNA, 19 bp, Artificial sequence
  SiRNA target sequence
tattttaaacaacgaataa

SEQ ID NO: 51408 - DNA, 20 bp, Artificial sequence
  SiRNA target sequence
atgaaggaaaaaaccaatta

SEQ ID NO: 51409 - DNA, 20 bp, Artificial sequence
  SiRNA target sequence
tgaaggaaaaaaccaattat

SEQ ID NO: 51410 - DNA, 20 bp, Artificial sequence
  SiRNA target sequence
gaaggaaaaaaccaattatg

SEQ ID NO: 51411 - DNA, 20 bp, Artificial sequence
  SiRNA target sequence
aaggaaaaaaccaattatga

SEQ ID NO: 51412 - DNA, 20 bp, Artificial sequence
  SiRNA target sequence
aggaaaaaaccaattatgaa

SEQ ID NO: 51413 - DNA, 20 bp, Artificial sequence
  SiRNA target sequence
ggaaaaaaccaattatgaaa

SEQ ID NO: 51414 - DNA, 20 bp, Artificial sequence
  SiRNA target sequence
gaaaaaaccaattatgaaat

SEQ ID NO: 51415 - DNA, 20 bp, Artificial sequence
  SiRNA target sequence
aaaaaaccaattatgaaatt

SEQ ID NO: 51416 - DNA, 20 bp, Artificial sequence
  SiRNA target sequence
aaaaaccaattatgaaattt

SEQ ID NO: 51417 - DNA, 20 bp, Artificial sequence
  SiRNA target sequence
aaaaccaattatgaaatttt

SEQ ID NO: 51418 - DNA, 20 bp, Artificial sequence
  SiRNA target sequence
aaaccaattatgaaatttta

SEQ ID NO: 51419 - DNA, 20 bp, Artificial sequence
  SiRNA target sequence
aaccaattatgaaattttat

SEQ ID NO: 51420 - DNA, 20 bp, Artificial sequence
  SiRNA target sequence
accaattatgaaattttata

SEQ ID NO: 51421 - DNA, 20 bp, Artificial sequence
  SiRNA target sequence
ccaattatgaaattttatat

SEQ ID NO: 51422 - DNA, 20 bp, Artificial sequence
  SiRNA target sequence
caattatgaaattttatatg

SEQ ID NO: 51423 - DNA, 20 bp, Artificial sequence
  SiRNA target sequence
aattatgaaattttatatga

SEQ ID NO: 51424 - DNA, 20 bp, Artificial sequence
  SiRNA target sequence
attatgaaattttatatgat

SEQ ID NO: 51425 - DNA, 20 bp, Artificial sequence
  SiRNA target sequence
ttatgaaattttatatgata

SEQ ID NO: 51426 - DNA, 20 bp, Artificial sequence
  SiRNA target sequence
tatgaaattttatatgatac

SEQ ID NO: 51427 - DNA, 20 bp, Artificial sequence
  SiRNA target sequence
atgaaattttatatgataca

SEQ ID NO: 51428 - DNA, 20 bp, Artificial sequence
  SiRNA target sequence
tgaaattttatatgatacat

SEQ ID NO: 51429 - DNA, 20 bp, Artificial sequence
  SiRNA target sequence
gaaattttatatgatacatt

SEQ ID NO: 51430 - DNA, 20 bp, Artificial sequence
  SiRNA target sequence
aaattttatatgatacattt

SEQ ID NO: 51431 - DNA, 20 bp, Artificial sequence
  SiRNA target sequence
aattttatatgatacatttg

SEQ ID NO: 51432 - DNA, 20 bp, Artificial sequence
  SiRNA target sequence
attttatatgatacatttgt

SEQ ID NO: 51433 - DNA, 20 bp, Artificial sequence
  SiRNA target sequence
ttttatatgatacatttgta

SEQ ID NO: 51434 - DNA, 20 bp, Artificial sequence
  SiRNA target sequence
tttatatgatacatttgtaa

SEQ ID NO: 51435 - DNA, 20 bp, Artificial sequence
  SiRNA target sequence
ttatatgatacatttgtaaa

SEQ ID NO: 51436 - DNA, 20 bp, Artificial sequence
  SiRNA target sequence
tatatgatacatttgtaaaa

SEQ ID NO: 51437 - DNA, 20 bp, Artificial sequence
  SiRNA target sequence
atatgatacatttgtaaaat

SEQ ID NO: 51438 - DNA, 20 bp, Artificial sequence
  SiRNA target sequence
tatgatacatttgtaaaata

SEQ ID NO: 51439 - DNA, 20 bp, Artificial sequence
  SiRNA target sequence
atgatacatttgtaaaatat

SEQ ID NO: 51440 - DNA, 20 bp, Artificial sequence
  SiRNA target sequence
tgatacatttgtaaaatatt

SEQ ID NO: 51441 - DNA, 20 bp, Artificial sequence
  SiRNA target sequence
gatacatttgtaaaatattg

SEQ ID NO: 51442 - DNA, 20 bp, Artificial sequence
  SiRNA target sequence
atacatttgtaaaatattgt

SEQ ID NO: 51443 - DNA, 20 bp, Artificial sequence
  SiRNA target sequence
tacatttgtaaaatattgtt

SEQ ID NO: 51444 - DNA, 20 bp, Artificial sequence
  SiRNA target sequence
acatttgtaaaatattgtta

SEQ ID NO: 51445 - DNA, 20 bp, Artificial sequence
  SiRNA target sequence
catttgtaaaatattgttac

SEQ ID NO: 51446 - DNA, 20 bp, Artificial sequence
  SiRNA target sequence
atttgtaaaatattgttaca

SEQ ID NO: 51447 - DNA, 20 bp, Artificial sequence
  SiRNA target sequence
tttgtaaaatattgttacaa

SEQ ID NO: 51448 - DNA, 20 bp, Artificial sequence
  SiRNA target sequence
ttgtaaaatattgttacaat

SEQ ID NO: 51449 - DNA, 20 bp, Artificial sequence
  SiRNA target sequence
tgtaaaatattgttacaata

SEQ ID NO: 51450 - DNA, 20 bp, Artificial sequence
  SiRNA target sequence
gtaaaatattgttacaatat

SEQ ID NO: 51451 - DNA, 20 bp, Artificial sequence
  SiRNA target sequence
taaaatattgttacaatatt

SEQ ID NO: 51452 - DNA, 20 bp, Artificial sequence
  SiRNA target sequence
aaaatattgttacaatattt

SEQ ID NO: 51453 - DNA, 20 bp, Artificial sequence
  SiRNA target sequence
aaatattgttacaatatttc

SEQ ID NO: 51454 - DNA, 20 bp, Artificial sequence
  SiRNA target sequence
aatattgttacaatatttcc

SEQ ID NO: 51455 - DNA, 20 bp, Artificial sequence
  SiRNA target sequence
atattgttacaatatttcct

SEQ ID NO: 51456 - DNA, 20 bp, Artificial sequence
  SiRNA target sequence
tattgttacaatatttccta

SEQ ID NO: 51457 - DNA, 20 bp, Artificial sequence
  SiRNA target sequence
attgttacaatatttcctat

SEQ ID NO: 51458 - DNA, 20 bp, Artificial sequence
  SiRNA target sequence
ttgttacaatatttcctata

SEQ ID NO: 51459 - DNA, 20 bp, Artificial sequence
  SiRNA target sequence
tgttacaatatttcctatat

SEQ ID NO: 51460 - DNA, 20 bp, Artificial sequence
  SiRNA target sequence
gttacaatatttcctatata

SEQ ID NO: 51461 - DNA, 20 bp, Artificial sequence
  SiRNA target sequence
ttacaatatttcctatataa

SEQ ID NO: 51462 - DNA, 20 bp, Artificial sequence
  SiRNA target sequence
tacaatatttcctatataag

SEQ ID NO: 51463 - DNA, 20 bp, Artificial sequence
  SiRNA target sequence
acaatatttcctatataagg

SEQ ID NO: 51464 - DNA, 20 bp, Artificial sequence
  SiRNA target sequence
caatatttcctatataaggt

SEQ ID NO: 51465 - DNA, 20 bp, Artificial sequence
  SiRNA target sequence
aatatttcctatataaggta

SEQ ID NO: 51466 - DNA, 20 bp, Artificial sequence
  SiRNA target sequence
atatttcctatataaggtac

SEQ ID NO: 51467 - DNA, 20 bp, Artificial sequence
  SiRNA target sequence
tatttcctatataaggtacg

SEQ ID NO: 51468 - DNA, 20 bp, Artificial sequence
  SiRNA target sequence
atttcctatataaggtacgt

SEQ ID NO: 51469 - DNA, 20 bp, Artificial sequence
  SiRNA target sequence
tttcctatataaggtacgta

SEQ ID NO: 51470 - DNA, 20 bp, Artificial sequence
  SiRNA target sequence
ttcctatataaggtacgtaa

SEQ ID NO: 51471 - DNA, 20 bp, Artificial sequence
  SiRNA target sequence
tcctatataaggtacgtaat

SEQ ID NO: 51472 - DNA, 20 bp, Artificial sequence
  SiRNA target sequence
cctatataaggtacgtaatg

SEQ ID NO: 51473 - DNA, 20 bp, Artificial sequence
  SiRNA target sequence
ctatataaggtacgtaatgt

SEQ ID NO: 51474 - DNA, 20 bp, Artificial sequence
  SiRNA target sequence
tatataaggtacgtaatgtt

SEQ ID NO: 51475 - DNA, 20 bp, Artificial sequence
  SiRNA target sequence
atataaggtacgtaatgttt

SEQ ID NO: 51476 - DNA, 20 bp, Artificial sequence
  SiRNA target sequence
tataaggtacgtaatgtttc

SEQ ID NO: 51477 - DNA, 20 bp, Artificial sequence
  SiRNA target sequence
ataaggtacgtaatgtttcc

SEQ ID NO: 51478 - DNA, 20 bp, Artificial sequence
  SiRNA target sequence
taaggtacgtaatgtttccc

SEQ ID NO: 51479 - DNA, 20 bp, Artificial sequence
  SiRNA target sequence
aaggtacgtaatgtttccca

SEQ ID NO: 51480 - DNA, 20 bp, Artificial sequence
  SiRNA target sequence
aggtacgtaatgtttcccat

SEQ ID NO: 51481 - DNA, 20 bp, Artificial sequence
  SiRNA target sequence
ggtacgtaatgtttcccata

SEQ ID NO: 51482 - DNA, 20 bp, Artificial sequence
  SiRNA target sequence
gtacgtaatgtttcccatat

SEQ ID NO: 51483 - DNA, 20 bp, Artificial sequence
  SiRNA target sequence
tacgtaatgtttcccatatt

SEQ ID NO: 51484 - DNA, 20 bp, Artificial sequence
  SiRNA target sequence
acgtaatgtttcccatatta

SEQ ID NO: 51485 - DNA, 20 bp, Artificial sequence
  SiRNA target sequence
cgtaatgtttcccatattac

SEQ ID NO: 51486 - DNA, 20 bp, Artificial sequence
  SiRNA target sequence
gtaatgtttcccatattact

SEQ ID NO: 51487 - DNA, 20 bp, Artificial sequence
  SiRNA target sequence
taatgtttcccatattactg

SEQ ID NO: 51488 - DNA, 20 bp, Artificial sequence
  SiRNA target sequence
aatgtttcccatattactgt

SEQ ID NO: 51489 - DNA, 20 bp, Artificial sequence
  SiRNA target sequence
atgtttcccatattactgtc

SEQ ID NO: 51490 - DNA, 20 bp, Artificial sequence
  SiRNA target sequence
tgtttcccatattactgtct

SEQ ID NO: 51491 - DNA, 20 bp, Artificial sequence
  SiRNA target sequence
gtttcccatattactgtcta

SEQ ID NO: 51492 - DNA, 20 bp, Artificial sequence
  SiRNA target sequence
tttcccatattactgtctac

SEQ ID NO: 51493 - DNA, 20 bp, Artificial sequence
  SiRNA target sequence
ttcccatattactgtctaca

SEQ ID NO: 51494 - DNA, 20 bp, Artificial sequence
  SiRNA target sequence
tcccatattactgtctacaa

SEQ ID NO: 51495 - DNA, 20 bp, Artificial sequence
  SiRNA target sequence
cccatattactgtctacaat

SEQ ID NO: 51496 - DNA, 20 bp, Artificial sequence
  SiRNA target sequence
ccatattactgtctacaatt

SEQ ID NO: 51497 - DNA, 20 bp, Artificial sequence
  SiRNA target sequence
catattactgtctacaatta

SEQ ID NO: 51498 - DNA, 20 bp, Artificial sequence
  SiRNA target sequence
atattactgtctacaattat

SEQ ID NO: 51499 - DNA, 20 bp, Artificial sequence
  SiRNA target sequence
tattactgtctacaattata

SEQ ID NO: 51500 - DNA, 20 bp, Artificial sequence
  SiRNA target sequence
attactgtctacaattatag

SEQ ID NO: 51501 - DNA, 20 bp, Artificial sequence
  SiRNA target sequence
ttactgtctacaattatagc

SEQ ID NO: 51502 - DNA, 20 bp, Artificial sequence
  SiRNA target sequence
tactgtctacaattatagct

SEQ ID NO: 51503 - DNA, 20 bp, Artificial sequence
  SiRNA target sequence
actgtctacaattatagctt

SEQ ID NO: 51504 - DNA, 20 bp, Artificial sequence
  SiRNA target sequence
ctgtctacaattatagcttg

SEQ ID NO: 51505 - DNA, 20 bp, Artificial sequence
  SiRNA target sequence
tgtctacaattatagcttgt

SEQ ID NO: 51506 - DNA, 20 bp, Artificial sequence
  SiRNA target sequence
gtctacaattatagcttgtt

SEQ ID NO: 51507 - DNA, 20 bp, Artificial sequence
  SiRNA target sequence
tctacaattatagcttgtta

SEQ ID NO: 51508 - DNA, 20 bp, Artificial sequence
  SiRNA target sequence
ctacaattatagcttgttat

SEQ ID NO: 51509 - DNA, 20 bp, Artificial sequence
  SiRNA target sequence
tacaattatagcttgttatc

SEQ ID NO: 51510 - DNA, 20 bp, Artificial sequence
  SiRNA target sequence
acaattatagcttgttatct

SEQ ID NO: 51511 - DNA, 20 bp, Artificial sequence
  SiRNA target sequence
caattatagcttgttatctc

SEQ ID NO: 51512 - DNA, 20 bp, Artificial sequence
  SiRNA target sequence
aattatagcttgttatctcg

SEQ ID NO: 51513 - DNA, 20 bp, Artificial sequence
  SiRNA target sequence
attatagcttgttatctcga

SEQ ID NO: 51514 - DNA, 20 bp, Artificial sequence
  SiRNA target sequence
ttatagcttgttatctcgaa

SEQ ID NO: 51515 - DNA, 20 bp, Artificial sequence
  SiRNA target sequence
tatagcttgttatctcgaag

SEQ ID NO: 51516 - DNA, 20 bp, Artificial sequence
  SiRNA target sequence
atagcttgttatctcgaagt

SEQ ID NO: 51517 - DNA, 20 bp, Artificial sequence
  SiRNA target sequence
tagcttgttatctcgaagtt

SEQ ID NO: 51518 - DNA, 20 bp, Artificial sequence
  SiRNA target sequence
agcttgttatctcgaagttc

SEQ ID NO: 51519 - DNA, 20 bp, Artificial sequence
  SiRNA target sequence
gcttgttatctcgaagttca

SEQ ID NO: 51520 - DNA, 20 bp, Artificial sequence
  SiRNA target sequence
cttgttatctcgaagttcag

SEQ ID NO: 51521 - DNA, 20 bp, Artificial sequence
  SiRNA target sequence
ttgttatctcgaagttcagg

SEQ ID NO: 51522 - DNA, 20 bp, Artificial sequence
  SiRNA target sequence
tgttatctcgaagttcaggc

SEQ ID NO: 51523 - DNA, 20 bp, Artificial sequence
  SiRNA target sequence
gttatctcgaagttcaggca

SEQ ID NO: 51524 - DNA, 20 bp, Artificial sequence
  SiRNA target sequence
ttatctcgaagttcaggcaa

SEQ ID NO: 51525 - DNA, 20 bp, Artificial sequence
  SiRNA target sequence
tatctcgaagttcaggcaag

SEQ ID NO: 51526 - DNA, 20 bp, Artificial sequence
  SiRNA target sequence
atctcgaagttcaggcaagt

SEQ ID NO: 51527 - DNA, 20 bp, Artificial sequence
  SiRNA target sequence
tctcgaagttcaggcaagta

SEQ ID NO: 51528 - DNA, 20 bp, Artificial sequence
  SiRNA target sequence
ctcgaagttcaggcaagtaa

SEQ ID NO: 51529 - DNA, 20 bp, Artificial sequence
  SiRNA target sequence
tcgaagttcaggcaagtaac

SEQ ID NO: 51530 - DNA, 20 bp, Artificial sequence
  SiRNA target sequence
cgaagttcaggcaagtaaca

SEQ ID NO: 51531 - DNA, 20 bp, Artificial sequence
  SiRNA target sequence
gaagttcaggcaagtaacat

SEQ ID NO: 51532 - DNA, 20 bp, Artificial sequence
  SiRNA target sequence
aagttcaggcaagtaacata

SEQ ID NO: 51533 - DNA, 20 bp, Artificial sequence
  SiRNA target sequence
agttcaggcaagtaacatat

SEQ ID NO: 51534 - DNA, 20 bp, Artificial sequence
  SiRNA target sequence
gttcaggcaagtaacatatc

SEQ ID NO: 51535 - DNA, 20 bp, Artificial sequence
  SiRNA target sequence
ttcaggcaagtaacatatca

SEQ ID NO: 51536 - DNA, 20 bp, Artificial sequence
  SiRNA target sequence
tcaggcaagtaacatatcaa

SEQ ID NO: 51537 - DNA, 20 bp, Artificial sequence
  SiRNA target sequence
caggcaagtaacatatcaaa

SEQ ID NO: 51538 - DNA, 20 bp, Artificial sequence
  SiRNA target sequence
aggcaagtaacatatcaaaa

SEQ ID NO: 51539 - DNA, 20 bp, Artificial sequence
  SiRNA target sequence
ggcaagtaacatatcaaaaa

SEQ ID NO: 51540 - DNA, 20 bp, Artificial sequence
  SiRNA target sequence
gcaagtaacatatcaaaaag

SEQ ID NO: 51541 - DNA, 20 bp, Artificial sequence
  SiRNA target sequence
caagtaacatatcaaaaaga

SEQ ID NO: 51542 - DNA, 20 bp, Artificial sequence
  SiRNA target sequence
aagtaacatatcaaaaagaa

SEQ ID NO: 51543 - DNA, 20 bp, Artificial sequence
  SiRNA target sequence
agtaacatatcaaaaagaat

SEQ ID NO: 51544 - DNA, 20 bp, Artificial sequence
  SiRNA target sequence
gtaacatatcaaaaagaatt

SEQ ID NO: 51545 - DNA, 20 bp, Artificial sequence
  SiRNA target sequence
taacatatcaaaaagaattg

SEQ ID NO: 51546 - DNA, 20 bp, Artificial sequence
  SiRNA target sequence
aacatatcaaaaagaattgc

SEQ ID NO: 51547 - DNA, 20 bp, Artificial sequence
  SiRNA target sequence
acatatcaaaaagaattgca

SEQ ID NO: 51548 - DNA, 20 bp, Artificial sequence
  SiRNA target sequence
catatcaaaaagaattgcag

SEQ ID NO: 51549 - DNA, 20 bp, Artificial sequence
  SiRNA target sequence
atatcaaaaagaattgcaga

SEQ ID NO: 51550 - DNA, 20 bp, Artificial sequence
  SiRNA target sequence
tatcaaaaagaattgcagaa

SEQ ID NO: 51551 - DNA, 20 bp, Artificial sequence
  SiRNA target sequence
atcaaaaagaattgcagaag

SEQ ID NO: 51552 - DNA, 20 bp, Artificial sequence
  SiRNA target sequence
tcaaaaagaattgcagaaga

SEQ ID NO: 51553 - DNA, 20 bp, Artificial sequence
  SiRNA target sequence
caaaaagaattgcagaagat

SEQ ID NO: 51554 - DNA, 20 bp, Artificial sequence
  SiRNA target sequence
aaaaagaattgcagaagatt

SEQ ID NO: 51555 - DNA, 20 bp, Artificial sequence
  SiRNA target sequence
aaaagaattgcagaagattt

SEQ ID NO: 51556 - DNA, 20 bp, Artificial sequence
  SiRNA target sequence
aaagaattgcagaagatttt

SEQ ID NO: 51557 - DNA, 20 bp, Artificial sequence
  SiRNA target sequence
aagaattgcagaagattttg

SEQ ID NO: 51558 - DNA, 20 bp, Artificial sequence
  SiRNA target sequence
agaattgcagaagattttga

SEQ ID NO: 51559 - DNA, 20 bp, Artificial sequence
  SiRNA target sequence
gaattgcagaagattttgaa

SEQ ID NO: 51560 - DNA, 20 bp, Artificial sequence
  SiRNA target sequence
aattgcagaagattttgaaa

SEQ ID NO: 51561 - DNA, 20 bp, Artificial sequence
  SiRNA target sequence
attgcagaagattttgaaaa

SEQ ID NO: 51562 - DNA, 20 bp, Artificial sequence
  SiRNA target sequence
ttgcagaagattttgaaaat

SEQ ID NO: 51563 - DNA, 20 bp, Artificial sequence
  SiRNA target sequence
tgcagaagattttgaaaata

SEQ ID NO: 51564 - DNA, 20 bp, Artificial sequence
  SiRNA target sequence
gcagaagattttgaaaataa

SEQ ID NO: 51565 - DNA, 20 bp, Artificial sequence
  SiRNA target sequence
cagaagattttgaaaataaa

SEQ ID NO: 51566 - DNA, 20 bp, Artificial sequence
  SiRNA target sequence
agaagattttgaaaataaaa

SEQ ID NO: 51567 - DNA, 20 bp, Artificial sequence
  SiRNA target sequence
gaagattttgaaaataaaat

SEQ ID NO: 51568 - DNA, 20 bp, Artificial sequence
  SiRNA target sequence
aagattttgaaaataaaata

SEQ ID NO: 51569 - DNA, 20 bp, Artificial sequence
  SiRNA target sequence
agattttgaaaataaaataa

SEQ ID NO: 51570 - DNA, 20 bp, Artificial sequence
  SiRNA target sequence
gattttgaaaataaaataaa

SEQ ID NO: 51571 - DNA, 20 bp, Artificial sequence
  SiRNA target sequence
attttgaaaataaaataaat

SEQ ID NO: 51572 - DNA, 20 bp, Artificial sequence
  SiRNA target sequence
ttttgaaaataaaataaatg

SEQ ID NO: 51573 - DNA, 20 bp, Artificial sequence
  SiRNA target sequence
tttgaaaataaaataaatgc

SEQ ID NO: 51574 - DNA, 20 bp, Artificial sequence
  SiRNA target sequence
ttgaaaataaaataaatgca

SEQ ID NO: 51575 - DNA, 20 bp, Artificial sequence
  SiRNA target sequence
tgaaaataaaataaatgcag

SEQ ID NO: 51576 - DNA, 20 bp, Artificial sequence
  SiRNA target sequence
gaaaataaaataaatgcagg

SEQ ID NO: 51577 - DNA, 20 bp, Artificial sequence
  SiRNA target sequence
aaaataaaataaatgcagga

SEQ ID NO: 51578 - DNA, 20 bp, Artificial sequence
  SiRNA target sequence
aaataaaataaatgcaggaa

SEQ ID NO: 51579 - DNA, 20 bp, Artificial sequence
  SiRNA target sequence
aataaaataaatgcaggaaa

SEQ ID NO: 51580 - DNA, 20 bp, Artificial sequence
  SiRNA target sequence
ataaaataaatgcaggaaaa

SEQ ID NO: 51581 - DNA, 20 bp, Artificial sequence
  SiRNA target sequence
taaaataaatgcaggaaaaa

SEQ ID NO: 51582 - DNA, 20 bp, Artificial sequence
  SiRNA target sequence
aaaataaatgcaggaaaaag

SEQ ID NO: 51583 - DNA, 20 bp, Artificial sequence
  SiRNA target sequence
aaataaatgcaggaaaaagt

SEQ ID NO: 51584 - DNA, 20 bp, Artificial sequence
  SiRNA target sequence
aataaatgcaggaaaaagta

SEQ ID NO: 51585 - DNA, 20 bp, Artificial sequence
  SiRNA target sequence
ataaatgcaggaaaaagtat

SEQ ID NO: 51586 - DNA, 20 bp, Artificial sequence
  SiRNA target sequence
taaatgcaggaaaaagtata

SEQ ID NO: 51587 - DNA, 20 bp, Artificial sequence
  SiRNA target sequence
aaatgcaggaaaaagtatat

SEQ ID NO: 51588 - DNA, 20 bp, Artificial sequence
  SiRNA target sequence
aatgcaggaaaaagtatatt

SEQ ID NO: 51589 - DNA, 20 bp, Artificial sequence
  SiRNA target sequence
atgcaggaaaaagtatattt

SEQ ID NO: 51590 - DNA, 20 bp, Artificial sequence
  SiRNA target sequence
tgcaggaaaaagtatattta

SEQ ID NO: 51591 - DNA, 20 bp, Artificial sequence
  SiRNA target sequence
gcaggaaaaagtatatttaa

SEQ ID NO: 51592 - DNA, 20 bp, Artificial sequence
  SiRNA target sequence
caggaaaaagtatatttaaa

SEQ ID NO: 51593 - DNA, 20 bp, Artificial sequence
  SiRNA target sequence
aggaaaaagtatatttaaat

SEQ ID NO: 51594 - DNA, 20 bp, Artificial sequence
  SiRNA target sequence
ggaaaaagtatatttaaata

SEQ ID NO: 51595 - DNA, 20 bp, Artificial sequence
  SiRNA target sequence
gaaaaagtatatttaaatat

SEQ ID NO: 51596 - DNA, 20 bp, Artificial sequence
  SiRNA target sequence
aaaaagtatatttaaatata

SEQ ID NO: 51597 - DNA, 20 bp, Artificial sequence
  SiRNA target sequence
aaaagtatatttaaatatat

SEQ ID NO: 51598 - DNA, 20 bp, Artificial sequence
  SiRNA target sequence
aaagtatatttaaatatatt

SEQ ID NO: 51599 - DNA, 20 bp, Artificial sequence
  SiRNA target sequence
aagtatatttaaatatattt

SEQ ID NO: 51600 - DNA, 20 bp, Artificial sequence
  SiRNA target sequence
agtatatttaaatatatttt

SEQ ID NO: 51601 - DNA, 20 bp, Artificial sequence
  SiRNA target sequence
gtatatttaaatatatttta

SEQ ID NO: 51602 - DNA, 20 bp, Artificial sequence
  SiRNA target sequence
tatatttaaatatattttat

SEQ ID NO: 51603 - DNA, 20 bp, Artificial sequence
  SiRNA target sequence
atatttaaatatattttatt

SEQ ID NO: 51604 - DNA, 20 bp, Artificial sequence
  SiRNA target sequence
tatttaaatatattttattt

SEQ ID NO: 51605 - DNA, 20 bp, Artificial sequence
  SiRNA target sequence
atttaaatatattttatttt

SEQ ID NO: 51606 - DNA, 20 bp, Artificial sequence
  SiRNA target sequence
tttaaatatattttattttt

SEQ ID NO: 51607 - DNA, 20 bp, Artificial sequence
  SiRNA target sequence
ttaaatatattttattttta

SEQ ID NO: 51608 - DNA, 20 bp, Artificial sequence
  SiRNA target sequence
taaatatattttatttttaa

SEQ ID NO: 51609 - DNA, 20 bp, Artificial sequence
  SiRNA target sequence
aaatatattttatttttaac

SEQ ID NO: 51610 - DNA, 20 bp, Artificial sequence
  SiRNA target sequence
aatatattttatttttaact

SEQ ID NO: 51611 - DNA, 20 bp, Artificial sequence
  SiRNA target sequence
atatattttatttttaactt

SEQ ID NO: 51612 - DNA, 20 bp, Artificial sequence
  SiRNA target sequence
tatattttatttttaacttc

SEQ ID NO: 51613 - DNA, 20 bp, Artificial sequence
  SiRNA target sequence
atattttatttttaacttca

SEQ ID NO: 51614 - DNA, 20 bp, Artificial sequence
  SiRNA target sequence
tattttatttttaacttcat

SEQ ID NO: 51615 - DNA, 20 bp, Artificial sequence
  SiRNA target sequence
attttatttttaacttcatc

SEQ ID NO: 51616 - DNA, 20 bp, Artificial sequence
  SiRNA target sequence
ttttatttttaacttcatca

SEQ ID NO: 51617 - DNA, 20 bp, Artificial sequence
  SiRNA target sequence
tttatttttaacttcatcaa

SEQ ID NO: 51618 - DNA, 20 bp, Artificial sequence
  SiRNA target sequence
ttatttttaacttcatcaat

SEQ ID NO: 51619 - DNA, 20 bp, Artificial sequence
  SiRNA target sequence
tatttttaacttcatcaata

SEQ ID NO: 51620 - DNA, 20 bp, Artificial sequence
  SiRNA target sequence
atttttaacttcatcaatag

SEQ ID NO: 51621 - DNA, 20 bp, Artificial sequence
  SiRNA target sequence
tttttaacttcatcaatagt

SEQ ID NO: 51622 - DNA, 20 bp, Artificial sequence
  SiRNA target sequence
ttttaacttcatcaatagta

SEQ ID NO: 51623 - DNA, 20 bp, Artificial sequence
  SiRNA target sequence
tttaacttcatcaatagtat

SEQ ID NO: 51624 - DNA, 20 bp, Artificial sequence
  SiRNA target sequence
ttaacttcatcaatagtatt

SEQ ID NO: 51625 - DNA, 20 bp, Artificial sequence
  SiRNA target sequence
taacttcatcaatagtatta

SEQ ID NO: 51626 - DNA, 20 bp, Artificial sequence
  SiRNA target sequence
aacttcatcaatagtattaa

SEQ ID NO: 51627 - DNA, 20 bp, Artificial sequence
  SiRNA target sequence
acttcatcaatagtattaag

SEQ ID NO: 51628 - DNA, 20 bp, Artificial sequence
  SiRNA target sequence
cttcatcaatagtattaaga

SEQ ID NO: 51629 - DNA, 20 bp, Artificial sequence
  SiRNA target sequence
ttcatcaatagtattaagac

SEQ ID NO: 51630 - DNA, 20 bp, Artificial sequence
  SiRNA target sequence
tcatcaatagtattaagaca

SEQ ID NO: 51631 - DNA, 20 bp, Artificial sequence
  SiRNA target sequence
catcaatagtattaagacaa

SEQ ID NO: 51632 - DNA, 20 bp, Artificial sequence
  SiRNA target sequence
atcaatagtattaagacaaa

SEQ ID NO: 51633 - DNA, 20 bp, Artificial sequence
  SiRNA target sequence
tcaatagtattaagacaaat

SEQ ID NO: 51634 - DNA, 20 bp, Artificial sequence
  SiRNA target sequence
caatagtattaagacaaatt

SEQ ID NO: 51635 - DNA, 20 bp, Artificial sequence
  SiRNA target sequence
aatagtattaagacaaatta

SEQ ID NO: 51636 - DNA, 20 bp, Artificial sequence
  SiRNA target sequence
atagtattaagacaaattaa

SEQ ID NO: 51637 - DNA, 20 bp, Artificial sequence
  SiRNA target sequence
tagtattaagacaaattaat

SEQ ID NO: 51638 - DNA, 20 bp, Artificial sequence
  SiRNA target sequence
agtattaagacaaattaatg

SEQ ID NO: 51639 - DNA, 20 bp, Artificial sequence
  SiRNA target sequence
gtattaagacaaattaatga

SEQ ID NO: 51640 - DNA, 20 bp, Artificial sequence
  SiRNA target sequence
tattaagacaaattaatgat

SEQ ID NO: 51641 - DNA, 20 bp, Artificial sequence
  SiRNA target sequence
attaagacaaattaatgata

SEQ ID NO: 51642 - DNA, 20 bp, Artificial sequence
  SiRNA target sequence
ttaagacaaattaatgatat

SEQ ID NO: 51643 - DNA, 20 bp, Artificial sequence
  SiRNA target sequence
taagacaaattaatgatatt

SEQ ID NO: 51644 - DNA, 20 bp, Artificial sequence
  SiRNA target sequence
aagacaaattaatgatattg

SEQ ID NO: 51645 - DNA, 20 bp, Artificial sequence
  SiRNA target sequence
agacaaattaatgatattgt

SEQ ID NO: 51646 - DNA, 20 bp, Artificial sequence
  SiRNA target sequence
gacaaattaatgatattgtg

SEQ ID NO: 51647 - DNA, 20 bp, Artificial sequence
  SiRNA target sequence
acaaattaatgatattgtgt

SEQ ID NO: 51648 - DNA, 20 bp, Artificial sequence
  SiRNA target sequence
caaattaatgatattgtgtt

SEQ ID NO: 51649 - DNA, 20 bp, Artificial sequence
  SiRNA target sequence
aaattaatgatattgtgttt

SEQ ID NO: 51650 - DNA, 20 bp, Artificial sequence
  SiRNA target sequence
aattaatgatattgtgttta

SEQ ID NO: 51651 - DNA, 20 bp, Artificial sequence
  SiRNA target sequence
attaatgatattgtgtttag

SEQ ID NO: 51652 - DNA, 20 bp, Artificial sequence
  SiRNA target sequence
ttaatgatattgtgtttagc

SEQ ID NO: 51653 - DNA, 20 bp, Artificial sequence
  SiRNA target sequence
taatgatattgtgtttagcg

SEQ ID NO: 51654 - DNA, 20 bp, Artificial sequence
  SiRNA target sequence
aatgatattgtgtttagcgg

SEQ ID NO: 51655 - DNA, 20 bp, Artificial sequence
  SiRNA target sequence
atgatattgtgtttagcggg

SEQ ID NO: 51656 - DNA, 20 bp, Artificial sequence
  SiRNA target sequence
tgatattgtgtttagcgggc

SEQ ID NO: 51657 - DNA, 20 bp, Artificial sequence
  SiRNA target sequence
gatattgtgtttagcgggcc

SEQ ID NO: 51658 - DNA, 20 bp, Artificial sequence
  SiRNA target sequence
atattgtgtttagcgggcca

SEQ ID NO: 51659 - DNA, 20 bp, Artificial sequence
  SiRNA target sequence
tattgtgtttagcgggccaa

SEQ ID NO: 51660 - DNA, 20 bp, Artificial sequence
  SiRNA target sequence
attgtgtttagcgggccaat

SEQ ID NO: 51661 - DNA, 20 bp, Artificial sequence
  SiRNA target sequence
ttgtgtttagcgggccaata

SEQ ID NO: 51662 - DNA, 20 bp, Artificial sequence
  SiRNA target sequence
tgtgtttagcgggccaatac

SEQ ID NO: 51663 - DNA, 20 bp, Artificial sequence
  SiRNA target sequence
gtgtttagcgggccaataca

SEQ ID NO: 51664 - DNA, 20 bp, Artificial sequence
  SiRNA target sequence
tgtttagcgggccaatacaa

SEQ ID NO: 51665 - DNA, 20 bp, Artificial sequence
  SiRNA target sequence
gtttagcgggccaatacaat

SEQ ID NO: 51666 - DNA, 20 bp, Artificial sequence
  SiRNA target sequence
tttagcgggccaatacaatt

SEQ ID NO: 51667 - DNA, 20 bp, Artificial sequence
  SiRNA target sequence
ttagcgggccaatacaattt

SEQ ID NO: 51668 - DNA, 20 bp, Artificial sequence
  SiRNA target sequence
tagcgggccaatacaatttt

SEQ ID NO: 51669 - DNA, 20 bp, Artificial sequence
  SiRNA target sequence
agcgggccaatacaattttt

SEQ ID NO: 51670 - DNA, 20 bp, Artificial sequence
  SiRNA target sequence
gcgggccaatacaattttta

SEQ ID NO: 51671 - DNA, 20 bp, Artificial sequence
  SiRNA target sequence
cgggccaatacaatttttat

SEQ ID NO: 51672 - DNA, 20 bp, Artificial sequence
  SiRNA target sequence
gggccaatacaatttttata

SEQ ID NO: 51673 - DNA, 20 bp, Artificial sequence
  SiRNA target sequence
ggccaatacaatttttatat

SEQ ID NO: 51674 - DNA, 20 bp, Artificial sequence
  SiRNA target sequence
gccaatacaatttttatata

SEQ ID NO: 51675 - DNA, 20 bp, Artificial sequence
  SiRNA target sequence
ccaatacaatttttatataa

SEQ ID NO: 51676 - DNA, 20 bp, Artificial sequence
  SiRNA target sequence
caatacaatttttatataaa

SEQ ID NO: 51677 - DNA, 20 bp, Artificial sequence
  SiRNA target sequence
aatacaatttttatataaaa

SEQ ID NO: 51678 - DNA, 20 bp, Artificial sequence
  SiRNA target sequence
atacaatttttatataaaat

SEQ ID NO: 51679 - DNA, 20 bp, Artificial sequence
  SiRNA target sequence
tacaatttttatataaaatt

SEQ ID NO: 51680 - DNA, 20 bp, Artificial sequence
  SiRNA target sequence
acaatttttatataaaattg

SEQ ID NO: 51681 - DNA, 20 bp, Artificial sequence
  SiRNA target sequence
caatttttatataaaattgt

SEQ ID NO: 51682 - DNA, 20 bp, Artificial sequence
  SiRNA target sequence
aatttttatataaaattgtt

SEQ ID NO: 51683 - DNA, 20 bp, Artificial sequence
  SiRNA target sequence
atttttatataaaattgttg

SEQ ID NO: 51684 - DNA, 20 bp, Artificial sequence
  SiRNA target sequence
tttttatataaaattgttgg

SEQ ID NO: 51685 - DNA, 20 bp, Artificial sequence
  SiRNA target sequence
ttttatataaaattgttgga

SEQ ID NO: 51686 - DNA, 20 bp, Artificial sequence
  SiRNA target sequence
tttatataaaattgttggag

SEQ ID NO: 51687 - DNA, 20 bp, Artificial sequence
  SiRNA target sequence
ttatataaaattgttggagt

SEQ ID NO: 51688 - DNA, 20 bp, Artificial sequence
  SiRNA target sequence
tatataaaattgttggagtt

SEQ ID NO: 51689 - DNA, 20 bp, Artificial sequence
  SiRNA target sequence
atataaaattgttggagttg

SEQ ID NO: 51690 - DNA, 20 bp, Artificial sequence
  SiRNA target sequence
tataaaattgttggagttga

SEQ ID NO: 51691 - DNA, 20 bp, Artificial sequence
  SiRNA target sequence
ataaaattgttggagttgaa

SEQ ID NO: 51692 - DNA, 20 bp, Artificial sequence
  SiRNA target sequence
taaaattgttggagttgaag

SEQ ID NO: 51693 - DNA, 20 bp, Artificial sequence
  SiRNA target sequence
aaaattgttggagttgaagc

SEQ ID NO: 51694 - DNA, 20 bp, Artificial sequence
  SiRNA target sequence
aaattgttggagttgaagca

SEQ ID NO: 51695 - DNA, 20 bp, Artificial sequence
  SiRNA target sequence
aattgttggagttgaagcat

SEQ ID NO: 51696 - DNA, 20 bp, Artificial sequence
  SiRNA target sequence
attgttggagttgaagcatt

SEQ ID NO: 51697 - DNA, 20 bp, Artificial sequence
  SiRNA target sequence
ttgttggagttgaagcattt

SEQ ID NO: 51698 - DNA, 20 bp, Artificial sequence
  SiRNA target sequence
tgttggagttgaagcatttt

SEQ ID NO: 51699 - DNA, 20 bp, Artificial sequence
  SiRNA target sequence
gttggagttgaagcatttta

SEQ ID NO: 51700 - DNA, 20 bp, Artificial sequence
  SiRNA target sequence
ttggagttgaagcattttat

SEQ ID NO: 51701 - DNA, 20 bp, Artificial sequence
  SiRNA target sequence
tggagttgaagcattttatc

SEQ ID NO: 51702 - DNA, 20 bp, Artificial sequence
  SiRNA target sequence
ggagttgaagcattttatca

SEQ ID NO: 51703 - DNA, 20 bp, Artificial sequence
  SiRNA target sequence
gagttgaagcattttatcat

SEQ ID NO: 51704 - DNA, 20 bp, Artificial sequence
  SiRNA target sequence
agttgaagcattttatcatt

SEQ ID NO: 51705 - DNA, 20 bp, Artificial sequence
  SiRNA target sequence
gttgaagcattttatcatta

SEQ ID NO: 51706 - DNA, 20 bp, Artificial sequence
  SiRNA target sequence
ttgaagcattttatcattac

SEQ ID NO: 51707 - DNA, 20 bp, Artificial sequence
  SiRNA target sequence
tgaagcattttatcattaca

SEQ ID NO: 51708 - DNA, 20 bp, Artificial sequence
  SiRNA target sequence
gaagcattttatcattacat

SEQ ID NO: 51709 - DNA, 20 bp, Artificial sequence
  SiRNA target sequence
aagcattttatcattacatt

SEQ ID NO: 51710 - DNA, 20 bp, Artificial sequence
  SiRNA target sequence
agcattttatcattacattt

SEQ ID NO: 51711 - DNA, 20 bp, Artificial sequence
  SiRNA target sequence
gcattttatcattacatttc

SEQ ID NO: 51712 - DNA, 20 bp, Artificial sequence
  SiRNA target sequence
cattttatcattacatttca

SEQ ID NO: 51713 - DNA, 20 bp, Artificial sequence
  SiRNA target sequence
attttatcattacatttcat

SEQ ID NO: 51714 - DNA, 20 bp, Artificial sequence
  SiRNA target sequence
ttttatcattacatttcatt

SEQ ID NO: 51715 - DNA, 20 bp, Artificial sequence
  SiRNA target sequence
tttatcattacatttcatta

SEQ ID NO: 51716 - DNA, 20 bp, Artificial sequence
  SiRNA target sequence
ttatcattacatttcattaa

SEQ ID NO: 51717 - DNA, 20 bp, Artificial sequence
  SiRNA target sequence
tatcattacatttcattaaa

SEQ ID NO: 51718 - DNA, 20 bp, Artificial sequence
  SiRNA target sequence
atcattacatttcattaaac

SEQ ID NO: 51719 - DNA, 20 bp, Artificial sequence
  SiRNA target sequence
tcattacatttcattaaact

SEQ ID NO: 51720 - DNA, 20 bp, Artificial sequence
  SiRNA target sequence
cattacatttcattaaactt

SEQ ID NO: 51721 - DNA, 20 bp, Artificial sequence
  SiRNA target sequence
attacatttcattaaactta

SEQ ID NO: 51722 - DNA, 20 bp, Artificial sequence
  SiRNA target sequence
ttacatttcattaaacttag

SEQ ID NO: 51723 - DNA, 20 bp, Artificial sequence
  SiRNA target sequence
tacatttcattaaacttaga

SEQ ID NO: 51724 - DNA, 20 bp, Artificial sequence
  SiRNA target sequence
acatttcattaaacttagaa

SEQ ID NO: 51725 - DNA, 20 bp, Artificial sequence
  SiRNA target sequence
catttcattaaacttagaaa

SEQ ID NO: 51726 - DNA, 20 bp, Artificial sequence
  SiRNA target sequence
atttcattaaacttagaaaa

SEQ ID NO: 51727 - DNA, 20 bp, Artificial sequence
  SiRNA target sequence
tttcattaaacttagaaaat

SEQ ID NO: 51728 - DNA, 20 bp, Artificial sequence
  SiRNA target sequence
ttcattaaacttagaaaatt

SEQ ID NO: 51729 - DNA, 20 bp, Artificial sequence
  SiRNA target sequence
tcattaaacttagaaaattt

SEQ ID NO: 51730 - DNA, 20 bp, Artificial sequence
  SiRNA target sequence
cattaaacttagaaaatttt

SEQ ID NO: 51731 - DNA, 20 bp, Artificial sequence
  SiRNA target sequence
attaaacttagaaaatttta

SEQ ID NO: 51732 - DNA, 20 bp, Artificial sequence
  SiRNA target sequence
ttaaacttagaaaattttaa

SEQ ID NO: 51733 - DNA, 20 bp, Artificial sequence
  SiRNA target sequence
taaacttagaaaattttaac

SEQ ID NO: 51734 - DNA, 20 bp, Artificial sequence
  SiRNA target sequence
aaacttagaaaattttaaca

SEQ ID NO: 51735 - DNA, 20 bp, Artificial sequence
  SiRNA target sequence
aacttagaaaattttaacaa

SEQ ID NO: 51736 - DNA, 20 bp, Artificial sequence
  SiRNA target sequence
acttagaaaattttaacaaa

SEQ ID NO: 51737 - DNA, 20 bp, Artificial sequence
  SiRNA target sequence
cttagaaaattttaacaaaa

SEQ ID NO: 51738 - DNA, 20 bp, Artificial sequence
  SiRNA target sequence
ttagaaaattttaacaaaat

SEQ ID NO: 51739 - DNA, 20 bp, Artificial sequence
  SiRNA target sequence
tagaaaattttaacaaaata

SEQ ID NO: 51740 - DNA, 20 bp, Artificial sequence
  SiRNA target sequence
agaaaattttaacaaaatag

SEQ ID NO: 51741 - DNA, 20 bp, Artificial sequence
  SiRNA target sequence
gaaaattttaacaaaatagg

SEQ ID NO: 51742 - DNA, 20 bp, Artificial sequence
  SiRNA target sequence
aaaattttaacaaaatagga

SEQ ID NO: 51743 - DNA, 20 bp, Artificial sequence
  SiRNA target sequence
aaattttaacaaaataggaa

SEQ ID NO: 51744 - DNA, 20 bp, Artificial sequence
  SiRNA target sequence
aattttaacaaaataggaag

SEQ ID NO: 51745 - DNA, 20 bp, Artificial sequence
  SiRNA target sequence
attttaacaaaataggaagt

SEQ ID NO: 51746 - DNA, 20 bp, Artificial sequence
  SiRNA target sequence
ttttaacaaaataggaagtg

SEQ ID NO: 51747 - DNA, 20 bp, Artificial sequence
  SiRNA target sequence
tttaacaaaataggaagtgg

SEQ ID NO: 51748 - DNA, 20 bp, Artificial sequence
  SiRNA target sequence
ttaacaaaataggaagtgga

SEQ ID NO: 51749 - DNA, 20 bp, Artificial sequence
  SiRNA target sequence
taacaaaataggaagtggag

SEQ ID NO: 51750 - DNA, 20 bp, Artificial sequence
  SiRNA target sequence
aacaaaataggaagtggaga

SEQ ID NO: 51751 - DNA, 20 bp, Artificial sequence
  SiRNA target sequence
acaaaataggaagtggagag

SEQ ID NO: 51752 - DNA, 20 bp, Artificial sequence
  SiRNA target sequence
caaaataggaagtggagaga

SEQ ID NO: 51753 - DNA, 20 bp, Artificial sequence
  SiRNA target sequence
aaaataggaagtggagagat

SEQ ID NO: 51754 - DNA, 20 bp, Artificial sequence
  SiRNA target sequence
aaataggaagtggagagata

SEQ ID NO: 51755 - DNA, 20 bp, Artificial sequence
  SiRNA target sequence
aataggaagtggagagatac

SEQ ID NO: 51756 - DNA, 20 bp, Artificial sequence
  SiRNA target sequence
ataggaagtggagagataca

SEQ ID NO: 51757 - DNA, 20 bp, Artificial sequence
  SiRNA target sequence
taggaagtggagagatacaa

SEQ ID NO: 51758 - DNA, 20 bp, Artificial sequence
  SiRNA target sequence
aggaagtggagagatacaaa

SEQ ID NO: 51759 - DNA, 20 bp, Artificial sequence
  SiRNA target sequence
ggaagtggagagatacaaat

SEQ ID NO: 51760 - DNA, 20 bp, Artificial sequence
  SiRNA target sequence
gaagtggagagatacaaatg

SEQ ID NO: 51761 - DNA, 20 bp, Artificial sequence
  SiRNA target sequence
aagtggagagatacaaatga

SEQ ID NO: 51762 - DNA, 20 bp, Artificial sequence
  SiRNA target sequence
agtggagagatacaaatgat

SEQ ID NO: 51763 - DNA, 20 bp, Artificial sequence
  SiRNA target sequence
gtggagagatacaaatgatt

SEQ ID NO: 51764 - DNA, 20 bp, Artificial sequence
  SiRNA target sequence
tggagagatacaaatgatta

SEQ ID NO: 51765 - DNA, 20 bp, Artificial sequence
  SiRNA target sequence
ggagagatacaaatgattat

SEQ ID NO: 51766 - DNA, 20 bp, Artificial sequence
  SiRNA target sequence
gagagatacaaatgattatt

SEQ ID NO: 51767 - DNA, 20 bp, Artificial sequence
  SiRNA target sequence
agagatacaaatgattattg

SEQ ID NO: 51768 - DNA, 20 bp, Artificial sequence
  SiRNA target sequence
gagatacaaatgattattga

SEQ ID NO: 51769 - DNA, 20 bp, Artificial sequence
  SiRNA target sequence
agatacaaatgattattgag

SEQ ID NO: 51770 - DNA, 20 bp, Artificial sequence
  SiRNA target sequence
gatacaaatgattattgagc

SEQ ID NO: 51771 - DNA, 20 bp, Artificial sequence
  SiRNA target sequence
atacaaatgattattgagcg

SEQ ID NO: 51772 - DNA, 20 bp, Artificial sequence
  SiRNA target sequence
tacaaatgattattgagcgg

SEQ ID NO: 51773 - DNA, 20 bp, Artificial sequence
  SiRNA target sequence
acaaatgattattgagcgga

SEQ ID NO: 51774 - DNA, 20 bp, Artificial sequence
  SiRNA target sequence
caaatgattattgagcggaa

SEQ ID NO: 51775 - DNA, 20 bp, Artificial sequence
  SiRNA target sequence
aaatgattattgagcggaaa

SEQ ID NO: 51776 - DNA, 20 bp, Artificial sequence
  SiRNA target sequence
aatgattattgagcggaaaa

SEQ ID NO: 51777 - DNA, 20 bp, Artificial sequence
  SiRNA target sequence
atgattattgagcggaaaag

SEQ ID NO: 51778 - DNA, 20 bp, Artificial sequence
  SiRNA target sequence
tgattattgagcggaaaagt

SEQ ID NO: 51779 - DNA, 20 bp, Artificial sequence
  SiRNA target sequence
gattattgagcggaaaagta

SEQ ID NO: 51780 - DNA, 20 bp, Artificial sequence
  SiRNA target sequence
attattgagcggaaaagtag

SEQ ID NO: 51781 - DNA, 20 bp, Artificial sequence
  SiRNA target sequence
ttattgagcggaaaagtaga

SEQ ID NO: 51782 - DNA, 20 bp, Artificial sequence
  SiRNA target sequence
tattgagcggaaaagtagag

SEQ ID NO: 51783 - DNA, 20 bp, Artificial sequence
  SiRNA target sequence
attgagcggaaaagtagagc

SEQ ID NO: 51784 - DNA, 20 bp, Artificial sequence
  SiRNA target sequence
ttgagcggaaaagtagagca

SEQ ID NO: 51785 - DNA, 20 bp, Artificial sequence
  SiRNA target sequence
tgagcggaaaagtagagcat

SEQ ID NO: 51786 - DNA, 20 bp, Artificial sequence
  SiRNA target sequence
gagcggaaaagtagagcata

SEQ ID NO: 51787 - DNA, 20 bp, Artificial sequence
  SiRNA target sequence
agcggaaaagtagagcatat

SEQ ID NO: 51788 - DNA, 20 bp, Artificial sequence
  SiRNA target sequence
gcggaaaagtagagcatatg

SEQ ID NO: 51789 - DNA, 20 bp, Artificial sequence
  SiRNA target sequence
cggaaaagtagagcatatgg

SEQ ID NO: 51790 - DNA, 20 bp, Artificial sequence
  SiRNA target sequence
ggaaaagtagagcatatggt

SEQ ID NO: 51791 - DNA, 20 bp, Artificial sequence
  SiRNA target sequence
gaaaagtagagcatatggtg

SEQ ID NO: 51792 - DNA, 20 bp, Artificial sequence
  SiRNA target sequence
aaaagtagagcatatggtga

SEQ ID NO: 51793 - DNA, 20 bp, Artificial sequence
  SiRNA target sequence
aaagtagagcatatggtgac

SEQ ID NO: 51794 - DNA, 20 bp, Artificial sequence
  SiRNA target sequence
aagtagagcatatggtgaca

SEQ ID NO: 51795 - DNA, 20 bp, Artificial sequence
  SiRNA target sequence
agtagagcatatggtgacat

SEQ ID NO: 51796 - DNA, 20 bp, Artificial sequence
  SiRNA target sequence
gtagagcatatggtgacata

SEQ ID NO: 51797 - DNA, 20 bp, Artificial sequence
  SiRNA target sequence
tagagcatatggtgacatac

SEQ ID NO: 51798 - DNA, 20 bp, Artificial sequence
  SiRNA target sequence
agagcatatggtgacatact

SEQ ID NO: 51799 - DNA, 20 bp, Artificial sequence
  SiRNA target sequence
gagcatatggtgacatacta

SEQ ID NO: 51800 - DNA, 20 bp, Artificial sequence
  SiRNA target sequence
agcatatggtgacatactag

SEQ ID NO: 51801 - DNA, 20 bp, Artificial sequence
  SiRNA target sequence
gcatatggtgacatactaga

SEQ ID NO: 51802 - DNA, 20 bp, Artificial sequence
  SiRNA target sequence
catatggtgacatactagaa

SEQ ID NO: 51803 - DNA, 20 bp, Artificial sequence
  SiRNA target sequence
atatggtgacatactagaac

SEQ ID NO: 51804 - DNA, 20 bp, Artificial sequence
  SiRNA target sequence
tatggtgacatactagaact

SEQ ID NO: 51805 - DNA, 20 bp, Artificial sequence
  SiRNA target sequence
atggtgacatactagaacta

SEQ ID NO: 51806 - DNA, 20 bp, Artificial sequence
  SiRNA target sequence
tggtgacatactagaactaa

SEQ ID NO: 51807 - DNA, 20 bp, Artificial sequence
  SiRNA target sequence
ggtgacatactagaactaac

SEQ ID NO: 51808 - DNA, 20 bp, Artificial sequence
  SiRNA target sequence
gtgacatactagaactaact

SEQ ID NO: 51809 - DNA, 20 bp, Artificial sequence
  SiRNA target sequence
tgacatactagaactaacta

SEQ ID NO: 51810 - DNA, 20 bp, Artificial sequence
  SiRNA target sequence
gacatactagaactaactac

SEQ ID NO: 51811 - DNA, 20 bp, Artificial sequence
  SiRNA target sequence
acatactagaactaactact

SEQ ID NO: 51812 - DNA, 20 bp, Artificial sequence
  SiRNA target sequence
catactagaactaactactc

SEQ ID NO: 51813 - DNA, 20 bp, Artificial sequence
  SiRNA target sequence
atactagaactaactactct

SEQ ID NO: 51814 - DNA, 20 bp, Artificial sequence
  SiRNA target sequence
tactagaactaactactctc

SEQ ID NO: 51815 - DNA, 20 bp, Artificial sequence
  SiRNA target sequence
actagaactaactactctct

SEQ ID NO: 51816 - DNA, 20 bp, Artificial sequence
  SiRNA target sequence
ctagaactaactactctctc

SEQ ID NO: 51817 - DNA, 20 bp, Artificial sequence
  SiRNA target sequence
tagaactaactactctctcg

SEQ ID NO: 51818 - DNA, 20 bp, Artificial sequence
  SiRNA target sequence
agaactaactactctctcgg

SEQ ID NO: 51819 - DNA, 20 bp, Artificial sequence
  SiRNA target sequence
gaactaactactctctcggc

SEQ ID NO: 51820 - DNA, 20 bp, Artificial sequence
  SiRNA target sequence
aactaactactctctcggcc

SEQ ID NO: 51821 - DNA, 20 bp, Artificial sequence
  SiRNA target sequence
actaactactctctcggccg

SEQ ID NO: 51822 - DNA, 20 bp, Artificial sequence
  SiRNA target sequence
ctaactactctctcggccgt

SEQ ID NO: 51823 - DNA, 20 bp, Artificial sequence
  SiRNA target sequence
taactactctctcggccgta

SEQ ID NO: 51824 - DNA, 20 bp, Artificial sequence
  SiRNA target sequence
aactactctctcggccgtac

SEQ ID NO: 51825 - DNA, 20 bp, Artificial sequence
  SiRNA target sequence
actactctctcggccgtacc

SEQ ID NO: 51826 - DNA, 20 bp, Artificial sequence
  SiRNA target sequence
ctactctctcggccgtacca

SEQ ID NO: 51827 - DNA, 20 bp, Artificial sequence
  SiRNA target sequence
tactctctcggccgtaccaa

SEQ ID NO: 51828 - DNA, 20 bp, Artificial sequence
  SiRNA target sequence
actctctcggccgtaccaac

SEQ ID NO: 51829 - DNA, 20 bp, Artificial sequence
  SiRNA target sequence
ctctctcggccgtaccaacc

SEQ ID NO: 51830 - DNA, 20 bp, Artificial sequence
  SiRNA target sequence
tctctcggccgtaccaacct

SEQ ID NO: 51831 - DNA, 20 bp, Artificial sequence
  SiRNA target sequence
ctctcggccgtaccaacctg

SEQ ID NO: 51832 - DNA, 20 bp, Artificial sequence
  SiRNA target sequence
tctcggccgtaccaacctgt

SEQ ID NO: 51833 - DNA, 20 bp, Artificial sequence
  SiRNA target sequence
ctcggccgtaccaacctgta

SEQ ID NO: 51834 - DNA, 20 bp, Artificial sequence
  SiRNA target sequence
tcggccgtaccaacctgtat

SEQ ID NO: 51835 - DNA, 20 bp, Artificial sequence
  SiRNA target sequence
cggccgtaccaacctgtatt

SEQ ID NO: 51836 - DNA, 20 bp, Artificial sequence
  SiRNA target sequence
ggccgtaccaacctgtattg

SEQ ID NO: 51837 - DNA, 20 bp, Artificial sequence
  SiRNA target sequence
gccgtaccaacctgtattgt

SEQ ID NO: 51838 - DNA, 20 bp, Artificial sequence
  SiRNA target sequence
ccgtaccaacctgtattgta

SEQ ID NO: 51839 - DNA, 20 bp, Artificial sequence
  SiRNA target sequence
cgtaccaacctgtattgtag

SEQ ID NO: 51840 - DNA, 20 bp, Artificial sequence
  SiRNA target sequence
gtaccaacctgtattgtagt

SEQ ID NO: 51841 - DNA, 20 bp, Artificial sequence
  SiRNA target sequence
taccaacctgtattgtagtt

SEQ ID NO: 51842 - DNA, 20 bp, Artificial sequence
  SiRNA target sequence
accaacctgtattgtagtta

SEQ ID NO: 51843 - DNA, 20 bp, Artificial sequence
  SiRNA target sequence
ccaacctgtattgtagttat

SEQ ID NO: 51844 - DNA, 20 bp, Artificial sequence
  SiRNA target sequence
caacctgtattgtagttatt

SEQ ID NO: 51845 - DNA, 20 bp, Artificial sequence
  SiRNA target sequence
aacctgtattgtagttatta

SEQ ID NO: 51846 - DNA, 20 bp, Artificial sequence
  SiRNA target sequence
acctgtattgtagttattat

SEQ ID NO: 51847 - DNA, 20 bp, Artificial sequence
  SiRNA target sequence
cctgtattgtagttattatg

SEQ ID NO: 51848 - DNA, 20 bp, Artificial sequence
  SiRNA target sequence
ctgtattgtagttattatgt

SEQ ID NO: 51849 - DNA, 20 bp, Artificial sequence
  SiRNA target sequence
tgtattgtagttattatgtc

SEQ ID NO: 51850 - DNA, 20 bp, Artificial sequence
  SiRNA target sequence
gtattgtagttattatgtcg

SEQ ID NO: 51851 - DNA, 20 bp, Artificial sequence
  SiRNA target sequence
tattgtagttattatgtcgt

SEQ ID NO: 51852 - DNA, 20 bp, Artificial sequence
  SiRNA target sequence
attgtagttattatgtcgtt

SEQ ID NO: 51853 - DNA, 20 bp, Artificial sequence
  SiRNA target sequence
ttgtagttattatgtcgttt

SEQ ID NO: 51854 - DNA, 20 bp, Artificial sequence
  SiRNA target sequence
tgtagttattatgtcgtttt

SEQ ID NO: 51855 - DNA, 20 bp, Artificial sequence
  SiRNA target sequence
gtagttattatgtcgttttt

SEQ ID NO: 51856 - DNA, 20 bp, Artificial sequence
  SiRNA target sequence
tagttattatgtcgtttttc

SEQ ID NO: 51857 - DNA, 20 bp, Artificial sequence
  SiRNA target sequence
agttattatgtcgtttttct

SEQ ID NO: 51858 - DNA, 20 bp, Artificial sequence
  SiRNA target sequence
gttattatgtcgtttttctc

SEQ ID NO: 51859 - DNA, 20 bp, Artificial sequence
  SiRNA target sequence
ttattatgtcgtttttctca

SEQ ID NO: 51860 - DNA, 20 bp, Artificial sequence
  SiRNA target sequence
tattatgtcgtttttctcag

SEQ ID NO: 51861 - DNA, 20 bp, Artificial sequence
  SiRNA target sequence
attatgtcgtttttctcagt

SEQ ID NO: 51862 - DNA, 20 bp, Artificial sequence
  SiRNA target sequence
ttatgtcgtttttctcagta

SEQ ID NO: 51863 - DNA, 20 bp, Artificial sequence
  SiRNA target sequence
tatgtcgtttttctcagtat

SEQ ID NO: 51864 - DNA, 20 bp, Artificial sequence
  SiRNA target sequence
atgtcgtttttctcagtata

SEQ ID NO: 51865 - DNA, 20 bp, Artificial sequence
  SiRNA target sequence
tgtcgtttttctcagtatat

SEQ ID NO: 51866 - DNA, 20 bp, Artificial sequence
  SiRNA target sequence
gtcgtttttctcagtatata

SEQ ID NO: 51867 - DNA, 20 bp, Artificial sequence
  SiRNA target sequence
tcgtttttctcagtatataa

SEQ ID NO: 51868 - DNA, 20 bp, Artificial sequence
  SiRNA target sequence
cgtttttctcagtatataaa

SEQ ID NO: 51869 - DNA, 20 bp, Artificial sequence
  SiRNA target sequence
gtttttctcagtatataaaa

SEQ ID NO: 51870 - DNA, 20 bp, Artificial sequence
  SiRNA target sequence
tttttctcagtatataaaaa

SEQ ID NO: 51871 - DNA, 20 bp, Artificial sequence
  SiRNA target sequence
ttttctcagtatataaaaat

SEQ ID NO: 51872 - DNA, 20 bp, Artificial sequence
  SiRNA target sequence
tttctcagtatataaaaatt

SEQ ID NO: 51873 - DNA, 20 bp, Artificial sequence
  SiRNA target sequence
ttctcagtatataaaaattt

SEQ ID NO: 51874 - DNA, 20 bp, Artificial sequence
  SiRNA target sequence
tctcagtatataaaaatttg

SEQ ID NO: 51875 - DNA, 20 bp, Artificial sequence
  SiRNA target sequence
ctcagtatataaaaatttgg

SEQ ID NO: 51876 - DNA, 20 bp, Artificial sequence
  SiRNA target sequence
tcagtatataaaaatttggg

SEQ ID NO: 51877 - DNA, 20 bp, Artificial sequence
  SiRNA target sequence
cagtatataaaaatttggga

SEQ ID NO: 51878 - DNA, 20 bp, Artificial sequence
  SiRNA target sequence
agtatataaaaatttgggaa

SEQ ID NO: 51879 - DNA, 20 bp, Artificial sequence
  SiRNA target sequence
gtatataaaaatttgggaag

SEQ ID NO: 51880 - DNA, 20 bp, Artificial sequence
  SiRNA target sequence
tatataaaaatttgggaaga

SEQ ID NO: 51881 - DNA, 20 bp, Artificial sequence
  SiRNA target sequence
atataaaaatttgggaagag

SEQ ID NO: 51882 - DNA, 20 bp, Artificial sequence
  SiRNA target sequence
tataaaaatttgggaagaga

SEQ ID NO: 51883 - DNA, 20 bp, Artificial sequence
  SiRNA target sequence
ataaaaatttgggaagagat

SEQ ID NO: 51884 - DNA, 20 bp, Artificial sequence
  SiRNA target sequence
taaaaatttgggaagagatg

SEQ ID NO: 51885 - DNA, 20 bp, Artificial sequence
  SiRNA target sequence
aaaaatttgggaagagatgc

SEQ ID NO: 51886 - DNA, 20 bp, Artificial sequence
  SiRNA target sequence
aaaatttgggaagagatgca

SEQ ID NO: 51887 - DNA, 20 bp, Artificial sequence
  SiRNA target sequence
aaatttgggaagagatgcac

SEQ ID NO: 51888 - DNA, 20 bp, Artificial sequence
  SiRNA target sequence
aatttgggaagagatgcact

SEQ ID NO: 51889 - DNA, 20 bp, Artificial sequence
  SiRNA target sequence
atttgggaagagatgcactc

SEQ ID NO: 51890 - DNA, 20 bp, Artificial sequence
  SiRNA target sequence
tttgggaagagatgcactct

SEQ ID NO: 51891 - DNA, 20 bp, Artificial sequence
  SiRNA target sequence
ttgggaagagatgcactcta

SEQ ID NO: 51892 - DNA, 20 bp, Artificial sequence
  SiRNA target sequence
tgggaagagatgcactctac

SEQ ID NO: 51893 - DNA, 20 bp, Artificial sequence
  SiRNA target sequence
gggaagagatgcactctacg

SEQ ID NO: 51894 - DNA, 20 bp, Artificial sequence
  SiRNA target sequence
ggaagagatgcactctacgt

SEQ ID NO: 51895 - DNA, 20 bp, Artificial sequence
  SiRNA target sequence
gaagagatgcactctacgta

SEQ ID NO: 51896 - DNA, 20 bp, Artificial sequence
  SiRNA target sequence
aagagatgcactctacgtaa

SEQ ID NO: 51897 - DNA, 20 bp, Artificial sequence
  SiRNA target sequence
agagatgcactctacgtaat

SEQ ID NO: 51898 - DNA, 20 bp, Artificial sequence
  SiRNA target sequence
gagatgcactctacgtaatg

SEQ ID NO: 51899 - DNA, 20 bp, Artificial sequence
  SiRNA target sequence
agatgcactctacgtaatgt

SEQ ID NO: 51900 - DNA, 20 bp, Artificial sequence
  SiRNA target sequence
gatgcactctacgtaatgtt

SEQ ID NO: 51901 - DNA, 20 bp, Artificial sequence
  SiRNA target sequence
atgcactctacgtaatgttg

SEQ ID NO: 51902 - DNA, 20 bp, Artificial sequence
  SiRNA target sequence
tgcactctacgtaatgttgg

SEQ ID NO: 51903 - DNA, 20 bp, Artificial sequence
  SiRNA target sequence
gcactctacgtaatgttggc

SEQ ID NO: 51904 - DNA, 20 bp, Artificial sequence
  SiRNA target sequence
cactctacgtaatgttggct

SEQ ID NO: 51905 - DNA, 20 bp, Artificial sequence
  SiRNA target sequence
actctacgtaatgttggcta

SEQ ID NO: 51906 - DNA, 20 bp, Artificial sequence
  SiRNA target sequence
ctctacgtaatgttggctac

SEQ ID NO: 51907 - DNA, 20 bp, Artificial sequence
  SiRNA target sequence
tctacgtaatgttggctaca

SEQ ID NO: 51908 - DNA, 20 bp, Artificial sequence
  SiRNA target sequence
ctacgtaatgttggctacaa

SEQ ID NO: 51909 - DNA, 20 bp, Artificial sequence
  SiRNA target sequence
tacgtaatgttggctacaag

SEQ ID NO: 51910 - DNA, 20 bp, Artificial sequence
  SiRNA target sequence
acgtaatgttggctacaagt

SEQ ID NO: 51911 - DNA, 20 bp, Artificial sequence
  SiRNA target sequence
cgtaatgttggctacaagtg

SEQ ID NO: 51912 - DNA, 20 bp, Artificial sequence
  SiRNA target sequence
gtaatgttggctacaagtgc

SEQ ID NO: 51913 - DNA, 20 bp, Artificial sequence
  SiRNA target sequence
taatgttggctacaagtgcc

SEQ ID NO: 51914 - DNA, 20 bp, Artificial sequence
  SiRNA target sequence
aatgttggctacaagtgcct

SEQ ID NO: 51915 - DNA, 20 bp, Artificial sequence
  SiRNA target sequence
atgttggctacaagtgcctt

SEQ ID NO: 51916 - DNA, 20 bp, Artificial sequence
  SiRNA target sequence
tgttggctacaagtgccttg

SEQ ID NO: 51917 - DNA, 20 bp, Artificial sequence
  SiRNA target sequence
gttggctacaagtgccttgt

SEQ ID NO: 51918 - DNA, 20 bp, Artificial sequence
  SiRNA target sequence
ttggctacaagtgccttgta

SEQ ID NO: 51919 - DNA, 20 bp, Artificial sequence
  SiRNA target sequence
tggctacaagtgccttgtat

SEQ ID NO: 51920 - DNA, 20 bp, Artificial sequence
  SiRNA target sequence
ggctacaagtgccttgtatg

SEQ ID NO: 51921 - DNA, 20 bp, Artificial sequence
  SiRNA target sequence
gctacaagtgccttgtatgt

SEQ ID NO: 51922 - DNA, 20 bp, Artificial sequence
  SiRNA target sequence
ctacaagtgccttgtatgtg

SEQ ID NO: 51923 - DNA, 20 bp, Artificial sequence
  SiRNA target sequence
tacaagtgccttgtatgtgt

SEQ ID NO: 51924 - DNA, 20 bp, Artificial sequence
  SiRNA target sequence
acaagtgccttgtatgtgta

SEQ ID NO: 51925 - DNA, 20 bp, Artificial sequence
  SiRNA target sequence
caagtgccttgtatgtgtat

SEQ ID NO: 51926 - DNA, 20 bp, Artificial sequence
  SiRNA target sequence
aagtgccttgtatgtgtatt

SEQ ID NO: 51927 - DNA, 20 bp, Artificial sequence
  SiRNA target sequence
agtgccttgtatgtgtattt

SEQ ID NO: 51928 - DNA, 20 bp, Artificial sequence
  SiRNA target sequence
gtgccttgtatgtgtatttt

SEQ ID NO: 51929 - DNA, 20 bp, Artificial sequence
  SiRNA target sequence
tgccttgtatgtgtatttta

SEQ ID NO: 51930 - DNA, 20 bp, Artificial sequence
  SiRNA target sequence
gccttgtatgtgtattttac

SEQ ID NO: 51931 - DNA, 20 bp, Artificial sequence
  SiRNA target sequence
ccttgtatgtgtattttaca

SEQ ID NO: 51932 - DNA, 20 bp, Artificial sequence
  SiRNA target sequence
cttgtatgtgtattttacat

SEQ ID NO: 51933 - DNA, 20 bp, Artificial sequence
  SiRNA target sequence
ttgtatgtgtattttacatt

SEQ ID NO: 51934 - DNA, 20 bp, Artificial sequence
  SiRNA target sequence
tgtatgtgtattttacattt

SEQ ID NO: 51935 - DNA, 20 bp, Artificial sequence
  SiRNA target sequence
gtatgtgtattttacatttg

SEQ ID NO: 51936 - DNA, 20 bp, Artificial sequence
  SiRNA target sequence
tatgtgtattttacatttgt

SEQ ID NO: 51937 - DNA, 20 bp, Artificial sequence
  SiRNA target sequence
atgtgtattttacatttgta

SEQ ID NO: 51938 - DNA, 20 bp, Artificial sequence
  SiRNA target sequence
tgtgtattttacatttgtat

SEQ ID NO: 51939 - DNA, 20 bp, Artificial sequence
  SiRNA target sequence
gtgtattttacatttgtatt

SEQ ID NO: 51940 - DNA, 20 bp, Artificial sequence
  SiRNA target sequence
tgtattttacatttgtattt

SEQ ID NO: 51941 - DNA, 20 bp, Artificial sequence
  SiRNA target sequence
gtattttacatttgtatttt

SEQ ID NO: 51942 - DNA, 20 bp, Artificial sequence
  SiRNA target sequence
tattttacatttgtattttc

SEQ ID NO: 51943 - DNA, 20 bp, Artificial sequence
  SiRNA target sequence
attttacatttgtattttca

SEQ ID NO: 51944 - DNA, 20 bp, Artificial sequence
  SiRNA target sequence
ttttacatttgtattttcaa

SEQ ID NO: 51945 - DNA, 20 bp, Artificial sequence
  SiRNA target sequence
tttacatttgtattttcaat

SEQ ID NO: 51946 - DNA, 20 bp, Artificial sequence
  SiRNA target sequence
ttacatttgtattttcaata

SEQ ID NO: 51947 - DNA, 20 bp, Artificial sequence
  SiRNA target sequence
tacatttgtattttcaatat

SEQ ID NO: 51948 - DNA, 20 bp, Artificial sequence
  SiRNA target sequence
acatttgtattttcaatatg

SEQ ID NO: 51949 - DNA, 20 bp, Artificial sequence
  SiRNA target sequence
catttgtattttcaatatgg

SEQ ID NO: 51950 - DNA, 20 bp, Artificial sequence
  SiRNA target sequence
atttgtattttcaatatgga

SEQ ID NO: 51951 - DNA, 20 bp, Artificial sequence
  SiRNA target sequence
tttgtattttcaatatggag

SEQ ID NO: 51952 - DNA, 20 bp, Artificial sequence
  SiRNA target sequence
ttgtattttcaatatggaga

SEQ ID NO: 51953 - DNA, 20 bp, Artificial sequence
  SiRNA target sequence
tgtattttcaatatggagaa

SEQ ID NO: 51954 - DNA, 20 bp, Artificial sequence
  SiRNA target sequence
gtattttcaatatggagaaa

SEQ ID NO: 51955 - DNA, 20 bp, Artificial sequence
  SiRNA target sequence
tattttcaatatggagaaac

SEQ ID NO: 51956 - DNA, 20 bp, Artificial sequence
  SiRNA target sequence
attttcaatatggagaaaca

SEQ ID NO: 51957 - DNA, 20 bp, Artificial sequence
  SiRNA target sequence
ttttcaatatggagaaacaa

SEQ ID NO: 51958 - DNA, 20 bp, Artificial sequence
  SiRNA target sequence
tttcaatatggagaaacaat

SEQ ID NO: 51959 - DNA, 20 bp, Artificial sequence
  SiRNA target sequence
ttcaatatggagaaacaata

SEQ ID NO: 51960 - DNA, 20 bp, Artificial sequence
  SiRNA target sequence
tcaatatggagaaacaatat

SEQ ID NO: 51961 - DNA, 20 bp, Artificial sequence
  SiRNA target sequence
caatatggagaaacaatatt

SEQ ID NO: 51962 - DNA, 20 bp, Artificial sequence
  SiRNA target sequence
aatatggagaaacaatatta

SEQ ID NO: 51963 - DNA, 20 bp, Artificial sequence
  SiRNA target sequence
atatggagaaacaatattag

SEQ ID NO: 51964 - DNA, 20 bp, Artificial sequence
  SiRNA target sequence
tatggagaaacaatattaga

SEQ ID NO: 51965 - DNA, 20 bp, Artificial sequence
  SiRNA target sequence
atggagaaacaatattagaa

SEQ ID NO: 51966 - DNA, 20 bp, Artificial sequence
  SiRNA target sequence
tggagaaacaatattagaag

SEQ ID NO: 51967 - DNA, 20 bp, Artificial sequence
  SiRNA target sequence
ggagaaacaatattagaaga

SEQ ID NO: 51968 - DNA, 20 bp, Artificial sequence
  SiRNA target sequence
gagaaacaatattagaagac

SEQ ID NO: 51969 - DNA, 20 bp, Artificial sequence
  SiRNA target sequence
agaaacaatattagaagaca

SEQ ID NO: 51970 - DNA, 20 bp, Artificial sequence
  SiRNA target sequence
gaaacaatattagaagacaa

SEQ ID NO: 51971 - DNA, 20 bp, Artificial sequence
  SiRNA target sequence
aaacaatattagaagacaat

SEQ ID NO: 51972 - DNA, 20 bp, Artificial sequence
  SiRNA target sequence
aacaatattagaagacaata

SEQ ID NO: 51973 - DNA, 20 bp, Artificial sequence
  SiRNA target sequence
acaatattagaagacaatat

SEQ ID NO: 51974 - DNA, 20 bp, Artificial sequence
  SiRNA target sequence
caatattagaagacaatata

SEQ ID NO: 51975 - DNA, 20 bp, Artificial sequence
  SiRNA target sequence
aatattagaagacaatataa

SEQ ID NO: 51976 - DNA, 20 bp, Artificial sequence
  SiRNA target sequence
atattagaagacaatataat

SEQ ID NO: 51977 - DNA, 20 bp, Artificial sequence
  SiRNA target sequence
tattagaagacaatataata

SEQ ID NO: 51978 - DNA, 20 bp, Artificial sequence
  SiRNA target sequence
attagaagacaatataataa

SEQ ID NO: 51979 - DNA, 20 bp, Artificial sequence
  SiRNA target sequence
ttagaagacaatataataag

SEQ ID NO: 51980 - DNA, 20 bp, Artificial sequence
  SiRNA target sequence
tagaagacaatataataagt

SEQ ID NO: 51981 - DNA, 20 bp, Artificial sequence
  SiRNA target sequence
agaagacaatataataagtc

SEQ ID NO: 51982 - DNA, 20 bp, Artificial sequence
  SiRNA target sequence
gaagacaatataataagtca

SEQ ID NO: 51983 - DNA, 20 bp, Artificial sequence
  SiRNA target sequence
aagacaatataataagtcac

SEQ ID NO: 51984 - DNA, 20 bp, Artificial sequence
  SiRNA target sequence
agacaatataataagtcaca

SEQ ID NO: 51985 - DNA, 20 bp, Artificial sequence
  SiRNA target sequence
gacaatataataagtcacag

SEQ ID NO: 51986 - DNA, 20 bp, Artificial sequence
  SiRNA target sequence
acaatataataagtcacagg

SEQ ID NO: 51987 - DNA, 20 bp, Artificial sequence
  SiRNA target sequence
caatataataagtcacagga

SEQ ID NO: 51988 - DNA, 20 bp, Artificial sequence
  SiRNA target sequence
aatataataagtcacaggat

SEQ ID NO: 51989 - DNA, 20 bp, Artificial sequence
  SiRNA target sequence
atataataagtcacaggata

SEQ ID NO: 51990 - DNA, 20 bp, Artificial sequence
  SiRNA target sequence
tataataagtcacaggataa

SEQ ID NO: 51991 - DNA, 20 bp, Artificial sequence
  SiRNA target sequence
ataataagtcacaggataaa

SEQ ID NO: 51992 - DNA, 20 bp, Artificial sequence
  SiRNA target sequence
taataagtcacaggataaat

SEQ ID NO: 51993 - DNA, 20 bp, Artificial sequence
  SiRNA target sequence
aataagtcacaggataaatt

SEQ ID NO: 51994 - DNA, 20 bp, Artificial sequence
  SiRNA target sequence
ataagtcacaggataaatta

SEQ ID NO: 51995 - DNA, 20 bp, Artificial sequence
  SiRNA target sequence
taagtcacaggataaattat

SEQ ID NO: 51996 - DNA, 20 bp, Artificial sequence
  SiRNA target sequence
aagtcacaggataaattatc

SEQ ID NO: 51997 - DNA, 20 bp, Artificial sequence
  SiRNA target sequence
agtcacaggataaattatcg

SEQ ID NO: 51998 - DNA, 20 bp, Artificial sequence
  SiRNA target sequence
gtcacaggataaattatcga

SEQ ID NO: 51999 - DNA, 20 bp, Artificial sequence
  SiRNA target sequence
tcacaggataaattatcgaa

SEQ ID NO: 52000 - DNA, 20 bp, Artificial sequence
  SiRNA target sequence
cacaggataaattatcgaat

SEQ ID NO: 52001 - DNA, 20 bp, Artificial sequence
  SiRNA target sequence
acaggataaattatcgaata

SEQ ID NO: 52002 - DNA, 20 bp, Artificial sequence
  SiRNA target sequence
caggataaattatcgaataa

SEQ ID NO: 52003 - DNA, 20 bp, Artificial sequence
  SiRNA target sequence
aggataaattatcgaataaa

SEQ ID NO: 52004 - DNA, 20 bp, Artificial sequence
  SiRNA target sequence
ggataaattatcgaataaat

SEQ ID NO: 52005 - DNA, 20 bp, Artificial sequence
  SiRNA target sequence
gataaattatcgaataaatt

SEQ ID NO: 52006 - DNA, 20 bp, Artificial sequence
  SiRNA target sequence
ataaattatcgaataaatta

SEQ ID NO: 52007 - DNA, 20 bp, Artificial sequence
  SiRNA target sequence
taaattatcgaataaattac

SEQ ID NO: 52008 - DNA, 20 bp, Artificial sequence
  SiRNA target sequence
aaattatcgaataaattaca

SEQ ID NO: 52009 - DNA, 20 bp, Artificial sequence
  SiRNA target sequence
aattatcgaataaattacaa

SEQ ID NO: 52010 - DNA, 20 bp, Artificial sequence
  SiRNA target sequence
attatcgaataaattacaag

SEQ ID NO: 52011 - DNA, 20 bp, Artificial sequence
  SiRNA target sequence
ttatcgaataaattacaaga

SEQ ID NO: 52012 - DNA, 20 bp, Artificial sequence
  SiRNA target sequence
tatcgaataaattacaagat

SEQ ID NO: 52013 - DNA, 20 bp, Artificial sequence
  SiRNA target sequence
atcgaataaattacaagatt

SEQ ID NO: 52014 - DNA, 20 bp, Artificial sequence
  SiRNA target sequence
tcgaataaattacaagattt

SEQ ID NO: 52015 - DNA, 20 bp, Artificial sequence
  SiRNA target sequence
cgaataaattacaagatttt

SEQ ID NO: 52016 - DNA, 20 bp, Artificial sequence
  SiRNA target sequence
gaataaattacaagattttt

SEQ ID NO: 52017 - DNA, 20 bp, Artificial sequence
  SiRNA target sequence
aataaattacaagatttttt

SEQ ID NO: 52018 - DNA, 20 bp, Artificial sequence
  SiRNA target sequence
ataaattacaagatttttta

SEQ ID NO: 52019 - DNA, 20 bp, Artificial sequence
  SiRNA target sequence
taaattacaagattttttag

SEQ ID NO: 52020 - DNA, 20 bp, Artificial sequence
  SiRNA target sequence
aaattacaagattttttagc

SEQ ID NO: 52021 - DNA, 20 bp, Artificial sequence
  SiRNA target sequence
aattacaagattttttagct

SEQ ID NO: 52022 - DNA, 20 bp, Artificial sequence
  SiRNA target sequence
attacaagattttttagcta

SEQ ID NO: 52023 - DNA, 20 bp, Artificial sequence
  SiRNA target sequence
ttacaagattttttagctaa

SEQ ID NO: 52024 - DNA, 20 bp, Artificial sequence
  SiRNA target sequence
tacaagattttttagctaat

SEQ ID NO: 52025 - DNA, 20 bp, Artificial sequence
  SiRNA target sequence
acaagattttttagctaatc

SEQ ID NO: 52026 - DNA, 20 bp, Artificial sequence
  SiRNA target sequence
caagattttttagctaatca

SEQ ID NO: 52027 - DNA, 20 bp, Artificial sequence
  SiRNA target sequence
aagattttttagctaatcat

SEQ ID NO: 52028 - DNA, 20 bp, Artificial sequence
  SiRNA target sequence
agattttttagctaatcatg

SEQ ID NO: 52029 - DNA, 20 bp, Artificial sequence
  SiRNA target sequence
gattttttagctaatcatga

SEQ ID NO: 52030 - DNA, 20 bp, Artificial sequence
  SiRNA target sequence
attttttagctaatcatgaa

SEQ ID NO: 52031 - DNA, 20 bp, Artificial sequence
  SiRNA target sequence
ttttttagctaatcatgaaa

SEQ ID NO: 52032 - DNA, 20 bp, Artificial sequence
  SiRNA target sequence
tttttagctaatcatgaaac

SEQ ID NO: 52033 - DNA, 20 bp, Artificial sequence
  SiRNA target sequence
ttttagctaatcatgaaaca

SEQ ID NO: 52034 - DNA, 20 bp, Artificial sequence
  SiRNA target sequence
tttagctaatcatgaaacaa

SEQ ID NO: 52035 - DNA, 20 bp, Artificial sequence
  SiRNA target sequence
ttagctaatcatgaaacaat

SEQ ID NO: 52036 - DNA, 20 bp, Artificial sequence
  SiRNA target sequence
tagctaatcatgaaacaatt

SEQ ID NO: 52037 - DNA, 20 bp, Artificial sequence
  SiRNA target sequence
agctaatcatgaaacaatta

SEQ ID NO: 52038 - DNA, 20 bp, Artificial sequence
  SiRNA target sequence
gctaatcatgaaacaattaa

SEQ ID NO: 52039 - DNA, 20 bp, Artificial sequence
  SiRNA target sequence
ctaatcatgaaacaattaaa

SEQ ID NO: 52040 - DNA, 20 bp, Artificial sequence
  SiRNA target sequence
taatcatgaaacaattaaag

SEQ ID NO: 52041 - DNA, 20 bp, Artificial sequence
  SiRNA target sequence
aatcatgaaacaattaaagc

SEQ ID NO: 52042 - DNA, 20 bp, Artificial sequence
  SiRNA target sequence
atcatgaaacaattaaagcc

SEQ ID NO: 52043 - DNA, 20 bp, Artificial sequence
  SiRNA target sequence
tcatgaaacaattaaagcct

SEQ ID NO: 52044 - DNA, 20 bp, Artificial sequence
  SiRNA target sequence
catgaaacaattaaagccta

SEQ ID NO: 52045 - DNA, 20 bp, Artificial sequence
  SiRNA target sequence
atgaaacaattaaagcctat

SEQ ID NO: 52046 - DNA, 20 bp, Artificial sequence
  SiRNA target sequence
tgaaacaattaaagcctata

SEQ ID NO: 52047 - DNA, 20 bp, Artificial sequence
  SiRNA target sequence
gaaacaattaaagcctataa

SEQ ID NO: 52048 - DNA, 20 bp, Artificial sequence
  SiRNA target sequence
aaacaattaaagcctataat

SEQ ID NO: 52049 - DNA, 20 bp, Artificial sequence
  SiRNA target sequence
aacaattaaagcctataata

SEQ ID NO: 52050 - DNA, 20 bp, Artificial sequence
  SiRNA target sequence
acaattaaagcctataatat

SEQ ID NO: 52051 - DNA, 20 bp, Artificial sequence
  SiRNA target sequence
caattaaagcctataatatg

SEQ ID NO: 52052 - DNA, 20 bp, Artificial sequence
  SiRNA target sequence
aattaaagcctataatatgg

SEQ ID NO: 52053 - DNA, 20 bp, Artificial sequence
  SiRNA target sequence
attaaagcctataatatgga

SEQ ID NO: 52054 - DNA, 20 bp, Artificial sequence
  SiRNA target sequence
ttaaagcctataatatggaa

SEQ ID NO: 52055 - DNA, 20 bp, Artificial sequence
  SiRNA target sequence
taaagcctataatatggaag

SEQ ID NO: 52056 - DNA, 20 bp, Artificial sequence
  SiRNA target sequence
aaagcctataatatggaaga

SEQ ID NO: 52057 - DNA, 20 bp, Artificial sequence
  SiRNA target sequence
aagcctataatatggaagaa

SEQ ID NO: 52058 - DNA, 20 bp, Artificial sequence
  SiRNA target sequence
agcctataatatggaagaag

SEQ ID NO: 52059 - DNA, 20 bp, Artificial sequence
  SiRNA target sequence
gcctataatatggaagaaga

SEQ ID NO: 52060 - DNA, 20 bp, Artificial sequence
  SiRNA target sequence
cctataatatggaagaagaa

SEQ ID NO: 52061 - DNA, 20 bp, Artificial sequence
  SiRNA target sequence
ctataatatggaagaagaaa

SEQ ID NO: 52062 - DNA, 20 bp, Artificial sequence
  SiRNA target sequence
tataatatggaagaagaaac

SEQ ID NO: 52063 - DNA, 20 bp, Artificial sequence
  SiRNA target sequence
ataatatggaagaagaaact

SEQ ID NO: 52064 - DNA, 20 bp, Artificial sequence
  SiRNA target sequence
taatatggaagaagaaacta

SEQ ID NO: 52065 - DNA, 20 bp, Artificial sequence
  SiRNA target sequence
aatatggaagaagaaactat

SEQ ID NO: 52066 - DNA, 20 bp, Artificial sequence
  SiRNA target sequence
atatggaagaagaaactatt

SEQ ID NO: 52067 - DNA, 20 bp, Artificial sequence
  SiRNA target sequence
tatggaagaagaaactatta

SEQ ID NO: 52068 - DNA, 20 bp, Artificial sequence
  SiRNA target sequence
atggaagaagaaactattac

SEQ ID NO: 52069 - DNA, 20 bp, Artificial sequence
  SiRNA target sequence
tggaagaagaaactattaca

SEQ ID NO: 52070 - DNA, 20 bp, Artificial sequence
  SiRNA target sequence
ggaagaagaaactattacat

SEQ ID NO: 52071 - DNA, 20 bp, Artificial sequence
  SiRNA target sequence
gaagaagaaactattacata

SEQ ID NO: 52072 - DNA, 20 bp, Artificial sequence
  SiRNA target sequence
aagaagaaactattacatat

SEQ ID NO: 52073 - DNA, 20 bp, Artificial sequence
  SiRNA target sequence
agaagaaactattacatatt

SEQ ID NO: 52074 - DNA, 20 bp, Artificial sequence
  SiRNA target sequence
gaagaaactattacatattt

SEQ ID NO: 52075 - DNA, 20 bp, Artificial sequence
  SiRNA target sequence
aagaaactattacatatttt

SEQ ID NO: 52076 - DNA, 20 bp, Artificial sequence
  SiRNA target sequence
agaaactattacatattttg

SEQ ID NO: 52077 - DNA, 20 bp, Artificial sequence
  SiRNA target sequence
gaaactattacatattttga

SEQ ID NO: 52078 - DNA, 20 bp, Artificial sequence
  SiRNA target sequence
aaactattacatattttgat

SEQ ID NO: 52079 - DNA, 20 bp, Artificial sequence
  SiRNA target sequence
aactattacatattttgatg

SEQ ID NO: 52080 - DNA, 20 bp, Artificial sequence
  SiRNA target sequence
actattacatattttgatga

SEQ ID NO: 52081 - DNA, 20 bp, Artificial sequence
  SiRNA target sequence
ctattacatattttgatgaa

SEQ ID NO: 52082 - DNA, 20 bp, Artificial sequence
  SiRNA target sequence
tattacatattttgatgaaa

SEQ ID NO: 52083 - DNA, 20 bp, Artificial sequence
  SiRNA target sequence
attacatattttgatgaaaa

SEQ ID NO: 52084 - DNA, 20 bp, Artificial sequence
  SiRNA target sequence
ttacatattttgatgaaaat

SEQ ID NO: 52085 - DNA, 20 bp, Artificial sequence
  SiRNA target sequence
tacatattttgatgaaaatc

SEQ ID NO: 52086 - DNA, 20 bp, Artificial sequence
  SiRNA target sequence
acatattttgatgaaaatca

SEQ ID NO: 52087 - DNA, 20 bp, Artificial sequence
  SiRNA target sequence
catattttgatgaaaatcaa

SEQ ID NO: 52088 - DNA, 20 bp, Artificial sequence
  SiRNA target sequence
atattttgatgaaaatcaaa

SEQ ID NO: 52089 - DNA, 20 bp, Artificial sequence
  SiRNA target sequence
tattttgatgaaaatcaaaa

SEQ ID NO: 52090 - DNA, 20 bp, Artificial sequence
  SiRNA target sequence
attttgatgaaaatcaaaaa

SEQ ID NO: 52091 - DNA, 20 bp, Artificial sequence
  SiRNA target sequence
ttttgatgaaaatcaaaaac

SEQ ID NO: 52092 - DNA, 20 bp, Artificial sequence
  SiRNA target sequence
tttgatgaaaatcaaaaacc

SEQ ID NO: 52093 - DNA, 20 bp, Artificial sequence
  SiRNA target sequence
ttgatgaaaatcaaaaaccg

SEQ ID NO: 52094 - DNA, 20 bp, Artificial sequence
  SiRNA target sequence
tgatgaaaatcaaaaaccgg

SEQ ID NO: 52095 - DNA, 20 bp, Artificial sequence
  SiRNA target sequence
gatgaaaatcaaaaaccggt

SEQ ID NO: 52096 - DNA, 20 bp, Artificial sequence
  SiRNA target sequence
atgaaaatcaaaaaccggta

SEQ ID NO: 52097 - DNA, 20 bp, Artificial sequence
  SiRNA target sequence
tgaaaatcaaaaaccggtag

SEQ ID NO: 52098 - DNA, 20 bp, Artificial sequence
  SiRNA target sequence
gaaaatcaaaaaccggtaga

SEQ ID NO: 52099 - DNA, 20 bp, Artificial sequence
  SiRNA target sequence
aaaatcaaaaaccggtagaa

SEQ ID NO: 52100 - DNA, 20 bp, Artificial sequence
  SiRNA target sequence
aaatcaaaaaccggtagaat

SEQ ID NO: 52101 - DNA, 20 bp, Artificial sequence
  SiRNA target sequence
aatcaaaaaccggtagaata

SEQ ID NO: 52102 - DNA, 20 bp, Artificial sequence
  SiRNA target sequence
atcaaaaaccggtagaatat

SEQ ID NO: 52103 - DNA, 20 bp, Artificial sequence
  SiRNA target sequence
tcaaaaaccggtagaatatt

SEQ ID NO: 52104 - DNA, 20 bp, Artificial sequence
  SiRNA target sequence
caaaaaccggtagaatattt

SEQ ID NO: 52105 - DNA, 20 bp, Artificial sequence
  SiRNA target sequence
aaaaaccggtagaatatttt

SEQ ID NO: 52106 - DNA, 20 bp, Artificial sequence
  SiRNA target sequence
aaaaccggtagaatattttg

SEQ ID NO: 52107 - DNA, 20 bp, Artificial sequence
  SiRNA target sequence
aaaccggtagaatattttgg

SEQ ID NO: 52108 - DNA, 20 bp, Artificial sequence
  SiRNA target sequence
aaccggtagaatattttggg

SEQ ID NO: 52109 - DNA, 20 bp, Artificial sequence
  SiRNA target sequence
accggtagaatattttgggg

SEQ ID NO: 52110 - DNA, 20 bp, Artificial sequence
  SiRNA target sequence
ccggtagaatattttggggt

SEQ ID NO: 52111 - DNA, 20 bp, Artificial sequence
  SiRNA target sequence
cggtagaatattttggggta

SEQ ID NO: 52112 - DNA, 20 bp, Artificial sequence
  SiRNA target sequence
ggtagaatattttggggtaa

SEQ ID NO: 52113 - DNA, 20 bp, Artificial sequence
  SiRNA target sequence
gtagaatattttggggtaaa

SEQ ID NO: 52114 - DNA, 20 bp, Artificial sequence
  SiRNA target sequence
tagaatattttggggtaaag

SEQ ID NO: 52115 - DNA, 20 bp, Artificial sequence
  SiRNA target sequence
agaatattttggggtaaagt

SEQ ID NO: 52116 - DNA, 20 bp, Artificial sequence
  SiRNA target sequence
gaatattttggggtaaagtc

SEQ ID NO: 52117 - DNA, 20 bp, Artificial sequence
  SiRNA target sequence
aatattttggggtaaagtct

SEQ ID NO: 52118 - DNA, 20 bp, Artificial sequence
  SiRNA target sequence
atattttggggtaaagtctc

SEQ ID NO: 52119 - DNA, 20 bp, Artificial sequence
  SiRNA target sequence
tattttggggtaaagtctca

SEQ ID NO: 52120 - DNA, 20 bp, Artificial sequence
  SiRNA target sequence
attttggggtaaagtctcac

SEQ ID NO: 52121 - DNA, 20 bp, Artificial sequence
  SiRNA target sequence
ttttggggtaaagtctcaca

SEQ ID NO: 52122 - DNA, 20 bp, Artificial sequence
  SiRNA target sequence
tttggggtaaagtctcacag

SEQ ID NO: 52123 - DNA, 20 bp, Artificial sequence
  SiRNA target sequence
ttggggtaaagtctcacaga

SEQ ID NO: 52124 - DNA, 20 bp, Artificial sequence
  SiRNA target sequence
tggggtaaagtctcacagaa

SEQ ID NO: 52125 - DNA, 20 bp, Artificial sequence
  SiRNA target sequence
ggggtaaagtctcacagaat

SEQ ID NO: 52126 - DNA, 20 bp, Artificial sequence
  SiRNA target sequence
gggtaaagtctcacagaatt

SEQ ID NO: 52127 - DNA, 20 bp, Artificial sequence
  SiRNA target sequence
ggtaaagtctcacagaattt

SEQ ID NO: 52128 - DNA, 20 bp, Artificial sequence
  SiRNA target sequence
gtaaagtctcacagaatttt

SEQ ID NO: 52129 - DNA, 20 bp, Artificial sequence
  SiRNA target sequence
taaagtctcacagaattttg

SEQ ID NO: 52130 - DNA, 20 bp, Artificial sequence
  SiRNA target sequence
aaagtctcacagaattttgt

SEQ ID NO: 52131 - DNA, 20 bp, Artificial sequence
  SiRNA target sequence
aagtctcacagaattttgtt

SEQ ID NO: 52132 - DNA, 20 bp, Artificial sequence
  SiRNA target sequence
agtctcacagaattttgttc

SEQ ID NO: 52133 - DNA, 20 bp, Artificial sequence
  SiRNA target sequence
gtctcacagaattttgttct

SEQ ID NO: 52134 - DNA, 20 bp, Artificial sequence
  SiRNA target sequence
tctcacagaattttgttctc

SEQ ID NO: 52135 - DNA, 20 bp, Artificial sequence
  SiRNA target sequence
ctcacagaattttgttctct

SEQ ID NO: 52136 - DNA, 20 bp, Artificial sequence
  SiRNA target sequence
tcacagaattttgttctctc

SEQ ID NO: 52137 - DNA, 20 bp, Artificial sequence
  SiRNA target sequence
cacagaattttgttctctct

SEQ ID NO: 52138 - DNA, 20 bp, Artificial sequence
  SiRNA target sequence
acagaattttgttctctctt

SEQ ID NO: 52139 - DNA, 20 bp, Artificial sequence
  SiRNA target sequence
cagaattttgttctctcttt

SEQ ID NO: 52140 - DNA, 20 bp, Artificial sequence
  SiRNA target sequence
agaattttgttctctctttt

SEQ ID NO: 52141 - DNA, 20 bp, Artificial sequence
  SiRNA target sequence
gaattttgttctctctttta

SEQ ID NO: 52142 - DNA, 20 bp, Artificial sequence
  SiRNA target sequence
aattttgttctctcttttat

SEQ ID NO: 52143 - DNA, 20 bp, Artificial sequence
  SiRNA target sequence
attttgttctctcttttata

SEQ ID NO: 52144 - DNA, 20 bp, Artificial sequence
  SiRNA target sequence
ttttgttctctcttttatat

SEQ ID NO: 52145 - DNA, 20 bp, Artificial sequence
  SiRNA target sequence
tttgttctctcttttatata

SEQ ID NO: 52146 - DNA, 20 bp, Artificial sequence
  SiRNA target sequence
ttgttctctcttttatatat

SEQ ID NO: 52147 - DNA, 20 bp, Artificial sequence
  SiRNA target sequence
tgttctctcttttatatata

SEQ ID NO: 52148 - DNA, 20 bp, Artificial sequence
  SiRNA target sequence
gttctctcttttatatatac

SEQ ID NO: 52149 - DNA, 20 bp, Artificial sequence
  SiRNA target sequence
ttctctcttttatatataca

SEQ ID NO: 52150 - DNA, 20 bp, Artificial sequence
  SiRNA target sequence
tctctcttttatatatacaa

SEQ ID NO: 52151 - DNA, 20 bp, Artificial sequence
  SiRNA target sequence
ctctcttttatatatacaaa

SEQ ID NO: 52152 - DNA, 20 bp, Artificial sequence
  SiRNA target sequence
tctcttttatatatacaaaa

SEQ ID NO: 52153 - DNA, 20 bp, Artificial sequence
  SiRNA target sequence
ctcttttatatatacaaaaa

SEQ ID NO: 52154 - DNA, 20 bp, Artificial sequence
  SiRNA target sequence
tcttttatatatacaaaaaa

SEQ ID NO: 52155 - DNA, 20 bp, Artificial sequence
  SiRNA target sequence
cttttatatatacaaaaaat

SEQ ID NO: 52156 - DNA, 20 bp, Artificial sequence
  SiRNA target sequence
ttttatatatacaaaaaatg

SEQ ID NO: 52157 - DNA, 20 bp, Artificial sequence
  SiRNA target sequence
tttatatatacaaaaaatga

SEQ ID NO: 52158 - DNA, 20 bp, Artificial sequence
  SiRNA target sequence
ttatatatacaaaaaatgac

SEQ ID NO: 52159 - DNA, 20 bp, Artificial sequence
  SiRNA target sequence
tatatatacaaaaaatgaca

SEQ ID NO: 52160 - DNA, 20 bp, Artificial sequence
  SiRNA target sequence
atatatacaaaaaatgacat

SEQ ID NO: 52161 - DNA, 20 bp, Artificial sequence
  SiRNA target sequence
tatatacaaaaaatgacatt

SEQ ID NO: 52162 - DNA, 20 bp, Artificial sequence
  SiRNA target sequence
atatacaaaaaatgacattt

SEQ ID NO: 52163 - DNA, 20 bp, Artificial sequence
  SiRNA target sequence
tatacaaaaaatgacatttg

SEQ ID NO: 52164 - DNA, 20 bp, Artificial sequence
  SiRNA target sequence
atacaaaaaatgacatttgc

SEQ ID NO: 52165 - DNA, 20 bp, Artificial sequence
  SiRNA target sequence
tacaaaaaatgacatttgcg

SEQ ID NO: 52166 - DNA, 20 bp, Artificial sequence
  SiRNA target sequence
acaaaaaatgacatttgcga

SEQ ID NO: 52167 - DNA, 20 bp, Artificial sequence
  SiRNA target sequence
caaaaaatgacatttgcgat

SEQ ID NO: 52168 - DNA, 20 bp, Artificial sequence
  SiRNA target sequence
aaaaaatgacatttgcgata

SEQ ID NO: 52169 - DNA, 20 bp, Artificial sequence
  SiRNA target sequence
aaaaatgacatttgcgatac

SEQ ID NO: 52170 - DNA, 20 bp, Artificial sequence
  SiRNA target sequence
aaaatgacatttgcgataca

SEQ ID NO: 52171 - DNA, 20 bp, Artificial sequence
  SiRNA target sequence
aaatgacatttgcgatacag

SEQ ID NO: 52172 - DNA, 20 bp, Artificial sequence
  SiRNA target sequence
aatgacatttgcgatacagg

SEQ ID NO: 52173 - DNA, 20 bp, Artificial sequence
  SiRNA target sequence
atgacatttgcgatacaggc

SEQ ID NO: 52174 - DNA, 20 bp, Artificial sequence
  SiRNA target sequence
tgacatttgcgatacaggca

SEQ ID NO: 52175 - DNA, 20 bp, Artificial sequence
  SiRNA target sequence
gacatttgcgatacaggcaa

SEQ ID NO: 52176 - DNA, 20 bp, Artificial sequence
  SiRNA target sequence
acatttgcgatacaggcaat

SEQ ID NO: 52177 - DNA, 20 bp, Artificial sequence
  SiRNA target sequence
catttgcgatacaggcaatt

SEQ ID NO: 52178 - DNA, 20 bp, Artificial sequence
  SiRNA target sequence
atttgcgatacaggcaatta

SEQ ID NO: 52179 - DNA, 20 bp, Artificial sequence
  SiRNA target sequence
tttgcgatacaggcaattat

SEQ ID NO: 52180 - DNA, 20 bp, Artificial sequence
  SiRNA target sequence
ttgcgatacaggcaattatt

SEQ ID NO: 52181 - DNA, 20 bp, Artificial sequence
  SiRNA target sequence
tgcgatacaggcaattatta

SEQ ID NO: 52182 - DNA, 20 bp, Artificial sequence
  SiRNA target sequence
gcgatacaggcaattattat

SEQ ID NO: 52183 - DNA, 20 bp, Artificial sequence
  SiRNA target sequence
cgatacaggcaattattatt

SEQ ID NO: 52184 - DNA, 20 bp, Artificial sequence
  SiRNA target sequence
gatacaggcaattattatta

SEQ ID NO: 52185 - DNA, 20 bp, Artificial sequence
  SiRNA target sequence
atacaggcaattattattat

SEQ ID NO: 52186 - DNA, 20 bp, Artificial sequence
  SiRNA target sequence
tacaggcaattattattatc

SEQ ID NO: 52187 - DNA, 20 bp, Artificial sequence
  SiRNA target sequence
acaggcaattattattatca

SEQ ID NO: 52188 - DNA, 20 bp, Artificial sequence
  SiRNA target sequence
caggcaattattattatcac

SEQ ID NO: 52189 - DNA, 20 bp, Artificial sequence
  SiRNA target sequence
aggcaattattattatcaca

SEQ ID NO: 52190 - DNA, 20 bp, Artificial sequence
  SiRNA target sequence
ggcaattattattatcacat

SEQ ID NO: 52191 - DNA, 20 bp, Artificial sequence
  SiRNA target sequence
gcaattattattatcacatt

SEQ ID NO: 52192 - DNA, 20 bp, Artificial sequence
  SiRNA target sequence
caattattattatcacatta

SEQ ID NO: 52193 - DNA, 20 bp, Artificial sequence
  SiRNA target sequence
aattattattatcacattag

SEQ ID NO: 52194 - DNA, 20 bp, Artificial sequence
  SiRNA target sequence
attattattatcacattagg

SEQ ID NO: 52195 - DNA, 20 bp, Artificial sequence
  SiRNA target sequence
ttattattatcacattagga

SEQ ID NO: 52196 - DNA, 20 bp, Artificial sequence
  SiRNA target sequence
tattattatcacattaggat

SEQ ID NO: 52197 - DNA, 20 bp, Artificial sequence
  SiRNA target sequence
attattatcacattaggatc

SEQ ID NO: 52198 - DNA, 20 bp, Artificial sequence
  SiRNA target sequence
ttattatcacattaggatct

SEQ ID NO: 52199 - DNA, 20 bp, Artificial sequence
  SiRNA target sequence
tattatcacattaggatctt

SEQ ID NO: 52200 - DNA, 20 bp, Artificial sequence
  SiRNA target sequence
attatcacattaggatcttt

SEQ ID NO: 52201 - DNA, 20 bp, Artificial sequence
  SiRNA target sequence
ttatcacattaggatctttt

SEQ ID NO: 52202 - DNA, 20 bp, Artificial sequence
  SiRNA target sequence
tatcacattaggatcttttg

SEQ ID NO: 52203 - DNA, 20 bp, Artificial sequence
  SiRNA target sequence
atcacattaggatcttttgg

SEQ ID NO: 52204 - DNA, 20 bp, Artificial sequence
  SiRNA target sequence
tcacattaggatcttttgga

SEQ ID NO: 52205 - DNA, 20 bp, Artificial sequence
  SiRNA target sequence
cacattaggatcttttggat

SEQ ID NO: 52206 - DNA, 20 bp, Artificial sequence
  SiRNA target sequence
acattaggatcttttggata

SEQ ID NO: 52207 - DNA, 20 bp, Artificial sequence
  SiRNA target sequence
cattaggatcttttggatat

SEQ ID NO: 52208 - DNA, 20 bp, Artificial sequence
  SiRNA target sequence
attaggatcttttggatatt

SEQ ID NO: 52209 - DNA, 20 bp, Artificial sequence
  SiRNA target sequence
ttaggatcttttggatattt

SEQ ID NO: 52210 - DNA, 20 bp, Artificial sequence
  SiRNA target sequence
taggatcttttggatatttt

SEQ ID NO: 52211 - DNA, 20 bp, Artificial sequence
  SiRNA target sequence
aggatcttttggatattttc

SEQ ID NO: 52212 - DNA, 20 bp, Artificial sequence
  SiRNA target sequence
ggatcttttggatattttcc

SEQ ID NO: 52213 - DNA, 20 bp, Artificial sequence
  SiRNA target sequence
gatcttttggatattttccg

SEQ ID NO: 52214 - DNA, 20 bp, Artificial sequence
  SiRNA target sequence
atcttttggatattttccga

SEQ ID NO: 52215 - DNA, 20 bp, Artificial sequence
  SiRNA target sequence
tcttttggatattttccgat

SEQ ID NO: 52216 - DNA, 20 bp, Artificial sequence
  SiRNA target sequence
cttttggatattttccgatt

SEQ ID NO: 52217 - DNA, 20 bp, Artificial sequence
  SiRNA target sequence
ttttggatattttccgatta

SEQ ID NO: 52218 - DNA, 20 bp, Artificial sequence
  SiRNA target sequence
tttggatattttccgattaa

SEQ ID NO: 52219 - DNA, 20 bp, Artificial sequence
  SiRNA target sequence
ttggatattttccgattaaa

SEQ ID NO: 52220 - DNA, 20 bp, Artificial sequence
  SiRNA target sequence
tggatattttccgattaaat

SEQ ID NO: 52221 - DNA, 20 bp, Artificial sequence
  SiRNA target sequence
ggatattttccgattaaatt

SEQ ID NO: 52222 - DNA, 20 bp, Artificial sequence
  SiRNA target sequence
gatattttccgattaaatta

SEQ ID NO: 52223 - DNA, 20 bp, Artificial sequence
  SiRNA target sequence
atattttccgattaaattat

SEQ ID NO: 52224 - DNA, 20 bp, Artificial sequence
  SiRNA target sequence
tattttccgattaaattatc

SEQ ID NO: 52225 - DNA, 20 bp, Artificial sequence
  SiRNA target sequence
attttccgattaaattatcc

SEQ ID NO: 52226 - DNA, 20 bp, Artificial sequence
  SiRNA target sequence
ttttccgattaaattatcct

SEQ ID NO: 52227 - DNA, 20 bp, Artificial sequence
  SiRNA target sequence
tttccgattaaattatcctc

SEQ ID NO: 52228 - DNA, 20 bp, Artificial sequence
  SiRNA target sequence
ttccgattaaattatcctct

SEQ ID NO: 52229 - DNA, 20 bp, Artificial sequence
  SiRNA target sequence
tccgattaaattatcctctc

SEQ ID NO: 52230 - DNA, 20 bp, Artificial sequence
  SiRNA target sequence
ccgattaaattatcctctca

SEQ ID NO: 52231 - DNA, 20 bp, Artificial sequence
  SiRNA target sequence
cgattaaattatcctctcaa

SEQ ID NO: 52232 - DNA, 20 bp, Artificial sequence
  SiRNA target sequence
gattaaattatcctctcaac

SEQ ID NO: 52233 - DNA, 20 bp, Artificial sequence
  SiRNA target sequence
attaaattatcctctcaaca

SEQ ID NO: 52234 - DNA, 20 bp, Artificial sequence
  SiRNA target sequence
ttaaattatcctctcaacag

SEQ ID NO: 52235 - DNA, 20 bp, Artificial sequence
  SiRNA target sequence
taaattatcctctcaacagt

SEQ ID NO: 52236 - DNA, 20 bp, Artificial sequence
  SiRNA target sequence
aaattatcctctcaacagtt

SEQ ID NO: 52237 - DNA, 20 bp, Artificial sequence
  SiRNA target sequence
aattatcctctcaacagtta

SEQ ID NO: 52238 - DNA, 20 bp, Artificial sequence
  SiRNA target sequence
attatcctctcaacagttag

SEQ ID NO: 52239 - DNA, 20 bp, Artificial sequence
  SiRNA target sequence
ttatcctctcaacagttagt

SEQ ID NO: 52240 - DNA, 20 bp, Artificial sequence
  SiRNA target sequence
tatcctctcaacagttagtc

SEQ ID NO: 52241 - DNA, 20 bp, Artificial sequence
  SiRNA target sequence
atcctctcaacagttagtct

SEQ ID NO: 52242 - DNA, 20 bp, Artificial sequence
  SiRNA target sequence
tcctctcaacagttagtctt

SEQ ID NO: 52243 - DNA, 20 bp, Artificial sequence
  SiRNA target sequence
cctctcaacagttagtcttt

SEQ ID NO: 52244 - DNA, 20 bp, Artificial sequence
  SiRNA target sequence
ctctcaacagttagtctttt

SEQ ID NO: 52245 - DNA, 20 bp, Artificial sequence
  SiRNA target sequence
tctcaacagttagtctttta

SEQ ID NO: 52246 - DNA, 20 bp, Artificial sequence
  SiRNA target sequence
ctcaacagttagtcttttat

SEQ ID NO: 52247 - DNA, 20 bp, Artificial sequence
  SiRNA target sequence
tcaacagttagtcttttata

SEQ ID NO: 52248 - DNA, 20 bp, Artificial sequence
  SiRNA target sequence
caacagttagtcttttatat

SEQ ID NO: 52249 - DNA, 20 bp, Artificial sequence
  SiRNA target sequence
aacagttagtcttttatatt

SEQ ID NO: 52250 - DNA, 20 bp, Artificial sequence
  SiRNA target sequence
acagttagtcttttatattt

SEQ ID NO: 52251 - DNA, 20 bp, Artificial sequence
  SiRNA target sequence
cagttagtcttttatatttc

SEQ ID NO: 52252 - DNA, 20 bp, Artificial sequence
  SiRNA target sequence
agttagtcttttatatttcg

SEQ ID NO: 52253 - DNA, 20 bp, Artificial sequence
  SiRNA target sequence
gttagtcttttatatttcga

SEQ ID NO: 52254 - DNA, 20 bp, Artificial sequence
  SiRNA target sequence
ttagtcttttatatttcgat

SEQ ID NO: 52255 - DNA, 20 bp, Artificial sequence
  SiRNA target sequence
tagtcttttatatttcgatt

SEQ ID NO: 52256 - DNA, 20 bp, Artificial sequence
  SiRNA target sequence
agtcttttatatttcgatta

SEQ ID NO: 52257 - DNA, 20 bp, Artificial sequence
  SiRNA target sequence
gtcttttatatttcgattag

SEQ ID NO: 52258 - DNA, 20 bp, Artificial sequence
  SiRNA target sequence
tcttttatatttcgattagt

SEQ ID NO: 52259 - DNA, 20 bp, Artificial sequence
  SiRNA target sequence
cttttatatttcgattagta

SEQ ID NO: 52260 - DNA, 20 bp, Artificial sequence
  SiRNA target sequence
ttttatatttcgattagtaa

SEQ ID NO: 52261 - DNA, 20 bp, Artificial sequence
  SiRNA target sequence
tttatatttcgattagtaaa

SEQ ID NO: 52262 - DNA, 20 bp, Artificial sequence
  SiRNA target sequence
ttatatttcgattagtaaaa

SEQ ID NO: 52263 - DNA, 20 bp, Artificial sequence
  SiRNA target sequence
tatatttcgattagtaaaac

SEQ ID NO: 52264 - DNA, 20 bp, Artificial sequence
  SiRNA target sequence
atatttcgattagtaaaacg

SEQ ID NO: 52265 - DNA, 20 bp, Artificial sequence
  SiRNA target sequence
tatttcgattagtaaaacgt

SEQ ID NO: 52266 - DNA, 20 bp, Artificial sequence
  SiRNA target sequence
atttcgattagtaaaacgtt

SEQ ID NO: 52267 - DNA, 20 bp, Artificial sequence
  SiRNA target sequence
tttcgattagtaaaacgttg

SEQ ID NO: 52268 - DNA, 20 bp, Artificial sequence
  SiRNA target sequence
ttcgattagtaaaacgttga

SEQ ID NO: 52269 - DNA, 20 bp, Artificial sequence
  SiRNA target sequence
tcgattagtaaaacgttgac

SEQ ID NO: 52270 - DNA, 20 bp, Artificial sequence
  SiRNA target sequence
cgattagtaaaacgttgaca

SEQ ID NO: 52271 - DNA, 20 bp, Artificial sequence
  SiRNA target sequence
gattagtaaaacgttgacaa

SEQ ID NO: 52272 - DNA, 20 bp, Artificial sequence
  SiRNA target sequence
attagtaaaacgttgacaaa

SEQ ID NO: 52273 - DNA, 20 bp, Artificial sequence
  SiRNA target sequence
ttagtaaaacgttgacaaat

SEQ ID NO: 52274 - DNA, 20 bp, Artificial sequence
  SiRNA target sequence
tagtaaaacgttgacaaatt

SEQ ID NO: 52275 - DNA, 20 bp, Artificial sequence
  SiRNA target sequence
agtaaaacgttgacaaattc

SEQ ID NO: 52276 - DNA, 20 bp, Artificial sequence
  SiRNA target sequence
gtaaaacgttgacaaattcg

SEQ ID NO: 52277 - DNA, 20 bp, Artificial sequence
  SiRNA target sequence
taaaacgttgacaaattcgt

SEQ ID NO: 52278 - DNA, 20 bp, Artificial sequence
  SiRNA target sequence
aaaacgttgacaaattcgtt

SEQ ID NO: 52279 - DNA, 20 bp, Artificial sequence
  SiRNA target sequence
aaacgttgacaaattcgttg

SEQ ID NO: 52280 - DNA, 20 bp, Artificial sequence
  SiRNA target sequence
aacgttgacaaattcgttga

SEQ ID NO: 52281 - DNA, 20 bp, Artificial sequence
  SiRNA target sequence
acgttgacaaattcgttgag

SEQ ID NO: 52282 - DNA, 20 bp, Artificial sequence
  SiRNA target sequence
cgttgacaaattcgttgagc

SEQ ID NO: 52283 - DNA, 20 bp, Artificial sequence
  SiRNA target sequence
gttgacaaattcgttgagcg

SEQ ID NO: 52284 - DNA, 20 bp, Artificial sequence
  SiRNA target sequence
ttgacaaattcgttgagcga

SEQ ID NO: 52285 - DNA, 20 bp, Artificial sequence
  SiRNA target sequence
tgacaaattcgttgagcgaa

SEQ ID NO: 52286 - DNA, 20 bp, Artificial sequence
  SiRNA target sequence
gacaaattcgttgagcgaaa

SEQ ID NO: 52287 - DNA, 20 bp, Artificial sequence
  SiRNA target sequence
acaaattcgttgagcgaaat

SEQ ID NO: 52288 - DNA, 20 bp, Artificial sequence
  SiRNA target sequence
caaattcgttgagcgaaatg

SEQ ID NO: 52289 - DNA, 20 bp, Artificial sequence
  SiRNA target sequence
aaattcgttgagcgaaatgg

SEQ ID NO: 52290 - DNA, 20 bp, Artificial sequence
  SiRNA target sequence
aattcgttgagcgaaatggg

SEQ ID NO: 52291 - DNA, 20 bp, Artificial sequence
  SiRNA target sequence
attcgttgagcgaaatggga

SEQ ID NO: 52292 - DNA, 20 bp, Artificial sequence
  SiRNA target sequence
ttcgttgagcgaaatgggaa

SEQ ID NO: 52293 - DNA, 20 bp, Artificial sequence
  SiRNA target sequence
tcgttgagcgaaatgggaat

SEQ ID NO: 52294 - DNA, 20 bp, Artificial sequence
  SiRNA target sequence
cgttgagcgaaatgggaatg

SEQ ID NO: 52295 - DNA, 20 bp, Artificial sequence
  SiRNA target sequence
gttgagcgaaatgggaatgc

SEQ ID NO: 52296 - DNA, 20 bp, Artificial sequence
  SiRNA target sequence
ttgagcgaaatgggaatgct

SEQ ID NO: 52297 - DNA, 20 bp, Artificial sequence
  SiRNA target sequence
tgagcgaaatgggaatgcta

SEQ ID NO: 52298 - DNA, 20 bp, Artificial sequence
  SiRNA target sequence
gagcgaaatgggaatgctat

SEQ ID NO: 52299 - DNA, 20 bp, Artificial sequence
  SiRNA target sequence
agcgaaatgggaatgctata

SEQ ID NO: 52300 - DNA, 20 bp, Artificial sequence
  SiRNA target sequence
gcgaaatgggaatgctatac

SEQ ID NO: 52301 - DNA, 20 bp, Artificial sequence
  SiRNA target sequence
cgaaatgggaatgctataca

SEQ ID NO: 52302 - DNA, 20 bp, Artificial sequence
  SiRNA target sequence
gaaatgggaatgctatacac

SEQ ID NO: 52303 - DNA, 20 bp, Artificial sequence
  SiRNA target sequence
aaatgggaatgctatacaca

SEQ ID NO: 52304 - DNA, 20 bp, Artificial sequence
  SiRNA target sequence
aatgggaatgctatacacaa

SEQ ID NO: 52305 - DNA, 20 bp, Artificial sequence
  SiRNA target sequence
atgggaatgctatacacaag

SEQ ID NO: 52306 - DNA, 20 bp, Artificial sequence
  SiRNA target sequence
tgggaatgctatacacaaga

SEQ ID NO: 52307 - DNA, 20 bp, Artificial sequence
  SiRNA target sequence
gggaatgctatacacaagat

SEQ ID NO: 52308 - DNA, 20 bp, Artificial sequence
  SiRNA target sequence
ggaatgctatacacaagata

SEQ ID NO: 52309 - DNA, 20 bp, Artificial sequence
  SiRNA target sequence
gaatgctatacacaagatat

SEQ ID NO: 52310 - DNA, 20 bp, Artificial sequence
  SiRNA target sequence
aatgctatacacaagatatg

SEQ ID NO: 52311 - DNA, 20 bp, Artificial sequence
  SiRNA target sequence
atgctatacacaagatatgt

SEQ ID NO: 52312 - DNA, 20 bp, Artificial sequence
  SiRNA target sequence
tgctatacacaagatatgta

SEQ ID NO: 52313 - DNA, 20 bp, Artificial sequence
  SiRNA target sequence
gctatacacaagatatgtac

SEQ ID NO: 52314 - DNA, 20 bp, Artificial sequence
  SiRNA target sequence
ctatacacaagatatgtaca

SEQ ID NO: 52315 - DNA, 20 bp, Artificial sequence
  SiRNA target sequence
tatacacaagatatgtacaa

SEQ ID NO: 52316 - DNA, 20 bp, Artificial sequence
  SiRNA target sequence
atacacaagatatgtacaag

SEQ ID NO: 52317 - DNA, 20 bp, Artificial sequence
  SiRNA target sequence
tacacaagatatgtacaagg

SEQ ID NO: 52318 - DNA, 20 bp, Artificial sequence
  SiRNA target sequence
acacaagatatgtacaagga

SEQ ID NO: 52319 - DNA, 20 bp, Artificial sequence
  SiRNA target sequence
cacaagatatgtacaaggat

SEQ ID NO: 52320 - DNA, 20 bp, Artificial sequence
  SiRNA target sequence
acaagatatgtacaaggatt

SEQ ID NO: 52321 - DNA, 20 bp, Artificial sequence
  SiRNA target sequence
caagatatgtacaaggattt

SEQ ID NO: 52322 - DNA, 20 bp, Artificial sequence
  SiRNA target sequence
aagatatgtacaaggatttt

SEQ ID NO: 52323 - DNA, 20 bp, Artificial sequence
  SiRNA target sequence
agatatgtacaaggattttt

SEQ ID NO: 52324 - DNA, 20 bp, Artificial sequence
  SiRNA target sequence
gatatgtacaaggattttta

SEQ ID NO: 52325 - DNA, 20 bp, Artificial sequence
  SiRNA target sequence
atatgtacaaggatttttaa

SEQ ID NO: 52326 - DNA, 20 bp, Artificial sequence
  SiRNA target sequence
tatgtacaaggatttttaaa

SEQ ID NO: 52327 - DNA, 20 bp, Artificial sequence
  SiRNA target sequence
atgtacaaggatttttaaat

SEQ ID NO: 52328 - DNA, 20 bp, Artificial sequence
  SiRNA target sequence
tgtacaaggatttttaaatg

SEQ ID NO: 52329 - DNA, 20 bp, Artificial sequence
  SiRNA target sequence
gtacaaggatttttaaatgc

SEQ ID NO: 52330 - DNA, 20 bp, Artificial sequence
  SiRNA target sequence
tacaaggatttttaaatgca

SEQ ID NO: 52331 - DNA, 20 bp, Artificial sequence
  SiRNA target sequence
acaaggatttttaaatgcaa

SEQ ID NO: 52332 - DNA, 20 bp, Artificial sequence
  SiRNA target sequence
caaggatttttaaatgcaaa

SEQ ID NO: 52333 - DNA, 20 bp, Artificial sequence
  SiRNA target sequence
aaggatttttaaatgcaaag

SEQ ID NO: 52334 - DNA, 20 bp, Artificial sequence
  SiRNA target sequence
aggatttttaaatgcaaagt

SEQ ID NO: 52335 - DNA, 20 bp, Artificial sequence
  SiRNA target sequence
ggatttttaaatgcaaagtc

SEQ ID NO: 52336 - DNA, 20 bp, Artificial sequence
  SiRNA target sequence
gatttttaaatgcaaagtct

SEQ ID NO: 52337 - DNA, 20 bp, Artificial sequence
  SiRNA target sequence
atttttaaatgcaaagtctg

SEQ ID NO: 52338 - DNA, 20 bp, Artificial sequence
  SiRNA target sequence
tttttaaatgcaaagtctgg

SEQ ID NO: 52339 - DNA, 20 bp, Artificial sequence
  SiRNA target sequence
ttttaaatgcaaagtctgga

SEQ ID NO: 52340 - DNA, 20 bp, Artificial sequence
  SiRNA target sequence
tttaaatgcaaagtctggat

SEQ ID NO: 52341 - DNA, 20 bp, Artificial sequence
  SiRNA target sequence
ttaaatgcaaagtctggata

SEQ ID NO: 52342 - DNA, 20 bp, Artificial sequence
  SiRNA target sequence
taaatgcaaagtctggatat

SEQ ID NO: 52343 - DNA, 20 bp, Artificial sequence
  SiRNA target sequence
aaatgcaaagtctggatatt

SEQ ID NO: 52344 - DNA, 20 bp, Artificial sequence
  SiRNA target sequence
aatgcaaagtctggatatta

SEQ ID NO: 52345 - DNA, 20 bp, Artificial sequence
  SiRNA target sequence
atgcaaagtctggatattac

SEQ ID NO: 52346 - DNA, 20 bp, Artificial sequence
  SiRNA target sequence
tgcaaagtctggatattacg

SEQ ID NO: 52347 - DNA, 20 bp, Artificial sequence
  SiRNA target sequence
gcaaagtctggatattacga

SEQ ID NO: 52348 - DNA, 20 bp, Artificial sequence
  SiRNA target sequence
caaagtctggatattacgag

SEQ ID NO: 52349 - DNA, 20 bp, Artificial sequence
  SiRNA target sequence
aaagtctggatattacgagt

SEQ ID NO: 52350 - DNA, 20 bp, Artificial sequence
  SiRNA target sequence
aagtctggatattacgagtt

SEQ ID NO: 52351 - DNA, 20 bp, Artificial sequence
  SiRNA target sequence
agtctggatattacgagttt

SEQ ID NO: 52352 - DNA, 20 bp, Artificial sequence
  SiRNA target sequence
gtctggatattacgagttta

SEQ ID NO: 52353 - DNA, 20 bp, Artificial sequence
  SiRNA target sequence
tctggatattacgagtttaa

SEQ ID NO: 52354 - DNA, 20 bp, Artificial sequence
  SiRNA target sequence
ctggatattacgagtttaaa

SEQ ID NO: 52355 - DNA, 20 bp, Artificial sequence
  SiRNA target sequence
tggatattacgagtttaaag

SEQ ID NO: 52356 - DNA, 20 bp, Artificial sequence
  SiRNA target sequence
ggatattacgagtttaaaga

SEQ ID NO: 52357 - DNA, 20 bp, Artificial sequence
  SiRNA target sequence
gatattacgagtttaaagag

SEQ ID NO: 52358 - DNA, 20 bp, Artificial sequence
  SiRNA target sequence
atattacgagtttaaagagg

SEQ ID NO: 52359 - DNA, 20 bp, Artificial sequence
  SiRNA target sequence
tattacgagtttaaagagga

SEQ ID NO: 52360 - DNA, 20 bp, Artificial sequence
  SiRNA target sequence
attacgagtttaaagaggat

SEQ ID NO: 52361 - DNA, 20 bp, Artificial sequence
  SiRNA target sequence
ttacgagtttaaagaggata

SEQ ID NO: 52362 - DNA, 20 bp, Artificial sequence
  SiRNA target sequence
tacgagtttaaagaggatac

SEQ ID NO: 52363 - DNA, 20 bp, Artificial sequence
  SiRNA target sequence
acgagtttaaagaggataca

SEQ ID NO: 52364 - DNA, 20 bp, Artificial sequence
  SiRNA target sequence
cgagtttaaagaggatacac

SEQ ID NO: 52365 - DNA, 20 bp, Artificial sequence
  SiRNA target sequence
gagtttaaagaggatacaca

SEQ ID NO: 52366 - DNA, 20 bp, Artificial sequence
  SiRNA target sequence
agtttaaagaggatacacaa

SEQ ID NO: 52367 - DNA, 20 bp, Artificial sequence
  SiRNA target sequence
gtttaaagaggatacacaaa

SEQ ID NO: 52368 - DNA, 20 bp, Artificial sequence
  SiRNA target sequence
tttaaagaggatacacaaac

SEQ ID NO: 52369 - DNA, 20 bp, Artificial sequence
  SiRNA target sequence
ttaaagaggatacacaaact

SEQ ID NO: 52370 - DNA, 20 bp, Artificial sequence
  SiRNA target sequence
taaagaggatacacaaactg

SEQ ID NO: 52371 - DNA, 20 bp, Artificial sequence
  SiRNA target sequence
aaagaggatacacaaactga

SEQ ID NO: 52372 - DNA, 20 bp, Artificial sequence
  SiRNA target sequence
aagaggatacacaaactgat

SEQ ID NO: 52373 - DNA, 20 bp, Artificial sequence
  SiRNA target sequence
agaggatacacaaactgata

SEQ ID NO: 52374 - DNA, 20 bp, Artificial sequence
  SiRNA target sequence
gaggatacacaaactgataa

SEQ ID NO: 52375 - DNA, 20 bp, Artificial sequence
  SiRNA target sequence
aggatacacaaactgataaa

SEQ ID NO: 52376 - DNA, 20 bp, Artificial sequence
  SiRNA target sequence
ggatacacaaactgataaaa

SEQ ID NO: 52377 - DNA, 20 bp, Artificial sequence
  SiRNA target sequence
gatacacaaactgataaaat

SEQ ID NO: 52378 - DNA, 20 bp, Artificial sequence
  SiRNA target sequence
atacacaaactgataaaata

SEQ ID NO: 52379 - DNA, 20 bp, Artificial sequence
  SiRNA target sequence
tacacaaactgataaaataa

SEQ ID NO: 52380 - DNA, 20 bp, Artificial sequence
  SiRNA target sequence
acacaaactgataaaataag

SEQ ID NO: 52381 - DNA, 20 bp, Artificial sequence
  SiRNA target sequence
cacaaactgataaaataaga

SEQ ID NO: 52382 - DNA, 20 bp, Artificial sequence
  SiRNA target sequence
acaaactgataaaataagac

SEQ ID NO: 52383 - DNA, 20 bp, Artificial sequence
  SiRNA target sequence
caaactgataaaataagact

SEQ ID NO: 52384 - DNA, 20 bp, Artificial sequence
  SiRNA target sequence
aaactgataaaataagactg

SEQ ID NO: 52385 - DNA, 20 bp, Artificial sequence
  SiRNA target sequence
aactgataaaataagactga

SEQ ID NO: 52386 - DNA, 20 bp, Artificial sequence
  SiRNA target sequence
actgataaaataagactgat

SEQ ID NO: 52387 - DNA, 20 bp, Artificial sequence
  SiRNA target sequence
ctgataaaataagactgata

SEQ ID NO: 52388 - DNA, 20 bp, Artificial sequence
  SiRNA target sequence
tgataaaataagactgatag

SEQ ID NO: 52389 - DNA, 20 bp, Artificial sequence
  SiRNA target sequence
gataaaataagactgataga

SEQ ID NO: 52390 - DNA, 20 bp, Artificial sequence
  SiRNA target sequence
ataaaataagactgatagat

SEQ ID NO: 52391 - DNA, 20 bp, Artificial sequence
  SiRNA target sequence
taaaataagactgatagatt

SEQ ID NO: 52392 - DNA, 20 bp, Artificial sequence
  SiRNA target sequence
aaaataagactgatagattt

SEQ ID NO: 52393 - DNA, 20 bp, Artificial sequence
  SiRNA target sequence
aaataagactgatagatttt

SEQ ID NO: 52394 - DNA, 20 bp, Artificial sequence
  SiRNA target sequence
aataagactgatagatttta

SEQ ID NO: 52395 - DNA, 20 bp, Artificial sequence
  SiRNA target sequence
ataagactgatagattttaa

SEQ ID NO: 52396 - DNA, 20 bp, Artificial sequence
  SiRNA target sequence
taagactgatagattttaat

SEQ ID NO: 52397 - DNA, 20 bp, Artificial sequence
  SiRNA target sequence
aagactgatagattttaatg

SEQ ID NO: 52398 - DNA, 20 bp, Artificial sequence
  SiRNA target sequence
agactgatagattttaatga

SEQ ID NO: 52399 - DNA, 20 bp, Artificial sequence
  SiRNA target sequence
gactgatagattttaatgaa

SEQ ID NO: 52400 - DNA, 20 bp, Artificial sequence
  SiRNA target sequence
actgatagattttaatgaaa

SEQ ID NO: 52401 - DNA, 20 bp, Artificial sequence
  SiRNA target sequence
ctgatagattttaatgaaaa

SEQ ID NO: 52402 - DNA, 20 bp, Artificial sequence
  SiRNA target sequence
tgatagattttaatgaaaag

SEQ ID NO: 52403 - DNA, 20 bp, Artificial sequence
  SiRNA target sequence
gatagattttaatgaaaagc

SEQ ID NO: 52404 - DNA, 20 bp, Artificial sequence
  SiRNA target sequence
atagattttaatgaaaagct

SEQ ID NO: 52405 - DNA, 20 bp, Artificial sequence
  SiRNA target sequence
tagattttaatgaaaagcta

SEQ ID NO: 52406 - DNA, 20 bp, Artificial sequence
  SiRNA target sequence
agattttaatgaaaagctag

SEQ ID NO: 52407 - DNA, 20 bp, Artificial sequence
  SiRNA target sequence
gattttaatgaaaagctaga

SEQ ID NO: 52408 - DNA, 20 bp, Artificial sequence
  SiRNA target sequence
attttaatgaaaagctagaa

SEQ ID NO: 52409 - DNA, 20 bp, Artificial sequence
  SiRNA target sequence
ttttaatgaaaagctagaat

SEQ ID NO: 52410 - DNA, 20 bp, Artificial sequence
  SiRNA target sequence
tttaatgaaaagctagaatt

SEQ ID NO: 52411 - DNA, 20 bp, Artificial sequence
  SiRNA target sequence
ttaatgaaaagctagaattt

SEQ ID NO: 52412 - DNA, 20 bp, Artificial sequence
  SiRNA target sequence
taatgaaaagctagaattta

SEQ ID NO: 52413 - DNA, 20 bp, Artificial sequence
  SiRNA target sequence
aatgaaaagctagaatttag

SEQ ID NO: 52414 - DNA, 20 bp, Artificial sequence
  SiRNA target sequence
atgaaaagctagaatttaga

SEQ ID NO: 52415 - DNA, 20 bp, Artificial sequence
  SiRNA target sequence
tgaaaagctagaatttagaa

SEQ ID NO: 52416 - DNA, 20 bp, Artificial sequence
  SiRNA target sequence
gaaaagctagaatttagaaa

SEQ ID NO: 52417 - DNA, 20 bp, Artificial sequence
  SiRNA target sequence
aaaagctagaatttagaaat

SEQ ID NO: 52418 - DNA, 20 bp, Artificial sequence
  SiRNA target sequence
aaagctagaatttagaaatg

SEQ ID NO: 52419 - DNA, 20 bp, Artificial sequence
  SiRNA target sequence
aagctagaatttagaaatgt

SEQ ID NO: 52420 - DNA, 20 bp, Artificial sequence
  SiRNA target sequence
agctagaatttagaaatgta

SEQ ID NO: 52421 - DNA, 20 bp, Artificial sequence
  SiRNA target sequence
gctagaatttagaaatgtat

SEQ ID NO: 52422 - DNA, 20 bp, Artificial sequence
  SiRNA target sequence
ctagaatttagaaatgtatc

SEQ ID NO: 52423 - DNA, 20 bp, Artificial sequence
  SiRNA target sequence
tagaatttagaaatgtatct

SEQ ID NO: 52424 - DNA, 20 bp, Artificial sequence
  SiRNA target sequence
agaatttagaaatgtatctt

SEQ ID NO: 52425 - DNA, 20 bp, Artificial sequence
  SiRNA target sequence
gaatttagaaatgtatcttt

SEQ ID NO: 52426 - DNA, 20 bp, Artificial sequence
  SiRNA target sequence
aatttagaaatgtatctttt

SEQ ID NO: 52427 - DNA, 20 bp, Artificial sequence
  SiRNA target sequence
atttagaaatgtatctttta

SEQ ID NO: 52428 - DNA, 20 bp, Artificial sequence
  SiRNA target sequence
tttagaaatgtatcttttag

SEQ ID NO: 52429 - DNA, 20 bp, Artificial sequence
  SiRNA target sequence
ttagaaatgtatcttttagt

SEQ ID NO: 52430 - DNA, 20 bp, Artificial sequence
  SiRNA target sequence
tagaaatgtatcttttagtt

SEQ ID NO: 52431 - DNA, 20 bp, Artificial sequence
  SiRNA target sequence
agaaatgtatcttttagtta

SEQ ID NO: 52432 - DNA, 20 bp, Artificial sequence
  SiRNA target sequence
gaaatgtatcttttagttat

SEQ ID NO: 52433 - DNA, 20 bp, Artificial sequence
  SiRNA target sequence
aaatgtatcttttagttatt

SEQ ID NO: 52434 - DNA, 20 bp, Artificial sequence
  SiRNA target sequence
aatgtatcttttagttattt

SEQ ID NO: 52435 - DNA, 20 bp, Artificial sequence
  SiRNA target sequence
atgtatcttttagttattta

SEQ ID NO: 52436 - DNA, 20 bp, Artificial sequence
  SiRNA target sequence
tgtatcttttagttatttaa

SEQ ID NO: 52437 - DNA, 20 bp, Artificial sequence
  SiRNA target sequence
gtatcttttagttatttaaa

SEQ ID NO: 52438 - DNA, 20 bp, Artificial sequence
  SiRNA target sequence
tatcttttagttatttaaat

SEQ ID NO: 52439 - DNA, 20 bp, Artificial sequence
  SiRNA target sequence
atcttttagttatttaaata

SEQ ID NO: 52440 - DNA, 20 bp, Artificial sequence
  SiRNA target sequence
tcttttagttatttaaataa

SEQ ID NO: 52441 - DNA, 20 bp, Artificial sequence
  SiRNA target sequence
cttttagttatttaaataag

SEQ ID NO: 52442 - DNA, 20 bp, Artificial sequence
  SiRNA target sequence
ttttagttatttaaataagc

SEQ ID NO: 52443 - DNA, 20 bp, Artificial sequence
  SiRNA target sequence
tttagttatttaaataagcc

SEQ ID NO: 52444 - DNA, 20 bp, Artificial sequence
  SiRNA target sequence
ttagttatttaaataagcct

SEQ ID NO: 52445 - DNA, 20 bp, Artificial sequence
  SiRNA target sequence
tagttatttaaataagccta

SEQ ID NO: 52446 - DNA, 20 bp, Artificial sequence
  SiRNA target sequence
agttatttaaataagcctat

SEQ ID NO: 52447 - DNA, 20 bp, Artificial sequence
  SiRNA target sequence
gttatttaaataagcctatt

SEQ ID NO: 52448 - DNA, 20 bp, Artificial sequence
  SiRNA target sequence
ttatttaaataagcctattt

SEQ ID NO: 52449 - DNA, 20 bp, Artificial sequence
  SiRNA target sequence
tatttaaataagcctatttt

SEQ ID NO: 52450 - DNA, 20 bp, Artificial sequence
  SiRNA target sequence
atttaaataagcctatttta

SEQ ID NO: 52451 - DNA, 20 bp, Artificial sequence
  SiRNA target sequence
tttaaataagcctattttag

SEQ ID NO: 52452 - DNA, 20 bp, Artificial sequence
  SiRNA target sequence
ttaaataagcctattttagt

SEQ ID NO: 52453 - DNA, 20 bp, Artificial sequence
  SiRNA target sequence
taaataagcctattttagtg

SEQ ID NO: 52454 - DNA, 20 bp, Artificial sequence
  SiRNA target sequence
aaataagcctattttagtga

SEQ ID NO: 52455 - DNA, 20 bp, Artificial sequence
  SiRNA target sequence
aataagcctattttagtgaa

SEQ ID NO: 52456 - DNA, 20 bp, Artificial sequence
  SiRNA target sequence
ataagcctattttagtgaat

SEQ ID NO: 52457 - DNA, 20 bp, Artificial sequence
  SiRNA target sequence
taagcctattttagtgaatg

SEQ ID NO: 52458 - DNA, 20 bp, Artificial sequence
  SiRNA target sequence
aagcctattttagtgaatgc

SEQ ID NO: 52459 - DNA, 20 bp, Artificial sequence
  SiRNA target sequence
agcctattttagtgaatgct

SEQ ID NO: 52460 - DNA, 20 bp, Artificial sequence
  SiRNA target sequence
gcctattttagtgaatgcta

SEQ ID NO: 52461 - DNA, 20 bp, Artificial sequence
  SiRNA target sequence
cctattttagtgaatgctaa

SEQ ID NO: 52462 - DNA, 20 bp, Artificial sequence
  SiRNA target sequence
ctattttagtgaatgctaat

SEQ ID NO: 52463 - DNA, 20 bp, Artificial sequence
  SiRNA target sequence
tattttagtgaatgctaatt

SEQ ID NO: 52464 - DNA, 20 bp, Artificial sequence
  SiRNA target sequence
attttagtgaatgctaattt

SEQ ID NO: 52465 - DNA, 20 bp, Artificial sequence
  SiRNA target sequence
ttttagtgaatgctaatttc

SEQ ID NO: 52466 - DNA, 20 bp, Artificial sequence
  SiRNA target sequence
tttagtgaatgctaatttcg

SEQ ID NO: 52467 - DNA, 20 bp, Artificial sequence
  SiRNA target sequence
ttagtgaatgctaatttcgt

SEQ ID NO: 52468 - DNA, 20 bp, Artificial sequence
  SiRNA target sequence
tagtgaatgctaatttcgtt

SEQ ID NO: 52469 - DNA, 20 bp, Artificial sequence
  SiRNA target sequence
agtgaatgctaatttcgtta

SEQ ID NO: 52470 - DNA, 20 bp, Artificial sequence
  SiRNA target sequence
gtgaatgctaatttcgttat

SEQ ID NO: 52471 - DNA, 20 bp, Artificial sequence
  SiRNA target sequence
tgaatgctaatttcgttatt

SEQ ID NO: 52472 - DNA, 20 bp, Artificial sequence
  SiRNA target sequence
gaatgctaatttcgttatta

SEQ ID NO: 52473 - DNA, 20 bp, Artificial sequence
  SiRNA target sequence
aatgctaatttcgttattaa

SEQ ID NO: 52474 - DNA, 20 bp, Artificial sequence
  SiRNA target sequence
atgctaatttcgttattaat

SEQ ID NO: 52475 - DNA, 20 bp, Artificial sequence
  SiRNA target sequence
tgctaatttcgttattaata

SEQ ID NO: 52476 - DNA, 20 bp, Artificial sequence
  SiRNA target sequence
gctaatttcgttattaataa

SEQ ID NO: 52477 - DNA, 20 bp, Artificial sequence
  SiRNA target sequence
ctaatttcgttattaataaa

SEQ ID NO: 52478 - DNA, 20 bp, Artificial sequence
  SiRNA target sequence
taatttcgttattaataaag

SEQ ID NO: 52479 - DNA, 20 bp, Artificial sequence
  SiRNA target sequence
aatttcgttattaataaagg

SEQ ID NO: 52480 - DNA, 20 bp, Artificial sequence
  SiRNA target sequence
atttcgttattaataaaggg

SEQ ID NO: 52481 - DNA, 20 bp, Artificial sequence
  SiRNA target sequence
tttcgttattaataaagggg

SEQ ID NO: 52482 - DNA, 20 bp, Artificial sequence
  SiRNA target sequence
ttcgttattaataaagggga

SEQ ID NO: 52483 - DNA, 20 bp, Artificial sequence
  SiRNA target sequence
tcgttattaataaaggggag

SEQ ID NO: 52484 - DNA, 20 bp, Artificial sequence
  SiRNA target sequence
cgttattaataaaggggagc

SEQ ID NO: 52485 - DNA, 20 bp, Artificial sequence
  SiRNA target sequence
gttattaataaaggggagcg

SEQ ID NO: 52486 - DNA, 20 bp, Artificial sequence
  SiRNA target sequence
ttattaataaaggggagcgt

SEQ ID NO: 52487 - DNA, 20 bp, Artificial sequence
  SiRNA target sequence
tattaataaaggggagcgtg

SEQ ID NO: 52488 - DNA, 20 bp, Artificial sequence
  SiRNA target sequence
attaataaaggggagcgtgt

SEQ ID NO: 52489 - DNA, 20 bp, Artificial sequence
  SiRNA target sequence
ttaataaaggggagcgtgtt

SEQ ID NO: 52490 - DNA, 20 bp, Artificial sequence
  SiRNA target sequence
taataaaggggagcgtgttg

SEQ ID NO: 52491 - DNA, 20 bp, Artificial sequence
  SiRNA target sequence
aataaaggggagcgtgttgc

SEQ ID NO: 52492 - DNA, 20 bp, Artificial sequence
  SiRNA target sequence
ataaaggggagcgtgttgct

SEQ ID NO: 52493 - DNA, 20 bp, Artificial sequence
  SiRNA target sequence
taaaggggagcgtgttgcta

SEQ ID NO: 52494 - DNA, 20 bp, Artificial sequence
  SiRNA target sequence
aaaggggagcgtgttgctat

SEQ ID NO: 52495 - DNA, 20 bp, Artificial sequence
  SiRNA target sequence
aaggggagcgtgttgctatt

SEQ ID NO: 52496 - DNA, 20 bp, Artificial sequence
  SiRNA target sequence
aggggagcgtgttgctatta

SEQ ID NO: 52497 - DNA, 20 bp, Artificial sequence
  SiRNA target sequence
ggggagcgtgttgctattat

SEQ ID NO: 52498 - DNA, 20 bp, Artificial sequence
  SiRNA target sequence
gggagcgtgttgctattata

SEQ ID NO: 52499 - DNA, 20 bp, Artificial sequence
  SiRNA target sequence
ggagcgtgttgctattatag

SEQ ID NO: 52500 - DNA, 20 bp, Artificial sequence
  SiRNA target sequence
gagcgtgttgctattatagg

SEQ ID NO: 52501 - DNA, 20 bp, Artificial sequence
  SiRNA target sequence
agcgtgttgctattatagga

SEQ ID NO: 52502 - DNA, 20 bp, Artificial sequence
  SiRNA target sequence
gcgtgttgctattataggaa

SEQ ID NO: 52503 - DNA, 20 bp, Artificial sequence
  SiRNA target sequence
cgtgttgctattataggaaa

SEQ ID NO: 52504 - DNA, 20 bp, Artificial sequence
  SiRNA target sequence
gtgttgctattataggaaaa

SEQ ID NO: 52505 - DNA, 20 bp, Artificial sequence
  SiRNA target sequence
tgttgctattataggaaaaa

SEQ ID NO: 52506 - DNA, 20 bp, Artificial sequence
  SiRNA target sequence
gttgctattataggaaaaaa

SEQ ID NO: 52507 - DNA, 20 bp, Artificial sequence
  SiRNA target sequence
ttgctattataggaaaaaat

SEQ ID NO: 52508 - DNA, 20 bp, Artificial sequence
  SiRNA target sequence
tgctattataggaaaaaatg

SEQ ID NO: 52509 - DNA, 20 bp, Artificial sequence
  SiRNA target sequence
gctattataggaaaaaatgg

SEQ ID NO: 52510 - DNA, 20 bp, Artificial sequence
  SiRNA target sequence
ctattataggaaaaaatgga

SEQ ID NO: 52511 - DNA, 20 bp, Artificial sequence
  SiRNA target sequence
tattataggaaaaaatggaa

SEQ ID NO: 52512 - DNA, 20 bp, Artificial sequence
  SiRNA target sequence
attataggaaaaaatggaac

SEQ ID NO: 52513 - DNA, 20 bp, Artificial sequence
  SiRNA target sequence
ttataggaaaaaatggaaca

SEQ ID NO: 52514 - DNA, 20 bp, Artificial sequence
  SiRNA target sequence
tataggaaaaaatggaacag

SEQ ID NO: 52515 - DNA, 20 bp, Artificial sequence
  SiRNA target sequence
ataggaaaaaatggaacagg

SEQ ID NO: 52516 - DNA, 20 bp, Artificial sequence
  SiRNA target sequence
taggaaaaaatggaacaggt

SEQ ID NO: 52517 - DNA, 20 bp, Artificial sequence
  SiRNA target sequence
aggaaaaaatggaacaggta

SEQ ID NO: 52518 - DNA, 20 bp, Artificial sequence
  SiRNA target sequence
ggaaaaaatggaacaggtaa

SEQ ID NO: 52519 - DNA, 20 bp, Artificial sequence
  SiRNA target sequence
gaaaaaatggaacaggtaaa

SEQ ID NO: 52520 - DNA, 20 bp, Artificial sequence
  SiRNA target sequence
aaaaaatggaacaggtaaaa

SEQ ID NO: 52521 - DNA, 20 bp, Artificial sequence
  SiRNA target sequence
aaaaatggaacaggtaaaag

SEQ ID NO: 52522 - DNA, 20 bp, Artificial sequence
  SiRNA target sequence
aaaatggaacaggtaaaagt

SEQ ID NO: 52523 - DNA, 20 bp, Artificial sequence
  SiRNA target sequence
aaatggaacaggtaaaagta

SEQ ID NO: 52524 - DNA, 20 bp, Artificial sequence
  SiRNA target sequence
aatggaacaggtaaaagtac

SEQ ID NO: 52525 - DNA, 20 bp, Artificial sequence
  SiRNA target sequence
atggaacaggtaaaagtaca

SEQ ID NO: 52526 - DNA, 20 bp, Artificial sequence
  SiRNA target sequence
tggaacaggtaaaagtacaa

SEQ ID NO: 52527 - DNA, 20 bp, Artificial sequence
  SiRNA target sequence
ggaacaggtaaaagtacaat

SEQ ID NO: 52528 - DNA, 20 bp, Artificial sequence
  SiRNA target sequence
gaacaggtaaaagtacaata

SEQ ID NO: 52529 - DNA, 20 bp, Artificial sequence
  SiRNA target sequence
aacaggtaaaagtacaataa

SEQ ID NO: 52530 - DNA, 20 bp, Artificial sequence
  SiRNA target sequence
acaggtaaaagtacaataat

SEQ ID NO: 52531 - DNA, 20 bp, Artificial sequence
  SiRNA target sequence
caggtaaaagtacaataata

SEQ ID NO: 52532 - DNA, 20 bp, Artificial sequence
  SiRNA target sequence
aggtaaaagtacaataataa

SEQ ID NO: 52533 - DNA, 20 bp, Artificial sequence
  SiRNA target sequence
ggtaaaagtacaataataaa

SEQ ID NO: 52534 - DNA, 20 bp, Artificial sequence
  SiRNA target sequence
gtaaaagtacaataataaaa

SEQ ID NO: 52535 - DNA, 20 bp, Artificial sequence
  SiRNA target sequence
taaaagtacaataataaaat

SEQ ID NO: 52536 - DNA, 20 bp, Artificial sequence
  SiRNA target sequence
aaaagtacaataataaaatt

SEQ ID NO: 52537 - DNA, 20 bp, Artificial sequence
  SiRNA target sequence
aaagtacaataataaaattg

SEQ ID NO: 52538 - DNA, 20 bp, Artificial sequence
  SiRNA target sequence
aagtacaataataaaattgt

SEQ ID NO: 52539 - DNA, 20 bp, Artificial sequence
  SiRNA target sequence
agtacaataataaaattgtt

SEQ ID NO: 52540 - DNA, 20 bp, Artificial sequence
  SiRNA target sequence
gtacaataataaaattgtta

SEQ ID NO: 52541 - DNA, 20 bp, Artificial sequence
  SiRNA target sequence
tacaataataaaattgttaa

SEQ ID NO: 52542 - DNA, 20 bp, Artificial sequence
  SiRNA target sequence
acaataataaaattgttaat

SEQ ID NO: 52543 - DNA, 20 bp, Artificial sequence
  SiRNA target sequence
caataataaaattgttaatg

SEQ ID NO: 52544 - DNA, 20 bp, Artificial sequence
  SiRNA target sequence
aataataaaattgttaatga

SEQ ID NO: 52545 - DNA, 20 bp, Artificial sequence
  SiRNA target sequence
ataataaaattgttaatgaa

SEQ ID NO: 52546 - DNA, 20 bp, Artificial sequence
  SiRNA target sequence
taataaaattgttaatgaaa

SEQ ID NO: 52547 - DNA, 20 bp, Artificial sequence
  SiRNA target sequence
aataaaattgttaatgaaat

SEQ ID NO: 52548 - DNA, 20 bp, Artificial sequence
  SiRNA target sequence
ataaaattgttaatgaaatt

SEQ ID NO: 52549 - DNA, 20 bp, Artificial sequence
  SiRNA target sequence
taaaattgttaatgaaattt

SEQ ID NO: 52550 - DNA, 20 bp, Artificial sequence
  SiRNA target sequence
aaaattgttaatgaaatttt

SEQ ID NO: 52551 - DNA, 20 bp, Artificial sequence
  SiRNA target sequence
aaattgttaatgaaatttta

SEQ ID NO: 52552 - DNA, 20 bp, Artificial sequence
  SiRNA target sequence
aattgttaatgaaattttat

SEQ ID NO: 52553 - DNA, 20 bp, Artificial sequence
  SiRNA target sequence
attgttaatgaaattttata

SEQ ID NO: 52554 - DNA, 20 bp, Artificial sequence
  SiRNA target sequence
ttgttaatgaaattttataa

SEQ ID NO: 52555 - DNA, 20 bp, Artificial sequence
  SiRNA target sequence
tgttaatgaaattttataaa

SEQ ID NO: 52556 - DNA, 20 bp, Artificial sequence
  SiRNA target sequence
gttaatgaaattttataaat

SEQ ID NO: 52557 - DNA, 20 bp, Artificial sequence
  SiRNA target sequence
ttaatgaaattttataaata

SEQ ID NO: 52558 - DNA, 20 bp, Artificial sequence
  SiRNA target sequence
taatgaaattttataaatat

SEQ ID NO: 52559 - DNA, 20 bp, Artificial sequence
  SiRNA target sequence
aatgaaattttataaatatg

SEQ ID NO: 52560 - DNA, 20 bp, Artificial sequence
  SiRNA target sequence
atgaaattttataaatatga

SEQ ID NO: 52561 - DNA, 20 bp, Artificial sequence
  SiRNA target sequence
tgaaattttataaatatgat

SEQ ID NO: 52562 - DNA, 20 bp, Artificial sequence
  SiRNA target sequence
gaaattttataaatatgatg

SEQ ID NO: 52563 - DNA, 20 bp, Artificial sequence
  SiRNA target sequence
aaattttataaatatgatgg

SEQ ID NO: 52564 - DNA, 20 bp, Artificial sequence
  SiRNA target sequence
aattttataaatatgatgga

SEQ ID NO: 52565 - DNA, 20 bp, Artificial sequence
  SiRNA target sequence
attttataaatatgatggag

SEQ ID NO: 52566 - DNA, 20 bp, Artificial sequence
  SiRNA target sequence
ttttataaatatgatggaga

SEQ ID NO: 52567 - DNA, 20 bp, Artificial sequence
  SiRNA target sequence
tttataaatatgatggagat

SEQ ID NO: 52568 - DNA, 20 bp, Artificial sequence
  SiRNA target sequence
ttataaatatgatggagata

SEQ ID NO: 52569 - DNA, 20 bp, Artificial sequence
  SiRNA target sequence
tataaatatgatggagatat

SEQ ID NO: 52570 - DNA, 20 bp, Artificial sequence
  SiRNA target sequence
ataaatatgatggagatata

SEQ ID NO: 52571 - DNA, 20 bp, Artificial sequence
  SiRNA target sequence
taaatatgatggagatatat

SEQ ID NO: 52572 - DNA, 20 bp, Artificial sequence
  SiRNA target sequence
aaatatgatggagatatatt

SEQ ID NO: 52573 - DNA, 20 bp, Artificial sequence
  SiRNA target sequence
aatatgatggagatatatta

SEQ ID NO: 52574 - DNA, 20 bp, Artificial sequence
  SiRNA target sequence
atatgatggagatatattaa

SEQ ID NO: 52575 - DNA, 20 bp, Artificial sequence
  SiRNA target sequence
tatgatggagatatattaat

SEQ ID NO: 52576 - DNA, 20 bp, Artificial sequence
  SiRNA target sequence
atgatggagatatattaatt

SEQ ID NO: 52577 - DNA, 20 bp, Artificial sequence
  SiRNA target sequence
tgatggagatatattaattg

SEQ ID NO: 52578 - DNA, 20 bp, Artificial sequence
  SiRNA target sequence
gatggagatatattaattga

SEQ ID NO: 52579 - DNA, 20 bp, Artificial sequence
  SiRNA target sequence
atggagatatattaattgat

SEQ ID NO: 52580 - DNA, 20 bp, Artificial sequence
  SiRNA target sequence
tggagatatattaattgatg

SEQ ID NO: 52581 - DNA, 20 bp, Artificial sequence
  SiRNA target sequence
ggagatatattaattgatga

SEQ ID NO: 52582 - DNA, 20 bp, Artificial sequence
  SiRNA target sequence
gagatatattaattgatgat

SEQ ID NO: 52583 - DNA, 20 bp, Artificial sequence
  SiRNA target sequence
agatatattaattgatgata

SEQ ID NO: 52584 - DNA, 20 bp, Artificial sequence
  SiRNA target sequence
gatatattaattgatgatac

SEQ ID NO: 52585 - DNA, 20 bp, Artificial sequence
  SiRNA target sequence
atatattaattgatgataca

SEQ ID NO: 52586 - DNA, 20 bp, Artificial sequence
  SiRNA target sequence
tatattaattgatgatacag

SEQ ID NO: 52587 - DNA, 20 bp, Artificial sequence
  SiRNA target sequence
atattaattgatgatacaga

SEQ ID NO: 52588 - DNA, 20 bp, Artificial sequence
  SiRNA target sequence
tattaattgatgatacagaa

SEQ ID NO: 52589 - DNA, 20 bp, Artificial sequence
  SiRNA target sequence
attaattgatgatacagaaa

SEQ ID NO: 52590 - DNA, 20 bp, Artificial sequence
  SiRNA target sequence
ttaattgatgatacagaaat

SEQ ID NO: 52591 - DNA, 20 bp, Artificial sequence
  SiRNA target sequence
taattgatgatacagaaata

SEQ ID NO: 52592 - DNA, 20 bp, Artificial sequence
  SiRNA target sequence
aattgatgatacagaaatag

SEQ ID NO: 52593 - DNA, 20 bp, Artificial sequence
  SiRNA target sequence
attgatgatacagaaataga

SEQ ID NO: 52594 - DNA, 20 bp, Artificial sequence
  SiRNA target sequence
ttgatgatacagaaatagat

SEQ ID NO: 52595 - DNA, 20 bp, Artificial sequence
  SiRNA target sequence
tgatgatacagaaatagata

SEQ ID NO: 52596 - DNA, 20 bp, Artificial sequence
  SiRNA target sequence
gatgatacagaaatagataa

SEQ ID NO: 52597 - DNA, 20 bp, Artificial sequence
  SiRNA target sequence
atgatacagaaatagataat

SEQ ID NO: 52598 - DNA, 20 bp, Artificial sequence
  SiRNA target sequence
tgatacagaaatagataata

SEQ ID NO: 52599 - DNA, 20 bp, Artificial sequence
  SiRNA target sequence
gatacagaaatagataatat

SEQ ID NO: 52600 - DNA, 20 bp, Artificial sequence
  SiRNA target sequence
atacagaaatagataatatt

SEQ ID NO: 52601 - DNA, 20 bp, Artificial sequence
  SiRNA target sequence
tacagaaatagataatattt

SEQ ID NO: 52602 - DNA, 20 bp, Artificial sequence
  SiRNA target sequence
acagaaatagataatatttc

SEQ ID NO: 52603 - DNA, 20 bp, Artificial sequence
  SiRNA target sequence
cagaaatagataatatttcg

SEQ ID NO: 52604 - DNA, 20 bp, Artificial sequence
  SiRNA target sequence
agaaatagataatatttcgg

SEQ ID NO: 52605 - DNA, 20 bp, Artificial sequence
  SiRNA target sequence
gaaatagataatatttcgga

SEQ ID NO: 52606 - DNA, 20 bp, Artificial sequence
  SiRNA target sequence
aaatagataatatttcggat

SEQ ID NO: 52607 - DNA, 20 bp, Artificial sequence
  SiRNA target sequence
aatagataatatttcggata

SEQ ID NO: 52608 - DNA, 20 bp, Artificial sequence
  SiRNA target sequence
atagataatatttcggatag

SEQ ID NO: 52609 - DNA, 20 bp, Artificial sequence
  SiRNA target sequence
tagataatatttcggataga

SEQ ID NO: 52610 - DNA, 20 bp, Artificial sequence
  SiRNA target sequence
agataatatttcggatagaa

SEQ ID NO: 52611 - DNA, 20 bp, Artificial sequence
  SiRNA target sequence
gataatatttcggatagaag

SEQ ID NO: 52612 - DNA, 20 bp, Artificial sequence
  SiRNA target sequence
ataatatttcggatagaagt

SEQ ID NO: 52613 - DNA, 20 bp, Artificial sequence
  SiRNA target sequence
taatatttcggatagaagtt

SEQ ID NO: 52614 - DNA, 20 bp, Artificial sequence
  SiRNA target sequence
aatatttcggatagaagtta

SEQ ID NO: 52615 - DNA, 20 bp, Artificial sequence
  SiRNA target sequence
atatttcggatagaagttac

SEQ ID NO: 52616 - DNA, 20 bp, Artificial sequence
  SiRNA target sequence
tatttcggatagaagttaca

SEQ ID NO: 52617 - DNA, 20 bp, Artificial sequence
  SiRNA target sequence
atttcggatagaagttacag

SEQ ID NO: 52618 - DNA, 20 bp, Artificial sequence
  SiRNA target sequence
tttcggatagaagttacaga

SEQ ID NO: 52619 - DNA, 20 bp, Artificial sequence
  SiRNA target sequence
ttcggatagaagttacagaa

SEQ ID NO: 52620 - DNA, 20 bp, Artificial sequence
  SiRNA target sequence
tcggatagaagttacagaag

SEQ ID NO: 52621 - DNA, 20 bp, Artificial sequence
  SiRNA target sequence
cggatagaagttacagaagt

SEQ ID NO: 52622 - DNA, 20 bp, Artificial sequence
  SiRNA target sequence
ggatagaagttacagaagtt

SEQ ID NO: 52623 - DNA, 20 bp, Artificial sequence
  SiRNA target sequence
gatagaagttacagaagttt

SEQ ID NO: 52624 - DNA, 20 bp, Artificial sequence
  SiRNA target sequence
atagaagttacagaagttta

SEQ ID NO: 52625 - DNA, 20 bp, Artificial sequence
  SiRNA target sequence
tagaagttacagaagtttaa

SEQ ID NO: 52626 - DNA, 20 bp, Artificial sequence
  SiRNA target sequence
agaagttacagaagtttaat

SEQ ID NO: 52627 - DNA, 20 bp, Artificial sequence
  SiRNA target sequence
gaagttacagaagtttaata

SEQ ID NO: 52628 - DNA, 20 bp, Artificial sequence
  SiRNA target sequence
aagttacagaagtttaatat

SEQ ID NO: 52629 - DNA, 20 bp, Artificial sequence
  SiRNA target sequence
agttacagaagtttaatatc

SEQ ID NO: 52630 - DNA, 20 bp, Artificial sequence
  SiRNA target sequence
gttacagaagtttaatatca

SEQ ID NO: 52631 - DNA, 20 bp, Artificial sequence
  SiRNA target sequence
ttacagaagtttaatatcat

SEQ ID NO: 52632 - DNA, 20 bp, Artificial sequence
  SiRNA target sequence
tacagaagtttaatatcata

SEQ ID NO: 52633 - DNA, 20 bp, Artificial sequence
  SiRNA target sequence
acagaagtttaatatcatat

SEQ ID NO: 52634 - DNA, 20 bp, Artificial sequence
  SiRNA target sequence
cagaagtttaatatcatatg

SEQ ID NO: 52635 - DNA, 20 bp, Artificial sequence
  SiRNA target sequence
agaagtttaatatcatatgc

SEQ ID NO: 52636 - DNA, 20 bp, Artificial sequence
  SiRNA target sequence
gaagtttaatatcatatgca

SEQ ID NO: 52637 - DNA, 20 bp, Artificial sequence
  SiRNA target sequence
aagtttaatatcatatgcaa

SEQ ID NO: 52638 - DNA, 20 bp, Artificial sequence
  SiRNA target sequence
agtttaatatcatatgcaac

SEQ ID NO: 52639 - DNA, 20 bp, Artificial sequence
  SiRNA target sequence
gtttaatatcatatgcaaca

SEQ ID NO: 52640 - DNA, 20 bp, Artificial sequence
  SiRNA target sequence
tttaatatcatatgcaacac

SEQ ID NO: 52641 - DNA, 20 bp, Artificial sequence
  SiRNA target sequence
ttaatatcatatgcaacaca

SEQ ID NO: 52642 - DNA, 20 bp, Artificial sequence
  SiRNA target sequence
taatatcatatgcaacacaa

SEQ ID NO: 52643 - DNA, 20 bp, Artificial sequence
  SiRNA target sequence
aatatcatatgcaacacaaa

SEQ ID NO: 52644 - DNA, 20 bp, Artificial sequence
  SiRNA target sequence
atatcatatgcaacacaaaa

SEQ ID NO: 52645 - DNA, 20 bp, Artificial sequence
  SiRNA target sequence
tatcatatgcaacacaaaac

SEQ ID NO: 52646 - DNA, 20 bp, Artificial sequence
  SiRNA target sequence
atcatatgcaacacaaaaca

SEQ ID NO: 52647 - DNA, 20 bp, Artificial sequence
  SiRNA target sequence
tcatatgcaacacaaaacac

SEQ ID NO: 52648 - DNA, 20 bp, Artificial sequence
  SiRNA target sequence
catatgcaacacaaaacacg

SEQ ID NO: 52649 - DNA, 20 bp, Artificial sequence
  SiRNA target sequence
atatgcaacacaaaacacgt

SEQ ID NO: 52650 - DNA, 20 bp, Artificial sequence
  SiRNA target sequence
tatgcaacacaaaacacgtt

SEQ ID NO: 52651 - DNA, 20 bp, Artificial sequence
  SiRNA target sequence
atgcaacacaaaacacgttc

SEQ ID NO: 52652 - DNA, 20 bp, Artificial sequence
  SiRNA target sequence
tgcaacacaaaacacgttct

SEQ ID NO: 52653 - DNA, 20 bp, Artificial sequence
  SiRNA target sequence
gcaacacaaaacacgttctt

SEQ ID NO: 52654 - DNA, 20 bp, Artificial sequence
  SiRNA target sequence
caacacaaaacacgttctta

SEQ ID NO: 52655 - DNA, 20 bp, Artificial sequence
  SiRNA target sequence
aacacaaaacacgttcttat

SEQ ID NO: 52656 - DNA, 20 bp, Artificial sequence
  SiRNA target sequence
acacaaaacacgttcttatt

SEQ ID NO: 52657 - DNA, 20 bp, Artificial sequence
  SiRNA target sequence
cacaaaacacgttcttattc

SEQ ID NO: 52658 - DNA, 20 bp, Artificial sequence
  SiRNA target sequence
acaaaacacgttcttattcg

SEQ ID NO: 52659 - DNA, 20 bp, Artificial sequence
  SiRNA target sequence
caaaacacgttcttattcga

SEQ ID NO: 52660 - DNA, 20 bp, Artificial sequence
  SiRNA target sequence
aaaacacgttcttattcgat

SEQ ID NO: 52661 - DNA, 20 bp, Artificial sequence
  SiRNA target sequence
aaacacgttcttattcgata

SEQ ID NO: 52662 - DNA, 20 bp, Artificial sequence
  SiRNA target sequence
aacacgttcttattcgataa

SEQ ID NO: 52663 - DNA, 20 bp, Artificial sequence
  SiRNA target sequence
acacgttcttattcgataat

SEQ ID NO: 52664 - DNA, 20 bp, Artificial sequence
  SiRNA target sequence
cacgttcttattcgataata

SEQ ID NO: 52665 - DNA, 20 bp, Artificial sequence
  SiRNA target sequence
acgttcttattcgataatac

SEQ ID NO: 52666 - DNA, 20 bp, Artificial sequence
  SiRNA target sequence
cgttcttattcgataatact

SEQ ID NO: 52667 - DNA, 20 bp, Artificial sequence
  SiRNA target sequence
gttcttattcgataatactg

SEQ ID NO: 52668 - DNA, 20 bp, Artificial sequence
  SiRNA target sequence
ttcttattcgataatactgt

SEQ ID NO: 52669 - DNA, 20 bp, Artificial sequence
  SiRNA target sequence
tcttattcgataatactgtg

SEQ ID NO: 52670 - DNA, 20 bp, Artificial sequence
  SiRNA target sequence
cttattcgataatactgtga

SEQ ID NO: 52671 - DNA, 20 bp, Artificial sequence
  SiRNA target sequence
ttattcgataatactgtgac

SEQ ID NO: 52672 - DNA, 20 bp, Artificial sequence
  SiRNA target sequence
tattcgataatactgtgaca

SEQ ID NO: 52673 - DNA, 20 bp, Artificial sequence
  SiRNA target sequence
attcgataatactgtgacat

SEQ ID NO: 52674 - DNA, 20 bp, Artificial sequence
  SiRNA target sequence
ttcgataatactgtgacata

SEQ ID NO: 52675 - DNA, 20 bp, Artificial sequence
  SiRNA target sequence
tcgataatactgtgacatac

SEQ ID NO: 52676 - DNA, 20 bp, Artificial sequence
  SiRNA target sequence
cgataatactgtgacataca

SEQ ID NO: 52677 - DNA, 20 bp, Artificial sequence
  SiRNA target sequence
gataatactgtgacatacaa

SEQ ID NO: 52678 - DNA, 20 bp, Artificial sequence
  SiRNA target sequence
ataatactgtgacatacaat

SEQ ID NO: 52679 - DNA, 20 bp, Artificial sequence
  SiRNA target sequence
taatactgtgacatacaata

SEQ ID NO: 52680 - DNA, 20 bp, Artificial sequence
  SiRNA target sequence
aatactgtgacatacaatat

SEQ ID NO: 52681 - DNA, 20 bp, Artificial sequence
  SiRNA target sequence
atactgtgacatacaatata

SEQ ID NO: 52682 - DNA, 20 bp, Artificial sequence
  SiRNA target sequence
tactgtgacatacaatatat

SEQ ID NO: 52683 - DNA, 20 bp, Artificial sequence
  SiRNA target sequence
actgtgacatacaatatatt

SEQ ID NO: 52684 - DNA, 20 bp, Artificial sequence
  SiRNA target sequence
ctgtgacatacaatatattt

SEQ ID NO: 52685 - DNA, 20 bp, Artificial sequence
  SiRNA target sequence
tgtgacatacaatatatttt

SEQ ID NO: 52686 - DNA, 20 bp, Artificial sequence
  SiRNA target sequence
gtgacatacaatatatttta

SEQ ID NO: 52687 - DNA, 20 bp, Artificial sequence
  SiRNA target sequence
tgacatacaatatattttac

SEQ ID NO: 52688 - DNA, 20 bp, Artificial sequence
  SiRNA target sequence
gacatacaatatattttacg

SEQ ID NO: 52689 - DNA, 20 bp, Artificial sequence
  SiRNA target sequence
acatacaatatattttacgg

SEQ ID NO: 52690 - DNA, 20 bp, Artificial sequence
  SiRNA target sequence
catacaatatattttacggg

SEQ ID NO: 52691 - DNA, 20 bp, Artificial sequence
  SiRNA target sequence
atacaatatattttacggga

SEQ ID NO: 52692 - DNA, 20 bp, Artificial sequence
  SiRNA target sequence
tacaatatattttacgggac

SEQ ID NO: 52693 - DNA, 20 bp, Artificial sequence
  SiRNA target sequence
acaatatattttacgggact

SEQ ID NO: 52694 - DNA, 20 bp, Artificial sequence
  SiRNA target sequence
caatatattttacgggacta

SEQ ID NO: 52695 - DNA, 20 bp, Artificial sequence
  SiRNA target sequence
aatatattttacgggactaa

SEQ ID NO: 52696 - DNA, 20 bp, Artificial sequence
  SiRNA target sequence
atatattttacgggactaaa

SEQ ID NO: 52697 - DNA, 20 bp, Artificial sequence
  SiRNA target sequence
tatattttacgggactaaaa

SEQ ID NO: 52698 - DNA, 20 bp, Artificial sequence
  SiRNA target sequence
atattttacgggactaaaaa

SEQ ID NO: 52699 - DNA, 20 bp, Artificial sequence
  SiRNA target sequence
tattttacgggactaaaaac

SEQ ID NO: 52700 - DNA, 20 bp, Artificial sequence
  SiRNA target sequence
attttacgggactaaaaacg

SEQ ID NO: 52701 - DNA, 20 bp, Artificial sequence
  SiRNA target sequence
ttttacgggactaaaaacgt

SEQ ID NO: 52702 - DNA, 20 bp, Artificial sequence
  SiRNA target sequence
tttacgggactaaaaacgta

SEQ ID NO: 52703 - DNA, 20 bp, Artificial sequence
  SiRNA target sequence
ttacgggactaaaaacgtaa

SEQ ID NO: 52704 - DNA, 20 bp, Artificial sequence
  SiRNA target sequence
tacgggactaaaaacgtaac

SEQ ID NO: 52705 - DNA, 20 bp, Artificial sequence
  SiRNA target sequence
acgggactaaaaacgtaaca

SEQ ID NO: 52706 - DNA, 20 bp, Artificial sequence
  SiRNA target sequence
cgggactaaaaacgtaacag

SEQ ID NO: 52707 - DNA, 20 bp, Artificial sequence
  SiRNA target sequence
gggactaaaaacgtaacaga

SEQ ID NO: 52708 - DNA, 20 bp, Artificial sequence
  SiRNA target sequence
ggactaaaaacgtaacagaa

SEQ ID NO: 52709 - DNA, 20 bp, Artificial sequence
  SiRNA target sequence
gactaaaaacgtaacagaaa

SEQ ID NO: 52710 - DNA, 20 bp, Artificial sequence
  SiRNA target sequence
actaaaaacgtaacagaaaa

SEQ ID NO: 52711 - DNA, 20 bp, Artificial sequence
  SiRNA target sequence
ctaaaaacgtaacagaaaaa

SEQ ID NO: 52712 - DNA, 20 bp, Artificial sequence
  SiRNA target sequence
taaaaacgtaacagaaaaag

SEQ ID NO: 52713 - DNA, 20 bp, Artificial sequence
  SiRNA target sequence
aaaaacgtaacagaaaaaga

SEQ ID NO: 52714 - DNA, 20 bp, Artificial sequence
  SiRNA target sequence
aaaacgtaacagaaaaagaa

SEQ ID NO: 52715 - DNA, 20 bp, Artificial sequence
  SiRNA target sequence
aaacgtaacagaaaaagaag

SEQ ID NO: 52716 - DNA, 20 bp, Artificial sequence
  SiRNA target sequence
aacgtaacagaaaaagaagt

SEQ ID NO: 52717 - DNA, 20 bp, Artificial sequence
  SiRNA target sequence
acgtaacagaaaaagaagtt

SEQ ID NO: 52718 - DNA, 20 bp, Artificial sequence
  SiRNA target sequence
cgtaacagaaaaagaagttt

SEQ ID NO: 52719 - DNA, 20 bp, Artificial sequence
  SiRNA target sequence
gtaacagaaaaagaagtttt

SEQ ID NO: 52720 - DNA, 20 bp, Artificial sequence
  SiRNA target sequence
taacagaaaaagaagtttta

SEQ ID NO: 52721 - DNA, 20 bp, Artificial sequence
  SiRNA target sequence
aacagaaaaagaagttttag

SEQ ID NO: 52722 - DNA, 20 bp, Artificial sequence
  SiRNA target sequence
acagaaaaagaagttttaga

SEQ ID NO: 52723 - DNA, 20 bp, Artificial sequence
  SiRNA target sequence
cagaaaaagaagttttagaa

SEQ ID NO: 52724 - DNA, 20 bp, Artificial sequence
  SiRNA target sequence
agaaaaagaagttttagaat

SEQ ID NO: 52725 - DNA, 20 bp, Artificial sequence
  SiRNA target sequence
gaaaaagaagttttagaatt

SEQ ID NO: 52726 - DNA, 20 bp, Artificial sequence
  SiRNA target sequence
aaaaagaagttttagaatta

SEQ ID NO: 52727 - DNA, 20 bp, Artificial sequence
  SiRNA target sequence
aaaagaagttttagaattag

SEQ ID NO: 52728 - DNA, 20 bp, Artificial sequence
  SiRNA target sequence
aaagaagttttagaattagc

SEQ ID NO: 52729 - DNA, 20 bp, Artificial sequence
  SiRNA target sequence
aagaagttttagaattagcc

SEQ ID NO: 52730 - DNA, 20 bp, Artificial sequence
  SiRNA target sequence
agaagttttagaattagcca

SEQ ID NO: 52731 - DNA, 20 bp, Artificial sequence
  SiRNA target sequence
gaagttttagaattagccaa

SEQ ID NO: 52732 - DNA, 20 bp, Artificial sequence
  SiRNA target sequence
aagttttagaattagccaaa

SEQ ID NO: 52733 - DNA, 20 bp, Artificial sequence
  SiRNA target sequence
agttttagaattagccaaaa

SEQ ID NO: 52734 - DNA, 20 bp, Artificial sequence
  SiRNA target sequence
gttttagaattagccaaaaa

SEQ ID NO: 52735 - DNA, 20 bp, Artificial sequence
  SiRNA target sequence
ttttagaattagccaaaaaa

SEQ ID NO: 52736 - DNA, 20 bp, Artificial sequence
  SiRNA target sequence
tttagaattagccaaaaaaa

SEQ ID NO: 52737 - DNA, 20 bp, Artificial sequence
  SiRNA target sequence
ttagaattagccaaaaaaat

SEQ ID NO: 52738 - DNA, 20 bp, Artificial sequence
  SiRNA target sequence
tagaattagccaaaaaaata

SEQ ID NO: 52739 - DNA, 20 bp, Artificial sequence
  SiRNA target sequence
agaattagccaaaaaaatag

SEQ ID NO: 52740 - DNA, 20 bp, Artificial sequence
  SiRNA target sequence
gaattagccaaaaaaatagg

SEQ ID NO: 52741 - DNA, 20 bp, Artificial sequence
  SiRNA target sequence
aattagccaaaaaaataggt

SEQ ID NO: 52742 - DNA, 20 bp, Artificial sequence
  SiRNA target sequence
attagccaaaaaaataggtg

SEQ ID NO: 52743 - DNA, 20 bp, Artificial sequence
  SiRNA target sequence
ttagccaaaaaaataggtgt

SEQ ID NO: 52744 - DNA, 20 bp, Artificial sequence
  SiRNA target sequence
tagccaaaaaaataggtgta

SEQ ID NO: 52745 - DNA, 20 bp, Artificial sequence
  SiRNA target sequence
agccaaaaaaataggtgtat

SEQ ID NO: 52746 - DNA, 20 bp, Artificial sequence
  SiRNA target sequence
gccaaaaaaataggtgtatt

SEQ ID NO: 52747 - DNA, 20 bp, Artificial sequence
  SiRNA target sequence
ccaaaaaaataggtgtatta

SEQ ID NO: 52748 - DNA, 20 bp, Artificial sequence
  SiRNA target sequence
caaaaaaataggtgtattag

SEQ ID NO: 52749 - DNA, 20 bp, Artificial sequence
  SiRNA target sequence
aaaaaaataggtgtattaga

SEQ ID NO: 52750 - DNA, 20 bp, Artificial sequence
  SiRNA target sequence
aaaaaataggtgtattagag

SEQ ID NO: 52751 - DNA, 20 bp, Artificial sequence
  SiRNA target sequence
aaaaataggtgtattagagt

SEQ ID NO: 52752 - DNA, 20 bp, Artificial sequence
  SiRNA target sequence
aaaataggtgtattagagtc

SEQ ID NO: 52753 - DNA, 20 bp, Artificial sequence
  SiRNA target sequence
aaataggtgtattagagtct

SEQ ID NO: 52754 - DNA, 20 bp, Artificial sequence
  SiRNA target sequence
aataggtgtattagagtcta

SEQ ID NO: 52755 - DNA, 20 bp, Artificial sequence
  SiRNA target sequence
ataggtgtattagagtctat

SEQ ID NO: 52756 - DNA, 20 bp, Artificial sequence
  SiRNA target sequence
taggtgtattagagtctata

SEQ ID NO: 52757 - DNA, 20 bp, Artificial sequence
  SiRNA target sequence
aggtgtattagagtctatac

SEQ ID NO: 52758 - DNA, 20 bp, Artificial sequence
  SiRNA target sequence
ggtgtattagagtctataca

SEQ ID NO: 52759 - DNA, 20 bp, Artificial sequence
  SiRNA target sequence
gtgtattagagtctatacag

SEQ ID NO: 52760 - DNA, 20 bp, Artificial sequence
  SiRNA target sequence
tgtattagagtctatacagg

SEQ ID NO: 52761 - DNA, 20 bp, Artificial sequence
  SiRNA target sequence
gtattagagtctatacagga

SEQ ID NO: 52762 - DNA, 20 bp, Artificial sequence
  SiRNA target sequence
tattagagtctatacaggaa

SEQ ID NO: 52763 - DNA, 20 bp, Artificial sequence
  SiRNA target sequence
attagagtctatacaggaat

SEQ ID NO: 52764 - DNA, 20 bp, Artificial sequence
  SiRNA target sequence
ttagagtctatacaggaatt

SEQ ID NO: 52765 - DNA, 20 bp, Artificial sequence
  SiRNA target sequence
tagagtctatacaggaattt

SEQ ID NO: 52766 - DNA, 20 bp, Artificial sequence
  SiRNA target sequence
agagtctatacaggaattta

SEQ ID NO: 52767 - DNA, 20 bp, Artificial sequence
  SiRNA target sequence
gagtctatacaggaatttaa

SEQ ID NO: 52768 - DNA, 20 bp, Artificial sequence
  SiRNA target sequence
agtctatacaggaatttaaa

SEQ ID NO: 52769 - DNA, 20 bp, Artificial sequence
  SiRNA target sequence
gtctatacaggaatttaaag

SEQ ID NO: 52770 - DNA, 20 bp, Artificial sequence
  SiRNA target sequence
tctatacaggaatttaaaga

SEQ ID NO: 52771 - DNA, 20 bp, Artificial sequence
  SiRNA target sequence
ctatacaggaatttaaagat

SEQ ID NO: 52772 - DNA, 20 bp, Artificial sequence
  SiRNA target sequence
tatacaggaatttaaagatg

SEQ ID NO: 52773 - DNA, 20 bp, Artificial sequence
  SiRNA target sequence
atacaggaatttaaagatgg

SEQ ID NO: 52774 - DNA, 20 bp, Artificial sequence
  SiRNA target sequence
tacaggaatttaaagatggg

SEQ ID NO: 52775 - DNA, 20 bp, Artificial sequence
  SiRNA target sequence
acaggaatttaaagatgggt

SEQ ID NO: 52776 - DNA, 20 bp, Artificial sequence
  SiRNA target sequence
caggaatttaaagatgggtt

SEQ ID NO: 52777 - DNA, 20 bp, Artificial sequence
  SiRNA target sequence
aggaatttaaagatgggttt

SEQ ID NO: 52778 - DNA, 20 bp, Artificial sequence
  SiRNA target sequence
ggaatttaaagatgggttta

SEQ ID NO: 52779 - DNA, 20 bp, Artificial sequence
  SiRNA target sequence
gaatttaaagatgggtttag

SEQ ID NO: 52780 - DNA, 20 bp, Artificial sequence
  SiRNA target sequence
aatttaaagatgggtttagc

SEQ ID NO: 52781 - DNA, 20 bp, Artificial sequence
  SiRNA target sequence
atttaaagatgggtttagca

SEQ ID NO: 52782 - DNA, 20 bp, Artificial sequence
  SiRNA target sequence
tttaaagatgggtttagcac

SEQ ID NO: 52783 - DNA, 20 bp, Artificial sequence
  SiRNA target sequence
ttaaagatgggtttagcaca

SEQ ID NO: 52784 - DNA, 20 bp, Artificial sequence
  SiRNA target sequence
taaagatgggtttagcacat

SEQ ID NO: 52785 - DNA, 20 bp, Artificial sequence
  SiRNA target sequence
aaagatgggtttagcacatc

SEQ ID NO: 52786 - DNA, 20 bp, Artificial sequence
  SiRNA target sequence
aagatgggtttagcacatcg

SEQ ID NO: 52787 - DNA, 20 bp, Artificial sequence
  SiRNA target sequence
agatgggtttagcacatcgg

SEQ ID NO: 52788 - DNA, 20 bp, Artificial sequence
  SiRNA target sequence
gatgggtttagcacatcggt

SEQ ID NO: 52789 - DNA, 20 bp, Artificial sequence
  SiRNA target sequence
atgggtttagcacatcggtc

SEQ ID NO: 52790 - DNA, 20 bp, Artificial sequence
  SiRNA target sequence
tgggtttagcacatcggtcg

SEQ ID NO: 52791 - DNA, 20 bp, Artificial sequence
  SiRNA target sequence
gggtttagcacatcggtcgg

SEQ ID NO: 52792 - DNA, 20 bp, Artificial sequence
  SiRNA target sequence
ggtttagcacatcggtcggt

SEQ ID NO: 52793 - DNA, 20 bp, Artificial sequence
  SiRNA target sequence
gtttagcacatcggtcggtg

SEQ ID NO: 52794 - DNA, 20 bp, Artificial sequence
  SiRNA target sequence
tttagcacatcggtcggtga

SEQ ID NO: 52795 - DNA, 20 bp, Artificial sequence
  SiRNA target sequence
ttagcacatcggtcggtgaa

SEQ ID NO: 52796 - DNA, 20 bp, Artificial sequence
  SiRNA target sequence
tagcacatcggtcggtgaac

SEQ ID NO: 52797 - DNA, 20 bp, Artificial sequence
  SiRNA target sequence
agcacatcggtcggtgaacg

SEQ ID NO: 52798 - DNA, 20 bp, Artificial sequence
  SiRNA target sequence
gcacatcggtcggtgaacgc

SEQ ID NO: 52799 - DNA, 20 bp, Artificial sequence
  SiRNA target sequence
cacatcggtcggtgaacgcg

SEQ ID NO: 52800 - DNA, 20 bp, Artificial sequence
  SiRNA target sequence
acatcggtcggtgaacgcgg

SEQ ID NO: 52801 - DNA, 20 bp, Artificial sequence
  SiRNA target sequence
catcggtcggtgaacgcgga

SEQ ID NO: 52802 - DNA, 20 bp, Artificial sequence
  SiRNA target sequence
atcggtcggtgaacgcggaa

SEQ ID NO: 52803 - DNA, 20 bp, Artificial sequence
  SiRNA target sequence
tcggtcggtgaacgcggaag

SEQ ID NO: 52804 - DNA, 20 bp, Artificial sequence
  SiRNA target sequence
cggtcggtgaacgcggaaga

SEQ ID NO: 52805 - DNA, 20 bp, Artificial sequence
  SiRNA target sequence
ggtcggtgaacgcggaagat

SEQ ID NO: 52806 - DNA, 20 bp, Artificial sequence
  SiRNA target sequence
gtcggtgaacgcggaagatt

SEQ ID NO: 52807 - DNA, 20 bp, Artificial sequence
  SiRNA target sequence
tcggtgaacgcggaagattt

SEQ ID NO: 52808 - DNA, 20 bp, Artificial sequence
  SiRNA target sequence
cggtgaacgcggaagatttt

SEQ ID NO: 52809 - DNA, 20 bp, Artificial sequence
  SiRNA target sequence
ggtgaacgcggaagattttt

SEQ ID NO: 52810 - DNA, 20 bp, Artificial sequence
  SiRNA target sequence
gtgaacgcggaagattttta

SEQ ID NO: 52811 - DNA, 20 bp, Artificial sequence
  SiRNA target sequence
tgaacgcggaagatttttat

SEQ ID NO: 52812 - DNA, 20 bp, Artificial sequence
  SiRNA target sequence
gaacgcggaagatttttatc

SEQ ID NO: 52813 - DNA, 20 bp, Artificial sequence
  SiRNA target sequence
aacgcggaagatttttatct

SEQ ID NO: 52814 - DNA, 20 bp, Artificial sequence
  SiRNA target sequence
acgcggaagatttttatctg

SEQ ID NO: 52815 - DNA, 20 bp, Artificial sequence
  SiRNA target sequence
cgcggaagatttttatctgg

SEQ ID NO: 52816 - DNA, 20 bp, Artificial sequence
  SiRNA target sequence
gcggaagatttttatctggt

SEQ ID NO: 52817 - DNA, 20 bp, Artificial sequence
  SiRNA target sequence
cggaagatttttatctggtg

SEQ ID NO: 52818 - DNA, 20 bp, Artificial sequence
  SiRNA target sequence
ggaagatttttatctggtgg

SEQ ID NO: 52819 - DNA, 20 bp, Artificial sequence
  SiRNA target sequence
gaagatttttatctggtggt

SEQ ID NO: 52820 - DNA, 20 bp, Artificial sequence
  SiRNA target sequence
aagatttttatctggtggtg

SEQ ID NO: 52821 - DNA, 20 bp, Artificial sequence
  SiRNA target sequence
agatttttatctggtggtga

SEQ ID NO: 52822 - DNA, 20 bp, Artificial sequence
  SiRNA target sequence
gatttttatctggtggtgaa

SEQ ID NO: 52823 - DNA, 20 bp, Artificial sequence
  SiRNA target sequence
atttttatctggtggtgaaa

SEQ ID NO: 52824 - DNA, 20 bp, Artificial sequence
  SiRNA target sequence
tttttatctggtggtgaaag

SEQ ID NO: 52825 - DNA, 20 bp, Artificial sequence
  SiRNA target sequence
ttttatctggtggtgaaagg

SEQ ID NO: 52826 - DNA, 20 bp, Artificial sequence
  SiRNA target sequence
tttatctggtggtgaaaggc

SEQ ID NO: 52827 - DNA, 20 bp, Artificial sequence
  SiRNA target sequence
ttatctggtggtgaaaggca

SEQ ID NO: 52828 - DNA, 20 bp, Artificial sequence
  SiRNA target sequence
tatctggtggtgaaaggcaa

SEQ ID NO: 52829 - DNA, 20 bp, Artificial sequence
  SiRNA target sequence
atctggtggtgaaaggcaaa

SEQ ID NO: 52830 - DNA, 20 bp, Artificial sequence
  SiRNA target sequence
tctggtggtgaaaggcaaaa

SEQ ID NO: 52831 - DNA, 20 bp, Artificial sequence
  SiRNA target sequence
ctggtggtgaaaggcaaaaa

SEQ ID NO: 52832 - DNA, 20 bp, Artificial sequence
  SiRNA target sequence
tggtggtgaaaggcaaaaaa

SEQ ID NO: 52833 - DNA, 20 bp, Artificial sequence
  SiRNA target sequence
ggtggtgaaaggcaaaaaat

SEQ ID NO: 52834 - DNA, 20 bp, Artificial sequence
  SiRNA target sequence
gtggtgaaaggcaaaaaatt

SEQ ID NO: 52835 - DNA, 20 bp, Artificial sequence
  SiRNA target sequence
tggtgaaaggcaaaaaatta

SEQ ID NO: 52836 - DNA, 20 bp, Artificial sequence
  SiRNA target sequence
ggtgaaaggcaaaaaattat

SEQ ID NO: 52837 - DNA, 20 bp, Artificial sequence
  SiRNA target sequence
gtgaaaggcaaaaaattatg

SEQ ID NO: 52838 - DNA, 20 bp, Artificial sequence
  SiRNA target sequence
tgaaaggcaaaaaattatgc

SEQ ID NO: 52839 - DNA, 20 bp, Artificial sequence
  SiRNA target sequence
gaaaggcaaaaaattatgct

SEQ ID NO: 52840 - DNA, 20 bp, Artificial sequence
  SiRNA target sequence
aaaggcaaaaaattatgctg

SEQ ID NO: 52841 - DNA, 20 bp, Artificial sequence
  SiRNA target sequence
aaggcaaaaaattatgctga

SEQ ID NO: 52842 - DNA, 20 bp, Artificial sequence
  SiRNA target sequence
aggcaaaaaattatgctgat

SEQ ID NO: 52843 - DNA, 20 bp, Artificial sequence
  SiRNA target sequence
ggcaaaaaattatgctgatg

SEQ ID NO: 52844 - DNA, 20 bp, Artificial sequence
  SiRNA target sequence
gcaaaaaattatgctgatgc

SEQ ID NO: 52845 - DNA, 20 bp, Artificial sequence
  SiRNA target sequence
caaaaaattatgctgatgcg

SEQ ID NO: 52846 - DNA, 20 bp, Artificial sequence
  SiRNA target sequence
aaaaaattatgctgatgcgt

SEQ ID NO: 52847 - DNA, 20 bp, Artificial sequence
  SiRNA target sequence
aaaaattatgctgatgcgtg

SEQ ID NO: 52848 - DNA, 20 bp, Artificial sequence
  SiRNA target sequence
aaaattatgctgatgcgtgc

SEQ ID NO: 52849 - DNA, 20 bp, Artificial sequence
  SiRNA target sequence
aaattatgctgatgcgtgca

SEQ ID NO: 52850 - DNA, 20 bp, Artificial sequence
  SiRNA target sequence
aattatgctgatgcgtgcat

SEQ ID NO: 52851 - DNA, 20 bp, Artificial sequence
  SiRNA target sequence
attatgctgatgcgtgcatt

SEQ ID NO: 52852 - DNA, 20 bp, Artificial sequence
  SiRNA target sequence
ttatgctgatgcgtgcattg

SEQ ID NO: 52853 - DNA, 20 bp, Artificial sequence
  SiRNA target sequence
tatgctgatgcgtgcattgc

SEQ ID NO: 52854 - DNA, 20 bp, Artificial sequence
  SiRNA target sequence
atgctgatgcgtgcattgct

SEQ ID NO: 52855 - DNA, 20 bp, Artificial sequence
  SiRNA target sequence
tgctgatgcgtgcattgctt

SEQ ID NO: 52856 - DNA, 20 bp, Artificial sequence
  SiRNA target sequence
gctgatgcgtgcattgctta

SEQ ID NO: 52857 - DNA, 20 bp, Artificial sequence
  SiRNA target sequence
ctgatgcgtgcattgcttaa

SEQ ID NO: 52858 - DNA, 20 bp, Artificial sequence
  SiRNA target sequence
tgatgcgtgcattgcttaaa

SEQ ID NO: 52859 - DNA, 20 bp, Artificial sequence
  SiRNA target sequence
gatgcgtgcattgcttaaaa

SEQ ID NO: 52860 - DNA, 20 bp, Artificial sequence
  SiRNA target sequence
atgcgtgcattgcttaaaaa

SEQ ID NO: 52861 - DNA, 20 bp, Artificial sequence
  SiRNA target sequence
tgcgtgcattgcttaaaaat

SEQ ID NO: 52862 - DNA, 20 bp, Artificial sequence
  SiRNA target sequence
gcgtgcattgcttaaaaatt

SEQ ID NO: 52863 - DNA, 20 bp, Artificial sequence
  SiRNA target sequence
cgtgcattgcttaaaaattc

SEQ ID NO: 52864 - DNA, 20 bp, Artificial sequence
  SiRNA target sequence
gtgcattgcttaaaaattca

SEQ ID NO: 52865 - DNA, 20 bp, Artificial sequence
  SiRNA target sequence
tgcattgcttaaaaattcag

SEQ ID NO: 52866 - DNA, 20 bp, Artificial sequence
  SiRNA target sequence
gcattgcttaaaaattcaga

SEQ ID NO: 52867 - DNA, 20 bp, Artificial sequence
  SiRNA target sequence
cattgcttaaaaattcagag

SEQ ID NO: 52868 - DNA, 20 bp, Artificial sequence
  SiRNA target sequence
attgcttaaaaattcagaga

SEQ ID NO: 52869 - DNA, 20 bp, Artificial sequence
  SiRNA target sequence
ttgcttaaaaattcagagat

SEQ ID NO: 52870 - DNA, 20 bp, Artificial sequence
  SiRNA target sequence
tgcttaaaaattcagagatc

SEQ ID NO: 52871 - DNA, 20 bp, Artificial sequence
  SiRNA target sequence
gcttaaaaattcagagatcg

SEQ ID NO: 52872 - DNA, 20 bp, Artificial sequence
  SiRNA target sequence
cttaaaaattcagagatcgt

SEQ ID NO: 52873 - DNA, 20 bp, Artificial sequence
  SiRNA target sequence
ttaaaaattcagagatcgtt

SEQ ID NO: 52874 - DNA, 20 bp, Artificial sequence
  SiRNA target sequence
taaaaattcagagatcgttt

SEQ ID NO: 52875 - DNA, 20 bp, Artificial sequence
  SiRNA target sequence
aaaaattcagagatcgtttt

SEQ ID NO: 52876 - DNA, 20 bp, Artificial sequence
  SiRNA target sequence
aaaattcagagatcgtttta

SEQ ID NO: 52877 - DNA, 20 bp, Artificial sequence
  SiRNA target sequence
aaattcagagatcgttttat

SEQ ID NO: 52878 - DNA, 20 bp, Artificial sequence
  SiRNA target sequence
aattcagagatcgttttatt

SEQ ID NO: 52879 - DNA, 20 bp, Artificial sequence
  SiRNA target sequence
attcagagatcgttttatta

SEQ ID NO: 52880 - DNA, 20 bp, Artificial sequence
  SiRNA target sequence
ttcagagatcgttttattag

SEQ ID NO: 52881 - DNA, 20 bp, Artificial sequence
  SiRNA target sequence
tcagagatcgttttattaga

SEQ ID NO: 52882 - DNA, 20 bp, Artificial sequence
  SiRNA target sequence
cagagatcgttttattagac

SEQ ID NO: 52883 - DNA, 20 bp, Artificial sequence
  SiRNA target sequence
agagatcgttttattagacg

SEQ ID NO: 52884 - DNA, 20 bp, Artificial sequence
  SiRNA target sequence
gagatcgttttattagacga

SEQ ID NO: 52885 - DNA, 20 bp, Artificial sequence
  SiRNA target sequence
agatcgttttattagacgag

SEQ ID NO: 52886 - DNA, 20 bp, Artificial sequence
  SiRNA target sequence
gatcgttttattagacgagc

SEQ ID NO: 52887 - DNA, 20 bp, Artificial sequence
  SiRNA target sequence
atcgttttattagacgagcc

SEQ ID NO: 52888 - DNA, 20 bp, Artificial sequence
  SiRNA target sequence
tcgttttattagacgagcca

SEQ ID NO: 52889 - DNA, 20 bp, Artificial sequence
  SiRNA target sequence
cgttttattagacgagccaa

SEQ ID NO: 52890 - DNA, 20 bp, Artificial sequence
  SiRNA target sequence
gttttattagacgagccaac

SEQ ID NO: 52891 - DNA, 20 bp, Artificial sequence
  SiRNA target sequence
ttttattagacgagccaacc

SEQ ID NO: 52892 - DNA, 20 bp, Artificial sequence
  SiRNA target sequence
tttattagacgagccaacct

SEQ ID NO: 52893 - DNA, 20 bp, Artificial sequence
  SiRNA target sequence
ttattagacgagccaacctc

SEQ ID NO: 52894 - DNA, 20 bp, Artificial sequence
  SiRNA target sequence
tattagacgagccaacctca

SEQ ID NO: 52895 - DNA, 20 bp, Artificial sequence
  SiRNA target sequence
attagacgagccaacctcag

SEQ ID NO: 52896 - DNA, 20 bp, Artificial sequence
  SiRNA target sequence
ttagacgagccaacctcagc

SEQ ID NO: 52897 - DNA, 20 bp, Artificial sequence
  SiRNA target sequence
tagacgagccaacctcagca

SEQ ID NO: 52898 - DNA, 20 bp, Artificial sequence
  SiRNA target sequence
agacgagccaacctcagcac

SEQ ID NO: 52899 - DNA, 20 bp, Artificial sequence
  SiRNA target sequence
gacgagccaacctcagcact

SEQ ID NO: 52900 - DNA, 20 bp, Artificial sequence
  SiRNA target sequence
acgagccaacctcagcacta

SEQ ID NO: 52901 - DNA, 20 bp, Artificial sequence
  SiRNA target sequence
cgagccaacctcagcactag

SEQ ID NO: 52902 - DNA, 20 bp, Artificial sequence
  SiRNA target sequence
gagccaacctcagcactaga

SEQ ID NO: 52903 - DNA, 20 bp, Artificial sequence
  SiRNA target sequence
agccaacctcagcactagat

SEQ ID NO: 52904 - DNA, 20 bp, Artificial sequence
  SiRNA target sequence
gccaacctcagcactagata

SEQ ID NO: 52905 - DNA, 20 bp, Artificial sequence
  SiRNA target sequence
ccaacctcagcactagataa

SEQ ID NO: 52906 - DNA, 20 bp, Artificial sequence
  SiRNA target sequence
caacctcagcactagataaa

SEQ ID NO: 52907 - DNA, 20 bp, Artificial sequence
  SiRNA target sequence
aacctcagcactagataaaa

SEQ ID NO: 52908 - DNA, 20 bp, Artificial sequence
  SiRNA target sequence
acctcagcactagataaaaa

SEQ ID NO: 52909 - DNA, 20 bp, Artificial sequence
  SiRNA target sequence
cctcagcactagataaaaag

SEQ ID NO: 52910 - DNA, 20 bp, Artificial sequence
  SiRNA target sequence
ctcagcactagataaaaaga

SEQ ID NO: 52911 - DNA, 20 bp, Artificial sequence
  SiRNA target sequence
tcagcactagataaaaagag

SEQ ID NO: 52912 - DNA, 20 bp, Artificial sequence
  SiRNA target sequence
cagcactagataaaaagagt

SEQ ID NO: 52913 - DNA, 20 bp, Artificial sequence
  SiRNA target sequence
agcactagataaaaagagtg

SEQ ID NO: 52914 - DNA, 20 bp, Artificial sequence
  SiRNA target sequence
gcactagataaaaagagtga

SEQ ID NO: 52915 - DNA, 20 bp, Artificial sequence
  SiRNA target sequence
cactagataaaaagagtgaa

SEQ ID NO: 52916 - DNA, 20 bp, Artificial sequence
  SiRNA target sequence
actagataaaaagagtgaac

SEQ ID NO: 52917 - DNA, 20 bp, Artificial sequence
  SiRNA target sequence
ctagataaaaagagtgaact

SEQ ID NO: 52918 - DNA, 20 bp, Artificial sequence
  SiRNA target sequence
tagataaaaagagtgaacta

SEQ ID NO: 52919 - DNA, 20 bp, Artificial sequence
  SiRNA target sequence
agataaaaagagtgaactag

SEQ ID NO: 52920 - DNA, 20 bp, Artificial sequence
  SiRNA target sequence
gataaaaagagtgaactaga

SEQ ID NO: 52921 - DNA, 20 bp, Artificial sequence
  SiRNA target sequence
ataaaaagagtgaactagaa

SEQ ID NO: 52922 - DNA, 20 bp, Artificial sequence
  SiRNA target sequence
taaaaagagtgaactagaaa

SEQ ID NO: 52923 - DNA, 20 bp, Artificial sequence
  SiRNA target sequence
aaaaagagtgaactagaaac

SEQ ID NO: 52924 - DNA, 20 bp, Artificial sequence
  SiRNA target sequence
aaaagagtgaactagaaact

SEQ ID NO: 52925 - DNA, 20 bp, Artificial sequence
  SiRNA target sequence
aaagagtgaactagaaacta

SEQ ID NO: 52926 - DNA, 20 bp, Artificial sequence
  SiRNA target sequence
aagagtgaactagaaactat

SEQ ID NO: 52927 - DNA, 20 bp, Artificial sequence
  SiRNA target sequence
agagtgaactagaaactatg

SEQ ID NO: 52928 - DNA, 20 bp, Artificial sequence
  SiRNA target sequence
gagtgaactagaaactatga

SEQ ID NO: 52929 - DNA, 20 bp, Artificial sequence
  SiRNA target sequence
agtgaactagaaactatgac

SEQ ID NO: 52930 - DNA, 20 bp, Artificial sequence
  SiRNA target sequence
gtgaactagaaactatgaca

SEQ ID NO: 52931 - DNA, 20 bp, Artificial sequence
  SiRNA target sequence
tgaactagaaactatgacat

SEQ ID NO: 52932 - DNA, 20 bp, Artificial sequence
  SiRNA target sequence
gaactagaaactatgacata

SEQ ID NO: 52933 - DNA, 20 bp, Artificial sequence
  SiRNA target sequence
aactagaaactatgacatat

SEQ ID NO: 52934 - DNA, 20 bp, Artificial sequence
  SiRNA target sequence
actagaaactatgacatata

SEQ ID NO: 52935 - DNA, 20 bp, Artificial sequence
  SiRNA target sequence
ctagaaactatgacatatat

SEQ ID NO: 52936 - DNA, 20 bp, Artificial sequence
  SiRNA target sequence
tagaaactatgacatatatt

SEQ ID NO: 52937 - DNA, 20 bp, Artificial sequence
  SiRNA target sequence
agaaactatgacatatattt

SEQ ID NO: 52938 - DNA, 20 bp, Artificial sequence
  SiRNA target sequence
gaaactatgacatatatttt

SEQ ID NO: 52939 - DNA, 20 bp, Artificial sequence
  SiRNA target sequence
aaactatgacatatattttt

SEQ ID NO: 52940 - DNA, 20 bp, Artificial sequence
  SiRNA target sequence
aactatgacatatattttta

SEQ ID NO: 52941 - DNA, 20 bp, Artificial sequence
  SiRNA target sequence
actatgacatatatttttaa

SEQ ID NO: 52942 - DNA, 20 bp, Artificial sequence
  SiRNA target sequence
ctatgacatatatttttaat

SEQ ID NO: 52943 - DNA, 20 bp, Artificial sequence
  SiRNA target sequence
tatgacatatatttttaatg

SEQ ID NO: 52944 - DNA, 20 bp, Artificial sequence
  SiRNA target sequence
atgacatatatttttaatga

SEQ ID NO: 52945 - DNA, 20 bp, Artificial sequence
  SiRNA target sequence
tgacatatatttttaatgaa

SEQ ID NO: 52946 - DNA, 20 bp, Artificial sequence
  SiRNA target sequence
gacatatatttttaatgaat

SEQ ID NO: 52947 - DNA, 20 bp, Artificial sequence
  SiRNA target sequence
acatatatttttaatgaatt

SEQ ID NO: 52948 - DNA, 20 bp, Artificial sequence
  SiRNA target sequence
catatatttttaatgaattt

SEQ ID NO: 52949 - DNA, 20 bp, Artificial sequence
  SiRNA target sequence
atatatttttaatgaattta

SEQ ID NO: 52950 - DNA, 20 bp, Artificial sequence
  SiRNA target sequence
tatatttttaatgaatttaa

SEQ ID NO: 52951 - DNA, 20 bp, Artificial sequence
  SiRNA target sequence
atatttttaatgaatttaag

SEQ ID NO: 52952 - DNA, 20 bp, Artificial sequence
  SiRNA target sequence
tatttttaatgaatttaagt

SEQ ID NO: 52953 - DNA, 20 bp, Artificial sequence
  SiRNA target sequence
atttttaatgaatttaagta

SEQ ID NO: 52954 - DNA, 20 bp, Artificial sequence
  SiRNA target sequence
tttttaatgaatttaagtac

SEQ ID NO: 52955 - DNA, 20 bp, Artificial sequence
  SiRNA target sequence
ttttaatgaatttaagtacc

SEQ ID NO: 52956 - DNA, 20 bp, Artificial sequence
  SiRNA target sequence
tttaatgaatttaagtacca

SEQ ID NO: 52957 - DNA, 20 bp, Artificial sequence
  SiRNA target sequence
ttaatgaatttaagtaccat

SEQ ID NO: 52958 - DNA, 20 bp, Artificial sequence
  SiRNA target sequence
taatgaatttaagtaccata

SEQ ID NO: 52959 - DNA, 20 bp, Artificial sequence
  SiRNA target sequence
aatgaatttaagtaccatac

SEQ ID NO: 52960 - DNA, 20 bp, Artificial sequence
  SiRNA target sequence
atgaatttaagtaccatact

SEQ ID NO: 52961 - DNA, 20 bp, Artificial sequence
  SiRNA target sequence
tgaatttaagtaccatactt

SEQ ID NO: 52962 - DNA, 20 bp, Artificial sequence
  SiRNA target sequence
gaatttaagtaccatacttt

SEQ ID NO: 52963 - DNA, 20 bp, Artificial sequence
  SiRNA target sequence
aatttaagtaccatactttt

SEQ ID NO: 52964 - DNA, 20 bp, Artificial sequence
  SiRNA target sequence
atttaagtaccatacttttg

SEQ ID NO: 52965 - DNA, 20 bp, Artificial sequence
  SiRNA target sequence
tttaagtaccatacttttgt

SEQ ID NO: 52966 - DNA, 20 bp, Artificial sequence
  SiRNA target sequence
ttaagtaccatacttttgta

SEQ ID NO: 52967 - DNA, 20 bp, Artificial sequence
  SiRNA target sequence
taagtaccatacttttgtaa

SEQ ID NO: 52968 - DNA, 20 bp, Artificial sequence
  SiRNA target sequence
aagtaccatacttttgtaat

SEQ ID NO: 52969 - DNA, 20 bp, Artificial sequence
  SiRNA target sequence
agtaccatacttttgtaata

SEQ ID NO: 52970 - DNA, 20 bp, Artificial sequence
  SiRNA target sequence
gtaccatacttttgtaataa

SEQ ID NO: 52971 - DNA, 20 bp, Artificial sequence
  SiRNA target sequence
taccatacttttgtaataat

SEQ ID NO: 52972 - DNA, 20 bp, Artificial sequence
  SiRNA target sequence
accatacttttgtaataatt

SEQ ID NO: 52973 - DNA, 20 bp, Artificial sequence
  SiRNA target sequence
ccatacttttgtaataattg

SEQ ID NO: 52974 - DNA, 20 bp, Artificial sequence
  SiRNA target sequence
catacttttgtaataattgt

SEQ ID NO: 52975 - DNA, 20 bp, Artificial sequence
  SiRNA target sequence
atacttttgtaataattgta

SEQ ID NO: 52976 - DNA, 20 bp, Artificial sequence
  SiRNA target sequence
tacttttgtaataattgtac

SEQ ID NO: 52977 - DNA, 20 bp, Artificial sequence
  SiRNA target sequence
acttttgtaataattgtaca

SEQ ID NO: 52978 - DNA, 20 bp, Artificial sequence
  SiRNA target sequence
cttttgtaataattgtacac

SEQ ID NO: 52979 - DNA, 20 bp, Artificial sequence
  SiRNA target sequence
ttttgtaataattgtacaca

SEQ ID NO: 52980 - DNA, 20 bp, Artificial sequence
  SiRNA target sequence
tttgtaataattgtacacaa

SEQ ID NO: 52981 - DNA, 20 bp, Artificial sequence
  SiRNA target sequence
ttgtaataattgtacacaat

SEQ ID NO: 52982 - DNA, 20 bp, Artificial sequence
  SiRNA target sequence
tgtaataattgtacacaatc

SEQ ID NO: 52983 - DNA, 20 bp, Artificial sequence
  SiRNA target sequence
gtaataattgtacacaatct

SEQ ID NO: 52984 - DNA, 20 bp, Artificial sequence
  SiRNA target sequence
taataattgtacacaatcta

SEQ ID NO: 52985 - DNA, 20 bp, Artificial sequence
  SiRNA target sequence
aataattgtacacaatctag

SEQ ID NO: 52986 - DNA, 20 bp, Artificial sequence
  SiRNA target sequence
ataattgtacacaatctaga

SEQ ID NO: 52987 - DNA, 20 bp, Artificial sequence
  SiRNA target sequence
taattgtacacaatctagaa

SEQ ID NO: 52988 - DNA, 20 bp, Artificial sequence
  SiRNA target sequence
aattgtacacaatctagaat

SEQ ID NO: 52989 - DNA, 20 bp, Artificial sequence
  SiRNA target sequence
attgtacacaatctagaatt

SEQ ID NO: 52990 - DNA, 20 bp, Artificial sequence
  SiRNA target sequence
ttgtacacaatctagaatta

SEQ ID NO: 52991 - DNA, 20 bp, Artificial sequence
  SiRNA target sequence
tgtacacaatctagaattat

SEQ ID NO: 52992 - DNA, 20 bp, Artificial sequence
  SiRNA target sequence
gtacacaatctagaattatt

SEQ ID NO: 52993 - DNA, 20 bp, Artificial sequence
  SiRNA target sequence
tacacaatctagaattattg

SEQ ID NO: 52994 - DNA, 20 bp, Artificial sequence
  SiRNA target sequence
acacaatctagaattattgg

SEQ ID NO: 52995 - DNA, 20 bp, Artificial sequence
  SiRNA target sequence
cacaatctagaattattggc

SEQ ID NO: 52996 - DNA, 20 bp, Artificial sequence
  SiRNA target sequence
acaatctagaattattggct

SEQ ID NO: 52997 - DNA, 20 bp, Artificial sequence
  SiRNA target sequence
caatctagaattattggctt

SEQ ID NO: 52998 - DNA, 20 bp, Artificial sequence
  SiRNA target sequence
aatctagaattattggcttt

SEQ ID NO: 52999 - DNA, 20 bp, Artificial sequence
  SiRNA target sequence
atctagaattattggctttg

SEQ ID NO: 53000 - DNA, 20 bp, Artificial sequence
  SiRNA target sequence
tctagaattattggctttgt

SEQ ID NO: 53001 - DNA, 20 bp, Artificial sequence
  SiRNA target sequence
ctagaattattggctttgtt

SEQ ID NO: 53002 - DNA, 20 bp, Artificial sequence
  SiRNA target sequence
tagaattattggctttgttt

SEQ ID NO: 53003 - DNA, 20 bp, Artificial sequence
  SiRNA target sequence
agaattattggctttgtttg

SEQ ID NO: 53004 - DNA, 20 bp, Artificial sequence
  SiRNA target sequence
gaattattggctttgtttga

SEQ ID NO: 53005 - DNA, 20 bp, Artificial sequence
  SiRNA target sequence
aattattggctttgtttgat

SEQ ID NO: 53006 - DNA, 20 bp, Artificial sequence
  SiRNA target sequence
attattggctttgtttgata

SEQ ID NO: 53007 - DNA, 20 bp, Artificial sequence
  SiRNA target sequence
ttattggctttgtttgataa

SEQ ID NO: 53008 - DNA, 20 bp, Artificial sequence
  SiRNA target sequence
tattggctttgtttgataaa

SEQ ID NO: 53009 - DNA, 20 bp, Artificial sequence
  SiRNA target sequence
attggctttgtttgataaaa

SEQ ID NO: 53010 - DNA, 20 bp, Artificial sequence
  SiRNA target sequence
ttggctttgtttgataaaat

SEQ ID NO: 53011 - DNA, 20 bp, Artificial sequence
  SiRNA target sequence
tggctttgtttgataaaatt

SEQ ID NO: 53012 - DNA, 20 bp, Artificial sequence
  SiRNA target sequence
ggctttgtttgataaaattt

SEQ ID NO: 53013 - DNA, 20 bp, Artificial sequence
  SiRNA target sequence
gctttgtttgataaaatttt

SEQ ID NO: 53014 - DNA, 20 bp, Artificial sequence
  SiRNA target sequence
ctttgtttgataaaatttta

SEQ ID NO: 53015 - DNA, 20 bp, Artificial sequence
  SiRNA target sequence
tttgtttgataaaattttat

SEQ ID NO: 53016 - DNA, 20 bp, Artificial sequence
  SiRNA target sequence
ttgtttgataaaattttatt

SEQ ID NO: 53017 - DNA, 20 bp, Artificial sequence
  SiRNA target sequence
tgtttgataaaattttattt

SEQ ID NO: 53018 - DNA, 20 bp, Artificial sequence
  SiRNA target sequence
gtttgataaaattttatttg

SEQ ID NO: 53019 - DNA, 20 bp, Artificial sequence
  SiRNA target sequence
tttgataaaattttatttgt

SEQ ID NO: 53020 - DNA, 20 bp, Artificial sequence
  SiRNA target sequence
ttgataaaattttatttgta

SEQ ID NO: 53021 - DNA, 20 bp, Artificial sequence
  SiRNA target sequence
tgataaaattttatttgtaa

SEQ ID NO: 53022 - DNA, 20 bp, Artificial sequence
  SiRNA target sequence
gataaaattttatttgtaaa

SEQ ID NO: 53023 - DNA, 20 bp, Artificial sequence
  SiRNA target sequence
ataaaattttatttgtaaat

SEQ ID NO: 53024 - DNA, 20 bp, Artificial sequence
  SiRNA target sequence
taaaattttatttgtaaatg

SEQ ID NO: 53025 - DNA, 20 bp, Artificial sequence
  SiRNA target sequence
aaaattttatttgtaaatgg

SEQ ID NO: 53026 - DNA, 20 bp, Artificial sequence
  SiRNA target sequence
aaattttatttgtaaatggt

SEQ ID NO: 53027 - DNA, 20 bp, Artificial sequence
  SiRNA target sequence
aattttatttgtaaatggta

SEQ ID NO: 53028 - DNA, 20 bp, Artificial sequence
  SiRNA target sequence
attttatttgtaaatggtaa

SEQ ID NO: 53029 - DNA, 20 bp, Artificial sequence
  SiRNA target sequence
ttttatttgtaaatggtaat

SEQ ID NO: 53030 - DNA, 20 bp, Artificial sequence
  SiRNA target sequence
tttatttgtaaatggtaatg

SEQ ID NO: 53031 - DNA, 20 bp, Artificial sequence
  SiRNA target sequence
ttatttgtaaatggtaatga

SEQ ID NO: 53032 - DNA, 20 bp, Artificial sequence
  SiRNA target sequence
tatttgtaaatggtaatgag

SEQ ID NO: 53033 - DNA, 20 bp, Artificial sequence
  SiRNA target sequence
atttgtaaatggtaatgagg

SEQ ID NO: 53034 - DNA, 20 bp, Artificial sequence
  SiRNA target sequence
tttgtaaatggtaatgaggt

SEQ ID NO: 53035 - DNA, 20 bp, Artificial sequence
  SiRNA target sequence
ttgtaaatggtaatgaggta

SEQ ID NO: 53036 - DNA, 20 bp, Artificial sequence
  SiRNA target sequence
tgtaaatggtaatgaggtaa

SEQ ID NO: 53037 - DNA, 20 bp, Artificial sequence
  SiRNA target sequence
gtaaatggtaatgaggtaac

SEQ ID NO: 53038 - DNA, 20 bp, Artificial sequence
  SiRNA target sequence
taaatggtaatgaggtaaca

SEQ ID NO: 53039 - DNA, 20 bp, Artificial sequence
  SiRNA target sequence
aaatggtaatgaggtaacaa

SEQ ID NO: 53040 - DNA, 20 bp, Artificial sequence
  SiRNA target sequence
aatggtaatgaggtaacaat

SEQ ID NO: 53041 - DNA, 20 bp, Artificial sequence
  SiRNA target sequence
atggtaatgaggtaacaatg

SEQ ID NO: 53042 - DNA, 20 bp, Artificial sequence
  SiRNA target sequence
tggtaatgaggtaacaatga

SEQ ID NO: 53043 - DNA, 20 bp, Artificial sequence
  SiRNA target sequence
ggtaatgaggtaacaatgat

SEQ ID NO: 53044 - DNA, 20 bp, Artificial sequence
  SiRNA target sequence
gtaatgaggtaacaatgata

SEQ ID NO: 53045 - DNA, 20 bp, Artificial sequence
  SiRNA target sequence
taatgaggtaacaatgatag

SEQ ID NO: 53046 - DNA, 20 bp, Artificial sequence
  SiRNA target sequence
aatgaggtaacaatgataga

SEQ ID NO: 53047 - DNA, 20 bp, Artificial sequence
  SiRNA target sequence
atgaggtaacaatgatagaa

SEQ ID NO: 53048 - DNA, 20 bp, Artificial sequence
  SiRNA target sequence
tgaggtaacaatgatagaag

SEQ ID NO: 53049 - DNA, 20 bp, Artificial sequence
  SiRNA target sequence
gaggtaacaatgatagaaga

SEQ ID NO: 53050 - DNA, 20 bp, Artificial sequence
  SiRNA target sequence
aggtaacaatgatagaagac

SEQ ID NO: 53051 - DNA, 20 bp, Artificial sequence
  SiRNA target sequence
ggtaacaatgatagaagaca

SEQ ID NO: 53052 - DNA, 20 bp, Artificial sequence
  SiRNA target sequence
gtaacaatgatagaagacat

SEQ ID NO: 53053 - DNA, 20 bp, Artificial sequence
  SiRNA target sequence
taacaatgatagaagacatt

SEQ ID NO: 53054 - DNA, 20 bp, Artificial sequence
  SiRNA target sequence
aacaatgatagaagacatta

SEQ ID NO: 53055 - DNA, 20 bp, Artificial sequence
  SiRNA target sequence
acaatgatagaagacattaa

SEQ ID NO: 53056 - DNA, 20 bp, Artificial sequence
  SiRNA target sequence
caatgatagaagacattaac

SEQ ID NO: 53057 - DNA, 20 bp, Artificial sequence
  SiRNA target sequence
aatgatagaagacattaaca

SEQ ID NO: 53058 - DNA, 20 bp, Artificial sequence
  SiRNA target sequence
atgatagaagacattaacaa

SEQ ID NO: 53059 - DNA, 20 bp, Artificial sequence
  SiRNA target sequence
tgatagaagacattaacaaa

SEQ ID NO: 53060 - DNA, 20 bp, Artificial sequence
  SiRNA target sequence
gatagaagacattaacaaaa

SEQ ID NO: 53061 - DNA, 20 bp, Artificial sequence
  SiRNA target sequence
atagaagacattaacaaaaa

SEQ ID NO: 53062 - DNA, 20 bp, Artificial sequence
  SiRNA target sequence
tagaagacattaacaaaaaa

SEQ ID NO: 53063 - DNA, 20 bp, Artificial sequence
  SiRNA target sequence
agaagacattaacaaaaaac

SEQ ID NO: 53064 - DNA, 20 bp, Artificial sequence
  SiRNA target sequence
gaagacattaacaaaaaact

SEQ ID NO: 53065 - DNA, 20 bp, Artificial sequence
  SiRNA target sequence
aagacattaacaaaaaactt

SEQ ID NO: 53066 - DNA, 20 bp, Artificial sequence
  SiRNA target sequence
agacattaacaaaaaacttg

SEQ ID NO: 53067 - DNA, 20 bp, Artificial sequence
  SiRNA target sequence
gacattaacaaaaaacttga

SEQ ID NO: 53068 - DNA, 20 bp, Artificial sequence
  SiRNA target sequence
acattaacaaaaaacttgaa

SEQ ID NO: 53069 - DNA, 20 bp, Artificial sequence
  SiRNA target sequence
cattaacaaaaaacttgaag

SEQ ID NO: 53070 - DNA, 20 bp, Artificial sequence
  SiRNA target sequence
attaacaaaaaacttgaaga

SEQ ID NO: 53071 - DNA, 20 bp, Artificial sequence
  SiRNA target sequence
ttaacaaaaaacttgaagaa

SEQ ID NO: 53072 - DNA, 20 bp, Artificial sequence
  SiRNA target sequence
taacaaaaaacttgaagaaa

SEQ ID NO: 53073 - DNA, 20 bp, Artificial sequence
  SiRNA target sequence
aacaaaaaacttgaagaaaa

SEQ ID NO: 53074 - DNA, 20 bp, Artificial sequence
  SiRNA target sequence
acaaaaaacttgaagaaaat

SEQ ID NO: 53075 - DNA, 20 bp, Artificial sequence
  SiRNA target sequence
caaaaaacttgaagaaaatt

SEQ ID NO: 53076 - DNA, 20 bp, Artificial sequence
  SiRNA target sequence
aaaaaacttgaagaaaattc

SEQ ID NO: 53077 - DNA, 20 bp, Artificial sequence
  SiRNA target sequence
aaaaacttgaagaaaattca

SEQ ID NO: 53078 - DNA, 20 bp, Artificial sequence
  SiRNA target sequence
aaaacttgaagaaaattcaa

SEQ ID NO: 53079 - DNA, 20 bp, Artificial sequence
  SiRNA target sequence
aaacttgaagaaaattcaaa

SEQ ID NO: 53080 - DNA, 20 bp, Artificial sequence
  SiRNA target sequence
aacttgaagaaaattcaaag

SEQ ID NO: 53081 - DNA, 20 bp, Artificial sequence
  SiRNA target sequence
acttgaagaaaattcaaagt

SEQ ID NO: 53082 - DNA, 20 bp, Artificial sequence
  SiRNA target sequence
cttgaagaaaattcaaagta

SEQ ID NO: 53083 - DNA, 20 bp, Artificial sequence
  SiRNA target sequence
ttgaagaaaattcaaagtat

SEQ ID NO: 53084 - DNA, 20 bp, Artificial sequence
  SiRNA target sequence
tgaagaaaattcaaagtatt

SEQ ID NO: 53085 - DNA, 20 bp, Artificial sequence
  SiRNA target sequence
gaagaaaattcaaagtattt

SEQ ID NO: 53086 - DNA, 20 bp, Artificial sequence
  SiRNA target sequence
aagaaaattcaaagtatttt

SEQ ID NO: 53087 - DNA, 20 bp, Artificial sequence
  SiRNA target sequence
agaaaattcaaagtattttg

SEQ ID NO: 53088 - DNA, 20 bp, Artificial sequence
  SiRNA target sequence
gaaaattcaaagtattttgc

SEQ ID NO: 53089 - DNA, 20 bp, Artificial sequence
  SiRNA target sequence
aaaattcaaagtattttgca

SEQ ID NO: 53090 - DNA, 20 bp, Artificial sequence
  SiRNA target sequence
aaattcaaagtattttgcag

SEQ ID NO: 53091 - DNA, 20 bp, Artificial sequence
  SiRNA target sequence
aattcaaagtattttgcaga

SEQ ID NO: 53092 - DNA, 20 bp, Artificial sequence
  SiRNA target sequence
attcaaagtattttgcagat

SEQ ID NO: 53093 - DNA, 20 bp, Artificial sequence
  SiRNA target sequence
ttcaaagtattttgcagata

SEQ ID NO: 53094 - DNA, 20 bp, Artificial sequence
  SiRNA target sequence
tcaaagtattttgcagatat

SEQ ID NO: 53095 - DNA, 20 bp, Artificial sequence
  SiRNA target sequence
caaagtattttgcagatatt

SEQ ID NO: 53096 - DNA, 20 bp, Artificial sequence
  SiRNA target sequence
aaagtattttgcagatattt

SEQ ID NO: 53097 - DNA, 20 bp, Artificial sequence
  SiRNA target sequence
aagtattttgcagatatttt

SEQ ID NO: 53098 - DNA, 20 bp, Artificial sequence
  SiRNA target sequence
agtattttgcagatatttta

SEQ ID NO: 53099 - DNA, 20 bp, Artificial sequence
  SiRNA target sequence
gtattttgcagatattttaa

SEQ ID NO: 53100 - DNA, 20 bp, Artificial sequence
  SiRNA target sequence
tattttgcagatattttaaa

SEQ ID NO: 53101 - DNA, 20 bp, Artificial sequence
  SiRNA target sequence
attttgcagatattttaaac

SEQ ID NO: 53102 - DNA, 20 bp, Artificial sequence
  SiRNA target sequence
ttttgcagatattttaaaca

SEQ ID NO: 53103 - DNA, 20 bp, Artificial sequence
  SiRNA target sequence
tttgcagatattttaaacaa

SEQ ID NO: 53104 - DNA, 20 bp, Artificial sequence
  SiRNA target sequence
ttgcagatattttaaacaac

SEQ ID NO: 53105 - DNA, 20 bp, Artificial sequence
  SiRNA target sequence
tgcagatattttaaacaacg

SEQ ID NO: 53106 - DNA, 20 bp, Artificial sequence
  SiRNA target sequence
gcagatattttaaacaacga

SEQ ID NO: 53107 - DNA, 20 bp, Artificial sequence
  SiRNA target sequence
cagatattttaaacaacgaa

SEQ ID NO: 53108 - DNA, 20 bp, Artificial sequence
  SiRNA target sequence
agatattttaaacaacgaat

SEQ ID NO: 53109 - DNA, 20 bp, Artificial sequence
  SiRNA target sequence
gatattttaaacaacgaata

SEQ ID NO: 53110 - DNA, 20 bp, Artificial sequence
  SiRNA target sequence
atattttaaacaacgaataa

SEQ ID NO: 53111 - DNA, 21 bp, Artificial sequence
  SiRNA target sequence
atgaaggaaaaaaccaattat

SEQ ID NO: 53112 - DNA, 21 bp, Artificial sequence
  SiRNA target sequence
tgaaggaaaaaaccaattatg

SEQ ID NO: 53113 - DNA, 21 bp, Artificial sequence
  SiRNA target sequence
gaaggaaaaaaccaattatga

SEQ ID NO: 53114 - DNA, 21 bp, Artificial sequence
  SiRNA target sequence
aaggaaaaaaccaattatgaa

SEQ ID NO: 53115 - DNA, 21 bp, Artificial sequence
  SiRNA target sequence
aggaaaaaaccaattatgaaa

SEQ ID NO: 53116 - DNA, 21 bp, Artificial sequence
  SiRNA target sequence
ggaaaaaaccaattatgaaat

SEQ ID NO: 53117 - DNA, 21 bp, Artificial sequence
  SiRNA target sequence
gaaaaaaccaattatgaaatt

SEQ ID NO: 53118 - DNA, 21 bp, Artificial sequence
  SiRNA target sequence
aaaaaaccaattatgaaattt

SEQ ID NO: 53119 - DNA, 21 bp, Artificial sequence
  SiRNA target sequence
aaaaaccaattatgaaatttt

SEQ ID NO: 53120 - DNA, 21 bp, Artificial sequence
  SiRNA target sequence
aaaaccaattatgaaatttta

SEQ ID NO: 53121 - DNA, 21 bp, Artificial sequence
  SiRNA target sequence
aaaccaattatgaaattttat

SEQ ID NO: 53122 - DNA, 21 bp, Artificial sequence
  SiRNA target sequence
aaccaattatgaaattttata

SEQ ID NO: 53123 - DNA, 21 bp, Artificial sequence
  SiRNA target sequence
accaattatgaaattttatat

SEQ ID NO: 53124 - DNA, 21 bp, Artificial sequence
  SiRNA target sequence
ccaattatgaaattttatatg

SEQ ID NO: 53125 - DNA, 21 bp, Artificial sequence
  SiRNA target sequence
caattatgaaattttatatga

SEQ ID NO: 53126 - DNA, 21 bp, Artificial sequence
  SiRNA target sequence
aattatgaaattttatatgat

SEQ ID NO: 53127 - DNA, 21 bp, Artificial sequence
  SiRNA target sequence
attatgaaattttatatgata

SEQ ID NO: 53128 - DNA, 21 bp, Artificial sequence
  SiRNA target sequence
ttatgaaattttatatgatac

SEQ ID NO: 53129 - DNA, 21 bp, Artificial sequence
  SiRNA target sequence
tatgaaattttatatgataca

SEQ ID NO: 53130 - DNA, 21 bp, Artificial sequence
  SiRNA target sequence
atgaaattttatatgatacat

SEQ ID NO: 53131 - DNA, 21 bp, Artificial sequence
  SiRNA target sequence
tgaaattttatatgatacatt

SEQ ID NO: 53132 - DNA, 21 bp, Artificial sequence
  SiRNA target sequence
gaaattttatatgatacattt

SEQ ID NO: 53133 - DNA, 21 bp, Artificial sequence
  SiRNA target sequence
aaattttatatgatacatttg

SEQ ID NO: 53134 - DNA, 21 bp, Artificial sequence
  SiRNA target sequence
aattttatatgatacatttgt

SEQ ID NO: 53135 - DNA, 21 bp, Artificial sequence
  SiRNA target sequence
attttatatgatacatttgta

SEQ ID NO: 53136 - DNA, 21 bp, Artificial sequence
  SiRNA target sequence
ttttatatgatacatttgtaa

SEQ ID NO: 53137 - DNA, 21 bp, Artificial sequence
  SiRNA target sequence
tttatatgatacatttgtaaa

SEQ ID NO: 53138 - DNA, 21 bp, Artificial sequence
  SiRNA target sequence
ttatatgatacatttgtaaaa

SEQ ID NO: 53139 - DNA, 21 bp, Artificial sequence
  SiRNA target sequence
tatatgatacatttgtaaaat

SEQ ID NO: 53140 - DNA, 21 bp, Artificial sequence
  SiRNA target sequence
atatgatacatttgtaaaata

SEQ ID NO: 53141 - DNA, 21 bp, Artificial sequence
  SiRNA target sequence
tatgatacatttgtaaaatat

SEQ ID NO: 53142 - DNA, 21 bp, Artificial sequence
  SiRNA target sequence
atgatacatttgtaaaatatt

SEQ ID NO: 53143 - DNA, 21 bp, Artificial sequence
  SiRNA target sequence
tgatacatttgtaaaatattg

SEQ ID NO: 53144 - DNA, 21 bp, Artificial sequence
  SiRNA target sequence
gatacatttgtaaaatattgt

SEQ ID NO: 53145 - DNA, 21 bp, Artificial sequence
  SiRNA target sequence
atacatttgtaaaatattgtt

SEQ ID NO: 53146 - DNA, 21 bp, Artificial sequence
  SiRNA target sequence
tacatttgtaaaatattgtta

SEQ ID NO: 53147 - DNA, 21 bp, Artificial sequence
  SiRNA target sequence
acatttgtaaaatattgttac

SEQ ID NO: 53148 - DNA, 21 bp, Artificial sequence
  SiRNA target sequence
catttgtaaaatattgttaca

SEQ ID NO: 53149 - DNA, 21 bp, Artificial sequence
  SiRNA target sequence
atttgtaaaatattgttacaa

SEQ ID NO: 53150 - DNA, 21 bp, Artificial sequence
  SiRNA target sequence
tttgtaaaatattgttacaat

SEQ ID NO: 53151 - DNA, 21 bp, Artificial sequence
  SiRNA target sequence
ttgtaaaatattgttacaata

SEQ ID NO: 53152 - DNA, 21 bp, Artificial sequence
  SiRNA target sequence
tgtaaaatattgttacaatat

SEQ ID NO: 53153 - DNA, 21 bp, Artificial sequence
  SiRNA target sequence
gtaaaatattgttacaatatt

SEQ ID NO: 53154 - DNA, 21 bp, Artificial sequence
  SiRNA target sequence
taaaatattgttacaatattt

SEQ ID NO: 53155 - DNA, 21 bp, Artificial sequence
  SiRNA target sequence
aaaatattgttacaatatttc

SEQ ID NO: 53156 - DNA, 21 bp, Artificial sequence
  SiRNA target sequence
aaatattgttacaatatttcc

SEQ ID NO: 53157 - DNA, 21 bp, Artificial sequence
  SiRNA target sequence
aatattgttacaatatttcct

SEQ ID NO: 53158 - DNA, 21 bp, Artificial sequence
  SiRNA target sequence
atattgttacaatatttccta

SEQ ID NO: 53159 - DNA, 21 bp, Artificial sequence
  SiRNA target sequence
tattgttacaatatttcctat

SEQ ID NO: 53160 - DNA, 21 bp, Artificial sequence
  SiRNA target sequence
attgttacaatatttcctata

SEQ ID NO: 53161 - DNA, 21 bp, Artificial sequence
  SiRNA target sequence
ttgttacaatatttcctatat

SEQ ID NO: 53162 - DNA, 21 bp, Artificial sequence
  SiRNA target sequence
tgttacaatatttcctatata

SEQ ID NO: 53163 - DNA, 21 bp, Artificial sequence
  SiRNA target sequence
gttacaatatttcctatataa

SEQ ID NO: 53164 - DNA, 21 bp, Artificial sequence
  SiRNA target sequence
ttacaatatttcctatataag

SEQ ID NO: 53165 - DNA, 21 bp, Artificial sequence
  SiRNA target sequence
tacaatatttcctatataagg

SEQ ID NO: 53166 - DNA, 21 bp, Artificial sequence
  SiRNA target sequence
acaatatttcctatataaggt

SEQ ID NO: 53167 - DNA, 21 bp, Artificial sequence
  SiRNA target sequence
caatatttcctatataaggta

SEQ ID NO: 53168 - DNA, 21 bp, Artificial sequence
  SiRNA target sequence
aatatttcctatataaggtac

SEQ ID NO: 53169 - DNA, 21 bp, Artificial sequence
  SiRNA target sequence
atatttcctatataaggtacg

SEQ ID NO: 53170 - DNA, 21 bp, Artificial sequence
  SiRNA target sequence
tatttcctatataaggtacgt

SEQ ID NO: 53171 - DNA, 21 bp, Artificial sequence
  SiRNA target sequence
atttcctatataaggtacgta

SEQ ID NO: 53172 - DNA, 21 bp, Artificial sequence
  SiRNA target sequence
tttcctatataaggtacgtaa

SEQ ID NO: 53173 - DNA, 21 bp, Artificial sequence
  SiRNA target sequence
ttcctatataaggtacgtaat

SEQ ID NO: 53174 - DNA, 21 bp, Artificial sequence
  SiRNA target sequence
tcctatataaggtacgtaatg

SEQ ID NO: 53175 - DNA, 21 bp, Artificial sequence
  SiRNA target sequence
cctatataaggtacgtaatgt

SEQ ID NO: 53176 - DNA, 21 bp, Artificial sequence
  SiRNA target sequence
ctatataaggtacgtaatgtt

SEQ ID NO: 53177 - DNA, 21 bp, Artificial sequence
  SiRNA target sequence
tatataaggtacgtaatgttt

SEQ ID NO: 53178 - DNA, 21 bp, Artificial sequence
  SiRNA target sequence
atataaggtacgtaatgtttc

SEQ ID NO: 53179 - DNA, 21 bp, Artificial sequence
  SiRNA target sequence
tataaggtacgtaatgtttcc

SEQ ID NO: 53180 - DNA, 21 bp, Artificial sequence
  SiRNA target sequence
ataaggtacgtaatgtttccc

SEQ ID NO: 53181 - DNA, 21 bp, Artificial sequence
  SiRNA target sequence
taaggtacgtaatgtttccca

SEQ ID NO: 53182 - DNA, 21 bp, Artificial sequence
  SiRNA target sequence
aaggtacgtaatgtttcccat

SEQ ID NO: 53183 - DNA, 21 bp, Artificial sequence
  SiRNA target sequence
aggtacgtaatgtttcccata

SEQ ID NO: 53184 - DNA, 21 bp, Artificial sequence
  SiRNA target sequence
ggtacgtaatgtttcccatat

SEQ ID NO: 53185 - DNA, 21 bp, Artificial sequence
  SiRNA target sequence
gtacgtaatgtttcccatatt

SEQ ID NO: 53186 - DNA, 21 bp, Artificial sequence
  SiRNA target sequence
tacgtaatgtttcccatatta

SEQ ID NO: 53187 - DNA, 21 bp, Artificial sequence
  SiRNA target sequence
acgtaatgtttcccatattac

SEQ ID NO: 53188 - DNA, 21 bp, Artificial sequence
  SiRNA target sequence
cgtaatgtttcccatattact

SEQ ID NO: 53189 - DNA, 21 bp, Artificial sequence
  SiRNA target sequence
gtaatgtttcccatattactg

SEQ ID NO: 53190 - DNA, 21 bp, Artificial sequence
  SiRNA target sequence
taatgtttcccatattactgt

SEQ ID NO: 53191 - DNA, 21 bp, Artificial sequence
  SiRNA target sequence
aatgtttcccatattactgtc

SEQ ID NO: 53192 - DNA, 21 bp, Artificial sequence
  SiRNA target sequence
atgtttcccatattactgtct

SEQ ID NO: 53193 - DNA, 21 bp, Artificial sequence
  SiRNA target sequence
tgtttcccatattactgtcta

SEQ ID NO: 53194 - DNA, 21 bp, Artificial sequence
  SiRNA target sequence
gtttcccatattactgtctac

SEQ ID NO: 53195 - DNA, 21 bp, Artificial sequence
  SiRNA target sequence
tttcccatattactgtctaca

SEQ ID NO: 53196 - DNA, 21 bp, Artificial sequence
  SiRNA target sequence
ttcccatattactgtctacaa

SEQ ID NO: 53197 - DNA, 21 bp, Artificial sequence
  SiRNA target sequence
tcccatattactgtctacaat

SEQ ID NO: 53198 - DNA, 21 bp, Artificial sequence
  SiRNA target sequence
cccatattactgtctacaatt

SEQ ID NO: 53199 - DNA, 21 bp, Artificial sequence
  SiRNA target sequence
ccatattactgtctacaatta

SEQ ID NO: 53200 - DNA, 21 bp, Artificial sequence
  SiRNA target sequence
catattactgtctacaattat

SEQ ID NO: 53201 - DNA, 21 bp, Artificial sequence
  SiRNA target sequence
atattactgtctacaattata

SEQ ID NO: 53202 - DNA, 21 bp, Artificial sequence
  SiRNA target sequence
tattactgtctacaattatag

SEQ ID NO: 53203 - DNA, 21 bp, Artificial sequence
  SiRNA target sequence
attactgtctacaattatagc

SEQ ID NO: 53204 - DNA, 21 bp, Artificial sequence
  SiRNA target sequence
ttactgtctacaattatagct

SEQ ID NO: 53205 - DNA, 21 bp, Artificial sequence
  SiRNA target sequence
tactgtctacaattatagctt

SEQ ID NO: 53206 - DNA, 21 bp, Artificial sequence
  SiRNA target sequence
actgtctacaattatagcttg

SEQ ID NO: 53207 - DNA, 21 bp, Artificial sequence
  SiRNA target sequence
ctgtctacaattatagcttgt

SEQ ID NO: 53208 - DNA, 21 bp, Artificial sequence
  SiRNA target sequence
tgtctacaattatagcttgtt

SEQ ID NO: 53209 - DNA, 21 bp, Artificial sequence
  SiRNA target sequence
gtctacaattatagcttgtta

SEQ ID NO: 53210 - DNA, 21 bp, Artificial sequence
  SiRNA target sequence
tctacaattatagcttgttat

SEQ ID NO: 53211 - DNA, 21 bp, Artificial sequence
  SiRNA target sequence
ctacaattatagcttgttatc

SEQ ID NO: 53212 - DNA, 21 bp, Artificial sequence
  SiRNA target sequence
tacaattatagcttgttatct

SEQ ID NO: 53213 - DNA, 21 bp, Artificial sequence
  SiRNA target sequence
acaattatagcttgttatctc

SEQ ID NO: 53214 - DNA, 21 bp, Artificial sequence
  SiRNA target sequence
caattatagcttgttatctcg

SEQ ID NO: 53215 - DNA, 21 bp, Artificial sequence
  SiRNA target sequence
aattatagcttgttatctcga

SEQ ID NO: 53216 - DNA, 21 bp, Artificial sequence
  SiRNA target sequence
attatagcttgttatctcgaa

SEQ ID NO: 53217 - DNA, 21 bp, Artificial sequence
  SiRNA target sequence
ttatagcttgttatctcgaag

SEQ ID NO: 53218 - DNA, 21 bp, Artificial sequence
  SiRNA target sequence
tatagcttgttatctcgaagt

SEQ ID NO: 53219 - DNA, 21 bp, Artificial sequence
  SiRNA target sequence
atagcttgttatctcgaagtt

SEQ ID NO: 53220 - DNA, 21 bp, Artificial sequence
  SiRNA target sequence
tagcttgttatctcgaagttc

SEQ ID NO: 53221 - DNA, 21 bp, Artificial sequence
  SiRNA target sequence
agcttgttatctcgaagttca

SEQ ID NO: 53222 - DNA, 21 bp, Artificial sequence
  SiRNA target sequence
gcttgttatctcgaagttcag

SEQ ID NO: 53223 - DNA, 21 bp, Artificial sequence
  SiRNA target sequence
cttgttatctcgaagttcagg

SEQ ID NO: 53224 - DNA, 21 bp, Artificial sequence
  SiRNA target sequence
ttgttatctcgaagttcaggc

SEQ ID NO: 53225 - DNA, 21 bp, Artificial sequence
  SiRNA target sequence
tgttatctcgaagttcaggca

SEQ ID NO: 53226 - DNA, 21 bp, Artificial sequence
  SiRNA target sequence
gttatctcgaagttcaggcaa

SEQ ID NO: 53227 - DNA, 21 bp, Artificial sequence
  SiRNA target sequence
ttatctcgaagttcaggcaag

SEQ ID NO: 53228 - DNA, 21 bp, Artificial sequence
  SiRNA target sequence
tatctcgaagttcaggcaagt

SEQ ID NO: 53229 - DNA, 21 bp, Artificial sequence
  SiRNA target sequence
atctcgaagttcaggcaagta

SEQ ID NO: 53230 - DNA, 21 bp, Artificial sequence
  SiRNA target sequence
tctcgaagttcaggcaagtaa

SEQ ID NO: 53231 - DNA, 21 bp, Artificial sequence
  SiRNA target sequence
ctcgaagttcaggcaagtaac

SEQ ID NO: 53232 - DNA, 21 bp, Artificial sequence
  SiRNA target sequence
tcgaagttcaggcaagtaaca

SEQ ID NO: 53233 - DNA, 21 bp, Artificial sequence
  SiRNA target sequence
cgaagttcaggcaagtaacat

SEQ ID NO: 53234 - DNA, 21 bp, Artificial sequence
  SiRNA target sequence
gaagttcaggcaagtaacata

SEQ ID NO: 53235 - DNA, 21 bp, Artificial sequence
  SiRNA target sequence
aagttcaggcaagtaacatat

SEQ ID NO: 53236 - DNA, 21 bp, Artificial sequence
  SiRNA target sequence
agttcaggcaagtaacatatc

SEQ ID NO: 53237 - DNA, 21 bp, Artificial sequence
  SiRNA target sequence
gttcaggcaagtaacatatca

SEQ ID NO: 53238 - DNA, 21 bp, Artificial sequence
  SiRNA target sequence
ttcaggcaagtaacatatcaa

SEQ ID NO: 53239 - DNA, 21 bp, Artificial sequence
  SiRNA target sequence
tcaggcaagtaacatatcaaa

SEQ ID NO: 53240 - DNA, 21 bp, Artificial sequence
  SiRNA target sequence
caggcaagtaacatatcaaaa

SEQ ID NO: 53241 - DNA, 21 bp, Artificial sequence
  SiRNA target sequence
aggcaagtaacatatcaaaaa

SEQ ID NO: 53242 - DNA, 21 bp, Artificial sequence
  SiRNA target sequence
ggcaagtaacatatcaaaaag

SEQ ID NO: 53243 - DNA, 21 bp, Artificial sequence
  SiRNA target sequence
gcaagtaacatatcaaaaaga

SEQ ID NO: 53244 - DNA, 21 bp, Artificial sequence
  SiRNA target sequence
caagtaacatatcaaaaagaa

SEQ ID NO: 53245 - DNA, 21 bp, Artificial sequence
  SiRNA target sequence
aagtaacatatcaaaaagaat

SEQ ID NO: 53246 - DNA, 21 bp, Artificial sequence
  SiRNA target sequence
agtaacatatcaaaaagaatt

SEQ ID NO: 53247 - DNA, 21 bp, Artificial sequence
  SiRNA target sequence
gtaacatatcaaaaagaattg

SEQ ID NO: 53248 - DNA, 21 bp, Artificial sequence
  SiRNA target sequence
taacatatcaaaaagaattgc

SEQ ID NO: 53249 - DNA, 21 bp, Artificial sequence
  SiRNA target sequence
aacatatcaaaaagaattgca

SEQ ID NO: 53250 - DNA, 21 bp, Artificial sequence
  SiRNA target sequence
acatatcaaaaagaattgcag

SEQ ID NO: 53251 - DNA, 21 bp, Artificial sequence
  SiRNA target sequence
catatcaaaaagaattgcaga

SEQ ID NO: 53252 - DNA, 21 bp, Artificial sequence
  SiRNA target sequence
atatcaaaaagaattgcagaa

SEQ ID NO: 53253 - DNA, 21 bp, Artificial sequence
  SiRNA target sequence
tatcaaaaagaattgcagaag

SEQ ID NO: 53254 - DNA, 21 bp, Artificial sequence
  SiRNA target sequence
atcaaaaagaattgcagaaga

SEQ ID NO: 53255 - DNA, 21 bp, Artificial sequence
  SiRNA target sequence
tcaaaaagaattgcagaagat

SEQ ID NO: 53256 - DNA, 21 bp, Artificial sequence
  SiRNA target sequence
caaaaagaattgcagaagatt

SEQ ID NO: 53257 - DNA, 21 bp, Artificial sequence
  SiRNA target sequence
aaaaagaattgcagaagattt

SEQ ID NO: 53258 - DNA, 21 bp, Artificial sequence
  SiRNA target sequence
aaaagaattgcagaagatttt

SEQ ID NO: 53259 - DNA, 21 bp, Artificial sequence
  SiRNA target sequence
aaagaattgcagaagattttg

SEQ ID NO: 53260 - DNA, 21 bp, Artificial sequence
  SiRNA target sequence
aagaattgcagaagattttga

SEQ ID NO: 53261 - DNA, 21 bp, Artificial sequence
  SiRNA target sequence
agaattgcagaagattttgaa

SEQ ID NO: 53262 - DNA, 21 bp, Artificial sequence
  SiRNA target sequence
gaattgcagaagattttgaaa

SEQ ID NO: 53263 - DNA, 21 bp, Artificial sequence
  SiRNA target sequence
aattgcagaagattttgaaaa

SEQ ID NO: 53264 - DNA, 21 bp, Artificial sequence
  SiRNA target sequence
attgcagaagattttgaaaat

SEQ ID NO: 53265 - DNA, 21 bp, Artificial sequence
  SiRNA target sequence
ttgcagaagattttgaaaata

SEQ ID NO: 53266 - DNA, 21 bp, Artificial sequence
  SiRNA target sequence
tgcagaagattttgaaaataa

SEQ ID NO: 53267 - DNA, 21 bp, Artificial sequence
  SiRNA target sequence
gcagaagattttgaaaataaa

SEQ ID NO: 53268 - DNA, 21 bp, Artificial sequence
  SiRNA target sequence
cagaagattttgaaaataaaa

SEQ ID NO: 53269 - DNA, 21 bp, Artificial sequence
  SiRNA target sequence
agaagattttgaaaataaaat

SEQ ID NO: 53270 - DNA, 21 bp, Artificial sequence
  SiRNA target sequence
gaagattttgaaaataaaata

SEQ ID NO: 53271 - DNA, 21 bp, Artificial sequence
  SiRNA target sequence
aagattttgaaaataaaataa

SEQ ID NO: 53272 - DNA, 21 bp, Artificial sequence
  SiRNA target sequence
agattttgaaaataaaataaa

SEQ ID NO: 53273 - DNA, 21 bp, Artificial sequence
  SiRNA target sequence
gattttgaaaataaaataaat

SEQ ID NO: 53274 - DNA, 21 bp, Artificial sequence
  SiRNA target sequence
attttgaaaataaaataaatg

SEQ ID NO: 53275 - DNA, 21 bp, Artificial sequence
  SiRNA target sequence
ttttgaaaataaaataaatgc

SEQ ID NO: 53276 - DNA, 21 bp, Artificial sequence
  SiRNA target sequence
tttgaaaataaaataaatgca

SEQ ID NO: 53277 - DNA, 21 bp, Artificial sequence
  SiRNA target sequence
ttgaaaataaaataaatgcag

SEQ ID NO: 53278 - DNA, 21 bp, Artificial sequence
  SiRNA target sequence
tgaaaataaaataaatgcagg

SEQ ID NO: 53279 - DNA, 21 bp, Artificial sequence
  SiRNA target sequence
gaaaataaaataaatgcagga

SEQ ID NO: 53280 - DNA, 21 bp, Artificial sequence
  SiRNA target sequence
aaaataaaataaatgcaggaa

SEQ ID NO: 53281 - DNA, 21 bp, Artificial sequence
  SiRNA target sequence
aaataaaataaatgcaggaaa

SEQ ID NO: 53282 - DNA, 21 bp, Artificial sequence
  SiRNA target sequence
aataaaataaatgcaggaaaa

SEQ ID NO: 53283 - DNA, 21 bp, Artificial sequence
  SiRNA target sequence
ataaaataaatgcaggaaaaa

SEQ ID NO: 53284 - DNA, 21 bp, Artificial sequence
  SiRNA target sequence
taaaataaatgcaggaaaaag

SEQ ID NO: 53285 - DNA, 21 bp, Artificial sequence
  SiRNA target sequence
aaaataaatgcaggaaaaagt

SEQ ID NO: 53286 - DNA, 21 bp, Artificial sequence
  SiRNA target sequence
aaataaatgcaggaaaaagta

SEQ ID NO: 53287 - DNA, 21 bp, Artificial sequence
  SiRNA target sequence
aataaatgcaggaaaaagtat

SEQ ID NO: 53288 - DNA, 21 bp, Artificial sequence
  SiRNA target sequence
ataaatgcaggaaaaagtata

SEQ ID NO: 53289 - DNA, 21 bp, Artificial sequence
  SiRNA target sequence
taaatgcaggaaaaagtatat

SEQ ID NO: 53290 - DNA, 21 bp, Artificial sequence
  SiRNA target sequence
aaatgcaggaaaaagtatatt

SEQ ID NO: 53291 - DNA, 21 bp, Artificial sequence
  SiRNA target sequence
aatgcaggaaaaagtatattt

SEQ ID NO: 53292 - DNA, 21 bp, Artificial sequence
  SiRNA target sequence
atgcaggaaaaagtatattta

SEQ ID NO: 53293 - DNA, 21 bp, Artificial sequence
  SiRNA target sequence
tgcaggaaaaagtatatttaa

SEQ ID NO: 53294 - DNA, 21 bp, Artificial sequence
  SiRNA target sequence
gcaggaaaaagtatatttaaa

SEQ ID NO: 53295 - DNA, 21 bp, Artificial sequence
  SiRNA target sequence
caggaaaaagtatatttaaat

SEQ ID NO: 53296 - DNA, 21 bp, Artificial sequence
  SiRNA target sequence
aggaaaaagtatatttaaata

SEQ ID NO: 53297 - DNA, 21 bp, Artificial sequence
  SiRNA target sequence
ggaaaaagtatatttaaatat

SEQ ID NO: 53298 - DNA, 21 bp, Artificial sequence
  SiRNA target sequence
gaaaaagtatatttaaatata

SEQ ID NO: 53299 - DNA, 21 bp, Artificial sequence
  SiRNA target sequence
aaaaagtatatttaaatatat

SEQ ID NO: 53300 - DNA, 21 bp, Artificial sequence
  SiRNA target sequence
aaaagtatatttaaatatatt

SEQ ID NO: 53301 - DNA, 21 bp, Artificial sequence
  SiRNA target sequence
aaagtatatttaaatatattt

SEQ ID NO: 53302 - DNA, 21 bp, Artificial sequence
  SiRNA target sequence
aagtatatttaaatatatttt

SEQ ID NO: 53303 - DNA, 21 bp, Artificial sequence
  SiRNA target sequence
agtatatttaaatatatttta

SEQ ID NO: 53304 - DNA, 21 bp, Artificial sequence
  SiRNA target sequence
gtatatttaaatatattttat

SEQ ID NO: 53305 - DNA, 21 bp, Artificial sequence
  SiRNA target sequence
tatatttaaatatattttatt

SEQ ID NO: 53306 - DNA, 21 bp, Artificial sequence
  SiRNA target sequence
atatttaaatatattttattt

SEQ ID NO: 53307 - DNA, 21 bp, Artificial sequence
  SiRNA target sequence
tatttaaatatattttatttt

SEQ ID NO: 53308 - DNA, 21 bp, Artificial sequence
  SiRNA target sequence
atttaaatatattttattttt

SEQ ID NO: 53309 - DNA, 21 bp, Artificial sequence
  SiRNA target sequence
tttaaatatattttattttta

SEQ ID NO: 53310 - DNA, 21 bp, Artificial sequence
  SiRNA target sequence
ttaaatatattttatttttaa

SEQ ID NO: 53311 - DNA, 21 bp, Artificial sequence
  SiRNA target sequence
taaatatattttatttttaac

SEQ ID NO: 53312 - DNA, 21 bp, Artificial sequence
  SiRNA target sequence
aaatatattttatttttaact

SEQ ID NO: 53313 - DNA, 21 bp, Artificial sequence
  SiRNA target sequence
aatatattttatttttaactt

SEQ ID NO: 53314 - DNA, 21 bp, Artificial sequence
  SiRNA target sequence
atatattttatttttaacttc

SEQ ID NO: 53315 - DNA, 21 bp, Artificial sequence
  SiRNA target sequence
tatattttatttttaacttca

SEQ ID NO: 53316 - DNA, 21 bp, Artificial sequence
  SiRNA target sequence
atattttatttttaacttcat

SEQ ID NO: 53317 - DNA, 21 bp, Artificial sequence
  SiRNA target sequence
tattttatttttaacttcatc

SEQ ID NO: 53318 - DNA, 21 bp, Artificial sequence
  SiRNA target sequence
attttatttttaacttcatca

SEQ ID NO: 53319 - DNA, 21 bp, Artificial sequence
  SiRNA target sequence
ttttatttttaacttcatcaa

SEQ ID NO: 53320 - DNA, 21 bp, Artificial sequence
  SiRNA target sequence
tttatttttaacttcatcaat

SEQ ID NO: 53321 - DNA, 21 bp, Artificial sequence
  SiRNA target sequence
ttatttttaacttcatcaata

SEQ ID NO: 53322 - DNA, 21 bp, Artificial sequence
  SiRNA target sequence
tatttttaacttcatcaatag

SEQ ID NO: 53323 - DNA, 21 bp, Artificial sequence
  SiRNA target sequence
atttttaacttcatcaatagt

SEQ ID NO: 53324 - DNA, 21 bp, Artificial sequence
  SiRNA target sequence
tttttaacttcatcaatagta

SEQ ID NO: 53325 - DNA, 21 bp, Artificial sequence
  SiRNA target sequence
ttttaacttcatcaatagtat

SEQ ID NO: 53326 - DNA, 21 bp, Artificial sequence
  SiRNA target sequence
tttaacttcatcaatagtatt

SEQ ID NO: 53327 - DNA, 21 bp, Artificial sequence
  SiRNA target sequence
ttaacttcatcaatagtatta

SEQ ID NO: 53328 - DNA, 21 bp, Artificial sequence
  SiRNA target sequence
taacttcatcaatagtattaa

SEQ ID NO: 53329 - DNA, 21 bp, Artificial sequence
  SiRNA target sequence
aacttcatcaatagtattaag

SEQ ID NO: 53330 - DNA, 21 bp, Artificial sequence
  SiRNA target sequence
acttcatcaatagtattaaga

SEQ ID NO: 53331 - DNA, 21 bp, Artificial sequence
  SiRNA target sequence
cttcatcaatagtattaagac

SEQ ID NO: 53332 - DNA, 21 bp, Artificial sequence
  SiRNA target sequence
ttcatcaatagtattaagaca

SEQ ID NO: 53333 - DNA, 21 bp, Artificial sequence
  SiRNA target sequence
tcatcaatagtattaagacaa

SEQ ID NO: 53334 - DNA, 21 bp, Artificial sequence
  SiRNA target sequence
catcaatagtattaagacaaa

SEQ ID NO: 53335 - DNA, 21 bp, Artificial sequence
  SiRNA target sequence
atcaatagtattaagacaaat

SEQ ID NO: 53336 - DNA, 21 bp, Artificial sequence
  SiRNA target sequence
tcaatagtattaagacaaatt

SEQ ID NO: 53337 - DNA, 21 bp, Artificial sequence
  SiRNA target sequence
caatagtattaagacaaatta

SEQ ID NO: 53338 - DNA, 21 bp, Artificial sequence
  SiRNA target sequence
aatagtattaagacaaattaa

SEQ ID NO: 53339 - DNA, 21 bp, Artificial sequence
  SiRNA target sequence
atagtattaagacaaattaat

SEQ ID NO: 53340 - DNA, 21 bp, Artificial sequence
  SiRNA target sequence
tagtattaagacaaattaatg

SEQ ID NO: 53341 - DNA, 21 bp, Artificial sequence
  SiRNA target sequence
agtattaagacaaattaatga

SEQ ID NO: 53342 - DNA, 21 bp, Artificial sequence
  SiRNA target sequence
gtattaagacaaattaatgat

SEQ ID NO: 53343 - DNA, 21 bp, Artificial sequence
  SiRNA target sequence
tattaagacaaattaatgata

SEQ ID NO: 53344 - DNA, 21 bp, Artificial sequence
  SiRNA target sequence
attaagacaaattaatgatat

SEQ ID NO: 53345 - DNA, 21 bp, Artificial sequence
  SiRNA target sequence
ttaagacaaattaatgatatt

SEQ ID NO: 53346 - DNA, 21 bp, Artificial sequence
  SiRNA target sequence
taagacaaattaatgatattg

SEQ ID NO: 53347 - DNA, 21 bp, Artificial sequence
  SiRNA target sequence
aagacaaattaatgatattgt

SEQ ID NO: 53348 - DNA, 21 bp, Artificial sequence
  SiRNA target sequence
agacaaattaatgatattgtg

SEQ ID NO: 53349 - DNA, 21 bp, Artificial sequence
  SiRNA target sequence
gacaaattaatgatattgtgt

SEQ ID NO: 53350 - DNA, 21 bp, Artificial sequence
  SiRNA target sequence
acaaattaatgatattgtgtt

SEQ ID NO: 53351 - DNA, 21 bp, Artificial sequence
  SiRNA target sequence
caaattaatgatattgtgttt

SEQ ID NO: 53352 - DNA, 21 bp, Artificial sequence
  SiRNA target sequence
aaattaatgatattgtgttta

SEQ ID NO: 53353 - DNA, 21 bp, Artificial sequence
  SiRNA target sequence
aattaatgatattgtgtttag

SEQ ID NO: 53354 - DNA, 21 bp, Artificial sequence
  SiRNA target sequence
attaatgatattgtgtttagc

SEQ ID NO: 53355 - DNA, 21 bp, Artificial sequence
  SiRNA target sequence
ttaatgatattgtgtttagcg

SEQ ID NO: 53356 - DNA, 21 bp, Artificial sequence
  SiRNA target sequence
taatgatattgtgtttagcgg

SEQ ID NO: 53357 - DNA, 21 bp, Artificial sequence
  SiRNA target sequence
aatgatattgtgtttagcggg

SEQ ID NO: 53358 - DNA, 21 bp, Artificial sequence
  SiRNA target sequence
atgatattgtgtttagcgggc

SEQ ID NO: 53359 - DNA, 21 bp, Artificial sequence
  SiRNA target sequence
tgatattgtgtttagcgggcc

SEQ ID NO: 53360 - DNA, 21 bp, Artificial sequence
  SiRNA target sequence
gatattgtgtttagcgggcca

SEQ ID NO: 53361 - DNA, 21 bp, Artificial sequence
  SiRNA target sequence
atattgtgtttagcgggccaa

SEQ ID NO: 53362 - DNA, 21 bp, Artificial sequence
  SiRNA target sequence
tattgtgtttagcgggccaat

SEQ ID NO: 53363 - DNA, 21 bp, Artificial sequence
  SiRNA target sequence
attgtgtttagcgggccaata

SEQ ID NO: 53364 - DNA, 21 bp, Artificial sequence
  SiRNA target sequence
ttgtgtttagcgggccaatac

SEQ ID NO: 53365 - DNA, 21 bp, Artificial sequence
  SiRNA target sequence
tgtgtttagcgggccaataca

SEQ ID NO: 53366 - DNA, 21 bp, Artificial sequence
  SiRNA target sequence
gtgtttagcgggccaatacaa

SEQ ID NO: 53367 - DNA, 21 bp, Artificial sequence
  SiRNA target sequence
tgtttagcgggccaatacaat

SEQ ID NO: 53368 - DNA, 21 bp, Artificial sequence
  SiRNA target sequence
gtttagcgggccaatacaatt

SEQ ID NO: 53369 - DNA, 21 bp, Artificial sequence
  SiRNA target sequence
tttagcgggccaatacaattt

SEQ ID NO: 53370 - DNA, 21 bp, Artificial sequence
  SiRNA target sequence
ttagcgggccaatacaatttt

SEQ ID NO: 53371 - DNA, 21 bp, Artificial sequence
  SiRNA target sequence
tagcgggccaatacaattttt

SEQ ID NO: 53372 - DNA, 21 bp, Artificial sequence
  SiRNA target sequence
agcgggccaatacaattttta

SEQ ID NO: 53373 - DNA, 21 bp, Artificial sequence
  SiRNA target sequence
gcgggccaatacaatttttat

SEQ ID NO: 53374 - DNA, 21 bp, Artificial sequence
  SiRNA target sequence
cgggccaatacaatttttata

SEQ ID NO: 53375 - DNA, 21 bp, Artificial sequence
  SiRNA target sequence
gggccaatacaatttttatat

SEQ ID NO: 53376 - DNA, 21 bp, Artificial sequence
  SiRNA target sequence
ggccaatacaatttttatata

SEQ ID NO: 53377 - DNA, 21 bp, Artificial sequence
  SiRNA target sequence
gccaatacaatttttatataa

SEQ ID NO: 53378 - DNA, 21 bp, Artificial sequence
  SiRNA target sequence
ccaatacaatttttatataaa

SEQ ID NO: 53379 - DNA, 21 bp, Artificial sequence
  SiRNA target sequence
caatacaatttttatataaaa

SEQ ID NO: 53380 - DNA, 21 bp, Artificial sequence
  SiRNA target sequence
aatacaatttttatataaaat

SEQ ID NO: 53381 - DNA, 21 bp, Artificial sequence
  SiRNA target sequence
atacaatttttatataaaatt

SEQ ID NO: 53382 - DNA, 21 bp, Artificial sequence
  SiRNA target sequence
tacaatttttatataaaattg

SEQ ID NO: 53383 - DNA, 21 bp, Artificial sequence
  SiRNA target sequence
acaatttttatataaaattgt

SEQ ID NO: 53384 - DNA, 21 bp, Artificial sequence
  SiRNA target sequence
caatttttatataaaattgtt

SEQ ID NO: 53385 - DNA, 21 bp, Artificial sequence
  SiRNA target sequence
aatttttatataaaattgttg

SEQ ID NO: 53386 - DNA, 21 bp, Artificial sequence
  SiRNA target sequence
atttttatataaaattgttgg

SEQ ID NO: 53387 - DNA, 21 bp, Artificial sequence
  SiRNA target sequence
tttttatataaaattgttgga

SEQ ID NO: 53388 - DNA, 21 bp, Artificial sequence
  SiRNA target sequence
ttttatataaaattgttggag

SEQ ID NO: 53389 - DNA, 21 bp, Artificial sequence
  SiRNA target sequence
tttatataaaattgttggagt

SEQ ID NO: 53390 - DNA, 21 bp, Artificial sequence
  SiRNA target sequence
ttatataaaattgttggagtt

SEQ ID NO: 53391 - DNA, 21 bp, Artificial sequence
  SiRNA target sequence
tatataaaattgttggagttg

SEQ ID NO: 53392 - DNA, 21 bp, Artificial sequence
  SiRNA target sequence
atataaaattgttggagttga

SEQ ID NO: 53393 - DNA, 21 bp, Artificial sequence
  SiRNA target sequence
tataaaattgttggagttgaa

SEQ ID NO: 53394 - DNA, 21 bp, Artificial sequence
  SiRNA target sequence
ataaaattgttggagttgaag

SEQ ID NO: 53395 - DNA, 21 bp, Artificial sequence
  SiRNA target sequence
taaaattgttggagttgaagc

SEQ ID NO: 53396 - DNA, 21 bp, Artificial sequence
  SiRNA target sequence
aaaattgttggagttgaagca

SEQ ID NO: 53397 - DNA, 21 bp, Artificial sequence
  SiRNA target sequence
aaattgttggagttgaagcat

SEQ ID NO: 53398 - DNA, 21 bp, Artificial sequence
  SiRNA target sequence
aattgttggagttgaagcatt

SEQ ID NO: 53399 - DNA, 21 bp, Artificial sequence
  SiRNA target sequence
attgttggagttgaagcattt

SEQ ID NO: 53400 - DNA, 21 bp, Artificial sequence
  SiRNA target sequence
ttgttggagttgaagcatttt

SEQ ID NO: 53401 - DNA, 21 bp, Artificial sequence
  SiRNA target sequence
tgttggagttgaagcatttta

SEQ ID NO: 53402 - DNA, 21 bp, Artificial sequence
  SiRNA target sequence
gttggagttgaagcattttat

SEQ ID NO: 53403 - DNA, 21 bp, Artificial sequence
  SiRNA target sequence
ttggagttgaagcattttatc

SEQ ID NO: 53404 - DNA, 21 bp, Artificial sequence
  SiRNA target sequence
tggagttgaagcattttatca

SEQ ID NO: 53405 - DNA, 21 bp, Artificial sequence
  SiRNA target sequence
ggagttgaagcattttatcat

SEQ ID NO: 53406 - DNA, 21 bp, Artificial sequence
  SiRNA target sequence
gagttgaagcattttatcatt

SEQ ID NO: 53407 - DNA, 21 bp, Artificial sequence
  SiRNA target sequence
agttgaagcattttatcatta

SEQ ID NO: 53408 - DNA, 21 bp, Artificial sequence
  SiRNA target sequence
gttgaagcattttatcattac

SEQ ID NO: 53409 - DNA, 21 bp, Artificial sequence
  SiRNA target sequence
ttgaagcattttatcattaca

SEQ ID NO: 53410 - DNA, 21 bp, Artificial sequence
  SiRNA target sequence
tgaagcattttatcattacat

SEQ ID NO: 53411 - DNA, 21 bp, Artificial sequence
  SiRNA target sequence
gaagcattttatcattacatt

SEQ ID NO: 53412 - DNA, 21 bp, Artificial sequence
  SiRNA target sequence
aagcattttatcattacattt

SEQ ID NO: 53413 - DNA, 21 bp, Artificial sequence
  SiRNA target sequence
agcattttatcattacatttc

SEQ ID NO: 53414 - DNA, 21 bp, Artificial sequence
  SiRNA target sequence
gcattttatcattacatttca

SEQ ID NO: 53415 - DNA, 21 bp, Artificial sequence
  SiRNA target sequence
cattttatcattacatttcat

SEQ ID NO: 53416 - DNA, 21 bp, Artificial sequence
  SiRNA target sequence
attttatcattacatttcatt

SEQ ID NO: 53417 - DNA, 21 bp, Artificial sequence
  SiRNA target sequence
ttttatcattacatttcatta

SEQ ID NO: 53418 - DNA, 21 bp, Artificial sequence
  SiRNA target sequence
tttatcattacatttcattaa

SEQ ID NO: 53419 - DNA, 21 bp, Artificial sequence
  SiRNA target sequence
ttatcattacatttcattaaa

SEQ ID NO: 53420 - DNA, 21 bp, Artificial sequence
  SiRNA target sequence
tatcattacatttcattaaac

SEQ ID NO: 53421 - DNA, 21 bp, Artificial sequence
  SiRNA target sequence
atcattacatttcattaaact

SEQ ID NO: 53422 - DNA, 21 bp, Artificial sequence
  SiRNA target sequence
tcattacatttcattaaactt

SEQ ID NO: 53423 - DNA, 21 bp, Artificial sequence
  SiRNA target sequence
cattacatttcattaaactta

SEQ ID NO: 53424 - DNA, 21 bp, Artificial sequence
  SiRNA target sequence
attacatttcattaaacttag

SEQ ID NO: 53425 - DNA, 21 bp, Artificial sequence
  SiRNA target sequence
ttacatttcattaaacttaga

SEQ ID NO: 53426 - DNA, 21 bp, Artificial sequence
  SiRNA target sequence
tacatttcattaaacttagaa

SEQ ID NO: 53427 - DNA, 21 bp, Artificial sequence
  SiRNA target sequence
acatttcattaaacttagaaa

SEQ ID NO: 53428 - DNA, 21 bp, Artificial sequence
  SiRNA target sequence
catttcattaaacttagaaaa

SEQ ID NO: 53429 - DNA, 21 bp, Artificial sequence
  SiRNA target sequence
atttcattaaacttagaaaat

SEQ ID NO: 53430 - DNA, 21 bp, Artificial sequence
  SiRNA target sequence
tttcattaaacttagaaaatt

SEQ ID NO: 53431 - DNA, 21 bp, Artificial sequence
  SiRNA target sequence
ttcattaaacttagaaaattt

SEQ ID NO: 53432 - DNA, 21 bp, Artificial sequence
  SiRNA target sequence
tcattaaacttagaaaatttt

SEQ ID NO: 53433 - DNA, 21 bp, Artificial sequence
  SiRNA target sequence
cattaaacttagaaaatttta

SEQ ID NO: 53434 - DNA, 21 bp, Artificial sequence
  SiRNA target sequence
attaaacttagaaaattttaa

SEQ ID NO: 53435 - DNA, 21 bp, Artificial sequence
  SiRNA target sequence
ttaaacttagaaaattttaac

SEQ ID NO: 53436 - DNA, 21 bp, Artificial sequence
  SiRNA target sequence
taaacttagaaaattttaaca

SEQ ID NO: 53437 - DNA, 21 bp, Artificial sequence
  SiRNA target sequence
aaacttagaaaattttaacaa

SEQ ID NO: 53438 - DNA, 21 bp, Artificial sequence
  SiRNA target sequence
aacttagaaaattttaacaaa

SEQ ID NO: 53439 - DNA, 21 bp, Artificial sequence
  SiRNA target sequence
acttagaaaattttaacaaaa

SEQ ID NO: 53440 - DNA, 21 bp, Artificial sequence
  SiRNA target sequence
cttagaaaattttaacaaaat

SEQ ID NO: 53441 - DNA, 21 bp, Artificial sequence
  SiRNA target sequence
ttagaaaattttaacaaaata

SEQ ID NO: 53442 - DNA, 21 bp, Artificial sequence
  SiRNA target sequence
tagaaaattttaacaaaatag

SEQ ID NO: 53443 - DNA, 21 bp, Artificial sequence
  SiRNA target sequence
agaaaattttaacaaaatagg

SEQ ID NO: 53444 - DNA, 21 bp, Artificial sequence
  SiRNA target sequence
gaaaattttaacaaaatagga

SEQ ID NO: 53445 - DNA, 21 bp, Artificial sequence
  SiRNA target sequence
aaaattttaacaaaataggaa

SEQ ID NO: 53446 - DNA, 21 bp, Artificial sequence
  SiRNA target sequence
aaattttaacaaaataggaag

SEQ ID NO: 53447 - DNA, 21 bp, Artificial sequence
  SiRNA target sequence
aattttaacaaaataggaagt

SEQ ID NO: 53448 - DNA, 21 bp, Artificial sequence
  SiRNA target sequence
attttaacaaaataggaagtg

SEQ ID NO: 53449 - DNA, 21 bp, Artificial sequence
  SiRNA target sequence
ttttaacaaaataggaagtgg

SEQ ID NO: 53450 - DNA, 21 bp, Artificial sequence
  SiRNA target sequence
tttaacaaaataggaagtgga

SEQ ID NO: 53451 - DNA, 21 bp, Artificial sequence
  SiRNA target sequence
ttaacaaaataggaagtggag

SEQ ID NO: 53452 - DNA, 21 bp, Artificial sequence
  SiRNA target sequence
taacaaaataggaagtggaga

SEQ ID NO: 53453 - DNA, 21 bp, Artificial sequence
  SiRNA target sequence
aacaaaataggaagtggagag

SEQ ID NO: 53454 - DNA, 21 bp, Artificial sequence
  SiRNA target sequence
acaaaataggaagtggagaga

SEQ ID NO: 53455 - DNA, 21 bp, Artificial sequence
  SiRNA target sequence
caaaataggaagtggagagat

SEQ ID NO: 53456 - DNA, 21 bp, Artificial sequence
  SiRNA target sequence
aaaataggaagtggagagata

SEQ ID NO: 53457 - DNA, 21 bp, Artificial sequence
  SiRNA target sequence
aaataggaagtggagagatac

SEQ ID NO: 53458 - DNA, 21 bp, Artificial sequence
  SiRNA target sequence
aataggaagtggagagataca

SEQ ID NO: 53459 - DNA, 21 bp, Artificial sequence
  SiRNA target sequence
ataggaagtggagagatacaa

SEQ ID NO: 53460 - DNA, 21 bp, Artificial sequence
  SiRNA target sequence
taggaagtggagagatacaaa

SEQ ID NO: 53461 - DNA, 21 bp, Artificial sequence
  SiRNA target sequence
aggaagtggagagatacaaat

SEQ ID NO: 53462 - DNA, 21 bp, Artificial sequence
  SiRNA target sequence
ggaagtggagagatacaaatg

SEQ ID NO: 53463 - DNA, 21 bp, Artificial sequence
  SiRNA target sequence
gaagtggagagatacaaatga

SEQ ID NO: 53464 - DNA, 21 bp, Artificial sequence
  SiRNA target sequence
aagtggagagatacaaatgat

SEQ ID NO: 53465 - DNA, 21 bp, Artificial sequence
  SiRNA target sequence
agtggagagatacaaatgatt

SEQ ID NO: 53466 - DNA, 21 bp, Artificial sequence
  SiRNA target sequence
gtggagagatacaaatgatta

SEQ ID NO: 53467 - DNA, 21 bp, Artificial sequence
  SiRNA target sequence
tggagagatacaaatgattat

SEQ ID NO: 53468 - DNA, 21 bp, Artificial sequence
  SiRNA target sequence
ggagagatacaaatgattatt

SEQ ID NO: 53469 - DNA, 21 bp, Artificial sequence
  SiRNA target sequence
gagagatacaaatgattattg

SEQ ID NO: 53470 - DNA, 21 bp, Artificial sequence
  SiRNA target sequence
agagatacaaatgattattga

SEQ ID NO: 53471 - DNA, 21 bp, Artificial sequence
  SiRNA target sequence
gagatacaaatgattattgag

SEQ ID NO: 53472 - DNA, 21 bp, Artificial sequence
  SiRNA target sequence
agatacaaatgattattgagc

SEQ ID NO: 53473 - DNA, 21 bp, Artificial sequence
  SiRNA target sequence
gatacaaatgattattgagcg

SEQ ID NO: 53474 - DNA, 21 bp, Artificial sequence
  SiRNA target sequence
atacaaatgattattgagcgg

SEQ ID NO: 53475 - DNA, 21 bp, Artificial sequence
  SiRNA target sequence
tacaaatgattattgagcgga

SEQ ID NO: 53476 - DNA, 21 bp, Artificial sequence
  SiRNA target sequence
acaaatgattattgagcggaa

SEQ ID NO: 53477 - DNA, 21 bp, Artificial sequence
  SiRNA target sequence
caaatgattattgagcggaaa

SEQ ID NO: 53478 - DNA, 21 bp, Artificial sequence
  SiRNA target sequence
aaatgattattgagcggaaaa

SEQ ID NO: 53479 - DNA, 21 bp, Artificial sequence
  SiRNA target sequence
aatgattattgagcggaaaag

SEQ ID NO: 53480 - DNA, 21 bp, Artificial sequence
  SiRNA target sequence
atgattattgagcggaaaagt

SEQ ID NO: 53481 - DNA, 21 bp, Artificial sequence
  SiRNA target sequence
tgattattgagcggaaaagta

SEQ ID NO: 53482 - DNA, 21 bp, Artificial sequence
  SiRNA target sequence
gattattgagcggaaaagtag

SEQ ID NO: 53483 - DNA, 21 bp, Artificial sequence
  SiRNA target sequence
attattgagcggaaaagtaga

SEQ ID NO: 53484 - DNA, 21 bp, Artificial sequence
  SiRNA target sequence
ttattgagcggaaaagtagag

SEQ ID NO: 53485 - DNA, 21 bp, Artificial sequence
  SiRNA target sequence
tattgagcggaaaagtagagc

SEQ ID NO: 53486 - DNA, 21 bp, Artificial sequence
  SiRNA target sequence
attgagcggaaaagtagagca

SEQ ID NO: 53487 - DNA, 21 bp, Artificial sequence
  SiRNA target sequence
ttgagcggaaaagtagagcat

SEQ ID NO: 53488 - DNA, 21 bp, Artificial sequence
  SiRNA target sequence
tgagcggaaaagtagagcata

SEQ ID NO: 53489 - DNA, 21 bp, Artificial sequence
  SiRNA target sequence
gagcggaaaagtagagcatat

SEQ ID NO: 53490 - DNA, 21 bp, Artificial sequence
  SiRNA target sequence
agcggaaaagtagagcatatg

SEQ ID NO: 53491 - DNA, 21 bp, Artificial sequence
  SiRNA target sequence
gcggaaaagtagagcatatgg

SEQ ID NO: 53492 - DNA, 21 bp, Artificial sequence
  SiRNA target sequence
cggaaaagtagagcatatggt

SEQ ID NO: 53493 - DNA, 21 bp, Artificial sequence
  SiRNA target sequence
ggaaaagtagagcatatggtg

SEQ ID NO: 53494 - DNA, 21 bp, Artificial sequence
  SiRNA target sequence
gaaaagtagagcatatggtga

SEQ ID NO: 53495 - DNA, 21 bp, Artificial sequence
  SiRNA target sequence
aaaagtagagcatatggtgac

SEQ ID NO: 53496 - DNA, 21 bp, Artificial sequence
  SiRNA target sequence
aaagtagagcatatggtgaca

SEQ ID NO: 53497 - DNA, 21 bp, Artificial sequence
  SiRNA target sequence
aagtagagcatatggtgacat

SEQ ID NO: 53498 - DNA, 21 bp, Artificial sequence
  SiRNA target sequence
agtagagcatatggtgacata

SEQ ID NO: 53499 - DNA, 21 bp, Artificial sequence
  SiRNA target sequence
gtagagcatatggtgacatac

SEQ ID NO: 53500 - DNA, 21 bp, Artificial sequence
  SiRNA target sequence
tagagcatatggtgacatact

SEQ ID NO: 53501 - DNA, 21 bp, Artificial sequence
  SiRNA target sequence
agagcatatggtgacatacta

SEQ ID NO: 53502 - DNA, 21 bp, Artificial sequence
  SiRNA target sequence
gagcatatggtgacatactag

SEQ ID NO: 53503 - DNA, 21 bp, Artificial sequence
  SiRNA target sequence
agcatatggtgacatactaga

SEQ ID NO: 53504 - DNA, 21 bp, Artificial sequence
  SiRNA target sequence
gcatatggtgacatactagaa

SEQ ID NO: 53505 - DNA, 21 bp, Artificial sequence
  SiRNA target sequence
catatggtgacatactagaac

SEQ ID NO: 53506 - DNA, 21 bp, Artificial sequence
  SiRNA target sequence
atatggtgacatactagaact

SEQ ID NO: 53507 - DNA, 21 bp, Artificial sequence
  SiRNA target sequence
tatggtgacatactagaacta

SEQ ID NO: 53508 - DNA, 21 bp, Artificial sequence
  SiRNA target sequence
atggtgacatactagaactaa

SEQ ID NO: 53509 - DNA, 21 bp, Artificial sequence
  SiRNA target sequence
tggtgacatactagaactaac

SEQ ID NO: 53510 - DNA, 21 bp, Artificial sequence
  SiRNA target sequence
ggtgacatactagaactaact

SEQ ID NO: 53511 - DNA, 21 bp, Artificial sequence
  SiRNA target sequence
gtgacatactagaactaacta

SEQ ID NO: 53512 - DNA, 21 bp, Artificial sequence
  SiRNA target sequence
tgacatactagaactaactac

SEQ ID NO: 53513 - DNA, 21 bp, Artificial sequence
  SiRNA target sequence
gacatactagaactaactact

SEQ ID NO: 53514 - DNA, 21 bp, Artificial sequence
  SiRNA target sequence
acatactagaactaactactc

SEQ ID NO: 53515 - DNA, 21 bp, Artificial sequence
  SiRNA target sequence
catactagaactaactactct

SEQ ID NO: 53516 - DNA, 21 bp, Artificial sequence
  SiRNA target sequence
atactagaactaactactctc

SEQ ID NO: 53517 - DNA, 21 bp, Artificial sequence
  SiRNA target sequence
tactagaactaactactctct

SEQ ID NO: 53518 - DNA, 21 bp, Artificial sequence
  SiRNA target sequence
actagaactaactactctctc

SEQ ID NO: 53519 - DNA, 21 bp, Artificial sequence
  SiRNA target sequence
ctagaactaactactctctcg

SEQ ID NO: 53520 - DNA, 21 bp, Artificial sequence
  SiRNA target sequence
tagaactaactactctctcgg

SEQ ID NO: 53521 - DNA, 21 bp, Artificial sequence
  SiRNA target sequence
agaactaactactctctcggc

SEQ ID NO: 53522 - DNA, 21 bp, Artificial sequence
  SiRNA target sequence
gaactaactactctctcggcc

SEQ ID NO: 53523 - DNA, 21 bp, Artificial sequence
  SiRNA target sequence
aactaactactctctcggccg

SEQ ID NO: 53524 - DNA, 21 bp, Artificial sequence
  SiRNA target sequence
actaactactctctcggccgt

SEQ ID NO: 53525 - DNA, 21 bp, Artificial sequence
  SiRNA target sequence
ctaactactctctcggccgta

SEQ ID NO: 53526 - DNA, 21 bp, Artificial sequence
  SiRNA target sequence
taactactctctcggccgtac

SEQ ID NO: 53527 - DNA, 21 bp, Artificial sequence
  SiRNA target sequence
aactactctctcggccgtacc

SEQ ID NO: 53528 - DNA, 21 bp, Artificial sequence
  SiRNA target sequence
actactctctcggccgtacca

SEQ ID NO: 53529 - DNA, 21 bp, Artificial sequence
  SiRNA target sequence
ctactctctcggccgtaccaa

SEQ ID NO: 53530 - DNA, 21 bp, Artificial sequence
  SiRNA target sequence
tactctctcggccgtaccaac

SEQ ID NO: 53531 - DNA, 21 bp, Artificial sequence
  SiRNA target sequence
actctctcggccgtaccaacc

SEQ ID NO: 53532 - DNA, 21 bp, Artificial sequence
  SiRNA target sequence
ctctctcggccgtaccaacct

SEQ ID NO: 53533 - DNA, 21 bp, Artificial sequence
  SiRNA target sequence
tctctcggccgtaccaacctg

SEQ ID NO: 53534 - DNA, 21 bp, Artificial sequence
  SiRNA target sequence
ctctcggccgtaccaacctgt

SEQ ID NO: 53535 - DNA, 21 bp, Artificial sequence
  SiRNA target sequence
tctcggccgtaccaacctgta

SEQ ID NO: 53536 - DNA, 21 bp, Artificial sequence
  SiRNA target sequence
ctcggccgtaccaacctgtat

SEQ ID NO: 53537 - DNA, 21 bp, Artificial sequence
  SiRNA target sequence
tcggccgtaccaacctgtatt

SEQ ID NO: 53538 - DNA, 21 bp, Artificial sequence
  SiRNA target sequence
cggccgtaccaacctgtattg

SEQ ID NO: 53539 - DNA, 21 bp, Artificial sequence
  SiRNA target sequence
ggccgtaccaacctgtattgt

SEQ ID NO: 53540 - DNA, 21 bp, Artificial sequence
  SiRNA target sequence
gccgtaccaacctgtattgta

SEQ ID NO: 53541 - DNA, 21 bp, Artificial sequence
  SiRNA target sequence
ccgtaccaacctgtattgtag

SEQ ID NO: 53542 - DNA, 21 bp, Artificial sequence
  SiRNA target sequence
cgtaccaacctgtattgtagt

SEQ ID NO: 53543 - DNA, 21 bp, Artificial sequence
  SiRNA target sequence
gtaccaacctgtattgtagtt

SEQ ID NO: 53544 - DNA, 21 bp, Artificial sequence
  SiRNA target sequence
taccaacctgtattgtagtta

SEQ ID NO: 53545 - DNA, 21 bp, Artificial sequence
  SiRNA target sequence
accaacctgtattgtagttat

SEQ ID NO: 53546 - DNA, 21 bp, Artificial sequence
  SiRNA target sequence
ccaacctgtattgtagttatt

SEQ ID NO: 53547 - DNA, 21 bp, Artificial sequence
  SiRNA target sequence
caacctgtattgtagttatta

SEQ ID NO: 53548 - DNA, 21 bp, Artificial sequence
  SiRNA target sequence
aacctgtattgtagttattat

SEQ ID NO: 53549 - DNA, 21 bp, Artificial sequence
  SiRNA target sequence
acctgtattgtagttattatg

SEQ ID NO: 53550 - DNA, 21 bp, Artificial sequence
  SiRNA target sequence
cctgtattgtagttattatgt

SEQ ID NO: 53551 - DNA, 21 bp, Artificial sequence
  SiRNA target sequence
ctgtattgtagttattatgtc

SEQ ID NO: 53552 - DNA, 21 bp, Artificial sequence
  SiRNA target sequence
tgtattgtagttattatgtcg

SEQ ID NO: 53553 - DNA, 21 bp, Artificial sequence
  SiRNA target sequence
gtattgtagttattatgtcgt

SEQ ID NO: 53554 - DNA, 21 bp, Artificial sequence
  SiRNA target sequence
tattgtagttattatgtcgtt

SEQ ID NO: 53555 - DNA, 21 bp, Artificial sequence
  SiRNA target sequence
attgtagttattatgtcgttt

SEQ ID NO: 53556 - DNA, 21 bp, Artificial sequence
  SiRNA target sequence
ttgtagttattatgtcgtttt

SEQ ID NO: 53557 - DNA, 21 bp, Artificial sequence
  SiRNA target sequence
tgtagttattatgtcgttttt

SEQ ID NO: 53558 - DNA, 21 bp, Artificial sequence
  SiRNA target sequence
gtagttattatgtcgtttttc

SEQ ID NO: 53559 - DNA, 21 bp, Artificial sequence
  SiRNA target sequence
tagttattatgtcgtttttct

SEQ ID NO: 53560 - DNA, 21 bp, Artificial sequence
  SiRNA target sequence
agttattatgtcgtttttctc

SEQ ID NO: 53561 - DNA, 21 bp, Artificial sequence
  SiRNA target sequence
gttattatgtcgtttttctca

SEQ ID NO: 53562 - DNA, 21 bp, Artificial sequence
  SiRNA target sequence
ttattatgtcgtttttctcag

SEQ ID NO: 53563 - DNA, 21 bp, Artificial sequence
  SiRNA target sequence
tattatgtcgtttttctcagt

SEQ ID NO: 53564 - DNA, 21 bp, Artificial sequence
  SiRNA target sequence
attatgtcgtttttctcagta

SEQ ID NO: 53565 - DNA, 21 bp, Artificial sequence
  SiRNA target sequence
ttatgtcgtttttctcagtat

SEQ ID NO: 53566 - DNA, 21 bp, Artificial sequence
  SiRNA target sequence
tatgtcgtttttctcagtata

SEQ ID NO: 53567 - DNA, 21 bp, Artificial sequence
  SiRNA target sequence
atgtcgtttttctcagtatat

SEQ ID NO: 53568 - DNA, 21 bp, Artificial sequence
  SiRNA target sequence
tgtcgtttttctcagtatata

SEQ ID NO: 53569 - DNA, 21 bp, Artificial sequence
  SiRNA target sequence
gtcgtttttctcagtatataa

SEQ ID NO: 53570 - DNA, 21 bp, Artificial sequence
  SiRNA target sequence
tcgtttttctcagtatataaa

SEQ ID NO: 53571 - DNA, 21 bp, Artificial sequence
  SiRNA target sequence
cgtttttctcagtatataaaa

SEQ ID NO: 53572 - DNA, 21 bp, Artificial sequence
  SiRNA target sequence
gtttttctcagtatataaaaa

SEQ ID NO: 53573 - DNA, 21 bp, Artificial sequence
  SiRNA target sequence
tttttctcagtatataaaaat

SEQ ID NO: 53574 - DNA, 21 bp, Artificial sequence
  SiRNA target sequence
ttttctcagtatataaaaatt

SEQ ID NO: 53575 - DNA, 21 bp, Artificial sequence
  SiRNA target sequence
tttctcagtatataaaaattt

SEQ ID NO: 53576 - DNA, 21 bp, Artificial sequence
  SiRNA target sequence
ttctcagtatataaaaatttg

SEQ ID NO: 53577 - DNA, 21 bp, Artificial sequence
  SiRNA target sequence
tctcagtatataaaaatttgg

SEQ ID NO: 53578 - DNA, 21 bp, Artificial sequence
  SiRNA target sequence
ctcagtatataaaaatttggg

SEQ ID NO: 53579 - DNA, 21 bp, Artificial sequence
  SiRNA target sequence
tcagtatataaaaatttggga

SEQ ID NO: 53580 - DNA, 21 bp, Artificial sequence
  SiRNA target sequence
cagtatataaaaatttgggaa

SEQ ID NO: 53581 - DNA, 21 bp, Artificial sequence
  SiRNA target sequence
agtatataaaaatttgggaag

SEQ ID NO: 53582 - DNA, 21 bp, Artificial sequence
  SiRNA target sequence
gtatataaaaatttgggaaga

SEQ ID NO: 53583 - DNA, 21 bp, Artificial sequence
  SiRNA target sequence
tatataaaaatttgggaagag

SEQ ID NO: 53584 - DNA, 21 bp, Artificial sequence
  SiRNA target sequence
atataaaaatttgggaagaga

SEQ ID NO: 53585 - DNA, 21 bp, Artificial sequence
  SiRNA target sequence
tataaaaatttgggaagagat

SEQ ID NO: 53586 - DNA, 21 bp, Artificial sequence
  SiRNA target sequence
ataaaaatttgggaagagatg

SEQ ID NO: 53587 - DNA, 21 bp, Artificial sequence
  SiRNA target sequence
taaaaatttgggaagagatgc

SEQ ID NO: 53588 - DNA, 21 bp, Artificial sequence
  SiRNA target sequence
aaaaatttgggaagagatgca

SEQ ID NO: 53589 - DNA, 21 bp, Artificial sequence
  SiRNA target sequence
aaaatttgggaagagatgcac

SEQ ID NO: 53590 - DNA, 21 bp, Artificial sequence
  SiRNA target sequence
aaatttgggaagagatgcact

SEQ ID NO: 53591 - DNA, 21 bp, Artificial sequence
  SiRNA target sequence
aatttgggaagagatgcactc

SEQ ID NO: 53592 - DNA, 21 bp, Artificial sequence
  SiRNA target sequence
atttgggaagagatgcactct

SEQ ID NO: 53593 - DNA, 21 bp, Artificial sequence
  SiRNA target sequence
tttgggaagagatgcactcta

SEQ ID NO: 53594 - DNA, 21 bp, Artificial sequence
  SiRNA target sequence
ttgggaagagatgcactctac

SEQ ID NO: 53595 - DNA, 21 bp, Artificial sequence
  SiRNA target sequence
tgggaagagatgcactctacg

SEQ ID NO: 53596 - DNA, 21 bp, Artificial sequence
  SiRNA target sequence
gggaagagatgcactctacgt

SEQ ID NO: 53597 - DNA, 21 bp, Artificial sequence
  SiRNA target sequence
ggaagagatgcactctacgta

SEQ ID NO: 53598 - DNA, 21 bp, Artificial sequence
  SiRNA target sequence
gaagagatgcactctacgtaa

SEQ ID NO: 53599 - DNA, 21 bp, Artificial sequence
  SiRNA target sequence
aagagatgcactctacgtaat

SEQ ID NO: 53600 - DNA, 21 bp, Artificial sequence
  SiRNA target sequence
agagatgcactctacgtaatg

SEQ ID NO: 53601 - DNA, 21 bp, Artificial sequence
  SiRNA target sequence
gagatgcactctacgtaatgt

SEQ ID NO: 53602 - DNA, 21 bp, Artificial sequence
  SiRNA target sequence
agatgcactctacgtaatgtt

SEQ ID NO: 53603 - DNA, 21 bp, Artificial sequence
  SiRNA target sequence
gatgcactctacgtaatgttg

SEQ ID NO: 53604 - DNA, 21 bp, Artificial sequence
  SiRNA target sequence
atgcactctacgtaatgttgg

SEQ ID NO: 53605 - DNA, 21 bp, Artificial sequence
  SiRNA target sequence
tgcactctacgtaatgttggc

SEQ ID NO: 53606 - DNA, 21 bp, Artificial sequence
  SiRNA target sequence
gcactctacgtaatgttggct

SEQ ID NO: 53607 - DNA, 21 bp, Artificial sequence
  SiRNA target sequence
cactctacgtaatgttggcta

SEQ ID NO: 53608 - DNA, 21 bp, Artificial sequence
  SiRNA target sequence
actctacgtaatgttggctac

SEQ ID NO: 53609 - DNA, 21 bp, Artificial sequence
  SiRNA target sequence
ctctacgtaatgttggctaca

SEQ ID NO: 53610 - DNA, 21 bp, Artificial sequence
  SiRNA target sequence
tctacgtaatgttggctacaa

SEQ ID NO: 53611 - DNA, 21 bp, Artificial sequence
  SiRNA target sequence
ctacgtaatgttggctacaag

SEQ ID NO: 53612 - DNA, 21 bp, Artificial sequence
  SiRNA target sequence
tacgtaatgttggctacaagt

SEQ ID NO: 53613 - DNA, 21 bp, Artificial sequence
  SiRNA target sequence
acgtaatgttggctacaagtg

SEQ ID NO: 53614 - DNA, 21 bp, Artificial sequence
  SiRNA target sequence
cgtaatgttggctacaagtgc

SEQ ID NO: 53615 - DNA, 21 bp, Artificial sequence
  SiRNA target sequence
gtaatgttggctacaagtgcc

SEQ ID NO: 53616 - DNA, 21 bp, Artificial sequence
  SiRNA target sequence
taatgttggctacaagtgcct

SEQ ID NO: 53617 - DNA, 21 bp, Artificial sequence
  SiRNA target sequence
aatgttggctacaagtgcctt

SEQ ID NO: 53618 - DNA, 21 bp, Artificial sequence
  SiRNA target sequence
atgttggctacaagtgccttg

SEQ ID NO: 53619 - DNA, 21 bp, Artificial sequence
  SiRNA target sequence
tgttggctacaagtgccttgt

SEQ ID NO: 53620 - DNA, 21 bp, Artificial sequence
  SiRNA target sequence
gttggctacaagtgccttgta

SEQ ID NO: 53621 - DNA, 21 bp, Artificial sequence
  SiRNA target sequence
ttggctacaagtgccttgtat

SEQ ID NO: 53622 - DNA, 21 bp, Artificial sequence
  SiRNA target sequence
tggctacaagtgccttgtatg

SEQ ID NO: 53623 - DNA, 21 bp, Artificial sequence
  SiRNA target sequence
ggctacaagtgccttgtatgt

SEQ ID NO: 53624 - DNA, 21 bp, Artificial sequence
  SiRNA target sequence
gctacaagtgccttgtatgtg

SEQ ID NO: 53625 - DNA, 21 bp, Artificial sequence
  SiRNA target sequence
ctacaagtgccttgtatgtgt

SEQ ID NO: 53626 - DNA, 21 bp, Artificial sequence
  SiRNA target sequence
tacaagtgccttgtatgtgta

SEQ ID NO: 53627 - DNA, 21 bp, Artificial sequence
  SiRNA target sequence
acaagtgccttgtatgtgtat

SEQ ID NO: 53628 - DNA, 21 bp, Artificial sequence
  SiRNA target sequence
caagtgccttgtatgtgtatt

SEQ ID NO: 53629 - DNA, 21 bp, Artificial sequence
  SiRNA target sequence
aagtgccttgtatgtgtattt

SEQ ID NO: 53630 - DNA, 21 bp, Artificial sequence
  SiRNA target sequence
agtgccttgtatgtgtatttt

SEQ ID NO: 53631 - DNA, 21 bp, Artificial sequence
  SiRNA target sequence
gtgccttgtatgtgtatttta

SEQ ID NO: 53632 - DNA, 21 bp, Artificial sequence
  SiRNA target sequence
tgccttgtatgtgtattttac

SEQ ID NO: 53633 - DNA, 21 bp, Artificial sequence
  SiRNA target sequence
gccttgtatgtgtattttaca

SEQ ID NO: 53634 - DNA, 21 bp, Artificial sequence
  SiRNA target sequence
ccttgtatgtgtattttacat

SEQ ID NO: 53635 - DNA, 21 bp, Artificial sequence
  SiRNA target sequence
cttgtatgtgtattttacatt

SEQ ID NO: 53636 - DNA, 21 bp, Artificial sequence
  SiRNA target sequence
ttgtatgtgtattttacattt

SEQ ID NO: 53637 - DNA, 21 bp, Artificial sequence
  SiRNA target sequence
tgtatgtgtattttacatttg

SEQ ID NO: 53638 - DNA, 21 bp, Artificial sequence
  SiRNA target sequence
gtatgtgtattttacatttgt

SEQ ID NO: 53639 - DNA, 21 bp, Artificial sequence
  SiRNA target sequence
tatgtgtattttacatttgta

SEQ ID NO: 53640 - DNA, 21 bp, Artificial sequence
  SiRNA target sequence
atgtgtattttacatttgtat

SEQ ID NO: 53641 - DNA, 21 bp, Artificial sequence
  SiRNA target sequence
tgtgtattttacatttgtatt

SEQ ID NO: 53642 - DNA, 21 bp, Artificial sequence
  SiRNA target sequence
gtgtattttacatttgtattt

SEQ ID NO: 53643 - DNA, 21 bp, Artificial sequence
  SiRNA target sequence
tgtattttacatttgtatttt

SEQ ID NO: 53644 - DNA, 21 bp, Artificial sequence
  SiRNA target sequence
gtattttacatttgtattttc

SEQ ID NO: 53645 - DNA, 21 bp, Artificial sequence
  SiRNA target sequence
tattttacatttgtattttca

SEQ ID NO: 53646 - DNA, 21 bp, Artificial sequence
  SiRNA target sequence
attttacatttgtattttcaa

SEQ ID NO: 53647 - DNA, 21 bp, Artificial sequence
  SiRNA target sequence
ttttacatttgtattttcaat

SEQ ID NO: 53648 - DNA, 21 bp, Artificial sequence
  SiRNA target sequence
tttacatttgtattttcaata

SEQ ID NO: 53649 - DNA, 21 bp, Artificial sequence
  SiRNA target sequence
ttacatttgtattttcaatat

SEQ ID NO: 53650 - DNA, 21 bp, Artificial sequence
  SiRNA target sequence
tacatttgtattttcaatatg

SEQ ID NO: 53651 - DNA, 21 bp, Artificial sequence
  SiRNA target sequence
acatttgtattttcaatatgg

SEQ ID NO: 53652 - DNA, 21 bp, Artificial sequence
  SiRNA target sequence
catttgtattttcaatatgga

SEQ ID NO: 53653 - DNA, 21 bp, Artificial sequence
  SiRNA target sequence
atttgtattttcaatatggag

SEQ ID NO: 53654 - DNA, 21 bp, Artificial sequence
  SiRNA target sequence
tttgtattttcaatatggaga

SEQ ID NO: 53655 - DNA, 21 bp, Artificial sequence
  SiRNA target sequence
ttgtattttcaatatggagaa

SEQ ID NO: 53656 - DNA, 21 bp, Artificial sequence
  SiRNA target sequence
tgtattttcaatatggagaaa

SEQ ID NO: 53657 - DNA, 21 bp, Artificial sequence
  SiRNA target sequence
gtattttcaatatggagaaac

SEQ ID NO: 53658 - DNA, 21 bp, Artificial sequence
  SiRNA target sequence
tattttcaatatggagaaaca

SEQ ID NO: 53659 - DNA, 21 bp, Artificial sequence
  SiRNA target sequence
attttcaatatggagaaacaa

SEQ ID NO: 53660 - DNA, 21 bp, Artificial sequence
  SiRNA target sequence
ttttcaatatggagaaacaat

SEQ ID NO: 53661 - DNA, 21 bp, Artificial sequence
  SiRNA target sequence
tttcaatatggagaaacaata

SEQ ID NO: 53662 - DNA, 21 bp, Artificial sequence
  SiRNA target sequence
ttcaatatggagaaacaatat

SEQ ID NO: 53663 - DNA, 21 bp, Artificial sequence
  SiRNA target sequence
tcaatatggagaaacaatatt

SEQ ID NO: 53664 - DNA, 21 bp, Artificial sequence
  SiRNA target sequence
caatatggagaaacaatatta

SEQ ID NO: 53665 - DNA, 21 bp, Artificial sequence
  SiRNA target sequence
aatatggagaaacaatattag

SEQ ID NO: 53666 - DNA, 21 bp, Artificial sequence
  SiRNA target sequence
atatggagaaacaatattaga

SEQ ID NO: 53667 - DNA, 21 bp, Artificial sequence
  SiRNA target sequence
tatggagaaacaatattagaa

SEQ ID NO: 53668 - DNA, 21 bp, Artificial sequence
  SiRNA target sequence
atggagaaacaatattagaag

SEQ ID NO: 53669 - DNA, 21 bp, Artificial sequence
  SiRNA target sequence
tggagaaacaatattagaaga

SEQ ID NO: 53670 - DNA, 21 bp, Artificial sequence
  SiRNA target sequence
ggagaaacaatattagaagac

SEQ ID NO: 53671 - DNA, 21 bp, Artificial sequence
  SiRNA target sequence
gagaaacaatattagaagaca

SEQ ID NO: 53672 - DNA, 21 bp, Artificial sequence
  SiRNA target sequence
agaaacaatattagaagacaa

SEQ ID NO: 53673 - DNA, 21 bp, Artificial sequence
  SiRNA target sequence
gaaacaatattagaagacaat

SEQ ID NO: 53674 - DNA, 21 bp, Artificial sequence
  SiRNA target sequence
aaacaatattagaagacaata

SEQ ID NO: 53675 - DNA, 21 bp, Artificial sequence
  SiRNA target sequence
aacaatattagaagacaatat

SEQ ID NO: 53676 - DNA, 21 bp, Artificial sequence
  SiRNA target sequence
acaatattagaagacaatata

SEQ ID NO: 53677 - DNA, 21 bp, Artificial sequence
  SiRNA target sequence
caatattagaagacaatataa

SEQ ID NO: 53678 - DNA, 21 bp, Artificial sequence
  SiRNA target sequence
aatattagaagacaatataat

SEQ ID NO: 53679 - DNA, 21 bp, Artificial sequence
  SiRNA target sequence
atattagaagacaatataata

SEQ ID NO: 53680 - DNA, 21 bp, Artificial sequence
  SiRNA target sequence
tattagaagacaatataataa

SEQ ID NO: 53681 - DNA, 21 bp, Artificial sequence
  SiRNA target sequence
attagaagacaatataataag

SEQ ID NO: 53682 - DNA, 21 bp, Artificial sequence
  SiRNA target sequence
ttagaagacaatataataagt

SEQ ID NO: 53683 - DNA, 21 bp, Artificial sequence
  SiRNA target sequence
tagaagacaatataataagtc

SEQ ID NO: 53684 - DNA, 21 bp, Artificial sequence
  SiRNA target sequence
agaagacaatataataagtca

SEQ ID NO: 53685 - DNA, 21 bp, Artificial sequence
  SiRNA target sequence
gaagacaatataataagtcac

SEQ ID NO: 53686 - DNA, 21 bp, Artificial sequence
  SiRNA target sequence
aagacaatataataagtcaca

SEQ ID NO: 53687 - DNA, 21 bp, Artificial sequence
  SiRNA target sequence
agacaatataataagtcacag

SEQ ID NO: 53688 - DNA, 21 bp, Artificial sequence
  SiRNA target sequence
gacaatataataagtcacagg

SEQ ID NO: 53689 - DNA, 21 bp, Artificial sequence
  SiRNA target sequence
acaatataataagtcacagga

SEQ ID NO: 53690 - DNA, 21 bp, Artificial sequence
  SiRNA target sequence
caatataataagtcacaggat

SEQ ID NO: 53691 - DNA, 21 bp, Artificial sequence
  SiRNA target sequence
aatataataagtcacaggata

SEQ ID NO: 53692 - DNA, 21 bp, Artificial sequence
  SiRNA target sequence
atataataagtcacaggataa

SEQ ID NO: 53693 - DNA, 21 bp, Artificial sequence
  SiRNA target sequence
tataataagtcacaggataaa

SEQ ID NO: 53694 - DNA, 21 bp, Artificial sequence
  SiRNA target sequence
ataataagtcacaggataaat

SEQ ID NO: 53695 - DNA, 21 bp, Artificial sequence
  SiRNA target sequence
taataagtcacaggataaatt

SEQ ID NO: 53696 - DNA, 21 bp, Artificial sequence
  SiRNA target sequence
aataagtcacaggataaatta

SEQ ID NO: 53697 - DNA, 21 bp, Artificial sequence
  SiRNA target sequence
ataagtcacaggataaattat

SEQ ID NO: 53698 - DNA, 21 bp, Artificial sequence
  SiRNA target sequence
taagtcacaggataaattatc

SEQ ID NO: 53699 - DNA, 21 bp, Artificial sequence
  SiRNA target sequence
aagtcacaggataaattatcg

SEQ ID NO: 53700 - DNA, 21 bp, Artificial sequence
  SiRNA target sequence
agtcacaggataaattatcga

SEQ ID NO: 53701 - DNA, 21 bp, Artificial sequence
  SiRNA target sequence
gtcacaggataaattatcgaa

SEQ ID NO: 53702 - DNA, 21 bp, Artificial sequence
  SiRNA target sequence
tcacaggataaattatcgaat

SEQ ID NO: 53703 - DNA, 21 bp, Artificial sequence
  SiRNA target sequence
cacaggataaattatcgaata

SEQ ID NO: 53704 - DNA, 21 bp, Artificial sequence
  SiRNA target sequence
acaggataaattatcgaataa

SEQ ID NO: 53705 - DNA, 21 bp, Artificial sequence
  SiRNA target sequence
caggataaattatcgaataaa

SEQ ID NO: 53706 - DNA, 21 bp, Artificial sequence
  SiRNA target sequence
aggataaattatcgaataaat

SEQ ID NO: 53707 - DNA, 21 bp, Artificial sequence
  SiRNA target sequence
ggataaattatcgaataaatt

SEQ ID NO: 53708 - DNA, 21 bp, Artificial sequence
  SiRNA target sequence
gataaattatcgaataaatta

SEQ ID NO: 53709 - DNA, 21 bp, Artificial sequence
  SiRNA target sequence
ataaattatcgaataaattac

SEQ ID NO: 53710 - DNA, 21 bp, Artificial sequence
  SiRNA target sequence
taaattatcgaataaattaca

SEQ ID NO: 53711 - DNA, 21 bp, Artificial sequence
  SiRNA target sequence
aaattatcgaataaattacaa

SEQ ID NO: 53712 - DNA, 21 bp, Artificial sequence
  SiRNA target sequence
aattatcgaataaattacaag

SEQ ID NO: 53713 - DNA, 21 bp, Artificial sequence
  SiRNA target sequence
attatcgaataaattacaaga

SEQ ID NO: 53714 - DNA, 21 bp, Artificial sequence
  SiRNA target sequence
ttatcgaataaattacaagat

SEQ ID NO: 53715 - DNA, 21 bp, Artificial sequence
  SiRNA target sequence
tatcgaataaattacaagatt

SEQ ID NO: 53716 - DNA, 21 bp, Artificial sequence
  SiRNA target sequence
atcgaataaattacaagattt

SEQ ID NO: 53717 - DNA, 21 bp, Artificial sequence
  SiRNA target sequence
tcgaataaattacaagatttt

SEQ ID NO: 53718 - DNA, 21 bp, Artificial sequence
  SiRNA target sequence
cgaataaattacaagattttt

SEQ ID NO: 53719 - DNA, 21 bp, Artificial sequence
  SiRNA target sequence
gaataaattacaagatttttt

SEQ ID NO: 53720 - DNA, 21 bp, Artificial sequence
  SiRNA target sequence
aataaattacaagatttttta

SEQ ID NO: 53721 - DNA, 21 bp, Artificial sequence
  SiRNA target sequence
ataaattacaagattttttag

SEQ ID NO: 53722 - DNA, 21 bp, Artificial sequence
  SiRNA target sequence
taaattacaagattttttagc

SEQ ID NO: 53723 - DNA, 21 bp, Artificial sequence
  SiRNA target sequence
aaattacaagattttttagct

SEQ ID NO: 53724 - DNA, 21 bp, Artificial sequence
  SiRNA target sequence
aattacaagattttttagcta

SEQ ID NO: 53725 - DNA, 21 bp, Artificial sequence
  SiRNA target sequence
attacaagattttttagctaa

SEQ ID NO: 53726 - DNA, 21 bp, Artificial sequence
  SiRNA target sequence
ttacaagattttttagctaat

SEQ ID NO: 53727 - DNA, 21 bp, Artificial sequence
  SiRNA target sequence
tacaagattttttagctaatc

SEQ ID NO: 53728 - DNA, 21 bp, Artificial sequence
  SiRNA target sequence
acaagattttttagctaatca

SEQ ID NO: 53729 - DNA, 21 bp, Artificial sequence
  SiRNA target sequence
caagattttttagctaatcat

SEQ ID NO: 53730 - DNA, 21 bp, Artificial sequence
  SiRNA target sequence
aagattttttagctaatcatg

SEQ ID NO: 53731 - DNA, 21 bp, Artificial sequence
  SiRNA target sequence
agattttttagctaatcatga

SEQ ID NO: 53732 - DNA, 21 bp, Artificial sequence
  SiRNA target sequence
gattttttagctaatcatgaa

SEQ ID NO: 53733 - DNA, 21 bp, Artificial sequence
  SiRNA target sequence
attttttagctaatcatgaaa

SEQ ID NO: 53734 - DNA, 21 bp, Artificial sequence
  SiRNA target sequence
ttttttagctaatcatgaaac

SEQ ID NO: 53735 - DNA, 21 bp, Artificial sequence
  SiRNA target sequence
tttttagctaatcatgaaaca

SEQ ID NO: 53736 - DNA, 21 bp, Artificial sequence
  SiRNA target sequence
ttttagctaatcatgaaacaa

SEQ ID NO: 53737 - DNA, 21 bp, Artificial sequence
  SiRNA target sequence
tttagctaatcatgaaacaat

SEQ ID NO: 53738 - DNA, 21 bp, Artificial sequence
  SiRNA target sequence
ttagctaatcatgaaacaatt

SEQ ID NO: 53739 - DNA, 21 bp, Artificial sequence
  SiRNA target sequence
tagctaatcatgaaacaatta

SEQ ID NO: 53740 - DNA, 21 bp, Artificial sequence
  SiRNA target sequence
agctaatcatgaaacaattaa

SEQ ID NO: 53741 - DNA, 21 bp, Artificial sequence
  SiRNA target sequence
gctaatcatgaaacaattaaa

SEQ ID NO: 53742 - DNA, 21 bp, Artificial sequence
  SiRNA target sequence
ctaatcatgaaacaattaaag

SEQ ID NO: 53743 - DNA, 21 bp, Artificial sequence
  SiRNA target sequence
taatcatgaaacaattaaagc

SEQ ID NO: 53744 - DNA, 21 bp, Artificial sequence
  SiRNA target sequence
aatcatgaaacaattaaagcc

SEQ ID NO: 53745 - DNA, 21 bp, Artificial sequence
  SiRNA target sequence
atcatgaaacaattaaagcct

SEQ ID NO: 53746 - DNA, 21 bp, Artificial sequence
  SiRNA target sequence
tcatgaaacaattaaagccta

SEQ ID NO: 53747 - DNA, 21 bp, Artificial sequence
  SiRNA target sequence
catgaaacaattaaagcctat

SEQ ID NO: 53748 - DNA, 21 bp, Artificial sequence
  SiRNA target sequence
atgaaacaattaaagcctata

SEQ ID NO: 53749 - DNA, 21 bp, Artificial sequence
  SiRNA target sequence
tgaaacaattaaagcctataa

SEQ ID NO: 53750 - DNA, 21 bp, Artificial sequence
  SiRNA target sequence
gaaacaattaaagcctataat

SEQ ID NO: 53751 - DNA, 21 bp, Artificial sequence
  SiRNA target sequence
aaacaattaaagcctataata

SEQ ID NO: 53752 - DNA, 21 bp, Artificial sequence
  SiRNA target sequence
aacaattaaagcctataatat

SEQ ID NO: 53753 - DNA, 21 bp, Artificial sequence
  SiRNA target sequence
acaattaaagcctataatatg

SEQ ID NO: 53754 - DNA, 21 bp, Artificial sequence
  SiRNA target sequence
caattaaagcctataatatgg

SEQ ID NO: 53755 - DNA, 21 bp, Artificial sequence
  SiRNA target sequence
aattaaagcctataatatgga

SEQ ID NO: 53756 - DNA, 21 bp, Artificial sequence
  SiRNA target sequence
attaaagcctataatatggaa

SEQ ID NO: 53757 - DNA, 21 bp, Artificial sequence
  SiRNA target sequence
ttaaagcctataatatggaag

SEQ ID NO: 53758 - DNA, 21 bp, Artificial sequence
  SiRNA target sequence
taaagcctataatatggaaga

SEQ ID NO: 53759 - DNA, 21 bp, Artificial sequence
  SiRNA target sequence
aaagcctataatatggaagaa

SEQ ID NO: 53760 - DNA, 21 bp, Artificial sequence
  SiRNA target sequence
aagcctataatatggaagaag

SEQ ID NO: 53761 - DNA, 21 bp, Artificial sequence
  SiRNA target sequence
agcctataatatggaagaaga

SEQ ID NO: 53762 - DNA, 21 bp, Artificial sequence
  SiRNA target sequence
gcctataatatggaagaagaa

SEQ ID NO: 53763 - DNA, 21 bp, Artificial sequence
  SiRNA target sequence
cctataatatggaagaagaaa

SEQ ID NO: 53764 - DNA, 21 bp, Artificial sequence
  SiRNA target sequence
ctataatatggaagaagaaac

SEQ ID NO: 53765 - DNA, 21 bp, Artificial sequence
  SiRNA target sequence
tataatatggaagaagaaact

SEQ ID NO: 53766 - DNA, 21 bp, Artificial sequence
  SiRNA target sequence
ataatatggaagaagaaacta

SEQ ID NO: 53767 - DNA, 21 bp, Artificial sequence
  SiRNA target sequence
taatatggaagaagaaactat

SEQ ID NO: 53768 - DNA, 21 bp, Artificial sequence
  SiRNA target sequence
aatatggaagaagaaactatt

SEQ ID NO: 53769 - DNA, 21 bp, Artificial sequence
  SiRNA target sequence
atatggaagaagaaactatta

SEQ ID NO: 53770 - DNA, 21 bp, Artificial sequence
  SiRNA target sequence
tatggaagaagaaactattac

SEQ ID NO: 53771 - DNA, 21 bp, Artificial sequence
  SiRNA target sequence
atggaagaagaaactattaca

SEQ ID NO: 53772 - DNA, 21 bp, Artificial sequence
  SiRNA target sequence
tggaagaagaaactattacat

SEQ ID NO: 53773 - DNA, 21 bp, Artificial sequence
  SiRNA target sequence
ggaagaagaaactattacata

SEQ ID NO: 53774 - DNA, 21 bp, Artificial sequence
  SiRNA target sequence
gaagaagaaactattacatat

SEQ ID NO: 53775 - DNA, 21 bp, Artificial sequence
  SiRNA target sequence
aagaagaaactattacatatt

SEQ ID NO: 53776 - DNA, 21 bp, Artificial sequence
  SiRNA target sequence
agaagaaactattacatattt

SEQ ID NO: 53777 - DNA, 21 bp, Artificial sequence
  SiRNA target sequence
gaagaaactattacatatttt

SEQ ID NO: 53778 - DNA, 21 bp, Artificial sequence
  SiRNA target sequence
aagaaactattacatattttg

SEQ ID NO: 53779 - DNA, 21 bp, Artificial sequence
  SiRNA target sequence
agaaactattacatattttga

SEQ ID NO: 53780 - DNA, 21 bp, Artificial sequence
  SiRNA target sequence
gaaactattacatattttgat

SEQ ID NO: 53781 - DNA, 21 bp, Artificial sequence
  SiRNA target sequence
aaactattacatattttgatg

SEQ ID NO: 53782 - DNA, 21 bp, Artificial sequence
  SiRNA target sequence
aactattacatattttgatga

SEQ ID NO: 53783 - DNA, 21 bp, Artificial sequence
  SiRNA target sequence
actattacatattttgatgaa

SEQ ID NO: 53784 - DNA, 21 bp, Artificial sequence
  SiRNA target sequence
ctattacatattttgatgaaa

SEQ ID NO: 53785 - DNA, 21 bp, Artificial sequence
  SiRNA target sequence
tattacatattttgatgaaaa

SEQ ID NO: 53786 - DNA, 21 bp, Artificial sequence
  SiRNA target sequence
attacatattttgatgaaaat

SEQ ID NO: 53787 - DNA, 21 bp, Artificial sequence
  SiRNA target sequence
ttacatattttgatgaaaatc

SEQ ID NO: 53788 - DNA, 21 bp, Artificial sequence
  SiRNA target sequence
tacatattttgatgaaaatca

SEQ ID NO: 53789 - DNA, 21 bp, Artificial sequence
  SiRNA target sequence
acatattttgatgaaaatcaa

SEQ ID NO: 53790 - DNA, 21 bp, Artificial sequence
  SiRNA target sequence
catattttgatgaaaatcaaa

SEQ ID NO: 53791 - DNA, 21 bp, Artificial sequence
  SiRNA target sequence
atattttgatgaaaatcaaaa

SEQ ID NO: 53792 - DNA, 21 bp, Artificial sequence
  SiRNA target sequence
tattttgatgaaaatcaaaaa

SEQ ID NO: 53793 - DNA, 21 bp, Artificial sequence
  SiRNA target sequence
attttgatgaaaatcaaaaac

SEQ ID NO: 53794 - DNA, 21 bp, Artificial sequence
  SiRNA target sequence
ttttgatgaaaatcaaaaacc

SEQ ID NO: 53795 - DNA, 21 bp, Artificial sequence
  SiRNA target sequence
tttgatgaaaatcaaaaaccg

SEQ ID NO: 53796 - DNA, 21 bp, Artificial sequence
  SiRNA target sequence
ttgatgaaaatcaaaaaccgg

SEQ ID NO: 53797 - DNA, 21 bp, Artificial sequence
  SiRNA target sequence
tgatgaaaatcaaaaaccggt

SEQ ID NO: 53798 - DNA, 21 bp, Artificial sequence
  SiRNA target sequence
gatgaaaatcaaaaaccggta

SEQ ID NO: 53799 - DNA, 21 bp, Artificial sequence
  SiRNA target sequence
atgaaaatcaaaaaccggtag

SEQ ID NO: 53800 - DNA, 21 bp, Artificial sequence
  SiRNA target sequence
tgaaaatcaaaaaccggtaga

SEQ ID NO: 53801 - DNA, 21 bp, Artificial sequence
  SiRNA target sequence
gaaaatcaaaaaccggtagaa

SEQ ID NO: 53802 - DNA, 21 bp, Artificial sequence
  SiRNA target sequence
aaaatcaaaaaccggtagaat

SEQ ID NO: 53803 - DNA, 21 bp, Artificial sequence
  SiRNA target sequence
aaatcaaaaaccggtagaata

SEQ ID NO: 53804 - DNA, 21 bp, Artificial sequence
  SiRNA target sequence
aatcaaaaaccggtagaatat

SEQ ID NO: 53805 - DNA, 21 bp, Artificial sequence
  SiRNA target sequence
atcaaaaaccggtagaatatt

SEQ ID NO: 53806 - DNA, 21 bp, Artificial sequence
  SiRNA target sequence
tcaaaaaccggtagaatattt

SEQ ID NO: 53807 - DNA, 21 bp, Artificial sequence
  SiRNA target sequence
caaaaaccggtagaatatttt

SEQ ID NO: 53808 - DNA, 21 bp, Artificial sequence
  SiRNA target sequence
aaaaaccggtagaatattttg

SEQ ID NO: 53809 - DNA, 21 bp, Artificial sequence
  SiRNA target sequence
aaaaccggtagaatattttgg

SEQ ID NO: 53810 - DNA, 21 bp, Artificial sequence
  SiRNA target sequence
aaaccggtagaatattttggg

SEQ ID NO: 53811 - DNA, 21 bp, Artificial sequence
  SiRNA target sequence
aaccggtagaatattttgggg

SEQ ID NO: 53812 - DNA, 21 bp, Artificial sequence
  SiRNA target sequence
accggtagaatattttggggt

SEQ ID NO: 53813 - DNA, 21 bp, Artificial sequence
  SiRNA target sequence
ccggtagaatattttggggta

SEQ ID NO: 53814 - DNA, 21 bp, Artificial sequence
  SiRNA target sequence
cggtagaatattttggggtaa

SEQ ID NO: 53815 - DNA, 21 bp, Artificial sequence
  SiRNA target sequence
ggtagaatattttggggtaaa

SEQ ID NO: 53816 - DNA, 21 bp, Artificial sequence
  SiRNA target sequence
gtagaatattttggggtaaag

SEQ ID NO: 53817 - DNA, 21 bp, Artificial sequence
  SiRNA target sequence
tagaatattttggggtaaagt

SEQ ID NO: 53818 - DNA, 21 bp, Artificial sequence
  SiRNA target sequence
agaatattttggggtaaagtc

SEQ ID NO: 53819 - DNA, 21 bp, Artificial sequence
  SiRNA target sequence
gaatattttggggtaaagtct

SEQ ID NO: 53820 - DNA, 21 bp, Artificial sequence
  SiRNA target sequence
aatattttggggtaaagtctc

SEQ ID NO: 53821 - DNA, 21 bp, Artificial sequence
  SiRNA target sequence
atattttggggtaaagtctca

SEQ ID NO: 53822 - DNA, 21 bp, Artificial sequence
  SiRNA target sequence
tattttggggtaaagtctcac

SEQ ID NO: 53823 - DNA, 21 bp, Artificial sequence
  SiRNA target sequence
attttggggtaaagtctcaca

SEQ ID NO: 53824 - DNA, 21 bp, Artificial sequence
  SiRNA target sequence
ttttggggtaaagtctcacag

SEQ ID NO: 53825 - DNA, 21 bp, Artificial sequence
  SiRNA target sequence
tttggggtaaagtctcacaga

SEQ ID NO: 53826 - DNA, 21 bp, Artificial sequence
  SiRNA target sequence
ttggggtaaagtctcacagaa

SEQ ID NO: 53827 - DNA, 21 bp, Artificial sequence
  SiRNA target sequence
tggggtaaagtctcacagaat

SEQ ID NO: 53828 - DNA, 21 bp, Artificial sequence
  SiRNA target sequence
ggggtaaagtctcacagaatt

SEQ ID NO: 53829 - DNA, 21 bp, Artificial sequence
  SiRNA target sequence
gggtaaagtctcacagaattt

SEQ ID NO: 53830 - DNA, 21 bp, Artificial sequence
  SiRNA target sequence
ggtaaagtctcacagaatttt

SEQ ID NO: 53831 - DNA, 21 bp, Artificial sequence
  SiRNA target sequence
gtaaagtctcacagaattttg

SEQ ID NO: 53832 - DNA, 21 bp, Artificial sequence
  SiRNA target sequence
taaagtctcacagaattttgt

SEQ ID NO: 53833 - DNA, 21 bp, Artificial sequence
  SiRNA target sequence
aaagtctcacagaattttgtt

SEQ ID NO: 53834 - DNA, 21 bp, Artificial sequence
  SiRNA target sequence
aagtctcacagaattttgttc

SEQ ID NO: 53835 - DNA, 21 bp, Artificial sequence
  SiRNA target sequence
agtctcacagaattttgttct

SEQ ID NO: 53836 - DNA, 21 bp, Artificial sequence
  SiRNA target sequence
gtctcacagaattttgttctc

SEQ ID NO: 53837 - DNA, 21 bp, Artificial sequence
  SiRNA target sequence
tctcacagaattttgttctct

SEQ ID NO: 53838 - DNA, 21 bp, Artificial sequence
  SiRNA target sequence
ctcacagaattttgttctctc

SEQ ID NO: 53839 - DNA, 21 bp, Artificial sequence
  SiRNA target sequence
tcacagaattttgttctctct

SEQ ID NO: 53840 - DNA, 21 bp, Artificial sequence
  SiRNA target sequence
cacagaattttgttctctctt

SEQ ID NO: 53841 - DNA, 21 bp, Artificial sequence
  SiRNA target sequence
acagaattttgttctctcttt

SEQ ID NO: 53842 - DNA, 21 bp, Artificial sequence
  SiRNA target sequence
cagaattttgttctctctttt

SEQ ID NO: 53843 - DNA, 21 bp, Artificial sequence
  SiRNA target sequence
agaattttgttctctctttta

SEQ ID NO: 53844 - DNA, 21 bp, Artificial sequence
  SiRNA target sequence
gaattttgttctctcttttat

SEQ ID NO: 53845 - DNA, 21 bp, Artificial sequence
  SiRNA target sequence
aattttgttctctcttttata

SEQ ID NO: 53846 - DNA, 21 bp, Artificial sequence
  SiRNA target sequence
attttgttctctcttttatat

SEQ ID NO: 53847 - DNA, 21 bp, Artificial sequence
  SiRNA target sequence
ttttgttctctcttttatata

SEQ ID NO: 53848 - DNA, 21 bp, Artificial sequence
  SiRNA target sequence
tttgttctctcttttatatat

SEQ ID NO: 53849 - DNA, 21 bp, Artificial sequence
  SiRNA target sequence
ttgttctctcttttatatata

SEQ ID NO: 53850 - DNA, 21 bp, Artificial sequence
  SiRNA target sequence
tgttctctcttttatatatac

SEQ ID NO: 53851 - DNA, 21 bp, Artificial sequence
  SiRNA target sequence
gttctctcttttatatataca

SEQ ID NO: 53852 - DNA, 21 bp, Artificial sequence
  SiRNA target sequence
ttctctcttttatatatacaa

SEQ ID NO: 53853 - DNA, 21 bp, Artificial sequence
  SiRNA target sequence
tctctcttttatatatacaaa

SEQ ID NO: 53854 - DNA, 21 bp, Artificial sequence
  SiRNA target sequence
ctctcttttatatatacaaaa

SEQ ID NO: 53855 - DNA, 21 bp, Artificial sequence
  SiRNA target sequence
tctcttttatatatacaaaaa

SEQ ID NO: 53856 - DNA, 21 bp, Artificial sequence
  SiRNA target sequence
ctcttttatatatacaaaaaa

SEQ ID NO: 53857 - DNA, 21 bp, Artificial sequence
  SiRNA target sequence
tcttttatatatacaaaaaat

SEQ ID NO: 53858 - DNA, 21 bp, Artificial sequence
  SiRNA target sequence
cttttatatatacaaaaaatg

SEQ ID NO: 53859 - DNA, 21 bp, Artificial sequence
  SiRNA target sequence
ttttatatatacaaaaaatga

SEQ ID NO: 53860 - DNA, 21 bp, Artificial sequence
  SiRNA target sequence
tttatatatacaaaaaatgac

SEQ ID NO: 53861 - DNA, 21 bp, Artificial sequence
  SiRNA target sequence
ttatatatacaaaaaatgaca

SEQ ID NO: 53862 - DNA, 21 bp, Artificial sequence
  SiRNA target sequence
tatatatacaaaaaatgacat

SEQ ID NO: 53863 - DNA, 21 bp, Artificial sequence
  SiRNA target sequence
atatatacaaaaaatgacatt

SEQ ID NO: 53864 - DNA, 21 bp, Artificial sequence
  SiRNA target sequence
tatatacaaaaaatgacattt

SEQ ID NO: 53865 - DNA, 21 bp, Artificial sequence
  SiRNA target sequence
atatacaaaaaatgacatttg

SEQ ID NO: 53866 - DNA, 21 bp, Artificial sequence
  SiRNA target sequence
tatacaaaaaatgacatttgc

SEQ ID NO: 53867 - DNA, 21 bp, Artificial sequence
  SiRNA target sequence
atacaaaaaatgacatttgcg

SEQ ID NO: 53868 - DNA, 21 bp, Artificial sequence
  SiRNA target sequence
tacaaaaaatgacatttgcga

SEQ ID NO: 53869 - DNA, 21 bp, Artificial sequence
  SiRNA target sequence
acaaaaaatgacatttgcgat

SEQ ID NO: 53870 - DNA, 21 bp, Artificial sequence
  SiRNA target sequence
caaaaaatgacatttgcgata

SEQ ID NO: 53871 - DNA, 21 bp, Artificial sequence
  SiRNA target sequence
aaaaaatgacatttgcgatac

SEQ ID NO: 53872 - DNA, 21 bp, Artificial sequence
  SiRNA target sequence
aaaaatgacatttgcgataca

SEQ ID NO: 53873 - DNA, 21 bp, Artificial sequence
  SiRNA target sequence
aaaatgacatttgcgatacag

SEQ ID NO: 53874 - DNA, 21 bp, Artificial sequence
  SiRNA target sequence
aaatgacatttgcgatacagg

SEQ ID NO: 53875 - DNA, 21 bp, Artificial sequence
  SiRNA target sequence
aatgacatttgcgatacaggc

SEQ ID NO: 53876 - DNA, 21 bp, Artificial sequence
  SiRNA target sequence
atgacatttgcgatacaggca

SEQ ID NO: 53877 - DNA, 21 bp, Artificial sequence
  SiRNA target sequence
tgacatttgcgatacaggcaa

SEQ ID NO: 53878 - DNA, 21 bp, Artificial sequence
  SiRNA target sequence
gacatttgcgatacaggcaat

SEQ ID NO: 53879 - DNA, 21 bp, Artificial sequence
  SiRNA target sequence
acatttgcgatacaggcaatt

SEQ ID NO: 53880 - DNA, 21 bp, Artificial sequence
  SiRNA target sequence
catttgcgatacaggcaatta

SEQ ID NO: 53881 - DNA, 21 bp, Artificial sequence
  SiRNA target sequence
atttgcgatacaggcaattat

SEQ ID NO: 53882 - DNA, 21 bp, Artificial sequence
  SiRNA target sequence
tttgcgatacaggcaattatt

SEQ ID NO: 53883 - DNA, 21 bp, Artificial sequence
  SiRNA target sequence
ttgcgatacaggcaattatta

SEQ ID NO: 53884 - DNA, 21 bp, Artificial sequence
  SiRNA target sequence
tgcgatacaggcaattattat

SEQ ID NO: 53885 - DNA, 21 bp, Artificial sequence
  SiRNA target sequence
gcgatacaggcaattattatt

SEQ ID NO: 53886 - DNA, 21 bp, Artificial sequence
  SiRNA target sequence
cgatacaggcaattattatta

SEQ ID NO: 53887 - DNA, 21 bp, Artificial sequence
  SiRNA target sequence
gatacaggcaattattattat

SEQ ID NO: 53888 - DNA, 21 bp, Artificial sequence
  SiRNA target sequence
atacaggcaattattattatc

SEQ ID NO: 53889 - DNA, 21 bp, Artificial sequence
  SiRNA target sequence
tacaggcaattattattatca

SEQ ID NO: 53890 - DNA, 21 bp, Artificial sequence
  SiRNA target sequence
acaggcaattattattatcac

SEQ ID NO: 53891 - DNA, 21 bp, Artificial sequence
  SiRNA target sequence
caggcaattattattatcaca

SEQ ID NO: 53892 - DNA, 21 bp, Artificial sequence
  SiRNA target sequence
aggcaattattattatcacat

SEQ ID NO: 53893 - DNA, 21 bp, Artificial sequence
  SiRNA target sequence
ggcaattattattatcacatt

SEQ ID NO: 53894 - DNA, 21 bp, Artificial sequence
  SiRNA target sequence
gcaattattattatcacatta

SEQ ID NO: 53895 - DNA, 21 bp, Artificial sequence
  SiRNA target sequence
caattattattatcacattag

SEQ ID NO: 53896 - DNA, 21 bp, Artificial sequence
  SiRNA target sequence
aattattattatcacattagg

SEQ ID NO: 53897 - DNA, 21 bp, Artificial sequence
  SiRNA target sequence
attattattatcacattagga

SEQ ID NO: 53898 - DNA, 21 bp, Artificial sequence
  SiRNA target sequence
ttattattatcacattaggat

SEQ ID NO: 53899 - DNA, 21 bp, Artificial sequence
  SiRNA target sequence
tattattatcacattaggatc

SEQ ID NO: 53900 - DNA, 21 bp, Artificial sequence
  SiRNA target sequence
attattatcacattaggatct

SEQ ID NO: 53901 - DNA, 21 bp, Artificial sequence
  SiRNA target sequence
ttattatcacattaggatctt

SEQ ID NO: 53902 - DNA, 21 bp, Artificial sequence
  SiRNA target sequence
tattatcacattaggatcttt

SEQ ID NO: 53903 - DNA, 21 bp, Artificial sequence
  SiRNA target sequence
attatcacattaggatctttt

SEQ ID NO: 53904 - DNA, 21 bp, Artificial sequence
  SiRNA target sequence
ttatcacattaggatcttttg

SEQ ID NO: 53905 - DNA, 21 bp, Artificial sequence
  SiRNA target sequence
tatcacattaggatcttttgg

SEQ ID NO: 53906 - DNA, 21 bp, Artificial sequence
  SiRNA target sequence
atcacattaggatcttttgga

SEQ ID NO: 53907 - DNA, 21 bp, Artificial sequence
  SiRNA target sequence
tcacattaggatcttttggat

SEQ ID NO: 53908 - DNA, 21 bp, Artificial sequence
  SiRNA target sequence
cacattaggatcttttggata

SEQ ID NO: 53909 - DNA, 21 bp, Artificial sequence
  SiRNA target sequence
acattaggatcttttggatat

SEQ ID NO: 53910 - DNA, 21 bp, Artificial sequence
  SiRNA target sequence
cattaggatcttttggatatt

SEQ ID NO: 53911 - DNA, 21 bp, Artificial sequence
  SiRNA target sequence
attaggatcttttggatattt

SEQ ID NO: 53912 - DNA, 21 bp, Artificial sequence
  SiRNA target sequence
ttaggatcttttggatatttt

SEQ ID NO: 53913 - DNA, 21 bp, Artificial sequence
  SiRNA target sequence
taggatcttttggatattttc

SEQ ID NO: 53914 - DNA, 21 bp, Artificial sequence
  SiRNA target sequence
aggatcttttggatattttcc

SEQ ID NO: 53915 - DNA, 21 bp, Artificial sequence
  SiRNA target sequence
ggatcttttggatattttccg

SEQ ID NO: 53916 - DNA, 21 bp, Artificial sequence
  SiRNA target sequence
gatcttttggatattttccga

SEQ ID NO: 53917 - DNA, 21 bp, Artificial sequence
  SiRNA target sequence
atcttttggatattttccgat

SEQ ID NO: 53918 - DNA, 21 bp, Artificial sequence
  SiRNA target sequence
tcttttggatattttccgatt

SEQ ID NO: 53919 - DNA, 21 bp, Artificial sequence
  SiRNA target sequence
cttttggatattttccgatta

SEQ ID NO: 53920 - DNA, 21 bp, Artificial sequence
  SiRNA target sequence
ttttggatattttccgattaa

SEQ ID NO: 53921 - DNA, 21 bp, Artificial sequence
  SiRNA target sequence
tttggatattttccgattaaa

SEQ ID NO: 53922 - DNA, 21 bp, Artificial sequence
  SiRNA target sequence
ttggatattttccgattaaat

SEQ ID NO: 53923 - DNA, 21 bp, Artificial sequence
  SiRNA target sequence
tggatattttccgattaaatt

SEQ ID NO: 53924 - DNA, 21 bp, Artificial sequence
  SiRNA target sequence
ggatattttccgattaaatta

SEQ ID NO: 53925 - DNA, 21 bp, Artificial sequence
  SiRNA target sequence
gatattttccgattaaattat

SEQ ID NO: 53926 - DNA, 21 bp, Artificial sequence
  SiRNA target sequence
atattttccgattaaattatc

SEQ ID NO: 53927 - DNA, 21 bp, Artificial sequence
  SiRNA target sequence
tattttccgattaaattatcc

SEQ ID NO: 53928 - DNA, 21 bp, Artificial sequence
  SiRNA target sequence
attttccgattaaattatcct

SEQ ID NO: 53929 - DNA, 21 bp, Artificial sequence
  SiRNA target sequence
ttttccgattaaattatcctc

SEQ ID NO: 53930 - DNA, 21 bp, Artificial sequence
  SiRNA target sequence
tttccgattaaattatcctct

SEQ ID NO: 53931 - DNA, 21 bp, Artificial sequence
  SiRNA target sequence
ttccgattaaattatcctctc

SEQ ID NO: 53932 - DNA, 21 bp, Artificial sequence
  SiRNA target sequence
tccgattaaattatcctctca

SEQ ID NO: 53933 - DNA, 21 bp, Artificial sequence
  SiRNA target sequence
ccgattaaattatcctctcaa

SEQ ID NO: 53934 - DNA, 21 bp, Artificial sequence
  SiRNA target sequence
cgattaaattatcctctcaac

SEQ ID NO: 53935 - DNA, 21 bp, Artificial sequence
  SiRNA target sequence
gattaaattatcctctcaaca

SEQ ID NO: 53936 - DNA, 21 bp, Artificial sequence
  SiRNA target sequence
attaaattatcctctcaacag

SEQ ID NO: 53937 - DNA, 21 bp, Artificial sequence
  SiRNA target sequence
ttaaattatcctctcaacagt

SEQ ID NO: 53938 - DNA, 21 bp, Artificial sequence
  SiRNA target sequence
taaattatcctctcaacagtt

SEQ ID NO: 53939 - DNA, 21 bp, Artificial sequence
  SiRNA target sequence
aaattatcctctcaacagtta

SEQ ID NO: 53940 - DNA, 21 bp, Artificial sequence
  SiRNA target sequence
aattatcctctcaacagttag

SEQ ID NO: 53941 - DNA, 21 bp, Artificial sequence
  SiRNA target sequence
attatcctctcaacagttagt

SEQ ID NO: 53942 - DNA, 21 bp, Artificial sequence
  SiRNA target sequence
ttatcctctcaacagttagtc

SEQ ID NO: 53943 - DNA, 21 bp, Artificial sequence
  SiRNA target sequence
tatcctctcaacagttagtct

SEQ ID NO: 53944 - DNA, 21 bp, Artificial sequence
  SiRNA target sequence
atcctctcaacagttagtctt

SEQ ID NO: 53945 - DNA, 21 bp, Artificial sequence
  SiRNA target sequence
tcctctcaacagttagtcttt

SEQ ID NO: 53946 - DNA, 21 bp, Artificial sequence
  SiRNA target sequence
cctctcaacagttagtctttt

SEQ ID NO: 53947 - DNA, 21 bp, Artificial sequence
  SiRNA target sequence
ctctcaacagttagtctttta

SEQ ID NO: 53948 - DNA, 21 bp, Artificial sequence
  SiRNA target sequence
tctcaacagttagtcttttat

SEQ ID NO: 53949 - DNA, 21 bp, Artificial sequence
  SiRNA target sequence
ctcaacagttagtcttttata

SEQ ID NO: 53950 - DNA, 21 bp, Artificial sequence
  SiRNA target sequence
tcaacagttagtcttttatat

SEQ ID NO: 53951 - DNA, 21 bp, Artificial sequence
  SiRNA target sequence
caacagttagtcttttatatt

SEQ ID NO: 53952 - DNA, 21 bp, Artificial sequence
  SiRNA target sequence
aacagttagtcttttatattt

SEQ ID NO: 53953 - DNA, 21 bp, Artificial sequence
  SiRNA target sequence
acagttagtcttttatatttc

SEQ ID NO: 53954 - DNA, 21 bp, Artificial sequence
  SiRNA target sequence
cagttagtcttttatatttcg

SEQ ID NO: 53955 - DNA, 21 bp, Artificial sequence
  SiRNA target sequence
agttagtcttttatatttcga

SEQ ID NO: 53956 - DNA, 21 bp, Artificial sequence
  SiRNA target sequence
gttagtcttttatatttcgat

SEQ ID NO: 53957 - DNA, 21 bp, Artificial sequence
  SiRNA target sequence
ttagtcttttatatttcgatt

SEQ ID NO: 53958 - DNA, 21 bp, Artificial sequence
  SiRNA target sequence
tagtcttttatatttcgatta

SEQ ID NO: 53959 - DNA, 21 bp, Artificial sequence
  SiRNA target sequence
agtcttttatatttcgattag

SEQ ID NO: 53960 - DNA, 21 bp, Artificial sequence
  SiRNA target sequence
gtcttttatatttcgattagt

SEQ ID NO: 53961 - DNA, 21 bp, Artificial sequence
  SiRNA target sequence
tcttttatatttcgattagta

SEQ ID NO: 53962 - DNA, 21 bp, Artificial sequence
  SiRNA target sequence
cttttatatttcgattagtaa

SEQ ID NO: 53963 - DNA, 21 bp, Artificial sequence
  SiRNA target sequence
ttttatatttcgattagtaaa

SEQ ID NO: 53964 - DNA, 21 bp, Artificial sequence
  SiRNA target sequence
tttatatttcgattagtaaaa

SEQ ID NO: 53965 - DNA, 21 bp, Artificial sequence
  SiRNA target sequence
ttatatttcgattagtaaaac

SEQ ID NO: 53966 - DNA, 21 bp, Artificial sequence
  SiRNA target sequence
tatatttcgattagtaaaacg

SEQ ID NO: 53967 - DNA, 21 bp, Artificial sequence
  SiRNA target sequence
atatttcgattagtaaaacgt

SEQ ID NO: 53968 - DNA, 21 bp, Artificial sequence
  SiRNA target sequence
tatttcgattagtaaaacgtt

SEQ ID NO: 53969 - DNA, 21 bp, Artificial sequence
  SiRNA target sequence
atttcgattagtaaaacgttg

SEQ ID NO: 53970 - DNA, 21 bp, Artificial sequence
  SiRNA target sequence
tttcgattagtaaaacgttga

SEQ ID NO: 53971 - DNA, 21 bp, Artificial sequence
  SiRNA target sequence
ttcgattagtaaaacgttgac

SEQ ID NO: 53972 - DNA, 21 bp, Artificial sequence
  SiRNA target sequence
tcgattagtaaaacgttgaca

SEQ ID NO: 53973 - DNA, 21 bp, Artificial sequence
  SiRNA target sequence
cgattagtaaaacgttgacaa

SEQ ID NO: 53974 - DNA, 21 bp, Artificial sequence
  SiRNA target sequence
gattagtaaaacgttgacaaa

SEQ ID NO: 53975 - DNA, 21 bp, Artificial sequence
  SiRNA target sequence
attagtaaaacgttgacaaat

SEQ ID NO: 53976 - DNA, 21 bp, Artificial sequence
  SiRNA target sequence
ttagtaaaacgttgacaaatt

SEQ ID NO: 53977 - DNA, 21 bp, Artificial sequence
  SiRNA target sequence
tagtaaaacgttgacaaattc

SEQ ID NO: 53978 - DNA, 21 bp, Artificial sequence
  SiRNA target sequence
agtaaaacgttgacaaattcg

SEQ ID NO: 53979 - DNA, 21 bp, Artificial sequence
  SiRNA target sequence
gtaaaacgttgacaaattcgt

SEQ ID NO: 53980 - DNA, 21 bp, Artificial sequence
  SiRNA target sequence
taaaacgttgacaaattcgtt

SEQ ID NO: 53981 - DNA, 21 bp, Artificial sequence
  SiRNA target sequence
aaaacgttgacaaattcgttg

SEQ ID NO: 53982 - DNA, 21 bp, Artificial sequence
  SiRNA target sequence
aaacgttgacaaattcgttga

SEQ ID NO: 53983 - DNA, 21 bp, Artificial sequence
  SiRNA target sequence
aacgttgacaaattcgttgag

SEQ ID NO: 53984 - DNA, 21 bp, Artificial sequence
  SiRNA target sequence
acgttgacaaattcgttgagc

SEQ ID NO: 53985 - DNA, 21 bp, Artificial sequence
  SiRNA target sequence
cgttgacaaattcgttgagcg

SEQ ID NO: 53986 - DNA, 21 bp, Artificial sequence
  SiRNA target sequence
gttgacaaattcgttgagcga

SEQ ID NO: 53987 - DNA, 21 bp, Artificial sequence
  SiRNA target sequence
ttgacaaattcgttgagcgaa

SEQ ID NO: 53988 - DNA, 21 bp, Artificial sequence
  SiRNA target sequence
tgacaaattcgttgagcgaaa

SEQ ID NO: 53989 - DNA, 21 bp, Artificial sequence
  SiRNA target sequence
gacaaattcgttgagcgaaat

SEQ ID NO: 53990 - DNA, 21 bp, Artificial sequence
  SiRNA target sequence
acaaattcgttgagcgaaatg

SEQ ID NO: 53991 - DNA, 21 bp, Artificial sequence
  SiRNA target sequence
caaattcgttgagcgaaatgg

SEQ ID NO: 53992 - DNA, 21 bp, Artificial sequence
  SiRNA target sequence
aaattcgttgagcgaaatggg

SEQ ID NO: 53993 - DNA, 21 bp, Artificial sequence
  SiRNA target sequence
aattcgttgagcgaaatggga

SEQ ID NO: 53994 - DNA, 21 bp, Artificial sequence
  SiRNA target sequence
attcgttgagcgaaatgggaa

SEQ ID NO: 53995 - DNA, 21 bp, Artificial sequence
  SiRNA target sequence
ttcgttgagcgaaatgggaat

SEQ ID NO: 53996 - DNA, 21 bp, Artificial sequence
  SiRNA target sequence
tcgttgagcgaaatgggaatg

SEQ ID NO: 53997 - DNA, 21 bp, Artificial sequence
  SiRNA target sequence
cgttgagcgaaatgggaatgc

SEQ ID NO: 53998 - DNA, 21 bp, Artificial sequence
  SiRNA target sequence
gttgagcgaaatgggaatgct

SEQ ID NO: 53999 - DNA, 21 bp, Artificial sequence
  SiRNA target sequence
ttgagcgaaatgggaatgcta

SEQ ID NO: 54000 - DNA, 21 bp, Artificial sequence
  SiRNA target sequence
tgagcgaaatgggaatgctat

SEQ ID NO: 54001 - DNA, 21 bp, Artificial sequence
  SiRNA target sequence
gagcgaaatgggaatgctata

SEQ ID NO: 54002 - DNA, 21 bp, Artificial sequence
  SiRNA target sequence
agcgaaatgggaatgctatac

SEQ ID NO: 54003 - DNA, 21 bp, Artificial sequence
  SiRNA target sequence
gcgaaatgggaatgctataca

SEQ ID NO: 54004 - DNA, 21 bp, Artificial sequence
  SiRNA target sequence
cgaaatgggaatgctatacac

SEQ ID NO: 54005 - DNA, 21 bp, Artificial sequence
  SiRNA target sequence
gaaatgggaatgctatacaca

SEQ ID NO: 54006 - DNA, 21 bp, Artificial sequence
  SiRNA target sequence
aaatgggaatgctatacacaa

SEQ ID NO: 54007 - DNA, 21 bp, Artificial sequence
  SiRNA target sequence
aatgggaatgctatacacaag

SEQ ID NO: 54008 - DNA, 21 bp, Artificial sequence
  SiRNA target sequence
atgggaatgctatacacaaga

SEQ ID NO: 54009 - DNA, 21 bp, Artificial sequence
  SiRNA target sequence
tgggaatgctatacacaagat

SEQ ID NO: 54010 - DNA, 21 bp, Artificial sequence
  SiRNA target sequence
gggaatgctatacacaagata

SEQ ID NO: 54011 - DNA, 21 bp, Artificial sequence
  SiRNA target sequence
ggaatgctatacacaagatat

SEQ ID NO: 54012 - DNA, 21 bp, Artificial sequence
  SiRNA target sequence
gaatgctatacacaagatatg

SEQ ID NO: 54013 - DNA, 21 bp, Artificial sequence
  SiRNA target sequence
aatgctatacacaagatatgt

SEQ ID NO: 54014 - DNA, 21 bp, Artificial sequence
  SiRNA target sequence
atgctatacacaagatatgta

SEQ ID NO: 54015 - DNA, 21 bp, Artificial sequence
  SiRNA target sequence
tgctatacacaagatatgtac

SEQ ID NO: 54016 - DNA, 21 bp, Artificial sequence
  SiRNA target sequence
gctatacacaagatatgtaca

SEQ ID NO: 54017 - DNA, 21 bp, Artificial sequence
  SiRNA target sequence
ctatacacaagatatgtacaa

SEQ ID NO: 54018 - DNA, 21 bp, Artificial sequence
  SiRNA target sequence
tatacacaagatatgtacaag

SEQ ID NO: 54019 - DNA, 21 bp, Artificial sequence
  SiRNA target sequence
atacacaagatatgtacaagg

SEQ ID NO: 54020 - DNA, 21 bp, Artificial sequence
  SiRNA target sequence
tacacaagatatgtacaagga

SEQ ID NO: 54021 - DNA, 21 bp, Artificial sequence
  SiRNA target sequence
acacaagatatgtacaaggat

SEQ ID NO: 54022 - DNA, 21 bp, Artificial sequence
  SiRNA target sequence
cacaagatatgtacaaggatt

SEQ ID NO: 54023 - DNA, 21 bp, Artificial sequence
  SiRNA target sequence
acaagatatgtacaaggattt

SEQ ID NO: 54024 - DNA, 21 bp, Artificial sequence
  SiRNA target sequence
caagatatgtacaaggatttt

SEQ ID NO: 54025 - DNA, 21 bp, Artificial sequence
  SiRNA target sequence
aagatatgtacaaggattttt

SEQ ID NO: 54026 - DNA, 21 bp, Artificial sequence
  SiRNA target sequence
agatatgtacaaggattttta

SEQ ID NO: 54027 - DNA, 21 bp, Artificial sequence
  SiRNA target sequence
gatatgtacaaggatttttaa

SEQ ID NO: 54028 - DNA, 21 bp, Artificial sequence
  SiRNA target sequence
atatgtacaaggatttttaaa

SEQ ID NO: 54029 - DNA, 21 bp, Artificial sequence
  SiRNA target sequence
tatgtacaaggatttttaaat

SEQ ID NO: 54030 - DNA, 21 bp, Artificial sequence
  SiRNA target sequence
atgtacaaggatttttaaatg

SEQ ID NO: 54031 - DNA, 21 bp, Artificial sequence
  SiRNA target sequence
tgtacaaggatttttaaatgc

SEQ ID NO: 54032 - DNA, 21 bp, Artificial sequence
  SiRNA target sequence
gtacaaggatttttaaatgca

SEQ ID NO: 54033 - DNA, 21 bp, Artificial sequence
  SiRNA target sequence
tacaaggatttttaaatgcaa

SEQ ID NO: 54034 - DNA, 21 bp, Artificial sequence
  SiRNA target sequence
acaaggatttttaaatgcaaa

SEQ ID NO: 54035 - DNA, 21 bp, Artificial sequence
  SiRNA target sequence
caaggatttttaaatgcaaag

SEQ ID NO: 54036 - DNA, 21 bp, Artificial sequence
  SiRNA target sequence
aaggatttttaaatgcaaagt

SEQ ID NO: 54037 - DNA, 21 bp, Artificial sequence
  SiRNA target sequence
aggatttttaaatgcaaagtc

SEQ ID NO: 54038 - DNA, 21 bp, Artificial sequence
  SiRNA target sequence
ggatttttaaatgcaaagtct

SEQ ID NO: 54039 - DNA, 21 bp, Artificial sequence
  SiRNA target sequence
gatttttaaatgcaaagtctg

SEQ ID NO: 54040 - DNA, 21 bp, Artificial sequence
  SiRNA target sequence
atttttaaatgcaaagtctgg

SEQ ID NO: 54041 - DNA, 21 bp, Artificial sequence
  SiRNA target sequence
tttttaaatgcaaagtctgga

SEQ ID NO: 54042 - DNA, 21 bp, Artificial sequence
  SiRNA target sequence
ttttaaatgcaaagtctggat

SEQ ID NO: 54043 - DNA, 21 bp, Artificial sequence
  SiRNA target sequence
tttaaatgcaaagtctggata

SEQ ID NO: 54044 - DNA, 21 bp, Artificial sequence
  SiRNA target sequence
ttaaatgcaaagtctggatat

SEQ ID NO: 54045 - DNA, 21 bp, Artificial sequence
  SiRNA target sequence
taaatgcaaagtctggatatt

SEQ ID NO: 54046 - DNA, 21 bp, Artificial sequence
  SiRNA target sequence
aaatgcaaagtctggatatta

SEQ ID NO: 54047 - DNA, 21 bp, Artificial sequence
  SiRNA target sequence
aatgcaaagtctggatattac

SEQ ID NO: 54048 - DNA, 21 bp, Artificial sequence
  SiRNA target sequence
atgcaaagtctggatattacg

SEQ ID NO: 54049 - DNA, 21 bp, Artificial sequence
  SiRNA target sequence
tgcaaagtctggatattacga

SEQ ID NO: 54050 - DNA, 21 bp, Artificial sequence
  SiRNA target sequence
gcaaagtctggatattacgag

SEQ ID NO: 54051 - DNA, 21 bp, Artificial sequence
  SiRNA target sequence
caaagtctggatattacgagt

SEQ ID NO: 54052 - DNA, 21 bp, Artificial sequence
  SiRNA target sequence
aaagtctggatattacgagtt

SEQ ID NO: 54053 - DNA, 21 bp, Artificial sequence
  SiRNA target sequence
aagtctggatattacgagttt

SEQ ID NO: 54054 - DNA, 21 bp, Artificial sequence
  SiRNA target sequence
agtctggatattacgagttta

SEQ ID NO: 54055 - DNA, 21 bp, Artificial sequence
  SiRNA target sequence
gtctggatattacgagtttaa

SEQ ID NO: 54056 - DNA, 21 bp, Artificial sequence
  SiRNA target sequence
tctggatattacgagtttaaa

SEQ ID NO: 54057 - DNA, 21 bp, Artificial sequence
  SiRNA target sequence
ctggatattacgagtttaaag

SEQ ID NO: 54058 - DNA, 21 bp, Artificial sequence
  SiRNA target sequence
tggatattacgagtttaaaga

SEQ ID NO: 54059 - DNA, 21 bp, Artificial sequence
  SiRNA target sequence
ggatattacgagtttaaagag

SEQ ID NO: 54060 - DNA, 21 bp, Artificial sequence
  SiRNA target sequence
gatattacgagtttaaagagg

SEQ ID NO: 54061 - DNA, 21 bp, Artificial sequence
  SiRNA target sequence
atattacgagtttaaagagga

SEQ ID NO: 54062 - DNA, 21 bp, Artificial sequence
  SiRNA target sequence
tattacgagtttaaagaggat

SEQ ID NO: 54063 - DNA, 21 bp, Artificial sequence
  SiRNA target sequence
attacgagtttaaagaggata

SEQ ID NO: 54064 - DNA, 21 bp, Artificial sequence
  SiRNA target sequence
ttacgagtttaaagaggatac

SEQ ID NO: 54065 - DNA, 21 bp, Artificial sequence
  SiRNA target sequence
tacgagtttaaagaggataca

SEQ ID NO: 54066 - DNA, 21 bp, Artificial sequence
  SiRNA target sequence
acgagtttaaagaggatacac

SEQ ID NO: 54067 - DNA, 21 bp, Artificial sequence
  SiRNA target sequence
cgagtttaaagaggatacaca

SEQ ID NO: 54068 - DNA, 21 bp, Artificial sequence
  SiRNA target sequence
gagtttaaagaggatacacaa

SEQ ID NO: 54069 - DNA, 21 bp, Artificial sequence
  SiRNA target sequence
agtttaaagaggatacacaaa

SEQ ID NO: 54070 - DNA, 21 bp, Artificial sequence
  SiRNA target sequence
gtttaaagaggatacacaaac

SEQ ID NO: 54071 - DNA, 21 bp, Artificial sequence
  SiRNA target sequence
tttaaagaggatacacaaact

SEQ ID NO: 54072 - DNA, 21 bp, Artificial sequence
  SiRNA target sequence
ttaaagaggatacacaaactg

SEQ ID NO: 54073 - DNA, 21 bp, Artificial sequence
  SiRNA target sequence
taaagaggatacacaaactga

SEQ ID NO: 54074 - DNA, 21 bp, Artificial sequence
  SiRNA target sequence
aaagaggatacacaaactgat

SEQ ID NO: 54075 - DNA, 21 bp, Artificial sequence
  SiRNA target sequence
aagaggatacacaaactgata

SEQ ID NO: 54076 - DNA, 21 bp, Artificial sequence
  SiRNA target sequence
agaggatacacaaactgataa

SEQ ID NO: 54077 - DNA, 21 bp, Artificial sequence
  SiRNA target sequence
gaggatacacaaactgataaa

SEQ ID NO: 54078 - DNA, 21 bp, Artificial sequence
  SiRNA target sequence
aggatacacaaactgataaaa

SEQ ID NO: 54079 - DNA, 21 bp, Artificial sequence
  SiRNA target sequence
ggatacacaaactgataaaat

SEQ ID NO: 54080 - DNA, 21 bp, Artificial sequence
  SiRNA target sequence
gatacacaaactgataaaata

SEQ ID NO: 54081 - DNA, 21 bp, Artificial sequence
  SiRNA target sequence
atacacaaactgataaaataa

SEQ ID NO: 54082 - DNA, 21 bp, Artificial sequence
  SiRNA target sequence
tacacaaactgataaaataag

SEQ ID NO: 54083 - DNA, 21 bp, Artificial sequence
  SiRNA target sequence
acacaaactgataaaataaga

SEQ ID NO: 54084 - DNA, 21 bp, Artificial sequence
  SiRNA target sequence
cacaaactgataaaataagac

SEQ ID NO: 54085 - DNA, 21 bp, Artificial sequence
  SiRNA target sequence
acaaactgataaaataagact

SEQ ID NO: 54086 - DNA, 21 bp, Artificial sequence
  SiRNA target sequence
caaactgataaaataagactg

SEQ ID NO: 54087 - DNA, 21 bp, Artificial sequence
  SiRNA target sequence
aaactgataaaataagactga

SEQ ID NO: 54088 - DNA, 21 bp, Artificial sequence
  SiRNA target sequence
aactgataaaataagactgat

SEQ ID NO: 54089 - DNA, 21 bp, Artificial sequence
  SiRNA target sequence
actgataaaataagactgata

SEQ ID NO: 54090 - DNA, 21 bp, Artificial sequence
  SiRNA target sequence
ctgataaaataagactgatag

SEQ ID NO: 54091 - DNA, 21 bp, Artificial sequence
  SiRNA target sequence
tgataaaataagactgataga

SEQ ID NO: 54092 - DNA, 21 bp, Artificial sequence
  SiRNA target sequence
gataaaataagactgatagat

SEQ ID NO: 54093 - DNA, 21 bp, Artificial sequence
  SiRNA target sequence
ataaaataagactgatagatt

SEQ ID NO: 54094 - DNA, 21 bp, Artificial sequence
  SiRNA target sequence
taaaataagactgatagattt

SEQ ID NO: 54095 - DNA, 21 bp, Artificial sequence
  SiRNA target sequence
aaaataagactgatagatttt

SEQ ID NO: 54096 - DNA, 21 bp, Artificial sequence
  SiRNA target sequence
aaataagactgatagatttta

SEQ ID NO: 54097 - DNA, 21 bp, Artificial sequence
  SiRNA target sequence
aataagactgatagattttaa

SEQ ID NO: 54098 - DNA, 21 bp, Artificial sequence
  SiRNA target sequence
ataagactgatagattttaat

SEQ ID NO: 54099 - DNA, 21 bp, Artificial sequence
  SiRNA target sequence
taagactgatagattttaatg

SEQ ID NO: 54100 - DNA, 21 bp, Artificial sequence
  SiRNA target sequence
aagactgatagattttaatga

SEQ ID NO: 54101 - DNA, 21 bp, Artificial sequence
  SiRNA target sequence
agactgatagattttaatgaa

SEQ ID NO: 54102 - DNA, 21 bp, Artificial sequence
  SiRNA target sequence
gactgatagattttaatgaaa

SEQ ID NO: 54103 - DNA, 21 bp, Artificial sequence
  SiRNA target sequence
actgatagattttaatgaaaa

SEQ ID NO: 54104 - DNA, 21 bp, Artificial sequence
  SiRNA target sequence
ctgatagattttaatgaaaag

SEQ ID NO: 54105 - DNA, 21 bp, Artificial sequence
  SiRNA target sequence
tgatagattttaatgaaaagc

SEQ ID NO: 54106 - DNA, 21 bp, Artificial sequence
  SiRNA target sequence
gatagattttaatgaaaagct

SEQ ID NO: 54107 - DNA, 21 bp, Artificial sequence
  SiRNA target sequence
atagattttaatgaaaagcta

SEQ ID NO: 54108 - DNA, 21 bp, Artificial sequence
  SiRNA target sequence
tagattttaatgaaaagctag

SEQ ID NO: 54109 - DNA, 21 bp, Artificial sequence
  SiRNA target sequence
agattttaatgaaaagctaga

SEQ ID NO: 54110 - DNA, 21 bp, Artificial sequence
  SiRNA target sequence
gattttaatgaaaagctagaa

SEQ ID NO: 54111 - DNA, 21 bp, Artificial sequence
  SiRNA target sequence
attttaatgaaaagctagaat

SEQ ID NO: 54112 - DNA, 21 bp, Artificial sequence
  SiRNA target sequence
ttttaatgaaaagctagaatt

SEQ ID NO: 54113 - DNA, 21 bp, Artificial sequence
  SiRNA target sequence
tttaatgaaaagctagaattt

SEQ ID NO: 54114 - DNA, 21 bp, Artificial sequence
  SiRNA target sequence
ttaatgaaaagctagaattta

SEQ ID NO: 54115 - DNA, 21 bp, Artificial sequence
  SiRNA target sequence
taatgaaaagctagaatttag

SEQ ID NO: 54116 - DNA, 21 bp, Artificial sequence
  SiRNA target sequence
aatgaaaagctagaatttaga

SEQ ID NO: 54117 - DNA, 21 bp, Artificial sequence
  SiRNA target sequence
atgaaaagctagaatttagaa

SEQ ID NO: 54118 - DNA, 21 bp, Artificial sequence
  SiRNA target sequence
tgaaaagctagaatttagaaa

SEQ ID NO: 54119 - DNA, 21 bp, Artificial sequence
  SiRNA target sequence
gaaaagctagaatttagaaat

SEQ ID NO: 54120 - DNA, 21 bp, Artificial sequence
  SiRNA target sequence
aaaagctagaatttagaaatg

SEQ ID NO: 54121 - DNA, 21 bp, Artificial sequence
  SiRNA target sequence
aaagctagaatttagaaatgt

SEQ ID NO: 54122 - DNA, 21 bp, Artificial sequence
  SiRNA target sequence
aagctagaatttagaaatgta

SEQ ID NO: 54123 - DNA, 21 bp, Artificial sequence
  SiRNA target sequence
agctagaatttagaaatgtat

SEQ ID NO: 54124 - DNA, 21 bp, Artificial sequence
  SiRNA target sequence
gctagaatttagaaatgtatc

SEQ ID NO: 54125 - DNA, 21 bp, Artificial sequence
  SiRNA target sequence
ctagaatttagaaatgtatct

SEQ ID NO: 54126 - DNA, 21 bp, Artificial sequence
  SiRNA target sequence
tagaatttagaaatgtatctt

SEQ ID NO: 54127 - DNA, 21 bp, Artificial sequence
  SiRNA target sequence
agaatttagaaatgtatcttt

SEQ ID NO: 54128 - DNA, 21 bp, Artificial sequence
  SiRNA target sequence
gaatttagaaatgtatctttt

SEQ ID NO: 54129 - DNA, 21 bp, Artificial sequence
  SiRNA target sequence
aatttagaaatgtatctttta

SEQ ID NO: 54130 - DNA, 21 bp, Artificial sequence
  SiRNA target sequence
atttagaaatgtatcttttag

SEQ ID NO: 54131 - DNA, 21 bp, Artificial sequence
  SiRNA target sequence
tttagaaatgtatcttttagt

SEQ ID NO: 54132 - DNA, 21 bp, Artificial sequence
  SiRNA target sequence
ttagaaatgtatcttttagtt

SEQ ID NO: 54133 - DNA, 21 bp, Artificial sequence
  SiRNA target sequence
tagaaatgtatcttttagtta

SEQ ID NO: 54134 - DNA, 21 bp, Artificial sequence
  SiRNA target sequence
agaaatgtatcttttagttat

SEQ ID NO: 54135 - DNA, 21 bp, Artificial sequence
  SiRNA target sequence
gaaatgtatcttttagttatt

SEQ ID NO: 54136 - DNA, 21 bp, Artificial sequence
  SiRNA target sequence
aaatgtatcttttagttattt

SEQ ID NO: 54137 - DNA, 21 bp, Artificial sequence
  SiRNA target sequence
aatgtatcttttagttattta

SEQ ID NO: 54138 - DNA, 21 bp, Artificial sequence
  SiRNA target sequence
atgtatcttttagttatttaa

SEQ ID NO: 54139 - DNA, 21 bp, Artificial sequence
  SiRNA target sequence
tgtatcttttagttatttaaa

SEQ ID NO: 54140 - DNA, 21 bp, Artificial sequence
  SiRNA target sequence
gtatcttttagttatttaaat

SEQ ID NO: 54141 - DNA, 21 bp, Artificial sequence
  SiRNA target sequence
tatcttttagttatttaaata

SEQ ID NO: 54142 - DNA, 21 bp, Artificial sequence
  SiRNA target sequence
atcttttagttatttaaataa

SEQ ID NO: 54143 - DNA, 21 bp, Artificial sequence
  SiRNA target sequence
tcttttagttatttaaataag

SEQ ID NO: 54144 - DNA, 21 bp, Artificial sequence
  SiRNA target sequence
cttttagttatttaaataagc

SEQ ID NO: 54145 - DNA, 21 bp, Artificial sequence
  SiRNA target sequence
ttttagttatttaaataagcc

SEQ ID NO: 54146 - DNA, 21 bp, Artificial sequence
  SiRNA target sequence
tttagttatttaaataagcct

SEQ ID NO: 54147 - DNA, 21 bp, Artificial sequence
  SiRNA target sequence
ttagttatttaaataagccta

SEQ ID NO: 54148 - DNA, 21 bp, Artificial sequence
  SiRNA target sequence
tagttatttaaataagcctat

SEQ ID NO: 54149 - DNA, 21 bp, Artificial sequence
  SiRNA target sequence
agttatttaaataagcctatt

SEQ ID NO: 54150 - DNA, 21 bp, Artificial sequence
  SiRNA target sequence
gttatttaaataagcctattt

SEQ ID NO: 54151 - DNA, 21 bp, Artificial sequence
  SiRNA target sequence
ttatttaaataagcctatttt

SEQ ID NO: 54152 - DNA, 21 bp, Artificial sequence
  SiRNA target sequence
tatttaaataagcctatttta

SEQ ID NO: 54153 - DNA, 21 bp, Artificial sequence
  SiRNA target sequence
atttaaataagcctattttag

SEQ ID NO: 54154 - DNA, 21 bp, Artificial sequence
  SiRNA target sequence
tttaaataagcctattttagt

SEQ ID NO: 54155 - DNA, 21 bp, Artificial sequence
  SiRNA target sequence
ttaaataagcctattttagtg

SEQ ID NO: 54156 - DNA, 21 bp, Artificial sequence
  SiRNA target sequence
taaataagcctattttagtga

SEQ ID NO: 54157 - DNA, 21 bp, Artificial sequence
  SiRNA target sequence
aaataagcctattttagtgaa

SEQ ID NO: 54158 - DNA, 21 bp, Artificial sequence
  SiRNA target sequence
aataagcctattttagtgaat

SEQ ID NO: 54159 - DNA, 21 bp, Artificial sequence
  SiRNA target sequence
ataagcctattttagtgaatg

SEQ ID NO: 54160 - DNA, 21 bp, Artificial sequence
  SiRNA target sequence
taagcctattttagtgaatgc

SEQ ID NO: 54161 - DNA, 21 bp, Artificial sequence
  SiRNA target sequence
aagcctattttagtgaatgct

SEQ ID NO: 54162 - DNA, 21 bp, Artificial sequence
  SiRNA target sequence
agcctattttagtgaatgcta

SEQ ID NO: 54163 - DNA, 21 bp, Artificial sequence
  SiRNA target sequence
gcctattttagtgaatgctaa

SEQ ID NO: 54164 - DNA, 21 bp, Artificial sequence
  SiRNA target sequence
cctattttagtgaatgctaat

SEQ ID NO: 54165 - DNA, 21 bp, Artificial sequence
  SiRNA target sequence
ctattttagtgaatgctaatt

SEQ ID NO: 54166 - DNA, 21 bp, Artificial sequence
  SiRNA target sequence
tattttagtgaatgctaattt

SEQ ID NO: 54167 - DNA, 21 bp, Artificial sequence
  SiRNA target sequence
attttagtgaatgctaatttc

SEQ ID NO: 54168 - DNA, 21 bp, Artificial sequence
  SiRNA target sequence
ttttagtgaatgctaatttcg

SEQ ID NO: 54169 - DNA, 21 bp, Artificial sequence
  SiRNA target sequence
tttagtgaatgctaatttcgt

SEQ ID NO: 54170 - DNA, 21 bp, Artificial sequence
  SiRNA target sequence
ttagtgaatgctaatttcgtt

SEQ ID NO: 54171 - DNA, 21 bp, Artificial sequence
  SiRNA target sequence
tagtgaatgctaatttcgtta

SEQ ID NO: 54172 - DNA, 21 bp, Artificial sequence
  SiRNA target sequence
agtgaatgctaatttcgttat

SEQ ID NO: 54173 - DNA, 21 bp, Artificial sequence
  SiRNA target sequence
gtgaatgctaatttcgttatt

SEQ ID NO: 54174 - DNA, 21 bp, Artificial sequence
  SiRNA target sequence
tgaatgctaatttcgttatta

SEQ ID NO: 54175 - DNA, 21 bp, Artificial sequence
  SiRNA target sequence
gaatgctaatttcgttattaa

SEQ ID NO: 54176 - DNA, 21 bp, Artificial sequence
  SiRNA target sequence
aatgctaatttcgttattaat

SEQ ID NO: 54177 - DNA, 21 bp, Artificial sequence
  SiRNA target sequence
atgctaatttcgttattaata

SEQ ID NO: 54178 - DNA, 21 bp, Artificial sequence
  SiRNA target sequence
tgctaatttcgttattaataa

SEQ ID NO: 54179 - DNA, 21 bp, Artificial sequence
  SiRNA target sequence
gctaatttcgttattaataaa

SEQ ID NO: 54180 - DNA, 21 bp, Artificial sequence
  SiRNA target sequence
ctaatttcgttattaataaag

SEQ ID NO: 54181 - DNA, 21 bp, Artificial sequence
  SiRNA target sequence
taatttcgttattaataaagg

SEQ ID NO: 54182 - DNA, 21 bp, Artificial sequence
  SiRNA target sequence
aatttcgttattaataaaggg

SEQ ID NO: 54183 - DNA, 21 bp, Artificial sequence
  SiRNA target sequence
atttcgttattaataaagggg

SEQ ID NO: 54184 - DNA, 21 bp, Artificial sequence
  SiRNA target sequence
tttcgttattaataaagggga

SEQ ID NO: 54185 - DNA, 21 bp, Artificial sequence
  SiRNA target sequence
ttcgttattaataaaggggag

SEQ ID NO: 54186 - DNA, 21 bp, Artificial sequence
  SiRNA target sequence
tcgttattaataaaggggagc

SEQ ID NO: 54187 - DNA, 21 bp, Artificial sequence
  SiRNA target sequence
cgttattaataaaggggagcg

SEQ ID NO: 54188 - DNA, 21 bp, Artificial sequence
  SiRNA target sequence
gttattaataaaggggagcgt

SEQ ID NO: 54189 - DNA, 21 bp, Artificial sequence
  SiRNA target sequence
ttattaataaaggggagcgtg

SEQ ID NO: 54190 - DNA, 21 bp, Artificial sequence
  SiRNA target sequence
tattaataaaggggagcgtgt

SEQ ID NO: 54191 - DNA, 21 bp, Artificial sequence
  SiRNA target sequence
attaataaaggggagcgtgtt

SEQ ID NO: 54192 - DNA, 21 bp, Artificial sequence
  SiRNA target sequence
ttaataaaggggagcgtgttg

SEQ ID NO: 54193 - DNA, 21 bp, Artificial sequence
  SiRNA target sequence
taataaaggggagcgtgttgc

SEQ ID NO: 54194 - DNA, 21 bp, Artificial sequence
  SiRNA target sequence
aataaaggggagcgtgttgct

SEQ ID NO: 54195 - DNA, 21 bp, Artificial sequence
  SiRNA target sequence
ataaaggggagcgtgttgcta

SEQ ID NO: 54196 - DNA, 21 bp, Artificial sequence
  SiRNA target sequence
taaaggggagcgtgttgctat

SEQ ID NO: 54197 - DNA, 21 bp, Artificial sequence
  SiRNA target sequence
aaaggggagcgtgttgctatt

SEQ ID NO: 54198 - DNA, 21 bp, Artificial sequence
  SiRNA target sequence
aaggggagcgtgttgctatta

SEQ ID NO: 54199 - DNA, 21 bp, Artificial sequence
  SiRNA target sequence
aggggagcgtgttgctattat

SEQ ID NO: 54200 - DNA, 21 bp, Artificial sequence
  SiRNA target sequence
ggggagcgtgttgctattata

SEQ ID NO: 54201 - DNA, 21 bp, Artificial sequence
  SiRNA target sequence
gggagcgtgttgctattatag

SEQ ID NO: 54202 - DNA, 21 bp, Artificial sequence
  SiRNA target sequence
ggagcgtgttgctattatagg

SEQ ID NO: 54203 - DNA, 21 bp, Artificial sequence
  SiRNA target sequence
gagcgtgttgctattatagga

SEQ ID NO: 54204 - DNA, 21 bp, Artificial sequence
  SiRNA target sequence
agcgtgttgctattataggaa

SEQ ID NO: 54205 - DNA, 21 bp, Artificial sequence
  SiRNA target sequence
gcgtgttgctattataggaaa

SEQ ID NO: 54206 - DNA, 21 bp, Artificial sequence
  SiRNA target sequence
cgtgttgctattataggaaaa

SEQ ID NO: 54207 - DNA, 21 bp, Artificial sequence
  SiRNA target sequence
gtgttgctattataggaaaaa

SEQ ID NO: 54208 - DNA, 21 bp, Artificial sequence
  SiRNA target sequence
tgttgctattataggaaaaaa

SEQ ID NO: 54209 - DNA, 21 bp, Artificial sequence
  SiRNA target sequence
gttgctattataggaaaaaat

SEQ ID NO: 54210 - DNA, 21 bp, Artificial sequence
  SiRNA target sequence
ttgctattataggaaaaaatg

SEQ ID NO: 54211 - DNA, 21 bp, Artificial sequence
  SiRNA target sequence
tgctattataggaaaaaatgg

SEQ ID NO: 54212 - DNA, 21 bp, Artificial sequence
  SiRNA target sequence
gctattataggaaaaaatgga

SEQ ID NO: 54213 - DNA, 21 bp, Artificial sequence
  SiRNA target sequence
ctattataggaaaaaatggaa

SEQ ID NO: 54214 - DNA, 21 bp, Artificial sequence
  SiRNA target sequence
tattataggaaaaaatggaac

SEQ ID NO: 54215 - DNA, 21 bp, Artificial sequence
  SiRNA target sequence
attataggaaaaaatggaaca

SEQ ID NO: 54216 - DNA, 21 bp, Artificial sequence
  SiRNA target sequence
ttataggaaaaaatggaacag

SEQ ID NO: 54217 - DNA, 21 bp, Artificial sequence
  SiRNA target sequence
tataggaaaaaatggaacagg

SEQ ID NO: 54218 - DNA, 21 bp, Artificial sequence
  SiRNA target sequence
ataggaaaaaatggaacaggt

SEQ ID NO: 54219 - DNA, 21 bp, Artificial sequence
  SiRNA target sequence
taggaaaaaatggaacaggta

SEQ ID NO: 54220 - DNA, 21 bp, Artificial sequence
  SiRNA target sequence
aggaaaaaatggaacaggtaa

SEQ ID NO: 54221 - DNA, 21 bp, Artificial sequence
  SiRNA target sequence
ggaaaaaatggaacaggtaaa

SEQ ID NO: 54222 - DNA, 21 bp, Artificial sequence
  SiRNA target sequence
gaaaaaatggaacaggtaaaa

SEQ ID NO: 54223 - DNA, 21 bp, Artificial sequence
  SiRNA target sequence
aaaaaatggaacaggtaaaag

SEQ ID NO: 54224 - DNA, 21 bp, Artificial sequence
  SiRNA target sequence
aaaaatggaacaggtaaaagt

SEQ ID NO: 54225 - DNA, 21 bp, Artificial sequence
  SiRNA target sequence
aaaatggaacaggtaaaagta

SEQ ID NO: 54226 - DNA, 21 bp, Artificial sequence
  SiRNA target sequence
aaatggaacaggtaaaagtac

SEQ ID NO: 54227 - DNA, 21 bp, Artificial sequence
  SiRNA target sequence
aatggaacaggtaaaagtaca

SEQ ID NO: 54228 - DNA, 21 bp, Artificial sequence
  SiRNA target sequence
atggaacaggtaaaagtacaa

SEQ ID NO: 54229 - DNA, 21 bp, Artificial sequence
  SiRNA target sequence
tggaacaggtaaaagtacaat

SEQ ID NO: 54230 - DNA, 21 bp, Artificial sequence
  SiRNA target sequence
ggaacaggtaaaagtacaata

SEQ ID NO: 54231 - DNA, 21 bp, Artificial sequence
  SiRNA target sequence
gaacaggtaaaagtacaataa

SEQ ID NO: 54232 - DNA, 21 bp, Artificial sequence
  SiRNA target sequence
aacaggtaaaagtacaataat

SEQ ID NO: 54233 - DNA, 21 bp, Artificial sequence
  SiRNA target sequence
acaggtaaaagtacaataata

SEQ ID NO: 54234 - DNA, 21 bp, Artificial sequence
  SiRNA target sequence
caggtaaaagtacaataataa

SEQ ID NO: 54235 - DNA, 21 bp, Artificial sequence
  SiRNA target sequence
aggtaaaagtacaataataaa

SEQ ID NO: 54236 - DNA, 21 bp, Artificial sequence
  SiRNA target sequence
ggtaaaagtacaataataaaa

SEQ ID NO: 54237 - DNA, 21 bp, Artificial sequence
  SiRNA target sequence
gtaaaagtacaataataaaat

SEQ ID NO: 54238 - DNA, 21 bp, Artificial sequence
  SiRNA target sequence
taaaagtacaataataaaatt

SEQ ID NO: 54239 - DNA, 21 bp, Artificial sequence
  SiRNA target sequence
aaaagtacaataataaaattg

SEQ ID NO: 54240 - DNA, 21 bp, Artificial sequence
  SiRNA target sequence
aaagtacaataataaaattgt

SEQ ID NO: 54241 - DNA, 21 bp, Artificial sequence
  SiRNA target sequence
aagtacaataataaaattgtt

SEQ ID NO: 54242 - DNA, 21 bp, Artificial sequence
  SiRNA target sequence
agtacaataataaaattgtta

SEQ ID NO: 54243 - DNA, 21 bp, Artificial sequence
  SiRNA target sequence
gtacaataataaaattgttaa

SEQ ID NO: 54244 - DNA, 21 bp, Artificial sequence
  SiRNA target sequence
tacaataataaaattgttaat

SEQ ID NO: 54245 - DNA, 21 bp, Artificial sequence
  SiRNA target sequence
acaataataaaattgttaatg

SEQ ID NO: 54246 - DNA, 21 bp, Artificial sequence
  SiRNA target sequence
caataataaaattgttaatga

SEQ ID NO: 54247 - DNA, 21 bp, Artificial sequence
  SiRNA target sequence
aataataaaattgttaatgaa

SEQ ID NO: 54248 - DNA, 21 bp, Artificial sequence
  SiRNA target sequence
ataataaaattgttaatgaaa

SEQ ID NO: 54249 - DNA, 21 bp, Artificial sequence
  SiRNA target sequence
taataaaattgttaatgaaat

SEQ ID NO: 54250 - DNA, 21 bp, Artificial sequence
  SiRNA target sequence
aataaaattgttaatgaaatt

SEQ ID NO: 54251 - DNA, 21 bp, Artificial sequence
  SiRNA target sequence
ataaaattgttaatgaaattt

SEQ ID NO: 54252 - DNA, 21 bp, Artificial sequence
  SiRNA target sequence
taaaattgttaatgaaatttt

SEQ ID NO: 54253 - DNA, 21 bp, Artificial sequence
  SiRNA target sequence
aaaattgttaatgaaatttta

SEQ ID NO: 54254 - DNA, 21 bp, Artificial sequence
  SiRNA target sequence
aaattgttaatgaaattttat

SEQ ID NO: 54255 - DNA, 21 bp, Artificial sequence
  SiRNA target sequence
aattgttaatgaaattttata

SEQ ID NO: 54256 - DNA, 21 bp, Artificial sequence
  SiRNA target sequence
attgttaatgaaattttataa

SEQ ID NO: 54257 - DNA, 21 bp, Artificial sequence
  SiRNA target sequence
ttgttaatgaaattttataaa

SEQ ID NO: 54258 - DNA, 21 bp, Artificial sequence
  SiRNA target sequence
tgttaatgaaattttataaat

SEQ ID NO: 54259 - DNA, 21 bp, Artificial sequence
  SiRNA target sequence
gttaatgaaattttataaata

SEQ ID NO: 54260 - DNA, 21 bp, Artificial sequence
  SiRNA target sequence
ttaatgaaattttataaatat

SEQ ID NO: 54261 - DNA, 21 bp, Artificial sequence
  SiRNA target sequence
taatgaaattttataaatatg

SEQ ID NO: 54262 - DNA, 21 bp, Artificial sequence
  SiRNA target sequence
aatgaaattttataaatatga

SEQ ID NO: 54263 - DNA, 21 bp, Artificial sequence
  SiRNA target sequence
atgaaattttataaatatgat

SEQ ID NO: 54264 - DNA, 21 bp, Artificial sequence
  SiRNA target sequence
tgaaattttataaatatgatg

SEQ ID NO: 54265 - DNA, 21 bp, Artificial sequence
  SiRNA target sequence
gaaattttataaatatgatgg

SEQ ID NO: 54266 - DNA, 21 bp, Artificial sequence
  SiRNA target sequence
aaattttataaatatgatgga

SEQ ID NO: 54267 - DNA, 21 bp, Artificial sequence
  SiRNA target sequence
aattttataaatatgatggag

SEQ ID NO: 54268 - DNA, 21 bp, Artificial sequence
  SiRNA target sequence
attttataaatatgatggaga

SEQ ID NO: 54269 - DNA, 21 bp, Artificial sequence
  SiRNA target sequence
ttttataaatatgatggagat

SEQ ID NO: 54270 - DNA, 21 bp, Artificial sequence
  SiRNA target sequence
tttataaatatgatggagata

SEQ ID NO: 54271 - DNA, 21 bp, Artificial sequence
  SiRNA target sequence
ttataaatatgatggagatat

SEQ ID NO: 54272 - DNA, 21 bp, Artificial sequence
  SiRNA target sequence
tataaatatgatggagatata

SEQ ID NO: 54273 - DNA, 21 bp, Artificial sequence
  SiRNA target sequence
ataaatatgatggagatatat

SEQ ID NO: 54274 - DNA, 21 bp, Artificial sequence
  SiRNA target sequence
taaatatgatggagatatatt

SEQ ID NO: 54275 - DNA, 21 bp, Artificial sequence
  SiRNA target sequence
aaatatgatggagatatatta

SEQ ID NO: 54276 - DNA, 21 bp, Artificial sequence
  SiRNA target sequence
aatatgatggagatatattaa

SEQ ID NO: 54277 - DNA, 21 bp, Artificial sequence
  SiRNA target sequence
atatgatggagatatattaat

SEQ ID NO: 54278 - DNA, 21 bp, Artificial sequence
  SiRNA target sequence
tatgatggagatatattaatt

SEQ ID NO: 54279 - DNA, 21 bp, Artificial sequence
  SiRNA target sequence
atgatggagatatattaattg

SEQ ID NO: 54280 - DNA, 21 bp, Artificial sequence
  SiRNA target sequence
tgatggagatatattaattga

SEQ ID NO: 54281 - DNA, 21 bp, Artificial sequence
  SiRNA target sequence
gatggagatatattaattgat

SEQ ID NO: 54282 - DNA, 21 bp, Artificial sequence
  SiRNA target sequence
atggagatatattaattgatg

SEQ ID NO: 54283 - DNA, 21 bp, Artificial sequence
  SiRNA target sequence
tggagatatattaattgatga

SEQ ID NO: 54284 - DNA, 21 bp, Artificial sequence
  SiRNA target sequence
ggagatatattaattgatgat

SEQ ID NO: 54285 - DNA, 21 bp, Artificial sequence
  SiRNA target sequence
gagatatattaattgatgata

SEQ ID NO: 54286 - DNA, 21 bp, Artificial sequence
  SiRNA target sequence
agatatattaattgatgatac

SEQ ID NO: 54287 - DNA, 21 bp, Artificial sequence
  SiRNA target sequence
gatatattaattgatgataca

SEQ ID NO: 54288 - DNA, 21 bp, Artificial sequence
  SiRNA target sequence
atatattaattgatgatacag

SEQ ID NO: 54289 - DNA, 21 bp, Artificial sequence
  SiRNA target sequence
tatattaattgatgatacaga

SEQ ID NO: 54290 - DNA, 21 bp, Artificial sequence
  SiRNA target sequence
atattaattgatgatacagaa

SEQ ID NO: 54291 - DNA, 21 bp, Artificial sequence
  SiRNA target sequence
tattaattgatgatacagaaa

SEQ ID NO: 54292 - DNA, 21 bp, Artificial sequence
  SiRNA target sequence
attaattgatgatacagaaat

SEQ ID NO: 54293 - DNA, 21 bp, Artificial sequence
  SiRNA target sequence
ttaattgatgatacagaaata

SEQ ID NO: 54294 - DNA, 21 bp, Artificial sequence
  SiRNA target sequence
taattgatgatacagaaatag

SEQ ID NO: 54295 - DNA, 21 bp, Artificial sequence
  SiRNA target sequence
aattgatgatacagaaataga

SEQ ID NO: 54296 - DNA, 21 bp, Artificial sequence
  SiRNA target sequence
attgatgatacagaaatagat

SEQ ID NO: 54297 - DNA, 21 bp, Artificial sequence
  SiRNA target sequence
ttgatgatacagaaatagata

SEQ ID NO: 54298 - DNA, 21 bp, Artificial sequence
  SiRNA target sequence
tgatgatacagaaatagataa

SEQ ID NO: 54299 - DNA, 21 bp, Artificial sequence
  SiRNA target sequence
gatgatacagaaatagataat

SEQ ID NO: 54300 - DNA, 21 bp, Artificial sequence
  SiRNA target sequence
atgatacagaaatagataata

SEQ ID NO: 54301 - DNA, 21 bp, Artificial sequence
  SiRNA target sequence
tgatacagaaatagataatat

SEQ ID NO: 54302 - DNA, 21 bp, Artificial sequence
  SiRNA target sequence
gatacagaaatagataatatt

SEQ ID NO: 54303 - DNA, 21 bp, Artificial sequence
  SiRNA target sequence
atacagaaatagataatattt

SEQ ID NO: 54304 - DNA, 21 bp, Artificial sequence
  SiRNA target sequence
tacagaaatagataatatttc

SEQ ID NO: 54305 - DNA, 21 bp, Artificial sequence
  SiRNA target sequence
acagaaatagataatatttcg

SEQ ID NO: 54306 - DNA, 21 bp, Artificial sequence
  SiRNA target sequence
cagaaatagataatatttcgg

SEQ ID NO: 54307 - DNA, 21 bp, Artificial sequence
  SiRNA target sequence
agaaatagataatatttcgga

SEQ ID NO: 54308 - DNA, 21 bp, Artificial sequence
  SiRNA target sequence
gaaatagataatatttcggat

SEQ ID NO: 54309 - DNA, 21 bp, Artificial sequence
  SiRNA target sequence
aaatagataatatttcggata

SEQ ID NO: 54310 - DNA, 21 bp, Artificial sequence
  SiRNA target sequence
aatagataatatttcggatag

SEQ ID NO: 54311 - DNA, 21 bp, Artificial sequence
  SiRNA target sequence
atagataatatttcggataga

SEQ ID NO: 54312 - DNA, 21 bp, Artificial sequence
  SiRNA target sequence
tagataatatttcggatagaa

SEQ ID NO: 54313 - DNA, 21 bp, Artificial sequence
  SiRNA target sequence
agataatatttcggatagaag

SEQ ID NO: 54314 - DNA, 21 bp, Artificial sequence
  SiRNA target sequence
gataatatttcggatagaagt

SEQ ID NO: 54315 - DNA, 21 bp, Artificial sequence
  SiRNA target sequence
ataatatttcggatagaagtt

SEQ ID NO: 54316 - DNA, 21 bp, Artificial sequence
  SiRNA target sequence
taatatttcggatagaagtta

SEQ ID NO: 54317 - DNA, 21 bp, Artificial sequence
  SiRNA target sequence
aatatttcggatagaagttac

SEQ ID NO: 54318 - DNA, 21 bp, Artificial sequence
  SiRNA target sequence
atatttcggatagaagttaca

SEQ ID NO: 54319 - DNA, 21 bp, Artificial sequence
  SiRNA target sequence
tatttcggatagaagttacag

SEQ ID NO: 54320 - DNA, 21 bp, Artificial sequence
  SiRNA target sequence
atttcggatagaagttacaga

SEQ ID NO: 54321 - DNA, 21 bp, Artificial sequence
  SiRNA target sequence
tttcggatagaagttacagaa

SEQ ID NO: 54322 - DNA, 21 bp, Artificial sequence
  SiRNA target sequence
ttcggatagaagttacagaag

SEQ ID NO: 54323 - DNA, 21 bp, Artificial sequence
  SiRNA target sequence
tcggatagaagttacagaagt

SEQ ID NO: 54324 - DNA, 21 bp, Artificial sequence
  SiRNA target sequence
cggatagaagttacagaagtt

SEQ ID NO: 54325 - DNA, 21 bp, Artificial sequence
  SiRNA target sequence
ggatagaagttacagaagttt

SEQ ID NO: 54326 - DNA, 21 bp, Artificial sequence
  SiRNA target sequence
gatagaagttacagaagttta

SEQ ID NO: 54327 - DNA, 21 bp, Artificial sequence
  SiRNA target sequence
atagaagttacagaagtttaa

SEQ ID NO: 54328 - DNA, 21 bp, Artificial sequence
  SiRNA target sequence
tagaagttacagaagtttaat

SEQ ID NO: 54329 - DNA, 21 bp, Artificial sequence
  SiRNA target sequence
agaagttacagaagtttaata

SEQ ID NO: 54330 - DNA, 21 bp, Artificial sequence
  SiRNA target sequence
gaagttacagaagtttaatat

SEQ ID NO: 54331 - DNA, 21 bp, Artificial sequence
  SiRNA target sequence
aagttacagaagtttaatatc

SEQ ID NO: 54332 - DNA, 21 bp, Artificial sequence
  SiRNA target sequence
agttacagaagtttaatatca

SEQ ID NO: 54333 - DNA, 21 bp, Artificial sequence
  SiRNA target sequence
gttacagaagtttaatatcat

SEQ ID NO: 54334 - DNA, 21 bp, Artificial sequence
  SiRNA target sequence
ttacagaagtttaatatcata

SEQ ID NO: 54335 - DNA, 21 bp, Artificial sequence
  SiRNA target sequence
tacagaagtttaatatcatat

SEQ ID NO: 54336 - DNA, 21 bp, Artificial sequence
  SiRNA target sequence
acagaagtttaatatcatatg

SEQ ID NO: 54337 - DNA, 21 bp, Artificial sequence
  SiRNA target sequence
cagaagtttaatatcatatgc

SEQ ID NO: 54338 - DNA, 21 bp, Artificial sequence
  SiRNA target sequence
agaagtttaatatcatatgca

SEQ ID NO: 54339 - DNA, 21 bp, Artificial sequence
  SiRNA target sequence
gaagtttaatatcatatgcaa

SEQ ID NO: 54340 - DNA, 21 bp, Artificial sequence
  SiRNA target sequence
aagtttaatatcatatgcaac

SEQ ID NO: 54341 - DNA, 21 bp, Artificial sequence
  SiRNA target sequence
agtttaatatcatatgcaaca

SEQ ID NO: 54342 - DNA, 21 bp, Artificial sequence
  SiRNA target sequence
gtttaatatcatatgcaacac

SEQ ID NO: 54343 - DNA, 21 bp, Artificial sequence
  SiRNA target sequence
tttaatatcatatgcaacaca

SEQ ID NO: 54344 - DNA, 21 bp, Artificial sequence
  SiRNA target sequence
ttaatatcatatgcaacacaa

SEQ ID NO: 54345 - DNA, 21 bp, Artificial sequence
  SiRNA target sequence
taatatcatatgcaacacaaa

SEQ ID NO: 54346 - DNA, 21 bp, Artificial sequence
  SiRNA target sequence
aatatcatatgcaacacaaaa

SEQ ID NO: 54347 - DNA, 21 bp, Artificial sequence
  SiRNA target sequence
atatcatatgcaacacaaaac

SEQ ID NO: 54348 - DNA, 21 bp, Artificial sequence
  SiRNA target sequence
tatcatatgcaacacaaaaca

SEQ ID NO: 54349 - DNA, 21 bp, Artificial sequence
  SiRNA target sequence
atcatatgcaacacaaaacac

SEQ ID NO: 54350 - DNA, 21 bp, Artificial sequence
  SiRNA target sequence
tcatatgcaacacaaaacacg

SEQ ID NO: 54351 - DNA, 21 bp, Artificial sequence
  SiRNA target sequence
catatgcaacacaaaacacgt

SEQ ID NO: 54352 - DNA, 21 bp, Artificial sequence
  SiRNA target sequence
atatgcaacacaaaacacgtt

SEQ ID NO: 54353 - DNA, 21 bp, Artificial sequence
  SiRNA target sequence
tatgcaacacaaaacacgttc

SEQ ID NO: 54354 - DNA, 21 bp, Artificial sequence
  SiRNA target sequence
atgcaacacaaaacacgttct

SEQ ID NO: 54355 - DNA, 21 bp, Artificial sequence
  SiRNA target sequence
tgcaacacaaaacacgttctt

SEQ ID NO: 54356 - DNA, 21 bp, Artificial sequence
  SiRNA target sequence
gcaacacaaaacacgttctta

SEQ ID NO: 54357 - DNA, 21 bp, Artificial sequence
  SiRNA target sequence
caacacaaaacacgttcttat

SEQ ID NO: 54358 - DNA, 21 bp, Artificial sequence
  SiRNA target sequence
aacacaaaacacgttcttatt

SEQ ID NO: 54359 - DNA, 21 bp, Artificial sequence
  SiRNA target sequence
acacaaaacacgttcttattc

SEQ ID NO: 54360 - DNA, 21 bp, Artificial sequence
  SiRNA target sequence
cacaaaacacgttcttattcg

SEQ ID NO: 54361 - DNA, 21 bp, Artificial sequence
  SiRNA target sequence
acaaaacacgttcttattcga

SEQ ID NO: 54362 - DNA, 21 bp, Artificial sequence
  SiRNA target sequence
caaaacacgttcttattcgat

SEQ ID NO: 54363 - DNA, 21 bp, Artificial sequence
  SiRNA target sequence
aaaacacgttcttattcgata

SEQ ID NO: 54364 - DNA, 21 bp, Artificial sequence
  SiRNA target sequence
aaacacgttcttattcgataa

SEQ ID NO: 54365 - DNA, 21 bp, Artificial sequence
  SiRNA target sequence
aacacgttcttattcgataat

SEQ ID NO: 54366 - DNA, 21 bp, Artificial sequence
  SiRNA target sequence
acacgttcttattcgataata

SEQ ID NO: 54367 - DNA, 21 bp, Artificial sequence
  SiRNA target sequence
cacgttcttattcgataatac

SEQ ID NO: 54368 - DNA, 21 bp, Artificial sequence
  SiRNA target sequence
acgttcttattcgataatact

SEQ ID NO: 54369 - DNA, 21 bp, Artificial sequence
  SiRNA target sequence
cgttcttattcgataatactg

SEQ ID NO: 54370 - DNA, 21 bp, Artificial sequence
  SiRNA target sequence
gttcttattcgataatactgt

SEQ ID NO: 54371 - DNA, 21 bp, Artificial sequence
  SiRNA target sequence
ttcttattcgataatactgtg

SEQ ID NO: 54372 - DNA, 21 bp, Artificial sequence
  SiRNA target sequence
tcttattcgataatactgtga

SEQ ID NO: 54373 - DNA, 21 bp, Artificial sequence
  SiRNA target sequence
cttattcgataatactgtgac

SEQ ID NO: 54374 - DNA, 21 bp, Artificial sequence
  SiRNA target sequence
ttattcgataatactgtgaca

SEQ ID NO: 54375 - DNA, 21 bp, Artificial sequence
  SiRNA target sequence
tattcgataatactgtgacat

SEQ ID NO: 54376 - DNA, 21 bp, Artificial sequence
  SiRNA target sequence
attcgataatactgtgacata

SEQ ID NO: 54377 - DNA, 21 bp, Artificial sequence
  SiRNA target sequence
ttcgataatactgtgacatac

SEQ ID NO: 54378 - DNA, 21 bp, Artificial sequence
  SiRNA target sequence
tcgataatactgtgacataca

SEQ ID NO: 54379 - DNA, 21 bp, Artificial sequence
  SiRNA target sequence
cgataatactgtgacatacaa

SEQ ID NO: 54380 - DNA, 21 bp, Artificial sequence
  SiRNA target sequence
gataatactgtgacatacaat

SEQ ID NO: 54381 - DNA, 21 bp, Artificial sequence
  SiRNA target sequence
ataatactgtgacatacaata

SEQ ID NO: 54382 - DNA, 21 bp, Artificial sequence
  SiRNA target sequence
taatactgtgacatacaatat

SEQ ID NO: 54383 - DNA, 21 bp, Artificial sequence
  SiRNA target sequence
aatactgtgacatacaatata

SEQ ID NO: 54384 - DNA, 21 bp, Artificial sequence
  SiRNA target sequence
atactgtgacatacaatatat

SEQ ID NO: 54385 - DNA, 21 bp, Artificial sequence
  SiRNA target sequence
tactgtgacatacaatatatt

SEQ ID NO: 54386 - DNA, 21 bp, Artificial sequence
  SiRNA target sequence
actgtgacatacaatatattt

SEQ ID NO: 54387 - DNA, 21 bp, Artificial sequence
  SiRNA target sequence
ctgtgacatacaatatatttt

SEQ ID NO: 54388 - DNA, 21 bp, Artificial sequence
  SiRNA target sequence
tgtgacatacaatatatttta

SEQ ID NO: 54389 - DNA, 21 bp, Artificial sequence
  SiRNA target sequence
gtgacatacaatatattttac

SEQ ID NO: 54390 - DNA, 21 bp, Artificial sequence
  SiRNA target sequence
tgacatacaatatattttacg

SEQ ID NO: 54391 - DNA, 21 bp, Artificial sequence
  SiRNA target sequence
gacatacaatatattttacgg

SEQ ID NO: 54392 - DNA, 21 bp, Artificial sequence
  SiRNA target sequence
acatacaatatattttacggg

SEQ ID NO: 54393 - DNA, 21 bp, Artificial sequence
  SiRNA target sequence
catacaatatattttacggga

SEQ ID NO: 54394 - DNA, 21 bp, Artificial sequence
  SiRNA target sequence
atacaatatattttacgggac

SEQ ID NO: 54395 - DNA, 21 bp, Artificial sequence
  SiRNA target sequence
tacaatatattttacgggact

SEQ ID NO: 54396 - DNA, 21 bp, Artificial sequence
  SiRNA target sequence
acaatatattttacgggacta

SEQ ID NO: 54397 - DNA, 21 bp, Artificial sequence
  SiRNA target sequence
caatatattttacgggactaa

SEQ ID NO: 54398 - DNA, 21 bp, Artificial sequence
  SiRNA target sequence
aatatattttacgggactaaa

SEQ ID NO: 54399 - DNA, 21 bp, Artificial sequence
  SiRNA target sequence
atatattttacgggactaaaa

SEQ ID NO: 54400 - DNA, 21 bp, Artificial sequence
  SiRNA target sequence
tatattttacgggactaaaaa

SEQ ID NO: 54401 - DNA, 21 bp, Artificial sequence
  SiRNA target sequence
atattttacgggactaaaaac

SEQ ID NO: 54402 - DNA, 21 bp, Artificial sequence
  SiRNA target sequence
tattttacgggactaaaaacg

SEQ ID NO: 54403 - DNA, 21 bp, Artificial sequence
  SiRNA target sequence
attttacgggactaaaaacgt

SEQ ID NO: 54404 - DNA, 21 bp, Artificial sequence
  SiRNA target sequence
ttttacgggactaaaaacgta

SEQ ID NO: 54405 - DNA, 21 bp, Artificial sequence
  SiRNA target sequence
tttacgggactaaaaacgtaa

SEQ ID NO: 54406 - DNA, 21 bp, Artificial sequence
  SiRNA target sequence
ttacgggactaaaaacgtaac

SEQ ID NO: 54407 - DNA, 21 bp, Artificial sequence
  SiRNA target sequence
tacgggactaaaaacgtaaca

SEQ ID NO: 54408 - DNA, 21 bp, Artificial sequence
  SiRNA target sequence
acgggactaaaaacgtaacag

SEQ ID NO: 54409 - DNA, 21 bp, Artificial sequence
  SiRNA target sequence
cgggactaaaaacgtaacaga

SEQ ID NO: 54410 - DNA, 21 bp, Artificial sequence
  SiRNA target sequence
gggactaaaaacgtaacagaa

SEQ ID NO: 54411 - DNA, 21 bp, Artificial sequence
  SiRNA target sequence
ggactaaaaacgtaacagaaa

SEQ ID NO: 54412 - DNA, 21 bp, Artificial sequence
  SiRNA target sequence
gactaaaaacgtaacagaaaa

SEQ ID NO: 54413 - DNA, 21 bp, Artificial sequence
  SiRNA target sequence
actaaaaacgtaacagaaaaa

SEQ ID NO: 54414 - DNA, 21 bp, Artificial sequence
  SiRNA target sequence
ctaaaaacgtaacagaaaaag

SEQ ID NO: 54415 - DNA, 21 bp, Artificial sequence
  SiRNA target sequence
taaaaacgtaacagaaaaaga

SEQ ID NO: 54416 - DNA, 21 bp, Artificial sequence
  SiRNA target sequence
aaaaacgtaacagaaaaagaa

SEQ ID NO: 54417 - DNA, 21 bp, Artificial sequence
  SiRNA target sequence
aaaacgtaacagaaaaagaag

SEQ ID NO: 54418 - DNA, 21 bp, Artificial sequence
  SiRNA target sequence
aaacgtaacagaaaaagaagt

SEQ ID NO: 54419 - DNA, 21 bp, Artificial sequence
  SiRNA target sequence
aacgtaacagaaaaagaagtt

SEQ ID NO: 54420 - DNA, 21 bp, Artificial sequence
  SiRNA target sequence
acgtaacagaaaaagaagttt

SEQ ID NO: 54421 - DNA, 21 bp, Artificial sequence
  SiRNA target sequence
cgtaacagaaaaagaagtttt

SEQ ID NO: 54422 - DNA, 21 bp, Artificial sequence
  SiRNA target sequence
gtaacagaaaaagaagtttta

SEQ ID NO: 54423 - DNA, 21 bp, Artificial sequence
  SiRNA target sequence
taacagaaaaagaagttttag

SEQ ID NO: 54424 - DNA, 21 bp, Artificial sequence
  SiRNA target sequence
aacagaaaaagaagttttaga

SEQ ID NO: 54425 - DNA, 21 bp, Artificial sequence
  SiRNA target sequence
acagaaaaagaagttttagaa

SEQ ID NO: 54426 - DNA, 21 bp, Artificial sequence
  SiRNA target sequence
cagaaaaagaagttttagaat

SEQ ID NO: 54427 - DNA, 21 bp, Artificial sequence
  SiRNA target sequence
agaaaaagaagttttagaatt

SEQ ID NO: 54428 - DNA, 21 bp, Artificial sequence
  SiRNA target sequence
gaaaaagaagttttagaatta

SEQ ID NO: 54429 - DNA, 21 bp, Artificial sequence
  SiRNA target sequence
aaaaagaagttttagaattag

SEQ ID NO: 54430 - DNA, 21 bp, Artificial sequence
  SiRNA target sequence
aaaagaagttttagaattagc

SEQ ID NO: 54431 - DNA, 21 bp, Artificial sequence
  SiRNA target sequence
aaagaagttttagaattagcc

SEQ ID NO: 54432 - DNA, 21 bp, Artificial sequence
  SiRNA target sequence
aagaagttttagaattagcca

SEQ ID NO: 54433 - DNA, 21 bp, Artificial sequence
  SiRNA target sequence
agaagttttagaattagccaa

SEQ ID NO: 54434 - DNA, 21 bp, Artificial sequence
  SiRNA target sequence
gaagttttagaattagccaaa

SEQ ID NO: 54435 - DNA, 21 bp, Artificial sequence
  SiRNA target sequence
aagttttagaattagccaaaa

SEQ ID NO: 54436 - DNA, 21 bp, Artificial sequence
  SiRNA target sequence
agttttagaattagccaaaaa

SEQ ID NO: 54437 - DNA, 21 bp, Artificial sequence
  SiRNA target sequence
gttttagaattagccaaaaaa

SEQ ID NO: 54438 - DNA, 21 bp, Artificial sequence
  SiRNA target sequence
ttttagaattagccaaaaaaa

SEQ ID NO: 54439 - DNA, 21 bp, Artificial sequence
  SiRNA target sequence
tttagaattagccaaaaaaat

SEQ ID NO: 54440 - DNA, 21 bp, Artificial sequence
  SiRNA target sequence
ttagaattagccaaaaaaata

SEQ ID NO: 54441 - DNA, 21 bp, Artificial sequence
  SiRNA target sequence
tagaattagccaaaaaaatag

SEQ ID NO: 54442 - DNA, 21 bp, Artificial sequence
  SiRNA target sequence
agaattagccaaaaaaatagg

SEQ ID NO: 54443 - DNA, 21 bp, Artificial sequence
  SiRNA target sequence
gaattagccaaaaaaataggt

SEQ ID NO: 54444 - DNA, 21 bp, Artificial sequence
  SiRNA target sequence
aattagccaaaaaaataggtg

SEQ ID NO: 54445 - DNA, 21 bp, Artificial sequence
  SiRNA target sequence
attagccaaaaaaataggtgt

SEQ ID NO: 54446 - DNA, 21 bp, Artificial sequence
  SiRNA target sequence
ttagccaaaaaaataggtgta

SEQ ID NO: 54447 - DNA, 21 bp, Artificial sequence
  SiRNA target sequence
tagccaaaaaaataggtgtat

SEQ ID NO: 54448 - DNA, 21 bp, Artificial sequence
  SiRNA target sequence
agccaaaaaaataggtgtatt

SEQ ID NO: 54449 - DNA, 21 bp, Artificial sequence
  SiRNA target sequence
gccaaaaaaataggtgtatta

SEQ ID NO: 54450 - DNA, 21 bp, Artificial sequence
  SiRNA target sequence
ccaaaaaaataggtgtattag

SEQ ID NO: 54451 - DNA, 21 bp, Artificial sequence
  SiRNA target sequence
caaaaaaataggtgtattaga

SEQ ID NO: 54452 - DNA, 21 bp, Artificial sequence
  SiRNA target sequence
aaaaaaataggtgtattagag

SEQ ID NO: 54453 - DNA, 21 bp, Artificial sequence
  SiRNA target sequence
aaaaaataggtgtattagagt

SEQ ID NO: 54454 - DNA, 21 bp, Artificial sequence
  SiRNA target sequence
aaaaataggtgtattagagtc

SEQ ID NO: 54455 - DNA, 21 bp, Artificial sequence
  SiRNA target sequence
aaaataggtgtattagagtct

SEQ ID NO: 54456 - DNA, 21 bp, Artificial sequence
  SiRNA target sequence
aaataggtgtattagagtcta

SEQ ID NO: 54457 - DNA, 21 bp, Artificial sequence
  SiRNA target sequence
aataggtgtattagagtctat

SEQ ID NO: 54458 - DNA, 21 bp, Artificial sequence
  SiRNA target sequence
ataggtgtattagagtctata

SEQ ID NO: 54459 - DNA, 21 bp, Artificial sequence
  SiRNA target sequence
taggtgtattagagtctatac

SEQ ID NO: 54460 - DNA, 21 bp, Artificial sequence
  SiRNA target sequence
aggtgtattagagtctataca

SEQ ID NO: 54461 - DNA, 21 bp, Artificial sequence
  SiRNA target sequence
ggtgtattagagtctatacag

SEQ ID NO: 54462 - DNA, 21 bp, Artificial sequence
  SiRNA target sequence
gtgtattagagtctatacagg

SEQ ID NO: 54463 - DNA, 21 bp, Artificial sequence
  SiRNA target sequence
tgtattagagtctatacagga

SEQ ID NO: 54464 - DNA, 21 bp, Artificial sequence
  SiRNA target sequence
gtattagagtctatacaggaa

SEQ ID NO: 54465 - DNA, 21 bp, Artificial sequence
  SiRNA target sequence
tattagagtctatacaggaat

SEQ ID NO: 54466 - DNA, 21 bp, Artificial sequence
  SiRNA target sequence
attagagtctatacaggaatt

SEQ ID NO: 54467 - DNA, 21 bp, Artificial sequence
  SiRNA target sequence
ttagagtctatacaggaattt

SEQ ID NO: 54468 - DNA, 21 bp, Artificial sequence
  SiRNA target sequence
tagagtctatacaggaattta

SEQ ID NO: 54469 - DNA, 21 bp, Artificial sequence
  SiRNA target sequence
agagtctatacaggaatttaa

SEQ ID NO: 54470 - DNA, 21 bp, Artificial sequence
  SiRNA target sequence
gagtctatacaggaatttaaa

SEQ ID NO: 54471 - DNA, 21 bp, Artificial sequence
  SiRNA target sequence
agtctatacaggaatttaaag

SEQ ID NO: 54472 - DNA, 21 bp, Artificial sequence
  SiRNA target sequence
gtctatacaggaatttaaaga

SEQ ID NO: 54473 - DNA, 21 bp, Artificial sequence
  SiRNA target sequence
tctatacaggaatttaaagat

SEQ ID NO: 54474 - DNA, 21 bp, Artificial sequence
  SiRNA target sequence
ctatacaggaatttaaagatg

SEQ ID NO: 54475 - DNA, 21 bp, Artificial sequence
  SiRNA target sequence
tatacaggaatttaaagatgg

SEQ ID NO: 54476 - DNA, 21 bp, Artificial sequence
  SiRNA target sequence
atacaggaatttaaagatggg

SEQ ID NO: 54477 - DNA, 21 bp, Artificial sequence
  SiRNA target sequence
tacaggaatttaaagatgggt

SEQ ID NO: 54478 - DNA, 21 bp, Artificial sequence
  SiRNA target sequence
acaggaatttaaagatgggtt

SEQ ID NO: 54479 - DNA, 21 bp, Artificial sequence
  SiRNA target sequence
caggaatttaaagatgggttt

SEQ ID NO: 54480 - DNA, 21 bp, Artificial sequence
  SiRNA target sequence
aggaatttaaagatgggttta

SEQ ID NO: 54481 - DNA, 21 bp, Artificial sequence
  SiRNA target sequence
ggaatttaaagatgggtttag

SEQ ID NO: 54482 - DNA, 21 bp, Artificial sequence
  SiRNA target sequence
gaatttaaagatgggtttagc

SEQ ID NO: 54483 - DNA, 21 bp, Artificial sequence
  SiRNA target sequence
aatttaaagatgggtttagca

SEQ ID NO: 54484 - DNA, 21 bp, Artificial sequence
  SiRNA target sequence
atttaaagatgggtttagcac

SEQ ID NO: 54485 - DNA, 21 bp, Artificial sequence
  SiRNA target sequence
tttaaagatgggtttagcaca

SEQ ID NO: 54486 - DNA, 21 bp, Artificial sequence
  SiRNA target sequence
ttaaagatgggtttagcacat

SEQ ID NO: 54487 - DNA, 21 bp, Artificial sequence
  SiRNA target sequence
taaagatgggtttagcacatc

SEQ ID NO: 54488 - DNA, 21 bp, Artificial sequence
  SiRNA target sequence
aaagatgggtttagcacatcg

SEQ ID NO: 54489 - DNA, 21 bp, Artificial sequence
  SiRNA target sequence
aagatgggtttagcacatcgg

SEQ ID NO: 54490 - DNA, 21 bp, Artificial sequence
  SiRNA target sequence
agatgggtttagcacatcggt

SEQ ID NO: 54491 - DNA, 21 bp, Artificial sequence
  SiRNA target sequence
gatgggtttagcacatcggtc

SEQ ID NO: 54492 - DNA, 21 bp, Artificial sequence
  SiRNA target sequence
atgggtttagcacatcggtcg

SEQ ID NO: 54493 - DNA, 21 bp, Artificial sequence
  SiRNA target sequence
tgggtttagcacatcggtcgg

SEQ ID NO: 54494 - DNA, 21 bp, Artificial sequence
  SiRNA target sequence
gggtttagcacatcggtcggt

SEQ ID NO: 54495 - DNA, 21 bp, Artificial sequence
  SiRNA target sequence
ggtttagcacatcggtcggtg

SEQ ID NO: 54496 - DNA, 21 bp, Artificial sequence
  SiRNA target sequence
gtttagcacatcggtcggtga

SEQ ID NO: 54497 - DNA, 21 bp, Artificial sequence
  SiRNA target sequence
tttagcacatcggtcggtgaa

SEQ ID NO: 54498 - DNA, 21 bp, Artificial sequence
  SiRNA target sequence
ttagcacatcggtcggtgaac

SEQ ID NO: 54499 - DNA, 21 bp, Artificial sequence
  SiRNA target sequence
tagcacatcggtcggtgaacg

SEQ ID NO: 54500 - DNA, 21 bp, Artificial sequence
  SiRNA target sequence
agcacatcggtcggtgaacgc

SEQ ID NO: 54501 - DNA, 21 bp, Artificial sequence
  SiRNA target sequence
gcacatcggtcggtgaacgcg

SEQ ID NO: 54502 - DNA, 21 bp, Artificial sequence
  SiRNA target sequence
cacatcggtcggtgaacgcgg

SEQ ID NO: 54503 - DNA, 21 bp, Artificial sequence
  SiRNA target sequence
acatcggtcggtgaacgcgga

SEQ ID NO: 54504 - DNA, 21 bp, Artificial sequence
  SiRNA target sequence
catcggtcggtgaacgcggaa

SEQ ID NO: 54505 - DNA, 21 bp, Artificial sequence
  SiRNA target sequence
atcggtcggtgaacgcggaag

SEQ ID NO: 54506 - DNA, 21 bp, Artificial sequence
  SiRNA target sequence
tcggtcggtgaacgcggaaga

SEQ ID NO: 54507 - DNA, 21 bp, Artificial sequence
  SiRNA target sequence
cggtcggtgaacgcggaagat

SEQ ID NO: 54508 - DNA, 21 bp, Artificial sequence
  SiRNA target sequence
ggtcggtgaacgcggaagatt

SEQ ID NO: 54509 - DNA, 21 bp, Artificial sequence
  SiRNA target sequence
gtcggtgaacgcggaagattt

SEQ ID NO: 54510 - DNA, 21 bp, Artificial sequence
  SiRNA target sequence
tcggtgaacgcggaagatttt

SEQ ID NO: 54511 - DNA, 21 bp, Artificial sequence
  SiRNA target sequence
cggtgaacgcggaagattttt

SEQ ID NO: 54512 - DNA, 21 bp, Artificial sequence
  SiRNA target sequence
ggtgaacgcggaagattttta

SEQ ID NO: 54513 - DNA, 21 bp, Artificial sequence
  SiRNA target sequence
gtgaacgcggaagatttttat

SEQ ID NO: 54514 - DNA, 21 bp, Artificial sequence
  SiRNA target sequence
tgaacgcggaagatttttatc

SEQ ID NO: 54515 - DNA, 21 bp, Artificial sequence
  SiRNA target sequence
gaacgcggaagatttttatct

SEQ ID NO: 54516 - DNA, 21 bp, Artificial sequence
  SiRNA target sequence
aacgcggaagatttttatctg

SEQ ID NO: 54517 - DNA, 21 bp, Artificial sequence
  SiRNA target sequence
acgcggaagatttttatctgg

SEQ ID NO: 54518 - DNA, 21 bp, Artificial sequence
  SiRNA target sequence
cgcggaagatttttatctggt

SEQ ID NO: 54519 - DNA, 21 bp, Artificial sequence
  SiRNA target sequence
gcggaagatttttatctggtg

SEQ ID NO: 54520 - DNA, 21 bp, Artificial sequence
  SiRNA target sequence
cggaagatttttatctggtgg

SEQ ID NO: 54521 - DNA, 21 bp, Artificial sequence
  SiRNA target sequence
ggaagatttttatctggtggt

SEQ ID NO: 54522 - DNA, 21 bp, Artificial sequence
  SiRNA target sequence
gaagatttttatctggtggtg

SEQ ID NO: 54523 - DNA, 21 bp, Artificial sequence
  SiRNA target sequence
aagatttttatctggtggtga

SEQ ID NO: 54524 - DNA, 21 bp, Artificial sequence
  SiRNA target sequence
agatttttatctggtggtgaa

SEQ ID NO: 54525 - DNA, 21 bp, Artificial sequence
  SiRNA target sequence
gatttttatctggtggtgaaa

SEQ ID NO: 54526 - DNA, 21 bp, Artificial sequence
  SiRNA target sequence
atttttatctggtggtgaaag

SEQ ID NO: 54527 - DNA, 21 bp, Artificial sequence
  SiRNA target sequence
tttttatctggtggtgaaagg

SEQ ID NO: 54528 - DNA, 21 bp, Artificial sequence
  SiRNA target sequence
ttttatctggtggtgaaaggc

SEQ ID NO: 54529 - DNA, 21 bp, Artificial sequence
  SiRNA target sequence
tttatctggtggtgaaaggca

SEQ ID NO: 54530 - DNA, 21 bp, Artificial sequence
  SiRNA target sequence
ttatctggtggtgaaaggcaa

SEQ ID NO: 54531 - DNA, 21 bp, Artificial sequence
  SiRNA target sequence
tatctggtggtgaaaggcaaa

SEQ ID NO: 54532 - DNA, 21 bp, Artificial sequence
  SiRNA target sequence
atctggtggtgaaaggcaaaa

SEQ ID NO: 54533 - DNA, 21 bp, Artificial sequence
  SiRNA target sequence
tctggtggtgaaaggcaaaaa

SEQ ID NO: 54534 - DNA, 21 bp, Artificial sequence
  SiRNA target sequence
ctggtggtgaaaggcaaaaaa

SEQ ID NO: 54535 - DNA, 21 bp, Artificial sequence
  SiRNA target sequence
tggtggtgaaaggcaaaaaat

SEQ ID NO: 54536 - DNA, 21 bp, Artificial sequence
  SiRNA target sequence
ggtggtgaaaggcaaaaaatt

SEQ ID NO: 54537 - DNA, 21 bp, Artificial sequence
  SiRNA target sequence
gtggtgaaaggcaaaaaatta

SEQ ID NO: 54538 - DNA, 21 bp, Artificial sequence
  SiRNA target sequence
tggtgaaaggcaaaaaattat

SEQ ID NO: 54539 - DNA, 21 bp, Artificial sequence
  SiRNA target sequence
ggtgaaaggcaaaaaattatg

SEQ ID NO: 54540 - DNA, 21 bp, Artificial sequence
  SiRNA target sequence
gtgaaaggcaaaaaattatgc

SEQ ID NO: 54541 - DNA, 21 bp, Artificial sequence
  SiRNA target sequence
tgaaaggcaaaaaattatgct

SEQ ID NO: 54542 - DNA, 21 bp, Artificial sequence
  SiRNA target sequence
gaaaggcaaaaaattatgctg

SEQ ID NO: 54543 - DNA, 21 bp, Artificial sequence
  SiRNA target sequence
aaaggcaaaaaattatgctga

SEQ ID NO: 54544 - DNA, 21 bp, Artificial sequence
  SiRNA target sequence
aaggcaaaaaattatgctgat

SEQ ID NO: 54545 - DNA, 21 bp, Artificial sequence
  SiRNA target sequence
aggcaaaaaattatgctgatg

SEQ ID NO: 54546 - DNA, 21 bp, Artificial sequence
  SiRNA target sequence
ggcaaaaaattatgctgatgc

SEQ ID NO: 54547 - DNA, 21 bp, Artificial sequence
  SiRNA target sequence
gcaaaaaattatgctgatgcg

SEQ ID NO: 54548 - DNA, 21 bp, Artificial sequence
  SiRNA target sequence
caaaaaattatgctgatgcgt

SEQ ID NO: 54549 - DNA, 21 bp, Artificial sequence
  SiRNA target sequence
aaaaaattatgctgatgcgtg

SEQ ID NO: 54550 - DNA, 21 bp, Artificial sequence
  SiRNA target sequence
aaaaattatgctgatgcgtgc

SEQ ID NO: 54551 - DNA, 21 bp, Artificial sequence
  SiRNA target sequence
aaaattatgctgatgcgtgca

SEQ ID NO: 54552 - DNA, 21 bp, Artificial sequence
  SiRNA target sequence
aaattatgctgatgcgtgcat

SEQ ID NO: 54553 - DNA, 21 bp, Artificial sequence
  SiRNA target sequence
aattatgctgatgcgtgcatt

SEQ ID NO: 54554 - DNA, 21 bp, Artificial sequence
  SiRNA target sequence
attatgctgatgcgtgcattg

SEQ ID NO: 54555 - DNA, 21 bp, Artificial sequence
  SiRNA target sequence
ttatgctgatgcgtgcattgc

SEQ ID NO: 54556 - DNA, 21 bp, Artificial sequence
  SiRNA target sequence
tatgctgatgcgtgcattgct

SEQ ID NO: 54557 - DNA, 21 bp, Artificial sequence
  SiRNA target sequence
atgctgatgcgtgcattgctt

SEQ ID NO: 54558 - DNA, 21 bp, Artificial sequence
  SiRNA target sequence
tgctgatgcgtgcattgctta

SEQ ID NO: 54559 - DNA, 21 bp, Artificial sequence
  SiRNA target sequence
gctgatgcgtgcattgcttaa

SEQ ID NO: 54560 - DNA, 21 bp, Artificial sequence
  SiRNA target sequence
ctgatgcgtgcattgcttaaa

SEQ ID NO: 54561 - DNA, 21 bp, Artificial sequence
  SiRNA target sequence
tgatgcgtgcattgcttaaaa

SEQ ID NO: 54562 - DNA, 21 bp, Artificial sequence
  SiRNA target sequence
gatgcgtgcattgcttaaaaa

SEQ ID NO: 54563 - DNA, 21 bp, Artificial sequence
  SiRNA target sequence
atgcgtgcattgcttaaaaat

SEQ ID NO: 54564 - DNA, 21 bp, Artificial sequence
  SiRNA target sequence
tgcgtgcattgcttaaaaatt

SEQ ID NO: 54565 - DNA, 21 bp, Artificial sequence
  SiRNA target sequence
gcgtgcattgcttaaaaattc

SEQ ID NO: 54566 - DNA, 21 bp, Artificial sequence
  SiRNA target sequence
cgtgcattgcttaaaaattca

SEQ ID NO: 54567 - DNA, 21 bp, Artificial sequence
  SiRNA target sequence
gtgcattgcttaaaaattcag

SEQ ID NO: 54568 - DNA, 21 bp, Artificial sequence
  SiRNA target sequence
tgcattgcttaaaaattcaga

SEQ ID NO: 54569 - DNA, 21 bp, Artificial sequence
  SiRNA target sequence
gcattgcttaaaaattcagag

SEQ ID NO: 54570 - DNA, 21 bp, Artificial sequence
  SiRNA target sequence
cattgcttaaaaattcagaga

SEQ ID NO: 54571 - DNA, 21 bp, Artificial sequence
  SiRNA target sequence
attgcttaaaaattcagagat

SEQ ID NO: 54572 - DNA, 21 bp, Artificial sequence
  SiRNA target sequence
ttgcttaaaaattcagagatc

SEQ ID NO: 54573 - DNA, 21 bp, Artificial sequence
  SiRNA target sequence
tgcttaaaaattcagagatcg

SEQ ID NO: 54574 - DNA, 21 bp, Artificial sequence
  SiRNA target sequence
gcttaaaaattcagagatcgt

SEQ ID NO: 54575 - DNA, 21 bp, Artificial sequence
  SiRNA target sequence
cttaaaaattcagagatcgtt

SEQ ID NO: 54576 - DNA, 21 bp, Artificial sequence
  SiRNA target sequence
ttaaaaattcagagatcgttt

SEQ ID NO: 54577 - DNA, 21 bp, Artificial sequence
  SiRNA target sequence
taaaaattcagagatcgtttt

SEQ ID NO: 54578 - DNA, 21 bp, Artificial sequence
  SiRNA target sequence
aaaaattcagagatcgtttta

SEQ ID NO: 54579 - DNA, 21 bp, Artificial sequence
  SiRNA target sequence
aaaattcagagatcgttttat

SEQ ID NO: 54580 - DNA, 21 bp, Artificial sequence
  SiRNA target sequence
aaattcagagatcgttttatt

SEQ ID NO: 54581 - DNA, 21 bp, Artificial sequence
  SiRNA target sequence
aattcagagatcgttttatta

SEQ ID NO: 54582 - DNA, 21 bp, Artificial sequence
  SiRNA target sequence
attcagagatcgttttattag

SEQ ID NO: 54583 - DNA, 21 bp, Artificial sequence
  SiRNA target sequence
ttcagagatcgttttattaga

SEQ ID NO: 54584 - DNA, 21 bp, Artificial sequence
  SiRNA target sequence
tcagagatcgttttattagac

SEQ ID NO: 54585 - DNA, 21 bp, Artificial sequence
  SiRNA target sequence
cagagatcgttttattagacg

SEQ ID NO: 54586 - DNA, 21 bp, Artificial sequence
  SiRNA target sequence
agagatcgttttattagacga

SEQ ID NO: 54587 - DNA, 21 bp, Artificial sequence
  SiRNA target sequence
gagatcgttttattagacgag

SEQ ID NO: 54588 - DNA, 21 bp, Artificial sequence
  SiRNA target sequence
agatcgttttattagacgagc

SEQ ID NO: 54589 - DNA, 21 bp, Artificial sequence
  SiRNA target sequence
gatcgttttattagacgagcc

SEQ ID NO: 54590 - DNA, 21 bp, Artificial sequence
  SiRNA target sequence
atcgttttattagacgagcca

SEQ ID NO: 54591 - DNA, 21 bp, Artificial sequence
  SiRNA target sequence
tcgttttattagacgagccaa

SEQ ID NO: 54592 - DNA, 21 bp, Artificial sequence
  SiRNA target sequence
cgttttattagacgagccaac

SEQ ID NO: 54593 - DNA, 21 bp, Artificial sequence
  SiRNA target sequence
gttttattagacgagccaacc

SEQ ID NO: 54594 - DNA, 21 bp, Artificial sequence
  SiRNA target sequence
ttttattagacgagccaacct

SEQ ID NO: 54595 - DNA, 21 bp, Artificial sequence
  SiRNA target sequence
tttattagacgagccaacctc

SEQ ID NO: 54596 - DNA, 21 bp, Artificial sequence
  SiRNA target sequence
ttattagacgagccaacctca

SEQ ID NO: 54597 - DNA, 21 bp, Artificial sequence
  SiRNA target sequence
tattagacgagccaacctcag

SEQ ID NO: 54598 - DNA, 21 bp, Artificial sequence
  SiRNA target sequence
attagacgagccaacctcagc

SEQ ID NO: 54599 - DNA, 21 bp, Artificial sequence
  SiRNA target sequence
ttagacgagccaacctcagca

SEQ ID NO: 54600 - DNA, 21 bp, Artificial sequence
  SiRNA target sequence
tagacgagccaacctcagcac

SEQ ID NO: 54601 - DNA, 21 bp, Artificial sequence
  SiRNA target sequence
agacgagccaacctcagcact

SEQ ID NO: 54602 - DNA, 21 bp, Artificial sequence
  SiRNA target sequence
gacgagccaacctcagcacta

SEQ ID NO: 54603 - DNA, 21 bp, Artificial sequence
  SiRNA target sequence
acgagccaacctcagcactag

SEQ ID NO: 54604 - DNA, 21 bp, Artificial sequence
  SiRNA target sequence
cgagccaacctcagcactaga

SEQ ID NO: 54605 - DNA, 21 bp, Artificial sequence
  SiRNA target sequence
gagccaacctcagcactagat

SEQ ID NO: 54606 - DNA, 21 bp, Artificial sequence
  SiRNA target sequence
agccaacctcagcactagata

SEQ ID NO: 54607 - DNA, 21 bp, Artificial sequence
  SiRNA target sequence
gccaacctcagcactagataa

SEQ ID NO: 54608 - DNA, 21 bp, Artificial sequence
  SiRNA target sequence
ccaacctcagcactagataaa

SEQ ID NO: 54609 - DNA, 21 bp, Artificial sequence
  SiRNA target sequence
caacctcagcactagataaaa

SEQ ID NO: 54610 - DNA, 21 bp, Artificial sequence
  SiRNA target sequence
aacctcagcactagataaaaa

SEQ ID NO: 54611 - DNA, 21 bp, Artificial sequence
  SiRNA target sequence
acctcagcactagataaaaag

SEQ ID NO: 54612 - DNA, 21 bp, Artificial sequence
  SiRNA target sequence
cctcagcactagataaaaaga

SEQ ID NO: 54613 - DNA, 21 bp, Artificial sequence
  SiRNA target sequence
ctcagcactagataaaaagag

SEQ ID NO: 54614 - DNA, 21 bp, Artificial sequence
  SiRNA target sequence
tcagcactagataaaaagagt

SEQ ID NO: 54615 - DNA, 21 bp, Artificial sequence
  SiRNA target sequence
cagcactagataaaaagagtg

SEQ ID NO: 54616 - DNA, 21 bp, Artificial sequence
  SiRNA target sequence
agcactagataaaaagagtga

SEQ ID NO: 54617 - DNA, 21 bp, Artificial sequence
  SiRNA target sequence
gcactagataaaaagagtgaa

SEQ ID NO: 54618 - DNA, 21 bp, Artificial sequence
  SiRNA target sequence
cactagataaaaagagtgaac

SEQ ID NO: 54619 - DNA, 21 bp, Artificial sequence
  SiRNA target sequence
actagataaaaagagtgaact

SEQ ID NO: 54620 - DNA, 21 bp, Artificial sequence
  SiRNA target sequence
ctagataaaaagagtgaacta

SEQ ID NO: 54621 - DNA, 21 bp, Artificial sequence
  SiRNA target sequence
tagataaaaagagtgaactag

SEQ ID NO: 54622 - DNA, 21 bp, Artificial sequence
  SiRNA target sequence
agataaaaagagtgaactaga

SEQ ID NO: 54623 - DNA, 21 bp, Artificial sequence
  SiRNA target sequence
gataaaaagagtgaactagaa

SEQ ID NO: 54624 - DNA, 21 bp, Artificial sequence
  SiRNA target sequence
ataaaaagagtgaactagaaa

SEQ ID NO: 54625 - DNA, 21 bp, Artificial sequence
  SiRNA target sequence
taaaaagagtgaactagaaac

SEQ ID NO: 54626 - DNA, 21 bp, Artificial sequence
  SiRNA target sequence
aaaaagagtgaactagaaact

SEQ ID NO: 54627 - DNA, 21 bp, Artificial sequence
  SiRNA target sequence
aaaagagtgaactagaaacta

SEQ ID NO: 54628 - DNA, 21 bp, Artificial sequence
  SiRNA target sequence
aaagagtgaactagaaactat

SEQ ID NO: 54629 - DNA, 21 bp, Artificial sequence
  SiRNA target sequence
aagagtgaactagaaactatg

SEQ ID NO: 54630 - DNA, 21 bp, Artificial sequence
  SiRNA target sequence
agagtgaactagaaactatga

SEQ ID NO: 54631 - DNA, 21 bp, Artificial sequence
  SiRNA target sequence
gagtgaactagaaactatgac

SEQ ID NO: 54632 - DNA, 21 bp, Artificial sequence
  SiRNA target sequence
agtgaactagaaactatgaca

SEQ ID NO: 54633 - DNA, 21 bp, Artificial sequence
  SiRNA target sequence
gtgaactagaaactatgacat

SEQ ID NO: 54634 - DNA, 21 bp, Artificial sequence
  SiRNA target sequence
tgaactagaaactatgacata

SEQ ID NO: 54635 - DNA, 21 bp, Artificial sequence
  SiRNA target sequence
gaactagaaactatgacatat

SEQ ID NO: 54636 - DNA, 21 bp, Artificial sequence
  SiRNA target sequence
aactagaaactatgacatata

SEQ ID NO: 54637 - DNA, 21 bp, Artificial sequence
  SiRNA target sequence
actagaaactatgacatatat

SEQ ID NO: 54638 - DNA, 21 bp, Artificial sequence
  SiRNA target sequence
ctagaaactatgacatatatt

SEQ ID NO: 54639 - DNA, 21 bp, Artificial sequence
  SiRNA target sequence
tagaaactatgacatatattt

SEQ ID NO: 54640 - DNA, 21 bp, Artificial sequence
  SiRNA target sequence
agaaactatgacatatatttt

SEQ ID NO: 54641 - DNA, 21 bp, Artificial sequence
  SiRNA target sequence
gaaactatgacatatattttt

SEQ ID NO: 54642 - DNA, 21 bp, Artificial sequence
  SiRNA target sequence
aaactatgacatatattttta

SEQ ID NO: 54643 - DNA, 21 bp, Artificial sequence
  SiRNA target sequence
aactatgacatatatttttaa

SEQ ID NO: 54644 - DNA, 21 bp, Artificial sequence
  SiRNA target sequence
actatgacatatatttttaat

SEQ ID NO: 54645 - DNA, 21 bp, Artificial sequence
  SiRNA target sequence
ctatgacatatatttttaatg

SEQ ID NO: 54646 - DNA, 21 bp, Artificial sequence
  SiRNA target sequence
tatgacatatatttttaatga

SEQ ID NO: 54647 - DNA, 21 bp, Artificial sequence
  SiRNA target sequence
atgacatatatttttaatgaa

SEQ ID NO: 54648 - DNA, 21 bp, Artificial sequence
  SiRNA target sequence
tgacatatatttttaatgaat

SEQ ID NO: 54649 - DNA, 21 bp, Artificial sequence
  SiRNA target sequence
gacatatatttttaatgaatt

SEQ ID NO: 54650 - DNA, 21 bp, Artificial sequence
  SiRNA target sequence
acatatatttttaatgaattt

SEQ ID NO: 54651 - DNA, 21 bp, Artificial sequence
  SiRNA target sequence
catatatttttaatgaattta

SEQ ID NO: 54652 - DNA, 21 bp, Artificial sequence
  SiRNA target sequence
atatatttttaatgaatttaa

SEQ ID NO: 54653 - DNA, 21 bp, Artificial sequence
  SiRNA target sequence
tatatttttaatgaatttaag

SEQ ID NO: 54654 - DNA, 21 bp, Artificial sequence
  SiRNA target sequence
atatttttaatgaatttaagt

SEQ ID NO: 54655 - DNA, 21 bp, Artificial sequence
  SiRNA target sequence
tatttttaatgaatttaagta

SEQ ID NO: 54656 - DNA, 21 bp, Artificial sequence
  SiRNA target sequence
atttttaatgaatttaagtac

SEQ ID NO: 54657 - DNA, 21 bp, Artificial sequence
  SiRNA target sequence
tttttaatgaatttaagtacc

SEQ ID NO: 54658 - DNA, 21 bp, Artificial sequence
  SiRNA target sequence
ttttaatgaatttaagtacca

SEQ ID NO: 54659 - DNA, 21 bp, Artificial sequence
  SiRNA target sequence
tttaatgaatttaagtaccat

SEQ ID NO: 54660 - DNA, 21 bp, Artificial sequence
  SiRNA target sequence
ttaatgaatttaagtaccata

SEQ ID NO: 54661 - DNA, 21 bp, Artificial sequence
  SiRNA target sequence
taatgaatttaagtaccatac

SEQ ID NO: 54662 - DNA, 21 bp, Artificial sequence
  SiRNA target sequence
aatgaatttaagtaccatact

SEQ ID NO: 54663 - DNA, 21 bp, Artificial sequence
  SiRNA target sequence
atgaatttaagtaccatactt

SEQ ID NO: 54664 - DNA, 21 bp, Artificial sequence
  SiRNA target sequence
tgaatttaagtaccatacttt

SEQ ID NO: 54665 - DNA, 21 bp, Artificial sequence
  SiRNA target sequence
gaatttaagtaccatactttt

SEQ ID NO: 54666 - DNA, 21 bp, Artificial sequence
  SiRNA target sequence
aatttaagtaccatacttttg

SEQ ID NO: 54667 - DNA, 21 bp, Artificial sequence
  SiRNA target sequence
atttaagtaccatacttttgt

SEQ ID NO: 54668 - DNA, 21 bp, Artificial sequence
  SiRNA target sequence
tttaagtaccatacttttgta

SEQ ID NO: 54669 - DNA, 21 bp, Artificial sequence
  SiRNA target sequence
ttaagtaccatacttttgtaa

SEQ ID NO: 54670 - DNA, 21 bp, Artificial sequence
  SiRNA target sequence
taagtaccatacttttgtaat

SEQ ID NO: 54671 - DNA, 21 bp, Artificial sequence
  SiRNA target sequence
aagtaccatacttttgtaata

SEQ ID NO: 54672 - DNA, 21 bp, Artificial sequence
  SiRNA target sequence
agtaccatacttttgtaataa

SEQ ID NO: 54673 - DNA, 21 bp, Artificial sequence
  SiRNA target sequence
gtaccatacttttgtaataat

SEQ ID NO: 54674 - DNA, 21 bp, Artificial sequence
  SiRNA target sequence
taccatacttttgtaataatt

SEQ ID NO: 54675 - DNA, 21 bp, Artificial sequence
  SiRNA target sequence
accatacttttgtaataattg

SEQ ID NO: 54676 - DNA, 21 bp, Artificial sequence
  SiRNA target sequence
ccatacttttgtaataattgt

SEQ ID NO: 54677 - DNA, 21 bp, Artificial sequence
  SiRNA target sequence
catacttttgtaataattgta

SEQ ID NO: 54678 - DNA, 21 bp, Artificial sequence
  SiRNA target sequence
atacttttgtaataattgtac

SEQ ID NO: 54679 - DNA, 21 bp, Artificial sequence
  SiRNA target sequence
tacttttgtaataattgtaca

SEQ ID NO: 54680 - DNA, 21 bp, Artificial sequence
  SiRNA target sequence
acttttgtaataattgtacac

SEQ ID NO: 54681 - DNA, 21 bp, Artificial sequence
  SiRNA target sequence
cttttgtaataattgtacaca

SEQ ID NO: 54682 - DNA, 21 bp, Artificial sequence
  SiRNA target sequence
ttttgtaataattgtacacaa

SEQ ID NO: 54683 - DNA, 21 bp, Artificial sequence
  SiRNA target sequence
tttgtaataattgtacacaat

SEQ ID NO: 54684 - DNA, 21 bp, Artificial sequence
  SiRNA target sequence
ttgtaataattgtacacaatc

SEQ ID NO: 54685 - DNA, 21 bp, Artificial sequence
  SiRNA target sequence
tgtaataattgtacacaatct

SEQ ID NO: 54686 - DNA, 21 bp, Artificial sequence
  SiRNA target sequence
gtaataattgtacacaatcta

SEQ ID NO: 54687 - DNA, 21 bp, Artificial sequence
  SiRNA target sequence
taataattgtacacaatctag

SEQ ID NO: 54688 - DNA, 21 bp, Artificial sequence
  SiRNA target sequence
aataattgtacacaatctaga

SEQ ID NO: 54689 - DNA, 21 bp, Artificial sequence
  SiRNA target sequence
ataattgtacacaatctagaa

SEQ ID NO: 54690 - DNA, 21 bp, Artificial sequence
  SiRNA target sequence
taattgtacacaatctagaat

SEQ ID NO: 54691 - DNA, 21 bp, Artificial sequence
  SiRNA target sequence
aattgtacacaatctagaatt

SEQ ID NO: 54692 - DNA, 21 bp, Artificial sequence
  SiRNA target sequence
attgtacacaatctagaatta

SEQ ID NO: 54693 - DNA, 21 bp, Artificial sequence
  SiRNA target sequence
ttgtacacaatctagaattat

SEQ ID NO: 54694 - DNA, 21 bp, Artificial sequence
  SiRNA target sequence
tgtacacaatctagaattatt

SEQ ID NO: 54695 - DNA, 21 bp, Artificial sequence
  SiRNA target sequence
gtacacaatctagaattattg

SEQ ID NO: 54696 - DNA, 21 bp, Artificial sequence
  SiRNA target sequence
tacacaatctagaattattgg

SEQ ID NO: 54697 - DNA, 21 bp, Artificial sequence
  SiRNA target sequence
acacaatctagaattattggc

SEQ ID NO: 54698 - DNA, 21 bp, Artificial sequence
  SiRNA target sequence
cacaatctagaattattggct

SEQ ID NO: 54699 - DNA, 21 bp, Artificial sequence
  SiRNA target sequence
acaatctagaattattggctt

SEQ ID NO: 54700 - DNA, 21 bp, Artificial sequence
  SiRNA target sequence
caatctagaattattggcttt

SEQ ID NO: 54701 - DNA, 21 bp, Artificial sequence
  SiRNA target sequence
aatctagaattattggctttg

SEQ ID NO: 54702 - DNA, 21 bp, Artificial sequence
  SiRNA target sequence
atctagaattattggctttgt

SEQ ID NO: 54703 - DNA, 21 bp, Artificial sequence
  SiRNA target sequence
tctagaattattggctttgtt

SEQ ID NO: 54704 - DNA, 21 bp, Artificial sequence
  SiRNA target sequence
ctagaattattggctttgttt

SEQ ID NO: 54705 - DNA, 21 bp, Artificial sequence
  SiRNA target sequence
tagaattattggctttgtttg

SEQ ID NO: 54706 - DNA, 21 bp, Artificial sequence
  SiRNA target sequence
agaattattggctttgtttga

SEQ ID NO: 54707 - DNA, 21 bp, Artificial sequence
  SiRNA target sequence
gaattattggctttgtttgat

SEQ ID NO: 54708 - DNA, 21 bp, Artificial sequence
  SiRNA target sequence
aattattggctttgtttgata

SEQ ID NO: 54709 - DNA, 21 bp, Artificial sequence
  SiRNA target sequence
attattggctttgtttgataa

SEQ ID NO: 54710 - DNA, 21 bp, Artificial sequence
  SiRNA target sequence
ttattggctttgtttgataaa

SEQ ID NO: 54711 - DNA, 21 bp, Artificial sequence
  SiRNA target sequence
tattggctttgtttgataaaa

SEQ ID NO: 54712 - DNA, 21 bp, Artificial sequence
  SiRNA target sequence
attggctttgtttgataaaat

SEQ ID NO: 54713 - DNA, 21 bp, Artificial sequence
  SiRNA target sequence
ttggctttgtttgataaaatt

SEQ ID NO: 54714 - DNA, 21 bp, Artificial sequence
  SiRNA target sequence
tggctttgtttgataaaattt

SEQ ID NO: 54715 - DNA, 21 bp, Artificial sequence
  SiRNA target sequence
ggctttgtttgataaaatttt

SEQ ID NO: 54716 - DNA, 21 bp, Artificial sequence
  SiRNA target sequence
gctttgtttgataaaatttta

SEQ ID NO: 54717 - DNA, 21 bp, Artificial sequence
  SiRNA target sequence
ctttgtttgataaaattttat

SEQ ID NO: 54718 - DNA, 21 bp, Artificial sequence
  SiRNA target sequence
tttgtttgataaaattttatt

SEQ ID NO: 54719 - DNA, 21 bp, Artificial sequence
  SiRNA target sequence
ttgtttgataaaattttattt

SEQ ID NO: 54720 - DNA, 21 bp, Artificial sequence
  SiRNA target sequence
tgtttgataaaattttatttg

SEQ ID NO: 54721 - DNA, 21 bp, Artificial sequence
  SiRNA target sequence
gtttgataaaattttatttgt

SEQ ID NO: 54722 - DNA, 21 bp, Artificial sequence
  SiRNA target sequence
tttgataaaattttatttgta

SEQ ID NO: 54723 - DNA, 21 bp, Artificial sequence
  SiRNA target sequence
ttgataaaattttatttgtaa

SEQ ID NO: 54724 - DNA, 21 bp, Artificial sequence
  SiRNA target sequence
tgataaaattttatttgtaaa

SEQ ID NO: 54725 - DNA, 21 bp, Artificial sequence
  SiRNA target sequence
gataaaattttatttgtaaat

SEQ ID NO: 54726 - DNA, 21 bp, Artificial sequence
  SiRNA target sequence
ataaaattttatttgtaaatg

SEQ ID NO: 54727 - DNA, 21 bp, Artificial sequence
  SiRNA target sequence
taaaattttatttgtaaatgg

SEQ ID NO: 54728 - DNA, 21 bp, Artificial sequence
  SiRNA target sequence
aaaattttatttgtaaatggt

SEQ ID NO: 54729 - DNA, 21 bp, Artificial sequence
  SiRNA target sequence
aaattttatttgtaaatggta

SEQ ID NO: 54730 - DNA, 21 bp, Artificial sequence
  SiRNA target sequence
aattttatttgtaaatggtaa

SEQ ID NO: 54731 - DNA, 21 bp, Artificial sequence
  SiRNA target sequence
attttatttgtaaatggtaat

SEQ ID NO: 54732 - DNA, 21 bp, Artificial sequence
  SiRNA target sequence
ttttatttgtaaatggtaatg

SEQ ID NO: 54733 - DNA, 21 bp, Artificial sequence
  SiRNA target sequence
tttatttgtaaatggtaatga

SEQ ID NO: 54734 - DNA, 21 bp, Artificial sequence
  SiRNA target sequence
ttatttgtaaatggtaatgag

SEQ ID NO: 54735 - DNA, 21 bp, Artificial sequence
  SiRNA target sequence
tatttgtaaatggtaatgagg

SEQ ID NO: 54736 - DNA, 21 bp, Artificial sequence
  SiRNA target sequence
atttgtaaatggtaatgaggt

SEQ ID NO: 54737 - DNA, 21 bp, Artificial sequence
  SiRNA target sequence
tttgtaaatggtaatgaggta

SEQ ID NO: 54738 - DNA, 21 bp, Artificial sequence
  SiRNA target sequence
ttgtaaatggtaatgaggtaa

SEQ ID NO: 54739 - DNA, 21 bp, Artificial sequence
  SiRNA target sequence
tgtaaatggtaatgaggtaac

SEQ ID NO: 54740 - DNA, 21 bp, Artificial sequence
  SiRNA target sequence
gtaaatggtaatgaggtaaca

SEQ ID NO: 54741 - DNA, 21 bp, Artificial sequence
  SiRNA target sequence
taaatggtaatgaggtaacaa

SEQ ID NO: 54742 - DNA, 21 bp, Artificial sequence
  SiRNA target sequence
aaatggtaatgaggtaacaat

SEQ ID NO: 54743 - DNA, 21 bp, Artificial sequence
  SiRNA target sequence
aatggtaatgaggtaacaatg

SEQ ID NO: 54744 - DNA, 21 bp, Artificial sequence
  SiRNA target sequence
atggtaatgaggtaacaatga

SEQ ID NO: 54745 - DNA, 21 bp, Artificial sequence
  SiRNA target sequence
tggtaatgaggtaacaatgat

SEQ ID NO: 54746 - DNA, 21 bp, Artificial sequence
  SiRNA target sequence
ggtaatgaggtaacaatgata

SEQ ID NO: 54747 - DNA, 21 bp, Artificial sequence
  SiRNA target sequence
gtaatgaggtaacaatgatag

SEQ ID NO: 54748 - DNA, 21 bp, Artificial sequence
  SiRNA target sequence
taatgaggtaacaatgataga

SEQ ID NO: 54749 - DNA, 21 bp, Artificial sequence
  SiRNA target sequence
aatgaggtaacaatgatagaa

SEQ ID NO: 54750 - DNA, 21 bp, Artificial sequence
  SiRNA target sequence
atgaggtaacaatgatagaag

SEQ ID NO: 54751 - DNA, 21 bp, Artificial sequence
  SiRNA target sequence
tgaggtaacaatgatagaaga

SEQ ID NO: 54752 - DNA, 21 bp, Artificial sequence
  SiRNA target sequence
gaggtaacaatgatagaagac

SEQ ID NO: 54753 - DNA, 21 bp, Artificial sequence
  SiRNA target sequence
aggtaacaatgatagaagaca

SEQ ID NO: 54754 - DNA, 21 bp, Artificial sequence
  SiRNA target sequence
ggtaacaatgatagaagacat

SEQ ID NO: 54755 - DNA, 21 bp, Artificial sequence
  SiRNA target sequence
gtaacaatgatagaagacatt

SEQ ID NO: 54756 - DNA, 21 bp, Artificial sequence
  SiRNA target sequence
taacaatgatagaagacatta

SEQ ID NO: 54757 - DNA, 21 bp, Artificial sequence
  SiRNA target sequence
aacaatgatagaagacattaa

SEQ ID NO: 54758 - DNA, 21 bp, Artificial sequence
  SiRNA target sequence
acaatgatagaagacattaac

SEQ ID NO: 54759 - DNA, 21 bp, Artificial sequence
  SiRNA target sequence
caatgatagaagacattaaca

SEQ ID NO: 54760 - DNA, 21 bp, Artificial sequence
  SiRNA target sequence
aatgatagaagacattaacaa

SEQ ID NO: 54761 - DNA, 21 bp, Artificial sequence
  SiRNA target sequence
atgatagaagacattaacaaa

SEQ ID NO: 54762 - DNA, 21 bp, Artificial sequence
  SiRNA target sequence
tgatagaagacattaacaaaa

SEQ ID NO: 54763 - DNA, 21 bp, Artificial sequence
  SiRNA target sequence
gatagaagacattaacaaaaa

SEQ ID NO: 54764 - DNA, 21 bp, Artificial sequence
  SiRNA target sequence
atagaagacattaacaaaaaa

SEQ ID NO: 54765 - DNA, 21 bp, Artificial sequence
  SiRNA target sequence
tagaagacattaacaaaaaac

SEQ ID NO: 54766 - DNA, 21 bp, Artificial sequence
  SiRNA target sequence
agaagacattaacaaaaaact

SEQ ID NO: 54767 - DNA, 21 bp, Artificial sequence
  SiRNA target sequence
gaagacattaacaaaaaactt

SEQ ID NO: 54768 - DNA, 21 bp, Artificial sequence
  SiRNA target sequence
aagacattaacaaaaaacttg

SEQ ID NO: 54769 - DNA, 21 bp, Artificial sequence
  SiRNA target sequence
agacattaacaaaaaacttga

SEQ ID NO: 54770 - DNA, 21 bp, Artificial sequence
  SiRNA target sequence
gacattaacaaaaaacttgaa

SEQ ID NO: 54771 - DNA, 21 bp, Artificial sequence
  SiRNA target sequence
acattaacaaaaaacttgaag

SEQ ID NO: 54772 - DNA, 21 bp, Artificial sequence
  SiRNA target sequence
cattaacaaaaaacttgaaga

SEQ ID NO: 54773 - DNA, 21 bp, Artificial sequence
  SiRNA target sequence
attaacaaaaaacttgaagaa

SEQ ID NO: 54774 - DNA, 21 bp, Artificial sequence
  SiRNA target sequence
ttaacaaaaaacttgaagaaa

SEQ ID NO: 54775 - DNA, 21 bp, Artificial sequence
  SiRNA target sequence
taacaaaaaacttgaagaaaa

SEQ ID NO: 54776 - DNA, 21 bp, Artificial sequence
  SiRNA target sequence
aacaaaaaacttgaagaaaat

SEQ ID NO: 54777 - DNA, 21 bp, Artificial sequence
  SiRNA target sequence
acaaaaaacttgaagaaaatt

SEQ ID NO: 54778 - DNA, 21 bp, Artificial sequence
  SiRNA target sequence
caaaaaacttgaagaaaattc

SEQ ID NO: 54779 - DNA, 21 bp, Artificial sequence
  SiRNA target sequence
aaaaaacttgaagaaaattca

SEQ ID NO: 54780 - DNA, 21 bp, Artificial sequence
  SiRNA target sequence
aaaaacttgaagaaaattcaa

SEQ ID NO: 54781 - DNA, 21 bp, Artificial sequence
  SiRNA target sequence
aaaacttgaagaaaattcaaa

SEQ ID NO: 54782 - DNA, 21 bp, Artificial sequence
  SiRNA target sequence
aaacttgaagaaaattcaaag

SEQ ID NO: 54783 - DNA, 21 bp, Artificial sequence
  SiRNA target sequence
aacttgaagaaaattcaaagt

SEQ ID NO: 54784 - DNA, 21 bp, Artificial sequence
  SiRNA target sequence
acttgaagaaaattcaaagta

SEQ ID NO: 54785 - DNA, 21 bp, Artificial sequence
  SiRNA target sequence
cttgaagaaaattcaaagtat

SEQ ID NO: 54786 - DNA, 21 bp, Artificial sequence
  SiRNA target sequence
ttgaagaaaattcaaagtatt

SEQ ID NO: 54787 - DNA, 21 bp, Artificial sequence
  SiRNA target sequence
tgaagaaaattcaaagtattt

SEQ ID NO: 54788 - DNA, 21 bp, Artificial sequence
  SiRNA target sequence
gaagaaaattcaaagtatttt

SEQ ID NO: 54789 - DNA, 21 bp, Artificial sequence
  SiRNA target sequence
aagaaaattcaaagtattttg

SEQ ID NO: 54790 - DNA, 21 bp, Artificial sequence
  SiRNA target sequence
agaaaattcaaagtattttgc

SEQ ID NO: 54791 - DNA, 21 bp, Artificial sequence
  SiRNA target sequence
gaaaattcaaagtattttgca

SEQ ID NO: 54792 - DNA, 21 bp, Artificial sequence
  SiRNA target sequence
aaaattcaaagtattttgcag

SEQ ID NO: 54793 - DNA, 21 bp, Artificial sequence
  SiRNA target sequence
aaattcaaagtattttgcaga

SEQ ID NO: 54794 - DNA, 21 bp, Artificial sequence
  SiRNA target sequence
aattcaaagtattttgcagat

SEQ ID NO: 54795 - DNA, 21 bp, Artificial sequence
  SiRNA target sequence
attcaaagtattttgcagata

SEQ ID NO: 54796 - DNA, 21 bp, Artificial sequence
  SiRNA target sequence
ttcaaagtattttgcagatat

SEQ ID NO: 54797 - DNA, 21 bp, Artificial sequence
  SiRNA target sequence
tcaaagtattttgcagatatt

SEQ ID NO: 54798 - DNA, 21 bp, Artificial sequence
  SiRNA target sequence
caaagtattttgcagatattt

SEQ ID NO: 54799 - DNA, 21 bp, Artificial sequence
  SiRNA target sequence
aaagtattttgcagatatttt

SEQ ID NO: 54800 - DNA, 21 bp, Artificial sequence
  SiRNA target sequence
aagtattttgcagatatttta

SEQ ID NO: 54801 - DNA, 21 bp, Artificial sequence
  SiRNA target sequence
agtattttgcagatattttaa

SEQ ID NO: 54802 - DNA, 21 bp, Artificial sequence
  SiRNA target sequence
gtattttgcagatattttaaa

SEQ ID NO: 54803 - DNA, 21 bp, Artificial sequence
  SiRNA target sequence
tattttgcagatattttaaac

SEQ ID NO: 54804 - DNA, 21 bp, Artificial sequence
  SiRNA target sequence
attttgcagatattttaaaca

SEQ ID NO: 54805 - DNA, 21 bp, Artificial sequence
  SiRNA target sequence
ttttgcagatattttaaacaa

SEQ ID NO: 54806 - DNA, 21 bp, Artificial sequence
  SiRNA target sequence
tttgcagatattttaaacaac

SEQ ID NO: 54807 - DNA, 21 bp, Artificial sequence
  SiRNA target sequence
ttgcagatattttaaacaacg

SEQ ID NO: 54808 - DNA, 21 bp, Artificial sequence
  SiRNA target sequence
tgcagatattttaaacaacga

SEQ ID NO: 54809 - DNA, 21 bp, Artificial sequence
  SiRNA target sequence
gcagatattttaaacaacgaa

SEQ ID NO: 54810 - DNA, 21 bp, Artificial sequence
  SiRNA target sequence
cagatattttaaacaacgaat

SEQ ID NO: 54811 - DNA, 21 bp, Artificial sequence
  SiRNA target sequence
agatattttaaacaacgaata

SEQ ID NO: 54812 - DNA, 21 bp, Artificial sequence
  SiRNA target sequence
gatattttaaacaacgaataa

SEQ ID NO: 54813 - DNA, 22 bp, Artificial sequence
  SiRNA target sequence
atgaaggaaaaaaccaattatg

SEQ ID NO: 54814 - DNA, 22 bp, Artificial sequence
  SiRNA target sequence
tgaaggaaaaaaccaattatga

SEQ ID NO: 54815 - DNA, 22 bp, Artificial sequence
  SiRNA target sequence
gaaggaaaaaaccaattatgaa

SEQ ID NO: 54816 - DNA, 22 bp, Artificial sequence
  SiRNA target sequence
aaggaaaaaaccaattatgaaa

SEQ ID NO: 54817 - DNA, 22 bp, Artificial sequence
  SiRNA target sequence
aggaaaaaaccaattatgaaat

SEQ ID NO: 54818 - DNA, 22 bp, Artificial sequence
  SiRNA target sequence
ggaaaaaaccaattatgaaatt

SEQ ID NO: 54819 - DNA, 22 bp, Artificial sequence
  SiRNA target sequence
gaaaaaaccaattatgaaattt

SEQ ID NO: 54820 - DNA, 22 bp, Artificial sequence
  SiRNA target sequence
aaaaaaccaattatgaaatttt

SEQ ID NO: 54821 - DNA, 22 bp, Artificial sequence
  SiRNA target sequence
aaaaaccaattatgaaatttta

SEQ ID NO: 54822 - DNA, 22 bp, Artificial sequence
  SiRNA target sequence
aaaaccaattatgaaattttat

SEQ ID NO: 54823 - DNA, 22 bp, Artificial sequence
  SiRNA target sequence
aaaccaattatgaaattttata

SEQ ID NO: 54824 - DNA, 22 bp, Artificial sequence
  SiRNA target sequence
aaccaattatgaaattttatat

SEQ ID NO: 54825 - DNA, 22 bp, Artificial sequence
  SiRNA target sequence
accaattatgaaattttatatg

SEQ ID NO: 54826 - DNA, 22 bp, Artificial sequence
  SiRNA target sequence
ccaattatgaaattttatatga

SEQ ID NO: 54827 - DNA, 22 bp, Artificial sequence
  SiRNA target sequence
caattatgaaattttatatgat

SEQ ID NO: 54828 - DNA, 22 bp, Artificial sequence
  SiRNA target sequence
aattatgaaattttatatgata

SEQ ID NO: 54829 - DNA, 22 bp, Artificial sequence
  SiRNA target sequence
attatgaaattttatatgatac

SEQ ID NO: 54830 - DNA, 22 bp, Artificial sequence
  SiRNA target sequence
ttatgaaattttatatgataca

SEQ ID NO: 54831 - DNA, 22 bp, Artificial sequence
  SiRNA target sequence
tatgaaattttatatgatacat

SEQ ID NO: 54832 - DNA, 22 bp, Artificial sequence
  SiRNA target sequence
atgaaattttatatgatacatt

SEQ ID NO: 54833 - DNA, 22 bp, Artificial sequence
  SiRNA target sequence
tgaaattttatatgatacattt

SEQ ID NO: 54834 - DNA, 22 bp, Artificial sequence
  SiRNA target sequence
gaaattttatatgatacatttg

SEQ ID NO: 54835 - DNA, 22 bp, Artificial sequence
  SiRNA target sequence
aaattttatatgatacatttgt

SEQ ID NO: 54836 - DNA, 22 bp, Artificial sequence
  SiRNA target sequence
aattttatatgatacatttgta

SEQ ID NO: 54837 - DNA, 22 bp, Artificial sequence
  SiRNA target sequence
attttatatgatacatttgtaa

SEQ ID NO: 54838 - DNA, 22 bp, Artificial sequence
  SiRNA target sequence
ttttatatgatacatttgtaaa

SEQ ID NO: 54839 - DNA, 22 bp, Artificial sequence
  SiRNA target sequence
tttatatgatacatttgtaaaa

SEQ ID NO: 54840 - DNA, 22 bp, Artificial sequence
  SiRNA target sequence
ttatatgatacatttgtaaaat

SEQ ID NO: 54841 - DNA, 22 bp, Artificial sequence
  SiRNA target sequence
tatatgatacatttgtaaaata

SEQ ID NO: 54842 - DNA, 22 bp, Artificial sequence
  SiRNA target sequence
atatgatacatttgtaaaatat

SEQ ID NO: 54843 - DNA, 22 bp, Artificial sequence
  SiRNA target sequence
tatgatacatttgtaaaatatt

SEQ ID NO: 54844 - DNA, 22 bp, Artificial sequence
  SiRNA target sequence
atgatacatttgtaaaatattg

SEQ ID NO: 54845 - DNA, 22 bp, Artificial sequence
  SiRNA target sequence
tgatacatttgtaaaatattgt

SEQ ID NO: 54846 - DNA, 22 bp, Artificial sequence
  SiRNA target sequence
gatacatttgtaaaatattgtt

SEQ ID NO: 54847 - DNA, 22 bp, Artificial sequence
  SiRNA target sequence
atacatttgtaaaatattgtta

SEQ ID NO: 54848 - DNA, 22 bp, Artificial sequence
  SiRNA target sequence
tacatttgtaaaatattgttac

SEQ ID NO: 54849 - DNA, 22 bp, Artificial sequence
  SiRNA target sequence
acatttgtaaaatattgttaca

SEQ ID NO: 54850 - DNA, 22 bp, Artificial sequence
  SiRNA target sequence
catttgtaaaatattgttacaa

SEQ ID NO: 54851 - DNA, 22 bp, Artificial sequence
  SiRNA target sequence
atttgtaaaatattgttacaat

SEQ ID NO: 54852 - DNA, 22 bp, Artificial sequence
  SiRNA target sequence
tttgtaaaatattgttacaata

SEQ ID NO: 54853 - DNA, 22 bp, Artificial sequence
  SiRNA target sequence
ttgtaaaatattgttacaatat

SEQ ID NO: 54854 - DNA, 22 bp, Artificial sequence
  SiRNA target sequence
tgtaaaatattgttacaatatt

SEQ ID NO: 54855 - DNA, 22 bp, Artificial sequence
  SiRNA target sequence
gtaaaatattgttacaatattt

SEQ ID NO: 54856 - DNA, 22 bp, Artificial sequence
  SiRNA target sequence
taaaatattgttacaatatttc

SEQ ID NO: 54857 - DNA, 22 bp, Artificial sequence
  SiRNA target sequence
aaaatattgttacaatatttcc

SEQ ID NO: 54858 - DNA, 22 bp, Artificial sequence
  SiRNA target sequence
aaatattgttacaatatttcct

SEQ ID NO: 54859 - DNA, 22 bp, Artificial sequence
  SiRNA target sequence
aatattgttacaatatttccta

SEQ ID NO: 54860 - DNA, 22 bp, Artificial sequence
  SiRNA target sequence
atattgttacaatatttcctat

SEQ ID NO: 54861 - DNA, 22 bp, Artificial sequence
  SiRNA target sequence
tattgttacaatatttcctata

SEQ ID NO: 54862 - DNA, 22 bp, Artificial sequence
  SiRNA target sequence
attgttacaatatttcctatat

SEQ ID NO: 54863 - DNA, 22 bp, Artificial sequence
  SiRNA target sequence
ttgttacaatatttcctatata

SEQ ID NO: 54864 - DNA, 22 bp, Artificial sequence
  SiRNA target sequence
tgttacaatatttcctatataa

SEQ ID NO: 54865 - DNA, 22 bp, Artificial sequence
  SiRNA target sequence
gttacaatatttcctatataag

SEQ ID NO: 54866 - DNA, 22 bp, Artificial sequence
  SiRNA target sequence
ttacaatatttcctatataagg

SEQ ID NO: 54867 - DNA, 22 bp, Artificial sequence
  SiRNA target sequence
tacaatatttcctatataaggt

SEQ ID NO: 54868 - DNA, 22 bp, Artificial sequence
  SiRNA target sequence
acaatatttcctatataaggta

SEQ ID NO: 54869 - DNA, 22 bp, Artificial sequence
  SiRNA target sequence
caatatttcctatataaggtac

SEQ ID NO: 54870 - DNA, 22 bp, Artificial sequence
  SiRNA target sequence
aatatttcctatataaggtacg

SEQ ID NO: 54871 - DNA, 22 bp, Artificial sequence
  SiRNA target sequence
atatttcctatataaggtacgt

SEQ ID NO: 54872 - DNA, 22 bp, Artificial sequence
  SiRNA target sequence
tatttcctatataaggtacgta

SEQ ID NO: 54873 - DNA, 22 bp, Artificial sequence
  SiRNA target sequence
atttcctatataaggtacgtaa

SEQ ID NO: 54874 - DNA, 22 bp, Artificial sequence
  SiRNA target sequence
tttcctatataaggtacgtaat

SEQ ID NO: 54875 - DNA, 22 bp, Artificial sequence
  SiRNA target sequence
ttcctatataaggtacgtaatg

SEQ ID NO: 54876 - DNA, 22 bp, Artificial sequence
  SiRNA target sequence
tcctatataaggtacgtaatgt

SEQ ID NO: 54877 - DNA, 22 bp, Artificial sequence
  SiRNA target sequence
cctatataaggtacgtaatgtt

SEQ ID NO: 54878 - DNA, 22 bp, Artificial sequence
  SiRNA target sequence
ctatataaggtacgtaatgttt

SEQ ID NO: 54879 - DNA, 22 bp, Artificial sequence
  SiRNA target sequence
tatataaggtacgtaatgtttc

SEQ ID NO: 54880 - DNA, 22 bp, Artificial sequence
  SiRNA target sequence
atataaggtacgtaatgtttcc

SEQ ID NO: 54881 - DNA, 22 bp, Artificial sequence
  SiRNA target sequence
tataaggtacgtaatgtttccc

SEQ ID NO: 54882 - DNA, 22 bp, Artificial sequence
  SiRNA target sequence
ataaggtacgtaatgtttccca

SEQ ID NO: 54883 - DNA, 22 bp, Artificial sequence
  SiRNA target sequence
taaggtacgtaatgtttcccat

SEQ ID NO: 54884 - DNA, 22 bp, Artificial sequence
  SiRNA target sequence
aaggtacgtaatgtttcccata

SEQ ID NO: 54885 - DNA, 22 bp, Artificial sequence
  SiRNA target sequence
aggtacgtaatgtttcccatat

SEQ ID NO: 54886 - DNA, 22 bp, Artificial sequence
  SiRNA target sequence
ggtacgtaatgtttcccatatt

SEQ ID NO: 54887 - DNA, 22 bp, Artificial sequence
  SiRNA target sequence
gtacgtaatgtttcccatatta

SEQ ID NO: 54888 - DNA, 22 bp, Artificial sequence
  SiRNA target sequence
tacgtaatgtttcccatattac

SEQ ID NO: 54889 - DNA, 22 bp, Artificial sequence
  SiRNA target sequence
acgtaatgtttcccatattact

SEQ ID NO: 54890 - DNA, 22 bp, Artificial sequence
  SiRNA target sequence
cgtaatgtttcccatattactg

SEQ ID NO: 54891 - DNA, 22 bp, Artificial sequence
  SiRNA target sequence
gtaatgtttcccatattactgt

SEQ ID NO: 54892 - DNA, 22 bp, Artificial sequence
  SiRNA target sequence
taatgtttcccatattactgtc

SEQ ID NO: 54893 - DNA, 22 bp, Artificial sequence
  SiRNA target sequence
aatgtttcccatattactgtct

SEQ ID NO: 54894 - DNA, 22 bp, Artificial sequence
  SiRNA target sequence
atgtttcccatattactgtcta

SEQ ID NO: 54895 - DNA, 22 bp, Artificial sequence
  SiRNA target sequence
tgtttcccatattactgtctac

SEQ ID NO: 54896 - DNA, 22 bp, Artificial sequence
  SiRNA target sequence
gtttcccatattactgtctaca

SEQ ID NO: 54897 - DNA, 22 bp, Artificial sequence
  SiRNA target sequence
tttcccatattactgtctacaa

SEQ ID NO: 54898 - DNA, 22 bp, Artificial sequence
  SiRNA target sequence
ttcccatattactgtctacaat

SEQ ID NO: 54899 - DNA, 22 bp, Artificial sequence
  SiRNA target sequence
tcccatattactgtctacaatt

SEQ ID NO: 54900 - DNA, 22 bp, Artificial sequence
  SiRNA target sequence
cccatattactgtctacaatta

SEQ ID NO: 54901 - DNA, 22 bp, Artificial sequence
  SiRNA target sequence
ccatattactgtctacaattat

SEQ ID NO: 54902 - DNA, 22 bp, Artificial sequence
  SiRNA target sequence
catattactgtctacaattata

SEQ ID NO: 54903 - DNA, 22 bp, Artificial sequence
  SiRNA target sequence
atattactgtctacaattatag

SEQ ID NO: 54904 - DNA, 22 bp, Artificial sequence
  SiRNA target sequence
tattactgtctacaattatagc

SEQ ID NO: 54905 - DNA, 22 bp, Artificial sequence
  SiRNA target sequence
attactgtctacaattatagct

SEQ ID NO: 54906 - DNA, 22 bp, Artificial sequence
  SiRNA target sequence
ttactgtctacaattatagctt

SEQ ID NO: 54907 - DNA, 22 bp, Artificial sequence
  SiRNA target sequence
tactgtctacaattatagcttg

SEQ ID NO: 54908 - DNA, 22 bp, Artificial sequence
  SiRNA target sequence
actgtctacaattatagcttgt

SEQ ID NO: 54909 - DNA, 22 bp, Artificial sequence
  SiRNA target sequence
ctgtctacaattatagcttgtt

SEQ ID NO: 54910 - DNA, 22 bp, Artificial sequence
  SiRNA target sequence
tgtctacaattatagcttgtta

SEQ ID NO: 54911 - DNA, 22 bp, Artificial sequence
  SiRNA target sequence
gtctacaattatagcttgttat

SEQ ID NO: 54912 - DNA, 22 bp, Artificial sequence
  SiRNA target sequence
tctacaattatagcttgttatc

SEQ ID NO: 54913 - DNA, 22 bp, Artificial sequence
  SiRNA target sequence
ctacaattatagcttgttatct

SEQ ID NO: 54914 - DNA, 22 bp, Artificial sequence
  SiRNA target sequence
tacaattatagcttgttatctc

SEQ ID NO: 54915 - DNA, 22 bp, Artificial sequence
  SiRNA target sequence
acaattatagcttgttatctcg

SEQ ID NO: 54916 - DNA, 22 bp, Artificial sequence
  SiRNA target sequence
caattatagcttgttatctcga

SEQ ID NO: 54917 - DNA, 22 bp, Artificial sequence
  SiRNA target sequence
aattatagcttgttatctcgaa

SEQ ID NO: 54918 - DNA, 22 bp, Artificial sequence
  SiRNA target sequence
attatagcttgttatctcgaag

SEQ ID NO: 54919 - DNA, 22 bp, Artificial sequence
  SiRNA target sequence
ttatagcttgttatctcgaagt

SEQ ID NO: 54920 - DNA, 22 bp, Artificial sequence
  SiRNA target sequence
tatagcttgttatctcgaagtt

SEQ ID NO: 54921 - DNA, 22 bp, Artificial sequence
  SiRNA target sequence
atagcttgttatctcgaagttc

SEQ ID NO: 54922 - DNA, 22 bp, Artificial sequence
  SiRNA target sequence
tagcttgttatctcgaagttca

SEQ ID NO: 54923 - DNA, 22 bp, Artificial sequence
  SiRNA target sequence
agcttgttatctcgaagttcag

SEQ ID NO: 54924 - DNA, 22 bp, Artificial sequence
  SiRNA target sequence
gcttgttatctcgaagttcagg

SEQ ID NO: 54925 - DNA, 22 bp, Artificial sequence
  SiRNA target sequence
cttgttatctcgaagttcaggc

SEQ ID NO: 54926 - DNA, 22 bp, Artificial sequence
  SiRNA target sequence
ttgttatctcgaagttcaggca

SEQ ID NO: 54927 - DNA, 22 bp, Artificial sequence
  SiRNA target sequence
tgttatctcgaagttcaggcaa

SEQ ID NO: 54928 - DNA, 22 bp, Artificial sequence
  SiRNA target sequence
gttatctcgaagttcaggcaag

SEQ ID NO: 54929 - DNA, 22 bp, Artificial sequence
  SiRNA target sequence
ttatctcgaagttcaggcaagt

SEQ ID NO: 54930 - DNA, 22 bp, Artificial sequence
  SiRNA target sequence
tatctcgaagttcaggcaagta

SEQ ID NO: 54931 - DNA, 22 bp, Artificial sequence
  SiRNA target sequence
atctcgaagttcaggcaagtaa

SEQ ID NO: 54932 - DNA, 22 bp, Artificial sequence
  SiRNA target sequence
tctcgaagttcaggcaagtaac

SEQ ID NO: 54933 - DNA, 22 bp, Artificial sequence
  SiRNA target sequence
ctcgaagttcaggcaagtaaca

SEQ ID NO: 54934 - DNA, 22 bp, Artificial sequence
  SiRNA target sequence
tcgaagttcaggcaagtaacat

SEQ ID NO: 54935 - DNA, 22 bp, Artificial sequence
  SiRNA target sequence
cgaagttcaggcaagtaacata

SEQ ID NO: 54936 - DNA, 22 bp, Artificial sequence
  SiRNA target sequence
gaagttcaggcaagtaacatat

SEQ ID NO: 54937 - DNA, 22 bp, Artificial sequence
  SiRNA target sequence
aagttcaggcaagtaacatatc

SEQ ID NO: 54938 - DNA, 22 bp, Artificial sequence
  SiRNA target sequence
agttcaggcaagtaacatatca

SEQ ID NO: 54939 - DNA, 22 bp, Artificial sequence
  SiRNA target sequence
gttcaggcaagtaacatatcaa

SEQ ID NO: 54940 - DNA, 22 bp, Artificial sequence
  SiRNA target sequence
ttcaggcaagtaacatatcaaa

SEQ ID NO: 54941 - DNA, 22 bp, Artificial sequence
  SiRNA target sequence
tcaggcaagtaacatatcaaaa

SEQ ID NO: 54942 - DNA, 22 bp, Artificial sequence
  SiRNA target sequence
caggcaagtaacatatcaaaaa

SEQ ID NO: 54943 - DNA, 22 bp, Artificial sequence
  SiRNA target sequence
aggcaagtaacatatcaaaaag

SEQ ID NO: 54944 - DNA, 22 bp, Artificial sequence
  SiRNA target sequence
ggcaagtaacatatcaaaaaga

SEQ ID NO: 54945 - DNA, 22 bp, Artificial sequence
  SiRNA target sequence
gcaagtaacatatcaaaaagaa

SEQ ID NO: 54946 - DNA, 22 bp, Artificial sequence
  SiRNA target sequence
caagtaacatatcaaaaagaat

SEQ ID NO: 54947 - DNA, 22 bp, Artificial sequence
  SiRNA target sequence
aagtaacatatcaaaaagaatt

SEQ ID NO: 54948 - DNA, 22 bp, Artificial sequence
  SiRNA target sequence
agtaacatatcaaaaagaattg

SEQ ID NO: 54949 - DNA, 22 bp, Artificial sequence
  SiRNA target sequence
gtaacatatcaaaaagaattgc

SEQ ID NO: 54950 - DNA, 22 bp, Artificial sequence
  SiRNA target sequence
taacatatcaaaaagaattgca

SEQ ID NO: 54951 - DNA, 22 bp, Artificial sequence
  SiRNA target sequence
aacatatcaaaaagaattgcag

SEQ ID NO: 54952 - DNA, 22 bp, Artificial sequence
  SiRNA target sequence
acatatcaaaaagaattgcaga

SEQ ID NO: 54953 - DNA, 22 bp, Artificial sequence
  SiRNA target sequence
catatcaaaaagaattgcagaa

SEQ ID NO: 54954 - DNA, 22 bp, Artificial sequence
  SiRNA target sequence
atatcaaaaagaattgcagaag

SEQ ID NO: 54955 - DNA, 22 bp, Artificial sequence
  SiRNA target sequence
tatcaaaaagaattgcagaaga

SEQ ID NO: 54956 - DNA, 22 bp, Artificial sequence
  SiRNA target sequence
atcaaaaagaattgcagaagat

SEQ ID NO: 54957 - DNA, 22 bp, Artificial sequence
  SiRNA target sequence
tcaaaaagaattgcagaagatt

SEQ ID NO: 54958 - DNA, 22 bp, Artificial sequence
  SiRNA target sequence
caaaaagaattgcagaagattt

SEQ ID NO: 54959 - DNA, 22 bp, Artificial sequence
  SiRNA target sequence
aaaaagaattgcagaagatttt

SEQ ID NO: 54960 - DNA, 22 bp, Artificial sequence
  SiRNA target sequence
aaaagaattgcagaagattttg

SEQ ID NO: 54961 - DNA, 22 bp, Artificial sequence
  SiRNA target sequence
aaagaattgcagaagattttga

SEQ ID NO: 54962 - DNA, 22 bp, Artificial sequence
  SiRNA target sequence
aagaattgcagaagattttgaa

SEQ ID NO: 54963 - DNA, 22 bp, Artificial sequence
  SiRNA target sequence
agaattgcagaagattttgaaa

SEQ ID NO: 54964 - DNA, 22 bp, Artificial sequence
  SiRNA target sequence
gaattgcagaagattttgaaaa

SEQ ID NO: 54965 - DNA, 22 bp, Artificial sequence
  SiRNA target sequence
aattgcagaagattttgaaaat

SEQ ID NO: 54966 - DNA, 22 bp, Artificial sequence
  SiRNA target sequence
attgcagaagattttgaaaata

SEQ ID NO: 54967 - DNA, 22 bp, Artificial sequence
  SiRNA target sequence
ttgcagaagattttgaaaataa

SEQ ID NO: 54968 - DNA, 22 bp, Artificial sequence
  SiRNA target sequence
tgcagaagattttgaaaataaa

SEQ ID NO: 54969 - DNA, 22 bp, Artificial sequence
  SiRNA target sequence
gcagaagattttgaaaataaaa

SEQ ID NO: 54970 - DNA, 22 bp, Artificial sequence
  SiRNA target sequence
cagaagattttgaaaataaaat

SEQ ID NO: 54971 - DNA, 22 bp, Artificial sequence
  SiRNA target sequence
agaagattttgaaaataaaata

SEQ ID NO: 54972 - DNA, 22 bp, Artificial sequence
  SiRNA target sequence
gaagattttgaaaataaaataa

SEQ ID NO: 54973 - DNA, 22 bp, Artificial sequence
  SiRNA target sequence
aagattttgaaaataaaataaa

SEQ ID NO: 54974 - DNA, 22 bp, Artificial sequence
  SiRNA target sequence
agattttgaaaataaaataaat

SEQ ID NO: 54975 - DNA, 22 bp, Artificial sequence
  SiRNA target sequence
gattttgaaaataaaataaatg

SEQ ID NO: 54976 - DNA, 22 bp, Artificial sequence
  SiRNA target sequence
attttgaaaataaaataaatgc

SEQ ID NO: 54977 - DNA, 22 bp, Artificial sequence
  SiRNA target sequence
ttttgaaaataaaataaatgca

SEQ ID NO: 54978 - DNA, 22 bp, Artificial sequence
  SiRNA target sequence
tttgaaaataaaataaatgcag

SEQ ID NO: 54979 - DNA, 22 bp, Artificial sequence
  SiRNA target sequence
ttgaaaataaaataaatgcagg

SEQ ID NO: 54980 - DNA, 22 bp, Artificial sequence
  SiRNA target sequence
tgaaaataaaataaatgcagga

SEQ ID NO: 54981 - DNA, 22 bp, Artificial sequence
  SiRNA target sequence
gaaaataaaataaatgcaggaa

SEQ ID NO: 54982 - DNA, 22 bp, Artificial sequence
  SiRNA target sequence
aaaataaaataaatgcaggaaa

SEQ ID NO: 54983 - DNA, 22 bp, Artificial sequence
  SiRNA target sequence
aaataaaataaatgcaggaaaa

SEQ ID NO: 54984 - DNA, 22 bp, Artificial sequence
  SiRNA target sequence
aataaaataaatgcaggaaaaa

SEQ ID NO: 54985 - DNA, 22 bp, Artificial sequence
  SiRNA target sequence
ataaaataaatgcaggaaaaag

SEQ ID NO: 54986 - DNA, 22 bp, Artificial sequence
  SiRNA target sequence
taaaataaatgcaggaaaaagt

SEQ ID NO: 54987 - DNA, 22 bp, Artificial sequence
  SiRNA target sequence
aaaataaatgcaggaaaaagta

SEQ ID NO: 54988 - DNA, 22 bp, Artificial sequence
  SiRNA target sequence
aaataaatgcaggaaaaagtat

SEQ ID NO: 54989 - DNA, 22 bp, Artificial sequence
  SiRNA target sequence
aataaatgcaggaaaaagtata

SEQ ID NO: 54990 - DNA, 22 bp, Artificial sequence
  SiRNA target sequence
ataaatgcaggaaaaagtatat

SEQ ID NO: 54991 - DNA, 22 bp, Artificial sequence
  SiRNA target sequence
taaatgcaggaaaaagtatatt

SEQ ID NO: 54992 - DNA, 22 bp, Artificial sequence
  SiRNA target sequence
aaatgcaggaaaaagtatattt

SEQ ID NO: 54993 - DNA, 22 bp, Artificial sequence
  SiRNA target sequence
aatgcaggaaaaagtatattta

SEQ ID NO: 54994 - DNA, 22 bp, Artificial sequence
  SiRNA target sequence
atgcaggaaaaagtatatttaa

SEQ ID NO: 54995 - DNA, 22 bp, Artificial sequence
  SiRNA target sequence
tgcaggaaaaagtatatttaaa

SEQ ID NO: 54996 - DNA, 22 bp, Artificial sequence
  SiRNA target sequence
gcaggaaaaagtatatttaaat

SEQ ID NO: 54997 - DNA, 22 bp, Artificial sequence
  SiRNA target sequence
caggaaaaagtatatttaaata

SEQ ID NO: 54998 - DNA, 22 bp, Artificial sequence
  SiRNA target sequence
aggaaaaagtatatttaaatat

SEQ ID NO: 54999 - DNA, 22 bp, Artificial sequence
  SiRNA target sequence
ggaaaaagtatatttaaatata

SEQ ID NO: 55000 - DNA, 22 bp, Artificial sequence
  SiRNA target sequence
gaaaaagtatatttaaatatat

SEQ ID NO: 55001 - DNA, 22 bp, Artificial sequence
  SiRNA target sequence
aaaaagtatatttaaatatatt

SEQ ID NO: 55002 - DNA, 22 bp, Artificial sequence
  SiRNA target sequence
aaaagtatatttaaatatattt

SEQ ID NO: 55003 - DNA, 22 bp, Artificial sequence
  SiRNA target sequence
aaagtatatttaaatatatttt

SEQ ID NO: 55004 - DNA, 22 bp, Artificial sequence
  SiRNA target sequence
aagtatatttaaatatatttta

SEQ ID NO: 55005 - DNA, 22 bp, Artificial sequence
  SiRNA target sequence
agtatatttaaatatattttat

SEQ ID NO: 55006 - DNA, 22 bp, Artificial sequence
  SiRNA target sequence
gtatatttaaatatattttatt

SEQ ID NO: 55007 - DNA, 22 bp, Artificial sequence
  SiRNA target sequence
tatatttaaatatattttattt

SEQ ID NO: 55008 - DNA, 22 bp, Artificial sequence
  SiRNA target sequence
atatttaaatatattttatttt

SEQ ID NO: 55009 - DNA, 22 bp, Artificial sequence
  SiRNA target sequence
tatttaaatatattttattttt

SEQ ID NO: 55010 - DNA, 22 bp, Artificial sequence
  SiRNA target sequence
atttaaatatattttattttta

SEQ ID NO: 55011 - DNA, 22 bp, Artificial sequence
  SiRNA target sequence
tttaaatatattttatttttaa

SEQ ID NO: 55012 - DNA, 22 bp, Artificial sequence
  SiRNA target sequence
ttaaatatattttatttttaac

SEQ ID NO: 55013 - DNA, 22 bp, Artificial sequence
  SiRNA target sequence
taaatatattttatttttaact

SEQ ID NO: 55014 - DNA, 22 bp, Artificial sequence
  SiRNA target sequence
aaatatattttatttttaactt

SEQ ID NO: 55015 - DNA, 22 bp, Artificial sequence
  SiRNA target sequence
aatatattttatttttaacttc

SEQ ID NO: 55016 - DNA, 22 bp, Artificial sequence
  SiRNA target sequence
atatattttatttttaacttca

SEQ ID NO: 55017 - DNA, 22 bp, Artificial sequence
  SiRNA target sequence
tatattttatttttaacttcat

SEQ ID NO: 55018 - DNA, 22 bp, Artificial sequence
  SiRNA target sequence
atattttatttttaacttcatc

SEQ ID NO: 55019 - DNA, 22 bp, Artificial sequence
  SiRNA target sequence
tattttatttttaacttcatca

SEQ ID NO: 55020 - DNA, 22 bp, Artificial sequence
  SiRNA target sequence
attttatttttaacttcatcaa

SEQ ID NO: 55021 - DNA, 22 bp, Artificial sequence
  SiRNA target sequence
ttttatttttaacttcatcaat

SEQ ID NO: 55022 - DNA, 22 bp, Artificial sequence
  SiRNA target sequence
tttatttttaacttcatcaata

SEQ ID NO: 55023 - DNA, 22 bp, Artificial sequence
  SiRNA target sequence
ttatttttaacttcatcaatag

SEQ ID NO: 55024 - DNA, 22 bp, Artificial sequence
  SiRNA target sequence
tatttttaacttcatcaatagt

SEQ ID NO: 55025 - DNA, 22 bp, Artificial sequence
  SiRNA target sequence
atttttaacttcatcaatagta

SEQ ID NO: 55026 - DNA, 22 bp, Artificial sequence
  SiRNA target sequence
tttttaacttcatcaatagtat

SEQ ID NO: 55027 - DNA, 22 bp, Artificial sequence
  SiRNA target sequence
ttttaacttcatcaatagtatt

SEQ ID NO: 55028 - DNA, 22 bp, Artificial sequence
  SiRNA target sequence
tttaacttcatcaatagtatta

SEQ ID NO: 55029 - DNA, 22 bp, Artificial sequence
  SiRNA target sequence
ttaacttcatcaatagtattaa

SEQ ID NO: 55030 - DNA, 22 bp, Artificial sequence
  SiRNA target sequence
taacttcatcaatagtattaag

SEQ ID NO: 55031 - DNA, 22 bp, Artificial sequence
  SiRNA target sequence
aacttcatcaatagtattaaga

SEQ ID NO: 55032 - DNA, 22 bp, Artificial sequence
  SiRNA target sequence
acttcatcaatagtattaagac

SEQ ID NO: 55033 - DNA, 22 bp, Artificial sequence
  SiRNA target sequence
cttcatcaatagtattaagaca

SEQ ID NO: 55034 - DNA, 22 bp, Artificial sequence
  SiRNA target sequence
ttcatcaatagtattaagacaa

SEQ ID NO: 55035 - DNA, 22 bp, Artificial sequence
  SiRNA target sequence
tcatcaatagtattaagacaaa

SEQ ID NO: 55036 - DNA, 22 bp, Artificial sequence
  SiRNA target sequence
catcaatagtattaagacaaat

SEQ ID NO: 55037 - DNA, 22 bp, Artificial sequence
  SiRNA target sequence
atcaatagtattaagacaaatt

SEQ ID NO: 55038 - DNA, 22 bp, Artificial sequence
  SiRNA target sequence
tcaatagtattaagacaaatta

SEQ ID NO: 55039 - DNA, 22 bp, Artificial sequence
  SiRNA target sequence
caatagtattaagacaaattaa

SEQ ID NO: 55040 - DNA, 22 bp, Artificial sequence
  SiRNA target sequence
aatagtattaagacaaattaat

SEQ ID NO: 55041 - DNA, 22 bp, Artificial sequence
  SiRNA target sequence
atagtattaagacaaattaatg

SEQ ID NO: 55042 - DNA, 22 bp, Artificial sequence
  SiRNA target sequence
tagtattaagacaaattaatga

SEQ ID NO: 55043 - DNA, 22 bp, Artificial sequence
  SiRNA target sequence
agtattaagacaaattaatgat

SEQ ID NO: 55044 - DNA, 22 bp, Artificial sequence
  SiRNA target sequence
gtattaagacaaattaatgata

SEQ ID NO: 55045 - DNA, 22 bp, Artificial sequence
  SiRNA target sequence
tattaagacaaattaatgatat

SEQ ID NO: 55046 - DNA, 22 bp, Artificial sequence
  SiRNA target sequence
attaagacaaattaatgatatt

SEQ ID NO: 55047 - DNA, 22 bp, Artificial sequence
  SiRNA target sequence
ttaagacaaattaatgatattg

SEQ ID NO: 55048 - DNA, 22 bp, Artificial sequence
  SiRNA target sequence
taagacaaattaatgatattgt

SEQ ID NO: 55049 - DNA, 22 bp, Artificial sequence
  SiRNA target sequence
aagacaaattaatgatattgtg

SEQ ID NO: 55050 - DNA, 22 bp, Artificial sequence
  SiRNA target sequence
agacaaattaatgatattgtgt

SEQ ID NO: 55051 - DNA, 22 bp, Artificial sequence
  SiRNA target sequence
gacaaattaatgatattgtgtt

SEQ ID NO: 55052 - DNA, 22 bp, Artificial sequence
  SiRNA target sequence
acaaattaatgatattgtgttt

SEQ ID NO: 55053 - DNA, 22 bp, Artificial sequence
  SiRNA target sequence
caaattaatgatattgtgttta

SEQ ID NO: 55054 - DNA, 22 bp, Artificial sequence
  SiRNA target sequence
aaattaatgatattgtgtttag

SEQ ID NO: 55055 - DNA, 22 bp, Artificial sequence
  SiRNA target sequence
aattaatgatattgtgtttagc

SEQ ID NO: 55056 - DNA, 22 bp, Artificial sequence
  SiRNA target sequence
attaatgatattgtgtttagcg

SEQ ID NO: 55057 - DNA, 22 bp, Artificial sequence
  SiRNA target sequence
ttaatgatattgtgtttagcgg

SEQ ID NO: 55058 - DNA, 22 bp, Artificial sequence
  SiRNA target sequence
taatgatattgtgtttagcggg

SEQ ID NO: 55059 - DNA, 22 bp, Artificial sequence
  SiRNA target sequence
aatgatattgtgtttagcgggc

SEQ ID NO: 55060 - DNA, 22 bp, Artificial sequence
  SiRNA target sequence
atgatattgtgtttagcgggcc

SEQ ID NO: 55061 - DNA, 22 bp, Artificial sequence
  SiRNA target sequence
tgatattgtgtttagcgggcca

SEQ ID NO: 55062 - DNA, 22 bp, Artificial sequence
  SiRNA target sequence
gatattgtgtttagcgggccaa

SEQ ID NO: 55063 - DNA, 22 bp, Artificial sequence
  SiRNA target sequence
atattgtgtttagcgggccaat

SEQ ID NO: 55064 - DNA, 22 bp, Artificial sequence
  SiRNA target sequence
tattgtgtttagcgggccaata

SEQ ID NO: 55065 - DNA, 22 bp, Artificial sequence
  SiRNA target sequence
attgtgtttagcgggccaatac

SEQ ID NO: 55066 - DNA, 22 bp, Artificial sequence
  SiRNA target sequence
ttgtgtttagcgggccaataca

SEQ ID NO: 55067 - DNA, 22 bp, Artificial sequence
  SiRNA target sequence
tgtgtttagcgggccaatacaa

SEQ ID NO: 55068 - DNA, 22 bp, Artificial sequence
  SiRNA target sequence
gtgtttagcgggccaatacaat

SEQ ID NO: 55069 - DNA, 22 bp, Artificial sequence
  SiRNA target sequence
tgtttagcgggccaatacaatt

SEQ ID NO: 55070 - DNA, 22 bp, Artificial sequence
  SiRNA target sequence
gtttagcgggccaatacaattt

SEQ ID NO: 55071 - DNA, 22 bp, Artificial sequence
  SiRNA target sequence
tttagcgggccaatacaatttt

SEQ ID NO: 55072 - DNA, 22 bp, Artificial sequence
  SiRNA target sequence
ttagcgggccaatacaattttt

SEQ ID NO: 55073 - DNA, 22 bp, Artificial sequence
  SiRNA target sequence
tagcgggccaatacaattttta

SEQ ID NO: 55074 - DNA, 22 bp, Artificial sequence
  SiRNA target sequence
agcgggccaatacaatttttat

SEQ ID NO: 55075 - DNA, 22 bp, Artificial sequence
  SiRNA target sequence
gcgggccaatacaatttttata

SEQ ID NO: 55076 - DNA, 22 bp, Artificial sequence
  SiRNA target sequence
cgggccaatacaatttttatat

SEQ ID NO: 55077 - DNA, 22 bp, Artificial sequence
  SiRNA target sequence
gggccaatacaatttttatata

SEQ ID NO: 55078 - DNA, 22 bp, Artificial sequence
  SiRNA target sequence
ggccaatacaatttttatataa

SEQ ID NO: 55079 - DNA, 22 bp, Artificial sequence
  SiRNA target sequence
gccaatacaatttttatataaa

SEQ ID NO: 55080 - DNA, 22 bp, Artificial sequence
  SiRNA target sequence
ccaatacaatttttatataaaa

SEQ ID NO: 55081 - DNA, 22 bp, Artificial sequence
  SiRNA target sequence
caatacaatttttatataaaat

SEQ ID NO: 55082 - DNA, 22 bp, Artificial sequence
  SiRNA target sequence
aatacaatttttatataaaatt

SEQ ID NO: 55083 - DNA, 22 bp, Artificial sequence
  SiRNA target sequence
atacaatttttatataaaattg

SEQ ID NO: 55084 - DNA, 22 bp, Artificial sequence
  SiRNA target sequence
tacaatttttatataaaattgt

SEQ ID NO: 55085 - DNA, 22 bp, Artificial sequence
  SiRNA target sequence
acaatttttatataaaattgtt

SEQ ID NO: 55086 - DNA, 22 bp, Artificial sequence
  SiRNA target sequence
caatttttatataaaattgttg

SEQ ID NO: 55087 - DNA, 22 bp, Artificial sequence
  SiRNA target sequence
aatttttatataaaattgttgg

SEQ ID NO: 55088 - DNA, 22 bp, Artificial sequence
  SiRNA target sequence
atttttatataaaattgttgga

SEQ ID NO: 55089 - DNA, 22 bp, Artificial sequence
  SiRNA target sequence
tttttatataaaattgttggag

SEQ ID NO: 55090 - DNA, 22 bp, Artificial sequence
  SiRNA target sequence
ttttatataaaattgttggagt

SEQ ID NO: 55091 - DNA, 22 bp, Artificial sequence
  SiRNA target sequence
tttatataaaattgttggagtt

SEQ ID NO: 55092 - DNA, 22 bp, Artificial sequence
  SiRNA target sequence
ttatataaaattgttggagttg

SEQ ID NO: 55093 - DNA, 22 bp, Artificial sequence
  SiRNA target sequence
tatataaaattgttggagttga

SEQ ID NO: 55094 - DNA, 22 bp, Artificial sequence
  SiRNA target sequence
atataaaattgttggagttgaa

SEQ ID NO: 55095 - DNA, 22 bp, Artificial sequence
  SiRNA target sequence
tataaaattgttggagttgaag

SEQ ID NO: 55096 - DNA, 22 bp, Artificial sequence
  SiRNA target sequence
ataaaattgttggagttgaagc

SEQ ID NO: 55097 - DNA, 22 bp, Artificial sequence
  SiRNA target sequence
taaaattgttggagttgaagca

SEQ ID NO: 55098 - DNA, 22 bp, Artificial sequence
  SiRNA target sequence
aaaattgttggagttgaagcat

SEQ ID NO: 55099 - DNA, 22 bp, Artificial sequence
  SiRNA target sequence
aaattgttggagttgaagcatt

SEQ ID NO: 55100 - DNA, 22 bp, Artificial sequence
  SiRNA target sequence
aattgttggagttgaagcattt

SEQ ID NO: 55101 - DNA, 22 bp, Artificial sequence
  SiRNA target sequence
attgttggagttgaagcatttt

SEQ ID NO: 55102 - DNA, 22 bp, Artificial sequence
  SiRNA target sequence
ttgttggagttgaagcatttta

SEQ ID NO: 55103 - DNA, 22 bp, Artificial sequence
  SiRNA target sequence
tgttggagttgaagcattttat

SEQ ID NO: 55104 - DNA, 22 bp, Artificial sequence
  SiRNA target sequence
gttggagttgaagcattttatc

SEQ ID NO: 55105 - DNA, 22 bp, Artificial sequence
  SiRNA target sequence
ttggagttgaagcattttatca

SEQ ID NO: 55106 - DNA, 22 bp, Artificial sequence
  SiRNA target sequence
tggagttgaagcattttatcat

SEQ ID NO: 55107 - DNA, 22 bp, Artificial sequence
  SiRNA target sequence
ggagttgaagcattttatcatt

SEQ ID NO: 55108 - DNA, 22 bp, Artificial sequence
  SiRNA target sequence
gagttgaagcattttatcatta

SEQ ID NO: 55109 - DNA, 22 bp, Artificial sequence
  SiRNA target sequence
agttgaagcattttatcattac

SEQ ID NO: 55110 - DNA, 22 bp, Artificial sequence
  SiRNA target sequence
gttgaagcattttatcattaca

SEQ ID NO: 55111 - DNA, 22 bp, Artificial sequence
  SiRNA target sequence
ttgaagcattttatcattacat

SEQ ID NO: 55112 - DNA, 22 bp, Artificial sequence
  SiRNA target sequence
tgaagcattttatcattacatt

SEQ ID NO: 55113 - DNA, 22 bp, Artificial sequence
  SiRNA target sequence
gaagcattttatcattacattt

SEQ ID NO: 55114 - DNA, 22 bp, Artificial sequence
  SiRNA target sequence
aagcattttatcattacatttc

SEQ ID NO: 55115 - DNA, 22 bp, Artificial sequence
  SiRNA target sequence
agcattttatcattacatttca

SEQ ID NO: 55116 - DNA, 22 bp, Artificial sequence
  SiRNA target sequence
gcattttatcattacatttcat

SEQ ID NO: 55117 - DNA, 22 bp, Artificial sequence
  SiRNA target sequence
cattttatcattacatttcatt

SEQ ID NO: 55118 - DNA, 22 bp, Artificial sequence
  SiRNA target sequence
attttatcattacatttcatta

SEQ ID NO: 55119 - DNA, 22 bp, Artificial sequence
  SiRNA target sequence
ttttatcattacatttcattaa

SEQ ID NO: 55120 - DNA, 22 bp, Artificial sequence
  SiRNA target sequence
tttatcattacatttcattaaa

SEQ ID NO: 55121 - DNA, 22 bp, Artificial sequence
  SiRNA target sequence
ttatcattacatttcattaaac

SEQ ID NO: 55122 - DNA, 22 bp, Artificial sequence
  SiRNA target sequence
tatcattacatttcattaaact

SEQ ID NO: 55123 - DNA, 22 bp, Artificial sequence
  SiRNA target sequence
atcattacatttcattaaactt

SEQ ID NO: 55124 - DNA, 22 bp, Artificial sequence
  SiRNA target sequence
tcattacatttcattaaactta

SEQ ID NO: 55125 - DNA, 22 bp, Artificial sequence
  SiRNA target sequence
cattacatttcattaaacttag

SEQ ID NO: 55126 - DNA, 22 bp, Artificial sequence
  SiRNA target sequence
attacatttcattaaacttaga

SEQ ID NO: 55127 - DNA, 22 bp, Artificial sequence
  SiRNA target sequence
ttacatttcattaaacttagaa

SEQ ID NO: 55128 - DNA, 22 bp, Artificial sequence
  SiRNA target sequence
tacatttcattaaacttagaaa

SEQ ID NO: 55129 - DNA, 22 bp, Artificial sequence
  SiRNA target sequence
acatttcattaaacttagaaaa

SEQ ID NO: 55130 - DNA, 22 bp, Artificial sequence
  SiRNA target sequence
catttcattaaacttagaaaat

SEQ ID NO: 55131 - DNA, 22 bp, Artificial sequence
  SiRNA target sequence
atttcattaaacttagaaaatt

SEQ ID NO: 55132 - DNA, 22 bp, Artificial sequence
  SiRNA target sequence
tttcattaaacttagaaaattt

SEQ ID NO: 55133 - DNA, 22 bp, Artificial sequence
  SiRNA target sequence
ttcattaaacttagaaaatttt

SEQ ID NO: 55134 - DNA, 22 bp, Artificial sequence
  SiRNA target sequence
tcattaaacttagaaaatttta

SEQ ID NO: 55135 - DNA, 22 bp, Artificial sequence
  SiRNA target sequence
cattaaacttagaaaattttaa

SEQ ID NO: 55136 - DNA, 22 bp, Artificial sequence
  SiRNA target sequence
attaaacttagaaaattttaac

SEQ ID NO: 55137 - DNA, 22 bp, Artificial sequence
  SiRNA target sequence
ttaaacttagaaaattttaaca

SEQ ID NO: 55138 - DNA, 22 bp, Artificial sequence
  SiRNA target sequence
taaacttagaaaattttaacaa

SEQ ID NO: 55139 - DNA, 22 bp, Artificial sequence
  SiRNA target sequence
aaacttagaaaattttaacaaa

SEQ ID NO: 55140 - DNA, 22 bp, Artificial sequence
  SiRNA target sequence
aacttagaaaattttaacaaaa

SEQ ID NO: 55141 - DNA, 22 bp, Artificial sequence
  SiRNA target sequence
acttagaaaattttaacaaaat

SEQ ID NO: 55142 - DNA, 22 bp, Artificial sequence
  SiRNA target sequence
cttagaaaattttaacaaaata

SEQ ID NO: 55143 - DNA, 22 bp, Artificial sequence
  SiRNA target sequence
ttagaaaattttaacaaaatag

SEQ ID NO: 55144 - DNA, 22 bp, Artificial sequence
  SiRNA target sequence
tagaaaattttaacaaaatagg

SEQ ID NO: 55145 - DNA, 22 bp, Artificial sequence
  SiRNA target sequence
agaaaattttaacaaaatagga

SEQ ID NO: 55146 - DNA, 22 bp, Artificial sequence
  SiRNA target sequence
gaaaattttaacaaaataggaa

SEQ ID NO: 55147 - DNA, 22 bp, Artificial sequence
  SiRNA target sequence
aaaattttaacaaaataggaag

SEQ ID NO: 55148 - DNA, 22 bp, Artificial sequence
  SiRNA target sequence
aaattttaacaaaataggaagt

SEQ ID NO: 55149 - DNA, 22 bp, Artificial sequence
  SiRNA target sequence
aattttaacaaaataggaagtg

SEQ ID NO: 55150 - DNA, 22 bp, Artificial sequence
  SiRNA target sequence
attttaacaaaataggaagtgg

SEQ ID NO: 55151 - DNA, 22 bp, Artificial sequence
  SiRNA target sequence
ttttaacaaaataggaagtgga

SEQ ID NO: 55152 - DNA, 22 bp, Artificial sequence
  SiRNA target sequence
tttaacaaaataggaagtggag

SEQ ID NO: 55153 - DNA, 22 bp, Artificial sequence
  SiRNA target sequence
ttaacaaaataggaagtggaga

SEQ ID NO: 55154 - DNA, 22 bp, Artificial sequence
  SiRNA target sequence
taacaaaataggaagtggagag

SEQ ID NO: 55155 - DNA, 22 bp, Artificial sequence
  SiRNA target sequence
aacaaaataggaagtggagaga

SEQ ID NO: 55156 - DNA, 22 bp, Artificial sequence
  SiRNA target sequence
acaaaataggaagtggagagat

SEQ ID NO: 55157 - DNA, 22 bp, Artificial sequence
  SiRNA target sequence
caaaataggaagtggagagata

SEQ ID NO: 55158 - DNA, 22 bp, Artificial sequence
  SiRNA target sequence
aaaataggaagtggagagatac

SEQ ID NO: 55159 - DNA, 22 bp, Artificial sequence
  SiRNA target sequence
aaataggaagtggagagataca

SEQ ID NO: 55160 - DNA, 22 bp, Artificial sequence
  SiRNA target sequence
aataggaagtggagagatacaa

SEQ ID NO: 55161 - DNA, 22 bp, Artificial sequence
  SiRNA target sequence
ataggaagtggagagatacaaa

SEQ ID NO: 55162 - DNA, 22 bp, Artificial sequence
  SiRNA target sequence
taggaagtggagagatacaaat

SEQ ID NO: 55163 - DNA, 22 bp, Artificial sequence
  SiRNA target sequence
aggaagtggagagatacaaatg

SEQ ID NO: 55164 - DNA, 22 bp, Artificial sequence
  SiRNA target sequence
ggaagtggagagatacaaatga

SEQ ID NO: 55165 - DNA, 22 bp, Artificial sequence
  SiRNA target sequence
gaagtggagagatacaaatgat

SEQ ID NO: 55166 - DNA, 22 bp, Artificial sequence
  SiRNA target sequence
aagtggagagatacaaatgatt

SEQ ID NO: 55167 - DNA, 22 bp, Artificial sequence
  SiRNA target sequence
agtggagagatacaaatgatta

SEQ ID NO: 55168 - DNA, 22 bp, Artificial sequence
  SiRNA target sequence
gtggagagatacaaatgattat

SEQ ID NO: 55169 - DNA, 22 bp, Artificial sequence
  SiRNA target sequence
tggagagatacaaatgattatt

SEQ ID NO: 55170 - DNA, 22 bp, Artificial sequence
  SiRNA target sequence
ggagagatacaaatgattattg

SEQ ID NO: 55171 - DNA, 22 bp, Artificial sequence
  SiRNA target sequence
gagagatacaaatgattattga

SEQ ID NO: 55172 - DNA, 22 bp, Artificial sequence
  SiRNA target sequence
agagatacaaatgattattgag

SEQ ID NO: 55173 - DNA, 22 bp, Artificial sequence
  SiRNA target sequence
gagatacaaatgattattgagc

SEQ ID NO: 55174 - DNA, 22 bp, Artificial sequence
  SiRNA target sequence
agatacaaatgattattgagcg

SEQ ID NO: 55175 - DNA, 22 bp, Artificial sequence
  SiRNA target sequence
gatacaaatgattattgagcgg

SEQ ID NO: 55176 - DNA, 22 bp, Artificial sequence
  SiRNA target sequence
atacaaatgattattgagcgga

SEQ ID NO: 55177 - DNA, 22 bp, Artificial sequence
  SiRNA target sequence
tacaaatgattattgagcggaa

SEQ ID NO: 55178 - DNA, 22 bp, Artificial sequence
  SiRNA target sequence
acaaatgattattgagcggaaa

SEQ ID NO: 55179 - DNA, 22 bp, Artificial sequence
  SiRNA target sequence
caaatgattattgagcggaaaa

SEQ ID NO: 55180 - DNA, 22 bp, Artificial sequence
  SiRNA target sequence
aaatgattattgagcggaaaag

SEQ ID NO: 55181 - DNA, 22 bp, Artificial sequence
  SiRNA target sequence
aatgattattgagcggaaaagt

SEQ ID NO: 55182 - DNA, 22 bp, Artificial sequence
  SiRNA target sequence
atgattattgagcggaaaagta

SEQ ID NO: 55183 - DNA, 22 bp, Artificial sequence
  SiRNA target sequence
tgattattgagcggaaaagtag

SEQ ID NO: 55184 - DNA, 22 bp, Artificial sequence
  SiRNA target sequence
gattattgagcggaaaagtaga

SEQ ID NO: 55185 - DNA, 22 bp, Artificial sequence
  SiRNA target sequence
attattgagcggaaaagtagag

SEQ ID NO: 55186 - DNA, 22 bp, Artificial sequence
  SiRNA target sequence
ttattgagcggaaaagtagagc

SEQ ID NO: 55187 - DNA, 22 bp, Artificial sequence
  SiRNA target sequence
tattgagcggaaaagtagagca

SEQ ID NO: 55188 - DNA, 22 bp, Artificial sequence
  SiRNA target sequence
attgagcggaaaagtagagcat

SEQ ID NO: 55189 - DNA, 22 bp, Artificial sequence
  SiRNA target sequence
ttgagcggaaaagtagagcata

SEQ ID NO: 55190 - DNA, 22 bp, Artificial sequence
  SiRNA target sequence
tgagcggaaaagtagagcatat

SEQ ID NO: 55191 - DNA, 22 bp, Artificial sequence
  SiRNA target sequence
gagcggaaaagtagagcatatg

SEQ ID NO: 55192 - DNA, 22 bp, Artificial sequence
  SiRNA target sequence
agcggaaaagtagagcatatgg

SEQ ID NO: 55193 - DNA, 22 bp, Artificial sequence
  SiRNA target sequence
gcggaaaagtagagcatatggt

SEQ ID NO: 55194 - DNA, 22 bp, Artificial sequence
  SiRNA target sequence
cggaaaagtagagcatatggtg

SEQ ID NO: 55195 - DNA, 22 bp, Artificial sequence
  SiRNA target sequence
ggaaaagtagagcatatggtga

SEQ ID NO: 55196 - DNA, 22 bp, Artificial sequence
  SiRNA target sequence
gaaaagtagagcatatggtgac

SEQ ID NO: 55197 - DNA, 22 bp, Artificial sequence
  SiRNA target sequence
aaaagtagagcatatggtgaca

SEQ ID NO: 55198 - DNA, 22 bp, Artificial sequence
  SiRNA target sequence
aaagtagagcatatggtgacat

SEQ ID NO: 55199 - DNA, 22 bp, Artificial sequence
  SiRNA target sequence
aagtagagcatatggtgacata

SEQ ID NO: 55200 - DNA, 22 bp, Artificial sequence
  SiRNA target sequence
agtagagcatatggtgacatac

SEQ ID NO: 55201 - DNA, 22 bp, Artificial sequence
  SiRNA target sequence
gtagagcatatggtgacatact

SEQ ID NO: 55202 - DNA, 22 bp, Artificial sequence
  SiRNA target sequence
tagagcatatggtgacatacta

SEQ ID NO: 55203 - DNA, 22 bp, Artificial sequence
  SiRNA target sequence
agagcatatggtgacatactag

SEQ ID NO: 55204 - DNA, 22 bp, Artificial sequence
  SiRNA target sequence
gagcatatggtgacatactaga

SEQ ID NO: 55205 - DNA, 22 bp, Artificial sequence
  SiRNA target sequence
agcatatggtgacatactagaa

SEQ ID NO: 55206 - DNA, 22 bp, Artificial sequence
  SiRNA target sequence
gcatatggtgacatactagaac

SEQ ID NO: 55207 - DNA, 22 bp, Artificial sequence
  SiRNA target sequence
catatggtgacatactagaact

SEQ ID NO: 55208 - DNA, 22 bp, Artificial sequence
  SiRNA target sequence
atatggtgacatactagaacta

SEQ ID NO: 55209 - DNA, 22 bp, Artificial sequence
  SiRNA target sequence
tatggtgacatactagaactaa

SEQ ID NO: 55210 - DNA, 22 bp, Artificial sequence
  SiRNA target sequence
atggtgacatactagaactaac

SEQ ID NO: 55211 - DNA, 22 bp, Artificial sequence
  SiRNA target sequence
tggtgacatactagaactaact

SEQ ID NO: 55212 - DNA, 22 bp, Artificial sequence
  SiRNA target sequence
ggtgacatactagaactaacta

SEQ ID NO: 55213 - DNA, 22 bp, Artificial sequence
  SiRNA target sequence
gtgacatactagaactaactac

SEQ ID NO: 55214 - DNA, 22 bp, Artificial sequence
  SiRNA target sequence
tgacatactagaactaactact

SEQ ID NO: 55215 - DNA, 22 bp, Artificial sequence
  SiRNA target sequence
gacatactagaactaactactc

SEQ ID NO: 55216 - DNA, 22 bp, Artificial sequence
  SiRNA target sequence
acatactagaactaactactct

SEQ ID NO: 55217 - DNA, 22 bp, Artificial sequence
  SiRNA target sequence
catactagaactaactactctc

SEQ ID NO: 55218 - DNA, 22 bp, Artificial sequence
  SiRNA target sequence
atactagaactaactactctct

SEQ ID NO: 55219 - DNA, 22 bp, Artificial sequence
  SiRNA target sequence
tactagaactaactactctctc

SEQ ID NO: 55220 - DNA, 22 bp, Artificial sequence
  SiRNA target sequence
actagaactaactactctctcg

SEQ ID NO: 55221 - DNA, 22 bp, Artificial sequence
  SiRNA target sequence
ctagaactaactactctctcgg

SEQ ID NO: 55222 - DNA, 22 bp, Artificial sequence
  SiRNA target sequence
tagaactaactactctctcggc

SEQ ID NO: 55223 - DNA, 22 bp, Artificial sequence
  SiRNA target sequence
agaactaactactctctcggcc

SEQ ID NO: 55224 - DNA, 22 bp, Artificial sequence
  SiRNA target sequence
gaactaactactctctcggccg

SEQ ID NO: 55225 - DNA, 22 bp, Artificial sequence
  SiRNA target sequence
aactaactactctctcggccgt

SEQ ID NO: 55226 - DNA, 22 bp, Artificial sequence
  SiRNA target sequence
actaactactctctcggccgta

SEQ ID NO: 55227 - DNA, 22 bp, Artificial sequence
  SiRNA target sequence
ctaactactctctcggccgtac

SEQ ID NO: 55228 - DNA, 22 bp, Artificial sequence
  SiRNA target sequence
taactactctctcggccgtacc

SEQ ID NO: 55229 - DNA, 22 bp, Artificial sequence
  SiRNA target sequence
aactactctctcggccgtacca

SEQ ID NO: 55230 - DNA, 22 bp, Artificial sequence
  SiRNA target sequence
actactctctcggccgtaccaa

SEQ ID NO: 55231 - DNA, 22 bp, Artificial sequence
  SiRNA target sequence
ctactctctcggccgtaccaac

SEQ ID NO: 55232 - DNA, 22 bp, Artificial sequence
  SiRNA target sequence
tactctctcggccgtaccaacc

SEQ ID NO: 55233 - DNA, 22 bp, Artificial sequence
  SiRNA target sequence
actctctcggccgtaccaacct

SEQ ID NO: 55234 - DNA, 22 bp, Artificial sequence
  SiRNA target sequence
ctctctcggccgtaccaacctg

SEQ ID NO: 55235 - DNA, 22 bp, Artificial sequence
  SiRNA target sequence
tctctcggccgtaccaacctgt

SEQ ID NO: 55236 - DNA, 22 bp, Artificial sequence
  SiRNA target sequence
ctctcggccgtaccaacctgta

SEQ ID NO: 55237 - DNA, 22 bp, Artificial sequence
  SiRNA target sequence
tctcggccgtaccaacctgtat

SEQ ID NO: 55238 - DNA, 22 bp, Artificial sequence
  SiRNA target sequence
ctcggccgtaccaacctgtatt

SEQ ID NO: 55239 - DNA, 22 bp, Artificial sequence
  SiRNA target sequence
tcggccgtaccaacctgtattg

SEQ ID NO: 55240 - DNA, 22 bp, Artificial sequence
  SiRNA target sequence
cggccgtaccaacctgtattgt

SEQ ID NO: 55241 - DNA, 22 bp, Artificial sequence
  SiRNA target sequence
ggccgtaccaacctgtattgta

SEQ ID NO: 55242 - DNA, 22 bp, Artificial sequence
  SiRNA target sequence
gccgtaccaacctgtattgtag

SEQ ID NO: 55243 - DNA, 22 bp, Artificial sequence
  SiRNA target sequence
ccgtaccaacctgtattgtagt

SEQ ID NO: 55244 - DNA, 22 bp, Artificial sequence
  SiRNA target sequence
cgtaccaacctgtattgtagtt

SEQ ID NO: 55245 - DNA, 22 bp, Artificial sequence
  SiRNA target sequence
gtaccaacctgtattgtagtta

SEQ ID NO: 55246 - DNA, 22 bp, Artificial sequence
  SiRNA target sequence
taccaacctgtattgtagttat

SEQ ID NO: 55247 - DNA, 22 bp, Artificial sequence
  SiRNA target sequence
accaacctgtattgtagttatt

SEQ ID NO: 55248 - DNA, 22 bp, Artificial sequence
  SiRNA target sequence
ccaacctgtattgtagttatta

SEQ ID NO: 55249 - DNA, 22 bp, Artificial sequence
  SiRNA target sequence
caacctgtattgtagttattat

SEQ ID NO: 55250 - DNA, 22 bp, Artificial sequence
  SiRNA target sequence
aacctgtattgtagttattatg

SEQ ID NO: 55251 - DNA, 22 bp, Artificial sequence
  SiRNA target sequence
acctgtattgtagttattatgt

SEQ ID NO: 55252 - DNA, 22 bp, Artificial sequence
  SiRNA target sequence
cctgtattgtagttattatgtc

SEQ ID NO: 55253 - DNA, 22 bp, Artificial sequence
  SiRNA target sequence
ctgtattgtagttattatgtcg

SEQ ID NO: 55254 - DNA, 22 bp, Artificial sequence
  SiRNA target sequence
tgtattgtagttattatgtcgt

SEQ ID NO: 55255 - DNA, 22 bp, Artificial sequence
  SiRNA target sequence
gtattgtagttattatgtcgtt

SEQ ID NO: 55256 - DNA, 22 bp, Artificial sequence
  SiRNA target sequence
tattgtagttattatgtcgttt

SEQ ID NO: 55257 - DNA, 22 bp, Artificial sequence
  SiRNA target sequence
attgtagttattatgtcgtttt

SEQ ID NO: 55258 - DNA, 22 bp, Artificial sequence
  SiRNA target sequence
ttgtagttattatgtcgttttt

SEQ ID NO: 55259 - DNA, 22 bp, Artificial sequence
  SiRNA target sequence
tgtagttattatgtcgtttttc

SEQ ID NO: 55260 - DNA, 22 bp, Artificial sequence
  SiRNA target sequence
gtagttattatgtcgtttttct

SEQ ID NO: 55261 - DNA, 22 bp, Artificial sequence
  SiRNA target sequence
tagttattatgtcgtttttctc

SEQ ID NO: 55262 - DNA, 22 bp, Artificial sequence
  SiRNA target sequence
agttattatgtcgtttttctca

SEQ ID NO: 55263 - DNA, 22 bp, Artificial sequence
  SiRNA target sequence
gttattatgtcgtttttctcag

SEQ ID NO: 55264 - DNA, 22 bp, Artificial sequence
  SiRNA target sequence
ttattatgtcgtttttctcagt

SEQ ID NO: 55265 - DNA, 22 bp, Artificial sequence
  SiRNA target sequence
tattatgtcgtttttctcagta

SEQ ID NO: 55266 - DNA, 22 bp, Artificial sequence
  SiRNA target sequence
attatgtcgtttttctcagtat

SEQ ID NO: 55267 - DNA, 22 bp, Artificial sequence
  SiRNA target sequence
ttatgtcgtttttctcagtata

SEQ ID NO: 55268 - DNA, 22 bp, Artificial sequence
  SiRNA target sequence
tatgtcgtttttctcagtatat

SEQ ID NO: 55269 - DNA, 22 bp, Artificial sequence
  SiRNA target sequence
atgtcgtttttctcagtatata

SEQ ID NO: 55270 - DNA, 22 bp, Artificial sequence
  SiRNA target sequence
tgtcgtttttctcagtatataa

SEQ ID NO: 55271 - DNA, 22 bp, Artificial sequence
  SiRNA target sequence
gtcgtttttctcagtatataaa

SEQ ID NO: 55272 - DNA, 22 bp, Artificial sequence
  SiRNA target sequence
tcgtttttctcagtatataaaa

SEQ ID NO: 55273 - DNA, 22 bp, Artificial sequence
  SiRNA target sequence
cgtttttctcagtatataaaaa

SEQ ID NO: 55274 - DNA, 22 bp, Artificial sequence
  SiRNA target sequence
gtttttctcagtatataaaaat

SEQ ID NO: 55275 - DNA, 22 bp, Artificial sequence
  SiRNA target sequence
tttttctcagtatataaaaatt

SEQ ID NO: 55276 - DNA, 22 bp, Artificial sequence
  SiRNA target sequence
ttttctcagtatataaaaattt

SEQ ID NO: 55277 - DNA, 22 bp, Artificial sequence
  SiRNA target sequence
tttctcagtatataaaaatttg

SEQ ID NO: 55278 - DNA, 22 bp, Artificial sequence
  SiRNA target sequence
ttctcagtatataaaaatttgg

SEQ ID NO: 55279 - DNA, 22 bp, Artificial sequence
  SiRNA target sequence
tctcagtatataaaaatttggg

SEQ ID NO: 55280 - DNA, 22 bp, Artificial sequence
  SiRNA target sequence
ctcagtatataaaaatttggga

SEQ ID NO: 55281 - DNA, 22 bp, Artificial sequence
  SiRNA target sequence
tcagtatataaaaatttgggaa

SEQ ID NO: 55282 - DNA, 22 bp, Artificial sequence
  SiRNA target sequence
cagtatataaaaatttgggaag

SEQ ID NO: 55283 - DNA, 22 bp, Artificial sequence
  SiRNA target sequence
agtatataaaaatttgggaaga

SEQ ID NO: 55284 - DNA, 22 bp, Artificial sequence
  SiRNA target sequence
gtatataaaaatttgggaagag

SEQ ID NO: 55285 - DNA, 22 bp, Artificial sequence
  SiRNA target sequence
tatataaaaatttgggaagaga

SEQ ID NO: 55286 - DNA, 22 bp, Artificial sequence
  SiRNA target sequence
atataaaaatttgggaagagat

SEQ ID NO: 55287 - DNA, 22 bp, Artificial sequence
  SiRNA target sequence
tataaaaatttgggaagagatg

SEQ ID NO: 55288 - DNA, 22 bp, Artificial sequence
  SiRNA target sequence
ataaaaatttgggaagagatgc

SEQ ID NO: 55289 - DNA, 22 bp, Artificial sequence
  SiRNA target sequence
taaaaatttgggaagagatgca

SEQ ID NO: 55290 - DNA, 22 bp, Artificial sequence
  SiRNA target sequence
aaaaatttgggaagagatgcac

SEQ ID NO: 55291 - DNA, 22 bp, Artificial sequence
  SiRNA target sequence
aaaatttgggaagagatgcact

SEQ ID NO: 55292 - DNA, 22 bp, Artificial sequence
  SiRNA target sequence
aaatttgggaagagatgcactc

SEQ ID NO: 55293 - DNA, 22 bp, Artificial sequence
  SiRNA target sequence
aatttgggaagagatgcactct

SEQ ID NO: 55294 - DNA, 22 bp, Artificial sequence
  SiRNA target sequence
atttgggaagagatgcactcta

SEQ ID NO: 55295 - DNA, 22 bp, Artificial sequence
  SiRNA target sequence
tttgggaagagatgcactctac

SEQ ID NO: 55296 - DNA, 22 bp, Artificial sequence
  SiRNA target sequence
ttgggaagagatgcactctacg

SEQ ID NO: 55297 - DNA, 22 bp, Artificial sequence
  SiRNA target sequence
tgggaagagatgcactctacgt

SEQ ID NO: 55298 - DNA, 22 bp, Artificial sequence
  SiRNA target sequence
gggaagagatgcactctacgta

SEQ ID NO: 55299 - DNA, 22 bp, Artificial sequence
  SiRNA target sequence
ggaagagatgcactctacgtaa

SEQ ID NO: 55300 - DNA, 22 bp, Artificial sequence
  SiRNA target sequence
gaagagatgcactctacgtaat

SEQ ID NO: 55301 - DNA, 22 bp, Artificial sequence
  SiRNA target sequence
aagagatgcactctacgtaatg

SEQ ID NO: 55302 - DNA, 22 bp, Artificial sequence
  SiRNA target sequence
agagatgcactctacgtaatgt

SEQ ID NO: 55303 - DNA, 22 bp, Artificial sequence
  SiRNA target sequence
gagatgcactctacgtaatgtt

SEQ ID NO: 55304 - DNA, 22 bp, Artificial sequence
  SiRNA target sequence
agatgcactctacgtaatgttg

SEQ ID NO: 55305 - DNA, 22 bp, Artificial sequence
  SiRNA target sequence
gatgcactctacgtaatgttgg

SEQ ID NO: 55306 - DNA, 22 bp, Artificial sequence
  SiRNA target sequence
atgcactctacgtaatgttggc

SEQ ID NO: 55307 - DNA, 22 bp, Artificial sequence
  SiRNA target sequence
tgcactctacgtaatgttggct

SEQ ID NO: 55308 - DNA, 22 bp, Artificial sequence
  SiRNA target sequence
gcactctacgtaatgttggcta

SEQ ID NO: 55309 - DNA, 22 bp, Artificial sequence
  SiRNA target sequence
cactctacgtaatgttggctac

SEQ ID NO: 55310 - DNA, 22 bp, Artificial sequence
  SiRNA target sequence
actctacgtaatgttggctaca

SEQ ID NO: 55311 - DNA, 22 bp, Artificial sequence
  SiRNA target sequence
ctctacgtaatgttggctacaa

SEQ ID NO: 55312 - DNA, 22 bp, Artificial sequence
  SiRNA target sequence
tctacgtaatgttggctacaag

SEQ ID NO: 55313 - DNA, 22 bp, Artificial sequence
  SiRNA target sequence
ctacgtaatgttggctacaagt

SEQ ID NO: 55314 - DNA, 22 bp, Artificial sequence
  SiRNA target sequence
tacgtaatgttggctacaagtg

SEQ ID NO: 55315 - DNA, 22 bp, Artificial sequence
  SiRNA target sequence
acgtaatgttggctacaagtgc

SEQ ID NO: 55316 - DNA, 22 bp, Artificial sequence
  SiRNA target sequence
cgtaatgttggctacaagtgcc

SEQ ID NO: 55317 - DNA, 22 bp, Artificial sequence
  SiRNA target sequence
gtaatgttggctacaagtgcct

SEQ ID NO: 55318 - DNA, 22 bp, Artificial sequence
  SiRNA target sequence
taatgttggctacaagtgcctt

SEQ ID NO: 55319 - DNA, 22 bp, Artificial sequence
  SiRNA target sequence
aatgttggctacaagtgccttg

SEQ ID NO: 55320 - DNA, 22 bp, Artificial sequence
  SiRNA target sequence
atgttggctacaagtgccttgt

SEQ ID NO: 55321 - DNA, 22 bp, Artificial sequence
  SiRNA target sequence
tgttggctacaagtgccttgta

SEQ ID NO: 55322 - DNA, 22 bp, Artificial sequence
  SiRNA target sequence
gttggctacaagtgccttgtat

SEQ ID NO: 55323 - DNA, 22 bp, Artificial sequence
  SiRNA target sequence
ttggctacaagtgccttgtatg

SEQ ID NO: 55324 - DNA, 22 bp, Artificial sequence
  SiRNA target sequence
tggctacaagtgccttgtatgt

SEQ ID NO: 55325 - DNA, 22 bp, Artificial sequence
  SiRNA target sequence
ggctacaagtgccttgtatgtg

SEQ ID NO: 55326 - DNA, 22 bp, Artificial sequence
  SiRNA target sequence
gctacaagtgccttgtatgtgt

SEQ ID NO: 55327 - DNA, 22 bp, Artificial sequence
  SiRNA target sequence
ctacaagtgccttgtatgtgta

SEQ ID NO: 55328 - DNA, 22 bp, Artificial sequence
  SiRNA target sequence
tacaagtgccttgtatgtgtat

SEQ ID NO: 55329 - DNA, 22 bp, Artificial sequence
  SiRNA target sequence
acaagtgccttgtatgtgtatt

SEQ ID NO: 55330 - DNA, 22 bp, Artificial sequence
  SiRNA target sequence
caagtgccttgtatgtgtattt

SEQ ID NO: 55331 - DNA, 22 bp, Artificial sequence
  SiRNA target sequence
aagtgccttgtatgtgtatttt

SEQ ID NO: 55332 - DNA, 22 bp, Artificial sequence
  SiRNA target sequence
agtgccttgtatgtgtatttta

SEQ ID NO: 55333 - DNA, 22 bp, Artificial sequence
  SiRNA target sequence
gtgccttgtatgtgtattttac

SEQ ID NO: 55334 - DNA, 22 bp, Artificial sequence
  SiRNA target sequence
tgccttgtatgtgtattttaca

SEQ ID NO: 55335 - DNA, 22 bp, Artificial sequence
  SiRNA target sequence
gccttgtatgtgtattttacat

SEQ ID NO: 55336 - DNA, 22 bp, Artificial sequence
  SiRNA target sequence
ccttgtatgtgtattttacatt

SEQ ID NO: 55337 - DNA, 22 bp, Artificial sequence
  SiRNA target sequence
cttgtatgtgtattttacattt

SEQ ID NO: 55338 - DNA, 22 bp, Artificial sequence
  SiRNA target sequence
ttgtatgtgtattttacatttg

SEQ ID NO: 55339 - DNA, 22 bp, Artificial sequence
  SiRNA target sequence
tgtatgtgtattttacatttgt

SEQ ID NO: 55340 - DNA, 22 bp, Artificial sequence
  SiRNA target sequence
gtatgtgtattttacatttgta

SEQ ID NO: 55341 - DNA, 22 bp, Artificial sequence
  SiRNA target sequence
tatgtgtattttacatttgtat

SEQ ID NO: 55342 - DNA, 22 bp, Artificial sequence
  SiRNA target sequence
atgtgtattttacatttgtatt

SEQ ID NO: 55343 - DNA, 22 bp, Artificial sequence
  SiRNA target sequence
tgtgtattttacatttgtattt

SEQ ID NO: 55344 - DNA, 22 bp, Artificial sequence
  SiRNA target sequence
gtgtattttacatttgtatttt

SEQ ID NO: 55345 - DNA, 22 bp, Artificial sequence
  SiRNA target sequence
tgtattttacatttgtattttc

SEQ ID NO: 55346 - DNA, 22 bp, Artificial sequence
  SiRNA target sequence
gtattttacatttgtattttca

SEQ ID NO: 55347 - DNA, 22 bp, Artificial sequence
  SiRNA target sequence
tattttacatttgtattttcaa

SEQ ID NO: 55348 - DNA, 22 bp, Artificial sequence
  SiRNA target sequence
attttacatttgtattttcaat

SEQ ID NO: 55349 - DNA, 22 bp, Artificial sequence
  SiRNA target sequence
ttttacatttgtattttcaata

SEQ ID NO: 55350 - DNA, 22 bp, Artificial sequence
  SiRNA target sequence
tttacatttgtattttcaatat

SEQ ID NO: 55351 - DNA, 22 bp, Artificial sequence
  SiRNA target sequence
ttacatttgtattttcaatatg

SEQ ID NO: 55352 - DNA, 22 bp, Artificial sequence
  SiRNA target sequence
tacatttgtattttcaatatgg

SEQ ID NO: 55353 - DNA, 22 bp, Artificial sequence
  SiRNA target sequence
acatttgtattttcaatatgga

SEQ ID NO: 55354 - DNA, 22 bp, Artificial sequence
  SiRNA target sequence
catttgtattttcaatatggag

SEQ ID NO: 55355 - DNA, 22 bp, Artificial sequence
  SiRNA target sequence
atttgtattttcaatatggaga

SEQ ID NO: 55356 - DNA, 22 bp, Artificial sequence
  SiRNA target sequence
tttgtattttcaatatggagaa

SEQ ID NO: 55357 - DNA, 22 bp, Artificial sequence
  SiRNA target sequence
ttgtattttcaatatggagaaa

SEQ ID NO: 55358 - DNA, 22 bp, Artificial sequence
  SiRNA target sequence
tgtattttcaatatggagaaac

SEQ ID NO: 55359 - DNA, 22 bp, Artificial sequence
  SiRNA target sequence
gtattttcaatatggagaaaca

SEQ ID NO: 55360 - DNA, 22 bp, Artificial sequence
  SiRNA target sequence
tattttcaatatggagaaacaa

SEQ ID NO: 55361 - DNA, 22 bp, Artificial sequence
  SiRNA target sequence
attttcaatatggagaaacaat

SEQ ID NO: 55362 - DNA, 22 bp, Artificial sequence
  SiRNA target sequence
ttttcaatatggagaaacaata

SEQ ID NO: 55363 - DNA, 22 bp, Artificial sequence
  SiRNA target sequence
tttcaatatggagaaacaatat

SEQ ID NO: 55364 - DNA, 22 bp, Artificial sequence
  SiRNA target sequence
ttcaatatggagaaacaatatt

SEQ ID NO: 55365 - DNA, 22 bp, Artificial sequence
  SiRNA target sequence
tcaatatggagaaacaatatta

SEQ ID NO: 55366 - DNA, 22 bp, Artificial sequence
  SiRNA target sequence
caatatggagaaacaatattag

SEQ ID NO: 55367 - DNA, 22 bp, Artificial sequence
  SiRNA target sequence
aatatggagaaacaatattaga

SEQ ID NO: 55368 - DNA, 22 bp, Artificial sequence
  SiRNA target sequence
atatggagaaacaatattagaa

SEQ ID NO: 55369 - DNA, 22 bp, Artificial sequence
  SiRNA target sequence
tatggagaaacaatattagaag

SEQ ID NO: 55370 - DNA, 22 bp, Artificial sequence
  SiRNA target sequence
atggagaaacaatattagaaga

SEQ ID NO: 55371 - DNA, 22 bp, Artificial sequence
  SiRNA target sequence
tggagaaacaatattagaagac

SEQ ID NO: 55372 - DNA, 22 bp, Artificial sequence
  SiRNA target sequence
ggagaaacaatattagaagaca

SEQ ID NO: 55373 - DNA, 22 bp, Artificial sequence
  SiRNA target sequence
gagaaacaatattagaagacaa

SEQ ID NO: 55374 - DNA, 22 bp, Artificial sequence
  SiRNA target sequence
agaaacaatattagaagacaat

SEQ ID NO: 55375 - DNA, 22 bp, Artificial sequence
  SiRNA target sequence
gaaacaatattagaagacaata

SEQ ID NO: 55376 - DNA, 22 bp, Artificial sequence
  SiRNA target sequence
aaacaatattagaagacaatat

SEQ ID NO: 55377 - DNA, 22 bp, Artificial sequence
  SiRNA target sequence
aacaatattagaagacaatata

SEQ ID NO: 55378 - DNA, 22 bp, Artificial sequence
  SiRNA target sequence
acaatattagaagacaatataa

SEQ ID NO: 55379 - DNA, 22 bp, Artificial sequence
  SiRNA target sequence
caatattagaagacaatataat

SEQ ID NO: 55380 - DNA, 22 bp, Artificial sequence
  SiRNA target sequence
aatattagaagacaatataata

SEQ ID NO: 55381 - DNA, 22 bp, Artificial sequence
  SiRNA target sequence
atattagaagacaatataataa

SEQ ID NO: 55382 - DNA, 22 bp, Artificial sequence
  SiRNA target sequence
tattagaagacaatataataag

SEQ ID NO: 55383 - DNA, 22 bp, Artificial sequence
  SiRNA target sequence
attagaagacaatataataagt

SEQ ID NO: 55384 - DNA, 22 bp, Artificial sequence
  SiRNA target sequence
ttagaagacaatataataagtc

SEQ ID NO: 55385 - DNA, 22 bp, Artificial sequence
  SiRNA target sequence
tagaagacaatataataagtca

SEQ ID NO: 55386 - DNA, 22 bp, Artificial sequence
  SiRNA target sequence
agaagacaatataataagtcac

SEQ ID NO: 55387 - DNA, 22 bp, Artificial sequence
  SiRNA target sequence
gaagacaatataataagtcaca

SEQ ID NO: 55388 - DNA, 22 bp, Artificial sequence
  SiRNA target sequence
aagacaatataataagtcacag

SEQ ID NO: 55389 - DNA, 22 bp, Artificial sequence
  SiRNA target sequence
agacaatataataagtcacagg

SEQ ID NO: 55390 - DNA, 22 bp, Artificial sequence
  SiRNA target sequence
gacaatataataagtcacagga

SEQ ID NO: 55391 - DNA, 22 bp, Artificial sequence
  SiRNA target sequence
acaatataataagtcacaggat

SEQ ID NO: 55392 - DNA, 22 bp, Artificial sequence
  SiRNA target sequence
caatataataagtcacaggata

SEQ ID NO: 55393 - DNA, 22 bp, Artificial sequence
  SiRNA target sequence
aatataataagtcacaggataa

SEQ ID NO: 55394 - DNA, 22 bp, Artificial sequence
  SiRNA target sequence
atataataagtcacaggataaa

SEQ ID NO: 55395 - DNA, 22 bp, Artificial sequence
  SiRNA target sequence
tataataagtcacaggataaat

SEQ ID NO: 55396 - DNA, 22 bp, Artificial sequence
  SiRNA target sequence
ataataagtcacaggataaatt

SEQ ID NO: 55397 - DNA, 22 bp, Artificial sequence
  SiRNA target sequence
taataagtcacaggataaatta

SEQ ID NO: 55398 - DNA, 22 bp, Artificial sequence
  SiRNA target sequence
aataagtcacaggataaattat

SEQ ID NO: 55399 - DNA, 22 bp, Artificial sequence
  SiRNA target sequence
ataagtcacaggataaattatc

SEQ ID NO: 55400 - DNA, 22 bp, Artificial sequence
  SiRNA target sequence
taagtcacaggataaattatcg

SEQ ID NO: 55401 - DNA, 22 bp, Artificial sequence
  SiRNA target sequence
aagtcacaggataaattatcga

SEQ ID NO: 55402 - DNA, 22 bp, Artificial sequence
  SiRNA target sequence
agtcacaggataaattatcgaa

SEQ ID NO: 55403 - DNA, 22 bp, Artificial sequence
  SiRNA target sequence
gtcacaggataaattatcgaat

SEQ ID NO: 55404 - DNA, 22 bp, Artificial sequence
  SiRNA target sequence
tcacaggataaattatcgaata

SEQ ID NO: 55405 - DNA, 22 bp, Artificial sequence
  SiRNA target sequence
cacaggataaattatcgaataa

SEQ ID NO: 55406 - DNA, 22 bp, Artificial sequence
  SiRNA target sequence
acaggataaattatcgaataaa

SEQ ID NO: 55407 - DNA, 22 bp, Artificial sequence
  SiRNA target sequence
caggataaattatcgaataaat

SEQ ID NO: 55408 - DNA, 22 bp, Artificial sequence
  SiRNA target sequence
aggataaattatcgaataaatt

SEQ ID NO: 55409 - DNA, 22 bp, Artificial sequence
  SiRNA target sequence
ggataaattatcgaataaatta

SEQ ID NO: 55410 - DNA, 22 bp, Artificial sequence
  SiRNA target sequence
gataaattatcgaataaattac

SEQ ID NO: 55411 - DNA, 22 bp, Artificial sequence
  SiRNA target sequence
ataaattatcgaataaattaca

SEQ ID NO: 55412 - DNA, 22 bp, Artificial sequence
  SiRNA target sequence
taaattatcgaataaattacaa

SEQ ID NO: 55413 - DNA, 22 bp, Artificial sequence
  SiRNA target sequence
aaattatcgaataaattacaag

SEQ ID NO: 55414 - DNA, 22 bp, Artificial sequence
  SiRNA target sequence
aattatcgaataaattacaaga

SEQ ID NO: 55415 - DNA, 22 bp, Artificial sequence
  SiRNA target sequence
attatcgaataaattacaagat

SEQ ID NO: 55416 - DNA, 22 bp, Artificial sequence
  SiRNA target sequence
ttatcgaataaattacaagatt

SEQ ID NO: 55417 - DNA, 22 bp, Artificial sequence
  SiRNA target sequence
tatcgaataaattacaagattt

SEQ ID NO: 55418 - DNA, 22 bp, Artificial sequence
  SiRNA target sequence
atcgaataaattacaagatttt

SEQ ID NO: 55419 - DNA, 22 bp, Artificial sequence
  SiRNA target sequence
tcgaataaattacaagattttt

SEQ ID NO: 55420 - DNA, 22 bp, Artificial sequence
  SiRNA target sequence
cgaataaattacaagatttttt

SEQ ID NO: 55421 - DNA, 22 bp, Artificial sequence
  SiRNA target sequence
gaataaattacaagatttttta

SEQ ID NO: 55422 - DNA, 22 bp, Artificial sequence
  SiRNA target sequence
aataaattacaagattttttag

SEQ ID NO: 55423 - DNA, 22 bp, Artificial sequence
  SiRNA target sequence
ataaattacaagattttttagc

SEQ ID NO: 55424 - DNA, 22 bp, Artificial sequence
  SiRNA target sequence
taaattacaagattttttagct

SEQ ID NO: 55425 - DNA, 22 bp, Artificial sequence
  SiRNA target sequence
aaattacaagattttttagcta

SEQ ID NO: 55426 - DNA, 22 bp, Artificial sequence
  SiRNA target sequence
aattacaagattttttagctaa

SEQ ID NO: 55427 - DNA, 22 bp, Artificial sequence
  SiRNA target sequence
attacaagattttttagctaat

SEQ ID NO: 55428 - DNA, 22 bp, Artificial sequence
  SiRNA target sequence
ttacaagattttttagctaatc

SEQ ID NO: 55429 - DNA, 22 bp, Artificial sequence
  SiRNA target sequence
tacaagattttttagctaatca

SEQ ID NO: 55430 - DNA, 22 bp, Artificial sequence
  SiRNA target sequence
acaagattttttagctaatcat

SEQ ID NO: 55431 - DNA, 22 bp, Artificial sequence
  SiRNA target sequence
caagattttttagctaatcatg

SEQ ID NO: 55432 - DNA, 22 bp, Artificial sequence
  SiRNA target sequence
aagattttttagctaatcatga

SEQ ID NO: 55433 - DNA, 22 bp, Artificial sequence
  SiRNA target sequence
agattttttagctaatcatgaa

SEQ ID NO: 55434 - DNA, 22 bp, Artificial sequence
  SiRNA target sequence
gattttttagctaatcatgaaa

SEQ ID NO: 55435 - DNA, 22 bp, Artificial sequence
  SiRNA target sequence
attttttagctaatcatgaaac

SEQ ID NO: 55436 - DNA, 22 bp, Artificial sequence
  SiRNA target sequence
ttttttagctaatcatgaaaca

SEQ ID NO: 55437 - DNA, 22 bp, Artificial sequence
  SiRNA target sequence
tttttagctaatcatgaaacaa

SEQ ID NO: 55438 - DNA, 22 bp, Artificial sequence
  SiRNA target sequence
ttttagctaatcatgaaacaat

SEQ ID NO: 55439 - DNA, 22 bp, Artificial sequence
  SiRNA target sequence
tttagctaatcatgaaacaatt

SEQ ID NO: 55440 - DNA, 22 bp, Artificial sequence
  SiRNA target sequence
ttagctaatcatgaaacaatta

SEQ ID NO: 55441 - DNA, 22 bp, Artificial sequence
  SiRNA target sequence
tagctaatcatgaaacaattaa

SEQ ID NO: 55442 - DNA, 22 bp, Artificial sequence
  SiRNA target sequence
agctaatcatgaaacaattaaa

SEQ ID NO: 55443 - DNA, 22 bp, Artificial sequence
  SiRNA target sequence
gctaatcatgaaacaattaaag

SEQ ID NO: 55444 - DNA, 22 bp, Artificial sequence
  SiRNA target sequence
ctaatcatgaaacaattaaagc

SEQ ID NO: 55445 - DNA, 22 bp, Artificial sequence
  SiRNA target sequence
taatcatgaaacaattaaagcc

SEQ ID NO: 55446 - DNA, 22 bp, Artificial sequence
  SiRNA target sequence
aatcatgaaacaattaaagcct

SEQ ID NO: 55447 - DNA, 22 bp, Artificial sequence
  SiRNA target sequence
atcatgaaacaattaaagccta

SEQ ID NO: 55448 - DNA, 22 bp, Artificial sequence
  SiRNA target sequence
tcatgaaacaattaaagcctat

SEQ ID NO: 55449 - DNA, 22 bp, Artificial sequence
  SiRNA target sequence
catgaaacaattaaagcctata

SEQ ID NO: 55450 - DNA, 22 bp, Artificial sequence
  SiRNA target sequence
atgaaacaattaaagcctataa

SEQ ID NO: 55451 - DNA, 22 bp, Artificial sequence
  SiRNA target sequence
tgaaacaattaaagcctataat

SEQ ID NO: 55452 - DNA, 22 bp, Artificial sequence
  SiRNA target sequence
gaaacaattaaagcctataata

SEQ ID NO: 55453 - DNA, 22 bp, Artificial sequence
  SiRNA target sequence
aaacaattaaagcctataatat

SEQ ID NO: 55454 - DNA, 22 bp, Artificial sequence
  SiRNA target sequence
aacaattaaagcctataatatg

SEQ ID NO: 55455 - DNA, 22 bp, Artificial sequence
  SiRNA target sequence
acaattaaagcctataatatgg

SEQ ID NO: 55456 - DNA, 22 bp, Artificial sequence
  SiRNA target sequence
caattaaagcctataatatgga

SEQ ID NO: 55457 - DNA, 22 bp, Artificial sequence
  SiRNA target sequence
aattaaagcctataatatggaa

SEQ ID NO: 55458 - DNA, 22 bp, Artificial sequence
  SiRNA target sequence
attaaagcctataatatggaag

SEQ ID NO: 55459 - DNA, 22 bp, Artificial sequence
  SiRNA target sequence
ttaaagcctataatatggaaga

SEQ ID NO: 55460 - DNA, 22 bp, Artificial sequence
  SiRNA target sequence
taaagcctataatatggaagaa

SEQ ID NO: 55461 - DNA, 22 bp, Artificial sequence
  SiRNA target sequence
aaagcctataatatggaagaag

SEQ ID NO: 55462 - DNA, 22 bp, Artificial sequence
  SiRNA target sequence
aagcctataatatggaagaaga

SEQ ID NO: 55463 - DNA, 22 bp, Artificial sequence
  SiRNA target sequence
agcctataatatggaagaagaa

SEQ ID NO: 55464 - DNA, 22 bp, Artificial sequence
  SiRNA target sequence
gcctataatatggaagaagaaa

SEQ ID NO: 55465 - DNA, 22 bp, Artificial sequence
  SiRNA target sequence
cctataatatggaagaagaaac

SEQ ID NO: 55466 - DNA, 22 bp, Artificial sequence
  SiRNA target sequence
ctataatatggaagaagaaact

SEQ ID NO: 55467 - DNA, 22 bp, Artificial sequence
  SiRNA target sequence
tataatatggaagaagaaacta

SEQ ID NO: 55468 - DNA, 22 bp, Artificial sequence
  SiRNA target sequence
ataatatggaagaagaaactat

SEQ ID NO: 55469 - DNA, 22 bp, Artificial sequence
  SiRNA target sequence
taatatggaagaagaaactatt

SEQ ID NO: 55470 - DNA, 22 bp, Artificial sequence
  SiRNA target sequence
aatatggaagaagaaactatta

SEQ ID NO: 55471 - DNA, 22 bp, Artificial sequence
  SiRNA target sequence
atatggaagaagaaactattac

SEQ ID NO: 55472 - DNA, 22 bp, Artificial sequence
  SiRNA target sequence
tatggaagaagaaactattaca

SEQ ID NO: 55473 - DNA, 22 bp, Artificial sequence
  SiRNA target sequence
atggaagaagaaactattacat

SEQ ID NO: 55474 - DNA, 22 bp, Artificial sequence
  SiRNA target sequence
tggaagaagaaactattacata

SEQ ID NO: 55475 - DNA, 22 bp, Artificial sequence
  SiRNA target sequence
ggaagaagaaactattacatat

SEQ ID NO: 55476 - DNA, 22 bp, Artificial sequence
  SiRNA target sequence
gaagaagaaactattacatatt

SEQ ID NO: 55477 - DNA, 22 bp, Artificial sequence
  SiRNA target sequence
aagaagaaactattacatattt

SEQ ID NO: 55478 - DNA, 22 bp, Artificial sequence
  SiRNA target sequence
agaagaaactattacatatttt

SEQ ID NO: 55479 - DNA, 22 bp, Artificial sequence
  SiRNA target sequence
gaagaaactattacatattttg

SEQ ID NO: 55480 - DNA, 22 bp, Artificial sequence
  SiRNA target sequence
aagaaactattacatattttga

SEQ ID NO: 55481 - DNA, 22 bp, Artificial sequence
  SiRNA target sequence
agaaactattacatattttgat

SEQ ID NO: 55482 - DNA, 22 bp, Artificial sequence
  SiRNA target sequence
gaaactattacatattttgatg

SEQ ID NO: 55483 - DNA, 22 bp, Artificial sequence
  SiRNA target sequence
aaactattacatattttgatga

SEQ ID NO: 55484 - DNA, 22 bp, Artificial sequence
  SiRNA target sequence
aactattacatattttgatgaa

SEQ ID NO: 55485 - DNA, 22 bp, Artificial sequence
  SiRNA target sequence
actattacatattttgatgaaa

SEQ ID NO: 55486 - DNA, 22 bp, Artificial sequence
  SiRNA target sequence
ctattacatattttgatgaaaa

SEQ ID NO: 55487 - DNA, 22 bp, Artificial sequence
  SiRNA target sequence
tattacatattttgatgaaaat

SEQ ID NO: 55488 - DNA, 22 bp, Artificial sequence
  SiRNA target sequence
attacatattttgatgaaaatc

SEQ ID NO: 55489 - DNA, 22 bp, Artificial sequence
  SiRNA target sequence
ttacatattttgatgaaaatca

SEQ ID NO: 55490 - DNA, 22 bp, Artificial sequence
  SiRNA target sequence
tacatattttgatgaaaatcaa

SEQ ID NO: 55491 - DNA, 22 bp, Artificial sequence
  SiRNA target sequence
acatattttgatgaaaatcaaa

SEQ ID NO: 55492 - DNA, 22 bp, Artificial sequence
  SiRNA target sequence
catattttgatgaaaatcaaaa

SEQ ID NO: 55493 - DNA, 22 bp, Artificial sequence
  SiRNA target sequence
atattttgatgaaaatcaaaaa

SEQ ID NO: 55494 - DNA, 22 bp, Artificial sequence
  SiRNA target sequence
tattttgatgaaaatcaaaaac

SEQ ID NO: 55495 - DNA, 22 bp, Artificial sequence
  SiRNA target sequence
attttgatgaaaatcaaaaacc

SEQ ID NO: 55496 - DNA, 22 bp, Artificial sequence
  SiRNA target sequence
ttttgatgaaaatcaaaaaccg

SEQ ID NO: 55497 - DNA, 22 bp, Artificial sequence
  SiRNA target sequence
tttgatgaaaatcaaaaaccgg

SEQ ID NO: 55498 - DNA, 22 bp, Artificial sequence
  SiRNA target sequence
ttgatgaaaatcaaaaaccggt

SEQ ID NO: 55499 - DNA, 22 bp, Artificial sequence
  SiRNA target sequence
tgatgaaaatcaaaaaccggta

SEQ ID NO: 55500 - DNA, 22 bp, Artificial sequence
  SiRNA target sequence
gatgaaaatcaaaaaccggtag

SEQ ID NO: 55501 - DNA, 22 bp, Artificial sequence
  SiRNA target sequence
atgaaaatcaaaaaccggtaga

SEQ ID NO: 55502 - DNA, 22 bp, Artificial sequence
  SiRNA target sequence
tgaaaatcaaaaaccggtagaa

SEQ ID NO: 55503 - DNA, 22 bp, Artificial sequence
  SiRNA target sequence
gaaaatcaaaaaccggtagaat

SEQ ID NO: 55504 - DNA, 22 bp, Artificial sequence
  SiRNA target sequence
aaaatcaaaaaccggtagaata

SEQ ID NO: 55505 - DNA, 22 bp, Artificial sequence
  SiRNA target sequence
aaatcaaaaaccggtagaatat

SEQ ID NO: 55506 - DNA, 22 bp, Artificial sequence
  SiRNA target sequence
aatcaaaaaccggtagaatatt

SEQ ID NO: 55507 - DNA, 22 bp, Artificial sequence
  SiRNA target sequence
atcaaaaaccggtagaatattt

SEQ ID NO: 55508 - DNA, 22 bp, Artificial sequence
  SiRNA target sequence
tcaaaaaccggtagaatatttt

SEQ ID NO: 55509 - DNA, 22 bp, Artificial sequence
  SiRNA target sequence
caaaaaccggtagaatattttg

SEQ ID NO: 55510 - DNA, 22 bp, Artificial sequence
  SiRNA target sequence
aaaaaccggtagaatattttgg

SEQ ID NO: 55511 - DNA, 22 bp, Artificial sequence
  SiRNA target sequence
aaaaccggtagaatattttggg

SEQ ID NO: 55512 - DNA, 22 bp, Artificial sequence
  SiRNA target sequence
aaaccggtagaatattttgggg

SEQ ID NO: 55513 - DNA, 22 bp, Artificial sequence
  SiRNA target sequence
aaccggtagaatattttggggt

SEQ ID NO: 55514 - DNA, 22 bp, Artificial sequence
  SiRNA target sequence
accggtagaatattttggggta

SEQ ID NO: 55515 - DNA, 22 bp, Artificial sequence
  SiRNA target sequence
ccggtagaatattttggggtaa

SEQ ID NO: 55516 - DNA, 22 bp, Artificial sequence
  SiRNA target sequence
cggtagaatattttggggtaaa

SEQ ID NO: 55517 - DNA, 22 bp, Artificial sequence
  SiRNA target sequence
ggtagaatattttggggtaaag

SEQ ID NO: 55518 - DNA, 22 bp, Artificial sequence
  SiRNA target sequence
gtagaatattttggggtaaagt

SEQ ID NO: 55519 - DNA, 22 bp, Artificial sequence
  SiRNA target sequence
tagaatattttggggtaaagtc

SEQ ID NO: 55520 - DNA, 22 bp, Artificial sequence
  SiRNA target sequence
agaatattttggggtaaagtct

SEQ ID NO: 55521 - DNA, 22 bp, Artificial sequence
  SiRNA target sequence
gaatattttggggtaaagtctc

SEQ ID NO: 55522 - DNA, 22 bp, Artificial sequence
  SiRNA target sequence
aatattttggggtaaagtctca

SEQ ID NO: 55523 - DNA, 22 bp, Artificial sequence
  SiRNA target sequence
atattttggggtaaagtctcac

SEQ ID NO: 55524 - DNA, 22 bp, Artificial sequence
  SiRNA target sequence
tattttggggtaaagtctcaca

SEQ ID NO: 55525 - DNA, 22 bp, Artificial sequence
  SiRNA target sequence
attttggggtaaagtctcacag

SEQ ID NO: 55526 - DNA, 22 bp, Artificial sequence
  SiRNA target sequence
ttttggggtaaagtctcacaga

SEQ ID NO: 55527 - DNA, 22 bp, Artificial sequence
  SiRNA target sequence
tttggggtaaagtctcacagaa

SEQ ID NO: 55528 - DNA, 22 bp, Artificial sequence
  SiRNA target sequence
ttggggtaaagtctcacagaat

SEQ ID NO: 55529 - DNA, 22 bp, Artificial sequence
  SiRNA target sequence
tggggtaaagtctcacagaatt

SEQ ID NO: 55530 - DNA, 22 bp, Artificial sequence
  SiRNA target sequence
ggggtaaagtctcacagaattt

SEQ ID NO: 55531 - DNA, 22 bp, Artificial sequence
  SiRNA target sequence
gggtaaagtctcacagaatttt

SEQ ID NO: 55532 - DNA, 22 bp, Artificial sequence
  SiRNA target sequence
ggtaaagtctcacagaattttg

SEQ ID NO: 55533 - DNA, 22 bp, Artificial sequence
  SiRNA target sequence
gtaaagtctcacagaattttgt

SEQ ID NO: 55534 - DNA, 22 bp, Artificial sequence
  SiRNA target sequence
taaagtctcacagaattttgtt

SEQ ID NO: 55535 - DNA, 22 bp, Artificial sequence
  SiRNA target sequence
aaagtctcacagaattttgttc

SEQ ID NO: 55536 - DNA, 22 bp, Artificial sequence
  SiRNA target sequence
aagtctcacagaattttgttct

SEQ ID NO: 55537 - DNA, 22 bp, Artificial sequence
  SiRNA target sequence
agtctcacagaattttgttctc

SEQ ID NO: 55538 - DNA, 22 bp, Artificial sequence
  SiRNA target sequence
gtctcacagaattttgttctct

SEQ ID NO: 55539 - DNA, 22 bp, Artificial sequence
  SiRNA target sequence
tctcacagaattttgttctctc

SEQ ID NO: 55540 - DNA, 22 bp, Artificial sequence
  SiRNA target sequence
ctcacagaattttgttctctct

SEQ ID NO: 55541 - DNA, 22 bp, Artificial sequence
  SiRNA target sequence
tcacagaattttgttctctctt

SEQ ID NO: 55542 - DNA, 22 bp, Artificial sequence
  SiRNA target sequence
cacagaattttgttctctcttt

SEQ ID NO: 55543 - DNA, 22 bp, Artificial sequence
  SiRNA target sequence
acagaattttgttctctctttt

SEQ ID NO: 55544 - DNA, 22 bp, Artificial sequence
  SiRNA target sequence
cagaattttgttctctctttta

SEQ ID NO: 55545 - DNA, 22 bp, Artificial sequence
  SiRNA target sequence
agaattttgttctctcttttat

SEQ ID NO: 55546 - DNA, 22 bp, Artificial sequence
  SiRNA target sequence
gaattttgttctctcttttata

SEQ ID NO: 55547 - DNA, 22 bp, Artificial sequence
  SiRNA target sequence
aattttgttctctcttttatat

SEQ ID NO: 55548 - DNA, 22 bp, Artificial sequence
  SiRNA target sequence
attttgttctctcttttatata

SEQ ID NO: 55549 - DNA, 22 bp, Artificial sequence
  SiRNA target sequence
ttttgttctctcttttatatat

SEQ ID NO: 55550 - DNA, 22 bp, Artificial sequence
  SiRNA target sequence
tttgttctctcttttatatata

SEQ ID NO: 55551 - DNA, 22 bp, Artificial sequence
  SiRNA target sequence
ttgttctctcttttatatatac

SEQ ID NO: 55552 - DNA, 22 bp, Artificial sequence
  SiRNA target sequence
tgttctctcttttatatataca

SEQ ID NO: 55553 - DNA, 22 bp, Artificial sequence
  SiRNA target sequence
gttctctcttttatatatacaa

SEQ ID NO: 55554 - DNA, 22 bp, Artificial sequence
  SiRNA target sequence
ttctctcttttatatatacaaa

SEQ ID NO: 55555 - DNA, 22 bp, Artificial sequence
  SiRNA target sequence
tctctcttttatatatacaaaa

SEQ ID NO: 55556 - DNA, 22 bp, Artificial sequence
  SiRNA target sequence
ctctcttttatatatacaaaaa

SEQ ID NO: 55557 - DNA, 22 bp, Artificial sequence
  SiRNA target sequence
tctcttttatatatacaaaaaa

SEQ ID NO: 55558 - DNA, 22 bp, Artificial sequence
  SiRNA target sequence
ctcttttatatatacaaaaaat

SEQ ID NO: 55559 - DNA, 22 bp, Artificial sequence
  SiRNA target sequence
tcttttatatatacaaaaaatg

SEQ ID NO: 55560 - DNA, 22 bp, Artificial sequence
  SiRNA target sequence
cttttatatatacaaaaaatga

SEQ ID NO: 55561 - DNA, 22 bp, Artificial sequence
  SiRNA target sequence
ttttatatatacaaaaaatgac

SEQ ID NO: 55562 - DNA, 22 bp, Artificial sequence
  SiRNA target sequence
tttatatatacaaaaaatgaca

SEQ ID NO: 55563 - DNA, 22 bp, Artificial sequence
  SiRNA target sequence
ttatatatacaaaaaatgacat

SEQ ID NO: 55564 - DNA, 22 bp, Artificial sequence
  SiRNA target sequence
tatatatacaaaaaatgacatt

SEQ ID NO: 55565 - DNA, 22 bp, Artificial sequence
  SiRNA target sequence
atatatacaaaaaatgacattt

SEQ ID NO: 55566 - DNA, 22 bp, Artificial sequence
  SiRNA target sequence
tatatacaaaaaatgacatttg

SEQ ID NO: 55567 - DNA, 22 bp, Artificial sequence
  SiRNA target sequence
atatacaaaaaatgacatttgc

SEQ ID NO: 55568 - DNA, 22 bp, Artificial sequence
  SiRNA target sequence
tatacaaaaaatgacatttgcg

SEQ ID NO: 55569 - DNA, 22 bp, Artificial sequence
  SiRNA target sequence
atacaaaaaatgacatttgcga

SEQ ID NO: 55570 - DNA, 22 bp, Artificial sequence
  SiRNA target sequence
tacaaaaaatgacatttgcgat

SEQ ID NO: 55571 - DNA, 22 bp, Artificial sequence
  SiRNA target sequence
acaaaaaatgacatttgcgata

SEQ ID NO: 55572 - DNA, 22 bp, Artificial sequence
  SiRNA target sequence
caaaaaatgacatttgcgatac

SEQ ID NO: 55573 - DNA, 22 bp, Artificial sequence
  SiRNA target sequence
aaaaaatgacatttgcgataca

SEQ ID NO: 55574 - DNA, 22 bp, Artificial sequence
  SiRNA target sequence
aaaaatgacatttgcgatacag

SEQ ID NO: 55575 - DNA, 22 bp, Artificial sequence
  SiRNA target sequence
aaaatgacatttgcgatacagg

SEQ ID NO: 55576 - DNA, 22 bp, Artificial sequence
  SiRNA target sequence
aaatgacatttgcgatacaggc

SEQ ID NO: 55577 - DNA, 22 bp, Artificial sequence
  SiRNA target sequence
aatgacatttgcgatacaggca

SEQ ID NO: 55578 - DNA, 22 bp, Artificial sequence
  SiRNA target sequence
atgacatttgcgatacaggcaa

SEQ ID NO: 55579 - DNA, 22 bp, Artificial sequence
  SiRNA target sequence
tgacatttgcgatacaggcaat

SEQ ID NO: 55580 - DNA, 22 bp, Artificial sequence
  SiRNA target sequence
gacatttgcgatacaggcaatt

SEQ ID NO: 55581 - DNA, 22 bp, Artificial sequence
  SiRNA target sequence
acatttgcgatacaggcaatta

SEQ ID NO: 55582 - DNA, 22 bp, Artificial sequence
  SiRNA target sequence
catttgcgatacaggcaattat

SEQ ID NO: 55583 - DNA, 22 bp, Artificial sequence
  SiRNA target sequence
atttgcgatacaggcaattatt

SEQ ID NO: 55584 - DNA, 22 bp, Artificial sequence
  SiRNA target sequence
tttgcgatacaggcaattatta

SEQ ID NO: 55585 - DNA, 22 bp, Artificial sequence
  SiRNA target sequence
ttgcgatacaggcaattattat

SEQ ID NO: 55586 - DNA, 22 bp, Artificial sequence
  SiRNA target sequence
tgcgatacaggcaattattatt

SEQ ID NO: 55587 - DNA, 22 bp, Artificial sequence
  SiRNA target sequence
gcgatacaggcaattattatta

SEQ ID NO: 55588 - DNA, 22 bp, Artificial sequence
  SiRNA target sequence
cgatacaggcaattattattat

SEQ ID NO: 55589 - DNA, 22 bp, Artificial sequence
  SiRNA target sequence
gatacaggcaattattattatc

SEQ ID NO: 55590 - DNA, 22 bp, Artificial sequence
  SiRNA target sequence
atacaggcaattattattatca

SEQ ID NO: 55591 - DNA, 22 bp, Artificial sequence
  SiRNA target sequence
tacaggcaattattattatcac

SEQ ID NO: 55592 - DNA, 22 bp, Artificial sequence
  SiRNA target sequence
acaggcaattattattatcaca

SEQ ID NO: 55593 - DNA, 22 bp, Artificial sequence
  SiRNA target sequence
caggcaattattattatcacat

SEQ ID NO: 55594 - DNA, 22 bp, Artificial sequence
  SiRNA target sequence
aggcaattattattatcacatt

SEQ ID NO: 55595 - DNA, 22 bp, Artificial sequence
  SiRNA target sequence
ggcaattattattatcacatta

SEQ ID NO: 55596 - DNA, 22 bp, Artificial sequence
  SiRNA target sequence
gcaattattattatcacattag

SEQ ID NO: 55597 - DNA, 22 bp, Artificial sequence
  SiRNA target sequence
caattattattatcacattagg

SEQ ID NO: 55598 - DNA, 22 bp, Artificial sequence
  SiRNA target sequence
aattattattatcacattagga

SEQ ID NO: 55599 - DNA, 22 bp, Artificial sequence
  SiRNA target sequence
attattattatcacattaggat

SEQ ID NO: 55600 - DNA, 22 bp, Artificial sequence
  SiRNA target sequence
ttattattatcacattaggatc

SEQ ID NO: 55601 - DNA, 22 bp, Artificial sequence
  SiRNA target sequence
tattattatcacattaggatct

SEQ ID NO: 55602 - DNA, 22 bp, Artificial sequence
  SiRNA target sequence
attattatcacattaggatctt

SEQ ID NO: 55603 - DNA, 22 bp, Artificial sequence
  SiRNA target sequence
ttattatcacattaggatcttt

SEQ ID NO: 55604 - DNA, 22 bp, Artificial sequence
  SiRNA target sequence
tattatcacattaggatctttt

SEQ ID NO: 55605 - DNA, 22 bp, Artificial sequence
  SiRNA target sequence
attatcacattaggatcttttg

SEQ ID NO: 55606 - DNA, 22 bp, Artificial sequence
  SiRNA target sequence
ttatcacattaggatcttttgg

SEQ ID NO: 55607 - DNA, 22 bp, Artificial sequence
  SiRNA target sequence
tatcacattaggatcttttgga

SEQ ID NO: 55608 - DNA, 22 bp, Artificial sequence
  SiRNA target sequence
atcacattaggatcttttggat

SEQ ID NO: 55609 - DNA, 22 bp, Artificial sequence
  SiRNA target sequence
tcacattaggatcttttggata

SEQ ID NO: 55610 - DNA, 22 bp, Artificial sequence
  SiRNA target sequence
cacattaggatcttttggatat

SEQ ID NO: 55611 - DNA, 22 bp, Artificial sequence
  SiRNA target sequence
acattaggatcttttggatatt

SEQ ID NO: 55612 - DNA, 22 bp, Artificial sequence
  SiRNA target sequence
cattaggatcttttggatattt

SEQ ID NO: 55613 - DNA, 22 bp, Artificial sequence
  SiRNA target sequence
attaggatcttttggatatttt

SEQ ID NO: 55614 - DNA, 22 bp, Artificial sequence
  SiRNA target sequence
ttaggatcttttggatattttc

SEQ ID NO: 55615 - DNA, 22 bp, Artificial sequence
  SiRNA target sequence
taggatcttttggatattttcc

SEQ ID NO: 55616 - DNA, 22 bp, Artificial sequence
  SiRNA target sequence
aggatcttttggatattttccg

SEQ ID NO: 55617 - DNA, 22 bp, Artificial sequence
  SiRNA target sequence
ggatcttttggatattttccga

SEQ ID NO: 55618 - DNA, 22 bp, Artificial sequence
  SiRNA target sequence
gatcttttggatattttccgat

SEQ ID NO: 55619 - DNA, 22 bp, Artificial sequence
  SiRNA target sequence
atcttttggatattttccgatt

SEQ ID NO: 55620 - DNA, 22 bp, Artificial sequence
  SiRNA target sequence
tcttttggatattttccgatta

SEQ ID NO: 55621 - DNA, 22 bp, Artificial sequence
  SiRNA target sequence
cttttggatattttccgattaa

SEQ ID NO: 55622 - DNA, 22 bp, Artificial sequence
  SiRNA target sequence
ttttggatattttccgattaaa

SEQ ID NO: 55623 - DNA, 22 bp, Artificial sequence
  SiRNA target sequence
tttggatattttccgattaaat

SEQ ID NO: 55624 - DNA, 22 bp, Artificial sequence
  SiRNA target sequence
ttggatattttccgattaaatt

SEQ ID NO: 55625 - DNA, 22 bp, Artificial sequence
  SiRNA target sequence
tggatattttccgattaaatta

SEQ ID NO: 55626 - DNA, 22 bp, Artificial sequence
  SiRNA target sequence
ggatattttccgattaaattat

SEQ ID NO: 55627 - DNA, 22 bp, Artificial sequence
  SiRNA target sequence
gatattttccgattaaattatc

SEQ ID NO: 55628 - DNA, 22 bp, Artificial sequence
  SiRNA target sequence
atattttccgattaaattatcc

SEQ ID NO: 55629 - DNA, 22 bp, Artificial sequence
  SiRNA target sequence
tattttccgattaaattatcct

SEQ ID NO: 55630 - DNA, 22 bp, Artificial sequence
  SiRNA target sequence
attttccgattaaattatcctc

SEQ ID NO: 55631 - DNA, 22 bp, Artificial sequence
  SiRNA target sequence
ttttccgattaaattatcctct

SEQ ID NO: 55632 - DNA, 22 bp, Artificial sequence
  SiRNA target sequence
tttccgattaaattatcctctc

SEQ ID NO: 55633 - DNA, 22 bp, Artificial sequence
  SiRNA target sequence
ttccgattaaattatcctctca

SEQ ID NO: 55634 - DNA, 22 bp, Artificial sequence
  SiRNA target sequence
tccgattaaattatcctctcaa

SEQ ID NO: 55635 - DNA, 22 bp, Artificial sequence
  SiRNA target sequence
ccgattaaattatcctctcaac

SEQ ID NO: 55636 - DNA, 22 bp, Artificial sequence
  SiRNA target sequence
cgattaaattatcctctcaaca

SEQ ID NO: 55637 - DNA, 22 bp, Artificial sequence
  SiRNA target sequence
gattaaattatcctctcaacag

SEQ ID NO: 55638 - DNA, 22 bp, Artificial sequence
  SiRNA target sequence
attaaattatcctctcaacagt

SEQ ID NO: 55639 - DNA, 22 bp, Artificial sequence
  SiRNA target sequence
ttaaattatcctctcaacagtt

SEQ ID NO: 55640 - DNA, 22 bp, Artificial sequence
  SiRNA target sequence
taaattatcctctcaacagtta

SEQ ID NO: 55641 - DNA, 22 bp, Artificial sequence
  SiRNA target sequence
aaattatcctctcaacagttag

SEQ ID NO: 55642 - DNA, 22 bp, Artificial sequence
  SiRNA target sequence
aattatcctctcaacagttagt

SEQ ID NO: 55643 - DNA, 22 bp, Artificial sequence
  SiRNA target sequence
attatcctctcaacagttagtc

SEQ ID NO: 55644 - DNA, 22 bp, Artificial sequence
  SiRNA target sequence
ttatcctctcaacagttagtct

SEQ ID NO: 55645 - DNA, 22 bp, Artificial sequence
  SiRNA target sequence
tatcctctcaacagttagtctt

SEQ ID NO: 55646 - DNA, 22 bp, Artificial sequence
  SiRNA target sequence
atcctctcaacagttagtcttt

SEQ ID NO: 55647 - DNA, 22 bp, Artificial sequence
  SiRNA target sequence
tcctctcaacagttagtctttt

SEQ ID NO: 55648 - DNA, 22 bp, Artificial sequence
  SiRNA target sequence
cctctcaacagttagtctttta

SEQ ID NO: 55649 - DNA, 22 bp, Artificial sequence
  SiRNA target sequence
ctctcaacagttagtcttttat

SEQ ID NO: 55650 - DNA, 22 bp, Artificial sequence
  SiRNA target sequence
tctcaacagttagtcttttata

SEQ ID NO: 55651 - DNA, 22 bp, Artificial sequence
  SiRNA target sequence
ctcaacagttagtcttttatat

SEQ ID NO: 55652 - DNA, 22 bp, Artificial sequence
  SiRNA target sequence
tcaacagttagtcttttatatt

SEQ ID NO: 55653 - DNA, 22 bp, Artificial sequence
  SiRNA target sequence
caacagttagtcttttatattt

SEQ ID NO: 55654 - DNA, 22 bp, Artificial sequence
  SiRNA target sequence
aacagttagtcttttatatttc

SEQ ID NO: 55655 - DNA, 22 bp, Artificial sequence
  SiRNA target sequence
acagttagtcttttatatttcg

SEQ ID NO: 55656 - DNA, 22 bp, Artificial sequence
  SiRNA target sequence
cagttagtcttttatatttcga

SEQ ID NO: 55657 - DNA, 22 bp, Artificial sequence
  SiRNA target sequence
agttagtcttttatatttcgat

SEQ ID NO: 55658 - DNA, 22 bp, Artificial sequence
  SiRNA target sequence
gttagtcttttatatttcgatt

SEQ ID NO: 55659 - DNA, 22 bp, Artificial sequence
  SiRNA target sequence
ttagtcttttatatttcgatta

SEQ ID NO: 55660 - DNA, 22 bp, Artificial sequence
  SiRNA target sequence
tagtcttttatatttcgattag

SEQ ID NO: 55661 - DNA, 22 bp, Artificial sequence
  SiRNA target sequence
agtcttttatatttcgattagt

SEQ ID NO: 55662 - DNA, 22 bp, Artificial sequence
  SiRNA target sequence
gtcttttatatttcgattagta

SEQ ID NO: 55663 - DNA, 22 bp, Artificial sequence
  SiRNA target sequence
tcttttatatttcgattagtaa

SEQ ID NO: 55664 - DNA, 22 bp, Artificial sequence
  SiRNA target sequence
cttttatatttcgattagtaaa

SEQ ID NO: 55665 - DNA, 22 bp, Artificial sequence
  SiRNA target sequence
ttttatatttcgattagtaaaa

SEQ ID NO: 55666 - DNA, 22 bp, Artificial sequence
  SiRNA target sequence
tttatatttcgattagtaaaac

SEQ ID NO: 55667 - DNA, 22 bp, Artificial sequence
  SiRNA target sequence
ttatatttcgattagtaaaacg

SEQ ID NO: 55668 - DNA, 22 bp, Artificial sequence
  SiRNA target sequence
tatatttcgattagtaaaacgt

SEQ ID NO: 55669 - DNA, 22 bp, Artificial sequence
  SiRNA target sequence
atatttcgattagtaaaacgtt

SEQ ID NO: 55670 - DNA, 22 bp, Artificial sequence
  SiRNA target sequence
tatttcgattagtaaaacgttg

SEQ ID NO: 55671 - DNA, 22 bp, Artificial sequence
  SiRNA target sequence
atttcgattagtaaaacgttga

SEQ ID NO: 55672 - DNA, 22 bp, Artificial sequence
  SiRNA target sequence
tttcgattagtaaaacgttgac

SEQ ID NO: 55673 - DNA, 22 bp, Artificial sequence
  SiRNA target sequence
ttcgattagtaaaacgttgaca

SEQ ID NO: 55674 - DNA, 22 bp, Artificial sequence
  SiRNA target sequence
tcgattagtaaaacgttgacaa

SEQ ID NO: 55675 - DNA, 22 bp, Artificial sequence
  SiRNA target sequence
cgattagtaaaacgttgacaaa

SEQ ID NO: 55676 - DNA, 22 bp, Artificial sequence
  SiRNA target sequence
gattagtaaaacgttgacaaat

SEQ ID NO: 55677 - DNA, 22 bp, Artificial sequence
  SiRNA target sequence
attagtaaaacgttgacaaatt

SEQ ID NO: 55678 - DNA, 22 bp, Artificial sequence
  SiRNA target sequence
ttagtaaaacgttgacaaattc

SEQ ID NO: 55679 - DNA, 22 bp, Artificial sequence
  SiRNA target sequence
tagtaaaacgttgacaaattcg

SEQ ID NO: 55680 - DNA, 22 bp, Artificial sequence
  SiRNA target sequence
agtaaaacgttgacaaattcgt

SEQ ID NO: 55681 - DNA, 22 bp, Artificial sequence
  SiRNA target sequence
gtaaaacgttgacaaattcgtt

SEQ ID NO: 55682 - DNA, 22 bp, Artificial sequence
  SiRNA target sequence
taaaacgttgacaaattcgttg

SEQ ID NO: 55683 - DNA, 22 bp, Artificial sequence
  SiRNA target sequence
aaaacgttgacaaattcgttga

SEQ ID NO: 55684 - DNA, 22 bp, Artificial sequence
  SiRNA target sequence
aaacgttgacaaattcgttgag

SEQ ID NO: 55685 - DNA, 22 bp, Artificial sequence
  SiRNA target sequence
aacgttgacaaattcgttgagc

SEQ ID NO: 55686 - DNA, 22 bp, Artificial sequence
  SiRNA target sequence
acgttgacaaattcgttgagcg

SEQ ID NO: 55687 - DNA, 22 bp, Artificial sequence
  SiRNA target sequence
cgttgacaaattcgttgagcga

SEQ ID NO: 55688 - DNA, 22 bp, Artificial sequence
  SiRNA target sequence
gttgacaaattcgttgagcgaa

SEQ ID NO: 55689 - DNA, 22 bp, Artificial sequence
  SiRNA target sequence
ttgacaaattcgttgagcgaaa

SEQ ID NO: 55690 - DNA, 22 bp, Artificial sequence
  SiRNA target sequence
tgacaaattcgttgagcgaaat

SEQ ID NO: 55691 - DNA, 22 bp, Artificial sequence
  SiRNA target sequence
gacaaattcgttgagcgaaatg

SEQ ID NO: 55692 - DNA, 22 bp, Artificial sequence
  SiRNA target sequence
acaaattcgttgagcgaaatgg

SEQ ID NO: 55693 - DNA, 22 bp, Artificial sequence
  SiRNA target sequence
caaattcgttgagcgaaatggg

SEQ ID NO: 55694 - DNA, 22 bp, Artificial sequence
  SiRNA target sequence
aaattcgttgagcgaaatggga

SEQ ID NO: 55695 - DNA, 22 bp, Artificial sequence
  SiRNA target sequence
aattcgttgagcgaaatgggaa

SEQ ID NO: 55696 - DNA, 22 bp, Artificial sequence
  SiRNA target sequence
attcgttgagcgaaatgggaat

SEQ ID NO: 55697 - DNA, 22 bp, Artificial sequence
  SiRNA target sequence
ttcgttgagcgaaatgggaatg

SEQ ID NO: 55698 - DNA, 22 bp, Artificial sequence
  SiRNA target sequence
tcgttgagcgaaatgggaatgc

SEQ ID NO: 55699 - DNA, 22 bp, Artificial sequence
  SiRNA target sequence
cgttgagcgaaatgggaatgct

SEQ ID NO: 55700 - DNA, 22 bp, Artificial sequence
  SiRNA target sequence
gttgagcgaaatgggaatgcta

SEQ ID NO: 55701 - DNA, 22 bp, Artificial sequence
  SiRNA target sequence
ttgagcgaaatgggaatgctat

SEQ ID NO: 55702 - DNA, 22 bp, Artificial sequence
  SiRNA target sequence
tgagcgaaatgggaatgctata

SEQ ID NO: 55703 - DNA, 22 bp, Artificial sequence
  SiRNA target sequence
gagcgaaatgggaatgctatac

SEQ ID NO: 55704 - DNA, 22 bp, Artificial sequence
  SiRNA target sequence
agcgaaatgggaatgctataca

SEQ ID NO: 55705 - DNA, 22 bp, Artificial sequence
  SiRNA target sequence
gcgaaatgggaatgctatacac

SEQ ID NO: 55706 - DNA, 22 bp, Artificial sequence
  SiRNA target sequence
cgaaatgggaatgctatacaca

SEQ ID NO: 55707 - DNA, 22 bp, Artificial sequence
  SiRNA target sequence
gaaatgggaatgctatacacaa

SEQ ID NO: 55708 - DNA, 22 bp, Artificial sequence
  SiRNA target sequence
aaatgggaatgctatacacaag

SEQ ID NO: 55709 - DNA, 22 bp, Artificial sequence
  SiRNA target sequence
aatgggaatgctatacacaaga

SEQ ID NO: 55710 - DNA, 22 bp, Artificial sequence
  SiRNA target sequence
atgggaatgctatacacaagat

SEQ ID NO: 55711 - DNA, 22 bp, Artificial sequence
  SiRNA target sequence
tgggaatgctatacacaagata

SEQ ID NO: 55712 - DNA, 22 bp, Artificial sequence
  SiRNA target sequence
gggaatgctatacacaagatat

SEQ ID NO: 55713 - DNA, 22 bp, Artificial sequence
  SiRNA target sequence
ggaatgctatacacaagatatg

SEQ ID NO: 55714 - DNA, 22 bp, Artificial sequence
  SiRNA target sequence
gaatgctatacacaagatatgt

SEQ ID NO: 55715 - DNA, 22 bp, Artificial sequence
  SiRNA target sequence
aatgctatacacaagatatgta

SEQ ID NO: 55716 - DNA, 22 bp, Artificial sequence
  SiRNA target sequence
atgctatacacaagatatgtac

SEQ ID NO: 55717 - DNA, 22 bp, Artificial sequence
  SiRNA target sequence
tgctatacacaagatatgtaca

SEQ ID NO: 55718 - DNA, 22 bp, Artificial sequence
  SiRNA target sequence
gctatacacaagatatgtacaa

SEQ ID NO: 55719 - DNA, 22 bp, Artificial sequence
  SiRNA target sequence
ctatacacaagatatgtacaag

SEQ ID NO: 55720 - DNA, 22 bp, Artificial sequence
  SiRNA target sequence
tatacacaagatatgtacaagg

SEQ ID NO: 55721 - DNA, 22 bp, Artificial sequence
  SiRNA target sequence
atacacaagatatgtacaagga

SEQ ID NO: 55722 - DNA, 22 bp, Artificial sequence
  SiRNA target sequence
tacacaagatatgtacaaggat

SEQ ID NO: 55723 - DNA, 22 bp, Artificial sequence
  SiRNA target sequence
acacaagatatgtacaaggatt

SEQ ID NO: 55724 - DNA, 22 bp, Artificial sequence
  SiRNA target sequence
cacaagatatgtacaaggattt

SEQ ID NO: 55725 - DNA, 22 bp, Artificial sequence
  SiRNA target sequence
acaagatatgtacaaggatttt

SEQ ID NO: 55726 - DNA, 22 bp, Artificial sequence
  SiRNA target sequence
caagatatgtacaaggattttt

SEQ ID NO: 55727 - DNA, 22 bp, Artificial sequence
  SiRNA target sequence
aagatatgtacaaggattttta

SEQ ID NO: 55728 - DNA, 22 bp, Artificial sequence
  SiRNA target sequence
agatatgtacaaggatttttaa

SEQ ID NO: 55729 - DNA, 22 bp, Artificial sequence
  SiRNA target sequence
gatatgtacaaggatttttaaa

SEQ ID NO: 55730 - DNA, 22 bp, Artificial sequence
  SiRNA target sequence
atatgtacaaggatttttaaat

SEQ ID NO: 55731 - DNA, 22 bp, Artificial sequence
  SiRNA target sequence
tatgtacaaggatttttaaatg

SEQ ID NO: 55732 - DNA, 22 bp, Artificial sequence
  SiRNA target sequence
atgtacaaggatttttaaatgc

SEQ ID NO: 55733 - DNA, 22 bp, Artificial sequence
  SiRNA target sequence
tgtacaaggatttttaaatgca

SEQ ID NO: 55734 - DNA, 22 bp, Artificial sequence
  SiRNA target sequence
gtacaaggatttttaaatgcaa

SEQ ID NO: 55735 - DNA, 22 bp, Artificial sequence
  SiRNA target sequence
tacaaggatttttaaatgcaaa

SEQ ID NO: 55736 - DNA, 22 bp, Artificial sequence
  SiRNA target sequence
acaaggatttttaaatgcaaag

SEQ ID NO: 55737 - DNA, 22 bp, Artificial sequence
  SiRNA target sequence
caaggatttttaaatgcaaagt

SEQ ID NO: 55738 - DNA, 22 bp, Artificial sequence
  SiRNA target sequence
aaggatttttaaatgcaaagtc

SEQ ID NO: 55739 - DNA, 22 bp, Artificial sequence
  SiRNA target sequence
aggatttttaaatgcaaagtct

SEQ ID NO: 55740 - DNA, 22 bp, Artificial sequence
  SiRNA target sequence
ggatttttaaatgcaaagtctg

SEQ ID NO: 55741 - DNA, 22 bp, Artificial sequence
  SiRNA target sequence
gatttttaaatgcaaagtctgg

SEQ ID NO: 55742 - DNA, 22 bp, Artificial sequence
  SiRNA target sequence
atttttaaatgcaaagtctgga

SEQ ID NO: 55743 - DNA, 22 bp, Artificial sequence
  SiRNA target sequence
tttttaaatgcaaagtctggat

SEQ ID NO: 55744 - DNA, 22 bp, Artificial sequence
  SiRNA target sequence
ttttaaatgcaaagtctggata

SEQ ID NO: 55745 - DNA, 22 bp, Artificial sequence
  SiRNA target sequence
tttaaatgcaaagtctggatat

SEQ ID NO: 55746 - DNA, 22 bp, Artificial sequence
  SiRNA target sequence
ttaaatgcaaagtctggatatt

SEQ ID NO: 55747 - DNA, 22 bp, Artificial sequence
  SiRNA target sequence
taaatgcaaagtctggatatta

SEQ ID NO: 55748 - DNA, 22 bp, Artificial sequence
  SiRNA target sequence
aaatgcaaagtctggatattac

SEQ ID NO: 55749 - DNA, 22 bp, Artificial sequence
  SiRNA target sequence
aatgcaaagtctggatattacg

SEQ ID NO: 55750 - DNA, 22 bp, Artificial sequence
  SiRNA target sequence
atgcaaagtctggatattacga

SEQ ID NO: 55751 - DNA, 22 bp, Artificial sequence
  SiRNA target sequence
tgcaaagtctggatattacgag

SEQ ID NO: 55752 - DNA, 22 bp, Artificial sequence
  SiRNA target sequence
gcaaagtctggatattacgagt

SEQ ID NO: 55753 - DNA, 22 bp, Artificial sequence
  SiRNA target sequence
caaagtctggatattacgagtt

SEQ ID NO: 55754 - DNA, 22 bp, Artificial sequence
  SiRNA target sequence
aaagtctggatattacgagttt

SEQ ID NO: 55755 - DNA, 22 bp, Artificial sequence
  SiRNA target sequence
aagtctggatattacgagttta

SEQ ID NO: 55756 - DNA, 22 bp, Artificial sequence
  SiRNA target sequence
agtctggatattacgagtttaa

SEQ ID NO: 55757 - DNA, 22 bp, Artificial sequence
  SiRNA target sequence
gtctggatattacgagtttaaa

SEQ ID NO: 55758 - DNA, 22 bp, Artificial sequence
  SiRNA target sequence
tctggatattacgagtttaaag

SEQ ID NO: 55759 - DNA, 22 bp, Artificial sequence
  SiRNA target sequence
ctggatattacgagtttaaaga

SEQ ID NO: 55760 - DNA, 22 bp, Artificial sequence
  SiRNA target sequence
tggatattacgagtttaaagag

SEQ ID NO: 55761 - DNA, 22 bp, Artificial sequence
  SiRNA target sequence
ggatattacgagtttaaagagg

SEQ ID NO: 55762 - DNA, 22 bp, Artificial sequence
  SiRNA target sequence
gatattacgagtttaaagagga

SEQ ID NO: 55763 - DNA, 22 bp, Artificial sequence
  SiRNA target sequence
atattacgagtttaaagaggat

SEQ ID NO: 55764 - DNA, 22 bp, Artificial sequence
  SiRNA target sequence
tattacgagtttaaagaggata

SEQ ID NO: 55765 - DNA, 22 bp, Artificial sequence
  SiRNA target sequence
attacgagtttaaagaggatac

SEQ ID NO: 55766 - DNA, 22 bp, Artificial sequence
  SiRNA target sequence
ttacgagtttaaagaggataca

SEQ ID NO: 55767 - DNA, 22 bp, Artificial sequence
  SiRNA target sequence
tacgagtttaaagaggatacac

SEQ ID NO: 55768 - DNA, 22 bp, Artificial sequence
  SiRNA target sequence
acgagtttaaagaggatacaca

SEQ ID NO: 55769 - DNA, 22 bp, Artificial sequence
  SiRNA target sequence
cgagtttaaagaggatacacaa

SEQ ID NO: 55770 - DNA, 22 bp, Artificial sequence
  SiRNA target sequence
gagtttaaagaggatacacaaa

SEQ ID NO: 55771 - DNA, 22 bp, Artificial sequence
  SiRNA target sequence
agtttaaagaggatacacaaac

SEQ ID NO: 55772 - DNA, 22 bp, Artificial sequence
  SiRNA target sequence
gtttaaagaggatacacaaact

SEQ ID NO: 55773 - DNA, 22 bp, Artificial sequence
  SiRNA target sequence
tttaaagaggatacacaaactg

SEQ ID NO: 55774 - DNA, 22 bp, Artificial sequence
  SiRNA target sequence
ttaaagaggatacacaaactga

SEQ ID NO: 55775 - DNA, 22 bp, Artificial sequence
  SiRNA target sequence
taaagaggatacacaaactgat

SEQ ID NO: 55776 - DNA, 22 bp, Artificial sequence
  SiRNA target sequence
aaagaggatacacaaactgata

SEQ ID NO: 55777 - DNA, 22 bp, Artificial sequence
  SiRNA target sequence
aagaggatacacaaactgataa

SEQ ID NO: 55778 - DNA, 22 bp, Artificial sequence
  SiRNA target sequence
agaggatacacaaactgataaa

SEQ ID NO: 55779 - DNA, 22 bp, Artificial sequence
  SiRNA target sequence
gaggatacacaaactgataaaa

SEQ ID NO: 55780 - DNA, 22 bp, Artificial sequence
  SiRNA target sequence
aggatacacaaactgataaaat

SEQ ID NO: 55781 - DNA, 22 bp, Artificial sequence
  SiRNA target sequence
ggatacacaaactgataaaata

SEQ ID NO: 55782 - DNA, 22 bp, Artificial sequence
  SiRNA target sequence
gatacacaaactgataaaataa

SEQ ID NO: 55783 - DNA, 22 bp, Artificial sequence
  SiRNA target sequence
atacacaaactgataaaataag

SEQ ID NO: 55784 - DNA, 22 bp, Artificial sequence
  SiRNA target sequence
tacacaaactgataaaataaga

SEQ ID NO: 55785 - DNA, 22 bp, Artificial sequence
  SiRNA target sequence
acacaaactgataaaataagac

SEQ ID NO: 55786 - DNA, 22 bp, Artificial sequence
  SiRNA target sequence
cacaaactgataaaataagact

SEQ ID NO: 55787 - DNA, 22 bp, Artificial sequence
  SiRNA target sequence
acaaactgataaaataagactg

SEQ ID NO: 55788 - DNA, 22 bp, Artificial sequence
  SiRNA target sequence
caaactgataaaataagactga

SEQ ID NO: 55789 - DNA, 22 bp, Artificial sequence
  SiRNA target sequence
aaactgataaaataagactgat

SEQ ID NO: 55790 - DNA, 22 bp, Artificial sequence
  SiRNA target sequence
aactgataaaataagactgata

SEQ ID NO: 55791 - DNA, 22 bp, Artificial sequence
  SiRNA target sequence
actgataaaataagactgatag

SEQ ID NO: 55792 - DNA, 22 bp, Artificial sequence
  SiRNA target sequence
ctgataaaataagactgataga

SEQ ID NO: 55793 - DNA, 22 bp, Artificial sequence
  SiRNA target sequence
tgataaaataagactgatagat

SEQ ID NO: 55794 - DNA, 22 bp, Artificial sequence
  SiRNA target sequence
gataaaataagactgatagatt

SEQ ID NO: 55795 - DNA, 22 bp, Artificial sequence
  SiRNA target sequence
ataaaataagactgatagattt

SEQ ID NO: 55796 - DNA, 22 bp, Artificial sequence
  SiRNA target sequence
taaaataagactgatagatttt

SEQ ID NO: 55797 - DNA, 22 bp, Artificial sequence
  SiRNA target sequence
aaaataagactgatagatttta

SEQ ID NO: 55798 - DNA, 22 bp, Artificial sequence
  SiRNA target sequence
aaataagactgatagattttaa

SEQ ID NO: 55799 - DNA, 22 bp, Artificial sequence
  SiRNA target sequence
aataagactgatagattttaat

SEQ ID NO: 55800 - DNA, 22 bp, Artificial sequence
  SiRNA target sequence
ataagactgatagattttaatg

SEQ ID NO: 55801 - DNA, 22 bp, Artificial sequence
  SiRNA target sequence
taagactgatagattttaatga

SEQ ID NO: 55802 - DNA, 22 bp, Artificial sequence
  SiRNA target sequence
aagactgatagattttaatgaa

SEQ ID NO: 55803 - DNA, 22 bp, Artificial sequence
  SiRNA target sequence
agactgatagattttaatgaaa

SEQ ID NO: 55804 - DNA, 22 bp, Artificial sequence
  SiRNA target sequence
gactgatagattttaatgaaaa

SEQ ID NO: 55805 - DNA, 22 bp, Artificial sequence
  SiRNA target sequence
actgatagattttaatgaaaag

SEQ ID NO: 55806 - DNA, 22 bp, Artificial sequence
  SiRNA target sequence
ctgatagattttaatgaaaagc

SEQ ID NO: 55807 - DNA, 22 bp, Artificial sequence
  SiRNA target sequence
tgatagattttaatgaaaagct

SEQ ID NO: 55808 - DNA, 22 bp, Artificial sequence
  SiRNA target sequence
gatagattttaatgaaaagcta

SEQ ID NO: 55809 - DNA, 22 bp, Artificial sequence
  SiRNA target sequence
atagattttaatgaaaagctag

SEQ ID NO: 55810 - DNA, 22 bp, Artificial sequence
  SiRNA target sequence
tagattttaatgaaaagctaga

SEQ ID NO: 55811 - DNA, 22 bp, Artificial sequence
  SiRNA target sequence
agattttaatgaaaagctagaa

SEQ ID NO: 55812 - DNA, 22 bp, Artificial sequence
  SiRNA target sequence
gattttaatgaaaagctagaat

SEQ ID NO: 55813 - DNA, 22 bp, Artificial sequence
  SiRNA target sequence
attttaatgaaaagctagaatt

SEQ ID NO: 55814 - DNA, 22 bp, Artificial sequence
  SiRNA target sequence
ttttaatgaaaagctagaattt

SEQ ID NO: 55815 - DNA, 22 bp, Artificial sequence
  SiRNA target sequence
tttaatgaaaagctagaattta

SEQ ID NO: 55816 - DNA, 22 bp, Artificial sequence
  SiRNA target sequence
ttaatgaaaagctagaatttag

SEQ ID NO: 55817 - DNA, 22 bp, Artificial sequence
  SiRNA target sequence
taatgaaaagctagaatttaga

SEQ ID NO: 55818 - DNA, 22 bp, Artificial sequence
  SiRNA target sequence
aatgaaaagctagaatttagaa

SEQ ID NO: 55819 - DNA, 22 bp, Artificial sequence
  SiRNA target sequence
atgaaaagctagaatttagaaa

SEQ ID NO: 55820 - DNA, 22 bp, Artificial sequence
  SiRNA target sequence
tgaaaagctagaatttagaaat

SEQ ID NO: 55821 - DNA, 22 bp, Artificial sequence
  SiRNA target sequence
gaaaagctagaatttagaaatg

SEQ ID NO: 55822 - DNA, 22 bp, Artificial sequence
  SiRNA target sequence
aaaagctagaatttagaaatgt

SEQ ID NO: 55823 - DNA, 22 bp, Artificial sequence
  SiRNA target sequence
aaagctagaatttagaaatgta

SEQ ID NO: 55824 - DNA, 22 bp, Artificial sequence
  SiRNA target sequence
aagctagaatttagaaatgtat

SEQ ID NO: 55825 - DNA, 22 bp, Artificial sequence
  SiRNA target sequence
agctagaatttagaaatgtatc

SEQ ID NO: 55826 - DNA, 22 bp, Artificial sequence
  SiRNA target sequence
gctagaatttagaaatgtatct

SEQ ID NO: 55827 - DNA, 22 bp, Artificial sequence
  SiRNA target sequence
ctagaatttagaaatgtatctt

SEQ ID NO: 55828 - DNA, 22 bp, Artificial sequence
  SiRNA target sequence
tagaatttagaaatgtatcttt

SEQ ID NO: 55829 - DNA, 22 bp, Artificial sequence
  SiRNA target sequence
agaatttagaaatgtatctttt

SEQ ID NO: 55830 - DNA, 22 bp, Artificial sequence
  SiRNA target sequence
gaatttagaaatgtatctttta

SEQ ID NO: 55831 - DNA, 22 bp, Artificial sequence
  SiRNA target sequence
aatttagaaatgtatcttttag

SEQ ID NO: 55832 - DNA, 22 bp, Artificial sequence
  SiRNA target sequence
atttagaaatgtatcttttagt

SEQ ID NO: 55833 - DNA, 22 bp, Artificial sequence
  SiRNA target sequence
tttagaaatgtatcttttagtt

SEQ ID NO: 55834 - DNA, 22 bp, Artificial sequence
  SiRNA target sequence
ttagaaatgtatcttttagtta

SEQ ID NO: 55835 - DNA, 22 bp, Artificial sequence
  SiRNA target sequence
tagaaatgtatcttttagttat

SEQ ID NO: 55836 - DNA, 22 bp, Artificial sequence
  SiRNA target sequence
agaaatgtatcttttagttatt

SEQ ID NO: 55837 - DNA, 22 bp, Artificial sequence
  SiRNA target sequence
gaaatgtatcttttagttattt

SEQ ID NO: 55838 - DNA, 22 bp, Artificial sequence
  SiRNA target sequence
aaatgtatcttttagttattta

SEQ ID NO: 55839 - DNA, 22 bp, Artificial sequence
  SiRNA target sequence
aatgtatcttttagttatttaa

SEQ ID NO: 55840 - DNA, 22 bp, Artificial sequence
  SiRNA target sequence
atgtatcttttagttatttaaa

SEQ ID NO: 55841 - DNA, 22 bp, Artificial sequence
  SiRNA target sequence
tgtatcttttagttatttaaat

SEQ ID NO: 55842 - DNA, 22 bp, Artificial sequence
  SiRNA target sequence
gtatcttttagttatttaaata

SEQ ID NO: 55843 - DNA, 22 bp, Artificial sequence
  SiRNA target sequence
tatcttttagttatttaaataa

SEQ ID NO: 55844 - DNA, 22 bp, Artificial sequence
  SiRNA target sequence
atcttttagttatttaaataag

SEQ ID NO: 55845 - DNA, 22 bp, Artificial sequence
  SiRNA target sequence
tcttttagttatttaaataagc

SEQ ID NO: 55846 - DNA, 22 bp, Artificial sequence
  SiRNA target sequence
cttttagttatttaaataagcc

SEQ ID NO: 55847 - DNA, 22 bp, Artificial sequence
  SiRNA target sequence
ttttagttatttaaataagcct

SEQ ID NO: 55848 - DNA, 22 bp, Artificial sequence
  SiRNA target sequence
tttagttatttaaataagccta

SEQ ID NO: 55849 - DNA, 22 bp, Artificial sequence
  SiRNA target sequence
ttagttatttaaataagcctat

SEQ ID NO: 55850 - DNA, 22 bp, Artificial sequence
  SiRNA target sequence
tagttatttaaataagcctatt

SEQ ID NO: 55851 - DNA, 22 bp, Artificial sequence
  SiRNA target sequence
agttatttaaataagcctattt

SEQ ID NO: 55852 - DNA, 22 bp, Artificial sequence
  SiRNA target sequence
gttatttaaataagcctatttt

SEQ ID NO: 55853 - DNA, 22 bp, Artificial sequence
  SiRNA target sequence
ttatttaaataagcctatttta

SEQ ID NO: 55854 - DNA, 22 bp, Artificial sequence
  SiRNA target sequence
tatttaaataagcctattttag

SEQ ID NO: 55855 - DNA, 22 bp, Artificial sequence
  SiRNA target sequence
atttaaataagcctattttagt

SEQ ID NO: 55856 - DNA, 22 bp, Artificial sequence
  SiRNA target sequence
tttaaataagcctattttagtg

SEQ ID NO: 55857 - DNA, 22 bp, Artificial sequence
  SiRNA target sequence
ttaaataagcctattttagtga

SEQ ID NO: 55858 - DNA, 22 bp, Artificial sequence
  SiRNA target sequence
taaataagcctattttagtgaa

SEQ ID NO: 55859 - DNA, 22 bp, Artificial sequence
  SiRNA target sequence
aaataagcctattttagtgaat

SEQ ID NO: 55860 - DNA, 22 bp, Artificial sequence
  SiRNA target sequence
aataagcctattttagtgaatg

SEQ ID NO: 55861 - DNA, 22 bp, Artificial sequence
  SiRNA target sequence
ataagcctattttagtgaatgc

SEQ ID NO: 55862 - DNA, 22 bp, Artificial sequence
  SiRNA target sequence
taagcctattttagtgaatgct

SEQ ID NO: 55863 - DNA, 22 bp, Artificial sequence
  SiRNA target sequence
aagcctattttagtgaatgcta

SEQ ID NO: 55864 - DNA, 22 bp, Artificial sequence
  SiRNA target sequence
agcctattttagtgaatgctaa

SEQ ID NO: 55865 - DNA, 22 bp, Artificial sequence
  SiRNA target sequence
gcctattttagtgaatgctaat

SEQ ID NO: 55866 - DNA, 22 bp, Artificial sequence
  SiRNA target sequence
cctattttagtgaatgctaatt

SEQ ID NO: 55867 - DNA, 22 bp, Artificial sequence
  SiRNA target sequence
ctattttagtgaatgctaattt

SEQ ID NO: 55868 - DNA, 22 bp, Artificial sequence
  SiRNA target sequence
tattttagtgaatgctaatttc

SEQ ID NO: 55869 - DNA, 22 bp, Artificial sequence
  SiRNA target sequence
attttagtgaatgctaatttcg

SEQ ID NO: 55870 - DNA, 22 bp, Artificial sequence
  SiRNA target sequence
ttttagtgaatgctaatttcgt

SEQ ID NO: 55871 - DNA, 22 bp, Artificial sequence
  SiRNA target sequence
tttagtgaatgctaatttcgtt

SEQ ID NO: 55872 - DNA, 22 bp, Artificial sequence
  SiRNA target sequence
ttagtgaatgctaatttcgtta

SEQ ID NO: 55873 - DNA, 22 bp, Artificial sequence
  SiRNA target sequence
tagtgaatgctaatttcgttat

SEQ ID NO: 55874 - DNA, 22 bp, Artificial sequence
  SiRNA target sequence
agtgaatgctaatttcgttatt

SEQ ID NO: 55875 - DNA, 22 bp, Artificial sequence
  SiRNA target sequence
gtgaatgctaatttcgttatta

SEQ ID NO: 55876 - DNA, 22 bp, Artificial sequence
  SiRNA target sequence
tgaatgctaatttcgttattaa

SEQ ID NO: 55877 - DNA, 22 bp, Artificial sequence
  SiRNA target sequence
gaatgctaatttcgttattaat

SEQ ID NO: 55878 - DNA, 22 bp, Artificial sequence
  SiRNA target sequence
aatgctaatttcgttattaata

SEQ ID NO: 55879 - DNA, 22 bp, Artificial sequence
  SiRNA target sequence
atgctaatttcgttattaataa

SEQ ID NO: 55880 - DNA, 22 bp, Artificial sequence
  SiRNA target sequence
tgctaatttcgttattaataaa

SEQ ID NO: 55881 - DNA, 22 bp, Artificial sequence
  SiRNA target sequence
gctaatttcgttattaataaag

SEQ ID NO: 55882 - DNA, 22 bp, Artificial sequence
  SiRNA target sequence
ctaatttcgttattaataaagg

SEQ ID NO: 55883 - DNA, 22 bp, Artificial sequence
  SiRNA target sequence
taatttcgttattaataaaggg

SEQ ID NO: 55884 - DNA, 22 bp, Artificial sequence
  SiRNA target sequence
aatttcgttattaataaagggg

SEQ ID NO: 55885 - DNA, 22 bp, Artificial sequence
  SiRNA target sequence
atttcgttattaataaagggga

SEQ ID NO: 55886 - DNA, 22 bp, Artificial sequence
  SiRNA target sequence
tttcgttattaataaaggggag

SEQ ID NO: 55887 - DNA, 22 bp, Artificial sequence
  SiRNA target sequence
ttcgttattaataaaggggagc

SEQ ID NO: 55888 - DNA, 22 bp, Artificial sequence
  SiRNA target sequence
tcgttattaataaaggggagcg

SEQ ID NO: 55889 - DNA, 22 bp, Artificial sequence
  SiRNA target sequence
cgttattaataaaggggagcgt

SEQ ID NO: 55890 - DNA, 22 bp, Artificial sequence
  SiRNA target sequence
gttattaataaaggggagcgtg

SEQ ID NO: 55891 - DNA, 22 bp, Artificial sequence
  SiRNA target sequence
ttattaataaaggggagcgtgt

SEQ ID NO: 55892 - DNA, 22 bp, Artificial sequence
  SiRNA target sequence
tattaataaaggggagcgtgtt

SEQ ID NO: 55893 - DNA, 22 bp, Artificial sequence
  SiRNA target sequence
attaataaaggggagcgtgttg

SEQ ID NO: 55894 - DNA, 22 bp, Artificial sequence
  SiRNA target sequence
ttaataaaggggagcgtgttgc

SEQ ID NO: 55895 - DNA, 22 bp, Artificial sequence
  SiRNA target sequence
taataaaggggagcgtgttgct

SEQ ID NO: 55896 - DNA, 22 bp, Artificial sequence
  SiRNA target sequence
aataaaggggagcgtgttgcta

SEQ ID NO: 55897 - DNA, 22 bp, Artificial sequence
  SiRNA target sequence
ataaaggggagcgtgttgctat

SEQ ID NO: 55898 - DNA, 22 bp, Artificial sequence
  SiRNA target sequence
taaaggggagcgtgttgctatt

SEQ ID NO: 55899 - DNA, 22 bp, Artificial sequence
  SiRNA target sequence
aaaggggagcgtgttgctatta

SEQ ID NO: 55900 - DNA, 22 bp, Artificial sequence
  SiRNA target sequence
aaggggagcgtgttgctattat

SEQ ID NO: 55901 - DNA, 22 bp, Artificial sequence
  SiRNA target sequence
aggggagcgtgttgctattata

SEQ ID NO: 55902 - DNA, 22 bp, Artificial sequence
  SiRNA target sequence
ggggagcgtgttgctattatag

SEQ ID NO: 55903 - DNA, 22 bp, Artificial sequence
  SiRNA target sequence
gggagcgtgttgctattatagg

SEQ ID NO: 55904 - DNA, 22 bp, Artificial sequence
  SiRNA target sequence
ggagcgtgttgctattatagga

SEQ ID NO: 55905 - DNA, 22 bp, Artificial sequence
  SiRNA target sequence
gagcgtgttgctattataggaa

SEQ ID NO: 55906 - DNA, 22 bp, Artificial sequence
  SiRNA target sequence
agcgtgttgctattataggaaa

SEQ ID NO: 55907 - DNA, 22 bp, Artificial sequence
  SiRNA target sequence
gcgtgttgctattataggaaaa

SEQ ID NO: 55908 - DNA, 22 bp, Artificial sequence
  SiRNA target sequence
cgtgttgctattataggaaaaa

SEQ ID NO: 55909 - DNA, 22 bp, Artificial sequence
  SiRNA target sequence
gtgttgctattataggaaaaaa

SEQ ID NO: 55910 - DNA, 22 bp, Artificial sequence
  SiRNA target sequence
tgttgctattataggaaaaaat

SEQ ID NO: 55911 - DNA, 22 bp, Artificial sequence
  SiRNA target sequence
gttgctattataggaaaaaatg

SEQ ID NO: 55912 - DNA, 22 bp, Artificial sequence
  SiRNA target sequence
ttgctattataggaaaaaatgg

SEQ ID NO: 55913 - DNA, 22 bp, Artificial sequence
  SiRNA target sequence
tgctattataggaaaaaatgga

SEQ ID NO: 55914 - DNA, 22 bp, Artificial sequence
  SiRNA target sequence
gctattataggaaaaaatggaa

SEQ ID NO: 55915 - DNA, 22 bp, Artificial sequence
  SiRNA target sequence
ctattataggaaaaaatggaac

SEQ ID NO: 55916 - DNA, 22 bp, Artificial sequence
  SiRNA target sequence
tattataggaaaaaatggaaca

SEQ ID NO: 55917 - DNA, 22 bp, Artificial sequence
  SiRNA target sequence
attataggaaaaaatggaacag

SEQ ID NO: 55918 - DNA, 22 bp, Artificial sequence
  SiRNA target sequence
ttataggaaaaaatggaacagg

SEQ ID NO: 55919 - DNA, 22 bp, Artificial sequence
  SiRNA target sequence
tataggaaaaaatggaacaggt

SEQ ID NO: 55920 - DNA, 22 bp, Artificial sequence
  SiRNA target sequence
ataggaaaaaatggaacaggta

SEQ ID NO: 55921 - DNA, 22 bp, Artificial sequence
  SiRNA target sequence
taggaaaaaatggaacaggtaa

SEQ ID NO: 55922 - DNA, 22 bp, Artificial sequence
  SiRNA target sequence
aggaaaaaatggaacaggtaaa

SEQ ID NO: 55923 - DNA, 22 bp, Artificial sequence
  SiRNA target sequence
ggaaaaaatggaacaggtaaaa

SEQ ID NO: 55924 - DNA, 22 bp, Artificial sequence
  SiRNA target sequence
gaaaaaatggaacaggtaaaag

SEQ ID NO: 55925 - DNA, 22 bp, Artificial sequence
  SiRNA target sequence
aaaaaatggaacaggtaaaagt

SEQ ID NO: 55926 - DNA, 22 bp, Artificial sequence
  SiRNA target sequence
aaaaatggaacaggtaaaagta

SEQ ID NO: 55927 - DNA, 22 bp, Artificial sequence
  SiRNA target sequence
aaaatggaacaggtaaaagtac

SEQ ID NO: 55928 - DNA, 22 bp, Artificial sequence
  SiRNA target sequence
aaatggaacaggtaaaagtaca

SEQ ID NO: 55929 - DNA, 22 bp, Artificial sequence
  SiRNA target sequence
aatggaacaggtaaaagtacaa

SEQ ID NO: 55930 - DNA, 22 bp, Artificial sequence
  SiRNA target sequence
atggaacaggtaaaagtacaat

SEQ ID NO: 55931 - DNA, 22 bp, Artificial sequence
  SiRNA target sequence
tggaacaggtaaaagtacaata

SEQ ID NO: 55932 - DNA, 22 bp, Artificial sequence
  SiRNA target sequence
ggaacaggtaaaagtacaataa

SEQ ID NO: 55933 - DNA, 22 bp, Artificial sequence
  SiRNA target sequence
gaacaggtaaaagtacaataat

SEQ ID NO: 55934 - DNA, 22 bp, Artificial sequence
  SiRNA target sequence
aacaggtaaaagtacaataata

SEQ ID NO: 55935 - DNA, 22 bp, Artificial sequence
  SiRNA target sequence
acaggtaaaagtacaataataa

SEQ ID NO: 55936 - DNA, 22 bp, Artificial sequence
  SiRNA target sequence
caggtaaaagtacaataataaa

SEQ ID NO: 55937 - DNA, 22 bp, Artificial sequence
  SiRNA target sequence
aggtaaaagtacaataataaaa

SEQ ID NO: 55938 - DNA, 22 bp, Artificial sequence
  SiRNA target sequence
ggtaaaagtacaataataaaat

SEQ ID NO: 55939 - DNA, 22 bp, Artificial sequence
  SiRNA target sequence
gtaaaagtacaataataaaatt

SEQ ID NO: 55940 - DNA, 22 bp, Artificial sequence
  SiRNA target sequence
taaaagtacaataataaaattg

SEQ ID NO: 55941 - DNA, 22 bp, Artificial sequence
  SiRNA target sequence
aaaagtacaataataaaattgt

SEQ ID NO: 55942 - DNA, 22 bp, Artificial sequence
  SiRNA target sequence
aaagtacaataataaaattgtt

SEQ ID NO: 55943 - DNA, 22 bp, Artificial sequence
  SiRNA target sequence
aagtacaataataaaattgtta

SEQ ID NO: 55944 - DNA, 22 bp, Artificial sequence
  SiRNA target sequence
agtacaataataaaattgttaa

SEQ ID NO: 55945 - DNA, 22 bp, Artificial sequence
  SiRNA target sequence
gtacaataataaaattgttaat

SEQ ID NO: 55946 - DNA, 22 bp, Artificial sequence
  SiRNA target sequence
tacaataataaaattgttaatg

SEQ ID NO: 55947 - DNA, 22 bp, Artificial sequence
  SiRNA target sequence
acaataataaaattgttaatga

SEQ ID NO: 55948 - DNA, 22 bp, Artificial sequence
  SiRNA target sequence
caataataaaattgttaatgaa

SEQ ID NO: 55949 - DNA, 22 bp, Artificial sequence
  SiRNA target sequence
aataataaaattgttaatgaaa

SEQ ID NO: 55950 - DNA, 22 bp, Artificial sequence
  SiRNA target sequence
ataataaaattgttaatgaaat

SEQ ID NO: 55951 - DNA, 22 bp, Artificial sequence
  SiRNA target sequence
taataaaattgttaatgaaatt

SEQ ID NO: 55952 - DNA, 22 bp, Artificial sequence
  SiRNA target sequence
aataaaattgttaatgaaattt

SEQ ID NO: 55953 - DNA, 22 bp, Artificial sequence
  SiRNA target sequence
ataaaattgttaatgaaatttt

SEQ ID NO: 55954 - DNA, 22 bp, Artificial sequence
  SiRNA target sequence
taaaattgttaatgaaatttta

SEQ ID NO: 55955 - DNA, 22 bp, Artificial sequence
  SiRNA target sequence
aaaattgttaatgaaattttat

SEQ ID NO: 55956 - DNA, 22 bp, Artificial sequence
  SiRNA target sequence
aaattgttaatgaaattttata

SEQ ID NO: 55957 - DNA, 22 bp, Artificial sequence
  SiRNA target sequence
aattgttaatgaaattttataa

SEQ ID NO: 55958 - DNA, 22 bp, Artificial sequence
  SiRNA target sequence
attgttaatgaaattttataaa

SEQ ID NO: 55959 - DNA, 22 bp, Artificial sequence
  SiRNA target sequence
ttgttaatgaaattttataaat

SEQ ID NO: 55960 - DNA, 22 bp, Artificial sequence
  SiRNA target sequence
tgttaatgaaattttataaata

SEQ ID NO: 55961 - DNA, 22 bp, Artificial sequence
  SiRNA target sequence
gttaatgaaattttataaatat

SEQ ID NO: 55962 - DNA, 22 bp, Artificial sequence
  SiRNA target sequence
ttaatgaaattttataaatatg

SEQ ID NO: 55963 - DNA, 22 bp, Artificial sequence
  SiRNA target sequence
taatgaaattttataaatatga

SEQ ID NO: 55964 - DNA, 22 bp, Artificial sequence
  SiRNA target sequence
aatgaaattttataaatatgat

SEQ ID NO: 55965 - DNA, 22 bp, Artificial sequence
  SiRNA target sequence
atgaaattttataaatatgatg

SEQ ID NO: 55966 - DNA, 22 bp, Artificial sequence
  SiRNA target sequence
tgaaattttataaatatgatgg

SEQ ID NO: 55967 - DNA, 22 bp, Artificial sequence
  SiRNA target sequence
gaaattttataaatatgatgga

SEQ ID NO: 55968 - DNA, 22 bp, Artificial sequence
  SiRNA target sequence
aaattttataaatatgatggag

SEQ ID NO: 55969 - DNA, 22 bp, Artificial sequence
  SiRNA target sequence
aattttataaatatgatggaga

SEQ ID NO: 55970 - DNA, 22 bp, Artificial sequence
  SiRNA target sequence
attttataaatatgatggagat

SEQ ID NO: 55971 - DNA, 22 bp, Artificial sequence
  SiRNA target sequence
ttttataaatatgatggagata

SEQ ID NO: 55972 - DNA, 22 bp, Artificial sequence
  SiRNA target sequence
tttataaatatgatggagatat

SEQ ID NO: 55973 - DNA, 22 bp, Artificial sequence
  SiRNA target sequence
ttataaatatgatggagatata

SEQ ID NO: 55974 - DNA, 22 bp, Artificial sequence
  SiRNA target sequence
tataaatatgatggagatatat

SEQ ID NO: 55975 - DNA, 22 bp, Artificial sequence
  SiRNA target sequence
ataaatatgatggagatatatt

SEQ ID NO: 55976 - DNA, 22 bp, Artificial sequence
  SiRNA target sequence
taaatatgatggagatatatta

SEQ ID NO: 55977 - DNA, 22 bp, Artificial sequence
  SiRNA target sequence
aaatatgatggagatatattaa

SEQ ID NO: 55978 - DNA, 22 bp, Artificial sequence
  SiRNA target sequence
aatatgatggagatatattaat

SEQ ID NO: 55979 - DNA, 22 bp, Artificial sequence
  SiRNA target sequence
atatgatggagatatattaatt

SEQ ID NO: 55980 - DNA, 22 bp, Artificial sequence
  SiRNA target sequence
tatgatggagatatattaattg

SEQ ID NO: 55981 - DNA, 22 bp, Artificial sequence
  SiRNA target sequence
atgatggagatatattaattga

SEQ ID NO: 55982 - DNA, 22 bp, Artificial sequence
  SiRNA target sequence
tgatggagatatattaattgat

SEQ ID NO: 55983 - DNA, 22 bp, Artificial sequence
  SiRNA target sequence
gatggagatatattaattgatg

SEQ ID NO: 55984 - DNA, 22 bp, Artificial sequence
  SiRNA target sequence
atggagatatattaattgatga

SEQ ID NO: 55985 - DNA, 22 bp, Artificial sequence
  SiRNA target sequence
tggagatatattaattgatgat

SEQ ID NO: 55986 - DNA, 22 bp, Artificial sequence
  SiRNA target sequence
ggagatatattaattgatgata

SEQ ID NO: 55987 - DNA, 22 bp, Artificial sequence
  SiRNA target sequence
gagatatattaattgatgatac

SEQ ID NO: 55988 - DNA, 22 bp, Artificial sequence
  SiRNA target sequence
agatatattaattgatgataca

SEQ ID NO: 55989 - DNA, 22 bp, Artificial sequence
  SiRNA target sequence
gatatattaattgatgatacag

SEQ ID NO: 55990 - DNA, 22 bp, Artificial sequence
  SiRNA target sequence
atatattaattgatgatacaga

SEQ ID NO: 55991 - DNA, 22 bp, Artificial sequence
  SiRNA target sequence
tatattaattgatgatacagaa

SEQ ID NO: 55992 - DNA, 22 bp, Artificial sequence
  SiRNA target sequence
atattaattgatgatacagaaa

SEQ ID NO: 55993 - DNA, 22 bp, Artificial sequence
  SiRNA target sequence
tattaattgatgatacagaaat

SEQ ID NO: 55994 - DNA, 22 bp, Artificial sequence
  SiRNA target sequence
attaattgatgatacagaaata

SEQ ID NO: 55995 - DNA, 22 bp, Artificial sequence
  SiRNA target sequence
ttaattgatgatacagaaatag

SEQ ID NO: 55996 - DNA, 22 bp, Artificial sequence
  SiRNA target sequence
taattgatgatacagaaataga

SEQ ID NO: 55997 - DNA, 22 bp, Artificial sequence
  SiRNA target sequence
aattgatgatacagaaatagat

SEQ ID NO: 55998 - DNA, 22 bp, Artificial sequence
  SiRNA target sequence
attgatgatacagaaatagata

SEQ ID NO: 55999 - DNA, 22 bp, Artificial sequence
  SiRNA target sequence
ttgatgatacagaaatagataa

SEQ ID NO: 56000 - DNA, 22 bp, Artificial sequence
  SiRNA target sequence
tgatgatacagaaatagataat

SEQ ID NO: 56001 - DNA, 22 bp, Artificial sequence
  SiRNA target sequence
gatgatacagaaatagataata

SEQ ID NO: 56002 - DNA, 22 bp, Artificial sequence
  SiRNA target sequence
atgatacagaaatagataatat

SEQ ID NO: 56003 - DNA, 22 bp, Artificial sequence
  SiRNA target sequence
tgatacagaaatagataatatt

SEQ ID NO: 56004 - DNA, 22 bp, Artificial sequence
  SiRNA target sequence
gatacagaaatagataatattt

SEQ ID NO: 56005 - DNA, 22 bp, Artificial sequence
  SiRNA target sequence
atacagaaatagataatatttc

SEQ ID NO: 56006 - DNA, 22 bp, Artificial sequence
  SiRNA target sequence
tacagaaatagataatatttcg

SEQ ID NO: 56007 - DNA, 22 bp, Artificial sequence
  SiRNA target sequence
acagaaatagataatatttcgg

SEQ ID NO: 56008 - DNA, 22 bp, Artificial sequence
  SiRNA target sequence
cagaaatagataatatttcgga

SEQ ID NO: 56009 - DNA, 22 bp, Artificial sequence
  SiRNA target sequence
agaaatagataatatttcggat

SEQ ID NO: 56010 - DNA, 22 bp, Artificial sequence
  SiRNA target sequence
gaaatagataatatttcggata

SEQ ID NO: 56011 - DNA, 22 bp, Artificial sequence
  SiRNA target sequence
aaatagataatatttcggatag

SEQ ID NO: 56012 - DNA, 22 bp, Artificial sequence
  SiRNA target sequence
aatagataatatttcggataga

SEQ ID NO: 56013 - DNA, 22 bp, Artificial sequence
  SiRNA target sequence
atagataatatttcggatagaa

SEQ ID NO: 56014 - DNA, 22 bp, Artificial sequence
  SiRNA target sequence
tagataatatttcggatagaag

SEQ ID NO: 56015 - DNA, 22 bp, Artificial sequence
  SiRNA target sequence
agataatatttcggatagaagt

SEQ ID NO: 56016 - DNA, 22 bp, Artificial sequence
  SiRNA target sequence
gataatatttcggatagaagtt

SEQ ID NO: 56017 - DNA, 22 bp, Artificial sequence
  SiRNA target sequence
ataatatttcggatagaagtta

SEQ ID NO: 56018 - DNA, 22 bp, Artificial sequence
  SiRNA target sequence
taatatttcggatagaagttac

SEQ ID NO: 56019 - DNA, 22 bp, Artificial sequence
  SiRNA target sequence
aatatttcggatagaagttaca

SEQ ID NO: 56020 - DNA, 22 bp, Artificial sequence
  SiRNA target sequence
atatttcggatagaagttacag

SEQ ID NO: 56021 - DNA, 22 bp, Artificial sequence
  SiRNA target sequence
tatttcggatagaagttacaga

SEQ ID NO: 56022 - DNA, 22 bp, Artificial sequence
  SiRNA target sequence
atttcggatagaagttacagaa

SEQ ID NO: 56023 - DNA, 22 bp, Artificial sequence
  SiRNA target sequence
tttcggatagaagttacagaag

SEQ ID NO: 56024 - DNA, 22 bp, Artificial sequence
  SiRNA target sequence
ttcggatagaagttacagaagt

SEQ ID NO: 56025 - DNA, 22 bp, Artificial sequence
  SiRNA target sequence
tcggatagaagttacagaagtt

SEQ ID NO: 56026 - DNA, 22 bp, Artificial sequence
  SiRNA target sequence
cggatagaagttacagaagttt

SEQ ID NO: 56027 - DNA, 22 bp, Artificial sequence
  SiRNA target sequence
ggatagaagttacagaagttta

SEQ ID NO: 56028 - DNA, 22 bp, Artificial sequence
  SiRNA target sequence
gatagaagttacagaagtttaa

SEQ ID NO: 56029 - DNA, 22 bp, Artificial sequence
  SiRNA target sequence
atagaagttacagaagtttaat

SEQ ID NO: 56030 - DNA, 22 bp, Artificial sequence
  SiRNA target sequence
tagaagttacagaagtttaata

SEQ ID NO: 56031 - DNA, 22 bp, Artificial sequence
  SiRNA target sequence
agaagttacagaagtttaatat

SEQ ID NO: 56032 - DNA, 22 bp, Artificial sequence
  SiRNA target sequence
gaagttacagaagtttaatatc

SEQ ID NO: 56033 - DNA, 22 bp, Artificial sequence
  SiRNA target sequence
aagttacagaagtttaatatca

SEQ ID NO: 56034 - DNA, 22 bp, Artificial sequence
  SiRNA target sequence
agttacagaagtttaatatcat

SEQ ID NO: 56035 - DNA, 22 bp, Artificial sequence
  SiRNA target sequence
gttacagaagtttaatatcata

SEQ ID NO: 56036 - DNA, 22 bp, Artificial sequence
  SiRNA target sequence
ttacagaagtttaatatcatat

SEQ ID NO: 56037 - DNA, 22 bp, Artificial sequence
  SiRNA target sequence
tacagaagtttaatatcatatg

SEQ ID NO: 56038 - DNA, 22 bp, Artificial sequence
  SiRNA target sequence
acagaagtttaatatcatatgc

SEQ ID NO: 56039 - DNA, 22 bp, Artificial sequence
  SiRNA target sequence
cagaagtttaatatcatatgca

SEQ ID NO: 56040 - DNA, 22 bp, Artificial sequence
  SiRNA target sequence
agaagtttaatatcatatgcaa

SEQ ID NO: 56041 - DNA, 22 bp, Artificial sequence
  SiRNA target sequence
gaagtttaatatcatatgcaac

SEQ ID NO: 56042 - DNA, 22 bp, Artificial sequence
  SiRNA target sequence
aagtttaatatcatatgcaaca

SEQ ID NO: 56043 - DNA, 22 bp, Artificial sequence
  SiRNA target sequence
agtttaatatcatatgcaacac

SEQ ID NO: 56044 - DNA, 22 bp, Artificial sequence
  SiRNA target sequence
gtttaatatcatatgcaacaca

SEQ ID NO: 56045 - DNA, 22 bp, Artificial sequence
  SiRNA target sequence
tttaatatcatatgcaacacaa

SEQ ID NO: 56046 - DNA, 22 bp, Artificial sequence
  SiRNA target sequence
ttaatatcatatgcaacacaaa

SEQ ID NO: 56047 - DNA, 22 bp, Artificial sequence
  SiRNA target sequence
taatatcatatgcaacacaaaa

SEQ ID NO: 56048 - DNA, 22 bp, Artificial sequence
  SiRNA target sequence
aatatcatatgcaacacaaaac

SEQ ID NO: 56049 - DNA, 22 bp, Artificial sequence
  SiRNA target sequence
atatcatatgcaacacaaaaca

SEQ ID NO: 56050 - DNA, 22 bp, Artificial sequence
  SiRNA target sequence
tatcatatgcaacacaaaacac

SEQ ID NO: 56051 - DNA, 22 bp, Artificial sequence
  SiRNA target sequence
atcatatgcaacacaaaacacg

SEQ ID NO: 56052 - DNA, 22 bp, Artificial sequence
  SiRNA target sequence
tcatatgcaacacaaaacacgt

SEQ ID NO: 56053 - DNA, 22 bp, Artificial sequence
  SiRNA target sequence
catatgcaacacaaaacacgtt

SEQ ID NO: 56054 - DNA, 22 bp, Artificial sequence
  SiRNA target sequence
atatgcaacacaaaacacgttc

SEQ ID NO: 56055 - DNA, 22 bp, Artificial sequence
  SiRNA target sequence
tatgcaacacaaaacacgttct

SEQ ID NO: 56056 - DNA, 22 bp, Artificial sequence
  SiRNA target sequence
atgcaacacaaaacacgttctt

SEQ ID NO: 56057 - DNA, 22 bp, Artificial sequence
  SiRNA target sequence
tgcaacacaaaacacgttctta

SEQ ID NO: 56058 - DNA, 22 bp, Artificial sequence
  SiRNA target sequence
gcaacacaaaacacgttcttat

SEQ ID NO: 56059 - DNA, 22 bp, Artificial sequence
  SiRNA target sequence
caacacaaaacacgttcttatt

SEQ ID NO: 56060 - DNA, 22 bp, Artificial sequence
  SiRNA target sequence
aacacaaaacacgttcttattc

SEQ ID NO: 56061 - DNA, 22 bp, Artificial sequence
  SiRNA target sequence
acacaaaacacgttcttattcg

SEQ ID NO: 56062 - DNA, 22 bp, Artificial sequence
  SiRNA target sequence
cacaaaacacgttcttattcga

SEQ ID NO: 56063 - DNA, 22 bp, Artificial sequence
  SiRNA target sequence
acaaaacacgttcttattcgat

SEQ ID NO: 56064 - DNA, 22 bp, Artificial sequence
  SiRNA target sequence
caaaacacgttcttattcgata

SEQ ID NO: 56065 - DNA, 22 bp, Artificial sequence
  SiRNA target sequence
aaaacacgttcttattcgataa

SEQ ID NO: 56066 - DNA, 22 bp, Artificial sequence
  SiRNA target sequence
aaacacgttcttattcgataat

SEQ ID NO: 56067 - DNA, 22 bp, Artificial sequence
  SiRNA target sequence
aacacgttcttattcgataata

SEQ ID NO: 56068 - DNA, 22 bp, Artificial sequence
  SiRNA target sequence
acacgttcttattcgataatac

SEQ ID NO: 56069 - DNA, 22 bp, Artificial sequence
  SiRNA target sequence
cacgttcttattcgataatact

SEQ ID NO: 56070 - DNA, 22 bp, Artificial sequence
  SiRNA target sequence
acgttcttattcgataatactg

SEQ ID NO: 56071 - DNA, 22 bp, Artificial sequence
  SiRNA target sequence
cgttcttattcgataatactgt

SEQ ID NO: 56072 - DNA, 22 bp, Artificial sequence
  SiRNA target sequence
gttcttattcgataatactgtg

SEQ ID NO: 56073 - DNA, 22 bp, Artificial sequence
  SiRNA target sequence
ttcttattcgataatactgtga

SEQ ID NO: 56074 - DNA, 22 bp, Artificial sequence
  SiRNA target sequence
tcttattcgataatactgtgac

SEQ ID NO: 56075 - DNA, 22 bp, Artificial sequence
  SiRNA target sequence
cttattcgataatactgtgaca

SEQ ID NO: 56076 - DNA, 22 bp, Artificial sequence
  SiRNA target sequence
ttattcgataatactgtgacat

SEQ ID NO: 56077 - DNA, 22 bp, Artificial sequence
  SiRNA target sequence
tattcgataatactgtgacata

SEQ ID NO: 56078 - DNA, 22 bp, Artificial sequence
  SiRNA target sequence
attcgataatactgtgacatac

SEQ ID NO: 56079 - DNA, 22 bp, Artificial sequence
  SiRNA target sequence
ttcgataatactgtgacataca

SEQ ID NO: 56080 - DNA, 22 bp, Artificial sequence
  SiRNA target sequence
tcgataatactgtgacatacaa

SEQ ID NO: 56081 - DNA, 22 bp, Artificial sequence
  SiRNA target sequence
cgataatactgtgacatacaat

SEQ ID NO: 56082 - DNA, 22 bp, Artificial sequence
  SiRNA target sequence
gataatactgtgacatacaata

SEQ ID NO: 56083 - DNA, 22 bp, Artificial sequence
  SiRNA target sequence
ataatactgtgacatacaatat

SEQ ID NO: 56084 - DNA, 22 bp, Artificial sequence
  SiRNA target sequence
taatactgtgacatacaatata

SEQ ID NO: 56085 - DNA, 22 bp, Artificial sequence
  SiRNA target sequence
aatactgtgacatacaatatat

SEQ ID NO: 56086 - DNA, 22 bp, Artificial sequence
  SiRNA target sequence
atactgtgacatacaatatatt

SEQ ID NO: 56087 - DNA, 22 bp, Artificial sequence
  SiRNA target sequence
tactgtgacatacaatatattt

SEQ ID NO: 56088 - DNA, 22 bp, Artificial sequence
  SiRNA target sequence
actgtgacatacaatatatttt

SEQ ID NO: 56089 - DNA, 22 bp, Artificial sequence
  SiRNA target sequence
ctgtgacatacaatatatttta

SEQ ID NO: 56090 - DNA, 22 bp, Artificial sequence
  SiRNA target sequence
tgtgacatacaatatattttac

SEQ ID NO: 56091 - DNA, 22 bp, Artificial sequence
  SiRNA target sequence
gtgacatacaatatattttacg

SEQ ID NO: 56092 - DNA, 22 bp, Artificial sequence
  SiRNA target sequence
tgacatacaatatattttacgg

SEQ ID NO: 56093 - DNA, 22 bp, Artificial sequence
  SiRNA target sequence
gacatacaatatattttacggg

SEQ ID NO: 56094 - DNA, 22 bp, Artificial sequence
  SiRNA target sequence
acatacaatatattttacggga

SEQ ID NO: 56095 - DNA, 22 bp, Artificial sequence
  SiRNA target sequence
catacaatatattttacgggac

SEQ ID NO: 56096 - DNA, 22 bp, Artificial sequence
  SiRNA target sequence
atacaatatattttacgggact

SEQ ID NO: 56097 - DNA, 22 bp, Artificial sequence
  SiRNA target sequence
tacaatatattttacgggacta

SEQ ID NO: 56098 - DNA, 22 bp, Artificial sequence
  SiRNA target sequence
acaatatattttacgggactaa

SEQ ID NO: 56099 - DNA, 22 bp, Artificial sequence
  SiRNA target sequence
caatatattttacgggactaaa

SEQ ID NO: 56100 - DNA, 22 bp, Artificial sequence
  SiRNA target sequence
aatatattttacgggactaaaa

SEQ ID NO: 56101 - DNA, 22 bp, Artificial sequence
  SiRNA target sequence
atatattttacgggactaaaaa

SEQ ID NO: 56102 - DNA, 22 bp, Artificial sequence
  SiRNA target sequence
tatattttacgggactaaaaac

SEQ ID NO: 56103 - DNA, 22 bp, Artificial sequence
  SiRNA target sequence
atattttacgggactaaaaacg

SEQ ID NO: 56104 - DNA, 22 bp, Artificial sequence
  SiRNA target sequence
tattttacgggactaaaaacgt

SEQ ID NO: 56105 - DNA, 22 bp, Artificial sequence
  SiRNA target sequence
attttacgggactaaaaacgta

SEQ ID NO: 56106 - DNA, 22 bp, Artificial sequence
  SiRNA target sequence
ttttacgggactaaaaacgtaa

SEQ ID NO: 56107 - DNA, 22 bp, Artificial sequence
  SiRNA target sequence
tttacgggactaaaaacgtaac

SEQ ID NO: 56108 - DNA, 22 bp, Artificial sequence
  SiRNA target sequence
ttacgggactaaaaacgtaaca

SEQ ID NO: 56109 - DNA, 22 bp, Artificial sequence
  SiRNA target sequence
tacgggactaaaaacgtaacag

SEQ ID NO: 56110 - DNA, 22 bp, Artificial sequence
  SiRNA target sequence
acgggactaaaaacgtaacaga

SEQ ID NO: 56111 - DNA, 22 bp, Artificial sequence
  SiRNA target sequence
cgggactaaaaacgtaacagaa

SEQ ID NO: 56112 - DNA, 22 bp, Artificial sequence
  SiRNA target sequence
gggactaaaaacgtaacagaaa

SEQ ID NO: 56113 - DNA, 22 bp, Artificial sequence
  SiRNA target sequence
ggactaaaaacgtaacagaaaa

SEQ ID NO: 56114 - DNA, 22 bp, Artificial sequence
  SiRNA target sequence
gactaaaaacgtaacagaaaaa

SEQ ID NO: 56115 - DNA, 22 bp, Artificial sequence
  SiRNA target sequence
actaaaaacgtaacagaaaaag

SEQ ID NO: 56116 - DNA, 22 bp, Artificial sequence
  SiRNA target sequence
ctaaaaacgtaacagaaaaaga

SEQ ID NO: 56117 - DNA, 22 bp, Artificial sequence
  SiRNA target sequence
taaaaacgtaacagaaaaagaa

SEQ ID NO: 56118 - DNA, 22 bp, Artificial sequence
  SiRNA target sequence
aaaaacgtaacagaaaaagaag

SEQ ID NO: 56119 - DNA, 22 bp, Artificial sequence
  SiRNA target sequence
aaaacgtaacagaaaaagaagt

SEQ ID NO: 56120 - DNA, 22 bp, Artificial sequence
  SiRNA target sequence
aaacgtaacagaaaaagaagtt

SEQ ID NO: 56121 - DNA, 22 bp, Artificial sequence
  SiRNA target sequence
aacgtaacagaaaaagaagttt

SEQ ID NO: 56122 - DNA, 22 bp, Artificial sequence
  SiRNA target sequence
acgtaacagaaaaagaagtttt

SEQ ID NO: 56123 - DNA, 22 bp, Artificial sequence
  SiRNA target sequence
cgtaacagaaaaagaagtttta

SEQ ID NO: 56124 - DNA, 22 bp, Artificial sequence
  SiRNA target sequence
gtaacagaaaaagaagttttag

SEQ ID NO: 56125 - DNA, 22 bp, Artificial sequence
  SiRNA target sequence
taacagaaaaagaagttttaga

SEQ ID NO: 56126 - DNA, 22 bp, Artificial sequence
  SiRNA target sequence
aacagaaaaagaagttttagaa

SEQ ID NO: 56127 - DNA, 22 bp, Artificial sequence
  SiRNA target sequence
acagaaaaagaagttttagaat

SEQ ID NO: 56128 - DNA, 22 bp, Artificial sequence
  SiRNA target sequence
cagaaaaagaagttttagaatt

SEQ ID NO: 56129 - DNA, 22 bp, Artificial sequence
  SiRNA target sequence
agaaaaagaagttttagaatta

SEQ ID NO: 56130 - DNA, 22 bp, Artificial sequence
  SiRNA target sequence
gaaaaagaagttttagaattag

SEQ ID NO: 56131 - DNA, 22 bp, Artificial sequence
  SiRNA target sequence
aaaaagaagttttagaattagc

SEQ ID NO: 56132 - DNA, 22 bp, Artificial sequence
  SiRNA target sequence
aaaagaagttttagaattagcc

SEQ ID NO: 56133 - DNA, 22 bp, Artificial sequence
  SiRNA target sequence
aaagaagttttagaattagcca

SEQ ID NO: 56134 - DNA, 22 bp, Artificial sequence
  SiRNA target sequence
aagaagttttagaattagccaa

SEQ ID NO: 56135 - DNA, 22 bp, Artificial sequence
  SiRNA target sequence
agaagttttagaattagccaaa

SEQ ID NO: 56136 - DNA, 22 bp, Artificial sequence
  SiRNA target sequence
gaagttttagaattagccaaaa

SEQ ID NO: 56137 - DNA, 22 bp, Artificial sequence
  SiRNA target sequence
aagttttagaattagccaaaaa

SEQ ID NO: 56138 - DNA, 22 bp, Artificial sequence
  SiRNA target sequence
agttttagaattagccaaaaaa

SEQ ID NO: 56139 - DNA, 22 bp, Artificial sequence
  SiRNA target sequence
gttttagaattagccaaaaaaa

SEQ ID NO: 56140 - DNA, 22 bp, Artificial sequence
  SiRNA target sequence
ttttagaattagccaaaaaaat

SEQ ID NO: 56141 - DNA, 22 bp, Artificial sequence
  SiRNA target sequence
tttagaattagccaaaaaaata

SEQ ID NO: 56142 - DNA, 22 bp, Artificial sequence
  SiRNA target sequence
ttagaattagccaaaaaaatag

SEQ ID NO: 56143 - DNA, 22 bp, Artificial sequence
  SiRNA target sequence
tagaattagccaaaaaaatagg

SEQ ID NO: 56144 - DNA, 22 bp, Artificial sequence
  SiRNA target sequence
agaattagccaaaaaaataggt

SEQ ID NO: 56145 - DNA, 22 bp, Artificial sequence
  SiRNA target sequence
gaattagccaaaaaaataggtg

SEQ ID NO: 56146 - DNA, 22 bp, Artificial sequence
  SiRNA target sequence
aattagccaaaaaaataggtgt

SEQ ID NO: 56147 - DNA, 22 bp, Artificial sequence
  SiRNA target sequence
attagccaaaaaaataggtgta

SEQ ID NO: 56148 - DNA, 22 bp, Artificial sequence
  SiRNA target sequence
ttagccaaaaaaataggtgtat

SEQ ID NO: 56149 - DNA, 22 bp, Artificial sequence
  SiRNA target sequence
tagccaaaaaaataggtgtatt

SEQ ID NO: 56150 - DNA, 22 bp, Artificial sequence
  SiRNA target sequence
agccaaaaaaataggtgtatta

SEQ ID NO: 56151 - DNA, 22 bp, Artificial sequence
  SiRNA target sequence
gccaaaaaaataggtgtattag

SEQ ID NO: 56152 - DNA, 22 bp, Artificial sequence
  SiRNA target sequence
ccaaaaaaataggtgtattaga

SEQ ID NO: 56153 - DNA, 22 bp, Artificial sequence
  SiRNA target sequence
caaaaaaataggtgtattagag

SEQ ID NO: 56154 - DNA, 22 bp, Artificial sequence
  SiRNA target sequence
aaaaaaataggtgtattagagt

SEQ ID NO: 56155 - DNA, 22 bp, Artificial sequence
  SiRNA target sequence
aaaaaataggtgtattagagtc

SEQ ID NO: 56156 - DNA, 22 bp, Artificial sequence
  SiRNA target sequence
aaaaataggtgtattagagtct

SEQ ID NO: 56157 - DNA, 22 bp, Artificial sequence
  SiRNA target sequence
aaaataggtgtattagagtcta

SEQ ID NO: 56158 - DNA, 22 bp, Artificial sequence
  SiRNA target sequence
aaataggtgtattagagtctat

SEQ ID NO: 56159 - DNA, 22 bp, Artificial sequence
  SiRNA target sequence
aataggtgtattagagtctata

SEQ ID NO: 56160 - DNA, 22 bp, Artificial sequence
  SiRNA target sequence
ataggtgtattagagtctatac

SEQ ID NO: 56161 - DNA, 22 bp, Artificial sequence
  SiRNA target sequence
taggtgtattagagtctataca

SEQ ID NO: 56162 - DNA, 22 bp, Artificial sequence
  SiRNA target sequence
aggtgtattagagtctatacag

SEQ ID NO: 56163 - DNA, 22 bp, Artificial sequence
  SiRNA target sequence
ggtgtattagagtctatacagg

SEQ ID NO: 56164 - DNA, 22 bp, Artificial sequence
  SiRNA target sequence
gtgtattagagtctatacagga

SEQ ID NO: 56165 - DNA, 22 bp, Artificial sequence
  SiRNA target sequence
tgtattagagtctatacaggaa

SEQ ID NO: 56166 - DNA, 22 bp, Artificial sequence
  SiRNA target sequence
gtattagagtctatacaggaat

SEQ ID NO: 56167 - DNA, 22 bp, Artificial sequence
  SiRNA target sequence
tattagagtctatacaggaatt

SEQ ID NO: 56168 - DNA, 22 bp, Artificial sequence
  SiRNA target sequence
attagagtctatacaggaattt

SEQ ID NO: 56169 - DNA, 22 bp, Artificial sequence
  SiRNA target sequence
ttagagtctatacaggaattta

SEQ ID NO: 56170 - DNA, 22 bp, Artificial sequence
  SiRNA target sequence
tagagtctatacaggaatttaa

SEQ ID NO: 56171 - DNA, 22 bp, Artificial sequence
  SiRNA target sequence
agagtctatacaggaatttaaa

SEQ ID NO: 56172 - DNA, 22 bp, Artificial sequence
  SiRNA target sequence
gagtctatacaggaatttaaag

SEQ ID NO: 56173 - DNA, 22 bp, Artificial sequence
  SiRNA target sequence
agtctatacaggaatttaaaga

SEQ ID NO: 56174 - DNA, 22 bp, Artificial sequence
  SiRNA target sequence
gtctatacaggaatttaaagat

SEQ ID NO: 56175 - DNA, 22 bp, Artificial sequence
  SiRNA target sequence
tctatacaggaatttaaagatg

SEQ ID NO: 56176 - DNA, 22 bp, Artificial sequence
  SiRNA target sequence
ctatacaggaatttaaagatgg

SEQ ID NO: 56177 - DNA, 22 bp, Artificial sequence
  SiRNA target sequence
tatacaggaatttaaagatggg

SEQ ID NO: 56178 - DNA, 22 bp, Artificial sequence
  SiRNA target sequence
atacaggaatttaaagatgggt

SEQ ID NO: 56179 - DNA, 22 bp, Artificial sequence
  SiRNA target sequence
tacaggaatttaaagatgggtt

SEQ ID NO: 56180 - DNA, 22 bp, Artificial sequence
  SiRNA target sequence
acaggaatttaaagatgggttt

SEQ ID NO: 56181 - DNA, 22 bp, Artificial sequence
  SiRNA target sequence
caggaatttaaagatgggttta

SEQ ID NO: 56182 - DNA, 22 bp, Artificial sequence
  SiRNA target sequence
aggaatttaaagatgggtttag

SEQ ID NO: 56183 - DNA, 22 bp, Artificial sequence
  SiRNA target sequence
ggaatttaaagatgggtttagc

SEQ ID NO: 56184 - DNA, 22 bp, Artificial sequence
  SiRNA target sequence
gaatttaaagatgggtttagca

SEQ ID NO: 56185 - DNA, 22 bp, Artificial sequence
  SiRNA target sequence
aatttaaagatgggtttagcac

SEQ ID NO: 56186 - DNA, 22 bp, Artificial sequence
  SiRNA target sequence
atttaaagatgggtttagcaca

SEQ ID NO: 56187 - DNA, 22 bp, Artificial sequence
  SiRNA target sequence
tttaaagatgggtttagcacat

SEQ ID NO: 56188 - DNA, 22 bp, Artificial sequence
  SiRNA target sequence
ttaaagatgggtttagcacatc

SEQ ID NO: 56189 - DNA, 22 bp, Artificial sequence
  SiRNA target sequence
taaagatgggtttagcacatcg

SEQ ID NO: 56190 - DNA, 22 bp, Artificial sequence
  SiRNA target sequence
aaagatgggtttagcacatcgg

SEQ ID NO: 56191 - DNA, 22 bp, Artificial sequence
  SiRNA target sequence
aagatgggtttagcacatcggt

SEQ ID NO: 56192 - DNA, 22 bp, Artificial sequence
  SiRNA target sequence
agatgggtttagcacatcggtc

SEQ ID NO: 56193 - DNA, 22 bp, Artificial sequence
  SiRNA target sequence
gatgggtttagcacatcggtcg

SEQ ID NO: 56194 - DNA, 22 bp, Artificial sequence
  SiRNA target sequence
atgggtttagcacatcggtcgg

SEQ ID NO: 56195 - DNA, 22 bp, Artificial sequence
  SiRNA target sequence
tgggtttagcacatcggtcggt

SEQ ID NO: 56196 - DNA, 22 bp, Artificial sequence
  SiRNA target sequence
gggtttagcacatcggtcggtg

SEQ ID NO: 56197 - DNA, 22 bp, Artificial sequence
  SiRNA target sequence
ggtttagcacatcggtcggtga

SEQ ID NO: 56198 - DNA, 22 bp, Artificial sequence
  SiRNA target sequence
gtttagcacatcggtcggtgaa

SEQ ID NO: 56199 - DNA, 22 bp, Artificial sequence
  SiRNA target sequence
tttagcacatcggtcggtgaac

SEQ ID NO: 56200 - DNA, 22 bp, Artificial sequence
  SiRNA target sequence
ttagcacatcggtcggtgaacg

SEQ ID NO: 56201 - DNA, 22 bp, Artificial sequence
  SiRNA target sequence
tagcacatcggtcggtgaacgc

SEQ ID NO: 56202 - DNA, 22 bp, Artificial sequence
  SiRNA target sequence
agcacatcggtcggtgaacgcg

SEQ ID NO: 56203 - DNA, 22 bp, Artificial sequence
  SiRNA target sequence
gcacatcggtcggtgaacgcgg

SEQ ID NO: 56204 - DNA, 22 bp, Artificial sequence
  SiRNA target sequence
cacatcggtcggtgaacgcgga

SEQ ID NO: 56205 - DNA, 22 bp, Artificial sequence
  SiRNA target sequence
acatcggtcggtgaacgcggaa

SEQ ID NO: 56206 - DNA, 22 bp, Artificial sequence
  SiRNA target sequence
catcggtcggtgaacgcggaag

SEQ ID NO: 56207 - DNA, 22 bp, Artificial sequence
  SiRNA target sequence
atcggtcggtgaacgcggaaga

SEQ ID NO: 56208 - DNA, 22 bp, Artificial sequence
  SiRNA target sequence
tcggtcggtgaacgcggaagat

SEQ ID NO: 56209 - DNA, 22 bp, Artificial sequence
  SiRNA target sequence
cggtcggtgaacgcggaagatt

SEQ ID NO: 56210 - DNA, 22 bp, Artificial sequence
  SiRNA target sequence
ggtcggtgaacgcggaagattt

SEQ ID NO: 56211 - DNA, 22 bp, Artificial sequence
  SiRNA target sequence
gtcggtgaacgcggaagatttt

SEQ ID NO: 56212 - DNA, 22 bp, Artificial sequence
  SiRNA target sequence
tcggtgaacgcggaagattttt

SEQ ID NO: 56213 - DNA, 22 bp, Artificial sequence
  SiRNA target sequence
cggtgaacgcggaagattttta

SEQ ID NO: 56214 - DNA, 22 bp, Artificial sequence
  SiRNA target sequence
ggtgaacgcggaagatttttat

SEQ ID NO: 56215 - DNA, 22 bp, Artificial sequence
  SiRNA target sequence
gtgaacgcggaagatttttatc

SEQ ID NO: 56216 - DNA, 22 bp, Artificial sequence
  SiRNA target sequence
tgaacgcggaagatttttatct

SEQ ID NO: 56217 - DNA, 22 bp, Artificial sequence
  SiRNA target sequence
gaacgcggaagatttttatctg

SEQ ID NO: 56218 - DNA, 22 bp, Artificial sequence
  SiRNA target sequence
aacgcggaagatttttatctgg

SEQ ID NO: 56219 - DNA, 22 bp, Artificial sequence
  SiRNA target sequence
acgcggaagatttttatctggt

SEQ ID NO: 56220 - DNA, 22 bp, Artificial sequence
  SiRNA target sequence
cgcggaagatttttatctggtg

SEQ ID NO: 56221 - DNA, 22 bp, Artificial sequence
  SiRNA target sequence
gcggaagatttttatctggtgg

SEQ ID NO: 56222 - DNA, 22 bp, Artificial sequence
  SiRNA target sequence
cggaagatttttatctggtggt

SEQ ID NO: 56223 - DNA, 22 bp, Artificial sequence
  SiRNA target sequence
ggaagatttttatctggtggtg

SEQ ID NO: 56224 - DNA, 22 bp, Artificial sequence
  SiRNA target sequence
gaagatttttatctggtggtga

SEQ ID NO: 56225 - DNA, 22 bp, Artificial sequence
  SiRNA target sequence
aagatttttatctggtggtgaa

SEQ ID NO: 56226 - DNA, 22 bp, Artificial sequence
  SiRNA target sequence
agatttttatctggtggtgaaa

SEQ ID NO: 56227 - DNA, 22 bp, Artificial sequence
  SiRNA target sequence
gatttttatctggtggtgaaag

SEQ ID NO: 56228 - DNA, 22 bp, Artificial sequence
  SiRNA target sequence
atttttatctggtggtgaaagg

SEQ ID NO: 56229 - DNA, 22 bp, Artificial sequence
  SiRNA target sequence
tttttatctggtggtgaaaggc

SEQ ID NO: 56230 - DNA, 22 bp, Artificial sequence
  SiRNA target sequence
ttttatctggtggtgaaaggca

SEQ ID NO: 56231 - DNA, 22 bp, Artificial sequence
  SiRNA target sequence
tttatctggtggtgaaaggcaa

SEQ ID NO: 56232 - DNA, 22 bp, Artificial sequence
  SiRNA target sequence
ttatctggtggtgaaaggcaaa

SEQ ID NO: 56233 - DNA, 22 bp, Artificial sequence
  SiRNA target sequence
tatctggtggtgaaaggcaaaa

SEQ ID NO: 56234 - DNA, 22 bp, Artificial sequence
  SiRNA target sequence
atctggtggtgaaaggcaaaaa

SEQ ID NO: 56235 - DNA, 22 bp, Artificial sequence
  SiRNA target sequence
tctggtggtgaaaggcaaaaaa

SEQ ID NO: 56236 - DNA, 22 bp, Artificial sequence
  SiRNA target sequence
ctggtggtgaaaggcaaaaaat

SEQ ID NO: 56237 - DNA, 22 bp, Artificial sequence
  SiRNA target sequence
tggtggtgaaaggcaaaaaatt

SEQ ID NO: 56238 - DNA, 22 bp, Artificial sequence
  SiRNA target sequence
ggtggtgaaaggcaaaaaatta

SEQ ID NO: 56239 - DNA, 22 bp, Artificial sequence
  SiRNA target sequence
gtggtgaaaggcaaaaaattat

SEQ ID NO: 56240 - DNA, 22 bp, Artificial sequence
  SiRNA target sequence
tggtgaaaggcaaaaaattatg

SEQ ID NO: 56241 - DNA, 22 bp, Artificial sequence
  SiRNA target sequence
ggtgaaaggcaaaaaattatgc

SEQ ID NO: 56242 - DNA, 22 bp, Artificial sequence
  SiRNA target sequence
gtgaaaggcaaaaaattatgct

SEQ ID NO: 56243 - DNA, 22 bp, Artificial sequence
  SiRNA target sequence
tgaaaggcaaaaaattatgctg

SEQ ID NO: 56244 - DNA, 22 bp, Artificial sequence
  SiRNA target sequence
gaaaggcaaaaaattatgctga

SEQ ID NO: 56245 - DNA, 22 bp, Artificial sequence
  SiRNA target sequence
aaaggcaaaaaattatgctgat

SEQ ID NO: 56246 - DNA, 22 bp, Artificial sequence
  SiRNA target sequence
aaggcaaaaaattatgctgatg

SEQ ID NO: 56247 - DNA, 22 bp, Artificial sequence
  SiRNA target sequence
aggcaaaaaattatgctgatgc

SEQ ID NO: 56248 - DNA, 22 bp, Artificial sequence
  SiRNA target sequence
ggcaaaaaattatgctgatgcg

SEQ ID NO: 56249 - DNA, 22 bp, Artificial sequence
  SiRNA target sequence
gcaaaaaattatgctgatgcgt

SEQ ID NO: 56250 - DNA, 22 bp, Artificial sequence
  SiRNA target sequence
caaaaaattatgctgatgcgtg

SEQ ID NO: 56251 - DNA, 22 bp, Artificial sequence
  SiRNA target sequence
aaaaaattatgctgatgcgtgc

SEQ ID NO: 56252 - DNA, 22 bp, Artificial sequence
  SiRNA target sequence
aaaaattatgctgatgcgtgca

SEQ ID NO: 56253 - DNA, 22 bp, Artificial sequence
  SiRNA target sequence
aaaattatgctgatgcgtgcat

SEQ ID NO: 56254 - DNA, 22 bp, Artificial sequence
  SiRNA target sequence
aaattatgctgatgcgtgcatt

SEQ ID NO: 56255 - DNA, 22 bp, Artificial sequence
  SiRNA target sequence
aattatgctgatgcgtgcattg

SEQ ID NO: 56256 - DNA, 22 bp, Artificial sequence
  SiRNA target sequence
attatgctgatgcgtgcattgc

SEQ ID NO: 56257 - DNA, 22 bp, Artificial sequence
  SiRNA target sequence
ttatgctgatgcgtgcattgct

SEQ ID NO: 56258 - DNA, 22 bp, Artificial sequence
  SiRNA target sequence
tatgctgatgcgtgcattgctt

SEQ ID NO: 56259 - DNA, 22 bp, Artificial sequence
  SiRNA target sequence
atgctgatgcgtgcattgctta

SEQ ID NO: 56260 - DNA, 22 bp, Artificial sequence
  SiRNA target sequence
tgctgatgcgtgcattgcttaa

SEQ ID NO: 56261 - DNA, 22 bp, Artificial sequence
  SiRNA target sequence
gctgatgcgtgcattgcttaaa

SEQ ID NO: 56262 - DNA, 22 bp, Artificial sequence
  SiRNA target sequence
ctgatgcgtgcattgcttaaaa

SEQ ID NO: 56263 - DNA, 22 bp, Artificial sequence
  SiRNA target sequence
tgatgcgtgcattgcttaaaaa

SEQ ID NO: 56264 - DNA, 22 bp, Artificial sequence
  SiRNA target sequence
gatgcgtgcattgcttaaaaat

SEQ ID NO: 56265 - DNA, 22 bp, Artificial sequence
  SiRNA target sequence
atgcgtgcattgcttaaaaatt

SEQ ID NO: 56266 - DNA, 22 bp, Artificial sequence
  SiRNA target sequence
tgcgtgcattgcttaaaaattc

SEQ ID NO: 56267 - DNA, 22 bp, Artificial sequence
  SiRNA target sequence
gcgtgcattgcttaaaaattca

SEQ ID NO: 56268 - DNA, 22 bp, Artificial sequence
  SiRNA target sequence
cgtgcattgcttaaaaattcag

SEQ ID NO: 56269 - DNA, 22 bp, Artificial sequence
  SiRNA target sequence
gtgcattgcttaaaaattcaga

SEQ ID NO: 56270 - DNA, 22 bp, Artificial sequence
  SiRNA target sequence
tgcattgcttaaaaattcagag

SEQ ID NO: 56271 - DNA, 22 bp, Artificial sequence
  SiRNA target sequence
gcattgcttaaaaattcagaga

SEQ ID NO: 56272 - DNA, 22 bp, Artificial sequence
  SiRNA target sequence
cattgcttaaaaattcagagat

SEQ ID NO: 56273 - DNA, 22 bp, Artificial sequence
  SiRNA target sequence
attgcttaaaaattcagagatc

SEQ ID NO: 56274 - DNA, 22 bp, Artificial sequence
  SiRNA target sequence
ttgcttaaaaattcagagatcg

SEQ ID NO: 56275 - DNA, 22 bp, Artificial sequence
  SiRNA target sequence
tgcttaaaaattcagagatcgt

SEQ ID NO: 56276 - DNA, 22 bp, Artificial sequence
  SiRNA target sequence
gcttaaaaattcagagatcgtt

SEQ ID NO: 56277 - DNA, 22 bp, Artificial sequence
  SiRNA target sequence
cttaaaaattcagagatcgttt

SEQ ID NO: 56278 - DNA, 22 bp, Artificial sequence
  SiRNA target sequence
ttaaaaattcagagatcgtttt

SEQ ID NO: 56279 - DNA, 22 bp, Artificial sequence
  SiRNA target sequence
taaaaattcagagatcgtttta

SEQ ID NO: 56280 - DNA, 22 bp, Artificial sequence
  SiRNA target sequence
aaaaattcagagatcgttttat

SEQ ID NO: 56281 - DNA, 22 bp, Artificial sequence
  SiRNA target sequence
aaaattcagagatcgttttatt

SEQ ID NO: 56282 - DNA, 22 bp, Artificial sequence
  SiRNA target sequence
aaattcagagatcgttttatta

SEQ ID NO: 56283 - DNA, 22 bp, Artificial sequence
  SiRNA target sequence
aattcagagatcgttttattag

SEQ ID NO: 56284 - DNA, 22 bp, Artificial sequence
  SiRNA target sequence
attcagagatcgttttattaga

SEQ ID NO: 56285 - DNA, 22 bp, Artificial sequence
  SiRNA target sequence
ttcagagatcgttttattagac

SEQ ID NO: 56286 - DNA, 22 bp, Artificial sequence
  SiRNA target sequence
tcagagatcgttttattagacg

SEQ ID NO: 56287 - DNA, 22 bp, Artificial sequence
  SiRNA target sequence
cagagatcgttttattagacga

SEQ ID NO: 56288 - DNA, 22 bp, Artificial sequence
  SiRNA target sequence
agagatcgttttattagacgag

SEQ ID NO: 56289 - DNA, 22 bp, Artificial sequence
  SiRNA target sequence
gagatcgttttattagacgagc

SEQ ID NO: 56290 - DNA, 22 bp, Artificial sequence
  SiRNA target sequence
agatcgttttattagacgagcc

SEQ ID NO: 56291 - DNA, 22 bp, Artificial sequence
  SiRNA target sequence
gatcgttttattagacgagcca

SEQ ID NO: 56292 - DNA, 22 bp, Artificial sequence
  SiRNA target sequence
atcgttttattagacgagccaa

SEQ ID NO: 56293 - DNA, 22 bp, Artificial sequence
  SiRNA target sequence
tcgttttattagacgagccaac

SEQ ID NO: 56294 - DNA, 22 bp, Artificial sequence
  SiRNA target sequence
cgttttattagacgagccaacc

SEQ ID NO: 56295 - DNA, 22 bp, Artificial sequence
  SiRNA target sequence
gttttattagacgagccaacct

SEQ ID NO: 56296 - DNA, 22 bp, Artificial sequence
  SiRNA target sequence
ttttattagacgagccaacctc

SEQ ID NO: 56297 - DNA, 22 bp, Artificial sequence
  SiRNA target sequence
tttattagacgagccaacctca

SEQ ID NO: 56298 - DNA, 22 bp, Artificial sequence
  SiRNA target sequence
ttattagacgagccaacctcag

SEQ ID NO: 56299 - DNA, 22 bp, Artificial sequence
  SiRNA target sequence
tattagacgagccaacctcagc

SEQ ID NO: 56300 - DNA, 22 bp, Artificial sequence
  SiRNA target sequence
attagacgagccaacctcagca

SEQ ID NO: 56301 - DNA, 22 bp, Artificial sequence
  SiRNA target sequence
ttagacgagccaacctcagcac

SEQ ID NO: 56302 - DNA, 22 bp, Artificial sequence
  SiRNA target sequence
tagacgagccaacctcagcact

SEQ ID NO: 56303 - DNA, 22 bp, Artificial sequence
  SiRNA target sequence
agacgagccaacctcagcacta

SEQ ID NO: 56304 - DNA, 22 bp, Artificial sequence
  SiRNA target sequence
gacgagccaacctcagcactag

SEQ ID NO: 56305 - DNA, 22 bp, Artificial sequence
  SiRNA target sequence
acgagccaacctcagcactaga

SEQ ID NO: 56306 - DNA, 22 bp, Artificial sequence
  SiRNA target sequence
cgagccaacctcagcactagat

SEQ ID NO: 56307 - DNA, 22 bp, Artificial sequence
  SiRNA target sequence
gagccaacctcagcactagata

SEQ ID NO: 56308 - DNA, 22 bp, Artificial sequence
  SiRNA target sequence
agccaacctcagcactagataa

SEQ ID NO: 56309 - DNA, 22 bp, Artificial sequence
  SiRNA target sequence
gccaacctcagcactagataaa

SEQ ID NO: 56310 - DNA, 22 bp, Artificial sequence
  SiRNA target sequence
ccaacctcagcactagataaaa

SEQ ID NO: 56311 - DNA, 22 bp, Artificial sequence
  SiRNA target sequence
caacctcagcactagataaaaa

SEQ ID NO: 56312 - DNA, 22 bp, Artificial sequence
  SiRNA target sequence
aacctcagcactagataaaaag

SEQ ID NO: 56313 - DNA, 22 bp, Artificial sequence
  SiRNA target sequence
acctcagcactagataaaaaga

SEQ ID NO: 56314 - DNA, 22 bp, Artificial sequence
  SiRNA target sequence
cctcagcactagataaaaagag

SEQ ID NO: 56315 - DNA, 22 bp, Artificial sequence
  SiRNA target sequence
ctcagcactagataaaaagagt

SEQ ID NO: 56316 - DNA, 22 bp, Artificial sequence
  SiRNA target sequence
tcagcactagataaaaagagtg

SEQ ID NO: 56317 - DNA, 22 bp, Artificial sequence
  SiRNA target sequence
cagcactagataaaaagagtga

SEQ ID NO: 56318 - DNA, 22 bp, Artificial sequence
  SiRNA target sequence
agcactagataaaaagagtgaa

SEQ ID NO: 56319 - DNA, 22 bp, Artificial sequence
  SiRNA target sequence
gcactagataaaaagagtgaac

SEQ ID NO: 56320 - DNA, 22 bp, Artificial sequence
  SiRNA target sequence
cactagataaaaagagtgaact

SEQ ID NO: 56321 - DNA, 22 bp, Artificial sequence
  SiRNA target sequence
actagataaaaagagtgaacta

SEQ ID NO: 56322 - DNA, 22 bp, Artificial sequence
  SiRNA target sequence
ctagataaaaagagtgaactag

SEQ ID NO: 56323 - DNA, 22 bp, Artificial sequence
  SiRNA target sequence
tagataaaaagagtgaactaga

SEQ ID NO: 56324 - DNA, 22 bp, Artificial sequence
  SiRNA target sequence
agataaaaagagtgaactagaa

SEQ ID NO: 56325 - DNA, 22 bp, Artificial sequence
  SiRNA target sequence
gataaaaagagtgaactagaaa

SEQ ID NO: 56326 - DNA, 22 bp, Artificial sequence
  SiRNA target sequence
ataaaaagagtgaactagaaac

SEQ ID NO: 56327 - DNA, 22 bp, Artificial sequence
  SiRNA target sequence
taaaaagagtgaactagaaact

SEQ ID NO: 56328 - DNA, 22 bp, Artificial sequence
  SiRNA target sequence
aaaaagagtgaactagaaacta

SEQ ID NO: 56329 - DNA, 22 bp, Artificial sequence
  SiRNA target sequence
aaaagagtgaactagaaactat

SEQ ID NO: 56330 - DNA, 22 bp, Artificial sequence
  SiRNA target sequence
aaagagtgaactagaaactatg

SEQ ID NO: 56331 - DNA, 22 bp, Artificial sequence
  SiRNA target sequence
aagagtgaactagaaactatga

SEQ ID NO: 56332 - DNA, 22 bp, Artificial sequence
  SiRNA target sequence
agagtgaactagaaactatgac

SEQ ID NO: 56333 - DNA, 22 bp, Artificial sequence
  SiRNA target sequence
gagtgaactagaaactatgaca

SEQ ID NO: 56334 - DNA, 22 bp, Artificial sequence
  SiRNA target sequence
agtgaactagaaactatgacat

SEQ ID NO: 56335 - DNA, 22 bp, Artificial sequence
  SiRNA target sequence
gtgaactagaaactatgacata

SEQ ID NO: 56336 - DNA, 22 bp, Artificial sequence
  SiRNA target sequence
tgaactagaaactatgacatat

SEQ ID NO: 56337 - DNA, 22 bp, Artificial sequence
  SiRNA target sequence
gaactagaaactatgacatata

SEQ ID NO: 56338 - DNA, 22 bp, Artificial sequence
  SiRNA target sequence
aactagaaactatgacatatat

SEQ ID NO: 56339 - DNA, 22 bp, Artificial sequence
  SiRNA target sequence
actagaaactatgacatatatt

SEQ ID NO: 56340 - DNA, 22 bp, Artificial sequence
  SiRNA target sequence
ctagaaactatgacatatattt

SEQ ID NO: 56341 - DNA, 22 bp, Artificial sequence
  SiRNA target sequence
tagaaactatgacatatatttt

SEQ ID NO: 56342 - DNA, 22 bp, Artificial sequence
  SiRNA target sequence
agaaactatgacatatattttt

SEQ ID NO: 56343 - DNA, 22 bp, Artificial sequence
  SiRNA target sequence
gaaactatgacatatattttta

SEQ ID NO: 56344 - DNA, 22 bp, Artificial sequence
  SiRNA target sequence
aaactatgacatatatttttaa

SEQ ID NO: 56345 - DNA, 22 bp, Artificial sequence
  SiRNA target sequence
aactatgacatatatttttaat

SEQ ID NO: 56346 - DNA, 22 bp, Artificial sequence
  SiRNA target sequence
actatgacatatatttttaatg

SEQ ID NO: 56347 - DNA, 22 bp, Artificial sequence
  SiRNA target sequence
ctatgacatatatttttaatga

SEQ ID NO: 56348 - DNA, 22 bp, Artificial sequence
  SiRNA target sequence
tatgacatatatttttaatgaa

SEQ ID NO: 56349 - DNA, 22 bp, Artificial sequence
  SiRNA target sequence
atgacatatatttttaatgaat

SEQ ID NO: 56350 - DNA, 22 bp, Artificial sequence
  SiRNA target sequence
tgacatatatttttaatgaatt

SEQ ID NO: 56351 - DNA, 22 bp, Artificial sequence
  SiRNA target sequence
gacatatatttttaatgaattt

SEQ ID NO: 56352 - DNA, 22 bp, Artificial sequence
  SiRNA target sequence
acatatatttttaatgaattta

SEQ ID NO: 56353 - DNA, 22 bp, Artificial sequence
  SiRNA target sequence
catatatttttaatgaatttaa

SEQ ID NO: 56354 - DNA, 22 bp, Artificial sequence
  SiRNA target sequence
atatatttttaatgaatttaag

SEQ ID NO: 56355 - DNA, 22 bp, Artificial sequence
  SiRNA target sequence
tatatttttaatgaatttaagt

SEQ ID NO: 56356 - DNA, 22 bp, Artificial sequence
  SiRNA target sequence
atatttttaatgaatttaagta

SEQ ID NO: 56357 - DNA, 22 bp, Artificial sequence
  SiRNA target sequence
tatttttaatgaatttaagtac

SEQ ID NO: 56358 - DNA, 22 bp, Artificial sequence
  SiRNA target sequence
atttttaatgaatttaagtacc

SEQ ID NO: 56359 - DNA, 22 bp, Artificial sequence
  SiRNA target sequence
tttttaatgaatttaagtacca

SEQ ID NO: 56360 - DNA, 22 bp, Artificial sequence
  SiRNA target sequence
ttttaatgaatttaagtaccat

SEQ ID NO: 56361 - DNA, 22 bp, Artificial sequence
  SiRNA target sequence
tttaatgaatttaagtaccata

SEQ ID NO: 56362 - DNA, 22 bp, Artificial sequence
  SiRNA target sequence
ttaatgaatttaagtaccatac

SEQ ID NO: 56363 - DNA, 22 bp, Artificial sequence
  SiRNA target sequence
taatgaatttaagtaccatact

SEQ ID NO: 56364 - DNA, 22 bp, Artificial sequence
  SiRNA target sequence
aatgaatttaagtaccatactt

SEQ ID NO: 56365 - DNA, 22 bp, Artificial sequence
  SiRNA target sequence
atgaatttaagtaccatacttt

SEQ ID NO: 56366 - DNA, 22 bp, Artificial sequence
  SiRNA target sequence
tgaatttaagtaccatactttt

SEQ ID NO: 56367 - DNA, 22 bp, Artificial sequence
  SiRNA target sequence
gaatttaagtaccatacttttg

SEQ ID NO: 56368 - DNA, 22 bp, Artificial sequence
  SiRNA target sequence
aatttaagtaccatacttttgt

SEQ ID NO: 56369 - DNA, 22 bp, Artificial sequence
  SiRNA target sequence
atttaagtaccatacttttgta

SEQ ID NO: 56370 - DNA, 22 bp, Artificial sequence
  SiRNA target sequence
tttaagtaccatacttttgtaa

SEQ ID NO: 56371 - DNA, 22 bp, Artificial sequence
  SiRNA target sequence
ttaagtaccatacttttgtaat

SEQ ID NO: 56372 - DNA, 22 bp, Artificial sequence
  SiRNA target sequence
taagtaccatacttttgtaata

SEQ ID NO: 56373 - DNA, 22 bp, Artificial sequence
  SiRNA target sequence
aagtaccatacttttgtaataa

SEQ ID NO: 56374 - DNA, 22 bp, Artificial sequence
  SiRNA target sequence
agtaccatacttttgtaataat

SEQ ID NO: 56375 - DNA, 22 bp, Artificial sequence
  SiRNA target sequence
gtaccatacttttgtaataatt

SEQ ID NO: 56376 - DNA, 22 bp, Artificial sequence
  SiRNA target sequence
taccatacttttgtaataattg

SEQ ID NO: 56377 - DNA, 22 bp, Artificial sequence
  SiRNA target sequence
accatacttttgtaataattgt

SEQ ID NO: 56378 - DNA, 22 bp, Artificial sequence
  SiRNA target sequence
ccatacttttgtaataattgta

SEQ ID NO: 56379 - DNA, 22 bp, Artificial sequence
  SiRNA target sequence
catacttttgtaataattgtac

SEQ ID NO: 56380 - DNA, 22 bp, Artificial sequence
  SiRNA target sequence
atacttttgtaataattgtaca

SEQ ID NO: 56381 - DNA, 22 bp, Artificial sequence
  SiRNA target sequence
tacttttgtaataattgtacac

SEQ ID NO: 56382 - DNA, 22 bp, Artificial sequence
  SiRNA target sequence
acttttgtaataattgtacaca

SEQ ID NO: 56383 - DNA, 22 bp, Artificial sequence
  SiRNA target sequence
cttttgtaataattgtacacaa

SEQ ID NO: 56384 - DNA, 22 bp, Artificial sequence
  SiRNA target sequence
ttttgtaataattgtacacaat

SEQ ID NO: 56385 - DNA, 22 bp, Artificial sequence
  SiRNA target sequence
tttgtaataattgtacacaatc

SEQ ID NO: 56386 - DNA, 22 bp, Artificial sequence
  SiRNA target sequence
ttgtaataattgtacacaatct

SEQ ID NO: 56387 - DNA, 22 bp, Artificial sequence
  SiRNA target sequence
tgtaataattgtacacaatcta

SEQ ID NO: 56388 - DNA, 22 bp, Artificial sequence
  SiRNA target sequence
gtaataattgtacacaatctag

SEQ ID NO: 56389 - DNA, 22 bp, Artificial sequence
  SiRNA target sequence
taataattgtacacaatctaga

SEQ ID NO: 56390 - DNA, 22 bp, Artificial sequence
  SiRNA target sequence
aataattgtacacaatctagaa

SEQ ID NO: 56391 - DNA, 22 bp, Artificial sequence
  SiRNA target sequence
ataattgtacacaatctagaat

SEQ ID NO: 56392 - DNA, 22 bp, Artificial sequence
  SiRNA target sequence
taattgtacacaatctagaatt

SEQ ID NO: 56393 - DNA, 22 bp, Artificial sequence
  SiRNA target sequence
aattgtacacaatctagaatta

SEQ ID NO: 56394 - DNA, 22 bp, Artificial sequence
  SiRNA target sequence
attgtacacaatctagaattat

SEQ ID NO: 56395 - DNA, 22 bp, Artificial sequence
  SiRNA target sequence
ttgtacacaatctagaattatt

SEQ ID NO: 56396 - DNA, 22 bp, Artificial sequence
  SiRNA target sequence
tgtacacaatctagaattattg

SEQ ID NO: 56397 - DNA, 22 bp, Artificial sequence
  SiRNA target sequence
gtacacaatctagaattattgg

SEQ ID NO: 56398 - DNA, 22 bp, Artificial sequence
  SiRNA target sequence
tacacaatctagaattattggc

SEQ ID NO: 56399 - DNA, 22 bp, Artificial sequence
  SiRNA target sequence
acacaatctagaattattggct

SEQ ID NO: 56400 - DNA, 22 bp, Artificial sequence
  SiRNA target sequence
cacaatctagaattattggctt

SEQ ID NO: 56401 - DNA, 22 bp, Artificial sequence
  SiRNA target sequence
acaatctagaattattggcttt

SEQ ID NO: 56402 - DNA, 22 bp, Artificial sequence
  SiRNA target sequence
caatctagaattattggctttg

SEQ ID NO: 56403 - DNA, 22 bp, Artificial sequence
  SiRNA target sequence
aatctagaattattggctttgt

SEQ ID NO: 56404 - DNA, 22 bp, Artificial sequence
  SiRNA target sequence
atctagaattattggctttgtt

SEQ ID NO: 56405 - DNA, 22 bp, Artificial sequence
  SiRNA target sequence
tctagaattattggctttgttt

SEQ ID NO: 56406 - DNA, 22 bp, Artificial sequence
  SiRNA target sequence
ctagaattattggctttgtttg

SEQ ID NO: 56407 - DNA, 22 bp, Artificial sequence
  SiRNA target sequence
tagaattattggctttgtttga

SEQ ID NO: 56408 - DNA, 22 bp, Artificial sequence
  SiRNA target sequence
agaattattggctttgtttgat

SEQ ID NO: 56409 - DNA, 22 bp, Artificial sequence
  SiRNA target sequence
gaattattggctttgtttgata

SEQ ID NO: 56410 - DNA, 22 bp, Artificial sequence
  SiRNA target sequence
aattattggctttgtttgataa

SEQ ID NO: 56411 - DNA, 22 bp, Artificial sequence
  SiRNA target sequence
attattggctttgtttgataaa

SEQ ID NO: 56412 - DNA, 22 bp, Artificial sequence
  SiRNA target sequence
ttattggctttgtttgataaaa

SEQ ID NO: 56413 - DNA, 22 bp, Artificial sequence
  SiRNA target sequence
tattggctttgtttgataaaat

SEQ ID NO: 56414 - DNA, 22 bp, Artificial sequence
  SiRNA target sequence
attggctttgtttgataaaatt

SEQ ID NO: 56415 - DNA, 22 bp, Artificial sequence
  SiRNA target sequence
ttggctttgtttgataaaattt

SEQ ID NO: 56416 - DNA, 22 bp, Artificial sequence
  SiRNA target sequence
tggctttgtttgataaaatttt

SEQ ID NO: 56417 - DNA, 22 bp, Artificial sequence
  SiRNA target sequence
ggctttgtttgataaaatttta

SEQ ID NO: 56418 - DNA, 22 bp, Artificial sequence
  SiRNA target sequence
gctttgtttgataaaattttat

SEQ ID NO: 56419 - DNA, 22 bp, Artificial sequence
  SiRNA target sequence
ctttgtttgataaaattttatt

SEQ ID NO: 56420 - DNA, 22 bp, Artificial sequence
  SiRNA target sequence
tttgtttgataaaattttattt

SEQ ID NO: 56421 - DNA, 22 bp, Artificial sequence
  SiRNA target sequence
ttgtttgataaaattttatttg

SEQ ID NO: 56422 - DNA, 22 bp, Artificial sequence
  SiRNA target sequence
tgtttgataaaattttatttgt

SEQ ID NO: 56423 - DNA, 22 bp, Artificial sequence
  SiRNA target sequence
gtttgataaaattttatttgta

SEQ ID NO: 56424 - DNA, 22 bp, Artificial sequence
  SiRNA target sequence
tttgataaaattttatttgtaa

SEQ ID NO: 56425 - DNA, 22 bp, Artificial sequence
  SiRNA target sequence
ttgataaaattttatttgtaaa

SEQ ID NO: 56426 - DNA, 22 bp, Artificial sequence
  SiRNA target sequence
tgataaaattttatttgtaaat

SEQ ID NO: 56427 - DNA, 22 bp, Artificial sequence
  SiRNA target sequence
gataaaattttatttgtaaatg

SEQ ID NO: 56428 - DNA, 22 bp, Artificial sequence
  SiRNA target sequence
ataaaattttatttgtaaatgg

SEQ ID NO: 56429 - DNA, 22 bp, Artificial sequence
  SiRNA target sequence
taaaattttatttgtaaatggt

SEQ ID NO: 56430 - DNA, 22 bp, Artificial sequence
  SiRNA target sequence
aaaattttatttgtaaatggta

SEQ ID NO: 56431 - DNA, 22 bp, Artificial sequence
  SiRNA target sequence
aaattttatttgtaaatggtaa

SEQ ID NO: 56432 - DNA, 22 bp, Artificial sequence
  SiRNA target sequence
aattttatttgtaaatggtaat

SEQ ID NO: 56433 - DNA, 22 bp, Artificial sequence
  SiRNA target sequence
attttatttgtaaatggtaatg

SEQ ID NO: 56434 - DNA, 22 bp, Artificial sequence
  SiRNA target sequence
ttttatttgtaaatggtaatga

SEQ ID NO: 56435 - DNA, 22 bp, Artificial sequence
  SiRNA target sequence
tttatttgtaaatggtaatgag

SEQ ID NO: 56436 - DNA, 22 bp, Artificial sequence
  SiRNA target sequence
ttatttgtaaatggtaatgagg

SEQ ID NO: 56437 - DNA, 22 bp, Artificial sequence
  SiRNA target sequence
tatttgtaaatggtaatgaggt

SEQ ID NO: 56438 - DNA, 22 bp, Artificial sequence
  SiRNA target sequence
atttgtaaatggtaatgaggta

SEQ ID NO: 56439 - DNA, 22 bp, Artificial sequence
  SiRNA target sequence
tttgtaaatggtaatgaggtaa

SEQ ID NO: 56440 - DNA, 22 bp, Artificial sequence
  SiRNA target sequence
ttgtaaatggtaatgaggtaac

SEQ ID NO: 56441 - DNA, 22 bp, Artificial sequence
  SiRNA target sequence
tgtaaatggtaatgaggtaaca

SEQ ID NO: 56442 - DNA, 22 bp, Artificial sequence
  SiRNA target sequence
gtaaatggtaatgaggtaacaa

SEQ ID NO: 56443 - DNA, 22 bp, Artificial sequence
  SiRNA target sequence
taaatggtaatgaggtaacaat

SEQ ID NO: 56444 - DNA, 22 bp, Artificial sequence
  SiRNA target sequence
aaatggtaatgaggtaacaatg

SEQ ID NO: 56445 - DNA, 22 bp, Artificial sequence
  SiRNA target sequence
aatggtaatgaggtaacaatga

SEQ ID NO: 56446 - DNA, 22 bp, Artificial sequence
  SiRNA target sequence
atggtaatgaggtaacaatgat

SEQ ID NO: 56447 - DNA, 22 bp, Artificial sequence
  SiRNA target sequence
tggtaatgaggtaacaatgata

SEQ ID NO: 56448 - DNA, 22 bp, Artificial sequence
  SiRNA target sequence
ggtaatgaggtaacaatgatag

SEQ ID NO: 56449 - DNA, 22 bp, Artificial sequence
  SiRNA target sequence
gtaatgaggtaacaatgataga

SEQ ID NO: 56450 - DNA, 22 bp, Artificial sequence
  SiRNA target sequence
taatgaggtaacaatgatagaa

SEQ ID NO: 56451 - DNA, 22 bp, Artificial sequence
  SiRNA target sequence
aatgaggtaacaatgatagaag

SEQ ID NO: 56452 - DNA, 22 bp, Artificial sequence
  SiRNA target sequence
atgaggtaacaatgatagaaga

SEQ ID NO: 56453 - DNA, 22 bp, Artificial sequence
  SiRNA target sequence
tgaggtaacaatgatagaagac

SEQ ID NO: 56454 - DNA, 22 bp, Artificial sequence
  SiRNA target sequence
gaggtaacaatgatagaagaca

SEQ ID NO: 56455 - DNA, 22 bp, Artificial sequence
  SiRNA target sequence
aggtaacaatgatagaagacat

SEQ ID NO: 56456 - DNA, 22 bp, Artificial sequence
  SiRNA target sequence
ggtaacaatgatagaagacatt

SEQ ID NO: 56457 - DNA, 22 bp, Artificial sequence
  SiRNA target sequence
gtaacaatgatagaagacatta

SEQ ID NO: 56458 - DNA, 22 bp, Artificial sequence
  SiRNA target sequence
taacaatgatagaagacattaa

SEQ ID NO: 56459 - DNA, 22 bp, Artificial sequence
  SiRNA target sequence
aacaatgatagaagacattaac

SEQ ID NO: 56460 - DNA, 22 bp, Artificial sequence
  SiRNA target sequence
acaatgatagaagacattaaca

SEQ ID NO: 56461 - DNA, 22 bp, Artificial sequence
  SiRNA target sequence
caatgatagaagacattaacaa

SEQ ID NO: 56462 - DNA, 22 bp, Artificial sequence
  SiRNA target sequence
aatgatagaagacattaacaaa

SEQ ID NO: 56463 - DNA, 22 bp, Artificial sequence
  SiRNA target sequence
atgatagaagacattaacaaaa

SEQ ID NO: 56464 - DNA, 22 bp, Artificial sequence
  SiRNA target sequence
tgatagaagacattaacaaaaa

SEQ ID NO: 56465 - DNA, 22 bp, Artificial sequence
  SiRNA target sequence
gatagaagacattaacaaaaaa

SEQ ID NO: 56466 - DNA, 22 bp, Artificial sequence
  SiRNA target sequence
atagaagacattaacaaaaaac

SEQ ID NO: 56467 - DNA, 22 bp, Artificial sequence
  SiRNA target sequence
tagaagacattaacaaaaaact

SEQ ID NO: 56468 - DNA, 22 bp, Artificial sequence
  SiRNA target sequence
agaagacattaacaaaaaactt

SEQ ID NO: 56469 - DNA, 22 bp, Artificial sequence
  SiRNA target sequence
gaagacattaacaaaaaacttg

SEQ ID NO: 56470 - DNA, 22 bp, Artificial sequence
  SiRNA target sequence
aagacattaacaaaaaacttga

SEQ ID NO: 56471 - DNA, 22 bp, Artificial sequence
  SiRNA target sequence
agacattaacaaaaaacttgaa

SEQ ID NO: 56472 - DNA, 22 bp, Artificial sequence
  SiRNA target sequence
gacattaacaaaaaacttgaag

SEQ ID NO: 56473 - DNA, 22 bp, Artificial sequence
  SiRNA target sequence
acattaacaaaaaacttgaaga

SEQ ID NO: 56474 - DNA, 22 bp, Artificial sequence
  SiRNA target sequence
cattaacaaaaaacttgaagaa

SEQ ID NO: 56475 - DNA, 22 bp, Artificial sequence
  SiRNA target sequence
attaacaaaaaacttgaagaaa

SEQ ID NO: 56476 - DNA, 22 bp, Artificial sequence
  SiRNA target sequence
ttaacaaaaaacttgaagaaaa

SEQ ID NO: 56477 - DNA, 22 bp, Artificial sequence
  SiRNA target sequence
taacaaaaaacttgaagaaaat

SEQ ID NO: 56478 - DNA, 22 bp, Artificial sequence
  SiRNA target sequence
aacaaaaaacttgaagaaaatt

SEQ ID NO: 56479 - DNA, 22 bp, Artificial sequence
  SiRNA target sequence
acaaaaaacttgaagaaaattc

SEQ ID NO: 56480 - DNA, 22 bp, Artificial sequence
  SiRNA target sequence
caaaaaacttgaagaaaattca

SEQ ID NO: 56481 - DNA, 22 bp, Artificial sequence
  SiRNA target sequence
aaaaaacttgaagaaaattcaa

SEQ ID NO: 56482 - DNA, 22 bp, Artificial sequence
  SiRNA target sequence
aaaaacttgaagaaaattcaaa

SEQ ID NO: 56483 - DNA, 22 bp, Artificial sequence
  SiRNA target sequence
aaaacttgaagaaaattcaaag

SEQ ID NO: 56484 - DNA, 22 bp, Artificial sequence
  SiRNA target sequence
aaacttgaagaaaattcaaagt

SEQ ID NO: 56485 - DNA, 22 bp, Artificial sequence
  SiRNA target sequence
aacttgaagaaaattcaaagta

SEQ ID NO: 56486 - DNA, 22 bp, Artificial sequence
  SiRNA target sequence
acttgaagaaaattcaaagtat

SEQ ID NO: 56487 - DNA, 22 bp, Artificial sequence
  SiRNA target sequence
cttgaagaaaattcaaagtatt

SEQ ID NO: 56488 - DNA, 22 bp, Artificial sequence
  SiRNA target sequence
ttgaagaaaattcaaagtattt

SEQ ID NO: 56489 - DNA, 22 bp, Artificial sequence
  SiRNA target sequence
tgaagaaaattcaaagtatttt

SEQ ID NO: 56490 - DNA, 22 bp, Artificial sequence
  SiRNA target sequence
gaagaaaattcaaagtattttg

SEQ ID NO: 56491 - DNA, 22 bp, Artificial sequence
  SiRNA target sequence
aagaaaattcaaagtattttgc

SEQ ID NO: 56492 - DNA, 22 bp, Artificial sequence
  SiRNA target sequence
agaaaattcaaagtattttgca

SEQ ID NO: 56493 - DNA, 22 bp, Artificial sequence
  SiRNA target sequence
gaaaattcaaagtattttgcag

SEQ ID NO: 56494 - DNA, 22 bp, Artificial sequence
  SiRNA target sequence
aaaattcaaagtattttgcaga

SEQ ID NO: 56495 - DNA, 22 bp, Artificial sequence
  SiRNA target sequence
aaattcaaagtattttgcagat

SEQ ID NO: 56496 - DNA, 22 bp, Artificial sequence
  SiRNA target sequence
aattcaaagtattttgcagata

SEQ ID NO: 56497 - DNA, 22 bp, Artificial sequence
  SiRNA target sequence
attcaaagtattttgcagatat

SEQ ID NO: 56498 - DNA, 22 bp, Artificial sequence
  SiRNA target sequence
ttcaaagtattttgcagatatt

SEQ ID NO: 56499 - DNA, 22 bp, Artificial sequence
  SiRNA target sequence
tcaaagtattttgcagatattt

SEQ ID NO: 56500 - DNA, 22 bp, Artificial sequence
  SiRNA target sequence
caaagtattttgcagatatttt

SEQ ID NO: 56501 - DNA, 22 bp, Artificial sequence
  SiRNA target sequence
aaagtattttgcagatatttta

SEQ ID NO: 56502 - DNA, 22 bp, Artificial sequence
  SiRNA target sequence
aagtattttgcagatattttaa

SEQ ID NO: 56503 - DNA, 22 bp, Artificial sequence
  SiRNA target sequence
agtattttgcagatattttaaa

SEQ ID NO: 56504 - DNA, 22 bp, Artificial sequence
  SiRNA target sequence
gtattttgcagatattttaaac

SEQ ID NO: 56505 - DNA, 22 bp, Artificial sequence
  SiRNA target sequence
tattttgcagatattttaaaca

SEQ ID NO: 56506 - DNA, 22 bp, Artificial sequence
  SiRNA target sequence
attttgcagatattttaaacaa

SEQ ID NO: 56507 - DNA, 22 bp, Artificial sequence
  SiRNA target sequence
ttttgcagatattttaaacaac

SEQ ID NO: 56508 - DNA, 22 bp, Artificial sequence
  SiRNA target sequence
tttgcagatattttaaacaacg

SEQ ID NO: 56509 - DNA, 22 bp, Artificial sequence
  SiRNA target sequence
ttgcagatattttaaacaacga

SEQ ID NO: 56510 - DNA, 22 bp, Artificial sequence
  SiRNA target sequence
tgcagatattttaaacaacgaa

SEQ ID NO: 56511 - DNA, 22 bp, Artificial sequence
  SiRNA target sequence
gcagatattttaaacaacgaat

SEQ ID NO: 56512 - DNA, 22 bp, Artificial sequence
  SiRNA target sequence
cagatattttaaacaacgaata

SEQ ID NO: 56513 - DNA, 22 bp, Artificial sequence
  SiRNA target sequence
agatattttaaacaacgaataa

SEQ ID NO: 56514 - DNA, 23 bp, Artificial sequence
  SiRNA target sequence
atgaaggaaaaaaccaattatga

SEQ ID NO: 56515 - DNA, 23 bp, Artificial sequence
  SiRNA target sequence
tgaaggaaaaaaccaattatgaa

SEQ ID NO: 56516 - DNA, 23 bp, Artificial sequence
  SiRNA target sequence
gaaggaaaaaaccaattatgaaa

SEQ ID NO: 56517 - DNA, 23 bp, Artificial sequence
  SiRNA target sequence
aaggaaaaaaccaattatgaaat

SEQ ID NO: 56518 - DNA, 23 bp, Artificial sequence
  SiRNA target sequence
aggaaaaaaccaattatgaaatt

SEQ ID NO: 56519 - DNA, 23 bp, Artificial sequence
  SiRNA target sequence
ggaaaaaaccaattatgaaattt

SEQ ID NO: 56520 - DNA, 23 bp, Artificial sequence
  SiRNA target sequence
gaaaaaaccaattatgaaatttt

SEQ ID NO: 56521 - DNA, 23 bp, Artificial sequence
  SiRNA target sequence
aaaaaaccaattatgaaatttta

SEQ ID NO: 56522 - DNA, 23 bp, Artificial sequence
  SiRNA target sequence
aaaaaccaattatgaaattttat

SEQ ID NO: 56523 - DNA, 23 bp, Artificial sequence
  SiRNA target sequence
aaaaccaattatgaaattttata

SEQ ID NO: 56524 - DNA, 23 bp, Artificial sequence
  SiRNA target sequence
aaaccaattatgaaattttatat

SEQ ID NO: 56525 - DNA, 23 bp, Artificial sequence
  SiRNA target sequence
aaccaattatgaaattttatatg

SEQ ID NO: 56526 - DNA, 23 bp, Artificial sequence
  SiRNA target sequence
accaattatgaaattttatatga

SEQ ID NO: 56527 - DNA, 23 bp, Artificial sequence
  SiRNA target sequence
ccaattatgaaattttatatgat

SEQ ID NO: 56528 - DNA, 23 bp, Artificial sequence
  SiRNA target sequence
caattatgaaattttatatgata

SEQ ID NO: 56529 - DNA, 23 bp, Artificial sequence
  SiRNA target sequence
aattatgaaattttatatgatac

SEQ ID NO: 56530 - DNA, 23 bp, Artificial sequence
  SiRNA target sequence
attatgaaattttatatgataca

SEQ ID NO: 56531 - DNA, 23 bp, Artificial sequence
  SiRNA target sequence
ttatgaaattttatatgatacat

SEQ ID NO: 56532 - DNA, 23 bp, Artificial sequence
  SiRNA target sequence
tatgaaattttatatgatacatt

SEQ ID NO: 56533 - DNA, 23 bp, Artificial sequence
  SiRNA target sequence
atgaaattttatatgatacattt

SEQ ID NO: 56534 - DNA, 23 bp, Artificial sequence
  SiRNA target sequence
tgaaattttatatgatacatttg

SEQ ID NO: 56535 - DNA, 23 bp, Artificial sequence
  SiRNA target sequence
gaaattttatatgatacatttgt

SEQ ID NO: 56536 - DNA, 23 bp, Artificial sequence
  SiRNA target sequence
aaattttatatgatacatttgta

SEQ ID NO: 56537 - DNA, 23 bp, Artificial sequence
  SiRNA target sequence
aattttatatgatacatttgtaa

SEQ ID NO: 56538 - DNA, 23 bp, Artificial sequence
  SiRNA target sequence
attttatatgatacatttgtaaa

SEQ ID NO: 56539 - DNA, 23 bp, Artificial sequence
  SiRNA target sequence
ttttatatgatacatttgtaaaa

SEQ ID NO: 56540 - DNA, 23 bp, Artificial sequence
  SiRNA target sequence
tttatatgatacatttgtaaaat

SEQ ID NO: 56541 - DNA, 23 bp, Artificial sequence
  SiRNA target sequence
ttatatgatacatttgtaaaata

SEQ ID NO: 56542 - DNA, 23 bp, Artificial sequence
  SiRNA target sequence
tatatgatacatttgtaaaatat

SEQ ID NO: 56543 - DNA, 23 bp, Artificial sequence
  SiRNA target sequence
atatgatacatttgtaaaatatt

SEQ ID NO: 56544 - DNA, 23 bp, Artificial sequence
  SiRNA target sequence
tatgatacatttgtaaaatattg

SEQ ID NO: 56545 - DNA, 23 bp, Artificial sequence
  SiRNA target sequence
atgatacatttgtaaaatattgt

SEQ ID NO: 56546 - DNA, 23 bp, Artificial sequence
  SiRNA target sequence
tgatacatttgtaaaatattgtt

SEQ ID NO: 56547 - DNA, 23 bp, Artificial sequence
  SiRNA target sequence
gatacatttgtaaaatattgtta

SEQ ID NO: 56548 - DNA, 23 bp, Artificial sequence
  SiRNA target sequence
atacatttgtaaaatattgttac

SEQ ID NO: 56549 - DNA, 23 bp, Artificial sequence
  SiRNA target sequence
tacatttgtaaaatattgttaca

SEQ ID NO: 56550 - DNA, 23 bp, Artificial sequence
  SiRNA target sequence
acatttgtaaaatattgttacaa

SEQ ID NO: 56551 - DNA, 23 bp, Artificial sequence
  SiRNA target sequence
catttgtaaaatattgttacaat

SEQ ID NO: 56552 - DNA, 23 bp, Artificial sequence
  SiRNA target sequence
atttgtaaaatattgttacaata

SEQ ID NO: 56553 - DNA, 23 bp, Artificial sequence
  SiRNA target sequence
tttgtaaaatattgttacaatat

SEQ ID NO: 56554 - DNA, 23 bp, Artificial sequence
  SiRNA target sequence
ttgtaaaatattgttacaatatt

SEQ ID NO: 56555 - DNA, 23 bp, Artificial sequence
  SiRNA target sequence
tgtaaaatattgttacaatattt

SEQ ID NO: 56556 - DNA, 23 bp, Artificial sequence
  SiRNA target sequence
gtaaaatattgttacaatatttc

SEQ ID NO: 56557 - DNA, 23 bp, Artificial sequence
  SiRNA target sequence
taaaatattgttacaatatttcc

SEQ ID NO: 56558 - DNA, 23 bp, Artificial sequence
  SiRNA target sequence
aaaatattgttacaatatttcct

SEQ ID NO: 56559 - DNA, 23 bp, Artificial sequence
  SiRNA target sequence
aaatattgttacaatatttccta

SEQ ID NO: 56560 - DNA, 23 bp, Artificial sequence
  SiRNA target sequence
aatattgttacaatatttcctat

SEQ ID NO: 56561 - DNA, 23 bp, Artificial sequence
  SiRNA target sequence
atattgttacaatatttcctata

SEQ ID NO: 56562 - DNA, 23 bp, Artificial sequence
  SiRNA target sequence
tattgttacaatatttcctatat

SEQ ID NO: 56563 - DNA, 23 bp, Artificial sequence
  SiRNA target sequence
attgttacaatatttcctatata

SEQ ID NO: 56564 - DNA, 23 bp, Artificial sequence
  SiRNA target sequence
ttgttacaatatttcctatataa

SEQ ID NO: 56565 - DNA, 23 bp, Artificial sequence
  SiRNA target sequence
tgttacaatatttcctatataag

SEQ ID NO: 56566 - DNA, 23 bp, Artificial sequence
  SiRNA target sequence
gttacaatatttcctatataagg

SEQ ID NO: 56567 - DNA, 23 bp, Artificial sequence
  SiRNA target sequence
ttacaatatttcctatataaggt

SEQ ID NO: 56568 - DNA, 23 bp, Artificial sequence
  SiRNA target sequence
tacaatatttcctatataaggta

SEQ ID NO: 56569 - DNA, 23 bp, Artificial sequence
  SiRNA target sequence
acaatatttcctatataaggtac

SEQ ID NO: 56570 - DNA, 23 bp, Artificial sequence
  SiRNA target sequence
caatatttcctatataaggtacg

SEQ ID NO: 56571 - DNA, 23 bp, Artificial sequence
  SiRNA target sequence
aatatttcctatataaggtacgt

SEQ ID NO: 56572 - DNA, 23 bp, Artificial sequence
  SiRNA target sequence
atatttcctatataaggtacgta

SEQ ID NO: 56573 - DNA, 23 bp, Artificial sequence
  SiRNA target sequence
tatttcctatataaggtacgtaa

SEQ ID NO: 56574 - DNA, 23 bp, Artificial sequence
  SiRNA target sequence
atttcctatataaggtacgtaat

SEQ ID NO: 56575 - DNA, 23 bp, Artificial sequence
  SiRNA target sequence
tttcctatataaggtacgtaatg

SEQ ID NO: 56576 - DNA, 23 bp, Artificial sequence
  SiRNA target sequence
ttcctatataaggtacgtaatgt

SEQ ID NO: 56577 - DNA, 23 bp, Artificial sequence
  SiRNA target sequence
tcctatataaggtacgtaatgtt

SEQ ID NO: 56578 - DNA, 23 bp, Artificial sequence
  SiRNA target sequence
cctatataaggtacgtaatgttt

SEQ ID NO: 56579 - DNA, 23 bp, Artificial sequence
  SiRNA target sequence
ctatataaggtacgtaatgtttc

SEQ ID NO: 56580 - DNA, 23 bp, Artificial sequence
  SiRNA target sequence
tatataaggtacgtaatgtttcc

SEQ ID NO: 56581 - DNA, 23 bp, Artificial sequence
  SiRNA target sequence
atataaggtacgtaatgtttccc

SEQ ID NO: 56582 - DNA, 23 bp, Artificial sequence
  SiRNA target sequence
tataaggtacgtaatgtttccca

SEQ ID NO: 56583 - DNA, 23 bp, Artificial sequence
  SiRNA target sequence
ataaggtacgtaatgtttcccat

SEQ ID NO: 56584 - DNA, 23 bp, Artificial sequence
  SiRNA target sequence
taaggtacgtaatgtttcccata

SEQ ID NO: 56585 - DNA, 23 bp, Artificial sequence
  SiRNA target sequence
aaggtacgtaatgtttcccatat

SEQ ID NO: 56586 - DNA, 23 bp, Artificial sequence
  SiRNA target sequence
aggtacgtaatgtttcccatatt

SEQ ID NO: 56587 - DNA, 23 bp, Artificial sequence
  SiRNA target sequence
ggtacgtaatgtttcccatatta

SEQ ID NO: 56588 - DNA, 23 bp, Artificial sequence
  SiRNA target sequence
gtacgtaatgtttcccatattac

SEQ ID NO: 56589 - DNA, 23 bp, Artificial sequence
  SiRNA target sequence
tacgtaatgtttcccatattact

SEQ ID NO: 56590 - DNA, 23 bp, Artificial sequence
  SiRNA target sequence
acgtaatgtttcccatattactg

SEQ ID NO: 56591 - DNA, 23 bp, Artificial sequence
  SiRNA target sequence
cgtaatgtttcccatattactgt

SEQ ID NO: 56592 - DNA, 23 bp, Artificial sequence
  SiRNA target sequence
gtaatgtttcccatattactgtc

SEQ ID NO: 56593 - DNA, 23 bp, Artificial sequence
  SiRNA target sequence
taatgtttcccatattactgtct

SEQ ID NO: 56594 - DNA, 23 bp, Artificial sequence
  SiRNA target sequence
aatgtttcccatattactgtcta

SEQ ID NO: 56595 - DNA, 23 bp, Artificial sequence
  SiRNA target sequence
atgtttcccatattactgtctac

SEQ ID NO: 56596 - DNA, 23 bp, Artificial sequence
  SiRNA target sequence
tgtttcccatattactgtctaca

SEQ ID NO: 56597 - DNA, 23 bp, Artificial sequence
  SiRNA target sequence
gtttcccatattactgtctacaa

SEQ ID NO: 56598 - DNA, 23 bp, Artificial sequence
  SiRNA target sequence
tttcccatattactgtctacaat

SEQ ID NO: 56599 - DNA, 23 bp, Artificial sequence
  SiRNA target sequence
ttcccatattactgtctacaatt

SEQ ID NO: 56600 - DNA, 23 bp, Artificial sequence
  SiRNA target sequence
tcccatattactgtctacaatta

SEQ ID NO: 56601 - DNA, 23 bp, Artificial sequence
  SiRNA target sequence
cccatattactgtctacaattat

SEQ ID NO: 56602 - DNA, 23 bp, Artificial sequence
  SiRNA target sequence
ccatattactgtctacaattata

SEQ ID NO: 56603 - DNA, 23 bp, Artificial sequence
  SiRNA target sequence
catattactgtctacaattatag

SEQ ID NO: 56604 - DNA, 23 bp, Artificial sequence
  SiRNA target sequence
atattactgtctacaattatagc

SEQ ID NO: 56605 - DNA, 23 bp, Artificial sequence
  SiRNA target sequence
tattactgtctacaattatagct

SEQ ID NO: 56606 - DNA, 23 bp, Artificial sequence
  SiRNA target sequence
attactgtctacaattatagctt

SEQ ID NO: 56607 - DNA, 23 bp, Artificial sequence
  SiRNA target sequence
ttactgtctacaattatagcttg

SEQ ID NO: 56608 - DNA, 23 bp, Artificial sequence
  SiRNA target sequence
tactgtctacaattatagcttgt

SEQ ID NO: 56609 - DNA, 23 bp, Artificial sequence
  SiRNA target sequence
actgtctacaattatagcttgtt

SEQ ID NO: 56610 - DNA, 23 bp, Artificial sequence
  SiRNA target sequence
ctgtctacaattatagcttgtta

SEQ ID NO: 56611 - DNA, 23 bp, Artificial sequence
  SiRNA target sequence
tgtctacaattatagcttgttat

SEQ ID NO: 56612 - DNA, 23 bp, Artificial sequence
  SiRNA target sequence
gtctacaattatagcttgttatc

SEQ ID NO: 56613 - DNA, 23 bp, Artificial sequence
  SiRNA target sequence
tctacaattatagcttgttatct

SEQ ID NO: 56614 - DNA, 23 bp, Artificial sequence
  SiRNA target sequence
ctacaattatagcttgttatctc

SEQ ID NO: 56615 - DNA, 23 bp, Artificial sequence
  SiRNA target sequence
tacaattatagcttgttatctcg

SEQ ID NO: 56616 - DNA, 23 bp, Artificial sequence
  SiRNA target sequence
acaattatagcttgttatctcga

SEQ ID NO: 56617 - DNA, 23 bp, Artificial sequence
  SiRNA target sequence
caattatagcttgttatctcgaa

SEQ ID NO: 56618 - DNA, 23 bp, Artificial sequence
  SiRNA target sequence
aattatagcttgttatctcgaag

SEQ ID NO: 56619 - DNA, 23 bp, Artificial sequence
  SiRNA target sequence
attatagcttgttatctcgaagt

SEQ ID NO: 56620 - DNA, 23 bp, Artificial sequence
  SiRNA target sequence
ttatagcttgttatctcgaagtt

SEQ ID NO: 56621 - DNA, 23 bp, Artificial sequence
  SiRNA target sequence
tatagcttgttatctcgaagttc

SEQ ID NO: 56622 - DNA, 23 bp, Artificial sequence
  SiRNA target sequence
atagcttgttatctcgaagttca

SEQ ID NO: 56623 - DNA, 23 bp, Artificial sequence
  SiRNA target sequence
tagcttgttatctcgaagttcag

SEQ ID NO: 56624 - DNA, 23 bp, Artificial sequence
  SiRNA target sequence
agcttgttatctcgaagttcagg

SEQ ID NO: 56625 - DNA, 23 bp, Artificial sequence
  SiRNA target sequence
gcttgttatctcgaagttcaggc

SEQ ID NO: 56626 - DNA, 23 bp, Artificial sequence
  SiRNA target sequence
cttgttatctcgaagttcaggca

SEQ ID NO: 56627 - DNA, 23 bp, Artificial sequence
  SiRNA target sequence
ttgttatctcgaagttcaggcaa

SEQ ID NO: 56628 - DNA, 23 bp, Artificial sequence
  SiRNA target sequence
tgttatctcgaagttcaggcaag

SEQ ID NO: 56629 - DNA, 23 bp, Artificial sequence
  SiRNA target sequence
gttatctcgaagttcaggcaagt

SEQ ID NO: 56630 - DNA, 23 bp, Artificial sequence
  SiRNA target sequence
ttatctcgaagttcaggcaagta

SEQ ID NO: 56631 - DNA, 23 bp, Artificial sequence
  SiRNA target sequence
tatctcgaagttcaggcaagtaa

SEQ ID NO: 56632 - DNA, 23 bp, Artificial sequence
  SiRNA target sequence
atctcgaagttcaggcaagtaac

SEQ ID NO: 56633 - DNA, 23 bp, Artificial sequence
  SiRNA target sequence
tctcgaagttcaggcaagtaaca

SEQ ID NO: 56634 - DNA, 23 bp, Artificial sequence
  SiRNA target sequence
ctcgaagttcaggcaagtaacat

SEQ ID NO: 56635 - DNA, 23 bp, Artificial sequence
  SiRNA target sequence
tcgaagttcaggcaagtaacata

SEQ ID NO: 56636 - DNA, 23 bp, Artificial sequence
  SiRNA target sequence
cgaagttcaggcaagtaacatat

SEQ ID NO: 56637 - DNA, 23 bp, Artificial sequence
  SiRNA target sequence
gaagttcaggcaagtaacatatc

SEQ ID NO: 56638 - DNA, 23 bp, Artificial sequence
  SiRNA target sequence
aagttcaggcaagtaacatatca

SEQ ID NO: 56639 - DNA, 23 bp, Artificial sequence
  SiRNA target sequence
agttcaggcaagtaacatatcaa

SEQ ID NO: 56640 - DNA, 23 bp, Artificial sequence
  SiRNA target sequence
gttcaggcaagtaacatatcaaa

SEQ ID NO: 56641 - DNA, 23 bp, Artificial sequence
  SiRNA target sequence
ttcaggcaagtaacatatcaaaa

SEQ ID NO: 56642 - DNA, 23 bp, Artificial sequence
  SiRNA target sequence
tcaggcaagtaacatatcaaaaa

SEQ ID NO: 56643 - DNA, 23 bp, Artificial sequence
  SiRNA target sequence
caggcaagtaacatatcaaaaag

SEQ ID NO: 56644 - DNA, 23 bp, Artificial sequence
  SiRNA target sequence
aggcaagtaacatatcaaaaaga

SEQ ID NO: 56645 - DNA, 23 bp, Artificial sequence
  SiRNA target sequence
ggcaagtaacatatcaaaaagaa

SEQ ID NO: 56646 - DNA, 23 bp, Artificial sequence
  SiRNA target sequence
gcaagtaacatatcaaaaagaat

SEQ ID NO: 56647 - DNA, 23 bp, Artificial sequence
  SiRNA target sequence
caagtaacatatcaaaaagaatt

SEQ ID NO: 56648 - DNA, 23 bp, Artificial sequence
  SiRNA target sequence
aagtaacatatcaaaaagaattg

SEQ ID NO: 56649 - DNA, 23 bp, Artificial sequence
  SiRNA target sequence
agtaacatatcaaaaagaattgc

SEQ ID NO: 56650 - DNA, 23 bp, Artificial sequence
  SiRNA target sequence
gtaacatatcaaaaagaattgca

SEQ ID NO: 56651 - DNA, 23 bp, Artificial sequence
  SiRNA target sequence
taacatatcaaaaagaattgcag

SEQ ID NO: 56652 - DNA, 23 bp, Artificial sequence
  SiRNA target sequence
aacatatcaaaaagaattgcaga

SEQ ID NO: 56653 - DNA, 23 bp, Artificial sequence
  SiRNA target sequence
acatatcaaaaagaattgcagaa

SEQ ID NO: 56654 - DNA, 23 bp, Artificial sequence
  SiRNA target sequence
catatcaaaaagaattgcagaag

SEQ ID NO: 56655 - DNA, 23 bp, Artificial sequence
  SiRNA target sequence
atatcaaaaagaattgcagaaga

SEQ ID NO: 56656 - DNA, 23 bp, Artificial sequence
  SiRNA target sequence
tatcaaaaagaattgcagaagat

SEQ ID NO: 56657 - DNA, 23 bp, Artificial sequence
  SiRNA target sequence
atcaaaaagaattgcagaagatt

SEQ ID NO: 56658 - DNA, 23 bp, Artificial sequence
  SiRNA target sequence
tcaaaaagaattgcagaagattt

SEQ ID NO: 56659 - DNA, 23 bp, Artificial sequence
  SiRNA target sequence
caaaaagaattgcagaagatttt

SEQ ID NO: 56660 - DNA, 23 bp, Artificial sequence
  SiRNA target sequence
aaaaagaattgcagaagattttg

SEQ ID NO: 56661 - DNA, 23 bp, Artificial sequence
  SiRNA target sequence
aaaagaattgcagaagattttga

SEQ ID NO: 56662 - DNA, 23 bp, Artificial sequence
  SiRNA target sequence
aaagaattgcagaagattttgaa

SEQ ID NO: 56663 - DNA, 23 bp, Artificial sequence
  SiRNA target sequence
aagaattgcagaagattttgaaa

SEQ ID NO: 56664 - DNA, 23 bp, Artificial sequence
  SiRNA target sequence
agaattgcagaagattttgaaaa

SEQ ID NO: 56665 - DNA, 23 bp, Artificial sequence
  SiRNA target sequence
gaattgcagaagattttgaaaat

SEQ ID NO: 56666 - DNA, 23 bp, Artificial sequence
  SiRNA target sequence
aattgcagaagattttgaaaata

SEQ ID NO: 56667 - DNA, 23 bp, Artificial sequence
  SiRNA target sequence
attgcagaagattttgaaaataa

SEQ ID NO: 56668 - DNA, 23 bp, Artificial sequence
  SiRNA target sequence
ttgcagaagattttgaaaataaa

SEQ ID NO: 56669 - DNA, 23 bp, Artificial sequence
  SiRNA target sequence
tgcagaagattttgaaaataaaa

SEQ ID NO: 56670 - DNA, 23 bp, Artificial sequence
  SiRNA target sequence
gcagaagattttgaaaataaaat

SEQ ID NO: 56671 - DNA, 23 bp, Artificial sequence
  SiRNA target sequence
cagaagattttgaaaataaaata

SEQ ID NO: 56672 - DNA, 23 bp, Artificial sequence
  SiRNA target sequence
agaagattttgaaaataaaataa

SEQ ID NO: 56673 - DNA, 23 bp, Artificial sequence
  SiRNA target sequence
gaagattttgaaaataaaataaa

SEQ ID NO: 56674 - DNA, 23 bp, Artificial sequence
  SiRNA target sequence
aagattttgaaaataaaataaat

SEQ ID NO: 56675 - DNA, 23 bp, Artificial sequence
  SiRNA target sequence
agattttgaaaataaaataaatg

SEQ ID NO: 56676 - DNA, 23 bp, Artificial sequence
  SiRNA target sequence
gattttgaaaataaaataaatgc

SEQ ID NO: 56677 - DNA, 23 bp, Artificial sequence
  SiRNA target sequence
attttgaaaataaaataaatgca

SEQ ID NO: 56678 - DNA, 23 bp, Artificial sequence
  SiRNA target sequence
ttttgaaaataaaataaatgcag

SEQ ID NO: 56679 - DNA, 23 bp, Artificial sequence
  SiRNA target sequence
tttgaaaataaaataaatgcagg

SEQ ID NO: 56680 - DNA, 23 bp, Artificial sequence
  SiRNA target sequence
ttgaaaataaaataaatgcagga

SEQ ID NO: 56681 - DNA, 23 bp, Artificial sequence
  SiRNA target sequence
tgaaaataaaataaatgcaggaa

SEQ ID NO: 56682 - DNA, 23 bp, Artificial sequence
  SiRNA target sequence
gaaaataaaataaatgcaggaaa

SEQ ID NO: 56683 - DNA, 23 bp, Artificial sequence
  SiRNA target sequence
aaaataaaataaatgcaggaaaa

SEQ ID NO: 56684 - DNA, 23 bp, Artificial sequence
  SiRNA target sequence
aaataaaataaatgcaggaaaaa

SEQ ID NO: 56685 - DNA, 23 bp, Artificial sequence
  SiRNA target sequence
aataaaataaatgcaggaaaaag

SEQ ID NO: 56686 - DNA, 23 bp, Artificial sequence
  SiRNA target sequence
ataaaataaatgcaggaaaaagt

SEQ ID NO: 56687 - DNA, 23 bp, Artificial sequence
  SiRNA target sequence
taaaataaatgcaggaaaaagta

SEQ ID NO: 56688 - DNA, 23 bp, Artificial sequence
  SiRNA target sequence
aaaataaatgcaggaaaaagtat

SEQ ID NO: 56689 - DNA, 23 bp, Artificial sequence
  SiRNA target sequence
aaataaatgcaggaaaaagtata

SEQ ID NO: 56690 - DNA, 23 bp, Artificial sequence
  SiRNA target sequence
aataaatgcaggaaaaagtatat

SEQ ID NO: 56691 - DNA, 23 bp, Artificial sequence
  SiRNA target sequence
ataaatgcaggaaaaagtatatt

SEQ ID NO: 56692 - DNA, 23 bp, Artificial sequence
  SiRNA target sequence
taaatgcaggaaaaagtatattt

SEQ ID NO: 56693 - DNA, 23 bp, Artificial sequence
  SiRNA target sequence
aaatgcaggaaaaagtatattta

SEQ ID NO: 56694 - DNA, 23 bp, Artificial sequence
  SiRNA target sequence
aatgcaggaaaaagtatatttaa

SEQ ID NO: 56695 - DNA, 23 bp, Artificial sequence
  SiRNA target sequence
atgcaggaaaaagtatatttaaa

SEQ ID NO: 56696 - DNA, 23 bp, Artificial sequence
  SiRNA target sequence
tgcaggaaaaagtatatttaaat

SEQ ID NO: 56697 - DNA, 23 bp, Artificial sequence
  SiRNA target sequence
gcaggaaaaagtatatttaaata

SEQ ID NO: 56698 - DNA, 23 bp, Artificial sequence
  SiRNA target sequence
caggaaaaagtatatttaaatat

SEQ ID NO: 56699 - DNA, 23 bp, Artificial sequence
  SiRNA target sequence
aggaaaaagtatatttaaatata

SEQ ID NO: 56700 - DNA, 23 bp, Artificial sequence
  SiRNA target sequence
ggaaaaagtatatttaaatatat

SEQ ID NO: 56701 - DNA, 23 bp, Artificial sequence
  SiRNA target sequence
gaaaaagtatatttaaatatatt

SEQ ID NO: 56702 - DNA, 23 bp, Artificial sequence
  SiRNA target sequence
aaaaagtatatttaaatatattt

SEQ ID NO: 56703 - DNA, 23 bp, Artificial sequence
  SiRNA target sequence
aaaagtatatttaaatatatttt

SEQ ID NO: 56704 - DNA, 23 bp, Artificial sequence
  SiRNA target sequence
aaagtatatttaaatatatttta

SEQ ID NO: 56705 - DNA, 23 bp, Artificial sequence
  SiRNA target sequence
aagtatatttaaatatattttat

SEQ ID NO: 56706 - DNA, 23 bp, Artificial sequence
  SiRNA target sequence
agtatatttaaatatattttatt

SEQ ID NO: 56707 - DNA, 23 bp, Artificial sequence
  SiRNA target sequence
gtatatttaaatatattttattt

SEQ ID NO: 56708 - DNA, 23 bp, Artificial sequence
  SiRNA target sequence
tatatttaaatatattttatttt

SEQ ID NO: 56709 - DNA, 23 bp, Artificial sequence
  SiRNA target sequence
atatttaaatatattttattttt

SEQ ID NO: 56710 - DNA, 23 bp, Artificial sequence
  SiRNA target sequence
tatttaaatatattttattttta

SEQ ID NO: 56711 - DNA, 23 bp, Artificial sequence
  SiRNA target sequence
atttaaatatattttatttttaa

SEQ ID NO: 56712 - DNA, 23 bp, Artificial sequence
  SiRNA target sequence
tttaaatatattttatttttaac

SEQ ID NO: 56713 - DNA, 23 bp, Artificial sequence
  SiRNA target sequence
ttaaatatattttatttttaact

SEQ ID NO: 56714 - DNA, 23 bp, Artificial sequence
  SiRNA target sequence
taaatatattttatttttaactt

SEQ ID NO: 56715 - DNA, 23 bp, Artificial sequence
  SiRNA target sequence
aaatatattttatttttaacttc

SEQ ID NO: 56716 - DNA, 23 bp, Artificial sequence
  SiRNA target sequence
aatatattttatttttaacttca

SEQ ID NO: 56717 - DNA, 23 bp, Artificial sequence
  SiRNA target sequence
atatattttatttttaacttcat

SEQ ID NO: 56718 - DNA, 23 bp, Artificial sequence
  SiRNA target sequence
tatattttatttttaacttcatc

SEQ ID NO: 56719 - DNA, 23 bp, Artificial sequence
  SiRNA target sequence
atattttatttttaacttcatca

SEQ ID NO: 56720 - DNA, 23 bp, Artificial sequence
  SiRNA target sequence
tattttatttttaacttcatcaa

SEQ ID NO: 56721 - DNA, 23 bp, Artificial sequence
  SiRNA target sequence
attttatttttaacttcatcaat

SEQ ID NO: 56722 - DNA, 23 bp, Artificial sequence
  SiRNA target sequence
ttttatttttaacttcatcaata

SEQ ID NO: 56723 - DNA, 23 bp, Artificial sequence
  SiRNA target sequence
tttatttttaacttcatcaatag

SEQ ID NO: 56724 - DNA, 23 bp, Artificial sequence
  SiRNA target sequence
ttatttttaacttcatcaatagt

SEQ ID NO: 56725 - DNA, 23 bp, Artificial sequence
  SiRNA target sequence
tatttttaacttcatcaatagta

SEQ ID NO: 56726 - DNA, 23 bp, Artificial sequence
  SiRNA target sequence
atttttaacttcatcaatagtat

SEQ ID NO: 56727 - DNA, 23 bp, Artificial sequence
  SiRNA target sequence
tttttaacttcatcaatagtatt

SEQ ID NO: 56728 - DNA, 23 bp, Artificial sequence
  SiRNA target sequence
ttttaacttcatcaatagtatta

SEQ ID NO: 56729 - DNA, 23 bp, Artificial sequence
  SiRNA target sequence
tttaacttcatcaatagtattaa

SEQ ID NO: 56730 - DNA, 23 bp, Artificial sequence
  SiRNA target sequence
ttaacttcatcaatagtattaag

SEQ ID NO: 56731 - DNA, 23 bp, Artificial sequence
  SiRNA target sequence
taacttcatcaatagtattaaga

SEQ ID NO: 56732 - DNA, 23 bp, Artificial sequence
  SiRNA target sequence
aacttcatcaatagtattaagac

SEQ ID NO: 56733 - DNA, 23 bp, Artificial sequence
  SiRNA target sequence
acttcatcaatagtattaagaca

SEQ ID NO: 56734 - DNA, 23 bp, Artificial sequence
  SiRNA target sequence
cttcatcaatagtattaagacaa

SEQ ID NO: 56735 - DNA, 23 bp, Artificial sequence
  SiRNA target sequence
ttcatcaatagtattaagacaaa

SEQ ID NO: 56736 - DNA, 23 bp, Artificial sequence
  SiRNA target sequence
tcatcaatagtattaagacaaat

SEQ ID NO: 56737 - DNA, 23 bp, Artificial sequence
  SiRNA target sequence
catcaatagtattaagacaaatt

SEQ ID NO: 56738 - DNA, 23 bp, Artificial sequence
  SiRNA target sequence
atcaatagtattaagacaaatta

SEQ ID NO: 56739 - DNA, 23 bp, Artificial sequence
  SiRNA target sequence
tcaatagtattaagacaaattaa

SEQ ID NO: 56740 - DNA, 23 bp, Artificial sequence
  SiRNA target sequence
caatagtattaagacaaattaat

SEQ ID NO: 56741 - DNA, 23 bp, Artificial sequence
  SiRNA target sequence
aatagtattaagacaaattaatg

SEQ ID NO: 56742 - DNA, 23 bp, Artificial sequence
  SiRNA target sequence
atagtattaagacaaattaatga

SEQ ID NO: 56743 - DNA, 23 bp, Artificial sequence
  SiRNA target sequence
tagtattaagacaaattaatgat

SEQ ID NO: 56744 - DNA, 23 bp, Artificial sequence
  SiRNA target sequence
agtattaagacaaattaatgata

SEQ ID NO: 56745 - DNA, 23 bp, Artificial sequence
  SiRNA target sequence
gtattaagacaaattaatgatat

SEQ ID NO: 56746 - DNA, 23 bp, Artificial sequence
  SiRNA target sequence
tattaagacaaattaatgatatt

SEQ ID NO: 56747 - DNA, 23 bp, Artificial sequence
  SiRNA target sequence
attaagacaaattaatgatattg

SEQ ID NO: 56748 - DNA, 23 bp, Artificial sequence
  SiRNA target sequence
ttaagacaaattaatgatattgt

SEQ ID NO: 56749 - DNA, 23 bp, Artificial sequence
  SiRNA target sequence
taagacaaattaatgatattgtg

SEQ ID NO: 56750 - DNA, 23 bp, Artificial sequence
  SiRNA target sequence
aagacaaattaatgatattgtgt

SEQ ID NO: 56751 - DNA, 23 bp, Artificial sequence
  SiRNA target sequence
agacaaattaatgatattgtgtt

SEQ ID NO: 56752 - DNA, 23 bp, Artificial sequence
  SiRNA target sequence
gacaaattaatgatattgtgttt

SEQ ID NO: 56753 - DNA, 23 bp, Artificial sequence
  SiRNA target sequence
acaaattaatgatattgtgttta

SEQ ID NO: 56754 - DNA, 23 bp, Artificial sequence
  SiRNA target sequence
caaattaatgatattgtgtttag

SEQ ID NO: 56755 - DNA, 23 bp, Artificial sequence
  SiRNA target sequence
aaattaatgatattgtgtttagc

SEQ ID NO: 56756 - DNA, 23 bp, Artificial sequence
  SiRNA target sequence
aattaatgatattgtgtttagcg

SEQ ID NO: 56757 - DNA, 23 bp, Artificial sequence
  SiRNA target sequence
attaatgatattgtgtttagcgg

SEQ ID NO: 56758 - DNA, 23 bp, Artificial sequence
  SiRNA target sequence
ttaatgatattgtgtttagcggg

SEQ ID NO: 56759 - DNA, 23 bp, Artificial sequence
  SiRNA target sequence
taatgatattgtgtttagcgggc

SEQ ID NO: 56760 - DNA, 23 bp, Artificial sequence
  SiRNA target sequence
aatgatattgtgtttagcgggcc

SEQ ID NO: 56761 - DNA, 23 bp, Artificial sequence
  SiRNA target sequence
atgatattgtgtttagcgggcca

SEQ ID NO: 56762 - DNA, 23 bp, Artificial sequence
  SiRNA target sequence
tgatattgtgtttagcgggccaa

SEQ ID NO: 56763 - DNA, 23 bp, Artificial sequence
  SiRNA target sequence
gatattgtgtttagcgggccaat

SEQ ID NO: 56764 - DNA, 23 bp, Artificial sequence
  SiRNA target sequence
atattgtgtttagcgggccaata

SEQ ID NO: 56765 - DNA, 23 bp, Artificial sequence
  SiRNA target sequence
tattgtgtttagcgggccaatac

SEQ ID NO: 56766 - DNA, 23 bp, Artificial sequence
  SiRNA target sequence
attgtgtttagcgggccaataca

SEQ ID NO: 56767 - DNA, 23 bp, Artificial sequence
  SiRNA target sequence
ttgtgtttagcgggccaatacaa

SEQ ID NO: 56768 - DNA, 23 bp, Artificial sequence
  SiRNA target sequence
tgtgtttagcgggccaatacaat

SEQ ID NO: 56769 - DNA, 23 bp, Artificial sequence
  SiRNA target sequence
gtgtttagcgggccaatacaatt

SEQ ID NO: 56770 - DNA, 23 bp, Artificial sequence
  SiRNA target sequence
tgtttagcgggccaatacaattt

SEQ ID NO: 56771 - DNA, 23 bp, Artificial sequence
  SiRNA target sequence
gtttagcgggccaatacaatttt

SEQ ID NO: 56772 - DNA, 23 bp, Artificial sequence
  SiRNA target sequence
tttagcgggccaatacaattttt

SEQ ID NO: 56773 - DNA, 23 bp, Artificial sequence
  SiRNA target sequence
ttagcgggccaatacaattttta

SEQ ID NO: 56774 - DNA, 23 bp, Artificial sequence
  SiRNA target sequence
tagcgggccaatacaatttttat

SEQ ID NO: 56775 - DNA, 23 bp, Artificial sequence
  SiRNA target sequence
agcgggccaatacaatttttata

SEQ ID NO: 56776 - DNA, 23 bp, Artificial sequence
  SiRNA target sequence
gcgggccaatacaatttttatat

SEQ ID NO: 56777 - DNA, 23 bp, Artificial sequence
  SiRNA target sequence
cgggccaatacaatttttatata

SEQ ID NO: 56778 - DNA, 23 bp, Artificial sequence
  SiRNA target sequence
gggccaatacaatttttatataa

SEQ ID NO: 56779 - DNA, 23 bp, Artificial sequence
  SiRNA target sequence
ggccaatacaatttttatataaa

SEQ ID NO: 56780 - DNA, 23 bp, Artificial sequence
  SiRNA target sequence
gccaatacaatttttatataaaa

SEQ ID NO: 56781 - DNA, 23 bp, Artificial sequence
  SiRNA target sequence
ccaatacaatttttatataaaat

SEQ ID NO: 56782 - DNA, 23 bp, Artificial sequence
  SiRNA target sequence
caatacaatttttatataaaatt

SEQ ID NO: 56783 - DNA, 23 bp, Artificial sequence
  SiRNA target sequence
aatacaatttttatataaaattg

SEQ ID NO: 56784 - DNA, 23 bp, Artificial sequence
  SiRNA target sequence
atacaatttttatataaaattgt

SEQ ID NO: 56785 - DNA, 23 bp, Artificial sequence
  SiRNA target sequence
tacaatttttatataaaattgtt

SEQ ID NO: 56786 - DNA, 23 bp, Artificial sequence
  SiRNA target sequence
acaatttttatataaaattgttg

SEQ ID NO: 56787 - DNA, 23 bp, Artificial sequence
  SiRNA target sequence
caatttttatataaaattgttgg

SEQ ID NO: 56788 - DNA, 23 bp, Artificial sequence
  SiRNA target sequence
aatttttatataaaattgttgga

SEQ ID NO: 56789 - DNA, 23 bp, Artificial sequence
  SiRNA target sequence
atttttatataaaattgttggag

SEQ ID NO: 56790 - DNA, 23 bp, Artificial sequence
  SiRNA target sequence
tttttatataaaattgttggagt

SEQ ID NO: 56791 - DNA, 23 bp, Artificial sequence
  SiRNA target sequence
ttttatataaaattgttggagtt

SEQ ID NO: 56792 - DNA, 23 bp, Artificial sequence
  SiRNA target sequence
tttatataaaattgttggagttg

SEQ ID NO: 56793 - DNA, 23 bp, Artificial sequence
  SiRNA target sequence
ttatataaaattgttggagttga

SEQ ID NO: 56794 - DNA, 23 bp, Artificial sequence
  SiRNA target sequence
tatataaaattgttggagttgaa

SEQ ID NO: 56795 - DNA, 23 bp, Artificial sequence
  SiRNA target sequence
atataaaattgttggagttgaag

SEQ ID NO: 56796 - DNA, 23 bp, Artificial sequence
  SiRNA target sequence
tataaaattgttggagttgaagc

SEQ ID NO: 56797 - DNA, 23 bp, Artificial sequence
  SiRNA target sequence
ataaaattgttggagttgaagca

SEQ ID NO: 56798 - DNA, 23 bp, Artificial sequence
  SiRNA target sequence
taaaattgttggagttgaagcat

SEQ ID NO: 56799 - DNA, 23 bp, Artificial sequence
  SiRNA target sequence
aaaattgttggagttgaagcatt

SEQ ID NO: 56800 - DNA, 23 bp, Artificial sequence
  SiRNA target sequence
aaattgttggagttgaagcattt

SEQ ID NO: 56801 - DNA, 23 bp, Artificial sequence
  SiRNA target sequence
aattgttggagttgaagcatttt

SEQ ID NO: 56802 - DNA, 23 bp, Artificial sequence
  SiRNA target sequence
attgttggagttgaagcatttta

SEQ ID NO: 56803 - DNA, 23 bp, Artificial sequence
  SiRNA target sequence
ttgttggagttgaagcattttat

SEQ ID NO: 56804 - DNA, 23 bp, Artificial sequence
  SiRNA target sequence
tgttggagttgaagcattttatc

SEQ ID NO: 56805 - DNA, 23 bp, Artificial sequence
  SiRNA target sequence
gttggagttgaagcattttatca

SEQ ID NO: 56806 - DNA, 23 bp, Artificial sequence
  SiRNA target sequence
ttggagttgaagcattttatcat

SEQ ID NO: 56807 - DNA, 23 bp, Artificial sequence
  SiRNA target sequence
tggagttgaagcattttatcatt

SEQ ID NO: 56808 - DNA, 23 bp, Artificial sequence
  SiRNA target sequence
ggagttgaagcattttatcatta

SEQ ID NO: 56809 - DNA, 23 bp, Artificial sequence
  SiRNA target sequence
gagttgaagcattttatcattac

SEQ ID NO: 56810 - DNA, 23 bp, Artificial sequence
  SiRNA target sequence
agttgaagcattttatcattaca

SEQ ID NO: 56811 - DNA, 23 bp, Artificial sequence
  SiRNA target sequence
gttgaagcattttatcattacat

SEQ ID NO: 56812 - DNA, 23 bp, Artificial sequence
  SiRNA target sequence
ttgaagcattttatcattacatt

SEQ ID NO: 56813 - DNA, 23 bp, Artificial sequence
  SiRNA target sequence
tgaagcattttatcattacattt

SEQ ID NO: 56814 - DNA, 23 bp, Artificial sequence
  SiRNA target sequence
gaagcattttatcattacatttc

SEQ ID NO: 56815 - DNA, 23 bp, Artificial sequence
  SiRNA target sequence
aagcattttatcattacatttca

SEQ ID NO: 56816 - DNA, 23 bp, Artificial sequence
  SiRNA target sequence
agcattttatcattacatttcat

SEQ ID NO: 56817 - DNA, 23 bp, Artificial sequence
  SiRNA target sequence
gcattttatcattacatttcatt

SEQ ID NO: 56818 - DNA, 23 bp, Artificial sequence
  SiRNA target sequence
cattttatcattacatttcatta

SEQ ID NO: 56819 - DNA, 23 bp, Artificial sequence
  SiRNA target sequence
attttatcattacatttcattaa

SEQ ID NO: 56820 - DNA, 23 bp, Artificial sequence
  SiRNA target sequence
ttttatcattacatttcattaaa

SEQ ID NO: 56821 - DNA, 23 bp, Artificial sequence
  SiRNA target sequence
tttatcattacatttcattaaac

SEQ ID NO: 56822 - DNA, 23 bp, Artificial sequence
  SiRNA target sequence
ttatcattacatttcattaaact

SEQ ID NO: 56823 - DNA, 23 bp, Artificial sequence
  SiRNA target sequence
tatcattacatttcattaaactt

SEQ ID NO: 56824 - DNA, 23 bp, Artificial sequence
  SiRNA target sequence
atcattacatttcattaaactta

SEQ ID NO: 56825 - DNA, 23 bp, Artificial sequence
  SiRNA target sequence
tcattacatttcattaaacttag

SEQ ID NO: 56826 - DNA, 23 bp, Artificial sequence
  SiRNA target sequence
cattacatttcattaaacttaga

SEQ ID NO: 56827 - DNA, 23 bp, Artificial sequence
  SiRNA target sequence
attacatttcattaaacttagaa

SEQ ID NO: 56828 - DNA, 23 bp, Artificial sequence
  SiRNA target sequence
ttacatttcattaaacttagaaa

SEQ ID NO: 56829 - DNA, 23 bp, Artificial sequence
  SiRNA target sequence
tacatttcattaaacttagaaaa

SEQ ID NO: 56830 - DNA, 23 bp, Artificial sequence
  SiRNA target sequence
acatttcattaaacttagaaaat

SEQ ID NO: 56831 - DNA, 23 bp, Artificial sequence
  SiRNA target sequence
catttcattaaacttagaaaatt

SEQ ID NO: 56832 - DNA, 23 bp, Artificial sequence
  SiRNA target sequence
atttcattaaacttagaaaattt

SEQ ID NO: 56833 - DNA, 23 bp, Artificial sequence
  SiRNA target sequence
tttcattaaacttagaaaatttt

SEQ ID NO: 56834 - DNA, 23 bp, Artificial sequence
  SiRNA target sequence
ttcattaaacttagaaaatttta

SEQ ID NO: 56835 - DNA, 23 bp, Artificial sequence
  SiRNA target sequence
tcattaaacttagaaaattttaa

SEQ ID NO: 56836 - DNA, 23 bp, Artificial sequence
  SiRNA target sequence
cattaaacttagaaaattttaac

SEQ ID NO: 56837 - DNA, 23 bp, Artificial sequence
  SiRNA target sequence
attaaacttagaaaattttaaca

SEQ ID NO: 56838 - DNA, 23 bp, Artificial sequence
  SiRNA target sequence
ttaaacttagaaaattttaacaa

SEQ ID NO: 56839 - DNA, 23 bp, Artificial sequence
  SiRNA target sequence
taaacttagaaaattttaacaaa

SEQ ID NO: 56840 - DNA, 23 bp, Artificial sequence
  SiRNA target sequence
aaacttagaaaattttaacaaaa

SEQ ID NO: 56841 - DNA, 23 bp, Artificial sequence
  SiRNA target sequence
aacttagaaaattttaacaaaat

SEQ ID NO: 56842 - DNA, 23 bp, Artificial sequence
  SiRNA target sequence
acttagaaaattttaacaaaata

SEQ ID NO: 56843 - DNA, 23 bp, Artificial sequence
  SiRNA target sequence
cttagaaaattttaacaaaatag

SEQ ID NO: 56844 - DNA, 23 bp, Artificial sequence
  SiRNA target sequence
ttagaaaattttaacaaaatagg

SEQ ID NO: 56845 - DNA, 23 bp, Artificial sequence
  SiRNA target sequence
tagaaaattttaacaaaatagga

SEQ ID NO: 56846 - DNA, 23 bp, Artificial sequence
  SiRNA target sequence
agaaaattttaacaaaataggaa

SEQ ID NO: 56847 - DNA, 23 bp, Artificial sequence
  SiRNA target sequence
gaaaattttaacaaaataggaag

SEQ ID NO: 56848 - DNA, 23 bp, Artificial sequence
  SiRNA target sequence
aaaattttaacaaaataggaagt

SEQ ID NO: 56849 - DNA, 23 bp, Artificial sequence
  SiRNA target sequence
aaattttaacaaaataggaagtg

SEQ ID NO: 56850 - DNA, 23 bp, Artificial sequence
  SiRNA target sequence
aattttaacaaaataggaagtgg

SEQ ID NO: 56851 - DNA, 23 bp, Artificial sequence
  SiRNA target sequence
attttaacaaaataggaagtgga

SEQ ID NO: 56852 - DNA, 23 bp, Artificial sequence
  SiRNA target sequence
ttttaacaaaataggaagtggag

SEQ ID NO: 56853 - DNA, 23 bp, Artificial sequence
  SiRNA target sequence
tttaacaaaataggaagtggaga

SEQ ID NO: 56854 - DNA, 23 bp, Artificial sequence
  SiRNA target sequence
ttaacaaaataggaagtggagag

SEQ ID NO: 56855 - DNA, 23 bp, Artificial sequence
  SiRNA target sequence
taacaaaataggaagtggagaga

SEQ ID NO: 56856 - DNA, 23 bp, Artificial sequence
  SiRNA target sequence
aacaaaataggaagtggagagat

SEQ ID NO: 56857 - DNA, 23 bp, Artificial sequence
  SiRNA target sequence
acaaaataggaagtggagagata

SEQ ID NO: 56858 - DNA, 23 bp, Artificial sequence
  SiRNA target sequence
caaaataggaagtggagagatac

SEQ ID NO: 56859 - DNA, 23 bp, Artificial sequence
  SiRNA target sequence
aaaataggaagtggagagataca

SEQ ID NO: 56860 - DNA, 23 bp, Artificial sequence
  SiRNA target sequence
aaataggaagtggagagatacaa

SEQ ID NO: 56861 - DNA, 23 bp, Artificial sequence
  SiRNA target sequence
aataggaagtggagagatacaaa

SEQ ID NO: 56862 - DNA, 23 bp, Artificial sequence
  SiRNA target sequence
ataggaagtggagagatacaaat

SEQ ID NO: 56863 - DNA, 23 bp, Artificial sequence
  SiRNA target sequence
taggaagtggagagatacaaatg

SEQ ID NO: 56864 - DNA, 23 bp, Artificial sequence
  SiRNA target sequence
aggaagtggagagatacaaatga

SEQ ID NO: 56865 - DNA, 23 bp, Artificial sequence
  SiRNA target sequence
ggaagtggagagatacaaatgat

SEQ ID NO: 56866 - DNA, 23 bp, Artificial sequence
  SiRNA target sequence
gaagtggagagatacaaatgatt

SEQ ID NO: 56867 - DNA, 23 bp, Artificial sequence
  SiRNA target sequence
aagtggagagatacaaatgatta

SEQ ID NO: 56868 - DNA, 23 bp, Artificial sequence
  SiRNA target sequence
agtggagagatacaaatgattat

SEQ ID NO: 56869 - DNA, 23 bp, Artificial sequence
  SiRNA target sequence
gtggagagatacaaatgattatt

SEQ ID NO: 56870 - DNA, 23 bp, Artificial sequence
  SiRNA target sequence
tggagagatacaaatgattattg

SEQ ID NO: 56871 - DNA, 23 bp, Artificial sequence
  SiRNA target sequence
ggagagatacaaatgattattga

SEQ ID NO: 56872 - DNA, 23 bp, Artificial sequence
  SiRNA target sequence
gagagatacaaatgattattgag

SEQ ID NO: 56873 - DNA, 23 bp, Artificial sequence
  SiRNA target sequence
agagatacaaatgattattgagc

SEQ ID NO: 56874 - DNA, 23 bp, Artificial sequence
  SiRNA target sequence
gagatacaaatgattattgagcg

SEQ ID NO: 56875 - DNA, 23 bp, Artificial sequence
  SiRNA target sequence
agatacaaatgattattgagcgg

SEQ ID NO: 56876 - DNA, 23 bp, Artificial sequence
  SiRNA target sequence
gatacaaatgattattgagcgga

SEQ ID NO: 56877 - DNA, 23 bp, Artificial sequence
  SiRNA target sequence
atacaaatgattattgagcggaa

SEQ ID NO: 56878 - DNA, 23 bp, Artificial sequence
  SiRNA target sequence
tacaaatgattattgagcggaaa

SEQ ID NO: 56879 - DNA, 23 bp, Artificial sequence
  SiRNA target sequence
acaaatgattattgagcggaaaa

SEQ ID NO: 56880 - DNA, 23 bp, Artificial sequence
  SiRNA target sequence
caaatgattattgagcggaaaag

SEQ ID NO: 56881 - DNA, 23 bp, Artificial sequence
  SiRNA target sequence
aaatgattattgagcggaaaagt

SEQ ID NO: 56882 - DNA, 23 bp, Artificial sequence
  SiRNA target sequence
aatgattattgagcggaaaagta

SEQ ID NO: 56883 - DNA, 23 bp, Artificial sequence
  SiRNA target sequence
atgattattgagcggaaaagtag

SEQ ID NO: 56884 - DNA, 23 bp, Artificial sequence
  SiRNA target sequence
tgattattgagcggaaaagtaga

SEQ ID NO: 56885 - DNA, 23 bp, Artificial sequence
  SiRNA target sequence
gattattgagcggaaaagtagag

SEQ ID NO: 56886 - DNA, 23 bp, Artificial sequence
  SiRNA target sequence
attattgagcggaaaagtagagc

SEQ ID NO: 56887 - DNA, 23 bp, Artificial sequence
  SiRNA target sequence
ttattgagcggaaaagtagagca

SEQ ID NO: 56888 - DNA, 23 bp, Artificial sequence
  SiRNA target sequence
tattgagcggaaaagtagagcat

SEQ ID NO: 56889 - DNA, 23 bp, Artificial sequence
  SiRNA target sequence
attgagcggaaaagtagagcata

SEQ ID NO: 56890 - DNA, 23 bp, Artificial sequence
  SiRNA target sequence
ttgagcggaaaagtagagcatat

SEQ ID NO: 56891 - DNA, 23 bp, Artificial sequence
  SiRNA target sequence
tgagcggaaaagtagagcatatg

SEQ ID NO: 56892 - DNA, 23 bp, Artificial sequence
  SiRNA target sequence
gagcggaaaagtagagcatatgg

SEQ ID NO: 56893 - DNA, 23 bp, Artificial sequence
  SiRNA target sequence
agcggaaaagtagagcatatggt

SEQ ID NO: 56894 - DNA, 23 bp, Artificial sequence
  SiRNA target sequence
gcggaaaagtagagcatatggtg

SEQ ID NO: 56895 - DNA, 23 bp, Artificial sequence
  SiRNA target sequence
cggaaaagtagagcatatggtga

SEQ ID NO: 56896 - DNA, 23 bp, Artificial sequence
  SiRNA target sequence
ggaaaagtagagcatatggtgac

SEQ ID NO: 56897 - DNA, 23 bp, Artificial sequence
  SiRNA target sequence
gaaaagtagagcatatggtgaca

SEQ ID NO: 56898 - DNA, 23 bp, Artificial sequence
  SiRNA target sequence
aaaagtagagcatatggtgacat

SEQ ID NO: 56899 - DNA, 23 bp, Artificial sequence
  SiRNA target sequence
aaagtagagcatatggtgacata

SEQ ID NO: 56900 - DNA, 23 bp, Artificial sequence
  SiRNA target sequence
aagtagagcatatggtgacatac

SEQ ID NO: 56901 - DNA, 23 bp, Artificial sequence
  SiRNA target sequence
agtagagcatatggtgacatact

SEQ ID NO: 56902 - DNA, 23 bp, Artificial sequence
  SiRNA target sequence
gtagagcatatggtgacatacta

SEQ ID NO: 56903 - DNA, 23 bp, Artificial sequence
  SiRNA target sequence
tagagcatatggtgacatactag

SEQ ID NO: 56904 - DNA, 23 bp, Artificial sequence
  SiRNA target sequence
agagcatatggtgacatactaga

SEQ ID NO: 56905 - DNA, 23 bp, Artificial sequence
  SiRNA target sequence
gagcatatggtgacatactagaa

SEQ ID NO: 56906 - DNA, 23 bp, Artificial sequence
  SiRNA target sequence
agcatatggtgacatactagaac

SEQ ID NO: 56907 - DNA, 23 bp, Artificial sequence
  SiRNA target sequence
gcatatggtgacatactagaact

SEQ ID NO: 56908 - DNA, 23 bp, Artificial sequence
  SiRNA target sequence
catatggtgacatactagaacta

SEQ ID NO: 56909 - DNA, 23 bp, Artificial sequence
  SiRNA target sequence
atatggtgacatactagaactaa

SEQ ID NO: 56910 - DNA, 23 bp, Artificial sequence
  SiRNA target sequence
tatggtgacatactagaactaac

SEQ ID NO: 56911 - DNA, 23 bp, Artificial sequence
  SiRNA target sequence
atggtgacatactagaactaact

SEQ ID NO: 56912 - DNA, 23 bp, Artificial sequence
  SiRNA target sequence
tggtgacatactagaactaacta

SEQ ID NO: 56913 - DNA, 23 bp, Artificial sequence
  SiRNA target sequence
ggtgacatactagaactaactac

SEQ ID NO: 56914 - DNA, 23 bp, Artificial sequence
  SiRNA target sequence
gtgacatactagaactaactact

SEQ ID NO: 56915 - DNA, 23 bp, Artificial sequence
  SiRNA target sequence
tgacatactagaactaactactc

SEQ ID NO: 56916 - DNA, 23 bp, Artificial sequence
  SiRNA target sequence
gacatactagaactaactactct

SEQ ID NO: 56917 - DNA, 23 bp, Artificial sequence
  SiRNA target sequence
acatactagaactaactactctc

SEQ ID NO: 56918 - DNA, 23 bp, Artificial sequence
  SiRNA target sequence
catactagaactaactactctct

SEQ ID NO: 56919 - DNA, 23 bp, Artificial sequence
  SiRNA target sequence
atactagaactaactactctctc

SEQ ID NO: 56920 - DNA, 23 bp, Artificial sequence
  SiRNA target sequence
tactagaactaactactctctcg

SEQ ID NO: 56921 - DNA, 23 bp, Artificial sequence
  SiRNA target sequence
actagaactaactactctctcgg

SEQ ID NO: 56922 - DNA, 23 bp, Artificial sequence
  SiRNA target sequence
ctagaactaactactctctcggc

SEQ ID NO: 56923 - DNA, 23 bp, Artificial sequence
  SiRNA target sequence
tagaactaactactctctcggcc

SEQ ID NO: 56924 - DNA, 23 bp, Artificial sequence
  SiRNA target sequence
agaactaactactctctcggccg

SEQ ID NO: 56925 - DNA, 23 bp, Artificial sequence
  SiRNA target sequence
gaactaactactctctcggccgt

SEQ ID NO: 56926 - DNA, 23 bp, Artificial sequence
  SiRNA target sequence
aactaactactctctcggccgta

SEQ ID NO: 56927 - DNA, 23 bp, Artificial sequence
  SiRNA target sequence
actaactactctctcggccgtac

SEQ ID NO: 56928 - DNA, 23 bp, Artificial sequence
  SiRNA target sequence
ctaactactctctcggccgtacc

SEQ ID NO: 56929 - DNA, 23 bp, Artificial sequence
  SiRNA target sequence
taactactctctcggccgtacca

SEQ ID NO: 56930 - DNA, 23 bp, Artificial sequence
  SiRNA target sequence
aactactctctcggccgtaccaa

SEQ ID NO: 56931 - DNA, 23 bp, Artificial sequence
  SiRNA target sequence
actactctctcggccgtaccaac

SEQ ID NO: 56932 - DNA, 23 bp, Artificial sequence
  SiRNA target sequence
ctactctctcggccgtaccaacc

SEQ ID NO: 56933 - DNA, 23 bp, Artificial sequence
  SiRNA target sequence
tactctctcggccgtaccaacct

SEQ ID NO: 56934 - DNA, 23 bp, Artificial sequence
  SiRNA target sequence
actctctcggccgtaccaacctg

SEQ ID NO: 56935 - DNA, 23 bp, Artificial sequence
  SiRNA target sequence
ctctctcggccgtaccaacctgt

SEQ ID NO: 56936 - DNA, 23 bp, Artificial sequence
  SiRNA target sequence
tctctcggccgtaccaacctgta

SEQ ID NO: 56937 - DNA, 23 bp, Artificial sequence
  SiRNA target sequence
ctctcggccgtaccaacctgtat

SEQ ID NO: 56938 - DNA, 23 bp, Artificial sequence
  SiRNA target sequence
tctcggccgtaccaacctgtatt

SEQ ID NO: 56939 - DNA, 23 bp, Artificial sequence
  SiRNA target sequence
ctcggccgtaccaacctgtattg

SEQ ID NO: 56940 - DNA, 23 bp, Artificial sequence
  SiRNA target sequence
tcggccgtaccaacctgtattgt

SEQ ID NO: 56941 - DNA, 23 bp, Artificial sequence
  SiRNA target sequence
cggccgtaccaacctgtattgta

SEQ ID NO: 56942 - DNA, 23 bp, Artificial sequence
  SiRNA target sequence
ggccgtaccaacctgtattgtag

SEQ ID NO: 56943 - DNA, 23 bp, Artificial sequence
  SiRNA target sequence
gccgtaccaacctgtattgtagt

SEQ ID NO: 56944 - DNA, 23 bp, Artificial sequence
  SiRNA target sequence
ccgtaccaacctgtattgtagtt

SEQ ID NO: 56945 - DNA, 23 bp, Artificial sequence
  SiRNA target sequence
cgtaccaacctgtattgtagtta

SEQ ID NO: 56946 - DNA, 23 bp, Artificial sequence
  SiRNA target sequence
gtaccaacctgtattgtagttat

SEQ ID NO: 56947 - DNA, 23 bp, Artificial sequence
  SiRNA target sequence
taccaacctgtattgtagttatt

SEQ ID NO: 56948 - DNA, 23 bp, Artificial sequence
  SiRNA target sequence
accaacctgtattgtagttatta

SEQ ID NO: 56949 - DNA, 23 bp, Artificial sequence
  SiRNA target sequence
ccaacctgtattgtagttattat

SEQ ID NO: 56950 - DNA, 23 bp, Artificial sequence
  SiRNA target sequence
caacctgtattgtagttattatg

SEQ ID NO: 56951 - DNA, 23 bp, Artificial sequence
  SiRNA target sequence
aacctgtattgtagttattatgt

SEQ ID NO: 56952 - DNA, 23 bp, Artificial sequence
  SiRNA target sequence
acctgtattgtagttattatgtc

SEQ ID NO: 56953 - DNA, 23 bp, Artificial sequence
  SiRNA target sequence
cctgtattgtagttattatgtcg

SEQ ID NO: 56954 - DNA, 23 bp, Artificial sequence
  SiRNA target sequence
ctgtattgtagttattatgtcgt

SEQ ID NO: 56955 - DNA, 23 bp, Artificial sequence
  SiRNA target sequence
tgtattgtagttattatgtcgtt

SEQ ID NO: 56956 - DNA, 23 bp, Artificial sequence
  SiRNA target sequence
gtattgtagttattatgtcgttt

SEQ ID NO: 56957 - DNA, 23 bp, Artificial sequence
  SiRNA target sequence
tattgtagttattatgtcgtttt

SEQ ID NO: 56958 - DNA, 23 bp, Artificial sequence
  SiRNA target sequence
attgtagttattatgtcgttttt

SEQ ID NO: 56959 - DNA, 23 bp, Artificial sequence
  SiRNA target sequence
ttgtagttattatgtcgtttttc

SEQ ID NO: 56960 - DNA, 23 bp, Artificial sequence
  SiRNA target sequence
tgtagttattatgtcgtttttct

SEQ ID NO: 56961 - DNA, 23 bp, Artificial sequence
  SiRNA target sequence
gtagttattatgtcgtttttctc

SEQ ID NO: 56962 - DNA, 23 bp, Artificial sequence
  SiRNA target sequence
tagttattatgtcgtttttctca

SEQ ID NO: 56963 - DNA, 23 bp, Artificial sequence
  SiRNA target sequence
agttattatgtcgtttttctcag

SEQ ID NO: 56964 - DNA, 23 bp, Artificial sequence
  SiRNA target sequence
gttattatgtcgtttttctcagt

SEQ ID NO: 56965 - DNA, 23 bp, Artificial sequence
  SiRNA target sequence
ttattatgtcgtttttctcagta

SEQ ID NO: 56966 - DNA, 23 bp, Artificial sequence
  SiRNA target sequence
tattatgtcgtttttctcagtat

SEQ ID NO: 56967 - DNA, 23 bp, Artificial sequence
  SiRNA target sequence
attatgtcgtttttctcagtata

SEQ ID NO: 56968 - DNA, 23 bp, Artificial sequence
  SiRNA target sequence
ttatgtcgtttttctcagtatat

SEQ ID NO: 56969 - DNA, 23 bp, Artificial sequence
  SiRNA target sequence
tatgtcgtttttctcagtatata

SEQ ID NO: 56970 - DNA, 23 bp, Artificial sequence
  SiRNA target sequence
atgtcgtttttctcagtatataa

SEQ ID NO: 56971 - DNA, 23 bp, Artificial sequence
  SiRNA target sequence
tgtcgtttttctcagtatataaa

SEQ ID NO: 56972 - DNA, 23 bp, Artificial sequence
  SiRNA target sequence
gtcgtttttctcagtatataaaa

SEQ ID NO: 56973 - DNA, 23 bp, Artificial sequence
  SiRNA target sequence
tcgtttttctcagtatataaaaa

SEQ ID NO: 56974 - DNA, 23 bp, Artificial sequence
  SiRNA target sequence
cgtttttctcagtatataaaaat

SEQ ID NO: 56975 - DNA, 23 bp, Artificial sequence
  SiRNA target sequence
gtttttctcagtatataaaaatt

SEQ ID NO: 56976 - DNA, 23 bp, Artificial sequence
  SiRNA target sequence
tttttctcagtatataaaaattt

SEQ ID NO: 56977 - DNA, 23 bp, Artificial sequence
  SiRNA target sequence
ttttctcagtatataaaaatttg

SEQ ID NO: 56978 - DNA, 23 bp, Artificial sequence
  SiRNA target sequence
tttctcagtatataaaaatttgg

SEQ ID NO: 56979 - DNA, 23 bp, Artificial sequence
  SiRNA target sequence
ttctcagtatataaaaatttggg

SEQ ID NO: 56980 - DNA, 23 bp, Artificial sequence
  SiRNA target sequence
tctcagtatataaaaatttggga

SEQ ID NO: 56981 - DNA, 23 bp, Artificial sequence
  SiRNA target sequence
ctcagtatataaaaatttgggaa

SEQ ID NO: 56982 - DNA, 23 bp, Artificial sequence
  SiRNA target sequence
tcagtatataaaaatttgggaag

SEQ ID NO: 56983 - DNA, 23 bp, Artificial sequence
  SiRNA target sequence
cagtatataaaaatttgggaaga

SEQ ID NO: 56984 - DNA, 23 bp, Artificial sequence
  SiRNA target sequence
agtatataaaaatttgggaagag

SEQ ID NO: 56985 - DNA, 23 bp, Artificial sequence
  SiRNA target sequence
gtatataaaaatttgggaagaga

SEQ ID NO: 56986 - DNA, 23 bp, Artificial sequence
  SiRNA target sequence
tatataaaaatttgggaagagat

SEQ ID NO: 56987 - DNA, 23 bp, Artificial sequence
  SiRNA target sequence
atataaaaatttgggaagagatg

SEQ ID NO: 56988 - DNA, 23 bp, Artificial sequence
  SiRNA target sequence
tataaaaatttgggaagagatgc

SEQ ID NO: 56989 - DNA, 23 bp, Artificial sequence
  SiRNA target sequence
ataaaaatttgggaagagatgca

SEQ ID NO: 56990 - DNA, 23 bp, Artificial sequence
  SiRNA target sequence
taaaaatttgggaagagatgcac

SEQ ID NO: 56991 - DNA, 23 bp, Artificial sequence
  SiRNA target sequence
aaaaatttgggaagagatgcact

SEQ ID NO: 56992 - DNA, 23 bp, Artificial sequence
  SiRNA target sequence
aaaatttgggaagagatgcactc

SEQ ID NO: 56993 - DNA, 23 bp, Artificial sequence
  SiRNA target sequence
aaatttgggaagagatgcactct

SEQ ID NO: 56994 - DNA, 23 bp, Artificial sequence
  SiRNA target sequence
aatttgggaagagatgcactcta

SEQ ID NO: 56995 - DNA, 23 bp, Artificial sequence
  SiRNA target sequence
atttgggaagagatgcactctac

SEQ ID NO: 56996 - DNA, 23 bp, Artificial sequence
  SiRNA target sequence
tttgggaagagatgcactctacg

SEQ ID NO: 56997 - DNA, 23 bp, Artificial sequence
  SiRNA target sequence
ttgggaagagatgcactctacgt

SEQ ID NO: 56998 - DNA, 23 bp, Artificial sequence
  SiRNA target sequence
tgggaagagatgcactctacgta

SEQ ID NO: 56999 - DNA, 23 bp, Artificial sequence
  SiRNA target sequence
gggaagagatgcactctacgtaa

SEQ ID NO: 57000 - DNA, 23 bp, Artificial sequence
  SiRNA target sequence
ggaagagatgcactctacgtaat

SEQ ID NO: 57001 - DNA, 23 bp, Artificial sequence
  SiRNA target sequence
gaagagatgcactctacgtaatg

SEQ ID NO: 57002 - DNA, 23 bp, Artificial sequence
  SiRNA target sequence
aagagatgcactctacgtaatgt

SEQ ID NO: 57003 - DNA, 23 bp, Artificial sequence
  SiRNA target sequence
agagatgcactctacgtaatgtt

SEQ ID NO: 57004 - DNA, 23 bp, Artificial sequence
  SiRNA target sequence
gagatgcactctacgtaatgttg

SEQ ID NO: 57005 - DNA, 23 bp, Artificial sequence
  SiRNA target sequence
agatgcactctacgtaatgttgg

SEQ ID NO: 57006 - DNA, 23 bp, Artificial sequence
  SiRNA target sequence
gatgcactctacgtaatgttggc

SEQ ID NO: 57007 - DNA, 23 bp, Artificial sequence
  SiRNA target sequence
atgcactctacgtaatgttggct

SEQ ID NO: 57008 - DNA, 23 bp, Artificial sequence
  SiRNA target sequence
tgcactctacgtaatgttggcta

SEQ ID NO: 57009 - DNA, 23 bp, Artificial sequence
  SiRNA target sequence
gcactctacgtaatgttggctac

SEQ ID NO: 57010 - DNA, 23 bp, Artificial sequence
  SiRNA target sequence
cactctacgtaatgttggctaca

SEQ ID NO: 57011 - DNA, 23 bp, Artificial sequence
  SiRNA target sequence
actctacgtaatgttggctacaa

SEQ ID NO: 57012 - DNA, 23 bp, Artificial sequence
  SiRNA target sequence
ctctacgtaatgttggctacaag

SEQ ID NO: 57013 - DNA, 23 bp, Artificial sequence
  SiRNA target sequence
tctacgtaatgttggctacaagt

SEQ ID NO: 57014 - DNA, 23 bp, Artificial sequence
  SiRNA target sequence
ctacgtaatgttggctacaagtg

SEQ ID NO: 57015 - DNA, 23 bp, Artificial sequence
  SiRNA target sequence
tacgtaatgttggctacaagtgc

SEQ ID NO: 57016 - DNA, 23 bp, Artificial sequence
  SiRNA target sequence
acgtaatgttggctacaagtgcc

SEQ ID NO: 57017 - DNA, 23 bp, Artificial sequence
  SiRNA target sequence
cgtaatgttggctacaagtgcct

SEQ ID NO: 57018 - DNA, 23 bp, Artificial sequence
  SiRNA target sequence
gtaatgttggctacaagtgcctt

SEQ ID NO: 57019 - DNA, 23 bp, Artificial sequence
  SiRNA target sequence
taatgttggctacaagtgccttg

SEQ ID NO: 57020 - DNA, 23 bp, Artificial sequence
  SiRNA target sequence
aatgttggctacaagtgccttgt

SEQ ID NO: 57021 - DNA, 23 bp, Artificial sequence
  SiRNA target sequence
atgttggctacaagtgccttgta

SEQ ID NO: 57022 - DNA, 23 bp, Artificial sequence
  SiRNA target sequence
tgttggctacaagtgccttgtat

SEQ ID NO: 57023 - DNA, 23 bp, Artificial sequence
  SiRNA target sequence
gttggctacaagtgccttgtatg

SEQ ID NO: 57024 - DNA, 23 bp, Artificial sequence
  SiRNA target sequence
ttggctacaagtgccttgtatgt

SEQ ID NO: 57025 - DNA, 23 bp, Artificial sequence
  SiRNA target sequence
tggctacaagtgccttgtatgtg

SEQ ID NO: 57026 - DNA, 23 bp, Artificial sequence
  SiRNA target sequence
ggctacaagtgccttgtatgtgt

SEQ ID NO: 57027 - DNA, 23 bp, Artificial sequence
  SiRNA target sequence
gctacaagtgccttgtatgtgta

SEQ ID NO: 57028 - DNA, 23 bp, Artificial sequence
  SiRNA target sequence
ctacaagtgccttgtatgtgtat

SEQ ID NO: 57029 - DNA, 23 bp, Artificial sequence
  SiRNA target sequence
tacaagtgccttgtatgtgtatt

SEQ ID NO: 57030 - DNA, 23 bp, Artificial sequence
  SiRNA target sequence
acaagtgccttgtatgtgtattt

SEQ ID NO: 57031 - DNA, 23 bp, Artificial sequence
  SiRNA target sequence
caagtgccttgtatgtgtatttt

SEQ ID NO: 57032 - DNA, 23 bp, Artificial sequence
  SiRNA target sequence
aagtgccttgtatgtgtatttta

SEQ ID NO: 57033 - DNA, 23 bp, Artificial sequence
  SiRNA target sequence
agtgccttgtatgtgtattttac

SEQ ID NO: 57034 - DNA, 23 bp, Artificial sequence
  SiRNA target sequence
gtgccttgtatgtgtattttaca

SEQ ID NO: 57035 - DNA, 23 bp, Artificial sequence
  SiRNA target sequence
tgccttgtatgtgtattttacat

SEQ ID NO: 57036 - DNA, 23 bp, Artificial sequence
  SiRNA target sequence
gccttgtatgtgtattttacatt

SEQ ID NO: 57037 - DNA, 23 bp, Artificial sequence
  SiRNA target sequence
ccttgtatgtgtattttacattt

SEQ ID NO: 57038 - DNA, 23 bp, Artificial sequence
  SiRNA target sequence
cttgtatgtgtattttacatttg

SEQ ID NO: 57039 - DNA, 23 bp, Artificial sequence
  SiRNA target sequence
ttgtatgtgtattttacatttgt

SEQ ID NO: 57040 - DNA, 23 bp, Artificial sequence
  SiRNA target sequence
tgtatgtgtattttacatttgta

SEQ ID NO: 57041 - DNA, 23 bp, Artificial sequence
  SiRNA target sequence
gtatgtgtattttacatttgtat

SEQ ID NO: 57042 - DNA, 23 bp, Artificial sequence
  SiRNA target sequence
tatgtgtattttacatttgtatt

SEQ ID NO: 57043 - DNA, 23 bp, Artificial sequence
  SiRNA target sequence
atgtgtattttacatttgtattt

SEQ ID NO: 57044 - DNA, 23 bp, Artificial sequence
  SiRNA target sequence
tgtgtattttacatttgtatttt

SEQ ID NO: 57045 - DNA, 23 bp, Artificial sequence
  SiRNA target sequence
gtgtattttacatttgtattttc

SEQ ID NO: 57046 - DNA, 23 bp, Artificial sequence
  SiRNA target sequence
tgtattttacatttgtattttca

SEQ ID NO: 57047 - DNA, 23 bp, Artificial sequence
  SiRNA target sequence
gtattttacatttgtattttcaa

SEQ ID NO: 57048 - DNA, 23 bp, Artificial sequence
  SiRNA target sequence
tattttacatttgtattttcaat

SEQ ID NO: 57049 - DNA, 23 bp, Artificial sequence
  SiRNA target sequence
attttacatttgtattttcaata

SEQ ID NO: 57050 - DNA, 23 bp, Artificial sequence
  SiRNA target sequence
ttttacatttgtattttcaatat

SEQ ID NO: 57051 - DNA, 23 bp, Artificial sequence
  SiRNA target sequence
tttacatttgtattttcaatatg

SEQ ID NO: 57052 - DNA, 23 bp, Artificial sequence
  SiRNA target sequence
ttacatttgtattttcaatatgg

SEQ ID NO: 57053 - DNA, 23 bp, Artificial sequence
  SiRNA target sequence
tacatttgtattttcaatatgga

SEQ ID NO: 57054 - DNA, 23 bp, Artificial sequence
  SiRNA target sequence
acatttgtattttcaatatggag

SEQ ID NO: 57055 - DNA, 23 bp, Artificial sequence
  SiRNA target sequence
catttgtattttcaatatggaga

SEQ ID NO: 57056 - DNA, 23 bp, Artificial sequence
  SiRNA target sequence
atttgtattttcaatatggagaa

SEQ ID NO: 57057 - DNA, 23 bp, Artificial sequence
  SiRNA target sequence
tttgtattttcaatatggagaaa

SEQ ID NO: 57058 - DNA, 23 bp, Artificial sequence
  SiRNA target sequence
ttgtattttcaatatggagaaac

SEQ ID NO: 57059 - DNA, 23 bp, Artificial sequence
  SiRNA target sequence
tgtattttcaatatggagaaaca

SEQ ID NO: 57060 - DNA, 23 bp, Artificial sequence
  SiRNA target sequence
gtattttcaatatggagaaacaa

SEQ ID NO: 57061 - DNA, 23 bp, Artificial sequence
  SiRNA target sequence
tattttcaatatggagaaacaat

SEQ ID NO: 57062 - DNA, 23 bp, Artificial sequence
  SiRNA target sequence
attttcaatatggagaaacaata

SEQ ID NO: 57063 - DNA, 23 bp, Artificial sequence
  SiRNA target sequence
ttttcaatatggagaaacaatat

SEQ ID NO: 57064 - DNA, 23 bp, Artificial sequence
  SiRNA target sequence
tttcaatatggagaaacaatatt

SEQ ID NO: 57065 - DNA, 23 bp, Artificial sequence
  SiRNA target sequence
ttcaatatggagaaacaatatta

SEQ ID NO: 57066 - DNA, 23 bp, Artificial sequence
  SiRNA target sequence
tcaatatggagaaacaatattag

SEQ ID NO: 57067 - DNA, 23 bp, Artificial sequence
  SiRNA target sequence
caatatggagaaacaatattaga

SEQ ID NO: 57068 - DNA, 23 bp, Artificial sequence
  SiRNA target sequence
aatatggagaaacaatattagaa

SEQ ID NO: 57069 - DNA, 23 bp, Artificial sequence
  SiRNA target sequence
atatggagaaacaatattagaag

SEQ ID NO: 57070 - DNA, 23 bp, Artificial sequence
  SiRNA target sequence
tatggagaaacaatattagaaga

SEQ ID NO: 57071 - DNA, 23 bp, Artificial sequence
  SiRNA target sequence
atggagaaacaatattagaagac

SEQ ID NO: 57072 - DNA, 23 bp, Artificial sequence
  SiRNA target sequence
tggagaaacaatattagaagaca

SEQ ID NO: 57073 - DNA, 23 bp, Artificial sequence
  SiRNA target sequence
ggagaaacaatattagaagacaa

SEQ ID NO: 57074 - DNA, 23 bp, Artificial sequence
  SiRNA target sequence
gagaaacaatattagaagacaat

SEQ ID NO: 57075 - DNA, 23 bp, Artificial sequence
  SiRNA target sequence
agaaacaatattagaagacaata

SEQ ID NO: 57076 - DNA, 23 bp, Artificial sequence
  SiRNA target sequence
gaaacaatattagaagacaatat

SEQ ID NO: 57077 - DNA, 23 bp, Artificial sequence
  SiRNA target sequence
aaacaatattagaagacaatata

SEQ ID NO: 57078 - DNA, 23 bp, Artificial sequence
  SiRNA target sequence
aacaatattagaagacaatataa

SEQ ID NO: 57079 - DNA, 23 bp, Artificial sequence
  SiRNA target sequence
acaatattagaagacaatataat

SEQ ID NO: 57080 - DNA, 23 bp, Artificial sequence
  SiRNA target sequence
caatattagaagacaatataata

SEQ ID NO: 57081 - DNA, 23 bp, Artificial sequence
  SiRNA target sequence
aatattagaagacaatataataa

SEQ ID NO: 57082 - DNA, 23 bp, Artificial sequence
  SiRNA target sequence
atattagaagacaatataataag

SEQ ID NO: 57083 - DNA, 23 bp, Artificial sequence
  SiRNA target sequence
tattagaagacaatataataagt

SEQ ID NO: 57084 - DNA, 23 bp, Artificial sequence
  SiRNA target sequence
attagaagacaatataataagtc

SEQ ID NO: 57085 - DNA, 23 bp, Artificial sequence
  SiRNA target sequence
ttagaagacaatataataagtca

SEQ ID NO: 57086 - DNA, 23 bp, Artificial sequence
  SiRNA target sequence
tagaagacaatataataagtcac

SEQ ID NO: 57087 - DNA, 23 bp, Artificial sequence
  SiRNA target sequence
agaagacaatataataagtcaca

SEQ ID NO: 57088 - DNA, 23 bp, Artificial sequence
  SiRNA target sequence
gaagacaatataataagtcacag

SEQ ID NO: 57089 - DNA, 23 bp, Artificial sequence
  SiRNA target sequence
aagacaatataataagtcacagg

SEQ ID NO: 57090 - DNA, 23 bp, Artificial sequence
  SiRNA target sequence
agacaatataataagtcacagga

SEQ ID NO: 57091 - DNA, 23 bp, Artificial sequence
  SiRNA target sequence
gacaatataataagtcacaggat

SEQ ID NO: 57092 - DNA, 23 bp, Artificial sequence
  SiRNA target sequence
acaatataataagtcacaggata

SEQ ID NO: 57093 - DNA, 23 bp, Artificial sequence
  SiRNA target sequence
caatataataagtcacaggataa

SEQ ID NO: 57094 - DNA, 23 bp, Artificial sequence
  SiRNA target sequence
aatataataagtcacaggataaa

SEQ ID NO: 57095 - DNA, 23 bp, Artificial sequence
  SiRNA target sequence
atataataagtcacaggataaat

SEQ ID NO: 57096 - DNA, 23 bp, Artificial sequence
  SiRNA target sequence
tataataagtcacaggataaatt

SEQ ID NO: 57097 - DNA, 23 bp, Artificial sequence
  SiRNA target sequence
ataataagtcacaggataaatta

SEQ ID NO: 57098 - DNA, 23 bp, Artificial sequence
  SiRNA target sequence
taataagtcacaggataaattat

SEQ ID NO: 57099 - DNA, 23 bp, Artificial sequence
  SiRNA target sequence
aataagtcacaggataaattatc

SEQ ID NO: 57100 - DNA, 23 bp, Artificial sequence
  SiRNA target sequence
ataagtcacaggataaattatcg

SEQ ID NO: 57101 - DNA, 23 bp, Artificial sequence
  SiRNA target sequence
taagtcacaggataaattatcga

SEQ ID NO: 57102 - DNA, 23 bp, Artificial sequence
  SiRNA target sequence
aagtcacaggataaattatcgaa

SEQ ID NO: 57103 - DNA, 23 bp, Artificial sequence
  SiRNA target sequence
agtcacaggataaattatcgaat

SEQ ID NO: 57104 - DNA, 23 bp, Artificial sequence
  SiRNA target sequence
gtcacaggataaattatcgaata

SEQ ID NO: 57105 - DNA, 23 bp, Artificial sequence
  SiRNA target sequence
tcacaggataaattatcgaataa

SEQ ID NO: 57106 - DNA, 23 bp, Artificial sequence
  SiRNA target sequence
cacaggataaattatcgaataaa

SEQ ID NO: 57107 - DNA, 23 bp, Artificial sequence
  SiRNA target sequence
acaggataaattatcgaataaat

SEQ ID NO: 57108 - DNA, 23 bp, Artificial sequence
  SiRNA target sequence
caggataaattatcgaataaatt

SEQ ID NO: 57109 - DNA, 23 bp, Artificial sequence
  SiRNA target sequence
aggataaattatcgaataaatta

SEQ ID NO: 57110 - DNA, 23 bp, Artificial sequence
  SiRNA target sequence
ggataaattatcgaataaattac

SEQ ID NO: 57111 - DNA, 23 bp, Artificial sequence
  SiRNA target sequence
gataaattatcgaataaattaca

SEQ ID NO: 57112 - DNA, 23 bp, Artificial sequence
  SiRNA target sequence
ataaattatcgaataaattacaa

SEQ ID NO: 57113 - DNA, 23 bp, Artificial sequence
  SiRNA target sequence
taaattatcgaataaattacaag

SEQ ID NO: 57114 - DNA, 23 bp, Artificial sequence
  SiRNA target sequence
aaattatcgaataaattacaaga

SEQ ID NO: 57115 - DNA, 23 bp, Artificial sequence
  SiRNA target sequence
aattatcgaataaattacaagat

SEQ ID NO: 57116 - DNA, 23 bp, Artificial sequence
  SiRNA target sequence
attatcgaataaattacaagatt

SEQ ID NO: 57117 - DNA, 23 bp, Artificial sequence
  SiRNA target sequence
ttatcgaataaattacaagattt

SEQ ID NO: 57118 - DNA, 23 bp, Artificial sequence
  SiRNA target sequence
tatcgaataaattacaagatttt

SEQ ID NO: 57119 - DNA, 23 bp, Artificial sequence
  SiRNA target sequence
atcgaataaattacaagattttt

SEQ ID NO: 57120 - DNA, 23 bp, Artificial sequence
  SiRNA target sequence
tcgaataaattacaagatttttt

SEQ ID NO: 57121 - DNA, 23 bp, Artificial sequence
  SiRNA target sequence
cgaataaattacaagatttttta

SEQ ID NO: 57122 - DNA, 23 bp, Artificial sequence
  SiRNA target sequence
gaataaattacaagattttttag

SEQ ID NO: 57123 - DNA, 23 bp, Artificial sequence
  SiRNA target sequence
aataaattacaagattttttagc

SEQ ID NO: 57124 - DNA, 23 bp, Artificial sequence
  SiRNA target sequence
ataaattacaagattttttagct

SEQ ID NO: 57125 - DNA, 23 bp, Artificial sequence
  SiRNA target sequence
taaattacaagattttttagcta

SEQ ID NO: 57126 - DNA, 23 bp, Artificial sequence
  SiRNA target sequence
aaattacaagattttttagctaa

SEQ ID NO: 57127 - DNA, 23 bp, Artificial sequence
  SiRNA target sequence
aattacaagattttttagctaat

SEQ ID NO: 57128 - DNA, 23 bp, Artificial sequence
  SiRNA target sequence
attacaagattttttagctaatc

SEQ ID NO: 57129 - DNA, 23 bp, Artificial sequence
  SiRNA target sequence
ttacaagattttttagctaatca

SEQ ID NO: 57130 - DNA, 23 bp, Artificial sequence
  SiRNA target sequence
tacaagattttttagctaatcat

SEQ ID NO: 57131 - DNA, 23 bp, Artificial sequence
  SiRNA target sequence
acaagattttttagctaatcatg

SEQ ID NO: 57132 - DNA, 23 bp, Artificial sequence
  SiRNA target sequence
caagattttttagctaatcatga

SEQ ID NO: 57133 - DNA, 23 bp, Artificial sequence
  SiRNA target sequence
aagattttttagctaatcatgaa

SEQ ID NO: 57134 - DNA, 23 bp, Artificial sequence
  SiRNA target sequence
agattttttagctaatcatgaaa

SEQ ID NO: 57135 - DNA, 23 bp, Artificial sequence
  SiRNA target sequence
gattttttagctaatcatgaaac

SEQ ID NO: 57136 - DNA, 23 bp, Artificial sequence
  SiRNA target sequence
attttttagctaatcatgaaaca

SEQ ID NO: 57137 - DNA, 23 bp, Artificial sequence
  SiRNA target sequence
ttttttagctaatcatgaaacaa

SEQ ID NO: 57138 - DNA, 23 bp, Artificial sequence
  SiRNA target sequence
tttttagctaatcatgaaacaat

SEQ ID NO: 57139 - DNA, 23 bp, Artificial sequence
  SiRNA target sequence
ttttagctaatcatgaaacaatt

SEQ ID NO: 57140 - DNA, 23 bp, Artificial sequence
  SiRNA target sequence
tttagctaatcatgaaacaatta

SEQ ID NO: 57141 - DNA, 23 bp, Artificial sequence
  SiRNA target sequence
ttagctaatcatgaaacaattaa

SEQ ID NO: 57142 - DNA, 23 bp, Artificial sequence
  SiRNA target sequence
tagctaatcatgaaacaattaaa

SEQ ID NO: 57143 - DNA, 23 bp, Artificial sequence
  SiRNA target sequence
agctaatcatgaaacaattaaag

SEQ ID NO: 57144 - DNA, 23 bp, Artificial sequence
  SiRNA target sequence
gctaatcatgaaacaattaaagc

SEQ ID NO: 57145 - DNA, 23 bp, Artificial sequence
  SiRNA target sequence
ctaatcatgaaacaattaaagcc

SEQ ID NO: 57146 - DNA, 23 bp, Artificial sequence
  SiRNA target sequence
taatcatgaaacaattaaagcct

SEQ ID NO: 57147 - DNA, 23 bp, Artificial sequence
  SiRNA target sequence
aatcatgaaacaattaaagccta

SEQ ID NO: 57148 - DNA, 23 bp, Artificial sequence
  SiRNA target sequence
atcatgaaacaattaaagcctat

SEQ ID NO: 57149 - DNA, 23 bp, Artificial sequence
  SiRNA target sequence
tcatgaaacaattaaagcctata

SEQ ID NO: 57150 - DNA, 23 bp, Artificial sequence
  SiRNA target sequence
catgaaacaattaaagcctataa

SEQ ID NO: 57151 - DNA, 23 bp, Artificial sequence
  SiRNA target sequence
atgaaacaattaaagcctataat

SEQ ID NO: 57152 - DNA, 23 bp, Artificial sequence
  SiRNA target sequence
tgaaacaattaaagcctataata

SEQ ID NO: 57153 - DNA, 23 bp, Artificial sequence
  SiRNA target sequence
gaaacaattaaagcctataatat

SEQ ID NO: 57154 - DNA, 23 bp, Artificial sequence
  SiRNA target sequence
aaacaattaaagcctataatatg

SEQ ID NO: 57155 - DNA, 23 bp, Artificial sequence
  SiRNA target sequence
aacaattaaagcctataatatgg

SEQ ID NO: 57156 - DNA, 23 bp, Artificial sequence
  SiRNA target sequence
acaattaaagcctataatatgga

SEQ ID NO: 57157 - DNA, 23 bp, Artificial sequence
  SiRNA target sequence
caattaaagcctataatatggaa

SEQ ID NO: 57158 - DNA, 23 bp, Artificial sequence
  SiRNA target sequence
aattaaagcctataatatggaag

SEQ ID NO: 57159 - DNA, 23 bp, Artificial sequence
  SiRNA target sequence
attaaagcctataatatggaaga

SEQ ID NO: 57160 - DNA, 23 bp, Artificial sequence
  SiRNA target sequence
ttaaagcctataatatggaagaa

SEQ ID NO: 57161 - DNA, 23 bp, Artificial sequence
  SiRNA target sequence
taaagcctataatatggaagaag

SEQ ID NO: 57162 - DNA, 23 bp, Artificial sequence
  SiRNA target sequence
aaagcctataatatggaagaaga

SEQ ID NO: 57163 - DNA, 23 bp, Artificial sequence
  SiRNA target sequence
aagcctataatatggaagaagaa

SEQ ID NO: 57164 - DNA, 23 bp, Artificial sequence
  SiRNA target sequence
agcctataatatggaagaagaaa

SEQ ID NO: 57165 - DNA, 23 bp, Artificial sequence
  SiRNA target sequence
gcctataatatggaagaagaaac

SEQ ID NO: 57166 - DNA, 23 bp, Artificial sequence
  SiRNA target sequence
cctataatatggaagaagaaact

SEQ ID NO: 57167 - DNA, 23 bp, Artificial sequence
  SiRNA target sequence
ctataatatggaagaagaaacta

SEQ ID NO: 57168 - DNA, 23 bp, Artificial sequence
  SiRNA target sequence
tataatatggaagaagaaactat

SEQ ID NO: 57169 - DNA, 23 bp, Artificial sequence
  SiRNA target sequence
ataatatggaagaagaaactatt

SEQ ID NO: 57170 - DNA, 23 bp, Artificial sequence
  SiRNA target sequence
taatatggaagaagaaactatta

SEQ ID NO: 57171 - DNA, 23 bp, Artificial sequence
  SiRNA target sequence
aatatggaagaagaaactattac

SEQ ID NO: 57172 - DNA, 23 bp, Artificial sequence
  SiRNA target sequence
atatggaagaagaaactattaca

SEQ ID NO: 57173 - DNA, 23 bp, Artificial sequence
  SiRNA target sequence
tatggaagaagaaactattacat

SEQ ID NO: 57174 - DNA, 23 bp, Artificial sequence
  SiRNA target sequence
atggaagaagaaactattacata

SEQ ID NO: 57175 - DNA, 23 bp, Artificial sequence
  SiRNA target sequence
tggaagaagaaactattacatat

SEQ ID NO: 57176 - DNA, 23 bp, Artificial sequence
  SiRNA target sequence
ggaagaagaaactattacatatt

SEQ ID NO: 57177 - DNA, 23 bp, Artificial sequence
  SiRNA target sequence
gaagaagaaactattacatattt

SEQ ID NO: 57178 - DNA, 23 bp, Artificial sequence
  SiRNA target sequence
aagaagaaactattacatatttt

SEQ ID NO: 57179 - DNA, 23 bp, Artificial sequence
  SiRNA target sequence
agaagaaactattacatattttg

SEQ ID NO: 57180 - DNA, 23 bp, Artificial sequence
  SiRNA target sequence
gaagaaactattacatattttga

SEQ ID NO: 57181 - DNA, 23 bp, Artificial sequence
  SiRNA target sequence
aagaaactattacatattttgat

SEQ ID NO: 57182 - DNA, 23 bp, Artificial sequence
  SiRNA target sequence
agaaactattacatattttgatg

SEQ ID NO: 57183 - DNA, 23 bp, Artificial sequence
  SiRNA target sequence
gaaactattacatattttgatga

SEQ ID NO: 57184 - DNA, 23 bp, Artificial sequence
  SiRNA target sequence
aaactattacatattttgatgaa

SEQ ID NO: 57185 - DNA, 23 bp, Artificial sequence
  SiRNA target sequence
aactattacatattttgatgaaa

SEQ ID NO: 57186 - DNA, 23 bp, Artificial sequence
  SiRNA target sequence
actattacatattttgatgaaaa

SEQ ID NO: 57187 - DNA, 23 bp, Artificial sequence
  SiRNA target sequence
ctattacatattttgatgaaaat

SEQ ID NO: 57188 - DNA, 23 bp, Artificial sequence
  SiRNA target sequence
tattacatattttgatgaaaatc

SEQ ID NO: 57189 - DNA, 23 bp, Artificial sequence
  SiRNA target sequence
attacatattttgatgaaaatca

SEQ ID NO: 57190 - DNA, 23 bp, Artificial sequence
  SiRNA target sequence
ttacatattttgatgaaaatcaa

SEQ ID NO: 57191 - DNA, 23 bp, Artificial sequence
  SiRNA target sequence
tacatattttgatgaaaatcaaa

SEQ ID NO: 57192 - DNA, 23 bp, Artificial sequence
  SiRNA target sequence
acatattttgatgaaaatcaaaa

SEQ ID NO: 57193 - DNA, 23 bp, Artificial sequence
  SiRNA target sequence
catattttgatgaaaatcaaaaa

SEQ ID NO: 57194 - DNA, 23 bp, Artificial sequence
  SiRNA target sequence
atattttgatgaaaatcaaaaac

SEQ ID NO: 57195 - DNA, 23 bp, Artificial sequence
  SiRNA target sequence
tattttgatgaaaatcaaaaacc

SEQ ID NO: 57196 - DNA, 23 bp, Artificial sequence
  SiRNA target sequence
attttgatgaaaatcaaaaaccg

SEQ ID NO: 57197 - DNA, 23 bp, Artificial sequence
  SiRNA target sequence
ttttgatgaaaatcaaaaaccgg

SEQ ID NO: 57198 - DNA, 23 bp, Artificial sequence
  SiRNA target sequence
tttgatgaaaatcaaaaaccggt

SEQ ID NO: 57199 - DNA, 23 bp, Artificial sequence
  SiRNA target sequence
ttgatgaaaatcaaaaaccggta

SEQ ID NO: 57200 - DNA, 23 bp, Artificial sequence
  SiRNA target sequence
tgatgaaaatcaaaaaccggtag

SEQ ID NO: 57201 - DNA, 23 bp, Artificial sequence
  SiRNA target sequence
gatgaaaatcaaaaaccggtaga

SEQ ID NO: 57202 - DNA, 23 bp, Artificial sequence
  SiRNA target sequence
atgaaaatcaaaaaccggtagaa

SEQ ID NO: 57203 - DNA, 23 bp, Artificial sequence
  SiRNA target sequence
tgaaaatcaaaaaccggtagaat

SEQ ID NO: 57204 - DNA, 23 bp, Artificial sequence
  SiRNA target sequence
gaaaatcaaaaaccggtagaata

SEQ ID NO: 57205 - DNA, 23 bp, Artificial sequence
  SiRNA target sequence
aaaatcaaaaaccggtagaatat

SEQ ID NO: 57206 - DNA, 23 bp, Artificial sequence
  SiRNA target sequence
aaatcaaaaaccggtagaatatt

SEQ ID NO: 57207 - DNA, 23 bp, Artificial sequence
  SiRNA target sequence
aatcaaaaaccggtagaatattt

SEQ ID NO: 57208 - DNA, 23 bp, Artificial sequence
  SiRNA target sequence
atcaaaaaccggtagaatatttt

SEQ ID NO: 57209 - DNA, 23 bp, Artificial sequence
  SiRNA target sequence
tcaaaaaccggtagaatattttg

SEQ ID NO: 57210 - DNA, 23 bp, Artificial sequence
  SiRNA target sequence
caaaaaccggtagaatattttgg

SEQ ID NO: 57211 - DNA, 23 bp, Artificial sequence
  SiRNA target sequence
aaaaaccggtagaatattttggg

SEQ ID NO: 57212 - DNA, 23 bp, Artificial sequence
  SiRNA target sequence
aaaaccggtagaatattttgggg

SEQ ID NO: 57213 - DNA, 23 bp, Artificial sequence
  SiRNA target sequence
aaaccggtagaatattttggggt

SEQ ID NO: 57214 - DNA, 23 bp, Artificial sequence
  SiRNA target sequence
aaccggtagaatattttggggta

SEQ ID NO: 57215 - DNA, 23 bp, Artificial sequence
  SiRNA target sequence
accggtagaatattttggggtaa

SEQ ID NO: 57216 - DNA, 23 bp, Artificial sequence
  SiRNA target sequence
ccggtagaatattttggggtaaa

SEQ ID NO: 57217 - DNA, 23 bp, Artificial sequence
  SiRNA target sequence
cggtagaatattttggggtaaag

SEQ ID NO: 57218 - DNA, 23 bp, Artificial sequence
  SiRNA target sequence
ggtagaatattttggggtaaagt

SEQ ID NO: 57219 - DNA, 23 bp, Artificial sequence
  SiRNA target sequence
gtagaatattttggggtaaagtc

SEQ ID NO: 57220 - DNA, 23 bp, Artificial sequence
  SiRNA target sequence
tagaatattttggggtaaagtct

SEQ ID NO: 57221 - DNA, 23 bp, Artificial sequence
  SiRNA target sequence
agaatattttggggtaaagtctc

SEQ ID NO: 57222 - DNA, 23 bp, Artificial sequence
  SiRNA target sequence
gaatattttggggtaaagtctca

SEQ ID NO: 57223 - DNA, 23 bp, Artificial sequence
  SiRNA target sequence
aatattttggggtaaagtctcac

SEQ ID NO: 57224 - DNA, 23 bp, Artificial sequence
  SiRNA target sequence
atattttggggtaaagtctcaca

SEQ ID NO: 57225 - DNA, 23 bp, Artificial sequence
  SiRNA target sequence
tattttggggtaaagtctcacag

SEQ ID NO: 57226 - DNA, 23 bp, Artificial sequence
  SiRNA target sequence
attttggggtaaagtctcacaga

SEQ ID NO: 57227 - DNA, 23 bp, Artificial sequence
  SiRNA target sequence
ttttggggtaaagtctcacagaa

SEQ ID NO: 57228 - DNA, 23 bp, Artificial sequence
  SiRNA target sequence
tttggggtaaagtctcacagaat

SEQ ID NO: 57229 - DNA, 23 bp, Artificial sequence
  SiRNA target sequence
ttggggtaaagtctcacagaatt

SEQ ID NO: 57230 - DNA, 23 bp, Artificial sequence
  SiRNA target sequence
tggggtaaagtctcacagaattt

SEQ ID NO: 57231 - DNA, 23 bp, Artificial sequence
  SiRNA target sequence
ggggtaaagtctcacagaatttt

SEQ ID NO: 57232 - DNA, 23 bp, Artificial sequence
  SiRNA target sequence
gggtaaagtctcacagaattttg

SEQ ID NO: 57233 - DNA, 23 bp, Artificial sequence
  SiRNA target sequence
ggtaaagtctcacagaattttgt

SEQ ID NO: 57234 - DNA, 23 bp, Artificial sequence
  SiRNA target sequence
gtaaagtctcacagaattttgtt

SEQ ID NO: 57235 - DNA, 23 bp, Artificial sequence
  SiRNA target sequence
taaagtctcacagaattttgttc

SEQ ID NO: 57236 - DNA, 23 bp, Artificial sequence
  SiRNA target sequence
aaagtctcacagaattttgttct

SEQ ID NO: 57237 - DNA, 23 bp, Artificial sequence
  SiRNA target sequence
aagtctcacagaattttgttctc

SEQ ID NO: 57238 - DNA, 23 bp, Artificial sequence
  SiRNA target sequence
agtctcacagaattttgttctct

SEQ ID NO: 57239 - DNA, 23 bp, Artificial sequence
  SiRNA target sequence
gtctcacagaattttgttctctc

SEQ ID NO: 57240 - DNA, 23 bp, Artificial sequence
  SiRNA target sequence
tctcacagaattttgttctctct

SEQ ID NO: 57241 - DNA, 23 bp, Artificial sequence
  SiRNA target sequence
ctcacagaattttgttctctctt

SEQ ID NO: 57242 - DNA, 23 bp, Artificial sequence
  SiRNA target sequence
tcacagaattttgttctctcttt

SEQ ID NO: 57243 - DNA, 23 bp, Artificial sequence
  SiRNA target sequence
cacagaattttgttctctctttt

SEQ ID NO: 57244 - DNA, 23 bp, Artificial sequence
  SiRNA target sequence
acagaattttgttctctctttta

SEQ ID NO: 57245 - DNA, 23 bp, Artificial sequence
  SiRNA target sequence
cagaattttgttctctcttttat

SEQ ID NO: 57246 - DNA, 23 bp, Artificial sequence
  SiRNA target sequence
agaattttgttctctcttttata

SEQ ID NO: 57247 - DNA, 23 bp, Artificial sequence
  SiRNA target sequence
gaattttgttctctcttttatat

SEQ ID NO: 57248 - DNA, 23 bp, Artificial sequence
  SiRNA target sequence
aattttgttctctcttttatata

SEQ ID NO: 57249 - DNA, 23 bp, Artificial sequence
  SiRNA target sequence
attttgttctctcttttatatat

SEQ ID NO: 57250 - DNA, 23 bp, Artificial sequence
  SiRNA target sequence
ttttgttctctcttttatatata

SEQ ID NO: 57251 - DNA, 23 bp, Artificial sequence
  SiRNA target sequence
tttgttctctcttttatatatac

SEQ ID NO: 57252 - DNA, 23 bp, Artificial sequence
  SiRNA target sequence
ttgttctctcttttatatataca

SEQ ID NO: 57253 - DNA, 23 bp, Artificial sequence
  SiRNA target sequence
tgttctctcttttatatatacaa

SEQ ID NO: 57254 - DNA, 23 bp, Artificial sequence
  SiRNA target sequence
gttctctcttttatatatacaaa

SEQ ID NO: 57255 - DNA, 23 bp, Artificial sequence
  SiRNA target sequence
ttctctcttttatatatacaaaa

SEQ ID NO: 57256 - DNA, 23 bp, Artificial sequence
  SiRNA target sequence
tctctcttttatatatacaaaaa

SEQ ID NO: 57257 - DNA, 23 bp, Artificial sequence
  SiRNA target sequence
ctctcttttatatatacaaaaaa

SEQ ID NO: 57258 - DNA, 23 bp, Artificial sequence
  SiRNA target sequence
tctcttttatatatacaaaaaat

SEQ ID NO: 57259 - DNA, 23 bp, Artificial sequence
  SiRNA target sequence
ctcttttatatatacaaaaaatg

SEQ ID NO: 57260 - DNA, 23 bp, Artificial sequence
  SiRNA target sequence
tcttttatatatacaaaaaatga

SEQ ID NO: 57261 - DNA, 23 bp, Artificial sequence
  SiRNA target sequence
cttttatatatacaaaaaatgac

SEQ ID NO: 57262 - DNA, 23 bp, Artificial sequence
  SiRNA target sequence
ttttatatatacaaaaaatgaca

SEQ ID NO: 57263 - DNA, 23 bp, Artificial sequence
  SiRNA target sequence
tttatatatacaaaaaatgacat

SEQ ID NO: 57264 - DNA, 23 bp, Artificial sequence
  SiRNA target sequence
ttatatatacaaaaaatgacatt

SEQ ID NO: 57265 - DNA, 23 bp, Artificial sequence
  SiRNA target sequence
tatatatacaaaaaatgacattt

SEQ ID NO: 57266 - DNA, 23 bp, Artificial sequence
  SiRNA target sequence
atatatacaaaaaatgacatttg

SEQ ID NO: 57267 - DNA, 23 bp, Artificial sequence
  SiRNA target sequence
tatatacaaaaaatgacatttgc

SEQ ID NO: 57268 - DNA, 23 bp, Artificial sequence
  SiRNA target sequence
atatacaaaaaatgacatttgcg

SEQ ID NO: 57269 - DNA, 23 bp, Artificial sequence
  SiRNA target sequence
tatacaaaaaatgacatttgcga

SEQ ID NO: 57270 - DNA, 23 bp, Artificial sequence
  SiRNA target sequence
atacaaaaaatgacatttgcgat

SEQ ID NO: 57271 - DNA, 23 bp, Artificial sequence
  SiRNA target sequence
tacaaaaaatgacatttgcgata

SEQ ID NO: 57272 - DNA, 23 bp, Artificial sequence
  SiRNA target sequence
acaaaaaatgacatttgcgatac

SEQ ID NO: 57273 - DNA, 23 bp, Artificial sequence
  SiRNA target sequence
caaaaaatgacatttgcgataca

SEQ ID NO: 57274 - DNA, 23 bp, Artificial sequence
  SiRNA target sequence
aaaaaatgacatttgcgatacag

SEQ ID NO: 57275 - DNA, 23 bp, Artificial sequence
  SiRNA target sequence
aaaaatgacatttgcgatacagg

SEQ ID NO: 57276 - DNA, 23 bp, Artificial sequence
  SiRNA target sequence
aaaatgacatttgcgatacaggc

SEQ ID NO: 57277 - DNA, 23 bp, Artificial sequence
  SiRNA target sequence
aaatgacatttgcgatacaggca

SEQ ID NO: 57278 - DNA, 23 bp, Artificial sequence
  SiRNA target sequence
aatgacatttgcgatacaggcaa

SEQ ID NO: 57279 - DNA, 23 bp, Artificial sequence
  SiRNA target sequence
atgacatttgcgatacaggcaat

SEQ ID NO: 57280 - DNA, 23 bp, Artificial sequence
  SiRNA target sequence
tgacatttgcgatacaggcaatt

SEQ ID NO: 57281 - DNA, 23 bp, Artificial sequence
  SiRNA target sequence
gacatttgcgatacaggcaatta

SEQ ID NO: 57282 - DNA, 23 bp, Artificial sequence
  SiRNA target sequence
acatttgcgatacaggcaattat

SEQ ID NO: 57283 - DNA, 23 bp, Artificial sequence
  SiRNA target sequence
catttgcgatacaggcaattatt

SEQ ID NO: 57284 - DNA, 23 bp, Artificial sequence
  SiRNA target sequence
atttgcgatacaggcaattatta

SEQ ID NO: 57285 - DNA, 23 bp, Artificial sequence
  SiRNA target sequence
tttgcgatacaggcaattattat

SEQ ID NO: 57286 - DNA, 23 bp, Artificial sequence
  SiRNA target sequence
ttgcgatacaggcaattattatt

SEQ ID NO: 57287 - DNA, 23 bp, Artificial sequence
  SiRNA target sequence
tgcgatacaggcaattattatta

SEQ ID NO: 57288 - DNA, 23 bp, Artificial sequence
  SiRNA target sequence
gcgatacaggcaattattattat

SEQ ID NO: 57289 - DNA, 23 bp, Artificial sequence
  SiRNA target sequence
cgatacaggcaattattattatc

SEQ ID NO: 57290 - DNA, 23 bp, Artificial sequence
  SiRNA target sequence
gatacaggcaattattattatca

SEQ ID NO: 57291 - DNA, 23 bp, Artificial sequence
  SiRNA target sequence
atacaggcaattattattatcac

SEQ ID NO: 57292 - DNA, 23 bp, Artificial sequence
  SiRNA target sequence
tacaggcaattattattatcaca

SEQ ID NO: 57293 - DNA, 23 bp, Artificial sequence
  SiRNA target sequence
acaggcaattattattatcacat

SEQ ID NO: 57294 - DNA, 23 bp, Artificial sequence
  SiRNA target sequence
caggcaattattattatcacatt

SEQ ID NO: 57295 - DNA, 23 bp, Artificial sequence
  SiRNA target sequence
aggcaattattattatcacatta

SEQ ID NO: 57296 - DNA, 23 bp, Artificial sequence
  SiRNA target sequence
ggcaattattattatcacattag

SEQ ID NO: 57297 - DNA, 23 bp, Artificial sequence
  SiRNA target sequence
gcaattattattatcacattagg

SEQ ID NO: 57298 - DNA, 23 bp, Artificial sequence
  SiRNA target sequence
caattattattatcacattagga

SEQ ID NO: 57299 - DNA, 23 bp, Artificial sequence
  SiRNA target sequence
aattattattatcacattaggat

SEQ ID NO: 57300 - DNA, 23 bp, Artificial sequence
  SiRNA target sequence
attattattatcacattaggatc

SEQ ID NO: 57301 - DNA, 23 bp, Artificial sequence
  SiRNA target sequence
ttattattatcacattaggatct

SEQ ID NO: 57302 - DNA, 23 bp, Artificial sequence
  SiRNA target sequence
tattattatcacattaggatctt

SEQ ID NO: 57303 - DNA, 23 bp, Artificial sequence
  SiRNA target sequence
attattatcacattaggatcttt

SEQ ID NO: 57304 - DNA, 23 bp, Artificial sequence
  SiRNA target sequence
ttattatcacattaggatctttt

SEQ ID NO: 57305 - DNA, 23 bp, Artificial sequence
  SiRNA target sequence
tattatcacattaggatcttttg

SEQ ID NO: 57306 - DNA, 23 bp, Artificial sequence
  SiRNA target sequence
attatcacattaggatcttttgg

SEQ ID NO: 57307 - DNA, 23 bp, Artificial sequence
  SiRNA target sequence
ttatcacattaggatcttttgga

SEQ ID NO: 57308 - DNA, 23 bp, Artificial sequence
  SiRNA target sequence
tatcacattaggatcttttggat

SEQ ID NO: 57309 - DNA, 23 bp, Artificial sequence
  SiRNA target sequence
atcacattaggatcttttggata

SEQ ID NO: 57310 - DNA, 23 bp, Artificial sequence
  SiRNA target sequence
tcacattaggatcttttggatat

SEQ ID NO: 57311 - DNA, 23 bp, Artificial sequence
  SiRNA target sequence
cacattaggatcttttggatatt

SEQ ID NO: 57312 - DNA, 23 bp, Artificial sequence
  SiRNA target sequence
acattaggatcttttggatattt

SEQ ID NO: 57313 - DNA, 23 bp, Artificial sequence
  SiRNA target sequence
cattaggatcttttggatatttt

SEQ ID NO: 57314 - DNA, 23 bp, Artificial sequence
  SiRNA target sequence
attaggatcttttggatattttc

SEQ ID NO: 57315 - DNA, 23 bp, Artificial sequence
  SiRNA target sequence
ttaggatcttttggatattttcc

SEQ ID NO: 57316 - DNA, 23 bp, Artificial sequence
  SiRNA target sequence
taggatcttttggatattttccg

SEQ ID NO: 57317 - DNA, 23 bp, Artificial sequence
  SiRNA target sequence
aggatcttttggatattttccga

SEQ ID NO: 57318 - DNA, 23 bp, Artificial sequence
  SiRNA target sequence
ggatcttttggatattttccgat

SEQ ID NO: 57319 - DNA, 23 bp, Artificial sequence
  SiRNA target sequence
gatcttttggatattttccgatt

SEQ ID NO: 57320 - DNA, 23 bp, Artificial sequence
  SiRNA target sequence
atcttttggatattttccgatta

SEQ ID NO: 57321 - DNA, 23 bp, Artificial sequence
  SiRNA target sequence
tcttttggatattttccgattaa

SEQ ID NO: 57322 - DNA, 23 bp, Artificial sequence
  SiRNA target sequence
cttttggatattttccgattaaa

SEQ ID NO: 57323 - DNA, 23 bp, Artificial sequence
  SiRNA target sequence
ttttggatattttccgattaaat

SEQ ID NO: 57324 - DNA, 23 bp, Artificial sequence
  SiRNA target sequence
tttggatattttccgattaaatt

SEQ ID NO: 57325 - DNA, 23 bp, Artificial sequence
  SiRNA target sequence
ttggatattttccgattaaatta

SEQ ID NO: 57326 - DNA, 23 bp, Artificial sequence
  SiRNA target sequence
tggatattttccgattaaattat

SEQ ID NO: 57327 - DNA, 23 bp, Artificial sequence
  SiRNA target sequence
ggatattttccgattaaattatc

SEQ ID NO: 57328 - DNA, 23 bp, Artificial sequence
  SiRNA target sequence
gatattttccgattaaattatcc

SEQ ID NO: 57329 - DNA, 23 bp, Artificial sequence
  SiRNA target sequence
atattttccgattaaattatcct

SEQ ID NO: 57330 - DNA, 23 bp, Artificial sequence
  SiRNA target sequence
tattttccgattaaattatcctc

SEQ ID NO: 57331 - DNA, 23 bp, Artificial sequence
  SiRNA target sequence
attttccgattaaattatcctct

SEQ ID NO: 57332 - DNA, 23 bp, Artificial sequence
  SiRNA target sequence
ttttccgattaaattatcctctc

SEQ ID NO: 57333 - DNA, 23 bp, Artificial sequence
  SiRNA target sequence
tttccgattaaattatcctctca

SEQ ID NO: 57334 - DNA, 23 bp, Artificial sequence
  SiRNA target sequence
ttccgattaaattatcctctcaa

SEQ ID NO: 57335 - DNA, 23 bp, Artificial sequence
  SiRNA target sequence
tccgattaaattatcctctcaac

SEQ ID NO: 57336 - DNA, 23 bp, Artificial sequence
  SiRNA target sequence
ccgattaaattatcctctcaaca

SEQ ID NO: 57337 - DNA, 23 bp, Artificial sequence
  SiRNA target sequence
cgattaaattatcctctcaacag

SEQ ID NO: 57338 - DNA, 23 bp, Artificial sequence
  SiRNA target sequence
gattaaattatcctctcaacagt

SEQ ID NO: 57339 - DNA, 23 bp, Artificial sequence
  SiRNA target sequence
attaaattatcctctcaacagtt

SEQ ID NO: 57340 - DNA, 23 bp, Artificial sequence
  SiRNA target sequence
ttaaattatcctctcaacagtta

SEQ ID NO: 57341 - DNA, 23 bp, Artificial sequence
  SiRNA target sequence
taaattatcctctcaacagttag

SEQ ID NO: 57342 - DNA, 23 bp, Artificial sequence
  SiRNA target sequence
aaattatcctctcaacagttagt

SEQ ID NO: 57343 - DNA, 23 bp, Artificial sequence
  SiRNA target sequence
aattatcctctcaacagttagtc

SEQ ID NO: 57344 - DNA, 23 bp, Artificial sequence
  SiRNA target sequence
attatcctctcaacagttagtct

SEQ ID NO: 57345 - DNA, 23 bp, Artificial sequence
  SiRNA target sequence
ttatcctctcaacagttagtctt

SEQ ID NO: 57346 - DNA, 23 bp, Artificial sequence
  SiRNA target sequence
tatcctctcaacagttagtcttt

SEQ ID NO: 57347 - DNA, 23 bp, Artificial sequence
  SiRNA target sequence
atcctctcaacagttagtctttt

SEQ ID NO: 57348 - DNA, 23 bp, Artificial sequence
  SiRNA target sequence
tcctctcaacagttagtctttta

SEQ ID NO: 57349 - DNA, 23 bp, Artificial sequence
  SiRNA target sequence
cctctcaacagttagtcttttat

SEQ ID NO: 57350 - DNA, 23 bp, Artificial sequence
  SiRNA target sequence
ctctcaacagttagtcttttata

SEQ ID NO: 57351 - DNA, 23 bp, Artificial sequence
  SiRNA target sequence
tctcaacagttagtcttttatat

SEQ ID NO: 57352 - DNA, 23 bp, Artificial sequence
  SiRNA target sequence
ctcaacagttagtcttttatatt

SEQ ID NO: 57353 - DNA, 23 bp, Artificial sequence
  SiRNA target sequence
tcaacagttagtcttttatattt

SEQ ID NO: 57354 - DNA, 23 bp, Artificial sequence
  SiRNA target sequence
caacagttagtcttttatatttc

SEQ ID NO: 57355 - DNA, 23 bp, Artificial sequence
  SiRNA target sequence
aacagttagtcttttatatttcg

SEQ ID NO: 57356 - DNA, 23 bp, Artificial sequence
  SiRNA target sequence
acagttagtcttttatatttcga

SEQ ID NO: 57357 - DNA, 23 bp, Artificial sequence
  SiRNA target sequence
cagttagtcttttatatttcgat

SEQ ID NO: 57358 - DNA, 23 bp, Artificial sequence
  SiRNA target sequence
agttagtcttttatatttcgatt

SEQ ID NO: 57359 - DNA, 23 bp, Artificial sequence
  SiRNA target sequence
gttagtcttttatatttcgatta

SEQ ID NO: 57360 - DNA, 23 bp, Artificial sequence
  SiRNA target sequence
ttagtcttttatatttcgattag

SEQ ID NO: 57361 - DNA, 23 bp, Artificial sequence
  SiRNA target sequence
tagtcttttatatttcgattagt

SEQ ID NO: 57362 - DNA, 23 bp, Artificial sequence
  SiRNA target sequence
agtcttttatatttcgattagta

SEQ ID NO: 57363 - DNA, 23 bp, Artificial sequence
  SiRNA target sequence
gtcttttatatttcgattagtaa

SEQ ID NO: 57364 - DNA, 23 bp, Artificial sequence
  SiRNA target sequence
tcttttatatttcgattagtaaa

SEQ ID NO: 57365 - DNA, 23 bp, Artificial sequence
  SiRNA target sequence
cttttatatttcgattagtaaaa

SEQ ID NO: 57366 - DNA, 23 bp, Artificial sequence
  SiRNA target sequence
ttttatatttcgattagtaaaac

SEQ ID NO: 57367 - DNA, 23 bp, Artificial sequence
  SiRNA target sequence
tttatatttcgattagtaaaacg

SEQ ID NO: 57368 - DNA, 23 bp, Artificial sequence
  SiRNA target sequence
ttatatttcgattagtaaaacgt

SEQ ID NO: 57369 - DNA, 23 bp, Artificial sequence
  SiRNA target sequence
tatatttcgattagtaaaacgtt

SEQ ID NO: 57370 - DNA, 23 bp, Artificial sequence
  SiRNA target sequence
atatttcgattagtaaaacgttg

SEQ ID NO: 57371 - DNA, 23 bp, Artificial sequence
  SiRNA target sequence
tatttcgattagtaaaacgttga

SEQ ID NO: 57372 - DNA, 23 bp, Artificial sequence
  SiRNA target sequence
atttcgattagtaaaacgttgac

SEQ ID NO: 57373 - DNA, 23 bp, Artificial sequence
  SiRNA target sequence
tttcgattagtaaaacgttgaca

SEQ ID NO: 57374 - DNA, 23 bp, Artificial sequence
  SiRNA target sequence
ttcgattagtaaaacgttgacaa

SEQ ID NO: 57375 - DNA, 23 bp, Artificial sequence
  SiRNA target sequence
tcgattagtaaaacgttgacaaa

SEQ ID NO: 57376 - DNA, 23 bp, Artificial sequence
  SiRNA target sequence
cgattagtaaaacgttgacaaat

SEQ ID NO: 57377 - DNA, 23 bp, Artificial sequence
  SiRNA target sequence
gattagtaaaacgttgacaaatt

SEQ ID NO: 57378 - DNA, 23 bp, Artificial sequence
  SiRNA target sequence
attagtaaaacgttgacaaattc

SEQ ID NO: 57379 - DNA, 23 bp, Artificial sequence
  SiRNA target sequence
ttagtaaaacgttgacaaattcg

SEQ ID NO: 57380 - DNA, 23 bp, Artificial sequence
  SiRNA target sequence
tagtaaaacgttgacaaattcgt

SEQ ID NO: 57381 - DNA, 23 bp, Artificial sequence
  SiRNA target sequence
agtaaaacgttgacaaattcgtt

SEQ ID NO: 57382 - DNA, 23 bp, Artificial sequence
  SiRNA target sequence
gtaaaacgttgacaaattcgttg

SEQ ID NO: 57383 - DNA, 23 bp, Artificial sequence
  SiRNA target sequence
taaaacgttgacaaattcgttga

SEQ ID NO: 57384 - DNA, 23 bp, Artificial sequence
  SiRNA target sequence
aaaacgttgacaaattcgttgag

SEQ ID NO: 57385 - DNA, 23 bp, Artificial sequence
  SiRNA target sequence
aaacgttgacaaattcgttgagc

SEQ ID NO: 57386 - DNA, 23 bp, Artificial sequence
  SiRNA target sequence
aacgttgacaaattcgttgagcg

SEQ ID NO: 57387 - DNA, 23 bp, Artificial sequence
  SiRNA target sequence
acgttgacaaattcgttgagcga

SEQ ID NO: 57388 - DNA, 23 bp, Artificial sequence
  SiRNA target sequence
cgttgacaaattcgttgagcgaa

SEQ ID NO: 57389 - DNA, 23 bp, Artificial sequence
  SiRNA target sequence
gttgacaaattcgttgagcgaaa

SEQ ID NO: 57390 - DNA, 23 bp, Artificial sequence
  SiRNA target sequence
ttgacaaattcgttgagcgaaat

SEQ ID NO: 57391 - DNA, 23 bp, Artificial sequence
  SiRNA target sequence
tgacaaattcgttgagcgaaatg

SEQ ID NO: 57392 - DNA, 23 bp, Artificial sequence
  SiRNA target sequence
gacaaattcgttgagcgaaatgg

SEQ ID NO: 57393 - DNA, 23 bp, Artificial sequence
  SiRNA target sequence
acaaattcgttgagcgaaatggg

SEQ ID NO: 57394 - DNA, 23 bp, Artificial sequence
  SiRNA target sequence
caaattcgttgagcgaaatggga

SEQ ID NO: 57395 - DNA, 23 bp, Artificial sequence
  SiRNA target sequence
aaattcgttgagcgaaatgggaa

SEQ ID NO: 57396 - DNA, 23 bp, Artificial sequence
  SiRNA target sequence
aattcgttgagcgaaatgggaat

SEQ ID NO: 57397 - DNA, 23 bp, Artificial sequence
  SiRNA target sequence
attcgttgagcgaaatgggaatg

SEQ ID NO: 57398 - DNA, 23 bp, Artificial sequence
  SiRNA target sequence
ttcgttgagcgaaatgggaatgc

SEQ ID NO: 57399 - DNA, 23 bp, Artificial sequence
  SiRNA target sequence
tcgttgagcgaaatgggaatgct

SEQ ID NO: 57400 - DNA, 23 bp, Artificial sequence
  SiRNA target sequence
cgttgagcgaaatgggaatgcta

SEQ ID NO: 57401 - DNA, 23 bp, Artificial sequence
  SiRNA target sequence
gttgagcgaaatgggaatgctat

SEQ ID NO: 57402 - DNA, 23 bp, Artificial sequence
  SiRNA target sequence
ttgagcgaaatgggaatgctata

SEQ ID NO: 57403 - DNA, 23 bp, Artificial sequence
  SiRNA target sequence
tgagcgaaatgggaatgctatac

SEQ ID NO: 57404 - DNA, 23 bp, Artificial sequence
  SiRNA target sequence
gagcgaaatgggaatgctataca

SEQ ID NO: 57405 - DNA, 23 bp, Artificial sequence
  SiRNA target sequence
agcgaaatgggaatgctatacac

SEQ ID NO: 57406 - DNA, 23 bp, Artificial sequence
  SiRNA target sequence
gcgaaatgggaatgctatacaca

SEQ ID NO: 57407 - DNA, 23 bp, Artificial sequence
  SiRNA target sequence
cgaaatgggaatgctatacacaa

SEQ ID NO: 57408 - DNA, 23 bp, Artificial sequence
  SiRNA target sequence
gaaatgggaatgctatacacaag

SEQ ID NO: 57409 - DNA, 23 bp, Artificial sequence
  SiRNA target sequence
aaatgggaatgctatacacaaga

SEQ ID NO: 57410 - DNA, 23 bp, Artificial sequence
  SiRNA target sequence
aatgggaatgctatacacaagat

SEQ ID NO: 57411 - DNA, 23 bp, Artificial sequence
  SiRNA target sequence
atgggaatgctatacacaagata

SEQ ID NO: 57412 - DNA, 23 bp, Artificial sequence
  SiRNA target sequence
tgggaatgctatacacaagatat

SEQ ID NO: 57413 - DNA, 23 bp, Artificial sequence
  SiRNA target sequence
gggaatgctatacacaagatatg

SEQ ID NO: 57414 - DNA, 23 bp, Artificial sequence
  SiRNA target sequence
ggaatgctatacacaagatatgt

SEQ ID NO: 57415 - DNA, 23 bp, Artificial sequence
  SiRNA target sequence
gaatgctatacacaagatatgta

SEQ ID NO: 57416 - DNA, 23 bp, Artificial sequence
  SiRNA target sequence
aatgctatacacaagatatgtac

SEQ ID NO: 57417 - DNA, 23 bp, Artificial sequence
  SiRNA target sequence
atgctatacacaagatatgtaca

SEQ ID NO: 57418 - DNA, 23 bp, Artificial sequence
  SiRNA target sequence
tgctatacacaagatatgtacaa

SEQ ID NO: 57419 - DNA, 23 bp, Artificial sequence
  SiRNA target sequence
gctatacacaagatatgtacaag

SEQ ID NO: 57420 - DNA, 23 bp, Artificial sequence
  SiRNA target sequence
ctatacacaagatatgtacaagg

SEQ ID NO: 57421 - DNA, 23 bp, Artificial sequence
  SiRNA target sequence
tatacacaagatatgtacaagga

SEQ ID NO: 57422 - DNA, 23 bp, Artificial sequence
  SiRNA target sequence
atacacaagatatgtacaaggat

SEQ ID NO: 57423 - DNA, 23 bp, Artificial sequence
  SiRNA target sequence
tacacaagatatgtacaaggatt

SEQ ID NO: 57424 - DNA, 23 bp, Artificial sequence
  SiRNA target sequence
acacaagatatgtacaaggattt

SEQ ID NO: 57425 - DNA, 23 bp, Artificial sequence
  SiRNA target sequence
cacaagatatgtacaaggatttt

SEQ ID NO: 57426 - DNA, 23 bp, Artificial sequence
  SiRNA target sequence
acaagatatgtacaaggattttt

SEQ ID NO: 57427 - DNA, 23 bp, Artificial sequence
  SiRNA target sequence
caagatatgtacaaggattttta

SEQ ID NO: 57428 - DNA, 23 bp, Artificial sequence
  SiRNA target sequence
aagatatgtacaaggatttttaa

SEQ ID NO: 57429 - DNA, 23 bp, Artificial sequence
  SiRNA target sequence
agatatgtacaaggatttttaaa

SEQ ID NO: 57430 - DNA, 23 bp, Artificial sequence
  SiRNA target sequence
gatatgtacaaggatttttaaat

SEQ ID NO: 57431 - DNA, 23 bp, Artificial sequence
  SiRNA target sequence
atatgtacaaggatttttaaatg

SEQ ID NO: 57432 - DNA, 23 bp, Artificial sequence
  SiRNA target sequence
tatgtacaaggatttttaaatgc

SEQ ID NO: 57433 - DNA, 23 bp, Artificial sequence
  SiRNA target sequence
atgtacaaggatttttaaatgca

SEQ ID NO: 57434 - DNA, 23 bp, Artificial sequence
  SiRNA target sequence
tgtacaaggatttttaaatgcaa

SEQ ID NO: 57435 - DNA, 23 bp, Artificial sequence
  SiRNA target sequence
gtacaaggatttttaaatgcaaa

SEQ ID NO: 57436 - DNA, 23 bp, Artificial sequence
  SiRNA target sequence
tacaaggatttttaaatgcaaag

SEQ ID NO: 57437 - DNA, 23 bp, Artificial sequence
  SiRNA target sequence
acaaggatttttaaatgcaaagt

SEQ ID NO: 57438 - DNA, 23 bp, Artificial sequence
  SiRNA target sequence
caaggatttttaaatgcaaagtc

SEQ ID NO: 57439 - DNA, 23 bp, Artificial sequence
  SiRNA target sequence
aaggatttttaaatgcaaagtct

SEQ ID NO: 57440 - DNA, 23 bp, Artificial sequence
  SiRNA target sequence
aggatttttaaatgcaaagtctg

SEQ ID NO: 57441 - DNA, 23 bp, Artificial sequence
  SiRNA target sequence
ggatttttaaatgcaaagtctgg

SEQ ID NO: 57442 - DNA, 23 bp, Artificial sequence
  SiRNA target sequence
gatttttaaatgcaaagtctgga

SEQ ID NO: 57443 - DNA, 23 bp, Artificial sequence
  SiRNA target sequence
atttttaaatgcaaagtctggat

SEQ ID NO: 57444 - DNA, 23 bp, Artificial sequence
  SiRNA target sequence
tttttaaatgcaaagtctggata

SEQ ID NO: 57445 - DNA, 23 bp, Artificial sequence
  SiRNA target sequence
ttttaaatgcaaagtctggatat

SEQ ID NO: 57446 - DNA, 23 bp, Artificial sequence
  SiRNA target sequence
tttaaatgcaaagtctggatatt

SEQ ID NO: 57447 - DNA, 23 bp, Artificial sequence
  SiRNA target sequence
ttaaatgcaaagtctggatatta

SEQ ID NO: 57448 - DNA, 23 bp, Artificial sequence
  SiRNA target sequence
taaatgcaaagtctggatattac

SEQ ID NO: 57449 - DNA, 23 bp, Artificial sequence
  SiRNA target sequence
aaatgcaaagtctggatattacg

SEQ ID NO: 57450 - DNA, 23 bp, Artificial sequence
  SiRNA target sequence
aatgcaaagtctggatattacga

SEQ ID NO: 57451 - DNA, 23 bp, Artificial sequence
  SiRNA target sequence
atgcaaagtctggatattacgag

SEQ ID NO: 57452 - DNA, 23 bp, Artificial sequence
  SiRNA target sequence
tgcaaagtctggatattacgagt

SEQ ID NO: 57453 - DNA, 23 bp, Artificial sequence
  SiRNA target sequence
gcaaagtctggatattacgagtt

SEQ ID NO: 57454 - DNA, 23 bp, Artificial sequence
  SiRNA target sequence
caaagtctggatattacgagttt

SEQ ID NO: 57455 - DNA, 23 bp, Artificial sequence
  SiRNA target sequence
aaagtctggatattacgagttta

SEQ ID NO: 57456 - DNA, 23 bp, Artificial sequence
  SiRNA target sequence
aagtctggatattacgagtttaa

SEQ ID NO: 57457 - DNA, 23 bp, Artificial sequence
  SiRNA target sequence
agtctggatattacgagtttaaa

SEQ ID NO: 57458 - DNA, 23 bp, Artificial sequence
  SiRNA target sequence
gtctggatattacgagtttaaag

SEQ ID NO: 57459 - DNA, 23 bp, Artificial sequence
  SiRNA target sequence
tctggatattacgagtttaaaga

SEQ ID NO: 57460 - DNA, 23 bp, Artificial sequence
  SiRNA target sequence
ctggatattacgagtttaaagag

SEQ ID NO: 57461 - DNA, 23 bp, Artificial sequence
  SiRNA target sequence
tggatattacgagtttaaagagg

SEQ ID NO: 57462 - DNA, 23 bp, Artificial sequence
  SiRNA target sequence
ggatattacgagtttaaagagga

SEQ ID NO: 57463 - DNA, 23 bp, Artificial sequence
  SiRNA target sequence
gatattacgagtttaaagaggat

SEQ ID NO: 57464 - DNA, 23 bp, Artificial sequence
  SiRNA target sequence
atattacgagtttaaagaggata

SEQ ID NO: 57465 - DNA, 23 bp, Artificial sequence
  SiRNA target sequence
tattacgagtttaaagaggatac

SEQ ID NO: 57466 - DNA, 23 bp, Artificial sequence
  SiRNA target sequence
attacgagtttaaagaggataca

SEQ ID NO: 57467 - DNA, 23 bp, Artificial sequence
  SiRNA target sequence
ttacgagtttaaagaggatacac

SEQ ID NO: 57468 - DNA, 23 bp, Artificial sequence
  SiRNA target sequence
tacgagtttaaagaggatacaca

SEQ ID NO: 57469 - DNA, 23 bp, Artificial sequence
  SiRNA target sequence
acgagtttaaagaggatacacaa

SEQ ID NO: 57470 - DNA, 23 bp, Artificial sequence
  SiRNA target sequence
cgagtttaaagaggatacacaaa

SEQ ID NO: 57471 - DNA, 23 bp, Artificial sequence
  SiRNA target sequence
gagtttaaagaggatacacaaac

SEQ ID NO: 57472 - DNA, 23 bp, Artificial sequence
  SiRNA target sequence
agtttaaagaggatacacaaact

SEQ ID NO: 57473 - DNA, 23 bp, Artificial sequence
  SiRNA target sequence
gtttaaagaggatacacaaactg

SEQ ID NO: 57474 - DNA, 23 bp, Artificial sequence
  SiRNA target sequence
tttaaagaggatacacaaactga

SEQ ID NO: 57475 - DNA, 23 bp, Artificial sequence
  SiRNA target sequence
ttaaagaggatacacaaactgat

SEQ ID NO: 57476 - DNA, 23 bp, Artificial sequence
  SiRNA target sequence
taaagaggatacacaaactgata

SEQ ID NO: 57477 - DNA, 23 bp, Artificial sequence
  SiRNA target sequence
aaagaggatacacaaactgataa

SEQ ID NO: 57478 - DNA, 23 bp, Artificial sequence
  SiRNA target sequence
aagaggatacacaaactgataaa

SEQ ID NO: 57479 - DNA, 23 bp, Artificial sequence
  SiRNA target sequence
agaggatacacaaactgataaaa

SEQ ID NO: 57480 - DNA, 23 bp, Artificial sequence
  SiRNA target sequence
gaggatacacaaactgataaaat

SEQ ID NO: 57481 - DNA, 23 bp, Artificial sequence
  SiRNA target sequence
aggatacacaaactgataaaata

SEQ ID NO: 57482 - DNA, 23 bp, Artificial sequence
  SiRNA target sequence
ggatacacaaactgataaaataa

SEQ ID NO: 57483 - DNA, 23 bp, Artificial sequence
  SiRNA target sequence
gatacacaaactgataaaataag

SEQ ID NO: 57484 - DNA, 23 bp, Artificial sequence
  SiRNA target sequence
atacacaaactgataaaataaga

SEQ ID NO: 57485 - DNA, 23 bp, Artificial sequence
  SiRNA target sequence
tacacaaactgataaaataagac

SEQ ID NO: 57486 - DNA, 23 bp, Artificial sequence
  SiRNA target sequence
acacaaactgataaaataagact

SEQ ID NO: 57487 - DNA, 23 bp, Artificial sequence
  SiRNA target sequence
cacaaactgataaaataagactg

SEQ ID NO: 57488 - DNA, 23 bp, Artificial sequence
  SiRNA target sequence
acaaactgataaaataagactga

SEQ ID NO: 57489 - DNA, 23 bp, Artificial sequence
  SiRNA target sequence
caaactgataaaataagactgat

SEQ ID NO: 57490 - DNA, 23 bp, Artificial sequence
  SiRNA target sequence
aaactgataaaataagactgata

SEQ ID NO: 57491 - DNA, 23 bp, Artificial sequence
  SiRNA target sequence
aactgataaaataagactgatag

SEQ ID NO: 57492 - DNA, 23 bp, Artificial sequence
  SiRNA target sequence
actgataaaataagactgataga

SEQ ID NO: 57493 - DNA, 23 bp, Artificial sequence
  SiRNA target sequence
ctgataaaataagactgatagat

SEQ ID NO: 57494 - DNA, 23 bp, Artificial sequence
  SiRNA target sequence
tgataaaataagactgatagatt

SEQ ID NO: 57495 - DNA, 23 bp, Artificial sequence
  SiRNA target sequence
gataaaataagactgatagattt

SEQ ID NO: 57496 - DNA, 23 bp, Artificial sequence
  SiRNA target sequence
ataaaataagactgatagatttt

SEQ ID NO: 57497 - DNA, 23 bp, Artificial sequence
  SiRNA target sequence
taaaataagactgatagatttta

SEQ ID NO: 57498 - DNA, 23 bp, Artificial sequence
  SiRNA target sequence
aaaataagactgatagattttaa

SEQ ID NO: 57499 - DNA, 23 bp, Artificial sequence
  SiRNA target sequence
aaataagactgatagattttaat

SEQ ID NO: 57500 - DNA, 23 bp, Artificial sequence
  SiRNA target sequence
aataagactgatagattttaatg

SEQ ID NO: 57501 - DNA, 23 bp, Artificial sequence
  SiRNA target sequence
ataagactgatagattttaatga

SEQ ID NO: 57502 - DNA, 23 bp, Artificial sequence
  SiRNA target sequence
taagactgatagattttaatgaa

SEQ ID NO: 57503 - DNA, 23 bp, Artificial sequence
  SiRNA target sequence
aagactgatagattttaatgaaa

SEQ ID NO: 57504 - DNA, 23 bp, Artificial sequence
  SiRNA target sequence
agactgatagattttaatgaaaa

SEQ ID NO: 57505 - DNA, 23 bp, Artificial sequence
  SiRNA target sequence
gactgatagattttaatgaaaag

SEQ ID NO: 57506 - DNA, 23 bp, Artificial sequence
  SiRNA target sequence
actgatagattttaatgaaaagc

SEQ ID NO: 57507 - DNA, 23 bp, Artificial sequence
  SiRNA target sequence
ctgatagattttaatgaaaagct

SEQ ID NO: 57508 - DNA, 23 bp, Artificial sequence
  SiRNA target sequence
tgatagattttaatgaaaagcta

SEQ ID NO: 57509 - DNA, 23 bp, Artificial sequence
  SiRNA target sequence
gatagattttaatgaaaagctag

SEQ ID NO: 57510 - DNA, 23 bp, Artificial sequence
  SiRNA target sequence
atagattttaatgaaaagctaga

SEQ ID NO: 57511 - DNA, 23 bp, Artificial sequence
  SiRNA target sequence
tagattttaatgaaaagctagaa

SEQ ID NO: 57512 - DNA, 23 bp, Artificial sequence
  SiRNA target sequence
agattttaatgaaaagctagaat

SEQ ID NO: 57513 - DNA, 23 bp, Artificial sequence
  SiRNA target sequence
gattttaatgaaaagctagaatt

SEQ ID NO: 57514 - DNA, 23 bp, Artificial sequence
  SiRNA target sequence
attttaatgaaaagctagaattt

SEQ ID NO: 57515 - DNA, 23 bp, Artificial sequence
  SiRNA target sequence
ttttaatgaaaagctagaattta

SEQ ID NO: 57516 - DNA, 23 bp, Artificial sequence
  SiRNA target sequence
tttaatgaaaagctagaatttag

SEQ ID NO: 57517 - DNA, 23 bp, Artificial sequence
  SiRNA target sequence
ttaatgaaaagctagaatttaga

SEQ ID NO: 57518 - DNA, 23 bp, Artificial sequence
  SiRNA target sequence
taatgaaaagctagaatttagaa

SEQ ID NO: 57519 - DNA, 23 bp, Artificial sequence
  SiRNA target sequence
aatgaaaagctagaatttagaaa

SEQ ID NO: 57520 - DNA, 23 bp, Artificial sequence
  SiRNA target sequence
atgaaaagctagaatttagaaat

SEQ ID NO: 57521 - DNA, 23 bp, Artificial sequence
  SiRNA target sequence
tgaaaagctagaatttagaaatg

SEQ ID NO: 57522 - DNA, 23 bp, Artificial sequence
  SiRNA target sequence
gaaaagctagaatttagaaatgt

SEQ ID NO: 57523 - DNA, 23 bp, Artificial sequence
  SiRNA target sequence
aaaagctagaatttagaaatgta

SEQ ID NO: 57524 - DNA, 23 bp, Artificial sequence
  SiRNA target sequence
aaagctagaatttagaaatgtat

SEQ ID NO: 57525 - DNA, 23 bp, Artificial sequence
  SiRNA target sequence
aagctagaatttagaaatgtatc

SEQ ID NO: 57526 - DNA, 23 bp, Artificial sequence
  SiRNA target sequence
agctagaatttagaaatgtatct

SEQ ID NO: 57527 - DNA, 23 bp, Artificial sequence
  SiRNA target sequence
gctagaatttagaaatgtatctt

SEQ ID NO: 57528 - DNA, 23 bp, Artificial sequence
  SiRNA target sequence
ctagaatttagaaatgtatcttt

SEQ ID NO: 57529 - DNA, 23 bp, Artificial sequence
  SiRNA target sequence
tagaatttagaaatgtatctttt

SEQ ID NO: 57530 - DNA, 23 bp, Artificial sequence
  SiRNA target sequence
agaatttagaaatgtatctttta

SEQ ID NO: 57531 - DNA, 23 bp, Artificial sequence
  SiRNA target sequence
gaatttagaaatgtatcttttag

SEQ ID NO: 57532 - DNA, 23 bp, Artificial sequence
  SiRNA target sequence
aatttagaaatgtatcttttagt

SEQ ID NO: 57533 - DNA, 23 bp, Artificial sequence
  SiRNA target sequence
atttagaaatgtatcttttagtt

SEQ ID NO: 57534 - DNA, 23 bp, Artificial sequence
  SiRNA target sequence
tttagaaatgtatcttttagtta

SEQ ID NO: 57535 - DNA, 23 bp, Artificial sequence
  SiRNA target sequence
ttagaaatgtatcttttagttat

SEQ ID NO: 57536 - DNA, 23 bp, Artificial sequence
  SiRNA target sequence
tagaaatgtatcttttagttatt

SEQ ID NO: 57537 - DNA, 23 bp, Artificial sequence
  SiRNA target sequence
agaaatgtatcttttagttattt

SEQ ID NO: 57538 - DNA, 23 bp, Artificial sequence
  SiRNA target sequence
gaaatgtatcttttagttattta

SEQ ID NO: 57539 - DNA, 23 bp, Artificial sequence
  SiRNA target sequence
aaatgtatcttttagttatttaa

SEQ ID NO: 57540 - DNA, 23 bp, Artificial sequence
  SiRNA target sequence
aatgtatcttttagttatttaaa

SEQ ID NO: 57541 - DNA, 23 bp, Artificial sequence
  SiRNA target sequence
atgtatcttttagttatttaaat

SEQ ID NO: 57542 - DNA, 23 bp, Artificial sequence
  SiRNA target sequence
tgtatcttttagttatttaaata

SEQ ID NO: 57543 - DNA, 23 bp, Artificial sequence
  SiRNA target sequence
gtatcttttagttatttaaataa

SEQ ID NO: 57544 - DNA, 23 bp, Artificial sequence
  SiRNA target sequence
tatcttttagttatttaaataag

SEQ ID NO: 57545 - DNA, 23 bp, Artificial sequence
  SiRNA target sequence
atcttttagttatttaaataagc

SEQ ID NO: 57546 - DNA, 23 bp, Artificial sequence
  SiRNA target sequence
tcttttagttatttaaataagcc

SEQ ID NO: 57547 - DNA, 23 bp, Artificial sequence
  SiRNA target sequence
cttttagttatttaaataagcct

SEQ ID NO: 57548 - DNA, 23 bp, Artificial sequence
  SiRNA target sequence
ttttagttatttaaataagccta

SEQ ID NO: 57549 - DNA, 23 bp, Artificial sequence
  SiRNA target sequence
tttagttatttaaataagcctat

SEQ ID NO: 57550 - DNA, 23 bp, Artificial sequence
  SiRNA target sequence
ttagttatttaaataagcctatt

SEQ ID NO: 57551 - DNA, 23 bp, Artificial sequence
  SiRNA target sequence
tagttatttaaataagcctattt

SEQ ID NO: 57552 - DNA, 23 bp, Artificial sequence
  SiRNA target sequence
agttatttaaataagcctatttt

SEQ ID NO: 57553 - DNA, 23 bp, Artificial sequence
  SiRNA target sequence
gttatttaaataagcctatttta

SEQ ID NO: 57554 - DNA, 23 bp, Artificial sequence
  SiRNA target sequence
ttatttaaataagcctattttag

SEQ ID NO: 57555 - DNA, 23 bp, Artificial sequence
  SiRNA target sequence
tatttaaataagcctattttagt

SEQ ID NO: 57556 - DNA, 23 bp, Artificial sequence
  SiRNA target sequence
atttaaataagcctattttagtg

SEQ ID NO: 57557 - DNA, 23 bp, Artificial sequence
  SiRNA target sequence
tttaaataagcctattttagtga

SEQ ID NO: 57558 - DNA, 23 bp, Artificial sequence
  SiRNA target sequence
ttaaataagcctattttagtgaa

SEQ ID NO: 57559 - DNA, 23 bp, Artificial sequence
  SiRNA target sequence
taaataagcctattttagtgaat

SEQ ID NO: 57560 - DNA, 23 bp, Artificial sequence
  SiRNA target sequence
aaataagcctattttagtgaatg

SEQ ID NO: 57561 - DNA, 23 bp, Artificial sequence
  SiRNA target sequence
aataagcctattttagtgaatgc

SEQ ID NO: 57562 - DNA, 23 bp, Artificial sequence
  SiRNA target sequence
ataagcctattttagtgaatgct

SEQ ID NO: 57563 - DNA, 23 bp, Artificial sequence
  SiRNA target sequence
taagcctattttagtgaatgcta

SEQ ID NO: 57564 - DNA, 23 bp, Artificial sequence
  SiRNA target sequence
aagcctattttagtgaatgctaa

SEQ ID NO: 57565 - DNA, 23 bp, Artificial sequence
  SiRNA target sequence
agcctattttagtgaatgctaat

SEQ ID NO: 57566 - DNA, 23 bp, Artificial sequence
  SiRNA target sequence
gcctattttagtgaatgctaatt

SEQ ID NO: 57567 - DNA, 23 bp, Artificial sequence
  SiRNA target sequence
cctattttagtgaatgctaattt

SEQ ID NO: 57568 - DNA, 23 bp, Artificial sequence
  SiRNA target sequence
ctattttagtgaatgctaatttc

SEQ ID NO: 57569 - DNA, 23 bp, Artificial sequence
  SiRNA target sequence
tattttagtgaatgctaatttcg

SEQ ID NO: 57570 - DNA, 23 bp, Artificial sequence
  SiRNA target sequence
attttagtgaatgctaatttcgt

SEQ ID NO: 57571 - DNA, 23 bp, Artificial sequence
  SiRNA target sequence
ttttagtgaatgctaatttcgtt

SEQ ID NO: 57572 - DNA, 23 bp, Artificial sequence
  SiRNA target sequence
tttagtgaatgctaatttcgtta

SEQ ID NO: 57573 - DNA, 23 bp, Artificial sequence
  SiRNA target sequence
ttagtgaatgctaatttcgttat

SEQ ID NO: 57574 - DNA, 23 bp, Artificial sequence
  SiRNA target sequence
tagtgaatgctaatttcgttatt

SEQ ID NO: 57575 - DNA, 23 bp, Artificial sequence
  SiRNA target sequence
agtgaatgctaatttcgttatta

SEQ ID NO: 57576 - DNA, 23 bp, Artificial sequence
  SiRNA target sequence
gtgaatgctaatttcgttattaa

SEQ ID NO: 57577 - DNA, 23 bp, Artificial sequence
  SiRNA target sequence
tgaatgctaatttcgttattaat

SEQ ID NO: 57578 - DNA, 23 bp, Artificial sequence
  SiRNA target sequence
gaatgctaatttcgttattaata

SEQ ID NO: 57579 - DNA, 23 bp, Artificial sequence
  SiRNA target sequence
aatgctaatttcgttattaataa

SEQ ID NO: 57580 - DNA, 23 bp, Artificial sequence
  SiRNA target sequence
atgctaatttcgttattaataaa

SEQ ID NO: 57581 - DNA, 23 bp, Artificial sequence
  SiRNA target sequence
tgctaatttcgttattaataaag

SEQ ID NO: 57582 - DNA, 23 bp, Artificial sequence
  SiRNA target sequence
gctaatttcgttattaataaagg

SEQ ID NO: 57583 - DNA, 23 bp, Artificial sequence
  SiRNA target sequence
ctaatttcgttattaataaaggg

SEQ ID NO: 57584 - DNA, 23 bp, Artificial sequence
  SiRNA target sequence
taatttcgttattaataaagggg

SEQ ID NO: 57585 - DNA, 23 bp, Artificial sequence
  SiRNA target sequence
aatttcgttattaataaagggga

SEQ ID NO: 57586 - DNA, 23 bp, Artificial sequence
  SiRNA target sequence
atttcgttattaataaaggggag

SEQ ID NO: 57587 - DNA, 23 bp, Artificial sequence
  SiRNA target sequence
tttcgttattaataaaggggagc

SEQ ID NO: 57588 - DNA, 23 bp, Artificial sequence
  SiRNA target sequence
ttcgttattaataaaggggagcg

SEQ ID NO: 57589 - DNA, 23 bp, Artificial sequence
  SiRNA target sequence
tcgttattaataaaggggagcgt

SEQ ID NO: 57590 - DNA, 23 bp, Artificial sequence
  SiRNA target sequence
cgttattaataaaggggagcgtg

SEQ ID NO: 57591 - DNA, 23 bp, Artificial sequence
  SiRNA target sequence
gttattaataaaggggagcgtgt

SEQ ID NO: 57592 - DNA, 23 bp, Artificial sequence
  SiRNA target sequence
ttattaataaaggggagcgtgtt

SEQ ID NO: 57593 - DNA, 23 bp, Artificial sequence
  SiRNA target sequence
tattaataaaggggagcgtgttg

SEQ ID NO: 57594 - DNA, 23 bp, Artificial sequence
  SiRNA target sequence
attaataaaggggagcgtgttgc

SEQ ID NO: 57595 - DNA, 23 bp, Artificial sequence
  SiRNA target sequence
ttaataaaggggagcgtgttgct

SEQ ID NO: 57596 - DNA, 23 bp, Artificial sequence
  SiRNA target sequence
taataaaggggagcgtgttgcta

SEQ ID NO: 57597 - DNA, 23 bp, Artificial sequence
  SiRNA target sequence
aataaaggggagcgtgttgctat

SEQ ID NO: 57598 - DNA, 23 bp, Artificial sequence
  SiRNA target sequence
ataaaggggagcgtgttgctatt

SEQ ID NO: 57599 - DNA, 23 bp, Artificial sequence
  SiRNA target sequence
taaaggggagcgtgttgctatta

SEQ ID NO: 57600 - DNA, 23 bp, Artificial sequence
  SiRNA target sequence
aaaggggagcgtgttgctattat

SEQ ID NO: 57601 - DNA, 23 bp, Artificial sequence
  SiRNA target sequence
aaggggagcgtgttgctattata

SEQ ID NO: 57602 - DNA, 23 bp, Artificial sequence
  SiRNA target sequence
aggggagcgtgttgctattatag

SEQ ID NO: 57603 - DNA, 23 bp, Artificial sequence
  SiRNA target sequence
ggggagcgtgttgctattatagg

SEQ ID NO: 57604 - DNA, 23 bp, Artificial sequence
  SiRNA target sequence
gggagcgtgttgctattatagga

SEQ ID NO: 57605 - DNA, 23 bp, Artificial sequence
  SiRNA target sequence
ggagcgtgttgctattataggaa

SEQ ID NO: 57606 - DNA, 23 bp, Artificial sequence
  SiRNA target sequence
gagcgtgttgctattataggaaa

SEQ ID NO: 57607 - DNA, 23 bp, Artificial sequence
  SiRNA target sequence
agcgtgttgctattataggaaaa

SEQ ID NO: 57608 - DNA, 23 bp, Artificial sequence
  SiRNA target sequence
gcgtgttgctattataggaaaaa

SEQ ID NO: 57609 - DNA, 23 bp, Artificial sequence
  SiRNA target sequence
cgtgttgctattataggaaaaaa

SEQ ID NO: 57610 - DNA, 23 bp, Artificial sequence
  SiRNA target sequence
gtgttgctattataggaaaaaat

SEQ ID NO: 57611 - DNA, 23 bp, Artificial sequence
  SiRNA target sequence
tgttgctattataggaaaaaatg

SEQ ID NO: 57612 - DNA, 23 bp, Artificial sequence
  SiRNA target sequence
gttgctattataggaaaaaatgg

SEQ ID NO: 57613 - DNA, 23 bp, Artificial sequence
  SiRNA target sequence
ttgctattataggaaaaaatgga

SEQ ID NO: 57614 - DNA, 23 bp, Artificial sequence
  SiRNA target sequence
tgctattataggaaaaaatggaa

SEQ ID NO: 57615 - DNA, 23 bp, Artificial sequence
  SiRNA target sequence
gctattataggaaaaaatggaac

SEQ ID NO: 57616 - DNA, 23 bp, Artificial sequence
  SiRNA target sequence
ctattataggaaaaaatggaaca

SEQ ID NO: 57617 - DNA, 23 bp, Artificial sequence
  SiRNA target sequence
tattataggaaaaaatggaacag

SEQ ID NO: 57618 - DNA, 23 bp, Artificial sequence
  SiRNA target sequence
attataggaaaaaatggaacagg

SEQ ID NO: 57619 - DNA, 23 bp, Artificial sequence
  SiRNA target sequence
ttataggaaaaaatggaacaggt

SEQ ID NO: 57620 - DNA, 23 bp, Artificial sequence
  SiRNA target sequence
tataggaaaaaatggaacaggta

SEQ ID NO: 57621 - DNA, 23 bp, Artificial sequence
  SiRNA target sequence
ataggaaaaaatggaacaggtaa

SEQ ID NO: 57622 - DNA, 23 bp, Artificial sequence
  SiRNA target sequence
taggaaaaaatggaacaggtaaa

SEQ ID NO: 57623 - DNA, 23 bp, Artificial sequence
  SiRNA target sequence
aggaaaaaatggaacaggtaaaa

SEQ ID NO: 57624 - DNA, 23 bp, Artificial sequence
  SiRNA target sequence
ggaaaaaatggaacaggtaaaag

SEQ ID NO: 57625 - DNA, 23 bp, Artificial sequence
  SiRNA target sequence
gaaaaaatggaacaggtaaaagt

SEQ ID NO: 57626 - DNA, 23 bp, Artificial sequence
  SiRNA target sequence
aaaaaatggaacaggtaaaagta

SEQ ID NO: 57627 - DNA, 23 bp, Artificial sequence
  SiRNA target sequence
aaaaatggaacaggtaaaagtac

SEQ ID NO: 57628 - DNA, 23 bp, Artificial sequence
  SiRNA target sequence
aaaatggaacaggtaaaagtaca

SEQ ID NO: 57629 - DNA, 23 bp, Artificial sequence
  SiRNA target sequence
aaatggaacaggtaaaagtacaa

SEQ ID NO: 57630 - DNA, 23 bp, Artificial sequence
  SiRNA target sequence
aatggaacaggtaaaagtacaat

SEQ ID NO: 57631 - DNA, 23 bp, Artificial sequence
  SiRNA target sequence
atggaacaggtaaaagtacaata

SEQ ID NO: 57632 - DNA, 23 bp, Artificial sequence
  SiRNA target sequence
tggaacaggtaaaagtacaataa

SEQ ID NO: 57633 - DNA, 23 bp, Artificial sequence
  SiRNA target sequence
ggaacaggtaaaagtacaataat

SEQ ID NO: 57634 - DNA, 23 bp, Artificial sequence
  SiRNA target sequence
gaacaggtaaaagtacaataata

SEQ ID NO: 57635 - DNA, 23 bp, Artificial sequence
  SiRNA target sequence
aacaggtaaaagtacaataataa

SEQ ID NO: 57636 - DNA, 23 bp, Artificial sequence
  SiRNA target sequence
acaggtaaaagtacaataataaa

SEQ ID NO: 57637 - DNA, 23 bp, Artificial sequence
  SiRNA target sequence
caggtaaaagtacaataataaaa

SEQ ID NO: 57638 - DNA, 23 bp, Artificial sequence
  SiRNA target sequence
aggtaaaagtacaataataaaat

SEQ ID NO: 57639 - DNA, 23 bp, Artificial sequence
  SiRNA target sequence
ggtaaaagtacaataataaaatt

SEQ ID NO: 57640 - DNA, 23 bp, Artificial sequence
  SiRNA target sequence
gtaaaagtacaataataaaattg

SEQ ID NO: 57641 - DNA, 23 bp, Artificial sequence
  SiRNA target sequence
taaaagtacaataataaaattgt

SEQ ID NO: 57642 - DNA, 23 bp, Artificial sequence
  SiRNA target sequence
aaaagtacaataataaaattgtt

SEQ ID NO: 57643 - DNA, 23 bp, Artificial sequence
  SiRNA target sequence
aaagtacaataataaaattgtta

SEQ ID NO: 57644 - DNA, 23 bp, Artificial sequence
  SiRNA target sequence
aagtacaataataaaattgttaa

SEQ ID NO: 57645 - DNA, 23 bp, Artificial sequence
  SiRNA target sequence
agtacaataataaaattgttaat

SEQ ID NO: 57646 - DNA, 23 bp, Artificial sequence
  SiRNA target sequence
gtacaataataaaattgttaatg

SEQ ID NO: 57647 - DNA, 23 bp, Artificial sequence
  SiRNA target sequence
tacaataataaaattgttaatga

SEQ ID NO: 57648 - DNA, 23 bp, Artificial sequence
  SiRNA target sequence
acaataataaaattgttaatgaa

SEQ ID NO: 57649 - DNA, 23 bp, Artificial sequence
  SiRNA target sequence
caataataaaattgttaatgaaa

SEQ ID NO: 57650 - DNA, 23 bp, Artificial sequence
  SiRNA target sequence
aataataaaattgttaatgaaat

SEQ ID NO: 57651 - DNA, 23 bp, Artificial sequence
  SiRNA target sequence
ataataaaattgttaatgaaatt

SEQ ID NO: 57652 - DNA, 23 bp, Artificial sequence
  SiRNA target sequence
taataaaattgttaatgaaattt

SEQ ID NO: 57653 - DNA, 23 bp, Artificial sequence
  SiRNA target sequence
aataaaattgttaatgaaatttt

SEQ ID NO: 57654 - DNA, 23 bp, Artificial sequence
  SiRNA target sequence
ataaaattgttaatgaaatttta

SEQ ID NO: 57655 - DNA, 23 bp, Artificial sequence
  SiRNA target sequence
taaaattgttaatgaaattttat

SEQ ID NO: 57656 - DNA, 23 bp, Artificial sequence
  SiRNA target sequence
aaaattgttaatgaaattttata

SEQ ID NO: 57657 - DNA, 23 bp, Artificial sequence
  SiRNA target sequence
aaattgttaatgaaattttataa

SEQ ID NO: 57658 - DNA, 23 bp, Artificial sequence
  SiRNA target sequence
aattgttaatgaaattttataaa

SEQ ID NO: 57659 - DNA, 23 bp, Artificial sequence
  SiRNA target sequence
attgttaatgaaattttataaat

SEQ ID NO: 57660 - DNA, 23 bp, Artificial sequence
  SiRNA target sequence
ttgttaatgaaattttataaata

SEQ ID NO: 57661 - DNA, 23 bp, Artificial sequence
  SiRNA target sequence
tgttaatgaaattttataaatat

SEQ ID NO: 57662 - DNA, 23 bp, Artificial sequence
  SiRNA target sequence
gttaatgaaattttataaatatg

SEQ ID NO: 57663 - DNA, 23 bp, Artificial sequence
  SiRNA target sequence
ttaatgaaattttataaatatga

SEQ ID NO: 57664 - DNA, 23 bp, Artificial sequence
  SiRNA target sequence
taatgaaattttataaatatgat

SEQ ID NO: 57665 - DNA, 23 bp, Artificial sequence
  SiRNA target sequence
aatgaaattttataaatatgatg

SEQ ID NO: 57666 - DNA, 23 bp, Artificial sequence
  SiRNA target sequence
atgaaattttataaatatgatgg

SEQ ID NO: 57667 - DNA, 23 bp, Artificial sequence
  SiRNA target sequence
tgaaattttataaatatgatgga

SEQ ID NO: 57668 - DNA, 23 bp, Artificial sequence
  SiRNA target sequence
gaaattttataaatatgatggag

SEQ ID NO: 57669 - DNA, 23 bp, Artificial sequence
  SiRNA target sequence
aaattttataaatatgatggaga

SEQ ID NO: 57670 - DNA, 23 bp, Artificial sequence
  SiRNA target sequence
aattttataaatatgatggagat

SEQ ID NO: 57671 - DNA, 23 bp, Artificial sequence
  SiRNA target sequence
attttataaatatgatggagata

SEQ ID NO: 57672 - DNA, 23 bp, Artificial sequence
  SiRNA target sequence
ttttataaatatgatggagatat

SEQ ID NO: 57673 - DNA, 23 bp, Artificial sequence
  SiRNA target sequence
tttataaatatgatggagatata

SEQ ID NO: 57674 - DNA, 23 bp, Artificial sequence
  SiRNA target sequence
ttataaatatgatggagatatat

SEQ ID NO: 57675 - DNA, 23 bp, Artificial sequence
  SiRNA target sequence
tataaatatgatggagatatatt

SEQ ID NO: 57676 - DNA, 23 bp, Artificial sequence
  SiRNA target sequence
ataaatatgatggagatatatta

SEQ ID NO: 57677 - DNA, 23 bp, Artificial sequence
  SiRNA target sequence
taaatatgatggagatatattaa

SEQ ID NO: 57678 - DNA, 23 bp, Artificial sequence
  SiRNA target sequence
aaatatgatggagatatattaat

SEQ ID NO: 57679 - DNA, 23 bp, Artificial sequence
  SiRNA target sequence
aatatgatggagatatattaatt

SEQ ID NO: 57680 - DNA, 23 bp, Artificial sequence
  SiRNA target sequence
atatgatggagatatattaattg

SEQ ID NO: 57681 - DNA, 23 bp, Artificial sequence
  SiRNA target sequence
tatgatggagatatattaattga

SEQ ID NO: 57682 - DNA, 23 bp, Artificial sequence
  SiRNA target sequence
atgatggagatatattaattgat

SEQ ID NO: 57683 - DNA, 23 bp, Artificial sequence
  SiRNA target sequence
tgatggagatatattaattgatg

SEQ ID NO: 57684 - DNA, 23 bp, Artificial sequence
  SiRNA target sequence
gatggagatatattaattgatga

SEQ ID NO: 57685 - DNA, 23 bp, Artificial sequence
  SiRNA target sequence
atggagatatattaattgatgat

SEQ ID NO: 57686 - DNA, 23 bp, Artificial sequence
  SiRNA target sequence
tggagatatattaattgatgata

SEQ ID NO: 57687 - DNA, 23 bp, Artificial sequence
  SiRNA target sequence
ggagatatattaattgatgatac

SEQ ID NO: 57688 - DNA, 23 bp, Artificial sequence
  SiRNA target sequence
gagatatattaattgatgataca

SEQ ID NO: 57689 - DNA, 23 bp, Artificial sequence
  SiRNA target sequence
agatatattaattgatgatacag

SEQ ID NO: 57690 - DNA, 23 bp, Artificial sequence
  SiRNA target sequence
gatatattaattgatgatacaga

SEQ ID NO: 57691 - DNA, 23 bp, Artificial sequence
  SiRNA target sequence
atatattaattgatgatacagaa

SEQ ID NO: 57692 - DNA, 23 bp, Artificial sequence
  SiRNA target sequence
tatattaattgatgatacagaaa

SEQ ID NO: 57693 - DNA, 23 bp, Artificial sequence
  SiRNA target sequence
atattaattgatgatacagaaat

SEQ ID NO: 57694 - DNA, 23 bp, Artificial sequence
  SiRNA target sequence
tattaattgatgatacagaaata

SEQ ID NO: 57695 - DNA, 23 bp, Artificial sequence
  SiRNA target sequence
attaattgatgatacagaaatag

SEQ ID NO: 57696 - DNA, 23 bp, Artificial sequence
  SiRNA target sequence
ttaattgatgatacagaaataga

SEQ ID NO: 57697 - DNA, 23 bp, Artificial sequence
  SiRNA target sequence
taattgatgatacagaaatagat

SEQ ID NO: 57698 - DNA, 23 bp, Artificial sequence
  SiRNA target sequence
aattgatgatacagaaatagata

SEQ ID NO: 57699 - DNA, 23 bp, Artificial sequence
  SiRNA target sequence
attgatgatacagaaatagataa

SEQ ID NO: 57700 - DNA, 23 bp, Artificial sequence
  SiRNA target sequence
ttgatgatacagaaatagataat

SEQ ID NO: 57701 - DNA, 23 bp, Artificial sequence
  SiRNA target sequence
tgatgatacagaaatagataata

SEQ ID NO: 57702 - DNA, 23 bp, Artificial sequence
  SiRNA target sequence
gatgatacagaaatagataatat

SEQ ID NO: 57703 - DNA, 23 bp, Artificial sequence
  SiRNA target sequence
atgatacagaaatagataatatt

SEQ ID NO: 57704 - DNA, 23 bp, Artificial sequence
  SiRNA target sequence
tgatacagaaatagataatattt

SEQ ID NO: 57705 - DNA, 23 bp, Artificial sequence
  SiRNA target sequence
gatacagaaatagataatatttc

SEQ ID NO: 57706 - DNA, 23 bp, Artificial sequence
  SiRNA target sequence
atacagaaatagataatatttcg

SEQ ID NO: 57707 - DNA, 23 bp, Artificial sequence
  SiRNA target sequence
tacagaaatagataatatttcgg

SEQ ID NO: 57708 - DNA, 23 bp, Artificial sequence
  SiRNA target sequence
acagaaatagataatatttcgga

SEQ ID NO: 57709 - DNA, 23 bp, Artificial sequence
  SiRNA target sequence
cagaaatagataatatttcggat

SEQ ID NO: 57710 - DNA, 23 bp, Artificial sequence
  SiRNA target sequence
agaaatagataatatttcggata

SEQ ID NO: 57711 - DNA, 23 bp, Artificial sequence
  SiRNA target sequence
gaaatagataatatttcggatag

SEQ ID NO: 57712 - DNA, 23 bp, Artificial sequence
  SiRNA target sequence
aaatagataatatttcggataga

SEQ ID NO: 57713 - DNA, 23 bp, Artificial sequence
  SiRNA target sequence
aatagataatatttcggatagaa

SEQ ID NO: 57714 - DNA, 23 bp, Artificial sequence
  SiRNA target sequence
atagataatatttcggatagaag

SEQ ID NO: 57715 - DNA, 23 bp, Artificial sequence
  SiRNA target sequence
tagataatatttcggatagaagt

SEQ ID NO: 57716 - DNA, 23 bp, Artificial sequence
  SiRNA target sequence
agataatatttcggatagaagtt

SEQ ID NO: 57717 - DNA, 23 bp, Artificial sequence
  SiRNA target sequence
gataatatttcggatagaagtta

SEQ ID NO: 57718 - DNA, 23 bp, Artificial sequence
  SiRNA target sequence
ataatatttcggatagaagttac

SEQ ID NO: 57719 - DNA, 23 bp, Artificial sequence
  SiRNA target sequence
taatatttcggatagaagttaca

SEQ ID NO: 57720 - DNA, 23 bp, Artificial sequence
  SiRNA target sequence
aatatttcggatagaagttacag

SEQ ID NO: 57721 - DNA, 23 bp, Artificial sequence
  SiRNA target sequence
atatttcggatagaagttacaga

SEQ ID NO: 57722 - DNA, 23 bp, Artificial sequence
  SiRNA target sequence
tatttcggatagaagttacagaa

SEQ ID NO: 57723 - DNA, 23 bp, Artificial sequence
  SiRNA target sequence
atttcggatagaagttacagaag

SEQ ID NO: 57724 - DNA, 23 bp, Artificial sequence
  SiRNA target sequence
tttcggatagaagttacagaagt

SEQ ID NO: 57725 - DNA, 23 bp, Artificial sequence
  SiRNA target sequence
ttcggatagaagttacagaagtt

SEQ ID NO: 57726 - DNA, 23 bp, Artificial sequence
  SiRNA target sequence
tcggatagaagttacagaagttt

SEQ ID NO: 57727 - DNA, 23 bp, Artificial sequence
  SiRNA target sequence
cggatagaagttacagaagttta

SEQ ID NO: 57728 - DNA, 23 bp, Artificial sequence
  SiRNA target sequence
ggatagaagttacagaagtttaa

SEQ ID NO: 57729 - DNA, 23 bp, Artificial sequence
  SiRNA target sequence
gatagaagttacagaagtttaat

SEQ ID NO: 57730 - DNA, 23 bp, Artificial sequence
  SiRNA target sequence
atagaagttacagaagtttaata

SEQ ID NO: 57731 - DNA, 23 bp, Artificial sequence
  SiRNA target sequence
tagaagttacagaagtttaatat

SEQ ID NO: 57732 - DNA, 23 bp, Artificial sequence
  SiRNA target sequence
agaagttacagaagtttaatatc

SEQ ID NO: 57733 - DNA, 23 bp, Artificial sequence
  SiRNA target sequence
gaagttacagaagtttaatatca

SEQ ID NO: 57734 - DNA, 23 bp, Artificial sequence
  SiRNA target sequence
aagttacagaagtttaatatcat

SEQ ID NO: 57735 - DNA, 23 bp, Artificial sequence
  SiRNA target sequence
agttacagaagtttaatatcata

SEQ ID NO: 57736 - DNA, 23 bp, Artificial sequence
  SiRNA target sequence
gttacagaagtttaatatcatat

SEQ ID NO: 57737 - DNA, 23 bp, Artificial sequence
  SiRNA target sequence
ttacagaagtttaatatcatatg

SEQ ID NO: 57738 - DNA, 23 bp, Artificial sequence
  SiRNA target sequence
tacagaagtttaatatcatatgc

SEQ ID NO: 57739 - DNA, 23 bp, Artificial sequence
  SiRNA target sequence
acagaagtttaatatcatatgca

SEQ ID NO: 57740 - DNA, 23 bp, Artificial sequence
  SiRNA target sequence
cagaagtttaatatcatatgcaa

SEQ ID NO: 57741 - DNA, 23 bp, Artificial sequence
  SiRNA target sequence
agaagtttaatatcatatgcaac

SEQ ID NO: 57742 - DNA, 23 bp, Artificial sequence
  SiRNA target sequence
gaagtttaatatcatatgcaaca

SEQ ID NO: 57743 - DNA, 23 bp, Artificial sequence
  SiRNA target sequence
aagtttaatatcatatgcaacac

SEQ ID NO: 57744 - DNA, 23 bp, Artificial sequence
  SiRNA target sequence
agtttaatatcatatgcaacaca

SEQ ID NO: 57745 - DNA, 23 bp, Artificial sequence
  SiRNA target sequence
gtttaatatcatatgcaacacaa

SEQ ID NO: 57746 - DNA, 23 bp, Artificial sequence
  SiRNA target sequence
tttaatatcatatgcaacacaaa

SEQ ID NO: 57747 - DNA, 23 bp, Artificial sequence
  SiRNA target sequence
ttaatatcatatgcaacacaaaa

SEQ ID NO: 57748 - DNA, 23 bp, Artificial sequence
  SiRNA target sequence
taatatcatatgcaacacaaaac

SEQ ID NO: 57749 - DNA, 23 bp, Artificial sequence
  SiRNA target sequence
aatatcatatgcaacacaaaaca

SEQ ID NO: 57750 - DNA, 23 bp, Artificial sequence
  SiRNA target sequence
atatcatatgcaacacaaaacac

SEQ ID NO: 57751 - DNA, 23 bp, Artificial sequence
  SiRNA target sequence
tatcatatgcaacacaaaacacg

SEQ ID NO: 57752 - DNA, 23 bp, Artificial sequence
  SiRNA target sequence
atcatatgcaacacaaaacacgt

SEQ ID NO: 57753 - DNA, 23 bp, Artificial sequence
  SiRNA target sequence
tcatatgcaacacaaaacacgtt

SEQ ID NO: 57754 - DNA, 23 bp, Artificial sequence
  SiRNA target sequence
catatgcaacacaaaacacgttc

SEQ ID NO: 57755 - DNA, 23 bp, Artificial sequence
  SiRNA target sequence
atatgcaacacaaaacacgttct

SEQ ID NO: 57756 - DNA, 23 bp, Artificial sequence
  SiRNA target sequence
tatgcaacacaaaacacgttctt

SEQ ID NO: 57757 - DNA, 23 bp, Artificial sequence
  SiRNA target sequence
atgcaacacaaaacacgttctta

SEQ ID NO: 57758 - DNA, 23 bp, Artificial sequence
  SiRNA target sequence
tgcaacacaaaacacgttcttat

SEQ ID NO: 57759 - DNA, 23 bp, Artificial sequence
  SiRNA target sequence
gcaacacaaaacacgttcttatt

SEQ ID NO: 57760 - DNA, 23 bp, Artificial sequence
  SiRNA target sequence
caacacaaaacacgttcttattc

SEQ ID NO: 57761 - DNA, 23 bp, Artificial sequence
  SiRNA target sequence
aacacaaaacacgttcttattcg

SEQ ID NO: 57762 - DNA, 23 bp, Artificial sequence
  SiRNA target sequence
acacaaaacacgttcttattcga

SEQ ID NO: 57763 - DNA, 23 bp, Artificial sequence
  SiRNA target sequence
cacaaaacacgttcttattcgat

SEQ ID NO: 57764 - DNA, 23 bp, Artificial sequence
  SiRNA target sequence
acaaaacacgttcttattcgata

SEQ ID NO: 57765 - DNA, 23 bp, Artificial sequence
  SiRNA target sequence
caaaacacgttcttattcgataa

SEQ ID NO: 57766 - DNA, 23 bp, Artificial sequence
  SiRNA target sequence
aaaacacgttcttattcgataat

SEQ ID NO: 57767 - DNA, 23 bp, Artificial sequence
  SiRNA target sequence
aaacacgttcttattcgataata

SEQ ID NO: 57768 - DNA, 23 bp, Artificial sequence
  SiRNA target sequence
aacacgttcttattcgataatac

SEQ ID NO: 57769 - DNA, 23 bp, Artificial sequence
  SiRNA target sequence
acacgttcttattcgataatact

SEQ ID NO: 57770 - DNA, 23 bp, Artificial sequence
  SiRNA target sequence
cacgttcttattcgataatactg

SEQ ID NO: 57771 - DNA, 23 bp, Artificial sequence
  SiRNA target sequence
acgttcttattcgataatactgt

SEQ ID NO: 57772 - DNA, 23 bp, Artificial sequence
  SiRNA target sequence
cgttcttattcgataatactgtg

SEQ ID NO: 57773 - DNA, 23 bp, Artificial sequence
  SiRNA target sequence
gttcttattcgataatactgtga

SEQ ID NO: 57774 - DNA, 23 bp, Artificial sequence
  SiRNA target sequence
ttcttattcgataatactgtgac

SEQ ID NO: 57775 - DNA, 23 bp, Artificial sequence
  SiRNA target sequence
tcttattcgataatactgtgaca

SEQ ID NO: 57776 - DNA, 23 bp, Artificial sequence
  SiRNA target sequence
cttattcgataatactgtgacat

SEQ ID NO: 57777 - DNA, 23 bp, Artificial sequence
  SiRNA target sequence
ttattcgataatactgtgacata

SEQ ID NO: 57778 - DNA, 23 bp, Artificial sequence
  SiRNA target sequence
tattcgataatactgtgacatac

SEQ ID NO: 57779 - DNA, 23 bp, Artificial sequence
  SiRNA target sequence
attcgataatactgtgacataca

SEQ ID NO: 57780 - DNA, 23 bp, Artificial sequence
  SiRNA target sequence
ttcgataatactgtgacatacaa

SEQ ID NO: 57781 - DNA, 23 bp, Artificial sequence
  SiRNA target sequence
tcgataatactgtgacatacaat

SEQ ID NO: 57782 - DNA, 23 bp, Artificial sequence
  SiRNA target sequence
cgataatactgtgacatacaata

SEQ ID NO: 57783 - DNA, 23 bp, Artificial sequence
  SiRNA target sequence
gataatactgtgacatacaatat

SEQ ID NO: 57784 - DNA, 23 bp, Artificial sequence
  SiRNA target sequence
ataatactgtgacatacaatata

SEQ ID NO: 57785 - DNA, 23 bp, Artificial sequence
  SiRNA target sequence
taatactgtgacatacaatatat

SEQ ID NO: 57786 - DNA, 23 bp, Artificial sequence
  SiRNA target sequence
aatactgtgacatacaatatatt

SEQ ID NO: 57787 - DNA, 23 bp, Artificial sequence
  SiRNA target sequence
atactgtgacatacaatatattt

SEQ ID NO: 57788 - DNA, 23 bp, Artificial sequence
  SiRNA target sequence
tactgtgacatacaatatatttt

SEQ ID NO: 57789 - DNA, 23 bp, Artificial sequence
  SiRNA target sequence
actgtgacatacaatatatttta

SEQ ID NO: 57790 - DNA, 23 bp, Artificial sequence
  SiRNA target sequence
ctgtgacatacaatatattttac

SEQ ID NO: 57791 - DNA, 23 bp, Artificial sequence
  SiRNA target sequence
tgtgacatacaatatattttacg

SEQ ID NO: 57792 - DNA, 23 bp, Artificial sequence
  SiRNA target sequence
gtgacatacaatatattttacgg

SEQ ID NO: 57793 - DNA, 23 bp, Artificial sequence
  SiRNA target sequence
tgacatacaatatattttacggg

SEQ ID NO: 57794 - DNA, 23 bp, Artificial sequence
  SiRNA target sequence
gacatacaatatattttacggga

SEQ ID NO: 57795 - DNA, 23 bp, Artificial sequence
  SiRNA target sequence
acatacaatatattttacgggac

SEQ ID NO: 57796 - DNA, 23 bp, Artificial sequence
  SiRNA target sequence
catacaatatattttacgggact

SEQ ID NO: 57797 - DNA, 23 bp, Artificial sequence
  SiRNA target sequence
atacaatatattttacgggacta

SEQ ID NO: 57798 - DNA, 23 bp, Artificial sequence
  SiRNA target sequence
tacaatatattttacgggactaa

SEQ ID NO: 57799 - DNA, 23 bp, Artificial sequence
  SiRNA target sequence
acaatatattttacgggactaaa

SEQ ID NO: 57800 - DNA, 23 bp, Artificial sequence
  SiRNA target sequence
caatatattttacgggactaaaa

SEQ ID NO: 57801 - DNA, 23 bp, Artificial sequence
  SiRNA target sequence
aatatattttacgggactaaaaa

SEQ ID NO: 57802 - DNA, 23 bp, Artificial sequence
  SiRNA target sequence
atatattttacgggactaaaaac

SEQ ID NO: 57803 - DNA, 23 bp, Artificial sequence
  SiRNA target sequence
tatattttacgggactaaaaacg

SEQ ID NO: 57804 - DNA, 23 bp, Artificial sequence
  SiRNA target sequence
atattttacgggactaaaaacgt

SEQ ID NO: 57805 - DNA, 23 bp, Artificial sequence
  SiRNA target sequence
tattttacgggactaaaaacgta

SEQ ID NO: 57806 - DNA, 23 bp, Artificial sequence
  SiRNA target sequence
attttacgggactaaaaacgtaa

SEQ ID NO: 57807 - DNA, 23 bp, Artificial sequence
  SiRNA target sequence
ttttacgggactaaaaacgtaac

SEQ ID NO: 57808 - DNA, 23 bp, Artificial sequence
  SiRNA target sequence
tttacgggactaaaaacgtaaca

SEQ ID NO: 57809 - DNA, 23 bp, Artificial sequence
  SiRNA target sequence
ttacgggactaaaaacgtaacag

SEQ ID NO: 57810 - DNA, 23 bp, Artificial sequence
  SiRNA target sequence
tacgggactaaaaacgtaacaga

SEQ ID NO: 57811 - DNA, 23 bp, Artificial sequence
  SiRNA target sequence
acgggactaaaaacgtaacagaa

SEQ ID NO: 57812 - DNA, 23 bp, Artificial sequence
  SiRNA target sequence
cgggactaaaaacgtaacagaaa

SEQ ID NO: 57813 - DNA, 23 bp, Artificial sequence
  SiRNA target sequence
gggactaaaaacgtaacagaaaa

SEQ ID NO: 57814 - DNA, 23 bp, Artificial sequence
  SiRNA target sequence
ggactaaaaacgtaacagaaaaa

SEQ ID NO: 57815 - DNA, 23 bp, Artificial sequence
  SiRNA target sequence
gactaaaaacgtaacagaaaaag

SEQ ID NO: 57816 - DNA, 23 bp, Artificial sequence
  SiRNA target sequence
actaaaaacgtaacagaaaaaga

SEQ ID NO: 57817 - DNA, 23 bp, Artificial sequence
  SiRNA target sequence
ctaaaaacgtaacagaaaaagaa

SEQ ID NO: 57818 - DNA, 23 bp, Artificial sequence
  SiRNA target sequence
taaaaacgtaacagaaaaagaag

SEQ ID NO: 57819 - DNA, 23 bp, Artificial sequence
  SiRNA target sequence
aaaaacgtaacagaaaaagaagt

SEQ ID NO: 57820 - DNA, 23 bp, Artificial sequence
  SiRNA target sequence
aaaacgtaacagaaaaagaagtt

SEQ ID NO: 57821 - DNA, 23 bp, Artificial sequence
  SiRNA target sequence
aaacgtaacagaaaaagaagttt

SEQ ID NO: 57822 - DNA, 23 bp, Artificial sequence
  SiRNA target sequence
aacgtaacagaaaaagaagtttt

SEQ ID NO: 57823 - DNA, 23 bp, Artificial sequence
  SiRNA target sequence
acgtaacagaaaaagaagtttta

SEQ ID NO: 57824 - DNA, 23 bp, Artificial sequence
  SiRNA target sequence
cgtaacagaaaaagaagttttag

SEQ ID NO: 57825 - DNA, 23 bp, Artificial sequence
  SiRNA target sequence
gtaacagaaaaagaagttttaga

SEQ ID NO: 57826 - DNA, 23 bp, Artificial sequence
  SiRNA target sequence
taacagaaaaagaagttttagaa

SEQ ID NO: 57827 - DNA, 23 bp, Artificial sequence
  SiRNA target sequence
aacagaaaaagaagttttagaat

SEQ ID NO: 57828 - DNA, 23 bp, Artificial sequence
  SiRNA target sequence
acagaaaaagaagttttagaatt

SEQ ID NO: 57829 - DNA, 23 bp, Artificial sequence
  SiRNA target sequence
cagaaaaagaagttttagaatta

SEQ ID NO: 57830 - DNA, 23 bp, Artificial sequence
  SiRNA target sequence
agaaaaagaagttttagaattag

SEQ ID NO: 57831 - DNA, 23 bp, Artificial sequence
  SiRNA target sequence
gaaaaagaagttttagaattagc

SEQ ID NO: 57832 - DNA, 23 bp, Artificial sequence
  SiRNA target sequence
aaaaagaagttttagaattagcc

SEQ ID NO: 57833 - DNA, 23 bp, Artificial sequence
  SiRNA target sequence
aaaagaagttttagaattagcca

SEQ ID NO: 57834 - DNA, 23 bp, Artificial sequence
  SiRNA target sequence
aaagaagttttagaattagccaa

SEQ ID NO: 57835 - DNA, 23 bp, Artificial sequence
  SiRNA target sequence
aagaagttttagaattagccaaa

SEQ ID NO: 57836 - DNA, 23 bp, Artificial sequence
  SiRNA target sequence
agaagttttagaattagccaaaa

SEQ ID NO: 57837 - DNA, 23 bp, Artificial sequence
  SiRNA target sequence
gaagttttagaattagccaaaaa

SEQ ID NO: 57838 - DNA, 23 bp, Artificial sequence
  SiRNA target sequence
aagttttagaattagccaaaaaa

SEQ ID NO: 57839 - DNA, 23 bp, Artificial sequence
  SiRNA target sequence
agttttagaattagccaaaaaaa

SEQ ID NO: 57840 - DNA, 23 bp, Artificial sequence
  SiRNA target sequence
gttttagaattagccaaaaaaat

SEQ ID NO: 57841 - DNA, 23 bp, Artificial sequence
  SiRNA target sequence
ttttagaattagccaaaaaaata

SEQ ID NO: 57842 - DNA, 23 bp, Artificial sequence
  SiRNA target sequence
tttagaattagccaaaaaaatag

SEQ ID NO: 57843 - DNA, 23 bp, Artificial sequence
  SiRNA target sequence
ttagaattagccaaaaaaatagg

SEQ ID NO: 57844 - DNA, 23 bp, Artificial sequence
  SiRNA target sequence
tagaattagccaaaaaaataggt

SEQ ID NO: 57845 - DNA, 23 bp, Artificial sequence
  SiRNA target sequence
agaattagccaaaaaaataggtg

SEQ ID NO: 57846 - DNA, 23 bp, Artificial sequence
  SiRNA target sequence
gaattagccaaaaaaataggtgt

SEQ ID NO: 57847 - DNA, 23 bp, Artificial sequence
  SiRNA target sequence
aattagccaaaaaaataggtgta

SEQ ID NO: 57848 - DNA, 23 bp, Artificial sequence
  SiRNA target sequence
attagccaaaaaaataggtgtat

SEQ ID NO: 57849 - DNA, 23 bp, Artificial sequence
  SiRNA target sequence
ttagccaaaaaaataggtgtatt

SEQ ID NO: 57850 - DNA, 23 bp, Artificial sequence
  SiRNA target sequence
tagccaaaaaaataggtgtatta

SEQ ID NO: 57851 - DNA, 23 bp, Artificial sequence
  SiRNA target sequence
agccaaaaaaataggtgtattag

SEQ ID NO: 57852 - DNA, 23 bp, Artificial sequence
  SiRNA target sequence
gccaaaaaaataggtgtattaga

SEQ ID NO: 57853 - DNA, 23 bp, Artificial sequence
  SiRNA target sequence
ccaaaaaaataggtgtattagag

SEQ ID NO: 57854 - DNA, 23 bp, Artificial sequence
  SiRNA target sequence
caaaaaaataggtgtattagagt

SEQ ID NO: 57855 - DNA, 23 bp, Artificial sequence
  SiRNA target sequence
aaaaaaataggtgtattagagtc

SEQ ID NO: 57856 - DNA, 23 bp, Artificial sequence
  SiRNA target sequence
aaaaaataggtgtattagagtct

SEQ ID NO: 57857 - DNA, 23 bp, Artificial sequence
  SiRNA target sequence
aaaaataggtgtattagagtcta

SEQ ID NO: 57858 - DNA, 23 bp, Artificial sequence
  SiRNA target sequence
aaaataggtgtattagagtctat

SEQ ID NO: 57859 - DNA, 23 bp, Artificial sequence
  SiRNA target sequence
aaataggtgtattagagtctata

SEQ ID NO: 57860 - DNA, 23 bp, Artificial sequence
  SiRNA target sequence
aataggtgtattagagtctatac

SEQ ID NO: 57861 - DNA, 23 bp, Artificial sequence
  SiRNA target sequence
ataggtgtattagagtctataca

SEQ ID NO: 57862 - DNA, 23 bp, Artificial sequence
  SiRNA target sequence
taggtgtattagagtctatacag

SEQ ID NO: 57863 - DNA, 23 bp, Artificial sequence
  SiRNA target sequence
aggtgtattagagtctatacagg

SEQ ID NO: 57864 - DNA, 23 bp, Artificial sequence
  SiRNA target sequence
ggtgtattagagtctatacagga

SEQ ID NO: 57865 - DNA, 23 bp, Artificial sequence
  SiRNA target sequence
gtgtattagagtctatacaggaa

SEQ ID NO: 57866 - DNA, 23 bp, Artificial sequence
  SiRNA target sequence
tgtattagagtctatacaggaat

SEQ ID NO: 57867 - DNA, 23 bp, Artificial sequence
  SiRNA target sequence
gtattagagtctatacaggaatt

SEQ ID NO: 57868 - DNA, 23 bp, Artificial sequence
  SiRNA target sequence
tattagagtctatacaggaattt

SEQ ID NO: 57869 - DNA, 23 bp, Artificial sequence
  SiRNA target sequence
attagagtctatacaggaattta

SEQ ID NO: 57870 - DNA, 23 bp, Artificial sequence
  SiRNA target sequence
ttagagtctatacaggaatttaa

SEQ ID NO: 57871 - DNA, 23 bp, Artificial sequence
  SiRNA target sequence
tagagtctatacaggaatttaaa

SEQ ID NO: 57872 - DNA, 23 bp, Artificial sequence
  SiRNA target sequence
agagtctatacaggaatttaaag

SEQ ID NO: 57873 - DNA, 23 bp, Artificial sequence
  SiRNA target sequence
gagtctatacaggaatttaaaga

SEQ ID NO: 57874 - DNA, 23 bp, Artificial sequence
  SiRNA target sequence
agtctatacaggaatttaaagat

SEQ ID NO: 57875 - DNA, 23 bp, Artificial sequence
  SiRNA target sequence
gtctatacaggaatttaaagatg

SEQ ID NO: 57876 - DNA, 23 bp, Artificial sequence
  SiRNA target sequence
tctatacaggaatttaaagatgg

SEQ ID NO: 57877 - DNA, 23 bp, Artificial sequence
  SiRNA target sequence
ctatacaggaatttaaagatggg

SEQ ID NO: 57878 - DNA, 23 bp, Artificial sequence
  SiRNA target sequence
tatacaggaatttaaagatgggt

SEQ ID NO: 57879 - DNA, 23 bp, Artificial sequence
  SiRNA target sequence
atacaggaatttaaagatgggtt

SEQ ID NO: 57880 - DNA, 23 bp, Artificial sequence
  SiRNA target sequence
tacaggaatttaaagatgggttt

SEQ ID NO: 57881 - DNA, 23 bp, Artificial sequence
  SiRNA target sequence
acaggaatttaaagatgggttta

SEQ ID NO: 57882 - DNA, 23 bp, Artificial sequence
  SiRNA target sequence
caggaatttaaagatgggtttag

SEQ ID NO: 57883 - DNA, 23 bp, Artificial sequence
  SiRNA target sequence
aggaatttaaagatgggtttagc

SEQ ID NO: 57884 - DNA, 23 bp, Artificial sequence
  SiRNA target sequence
ggaatttaaagatgggtttagca

SEQ ID NO: 57885 - DNA, 23 bp, Artificial sequence
  SiRNA target sequence
gaatttaaagatgggtttagcac

SEQ ID NO: 57886 - DNA, 23 bp, Artificial sequence
  SiRNA target sequence
aatttaaagatgggtttagcaca

SEQ ID NO: 57887 - DNA, 23 bp, Artificial sequence
  SiRNA target sequence
atttaaagatgggtttagcacat

SEQ ID NO: 57888 - DNA, 23 bp, Artificial sequence
  SiRNA target sequence
tttaaagatgggtttagcacatc

SEQ ID NO: 57889 - DNA, 23 bp, Artificial sequence
  SiRNA target sequence
ttaaagatgggtttagcacatcg

SEQ ID NO: 57890 - DNA, 23 bp, Artificial sequence
  SiRNA target sequence
taaagatgggtttagcacatcgg

SEQ ID NO: 57891 - DNA, 23 bp, Artificial sequence
  SiRNA target sequence
aaagatgggtttagcacatcggt

SEQ ID NO: 57892 - DNA, 23 bp, Artificial sequence
  SiRNA target sequence
aagatgggtttagcacatcggtc

SEQ ID NO: 57893 - DNA, 23 bp, Artificial sequence
  SiRNA target sequence
agatgggtttagcacatcggtcg

SEQ ID NO: 57894 - DNA, 23 bp, Artificial sequence
  SiRNA target sequence
gatgggtttagcacatcggtcgg

SEQ ID NO: 57895 - DNA, 23 bp, Artificial sequence
  SiRNA target sequence
atgggtttagcacatcggtcggt

SEQ ID NO: 57896 - DNA, 23 bp, Artificial sequence
  SiRNA target sequence
tgggtttagcacatcggtcggtg

SEQ ID NO: 57897 - DNA, 23 bp, Artificial sequence
  SiRNA target sequence
gggtttagcacatcggtcggtga

SEQ ID NO: 57898 - DNA, 23 bp, Artificial sequence
  SiRNA target sequence
ggtttagcacatcggtcggtgaa

SEQ ID NO: 57899 - DNA, 23 bp, Artificial sequence
  SiRNA target sequence
gtttagcacatcggtcggtgaac

SEQ ID NO: 57900 - DNA, 23 bp, Artificial sequence
  SiRNA target sequence
tttagcacatcggtcggtgaacg

SEQ ID NO: 57901 - DNA, 23 bp, Artificial sequence
  SiRNA target sequence
ttagcacatcggtcggtgaacgc

SEQ ID NO: 57902 - DNA, 23 bp, Artificial sequence
  SiRNA target sequence
tagcacatcggtcggtgaacgcg

SEQ ID NO: 57903 - DNA, 23 bp, Artificial sequence
  SiRNA target sequence
agcacatcggtcggtgaacgcgg

SEQ ID NO: 57904 - DNA, 23 bp, Artificial sequence
  SiRNA target sequence
gcacatcggtcggtgaacgcgga

SEQ ID NO: 57905 - DNA, 23 bp, Artificial sequence
  SiRNA target sequence
cacatcggtcggtgaacgcggaa

SEQ ID NO: 57906 - DNA, 23 bp, Artificial sequence
  SiRNA target sequence
acatcggtcggtgaacgcggaag

SEQ ID NO: 57907 - DNA, 23 bp, Artificial sequence
  SiRNA target sequence
catcggtcggtgaacgcggaaga

SEQ ID NO: 57908 - DNA, 23 bp, Artificial sequence
  SiRNA target sequence
atcggtcggtgaacgcggaagat

SEQ ID NO: 57909 - DNA, 23 bp, Artificial sequence
  SiRNA target sequence
tcggtcggtgaacgcggaagatt

SEQ ID NO: 57910 - DNA, 23 bp, Artificial sequence
  SiRNA target sequence
cggtcggtgaacgcggaagattt

SEQ ID NO: 57911 - DNA, 23 bp, Artificial sequence
  SiRNA target sequence
ggtcggtgaacgcggaagatttt

SEQ ID NO: 57912 - DNA, 23 bp, Artificial sequence
  SiRNA target sequence
gtcggtgaacgcggaagattttt

SEQ ID NO: 57913 - DNA, 23 bp, Artificial sequence
  SiRNA target sequence
tcggtgaacgcggaagattttta

SEQ ID NO: 57914 - DNA, 23 bp, Artificial sequence
  SiRNA target sequence
cggtgaacgcggaagatttttat

SEQ ID NO: 57915 - DNA, 23 bp, Artificial sequence
  SiRNA target sequence
ggtgaacgcggaagatttttatc

SEQ ID NO: 57916 - DNA, 23 bp, Artificial sequence
  SiRNA target sequence
gtgaacgcggaagatttttatct

SEQ ID NO: 57917 - DNA, 23 bp, Artificial sequence
  SiRNA target sequence
tgaacgcggaagatttttatctg

SEQ ID NO: 57918 - DNA, 23 bp, Artificial sequence
  SiRNA target sequence
gaacgcggaagatttttatctgg

SEQ ID NO: 57919 - DNA, 23 bp, Artificial sequence
  SiRNA target sequence
aacgcggaagatttttatctggt

SEQ ID NO: 57920 - DNA, 23 bp, Artificial sequence
  SiRNA target sequence
acgcggaagatttttatctggtg

SEQ ID NO: 57921 - DNA, 23 bp, Artificial sequence
  SiRNA target sequence
cgcggaagatttttatctggtgg

SEQ ID NO: 57922 - DNA, 23 bp, Artificial sequence
  SiRNA target sequence
gcggaagatttttatctggtggt

SEQ ID NO: 57923 - DNA, 23 bp, Artificial sequence
  SiRNA target sequence
cggaagatttttatctggtggtg

SEQ ID NO: 57924 - DNA, 23 bp, Artificial sequence
  SiRNA target sequence
ggaagatttttatctggtggtga

SEQ ID NO: 57925 - DNA, 23 bp, Artificial sequence
  SiRNA target sequence
gaagatttttatctggtggtgaa

SEQ ID NO: 57926 - DNA, 23 bp, Artificial sequence
  SiRNA target sequence
aagatttttatctggtggtgaaa

SEQ ID NO: 57927 - DNA, 23 bp, Artificial sequence
  SiRNA target sequence
agatttttatctggtggtgaaag

SEQ ID NO: 57928 - DNA, 23 bp, Artificial sequence
  SiRNA target sequence
gatttttatctggtggtgaaagg

SEQ ID NO: 57929 - DNA, 23 bp, Artificial sequence
  SiRNA target sequence
atttttatctggtggtgaaaggc

SEQ ID NO: 57930 - DNA, 23 bp, Artificial sequence
  SiRNA target sequence
tttttatctggtggtgaaaggca

SEQ ID NO: 57931 - DNA, 23 bp, Artificial sequence
  SiRNA target sequence
ttttatctggtggtgaaaggcaa

SEQ ID NO: 57932 - DNA, 23 bp, Artificial sequence
  SiRNA target sequence
tttatctggtggtgaaaggcaaa

SEQ ID NO: 57933 - DNA, 23 bp, Artificial sequence
  SiRNA target sequence
ttatctggtggtgaaaggcaaaa

SEQ ID NO: 57934 - DNA, 23 bp, Artificial sequence
  SiRNA target sequence
tatctggtggtgaaaggcaaaaa

SEQ ID NO: 57935 - DNA, 23 bp, Artificial sequence
  SiRNA target sequence
atctggtggtgaaaggcaaaaaa

SEQ ID NO: 57936 - DNA, 23 bp, Artificial sequence
  SiRNA target sequence
tctggtggtgaaaggcaaaaaat

SEQ ID NO: 57937 - DNA, 23 bp, Artificial sequence
  SiRNA target sequence
ctggtggtgaaaggcaaaaaatt

SEQ ID NO: 57938 - DNA, 23 bp, Artificial sequence
  SiRNA target sequence
tggtggtgaaaggcaaaaaatta

SEQ ID NO: 57939 - DNA, 23 bp, Artificial sequence
  SiRNA target sequence
ggtggtgaaaggcaaaaaattat

SEQ ID NO: 57940 - DNA, 23 bp, Artificial sequence
  SiRNA target sequence
gtggtgaaaggcaaaaaattatg

SEQ ID NO: 57941 - DNA, 23 bp, Artificial sequence
  SiRNA target sequence
tggtgaaaggcaaaaaattatgc

SEQ ID NO: 57942 - DNA, 23 bp, Artificial sequence
  SiRNA target sequence
ggtgaaaggcaaaaaattatgct

SEQ ID NO: 57943 - DNA, 23 bp, Artificial sequence
  SiRNA target sequence
gtgaaaggcaaaaaattatgctg

SEQ ID NO: 57944 - DNA, 23 bp, Artificial sequence
  SiRNA target sequence
tgaaaggcaaaaaattatgctga

SEQ ID NO: 57945 - DNA, 23 bp, Artificial sequence
  SiRNA target sequence
gaaaggcaaaaaattatgctgat

SEQ ID NO: 57946 - DNA, 23 bp, Artificial sequence
  SiRNA target sequence
aaaggcaaaaaattatgctgatg

SEQ ID NO: 57947 - DNA, 23 bp, Artificial sequence
  SiRNA target sequence
aaggcaaaaaattatgctgatgc

SEQ ID NO: 57948 - DNA, 23 bp, Artificial sequence
  SiRNA target sequence
aggcaaaaaattatgctgatgcg

SEQ ID NO: 57949 - DNA, 23 bp, Artificial sequence
  SiRNA target sequence
ggcaaaaaattatgctgatgcgt

SEQ ID NO: 57950 - DNA, 23 bp, Artificial sequence
  SiRNA target sequence
gcaaaaaattatgctgatgcgtg

SEQ ID NO: 57951 - DNA, 23 bp, Artificial sequence
  SiRNA target sequence
caaaaaattatgctgatgcgtgc

SEQ ID NO: 57952 - DNA, 23 bp, Artificial sequence
  SiRNA target sequence
aaaaaattatgctgatgcgtgca

SEQ ID NO: 57953 - DNA, 23 bp, Artificial sequence
  SiRNA target sequence
aaaaattatgctgatgcgtgcat

SEQ ID NO: 57954 - DNA, 23 bp, Artificial sequence
  SiRNA target sequence
aaaattatgctgatgcgtgcatt

SEQ ID NO: 57955 - DNA, 23 bp, Artificial sequence
  SiRNA target sequence
aaattatgctgatgcgtgcattg

SEQ ID NO: 57956 - DNA, 23 bp, Artificial sequence
  SiRNA target sequence
aattatgctgatgcgtgcattgc

SEQ ID NO: 57957 - DNA, 23 bp, Artificial sequence
  SiRNA target sequence
attatgctgatgcgtgcattgct

SEQ ID NO: 57958 - DNA, 23 bp, Artificial sequence
  SiRNA target sequence
ttatgctgatgcgtgcattgctt

SEQ ID NO: 57959 - DNA, 23 bp, Artificial sequence
  SiRNA target sequence
tatgctgatgcgtgcattgctta

SEQ ID NO: 57960 - DNA, 23 bp, Artificial sequence
  SiRNA target sequence
atgctgatgcgtgcattgcttaa

SEQ ID NO: 57961 - DNA, 23 bp, Artificial sequence
  SiRNA target sequence
tgctgatgcgtgcattgcttaaa

SEQ ID NO: 57962 - DNA, 23 bp, Artificial sequence
  SiRNA target sequence
gctgatgcgtgcattgcttaaaa

SEQ ID NO: 57963 - DNA, 23 bp, Artificial sequence
  SiRNA target sequence
ctgatgcgtgcattgcttaaaaa

SEQ ID NO: 57964 - DNA, 23 bp, Artificial sequence
  SiRNA target sequence
tgatgcgtgcattgcttaaaaat

SEQ ID NO: 57965 - DNA, 23 bp, Artificial sequence
  SiRNA target sequence
gatgcgtgcattgcttaaaaatt

SEQ ID NO: 57966 - DNA, 23 bp, Artificial sequence
  SiRNA target sequence
atgcgtgcattgcttaaaaattc

SEQ ID NO: 57967 - DNA, 23 bp, Artificial sequence
  SiRNA target sequence
tgcgtgcattgcttaaaaattca

SEQ ID NO: 57968 - DNA, 23 bp, Artificial sequence
  SiRNA target sequence
gcgtgcattgcttaaaaattcag

SEQ ID NO: 57969 - DNA, 23 bp, Artificial sequence
  SiRNA target sequence
cgtgcattgcttaaaaattcaga

SEQ ID NO: 57970 - DNA, 23 bp, Artificial sequence
  SiRNA target sequence
gtgcattgcttaaaaattcagag

SEQ ID NO: 57971 - DNA, 23 bp, Artificial sequence
  SiRNA target sequence
tgcattgcttaaaaattcagaga

SEQ ID NO: 57972 - DNA, 23 bp, Artificial sequence
  SiRNA target sequence
gcattgcttaaaaattcagagat

SEQ ID NO: 57973 - DNA, 23 bp, Artificial sequence
  SiRNA target sequence
cattgcttaaaaattcagagatc

SEQ ID NO: 57974 - DNA, 23 bp, Artificial sequence
  SiRNA target sequence
attgcttaaaaattcagagatcg

SEQ ID NO: 57975 - DNA, 23 bp, Artificial sequence
  SiRNA target sequence
ttgcttaaaaattcagagatcgt

SEQ ID NO: 57976 - DNA, 23 bp, Artificial sequence
  SiRNA target sequence
tgcttaaaaattcagagatcgtt

SEQ ID NO: 57977 - DNA, 23 bp, Artificial sequence
  SiRNA target sequence
gcttaaaaattcagagatcgttt

SEQ ID NO: 57978 - DNA, 23 bp, Artificial sequence
  SiRNA target sequence
cttaaaaattcagagatcgtttt

SEQ ID NO: 57979 - DNA, 23 bp, Artificial sequence
  SiRNA target sequence
ttaaaaattcagagatcgtttta

SEQ ID NO: 57980 - DNA, 23 bp, Artificial sequence
  SiRNA target sequence
taaaaattcagagatcgttttat

SEQ ID NO: 57981 - DNA, 23 bp, Artificial sequence
  SiRNA target sequence
aaaaattcagagatcgttttatt

SEQ ID NO: 57982 - DNA, 23 bp, Artificial sequence
  SiRNA target sequence
aaaattcagagatcgttttatta

SEQ ID NO: 57983 - DNA, 23 bp, Artificial sequence
  SiRNA target sequence
aaattcagagatcgttttattag

SEQ ID NO: 57984 - DNA, 23 bp, Artificial sequence
  SiRNA target sequence
aattcagagatcgttttattaga

SEQ ID NO: 57985 - DNA, 23 bp, Artificial sequence
  SiRNA target sequence
attcagagatcgttttattagac

SEQ ID NO: 57986 - DNA, 23 bp, Artificial sequence
  SiRNA target sequence
ttcagagatcgttttattagacg

SEQ ID NO: 57987 - DNA, 23 bp, Artificial sequence
  SiRNA target sequence
tcagagatcgttttattagacga

SEQ ID NO: 57988 - DNA, 23 bp, Artificial sequence
  SiRNA target sequence
cagagatcgttttattagacgag

SEQ ID NO: 57989 - DNA, 23 bp, Artificial sequence
  SiRNA target sequence
agagatcgttttattagacgagc

SEQ ID NO: 57990 - DNA, 23 bp, Artificial sequence
  SiRNA target sequence
gagatcgttttattagacgagcc

SEQ ID NO: 57991 - DNA, 23 bp, Artificial sequence
  SiRNA target sequence
agatcgttttattagacgagcca

SEQ ID NO: 57992 - DNA, 23 bp, Artificial sequence
  SiRNA target sequence
gatcgttttattagacgagccaa

SEQ ID NO: 57993 - DNA, 23 bp, Artificial sequence
  SiRNA target sequence
atcgttttattagacgagccaac

SEQ ID NO: 57994 - DNA, 23 bp, Artificial sequence
  SiRNA target sequence
tcgttttattagacgagccaacc

SEQ ID NO: 57995 - DNA, 23 bp, Artificial sequence
  SiRNA target sequence
cgttttattagacgagccaacct

SEQ ID NO: 57996 - DNA, 23 bp, Artificial sequence
  SiRNA target sequence
gttttattagacgagccaacctc

SEQ ID NO: 57997 - DNA, 23 bp, Artificial sequence
  SiRNA target sequence
ttttattagacgagccaacctca

SEQ ID NO: 57998 - DNA, 23 bp, Artificial sequence
  SiRNA target sequence
tttattagacgagccaacctcag

SEQ ID NO: 57999 - DNA, 23 bp, Artificial sequence
  SiRNA target sequence
ttattagacgagccaacctcagc

SEQ ID NO: 58000 - DNA, 23 bp, Artificial sequence
  SiRNA target sequence
tattagacgagccaacctcagca

SEQ ID NO: 58001 - DNA, 23 bp, Artificial sequence
  SiRNA target sequence
attagacgagccaacctcagcac

SEQ ID NO: 58002 - DNA, 23 bp, Artificial sequence
  SiRNA target sequence
ttagacgagccaacctcagcact

SEQ ID NO: 58003 - DNA, 23 bp, Artificial sequence
  SiRNA target sequence
tagacgagccaacctcagcacta

SEQ ID NO: 58004 - DNA, 23 bp, Artificial sequence
  SiRNA target sequence
agacgagccaacctcagcactag

SEQ ID NO: 58005 - DNA, 23 bp, Artificial sequence
  SiRNA target sequence
gacgagccaacctcagcactaga

SEQ ID NO: 58006 - DNA, 23 bp, Artificial sequence
  SiRNA target sequence
acgagccaacctcagcactagat

SEQ ID NO: 58007 - DNA, 23 bp, Artificial sequence
  SiRNA target sequence
cgagccaacctcagcactagata

SEQ ID NO: 58008 - DNA, 23 bp, Artificial sequence
  SiRNA target sequence
gagccaacctcagcactagataa

SEQ ID NO: 58009 - DNA, 23 bp, Artificial sequence
  SiRNA target sequence
agccaacctcagcactagataaa

SEQ ID NO: 58010 - DNA, 23 bp, Artificial sequence
  SiRNA target sequence
gccaacctcagcactagataaaa

SEQ ID NO: 58011 - DNA, 23 bp, Artificial sequence
  SiRNA target sequence
ccaacctcagcactagataaaaa

SEQ ID NO: 58012 - DNA, 23 bp, Artificial sequence
  SiRNA target sequence
caacctcagcactagataaaaag

SEQ ID NO: 58013 - DNA, 23 bp, Artificial sequence
  SiRNA target sequence
aacctcagcactagataaaaaga

SEQ ID NO: 58014 - DNA, 23 bp, Artificial sequence
  SiRNA target sequence
acctcagcactagataaaaagag

SEQ ID NO: 58015 - DNA, 23 bp, Artificial sequence
  SiRNA target sequence
cctcagcactagataaaaagagt

SEQ ID NO: 58016 - DNA, 23 bp, Artificial sequence
  SiRNA target sequence
ctcagcactagataaaaagagtg

SEQ ID NO: 58017 - DNA, 23 bp, Artificial sequence
  SiRNA target sequence
tcagcactagataaaaagagtga

SEQ ID NO: 58018 - DNA, 23 bp, Artificial sequence
  SiRNA target sequence
cagcactagataaaaagagtgaa

SEQ ID NO: 58019 - DNA, 23 bp, Artificial sequence
  SiRNA target sequence
agcactagataaaaagagtgaac

SEQ ID NO: 58020 - DNA, 23 bp, Artificial sequence
  SiRNA target sequence
gcactagataaaaagagtgaact

SEQ ID NO: 58021 - DNA, 23 bp, Artificial sequence
  SiRNA target sequence
cactagataaaaagagtgaacta

SEQ ID NO: 58022 - DNA, 23 bp, Artificial sequence
  SiRNA target sequence
actagataaaaagagtgaactag

SEQ ID NO: 58023 - DNA, 23 bp, Artificial sequence
  SiRNA target sequence
ctagataaaaagagtgaactaga

SEQ ID NO: 58024 - DNA, 23 bp, Artificial sequence
  SiRNA target sequence
tagataaaaagagtgaactagaa

SEQ ID NO: 58025 - DNA, 23 bp, Artificial sequence
  SiRNA target sequence
agataaaaagagtgaactagaaa

SEQ ID NO: 58026 - DNA, 23 bp, Artificial sequence
  SiRNA target sequence
gataaaaagagtgaactagaaac

SEQ ID NO: 58027 - DNA, 23 bp, Artificial sequence
  SiRNA target sequence
ataaaaagagtgaactagaaact

SEQ ID NO: 58028 - DNA, 23 bp, Artificial sequence
  SiRNA target sequence
taaaaagagtgaactagaaacta

SEQ ID NO: 58029 - DNA, 23 bp, Artificial sequence
  SiRNA target sequence
aaaaagagtgaactagaaactat

SEQ ID NO: 58030 - DNA, 23 bp, Artificial sequence
  SiRNA target sequence
aaaagagtgaactagaaactatg

SEQ ID NO: 58031 - DNA, 23 bp, Artificial sequence
  SiRNA target sequence
aaagagtgaactagaaactatga

SEQ ID NO: 58032 - DNA, 23 bp, Artificial sequence
  SiRNA target sequence
aagagtgaactagaaactatgac

SEQ ID NO: 58033 - DNA, 23 bp, Artificial sequence
  SiRNA target sequence
agagtgaactagaaactatgaca

SEQ ID NO: 58034 - DNA, 23 bp, Artificial sequence
  SiRNA target sequence
gagtgaactagaaactatgacat

SEQ ID NO: 58035 - DNA, 23 bp, Artificial sequence
  SiRNA target sequence
agtgaactagaaactatgacata

SEQ ID NO: 58036 - DNA, 23 bp, Artificial sequence
  SiRNA target sequence
gtgaactagaaactatgacatat

SEQ ID NO: 58037 - DNA, 23 bp, Artificial sequence
  SiRNA target sequence
tgaactagaaactatgacatata

SEQ ID NO: 58038 - DNA, 23 bp, Artificial sequence
  SiRNA target sequence
gaactagaaactatgacatatat

SEQ ID NO: 58039 - DNA, 23 bp, Artificial sequence
  SiRNA target sequence
aactagaaactatgacatatatt

SEQ ID NO: 58040 - DNA, 23 bp, Artificial sequence
  SiRNA target sequence
actagaaactatgacatatattt

SEQ ID NO: 58041 - DNA, 23 bp, Artificial sequence
  SiRNA target sequence
ctagaaactatgacatatatttt

SEQ ID NO: 58042 - DNA, 23 bp, Artificial sequence
  SiRNA target sequence
tagaaactatgacatatattttt

SEQ ID NO: 58043 - DNA, 23 bp, Artificial sequence
  SiRNA target sequence
agaaactatgacatatattttta

SEQ ID NO: 58044 - DNA, 23 bp, Artificial sequence
  SiRNA target sequence
gaaactatgacatatatttttaa

SEQ ID NO: 58045 - DNA, 23 bp, Artificial sequence
  SiRNA target sequence
aaactatgacatatatttttaat

SEQ ID NO: 58046 - DNA, 23 bp, Artificial sequence
  SiRNA target sequence
aactatgacatatatttttaatg

SEQ ID NO: 58047 - DNA, 23 bp, Artificial sequence
  SiRNA target sequence
actatgacatatatttttaatga

SEQ ID NO: 58048 - DNA, 23 bp, Artificial sequence
  SiRNA target sequence
ctatgacatatatttttaatgaa

SEQ ID NO: 58049 - DNA, 23 bp, Artificial sequence
  SiRNA target sequence
tatgacatatatttttaatgaat

SEQ ID NO: 58050 - DNA, 23 bp, Artificial sequence
  SiRNA target sequence
atgacatatatttttaatgaatt

SEQ ID NO: 58051 - DNA, 23 bp, Artificial sequence
  SiRNA target sequence
tgacatatatttttaatgaattt

SEQ ID NO: 58052 - DNA, 23 bp, Artificial sequence
  SiRNA target sequence
gacatatatttttaatgaattta

SEQ ID NO: 58053 - DNA, 23 bp, Artificial sequence
  SiRNA target sequence
acatatatttttaatgaatttaa

SEQ ID NO: 58054 - DNA, 23 bp, Artificial sequence
  SiRNA target sequence
catatatttttaatgaatttaag

SEQ ID NO: 58055 - DNA, 23 bp, Artificial sequence
  SiRNA target sequence
atatatttttaatgaatttaagt

SEQ ID NO: 58056 - DNA, 23 bp, Artificial sequence
  SiRNA target sequence
tatatttttaatgaatttaagta

SEQ ID NO: 58057 - DNA, 23 bp, Artificial sequence
  SiRNA target sequence
atatttttaatgaatttaagtac

SEQ ID NO: 58058 - DNA, 23 bp, Artificial sequence
  SiRNA target sequence
tatttttaatgaatttaagtacc

SEQ ID NO: 58059 - DNA, 23 bp, Artificial sequence
  SiRNA target sequence
atttttaatgaatttaagtacca

SEQ ID NO: 58060 - DNA, 23 bp, Artificial sequence
  SiRNA target sequence
tttttaatgaatttaagtaccat

SEQ ID NO: 58061 - DNA, 23 bp, Artificial sequence
  SiRNA target sequence
ttttaatgaatttaagtaccata

SEQ ID NO: 58062 - DNA, 23 bp, Artificial sequence
  SiRNA target sequence
tttaatgaatttaagtaccatac

SEQ ID NO: 58063 - DNA, 23 bp, Artificial sequence
  SiRNA target sequence
ttaatgaatttaagtaccatact

SEQ ID NO: 58064 - DNA, 23 bp, Artificial sequence
  SiRNA target sequence
taatgaatttaagtaccatactt

SEQ ID NO: 58065 - DNA, 23 bp, Artificial sequence
  SiRNA target sequence
aatgaatttaagtaccatacttt

SEQ ID NO: 58066 - DNA, 23 bp, Artificial sequence
  SiRNA target sequence
atgaatttaagtaccatactttt

SEQ ID NO: 58067 - DNA, 23 bp, Artificial sequence
  SiRNA target sequence
tgaatttaagtaccatacttttg

SEQ ID NO: 58068 - DNA, 23 bp, Artificial sequence
  SiRNA target sequence
gaatttaagtaccatacttttgt

SEQ ID NO: 58069 - DNA, 23 bp, Artificial sequence
  SiRNA target sequence
aatttaagtaccatacttttgta

SEQ ID NO: 58070 - DNA, 23 bp, Artificial sequence
  SiRNA target sequence
atttaagtaccatacttttgtaa

SEQ ID NO: 58071 - DNA, 23 bp, Artificial sequence
  SiRNA target sequence
tttaagtaccatacttttgtaat

SEQ ID NO: 58072 - DNA, 23 bp, Artificial sequence
  SiRNA target sequence
ttaagtaccatacttttgtaata

SEQ ID NO: 58073 - DNA, 23 bp, Artificial sequence
  SiRNA target sequence
taagtaccatacttttgtaataa

SEQ ID NO: 58074 - DNA, 23 bp, Artificial sequence
  SiRNA target sequence
aagtaccatacttttgtaataat

SEQ ID NO: 58075 - DNA, 23 bp, Artificial sequence
  SiRNA target sequence
agtaccatacttttgtaataatt

SEQ ID NO: 58076 - DNA, 23 bp, Artificial sequence
  SiRNA target sequence
gtaccatacttttgtaataattg

SEQ ID NO: 58077 - DNA, 23 bp, Artificial sequence
  SiRNA target sequence
taccatacttttgtaataattgt

SEQ ID NO: 58078 - DNA, 23 bp, Artificial sequence
  SiRNA target sequence
accatacttttgtaataattgta

SEQ ID NO: 58079 - DNA, 23 bp, Artificial sequence
  SiRNA target sequence
ccatacttttgtaataattgtac

SEQ ID NO: 58080 - DNA, 23 bp, Artificial sequence
  SiRNA target sequence
catacttttgtaataattgtaca

SEQ ID NO: 58081 - DNA, 23 bp, Artificial sequence
  SiRNA target sequence
atacttttgtaataattgtacac

SEQ ID NO: 58082 - DNA, 23 bp, Artificial sequence
  SiRNA target sequence
tacttttgtaataattgtacaca

SEQ ID NO: 58083 - DNA, 23 bp, Artificial sequence
  SiRNA target sequence
acttttgtaataattgtacacaa

SEQ ID NO: 58084 - DNA, 23 bp, Artificial sequence
  SiRNA target sequence
cttttgtaataattgtacacaat

SEQ ID NO: 58085 - DNA, 23 bp, Artificial sequence
  SiRNA target sequence
ttttgtaataattgtacacaatc

SEQ ID NO: 58086 - DNA, 23 bp, Artificial sequence
  SiRNA target sequence
tttgtaataattgtacacaatct

SEQ ID NO: 58087 - DNA, 23 bp, Artificial sequence
  SiRNA target sequence
ttgtaataattgtacacaatcta

SEQ ID NO: 58088 - DNA, 23 bp, Artificial sequence
  SiRNA target sequence
tgtaataattgtacacaatctag

SEQ ID NO: 58089 - DNA, 23 bp, Artificial sequence
  SiRNA target sequence
gtaataattgtacacaatctaga

SEQ ID NO: 58090 - DNA, 23 bp, Artificial sequence
  SiRNA target sequence
taataattgtacacaatctagaa

SEQ ID NO: 58091 - DNA, 23 bp, Artificial sequence
  SiRNA target sequence
aataattgtacacaatctagaat

SEQ ID NO: 58092 - DNA, 23 bp, Artificial sequence
  SiRNA target sequence
ataattgtacacaatctagaatt

SEQ ID NO: 58093 - DNA, 23 bp, Artificial sequence
  SiRNA target sequence
taattgtacacaatctagaatta

SEQ ID NO: 58094 - DNA, 23 bp, Artificial sequence
  SiRNA target sequence
aattgtacacaatctagaattat

SEQ ID NO: 58095 - DNA, 23 bp, Artificial sequence
  SiRNA target sequence
attgtacacaatctagaattatt

SEQ ID NO: 58096 - DNA, 23 bp, Artificial sequence
  SiRNA target sequence
ttgtacacaatctagaattattg

SEQ ID NO: 58097 - DNA, 23 bp, Artificial sequence
  SiRNA target sequence
tgtacacaatctagaattattgg

SEQ ID NO: 58098 - DNA, 23 bp, Artificial sequence
  SiRNA target sequence
gtacacaatctagaattattggc

SEQ ID NO: 58099 - DNA, 23 bp, Artificial sequence
  SiRNA target sequence
tacacaatctagaattattggct

SEQ ID NO: 58100 - DNA, 23 bp, Artificial sequence
  SiRNA target sequence
acacaatctagaattattggctt

SEQ ID NO: 58101 - DNA, 23 bp, Artificial sequence
  SiRNA target sequence
cacaatctagaattattggcttt

SEQ ID NO: 58102 - DNA, 23 bp, Artificial sequence
  SiRNA target sequence
acaatctagaattattggctttg

SEQ ID NO: 58103 - DNA, 23 bp, Artificial sequence
  SiRNA target sequence
caatctagaattattggctttgt

SEQ ID NO: 58104 - DNA, 23 bp, Artificial sequence
  SiRNA target sequence
aatctagaattattggctttgtt

SEQ ID NO: 58105 - DNA, 23 bp, Artificial sequence
  SiRNA target sequence
atctagaattattggctttgttt

SEQ ID NO: 58106 - DNA, 23 bp, Artificial sequence
  SiRNA target sequence
tctagaattattggctttgtttg

SEQ ID NO: 58107 - DNA, 23 bp, Artificial sequence
  SiRNA target sequence
ctagaattattggctttgtttga

SEQ ID NO: 58108 - DNA, 23 bp, Artificial sequence
  SiRNA target sequence
tagaattattggctttgtttgat

SEQ ID NO: 58109 - DNA, 23 bp, Artificial sequence
  SiRNA target sequence
agaattattggctttgtttgata

SEQ ID NO: 58110 - DNA, 23 bp, Artificial sequence
  SiRNA target sequence
gaattattggctttgtttgataa

SEQ ID NO: 58111 - DNA, 23 bp, Artificial sequence
  SiRNA target sequence
aattattggctttgtttgataaa

SEQ ID NO: 58112 - DNA, 23 bp, Artificial sequence
  SiRNA target sequence
attattggctttgtttgataaaa

SEQ ID NO: 58113 - DNA, 23 bp, Artificial sequence
  SiRNA target sequence
ttattggctttgtttgataaaat

SEQ ID NO: 58114 - DNA, 23 bp, Artificial sequence
  SiRNA target sequence
tattggctttgtttgataaaatt

SEQ ID NO: 58115 - DNA, 23 bp, Artificial sequence
  SiRNA target sequence
attggctttgtttgataaaattt

SEQ ID NO: 58116 - DNA, 23 bp, Artificial sequence
  SiRNA target sequence
ttggctttgtttgataaaatttt

SEQ ID NO: 58117 - DNA, 23 bp, Artificial sequence
  SiRNA target sequence
tggctttgtttgataaaatttta

SEQ ID NO: 58118 - DNA, 23 bp, Artificial sequence
  SiRNA target sequence
ggctttgtttgataaaattttat

SEQ ID NO: 58119 - DNA, 23 bp, Artificial sequence
  SiRNA target sequence
gctttgtttgataaaattttatt

SEQ ID NO: 58120 - DNA, 23 bp, Artificial sequence
  SiRNA target sequence
ctttgtttgataaaattttattt

SEQ ID NO: 58121 - DNA, 23 bp, Artificial sequence
  SiRNA target sequence
tttgtttgataaaattttatttg

SEQ ID NO: 58122 - DNA, 23 bp, Artificial sequence
  SiRNA target sequence
ttgtttgataaaattttatttgt

SEQ ID NO: 58123 - DNA, 23 bp, Artificial sequence
  SiRNA target sequence
tgtttgataaaattttatttgta

SEQ ID NO: 58124 - DNA, 23 bp, Artificial sequence
  SiRNA target sequence
gtttgataaaattttatttgtaa

SEQ ID NO: 58125 - DNA, 23 bp, Artificial sequence
  SiRNA target sequence
tttgataaaattttatttgtaaa

SEQ ID NO: 58126 - DNA, 23 bp, Artificial sequence
  SiRNA target sequence
ttgataaaattttatttgtaaat

SEQ ID NO: 58127 - DNA, 23 bp, Artificial sequence
  SiRNA target sequence
tgataaaattttatttgtaaatg

SEQ ID NO: 58128 - DNA, 23 bp, Artificial sequence
  SiRNA target sequence
gataaaattttatttgtaaatgg

SEQ ID NO: 58129 - DNA, 23 bp, Artificial sequence
  SiRNA target sequence
ataaaattttatttgtaaatggt

SEQ ID NO: 58130 - DNA, 23 bp, Artificial sequence
  SiRNA target sequence
taaaattttatttgtaaatggta

SEQ ID NO: 58131 - DNA, 23 bp, Artificial sequence
  SiRNA target sequence
aaaattttatttgtaaatggtaa

SEQ ID NO: 58132 - DNA, 23 bp, Artificial sequence
  SiRNA target sequence
aaattttatttgtaaatggtaat

SEQ ID NO: 58133 - DNA, 23 bp, Artificial sequence
  SiRNA target sequence
aattttatttgtaaatggtaatg

SEQ ID NO: 58134 - DNA, 23 bp, Artificial sequence
  SiRNA target sequence
attttatttgtaaatggtaatga

SEQ ID NO: 58135 - DNA, 23 bp, Artificial sequence
  SiRNA target sequence
ttttatttgtaaatggtaatgag

SEQ ID NO: 58136 - DNA, 23 bp, Artificial sequence
  SiRNA target sequence
tttatttgtaaatggtaatgagg

SEQ ID NO: 58137 - DNA, 23 bp, Artificial sequence
  SiRNA target sequence
ttatttgtaaatggtaatgaggt

SEQ ID NO: 58138 - DNA, 23 bp, Artificial sequence
  SiRNA target sequence
tatttgtaaatggtaatgaggta

SEQ ID NO: 58139 - DNA, 23 bp, Artificial sequence
  SiRNA target sequence
atttgtaaatggtaatgaggtaa

SEQ ID NO: 58140 - DNA, 23 bp, Artificial sequence
  SiRNA target sequence
tttgtaaatggtaatgaggtaac

SEQ ID NO: 58141 - DNA, 23 bp, Artificial sequence
  SiRNA target sequence
ttgtaaatggtaatgaggtaaca

SEQ ID NO: 58142 - DNA, 23 bp, Artificial sequence
  SiRNA target sequence
tgtaaatggtaatgaggtaacaa

SEQ ID NO: 58143 - DNA, 23 bp, Artificial sequence
  SiRNA target sequence
gtaaatggtaatgaggtaacaat

SEQ ID NO: 58144 - DNA, 23 bp, Artificial sequence
  SiRNA target sequence
taaatggtaatgaggtaacaatg

SEQ ID NO: 58145 - DNA, 23 bp, Artificial sequence
  SiRNA target sequence
aaatggtaatgaggtaacaatga

SEQ ID NO: 58146 - DNA, 23 bp, Artificial sequence
  SiRNA target sequence
aatggtaatgaggtaacaatgat

SEQ ID NO: 58147 - DNA, 23 bp, Artificial sequence
  SiRNA target sequence
atggtaatgaggtaacaatgata

SEQ ID NO: 58148 - DNA, 23 bp, Artificial sequence
  SiRNA target sequence
tggtaatgaggtaacaatgatag

SEQ ID NO: 58149 - DNA, 23 bp, Artificial sequence
  SiRNA target sequence
ggtaatgaggtaacaatgataga

SEQ ID NO: 58150 - DNA, 23 bp, Artificial sequence
  SiRNA target sequence
gtaatgaggtaacaatgatagaa

SEQ ID NO: 58151 - DNA, 23 bp, Artificial sequence
  SiRNA target sequence
taatgaggtaacaatgatagaag

SEQ ID NO: 58152 - DNA, 23 bp, Artificial sequence
  SiRNA target sequence
aatgaggtaacaatgatagaaga

SEQ ID NO: 58153 - DNA, 23 bp, Artificial sequence
  SiRNA target sequence
atgaggtaacaatgatagaagac

SEQ ID NO: 58154 - DNA, 23 bp, Artificial sequence
  SiRNA target sequence
tgaggtaacaatgatagaagaca

SEQ ID NO: 58155 - DNA, 23 bp, Artificial sequence
  SiRNA target sequence
gaggtaacaatgatagaagacat

SEQ ID NO: 58156 - DNA, 23 bp, Artificial sequence
  SiRNA target sequence
aggtaacaatgatagaagacatt

SEQ ID NO: 58157 - DNA, 23 bp, Artificial sequence
  SiRNA target sequence
ggtaacaatgatagaagacatta

SEQ ID NO: 58158 - DNA, 23 bp, Artificial sequence
  SiRNA target sequence
gtaacaatgatagaagacattaa

SEQ ID NO: 58159 - DNA, 23 bp, Artificial sequence
  SiRNA target sequence
taacaatgatagaagacattaac

SEQ ID NO: 58160 - DNA, 23 bp, Artificial sequence
  SiRNA target sequence
aacaatgatagaagacattaaca

SEQ ID NO: 58161 - DNA, 23 bp, Artificial sequence
  SiRNA target sequence
acaatgatagaagacattaacaa

SEQ ID NO: 58162 - DNA, 23 bp, Artificial sequence
  SiRNA target sequence
caatgatagaagacattaacaaa

SEQ ID NO: 58163 - DNA, 23 bp, Artificial sequence
  SiRNA target sequence
aatgatagaagacattaacaaaa

SEQ ID NO: 58164 - DNA, 23 bp, Artificial sequence
  SiRNA target sequence
atgatagaagacattaacaaaaa

SEQ ID NO: 58165 - DNA, 23 bp, Artificial sequence
  SiRNA target sequence
tgatagaagacattaacaaaaaa

SEQ ID NO: 58166 - DNA, 23 bp, Artificial sequence
  SiRNA target sequence
gatagaagacattaacaaaaaac

SEQ ID NO: 58167 - DNA, 23 bp, Artificial sequence
  SiRNA target sequence
atagaagacattaacaaaaaact

SEQ ID NO: 58168 - DNA, 23 bp, Artificial sequence
  SiRNA target sequence
tagaagacattaacaaaaaactt

SEQ ID NO: 58169 - DNA, 23 bp, Artificial sequence
  SiRNA target sequence
agaagacattaacaaaaaacttg

SEQ ID NO: 58170 - DNA, 23 bp, Artificial sequence
  SiRNA target sequence
gaagacattaacaaaaaacttga

SEQ ID NO: 58171 - DNA, 23 bp, Artificial sequence
  SiRNA target sequence
aagacattaacaaaaaacttgaa

SEQ ID NO: 58172 - DNA, 23 bp, Artificial sequence
  SiRNA target sequence
agacattaacaaaaaacttgaag

SEQ ID NO: 58173 - DNA, 23 bp, Artificial sequence
  SiRNA target sequence
gacattaacaaaaaacttgaaga

SEQ ID NO: 58174 - DNA, 23 bp, Artificial sequence
  SiRNA target sequence
acattaacaaaaaacttgaagaa

SEQ ID NO: 58175 - DNA, 23 bp, Artificial sequence
  SiRNA target sequence
cattaacaaaaaacttgaagaaa

SEQ ID NO: 58176 - DNA, 23 bp, Artificial sequence
  SiRNA target sequence
attaacaaaaaacttgaagaaaa

SEQ ID NO: 58177 - DNA, 23 bp, Artificial sequence
  SiRNA target sequence
ttaacaaaaaacttgaagaaaat

SEQ ID NO: 58178 - DNA, 23 bp, Artificial sequence
  SiRNA target sequence
taacaaaaaacttgaagaaaatt

SEQ ID NO: 58179 - DNA, 23 bp, Artificial sequence
  SiRNA target sequence
aacaaaaaacttgaagaaaattc

SEQ ID NO: 58180 - DNA, 23 bp, Artificial sequence
  SiRNA target sequence
acaaaaaacttgaagaaaattca

SEQ ID NO: 58181 - DNA, 23 bp, Artificial sequence
  SiRNA target sequence
caaaaaacttgaagaaaattcaa

SEQ ID NO: 58182 - DNA, 23 bp, Artificial sequence
  SiRNA target sequence
aaaaaacttgaagaaaattcaaa

SEQ ID NO: 58183 - DNA, 23 bp, Artificial sequence
  SiRNA target sequence
aaaaacttgaagaaaattcaaag

SEQ ID NO: 58184 - DNA, 23 bp, Artificial sequence
  SiRNA target sequence
aaaacttgaagaaaattcaaagt

SEQ ID NO: 58185 - DNA, 23 bp, Artificial sequence
  SiRNA target sequence
aaacttgaagaaaattcaaagta

SEQ ID NO: 58186 - DNA, 23 bp, Artificial sequence
  SiRNA target sequence
aacttgaagaaaattcaaagtat

SEQ ID NO: 58187 - DNA, 23 bp, Artificial sequence
  SiRNA target sequence
acttgaagaaaattcaaagtatt

SEQ ID NO: 58188 - DNA, 23 bp, Artificial sequence
  SiRNA target sequence
cttgaagaaaattcaaagtattt

SEQ ID NO: 58189 - DNA, 23 bp, Artificial sequence
  SiRNA target sequence
ttgaagaaaattcaaagtatttt

SEQ ID NO: 58190 - DNA, 23 bp, Artificial sequence
  SiRNA target sequence
tgaagaaaattcaaagtattttg

SEQ ID NO: 58191 - DNA, 23 bp, Artificial sequence
  SiRNA target sequence
gaagaaaattcaaagtattttgc

SEQ ID NO: 58192 - DNA, 23 bp, Artificial sequence
  SiRNA target sequence
aagaaaattcaaagtattttgca

SEQ ID NO: 58193 - DNA, 23 bp, Artificial sequence
  SiRNA target sequence
agaaaattcaaagtattttgcag

SEQ ID NO: 58194 - DNA, 23 bp, Artificial sequence
  SiRNA target sequence
gaaaattcaaagtattttgcaga

SEQ ID NO: 58195 - DNA, 23 bp, Artificial sequence
  SiRNA target sequence
aaaattcaaagtattttgcagat

SEQ ID NO: 58196 - DNA, 23 bp, Artificial sequence
  SiRNA target sequence
aaattcaaagtattttgcagata

SEQ ID NO: 58197 - DNA, 23 bp, Artificial sequence
  SiRNA target sequence
aattcaaagtattttgcagatat

SEQ ID NO: 58198 - DNA, 23 bp, Artificial sequence
  SiRNA target sequence
attcaaagtattttgcagatatt

SEQ ID NO: 58199 - DNA, 23 bp, Artificial sequence
  SiRNA target sequence
ttcaaagtattttgcagatattt

SEQ ID NO: 58200 - DNA, 23 bp, Artificial sequence
  SiRNA target sequence
tcaaagtattttgcagatatttt

SEQ ID NO: 58201 - DNA, 23 bp, Artificial sequence
  SiRNA target sequence
caaagtattttgcagatatttta

SEQ ID NO: 58202 - DNA, 23 bp, Artificial sequence
  SiRNA target sequence
aaagtattttgcagatattttaa

SEQ ID NO: 58203 - DNA, 23 bp, Artificial sequence
  SiRNA target sequence
aagtattttgcagatattttaaa

SEQ ID NO: 58204 - DNA, 23 bp, Artificial sequence
  SiRNA target sequence
agtattttgcagatattttaaac

SEQ ID NO: 58205 - DNA, 23 bp, Artificial sequence
  SiRNA target sequence
gtattttgcagatattttaaaca

SEQ ID NO: 58206 - DNA, 23 bp, Artificial sequence
  SiRNA target sequence
tattttgcagatattttaaacaa

SEQ ID NO: 58207 - DNA, 23 bp, Artificial sequence
  SiRNA target sequence
attttgcagatattttaaacaac

SEQ ID NO: 58208 - DNA, 23 bp, Artificial sequence
  SiRNA target sequence
ttttgcagatattttaaacaacg

SEQ ID NO: 58209 - DNA, 23 bp, Artificial sequence
  SiRNA target sequence
tttgcagatattttaaacaacga

SEQ ID NO: 58210 - DNA, 23 bp, Artificial sequence
  SiRNA target sequence
ttgcagatattttaaacaacgaa

SEQ ID NO: 58211 - DNA, 23 bp, Artificial sequence
  SiRNA target sequence
tgcagatattttaaacaacgaat

SEQ ID NO: 58212 - DNA, 23 bp, Artificial sequence
  SiRNA target sequence
gcagatattttaaacaacgaata

SEQ ID NO: 58213 - DNA, 23 bp, Artificial sequence
  SiRNA target sequence
cagatattttaaacaacgaataa

SEQ ID NO: 58214 - DNA, 24 bp, Artificial sequence
  SiRNA target sequence
atgaaggaaaaaaccaattatgaa

SEQ ID NO: 58215 - DNA, 24 bp, Artificial sequence
  SiRNA target sequence
tgaaggaaaaaaccaattatgaaa

SEQ ID NO: 58216 - DNA, 24 bp, Artificial sequence
  SiRNA target sequence
gaaggaaaaaaccaattatgaaat

SEQ ID NO: 58217 - DNA, 24 bp, Artificial sequence
  SiRNA target sequence
aaggaaaaaaccaattatgaaatt

SEQ ID NO: 58218 - DNA, 24 bp, Artificial sequence
  SiRNA target sequence
aggaaaaaaccaattatgaaattt

SEQ ID NO: 58219 - DNA, 24 bp, Artificial sequence
  SiRNA target sequence
ggaaaaaaccaattatgaaatttt

SEQ ID NO: 58220 - DNA, 24 bp, Artificial sequence
  SiRNA target sequence
gaaaaaaccaattatgaaatttta

SEQ ID NO: 58221 - DNA, 24 bp, Artificial sequence
  SiRNA target sequence
aaaaaaccaattatgaaattttat

SEQ ID NO: 58222 - DNA, 24 bp, Artificial sequence
  SiRNA target sequence
aaaaaccaattatgaaattttata

SEQ ID NO: 58223 - DNA, 24 bp, Artificial sequence
  SiRNA target sequence
aaaaccaattatgaaattttatat

SEQ ID NO: 58224 - DNA, 24 bp, Artificial sequence
  SiRNA target sequence
aaaccaattatgaaattttatatg

SEQ ID NO: 58225 - DNA, 24 bp, Artificial sequence
  SiRNA target sequence
aaccaattatgaaattttatatga

SEQ ID NO: 58226 - DNA, 24 bp, Artificial sequence
  SiRNA target sequence
accaattatgaaattttatatgat

SEQ ID NO: 58227 - DNA, 24 bp, Artificial sequence
  SiRNA target sequence
ccaattatgaaattttatatgata

SEQ ID NO: 58228 - DNA, 24 bp, Artificial sequence
  SiRNA target sequence
caattatgaaattttatatgatac

SEQ ID NO: 58229 - DNA, 24 bp, Artificial sequence
  SiRNA target sequence
aattatgaaattttatatgataca

SEQ ID NO: 58230 - DNA, 24 bp, Artificial sequence
  SiRNA target sequence
attatgaaattttatatgatacat

SEQ ID NO: 58231 - DNA, 24 bp, Artificial sequence
  SiRNA target sequence
ttatgaaattttatatgatacatt

SEQ ID NO: 58232 - DNA, 24 bp, Artificial sequence
  SiRNA target sequence
tatgaaattttatatgatacattt

SEQ ID NO: 58233 - DNA, 24 bp, Artificial sequence
  SiRNA target sequence
atgaaattttatatgatacatttg

SEQ ID NO: 58234 - DNA, 24 bp, Artificial sequence
  SiRNA target sequence
tgaaattttatatgatacatttgt

SEQ ID NO: 58235 - DNA, 24 bp, Artificial sequence
  SiRNA target sequence
gaaattttatatgatacatttgta

SEQ ID NO: 58236 - DNA, 24 bp, Artificial sequence
  SiRNA target sequence
aaattttatatgatacatttgtaa

SEQ ID NO: 58237 - DNA, 24 bp, Artificial sequence
  SiRNA target sequence
aattttatatgatacatttgtaaa

SEQ ID NO: 58238 - DNA, 24 bp, Artificial sequence
  SiRNA target sequence
attttatatgatacatttgtaaaa

SEQ ID NO: 58239 - DNA, 24 bp, Artificial sequence
  SiRNA target sequence
ttttatatgatacatttgtaaaat

SEQ ID NO: 58240 - DNA, 24 bp, Artificial sequence
  SiRNA target sequence
tttatatgatacatttgtaaaata

SEQ ID NO: 58241 - DNA, 24 bp, Artificial sequence
  SiRNA target sequence
ttatatgatacatttgtaaaatat

SEQ ID NO: 58242 - DNA, 24 bp, Artificial sequence
  SiRNA target sequence
tatatgatacatttgtaaaatatt

SEQ ID NO: 58243 - DNA, 24 bp, Artificial sequence
  SiRNA target sequence
atatgatacatttgtaaaatattg

SEQ ID NO: 58244 - DNA, 24 bp, Artificial sequence
  SiRNA target sequence
tatgatacatttgtaaaatattgt

SEQ ID NO: 58245 - DNA, 24 bp, Artificial sequence
  SiRNA target sequence
atgatacatttgtaaaatattgtt

SEQ ID NO: 58246 - DNA, 24 bp, Artificial sequence
  SiRNA target sequence
tgatacatttgtaaaatattgtta

SEQ ID NO: 58247 - DNA, 24 bp, Artificial sequence
  SiRNA target sequence
gatacatttgtaaaatattgttac

SEQ ID NO: 58248 - DNA, 24 bp, Artificial sequence
  SiRNA target sequence
atacatttgtaaaatattgttaca

SEQ ID NO: 58249 - DNA, 24 bp, Artificial sequence
  SiRNA target sequence
tacatttgtaaaatattgttacaa

SEQ ID NO: 58250 - DNA, 24 bp, Artificial sequence
  SiRNA target sequence
acatttgtaaaatattgttacaat

SEQ ID NO: 58251 - DNA, 24 bp, Artificial sequence
  SiRNA target sequence
catttgtaaaatattgttacaata

SEQ ID NO: 58252 - DNA, 24 bp, Artificial sequence
  SiRNA target sequence
atttgtaaaatattgttacaatat

SEQ ID NO: 58253 - DNA, 24 bp, Artificial sequence
  SiRNA target sequence
tttgtaaaatattgttacaatatt

SEQ ID NO: 58254 - DNA, 24 bp, Artificial sequence
  SiRNA target sequence
ttgtaaaatattgttacaatattt

SEQ ID NO: 58255 - DNA, 24 bp, Artificial sequence
  SiRNA target sequence
tgtaaaatattgttacaatatttc

SEQ ID NO: 58256 - DNA, 24 bp, Artificial sequence
  SiRNA target sequence
gtaaaatattgttacaatatttcc

SEQ ID NO: 58257 - DNA, 24 bp, Artificial sequence
  SiRNA target sequence
taaaatattgttacaatatttcct

SEQ ID NO: 58258 - DNA, 24 bp, Artificial sequence
  SiRNA target sequence
aaaatattgttacaatatttccta

SEQ ID NO: 58259 - DNA, 24 bp, Artificial sequence
  SiRNA target sequence
aaatattgttacaatatttcctat

SEQ ID NO: 58260 - DNA, 24 bp, Artificial sequence
  SiRNA target sequence
aatattgttacaatatttcctata

SEQ ID NO: 58261 - DNA, 24 bp, Artificial sequence
  SiRNA target sequence
atattgttacaatatttcctatat

SEQ ID NO: 58262 - DNA, 24 bp, Artificial sequence
  SiRNA target sequence
tattgttacaatatttcctatata

SEQ ID NO: 58263 - DNA, 24 bp, Artificial sequence
  SiRNA target sequence
attgttacaatatttcctatataa

SEQ ID NO: 58264 - DNA, 24 bp, Artificial sequence
  SiRNA target sequence
ttgttacaatatttcctatataag

SEQ ID NO: 58265 - DNA, 24 bp, Artificial sequence
  SiRNA target sequence
tgttacaatatttcctatataagg

SEQ ID NO: 58266 - DNA, 24 bp, Artificial sequence
  SiRNA target sequence
gttacaatatttcctatataaggt

SEQ ID NO: 58267 - DNA, 24 bp, Artificial sequence
  SiRNA target sequence
ttacaatatttcctatataaggta

SEQ ID NO: 58268 - DNA, 24 bp, Artificial sequence
  SiRNA target sequence
tacaatatttcctatataaggtac

SEQ ID NO: 58269 - DNA, 24 bp, Artificial sequence
  SiRNA target sequence
acaatatttcctatataaggtacg

SEQ ID NO: 58270 - DNA, 24 bp, Artificial sequence
  SiRNA target sequence
caatatttcctatataaggtacgt

SEQ ID NO: 58271 - DNA, 24 bp, Artificial sequence
  SiRNA target sequence
aatatttcctatataaggtacgta

SEQ ID NO: 58272 - DNA, 24 bp, Artificial sequence
  SiRNA target sequence
atatttcctatataaggtacgtaa

SEQ ID NO: 58273 - DNA, 24 bp, Artificial sequence
  SiRNA target sequence
tatttcctatataaggtacgtaat

SEQ ID NO: 58274 - DNA, 24 bp, Artificial sequence
  SiRNA target sequence
atttcctatataaggtacgtaatg

SEQ ID NO: 58275 - DNA, 24 bp, Artificial sequence
  SiRNA target sequence
tttcctatataaggtacgtaatgt

SEQ ID NO: 58276 - DNA, 24 bp, Artificial sequence
  SiRNA target sequence
ttcctatataaggtacgtaatgtt

SEQ ID NO: 58277 - DNA, 24 bp, Artificial sequence
  SiRNA target sequence
tcctatataaggtacgtaatgttt

SEQ ID NO: 58278 - DNA, 24 bp, Artificial sequence
  SiRNA target sequence
cctatataaggtacgtaatgtttc

SEQ ID NO: 58279 - DNA, 24 bp, Artificial sequence
  SiRNA target sequence
ctatataaggtacgtaatgtttcc

SEQ ID NO: 58280 - DNA, 24 bp, Artificial sequence
  SiRNA target sequence
tatataaggtacgtaatgtttccc

SEQ ID NO: 58281 - DNA, 24 bp, Artificial sequence
  SiRNA target sequence
atataaggtacgtaatgtttccca

SEQ ID NO: 58282 - DNA, 24 bp, Artificial sequence
  SiRNA target sequence
tataaggtacgtaatgtttcccat

SEQ ID NO: 58283 - DNA, 24 bp, Artificial sequence
  SiRNA target sequence
ataaggtacgtaatgtttcccata

SEQ ID NO: 58284 - DNA, 24 bp, Artificial sequence
  SiRNA target sequence
taaggtacgtaatgtttcccatat

SEQ ID NO: 58285 - DNA, 24 bp, Artificial sequence
  SiRNA target sequence
aaggtacgtaatgtttcccatatt

SEQ ID NO: 58286 - DNA, 24 bp, Artificial sequence
  SiRNA target sequence
aggtacgtaatgtttcccatatta

SEQ ID NO: 58287 - DNA, 24 bp, Artificial sequence
  SiRNA target sequence
ggtacgtaatgtttcccatattac

SEQ ID NO: 58288 - DNA, 24 bp, Artificial sequence
  SiRNA target sequence
gtacgtaatgtttcccatattact

SEQ ID NO: 58289 - DNA, 24 bp, Artificial sequence
  SiRNA target sequence
tacgtaatgtttcccatattactg

SEQ ID NO: 58290 - DNA, 24 bp, Artificial sequence
  SiRNA target sequence
acgtaatgtttcccatattactgt

SEQ ID NO: 58291 - DNA, 24 bp, Artificial sequence
  SiRNA target sequence
cgtaatgtttcccatattactgtc

SEQ ID NO: 58292 - DNA, 24 bp, Artificial sequence
  SiRNA target sequence
gtaatgtttcccatattactgtct

SEQ ID NO: 58293 - DNA, 24 bp, Artificial sequence
  SiRNA target sequence
taatgtttcccatattactgtcta

SEQ ID NO: 58294 - DNA, 24 bp, Artificial sequence
  SiRNA target sequence
aatgtttcccatattactgtctac

SEQ ID NO: 58295 - DNA, 24 bp, Artificial sequence
  SiRNA target sequence
atgtttcccatattactgtctaca

SEQ ID NO: 58296 - DNA, 24 bp, Artificial sequence
  SiRNA target sequence
tgtttcccatattactgtctacaa

SEQ ID NO: 58297 - DNA, 24 bp, Artificial sequence
  SiRNA target sequence
gtttcccatattactgtctacaat

SEQ ID NO: 58298 - DNA, 24 bp, Artificial sequence
  SiRNA target sequence
tttcccatattactgtctacaatt

SEQ ID NO: 58299 - DNA, 24 bp, Artificial sequence
  SiRNA target sequence
ttcccatattactgtctacaatta

SEQ ID NO: 58300 - DNA, 24 bp, Artificial sequence
  SiRNA target sequence
tcccatattactgtctacaattat

SEQ ID NO: 58301 - DNA, 24 bp, Artificial sequence
  SiRNA target sequence
cccatattactgtctacaattata

SEQ ID NO: 58302 - DNA, 24 bp, Artificial sequence
  SiRNA target sequence
ccatattactgtctacaattatag

SEQ ID NO: 58303 - DNA, 24 bp, Artificial sequence
  SiRNA target sequence
catattactgtctacaattatagc

SEQ ID NO: 58304 - DNA, 24 bp, Artificial sequence
  SiRNA target sequence
atattactgtctacaattatagct

SEQ ID NO: 58305 - DNA, 24 bp, Artificial sequence
  SiRNA target sequence
tattactgtctacaattatagctt

SEQ ID NO: 58306 - DNA, 24 bp, Artificial sequence
  SiRNA target sequence
attactgtctacaattatagcttg

SEQ ID NO: 58307 - DNA, 24 bp, Artificial sequence
  SiRNA target sequence
ttactgtctacaattatagcttgt

SEQ ID NO: 58308 - DNA, 24 bp, Artificial sequence
  SiRNA target sequence
tactgtctacaattatagcttgtt

SEQ ID NO: 58309 - DNA, 24 bp, Artificial sequence
  SiRNA target sequence
actgtctacaattatagcttgtta

SEQ ID NO: 58310 - DNA, 24 bp, Artificial sequence
  SiRNA target sequence
ctgtctacaattatagcttgttat

SEQ ID NO: 58311 - DNA, 24 bp, Artificial sequence
  SiRNA target sequence
tgtctacaattatagcttgttatc

SEQ ID NO: 58312 - DNA, 24 bp, Artificial sequence
  SiRNA target sequence
gtctacaattatagcttgttatct

SEQ ID NO: 58313 - DNA, 24 bp, Artificial sequence
  SiRNA target sequence
tctacaattatagcttgttatctc

SEQ ID NO: 58314 - DNA, 24 bp, Artificial sequence
  SiRNA target sequence
ctacaattatagcttgttatctcg

SEQ ID NO: 58315 - DNA, 24 bp, Artificial sequence
  SiRNA target sequence
tacaattatagcttgttatctcga

SEQ ID NO: 58316 - DNA, 24 bp, Artificial sequence
  SiRNA target sequence
acaattatagcttgttatctcgaa

SEQ ID NO: 58317 - DNA, 24 bp, Artificial sequence
  SiRNA target sequence
caattatagcttgttatctcgaag

SEQ ID NO: 58318 - DNA, 24 bp, Artificial sequence
  SiRNA target sequence
aattatagcttgttatctcgaagt

SEQ ID NO: 58319 - DNA, 24 bp, Artificial sequence
  SiRNA target sequence
attatagcttgttatctcgaagtt

SEQ ID NO: 58320 - DNA, 24 bp, Artificial sequence
  SiRNA target sequence
ttatagcttgttatctcgaagttc

SEQ ID NO: 58321 - DNA, 24 bp, Artificial sequence
  SiRNA target sequence
tatagcttgttatctcgaagttca

SEQ ID NO: 58322 - DNA, 24 bp, Artificial sequence
  SiRNA target sequence
atagcttgttatctcgaagttcag

SEQ ID NO: 58323 - DNA, 24 bp, Artificial sequence
  SiRNA target sequence
tagcttgttatctcgaagttcagg

SEQ ID NO: 58324 - DNA, 24 bp, Artificial sequence
  SiRNA target sequence
agcttgttatctcgaagttcaggc

SEQ ID NO: 58325 - DNA, 24 bp, Artificial sequence
  SiRNA target sequence
gcttgttatctcgaagttcaggca

SEQ ID NO: 58326 - DNA, 24 bp, Artificial sequence
  SiRNA target sequence
cttgttatctcgaagttcaggcaa

SEQ ID NO: 58327 - DNA, 24 bp, Artificial sequence
  SiRNA target sequence
ttgttatctcgaagttcaggcaag

SEQ ID NO: 58328 - DNA, 24 bp, Artificial sequence
  SiRNA target sequence
tgttatctcgaagttcaggcaagt

SEQ ID NO: 58329 - DNA, 24 bp, Artificial sequence
  SiRNA target sequence
gttatctcgaagttcaggcaagta

SEQ ID NO: 58330 - DNA, 24 bp, Artificial sequence
  SiRNA target sequence
ttatctcgaagttcaggcaagtaa

SEQ ID NO: 58331 - DNA, 24 bp, Artificial sequence
  SiRNA target sequence
tatctcgaagttcaggcaagtaac

SEQ ID NO: 58332 - DNA, 24 bp, Artificial sequence
  SiRNA target sequence
atctcgaagttcaggcaagtaaca

SEQ ID NO: 58333 - DNA, 24 bp, Artificial sequence
  SiRNA target sequence
tctcgaagttcaggcaagtaacat

SEQ ID NO: 58334 - DNA, 24 bp, Artificial sequence
  SiRNA target sequence
ctcgaagttcaggcaagtaacata

SEQ ID NO: 58335 - DNA, 24 bp, Artificial sequence
  SiRNA target sequence
tcgaagttcaggcaagtaacatat

SEQ ID NO: 58336 - DNA, 24 bp, Artificial sequence
  SiRNA target sequence
cgaagttcaggcaagtaacatatc

SEQ ID NO: 58337 - DNA, 24 bp, Artificial sequence
  SiRNA target sequence
gaagttcaggcaagtaacatatca

SEQ ID NO: 58338 - DNA, 24 bp, Artificial sequence
  SiRNA target sequence
aagttcaggcaagtaacatatcaa

SEQ ID NO: 58339 - DNA, 24 bp, Artificial sequence
  SiRNA target sequence
agttcaggcaagtaacatatcaaa

SEQ ID NO: 58340 - DNA, 24 bp, Artificial sequence
  SiRNA target sequence
gttcaggcaagtaacatatcaaaa

SEQ ID NO: 58341 - DNA, 24 bp, Artificial sequence
  SiRNA target sequence
ttcaggcaagtaacatatcaaaaa

SEQ ID NO: 58342 - DNA, 24 bp, Artificial sequence
  SiRNA target sequence
tcaggcaagtaacatatcaaaaag

SEQ ID NO: 58343 - DNA, 24 bp, Artificial sequence
  SiRNA target sequence
caggcaagtaacatatcaaaaaga

SEQ ID NO: 58344 - DNA, 24 bp, Artificial sequence
  SiRNA target sequence
aggcaagtaacatatcaaaaagaa

SEQ ID NO: 58345 - DNA, 24 bp, Artificial sequence
  SiRNA target sequence
ggcaagtaacatatcaaaaagaat

SEQ ID NO: 58346 - DNA, 24 bp, Artificial sequence
  SiRNA target sequence
gcaagtaacatatcaaaaagaatt

SEQ ID NO: 58347 - DNA, 24 bp, Artificial sequence
  SiRNA target sequence
caagtaacatatcaaaaagaattg

SEQ ID NO: 58348 - DNA, 24 bp, Artificial sequence
  SiRNA target sequence
aagtaacatatcaaaaagaattgc

SEQ ID NO: 58349 - DNA, 24 bp, Artificial sequence
  SiRNA target sequence
agtaacatatcaaaaagaattgca

SEQ ID NO: 58350 - DNA, 24 bp, Artificial sequence
  SiRNA target sequence
gtaacatatcaaaaagaattgcag

SEQ ID NO: 58351 - DNA, 24 bp, Artificial sequence
  SiRNA target sequence
taacatatcaaaaagaattgcaga

SEQ ID NO: 58352 - DNA, 24 bp, Artificial sequence
  SiRNA target sequence
aacatatcaaaaagaattgcagaa

SEQ ID NO: 58353 - DNA, 24 bp, Artificial sequence
  SiRNA target sequence
acatatcaaaaagaattgcagaag

SEQ ID NO: 58354 - DNA, 24 bp, Artificial sequence
  SiRNA target sequence
catatcaaaaagaattgcagaaga

SEQ ID NO: 58355 - DNA, 24 bp, Artificial sequence
  SiRNA target sequence
atatcaaaaagaattgcagaagat

SEQ ID NO: 58356 - DNA, 24 bp, Artificial sequence
  SiRNA target sequence
tatcaaaaagaattgcagaagatt

SEQ ID NO: 58357 - DNA, 24 bp, Artificial sequence
  SiRNA target sequence
atcaaaaagaattgcagaagattt

SEQ ID NO: 58358 - DNA, 24 bp, Artificial sequence
  SiRNA target sequence
tcaaaaagaattgcagaagatttt

SEQ ID NO: 58359 - DNA, 24 bp, Artificial sequence
  SiRNA target sequence
caaaaagaattgcagaagattttg

SEQ ID NO: 58360 - DNA, 24 bp, Artificial sequence
  SiRNA target sequence
aaaaagaattgcagaagattttga

SEQ ID NO: 58361 - DNA, 24 bp, Artificial sequence
  SiRNA target sequence
aaaagaattgcagaagattttgaa

SEQ ID NO: 58362 - DNA, 24 bp, Artificial sequence
  SiRNA target sequence
aaagaattgcagaagattttgaaa

SEQ ID NO: 58363 - DNA, 24 bp, Artificial sequence
  SiRNA target sequence
aagaattgcagaagattttgaaaa

SEQ ID NO: 58364 - DNA, 24 bp, Artificial sequence
  SiRNA target sequence
agaattgcagaagattttgaaaat

SEQ ID NO: 58365 - DNA, 24 bp, Artificial sequence
  SiRNA target sequence
gaattgcagaagattttgaaaata

SEQ ID NO: 58366 - DNA, 24 bp, Artificial sequence
  SiRNA target sequence
aattgcagaagattttgaaaataa

SEQ ID NO: 58367 - DNA, 24 bp, Artificial sequence
  SiRNA target sequence
attgcagaagattttgaaaataaa

SEQ ID NO: 58368 - DNA, 24 bp, Artificial sequence
  SiRNA target sequence
ttgcagaagattttgaaaataaaa

SEQ ID NO: 58369 - DNA, 24 bp, Artificial sequence
  SiRNA target sequence
tgcagaagattttgaaaataaaat

SEQ ID NO: 58370 - DNA, 24 bp, Artificial sequence
  SiRNA target sequence
gcagaagattttgaaaataaaata

SEQ ID NO: 58371 - DNA, 24 bp, Artificial sequence
  SiRNA target sequence
cagaagattttgaaaataaaataa

SEQ ID NO: 58372 - DNA, 24 bp, Artificial sequence
  SiRNA target sequence
agaagattttgaaaataaaataaa

SEQ ID NO: 58373 - DNA, 24 bp, Artificial sequence
  SiRNA target sequence
gaagattttgaaaataaaataaat

SEQ ID NO: 58374 - DNA, 24 bp, Artificial sequence
  SiRNA target sequence
aagattttgaaaataaaataaatg

SEQ ID NO: 58375 - DNA, 24 bp, Artificial sequence
  SiRNA target sequence
agattttgaaaataaaataaatgc

SEQ ID NO: 58376 - DNA, 24 bp, Artificial sequence
  SiRNA target sequence
gattttgaaaataaaataaatgca

SEQ ID NO: 58377 - DNA, 24 bp, Artificial sequence
  SiRNA target sequence
attttgaaaataaaataaatgcag

SEQ ID NO: 58378 - DNA, 24 bp, Artificial sequence
  SiRNA target sequence
ttttgaaaataaaataaatgcagg

SEQ ID NO: 58379 - DNA, 24 bp, Artificial sequence
  SiRNA target sequence
tttgaaaataaaataaatgcagga

SEQ ID NO: 58380 - DNA, 24 bp, Artificial sequence
  SiRNA target sequence
ttgaaaataaaataaatgcaggaa

SEQ ID NO: 58381 - DNA, 24 bp, Artificial sequence
  SiRNA target sequence
tgaaaataaaataaatgcaggaaa

SEQ ID NO: 58382 - DNA, 24 bp, Artificial sequence
  SiRNA target sequence
gaaaataaaataaatgcaggaaaa

SEQ ID NO: 58383 - DNA, 24 bp, Artificial sequence
  SiRNA target sequence
aaaataaaataaatgcaggaaaaa

SEQ ID NO: 58384 - DNA, 24 bp, Artificial sequence
  SiRNA target sequence
aaataaaataaatgcaggaaaaag

SEQ ID NO: 58385 - DNA, 24 bp, Artificial sequence
  SiRNA target sequence
aataaaataaatgcaggaaaaagt

SEQ ID NO: 58386 - DNA, 24 bp, Artificial sequence
  SiRNA target sequence
ataaaataaatgcaggaaaaagta

SEQ ID NO: 58387 - DNA, 24 bp, Artificial sequence
  SiRNA target sequence
taaaataaatgcaggaaaaagtat

SEQ ID NO: 58388 - DNA, 24 bp, Artificial sequence
  SiRNA target sequence
aaaataaatgcaggaaaaagtata

SEQ ID NO: 58389 - DNA, 24 bp, Artificial sequence
  SiRNA target sequence
aaataaatgcaggaaaaagtatat

SEQ ID NO: 58390 - DNA, 24 bp, Artificial sequence
  SiRNA target sequence
aataaatgcaggaaaaagtatatt

SEQ ID NO: 58391 - DNA, 24 bp, Artificial sequence
  SiRNA target sequence
ataaatgcaggaaaaagtatattt

SEQ ID NO: 58392 - DNA, 24 bp, Artificial sequence
  SiRNA target sequence
taaatgcaggaaaaagtatattta

SEQ ID NO: 58393 - DNA, 24 bp, Artificial sequence
  SiRNA target sequence
aaatgcaggaaaaagtatatttaa

SEQ ID NO: 58394 - DNA, 24 bp, Artificial sequence
  SiRNA target sequence
aatgcaggaaaaagtatatttaaa

SEQ ID NO: 58395 - DNA, 24 bp, Artificial sequence
  SiRNA target sequence
atgcaggaaaaagtatatttaaat

SEQ ID NO: 58396 - DNA, 24 bp, Artificial sequence
  SiRNA target sequence
tgcaggaaaaagtatatttaaata

SEQ ID NO: 58397 - DNA, 24 bp, Artificial sequence
  SiRNA target sequence
gcaggaaaaagtatatttaaatat

SEQ ID NO: 58398 - DNA, 24 bp, Artificial sequence
  SiRNA target sequence
caggaaaaagtatatttaaatata

SEQ ID NO: 58399 - DNA, 24 bp, Artificial sequence
  SiRNA target sequence
aggaaaaagtatatttaaatatat

SEQ ID NO: 58400 - DNA, 24 bp, Artificial sequence
  SiRNA target sequence
ggaaaaagtatatttaaatatatt

SEQ ID NO: 58401 - DNA, 24 bp, Artificial sequence
  SiRNA target sequence
gaaaaagtatatttaaatatattt

SEQ ID NO: 58402 - DNA, 24 bp, Artificial sequence
  SiRNA target sequence
aaaaagtatatttaaatatatttt

SEQ ID NO: 58403 - DNA, 24 bp, Artificial sequence
  SiRNA target sequence
aaaagtatatttaaatatatttta

SEQ ID NO: 58404 - DNA, 24 bp, Artificial sequence
  SiRNA target sequence
aaagtatatttaaatatattttat

SEQ ID NO: 58405 - DNA, 24 bp, Artificial sequence
  SiRNA target sequence
aagtatatttaaatatattttatt

SEQ ID NO: 58406 - DNA, 24 bp, Artificial sequence
  SiRNA target sequence
agtatatttaaatatattttattt

SEQ ID NO: 58407 - DNA, 24 bp, Artificial sequence
  SiRNA target sequence
gtatatttaaatatattttatttt

SEQ ID NO: 58408 - DNA, 24 bp, Artificial sequence
  SiRNA target sequence
tatatttaaatatattttattttt

SEQ ID NO: 58409 - DNA, 24 bp, Artificial sequence
  SiRNA target sequence
atatttaaatatattttattttta

SEQ ID NO: 58410 - DNA, 24 bp, Artificial sequence
  SiRNA target sequence
tatttaaatatattttatttttaa

SEQ ID NO: 58411 - DNA, 24 bp, Artificial sequence
  SiRNA target sequence
atttaaatatattttatttttaac

SEQ ID NO: 58412 - DNA, 24 bp, Artificial sequence
  SiRNA target sequence
tttaaatatattttatttttaact

SEQ ID NO: 58413 - DNA, 24 bp, Artificial sequence
  SiRNA target sequence
ttaaatatattttatttttaactt

SEQ ID NO: 58414 - DNA, 24 bp, Artificial sequence
  SiRNA target sequence
taaatatattttatttttaacttc

SEQ ID NO: 58415 - DNA, 24 bp, Artificial sequence
  SiRNA target sequence
aaatatattttatttttaacttca

SEQ ID NO: 58416 - DNA, 24 bp, Artificial sequence
  SiRNA target sequence
aatatattttatttttaacttcat

SEQ ID NO: 58417 - DNA, 24 bp, Artificial sequence
  SiRNA target sequence
atatattttatttttaacttcatc

SEQ ID NO: 58418 - DNA, 24 bp, Artificial sequence
  SiRNA target sequence
tatattttatttttaacttcatca

SEQ ID NO: 58419 - DNA, 24 bp, Artificial sequence
  SiRNA target sequence
atattttatttttaacttcatcaa

SEQ ID NO: 58420 - DNA, 24 bp, Artificial sequence
  SiRNA target sequence
tattttatttttaacttcatcaat

SEQ ID NO: 58421 - DNA, 24 bp, Artificial sequence
  SiRNA target sequence
attttatttttaacttcatcaata

SEQ ID NO: 58422 - DNA, 24 bp, Artificial sequence
  SiRNA target sequence
ttttatttttaacttcatcaatag

SEQ ID NO: 58423 - DNA, 24 bp, Artificial sequence
  SiRNA target sequence
tttatttttaacttcatcaatagt

SEQ ID NO: 58424 - DNA, 24 bp, Artificial sequence
  SiRNA target sequence
ttatttttaacttcatcaatagta

SEQ ID NO: 58425 - DNA, 24 bp, Artificial sequence
  SiRNA target sequence
tatttttaacttcatcaatagtat

SEQ ID NO: 58426 - DNA, 24 bp, Artificial sequence
  SiRNA target sequence
atttttaacttcatcaatagtatt

SEQ ID NO: 58427 - DNA, 24 bp, Artificial sequence
  SiRNA target sequence
tttttaacttcatcaatagtatta

SEQ ID NO: 58428 - DNA, 24 bp, Artificial sequence
  SiRNA target sequence
ttttaacttcatcaatagtattaa

SEQ ID NO: 58429 - DNA, 24 bp, Artificial sequence
  SiRNA target sequence
tttaacttcatcaatagtattaag

SEQ ID NO: 58430 - DNA, 24 bp, Artificial sequence
  SiRNA target sequence
ttaacttcatcaatagtattaaga

SEQ ID NO: 58431 - DNA, 24 bp, Artificial sequence
  SiRNA target sequence
taacttcatcaatagtattaagac

SEQ ID NO: 58432 - DNA, 24 bp, Artificial sequence
  SiRNA target sequence
aacttcatcaatagtattaagaca

SEQ ID NO: 58433 - DNA, 24 bp, Artificial sequence
  SiRNA target sequence
acttcatcaatagtattaagacaa

SEQ ID NO: 58434 - DNA, 24 bp, Artificial sequence
  SiRNA target sequence
cttcatcaatagtattaagacaaa

SEQ ID NO: 58435 - DNA, 24 bp, Artificial sequence
  SiRNA target sequence
ttcatcaatagtattaagacaaat

SEQ ID NO: 58436 - DNA, 24 bp, Artificial sequence
  SiRNA target sequence
tcatcaatagtattaagacaaatt

SEQ ID NO: 58437 - DNA, 24 bp, Artificial sequence
  SiRNA target sequence
catcaatagtattaagacaaatta

SEQ ID NO: 58438 - DNA, 24 bp, Artificial sequence
  SiRNA target sequence
atcaatagtattaagacaaattaa

SEQ ID NO: 58439 - DNA, 24 bp, Artificial sequence
  SiRNA target sequence
tcaatagtattaagacaaattaat

SEQ ID NO: 58440 - DNA, 24 bp, Artificial sequence
  SiRNA target sequence
caatagtattaagacaaattaatg

SEQ ID NO: 58441 - DNA, 24 bp, Artificial sequence
  SiRNA target sequence
aatagtattaagacaaattaatga

SEQ ID NO: 58442 - DNA, 24 bp, Artificial sequence
  SiRNA target sequence
atagtattaagacaaattaatgat

SEQ ID NO: 58443 - DNA, 24 bp, Artificial sequence
  SiRNA target sequence
tagtattaagacaaattaatgata

SEQ ID NO: 58444 - DNA, 24 bp, Artificial sequence
  SiRNA target sequence
agtattaagacaaattaatgatat

SEQ ID NO: 58445 - DNA, 24 bp, Artificial sequence
  SiRNA target sequence
gtattaagacaaattaatgatatt

SEQ ID NO: 58446 - DNA, 24 bp, Artificial sequence
  SiRNA target sequence
tattaagacaaattaatgatattg

SEQ ID NO: 58447 - DNA, 24 bp, Artificial sequence
  SiRNA target sequence
attaagacaaattaatgatattgt

SEQ ID NO: 58448 - DNA, 24 bp, Artificial sequence
  SiRNA target sequence
ttaagacaaattaatgatattgtg

SEQ ID NO: 58449 - DNA, 24 bp, Artificial sequence
  SiRNA target sequence
taagacaaattaatgatattgtgt

SEQ ID NO: 58450 - DNA, 24 bp, Artificial sequence
  SiRNA target sequence
aagacaaattaatgatattgtgtt

SEQ ID NO: 58451 - DNA, 24 bp, Artificial sequence
  SiRNA target sequence
agacaaattaatgatattgtgttt

SEQ ID NO: 58452 - DNA, 24 bp, Artificial sequence
  SiRNA target sequence
gacaaattaatgatattgtgttta

SEQ ID NO: 58453 - DNA, 24 bp, Artificial sequence
  SiRNA target sequence
acaaattaatgatattgtgtttag

SEQ ID NO: 58454 - DNA, 24 bp, Artificial sequence
  SiRNA target sequence
caaattaatgatattgtgtttagc

SEQ ID NO: 58455 - DNA, 24 bp, Artificial sequence
  SiRNA target sequence
aaattaatgatattgtgtttagcg

SEQ ID NO: 58456 - DNA, 24 bp, Artificial sequence
  SiRNA target sequence
aattaatgatattgtgtttagcgg

SEQ ID NO: 58457 - DNA, 24 bp, Artificial sequence
  SiRNA target sequence
attaatgatattgtgtttagcggg

SEQ ID NO: 58458 - DNA, 24 bp, Artificial sequence
  SiRNA target sequence
ttaatgatattgtgtttagcgggc

SEQ ID NO: 58459 - DNA, 24 bp, Artificial sequence
  SiRNA target sequence
taatgatattgtgtttagcgggcc

SEQ ID NO: 58460 - DNA, 24 bp, Artificial sequence
  SiRNA target sequence
aatgatattgtgtttagcgggcca

SEQ ID NO: 58461 - DNA, 24 bp, Artificial sequence
  SiRNA target sequence
atgatattgtgtttagcgggccaa

SEQ ID NO: 58462 - DNA, 24 bp, Artificial sequence
  SiRNA target sequence
tgatattgtgtttagcgggccaat

SEQ ID NO: 58463 - DNA, 24 bp, Artificial sequence
  SiRNA target sequence
gatattgtgtttagcgggccaata

SEQ ID NO: 58464 - DNA, 24 bp, Artificial sequence
  SiRNA target sequence
atattgtgtttagcgggccaatac

SEQ ID NO: 58465 - DNA, 24 bp, Artificial sequence
  SiRNA target sequence
tattgtgtttagcgggccaataca

SEQ ID NO: 58466 - DNA, 24 bp, Artificial sequence
  SiRNA target sequence
attgtgtttagcgggccaatacaa

SEQ ID NO: 58467 - DNA, 24 bp, Artificial sequence
  SiRNA target sequence
ttgtgtttagcgggccaatacaat

SEQ ID NO: 58468 - DNA, 24 bp, Artificial sequence
  SiRNA target sequence
tgtgtttagcgggccaatacaatt

SEQ ID NO: 58469 - DNA, 24 bp, Artificial sequence
  SiRNA target sequence
gtgtttagcgggccaatacaattt

SEQ ID NO: 58470 - DNA, 24 bp, Artificial sequence
  SiRNA target sequence
tgtttagcgggccaatacaatttt

SEQ ID NO: 58471 - DNA, 24 bp, Artificial sequence
  SiRNA target sequence
gtttagcgggccaatacaattttt

SEQ ID NO: 58472 - DNA, 24 bp, Artificial sequence
  SiRNA target sequence
tttagcgggccaatacaattttta

SEQ ID NO: 58473 - DNA, 24 bp, Artificial sequence
  SiRNA target sequence
ttagcgggccaatacaatttttat

SEQ ID NO: 58474 - DNA, 24 bp, Artificial sequence
  SiRNA target sequence
tagcgggccaatacaatttttata

SEQ ID NO: 58475 - DNA, 24 bp, Artificial sequence
  SiRNA target sequence
agcgggccaatacaatttttatat

SEQ ID NO: 58476 - DNA, 24 bp, Artificial sequence
  SiRNA target sequence
gcgggccaatacaatttttatata

SEQ ID NO: 58477 - DNA, 24 bp, Artificial sequence
  SiRNA target sequence
cgggccaatacaatttttatataa

SEQ ID NO: 58478 - DNA, 24 bp, Artificial sequence
  SiRNA target sequence
gggccaatacaatttttatataaa

SEQ ID NO: 58479 - DNA, 24 bp, Artificial sequence
  SiRNA target sequence
ggccaatacaatttttatataaaa

SEQ ID NO: 58480 - DNA, 24 bp, Artificial sequence
  SiRNA target sequence
gccaatacaatttttatataaaat

SEQ ID NO: 58481 - DNA, 24 bp, Artificial sequence
  SiRNA target sequence
ccaatacaatttttatataaaatt

SEQ ID NO: 58482 - DNA, 24 bp, Artificial sequence
  SiRNA target sequence
caatacaatttttatataaaattg

SEQ ID NO: 58483 - DNA, 24 bp, Artificial sequence
  SiRNA target sequence
aatacaatttttatataaaattgt

SEQ ID NO: 58484 - DNA, 24 bp, Artificial sequence
  SiRNA target sequence
atacaatttttatataaaattgtt

SEQ ID NO: 58485 - DNA, 24 bp, Artificial sequence
  SiRNA target sequence
tacaatttttatataaaattgttg

SEQ ID NO: 58486 - DNA, 24 bp, Artificial sequence
  SiRNA target sequence
acaatttttatataaaattgttgg

SEQ ID NO: 58487 - DNA, 24 bp, Artificial sequence
  SiRNA target sequence
caatttttatataaaattgttgga

SEQ ID NO: 58488 - DNA, 24 bp, Artificial sequence
  SiRNA target sequence
aatttttatataaaattgttggag

SEQ ID NO: 58489 - DNA, 24 bp, Artificial sequence
  SiRNA target sequence
atttttatataaaattgttggagt

SEQ ID NO: 58490 - DNA, 24 bp, Artificial sequence
  SiRNA target sequence
tttttatataaaattgttggagtt

SEQ ID NO: 58491 - DNA, 24 bp, Artificial sequence
  SiRNA target sequence
ttttatataaaattgttggagttg

SEQ ID NO: 58492 - DNA, 24 bp, Artificial sequence
  SiRNA target sequence
tttatataaaattgttggagttga

SEQ ID NO: 58493 - DNA, 24 bp, Artificial sequence
  SiRNA target sequence
ttatataaaattgttggagttgaa

SEQ ID NO: 58494 - DNA, 24 bp, Artificial sequence
  SiRNA target sequence
tatataaaattgttggagttgaag

SEQ ID NO: 58495 - DNA, 24 bp, Artificial sequence
  SiRNA target sequence
atataaaattgttggagttgaagc

SEQ ID NO: 58496 - DNA, 24 bp, Artificial sequence
  SiRNA target sequence
tataaaattgttggagttgaagca

SEQ ID NO: 58497 - DNA, 24 bp, Artificial sequence
  SiRNA target sequence
ataaaattgttggagttgaagcat

SEQ ID NO: 58498 - DNA, 24 bp, Artificial sequence
  SiRNA target sequence
taaaattgttggagttgaagcatt

SEQ ID NO: 58499 - DNA, 24 bp, Artificial sequence
  SiRNA target sequence
aaaattgttggagttgaagcattt

SEQ ID NO: 58500 - DNA, 24 bp, Artificial sequence
  SiRNA target sequence
aaattgttggagttgaagcatttt

SEQ ID NO: 58501 - DNA, 24 bp, Artificial sequence
  SiRNA target sequence
aattgttggagttgaagcatttta

SEQ ID NO: 58502 - DNA, 24 bp, Artificial sequence
  SiRNA target sequence
attgttggagttgaagcattttat

SEQ ID NO: 58503 - DNA, 24 bp, Artificial sequence
  SiRNA target sequence
ttgttggagttgaagcattttatc

SEQ ID NO: 58504 - DNA, 24 bp, Artificial sequence
  SiRNA target sequence
tgttggagttgaagcattttatca

SEQ ID NO: 58505 - DNA, 24 bp, Artificial sequence
  SiRNA target sequence
gttggagttgaagcattttatcat

SEQ ID NO: 58506 - DNA, 24 bp, Artificial sequence
  SiRNA target sequence
ttggagttgaagcattttatcatt

SEQ ID NO: 58507 - DNA, 24 bp, Artificial sequence
  SiRNA target sequence
tggagttgaagcattttatcatta

SEQ ID NO: 58508 - DNA, 24 bp, Artificial sequence
  SiRNA target sequence
ggagttgaagcattttatcattac

SEQ ID NO: 58509 - DNA, 24 bp, Artificial sequence
  SiRNA target sequence
gagttgaagcattttatcattaca

SEQ ID NO: 58510 - DNA, 24 bp, Artificial sequence
  SiRNA target sequence
agttgaagcattttatcattacat

SEQ ID NO: 58511 - DNA, 24 bp, Artificial sequence
  SiRNA target sequence
gttgaagcattttatcattacatt

SEQ ID NO: 58512 - DNA, 24 bp, Artificial sequence
  SiRNA target sequence
ttgaagcattttatcattacattt

SEQ ID NO: 58513 - DNA, 24 bp, Artificial sequence
  SiRNA target sequence
tgaagcattttatcattacatttc

SEQ ID NO: 58514 - DNA, 24 bp, Artificial sequence
  SiRNA target sequence
gaagcattttatcattacatttca

SEQ ID NO: 58515 - DNA, 24 bp, Artificial sequence
  SiRNA target sequence
aagcattttatcattacatttcat

SEQ ID NO: 58516 - DNA, 24 bp, Artificial sequence
  SiRNA target sequence
agcattttatcattacatttcatt

SEQ ID NO: 58517 - DNA, 24 bp, Artificial sequence
  SiRNA target sequence
gcattttatcattacatttcatta

SEQ ID NO: 58518 - DNA, 24 bp, Artificial sequence
  SiRNA target sequence
cattttatcattacatttcattaa

SEQ ID NO: 58519 - DNA, 24 bp, Artificial sequence
  SiRNA target sequence
attttatcattacatttcattaaa

SEQ ID NO: 58520 - DNA, 24 bp, Artificial sequence
  SiRNA target sequence
ttttatcattacatttcattaaac

SEQ ID NO: 58521 - DNA, 24 bp, Artificial sequence
  SiRNA target sequence
tttatcattacatttcattaaact

SEQ ID NO: 58522 - DNA, 24 bp, Artificial sequence
  SiRNA target sequence
ttatcattacatttcattaaactt

SEQ ID NO: 58523 - DNA, 24 bp, Artificial sequence
  SiRNA target sequence
tatcattacatttcattaaactta

SEQ ID NO: 58524 - DNA, 24 bp, Artificial sequence
  SiRNA target sequence
atcattacatttcattaaacttag

SEQ ID NO: 58525 - DNA, 24 bp, Artificial sequence
  SiRNA target sequence
tcattacatttcattaaacttaga

SEQ ID NO: 58526 - DNA, 24 bp, Artificial sequence
  SiRNA target sequence
cattacatttcattaaacttagaa

SEQ ID NO: 58527 - DNA, 24 bp, Artificial sequence
  SiRNA target sequence
attacatttcattaaacttagaaa

SEQ ID NO: 58528 - DNA, 24 bp, Artificial sequence
  SiRNA target sequence
ttacatttcattaaacttagaaaa

SEQ ID NO: 58529 - DNA, 24 bp, Artificial sequence
  SiRNA target sequence
tacatttcattaaacttagaaaat

SEQ ID NO: 58530 - DNA, 24 bp, Artificial sequence
  SiRNA target sequence
acatttcattaaacttagaaaatt

SEQ ID NO: 58531 - DNA, 24 bp, Artificial sequence
  SiRNA target sequence
catttcattaaacttagaaaattt

SEQ ID NO: 58532 - DNA, 24 bp, Artificial sequence
  SiRNA target sequence
atttcattaaacttagaaaatttt

SEQ ID NO: 58533 - DNA, 24 bp, Artificial sequence
  SiRNA target sequence
tttcattaaacttagaaaatttta

SEQ ID NO: 58534 - DNA, 24 bp, Artificial sequence
  SiRNA target sequence
ttcattaaacttagaaaattttaa

SEQ ID NO: 58535 - DNA, 24 bp, Artificial sequence
  SiRNA target sequence
tcattaaacttagaaaattttaac

SEQ ID NO: 58536 - DNA, 24 bp, Artificial sequence
  SiRNA target sequence
cattaaacttagaaaattttaaca

SEQ ID NO: 58537 - DNA, 24 bp, Artificial sequence
  SiRNA target sequence
attaaacttagaaaattttaacaa

SEQ ID NO: 58538 - DNA, 24 bp, Artificial sequence
  SiRNA target sequence
ttaaacttagaaaattttaacaaa

SEQ ID NO: 58539 - DNA, 24 bp, Artificial sequence
  SiRNA target sequence
taaacttagaaaattttaacaaaa

SEQ ID NO: 58540 - DNA, 24 bp, Artificial sequence
  SiRNA target sequence
aaacttagaaaattttaacaaaat

SEQ ID NO: 58541 - DNA, 24 bp, Artificial sequence
  SiRNA target sequence
aacttagaaaattttaacaaaata

SEQ ID NO: 58542 - DNA, 24 bp, Artificial sequence
  SiRNA target sequence
acttagaaaattttaacaaaatag

SEQ ID NO: 58543 - DNA, 24 bp, Artificial sequence
  SiRNA target sequence
cttagaaaattttaacaaaatagg

SEQ ID NO: 58544 - DNA, 24 bp, Artificial sequence
  SiRNA target sequence
ttagaaaattttaacaaaatagga

SEQ ID NO: 58545 - DNA, 24 bp, Artificial sequence
  SiRNA target sequence
tagaaaattttaacaaaataggaa

SEQ ID NO: 58546 - DNA, 24 bp, Artificial sequence
  SiRNA target sequence
agaaaattttaacaaaataggaag

SEQ ID NO: 58547 - DNA, 24 bp, Artificial sequence
  SiRNA target sequence
gaaaattttaacaaaataggaagt

SEQ ID NO: 58548 - DNA, 24 bp, Artificial sequence
  SiRNA target sequence
aaaattttaacaaaataggaagtg

SEQ ID NO: 58549 - DNA, 24 bp, Artificial sequence
  SiRNA target sequence
aaattttaacaaaataggaagtgg

SEQ ID NO: 58550 - DNA, 24 bp, Artificial sequence
  SiRNA target sequence
aattttaacaaaataggaagtgga

SEQ ID NO: 58551 - DNA, 24 bp, Artificial sequence
  SiRNA target sequence
attttaacaaaataggaagtggag

SEQ ID NO: 58552 - DNA, 24 bp, Artificial sequence
  SiRNA target sequence
ttttaacaaaataggaagtggaga

SEQ ID NO: 58553 - DNA, 24 bp, Artificial sequence
  SiRNA target sequence
tttaacaaaataggaagtggagag

SEQ ID NO: 58554 - DNA, 24 bp, Artificial sequence
  SiRNA target sequence
ttaacaaaataggaagtggagaga

SEQ ID NO: 58555 - DNA, 24 bp, Artificial sequence
  SiRNA target sequence
taacaaaataggaagtggagagat

SEQ ID NO: 58556 - DNA, 24 bp, Artificial sequence
  SiRNA target sequence
aacaaaataggaagtggagagata

SEQ ID NO: 58557 - DNA, 24 bp, Artificial sequence
  SiRNA target sequence
acaaaataggaagtggagagatac

SEQ ID NO: 58558 - DNA, 24 bp, Artificial sequence
  SiRNA target sequence
caaaataggaagtggagagataca

SEQ ID NO: 58559 - DNA, 24 bp, Artificial sequence
  SiRNA target sequence
aaaataggaagtggagagatacaa

SEQ ID NO: 58560 - DNA, 24 bp, Artificial sequence
  SiRNA target sequence
aaataggaagtggagagatacaaa

SEQ ID NO: 58561 - DNA, 24 bp, Artificial sequence
  SiRNA target sequence
aataggaagtggagagatacaaat

SEQ ID NO: 58562 - DNA, 24 bp, Artificial sequence
  SiRNA target sequence
ataggaagtggagagatacaaatg

SEQ ID NO: 58563 - DNA, 24 bp, Artificial sequence
  SiRNA target sequence
taggaagtggagagatacaaatga

SEQ ID NO: 58564 - DNA, 24 bp, Artificial sequence
  SiRNA target sequence
aggaagtggagagatacaaatgat

SEQ ID NO: 58565 - DNA, 24 bp, Artificial sequence
  SiRNA target sequence
ggaagtggagagatacaaatgatt

SEQ ID NO: 58566 - DNA, 24 bp, Artificial sequence
  SiRNA target sequence
gaagtggagagatacaaatgatta

SEQ ID NO: 58567 - DNA, 24 bp, Artificial sequence
  SiRNA target sequence
aagtggagagatacaaatgattat

SEQ ID NO: 58568 - DNA, 24 bp, Artificial sequence
  SiRNA target sequence
agtggagagatacaaatgattatt

SEQ ID NO: 58569 - DNA, 24 bp, Artificial sequence
  SiRNA target sequence
gtggagagatacaaatgattattg

SEQ ID NO: 58570 - DNA, 24 bp, Artificial sequence
  SiRNA target sequence
tggagagatacaaatgattattga

SEQ ID NO: 58571 - DNA, 24 bp, Artificial sequence
  SiRNA target sequence
ggagagatacaaatgattattgag

SEQ ID NO: 58572 - DNA, 24 bp, Artificial sequence
  SiRNA target sequence
gagagatacaaatgattattgagc

SEQ ID NO: 58573 - DNA, 24 bp, Artificial sequence
  SiRNA target sequence
agagatacaaatgattattgagcg

SEQ ID NO: 58574 - DNA, 24 bp, Artificial sequence
  SiRNA target sequence
gagatacaaatgattattgagcgg

SEQ ID NO: 58575 - DNA, 24 bp, Artificial sequence
  SiRNA target sequence
agatacaaatgattattgagcgga

SEQ ID NO: 58576 - DNA, 24 bp, Artificial sequence
  SiRNA target sequence
gatacaaatgattattgagcggaa

SEQ ID NO: 58577 - DNA, 24 bp, Artificial sequence
  SiRNA target sequence
atacaaatgattattgagcggaaa

SEQ ID NO: 58578 - DNA, 24 bp, Artificial sequence
  SiRNA target sequence
tacaaatgattattgagcggaaaa

SEQ ID NO: 58579 - DNA, 24 bp, Artificial sequence
  SiRNA target sequence
acaaatgattattgagcggaaaag

SEQ ID NO: 58580 - DNA, 24 bp, Artificial sequence
  SiRNA target sequence
caaatgattattgagcggaaaagt

SEQ ID NO: 58581 - DNA, 24 bp, Artificial sequence
  SiRNA target sequence
aaatgattattgagcggaaaagta

SEQ ID NO: 58582 - DNA, 24 bp, Artificial sequence
  SiRNA target sequence
aatgattattgagcggaaaagtag

SEQ ID NO: 58583 - DNA, 24 bp, Artificial sequence
  SiRNA target sequence
atgattattgagcggaaaagtaga

SEQ ID NO: 58584 - DNA, 24 bp, Artificial sequence
  SiRNA target sequence
tgattattgagcggaaaagtagag

SEQ ID NO: 58585 - DNA, 24 bp, Artificial sequence
  SiRNA target sequence
gattattgagcggaaaagtagagc

SEQ ID NO: 58586 - DNA, 24 bp, Artificial sequence
  SiRNA target sequence
attattgagcggaaaagtagagca

SEQ ID NO: 58587 - DNA, 24 bp, Artificial sequence
  SiRNA target sequence
ttattgagcggaaaagtagagcat

SEQ ID NO: 58588 - DNA, 24 bp, Artificial sequence
  SiRNA target sequence
tattgagcggaaaagtagagcata

SEQ ID NO: 58589 - DNA, 24 bp, Artificial sequence
  SiRNA target sequence
attgagcggaaaagtagagcatat

SEQ ID NO: 58590 - DNA, 24 bp, Artificial sequence
  SiRNA target sequence
ttgagcggaaaagtagagcatatg

SEQ ID NO: 58591 - DNA, 24 bp, Artificial sequence
  SiRNA target sequence
tgagcggaaaagtagagcatatgg

SEQ ID NO: 58592 - DNA, 24 bp, Artificial sequence
  SiRNA target sequence
gagcggaaaagtagagcatatggt

SEQ ID NO: 58593 - DNA, 24 bp, Artificial sequence
  SiRNA target sequence
agcggaaaagtagagcatatggtg

SEQ ID NO: 58594 - DNA, 24 bp, Artificial sequence
  SiRNA target sequence
gcggaaaagtagagcatatggtga

SEQ ID NO: 58595 - DNA, 24 bp, Artificial sequence
  SiRNA target sequence
cggaaaagtagagcatatggtgac

SEQ ID NO: 58596 - DNA, 24 bp, Artificial sequence
  SiRNA target sequence
ggaaaagtagagcatatggtgaca

SEQ ID NO: 58597 - DNA, 24 bp, Artificial sequence
  SiRNA target sequence
gaaaagtagagcatatggtgacat

SEQ ID NO: 58598 - DNA, 24 bp, Artificial sequence
  SiRNA target sequence
aaaagtagagcatatggtgacata

SEQ ID NO: 58599 - DNA, 24 bp, Artificial sequence
  SiRNA target sequence
aaagtagagcatatggtgacatac

SEQ ID NO: 58600 - DNA, 24 bp, Artificial sequence
  SiRNA target sequence
aagtagagcatatggtgacatact

SEQ ID NO: 58601 - DNA, 24 bp, Artificial sequence
  SiRNA target sequence
agtagagcatatggtgacatacta

SEQ ID NO: 58602 - DNA, 24 bp, Artificial sequence
  SiRNA target sequence
gtagagcatatggtgacatactag

SEQ ID NO: 58603 - DNA, 24 bp, Artificial sequence
  SiRNA target sequence
tagagcatatggtgacatactaga

SEQ ID NO: 58604 - DNA, 24 bp, Artificial sequence
  SiRNA target sequence
agagcatatggtgacatactagaa

SEQ ID NO: 58605 - DNA, 24 bp, Artificial sequence
  SiRNA target sequence
gagcatatggtgacatactagaac

SEQ ID NO: 58606 - DNA, 24 bp, Artificial sequence
  SiRNA target sequence
agcatatggtgacatactagaact

SEQ ID NO: 58607 - DNA, 24 bp, Artificial sequence
  SiRNA target sequence
gcatatggtgacatactagaacta

SEQ ID NO: 58608 - DNA, 24 bp, Artificial sequence
  SiRNA target sequence
catatggtgacatactagaactaa

SEQ ID NO: 58609 - DNA, 24 bp, Artificial sequence
  SiRNA target sequence
atatggtgacatactagaactaac

SEQ ID NO: 58610 - DNA, 24 bp, Artificial sequence
  SiRNA target sequence
tatggtgacatactagaactaact

SEQ ID NO: 58611 - DNA, 24 bp, Artificial sequence
  SiRNA target sequence
atggtgacatactagaactaacta

SEQ ID NO: 58612 - DNA, 24 bp, Artificial sequence
  SiRNA target sequence
tggtgacatactagaactaactac

SEQ ID NO: 58613 - DNA, 24 bp, Artificial sequence
  SiRNA target sequence
ggtgacatactagaactaactact

SEQ ID NO: 58614 - DNA, 24 bp, Artificial sequence
  SiRNA target sequence
gtgacatactagaactaactactc

SEQ ID NO: 58615 - DNA, 24 bp, Artificial sequence
  SiRNA target sequence
tgacatactagaactaactactct

SEQ ID NO: 58616 - DNA, 24 bp, Artificial sequence
  SiRNA target sequence
gacatactagaactaactactctc

SEQ ID NO: 58617 - DNA, 24 bp, Artificial sequence
  SiRNA target sequence
acatactagaactaactactctct

SEQ ID NO: 58618 - DNA, 24 bp, Artificial sequence
  SiRNA target sequence
catactagaactaactactctctc

SEQ ID NO: 58619 - DNA, 24 bp, Artificial sequence
  SiRNA target sequence
atactagaactaactactctctcg

SEQ ID NO: 58620 - DNA, 24 bp, Artificial sequence
  SiRNA target sequence
tactagaactaactactctctcgg

SEQ ID NO: 58621 - DNA, 24 bp, Artificial sequence
  SiRNA target sequence
actagaactaactactctctcggc

SEQ ID NO: 58622 - DNA, 24 bp, Artificial sequence
  SiRNA target sequence
ctagaactaactactctctcggcc

SEQ ID NO: 58623 - DNA, 24 bp, Artificial sequence
  SiRNA target sequence
tagaactaactactctctcggccg

SEQ ID NO: 58624 - DNA, 24 bp, Artificial sequence
  SiRNA target sequence
agaactaactactctctcggccgt

SEQ ID NO: 58625 - DNA, 24 bp, Artificial sequence
  SiRNA target sequence
gaactaactactctctcggccgta

SEQ ID NO: 58626 - DNA, 24 bp, Artificial sequence
  SiRNA target sequence
aactaactactctctcggccgtac

SEQ ID NO: 58627 - DNA, 24 bp, Artificial sequence
  SiRNA target sequence
actaactactctctcggccgtacc

SEQ ID NO: 58628 - DNA, 24 bp, Artificial sequence
  SiRNA target sequence
ctaactactctctcggccgtacca

SEQ ID NO: 58629 - DNA, 24 bp, Artificial sequence
  SiRNA target sequence
taactactctctcggccgtaccaa

SEQ ID NO: 58630 - DNA, 24 bp, Artificial sequence
  SiRNA target sequence
aactactctctcggccgtaccaac

SEQ ID NO: 58631 - DNA, 24 bp, Artificial sequence
  SiRNA target sequence
actactctctcggccgtaccaacc

SEQ ID NO: 58632 - DNA, 24 bp, Artificial sequence
  SiRNA target sequence
ctactctctcggccgtaccaacct

SEQ ID NO: 58633 - DNA, 24 bp, Artificial sequence
  SiRNA target sequence
tactctctcggccgtaccaacctg

SEQ ID NO: 58634 - DNA, 24 bp, Artificial sequence
  SiRNA target sequence
actctctcggccgtaccaacctgt

SEQ ID NO: 58635 - DNA, 24 bp, Artificial sequence
  SiRNA target sequence
ctctctcggccgtaccaacctgta

SEQ ID NO: 58636 - DNA, 24 bp, Artificial sequence
  SiRNA target sequence
tctctcggccgtaccaacctgtat

SEQ ID NO: 58637 - DNA, 24 bp, Artificial sequence
  SiRNA target sequence
ctctcggccgtaccaacctgtatt

SEQ ID NO: 58638 - DNA, 24 bp, Artificial sequence
  SiRNA target sequence
tctcggccgtaccaacctgtattg

SEQ ID NO: 58639 - DNA, 24 bp, Artificial sequence
  SiRNA target sequence
ctcggccgtaccaacctgtattgt

SEQ ID NO: 58640 - DNA, 24 bp, Artificial sequence
  SiRNA target sequence
tcggccgtaccaacctgtattgta

SEQ ID NO: 58641 - DNA, 24 bp, Artificial sequence
  SiRNA target sequence
cggccgtaccaacctgtattgtag

SEQ ID NO: 58642 - DNA, 24 bp, Artificial sequence
  SiRNA target sequence
ggccgtaccaacctgtattgtagt

SEQ ID NO: 58643 - DNA, 24 bp, Artificial sequence
  SiRNA target sequence
gccgtaccaacctgtattgtagtt

SEQ ID NO: 58644 - DNA, 24 bp, Artificial sequence
  SiRNA target sequence
ccgtaccaacctgtattgtagtta

SEQ ID NO: 58645 - DNA, 24 bp, Artificial sequence
  SiRNA target sequence
cgtaccaacctgtattgtagttat

SEQ ID NO: 58646 - DNA, 24 bp, Artificial sequence
  SiRNA target sequence
gtaccaacctgtattgtagttatt

SEQ ID NO: 58647 - DNA, 24 bp, Artificial sequence
  SiRNA target sequence
taccaacctgtattgtagttatta

SEQ ID NO: 58648 - DNA, 24 bp, Artificial sequence
  SiRNA target sequence
accaacctgtattgtagttattat

SEQ ID NO: 58649 - DNA, 24 bp, Artificial sequence
  SiRNA target sequence
ccaacctgtattgtagttattatg

SEQ ID NO: 58650 - DNA, 24 bp, Artificial sequence
  SiRNA target sequence
caacctgtattgtagttattatgt

SEQ ID NO: 58651 - DNA, 24 bp, Artificial sequence
  SiRNA target sequence
aacctgtattgtagttattatgtc

SEQ ID NO: 58652 - DNA, 24 bp, Artificial sequence
  SiRNA target sequence
acctgtattgtagttattatgtcg

SEQ ID NO: 58653 - DNA, 24 bp, Artificial sequence
  SiRNA target sequence
cctgtattgtagttattatgtcgt

SEQ ID NO: 58654 - DNA, 24 bp, Artificial sequence
  SiRNA target sequence
ctgtattgtagttattatgtcgtt

SEQ ID NO: 58655 - DNA, 24 bp, Artificial sequence
  SiRNA target sequence
tgtattgtagttattatgtcgttt

SEQ ID NO: 58656 - DNA, 24 bp, Artificial sequence
  SiRNA target sequence
gtattgtagttattatgtcgtttt

SEQ ID NO: 58657 - DNA, 24 bp, Artificial sequence
  SiRNA target sequence
tattgtagttattatgtcgttttt

SEQ ID NO: 58658 - DNA, 24 bp, Artificial sequence
  SiRNA target sequence
attgtagttattatgtcgtttttc

SEQ ID NO: 58659 - DNA, 24 bp, Artificial sequence
  SiRNA target sequence
ttgtagttattatgtcgtttttct

SEQ ID NO: 58660 - DNA, 24 bp, Artificial sequence
  SiRNA target sequence
tgtagttattatgtcgtttttctc

SEQ ID NO: 58661 - DNA, 24 bp, Artificial sequence
  SiRNA target sequence
gtagttattatgtcgtttttctca

SEQ ID NO: 58662 - DNA, 24 bp, Artificial sequence
  SiRNA target sequence
tagttattatgtcgtttttctcag

SEQ ID NO: 58663 - DNA, 24 bp, Artificial sequence
  SiRNA target sequence
agttattatgtcgtttttctcagt

SEQ ID NO: 58664 - DNA, 24 bp, Artificial sequence
  SiRNA target sequence
gttattatgtcgtttttctcagta

SEQ ID NO: 58665 - DNA, 24 bp, Artificial sequence
  SiRNA target sequence
ttattatgtcgtttttctcagtat

SEQ ID NO: 58666 - DNA, 24 bp, Artificial sequence
  SiRNA target sequence
tattatgtcgtttttctcagtata

SEQ ID NO: 58667 - DNA, 24 bp, Artificial sequence
  SiRNA target sequence
attatgtcgtttttctcagtatat

SEQ ID NO: 58668 - DNA, 24 bp, Artificial sequence
  SiRNA target sequence
ttatgtcgtttttctcagtatata

SEQ ID NO: 58669 - DNA, 24 bp, Artificial sequence
  SiRNA target sequence
tatgtcgtttttctcagtatataa

SEQ ID NO: 58670 - DNA, 24 bp, Artificial sequence
  SiRNA target sequence
atgtcgtttttctcagtatataaa

SEQ ID NO: 58671 - DNA, 24 bp, Artificial sequence
  SiRNA target sequence
tgtcgtttttctcagtatataaaa

SEQ ID NO: 58672 - DNA, 24 bp, Artificial sequence
  SiRNA target sequence
gtcgtttttctcagtatataaaaa

SEQ ID NO: 58673 - DNA, 24 bp, Artificial sequence
  SiRNA target sequence
tcgtttttctcagtatataaaaat

SEQ ID NO: 58674 - DNA, 24 bp, Artificial sequence
  SiRNA target sequence
cgtttttctcagtatataaaaatt

SEQ ID NO: 58675 - DNA, 24 bp, Artificial sequence
  SiRNA target sequence
gtttttctcagtatataaaaattt

SEQ ID NO: 58676 - DNA, 24 bp, Artificial sequence
  SiRNA target sequence
tttttctcagtatataaaaatttg

SEQ ID NO: 58677 - DNA, 24 bp, Artificial sequence
  SiRNA target sequence
ttttctcagtatataaaaatttgg

SEQ ID NO: 58678 - DNA, 24 bp, Artificial sequence
  SiRNA target sequence
tttctcagtatataaaaatttggg

SEQ ID NO: 58679 - DNA, 24 bp, Artificial sequence
  SiRNA target sequence
ttctcagtatataaaaatttggga

SEQ ID NO: 58680 - DNA, 24 bp, Artificial sequence
  SiRNA target sequence
tctcagtatataaaaatttgggaa

SEQ ID NO: 58681 - DNA, 24 bp, Artificial sequence
  SiRNA target sequence
ctcagtatataaaaatttgggaag

SEQ ID NO: 58682 - DNA, 24 bp, Artificial sequence
  SiRNA target sequence
tcagtatataaaaatttgggaaga

SEQ ID NO: 58683 - DNA, 24 bp, Artificial sequence
  SiRNA target sequence
cagtatataaaaatttgggaagag

SEQ ID NO: 58684 - DNA, 24 bp, Artificial sequence
  SiRNA target sequence
agtatataaaaatttgggaagaga

SEQ ID NO: 58685 - DNA, 24 bp, Artificial sequence
  SiRNA target sequence
gtatataaaaatttgggaagagat

SEQ ID NO: 58686 - DNA, 24 bp, Artificial sequence
  SiRNA target sequence
tatataaaaatttgggaagagatg

SEQ ID NO: 58687 - DNA, 24 bp, Artificial sequence
  SiRNA target sequence
atataaaaatttgggaagagatgc

SEQ ID NO: 58688 - DNA, 24 bp, Artificial sequence
  SiRNA target sequence
tataaaaatttgggaagagatgca

SEQ ID NO: 58689 - DNA, 24 bp, Artificial sequence
  SiRNA target sequence
ataaaaatttgggaagagatgcac

SEQ ID NO: 58690 - DNA, 24 bp, Artificial sequence
  SiRNA target sequence
taaaaatttgggaagagatgcact

SEQ ID NO: 58691 - DNA, 24 bp, Artificial sequence
  SiRNA target sequence
aaaaatttgggaagagatgcactc

SEQ ID NO: 58692 - DNA, 24 bp, Artificial sequence
  SiRNA target sequence
aaaatttgggaagagatgcactct

SEQ ID NO: 58693 - DNA, 24 bp, Artificial sequence
  SiRNA target sequence
aaatttgggaagagatgcactcta

SEQ ID NO: 58694 - DNA, 24 bp, Artificial sequence
  SiRNA target sequence
aatttgggaagagatgcactctac

SEQ ID NO: 58695 - DNA, 24 bp, Artificial sequence
  SiRNA target sequence
atttgggaagagatgcactctacg

SEQ ID NO: 58696 - DNA, 24 bp, Artificial sequence
  SiRNA target sequence
tttgggaagagatgcactctacgt

SEQ ID NO: 58697 - DNA, 24 bp, Artificial sequence
  SiRNA target sequence
ttgggaagagatgcactctacgta

SEQ ID NO: 58698 - DNA, 24 bp, Artificial sequence
  SiRNA target sequence
tgggaagagatgcactctacgtaa

SEQ ID NO: 58699 - DNA, 24 bp, Artificial sequence
  SiRNA target sequence
gggaagagatgcactctacgtaat

SEQ ID NO: 58700 - DNA, 24 bp, Artificial sequence
  SiRNA target sequence
ggaagagatgcactctacgtaatg

SEQ ID NO: 58701 - DNA, 24 bp, Artificial sequence
  SiRNA target sequence
gaagagatgcactctacgtaatgt

SEQ ID NO: 58702 - DNA, 24 bp, Artificial sequence
  SiRNA target sequence
aagagatgcactctacgtaatgtt

SEQ ID NO: 58703 - DNA, 24 bp, Artificial sequence
  SiRNA target sequence
agagatgcactctacgtaatgttg

SEQ ID NO: 58704 - DNA, 24 bp, Artificial sequence
  SiRNA target sequence
gagatgcactctacgtaatgttgg

SEQ ID NO: 58705 - DNA, 24 bp, Artificial sequence
  SiRNA target sequence
agatgcactctacgtaatgttggc

SEQ ID NO: 58706 - DNA, 24 bp, Artificial sequence
  SiRNA target sequence
gatgcactctacgtaatgttggct

SEQ ID NO: 58707 - DNA, 24 bp, Artificial sequence
  SiRNA target sequence
atgcactctacgtaatgttggcta

SEQ ID NO: 58708 - DNA, 24 bp, Artificial sequence
  SiRNA target sequence
tgcactctacgtaatgttggctac

SEQ ID NO: 58709 - DNA, 24 bp, Artificial sequence
  SiRNA target sequence
gcactctacgtaatgttggctaca

SEQ ID NO: 58710 - DNA, 24 bp, Artificial sequence
  SiRNA target sequence
cactctacgtaatgttggctacaa

SEQ ID NO: 58711 - DNA, 24 bp, Artificial sequence
  SiRNA target sequence
actctacgtaatgttggctacaag

SEQ ID NO: 58712 - DNA, 24 bp, Artificial sequence
  SiRNA target sequence
ctctacgtaatgttggctacaagt

SEQ ID NO: 58713 - DNA, 24 bp, Artificial sequence
  SiRNA target sequence
tctacgtaatgttggctacaagtg

SEQ ID NO: 58714 - DNA, 24 bp, Artificial sequence
  SiRNA target sequence
ctacgtaatgttggctacaagtgc

SEQ ID NO: 58715 - DNA, 24 bp, Artificial sequence
  SiRNA target sequence
tacgtaatgttggctacaagtgcc

SEQ ID NO: 58716 - DNA, 24 bp, Artificial sequence
  SiRNA target sequence
acgtaatgttggctacaagtgcct

SEQ ID NO: 58717 - DNA, 24 bp, Artificial sequence
  SiRNA target sequence
cgtaatgttggctacaagtgcctt

SEQ ID NO: 58718 - DNA, 24 bp, Artificial sequence
  SiRNA target sequence
gtaatgttggctacaagtgccttg

SEQ ID NO: 58719 - DNA, 24 bp, Artificial sequence
  SiRNA target sequence
taatgttggctacaagtgccttgt

SEQ ID NO: 58720 - DNA, 24 bp, Artificial sequence
  SiRNA target sequence
aatgttggctacaagtgccttgta

SEQ ID NO: 58721 - DNA, 24 bp, Artificial sequence
  SiRNA target sequence
atgttggctacaagtgccttgtat

SEQ ID NO: 58722 - DNA, 24 bp, Artificial sequence
  SiRNA target sequence
tgttggctacaagtgccttgtatg

SEQ ID NO: 58723 - DNA, 24 bp, Artificial sequence
  SiRNA target sequence
gttggctacaagtgccttgtatgt

SEQ ID NO: 58724 - DNA, 24 bp, Artificial sequence
  SiRNA target sequence
ttggctacaagtgccttgtatgtg

SEQ ID NO: 58725 - DNA, 24 bp, Artificial sequence
  SiRNA target sequence
tggctacaagtgccttgtatgtgt

SEQ ID NO: 58726 - DNA, 24 bp, Artificial sequence
  SiRNA target sequence
ggctacaagtgccttgtatgtgta

SEQ ID NO: 58727 - DNA, 24 bp, Artificial sequence
  SiRNA target sequence
gctacaagtgccttgtatgtgtat

SEQ ID NO: 58728 - DNA, 24 bp, Artificial sequence
  SiRNA target sequence
ctacaagtgccttgtatgtgtatt

SEQ ID NO: 58729 - DNA, 24 bp, Artificial sequence
  SiRNA target sequence
tacaagtgccttgtatgtgtattt

SEQ ID NO: 58730 - DNA, 24 bp, Artificial sequence
  SiRNA target sequence
acaagtgccttgtatgtgtatttt

SEQ ID NO: 58731 - DNA, 24 bp, Artificial sequence
  SiRNA target sequence
caagtgccttgtatgtgtatttta

SEQ ID NO: 58732 - DNA, 24 bp, Artificial sequence
  SiRNA target sequence
aagtgccttgtatgtgtattttac

SEQ ID NO: 58733 - DNA, 24 bp, Artificial sequence
  SiRNA target sequence
agtgccttgtatgtgtattttaca

SEQ ID NO: 58734 - DNA, 24 bp, Artificial sequence
  SiRNA target sequence
gtgccttgtatgtgtattttacat

SEQ ID NO: 58735 - DNA, 24 bp, Artificial sequence
  SiRNA target sequence
tgccttgtatgtgtattttacatt

SEQ ID NO: 58736 - DNA, 24 bp, Artificial sequence
  SiRNA target sequence
gccttgtatgtgtattttacattt

SEQ ID NO: 58737 - DNA, 24 bp, Artificial sequence
  SiRNA target sequence
ccttgtatgtgtattttacatttg

SEQ ID NO: 58738 - DNA, 24 bp, Artificial sequence
  SiRNA target sequence
cttgtatgtgtattttacatttgt

SEQ ID NO: 58739 - DNA, 24 bp, Artificial sequence
  SiRNA target sequence
ttgtatgtgtattttacatttgta

SEQ ID NO: 58740 - DNA, 24 bp, Artificial sequence
  SiRNA target sequence
tgtatgtgtattttacatttgtat

SEQ ID NO: 58741 - DNA, 24 bp, Artificial sequence
  SiRNA target sequence
gtatgtgtattttacatttgtatt

SEQ ID NO: 58742 - DNA, 24 bp, Artificial sequence
  SiRNA target sequence
tatgtgtattttacatttgtattt

SEQ ID NO: 58743 - DNA, 24 bp, Artificial sequence
  SiRNA target sequence
atgtgtattttacatttgtatttt

SEQ ID NO: 58744 - DNA, 24 bp, Artificial sequence
  SiRNA target sequence
tgtgtattttacatttgtattttc

SEQ ID NO: 58745 - DNA, 24 bp, Artificial sequence
  SiRNA target sequence
gtgtattttacatttgtattttca

SEQ ID NO: 58746 - DNA, 24 bp, Artificial sequence
  SiRNA target sequence
tgtattttacatttgtattttcaa

SEQ ID NO: 58747 - DNA, 24 bp, Artificial sequence
  SiRNA target sequence
gtattttacatttgtattttcaat

SEQ ID NO: 58748 - DNA, 24 bp, Artificial sequence
  SiRNA target sequence
tattttacatttgtattttcaata

SEQ ID NO: 58749 - DNA, 24 bp, Artificial sequence
  SiRNA target sequence
attttacatttgtattttcaatat

SEQ ID NO: 58750 - DNA, 24 bp, Artificial sequence
  SiRNA target sequence
ttttacatttgtattttcaatatg

SEQ ID NO: 58751 - DNA, 24 bp, Artificial sequence
  SiRNA target sequence
tttacatttgtattttcaatatgg

SEQ ID NO: 58752 - DNA, 24 bp, Artificial sequence
  SiRNA target sequence
ttacatttgtattttcaatatgga

SEQ ID NO: 58753 - DNA, 24 bp, Artificial sequence
  SiRNA target sequence
tacatttgtattttcaatatggag

SEQ ID NO: 58754 - DNA, 24 bp, Artificial sequence
  SiRNA target sequence
acatttgtattttcaatatggaga

SEQ ID NO: 58755 - DNA, 24 bp, Artificial sequence
  SiRNA target sequence
catttgtattttcaatatggagaa

SEQ ID NO: 58756 - DNA, 24 bp, Artificial sequence
  SiRNA target sequence
atttgtattttcaatatggagaaa

SEQ ID NO: 58757 - DNA, 24 bp, Artificial sequence
  SiRNA target sequence
tttgtattttcaatatggagaaac

SEQ ID NO: 58758 - DNA, 24 bp, Artificial sequence
  SiRNA target sequence
ttgtattttcaatatggagaaaca

SEQ ID NO: 58759 - DNA, 24 bp, Artificial sequence
  SiRNA target sequence
tgtattttcaatatggagaaacaa

SEQ ID NO: 58760 - DNA, 24 bp, Artificial sequence
  SiRNA target sequence
gtattttcaatatggagaaacaat

SEQ ID NO: 58761 - DNA, 24 bp, Artificial sequence
  SiRNA target sequence
tattttcaatatggagaaacaata

SEQ ID NO: 58762 - DNA, 24 bp, Artificial sequence
  SiRNA target sequence
attttcaatatggagaaacaatat

SEQ ID NO: 58763 - DNA, 24 bp, Artificial sequence
  SiRNA target sequence
ttttcaatatggagaaacaatatt

SEQ ID NO: 58764 - DNA, 24 bp, Artificial sequence
  SiRNA target sequence
tttcaatatggagaaacaatatta

SEQ ID NO: 58765 - DNA, 24 bp, Artificial sequence
  SiRNA target sequence
ttcaatatggagaaacaatattag

SEQ ID NO: 58766 - DNA, 24 bp, Artificial sequence
  SiRNA target sequence
tcaatatggagaaacaatattaga

SEQ ID NO: 58767 - DNA, 24 bp, Artificial sequence
  SiRNA target sequence
caatatggagaaacaatattagaa

SEQ ID NO: 58768 - DNA, 24 bp, Artificial sequence
  SiRNA target sequence
aatatggagaaacaatattagaag

SEQ ID NO: 58769 - DNA, 24 bp, Artificial sequence
  SiRNA target sequence
atatggagaaacaatattagaaga

SEQ ID NO: 58770 - DNA, 24 bp, Artificial sequence
  SiRNA target sequence
tatggagaaacaatattagaagac

SEQ ID NO: 58771 - DNA, 24 bp, Artificial sequence
  SiRNA target sequence
atggagaaacaatattagaagaca

SEQ ID NO: 58772 - DNA, 24 bp, Artificial sequence
  SiRNA target sequence
tggagaaacaatattagaagacaa

SEQ ID NO: 58773 - DNA, 24 bp, Artificial sequence
  SiRNA target sequence
ggagaaacaatattagaagacaat

SEQ ID NO: 58774 - DNA, 24 bp, Artificial sequence
  SiRNA target sequence
gagaaacaatattagaagacaata

SEQ ID NO: 58775 - DNA, 24 bp, Artificial sequence
  SiRNA target sequence
agaaacaatattagaagacaatat

SEQ ID NO: 58776 - DNA, 24 bp, Artificial sequence
  SiRNA target sequence
gaaacaatattagaagacaatata

SEQ ID NO: 58777 - DNA, 24 bp, Artificial sequence
  SiRNA target sequence
aaacaatattagaagacaatataa

SEQ ID NO: 58778 - DNA, 24 bp, Artificial sequence
  SiRNA target sequence
aacaatattagaagacaatataat

SEQ ID NO: 58779 - DNA, 24 bp, Artificial sequence
  SiRNA target sequence
acaatattagaagacaatataata

SEQ ID NO: 58780 - DNA, 24 bp, Artificial sequence
  SiRNA target sequence
caatattagaagacaatataataa

SEQ ID NO: 58781 - DNA, 24 bp, Artificial sequence
  SiRNA target sequence
aatattagaagacaatataataag

SEQ ID NO: 58782 - DNA, 24 bp, Artificial sequence
  SiRNA target sequence
atattagaagacaatataataagt

SEQ ID NO: 58783 - DNA, 24 bp, Artificial sequence
  SiRNA target sequence
tattagaagacaatataataagtc

SEQ ID NO: 58784 - DNA, 24 bp, Artificial sequence
  SiRNA target sequence
attagaagacaatataataagtca

SEQ ID NO: 58785 - DNA, 24 bp, Artificial sequence
  SiRNA target sequence
ttagaagacaatataataagtcac

SEQ ID NO: 58786 - DNA, 24 bp, Artificial sequence
  SiRNA target sequence
tagaagacaatataataagtcaca

SEQ ID NO: 58787 - DNA, 24 bp, Artificial sequence
  SiRNA target sequence
agaagacaatataataagtcacag

SEQ ID NO: 58788 - DNA, 24 bp, Artificial sequence
  SiRNA target sequence
gaagacaatataataagtcacagg

SEQ ID NO: 58789 - DNA, 24 bp, Artificial sequence
  SiRNA target sequence
aagacaatataataagtcacagga

SEQ ID NO: 58790 - DNA, 24 bp, Artificial sequence
  SiRNA target sequence
agacaatataataagtcacaggat

SEQ ID NO: 58791 - DNA, 24 bp, Artificial sequence
  SiRNA target sequence
gacaatataataagtcacaggata

SEQ ID NO: 58792 - DNA, 24 bp, Artificial sequence
  SiRNA target sequence
acaatataataagtcacaggataa

SEQ ID NO: 58793 - DNA, 24 bp, Artificial sequence
  SiRNA target sequence
caatataataagtcacaggataaa

SEQ ID NO: 58794 - DNA, 24 bp, Artificial sequence
  SiRNA target sequence
aatataataagtcacaggataaat

SEQ ID NO: 58795 - DNA, 24 bp, Artificial sequence
  SiRNA target sequence
atataataagtcacaggataaatt

SEQ ID NO: 58796 - DNA, 24 bp, Artificial sequence
  SiRNA target sequence
tataataagtcacaggataaatta

SEQ ID NO: 58797 - DNA, 24 bp, Artificial sequence
  SiRNA target sequence
ataataagtcacaggataaattat

SEQ ID NO: 58798 - DNA, 24 bp, Artificial sequence
  SiRNA target sequence
taataagtcacaggataaattatc

SEQ ID NO: 58799 - DNA, 24 bp, Artificial sequence
  SiRNA target sequence
aataagtcacaggataaattatcg

SEQ ID NO: 58800 - DNA, 24 bp, Artificial sequence
  SiRNA target sequence
ataagtcacaggataaattatcga

SEQ ID NO: 58801 - DNA, 24 bp, Artificial sequence
  SiRNA target sequence
taagtcacaggataaattatcgaa

SEQ ID NO: 58802 - DNA, 24 bp, Artificial sequence
  SiRNA target sequence
aagtcacaggataaattatcgaat

SEQ ID NO: 58803 - DNA, 24 bp, Artificial sequence
  SiRNA target sequence
agtcacaggataaattatcgaata

SEQ ID NO: 58804 - DNA, 24 bp, Artificial sequence
  SiRNA target sequence
gtcacaggataaattatcgaataa

SEQ ID NO: 58805 - DNA, 24 bp, Artificial sequence
  SiRNA target sequence
tcacaggataaattatcgaataaa

SEQ ID NO: 58806 - DNA, 24 bp, Artificial sequence
  SiRNA target sequence
cacaggataaattatcgaataaat

SEQ ID NO: 58807 - DNA, 24 bp, Artificial sequence
  SiRNA target sequence
acaggataaattatcgaataaatt

SEQ ID NO: 58808 - DNA, 24 bp, Artificial sequence
  SiRNA target sequence
caggataaattatcgaataaatta

SEQ ID NO: 58809 - DNA, 24 bp, Artificial sequence
  SiRNA target sequence
aggataaattatcgaataaattac

SEQ ID NO: 58810 - DNA, 24 bp, Artificial sequence
  SiRNA target sequence
ggataaattatcgaataaattaca

SEQ ID NO: 58811 - DNA, 24 bp, Artificial sequence
  SiRNA target sequence
gataaattatcgaataaattacaa

SEQ ID NO: 58812 - DNA, 24 bp, Artificial sequence
  SiRNA target sequence
ataaattatcgaataaattacaag

SEQ ID NO: 58813 - DNA, 24 bp, Artificial sequence
  SiRNA target sequence
taaattatcgaataaattacaaga

SEQ ID NO: 58814 - DNA, 24 bp, Artificial sequence
  SiRNA target sequence
aaattatcgaataaattacaagat

SEQ ID NO: 58815 - DNA, 24 bp, Artificial sequence
  SiRNA target sequence
aattatcgaataaattacaagatt

SEQ ID NO: 58816 - DNA, 24 bp, Artificial sequence
  SiRNA target sequence
attatcgaataaattacaagattt

SEQ ID NO: 58817 - DNA, 24 bp, Artificial sequence
  SiRNA target sequence
ttatcgaataaattacaagatttt

SEQ ID NO: 58818 - DNA, 24 bp, Artificial sequence
  SiRNA target sequence
tatcgaataaattacaagattttt

SEQ ID NO: 58819 - DNA, 24 bp, Artificial sequence
  SiRNA target sequence
atcgaataaattacaagatttttt

SEQ ID NO: 58820 - DNA, 24 bp, Artificial sequence
  SiRNA target sequence
tcgaataaattacaagatttttta

SEQ ID NO: 58821 - DNA, 24 bp, Artificial sequence
  SiRNA target sequence
cgaataaattacaagattttttag

SEQ ID NO: 58822 - DNA, 24 bp, Artificial sequence
  SiRNA target sequence
gaataaattacaagattttttagc

SEQ ID NO: 58823 - DNA, 24 bp, Artificial sequence
  SiRNA target sequence
aataaattacaagattttttagct

SEQ ID NO: 58824 - DNA, 24 bp, Artificial sequence
  SiRNA target sequence
ataaattacaagattttttagcta

SEQ ID NO: 58825 - DNA, 24 bp, Artificial sequence
  SiRNA target sequence
taaattacaagattttttagctaa

SEQ ID NO: 58826 - DNA, 24 bp, Artificial sequence
  SiRNA target sequence
aaattacaagattttttagctaat

SEQ ID NO: 58827 - DNA, 24 bp, Artificial sequence
  SiRNA target sequence
aattacaagattttttagctaatc

SEQ ID NO: 58828 - DNA, 24 bp, Artificial sequence
  SiRNA target sequence
attacaagattttttagctaatca

SEQ ID NO: 58829 - DNA, 24 bp, Artificial sequence
  SiRNA target sequence
ttacaagattttttagctaatcat

SEQ ID NO: 58830 - DNA, 24 bp, Artificial sequence
  SiRNA target sequence
tacaagattttttagctaatcatg

SEQ ID NO: 58831 - DNA, 24 bp, Artificial sequence
  SiRNA target sequence
acaagattttttagctaatcatga

SEQ ID NO: 58832 - DNA, 24 bp, Artificial sequence
  SiRNA target sequence
caagattttttagctaatcatgaa

SEQ ID NO: 58833 - DNA, 24 bp, Artificial sequence
  SiRNA target sequence
aagattttttagctaatcatgaaa

SEQ ID NO: 58834 - DNA, 24 bp, Artificial sequence
  SiRNA target sequence
agattttttagctaatcatgaaac

SEQ ID NO: 58835 - DNA, 24 bp, Artificial sequence
  SiRNA target sequence
gattttttagctaatcatgaaaca

SEQ ID NO: 58836 - DNA, 24 bp, Artificial sequence
  SiRNA target sequence
attttttagctaatcatgaaacaa

SEQ ID NO: 58837 - DNA, 24 bp, Artificial sequence
  SiRNA target sequence
ttttttagctaatcatgaaacaat

SEQ ID NO: 58838 - DNA, 24 bp, Artificial sequence
  SiRNA target sequence
tttttagctaatcatgaaacaatt

SEQ ID NO: 58839 - DNA, 24 bp, Artificial sequence
  SiRNA target sequence
ttttagctaatcatgaaacaatta

SEQ ID NO: 58840 - DNA, 24 bp, Artificial sequence
  SiRNA target sequence
tttagctaatcatgaaacaattaa

SEQ ID NO: 58841 - DNA, 24 bp, Artificial sequence
  SiRNA target sequence
ttagctaatcatgaaacaattaaa

SEQ ID NO: 58842 - DNA, 24 bp, Artificial sequence
  SiRNA target sequence
tagctaatcatgaaacaattaaag

SEQ ID NO: 58843 - DNA, 24 bp, Artificial sequence
  SiRNA target sequence
agctaatcatgaaacaattaaagc

SEQ ID NO: 58844 - DNA, 24 bp, Artificial sequence
  SiRNA target sequence
gctaatcatgaaacaattaaagcc

SEQ ID NO: 58845 - DNA, 24 bp, Artificial sequence
  SiRNA target sequence
ctaatcatgaaacaattaaagcct

SEQ ID NO: 58846 - DNA, 24 bp, Artificial sequence
  SiRNA target sequence
taatcatgaaacaattaaagccta

SEQ ID NO: 58847 - DNA, 24 bp, Artificial sequence
  SiRNA target sequence
aatcatgaaacaattaaagcctat

SEQ ID NO: 58848 - DNA, 24 bp, Artificial sequence
  SiRNA target sequence
atcatgaaacaattaaagcctata

SEQ ID NO: 58849 - DNA, 24 bp, Artificial sequence
  SiRNA target sequence
tcatgaaacaattaaagcctataa

SEQ ID NO: 58850 - DNA, 24 bp, Artificial sequence
  SiRNA target sequence
catgaaacaattaaagcctataat

SEQ ID NO: 58851 - DNA, 24 bp, Artificial sequence
  SiRNA target sequence
atgaaacaattaaagcctataata

SEQ ID NO: 58852 - DNA, 24 bp, Artificial sequence
  SiRNA target sequence
tgaaacaattaaagcctataatat

SEQ ID NO: 58853 - DNA, 24 bp, Artificial sequence
  SiRNA target sequence
gaaacaattaaagcctataatatg

SEQ ID NO: 58854 - DNA, 24 bp, Artificial sequence
  SiRNA target sequence
aaacaattaaagcctataatatgg

SEQ ID NO: 58855 - DNA, 24 bp, Artificial sequence
  SiRNA target sequence
aacaattaaagcctataatatgga

SEQ ID NO: 58856 - DNA, 24 bp, Artificial sequence
  SiRNA target sequence
acaattaaagcctataatatggaa

SEQ ID NO: 58857 - DNA, 24 bp, Artificial sequence
  SiRNA target sequence
caattaaagcctataatatggaag

SEQ ID NO: 58858 - DNA, 24 bp, Artificial sequence
  SiRNA target sequence
aattaaagcctataatatggaaga

SEQ ID NO: 58859 - DNA, 24 bp, Artificial sequence
  SiRNA target sequence
attaaagcctataatatggaagaa

SEQ ID NO: 58860 - DNA, 24 bp, Artificial sequence
  SiRNA target sequence
ttaaagcctataatatggaagaag

SEQ ID NO: 58861 - DNA, 24 bp, Artificial sequence
  SiRNA target sequence
taaagcctataatatggaagaaga

SEQ ID NO: 58862 - DNA, 24 bp, Artificial sequence
  SiRNA target sequence
aaagcctataatatggaagaagaa

SEQ ID NO: 58863 - DNA, 24 bp, Artificial sequence
  SiRNA target sequence
aagcctataatatggaagaagaaa

SEQ ID NO: 58864 - DNA, 24 bp, Artificial sequence
  SiRNA target sequence
agcctataatatggaagaagaaac

SEQ ID NO: 58865 - DNA, 24 bp, Artificial sequence
  SiRNA target sequence
gcctataatatggaagaagaaact

SEQ ID NO: 58866 - DNA, 24 bp, Artificial sequence
  SiRNA target sequence
cctataatatggaagaagaaacta

SEQ ID NO: 58867 - DNA, 24 bp, Artificial sequence
  SiRNA target sequence
ctataatatggaagaagaaactat

SEQ ID NO: 58868 - DNA, 24 bp, Artificial sequence
  SiRNA target sequence
tataatatggaagaagaaactatt

SEQ ID NO: 58869 - DNA, 24 bp, Artificial sequence
  SiRNA target sequence
ataatatggaagaagaaactatta

SEQ ID NO: 58870 - DNA, 24 bp, Artificial sequence
  SiRNA target sequence
taatatggaagaagaaactattac

SEQ ID NO: 58871 - DNA, 24 bp, Artificial sequence
  SiRNA target sequence
aatatggaagaagaaactattaca

SEQ ID NO: 58872 - DNA, 24 bp, Artificial sequence
  SiRNA target sequence
atatggaagaagaaactattacat

SEQ ID NO: 58873 - DNA, 24 bp, Artificial sequence
  SiRNA target sequence
tatggaagaagaaactattacata

SEQ ID NO: 58874 - DNA, 24 bp, Artificial sequence
  SiRNA target sequence
atggaagaagaaactattacatat

SEQ ID NO: 58875 - DNA, 24 bp, Artificial sequence
  SiRNA target sequence
tggaagaagaaactattacatatt

SEQ ID NO: 58876 - DNA, 24 bp, Artificial sequence
  SiRNA target sequence
ggaagaagaaactattacatattt

SEQ ID NO: 58877 - DNA, 24 bp, Artificial sequence
  SiRNA target sequence
gaagaagaaactattacatatttt

SEQ ID NO: 58878 - DNA, 24 bp, Artificial sequence
  SiRNA target sequence
aagaagaaactattacatattttg

SEQ ID NO: 58879 - DNA, 24 bp, Artificial sequence
  SiRNA target sequence
agaagaaactattacatattttga

SEQ ID NO: 58880 - DNA, 24 bp, Artificial sequence
  SiRNA target sequence
gaagaaactattacatattttgat

SEQ ID NO: 58881 - DNA, 24 bp, Artificial sequence
  SiRNA target sequence
aagaaactattacatattttgatg

SEQ ID NO: 58882 - DNA, 24 bp, Artificial sequence
  SiRNA target sequence
agaaactattacatattttgatga

SEQ ID NO: 58883 - DNA, 24 bp, Artificial sequence
  SiRNA target sequence
gaaactattacatattttgatgaa

SEQ ID NO: 58884 - DNA, 24 bp, Artificial sequence
  SiRNA target sequence
aaactattacatattttgatgaaa

SEQ ID NO: 58885 - DNA, 24 bp, Artificial sequence
  SiRNA target sequence
aactattacatattttgatgaaaa

SEQ ID NO: 58886 - DNA, 24 bp, Artificial sequence
  SiRNA target sequence
actattacatattttgatgaaaat

SEQ ID NO: 58887 - DNA, 24 bp, Artificial sequence
  SiRNA target sequence
ctattacatattttgatgaaaatc

SEQ ID NO: 58888 - DNA, 24 bp, Artificial sequence
  SiRNA target sequence
tattacatattttgatgaaaatca

SEQ ID NO: 58889 - DNA, 24 bp, Artificial sequence
  SiRNA target sequence
attacatattttgatgaaaatcaa

SEQ ID NO: 58890 - DNA, 24 bp, Artificial sequence
  SiRNA target sequence
ttacatattttgatgaaaatcaaa

SEQ ID NO: 58891 - DNA, 24 bp, Artificial sequence
  SiRNA target sequence
tacatattttgatgaaaatcaaaa

SEQ ID NO: 58892 - DNA, 24 bp, Artificial sequence
  SiRNA target sequence
acatattttgatgaaaatcaaaaa

SEQ ID NO: 58893 - DNA, 24 bp, Artificial sequence
  SiRNA target sequence
catattttgatgaaaatcaaaaac

SEQ ID NO: 58894 - DNA, 24 bp, Artificial sequence
  SiRNA target sequence
atattttgatgaaaatcaaaaacc

SEQ ID NO: 58895 - DNA, 24 bp, Artificial sequence
  SiRNA target sequence
tattttgatgaaaatcaaaaaccg

SEQ ID NO: 58896 - DNA, 24 bp, Artificial sequence
  SiRNA target sequence
attttgatgaaaatcaaaaaccgg

SEQ ID NO: 58897 - DNA, 24 bp, Artificial sequence
  SiRNA target sequence
ttttgatgaaaatcaaaaaccggt

SEQ ID NO: 58898 - DNA, 24 bp, Artificial sequence
  SiRNA target sequence
tttgatgaaaatcaaaaaccggta

SEQ ID NO: 58899 - DNA, 24 bp, Artificial sequence
  SiRNA target sequence
ttgatgaaaatcaaaaaccggtag

SEQ ID NO: 58900 - DNA, 24 bp, Artificial sequence
  SiRNA target sequence
tgatgaaaatcaaaaaccggtaga

SEQ ID NO: 58901 - DNA, 24 bp, Artificial sequence
  SiRNA target sequence
gatgaaaatcaaaaaccggtagaa

SEQ ID NO: 58902 - DNA, 24 bp, Artificial sequence
  SiRNA target sequence
atgaaaatcaaaaaccggtagaat

SEQ ID NO: 58903 - DNA, 24 bp, Artificial sequence
  SiRNA target sequence
tgaaaatcaaaaaccggtagaata

SEQ ID NO: 58904 - DNA, 24 bp, Artificial sequence
  SiRNA target sequence
gaaaatcaaaaaccggtagaatat

SEQ ID NO: 58905 - DNA, 24 bp, Artificial sequence
  SiRNA target sequence
aaaatcaaaaaccggtagaatatt

SEQ ID NO: 58906 - DNA, 24 bp, Artificial sequence
  SiRNA target sequence
aaatcaaaaaccggtagaatattt

SEQ ID NO: 58907 - DNA, 24 bp, Artificial sequence
  SiRNA target sequence
aatcaaaaaccggtagaatatttt

SEQ ID NO: 58908 - DNA, 24 bp, Artificial sequence
  SiRNA target sequence
atcaaaaaccggtagaatattttg

SEQ ID NO: 58909 - DNA, 24 bp, Artificial sequence
  SiRNA target sequence
tcaaaaaccggtagaatattttgg

SEQ ID NO: 58910 - DNA, 24 bp, Artificial sequence
  SiRNA target sequence
caaaaaccggtagaatattttggg

SEQ ID NO: 58911 - DNA, 24 bp, Artificial sequence
  SiRNA target sequence
aaaaaccggtagaatattttgggg

SEQ ID NO: 58912 - DNA, 24 bp, Artificial sequence
  SiRNA target sequence
aaaaccggtagaatattttggggt

SEQ ID NO: 58913 - DNA, 24 bp, Artificial sequence
  SiRNA target sequence
aaaccggtagaatattttggggta

SEQ ID NO: 58914 - DNA, 24 bp, Artificial sequence
  SiRNA target sequence
aaccggtagaatattttggggtaa

SEQ ID NO: 58915 - DNA, 24 bp, Artificial sequence
  SiRNA target sequence
accggtagaatattttggggtaaa

SEQ ID NO: 58916 - DNA, 24 bp, Artificial sequence
  SiRNA target sequence
ccggtagaatattttggggtaaag

SEQ ID NO: 58917 - DNA, 24 bp, Artificial sequence
  SiRNA target sequence
cggtagaatattttggggtaaagt

SEQ ID NO: 58918 - DNA, 24 bp, Artificial sequence
  SiRNA target sequence
ggtagaatattttggggtaaagtc

SEQ ID NO: 58919 - DNA, 24 bp, Artificial sequence
  SiRNA target sequence
gtagaatattttggggtaaagtct

SEQ ID NO: 58920 - DNA, 24 bp, Artificial sequence
  SiRNA target sequence
tagaatattttggggtaaagtctc

SEQ ID NO: 58921 - DNA, 24 bp, Artificial sequence
  SiRNA target sequence
agaatattttggggtaaagtctca

SEQ ID NO: 58922 - DNA, 24 bp, Artificial sequence
  SiRNA target sequence
gaatattttggggtaaagtctcac

SEQ ID NO: 58923 - DNA, 24 bp, Artificial sequence
  SiRNA target sequence
aatattttggggtaaagtctcaca

SEQ ID NO: 58924 - DNA, 24 bp, Artificial sequence
  SiRNA target sequence
atattttggggtaaagtctcacag

SEQ ID NO: 58925 - DNA, 24 bp, Artificial sequence
  SiRNA target sequence
tattttggggtaaagtctcacaga

SEQ ID NO: 58926 - DNA, 24 bp, Artificial sequence
  SiRNA target sequence
attttggggtaaagtctcacagaa

SEQ ID NO: 58927 - DNA, 24 bp, Artificial sequence
  SiRNA target sequence
ttttggggtaaagtctcacagaat

SEQ ID NO: 58928 - DNA, 24 bp, Artificial sequence
  SiRNA target sequence
tttggggtaaagtctcacagaatt

SEQ ID NO: 58929 - DNA, 24 bp, Artificial sequence
  SiRNA target sequence
ttggggtaaagtctcacagaattt

SEQ ID NO: 58930 - DNA, 24 bp, Artificial sequence
  SiRNA target sequence
tggggtaaagtctcacagaatttt

SEQ ID NO: 58931 - DNA, 24 bp, Artificial sequence
  SiRNA target sequence
ggggtaaagtctcacagaattttg

SEQ ID NO: 58932 - DNA, 24 bp, Artificial sequence
  SiRNA target sequence
gggtaaagtctcacagaattttgt

SEQ ID NO: 58933 - DNA, 24 bp, Artificial sequence
  SiRNA target sequence
ggtaaagtctcacagaattttgtt

SEQ ID NO: 58934 - DNA, 24 bp, Artificial sequence
  SiRNA target sequence
gtaaagtctcacagaattttgttc

SEQ ID NO: 58935 - DNA, 24 bp, Artificial sequence
  SiRNA target sequence
taaagtctcacagaattttgttct

SEQ ID NO: 58936 - DNA, 24 bp, Artificial sequence
  SiRNA target sequence
aaagtctcacagaattttgttctc

SEQ ID NO: 58937 - DNA, 24 bp, Artificial sequence
  SiRNA target sequence
aagtctcacagaattttgttctct

SEQ ID NO: 58938 - DNA, 24 bp, Artificial sequence
  SiRNA target sequence
agtctcacagaattttgttctctc

SEQ ID NO: 58939 - DNA, 24 bp, Artificial sequence
  SiRNA target sequence
gtctcacagaattttgttctctct

SEQ ID NO: 58940 - DNA, 24 bp, Artificial sequence
  SiRNA target sequence
tctcacagaattttgttctctctt

SEQ ID NO: 58941 - DNA, 24 bp, Artificial sequence
  SiRNA target sequence
ctcacagaattttgttctctcttt

SEQ ID NO: 58942 - DNA, 24 bp, Artificial sequence
  SiRNA target sequence
tcacagaattttgttctctctttt

SEQ ID NO: 58943 - DNA, 24 bp, Artificial sequence
  SiRNA target sequence
cacagaattttgttctctctttta

SEQ ID NO: 58944 - DNA, 24 bp, Artificial sequence
  SiRNA target sequence
acagaattttgttctctcttttat

SEQ ID NO: 58945 - DNA, 24 bp, Artificial sequence
  SiRNA target sequence
cagaattttgttctctcttttata

SEQ ID NO: 58946 - DNA, 24 bp, Artificial sequence
  SiRNA target sequence
agaattttgttctctcttttatat

SEQ ID NO: 58947 - DNA, 24 bp, Artificial sequence
  SiRNA target sequence
gaattttgttctctcttttatata

SEQ ID NO: 58948 - DNA, 24 bp, Artificial sequence
  SiRNA target sequence
aattttgttctctcttttatatat

SEQ ID NO: 58949 - DNA, 24 bp, Artificial sequence
  SiRNA target sequence
attttgttctctcttttatatata

SEQ ID NO: 58950 - DNA, 24 bp, Artificial sequence
  SiRNA target sequence
ttttgttctctcttttatatatac

SEQ ID NO: 58951 - DNA, 24 bp, Artificial sequence
  SiRNA target sequence
tttgttctctcttttatatataca

SEQ ID NO: 58952 - DNA, 24 bp, Artificial sequence
  SiRNA target sequence
ttgttctctcttttatatatacaa

SEQ ID NO: 58953 - DNA, 24 bp, Artificial sequence
  SiRNA target sequence
tgttctctcttttatatatacaaa

SEQ ID NO: 58954 - DNA, 24 bp, Artificial sequence
  SiRNA target sequence
gttctctcttttatatatacaaaa

SEQ ID NO: 58955 - DNA, 24 bp, Artificial sequence
  SiRNA target sequence
ttctctcttttatatatacaaaaa

SEQ ID NO: 58956 - DNA, 24 bp, Artificial sequence
  SiRNA target sequence
tctctcttttatatatacaaaaaa

SEQ ID NO: 58957 - DNA, 24 bp, Artificial sequence
  SiRNA target sequence
ctctcttttatatatacaaaaaat

SEQ ID NO: 58958 - DNA, 24 bp, Artificial sequence
  SiRNA target sequence
tctcttttatatatacaaaaaatg

SEQ ID NO: 58959 - DNA, 24 bp, Artificial sequence
  SiRNA target sequence
ctcttttatatatacaaaaaatga

SEQ ID NO: 58960 - DNA, 24 bp, Artificial sequence
  SiRNA target sequence
tcttttatatatacaaaaaatgac

SEQ ID NO: 58961 - DNA, 24 bp, Artificial sequence
  SiRNA target sequence
cttttatatatacaaaaaatgaca

SEQ ID NO: 58962 - DNA, 24 bp, Artificial sequence
  SiRNA target sequence
ttttatatatacaaaaaatgacat

SEQ ID NO: 58963 - DNA, 24 bp, Artificial sequence
  SiRNA target sequence
tttatatatacaaaaaatgacatt

SEQ ID NO: 58964 - DNA, 24 bp, Artificial sequence
  SiRNA target sequence
ttatatatacaaaaaatgacattt

SEQ ID NO: 58965 - DNA, 24 bp, Artificial sequence
  SiRNA target sequence
tatatatacaaaaaatgacatttg

SEQ ID NO: 58966 - DNA, 24 bp, Artificial sequence
  SiRNA target sequence
atatatacaaaaaatgacatttgc

SEQ ID NO: 58967 - DNA, 24 bp, Artificial sequence
  SiRNA target sequence
tatatacaaaaaatgacatttgcg

SEQ ID NO: 58968 - DNA, 24 bp, Artificial sequence
  SiRNA target sequence
atatacaaaaaatgacatttgcga

SEQ ID NO: 58969 - DNA, 24 bp, Artificial sequence
  SiRNA target sequence
tatacaaaaaatgacatttgcgat

SEQ ID NO: 58970 - DNA, 24 bp, Artificial sequence
  SiRNA target sequence
atacaaaaaatgacatttgcgata

SEQ ID NO: 58971 - DNA, 24 bp, Artificial sequence
  SiRNA target sequence
tacaaaaaatgacatttgcgatac

SEQ ID NO: 58972 - DNA, 24 bp, Artificial sequence
  SiRNA target sequence
acaaaaaatgacatttgcgataca

SEQ ID NO: 58973 - DNA, 24 bp, Artificial sequence
  SiRNA target sequence
caaaaaatgacatttgcgatacag

SEQ ID NO: 58974 - DNA, 24 bp, Artificial sequence
  SiRNA target sequence
aaaaaatgacatttgcgatacagg

SEQ ID NO: 58975 - DNA, 24 bp, Artificial sequence
  SiRNA target sequence
aaaaatgacatttgcgatacaggc

SEQ ID NO: 58976 - DNA, 24 bp, Artificial sequence
  SiRNA target sequence
aaaatgacatttgcgatacaggca

SEQ ID NO: 58977 - DNA, 24 bp, Artificial sequence
  SiRNA target sequence
aaatgacatttgcgatacaggcaa

SEQ ID NO: 58978 - DNA, 24 bp, Artificial sequence
  SiRNA target sequence
aatgacatttgcgatacaggcaat

SEQ ID NO: 58979 - DNA, 24 bp, Artificial sequence
  SiRNA target sequence
atgacatttgcgatacaggcaatt

SEQ ID NO: 58980 - DNA, 24 bp, Artificial sequence
  SiRNA target sequence
tgacatttgcgatacaggcaatta

SEQ ID NO: 58981 - DNA, 24 bp, Artificial sequence
  SiRNA target sequence
gacatttgcgatacaggcaattat

SEQ ID NO: 58982 - DNA, 24 bp, Artificial sequence
  SiRNA target sequence
acatttgcgatacaggcaattatt

SEQ ID NO: 58983 - DNA, 24 bp, Artificial sequence
  SiRNA target sequence
catttgcgatacaggcaattatta

SEQ ID NO: 58984 - DNA, 24 bp, Artificial sequence
  SiRNA target sequence
atttgcgatacaggcaattattat

SEQ ID NO: 58985 - DNA, 24 bp, Artificial sequence
  SiRNA target sequence
tttgcgatacaggcaattattatt

SEQ ID NO: 58986 - DNA, 24 bp, Artificial sequence
  SiRNA target sequence
ttgcgatacaggcaattattatta

SEQ ID NO: 58987 - DNA, 24 bp, Artificial sequence
  SiRNA target sequence
tgcgatacaggcaattattattat

SEQ ID NO: 58988 - DNA, 24 bp, Artificial sequence
  SiRNA target sequence
gcgatacaggcaattattattatc

SEQ ID NO: 58989 - DNA, 24 bp, Artificial sequence
  SiRNA target sequence
cgatacaggcaattattattatca

SEQ ID NO: 58990 - DNA, 24 bp, Artificial sequence
  SiRNA target sequence
gatacaggcaattattattatcac

SEQ ID NO: 58991 - DNA, 24 bp, Artificial sequence
  SiRNA target sequence
atacaggcaattattattatcaca

SEQ ID NO: 58992 - DNA, 24 bp, Artificial sequence
  SiRNA target sequence
tacaggcaattattattatcacat

SEQ ID NO: 58993 - DNA, 24 bp, Artificial sequence
  SiRNA target sequence
acaggcaattattattatcacatt

SEQ ID NO: 58994 - DNA, 24 bp, Artificial sequence
  SiRNA target sequence
caggcaattattattatcacatta

SEQ ID NO: 58995 - DNA, 24 bp, Artificial sequence
  SiRNA target sequence
aggcaattattattatcacattag

SEQ ID NO: 58996 - DNA, 24 bp, Artificial sequence
  SiRNA target sequence
ggcaattattattatcacattagg

SEQ ID NO: 58997 - DNA, 24 bp, Artificial sequence
  SiRNA target sequence
gcaattattattatcacattagga

SEQ ID NO: 58998 - DNA, 24 bp, Artificial sequence
  SiRNA target sequence
caattattattatcacattaggat

SEQ ID NO: 58999 - DNA, 24 bp, Artificial sequence
  SiRNA target sequence
aattattattatcacattaggatc

SEQ ID NO: 59000 - DNA, 24 bp, Artificial sequence
  SiRNA target sequence
attattattatcacattaggatct

SEQ ID NO: 59001 - DNA, 24 bp, Artificial sequence
  SiRNA target sequence
ttattattatcacattaggatctt

SEQ ID NO: 59002 - DNA, 24 bp, Artificial sequence
  SiRNA target sequence
tattattatcacattaggatcttt

SEQ ID NO: 59003 - DNA, 24 bp, Artificial sequence
  SiRNA target sequence
attattatcacattaggatctttt

SEQ ID NO: 59004 - DNA, 24 bp, Artificial sequence
  SiRNA target sequence
ttattatcacattaggatcttttg

SEQ ID NO: 59005 - DNA, 24 bp, Artificial sequence
  SiRNA target sequence
tattatcacattaggatcttttgg

SEQ ID NO: 59006 - DNA, 24 bp, Artificial sequence
  SiRNA target sequence
attatcacattaggatcttttgga

SEQ ID NO: 59007 - DNA, 24 bp, Artificial sequence
  SiRNA target sequence
ttatcacattaggatcttttggat

SEQ ID NO: 59008 - DNA, 24 bp, Artificial sequence
  SiRNA target sequence
tatcacattaggatcttttggata

SEQ ID NO: 59009 - DNA, 24 bp, Artificial sequence
  SiRNA target sequence
atcacattaggatcttttggatat

SEQ ID NO: 59010 - DNA, 24 bp, Artificial sequence
  SiRNA target sequence
tcacattaggatcttttggatatt

SEQ ID NO: 59011 - DNA, 24 bp, Artificial sequence
  SiRNA target sequence
cacattaggatcttttggatattt

SEQ ID NO: 59012 - DNA, 24 bp, Artificial sequence
  SiRNA target sequence
acattaggatcttttggatatttt

SEQ ID NO: 59013 - DNA, 24 bp, Artificial sequence
  SiRNA target sequence
cattaggatcttttggatattttc

SEQ ID NO: 59014 - DNA, 24 bp, Artificial sequence
  SiRNA target sequence
attaggatcttttggatattttcc

SEQ ID NO: 59015 - DNA, 24 bp, Artificial sequence
  SiRNA target sequence
ttaggatcttttggatattttccg

SEQ ID NO: 59016 - DNA, 24 bp, Artificial sequence
  SiRNA target sequence
taggatcttttggatattttccga

SEQ ID NO: 59017 - DNA, 24 bp, Artificial sequence
  SiRNA target sequence
aggatcttttggatattttccgat

SEQ ID NO: 59018 - DNA, 24 bp, Artificial sequence
  SiRNA target sequence
ggatcttttggatattttccgatt

SEQ ID NO: 59019 - DNA, 24 bp, Artificial sequence
  SiRNA target sequence
gatcttttggatattttccgatta

SEQ ID NO: 59020 - DNA, 24 bp, Artificial sequence
  SiRNA target sequence
atcttttggatattttccgattaa

SEQ ID NO: 59021 - DNA, 24 bp, Artificial sequence
  SiRNA target sequence
tcttttggatattttccgattaaa

SEQ ID NO: 59022 - DNA, 24 bp, Artificial sequence
  SiRNA target sequence
cttttggatattttccgattaaat

SEQ ID NO: 59023 - DNA, 24 bp, Artificial sequence
  SiRNA target sequence
ttttggatattttccgattaaatt

SEQ ID NO: 59024 - DNA, 24 bp, Artificial sequence
  SiRNA target sequence
tttggatattttccgattaaatta

SEQ ID NO: 59025 - DNA, 24 bp, Artificial sequence
  SiRNA target sequence
ttggatattttccgattaaattat

SEQ ID NO: 59026 - DNA, 24 bp, Artificial sequence
  SiRNA target sequence
tggatattttccgattaaattatc

SEQ ID NO: 59027 - DNA, 24 bp, Artificial sequence
  SiRNA target sequence
ggatattttccgattaaattatcc

SEQ ID NO: 59028 - DNA, 24 bp, Artificial sequence
  SiRNA target sequence
gatattttccgattaaattatcct

SEQ ID NO: 59029 - DNA, 24 bp, Artificial sequence
  SiRNA target sequence
atattttccgattaaattatcctc

SEQ ID NO: 59030 - DNA, 24 bp, Artificial sequence
  SiRNA target sequence
tattttccgattaaattatcctct

SEQ ID NO: 59031 - DNA, 24 bp, Artificial sequence
  SiRNA target sequence
attttccgattaaattatcctctc

SEQ ID NO: 59032 - DNA, 24 bp, Artificial sequence
  SiRNA target sequence
ttttccgattaaattatcctctca

SEQ ID NO: 59033 - DNA, 24 bp, Artificial sequence
  SiRNA target sequence
tttccgattaaattatcctctcaa

SEQ ID NO: 59034 - DNA, 24 bp, Artificial sequence
  SiRNA target sequence
ttccgattaaattatcctctcaac

SEQ ID NO: 59035 - DNA, 24 bp, Artificial sequence
  SiRNA target sequence
tccgattaaattatcctctcaaca

SEQ ID NO: 59036 - DNA, 24 bp, Artificial sequence
  SiRNA target sequence
ccgattaaattatcctctcaacag

SEQ ID NO: 59037 - DNA, 24 bp, Artificial sequence
  SiRNA target sequence
cgattaaattatcctctcaacagt

SEQ ID NO: 59038 - DNA, 24 bp, Artificial sequence
  SiRNA target sequence
gattaaattatcctctcaacagtt

SEQ ID NO: 59039 - DNA, 24 bp, Artificial sequence
  SiRNA target sequence
attaaattatcctctcaacagtta

SEQ ID NO: 59040 - DNA, 24 bp, Artificial sequence
  SiRNA target sequence
ttaaattatcctctcaacagttag

SEQ ID NO: 59041 - DNA, 24 bp, Artificial sequence
  SiRNA target sequence
taaattatcctctcaacagttagt

SEQ ID NO: 59042 - DNA, 24 bp, Artificial sequence
  SiRNA target sequence
aaattatcctctcaacagttagtc

SEQ ID NO: 59043 - DNA, 24 bp, Artificial sequence
  SiRNA target sequence
aattatcctctcaacagttagtct

SEQ ID NO: 59044 - DNA, 24 bp, Artificial sequence
  SiRNA target sequence
attatcctctcaacagttagtctt

SEQ ID NO: 59045 - DNA, 24 bp, Artificial sequence
  SiRNA target sequence
ttatcctctcaacagttagtcttt

SEQ ID NO: 59046 - DNA, 24 bp, Artificial sequence
  SiRNA target sequence
tatcctctcaacagttagtctttt

SEQ ID NO: 59047 - DNA, 24 bp, Artificial sequence
  SiRNA target sequence
atcctctcaacagttagtctttta

SEQ ID NO: 59048 - DNA, 24 bp, Artificial sequence
  SiRNA target sequence
tcctctcaacagttagtcttttat

SEQ ID NO: 59049 - DNA, 24 bp, Artificial sequence
  SiRNA target sequence
cctctcaacagttagtcttttata

SEQ ID NO: 59050 - DNA, 24 bp, Artificial sequence
  SiRNA target sequence
ctctcaacagttagtcttttatat

SEQ ID NO: 59051 - DNA, 24 bp, Artificial sequence
  SiRNA target sequence
tctcaacagttagtcttttatatt

SEQ ID NO: 59052 - DNA, 24 bp, Artificial sequence
  SiRNA target sequence
ctcaacagttagtcttttatattt

SEQ ID NO: 59053 - DNA, 24 bp, Artificial sequence
  SiRNA target sequence
tcaacagttagtcttttatatttc

SEQ ID NO: 59054 - DNA, 24 bp, Artificial sequence
  SiRNA target sequence
caacagttagtcttttatatttcg

SEQ ID NO: 59055 - DNA, 24 bp, Artificial sequence
  SiRNA target sequence
aacagttagtcttttatatttcga

SEQ ID NO: 59056 - DNA, 24 bp, Artificial sequence
  SiRNA target sequence
acagttagtcttttatatttcgat

SEQ ID NO: 59057 - DNA, 24 bp, Artificial sequence
  SiRNA target sequence
cagttagtcttttatatttcgatt

SEQ ID NO: 59058 - DNA, 24 bp, Artificial sequence
  SiRNA target sequence
agttagtcttttatatttcgatta

SEQ ID NO: 59059 - DNA, 24 bp, Artificial sequence
  SiRNA target sequence
gttagtcttttatatttcgattag

SEQ ID NO: 59060 - DNA, 24 bp, Artificial sequence
  SiRNA target sequence
ttagtcttttatatttcgattagt

SEQ ID NO: 59061 - DNA, 24 bp, Artificial sequence
  SiRNA target sequence
tagtcttttatatttcgattagta

SEQ ID NO: 59062 - DNA, 24 bp, Artificial sequence
  SiRNA target sequence
agtcttttatatttcgattagtaa

SEQ ID NO: 59063 - DNA, 24 bp, Artificial sequence
  SiRNA target sequence
gtcttttatatttcgattagtaaa

SEQ ID NO: 59064 - DNA, 24 bp, Artificial sequence
  SiRNA target sequence
tcttttatatttcgattagtaaaa

SEQ ID NO: 59065 - DNA, 24 bp, Artificial sequence
  SiRNA target sequence
cttttatatttcgattagtaaaac

SEQ ID NO: 59066 - DNA, 24 bp, Artificial sequence
  SiRNA target sequence
ttttatatttcgattagtaaaacg

SEQ ID NO: 59067 - DNA, 24 bp, Artificial sequence
  SiRNA target sequence
tttatatttcgattagtaaaacgt

SEQ ID NO: 59068 - DNA, 24 bp, Artificial sequence
  SiRNA target sequence
ttatatttcgattagtaaaacgtt

SEQ ID NO: 59069 - DNA, 24 bp, Artificial sequence
  SiRNA target sequence
tatatttcgattagtaaaacgttg

SEQ ID NO: 59070 - DNA, 24 bp, Artificial sequence
  SiRNA target sequence
atatttcgattagtaaaacgttga

SEQ ID NO: 59071 - DNA, 24 bp, Artificial sequence
  SiRNA target sequence
tatttcgattagtaaaacgttgac

SEQ ID NO: 59072 - DNA, 24 bp, Artificial sequence
  SiRNA target sequence
atttcgattagtaaaacgttgaca

SEQ ID NO: 59073 - DNA, 24 bp, Artificial sequence
  SiRNA target sequence
tttcgattagtaaaacgttgacaa

SEQ ID NO: 59074 - DNA, 24 bp, Artificial sequence
  SiRNA target sequence
ttcgattagtaaaacgttgacaaa

SEQ ID NO: 59075 - DNA, 24 bp, Artificial sequence
  SiRNA target sequence
tcgattagtaaaacgttgacaaat

SEQ ID NO: 59076 - DNA, 24 bp, Artificial sequence
  SiRNA target sequence
cgattagtaaaacgttgacaaatt

SEQ ID NO: 59077 - DNA, 24 bp, Artificial sequence
  SiRNA target sequence
gattagtaaaacgttgacaaattc

SEQ ID NO: 59078 - DNA, 24 bp, Artificial sequence
  SiRNA target sequence
attagtaaaacgttgacaaattcg

SEQ ID NO: 59079 - DNA, 24 bp, Artificial sequence
  SiRNA target sequence
ttagtaaaacgttgacaaattcgt

SEQ ID NO: 59080 - DNA, 24 bp, Artificial sequence
  SiRNA target sequence
tagtaaaacgttgacaaattcgtt

SEQ ID NO: 59081 - DNA, 24 bp, Artificial sequence
  SiRNA target sequence
agtaaaacgttgacaaattcgttg

SEQ ID NO: 59082 - DNA, 24 bp, Artificial sequence
  SiRNA target sequence
gtaaaacgttgacaaattcgttga

SEQ ID NO: 59083 - DNA, 24 bp, Artificial sequence
  SiRNA target sequence
taaaacgttgacaaattcgttgag

SEQ ID NO: 59084 - DNA, 24 bp, Artificial sequence
  SiRNA target sequence
aaaacgttgacaaattcgttgagc

SEQ ID NO: 59085 - DNA, 24 bp, Artificial sequence
  SiRNA target sequence
aaacgttgacaaattcgttgagcg

SEQ ID NO: 59086 - DNA, 24 bp, Artificial sequence
  SiRNA target sequence
aacgttgacaaattcgttgagcga

SEQ ID NO: 59087 - DNA, 24 bp, Artificial sequence
  SiRNA target sequence
acgttgacaaattcgttgagcgaa

SEQ ID NO: 59088 - DNA, 24 bp, Artificial sequence
  SiRNA target sequence
cgttgacaaattcgttgagcgaaa

SEQ ID NO: 59089 - DNA, 24 bp, Artificial sequence
  SiRNA target sequence
gttgacaaattcgttgagcgaaat

SEQ ID NO: 59090 - DNA, 24 bp, Artificial sequence
  SiRNA target sequence
ttgacaaattcgttgagcgaaatg

SEQ ID NO: 59091 - DNA, 24 bp, Artificial sequence
  SiRNA target sequence
tgacaaattcgttgagcgaaatgg

SEQ ID NO: 59092 - DNA, 24 bp, Artificial sequence
  SiRNA target sequence
gacaaattcgttgagcgaaatggg

SEQ ID NO: 59093 - DNA, 24 bp, Artificial sequence
  SiRNA target sequence
acaaattcgttgagcgaaatggga

SEQ ID NO: 59094 - DNA, 24 bp, Artificial sequence
  SiRNA target sequence
caaattcgttgagcgaaatgggaa

SEQ ID NO: 59095 - DNA, 24 bp, Artificial sequence
  SiRNA target sequence
aaattcgttgagcgaaatgggaat

SEQ ID NO: 59096 - DNA, 24 bp, Artificial sequence
  SiRNA target sequence
aattcgttgagcgaaatgggaatg

SEQ ID NO: 59097 - DNA, 24 bp, Artificial sequence
  SiRNA target sequence
attcgttgagcgaaatgggaatgc

SEQ ID NO: 59098 - DNA, 24 bp, Artificial sequence
  SiRNA target sequence
ttcgttgagcgaaatgggaatgct

SEQ ID NO: 59099 - DNA, 24 bp, Artificial sequence
  SiRNA target sequence
tcgttgagcgaaatgggaatgcta

SEQ ID NO: 59100 - DNA, 24 bp, Artificial sequence
  SiRNA target sequence
cgttgagcgaaatgggaatgctat

SEQ ID NO: 59101 - DNA, 24 bp, Artificial sequence
  SiRNA target sequence
gttgagcgaaatgggaatgctata

SEQ ID NO: 59102 - DNA, 24 bp, Artificial sequence
  SiRNA target sequence
ttgagcgaaatgggaatgctatac

SEQ ID NO: 59103 - DNA, 24 bp, Artificial sequence
  SiRNA target sequence
tgagcgaaatgggaatgctataca

SEQ ID NO: 59104 - DNA, 24 bp, Artificial sequence
  SiRNA target sequence
gagcgaaatgggaatgctatacac

SEQ ID NO: 59105 - DNA, 24 bp, Artificial sequence
  SiRNA target sequence
agcgaaatgggaatgctatacaca

SEQ ID NO: 59106 - DNA, 24 bp, Artificial sequence
  SiRNA target sequence
gcgaaatgggaatgctatacacaa

SEQ ID NO: 59107 - DNA, 24 bp, Artificial sequence
  SiRNA target sequence
cgaaatgggaatgctatacacaag

SEQ ID NO: 59108 - DNA, 24 bp, Artificial sequence
  SiRNA target sequence
gaaatgggaatgctatacacaaga

SEQ ID NO: 59109 - DNA, 24 bp, Artificial sequence
  SiRNA target sequence
aaatgggaatgctatacacaagat

SEQ ID NO: 59110 - DNA, 24 bp, Artificial sequence
  SiRNA target sequence
aatgggaatgctatacacaagata

SEQ ID NO: 59111 - DNA, 24 bp, Artificial sequence
  SiRNA target sequence
atgggaatgctatacacaagatat

SEQ ID NO: 59112 - DNA, 24 bp, Artificial sequence
  SiRNA target sequence
tgggaatgctatacacaagatatg

SEQ ID NO: 59113 - DNA, 24 bp, Artificial sequence
  SiRNA target sequence
gggaatgctatacacaagatatgt

SEQ ID NO: 59114 - DNA, 24 bp, Artificial sequence
  SiRNA target sequence
ggaatgctatacacaagatatgta

SEQ ID NO: 59115 - DNA, 24 bp, Artificial sequence
  SiRNA target sequence
gaatgctatacacaagatatgtac

SEQ ID NO: 59116 - DNA, 24 bp, Artificial sequence
  SiRNA target sequence
aatgctatacacaagatatgtaca

SEQ ID NO: 59117 - DNA, 24 bp, Artificial sequence
  SiRNA target sequence
atgctatacacaagatatgtacaa

SEQ ID NO: 59118 - DNA, 24 bp, Artificial sequence
  SiRNA target sequence
tgctatacacaagatatgtacaag

SEQ ID NO: 59119 - DNA, 24 bp, Artificial sequence
  SiRNA target sequence
gctatacacaagatatgtacaagg

SEQ ID NO: 59120 - DNA, 24 bp, Artificial sequence
  SiRNA target sequence
ctatacacaagatatgtacaagga

SEQ ID NO: 59121 - DNA, 24 bp, Artificial sequence
  SiRNA target sequence
tatacacaagatatgtacaaggat

SEQ ID NO: 59122 - DNA, 24 bp, Artificial sequence
  SiRNA target sequence
atacacaagatatgtacaaggatt

SEQ ID NO: 59123 - DNA, 24 bp, Artificial sequence
  SiRNA target sequence
tacacaagatatgtacaaggattt

SEQ ID NO: 59124 - DNA, 24 bp, Artificial sequence
  SiRNA target sequence
acacaagatatgtacaaggatttt

SEQ ID NO: 59125 - DNA, 24 bp, Artificial sequence
  SiRNA target sequence
cacaagatatgtacaaggattttt

SEQ ID NO: 59126 - DNA, 24 bp, Artificial sequence
  SiRNA target sequence
acaagatatgtacaaggattttta

SEQ ID NO: 59127 - DNA, 24 bp, Artificial sequence
  SiRNA target sequence
caagatatgtacaaggatttttaa

SEQ ID NO: 59128 - DNA, 24 bp, Artificial sequence
  SiRNA target sequence
aagatatgtacaaggatttttaaa

SEQ ID NO: 59129 - DNA, 24 bp, Artificial sequence
  SiRNA target sequence
agatatgtacaaggatttttaaat

SEQ ID NO: 59130 - DNA, 24 bp, Artificial sequence
  SiRNA target sequence
gatatgtacaaggatttttaaatg

SEQ ID NO: 59131 - DNA, 24 bp, Artificial sequence
  SiRNA target sequence
atatgtacaaggatttttaaatgc

SEQ ID NO: 59132 - DNA, 24 bp, Artificial sequence
  SiRNA target sequence
tatgtacaaggatttttaaatgca

SEQ ID NO: 59133 - DNA, 24 bp, Artificial sequence
  SiRNA target sequence
atgtacaaggatttttaaatgcaa

SEQ ID NO: 59134 - DNA, 24 bp, Artificial sequence
  SiRNA target sequence
tgtacaaggatttttaaatgcaaa

SEQ ID NO: 59135 - DNA, 24 bp, Artificial sequence
  SiRNA target sequence
gtacaaggatttttaaatgcaaag

SEQ ID NO: 59136 - DNA, 24 bp, Artificial sequence
  SiRNA target sequence
tacaaggatttttaaatgcaaagt

SEQ ID NO: 59137 - DNA, 24 bp, Artificial sequence
  SiRNA target sequence
acaaggatttttaaatgcaaagtc

SEQ ID NO: 59138 - DNA, 24 bp, Artificial sequence
  SiRNA target sequence
caaggatttttaaatgcaaagtct

SEQ ID NO: 59139 - DNA, 24 bp, Artificial sequence
  SiRNA target sequence
aaggatttttaaatgcaaagtctg

SEQ ID NO: 59140 - DNA, 24 bp, Artificial sequence
  SiRNA target sequence
aggatttttaaatgcaaagtctgg

SEQ ID NO: 59141 - DNA, 24 bp, Artificial sequence
  SiRNA target sequence
ggatttttaaatgcaaagtctgga

SEQ ID NO: 59142 - DNA, 24 bp, Artificial sequence
  SiRNA target sequence
gatttttaaatgcaaagtctggat

SEQ ID NO: 59143 - DNA, 24 bp, Artificial sequence
  SiRNA target sequence
atttttaaatgcaaagtctggata

SEQ ID NO: 59144 - DNA, 24 bp, Artificial sequence
  SiRNA target sequence
tttttaaatgcaaagtctggatat

SEQ ID NO: 59145 - DNA, 24 bp, Artificial sequence
  SiRNA target sequence
ttttaaatgcaaagtctggatatt

SEQ ID NO: 59146 - DNA, 24 bp, Artificial sequence
  SiRNA target sequence
tttaaatgcaaagtctggatatta

SEQ ID NO: 59147 - DNA, 24 bp, Artificial sequence
  SiRNA target sequence
ttaaatgcaaagtctggatattac

SEQ ID NO: 59148 - DNA, 24 bp, Artificial sequence
  SiRNA target sequence
taaatgcaaagtctggatattacg

SEQ ID NO: 59149 - DNA, 24 bp, Artificial sequence
  SiRNA target sequence
aaatgcaaagtctggatattacga

SEQ ID NO: 59150 - DNA, 24 bp, Artificial sequence
  SiRNA target sequence
aatgcaaagtctggatattacgag

SEQ ID NO: 59151 - DNA, 24 bp, Artificial sequence
  SiRNA target sequence
atgcaaagtctggatattacgagt

SEQ ID NO: 59152 - DNA, 24 bp, Artificial sequence
  SiRNA target sequence
tgcaaagtctggatattacgagtt

SEQ ID NO: 59153 - DNA, 24 bp, Artificial sequence
  SiRNA target sequence
gcaaagtctggatattacgagttt

SEQ ID NO: 59154 - DNA, 24 bp, Artificial sequence
  SiRNA target sequence
caaagtctggatattacgagttta

SEQ ID NO: 59155 - DNA, 24 bp, Artificial sequence
  SiRNA target sequence
aaagtctggatattacgagtttaa

SEQ ID NO: 59156 - DNA, 24 bp, Artificial sequence
  SiRNA target sequence
aagtctggatattacgagtttaaa

SEQ ID NO: 59157 - DNA, 24 bp, Artificial sequence
  SiRNA target sequence
agtctggatattacgagtttaaag

SEQ ID NO: 59158 - DNA, 24 bp, Artificial sequence
  SiRNA target sequence
gtctggatattacgagtttaaaga

SEQ ID NO: 59159 - DNA, 24 bp, Artificial sequence
  SiRNA target sequence
tctggatattacgagtttaaagag

SEQ ID NO: 59160 - DNA, 24 bp, Artificial sequence
  SiRNA target sequence
ctggatattacgagtttaaagagg

SEQ ID NO: 59161 - DNA, 24 bp, Artificial sequence
  SiRNA target sequence
tggatattacgagtttaaagagga

SEQ ID NO: 59162 - DNA, 24 bp, Artificial sequence
  SiRNA target sequence
ggatattacgagtttaaagaggat

SEQ ID NO: 59163 - DNA, 24 bp, Artificial sequence
  SiRNA target sequence
gatattacgagtttaaagaggata

SEQ ID NO: 59164 - DNA, 24 bp, Artificial sequence
  SiRNA target sequence
atattacgagtttaaagaggatac

SEQ ID NO: 59165 - DNA, 24 bp, Artificial sequence
  SiRNA target sequence
tattacgagtttaaagaggataca

SEQ ID NO: 59166 - DNA, 24 bp, Artificial sequence
  SiRNA target sequence
attacgagtttaaagaggatacac

SEQ ID NO: 59167 - DNA, 24 bp, Artificial sequence
  SiRNA target sequence
ttacgagtttaaagaggatacaca

SEQ ID NO: 59168 - DNA, 24 bp, Artificial sequence
  SiRNA target sequence
tacgagtttaaagaggatacacaa

SEQ ID NO: 59169 - DNA, 24 bp, Artificial sequence
  SiRNA target sequence
acgagtttaaagaggatacacaaa

SEQ ID NO: 59170 - DNA, 24 bp, Artificial sequence
  SiRNA target sequence
cgagtttaaagaggatacacaaac

SEQ ID NO: 59171 - DNA, 24 bp, Artificial sequence
  SiRNA target sequence
gagtttaaagaggatacacaaact

SEQ ID NO: 59172 - DNA, 24 bp, Artificial sequence
  SiRNA target sequence
agtttaaagaggatacacaaactg

SEQ ID NO: 59173 - DNA, 24 bp, Artificial sequence
  SiRNA target sequence
gtttaaagaggatacacaaactga

SEQ ID NO: 59174 - DNA, 24 bp, Artificial sequence
  SiRNA target sequence
tttaaagaggatacacaaactgat

SEQ ID NO: 59175 - DNA, 24 bp, Artificial sequence
  SiRNA target sequence
ttaaagaggatacacaaactgata

SEQ ID NO: 59176 - DNA, 24 bp, Artificial sequence
  SiRNA target sequence
taaagaggatacacaaactgataa

SEQ ID NO: 59177 - DNA, 24 bp, Artificial sequence
  SiRNA target sequence
aaagaggatacacaaactgataaa

SEQ ID NO: 59178 - DNA, 24 bp, Artificial sequence
  SiRNA target sequence
aagaggatacacaaactgataaaa

SEQ ID NO: 59179 - DNA, 24 bp, Artificial sequence
  SiRNA target sequence
agaggatacacaaactgataaaat

SEQ ID NO: 59180 - DNA, 24 bp, Artificial sequence
  SiRNA target sequence
gaggatacacaaactgataaaata

SEQ ID NO: 59181 - DNA, 24 bp, Artificial sequence
  SiRNA target sequence
aggatacacaaactgataaaataa

SEQ ID NO: 59182 - DNA, 24 bp, Artificial sequence
  SiRNA target sequence
ggatacacaaactgataaaataag

SEQ ID NO: 59183 - DNA, 24 bp, Artificial sequence
  SiRNA target sequence
gatacacaaactgataaaataaga

SEQ ID NO: 59184 - DNA, 24 bp, Artificial sequence
  SiRNA target sequence
atacacaaactgataaaataagac

SEQ ID NO: 59185 - DNA, 24 bp, Artificial sequence
  SiRNA target sequence
tacacaaactgataaaataagact

SEQ ID NO: 59186 - DNA, 24 bp, Artificial sequence
  SiRNA target sequence
acacaaactgataaaataagactg

SEQ ID NO: 59187 - DNA, 24 bp, Artificial sequence
  SiRNA target sequence
cacaaactgataaaataagactga

SEQ ID NO: 59188 - DNA, 24 bp, Artificial sequence
  SiRNA target sequence
acaaactgataaaataagactgat

SEQ ID NO: 59189 - DNA, 24 bp, Artificial sequence
  SiRNA target sequence
caaactgataaaataagactgata

SEQ ID NO: 59190 - DNA, 24 bp, Artificial sequence
  SiRNA target sequence
aaactgataaaataagactgatag

SEQ ID NO: 59191 - DNA, 24 bp, Artificial sequence
  SiRNA target sequence
aactgataaaataagactgataga

SEQ ID NO: 59192 - DNA, 24 bp, Artificial sequence
  SiRNA target sequence
actgataaaataagactgatagat

SEQ ID NO: 59193 - DNA, 24 bp, Artificial sequence
  SiRNA target sequence
ctgataaaataagactgatagatt

SEQ ID NO: 59194 - DNA, 24 bp, Artificial sequence
  SiRNA target sequence
tgataaaataagactgatagattt

SEQ ID NO: 59195 - DNA, 24 bp, Artificial sequence
  SiRNA target sequence
gataaaataagactgatagatttt

SEQ ID NO: 59196 - DNA, 24 bp, Artificial sequence
  SiRNA target sequence
ataaaataagactgatagatttta

SEQ ID NO: 59197 - DNA, 24 bp, Artificial sequence
  SiRNA target sequence
taaaataagactgatagattttaa

SEQ ID NO: 59198 - DNA, 24 bp, Artificial sequence
  SiRNA target sequence
aaaataagactgatagattttaat

SEQ ID NO: 59199 - DNA, 24 bp, Artificial sequence
  SiRNA target sequence
aaataagactgatagattttaatg

SEQ ID NO: 59200 - DNA, 24 bp, Artificial sequence
  SiRNA target sequence
aataagactgatagattttaatga

SEQ ID NO: 59201 - DNA, 24 bp, Artificial sequence
  SiRNA target sequence
ataagactgatagattttaatgaa

SEQ ID NO: 59202 - DNA, 24 bp, Artificial sequence
  SiRNA target sequence
taagactgatagattttaatgaaa

SEQ ID NO: 59203 - DNA, 24 bp, Artificial sequence
  SiRNA target sequence
aagactgatagattttaatgaaaa

SEQ ID NO: 59204 - DNA, 24 bp, Artificial sequence
  SiRNA target sequence
agactgatagattttaatgaaaag

SEQ ID NO: 59205 - DNA, 24 bp, Artificial sequence
  SiRNA target sequence
gactgatagattttaatgaaaagc

SEQ ID NO: 59206 - DNA, 24 bp, Artificial sequence
  SiRNA target sequence
actgatagattttaatgaaaagct

SEQ ID NO: 59207 - DNA, 24 bp, Artificial sequence
  SiRNA target sequence
ctgatagattttaatgaaaagcta

SEQ ID NO: 59208 - DNA, 24 bp, Artificial sequence
  SiRNA target sequence
tgatagattttaatgaaaagctag

SEQ ID NO: 59209 - DNA, 24 bp, Artificial sequence
  SiRNA target sequence
gatagattttaatgaaaagctaga

SEQ ID NO: 59210 - DNA, 24 bp, Artificial sequence
  SiRNA target sequence
atagattttaatgaaaagctagaa

SEQ ID NO: 59211 - DNA, 24 bp, Artificial sequence
  SiRNA target sequence
tagattttaatgaaaagctagaat

SEQ ID NO: 59212 - DNA, 24 bp, Artificial sequence
  SiRNA target sequence
agattttaatgaaaagctagaatt

SEQ ID NO: 59213 - DNA, 24 bp, Artificial sequence
  SiRNA target sequence
gattttaatgaaaagctagaattt

SEQ ID NO: 59214 - DNA, 24 bp, Artificial sequence
  SiRNA target sequence
attttaatgaaaagctagaattta

SEQ ID NO: 59215 - DNA, 24 bp, Artificial sequence
  SiRNA target sequence
ttttaatgaaaagctagaatttag

SEQ ID NO: 59216 - DNA, 24 bp, Artificial sequence
  SiRNA target sequence
tttaatgaaaagctagaatttaga

SEQ ID NO: 59217 - DNA, 24 bp, Artificial sequence
  SiRNA target sequence
ttaatgaaaagctagaatttagaa

SEQ ID NO: 59218 - DNA, 24 bp, Artificial sequence
  SiRNA target sequence
taatgaaaagctagaatttagaaa

SEQ ID NO: 59219 - DNA, 24 bp, Artificial sequence
  SiRNA target sequence
aatgaaaagctagaatttagaaat

SEQ ID NO: 59220 - DNA, 24 bp, Artificial sequence
  SiRNA target sequence
atgaaaagctagaatttagaaatg

SEQ ID NO: 59221 - DNA, 24 bp, Artificial sequence
  SiRNA target sequence
tgaaaagctagaatttagaaatgt

SEQ ID NO: 59222 - DNA, 24 bp, Artificial sequence
  SiRNA target sequence
gaaaagctagaatttagaaatgta

SEQ ID NO: 59223 - DNA, 24 bp, Artificial sequence
  SiRNA target sequence
aaaagctagaatttagaaatgtat

SEQ ID NO: 59224 - DNA, 24 bp, Artificial sequence
  SiRNA target sequence
aaagctagaatttagaaatgtatc

SEQ ID NO: 59225 - DNA, 24 bp, Artificial sequence
  SiRNA target sequence
aagctagaatttagaaatgtatct

SEQ ID NO: 59226 - DNA, 24 bp, Artificial sequence
  SiRNA target sequence
agctagaatttagaaatgtatctt

SEQ ID NO: 59227 - DNA, 24 bp, Artificial sequence
  SiRNA target sequence
gctagaatttagaaatgtatcttt

SEQ ID NO: 59228 - DNA, 24 bp, Artificial sequence
  SiRNA target sequence
ctagaatttagaaatgtatctttt

SEQ ID NO: 59229 - DNA, 24 bp, Artificial sequence
  SiRNA target sequence
tagaatttagaaatgtatctttta

SEQ ID NO: 59230 - DNA, 24 bp, Artificial sequence
  SiRNA target sequence
agaatttagaaatgtatcttttag

SEQ ID NO: 59231 - DNA, 24 bp, Artificial sequence
  SiRNA target sequence
gaatttagaaatgtatcttttagt

SEQ ID NO: 59232 - DNA, 24 bp, Artificial sequence
  SiRNA target sequence
aatttagaaatgtatcttttagtt

SEQ ID NO: 59233 - DNA, 24 bp, Artificial sequence
  SiRNA target sequence
atttagaaatgtatcttttagtta

SEQ ID NO: 59234 - DNA, 24 bp, Artificial sequence
  SiRNA target sequence
tttagaaatgtatcttttagttat

SEQ ID NO: 59235 - DNA, 24 bp, Artificial sequence
  SiRNA target sequence
ttagaaatgtatcttttagttatt

SEQ ID NO: 59236 - DNA, 24 bp, Artificial sequence
  SiRNA target sequence
tagaaatgtatcttttagttattt

SEQ ID NO: 59237 - DNA, 24 bp, Artificial sequence
  SiRNA target sequence
agaaatgtatcttttagttattta

SEQ ID NO: 59238 - DNA, 24 bp, Artificial sequence
  SiRNA target sequence
gaaatgtatcttttagttatttaa

SEQ ID NO: 59239 - DNA, 24 bp, Artificial sequence
  SiRNA target sequence
aaatgtatcttttagttatttaaa

SEQ ID NO: 59240 - DNA, 24 bp, Artificial sequence
  SiRNA target sequence
aatgtatcttttagttatttaaat

SEQ ID NO: 59241 - DNA, 24 bp, Artificial sequence
  SiRNA target sequence
atgtatcttttagttatttaaata

SEQ ID NO: 59242 - DNA, 24 bp, Artificial sequence
  SiRNA target sequence
tgtatcttttagttatttaaataa

SEQ ID NO: 59243 - DNA, 24 bp, Artificial sequence
  SiRNA target sequence
gtatcttttagttatttaaataag

SEQ ID NO: 59244 - DNA, 24 bp, Artificial sequence
  SiRNA target sequence
tatcttttagttatttaaataagc

SEQ ID NO: 59245 - DNA, 24 bp, Artificial sequence
  SiRNA target sequence
atcttttagttatttaaataagcc

SEQ ID NO: 59246 - DNA, 24 bp, Artificial sequence
  SiRNA target sequence
tcttttagttatttaaataagcct

SEQ ID NO: 59247 - DNA, 24 bp, Artificial sequence
  SiRNA target sequence
cttttagttatttaaataagccta

SEQ ID NO: 59248 - DNA, 24 bp, Artificial sequence
  SiRNA target sequence
ttttagttatttaaataagcctat

SEQ ID NO: 59249 - DNA, 24 bp, Artificial sequence
  SiRNA target sequence
tttagttatttaaataagcctatt

SEQ ID NO: 59250 - DNA, 24 bp, Artificial sequence
  SiRNA target sequence
ttagttatttaaataagcctattt

SEQ ID NO: 59251 - DNA, 24 bp, Artificial sequence
  SiRNA target sequence
tagttatttaaataagcctatttt

SEQ ID NO: 59252 - DNA, 24 bp, Artificial sequence
  SiRNA target sequence
agttatttaaataagcctatttta

SEQ ID NO: 59253 - DNA, 24 bp, Artificial sequence
  SiRNA target sequence
gttatttaaataagcctattttag

SEQ ID NO: 59254 - DNA, 24 bp, Artificial sequence
  SiRNA target sequence
ttatttaaataagcctattttagt

SEQ ID NO: 59255 - DNA, 24 bp, Artificial sequence
  SiRNA target sequence
tatttaaataagcctattttagtg

SEQ ID NO: 59256 - DNA, 24 bp, Artificial sequence
  SiRNA target sequence
atttaaataagcctattttagtga

SEQ ID NO: 59257 - DNA, 24 bp, Artificial sequence
  SiRNA target sequence
tttaaataagcctattttagtgaa

SEQ ID NO: 59258 - DNA, 24 bp, Artificial sequence
  SiRNA target sequence
ttaaataagcctattttagtgaat

SEQ ID NO: 59259 - DNA, 24 bp, Artificial sequence
  SiRNA target sequence
taaataagcctattttagtgaatg

SEQ ID NO: 59260 - DNA, 24 bp, Artificial sequence
  SiRNA target sequence
aaataagcctattttagtgaatgc

SEQ ID NO: 59261 - DNA, 24 bp, Artificial sequence
  SiRNA target sequence
aataagcctattttagtgaatgct

SEQ ID NO: 59262 - DNA, 24 bp, Artificial sequence
  SiRNA target sequence
ataagcctattttagtgaatgcta

SEQ ID NO: 59263 - DNA, 24 bp, Artificial sequence
  SiRNA target sequence
taagcctattttagtgaatgctaa

SEQ ID NO: 59264 - DNA, 24 bp, Artificial sequence
  SiRNA target sequence
aagcctattttagtgaatgctaat

SEQ ID NO: 59265 - DNA, 24 bp, Artificial sequence
  SiRNA target sequence
agcctattttagtgaatgctaatt

SEQ ID NO: 59266 - DNA, 24 bp, Artificial sequence
  SiRNA target sequence
gcctattttagtgaatgctaattt

SEQ ID NO: 59267 - DNA, 24 bp, Artificial sequence
  SiRNA target sequence
cctattttagtgaatgctaatttc

SEQ ID NO: 59268 - DNA, 24 bp, Artificial sequence
  SiRNA target sequence
ctattttagtgaatgctaatttcg

SEQ ID NO: 59269 - DNA, 24 bp, Artificial sequence
  SiRNA target sequence
tattttagtgaatgctaatttcgt

SEQ ID NO: 59270 - DNA, 24 bp, Artificial sequence
  SiRNA target sequence
attttagtgaatgctaatttcgtt

SEQ ID NO: 59271 - DNA, 24 bp, Artificial sequence
  SiRNA target sequence
ttttagtgaatgctaatttcgtta

SEQ ID NO: 59272 - DNA, 24 bp, Artificial sequence
  SiRNA target sequence
tttagtgaatgctaatttcgttat

SEQ ID NO: 59273 - DNA, 24 bp, Artificial sequence
  SiRNA target sequence
ttagtgaatgctaatttcgttatt

SEQ ID NO: 59274 - DNA, 24 bp, Artificial sequence
  SiRNA target sequence
tagtgaatgctaatttcgttatta

SEQ ID NO: 59275 - DNA, 24 bp, Artificial sequence
  SiRNA target sequence
agtgaatgctaatttcgttattaa

SEQ ID NO: 59276 - DNA, 24 bp, Artificial sequence
  SiRNA target sequence
gtgaatgctaatttcgttattaat

SEQ ID NO: 59277 - DNA, 24 bp, Artificial sequence
  SiRNA target sequence
tgaatgctaatttcgttattaata

SEQ ID NO: 59278 - DNA, 24 bp, Artificial sequence
  SiRNA target sequence
gaatgctaatttcgttattaataa

SEQ ID NO: 59279 - DNA, 24 bp, Artificial sequence
  SiRNA target sequence
aatgctaatttcgttattaataaa

SEQ ID NO: 59280 - DNA, 24 bp, Artificial sequence
  SiRNA target sequence
atgctaatttcgttattaataaag

SEQ ID NO: 59281 - DNA, 24 bp, Artificial sequence
  SiRNA target sequence
tgctaatttcgttattaataaagg

SEQ ID NO: 59282 - DNA, 24 bp, Artificial sequence
  SiRNA target sequence
gctaatttcgttattaataaaggg

SEQ ID NO: 59283 - DNA, 24 bp, Artificial sequence
  SiRNA target sequence
ctaatttcgttattaataaagggg

SEQ ID NO: 59284 - DNA, 24 bp, Artificial sequence
  SiRNA target sequence
taatttcgttattaataaagggga

SEQ ID NO: 59285 - DNA, 24 bp, Artificial sequence
  SiRNA target sequence
aatttcgttattaataaaggggag

SEQ ID NO: 59286 - DNA, 24 bp, Artificial sequence
  SiRNA target sequence
atttcgttattaataaaggggagc

SEQ ID NO: 59287 - DNA, 24 bp, Artificial sequence
  SiRNA target sequence
tttcgttattaataaaggggagcg

SEQ ID NO: 59288 - DNA, 24 bp, Artificial sequence
  SiRNA target sequence
ttcgttattaataaaggggagcgt

SEQ ID NO: 59289 - DNA, 24 bp, Artificial sequence
  SiRNA target sequence
tcgttattaataaaggggagcgtg

SEQ ID NO: 59290 - DNA, 24 bp, Artificial sequence
  SiRNA target sequence
cgttattaataaaggggagcgtgt

SEQ ID NO: 59291 - DNA, 24 bp, Artificial sequence
  SiRNA target sequence
gttattaataaaggggagcgtgtt

SEQ ID NO: 59292 - DNA, 24 bp, Artificial sequence
  SiRNA target sequence
ttattaataaaggggagcgtgttg

SEQ ID NO: 59293 - DNA, 24 bp, Artificial sequence
  SiRNA target sequence
tattaataaaggggagcgtgttgc

SEQ ID NO: 59294 - DNA, 24 bp, Artificial sequence
  SiRNA target sequence
attaataaaggggagcgtgttgct

SEQ ID NO: 59295 - DNA, 24 bp, Artificial sequence
  SiRNA target sequence
ttaataaaggggagcgtgttgcta

SEQ ID NO: 59296 - DNA, 24 bp, Artificial sequence
  SiRNA target sequence
taataaaggggagcgtgttgctat

SEQ ID NO: 59297 - DNA, 24 bp, Artificial sequence
  SiRNA target sequence
aataaaggggagcgtgttgctatt

SEQ ID NO: 59298 - DNA, 24 bp, Artificial sequence
  SiRNA target sequence
ataaaggggagcgtgttgctatta

SEQ ID NO: 59299 - DNA, 24 bp, Artificial sequence
  SiRNA target sequence
taaaggggagcgtgttgctattat

SEQ ID NO: 59300 - DNA, 24 bp, Artificial sequence
  SiRNA target sequence
aaaggggagcgtgttgctattata

SEQ ID NO: 59301 - DNA, 24 bp, Artificial sequence
  SiRNA target sequence
aaggggagcgtgttgctattatag

SEQ ID NO: 59302 - DNA, 24 bp, Artificial sequence
  SiRNA target sequence
aggggagcgtgttgctattatagg

SEQ ID NO: 59303 - DNA, 24 bp, Artificial sequence
  SiRNA target sequence
ggggagcgtgttgctattatagga

SEQ ID NO: 59304 - DNA, 24 bp, Artificial sequence
  SiRNA target sequence
gggagcgtgttgctattataggaa

SEQ ID NO: 59305 - DNA, 24 bp, Artificial sequence
  SiRNA target sequence
ggagcgtgttgctattataggaaa

SEQ ID NO: 59306 - DNA, 24 bp, Artificial sequence
  SiRNA target sequence
gagcgtgttgctattataggaaaa

SEQ ID NO: 59307 - DNA, 24 bp, Artificial sequence
  SiRNA target sequence
agcgtgttgctattataggaaaaa

SEQ ID NO: 59308 - DNA, 24 bp, Artificial sequence
  SiRNA target sequence
gcgtgttgctattataggaaaaaa

SEQ ID NO: 59309 - DNA, 24 bp, Artificial sequence
  SiRNA target sequence
cgtgttgctattataggaaaaaat

SEQ ID NO: 59310 - DNA, 24 bp, Artificial sequence
  SiRNA target sequence
gtgttgctattataggaaaaaatg

SEQ ID NO: 59311 - DNA, 24 bp, Artificial sequence
  SiRNA target sequence
tgttgctattataggaaaaaatgg

SEQ ID NO: 59312 - DNA, 24 bp, Artificial sequence
  SiRNA target sequence
gttgctattataggaaaaaatgga

SEQ ID NO: 59313 - DNA, 24 bp, Artificial sequence
  SiRNA target sequence
ttgctattataggaaaaaatggaa

SEQ ID NO: 59314 - DNA, 24 bp, Artificial sequence
  SiRNA target sequence
tgctattataggaaaaaatggaac

SEQ ID NO: 59315 - DNA, 24 bp, Artificial sequence
  SiRNA target sequence
gctattataggaaaaaatggaaca

SEQ ID NO: 59316 - DNA, 24 bp, Artificial sequence
  SiRNA target sequence
ctattataggaaaaaatggaacag

SEQ ID NO: 59317 - DNA, 24 bp, Artificial sequence
  SiRNA target sequence
tattataggaaaaaatggaacagg

SEQ ID NO: 59318 - DNA, 24 bp, Artificial sequence
  SiRNA target sequence
attataggaaaaaatggaacaggt

SEQ ID NO: 59319 - DNA, 24 bp, Artificial sequence
  SiRNA target sequence
ttataggaaaaaatggaacaggta

SEQ ID NO: 59320 - DNA, 24 bp, Artificial sequence
  SiRNA target sequence
tataggaaaaaatggaacaggtaa

SEQ ID NO: 59321 - DNA, 24 bp, Artificial sequence
  SiRNA target sequence
ataggaaaaaatggaacaggtaaa

SEQ ID NO: 59322 - DNA, 24 bp, Artificial sequence
  SiRNA target sequence
taggaaaaaatggaacaggtaaaa

SEQ ID NO: 59323 - DNA, 24 bp, Artificial sequence
  SiRNA target sequence
aggaaaaaatggaacaggtaaaag

SEQ ID NO: 59324 - DNA, 24 bp, Artificial sequence
  SiRNA target sequence
ggaaaaaatggaacaggtaaaagt

SEQ ID NO: 59325 - DNA, 24 bp, Artificial sequence
  SiRNA target sequence
gaaaaaatggaacaggtaaaagta

SEQ ID NO: 59326 - DNA, 24 bp, Artificial sequence
  SiRNA target sequence
aaaaaatggaacaggtaaaagtac

SEQ ID NO: 59327 - DNA, 24 bp, Artificial sequence
  SiRNA target sequence
aaaaatggaacaggtaaaagtaca

SEQ ID NO: 59328 - DNA, 24 bp, Artificial sequence
  SiRNA target sequence
aaaatggaacaggtaaaagtacaa

SEQ ID NO: 59329 - DNA, 24 bp, Artificial sequence
  SiRNA target sequence
aaatggaacaggtaaaagtacaat

SEQ ID NO: 59330 - DNA, 24 bp, Artificial sequence
  SiRNA target sequence
aatggaacaggtaaaagtacaata

SEQ ID NO: 59331 - DNA, 24 bp, Artificial sequence
  SiRNA target sequence
atggaacaggtaaaagtacaataa

SEQ ID NO: 59332 - DNA, 24 bp, Artificial sequence
  SiRNA target sequence
tggaacaggtaaaagtacaataat

SEQ ID NO: 59333 - DNA, 24 bp, Artificial sequence
  SiRNA target sequence
ggaacaggtaaaagtacaataata

SEQ ID NO: 59334 - DNA, 24 bp, Artificial sequence
  SiRNA target sequence
gaacaggtaaaagtacaataataa

SEQ ID NO: 59335 - DNA, 24 bp, Artificial sequence
  SiRNA target sequence
aacaggtaaaagtacaataataaa

SEQ ID NO: 59336 - DNA, 24 bp, Artificial sequence
  SiRNA target sequence
acaggtaaaagtacaataataaaa

SEQ ID NO: 59337 - DNA, 24 bp, Artificial sequence
  SiRNA target sequence
caggtaaaagtacaataataaaat

SEQ ID NO: 59338 - DNA, 24 bp, Artificial sequence
  SiRNA target sequence
aggtaaaagtacaataataaaatt

SEQ ID NO: 59339 - DNA, 24 bp, Artificial sequence
  SiRNA target sequence
ggtaaaagtacaataataaaattg

SEQ ID NO: 59340 - DNA, 24 bp, Artificial sequence
  SiRNA target sequence
gtaaaagtacaataataaaattgt

SEQ ID NO: 59341 - DNA, 24 bp, Artificial sequence
  SiRNA target sequence
taaaagtacaataataaaattgtt

SEQ ID NO: 59342 - DNA, 24 bp, Artificial sequence
  SiRNA target sequence
aaaagtacaataataaaattgtta

SEQ ID NO: 59343 - DNA, 24 bp, Artificial sequence
  SiRNA target sequence
aaagtacaataataaaattgttaa

SEQ ID NO: 59344 - DNA, 24 bp, Artificial sequence
  SiRNA target sequence
aagtacaataataaaattgttaat

SEQ ID NO: 59345 - DNA, 24 bp, Artificial sequence
  SiRNA target sequence
agtacaataataaaattgttaatg

SEQ ID NO: 59346 - DNA, 24 bp, Artificial sequence
  SiRNA target sequence
gtacaataataaaattgttaatga

SEQ ID NO: 59347 - DNA, 24 bp, Artificial sequence
  SiRNA target sequence
tacaataataaaattgttaatgaa

SEQ ID NO: 59348 - DNA, 24 bp, Artificial sequence
  SiRNA target sequence
acaataataaaattgttaatgaaa

SEQ ID NO: 59349 - DNA, 24 bp, Artificial sequence
  SiRNA target sequence
caataataaaattgttaatgaaat

SEQ ID NO: 59350 - DNA, 24 bp, Artificial sequence
  SiRNA target sequence
aataataaaattgttaatgaaatt

SEQ ID NO: 59351 - DNA, 24 bp, Artificial sequence
  SiRNA target sequence
ataataaaattgttaatgaaattt

SEQ ID NO: 59352 - DNA, 24 bp, Artificial sequence
  SiRNA target sequence
taataaaattgttaatgaaatttt

SEQ ID NO: 59353 - DNA, 24 bp, Artificial sequence
  SiRNA target sequence
aataaaattgttaatgaaatttta

SEQ ID NO: 59354 - DNA, 24 bp, Artificial sequence
  SiRNA target sequence
ataaaattgttaatgaaattttat

SEQ ID NO: 59355 - DNA, 24 bp, Artificial sequence
  SiRNA target sequence
taaaattgttaatgaaattttata

SEQ ID NO: 59356 - DNA, 24 bp, Artificial sequence
  SiRNA target sequence
aaaattgttaatgaaattttataa

SEQ ID NO: 59357 - DNA, 24 bp, Artificial sequence
  SiRNA target sequence
aaattgttaatgaaattttataaa

SEQ ID NO: 59358 - DNA, 24 bp, Artificial sequence
  SiRNA target sequence
aattgttaatgaaattttataaat

SEQ ID NO: 59359 - DNA, 24 bp, Artificial sequence
  SiRNA target sequence
attgttaatgaaattttataaata

SEQ ID NO: 59360 - DNA, 24 bp, Artificial sequence
  SiRNA target sequence
ttgttaatgaaattttataaatat

SEQ ID NO: 59361 - DNA, 24 bp, Artificial sequence
  SiRNA target sequence
tgttaatgaaattttataaatatg

SEQ ID NO: 59362 - DNA, 24 bp, Artificial sequence
  SiRNA target sequence
gttaatgaaattttataaatatga

SEQ ID NO: 59363 - DNA, 24 bp, Artificial sequence
  SiRNA target sequence
ttaatgaaattttataaatatgat

SEQ ID NO: 59364 - DNA, 24 bp, Artificial sequence
  SiRNA target sequence
taatgaaattttataaatatgatg

SEQ ID NO: 59365 - DNA, 24 bp, Artificial sequence
  SiRNA target sequence
aatgaaattttataaatatgatgg

SEQ ID NO: 59366 - DNA, 24 bp, Artificial sequence
  SiRNA target sequence
atgaaattttataaatatgatgga

SEQ ID NO: 59367 - DNA, 24 bp, Artificial sequence
  SiRNA target sequence
tgaaattttataaatatgatggag

SEQ ID NO: 59368 - DNA, 24 bp, Artificial sequence
  SiRNA target sequence
gaaattttataaatatgatggaga

SEQ ID NO: 59369 - DNA, 24 bp, Artificial sequence
  SiRNA target sequence
aaattttataaatatgatggagat

SEQ ID NO: 59370 - DNA, 24 bp, Artificial sequence
  SiRNA target sequence
aattttataaatatgatggagata

SEQ ID NO: 59371 - DNA, 24 bp, Artificial sequence
  SiRNA target sequence
attttataaatatgatggagatat

SEQ ID NO: 59372 - DNA, 24 bp, Artificial sequence
  SiRNA target sequence
ttttataaatatgatggagatata

SEQ ID NO: 59373 - DNA, 24 bp, Artificial sequence
  SiRNA target sequence
tttataaatatgatggagatatat

SEQ ID NO: 59374 - DNA, 24 bp, Artificial sequence
  SiRNA target sequence
ttataaatatgatggagatatatt

SEQ ID NO: 59375 - DNA, 24 bp, Artificial sequence
  SiRNA target sequence
tataaatatgatggagatatatta

SEQ ID NO: 59376 - DNA, 24 bp, Artificial sequence
  SiRNA target sequence
ataaatatgatggagatatattaa

SEQ ID NO: 59377 - DNA, 24 bp, Artificial sequence
  SiRNA target sequence
taaatatgatggagatatattaat

SEQ ID NO: 59378 - DNA, 24 bp, Artificial sequence
  SiRNA target sequence
aaatatgatggagatatattaatt

SEQ ID NO: 59379 - DNA, 24 bp, Artificial sequence
  SiRNA target sequence
aatatgatggagatatattaattg

SEQ ID NO: 59380 - DNA, 24 bp, Artificial sequence
  SiRNA target sequence
atatgatggagatatattaattga

SEQ ID NO: 59381 - DNA, 24 bp, Artificial sequence
  SiRNA target sequence
tatgatggagatatattaattgat

SEQ ID NO: 59382 - DNA, 24 bp, Artificial sequence
  SiRNA target sequence
atgatggagatatattaattgatg

SEQ ID NO: 59383 - DNA, 24 bp, Artificial sequence
  SiRNA target sequence
tgatggagatatattaattgatga

SEQ ID NO: 59384 - DNA, 24 bp, Artificial sequence
  SiRNA target sequence
gatggagatatattaattgatgat

SEQ ID NO: 59385 - DNA, 24 bp, Artificial sequence
  SiRNA target sequence
atggagatatattaattgatgata

SEQ ID NO: 59386 - DNA, 24 bp, Artificial sequence
  SiRNA target sequence
tggagatatattaattgatgatac

SEQ ID NO: 59387 - DNA, 24 bp, Artificial sequence
  SiRNA target sequence
ggagatatattaattgatgataca

SEQ ID NO: 59388 - DNA, 24 bp, Artificial sequence
  SiRNA target sequence
gagatatattaattgatgatacag

SEQ ID NO: 59389 - DNA, 24 bp, Artificial sequence
  SiRNA target sequence
agatatattaattgatgatacaga

SEQ ID NO: 59390 - DNA, 24 bp, Artificial sequence
  SiRNA target sequence
gatatattaattgatgatacagaa

SEQ ID NO: 59391 - DNA, 24 bp, Artificial sequence
  SiRNA target sequence
atatattaattgatgatacagaaa

SEQ ID NO: 59392 - DNA, 24 bp, Artificial sequence
  SiRNA target sequence
tatattaattgatgatacagaaat

SEQ ID NO: 59393 - DNA, 24 bp, Artificial sequence
  SiRNA target sequence
atattaattgatgatacagaaata

SEQ ID NO: 59394 - DNA, 24 bp, Artificial sequence
  SiRNA target sequence
tattaattgatgatacagaaatag

SEQ ID NO: 59395 - DNA, 24 bp, Artificial sequence
  SiRNA target sequence
attaattgatgatacagaaataga

SEQ ID NO: 59396 - DNA, 24 bp, Artificial sequence
  SiRNA target sequence
ttaattgatgatacagaaatagat

SEQ ID NO: 59397 - DNA, 24 bp, Artificial sequence
  SiRNA target sequence
taattgatgatacagaaatagata

SEQ ID NO: 59398 - DNA, 24 bp, Artificial sequence
  SiRNA target sequence
aattgatgatacagaaatagataa

SEQ ID NO: 59399 - DNA, 24 bp, Artificial sequence
  SiRNA target sequence
attgatgatacagaaatagataat

SEQ ID NO: 59400 - DNA, 24 bp, Artificial sequence
  SiRNA target sequence
ttgatgatacagaaatagataata

SEQ ID NO: 59401 - DNA, 24 bp, Artificial sequence
  SiRNA target sequence
tgatgatacagaaatagataatat

SEQ ID NO: 59402 - DNA, 24 bp, Artificial sequence
  SiRNA target sequence
gatgatacagaaatagataatatt

SEQ ID NO: 59403 - DNA, 24 bp, Artificial sequence
  SiRNA target sequence
atgatacagaaatagataatattt

SEQ ID NO: 59404 - DNA, 24 bp, Artificial sequence
  SiRNA target sequence
tgatacagaaatagataatatttc

SEQ ID NO: 59405 - DNA, 24 bp, Artificial sequence
  SiRNA target sequence
gatacagaaatagataatatttcg

SEQ ID NO: 59406 - DNA, 24 bp, Artificial sequence
  SiRNA target sequence
atacagaaatagataatatttcgg

SEQ ID NO: 59407 - DNA, 24 bp, Artificial sequence
  SiRNA target sequence
tacagaaatagataatatttcgga

SEQ ID NO: 59408 - DNA, 24 bp, Artificial sequence
  SiRNA target sequence
acagaaatagataatatttcggat

SEQ ID NO: 59409 - DNA, 24 bp, Artificial sequence
  SiRNA target sequence
cagaaatagataatatttcggata

SEQ ID NO: 59410 - DNA, 24 bp, Artificial sequence
  SiRNA target sequence
agaaatagataatatttcggatag

SEQ ID NO: 59411 - DNA, 24 bp, Artificial sequence
  SiRNA target sequence
gaaatagataatatttcggataga

SEQ ID NO: 59412 - DNA, 24 bp, Artificial sequence
  SiRNA target sequence
aaatagataatatttcggatagaa

SEQ ID NO: 59413 - DNA, 24 bp, Artificial sequence
  SiRNA target sequence
aatagataatatttcggatagaag

SEQ ID NO: 59414 - DNA, 24 bp, Artificial sequence
  SiRNA target sequence
atagataatatttcggatagaagt

SEQ ID NO: 59415 - DNA, 24 bp, Artificial sequence
  SiRNA target sequence
tagataatatttcggatagaagtt

SEQ ID NO: 59416 - DNA, 24 bp, Artificial sequence
  SiRNA target sequence
agataatatttcggatagaagtta

SEQ ID NO: 59417 - DNA, 24 bp, Artificial sequence
  SiRNA target sequence
gataatatttcggatagaagttac

SEQ ID NO: 59418 - DNA, 24 bp, Artificial sequence
  SiRNA target sequence
ataatatttcggatagaagttaca

SEQ ID NO: 59419 - DNA, 24 bp, Artificial sequence
  SiRNA target sequence
taatatttcggatagaagttacag

SEQ ID NO: 59420 - DNA, 24 bp, Artificial sequence
  SiRNA target sequence
aatatttcggatagaagttacaga

SEQ ID NO: 59421 - DNA, 24 bp, Artificial sequence
  SiRNA target sequence
atatttcggatagaagttacagaa

SEQ ID NO: 59422 - DNA, 24 bp, Artificial sequence
  SiRNA target sequence
tatttcggatagaagttacagaag

SEQ ID NO: 59423 - DNA, 24 bp, Artificial sequence
  SiRNA target sequence
atttcggatagaagttacagaagt

SEQ ID NO: 59424 - DNA, 24 bp, Artificial sequence
  SiRNA target sequence
tttcggatagaagttacagaagtt

SEQ ID NO: 59425 - DNA, 24 bp, Artificial sequence
  SiRNA target sequence
ttcggatagaagttacagaagttt

SEQ ID NO: 59426 - DNA, 24 bp, Artificial sequence
  SiRNA target sequence
tcggatagaagttacagaagttta

SEQ ID NO: 59427 - DNA, 24 bp, Artificial sequence
  SiRNA target sequence
cggatagaagttacagaagtttaa

SEQ ID NO: 59428 - DNA, 24 bp, Artificial sequence
  SiRNA target sequence
ggatagaagttacagaagtttaat

SEQ ID NO: 59429 - DNA, 24 bp, Artificial sequence
  SiRNA target sequence
gatagaagttacagaagtttaata

SEQ ID NO: 59430 - DNA, 24 bp, Artificial sequence
  SiRNA target sequence
atagaagttacagaagtttaatat

SEQ ID NO: 59431 - DNA, 24 bp, Artificial sequence
  SiRNA target sequence
tagaagttacagaagtttaatatc

SEQ ID NO: 59432 - DNA, 24 bp, Artificial sequence
  SiRNA target sequence
agaagttacagaagtttaatatca

SEQ ID NO: 59433 - DNA, 24 bp, Artificial sequence
  SiRNA target sequence
gaagttacagaagtttaatatcat

SEQ ID NO: 59434 - DNA, 24 bp, Artificial sequence
  SiRNA target sequence
aagttacagaagtttaatatcata

SEQ ID NO: 59435 - DNA, 24 bp, Artificial sequence
  SiRNA target sequence
agttacagaagtttaatatcatat

SEQ ID NO: 59436 - DNA, 24 bp, Artificial sequence
  SiRNA target sequence
gttacagaagtttaatatcatatg

SEQ ID NO: 59437 - DNA, 24 bp, Artificial sequence
  SiRNA target sequence
ttacagaagtttaatatcatatgc

SEQ ID NO: 59438 - DNA, 24 bp, Artificial sequence
  SiRNA target sequence
tacagaagtttaatatcatatgca

SEQ ID NO: 59439 - DNA, 24 bp, Artificial sequence
  SiRNA target sequence
acagaagtttaatatcatatgcaa

SEQ ID NO: 59440 - DNA, 24 bp, Artificial sequence
  SiRNA target sequence
cagaagtttaatatcatatgcaac

SEQ ID NO: 59441 - DNA, 24 bp, Artificial sequence
  SiRNA target sequence
agaagtttaatatcatatgcaaca

SEQ ID NO: 59442 - DNA, 24 bp, Artificial sequence
  SiRNA target sequence
gaagtttaatatcatatgcaacac

SEQ ID NO: 59443 - DNA, 24 bp, Artificial sequence
  SiRNA target sequence
aagtttaatatcatatgcaacaca

SEQ ID NO: 59444 - DNA, 24 bp, Artificial sequence
  SiRNA target sequence
agtttaatatcatatgcaacacaa

SEQ ID NO: 59445 - DNA, 24 bp, Artificial sequence
  SiRNA target sequence
gtttaatatcatatgcaacacaaa

SEQ ID NO: 59446 - DNA, 24 bp, Artificial sequence
  SiRNA target sequence
tttaatatcatatgcaacacaaaa

SEQ ID NO: 59447 - DNA, 24 bp, Artificial sequence
  SiRNA target sequence
ttaatatcatatgcaacacaaaac

SEQ ID NO: 59448 - DNA, 24 bp, Artificial sequence
  SiRNA target sequence
taatatcatatgcaacacaaaaca

SEQ ID NO: 59449 - DNA, 24 bp, Artificial sequence
  SiRNA target sequence
aatatcatatgcaacacaaaacac

SEQ ID NO: 59450 - DNA, 24 bp, Artificial sequence
  SiRNA target sequence
atatcatatgcaacacaaaacacg

SEQ ID NO: 59451 - DNA, 24 bp, Artificial sequence
  SiRNA target sequence
tatcatatgcaacacaaaacacgt

SEQ ID NO: 59452 - DNA, 24 bp, Artificial sequence
  SiRNA target sequence
atcatatgcaacacaaaacacgtt

SEQ ID NO: 59453 - DNA, 24 bp, Artificial sequence
  SiRNA target sequence
tcatatgcaacacaaaacacgttc

SEQ ID NO: 59454 - DNA, 24 bp, Artificial sequence
  SiRNA target sequence
catatgcaacacaaaacacgttct

SEQ ID NO: 59455 - DNA, 24 bp, Artificial sequence
  SiRNA target sequence
atatgcaacacaaaacacgttctt

SEQ ID NO: 59456 - DNA, 24 bp, Artificial sequence
  SiRNA target sequence
tatgcaacacaaaacacgttctta

SEQ ID NO: 59457 - DNA, 24 bp, Artificial sequence
  SiRNA target sequence
atgcaacacaaaacacgttcttat

SEQ ID NO: 59458 - DNA, 24 bp, Artificial sequence
  SiRNA target sequence
tgcaacacaaaacacgttcttatt

SEQ ID NO: 59459 - DNA, 24 bp, Artificial sequence
  SiRNA target sequence
gcaacacaaaacacgttcttattc

SEQ ID NO: 59460 - DNA, 24 bp, Artificial sequence
  SiRNA target sequence
caacacaaaacacgttcttattcg

SEQ ID NO: 59461 - DNA, 24 bp, Artificial sequence
  SiRNA target sequence
aacacaaaacacgttcttattcga

SEQ ID NO: 59462 - DNA, 24 bp, Artificial sequence
  SiRNA target sequence
acacaaaacacgttcttattcgat

SEQ ID NO: 59463 - DNA, 24 bp, Artificial sequence
  SiRNA target sequence
cacaaaacacgttcttattcgata

SEQ ID NO: 59464 - DNA, 24 bp, Artificial sequence
  SiRNA target sequence
acaaaacacgttcttattcgataa

SEQ ID NO: 59465 - DNA, 24 bp, Artificial sequence
  SiRNA target sequence
caaaacacgttcttattcgataat

SEQ ID NO: 59466 - DNA, 24 bp, Artificial sequence
  SiRNA target sequence
aaaacacgttcttattcgataata

SEQ ID NO: 59467 - DNA, 24 bp, Artificial sequence
  SiRNA target sequence
aaacacgttcttattcgataatac

SEQ ID NO: 59468 - DNA, 24 bp, Artificial sequence
  SiRNA target sequence
aacacgttcttattcgataatact

SEQ ID NO: 59469 - DNA, 24 bp, Artificial sequence
  SiRNA target sequence
acacgttcttattcgataatactg

SEQ ID NO: 59470 - DNA, 24 bp, Artificial sequence
  SiRNA target sequence
cacgttcttattcgataatactgt

SEQ ID NO: 59471 - DNA, 24 bp, Artificial sequence
  SiRNA target sequence
acgttcttattcgataatactgtg

SEQ ID NO: 59472 - DNA, 24 bp, Artificial sequence
  SiRNA target sequence
cgttcttattcgataatactgtga

SEQ ID NO: 59473 - DNA, 24 bp, Artificial sequence
  SiRNA target sequence
gttcttattcgataatactgtgac

SEQ ID NO: 59474 - DNA, 24 bp, Artificial sequence
  SiRNA target sequence
ttcttattcgataatactgtgaca

SEQ ID NO: 59475 - DNA, 24 bp, Artificial sequence
  SiRNA target sequence
tcttattcgataatactgtgacat

SEQ ID NO: 59476 - DNA, 24 bp, Artificial sequence
  SiRNA target sequence
cttattcgataatactgtgacata

SEQ ID NO: 59477 - DNA, 24 bp, Artificial sequence
  SiRNA target sequence
ttattcgataatactgtgacatac

SEQ ID NO: 59478 - DNA, 24 bp, Artificial sequence
  SiRNA target sequence
tattcgataatactgtgacataca

SEQ ID NO: 59479 - DNA, 24 bp, Artificial sequence
  SiRNA target sequence
attcgataatactgtgacatacaa

SEQ ID NO: 59480 - DNA, 24 bp, Artificial sequence
  SiRNA target sequence
ttcgataatactgtgacatacaat

SEQ ID NO: 59481 - DNA, 24 bp, Artificial sequence
  SiRNA target sequence
tcgataatactgtgacatacaata

SEQ ID NO: 59482 - DNA, 24 bp, Artificial sequence
  SiRNA target sequence
cgataatactgtgacatacaatat

SEQ ID NO: 59483 - DNA, 24 bp, Artificial sequence
  SiRNA target sequence
gataatactgtgacatacaatata

SEQ ID NO: 59484 - DNA, 24 bp, Artificial sequence
  SiRNA target sequence
ataatactgtgacatacaatatat

SEQ ID NO: 59485 - DNA, 24 bp, Artificial sequence
  SiRNA target sequence
taatactgtgacatacaatatatt

SEQ ID NO: 59486 - DNA, 24 bp, Artificial sequence
  SiRNA target sequence
aatactgtgacatacaatatattt

SEQ ID NO: 59487 - DNA, 24 bp, Artificial sequence
  SiRNA target sequence
atactgtgacatacaatatatttt

SEQ ID NO: 59488 - DNA, 24 bp, Artificial sequence
  SiRNA target sequence
tactgtgacatacaatatatttta

SEQ ID NO: 59489 - DNA, 24 bp, Artificial sequence
  SiRNA target sequence
actgtgacatacaatatattttac

SEQ ID NO: 59490 - DNA, 24 bp, Artificial sequence
  SiRNA target sequence
ctgtgacatacaatatattttacg

SEQ ID NO: 59491 - DNA, 24 bp, Artificial sequence
  SiRNA target sequence
tgtgacatacaatatattttacgg

SEQ ID NO: 59492 - DNA, 24 bp, Artificial sequence
  SiRNA target sequence
gtgacatacaatatattttacggg

SEQ ID NO: 59493 - DNA, 24 bp, Artificial sequence
  SiRNA target sequence
tgacatacaatatattttacggga

SEQ ID NO: 59494 - DNA, 24 bp, Artificial sequence
  SiRNA target sequence
gacatacaatatattttacgggac

SEQ ID NO: 59495 - DNA, 24 bp, Artificial sequence
  SiRNA target sequence
acatacaatatattttacgggact

SEQ ID NO: 59496 - DNA, 24 bp, Artificial sequence
  SiRNA target sequence
catacaatatattttacgggacta

SEQ ID NO: 59497 - DNA, 24 bp, Artificial sequence
  SiRNA target sequence
atacaatatattttacgggactaa

SEQ ID NO: 59498 - DNA, 24 bp, Artificial sequence
  SiRNA target sequence
tacaatatattttacgggactaaa

SEQ ID NO: 59499 - DNA, 24 bp, Artificial sequence
  SiRNA target sequence
acaatatattttacgggactaaaa

SEQ ID NO: 59500 - DNA, 24 bp, Artificial sequence
  SiRNA target sequence
caatatattttacgggactaaaaa

SEQ ID NO: 59501 - DNA, 24 bp, Artificial sequence
  SiRNA target sequence
aatatattttacgggactaaaaac

SEQ ID NO: 59502 - DNA, 24 bp, Artificial sequence
  SiRNA target sequence
atatattttacgggactaaaaacg

SEQ ID NO: 59503 - DNA, 24 bp, Artificial sequence
  SiRNA target sequence
tatattttacgggactaaaaacgt

SEQ ID NO: 59504 - DNA, 24 bp, Artificial sequence
  SiRNA target sequence
atattttacgggactaaaaacgta

SEQ ID NO: 59505 - DNA, 24 bp, Artificial sequence
  SiRNA target sequence
tattttacgggactaaaaacgtaa

SEQ ID NO: 59506 - DNA, 24 bp, Artificial sequence
  SiRNA target sequence
attttacgggactaaaaacgtaac

SEQ ID NO: 59507 - DNA, 24 bp, Artificial sequence
  SiRNA target sequence
ttttacgggactaaaaacgtaaca

SEQ ID NO: 59508 - DNA, 24 bp, Artificial sequence
  SiRNA target sequence
tttacgggactaaaaacgtaacag

SEQ ID NO: 59509 - DNA, 24 bp, Artificial sequence
  SiRNA target sequence
ttacgggactaaaaacgtaacaga

SEQ ID NO: 59510 - DNA, 24 bp, Artificial sequence
  SiRNA target sequence
tacgggactaaaaacgtaacagaa

SEQ ID NO: 59511 - DNA, 24 bp, Artificial sequence
  SiRNA target sequence
acgggactaaaaacgtaacagaaa

SEQ ID NO: 59512 - DNA, 24 bp, Artificial sequence
  SiRNA target sequence
cgggactaaaaacgtaacagaaaa

SEQ ID NO: 59513 - DNA, 24 bp, Artificial sequence
  SiRNA target sequence
gggactaaaaacgtaacagaaaaa

SEQ ID NO: 59514 - DNA, 24 bp, Artificial sequence
  SiRNA target sequence
ggactaaaaacgtaacagaaaaag

SEQ ID NO: 59515 - DNA, 24 bp, Artificial sequence
  SiRNA target sequence
gactaaaaacgtaacagaaaaaga

SEQ ID NO: 59516 - DNA, 24 bp, Artificial sequence
  SiRNA target sequence
actaaaaacgtaacagaaaaagaa

SEQ ID NO: 59517 - DNA, 24 bp, Artificial sequence
  SiRNA target sequence
ctaaaaacgtaacagaaaaagaag

SEQ ID NO: 59518 - DNA, 24 bp, Artificial sequence
  SiRNA target sequence
taaaaacgtaacagaaaaagaagt

SEQ ID NO: 59519 - DNA, 24 bp, Artificial sequence
  SiRNA target sequence
aaaaacgtaacagaaaaagaagtt

SEQ ID NO: 59520 - DNA, 24 bp, Artificial sequence
  SiRNA target sequence
aaaacgtaacagaaaaagaagttt

SEQ ID NO: 59521 - DNA, 24 bp, Artificial sequence
  SiRNA target sequence
aaacgtaacagaaaaagaagtttt

SEQ ID NO: 59522 - DNA, 24 bp, Artificial sequence
  SiRNA target sequence
aacgtaacagaaaaagaagtttta

SEQ ID NO: 59523 - DNA, 24 bp, Artificial sequence
  SiRNA target sequence
acgtaacagaaaaagaagttttag

SEQ ID NO: 59524 - DNA, 24 bp, Artificial sequence
  SiRNA target sequence
cgtaacagaaaaagaagttttaga

SEQ ID NO: 59525 - DNA, 24 bp, Artificial sequence
  SiRNA target sequence
gtaacagaaaaagaagttttagaa

SEQ ID NO: 59526 - DNA, 24 bp, Artificial sequence
  SiRNA target sequence
taacagaaaaagaagttttagaat

SEQ ID NO: 59527 - DNA, 24 bp, Artificial sequence
  SiRNA target sequence
aacagaaaaagaagttttagaatt

SEQ ID NO: 59528 - DNA, 24 bp, Artificial sequence
  SiRNA target sequence
acagaaaaagaagttttagaatta

SEQ ID NO: 59529 - DNA, 24 bp, Artificial sequence
  SiRNA target sequence
cagaaaaagaagttttagaattag

SEQ ID NO: 59530 - DNA, 24 bp, Artificial sequence
  SiRNA target sequence
agaaaaagaagttttagaattagc

SEQ ID NO: 59531 - DNA, 24 bp, Artificial sequence
  SiRNA target sequence
gaaaaagaagttttagaattagcc

SEQ ID NO: 59532 - DNA, 24 bp, Artificial sequence
  SiRNA target sequence
aaaaagaagttttagaattagcca

SEQ ID NO: 59533 - DNA, 24 bp, Artificial sequence
  SiRNA target sequence
aaaagaagttttagaattagccaa

SEQ ID NO: 59534 - DNA, 24 bp, Artificial sequence
  SiRNA target sequence
aaagaagttttagaattagccaaa

SEQ ID NO: 59535 - DNA, 24 bp, Artificial sequence
  SiRNA target sequence
aagaagttttagaattagccaaaa

SEQ ID NO: 59536 - DNA, 24 bp, Artificial sequence
  SiRNA target sequence
agaagttttagaattagccaaaaa

SEQ ID NO: 59537 - DNA, 24 bp, Artificial sequence
  SiRNA target sequence
gaagttttagaattagccaaaaaa

SEQ ID NO: 59538 - DNA, 24 bp, Artificial sequence
  SiRNA target sequence
aagttttagaattagccaaaaaaa

SEQ ID NO: 59539 - DNA, 24 bp, Artificial sequence
  SiRNA target sequence
agttttagaattagccaaaaaaat

SEQ ID NO: 59540 - DNA, 24 bp, Artificial sequence
  SiRNA target sequence
gttttagaattagccaaaaaaata

SEQ ID NO: 59541 - DNA, 24 bp, Artificial sequence
  SiRNA target sequence
ttttagaattagccaaaaaaatag

SEQ ID NO: 59542 - DNA, 24 bp, Artificial sequence
  SiRNA target sequence
tttagaattagccaaaaaaatagg

SEQ ID NO: 59543 - DNA, 24 bp, Artificial sequence
  SiRNA target sequence
ttagaattagccaaaaaaataggt

SEQ ID NO: 59544 - DNA, 24 bp, Artificial sequence
  SiRNA target sequence
tagaattagccaaaaaaataggtg

SEQ ID NO: 59545 - DNA, 24 bp, Artificial sequence
  SiRNA target sequence
agaattagccaaaaaaataggtgt

SEQ ID NO: 59546 - DNA, 24 bp, Artificial sequence
  SiRNA target sequence
gaattagccaaaaaaataggtgta

SEQ ID NO: 59547 - DNA, 24 bp, Artificial sequence
  SiRNA target sequence
aattagccaaaaaaataggtgtat

SEQ ID NO: 59548 - DNA, 24 bp, Artificial sequence
  SiRNA target sequence
attagccaaaaaaataggtgtatt

SEQ ID NO: 59549 - DNA, 24 bp, Artificial sequence
  SiRNA target sequence
ttagccaaaaaaataggtgtatta

SEQ ID NO: 59550 - DNA, 24 bp, Artificial sequence
  SiRNA target sequence
tagccaaaaaaataggtgtattag

SEQ ID NO: 59551 - DNA, 24 bp, Artificial sequence
  SiRNA target sequence
agccaaaaaaataggtgtattaga

SEQ ID NO: 59552 - DNA, 24 bp, Artificial sequence
  SiRNA target sequence
gccaaaaaaataggtgtattagag

SEQ ID NO: 59553 - DNA, 24 bp, Artificial sequence
  SiRNA target sequence
ccaaaaaaataggtgtattagagt

SEQ ID NO: 59554 - DNA, 24 bp, Artificial sequence
  SiRNA target sequence
caaaaaaataggtgtattagagtc

SEQ ID NO: 59555 - DNA, 24 bp, Artificial sequence
  SiRNA target sequence
aaaaaaataggtgtattagagtct

SEQ ID NO: 59556 - DNA, 24 bp, Artificial sequence
  SiRNA target sequence
aaaaaataggtgtattagagtcta

SEQ ID NO: 59557 - DNA, 24 bp, Artificial sequence
  SiRNA target sequence
aaaaataggtgtattagagtctat

SEQ ID NO: 59558 - DNA, 24 bp, Artificial sequence
  SiRNA target sequence
aaaataggtgtattagagtctata

SEQ ID NO: 59559 - DNA, 24 bp, Artificial sequence
  SiRNA target sequence
aaataggtgtattagagtctatac

SEQ ID NO: 59560 - DNA, 24 bp, Artificial sequence
  SiRNA target sequence
aataggtgtattagagtctataca

SEQ ID NO: 59561 - DNA, 24 bp, Artificial sequence
  SiRNA target sequence
ataggtgtattagagtctatacag

SEQ ID NO: 59562 - DNA, 24 bp, Artificial sequence
  SiRNA target sequence
taggtgtattagagtctatacagg

SEQ ID NO: 59563 - DNA, 24 bp, Artificial sequence
  SiRNA target sequence
aggtgtattagagtctatacagga

SEQ ID NO: 59564 - DNA, 24 bp, Artificial sequence
  SiRNA target sequence
ggtgtattagagtctatacaggaa

SEQ ID NO: 59565 - DNA, 24 bp, Artificial sequence
  SiRNA target sequence
gtgtattagagtctatacaggaat

SEQ ID NO: 59566 - DNA, 24 bp, Artificial sequence
  SiRNA target sequence
tgtattagagtctatacaggaatt

SEQ ID NO: 59567 - DNA, 24 bp, Artificial sequence
  SiRNA target sequence
gtattagagtctatacaggaattt

SEQ ID NO: 59568 - DNA, 24 bp, Artificial sequence
  SiRNA target sequence
tattagagtctatacaggaattta

SEQ ID NO: 59569 - DNA, 24 bp, Artificial sequence
  SiRNA target sequence
attagagtctatacaggaatttaa

SEQ ID NO: 59570 - DNA, 24 bp, Artificial sequence
  SiRNA target sequence
ttagagtctatacaggaatttaaa

SEQ ID NO: 59571 - DNA, 24 bp, Artificial sequence
  SiRNA target sequence
tagagtctatacaggaatttaaag

SEQ ID NO: 59572 - DNA, 24 bp, Artificial sequence
  SiRNA target sequence
agagtctatacaggaatttaaaga

SEQ ID NO: 59573 - DNA, 24 bp, Artificial sequence
  SiRNA target sequence
gagtctatacaggaatttaaagat

SEQ ID NO: 59574 - DNA, 24 bp, Artificial sequence
  SiRNA target sequence
agtctatacaggaatttaaagatg

SEQ ID NO: 59575 - DNA, 24 bp, Artificial sequence
  SiRNA target sequence
gtctatacaggaatttaaagatgg

SEQ ID NO: 59576 - DNA, 24 bp, Artificial sequence
  SiRNA target sequence
tctatacaggaatttaaagatggg

SEQ ID NO: 59577 - DNA, 24 bp, Artificial sequence
  SiRNA target sequence
ctatacaggaatttaaagatgggt

SEQ ID NO: 59578 - DNA, 24 bp, Artificial sequence
  SiRNA target sequence
tatacaggaatttaaagatgggtt

SEQ ID NO: 59579 - DNA, 24 bp, Artificial sequence
  SiRNA target sequence
atacaggaatttaaagatgggttt

SEQ ID NO: 59580 - DNA, 24 bp, Artificial sequence
  SiRNA target sequence
tacaggaatttaaagatgggttta

SEQ ID NO: 59581 - DNA, 24 bp, Artificial sequence
  SiRNA target sequence
acaggaatttaaagatgggtttag

SEQ ID NO: 59582 - DNA, 24 bp, Artificial sequence
  SiRNA target sequence
caggaatttaaagatgggtttagc

SEQ ID NO: 59583 - DNA, 24 bp, Artificial sequence
  SiRNA target sequence
aggaatttaaagatgggtttagca

SEQ ID NO: 59584 - DNA, 24 bp, Artificial sequence
  SiRNA target sequence
ggaatttaaagatgggtttagcac

SEQ ID NO: 59585 - DNA, 24 bp, Artificial sequence
  SiRNA target sequence
gaatttaaagatgggtttagcaca

SEQ ID NO: 59586 - DNA, 24 bp, Artificial sequence
  SiRNA target sequence
aatttaaagatgggtttagcacat

SEQ ID NO: 59587 - DNA, 24 bp, Artificial sequence
  SiRNA target sequence
atttaaagatgggtttagcacatc

SEQ ID NO: 59588 - DNA, 24 bp, Artificial sequence
  SiRNA target sequence
tttaaagatgggtttagcacatcg

SEQ ID NO: 59589 - DNA, 24 bp, Artificial sequence
  SiRNA target sequence
ttaaagatgggtttagcacatcgg

SEQ ID NO: 59590 - DNA, 24 bp, Artificial sequence
  SiRNA target sequence
taaagatgggtttagcacatcggt

SEQ ID NO: 59591 - DNA, 24 bp, Artificial sequence
  SiRNA target sequence
aaagatgggtttagcacatcggtc

SEQ ID NO: 59592 - DNA, 24 bp, Artificial sequence
  SiRNA target sequence
aagatgggtttagcacatcggtcg

SEQ ID NO: 59593 - DNA, 24 bp, Artificial sequence
  SiRNA target sequence
agatgggtttagcacatcggtcgg

SEQ ID NO: 59594 - DNA, 24 bp, Artificial sequence
  SiRNA target sequence
gatgggtttagcacatcggtcggt

SEQ ID NO: 59595 - DNA, 24 bp, Artificial sequence
  SiRNA target sequence
atgggtttagcacatcggtcggtg

SEQ ID NO: 59596 - DNA, 24 bp, Artificial sequence
  SiRNA target sequence
tgggtttagcacatcggtcggtga

SEQ ID NO: 59597 - DNA, 24 bp, Artificial sequence
  SiRNA target sequence
gggtttagcacatcggtcggtgaa

SEQ ID NO: 59598 - DNA, 24 bp, Artificial sequence
  SiRNA target sequence
ggtttagcacatcggtcggtgaac

SEQ ID NO: 59599 - DNA, 24 bp, Artificial sequence
  SiRNA target sequence
gtttagcacatcggtcggtgaacg

SEQ ID NO: 59600 - DNA, 24 bp, Artificial sequence
  SiRNA target sequence
tttagcacatcggtcggtgaacgc

SEQ ID NO: 59601 - DNA, 24 bp, Artificial sequence
  SiRNA target sequence
ttagcacatcggtcggtgaacgcg

SEQ ID NO: 59602 - DNA, 24 bp, Artificial sequence
  SiRNA target sequence
tagcacatcggtcggtgaacgcgg

SEQ ID NO: 59603 - DNA, 24 bp, Artificial sequence
  SiRNA target sequence
agcacatcggtcggtgaacgcgga

SEQ ID NO: 59604 - DNA, 24 bp, Artificial sequence
  SiRNA target sequence
gcacatcggtcggtgaacgcggaa

SEQ ID NO: 59605 - DNA, 24 bp, Artificial sequence
  SiRNA target sequence
cacatcggtcggtgaacgcggaag

SEQ ID NO: 59606 - DNA, 24 bp, Artificial sequence
  SiRNA target sequence
acatcggtcggtgaacgcggaaga

SEQ ID NO: 59607 - DNA, 24 bp, Artificial sequence
  SiRNA target sequence
catcggtcggtgaacgcggaagat

SEQ ID NO: 59608 - DNA, 24 bp, Artificial sequence
  SiRNA target sequence
atcggtcggtgaacgcggaagatt

SEQ ID NO: 59609 - DNA, 24 bp, Artificial sequence
  SiRNA target sequence
tcggtcggtgaacgcggaagattt

SEQ ID NO: 59610 - DNA, 24 bp, Artificial sequence
  SiRNA target sequence
cggtcggtgaacgcggaagatttt

SEQ ID NO: 59611 - DNA, 24 bp, Artificial sequence
  SiRNA target sequence
ggtcggtgaacgcggaagattttt

SEQ ID NO: 59612 - DNA, 24 bp, Artificial sequence
  SiRNA target sequence
gtcggtgaacgcggaagattttta

SEQ ID NO: 59613 - DNA, 24 bp, Artificial sequence
  SiRNA target sequence
tcggtgaacgcggaagatttttat

SEQ ID NO: 59614 - DNA, 24 bp, Artificial sequence
  SiRNA target sequence
cggtgaacgcggaagatttttatc

SEQ ID NO: 59615 - DNA, 24 bp, Artificial sequence
  SiRNA target sequence
ggtgaacgcggaagatttttatct

SEQ ID NO: 59616 - DNA, 24 bp, Artificial sequence
  SiRNA target sequence
gtgaacgcggaagatttttatctg

SEQ ID NO: 59617 - DNA, 24 bp, Artificial sequence
  SiRNA target sequence
tgaacgcggaagatttttatctgg

SEQ ID NO: 59618 - DNA, 24 bp, Artificial sequence
  SiRNA target sequence
gaacgcggaagatttttatctggt

SEQ ID NO: 59619 - DNA, 24 bp, Artificial sequence
  SiRNA target sequence
aacgcggaagatttttatctggtg

SEQ ID NO: 59620 - DNA, 24 bp, Artificial sequence
  SiRNA target sequence
acgcggaagatttttatctggtgg

SEQ ID NO: 59621 - DNA, 24 bp, Artificial sequence
  SiRNA target sequence
cgcggaagatttttatctggtggt

SEQ ID NO: 59622 - DNA, 24 bp, Artificial sequence
  SiRNA target sequence
gcggaagatttttatctggtggtg

SEQ ID NO: 59623 - DNA, 24 bp, Artificial sequence
  SiRNA target sequence
cggaagatttttatctggtggtga

SEQ ID NO: 59624 - DNA, 24 bp, Artificial sequence
  SiRNA target sequence
ggaagatttttatctggtggtgaa

SEQ ID NO: 59625 - DNA, 24 bp, Artificial sequence
  SiRNA target sequence
gaagatttttatctggtggtgaaa

SEQ ID NO: 59626 - DNA, 24 bp, Artificial sequence
  SiRNA target sequence
aagatttttatctggtggtgaaag

SEQ ID NO: 59627 - DNA, 24 bp, Artificial sequence
  SiRNA target sequence
agatttttatctggtggtgaaagg

SEQ ID NO: 59628 - DNA, 24 bp, Artificial sequence
  SiRNA target sequence
gatttttatctggtggtgaaaggc

SEQ ID NO: 59629 - DNA, 24 bp, Artificial sequence
  SiRNA target sequence
atttttatctggtggtgaaaggca

SEQ ID NO: 59630 - DNA, 24 bp, Artificial sequence
  SiRNA target sequence
tttttatctggtggtgaaaggcaa

SEQ ID NO: 59631 - DNA, 24 bp, Artificial sequence
  SiRNA target sequence
ttttatctggtggtgaaaggcaaa

SEQ ID NO: 59632 - DNA, 24 bp, Artificial sequence
  SiRNA target sequence
tttatctggtggtgaaaggcaaaa

SEQ ID NO: 59633 - DNA, 24 bp, Artificial sequence
  SiRNA target sequence
ttatctggtggtgaaaggcaaaaa

SEQ ID NO: 59634 - DNA, 24 bp, Artificial sequence
  SiRNA target sequence
tatctggtggtgaaaggcaaaaaa

SEQ ID NO: 59635 - DNA, 24 bp, Artificial sequence
  SiRNA target sequence
atctggtggtgaaaggcaaaaaat

SEQ ID NO: 59636 - DNA, 24 bp, Artificial sequence
  SiRNA target sequence
tctggtggtgaaaggcaaaaaatt

SEQ ID NO: 59637 - DNA, 24 bp, Artificial sequence
  SiRNA target sequence
ctggtggtgaaaggcaaaaaatta

SEQ ID NO: 59638 - DNA, 24 bp, Artificial sequence
  SiRNA target sequence
tggtggtgaaaggcaaaaaattat

SEQ ID NO: 59639 - DNA, 24 bp, Artificial sequence
  SiRNA target sequence
ggtggtgaaaggcaaaaaattatg

SEQ ID NO: 59640 - DNA, 24 bp, Artificial sequence
  SiRNA target sequence
gtggtgaaaggcaaaaaattatgc

SEQ ID NO: 59641 - DNA, 24 bp, Artificial sequence
  SiRNA target sequence
tggtgaaaggcaaaaaattatgct

SEQ ID NO: 59642 - DNA, 24 bp, Artificial sequence
  SiRNA target sequence
ggtgaaaggcaaaaaattatgctg

SEQ ID NO: 59643 - DNA, 24 bp, Artificial sequence
  SiRNA target sequence
gtgaaaggcaaaaaattatgctga

SEQ ID NO: 59644 - DNA, 24 bp, Artificial sequence
  SiRNA target sequence
tgaaaggcaaaaaattatgctgat

SEQ ID NO: 59645 - DNA, 24 bp, Artificial sequence
  SiRNA target sequence
gaaaggcaaaaaattatgctgatg

SEQ ID NO: 59646 - DNA, 24 bp, Artificial sequence
  SiRNA target sequence
aaaggcaaaaaattatgctgatgc

SEQ ID NO: 59647 - DNA, 24 bp, Artificial sequence
  SiRNA target sequence
aaggcaaaaaattatgctgatgcg

SEQ ID NO: 59648 - DNA, 24 bp, Artificial sequence
  SiRNA target sequence
aggcaaaaaattatgctgatgcgt

SEQ ID NO: 59649 - DNA, 24 bp, Artificial sequence
  SiRNA target sequence
ggcaaaaaattatgctgatgcgtg

SEQ ID NO: 59650 - DNA, 24 bp, Artificial sequence
  SiRNA target sequence
gcaaaaaattatgctgatgcgtgc

SEQ ID NO: 59651 - DNA, 24 bp, Artificial sequence
  SiRNA target sequence
caaaaaattatgctgatgcgtgca

SEQ ID NO: 59652 - DNA, 24 bp, Artificial sequence
  SiRNA target sequence
aaaaaattatgctgatgcgtgcat

SEQ ID NO: 59653 - DNA, 24 bp, Artificial sequence
  SiRNA target sequence
aaaaattatgctgatgcgtgcatt

SEQ ID NO: 59654 - DNA, 24 bp, Artificial sequence
  SiRNA target sequence
aaaattatgctgatgcgtgcattg

SEQ ID NO: 59655 - DNA, 24 bp, Artificial sequence
  SiRNA target sequence
aaattatgctgatgcgtgcattgc

SEQ ID NO: 59656 - DNA, 24 bp, Artificial sequence
  SiRNA target sequence
aattatgctgatgcgtgcattgct

SEQ ID NO: 59657 - DNA, 24 bp, Artificial sequence
  SiRNA target sequence
attatgctgatgcgtgcattgctt

SEQ ID NO: 59658 - DNA, 24 bp, Artificial sequence
  SiRNA target sequence
ttatgctgatgcgtgcattgctta

SEQ ID NO: 59659 - DNA, 24 bp, Artificial sequence
  SiRNA target sequence
tatgctgatgcgtgcattgcttaa

SEQ ID NO: 59660 - DNA, 24 bp, Artificial sequence
  SiRNA target sequence
atgctgatgcgtgcattgcttaaa

SEQ ID NO: 59661 - DNA, 24 bp, Artificial sequence
  SiRNA target sequence
tgctgatgcgtgcattgcttaaaa

SEQ ID NO: 59662 - DNA, 24 bp, Artificial sequence
  SiRNA target sequence
gctgatgcgtgcattgcttaaaaa

SEQ ID NO: 59663 - DNA, 24 bp, Artificial sequence
  SiRNA target sequence
ctgatgcgtgcattgcttaaaaat

SEQ ID NO: 59664 - DNA, 24 bp, Artificial sequence
  SiRNA target sequence
tgatgcgtgcattgcttaaaaatt

SEQ ID NO: 59665 - DNA, 24 bp, Artificial sequence
  SiRNA target sequence
gatgcgtgcattgcttaaaaattc

SEQ ID NO: 59666 - DNA, 24 bp, Artificial sequence
  SiRNA target sequence
atgcgtgcattgcttaaaaattca

SEQ ID NO: 59667 - DNA, 24 bp, Artificial sequence
  SiRNA target sequence
tgcgtgcattgcttaaaaattcag

SEQ ID NO: 59668 - DNA, 24 bp, Artificial sequence
  SiRNA target sequence
gcgtgcattgcttaaaaattcaga

SEQ ID NO: 59669 - DNA, 24 bp, Artificial sequence
  SiRNA target sequence
cgtgcattgcttaaaaattcagag

SEQ ID NO: 59670 - DNA, 24 bp, Artificial sequence
  SiRNA target sequence
gtgcattgcttaaaaattcagaga

SEQ ID NO: 59671 - DNA, 24 bp, Artificial sequence
  SiRNA target sequence
tgcattgcttaaaaattcagagat

SEQ ID NO: 59672 - DNA, 24 bp, Artificial sequence
  SiRNA target sequence
gcattgcttaaaaattcagagatc

SEQ ID NO: 59673 - DNA, 24 bp, Artificial sequence
  SiRNA target sequence
cattgcttaaaaattcagagatcg

SEQ ID NO: 59674 - DNA, 24 bp, Artificial sequence
  SiRNA target sequence
attgcttaaaaattcagagatcgt

SEQ ID NO: 59675 - DNA, 24 bp, Artificial sequence
  SiRNA target sequence
ttgcttaaaaattcagagatcgtt

SEQ ID NO: 59676 - DNA, 24 bp, Artificial sequence
  SiRNA target sequence
tgcttaaaaattcagagatcgttt

SEQ ID NO: 59677 - DNA, 24 bp, Artificial sequence
  SiRNA target sequence
gcttaaaaattcagagatcgtttt

SEQ ID NO: 59678 - DNA, 24 bp, Artificial sequence
  SiRNA target sequence
cttaaaaattcagagatcgtttta

SEQ ID NO: 59679 - DNA, 24 bp, Artificial sequence
  SiRNA target sequence
ttaaaaattcagagatcgttttat

SEQ ID NO: 59680 - DNA, 24 bp, Artificial sequence
  SiRNA target sequence
taaaaattcagagatcgttttatt

SEQ ID NO: 59681 - DNA, 24 bp, Artificial sequence
  SiRNA target sequence
aaaaattcagagatcgttttatta

SEQ ID NO: 59682 - DNA, 24 bp, Artificial sequence
  SiRNA target sequence
aaaattcagagatcgttttattag

SEQ ID NO: 59683 - DNA, 24 bp, Artificial sequence
  SiRNA target sequence
aaattcagagatcgttttattaga

SEQ ID NO: 59684 - DNA, 24 bp, Artificial sequence
  SiRNA target sequence
aattcagagatcgttttattagac

SEQ ID NO: 59685 - DNA, 24 bp, Artificial sequence
  SiRNA target sequence
attcagagatcgttttattagacg

SEQ ID NO: 59686 - DNA, 24 bp, Artificial sequence
  SiRNA target sequence
ttcagagatcgttttattagacga

SEQ ID NO: 59687 - DNA, 24 bp, Artificial sequence
  SiRNA target sequence
tcagagatcgttttattagacgag

SEQ ID NO: 59688 - DNA, 24 bp, Artificial sequence
  SiRNA target sequence
cagagatcgttttattagacgagc

SEQ ID NO: 59689 - DNA, 24 bp, Artificial sequence
  SiRNA target sequence
agagatcgttttattagacgagcc

SEQ ID NO: 59690 - DNA, 24 bp, Artificial sequence
  SiRNA target sequence
gagatcgttttattagacgagcca

SEQ ID NO: 59691 - DNA, 24 bp, Artificial sequence
  SiRNA target sequence
agatcgttttattagacgagccaa

SEQ ID NO: 59692 - DNA, 24 bp, Artificial sequence
  SiRNA target sequence
gatcgttttattagacgagccaac

SEQ ID NO: 59693 - DNA, 24 bp, Artificial sequence
  SiRNA target sequence
atcgttttattagacgagccaacc

SEQ ID NO: 59694 - DNA, 24 bp, Artificial sequence
  SiRNA target sequence
tcgttttattagacgagccaacct

SEQ ID NO: 59695 - DNA, 24 bp, Artificial sequence
  SiRNA target sequence
cgttttattagacgagccaacctc

SEQ ID NO: 59696 - DNA, 24 bp, Artificial sequence
  SiRNA target sequence
gttttattagacgagccaacctca

SEQ ID NO: 59697 - DNA, 24 bp, Artificial sequence
  SiRNA target sequence
ttttattagacgagccaacctcag

SEQ ID NO: 59698 - DNA, 24 bp, Artificial sequence
  SiRNA target sequence
tttattagacgagccaacctcagc

SEQ ID NO: 59699 - DNA, 24 bp, Artificial sequence
  SiRNA target sequence
ttattagacgagccaacctcagca

SEQ ID NO: 59700 - DNA, 24 bp, Artificial sequence
  SiRNA target sequence
tattagacgagccaacctcagcac

SEQ ID NO: 59701 - DNA, 24 bp, Artificial sequence
  SiRNA target sequence
attagacgagccaacctcagcact

SEQ ID NO: 59702 - DNA, 24 bp, Artificial sequence
  SiRNA target sequence
ttagacgagccaacctcagcacta

SEQ ID NO: 59703 - DNA, 24 bp, Artificial sequence
  SiRNA target sequence
tagacgagccaacctcagcactag

SEQ ID NO: 59704 - DNA, 24 bp, Artificial sequence
  SiRNA target sequence
agacgagccaacctcagcactaga

SEQ ID NO: 59705 - DNA, 24 bp, Artificial sequence
  SiRNA target sequence
gacgagccaacctcagcactagat

SEQ ID NO: 59706 - DNA, 24 bp, Artificial sequence
  SiRNA target sequence
acgagccaacctcagcactagata

SEQ ID NO: 59707 - DNA, 24 bp, Artificial sequence
  SiRNA target sequence
cgagccaacctcagcactagataa

SEQ ID NO: 59708 - DNA, 24 bp, Artificial sequence
  SiRNA target sequence
gagccaacctcagcactagataaa

SEQ ID NO: 59709 - DNA, 24 bp, Artificial sequence
  SiRNA target sequence
agccaacctcagcactagataaaa

SEQ ID NO: 59710 - DNA, 24 bp, Artificial sequence
  SiRNA target sequence
gccaacctcagcactagataaaaa

SEQ ID NO: 59711 - DNA, 24 bp, Artificial sequence
  SiRNA target sequence
ccaacctcagcactagataaaaag

SEQ ID NO: 59712 - DNA, 24 bp, Artificial sequence
  SiRNA target sequence
caacctcagcactagataaaaaga

SEQ ID NO: 59713 - DNA, 24 bp, Artificial sequence
  SiRNA target sequence
aacctcagcactagataaaaagag

SEQ ID NO: 59714 - DNA, 24 bp, Artificial sequence
  SiRNA target sequence
acctcagcactagataaaaagagt

SEQ ID NO: 59715 - DNA, 24 bp, Artificial sequence
  SiRNA target sequence
cctcagcactagataaaaagagtg

SEQ ID NO: 59716 - DNA, 24 bp, Artificial sequence
  SiRNA target sequence
ctcagcactagataaaaagagtga

SEQ ID NO: 59717 - DNA, 24 bp, Artificial sequence
  SiRNA target sequence
tcagcactagataaaaagagtgaa

SEQ ID NO: 59718 - DNA, 24 bp, Artificial sequence
  SiRNA target sequence
cagcactagataaaaagagtgaac

SEQ ID NO: 59719 - DNA, 24 bp, Artificial sequence
  SiRNA target sequence
agcactagataaaaagagtgaact

SEQ ID NO: 59720 - DNA, 24 bp, Artificial sequence
  SiRNA target sequence
gcactagataaaaagagtgaacta

SEQ ID NO: 59721 - DNA, 24 bp, Artificial sequence
  SiRNA target sequence
cactagataaaaagagtgaactag

SEQ ID NO: 59722 - DNA, 24 bp, Artificial sequence
  SiRNA target sequence
actagataaaaagagtgaactaga

SEQ ID NO: 59723 - DNA, 24 bp, Artificial sequence
  SiRNA target sequence
ctagataaaaagagtgaactagaa

SEQ ID NO: 59724 - DNA, 24 bp, Artificial sequence
  SiRNA target sequence
tagataaaaagagtgaactagaaa

SEQ ID NO: 59725 - DNA, 24 bp, Artificial sequence
  SiRNA target sequence
agataaaaagagtgaactagaaac

SEQ ID NO: 59726 - DNA, 24 bp, Artificial sequence
  SiRNA target sequence
gataaaaagagtgaactagaaact

SEQ ID NO: 59727 - DNA, 24 bp, Artificial sequence
  SiRNA target sequence
ataaaaagagtgaactagaaacta

SEQ ID NO: 59728 - DNA, 24 bp, Artificial sequence
  SiRNA target sequence
taaaaagagtgaactagaaactat

SEQ ID NO: 59729 - DNA, 24 bp, Artificial sequence
  SiRNA target sequence
aaaaagagtgaactagaaactatg

SEQ ID NO: 59730 - DNA, 24 bp, Artificial sequence
  SiRNA target sequence
aaaagagtgaactagaaactatga

SEQ ID NO: 59731 - DNA, 24 bp, Artificial sequence
  SiRNA target sequence
aaagagtgaactagaaactatgac

SEQ ID NO: 59732 - DNA, 24 bp, Artificial sequence
  SiRNA target sequence
aagagtgaactagaaactatgaca

SEQ ID NO: 59733 - DNA, 24 bp, Artificial sequence
  SiRNA target sequence
agagtgaactagaaactatgacat

SEQ ID NO: 59734 - DNA, 24 bp, Artificial sequence
  SiRNA target sequence
gagtgaactagaaactatgacata

SEQ ID NO: 59735 - DNA, 24 bp, Artificial sequence
  SiRNA target sequence
agtgaactagaaactatgacatat

SEQ ID NO: 59736 - DNA, 24 bp, Artificial sequence
  SiRNA target sequence
gtgaactagaaactatgacatata

SEQ ID NO: 59737 - DNA, 24 bp, Artificial sequence
  SiRNA target sequence
tgaactagaaactatgacatatat

SEQ ID NO: 59738 - DNA, 24 bp, Artificial sequence
  SiRNA target sequence
gaactagaaactatgacatatatt

SEQ ID NO: 59739 - DNA, 24 bp, Artificial sequence
  SiRNA target sequence
aactagaaactatgacatatattt

SEQ ID NO: 59740 - DNA, 24 bp, Artificial sequence
  SiRNA target sequence
actagaaactatgacatatatttt

SEQ ID NO: 59741 - DNA, 24 bp, Artificial sequence
  SiRNA target sequence
ctagaaactatgacatatattttt

SEQ ID NO: 59742 - DNA, 24 bp, Artificial sequence
  SiRNA target sequence
tagaaactatgacatatattttta

SEQ ID NO: 59743 - DNA, 24 bp, Artificial sequence
  SiRNA target sequence
agaaactatgacatatatttttaa

SEQ ID NO: 59744 - DNA, 24 bp, Artificial sequence
  SiRNA target sequence
gaaactatgacatatatttttaat

SEQ ID NO: 59745 - DNA, 24 bp, Artificial sequence
  SiRNA target sequence
aaactatgacatatatttttaatg

SEQ ID NO: 59746 - DNA, 24 bp, Artificial sequence
  SiRNA target sequence
aactatgacatatatttttaatga

SEQ ID NO: 59747 - DNA, 24 bp, Artificial sequence
  SiRNA target sequence
actatgacatatatttttaatgaa

SEQ ID NO: 59748 - DNA, 24 bp, Artificial sequence
  SiRNA target sequence
ctatgacatatatttttaatgaat

SEQ ID NO: 59749 - DNA, 24 bp, Artificial sequence
  SiRNA target sequence
tatgacatatatttttaatgaatt

SEQ ID NO: 59750 - DNA, 24 bp, Artificial sequence
  SiRNA target sequence
atgacatatatttttaatgaattt

SEQ ID NO: 59751 - DNA, 24 bp, Artificial sequence
  SiRNA target sequence
tgacatatatttttaatgaattta

SEQ ID NO: 59752 - DNA, 24 bp, Artificial sequence
  SiRNA target sequence
gacatatatttttaatgaatttaa

SEQ ID NO: 59753 - DNA, 24 bp, Artificial sequence
  SiRNA target sequence
acatatatttttaatgaatttaag

SEQ ID NO: 59754 - DNA, 24 bp, Artificial sequence
  SiRNA target sequence
catatatttttaatgaatttaagt

SEQ ID NO: 59755 - DNA, 24 bp, Artificial sequence
  SiRNA target sequence
atatatttttaatgaatttaagta

SEQ ID NO: 59756 - DNA, 24 bp, Artificial sequence
  SiRNA target sequence
tatatttttaatgaatttaagtac

SEQ ID NO: 59757 - DNA, 24 bp, Artificial sequence
  SiRNA target sequence
atatttttaatgaatttaagtacc

SEQ ID NO: 59758 - DNA, 24 bp, Artificial sequence
  SiRNA target sequence
tatttttaatgaatttaagtacca

SEQ ID NO: 59759 - DNA, 24 bp, Artificial sequence
  SiRNA target sequence
atttttaatgaatttaagtaccat

SEQ ID NO: 59760 - DNA, 24 bp, Artificial sequence
  SiRNA target sequence
tttttaatgaatttaagtaccata

SEQ ID NO: 59761 - DNA, 24 bp, Artificial sequence
  SiRNA target sequence
ttttaatgaatttaagtaccatac

SEQ ID NO: 59762 - DNA, 24 bp, Artificial sequence
  SiRNA target sequence
tttaatgaatttaagtaccatact

SEQ ID NO: 59763 - DNA, 24 bp, Artificial sequence
  SiRNA target sequence
ttaatgaatttaagtaccatactt

SEQ ID NO: 59764 - DNA, 24 bp, Artificial sequence
  SiRNA target sequence
taatgaatttaagtaccatacttt

SEQ ID NO: 59765 - DNA, 24 bp, Artificial sequence
  SiRNA target sequence
aatgaatttaagtaccatactttt

SEQ ID NO: 59766 - DNA, 24 bp, Artificial sequence
  SiRNA target sequence
atgaatttaagtaccatacttttg

SEQ ID NO: 59767 - DNA, 24 bp, Artificial sequence
  SiRNA target sequence
tgaatttaagtaccatacttttgt

SEQ ID NO: 59768 - DNA, 24 bp, Artificial sequence
  SiRNA target sequence
gaatttaagtaccatacttttgta

SEQ ID NO: 59769 - DNA, 24 bp, Artificial sequence
  SiRNA target sequence
aatttaagtaccatacttttgtaa

SEQ ID NO: 59770 - DNA, 24 bp, Artificial sequence
  SiRNA target sequence
atttaagtaccatacttttgtaat

SEQ ID NO: 59771 - DNA, 24 bp, Artificial sequence
  SiRNA target sequence
tttaagtaccatacttttgtaata

SEQ ID NO: 59772 - DNA, 24 bp, Artificial sequence
  SiRNA target sequence
ttaagtaccatacttttgtaataa

SEQ ID NO: 59773 - DNA, 24 bp, Artificial sequence
  SiRNA target sequence
taagtaccatacttttgtaataat

SEQ ID NO: 59774 - DNA, 24 bp, Artificial sequence
  SiRNA target sequence
aagtaccatacttttgtaataatt

SEQ ID NO: 59775 - DNA, 24 bp, Artificial sequence
  SiRNA target sequence
agtaccatacttttgtaataattg

SEQ ID NO: 59776 - DNA, 24 bp, Artificial sequence
  SiRNA target sequence
gtaccatacttttgtaataattgt

SEQ ID NO: 59777 - DNA, 24 bp, Artificial sequence
  SiRNA target sequence
taccatacttttgtaataattgta

SEQ ID NO: 59778 - DNA, 24 bp, Artificial sequence
  SiRNA target sequence
accatacttttgtaataattgtac

SEQ ID NO: 59779 - DNA, 24 bp, Artificial sequence
  SiRNA target sequence
ccatacttttgtaataattgtaca

SEQ ID NO: 59780 - DNA, 24 bp, Artificial sequence
  SiRNA target sequence
catacttttgtaataattgtacac

SEQ ID NO: 59781 - DNA, 24 bp, Artificial sequence
  SiRNA target sequence
atacttttgtaataattgtacaca

SEQ ID NO: 59782 - DNA, 24 bp, Artificial sequence
  SiRNA target sequence
tacttttgtaataattgtacacaa

SEQ ID NO: 59783 - DNA, 24 bp, Artificial sequence
  SiRNA target sequence
acttttgtaataattgtacacaat

SEQ ID NO: 59784 - DNA, 24 bp, Artificial sequence
  SiRNA target sequence
cttttgtaataattgtacacaatc

SEQ ID NO: 59785 - DNA, 24 bp, Artificial sequence
  SiRNA target sequence
ttttgtaataattgtacacaatct

SEQ ID NO: 59786 - DNA, 24 bp, Artificial sequence
  SiRNA target sequence
tttgtaataattgtacacaatcta

SEQ ID NO: 59787 - DNA, 24 bp, Artificial sequence
  SiRNA target sequence
ttgtaataattgtacacaatctag

SEQ ID NO: 59788 - DNA, 24 bp, Artificial sequence
  SiRNA target sequence
tgtaataattgtacacaatctaga

SEQ ID NO: 59789 - DNA, 24 bp, Artificial sequence
  SiRNA target sequence
gtaataattgtacacaatctagaa

SEQ ID NO: 59790 - DNA, 24 bp, Artificial sequence
  SiRNA target sequence
taataattgtacacaatctagaat

SEQ ID NO: 59791 - DNA, 24 bp, Artificial sequence
  SiRNA target sequence
aataattgtacacaatctagaatt

SEQ ID NO: 59792 - DNA, 24 bp, Artificial sequence
  SiRNA target sequence
ataattgtacacaatctagaatta

SEQ ID NO: 59793 - DNA, 24 bp, Artificial sequence
  SiRNA target sequence
taattgtacacaatctagaattat

SEQ ID NO: 59794 - DNA, 24 bp, Artificial sequence
  SiRNA target sequence
aattgtacacaatctagaattatt

SEQ ID NO: 59795 - DNA, 24 bp, Artificial sequence
  SiRNA target sequence
attgtacacaatctagaattattg

SEQ ID NO: 59796 - DNA, 24 bp, Artificial sequence
  SiRNA target sequence
ttgtacacaatctagaattattgg

SEQ ID NO: 59797 - DNA, 24 bp, Artificial sequence
  SiRNA target sequence
tgtacacaatctagaattattggc

SEQ ID NO: 59798 - DNA, 24 bp, Artificial sequence
  SiRNA target sequence
gtacacaatctagaattattggct

SEQ ID NO: 59799 - DNA, 24 bp, Artificial sequence
  SiRNA target sequence
tacacaatctagaattattggctt

SEQ ID NO: 59800 - DNA, 24 bp, Artificial sequence
  SiRNA target sequence
acacaatctagaattattggcttt

SEQ ID NO: 59801 - DNA, 24 bp, Artificial sequence
  SiRNA target sequence
cacaatctagaattattggctttg

SEQ ID NO: 59802 - DNA, 24 bp, Artificial sequence
  SiRNA target sequence
acaatctagaattattggctttgt

SEQ ID NO: 59803 - DNA, 24 bp, Artificial sequence
  SiRNA target sequence
caatctagaattattggctttgtt

SEQ ID NO: 59804 - DNA, 24 bp, Artificial sequence
  SiRNA target sequence
aatctagaattattggctttgttt

SEQ ID NO: 59805 - DNA, 24 bp, Artificial sequence
  SiRNA target sequence
atctagaattattggctttgtttg

SEQ ID NO: 59806 - DNA, 24 bp, Artificial sequence
  SiRNA target sequence
tctagaattattggctttgtttga

SEQ ID NO: 59807 - DNA, 24 bp, Artificial sequence
  SiRNA target sequence
ctagaattattggctttgtttgat

SEQ ID NO: 59808 - DNA, 24 bp, Artificial sequence
  SiRNA target sequence
tagaattattggctttgtttgata

SEQ ID NO: 59809 - DNA, 24 bp, Artificial sequence
  SiRNA target sequence
agaattattggctttgtttgataa

SEQ ID NO: 59810 - DNA, 24 bp, Artificial sequence
  SiRNA target sequence
gaattattggctttgtttgataaa

SEQ ID NO: 59811 - DNA, 24 bp, Artificial sequence
  SiRNA target sequence
aattattggctttgtttgataaaa

SEQ ID NO: 59812 - DNA, 24 bp, Artificial sequence
  SiRNA target sequence
attattggctttgtttgataaaat

SEQ ID NO: 59813 - DNA, 24 bp, Artificial sequence
  SiRNA target sequence
ttattggctttgtttgataaaatt

SEQ ID NO: 59814 - DNA, 24 bp, Artificial sequence
  SiRNA target sequence
tattggctttgtttgataaaattt

SEQ ID NO: 59815 - DNA, 24 bp, Artificial sequence
  SiRNA target sequence
attggctttgtttgataaaatttt

SEQ ID NO: 59816 - DNA, 24 bp, Artificial sequence
  SiRNA target sequence
ttggctttgtttgataaaatttta

SEQ ID NO: 59817 - DNA, 24 bp, Artificial sequence
  SiRNA target sequence
tggctttgtttgataaaattttat

SEQ ID NO: 59818 - DNA, 24 bp, Artificial sequence
  SiRNA target sequence
ggctttgtttgataaaattttatt

SEQ ID NO: 59819 - DNA, 24 bp, Artificial sequence
  SiRNA target sequence
gctttgtttgataaaattttattt

SEQ ID NO: 59820 - DNA, 24 bp, Artificial sequence
  SiRNA target sequence
ctttgtttgataaaattttatttg

SEQ ID NO: 59821 - DNA, 24 bp, Artificial sequence
  SiRNA target sequence
tttgtttgataaaattttatttgt

SEQ ID NO: 59822 - DNA, 24 bp, Artificial sequence
  SiRNA target sequence
ttgtttgataaaattttatttgta

SEQ ID NO: 59823 - DNA, 24 bp, Artificial sequence
  SiRNA target sequence
tgtttgataaaattttatttgtaa

SEQ ID NO: 59824 - DNA, 24 bp, Artificial sequence
  SiRNA target sequence
gtttgataaaattttatttgtaaa

SEQ ID NO: 59825 - DNA, 24 bp, Artificial sequence
  SiRNA target sequence
tttgataaaattttatttgtaaat

SEQ ID NO: 59826 - DNA, 24 bp, Artificial sequence
  SiRNA target sequence
ttgataaaattttatttgtaaatg

SEQ ID NO: 59827 - DNA, 24 bp, Artificial sequence
  SiRNA target sequence
tgataaaattttatttgtaaatgg

SEQ ID NO: 59828 - DNA, 24 bp, Artificial sequence
  SiRNA target sequence
gataaaattttatttgtaaatggt

SEQ ID NO: 59829 - DNA, 24 bp, Artificial sequence
  SiRNA target sequence
ataaaattttatttgtaaatggta

SEQ ID NO: 59830 - DNA, 24 bp, Artificial sequence
  SiRNA target sequence
taaaattttatttgtaaatggtaa

SEQ ID NO: 59831 - DNA, 24 bp, Artificial sequence
  SiRNA target sequence
aaaattttatttgtaaatggtaat

SEQ ID NO: 59832 - DNA, 24 bp, Artificial sequence
  SiRNA target sequence
aaattttatttgtaaatggtaatg

SEQ ID NO: 59833 - DNA, 24 bp, Artificial sequence
  SiRNA target sequence
aattttatttgtaaatggtaatga

SEQ ID NO: 59834 - DNA, 24 bp, Artificial sequence
  SiRNA target sequence
attttatttgtaaatggtaatgag

SEQ ID NO: 59835 - DNA, 24 bp, Artificial sequence
  SiRNA target sequence
ttttatttgtaaatggtaatgagg

SEQ ID NO: 59836 - DNA, 24 bp, Artificial sequence
  SiRNA target sequence
tttatttgtaaatggtaatgaggt

SEQ ID NO: 59837 - DNA, 24 bp, Artificial sequence
  SiRNA target sequence
ttatttgtaaatggtaatgaggta

SEQ ID NO: 59838 - DNA, 24 bp, Artificial sequence
  SiRNA target sequence
tatttgtaaatggtaatgaggtaa

SEQ ID NO: 59839 - DNA, 24 bp, Artificial sequence
  SiRNA target sequence
atttgtaaatggtaatgaggtaac

SEQ ID NO: 59840 - DNA, 24 bp, Artificial sequence
  SiRNA target sequence
tttgtaaatggtaatgaggtaaca

SEQ ID NO: 59841 - DNA, 24 bp, Artificial sequence
  SiRNA target sequence
ttgtaaatggtaatgaggtaacaa

SEQ ID NO: 59842 - DNA, 24 bp, Artificial sequence
  SiRNA target sequence
tgtaaatggtaatgaggtaacaat

SEQ ID NO: 59843 - DNA, 24 bp, Artificial sequence
  SiRNA target sequence
gtaaatggtaatgaggtaacaatg

SEQ ID NO: 59844 - DNA, 24 bp, Artificial sequence
  SiRNA target sequence
taaatggtaatgaggtaacaatga

SEQ ID NO: 59845 - DNA, 24 bp, Artificial sequence
  SiRNA target sequence
aaatggtaatgaggtaacaatgat

SEQ ID NO: 59846 - DNA, 24 bp, Artificial sequence
  SiRNA target sequence
aatggtaatgaggtaacaatgata

SEQ ID NO: 59847 - DNA, 24 bp, Artificial sequence
  SiRNA target sequence
atggtaatgaggtaacaatgatag

SEQ ID NO: 59848 - DNA, 24 bp, Artificial sequence
  SiRNA target sequence
tggtaatgaggtaacaatgataga

SEQ ID NO: 59849 - DNA, 24 bp, Artificial sequence
  SiRNA target sequence
ggtaatgaggtaacaatgatagaa

SEQ ID NO: 59850 - DNA, 24 bp, Artificial sequence
  SiRNA target sequence
gtaatgaggtaacaatgatagaag

SEQ ID NO: 59851 - DNA, 24 bp, Artificial sequence
  SiRNA target sequence
taatgaggtaacaatgatagaaga

SEQ ID NO: 59852 - DNA, 24 bp, Artificial sequence
  SiRNA target sequence
aatgaggtaacaatgatagaagac

SEQ ID NO: 59853 - DNA, 24 bp, Artificial sequence
  SiRNA target sequence
atgaggtaacaatgatagaagaca

SEQ ID NO: 59854 - DNA, 24 bp, Artificial sequence
  SiRNA target sequence
tgaggtaacaatgatagaagacat

SEQ ID NO: 59855 - DNA, 24 bp, Artificial sequence
  SiRNA target sequence
gaggtaacaatgatagaagacatt

SEQ ID NO: 59856 - DNA, 24 bp, Artificial sequence
  SiRNA target sequence
aggtaacaatgatagaagacatta

SEQ ID NO: 59857 - DNA, 24 bp, Artificial sequence
  SiRNA target sequence
ggtaacaatgatagaagacattaa

SEQ ID NO: 59858 - DNA, 24 bp, Artificial sequence
  SiRNA target sequence
gtaacaatgatagaagacattaac

SEQ ID NO: 59859 - DNA, 24 bp, Artificial sequence
  SiRNA target sequence
taacaatgatagaagacattaaca

SEQ ID NO: 59860 - DNA, 24 bp, Artificial sequence
  SiRNA target sequence
aacaatgatagaagacattaacaa

SEQ ID NO: 59861 - DNA, 24 bp, Artificial sequence
  SiRNA target sequence
acaatgatagaagacattaacaaa

SEQ ID NO: 59862 - DNA, 24 bp, Artificial sequence
  SiRNA target sequence
caatgatagaagacattaacaaaa

SEQ ID NO: 59863 - DNA, 24 bp, Artificial sequence
  SiRNA target sequence
aatgatagaagacattaacaaaaa

SEQ ID NO: 59864 - DNA, 24 bp, Artificial sequence
  SiRNA target sequence
atgatagaagacattaacaaaaaa

SEQ ID NO: 59865 - DNA, 24 bp, Artificial sequence
  SiRNA target sequence
tgatagaagacattaacaaaaaac

SEQ ID NO: 59866 - DNA, 24 bp, Artificial sequence
  SiRNA target sequence
gatagaagacattaacaaaaaact

SEQ ID NO: 59867 - DNA, 24 bp, Artificial sequence
  SiRNA target sequence
atagaagacattaacaaaaaactt

SEQ ID NO: 59868 - DNA, 24 bp, Artificial sequence
  SiRNA target sequence
tagaagacattaacaaaaaacttg

SEQ ID NO: 59869 - DNA, 24 bp, Artificial sequence
  SiRNA target sequence
agaagacattaacaaaaaacttga

SEQ ID NO: 59870 - DNA, 24 bp, Artificial sequence
  SiRNA target sequence
gaagacattaacaaaaaacttgaa

SEQ ID NO: 59871 - DNA, 24 bp, Artificial sequence
  SiRNA target sequence
aagacattaacaaaaaacttgaag

SEQ ID NO: 59872 - DNA, 24 bp, Artificial sequence
  SiRNA target sequence
agacattaacaaaaaacttgaaga

SEQ ID NO: 59873 - DNA, 24 bp, Artificial sequence
  SiRNA target sequence
gacattaacaaaaaacttgaagaa

SEQ ID NO: 59874 - DNA, 24 bp, Artificial sequence
  SiRNA target sequence
acattaacaaaaaacttgaagaaa

SEQ ID NO: 59875 - DNA, 24 bp, Artificial sequence
  SiRNA target sequence
cattaacaaaaaacttgaagaaaa

SEQ ID NO: 59876 - DNA, 24 bp, Artificial sequence
  SiRNA target sequence
attaacaaaaaacttgaagaaaat

SEQ ID NO: 59877 - DNA, 24 bp, Artificial sequence
  SiRNA target sequence
ttaacaaaaaacttgaagaaaatt

SEQ ID NO: 59878 - DNA, 24 bp, Artificial sequence
  SiRNA target sequence
taacaaaaaacttgaagaaaattc

SEQ ID NO: 59879 - DNA, 24 bp, Artificial sequence
  SiRNA target sequence
aacaaaaaacttgaagaaaattca

SEQ ID NO: 59880 - DNA, 24 bp, Artificial sequence
  SiRNA target sequence
acaaaaaacttgaagaaaattcaa

SEQ ID NO: 59881 - DNA, 24 bp, Artificial sequence
  SiRNA target sequence
caaaaaacttgaagaaaattcaaa

SEQ ID NO: 59882 - DNA, 24 bp, Artificial sequence
  SiRNA target sequence
aaaaaacttgaagaaaattcaaag

SEQ ID NO: 59883 - DNA, 24 bp, Artificial sequence
  SiRNA target sequence
aaaaacttgaagaaaattcaaagt

SEQ ID NO: 59884 - DNA, 24 bp, Artificial sequence
  SiRNA target sequence
aaaacttgaagaaaattcaaagta

SEQ ID NO: 59885 - DNA, 24 bp, Artificial sequence
  SiRNA target sequence
aaacttgaagaaaattcaaagtat

SEQ ID NO: 59886 - DNA, 24 bp, Artificial sequence
  SiRNA target sequence
aacttgaagaaaattcaaagtatt

SEQ ID NO: 59887 - DNA, 24 bp, Artificial sequence
  SiRNA target sequence
acttgaagaaaattcaaagtattt

SEQ ID NO: 59888 - DNA, 24 bp, Artificial sequence
  SiRNA target sequence
cttgaagaaaattcaaagtatttt

SEQ ID NO: 59889 - DNA, 24 bp, Artificial sequence
  SiRNA target sequence
ttgaagaaaattcaaagtattttg

SEQ ID NO: 59890 - DNA, 24 bp, Artificial sequence
  SiRNA target sequence
tgaagaaaattcaaagtattttgc

SEQ ID NO: 59891 - DNA, 24 bp, Artificial sequence
  SiRNA target sequence
gaagaaaattcaaagtattttgca

SEQ ID NO: 59892 - DNA, 24 bp, Artificial sequence
  SiRNA target sequence
aagaaaattcaaagtattttgcag

SEQ ID NO: 59893 - DNA, 24 bp, Artificial sequence
  SiRNA target sequence
agaaaattcaaagtattttgcaga

SEQ ID NO: 59894 - DNA, 24 bp, Artificial sequence
  SiRNA target sequence
gaaaattcaaagtattttgcagat

SEQ ID NO: 59895 - DNA, 24 bp, Artificial sequence
  SiRNA target sequence
aaaattcaaagtattttgcagata

SEQ ID NO: 59896 - DNA, 24 bp, Artificial sequence
  SiRNA target sequence
aaattcaaagtattttgcagatat

SEQ ID NO: 59897 - DNA, 24 bp, Artificial sequence
  SiRNA target sequence
aattcaaagtattttgcagatatt

SEQ ID NO: 59898 - DNA, 24 bp, Artificial sequence
  SiRNA target sequence
attcaaagtattttgcagatattt

SEQ ID NO: 59899 - DNA, 24 bp, Artificial sequence
  SiRNA target sequence
ttcaaagtattttgcagatatttt

SEQ ID NO: 59900 - DNA, 24 bp, Artificial sequence
  SiRNA target sequence
tcaaagtattttgcagatatttta

SEQ ID NO: 59901 - DNA, 24 bp, Artificial sequence
  SiRNA target sequence
caaagtattttgcagatattttaa

SEQ ID NO: 59902 - DNA, 24 bp, Artificial sequence
  SiRNA target sequence
aaagtattttgcagatattttaaa

SEQ ID NO: 59903 - DNA, 24 bp, Artificial sequence
  SiRNA target sequence
aagtattttgcagatattttaaac

SEQ ID NO: 59904 - DNA, 24 bp, Artificial sequence
  SiRNA target sequence
agtattttgcagatattttaaaca

SEQ ID NO: 59905 - DNA, 24 bp, Artificial sequence
  SiRNA target sequence
gtattttgcagatattttaaacaa

SEQ ID NO: 59906 - DNA, 24 bp, Artificial sequence
  SiRNA target sequence
tattttgcagatattttaaacaac

SEQ ID NO: 59907 - DNA, 24 bp, Artificial sequence
  SiRNA target sequence
attttgcagatattttaaacaacg

SEQ ID NO: 59908 - DNA, 24 bp, Artificial sequence
  SiRNA target sequence
ttttgcagatattttaaacaacga

SEQ ID NO: 59909 - DNA, 24 bp, Artificial sequence
  SiRNA target sequence
tttgcagatattttaaacaacgaa

SEQ ID NO: 59910 - DNA, 24 bp, Artificial sequence
  SiRNA target sequence
ttgcagatattttaaacaacgaat

SEQ ID NO: 59911 - DNA, 24 bp, Artificial sequence
  SiRNA target sequence
tgcagatattttaaacaacgaata

SEQ ID NO: 59912 - DNA, 24 bp, Artificial sequence
  SiRNA target sequence
gcagatattttaaacaacgaataa

SEQ ID NO: 59913 - DNA, 25 bp, Artificial sequence
  SiRNA target sequence
atgaaggaaaaaaccaattatgaaa

SEQ ID NO: 59914 - DNA, 25 bp, Artificial sequence
  SiRNA target sequence
tgaaggaaaaaaccaattatgaaat

SEQ ID NO: 59915 - DNA, 25 bp, Artificial sequence
  SiRNA target sequence
gaaggaaaaaaccaattatgaaatt

SEQ ID NO: 59916 - DNA, 25 bp, Artificial sequence
  SiRNA target sequence
aaggaaaaaaccaattatgaaattt

SEQ ID NO: 59917 - DNA, 25 bp, Artificial sequence
  SiRNA target sequence
aggaaaaaaccaattatgaaatttt

SEQ ID NO: 59918 - DNA, 25 bp, Artificial sequence
  SiRNA target sequence
ggaaaaaaccaattatgaaatttta

SEQ ID NO: 59919 - DNA, 25 bp, Artificial sequence
  SiRNA target sequence
gaaaaaaccaattatgaaattttat

SEQ ID NO: 59920 - DNA, 25 bp, Artificial sequence
  SiRNA target sequence
aaaaaaccaattatgaaattttata

SEQ ID NO: 59921 - DNA, 25 bp, Artificial sequence
  SiRNA target sequence
aaaaaccaattatgaaattttatat

SEQ ID NO: 59922 - DNA, 25 bp, Artificial sequence
  SiRNA target sequence
aaaaccaattatgaaattttatatg

SEQ ID NO: 59923 - DNA, 25 bp, Artificial sequence
  SiRNA target sequence
aaaccaattatgaaattttatatga

SEQ ID NO: 59924 - DNA, 25 bp, Artificial sequence
  SiRNA target sequence
aaccaattatgaaattttatatgat

SEQ ID NO: 59925 - DNA, 25 bp, Artificial sequence
  SiRNA target sequence
accaattatgaaattttatatgata

SEQ ID NO: 59926 - DNA, 25 bp, Artificial sequence
  SiRNA target sequence
ccaattatgaaattttatatgatac

SEQ ID NO: 59927 - DNA, 25 bp, Artificial sequence
  SiRNA target sequence
caattatgaaattttatatgataca

SEQ ID NO: 59928 - DNA, 25 bp, Artificial sequence
  SiRNA target sequence
aattatgaaattttatatgatacat

SEQ ID NO: 59929 - DNA, 25 bp, Artificial sequence
  SiRNA target sequence
attatgaaattttatatgatacatt

SEQ ID NO: 59930 - DNA, 25 bp, Artificial sequence
  SiRNA target sequence
ttatgaaattttatatgatacattt

SEQ ID NO: 59931 - DNA, 25 bp, Artificial sequence
  SiRNA target sequence
tatgaaattttatatgatacatttg

SEQ ID NO: 59932 - DNA, 25 bp, Artificial sequence
  SiRNA target sequence
atgaaattttatatgatacatttgt

SEQ ID NO: 59933 - DNA, 25 bp, Artificial sequence
  SiRNA target sequence
tgaaattttatatgatacatttgta

SEQ ID NO: 59934 - DNA, 25 bp, Artificial sequence
  SiRNA target sequence
gaaattttatatgatacatttgtaa

SEQ ID NO: 59935 - DNA, 25 bp, Artificial sequence
  SiRNA target sequence
aaattttatatgatacatttgtaaa

SEQ ID NO: 59936 - DNA, 25 bp, Artificial sequence
  SiRNA target sequence
aattttatatgatacatttgtaaaa

SEQ ID NO: 59937 - DNA, 25 bp, Artificial sequence
  SiRNA target sequence
attttatatgatacatttgtaaaat

SEQ ID NO: 59938 - DNA, 25 bp, Artificial sequence
  SiRNA target sequence
ttttatatgatacatttgtaaaata

SEQ ID NO: 59939 - DNA, 25 bp, Artificial sequence
  SiRNA target sequence
tttatatgatacatttgtaaaatat

SEQ ID NO: 59940 - DNA, 25 bp, Artificial sequence
  SiRNA target sequence
ttatatgatacatttgtaaaatatt

SEQ ID NO: 59941 - DNA, 25 bp, Artificial sequence
  SiRNA target sequence
tatatgatacatttgtaaaatattg

SEQ ID NO: 59942 - DNA, 25 bp, Artificial sequence
  SiRNA target sequence
atatgatacatttgtaaaatattgt

SEQ ID NO: 59943 - DNA, 25 bp, Artificial sequence
  SiRNA target sequence
tatgatacatttgtaaaatattgtt

SEQ ID NO: 59944 - DNA, 25 bp, Artificial sequence
  SiRNA target sequence
atgatacatttgtaaaatattgtta

SEQ ID NO: 59945 - DNA, 25 bp, Artificial sequence
  SiRNA target sequence
tgatacatttgtaaaatattgttac

SEQ ID NO: 59946 - DNA, 25 bp, Artificial sequence
  SiRNA target sequence
gatacatttgtaaaatattgttaca

SEQ ID NO: 59947 - DNA, 25 bp, Artificial sequence
  SiRNA target sequence
atacatttgtaaaatattgttacaa

SEQ ID NO: 59948 - DNA, 25 bp, Artificial sequence
  SiRNA target sequence
tacatttgtaaaatattgttacaat

SEQ ID NO: 59949 - DNA, 25 bp, Artificial sequence
  SiRNA target sequence
acatttgtaaaatattgttacaata

SEQ ID NO: 59950 - DNA, 25 bp, Artificial sequence
  SiRNA target sequence
catttgtaaaatattgttacaatat

SEQ ID NO: 59951 - DNA, 25 bp, Artificial sequence
  SiRNA target sequence
atttgtaaaatattgttacaatatt

SEQ ID NO: 59952 - DNA, 25 bp, Artificial sequence
  SiRNA target sequence
tttgtaaaatattgttacaatattt

SEQ ID NO: 59953 - DNA, 25 bp, Artificial sequence
  SiRNA target sequence
ttgtaaaatattgttacaatatttc

SEQ ID NO: 59954 - DNA, 25 bp, Artificial sequence
  SiRNA target sequence
tgtaaaatattgttacaatatttcc

SEQ ID NO: 59955 - DNA, 25 bp, Artificial sequence
  SiRNA target sequence
gtaaaatattgttacaatatttcct

SEQ ID NO: 59956 - DNA, 25 bp, Artificial sequence
  SiRNA target sequence
taaaatattgttacaatatttccta

SEQ ID NO: 59957 - DNA, 25 bp, Artificial sequence
  SiRNA target sequence
aaaatattgttacaatatttcctat

SEQ ID NO: 59958 - DNA, 25 bp, Artificial sequence
  SiRNA target sequence
aaatattgttacaatatttcctata

SEQ ID NO: 59959 - DNA, 25 bp, Artificial sequence
  SiRNA target sequence
aatattgttacaatatttcctatat

SEQ ID NO: 59960 - DNA, 25 bp, Artificial sequence
  SiRNA target sequence
atattgttacaatatttcctatata

SEQ ID NO: 59961 - DNA, 25 bp, Artificial sequence
  SiRNA target sequence
tattgttacaatatttcctatataa

SEQ ID NO: 59962 - DNA, 25 bp, Artificial sequence
  SiRNA target sequence
attgttacaatatttcctatataag

SEQ ID NO: 59963 - DNA, 25 bp, Artificial sequence
  SiRNA target sequence
ttgttacaatatttcctatataagg

SEQ ID NO: 59964 - DNA, 25 bp, Artificial sequence
  SiRNA target sequence
tgttacaatatttcctatataaggt

SEQ ID NO: 59965 - DNA, 25 bp, Artificial sequence
  SiRNA target sequence
gttacaatatttcctatataaggta

SEQ ID NO: 59966 - DNA, 25 bp, Artificial sequence
  SiRNA target sequence
ttacaatatttcctatataaggtac

SEQ ID NO: 59967 - DNA, 25 bp, Artificial sequence
  SiRNA target sequence
tacaatatttcctatataaggtacg

SEQ ID NO: 59968 - DNA, 25 bp, Artificial sequence
  SiRNA target sequence
acaatatttcctatataaggtacgt

SEQ ID NO: 59969 - DNA, 25 bp, Artificial sequence
  SiRNA target sequence
caatatttcctatataaggtacgta

SEQ ID NO: 59970 - DNA, 25 bp, Artificial sequence
  SiRNA target sequence
aatatttcctatataaggtacgtaa

SEQ ID NO: 59971 - DNA, 25 bp, Artificial sequence
  SiRNA target sequence
atatttcctatataaggtacgtaat

SEQ ID NO: 59972 - DNA, 25 bp, Artificial sequence
  SiRNA target sequence
tatttcctatataaggtacgtaatg

SEQ ID NO: 59973 - DNA, 25 bp, Artificial sequence
  SiRNA target sequence
atttcctatataaggtacgtaatgt

SEQ ID NO: 59974 - DNA, 25 bp, Artificial sequence
  SiRNA target sequence
tttcctatataaggtacgtaatgtt

SEQ ID NO: 59975 - DNA, 25 bp, Artificial sequence
  SiRNA target sequence
ttcctatataaggtacgtaatgttt

SEQ ID NO: 59976 - DNA, 25 bp, Artificial sequence
  SiRNA target sequence
tcctatataaggtacgtaatgtttc

SEQ ID NO: 59977 - DNA, 25 bp, Artificial sequence
  SiRNA target sequence
cctatataaggtacgtaatgtttcc

SEQ ID NO: 59978 - DNA, 25 bp, Artificial sequence
  SiRNA target sequence
ctatataaggtacgtaatgtttccc

SEQ ID NO: 59979 - DNA, 25 bp, Artificial sequence
  SiRNA target sequence
tatataaggtacgtaatgtttccca

SEQ ID NO: 59980 - DNA, 25 bp, Artificial sequence
  SiRNA target sequence
atataaggtacgtaatgtttcccat

SEQ ID NO: 59981 - DNA, 25 bp, Artificial sequence
  SiRNA target sequence
tataaggtacgtaatgtttcccata

SEQ ID NO: 59982 - DNA, 25 bp, Artificial sequence
  SiRNA target sequence
ataaggtacgtaatgtttcccatat

SEQ ID NO: 59983 - DNA, 25 bp, Artificial sequence
  SiRNA target sequence
taaggtacgtaatgtttcccatatt

SEQ ID NO: 59984 - DNA, 25 bp, Artificial sequence
  SiRNA target sequence
aaggtacgtaatgtttcccatatta

SEQ ID NO: 59985 - DNA, 25 bp, Artificial sequence
  SiRNA target sequence
aggtacgtaatgtttcccatattac

SEQ ID NO: 59986 - DNA, 25 bp, Artificial sequence
  SiRNA target sequence
ggtacgtaatgtttcccatattact

SEQ ID NO: 59987 - DNA, 25 bp, Artificial sequence
  SiRNA target sequence
gtacgtaatgtttcccatattactg

SEQ ID NO: 59988 - DNA, 25 bp, Artificial sequence
  SiRNA target sequence
tacgtaatgtttcccatattactgt

SEQ ID NO: 59989 - DNA, 25 bp, Artificial sequence
  SiRNA target sequence
acgtaatgtttcccatattactgtc

SEQ ID NO: 59990 - DNA, 25 bp, Artificial sequence
  SiRNA target sequence
cgtaatgtttcccatattactgtct

SEQ ID NO: 59991 - DNA, 25 bp, Artificial sequence
  SiRNA target sequence
gtaatgtttcccatattactgtcta

SEQ ID NO: 59992 - DNA, 25 bp, Artificial sequence
  SiRNA target sequence
taatgtttcccatattactgtctac

SEQ ID NO: 59993 - DNA, 25 bp, Artificial sequence
  SiRNA target sequence
aatgtttcccatattactgtctaca

SEQ ID NO: 59994 - DNA, 25 bp, Artificial sequence
  SiRNA target sequence
atgtttcccatattactgtctacaa

SEQ ID NO: 59995 - DNA, 25 bp, Artificial sequence
  SiRNA target sequence
tgtttcccatattactgtctacaat

SEQ ID NO: 59996 - DNA, 25 bp, Artificial sequence
  SiRNA target sequence
gtttcccatattactgtctacaatt

SEQ ID NO: 59997 - DNA, 25 bp, Artificial sequence
  SiRNA target sequence
tttcccatattactgtctacaatta

SEQ ID NO: 59998 - DNA, 25 bp, Artificial sequence
  SiRNA target sequence
ttcccatattactgtctacaattat

SEQ ID NO: 59999 - DNA, 25 bp, Artificial sequence
  SiRNA target sequence
tcccatattactgtctacaattata

SEQ ID NO: 60000 - DNA, 25 bp, Artificial sequence
  SiRNA target sequence
cccatattactgtctacaattatag

SEQ ID NO: 60001 - DNA, 25 bp, Artificial sequence
  SiRNA target sequence
ccatattactgtctacaattatagc

SEQ ID NO: 60002 - DNA, 25 bp, Artificial sequence
  SiRNA target sequence
catattactgtctacaattatagct

SEQ ID NO: 60003 - DNA, 25 bp, Artificial sequence
  SiRNA target sequence
atattactgtctacaattatagctt

SEQ ID NO: 60004 - DNA, 25 bp, Artificial sequence
  SiRNA target sequence
tattactgtctacaattatagcttg

SEQ ID NO: 60005 - DNA, 25 bp, Artificial sequence
  SiRNA target sequence
attactgtctacaattatagcttgt

SEQ ID NO: 60006 - DNA, 25 bp, Artificial sequence
  SiRNA target sequence
ttactgtctacaattatagcttgtt

SEQ ID NO: 60007 - DNA, 25 bp, Artificial sequence
  SiRNA target sequence
tactgtctacaattatagcttgtta

SEQ ID NO: 60008 - DNA, 25 bp, Artificial sequence
  SiRNA target sequence
actgtctacaattatagcttgttat

SEQ ID NO: 60009 - DNA, 25 bp, Artificial sequence
  SiRNA target sequence
ctgtctacaattatagcttgttatc

SEQ ID NO: 60010 - DNA, 25 bp, Artificial sequence
  SiRNA target sequence
tgtctacaattatagcttgttatct

SEQ ID NO: 60011 - DNA, 25 bp, Artificial sequence
  SiRNA target sequence
gtctacaattatagcttgttatctc

SEQ ID NO: 60012 - DNA, 25 bp, Artificial sequence
  SiRNA target sequence
tctacaattatagcttgttatctcg

SEQ ID NO: 60013 - DNA, 25 bp, Artificial sequence
  SiRNA target sequence
ctacaattatagcttgttatctcga

SEQ ID NO: 60014 - DNA, 25 bp, Artificial sequence
  SiRNA target sequence
tacaattatagcttgttatctcgaa

SEQ ID NO: 60015 - DNA, 25 bp, Artificial sequence
  SiRNA target sequence
acaattatagcttgttatctcgaag

SEQ ID NO: 60016 - DNA, 25 bp, Artificial sequence
  SiRNA target sequence
caattatagcttgttatctcgaagt

SEQ ID NO: 60017 - DNA, 25 bp, Artificial sequence
  SiRNA target sequence
aattatagcttgttatctcgaagtt

SEQ ID NO: 60018 - DNA, 25 bp, Artificial sequence
  SiRNA target sequence
attatagcttgttatctcgaagttc

SEQ ID NO: 60019 - DNA, 25 bp, Artificial sequence
  SiRNA target sequence
ttatagcttgttatctcgaagttca

SEQ ID NO: 60020 - DNA, 25 bp, Artificial sequence
  SiRNA target sequence
tatagcttgttatctcgaagttcag

SEQ ID NO: 60021 - DNA, 25 bp, Artificial sequence
  SiRNA target sequence
atagcttgttatctcgaagttcagg

SEQ ID NO: 60022 - DNA, 25 bp, Artificial sequence
  SiRNA target sequence
tagcttgttatctcgaagttcaggc

SEQ ID NO: 60023 - DNA, 25 bp, Artificial sequence
  SiRNA target sequence
agcttgttatctcgaagttcaggca

SEQ ID NO: 60024 - DNA, 25 bp, Artificial sequence
  SiRNA target sequence
gcttgttatctcgaagttcaggcaa

SEQ ID NO: 60025 - DNA, 25 bp, Artificial sequence
  SiRNA target sequence
cttgttatctcgaagttcaggcaag

SEQ ID NO: 60026 - DNA, 25 bp, Artificial sequence
  SiRNA target sequence
ttgttatctcgaagttcaggcaagt

SEQ ID NO: 60027 - DNA, 25 bp, Artificial sequence
  SiRNA target sequence
tgttatctcgaagttcaggcaagta

SEQ ID NO: 60028 - DNA, 25 bp, Artificial sequence
  SiRNA target sequence
gttatctcgaagttcaggcaagtaa

SEQ ID NO: 60029 - DNA, 25 bp, Artificial sequence
  SiRNA target sequence
ttatctcgaagttcaggcaagtaac

SEQ ID NO: 60030 - DNA, 25 bp, Artificial sequence
  SiRNA target sequence
tatctcgaagttcaggcaagtaaca

SEQ ID NO: 60031 - DNA, 25 bp, Artificial sequence
  SiRNA target sequence
atctcgaagttcaggcaagtaacat

SEQ ID NO: 60032 - DNA, 25 bp, Artificial sequence
  SiRNA target sequence
tctcgaagttcaggcaagtaacata

SEQ ID NO: 60033 - DNA, 25 bp, Artificial sequence
  SiRNA target sequence
ctcgaagttcaggcaagtaacatat

SEQ ID NO: 60034 - DNA, 25 bp, Artificial sequence
  SiRNA target sequence
tcgaagttcaggcaagtaacatatc

SEQ ID NO: 60035 - DNA, 25 bp, Artificial sequence
  SiRNA target sequence
cgaagttcaggcaagtaacatatca

SEQ ID NO: 60036 - DNA, 25 bp, Artificial sequence
  SiRNA target sequence
gaagttcaggcaagtaacatatcaa

SEQ ID NO: 60037 - DNA, 25 bp, Artificial sequence
  SiRNA target sequence
aagttcaggcaagtaacatatcaaa

SEQ ID NO: 60038 - DNA, 25 bp, Artificial sequence
  SiRNA target sequence
agttcaggcaagtaacatatcaaaa

SEQ ID NO: 60039 - DNA, 25 bp, Artificial sequence
  SiRNA target sequence
gttcaggcaagtaacatatcaaaaa

SEQ ID NO: 60040 - DNA, 25 bp, Artificial sequence
  SiRNA target sequence
ttcaggcaagtaacatatcaaaaag

SEQ ID NO: 60041 - DNA, 25 bp, Artificial sequence
  SiRNA target sequence
tcaggcaagtaacatatcaaaaaga

SEQ ID NO: 60042 - DNA, 25 bp, Artificial sequence
  SiRNA target sequence
caggcaagtaacatatcaaaaagaa

SEQ ID NO: 60043 - DNA, 25 bp, Artificial sequence
  SiRNA target sequence
aggcaagtaacatatcaaaaagaat

SEQ ID NO: 60044 - DNA, 25 bp, Artificial sequence
  SiRNA target sequence
ggcaagtaacatatcaaaaagaatt

SEQ ID NO: 60045 - DNA, 25 bp, Artificial sequence
  SiRNA target sequence
gcaagtaacatatcaaaaagaattg

SEQ ID NO: 60046 - DNA, 25 bp, Artificial sequence
  SiRNA target sequence
caagtaacatatcaaaaagaattgc

SEQ ID NO: 60047 - DNA, 25 bp, Artificial sequence
  SiRNA target sequence
aagtaacatatcaaaaagaattgca

SEQ ID NO: 60048 - DNA, 25 bp, Artificial sequence
  SiRNA target sequence
agtaacatatcaaaaagaattgcag

SEQ ID NO: 60049 - DNA, 25 bp, Artificial sequence
  SiRNA target sequence
gtaacatatcaaaaagaattgcaga

SEQ ID NO: 60050 - DNA, 25 bp, Artificial sequence
  SiRNA target sequence
taacatatcaaaaagaattgcagaa

SEQ ID NO: 60051 - DNA, 25 bp, Artificial sequence
  SiRNA target sequence
aacatatcaaaaagaattgcagaag

SEQ ID NO: 60052 - DNA, 25 bp, Artificial sequence
  SiRNA target sequence
acatatcaaaaagaattgcagaaga

SEQ ID NO: 60053 - DNA, 25 bp, Artificial sequence
  SiRNA target sequence
catatcaaaaagaattgcagaagat

SEQ ID NO: 60054 - DNA, 25 bp, Artificial sequence
  SiRNA target sequence
atatcaaaaagaattgcagaagatt

SEQ ID NO: 60055 - DNA, 25 bp, Artificial sequence
  SiRNA target sequence
tatcaaaaagaattgcagaagattt

SEQ ID NO: 60056 - DNA, 25 bp, Artificial sequence
  SiRNA target sequence
atcaaaaagaattgcagaagatttt

SEQ ID NO: 60057 - DNA, 25 bp, Artificial sequence
  SiRNA target sequence
tcaaaaagaattgcagaagattttg

SEQ ID NO: 60058 - DNA, 25 bp, Artificial sequence
  SiRNA target sequence
caaaaagaattgcagaagattttga

SEQ ID NO: 60059 - DNA, 25 bp, Artificial sequence
  SiRNA target sequence
aaaaagaattgcagaagattttgaa

SEQ ID NO: 60060 - DNA, 25 bp, Artificial sequence
  SiRNA target sequence
aaaagaattgcagaagattttgaaa

SEQ ID NO: 60061 - DNA, 25 bp, Artificial sequence
  SiRNA target sequence
aaagaattgcagaagattttgaaaa

SEQ ID NO: 60062 - DNA, 25 bp, Artificial sequence
  SiRNA target sequence
aagaattgcagaagattttgaaaat

SEQ ID NO: 60063 - DNA, 25 bp, Artificial sequence
  SiRNA target sequence
agaattgcagaagattttgaaaata

SEQ ID NO: 60064 - DNA, 25 bp, Artificial sequence
  SiRNA target sequence
gaattgcagaagattttgaaaataa

SEQ ID NO: 60065 - DNA, 25 bp, Artificial sequence
  SiRNA target sequence
aattgcagaagattttgaaaataaa

SEQ ID NO: 60066 - DNA, 25 bp, Artificial sequence
  SiRNA target sequence
attgcagaagattttgaaaataaaa

SEQ ID NO: 60067 - DNA, 25 bp, Artificial sequence
  SiRNA target sequence
ttgcagaagattttgaaaataaaat

SEQ ID NO: 60068 - DNA, 25 bp, Artificial sequence
  SiRNA target sequence
tgcagaagattttgaaaataaaata

SEQ ID NO: 60069 - DNA, 25 bp, Artificial sequence
  SiRNA target sequence
gcagaagattttgaaaataaaataa

SEQ ID NO: 60070 - DNA, 25 bp, Artificial sequence
  SiRNA target sequence
cagaagattttgaaaataaaataaa

SEQ ID NO: 60071 - DNA, 25 bp, Artificial sequence
  SiRNA target sequence
agaagattttgaaaataaaataaat

SEQ ID NO: 60072 - DNA, 25 bp, Artificial sequence
  SiRNA target sequence
gaagattttgaaaataaaataaatg

SEQ ID NO: 60073 - DNA, 25 bp, Artificial sequence
  SiRNA target sequence
aagattttgaaaataaaataaatgc

SEQ ID NO: 60074 - DNA, 25 bp, Artificial sequence
  SiRNA target sequence
agattttgaaaataaaataaatgca

SEQ ID NO: 60075 - DNA, 25 bp, Artificial sequence
  SiRNA target sequence
gattttgaaaataaaataaatgcag

SEQ ID NO: 60076 - DNA, 25 bp, Artificial sequence
  SiRNA target sequence
attttgaaaataaaataaatgcagg

SEQ ID NO: 60077 - DNA, 25 bp, Artificial sequence
  SiRNA target sequence
ttttgaaaataaaataaatgcagga

SEQ ID NO: 60078 - DNA, 25 bp, Artificial sequence
  SiRNA target sequence
tttgaaaataaaataaatgcaggaa

SEQ ID NO: 60079 - DNA, 25 bp, Artificial sequence
  SiRNA target sequence
ttgaaaataaaataaatgcaggaaa

SEQ ID NO: 60080 - DNA, 25 bp, Artificial sequence
  SiRNA target sequence
tgaaaataaaataaatgcaggaaaa

SEQ ID NO: 60081 - DNA, 25 bp, Artificial sequence
  SiRNA target sequence
gaaaataaaataaatgcaggaaaaa

SEQ ID NO: 60082 - DNA, 25 bp, Artificial sequence
  SiRNA target sequence
aaaataaaataaatgcaggaaaaag

SEQ ID NO: 60083 - DNA, 25 bp, Artificial sequence
  SiRNA target sequence
aaataaaataaatgcaggaaaaagt

SEQ ID NO: 60084 - DNA, 25 bp, Artificial sequence
  SiRNA target sequence
aataaaataaatgcaggaaaaagta

SEQ ID NO: 60085 - DNA, 25 bp, Artificial sequence
  SiRNA target sequence
ataaaataaatgcaggaaaaagtat

SEQ ID NO: 60086 - DNA, 25 bp, Artificial sequence
  SiRNA target sequence
taaaataaatgcaggaaaaagtata

SEQ ID NO: 60087 - DNA, 25 bp, Artificial sequence
  SiRNA target sequence
aaaataaatgcaggaaaaagtatat

SEQ ID NO: 60088 - DNA, 25 bp, Artificial sequence
  SiRNA target sequence
aaataaatgcaggaaaaagtatatt

SEQ ID NO: 60089 - DNA, 25 bp, Artificial sequence
  SiRNA target sequence
aataaatgcaggaaaaagtatattt

SEQ ID NO: 60090 - DNA, 25 bp, Artificial sequence
  SiRNA target sequence
ataaatgcaggaaaaagtatattta

SEQ ID NO: 60091 - DNA, 25 bp, Artificial sequence
  SiRNA target sequence
taaatgcaggaaaaagtatatttaa

SEQ ID NO: 60092 - DNA, 25 bp, Artificial sequence
  SiRNA target sequence
aaatgcaggaaaaagtatatttaaa

SEQ ID NO: 60093 - DNA, 25 bp, Artificial sequence
  SiRNA target sequence
aatgcaggaaaaagtatatttaaat

SEQ ID NO: 60094 - DNA, 25 bp, Artificial sequence
  SiRNA target sequence
atgcaggaaaaagtatatttaaata

SEQ ID NO: 60095 - DNA, 25 bp, Artificial sequence
  SiRNA target sequence
tgcaggaaaaagtatatttaaatat

SEQ ID NO: 60096 - DNA, 25 bp, Artificial sequence
  SiRNA target sequence
gcaggaaaaagtatatttaaatata

SEQ ID NO: 60097 - DNA, 25 bp, Artificial sequence
  SiRNA target sequence
caggaaaaagtatatttaaatatat

SEQ ID NO: 60098 - DNA, 25 bp, Artificial sequence
  SiRNA target sequence
aggaaaaagtatatttaaatatatt

SEQ ID NO: 60099 - DNA, 25 bp, Artificial sequence
  SiRNA target sequence
ggaaaaagtatatttaaatatattt

SEQ ID NO: 60100 - DNA, 25 bp, Artificial sequence
  SiRNA target sequence
gaaaaagtatatttaaatatatttt

SEQ ID NO: 60101 - DNA, 25 bp, Artificial sequence
  SiRNA target sequence
aaaaagtatatttaaatatatttta

SEQ ID NO: 60102 - DNA, 25 bp, Artificial sequence
  SiRNA target sequence
aaaagtatatttaaatatattttat

SEQ ID NO: 60103 - DNA, 25 bp, Artificial sequence
  SiRNA target sequence
aaagtatatttaaatatattttatt

SEQ ID NO: 60104 - DNA, 25 bp, Artificial sequence
  SiRNA target sequence
aagtatatttaaatatattttattt

SEQ ID NO: 60105 - DNA, 25 bp, Artificial sequence
  SiRNA target sequence
agtatatttaaatatattttatttt

SEQ ID NO: 60106 - DNA, 25 bp, Artificial sequence
  SiRNA target sequence
gtatatttaaatatattttattttt

SEQ ID NO: 60107 - DNA, 25 bp, Artificial sequence
  SiRNA target sequence
tatatttaaatatattttattttta

SEQ ID NO: 60108 - DNA, 25 bp, Artificial sequence
  SiRNA target sequence
atatttaaatatattttatttttaa

SEQ ID NO: 60109 - DNA, 25 bp, Artificial sequence
  SiRNA target sequence
tatttaaatatattttatttttaac

SEQ ID NO: 60110 - DNA, 25 bp, Artificial sequence
  SiRNA target sequence
atttaaatatattttatttttaact

SEQ ID NO: 60111 - DNA, 25 bp, Artificial sequence
  SiRNA target sequence
tttaaatatattttatttttaactt

SEQ ID NO: 60112 - DNA, 25 bp, Artificial sequence
  SiRNA target sequence
ttaaatatattttatttttaacttc

SEQ ID NO: 60113 - DNA, 25 bp, Artificial sequence
  SiRNA target sequence
taaatatattttatttttaacttca

SEQ ID NO: 60114 - DNA, 25 bp, Artificial sequence
  SiRNA target sequence
aaatatattttatttttaacttcat

SEQ ID NO: 60115 - DNA, 25 bp, Artificial sequence
  SiRNA target sequence
aatatattttatttttaacttcatc

SEQ ID NO: 60116 - DNA, 25 bp, Artificial sequence
  SiRNA target sequence
atatattttatttttaacttcatca

SEQ ID NO: 60117 - DNA, 25 bp, Artificial sequence
  SiRNA target sequence
tatattttatttttaacttcatcaa

SEQ ID NO: 60118 - DNA, 25 bp, Artificial sequence
  SiRNA target sequence
atattttatttttaacttcatcaat

SEQ ID NO: 60119 - DNA, 25 bp, Artificial sequence
  SiRNA target sequence
tattttatttttaacttcatcaata

SEQ ID NO: 60120 - DNA, 25 bp, Artificial sequence
  SiRNA target sequence
attttatttttaacttcatcaatag

SEQ ID NO: 60121 - DNA, 25 bp, Artificial sequence
  SiRNA target sequence
ttttatttttaacttcatcaatagt

SEQ ID NO: 60122 - DNA, 25 bp, Artificial sequence
  SiRNA target sequence
tttatttttaacttcatcaatagta

SEQ ID NO: 60123 - DNA, 25 bp, Artificial sequence
  SiRNA target sequence
ttatttttaacttcatcaatagtat

SEQ ID NO: 60124 - DNA, 25 bp, Artificial sequence
  SiRNA target sequence
tatttttaacttcatcaatagtatt

SEQ ID NO: 60125 - DNA, 25 bp, Artificial sequence
  SiRNA target sequence
atttttaacttcatcaatagtatta

SEQ ID NO: 60126 - DNA, 25 bp, Artificial sequence
  SiRNA target sequence
tttttaacttcatcaatagtattaa

SEQ ID NO: 60127 - DNA, 25 bp, Artificial sequence
  SiRNA target sequence
ttttaacttcatcaatagtattaag

SEQ ID NO: 60128 - DNA, 25 bp, Artificial sequence
  SiRNA target sequence
tttaacttcatcaatagtattaaga

SEQ ID NO: 60129 - DNA, 25 bp, Artificial sequence
  SiRNA target sequence
ttaacttcatcaatagtattaagac

SEQ ID NO: 60130 - DNA, 25 bp, Artificial sequence
  SiRNA target sequence
taacttcatcaatagtattaagaca

SEQ ID NO: 60131 - DNA, 25 bp, Artificial sequence
  SiRNA target sequence
aacttcatcaatagtattaagacaa

SEQ ID NO: 60132 - DNA, 25 bp, Artificial sequence
  SiRNA target sequence
acttcatcaatagtattaagacaaa

SEQ ID NO: 60133 - DNA, 25 bp, Artificial sequence
  SiRNA target sequence
cttcatcaatagtattaagacaaat

SEQ ID NO: 60134 - DNA, 25 bp, Artificial sequence
  SiRNA target sequence
ttcatcaatagtattaagacaaatt

SEQ ID NO: 60135 - DNA, 25 bp, Artificial sequence
  SiRNA target sequence
tcatcaatagtattaagacaaatta

SEQ ID NO: 60136 - DNA, 25 bp, Artificial sequence
  SiRNA target sequence
catcaatagtattaagacaaattaa

SEQ ID NO: 60137 - DNA, 25 bp, Artificial sequence
  SiRNA target sequence
atcaatagtattaagacaaattaat

SEQ ID NO: 60138 - DNA, 25 bp, Artificial sequence
  SiRNA target sequence
tcaatagtattaagacaaattaatg

SEQ ID NO: 60139 - DNA, 25 bp, Artificial sequence
  SiRNA target sequence
caatagtattaagacaaattaatga

SEQ ID NO: 60140 - DNA, 25 bp, Artificial sequence
  SiRNA target sequence
aatagtattaagacaaattaatgat

SEQ ID NO: 60141 - DNA, 25 bp, Artificial sequence
  SiRNA target sequence
atagtattaagacaaattaatgata

SEQ ID NO: 60142 - DNA, 25 bp, Artificial sequence
  SiRNA target sequence
tagtattaagacaaattaatgatat

SEQ ID NO: 60143 - DNA, 25 bp, Artificial sequence
  SiRNA target sequence
agtattaagacaaattaatgatatt

SEQ ID NO: 60144 - DNA, 25 bp, Artificial sequence
  SiRNA target sequence
gtattaagacaaattaatgatattg

SEQ ID NO: 60145 - DNA, 25 bp, Artificial sequence
  SiRNA target sequence
tattaagacaaattaatgatattgt

SEQ ID NO: 60146 - DNA, 25 bp, Artificial sequence
  SiRNA target sequence
attaagacaaattaatgatattgtg

SEQ ID NO: 60147 - DNA, 25 bp, Artificial sequence
  SiRNA target sequence
ttaagacaaattaatgatattgtgt

SEQ ID NO: 60148 - DNA, 25 bp, Artificial sequence
  SiRNA target sequence
taagacaaattaatgatattgtgtt

SEQ ID NO: 60149 - DNA, 25 bp, Artificial sequence
  SiRNA target sequence
aagacaaattaatgatattgtgttt

SEQ ID NO: 60150 - DNA, 25 bp, Artificial sequence
  SiRNA target sequence
agacaaattaatgatattgtgttta

SEQ ID NO: 60151 - DNA, 25 bp, Artificial sequence
  SiRNA target sequence
gacaaattaatgatattgtgtttag

SEQ ID NO: 60152 - DNA, 25 bp, Artificial sequence
  SiRNA target sequence
acaaattaatgatattgtgtttagc

SEQ ID NO: 60153 - DNA, 25 bp, Artificial sequence
  SiRNA target sequence
caaattaatgatattgtgtttagcg

SEQ ID NO: 60154 - DNA, 25 bp, Artificial sequence
  SiRNA target sequence
aaattaatgatattgtgtttagcgg

SEQ ID NO: 60155 - DNA, 25 bp, Artificial sequence
  SiRNA target sequence
aattaatgatattgtgtttagcggg

SEQ ID NO: 60156 - DNA, 25 bp, Artificial sequence
  SiRNA target sequence
attaatgatattgtgtttagcgggc

SEQ ID NO: 60157 - DNA, 25 bp, Artificial sequence
  SiRNA target sequence
ttaatgatattgtgtttagcgggcc

SEQ ID NO: 60158 - DNA, 25 bp, Artificial sequence
  SiRNA target sequence
taatgatattgtgtttagcgggcca

SEQ ID NO: 60159 - DNA, 25 bp, Artificial sequence
  SiRNA target sequence
aatgatattgtgtttagcgggccaa

SEQ ID NO: 60160 - DNA, 25 bp, Artificial sequence
  SiRNA target sequence
atgatattgtgtttagcgggccaat

SEQ ID NO: 60161 - DNA, 25 bp, Artificial sequence
  SiRNA target sequence
tgatattgtgtttagcgggccaata

SEQ ID NO: 60162 - DNA, 25 bp, Artificial sequence
  SiRNA target sequence
gatattgtgtttagcgggccaatac

SEQ ID NO: 60163 - DNA, 25 bp, Artificial sequence
  SiRNA target sequence
atattgtgtttagcgggccaataca

SEQ ID NO: 60164 - DNA, 25 bp, Artificial sequence
  SiRNA target sequence
tattgtgtttagcgggccaatacaa

SEQ ID NO: 60165 - DNA, 25 bp, Artificial sequence
  SiRNA target sequence
attgtgtttagcgggccaatacaat

SEQ ID NO: 60166 - DNA, 25 bp, Artificial sequence
  SiRNA target sequence
ttgtgtttagcgggccaatacaatt

SEQ ID NO: 60167 - DNA, 25 bp, Artificial sequence
  SiRNA target sequence
tgtgtttagcgggccaatacaattt

SEQ ID NO: 60168 - DNA, 25 bp, Artificial sequence
  SiRNA target sequence
gtgtttagcgggccaatacaatttt

SEQ ID NO: 60169 - DNA, 25 bp, Artificial sequence
  SiRNA target sequence
tgtttagcgggccaatacaattttt

SEQ ID NO: 60170 - DNA, 25 bp, Artificial sequence
  SiRNA target sequence
gtttagcgggccaatacaattttta

SEQ ID NO: 60171 - DNA, 25 bp, Artificial sequence
  SiRNA target sequence
tttagcgggccaatacaatttttat

SEQ ID NO: 60172 - DNA, 25 bp, Artificial sequence
  SiRNA target sequence
ttagcgggccaatacaatttttata

SEQ ID NO: 60173 - DNA, 25 bp, Artificial sequence
  SiRNA target sequence
tagcgggccaatacaatttttatat

SEQ ID NO: 60174 - DNA, 25 bp, Artificial sequence
  SiRNA target sequence
agcgggccaatacaatttttatata

SEQ ID NO: 60175 - DNA, 25 bp, Artificial sequence
  SiRNA target sequence
gcgggccaatacaatttttatataa

SEQ ID NO: 60176 - DNA, 25 bp, Artificial sequence
  SiRNA target sequence
cgggccaatacaatttttatataaa

SEQ ID NO: 60177 - DNA, 25 bp, Artificial sequence
  SiRNA target sequence
gggccaatacaatttttatataaaa

SEQ ID NO: 60178 - DNA, 25 bp, Artificial sequence
  SiRNA target sequence
ggccaatacaatttttatataaaat

SEQ ID NO: 60179 - DNA, 25 bp, Artificial sequence
  SiRNA target sequence
gccaatacaatttttatataaaatt

SEQ ID NO: 60180 - DNA, 25 bp, Artificial sequence
  SiRNA target sequence
ccaatacaatttttatataaaattg

SEQ ID NO: 60181 - DNA, 25 bp, Artificial sequence
  SiRNA target sequence
caatacaatttttatataaaattgt

SEQ ID NO: 60182 - DNA, 25 bp, Artificial sequence
  SiRNA target sequence
aatacaatttttatataaaattgtt

SEQ ID NO: 60183 - DNA, 25 bp, Artificial sequence
  SiRNA target sequence
atacaatttttatataaaattgttg

SEQ ID NO: 60184 - DNA, 25 bp, Artificial sequence
  SiRNA target sequence
tacaatttttatataaaattgttgg

SEQ ID NO: 60185 - DNA, 25 bp, Artificial sequence
  SiRNA target sequence
acaatttttatataaaattgttgga

SEQ ID NO: 60186 - DNA, 25 bp, Artificial sequence
  SiRNA target sequence
caatttttatataaaattgttggag

SEQ ID NO: 60187 - DNA, 25 bp, Artificial sequence
  SiRNA target sequence
aatttttatataaaattgttggagt

SEQ ID NO: 60188 - DNA, 25 bp, Artificial sequence
  SiRNA target sequence
atttttatataaaattgttggagtt

SEQ ID NO: 60189 - DNA, 25 bp, Artificial sequence
  SiRNA target sequence
tttttatataaaattgttggagttg

SEQ ID NO: 60190 - DNA, 25 bp, Artificial sequence
  SiRNA target sequence
ttttatataaaattgttggagttga

SEQ ID NO: 60191 - DNA, 25 bp, Artificial sequence
  SiRNA target sequence
tttatataaaattgttggagttgaa

SEQ ID NO: 60192 - DNA, 25 bp, Artificial sequence
  SiRNA target sequence
ttatataaaattgttggagttgaag

SEQ ID NO: 60193 - DNA, 25 bp, Artificial sequence
  SiRNA target sequence
tatataaaattgttggagttgaagc

SEQ ID NO: 60194 - DNA, 25 bp, Artificial sequence
  SiRNA target sequence
atataaaattgttggagttgaagca

SEQ ID NO: 60195 - DNA, 25 bp, Artificial sequence
  SiRNA target sequence
tataaaattgttggagttgaagcat

SEQ ID NO: 60196 - DNA, 25 bp, Artificial sequence
  SiRNA target sequence
ataaaattgttggagttgaagcatt

SEQ ID NO: 60197 - DNA, 25 bp, Artificial sequence
  SiRNA target sequence
taaaattgttggagttgaagcattt

SEQ ID NO: 60198 - DNA, 25 bp, Artificial sequence
  SiRNA target sequence
aaaattgttggagttgaagcatttt

SEQ ID NO: 60199 - DNA, 25 bp, Artificial sequence
  SiRNA target sequence
aaattgttggagttgaagcatttta

SEQ ID NO: 60200 - DNA, 25 bp, Artificial sequence
  SiRNA target sequence
aattgttggagttgaagcattttat

SEQ ID NO: 60201 - DNA, 25 bp, Artificial sequence
  SiRNA target sequence
attgttggagttgaagcattttatc

SEQ ID NO: 60202 - DNA, 25 bp, Artificial sequence
  SiRNA target sequence
ttgttggagttgaagcattttatca

SEQ ID NO: 60203 - DNA, 25 bp, Artificial sequence
  SiRNA target sequence
tgttggagttgaagcattttatcat

SEQ ID NO: 60204 - DNA, 25 bp, Artificial sequence
  SiRNA target sequence
gttggagttgaagcattttatcatt

SEQ ID NO: 60205 - DNA, 25 bp, Artificial sequence
  SiRNA target sequence
ttggagttgaagcattttatcatta

SEQ ID NO: 60206 - DNA, 25 bp, Artificial sequence
  SiRNA target sequence
tggagttgaagcattttatcattac

SEQ ID NO: 60207 - DNA, 25 bp, Artificial sequence
  SiRNA target sequence
ggagttgaagcattttatcattaca

SEQ ID NO: 60208 - DNA, 25 bp, Artificial sequence
  SiRNA target sequence
gagttgaagcattttatcattacat

SEQ ID NO: 60209 - DNA, 25 bp, Artificial sequence
  SiRNA target sequence
agttgaagcattttatcattacatt

SEQ ID NO: 60210 - DNA, 25 bp, Artificial sequence
  SiRNA target sequence
gttgaagcattttatcattacattt

SEQ ID NO: 60211 - DNA, 25 bp, Artificial sequence
  SiRNA target sequence
ttgaagcattttatcattacatttc

SEQ ID NO: 60212 - DNA, 25 bp, Artificial sequence
  SiRNA target sequence
tgaagcattttatcattacatttca

SEQ ID NO: 60213 - DNA, 25 bp, Artificial sequence
  SiRNA target sequence
gaagcattttatcattacatttcat

SEQ ID NO: 60214 - DNA, 25 bp, Artificial sequence
  SiRNA target sequence
aagcattttatcattacatttcatt

SEQ ID NO: 60215 - DNA, 25 bp, Artificial sequence
  SiRNA target sequence
agcattttatcattacatttcatta

SEQ ID NO: 60216 - DNA, 25 bp, Artificial sequence
  SiRNA target sequence
gcattttatcattacatttcattaa

SEQ ID NO: 60217 - DNA, 25 bp, Artificial sequence
  SiRNA target sequence
cattttatcattacatttcattaaa

SEQ ID NO: 60218 - DNA, 25 bp, Artificial sequence
  SiRNA target sequence
attttatcattacatttcattaaac

SEQ ID NO: 60219 - DNA, 25 bp, Artificial sequence
  SiRNA target sequence
ttttatcattacatttcattaaact

SEQ ID NO: 60220 - DNA, 25 bp, Artificial sequence
  SiRNA target sequence
tttatcattacatttcattaaactt

SEQ ID NO: 60221 - DNA, 25 bp, Artificial sequence
  SiRNA target sequence
ttatcattacatttcattaaactta

SEQ ID NO: 60222 - DNA, 25 bp, Artificial sequence
  SiRNA target sequence
tatcattacatttcattaaacttag

SEQ ID NO: 60223 - DNA, 25 bp, Artificial sequence
  SiRNA target sequence
atcattacatttcattaaacttaga

SEQ ID NO: 60224 - DNA, 25 bp, Artificial sequence
  SiRNA target sequence
tcattacatttcattaaacttagaa

SEQ ID NO: 60225 - DNA, 25 bp, Artificial sequence
  SiRNA target sequence
cattacatttcattaaacttagaaa

SEQ ID NO: 60226 - DNA, 25 bp, Artificial sequence
  SiRNA target sequence
attacatttcattaaacttagaaaa

SEQ ID NO: 60227 - DNA, 25 bp, Artificial sequence
  SiRNA target sequence
ttacatttcattaaacttagaaaat

SEQ ID NO: 60228 - DNA, 25 bp, Artificial sequence
  SiRNA target sequence
tacatttcattaaacttagaaaatt

SEQ ID NO: 60229 - DNA, 25 bp, Artificial sequence
  SiRNA target sequence
acatttcattaaacttagaaaattt

SEQ ID NO: 60230 - DNA, 25 bp, Artificial sequence
  SiRNA target sequence
catttcattaaacttagaaaatttt

SEQ ID NO: 60231 - DNA, 25 bp, Artificial sequence
  SiRNA target sequence
atttcattaaacttagaaaatttta

SEQ ID NO: 60232 - DNA, 25 bp, Artificial sequence
  SiRNA target sequence
tttcattaaacttagaaaattttaa

SEQ ID NO: 60233 - DNA, 25 bp, Artificial sequence
  SiRNA target sequence
ttcattaaacttagaaaattttaac

SEQ ID NO: 60234 - DNA, 25 bp, Artificial sequence
  SiRNA target sequence
tcattaaacttagaaaattttaaca

SEQ ID NO: 60235 - DNA, 25 bp, Artificial sequence
  SiRNA target sequence
cattaaacttagaaaattttaacaa

SEQ ID NO: 60236 - DNA, 25 bp, Artificial sequence
  SiRNA target sequence
attaaacttagaaaattttaacaaa

SEQ ID NO: 60237 - DNA, 25 bp, Artificial sequence
  SiRNA target sequence
ttaaacttagaaaattttaacaaaa

SEQ ID NO: 60238 - DNA, 25 bp, Artificial sequence
  SiRNA target sequence
taaacttagaaaattttaacaaaat

SEQ ID NO: 60239 - DNA, 25 bp, Artificial sequence
  SiRNA target sequence
aaacttagaaaattttaacaaaata

SEQ ID NO: 60240 - DNA, 25 bp, Artificial sequence
  SiRNA target sequence
aacttagaaaattttaacaaaatag

SEQ ID NO: 60241 - DNA, 25 bp, Artificial sequence
  SiRNA target sequence
acttagaaaattttaacaaaatagg

SEQ ID NO: 60242 - DNA, 25 bp, Artificial sequence
  SiRNA target sequence
cttagaaaattttaacaaaatagga

SEQ ID NO: 60243 - DNA, 25 bp, Artificial sequence
  SiRNA target sequence
ttagaaaattttaacaaaataggaa

SEQ ID NO: 60244 - DNA, 25 bp, Artificial sequence
  SiRNA target sequence
tagaaaattttaacaaaataggaag

SEQ ID NO: 60245 - DNA, 25 bp, Artificial sequence
  SiRNA target sequence
agaaaattttaacaaaataggaagt

SEQ ID NO: 60246 - DNA, 25 bp, Artificial sequence
  SiRNA target sequence
gaaaattttaacaaaataggaagtg

SEQ ID NO: 60247 - DNA, 25 bp, Artificial sequence
  SiRNA target sequence
aaaattttaacaaaataggaagtgg

SEQ ID NO: 60248 - DNA, 25 bp, Artificial sequence
  SiRNA target sequence
aaattttaacaaaataggaagtgga

SEQ ID NO: 60249 - DNA, 25 bp, Artificial sequence
  SiRNA target sequence
aattttaacaaaataggaagtggag

SEQ ID NO: 60250 - DNA, 25 bp, Artificial sequence
  SiRNA target sequence
attttaacaaaataggaagtggaga

SEQ ID NO: 60251 - DNA, 25 bp, Artificial sequence
  SiRNA target sequence
ttttaacaaaataggaagtggagag

SEQ ID NO: 60252 - DNA, 25 bp, Artificial sequence
  SiRNA target sequence
tttaacaaaataggaagtggagaga

SEQ ID NO: 60253 - DNA, 25 bp, Artificial sequence
  SiRNA target sequence
ttaacaaaataggaagtggagagat

SEQ ID NO: 60254 - DNA, 25 bp, Artificial sequence
  SiRNA target sequence
taacaaaataggaagtggagagata

SEQ ID NO: 60255 - DNA, 25 bp, Artificial sequence
  SiRNA target sequence
aacaaaataggaagtggagagatac

SEQ ID NO: 60256 - DNA, 25 bp, Artificial sequence
  SiRNA target sequence
acaaaataggaagtggagagataca

SEQ ID NO: 60257 - DNA, 25 bp, Artificial sequence
  SiRNA target sequence
caaaataggaagtggagagatacaa

SEQ ID NO: 60258 - DNA, 25 bp, Artificial sequence
  SiRNA target sequence
aaaataggaagtggagagatacaaa

SEQ ID NO: 60259 - DNA, 25 bp, Artificial sequence
  SiRNA target sequence
aaataggaagtggagagatacaaat

SEQ ID NO: 60260 - DNA, 25 bp, Artificial sequence
  SiRNA target sequence
aataggaagtggagagatacaaatg

SEQ ID NO: 60261 - DNA, 25 bp, Artificial sequence
  SiRNA target sequence
ataggaagtggagagatacaaatga

SEQ ID NO: 60262 - DNA, 25 bp, Artificial sequence
  SiRNA target sequence
taggaagtggagagatacaaatgat

SEQ ID NO: 60263 - DNA, 25 bp, Artificial sequence
  SiRNA target sequence
aggaagtggagagatacaaatgatt

SEQ ID NO: 60264 - DNA, 25 bp, Artificial sequence
  SiRNA target sequence
ggaagtggagagatacaaatgatta

SEQ ID NO: 60265 - DNA, 25 bp, Artificial sequence
  SiRNA target sequence
gaagtggagagatacaaatgattat

SEQ ID NO: 60266 - DNA, 25 bp, Artificial sequence
  SiRNA target sequence
aagtggagagatacaaatgattatt

SEQ ID NO: 60267 - DNA, 25 bp, Artificial sequence
  SiRNA target sequence
agtggagagatacaaatgattattg

SEQ ID NO: 60268 - DNA, 25 bp, Artificial sequence
  SiRNA target sequence
gtggagagatacaaatgattattga

SEQ ID NO: 60269 - DNA, 25 bp, Artificial sequence
  SiRNA target sequence
tggagagatacaaatgattattgag

SEQ ID NO: 60270 - DNA, 25 bp, Artificial sequence
  SiRNA target sequence
ggagagatacaaatgattattgagc

SEQ ID NO: 60271 - DNA, 25 bp, Artificial sequence
  SiRNA target sequence
gagagatacaaatgattattgagcg

SEQ ID NO: 60272 - DNA, 25 bp, Artificial sequence
  SiRNA target sequence
agagatacaaatgattattgagcgg

SEQ ID NO: 60273 - DNA, 25 bp, Artificial sequence
  SiRNA target sequence
gagatacaaatgattattgagcgga

SEQ ID NO: 60274 - DNA, 25 bp, Artificial sequence
  SiRNA target sequence
agatacaaatgattattgagcggaa

SEQ ID NO: 60275 - DNA, 25 bp, Artificial sequence
  SiRNA target sequence
gatacaaatgattattgagcggaaa

SEQ ID NO: 60276 - DNA, 25 bp, Artificial sequence
  SiRNA target sequence
atacaaatgattattgagcggaaaa

SEQ ID NO: 60277 - DNA, 25 bp, Artificial sequence
  SiRNA target sequence
tacaaatgattattgagcggaaaag

SEQ ID NO: 60278 - DNA, 25 bp, Artificial sequence
  SiRNA target sequence
acaaatgattattgagcggaaaagt

SEQ ID NO: 60279 - DNA, 25 bp, Artificial sequence
  SiRNA target sequence
caaatgattattgagcggaaaagta

SEQ ID NO: 60280 - DNA, 25 bp, Artificial sequence
  SiRNA target sequence
aaatgattattgagcggaaaagtag

SEQ ID NO: 60281 - DNA, 25 bp, Artificial sequence
  SiRNA target sequence
aatgattattgagcggaaaagtaga

SEQ ID NO: 60282 - DNA, 25 bp, Artificial sequence
  SiRNA target sequence
atgattattgagcggaaaagtagag

SEQ ID NO: 60283 - DNA, 25 bp, Artificial sequence
  SiRNA target sequence
tgattattgagcggaaaagtagagc

SEQ ID NO: 60284 - DNA, 25 bp, Artificial sequence
  SiRNA target sequence
gattattgagcggaaaagtagagca

SEQ ID NO: 60285 - DNA, 25 bp, Artificial sequence
  SiRNA target sequence
attattgagcggaaaagtagagcat

SEQ ID NO: 60286 - DNA, 25 bp, Artificial sequence
  SiRNA target sequence
ttattgagcggaaaagtagagcata

SEQ ID NO: 60287 - DNA, 25 bp, Artificial sequence
  SiRNA target sequence
tattgagcggaaaagtagagcatat

SEQ ID NO: 60288 - DNA, 25 bp, Artificial sequence
  SiRNA target sequence
attgagcggaaaagtagagcatatg

SEQ ID NO: 60289 - DNA, 25 bp, Artificial sequence
  SiRNA target sequence
ttgagcggaaaagtagagcatatgg

SEQ ID NO: 60290 - DNA, 25 bp, Artificial sequence
  SiRNA target sequence
tgagcggaaaagtagagcatatggt

SEQ ID NO: 60291 - DNA, 25 bp, Artificial sequence
  SiRNA target sequence
gagcggaaaagtagagcatatggtg

SEQ ID NO: 60292 - DNA, 25 bp, Artificial sequence
  SiRNA target sequence
agcggaaaagtagagcatatggtga

SEQ ID NO: 60293 - DNA, 25 bp, Artificial sequence
  SiRNA target sequence
gcggaaaagtagagcatatggtgac

SEQ ID NO: 60294 - DNA, 25 bp, Artificial sequence
  SiRNA target sequence
cggaaaagtagagcatatggtgaca

SEQ ID NO: 60295 - DNA, 25 bp, Artificial sequence
  SiRNA target sequence
ggaaaagtagagcatatggtgacat

SEQ ID NO: 60296 - DNA, 25 bp, Artificial sequence
  SiRNA target sequence
gaaaagtagagcatatggtgacata

SEQ ID NO: 60297 - DNA, 25 bp, Artificial sequence
  SiRNA target sequence
aaaagtagagcatatggtgacatac

SEQ ID NO: 60298 - DNA, 25 bp, Artificial sequence
  SiRNA target sequence
aaagtagagcatatggtgacatact

SEQ ID NO: 60299 - DNA, 25 bp, Artificial sequence
  SiRNA target sequence
aagtagagcatatggtgacatacta

SEQ ID NO: 60300 - DNA, 25 bp, Artificial sequence
  SiRNA target sequence
agtagagcatatggtgacatactag

SEQ ID NO: 60301 - DNA, 25 bp, Artificial sequence
  SiRNA target sequence
gtagagcatatggtgacatactaga

SEQ ID NO: 60302 - DNA, 25 bp, Artificial sequence
  SiRNA target sequence
tagagcatatggtgacatactagaa

SEQ ID NO: 60303 - DNA, 25 bp, Artificial sequence
  SiRNA target sequence
agagcatatggtgacatactagaac

SEQ ID NO: 60304 - DNA, 25 bp, Artificial sequence
  SiRNA target sequence
gagcatatggtgacatactagaact

SEQ ID NO: 60305 - DNA, 25 bp, Artificial sequence
  SiRNA target sequence
agcatatggtgacatactagaacta

SEQ ID NO: 60306 - DNA, 25 bp, Artificial sequence
  SiRNA target sequence
gcatatggtgacatactagaactaa

SEQ ID NO: 60307 - DNA, 25 bp, Artificial sequence
  SiRNA target sequence
catatggtgacatactagaactaac

SEQ ID NO: 60308 - DNA, 25 bp, Artificial sequence
  SiRNA target sequence
atatggtgacatactagaactaact

SEQ ID NO: 60309 - DNA, 25 bp, Artificial sequence
  SiRNA target sequence
tatggtgacatactagaactaacta

SEQ ID NO: 60310 - DNA, 25 bp, Artificial sequence
  SiRNA target sequence
atggtgacatactagaactaactac

SEQ ID NO: 60311 - DNA, 25 bp, Artificial sequence
  SiRNA target sequence
tggtgacatactagaactaactact

SEQ ID NO: 60312 - DNA, 25 bp, Artificial sequence
  SiRNA target sequence
ggtgacatactagaactaactactc

SEQ ID NO: 60313 - DNA, 25 bp, Artificial sequence
  SiRNA target sequence
gtgacatactagaactaactactct

SEQ ID NO: 60314 - DNA, 25 bp, Artificial sequence
  SiRNA target sequence
tgacatactagaactaactactctc

SEQ ID NO: 60315 - DNA, 25 bp, Artificial sequence
  SiRNA target sequence
gacatactagaactaactactctct

SEQ ID NO: 60316 - DNA, 25 bp, Artificial sequence
  SiRNA target sequence
acatactagaactaactactctctc

SEQ ID NO: 60317 - DNA, 25 bp, Artificial sequence
  SiRNA target sequence
catactagaactaactactctctcg

SEQ ID NO: 60318 - DNA, 25 bp, Artificial sequence
  SiRNA target sequence
atactagaactaactactctctcgg

SEQ ID NO: 60319 - DNA, 25 bp, Artificial sequence
  SiRNA target sequence
tactagaactaactactctctcggc

SEQ ID NO: 60320 - DNA, 25 bp, Artificial sequence
  SiRNA target sequence
actagaactaactactctctcggcc

SEQ ID NO: 60321 - DNA, 25 bp, Artificial sequence
  SiRNA target sequence
ctagaactaactactctctcggccg

SEQ ID NO: 60322 - DNA, 25 bp, Artificial sequence
  SiRNA target sequence
tagaactaactactctctcggccgt

SEQ ID NO: 60323 - DNA, 25 bp, Artificial sequence
  SiRNA target sequence
agaactaactactctctcggccgta

SEQ ID NO: 60324 - DNA, 25 bp, Artificial sequence
  SiRNA target sequence
gaactaactactctctcggccgtac

SEQ ID NO: 60325 - DNA, 25 bp, Artificial sequence
  SiRNA target sequence
aactaactactctctcggccgtacc

SEQ ID NO: 60326 - DNA, 25 bp, Artificial sequence
  SiRNA target sequence
actaactactctctcggccgtacca

SEQ ID NO: 60327 - DNA, 25 bp, Artificial sequence
  SiRNA target sequence
ctaactactctctcggccgtaccaa

SEQ ID NO: 60328 - DNA, 25 bp, Artificial sequence
  SiRNA target sequence
taactactctctcggccgtaccaac

SEQ ID NO: 60329 - DNA, 25 bp, Artificial sequence
  SiRNA target sequence
aactactctctcggccgtaccaacc

SEQ ID NO: 60330 - DNA, 25 bp, Artificial sequence
  SiRNA target sequence
actactctctcggccgtaccaacct

SEQ ID NO: 60331 - DNA, 25 bp, Artificial sequence
  SiRNA target sequence
ctactctctcggccgtaccaacctg

SEQ ID NO: 60332 - DNA, 25 bp, Artificial sequence
  SiRNA target sequence
tactctctcggccgtaccaacctgt

SEQ ID NO: 60333 - DNA, 25 bp, Artificial sequence
  SiRNA target sequence
actctctcggccgtaccaacctgta

SEQ ID NO: 60334 - DNA, 25 bp, Artificial sequence
  SiRNA target sequence
ctctctcggccgtaccaacctgtat

SEQ ID NO: 60335 - DNA, 25 bp, Artificial sequence
  SiRNA target sequence
tctctcggccgtaccaacctgtatt

SEQ ID NO: 60336 - DNA, 25 bp, Artificial sequence
  SiRNA target sequence
ctctcggccgtaccaacctgtattg

SEQ ID NO: 60337 - DNA, 25 bp, Artificial sequence
  SiRNA target sequence
tctcggccgtaccaacctgtattgt

SEQ ID NO: 60338 - DNA, 25 bp, Artificial sequence
  SiRNA target sequence
ctcggccgtaccaacctgtattgta

SEQ ID NO: 60339 - DNA, 25 bp, Artificial sequence
  SiRNA target sequence
tcggccgtaccaacctgtattgtag

SEQ ID NO: 60340 - DNA, 25 bp, Artificial sequence
  SiRNA target sequence
cggccgtaccaacctgtattgtagt

SEQ ID NO: 60341 - DNA, 25 bp, Artificial sequence
  SiRNA target sequence
ggccgtaccaacctgtattgtagtt

SEQ ID NO: 60342 - DNA, 25 bp, Artificial sequence
  SiRNA target sequence
gccgtaccaacctgtattgtagtta

SEQ ID NO: 60343 - DNA, 25 bp, Artificial sequence
  SiRNA target sequence
ccgtaccaacctgtattgtagttat

SEQ ID NO: 60344 - DNA, 25 bp, Artificial sequence
  SiRNA target sequence
cgtaccaacctgtattgtagttatt

SEQ ID NO: 60345 - DNA, 25 bp, Artificial sequence
  SiRNA target sequence
gtaccaacctgtattgtagttatta

SEQ ID NO: 60346 - DNA, 25 bp, Artificial sequence
  SiRNA target sequence
taccaacctgtattgtagttattat

SEQ ID NO: 60347 - DNA, 25 bp, Artificial sequence
  SiRNA target sequence
accaacctgtattgtagttattatg

SEQ ID NO: 60348 - DNA, 25 bp, Artificial sequence
  SiRNA target sequence
ccaacctgtattgtagttattatgt

SEQ ID NO: 60349 - DNA, 25 bp, Artificial sequence
  SiRNA target sequence
caacctgtattgtagttattatgtc

SEQ ID NO: 60350 - DNA, 25 bp, Artificial sequence
  SiRNA target sequence
aacctgtattgtagttattatgtcg

SEQ ID NO: 60351 - DNA, 25 bp, Artificial sequence
  SiRNA target sequence
acctgtattgtagttattatgtcgt

SEQ ID NO: 60352 - DNA, 25 bp, Artificial sequence
  SiRNA target sequence
cctgtattgtagttattatgtcgtt

SEQ ID NO: 60353 - DNA, 25 bp, Artificial sequence
  SiRNA target sequence
ctgtattgtagttattatgtcgttt

SEQ ID NO: 60354 - DNA, 25 bp, Artificial sequence
  SiRNA target sequence
tgtattgtagttattatgtcgtttt

SEQ ID NO: 60355 - DNA, 25 bp, Artificial sequence
  SiRNA target sequence
gtattgtagttattatgtcgttttt

SEQ ID NO: 60356 - DNA, 25 bp, Artificial sequence
  SiRNA target sequence
tattgtagttattatgtcgtttttc

SEQ ID NO: 60357 - DNA, 25 bp, Artificial sequence
  SiRNA target sequence
attgtagttattatgtcgtttttct

SEQ ID NO: 60358 - DNA, 25 bp, Artificial sequence
  SiRNA target sequence
ttgtagttattatgtcgtttttctc

SEQ ID NO: 60359 - DNA, 25 bp, Artificial sequence
  SiRNA target sequence
tgtagttattatgtcgtttttctca

SEQ ID NO: 60360 - DNA, 25 bp, Artificial sequence
  SiRNA target sequence
gtagttattatgtcgtttttctcag

SEQ ID NO: 60361 - DNA, 25 bp, Artificial sequence
  SiRNA target sequence
tagttattatgtcgtttttctcagt

SEQ ID NO: 60362 - DNA, 25 bp, Artificial sequence
  SiRNA target sequence
agttattatgtcgtttttctcagta

SEQ ID NO: 60363 - DNA, 25 bp, Artificial sequence
  SiRNA target sequence
gttattatgtcgtttttctcagtat

SEQ ID NO: 60364 - DNA, 25 bp, Artificial sequence
  SiRNA target sequence
ttattatgtcgtttttctcagtata

SEQ ID NO: 60365 - DNA, 25 bp, Artificial sequence
  SiRNA target sequence
tattatgtcgtttttctcagtatat

SEQ ID NO: 60366 - DNA, 25 bp, Artificial sequence
  SiRNA target sequence
attatgtcgtttttctcagtatata

SEQ ID NO: 60367 - DNA, 25 bp, Artificial sequence
  SiRNA target sequence
ttatgtcgtttttctcagtatataa

SEQ ID NO: 60368 - DNA, 25 bp, Artificial sequence
  SiRNA target sequence
tatgtcgtttttctcagtatataaa

SEQ ID NO: 60369 - DNA, 25 bp, Artificial sequence
  SiRNA target sequence
atgtcgtttttctcagtatataaaa

SEQ ID NO: 60370 - DNA, 25 bp, Artificial sequence
  SiRNA target sequence
tgtcgtttttctcagtatataaaaa

SEQ ID NO: 60371 - DNA, 25 bp, Artificial sequence
  SiRNA target sequence
gtcgtttttctcagtatataaaaat

SEQ ID NO: 60372 - DNA, 25 bp, Artificial sequence
  SiRNA target sequence
tcgtttttctcagtatataaaaatt

SEQ ID NO: 60373 - DNA, 25 bp, Artificial sequence
  SiRNA target sequence
cgtttttctcagtatataaaaattt

SEQ ID NO: 60374 - DNA, 25 bp, Artificial sequence
  SiRNA target sequence
gtttttctcagtatataaaaatttg

SEQ ID NO: 60375 - DNA, 25 bp, Artificial sequence
  SiRNA target sequence
tttttctcagtatataaaaatttgg

SEQ ID NO: 60376 - DNA, 25 bp, Artificial sequence
  SiRNA target sequence
ttttctcagtatataaaaatttggg

SEQ ID NO: 60377 - DNA, 25 bp, Artificial sequence
  SiRNA target sequence
tttctcagtatataaaaatttggga

SEQ ID NO: 60378 - DNA, 25 bp, Artificial sequence
  SiRNA target sequence
ttctcagtatataaaaatttgggaa

SEQ ID NO: 60379 - DNA, 25 bp, Artificial sequence
  SiRNA target sequence
tctcagtatataaaaatttgggaag

SEQ ID NO: 60380 - DNA, 25 bp, Artificial sequence
  SiRNA target sequence
ctcagtatataaaaatttgggaaga

SEQ ID NO: 60381 - DNA, 25 bp, Artificial sequence
  SiRNA target sequence
tcagtatataaaaatttgggaagag

SEQ ID NO: 60382 - DNA, 25 bp, Artificial sequence
  SiRNA target sequence
cagtatataaaaatttgggaagaga

SEQ ID NO: 60383 - DNA, 25 bp, Artificial sequence
  SiRNA target sequence
agtatataaaaatttgggaagagat

SEQ ID NO: 60384 - DNA, 25 bp, Artificial sequence
  SiRNA target sequence
gtatataaaaatttgggaagagatg

SEQ ID NO: 60385 - DNA, 25 bp, Artificial sequence
  SiRNA target sequence
tatataaaaatttgggaagagatgc

SEQ ID NO: 60386 - DNA, 25 bp, Artificial sequence
  SiRNA target sequence
atataaaaatttgggaagagatgca

SEQ ID NO: 60387 - DNA, 25 bp, Artificial sequence
  SiRNA target sequence
tataaaaatttgggaagagatgcac

SEQ ID NO: 60388 - DNA, 25 bp, Artificial sequence
  SiRNA target sequence
ataaaaatttgggaagagatgcact

SEQ ID NO: 60389 - DNA, 25 bp, Artificial sequence
  SiRNA target sequence
taaaaatttgggaagagatgcactc

SEQ ID NO: 60390 - DNA, 25 bp, Artificial sequence
  SiRNA target sequence
aaaaatttgggaagagatgcactct

SEQ ID NO: 60391 - DNA, 25 bp, Artificial sequence
  SiRNA target sequence
aaaatttgggaagagatgcactcta

SEQ ID NO: 60392 - DNA, 25 bp, Artificial sequence
  SiRNA target sequence
aaatttgggaagagatgcactctac

SEQ ID NO: 60393 - DNA, 25 bp, Artificial sequence
  SiRNA target sequence
aatttgggaagagatgcactctacg

SEQ ID NO: 60394 - DNA, 25 bp, Artificial sequence
  SiRNA target sequence
atttgggaagagatgcactctacgt

SEQ ID NO: 60395 - DNA, 25 bp, Artificial sequence
  SiRNA target sequence
tttgggaagagatgcactctacgta

SEQ ID NO: 60396 - DNA, 25 bp, Artificial sequence
  SiRNA target sequence
ttgggaagagatgcactctacgtaa

SEQ ID NO: 60397 - DNA, 25 bp, Artificial sequence
  SiRNA target sequence
tgggaagagatgcactctacgtaat

SEQ ID NO: 60398 - DNA, 25 bp, Artificial sequence
  SiRNA target sequence
gggaagagatgcactctacgtaatg

SEQ ID NO: 60399 - DNA, 25 bp, Artificial sequence
  SiRNA target sequence
ggaagagatgcactctacgtaatgt

SEQ ID NO: 60400 - DNA, 25 bp, Artificial sequence
  SiRNA target sequence
gaagagatgcactctacgtaatgtt

SEQ ID NO: 60401 - DNA, 25 bp, Artificial sequence
  SiRNA target sequence
aagagatgcactctacgtaatgttg

SEQ ID NO: 60402 - DNA, 25 bp, Artificial sequence
  SiRNA target sequence
agagatgcactctacgtaatgttgg

SEQ ID NO: 60403 - DNA, 25 bp, Artificial sequence
  SiRNA target sequence
gagatgcactctacgtaatgttggc

SEQ ID NO: 60404 - DNA, 25 bp, Artificial sequence
  SiRNA target sequence
agatgcactctacgtaatgttggct

SEQ ID NO: 60405 - DNA, 25 bp, Artificial sequence
  SiRNA target sequence
gatgcactctacgtaatgttggcta

SEQ ID NO: 60406 - DNA, 25 bp, Artificial sequence
  SiRNA target sequence
atgcactctacgtaatgttggctac

SEQ ID NO: 60407 - DNA, 25 bp, Artificial sequence
  SiRNA target sequence
tgcactctacgtaatgttggctaca

SEQ ID NO: 60408 - DNA, 25 bp, Artificial sequence
  SiRNA target sequence
gcactctacgtaatgttggctacaa

SEQ ID NO: 60409 - DNA, 25 bp, Artificial sequence
  SiRNA target sequence
cactctacgtaatgttggctacaag

SEQ ID NO: 60410 - DNA, 25 bp, Artificial sequence
  SiRNA target sequence
actctacgtaatgttggctacaagt

SEQ ID NO: 60411 - DNA, 25 bp, Artificial sequence
  SiRNA target sequence
ctctacgtaatgttggctacaagtg

SEQ ID NO: 60412 - DNA, 25 bp, Artificial sequence
  SiRNA target sequence
tctacgtaatgttggctacaagtgc

SEQ ID NO: 60413 - DNA, 25 bp, Artificial sequence
  SiRNA target sequence
ctacgtaatgttggctacaagtgcc

SEQ ID NO: 60414 - DNA, 25 bp, Artificial sequence
  SiRNA target sequence
tacgtaatgttggctacaagtgcct

SEQ ID NO: 60415 - DNA, 25 bp, Artificial sequence
  SiRNA target sequence
acgtaatgttggctacaagtgcctt

SEQ ID NO: 60416 - DNA, 25 bp, Artificial sequence
  SiRNA target sequence
cgtaatgttggctacaagtgccttg

SEQ ID NO: 60417 - DNA, 25 bp, Artificial sequence
  SiRNA target sequence
gtaatgttggctacaagtgccttgt

SEQ ID NO: 60418 - DNA, 25 bp, Artificial sequence
  SiRNA target sequence
taatgttggctacaagtgccttgta

SEQ ID NO: 60419 - DNA, 25 bp, Artificial sequence
  SiRNA target sequence
aatgttggctacaagtgccttgtat

SEQ ID NO: 60420 - DNA, 25 bp, Artificial sequence
  SiRNA target sequence
atgttggctacaagtgccttgtatg

SEQ ID NO: 60421 - DNA, 25 bp, Artificial sequence
  SiRNA target sequence
tgttggctacaagtgccttgtatgt

SEQ ID NO: 60422 - DNA, 25 bp, Artificial sequence
  SiRNA target sequence
gttggctacaagtgccttgtatgtg

SEQ ID NO: 60423 - DNA, 25 bp, Artificial sequence
  SiRNA target sequence
ttggctacaagtgccttgtatgtgt

SEQ ID NO: 60424 - DNA, 25 bp, Artificial sequence
  SiRNA target sequence
tggctacaagtgccttgtatgtgta

SEQ ID NO: 60425 - DNA, 25 bp, Artificial sequence
  SiRNA target sequence
ggctacaagtgccttgtatgtgtat

SEQ ID NO: 60426 - DNA, 25 bp, Artificial sequence
  SiRNA target sequence
gctacaagtgccttgtatgtgtatt

SEQ ID NO: 60427 - DNA, 25 bp, Artificial sequence
  SiRNA target sequence
ctacaagtgccttgtatgtgtattt

SEQ ID NO: 60428 - DNA, 25 bp, Artificial sequence
  SiRNA target sequence
tacaagtgccttgtatgtgtatttt

SEQ ID NO: 60429 - DNA, 25 bp, Artificial sequence
  SiRNA target sequence
acaagtgccttgtatgtgtatttta

SEQ ID NO: 60430 - DNA, 25 bp, Artificial sequence
  SiRNA target sequence
caagtgccttgtatgtgtattttac

SEQ ID NO: 60431 - DNA, 25 bp, Artificial sequence
  SiRNA target sequence
aagtgccttgtatgtgtattttaca

SEQ ID NO: 60432 - DNA, 25 bp, Artificial sequence
  SiRNA target sequence
agtgccttgtatgtgtattttacat

SEQ ID NO: 60433 - DNA, 25 bp, Artificial sequence
  SiRNA target sequence
gtgccttgtatgtgtattttacatt

SEQ ID NO: 60434 - DNA, 25 bp, Artificial sequence
  SiRNA target sequence
tgccttgtatgtgtattttacattt

SEQ ID NO: 60435 - DNA, 25 bp, Artificial sequence
  SiRNA target sequence
gccttgtatgtgtattttacatttg

SEQ ID NO: 60436 - DNA, 25 bp, Artificial sequence
  SiRNA target sequence
ccttgtatgtgtattttacatttgt

SEQ ID NO: 60437 - DNA, 25 bp, Artificial sequence
  SiRNA target sequence
cttgtatgtgtattttacatttgta

SEQ ID NO: 60438 - DNA, 25 bp, Artificial sequence
  SiRNA target sequence
ttgtatgtgtattttacatttgtat

SEQ ID NO: 60439 - DNA, 25 bp, Artificial sequence
  SiRNA target sequence
tgtatgtgtattttacatttgtatt

SEQ ID NO: 60440 - DNA, 25 bp, Artificial sequence
  SiRNA target sequence
gtatgtgtattttacatttgtattt

SEQ ID NO: 60441 - DNA, 25 bp, Artificial sequence
  SiRNA target sequence
tatgtgtattttacatttgtatttt

SEQ ID NO: 60442 - DNA, 25 bp, Artificial sequence
  SiRNA target sequence
atgtgtattttacatttgtattttc

SEQ ID NO: 60443 - DNA, 25 bp, Artificial sequence
  SiRNA target sequence
tgtgtattttacatttgtattttca

SEQ ID NO: 60444 - DNA, 25 bp, Artificial sequence
  SiRNA target sequence
gtgtattttacatttgtattttcaa

SEQ ID NO: 60445 - DNA, 25 bp, Artificial sequence
  SiRNA target sequence
tgtattttacatttgtattttcaat

SEQ ID NO: 60446 - DNA, 25 bp, Artificial sequence
  SiRNA target sequence
gtattttacatttgtattttcaata

SEQ ID NO: 60447 - DNA, 25 bp, Artificial sequence
  SiRNA target sequence
tattttacatttgtattttcaatat

SEQ ID NO: 60448 - DNA, 25 bp, Artificial sequence
  SiRNA target sequence
attttacatttgtattttcaatatg

SEQ ID NO: 60449 - DNA, 25 bp, Artificial sequence
  SiRNA target sequence
ttttacatttgtattttcaatatgg

SEQ ID NO: 60450 - DNA, 25 bp, Artificial sequence
  SiRNA target sequence
tttacatttgtattttcaatatgga

SEQ ID NO: 60451 - DNA, 25 bp, Artificial sequence
  SiRNA target sequence
ttacatttgtattttcaatatggag

SEQ ID NO: 60452 - DNA, 25 bp, Artificial sequence
  SiRNA target sequence
tacatttgtattttcaatatggaga

SEQ ID NO: 60453 - DNA, 25 bp, Artificial sequence
  SiRNA target sequence
acatttgtattttcaatatggagaa

SEQ ID NO: 60454 - DNA, 25 bp, Artificial sequence
  SiRNA target sequence
catttgtattttcaatatggagaaa

SEQ ID NO: 60455 - DNA, 25 bp, Artificial sequence
  SiRNA target sequence
atttgtattttcaatatggagaaac

SEQ ID NO: 60456 - DNA, 25 bp, Artificial sequence
  SiRNA target sequence
tttgtattttcaatatggagaaaca

SEQ ID NO: 60457 - DNA, 25 bp, Artificial sequence
  SiRNA target sequence
ttgtattttcaatatggagaaacaa

SEQ ID NO: 60458 - DNA, 25 bp, Artificial sequence
  SiRNA target sequence
tgtattttcaatatggagaaacaat

SEQ ID NO: 60459 - DNA, 25 bp, Artificial sequence
  SiRNA target sequence
gtattttcaatatggagaaacaata

SEQ ID NO: 60460 - DNA, 25 bp, Artificial sequence
  SiRNA target sequence
tattttcaatatggagaaacaatat

SEQ ID NO: 60461 - DNA, 25 bp, Artificial sequence
  SiRNA target sequence
attttcaatatggagaaacaatatt

SEQ ID NO: 60462 - DNA, 25 bp, Artificial sequence
  SiRNA target sequence
ttttcaatatggagaaacaatatta

SEQ ID NO: 60463 - DNA, 25 bp, Artificial sequence
  SiRNA target sequence
tttcaatatggagaaacaatattag

SEQ ID NO: 60464 - DNA, 25 bp, Artificial sequence
  SiRNA target sequence
ttcaatatggagaaacaatattaga

SEQ ID NO: 60465 - DNA, 25 bp, Artificial sequence
  SiRNA target sequence
tcaatatggagaaacaatattagaa

SEQ ID NO: 60466 - DNA, 25 bp, Artificial sequence
  SiRNA target sequence
caatatggagaaacaatattagaag

SEQ ID NO: 60467 - DNA, 25 bp, Artificial sequence
  SiRNA target sequence
aatatggagaaacaatattagaaga

SEQ ID NO: 60468 - DNA, 25 bp, Artificial sequence
  SiRNA target sequence
atatggagaaacaatattagaagac

SEQ ID NO: 60469 - DNA, 25 bp, Artificial sequence
  SiRNA target sequence
tatggagaaacaatattagaagaca

SEQ ID NO: 60470 - DNA, 25 bp, Artificial sequence
  SiRNA target sequence
atggagaaacaatattagaagacaa

SEQ ID NO: 60471 - DNA, 25 bp, Artificial sequence
  SiRNA target sequence
tggagaaacaatattagaagacaat

SEQ ID NO: 60472 - DNA, 25 bp, Artificial sequence
  SiRNA target sequence
ggagaaacaatattagaagacaata

SEQ ID NO: 60473 - DNA, 25 bp, Artificial sequence
  SiRNA target sequence
gagaaacaatattagaagacaatat

SEQ ID NO: 60474 - DNA, 25 bp, Artificial sequence
  SiRNA target sequence
agaaacaatattagaagacaatata

SEQ ID NO: 60475 - DNA, 25 bp, Artificial sequence
  SiRNA target sequence
gaaacaatattagaagacaatataa

SEQ ID NO: 60476 - DNA, 25 bp, Artificial sequence
  SiRNA target sequence
aaacaatattagaagacaatataat

SEQ ID NO: 60477 - DNA, 25 bp, Artificial sequence
  SiRNA target sequence
aacaatattagaagacaatataata

SEQ ID NO: 60478 - DNA, 25 bp, Artificial sequence
  SiRNA target sequence
acaatattagaagacaatataataa

SEQ ID NO: 60479 - DNA, 25 bp, Artificial sequence
  SiRNA target sequence
caatattagaagacaatataataag

SEQ ID NO: 60480 - DNA, 25 bp, Artificial sequence
  SiRNA target sequence
aatattagaagacaatataataagt

SEQ ID NO: 60481 - DNA, 25 bp, Artificial sequence
  SiRNA target sequence
atattagaagacaatataataagtc

SEQ ID NO: 60482 - DNA, 25 bp, Artificial sequence
  SiRNA target sequence
tattagaagacaatataataagtca

SEQ ID NO: 60483 - DNA, 25 bp, Artificial sequence
  SiRNA target sequence
attagaagacaatataataagtcac

SEQ ID NO: 60484 - DNA, 25 bp, Artificial sequence
  SiRNA target sequence
ttagaagacaatataataagtcaca

SEQ ID NO: 60485 - DNA, 25 bp, Artificial sequence
  SiRNA target sequence
tagaagacaatataataagtcacag

SEQ ID NO: 60486 - DNA, 25 bp, Artificial sequence
  SiRNA target sequence
agaagacaatataataagtcacagg

SEQ ID NO: 60487 - DNA, 25 bp, Artificial sequence
  SiRNA target sequence
gaagacaatataataagtcacagga

SEQ ID NO: 60488 - DNA, 25 bp, Artificial sequence
  SiRNA target sequence
aagacaatataataagtcacaggat

SEQ ID NO: 60489 - DNA, 25 bp, Artificial sequence
  SiRNA target sequence
agacaatataataagtcacaggata

SEQ ID NO: 60490 - DNA, 25 bp, Artificial sequence
  SiRNA target sequence
gacaatataataagtcacaggataa

SEQ ID NO: 60491 - DNA, 25 bp, Artificial sequence
  SiRNA target sequence
acaatataataagtcacaggataaa

SEQ ID NO: 60492 - DNA, 25 bp, Artificial sequence
  SiRNA target sequence
caatataataagtcacaggataaat

SEQ ID NO: 60493 - DNA, 25 bp, Artificial sequence
  SiRNA target sequence
aatataataagtcacaggataaatt

SEQ ID NO: 60494 - DNA, 25 bp, Artificial sequence
  SiRNA target sequence
atataataagtcacaggataaatta

SEQ ID NO: 60495 - DNA, 25 bp, Artificial sequence
  SiRNA target sequence
tataataagtcacaggataaattat

SEQ ID NO: 60496 - DNA, 25 bp, Artificial sequence
  SiRNA target sequence
ataataagtcacaggataaattatc

SEQ ID NO: 60497 - DNA, 25 bp, Artificial sequence
  SiRNA target sequence
taataagtcacaggataaattatcg

SEQ ID NO: 60498 - DNA, 25 bp, Artificial sequence
  SiRNA target sequence
aataagtcacaggataaattatcga

SEQ ID NO: 60499 - DNA, 25 bp, Artificial sequence
  SiRNA target sequence
ataagtcacaggataaattatcgaa

SEQ ID NO: 60500 - DNA, 25 bp, Artificial sequence
  SiRNA target sequence
taagtcacaggataaattatcgaat

SEQ ID NO: 60501 - DNA, 25 bp, Artificial sequence
  SiRNA target sequence
aagtcacaggataaattatcgaata

SEQ ID NO: 60502 - DNA, 25 bp, Artificial sequence
  SiRNA target sequence
agtcacaggataaattatcgaataa

SEQ ID NO: 60503 - DNA, 25 bp, Artificial sequence
  SiRNA target sequence
gtcacaggataaattatcgaataaa

SEQ ID NO: 60504 - DNA, 25 bp, Artificial sequence
  SiRNA target sequence
tcacaggataaattatcgaataaat

SEQ ID NO: 60505 - DNA, 25 bp, Artificial sequence
  SiRNA target sequence
cacaggataaattatcgaataaatt

SEQ ID NO: 60506 - DNA, 25 bp, Artificial sequence
  SiRNA target sequence
acaggataaattatcgaataaatta

SEQ ID NO: 60507 - DNA, 25 bp, Artificial sequence
  SiRNA target sequence
caggataaattatcgaataaattac

SEQ ID NO: 60508 - DNA, 25 bp, Artificial sequence
  SiRNA target sequence
aggataaattatcgaataaattaca

SEQ ID NO: 60509 - DNA, 25 bp, Artificial sequence
  SiRNA target sequence
ggataaattatcgaataaattacaa

SEQ ID NO: 60510 - DNA, 25 bp, Artificial sequence
  SiRNA target sequence
gataaattatcgaataaattacaag

SEQ ID NO: 60511 - DNA, 25 bp, Artificial sequence
  SiRNA target sequence
ataaattatcgaataaattacaaga

SEQ ID NO: 60512 - DNA, 25 bp, Artificial sequence
  SiRNA target sequence
taaattatcgaataaattacaagat

SEQ ID NO: 60513 - DNA, 25 bp, Artificial sequence
  SiRNA target sequence
aaattatcgaataaattacaagatt

SEQ ID NO: 60514 - DNA, 25 bp, Artificial sequence
  SiRNA target sequence
aattatcgaataaattacaagattt

SEQ ID NO: 60515 - DNA, 25 bp, Artificial sequence
  SiRNA target sequence
attatcgaataaattacaagatttt

SEQ ID NO: 60516 - DNA, 25 bp, Artificial sequence
  SiRNA target sequence
ttatcgaataaattacaagattttt

SEQ ID NO: 60517 - DNA, 25 bp, Artificial sequence
  SiRNA target sequence
tatcgaataaattacaagatttttt

SEQ ID NO: 60518 - DNA, 25 bp, Artificial sequence
  SiRNA target sequence
atcgaataaattacaagatttttta

SEQ ID NO: 60519 - DNA, 25 bp, Artificial sequence
  SiRNA target sequence
tcgaataaattacaagattttttag

SEQ ID NO: 60520 - DNA, 25 bp, Artificial sequence
  SiRNA target sequence
cgaataaattacaagattttttagc

SEQ ID NO: 60521 - DNA, 25 bp, Artificial sequence
  SiRNA target sequence
gaataaattacaagattttttagct

SEQ ID NO: 60522 - DNA, 25 bp, Artificial sequence
  SiRNA target sequence
aataaattacaagattttttagcta

SEQ ID NO: 60523 - DNA, 25 bp, Artificial sequence
  SiRNA target sequence
ataaattacaagattttttagctaa

SEQ ID NO: 60524 - DNA, 25 bp, Artificial sequence
  SiRNA target sequence
taaattacaagattttttagctaat

SEQ ID NO: 60525 - DNA, 25 bp, Artificial sequence
  SiRNA target sequence
aaattacaagattttttagctaatc

SEQ ID NO: 60526 - DNA, 25 bp, Artificial sequence
  SiRNA target sequence
aattacaagattttttagctaatca

SEQ ID NO: 60527 - DNA, 25 bp, Artificial sequence
  SiRNA target sequence
attacaagattttttagctaatcat

SEQ ID NO: 60528 - DNA, 25 bp, Artificial sequence
  SiRNA target sequence
ttacaagattttttagctaatcatg

SEQ ID NO: 60529 - DNA, 25 bp, Artificial sequence
  SiRNA target sequence
tacaagattttttagctaatcatga

SEQ ID NO: 60530 - DNA, 25 bp, Artificial sequence
  SiRNA target sequence
acaagattttttagctaatcatgaa

SEQ ID NO: 60531 - DNA, 25 bp, Artificial sequence
  SiRNA target sequence
caagattttttagctaatcatgaaa

SEQ ID NO: 60532 - DNA, 25 bp, Artificial sequence
  SiRNA target sequence
aagattttttagctaatcatgaaac

SEQ ID NO: 60533 - DNA, 25 bp, Artificial sequence
  SiRNA target sequence
agattttttagctaatcatgaaaca

SEQ ID NO: 60534 - DNA, 25 bp, Artificial sequence
  SiRNA target sequence
gattttttagctaatcatgaaacaa

SEQ ID NO: 60535 - DNA, 25 bp, Artificial sequence
  SiRNA target sequence
attttttagctaatcatgaaacaat

SEQ ID NO: 60536 - DNA, 25 bp, Artificial sequence
  SiRNA target sequence
ttttttagctaatcatgaaacaatt

SEQ ID NO: 60537 - DNA, 25 bp, Artificial sequence
  SiRNA target sequence
tttttagctaatcatgaaacaatta

SEQ ID NO: 60538 - DNA, 25 bp, Artificial sequence
  SiRNA target sequence
ttttagctaatcatgaaacaattaa

SEQ ID NO: 60539 - DNA, 25 bp, Artificial sequence
  SiRNA target sequence
tttagctaatcatgaaacaattaaa

SEQ ID NO: 60540 - DNA, 25 bp, Artificial sequence
  SiRNA target sequence
ttagctaatcatgaaacaattaaag

SEQ ID NO: 60541 - DNA, 25 bp, Artificial sequence
  SiRNA target sequence
tagctaatcatgaaacaattaaagc

SEQ ID NO: 60542 - DNA, 25 bp, Artificial sequence
  SiRNA target sequence
agctaatcatgaaacaattaaagcc

SEQ ID NO: 60543 - DNA, 25 bp, Artificial sequence
  SiRNA target sequence
gctaatcatgaaacaattaaagcct

SEQ ID NO: 60544 - DNA, 25 bp, Artificial sequence
  SiRNA target sequence
ctaatcatgaaacaattaaagccta

SEQ ID NO: 60545 - DNA, 25 bp, Artificial sequence
  SiRNA target sequence
taatcatgaaacaattaaagcctat

SEQ ID NO: 60546 - DNA, 25 bp, Artificial sequence
  SiRNA target sequence
aatcatgaaacaattaaagcctata

SEQ ID NO: 60547 - DNA, 25 bp, Artificial sequence
  SiRNA target sequence
atcatgaaacaattaaagcctataa

SEQ ID NO: 60548 - DNA, 25 bp, Artificial sequence
  SiRNA target sequence
tcatgaaacaattaaagcctataat

SEQ ID NO: 60549 - DNA, 25 bp, Artificial sequence
  SiRNA target sequence
catgaaacaattaaagcctataata

SEQ ID NO: 60550 - DNA, 25 bp, Artificial sequence
  SiRNA target sequence
atgaaacaattaaagcctataatat

SEQ ID NO: 60551 - DNA, 25 bp, Artificial sequence
  SiRNA target sequence
tgaaacaattaaagcctataatatg

SEQ ID NO: 60552 - DNA, 25 bp, Artificial sequence
  SiRNA target sequence
gaaacaattaaagcctataatatgg

SEQ ID NO: 60553 - DNA, 25 bp, Artificial sequence
  SiRNA target sequence
aaacaattaaagcctataatatgga

SEQ ID NO: 60554 - DNA, 25 bp, Artificial sequence
  SiRNA target sequence
aacaattaaagcctataatatggaa

SEQ ID NO: 60555 - DNA, 25 bp, Artificial sequence
  SiRNA target sequence
acaattaaagcctataatatggaag

SEQ ID NO: 60556 - DNA, 25 bp, Artificial sequence
  SiRNA target sequence
caattaaagcctataatatggaaga

SEQ ID NO: 60557 - DNA, 25 bp, Artificial sequence
  SiRNA target sequence
aattaaagcctataatatggaagaa

SEQ ID NO: 60558 - DNA, 25 bp, Artificial sequence
  SiRNA target sequence
attaaagcctataatatggaagaag

SEQ ID NO: 60559 - DNA, 25 bp, Artificial sequence
  SiRNA target sequence
ttaaagcctataatatggaagaaga

SEQ ID NO: 60560 - DNA, 25 bp, Artificial sequence
  SiRNA target sequence
taaagcctataatatggaagaagaa

SEQ ID NO: 60561 - DNA, 25 bp, Artificial sequence
  SiRNA target sequence
aaagcctataatatggaagaagaaa

SEQ ID NO: 60562 - DNA, 25 bp, Artificial sequence
  SiRNA target sequence
aagcctataatatggaagaagaaac

SEQ ID NO: 60563 - DNA, 25 bp, Artificial sequence
  SiRNA target sequence
agcctataatatggaagaagaaact

SEQ ID NO: 60564 - DNA, 25 bp, Artificial sequence
  SiRNA target sequence
gcctataatatggaagaagaaacta

SEQ ID NO: 60565 - DNA, 25 bp, Artificial sequence
  SiRNA target sequence
cctataatatggaagaagaaactat

SEQ ID NO: 60566 - DNA, 25 bp, Artificial sequence
  SiRNA target sequence
ctataatatggaagaagaaactatt

SEQ ID NO: 60567 - DNA, 25 bp, Artificial sequence
  SiRNA target sequence
tataatatggaagaagaaactatta

SEQ ID NO: 60568 - DNA, 25 bp, Artificial sequence
  SiRNA target sequence
ataatatggaagaagaaactattac

SEQ ID NO: 60569 - DNA, 25 bp, Artificial sequence
  SiRNA target sequence
taatatggaagaagaaactattaca

SEQ ID NO: 60570 - DNA, 25 bp, Artificial sequence
  SiRNA target sequence
aatatggaagaagaaactattacat

SEQ ID NO: 60571 - DNA, 25 bp, Artificial sequence
  SiRNA target sequence
atatggaagaagaaactattacata

SEQ ID NO: 60572 - DNA, 25 bp, Artificial sequence
  SiRNA target sequence
tatggaagaagaaactattacatat

SEQ ID NO: 60573 - DNA, 25 bp, Artificial sequence
  SiRNA target sequence
atggaagaagaaactattacatatt

SEQ ID NO: 60574 - DNA, 25 bp, Artificial sequence
  SiRNA target sequence
tggaagaagaaactattacatattt

SEQ ID NO: 60575 - DNA, 25 bp, Artificial sequence
  SiRNA target sequence
ggaagaagaaactattacatatttt

SEQ ID NO: 60576 - DNA, 25 bp, Artificial sequence
  SiRNA target sequence
gaagaagaaactattacatattttg

SEQ ID NO: 60577 - DNA, 25 bp, Artificial sequence
  SiRNA target sequence
aagaagaaactattacatattttga

SEQ ID NO: 60578 - DNA, 25 bp, Artificial sequence
  SiRNA target sequence
agaagaaactattacatattttgat

SEQ ID NO: 60579 - DNA, 25 bp, Artificial sequence
  SiRNA target sequence
gaagaaactattacatattttgatg

SEQ ID NO: 60580 - DNA, 25 bp, Artificial sequence
  SiRNA target sequence
aagaaactattacatattttgatga

SEQ ID NO: 60581 - DNA, 25 bp, Artificial sequence
  SiRNA target sequence
agaaactattacatattttgatgaa

SEQ ID NO: 60582 - DNA, 25 bp, Artificial sequence
  SiRNA target sequence
gaaactattacatattttgatgaaa

SEQ ID NO: 60583 - DNA, 25 bp, Artificial sequence
  SiRNA target sequence
aaactattacatattttgatgaaaa

SEQ ID NO: 60584 - DNA, 25 bp, Artificial sequence
  SiRNA target sequence
aactattacatattttgatgaaaat

SEQ ID NO: 60585 - DNA, 25 bp, Artificial sequence
  SiRNA target sequence
actattacatattttgatgaaaatc

SEQ ID NO: 60586 - DNA, 25 bp, Artificial sequence
  SiRNA target sequence
ctattacatattttgatgaaaatca

SEQ ID NO: 60587 - DNA, 25 bp, Artificial sequence
  SiRNA target sequence
tattacatattttgatgaaaatcaa

SEQ ID NO: 60588 - DNA, 25 bp, Artificial sequence
  SiRNA target sequence
attacatattttgatgaaaatcaaa

SEQ ID NO: 60589 - DNA, 25 bp, Artificial sequence
  SiRNA target sequence
ttacatattttgatgaaaatcaaaa

SEQ ID NO: 60590 - DNA, 25 bp, Artificial sequence
  SiRNA target sequence
tacatattttgatgaaaatcaaaaa

SEQ ID NO: 60591 - DNA, 25 bp, Artificial sequence
  SiRNA target sequence
acatattttgatgaaaatcaaaaac

SEQ ID NO: 60592 - DNA, 25 bp, Artificial sequence
  SiRNA target sequence
catattttgatgaaaatcaaaaacc

SEQ ID NO: 60593 - DNA, 25 bp, Artificial sequence
  SiRNA target sequence
atattttgatgaaaatcaaaaaccg

SEQ ID NO: 60594 - DNA, 25 bp, Artificial sequence
  SiRNA target sequence
tattttgatgaaaatcaaaaaccgg

SEQ ID NO: 60595 - DNA, 25 bp, Artificial sequence
  SiRNA target sequence
attttgatgaaaatcaaaaaccggt

SEQ ID NO: 60596 - DNA, 25 bp, Artificial sequence
  SiRNA target sequence
ttttgatgaaaatcaaaaaccggta

SEQ ID NO: 60597 - DNA, 25 bp, Artificial sequence
  SiRNA target sequence
tttgatgaaaatcaaaaaccggtag

SEQ ID NO: 60598 - DNA, 25 bp, Artificial sequence
  SiRNA target sequence
ttgatgaaaatcaaaaaccggtaga

SEQ ID NO: 60599 - DNA, 25 bp, Artificial sequence
  SiRNA target sequence
tgatgaaaatcaaaaaccggtagaa

SEQ ID NO: 60600 - DNA, 25 bp, Artificial sequence
  SiRNA target sequence
gatgaaaatcaaaaaccggtagaat

SEQ ID NO: 60601 - DNA, 25 bp, Artificial sequence
  SiRNA target sequence
atgaaaatcaaaaaccggtagaata

SEQ ID NO: 60602 - DNA, 25 bp, Artificial sequence
  SiRNA target sequence
tgaaaatcaaaaaccggtagaatat

SEQ ID NO: 60603 - DNA, 25 bp, Artificial sequence
  SiRNA target sequence
gaaaatcaaaaaccggtagaatatt

SEQ ID NO: 60604 - DNA, 25 bp, Artificial sequence
  SiRNA target sequence
aaaatcaaaaaccggtagaatattt

SEQ ID NO: 60605 - DNA, 25 bp, Artificial sequence
  SiRNA target sequence
aaatcaaaaaccggtagaatatttt

SEQ ID NO: 60606 - DNA, 25 bp, Artificial sequence
  SiRNA target sequence
aatcaaaaaccggtagaatattttg

SEQ ID NO: 60607 - DNA, 25 bp, Artificial sequence
  SiRNA target sequence
atcaaaaaccggtagaatattttgg

SEQ ID NO: 60608 - DNA, 25 bp, Artificial sequence
  SiRNA target sequence
tcaaaaaccggtagaatattttggg

SEQ ID NO: 60609 - DNA, 25 bp, Artificial sequence
  SiRNA target sequence
caaaaaccggtagaatattttgggg

SEQ ID NO: 60610 - DNA, 25 bp, Artificial sequence
  SiRNA target sequence
aaaaaccggtagaatattttggggt

SEQ ID NO: 60611 - DNA, 25 bp, Artificial sequence
  SiRNA target sequence
aaaaccggtagaatattttggggta

SEQ ID NO: 60612 - DNA, 25 bp, Artificial sequence
  SiRNA target sequence
aaaccggtagaatattttggggtaa

SEQ ID NO: 60613 - DNA, 25 bp, Artificial sequence
  SiRNA target sequence
aaccggtagaatattttggggtaaa

SEQ ID NO: 60614 - DNA, 25 bp, Artificial sequence
  SiRNA target sequence
accggtagaatattttggggtaaag

SEQ ID NO: 60615 - DNA, 25 bp, Artificial sequence
  SiRNA target sequence
ccggtagaatattttggggtaaagt

SEQ ID NO: 60616 - DNA, 25 bp, Artificial sequence
  SiRNA target sequence
cggtagaatattttggggtaaagtc

SEQ ID NO: 60617 - DNA, 25 bp, Artificial sequence
  SiRNA target sequence
ggtagaatattttggggtaaagtct

SEQ ID NO: 60618 - DNA, 25 bp, Artificial sequence
  SiRNA target sequence
gtagaatattttggggtaaagtctc

SEQ ID NO: 60619 - DNA, 25 bp, Artificial sequence
  SiRNA target sequence
tagaatattttggggtaaagtctca

SEQ ID NO: 60620 - DNA, 25 bp, Artificial sequence
  SiRNA target sequence
agaatattttggggtaaagtctcac

SEQ ID NO: 60621 - DNA, 25 bp, Artificial sequence
  SiRNA target sequence
gaatattttggggtaaagtctcaca

SEQ ID NO: 60622 - DNA, 25 bp, Artificial sequence
  SiRNA target sequence
aatattttggggtaaagtctcacag

SEQ ID NO: 60623 - DNA, 25 bp, Artificial sequence
  SiRNA target sequence
atattttggggtaaagtctcacaga

SEQ ID NO: 60624 - DNA, 25 bp, Artificial sequence
  SiRNA target sequence
tattttggggtaaagtctcacagaa

SEQ ID NO: 60625 - DNA, 25 bp, Artificial sequence
  SiRNA target sequence
attttggggtaaagtctcacagaat

SEQ ID NO: 60626 - DNA, 25 bp, Artificial sequence
  SiRNA target sequence
ttttggggtaaagtctcacagaatt

SEQ ID NO: 60627 - DNA, 25 bp, Artificial sequence
  SiRNA target sequence
tttggggtaaagtctcacagaattt

SEQ ID NO: 60628 - DNA, 25 bp, Artificial sequence
  SiRNA target sequence
ttggggtaaagtctcacagaatttt

SEQ ID NO: 60629 - DNA, 25 bp, Artificial sequence
  SiRNA target sequence
tggggtaaagtctcacagaattttg

SEQ ID NO: 60630 - DNA, 25 bp, Artificial sequence
  SiRNA target sequence
ggggtaaagtctcacagaattttgt

SEQ ID NO: 60631 - DNA, 25 bp, Artificial sequence
  SiRNA target sequence
gggtaaagtctcacagaattttgtt

SEQ ID NO: 60632 - DNA, 25 bp, Artificial sequence
  SiRNA target sequence
ggtaaagtctcacagaattttgttc

SEQ ID NO: 60633 - DNA, 25 bp, Artificial sequence
  SiRNA target sequence
gtaaagtctcacagaattttgttct

SEQ ID NO: 60634 - DNA, 25 bp, Artificial sequence
  SiRNA target sequence
taaagtctcacagaattttgttctc

SEQ ID NO: 60635 - DNA, 25 bp, Artificial sequence
  SiRNA target sequence
aaagtctcacagaattttgttctct

SEQ ID NO: 60636 - DNA, 25 bp, Artificial sequence
  SiRNA target sequence
aagtctcacagaattttgttctctc

SEQ ID NO: 60637 - DNA, 25 bp, Artificial sequence
  SiRNA target sequence
agtctcacagaattttgttctctct

SEQ ID NO: 60638 - DNA, 25 bp, Artificial sequence
  SiRNA target sequence
gtctcacagaattttgttctctctt

SEQ ID NO: 60639 - DNA, 25 bp, Artificial sequence
  SiRNA target sequence
tctcacagaattttgttctctcttt

SEQ ID NO: 60640 - DNA, 25 bp, Artificial sequence
  SiRNA target sequence
ctcacagaattttgttctctctttt

SEQ ID NO: 60641 - DNA, 25 bp, Artificial sequence
  SiRNA target sequence
tcacagaattttgttctctctttta

SEQ ID NO: 60642 - DNA, 25 bp, Artificial sequence
  SiRNA target sequence
cacagaattttgttctctcttttat

SEQ ID NO: 60643 - DNA, 25 bp, Artificial sequence
  SiRNA target sequence
acagaattttgttctctcttttata

SEQ ID NO: 60644 - DNA, 25 bp, Artificial sequence
  SiRNA target sequence
cagaattttgttctctcttttatat

SEQ ID NO: 60645 - DNA, 25 bp, Artificial sequence
  SiRNA target sequence
agaattttgttctctcttttatata

SEQ ID NO: 60646 - DNA, 25 bp, Artificial sequence
  SiRNA target sequence
gaattttgttctctcttttatatat

SEQ ID NO: 60647 - DNA, 25 bp, Artificial sequence
  SiRNA target sequence
aattttgttctctcttttatatata

SEQ ID NO: 60648 - DNA, 25 bp, Artificial sequence
  SiRNA target sequence
attttgttctctcttttatatatac

SEQ ID NO: 60649 - DNA, 25 bp, Artificial sequence
  SiRNA target sequence
ttttgttctctcttttatatataca

SEQ ID NO: 60650 - DNA, 25 bp, Artificial sequence
  SiRNA target sequence
tttgttctctcttttatatatacaa

SEQ ID NO: 60651 - DNA, 25 bp, Artificial sequence
  SiRNA target sequence
ttgttctctcttttatatatacaaa

SEQ ID NO: 60652 - DNA, 25 bp, Artificial sequence
  SiRNA target sequence
tgttctctcttttatatatacaaaa

SEQ ID NO: 60653 - DNA, 25 bp, Artificial sequence
  SiRNA target sequence
gttctctcttttatatatacaaaaa

SEQ ID NO: 60654 - DNA, 25 bp, Artificial sequence
  SiRNA target sequence
ttctctcttttatatatacaaaaaa

SEQ ID NO: 60655 - DNA, 25 bp, Artificial sequence
  SiRNA target sequence
tctctcttttatatatacaaaaaat

SEQ ID NO: 60656 - DNA, 25 bp, Artificial sequence
  SiRNA target sequence
ctctcttttatatatacaaaaaatg

SEQ ID NO: 60657 - DNA, 25 bp, Artificial sequence
  SiRNA target sequence
tctcttttatatatacaaaaaatga

SEQ ID NO: 60658 - DNA, 25 bp, Artificial sequence
  SiRNA target sequence
ctcttttatatatacaaaaaatgac

SEQ ID NO: 60659 - DNA, 25 bp, Artificial sequence
  SiRNA target sequence
tcttttatatatacaaaaaatgaca

SEQ ID NO: 60660 - DNA, 25 bp, Artificial sequence
  SiRNA target sequence
cttttatatatacaaaaaatgacat

SEQ ID NO: 60661 - DNA, 25 bp, Artificial sequence
  SiRNA target sequence
ttttatatatacaaaaaatgacatt

SEQ ID NO: 60662 - DNA, 25 bp, Artificial sequence
  SiRNA target sequence
tttatatatacaaaaaatgacattt

SEQ ID NO: 60663 - DNA, 25 bp, Artificial sequence
  SiRNA target sequence
ttatatatacaaaaaatgacatttg

SEQ ID NO: 60664 - DNA, 25 bp, Artificial sequence
  SiRNA target sequence
tatatatacaaaaaatgacatttgc

SEQ ID NO: 60665 - DNA, 25 bp, Artificial sequence
  SiRNA target sequence
atatatacaaaaaatgacatttgcg

SEQ ID NO: 60666 - DNA, 25 bp, Artificial sequence
  SiRNA target sequence
tatatacaaaaaatgacatttgcga

SEQ ID NO: 60667 - DNA, 25 bp, Artificial sequence
  SiRNA target sequence
atatacaaaaaatgacatttgcgat

SEQ ID NO: 60668 - DNA, 25 bp, Artificial sequence
  SiRNA target sequence
tatacaaaaaatgacatttgcgata

SEQ ID NO: 60669 - DNA, 25 bp, Artificial sequence
  SiRNA target sequence
atacaaaaaatgacatttgcgatac

SEQ ID NO: 60670 - DNA, 25 bp, Artificial sequence
  SiRNA target sequence
tacaaaaaatgacatttgcgataca

SEQ ID NO: 60671 - DNA, 25 bp, Artificial sequence
  SiRNA target sequence
acaaaaaatgacatttgcgatacag

SEQ ID NO: 60672 - DNA, 25 bp, Artificial sequence
  SiRNA target sequence
caaaaaatgacatttgcgatacagg

SEQ ID NO: 60673 - DNA, 25 bp, Artificial sequence
  SiRNA target sequence
aaaaaatgacatttgcgatacaggc

SEQ ID NO: 60674 - DNA, 25 bp, Artificial sequence
  SiRNA target sequence
aaaaatgacatttgcgatacaggca

SEQ ID NO: 60675 - DNA, 25 bp, Artificial sequence
  SiRNA target sequence
aaaatgacatttgcgatacaggcaa

SEQ ID NO: 60676 - DNA, 25 bp, Artificial sequence
  SiRNA target sequence
aaatgacatttgcgatacaggcaat

SEQ ID NO: 60677 - DNA, 25 bp, Artificial sequence
  SiRNA target sequence
aatgacatttgcgatacaggcaatt

SEQ ID NO: 60678 - DNA, 25 bp, Artificial sequence
  SiRNA target sequence
atgacatttgcgatacaggcaatta

SEQ ID NO: 60679 - DNA, 25 bp, Artificial sequence
  SiRNA target sequence
tgacatttgcgatacaggcaattat

SEQ ID NO: 60680 - DNA, 25 bp, Artificial sequence
  SiRNA target sequence
gacatttgcgatacaggcaattatt

SEQ ID NO: 60681 - DNA, 25 bp, Artificial sequence
  SiRNA target sequence
acatttgcgatacaggcaattatta

SEQ ID NO: 60682 - DNA, 25 bp, Artificial sequence
  SiRNA target sequence
catttgcgatacaggcaattattat

SEQ ID NO: 60683 - DNA, 25 bp, Artificial sequence
  SiRNA target sequence
atttgcgatacaggcaattattatt

SEQ ID NO: 60684 - DNA, 25 bp, Artificial sequence
  SiRNA target sequence
tttgcgatacaggcaattattatta

SEQ ID NO: 60685 - DNA, 25 bp, Artificial sequence
  SiRNA target sequence
ttgcgatacaggcaattattattat

SEQ ID NO: 60686 - DNA, 25 bp, Artificial sequence
  SiRNA target sequence
tgcgatacaggcaattattattatc

SEQ ID NO: 60687 - DNA, 25 bp, Artificial sequence
  SiRNA target sequence
gcgatacaggcaattattattatca

SEQ ID NO: 60688 - DNA, 25 bp, Artificial sequence
  SiRNA target sequence
cgatacaggcaattattattatcac

SEQ ID NO: 60689 - DNA, 25 bp, Artificial sequence
  SiRNA target sequence
gatacaggcaattattattatcaca

SEQ ID NO: 60690 - DNA, 25 bp, Artificial sequence
  SiRNA target sequence
atacaggcaattattattatcacat

SEQ ID NO: 60691 - DNA, 25 bp, Artificial sequence
  SiRNA target sequence
tacaggcaattattattatcacatt

SEQ ID NO: 60692 - DNA, 25 bp, Artificial sequence
  SiRNA target sequence
acaggcaattattattatcacatta

SEQ ID NO: 60693 - DNA, 25 bp, Artificial sequence
  SiRNA target sequence
caggcaattattattatcacattag

SEQ ID NO: 60694 - DNA, 25 bp, Artificial sequence
  SiRNA target sequence
aggcaattattattatcacattagg

SEQ ID NO: 60695 - DNA, 25 bp, Artificial sequence
  SiRNA target sequence
ggcaattattattatcacattagga

SEQ ID NO: 60696 - DNA, 25 bp, Artificial sequence
  SiRNA target sequence
gcaattattattatcacattaggat

SEQ ID NO: 60697 - DNA, 25 bp, Artificial sequence
  SiRNA target sequence
caattattattatcacattaggatc

SEQ ID NO: 60698 - DNA, 25 bp, Artificial sequence
  SiRNA target sequence
aattattattatcacattaggatct

SEQ ID NO: 60699 - DNA, 25 bp, Artificial sequence
  SiRNA target sequence
attattattatcacattaggatctt

SEQ ID NO: 60700 - DNA, 25 bp, Artificial sequence
  SiRNA target sequence
ttattattatcacattaggatcttt

SEQ ID NO: 60701 - DNA, 25 bp, Artificial sequence
  SiRNA target sequence
tattattatcacattaggatctttt

SEQ ID NO: 60702 - DNA, 25 bp, Artificial sequence
  SiRNA target sequence
attattatcacattaggatcttttg

SEQ ID NO: 60703 - DNA, 25 bp, Artificial sequence
  SiRNA target sequence
ttattatcacattaggatcttttgg

SEQ ID NO: 60704 - DNA, 25 bp, Artificial sequence
  SiRNA target sequence
tattatcacattaggatcttttgga

SEQ ID NO: 60705 - DNA, 25 bp, Artificial sequence
  SiRNA target sequence
attatcacattaggatcttttggat

SEQ ID NO: 60706 - DNA, 25 bp, Artificial sequence
  SiRNA target sequence
ttatcacattaggatcttttggata

SEQ ID NO: 60707 - DNA, 25 bp, Artificial sequence
  SiRNA target sequence
tatcacattaggatcttttggatat

SEQ ID NO: 60708 - DNA, 25 bp, Artificial sequence
  SiRNA target sequence
atcacattaggatcttttggatatt

SEQ ID NO: 60709 - DNA, 25 bp, Artificial sequence
  SiRNA target sequence
tcacattaggatcttttggatattt

SEQ ID NO: 60710 - DNA, 25 bp, Artificial sequence
  SiRNA target sequence
cacattaggatcttttggatatttt

SEQ ID NO: 60711 - DNA, 25 bp, Artificial sequence
  SiRNA target sequence
acattaggatcttttggatattttc

SEQ ID NO: 60712 - DNA, 25 bp, Artificial sequence
  SiRNA target sequence
cattaggatcttttggatattttcc

SEQ ID NO: 60713 - DNA, 25 bp, Artificial sequence
  SiRNA target sequence
attaggatcttttggatattttccg

SEQ ID NO: 60714 - DNA, 25 bp, Artificial sequence
  SiRNA target sequence
ttaggatcttttggatattttccga

SEQ ID NO: 60715 - DNA, 25 bp, Artificial sequence
  SiRNA target sequence
taggatcttttggatattttccgat

SEQ ID NO: 60716 - DNA, 25 bp, Artificial sequence
  SiRNA target sequence
aggatcttttggatattttccgatt

SEQ ID NO: 60717 - DNA, 25 bp, Artificial sequence
  SiRNA target sequence
ggatcttttggatattttccgatta

SEQ ID NO: 60718 - DNA, 25 bp, Artificial sequence
  SiRNA target sequence
gatcttttggatattttccgattaa

SEQ ID NO: 60719 - DNA, 25 bp, Artificial sequence
  SiRNA target sequence
atcttttggatattttccgattaaa

SEQ ID NO: 60720 - DNA, 25 bp, Artificial sequence
  SiRNA target sequence
tcttttggatattttccgattaaat

SEQ ID NO: 60721 - DNA, 25 bp, Artificial sequence
  SiRNA target sequence
cttttggatattttccgattaaatt

SEQ ID NO: 60722 - DNA, 25 bp, Artificial sequence
  SiRNA target sequence
ttttggatattttccgattaaatta

SEQ ID NO: 60723 - DNA, 25 bp, Artificial sequence
  SiRNA target sequence
tttggatattttccgattaaattat

SEQ ID NO: 60724 - DNA, 25 bp, Artificial sequence
  SiRNA target sequence
ttggatattttccgattaaattatc

SEQ ID NO: 60725 - DNA, 25 bp, Artificial sequence
  SiRNA target sequence
tggatattttccgattaaattatcc

SEQ ID NO: 60726 - DNA, 25 bp, Artificial sequence
  SiRNA target sequence
ggatattttccgattaaattatcct

SEQ ID NO: 60727 - DNA, 25 bp, Artificial sequence
  SiRNA target sequence
gatattttccgattaaattatcctc

SEQ ID NO: 60728 - DNA, 25 bp, Artificial sequence
  SiRNA target sequence
atattttccgattaaattatcctct

SEQ ID NO: 60729 - DNA, 25 bp, Artificial sequence
  SiRNA target sequence
tattttccgattaaattatcctctc

SEQ ID NO: 60730 - DNA, 25 bp, Artificial sequence
  SiRNA target sequence
attttccgattaaattatcctctca

SEQ ID NO: 60731 - DNA, 25 bp, Artificial sequence
  SiRNA target sequence
ttttccgattaaattatcctctcaa

SEQ ID NO: 60732 - DNA, 25 bp, Artificial sequence
  SiRNA target sequence
tttccgattaaattatcctctcaac

SEQ ID NO: 60733 - DNA, 25 bp, Artificial sequence
  SiRNA target sequence
ttccgattaaattatcctctcaaca

SEQ ID NO: 60734 - DNA, 25 bp, Artificial sequence
  SiRNA target sequence
tccgattaaattatcctctcaacag

SEQ ID NO: 60735 - DNA, 25 bp, Artificial sequence
  SiRNA target sequence
ccgattaaattatcctctcaacagt

SEQ ID NO: 60736 - DNA, 25 bp, Artificial sequence
  SiRNA target sequence
cgattaaattatcctctcaacagtt

SEQ ID NO: 60737 - DNA, 25 bp, Artificial sequence
  SiRNA target sequence
gattaaattatcctctcaacagtta

SEQ ID NO: 60738 - DNA, 25 bp, Artificial sequence
  SiRNA target sequence
attaaattatcctctcaacagttag

SEQ ID NO: 60739 - DNA, 25 bp, Artificial sequence
  SiRNA target sequence
ttaaattatcctctcaacagttagt

SEQ ID NO: 60740 - DNA, 25 bp, Artificial sequence
  SiRNA target sequence
taaattatcctctcaacagttagtc

SEQ ID NO: 60741 - DNA, 25 bp, Artificial sequence
  SiRNA target sequence
aaattatcctctcaacagttagtct

SEQ ID NO: 60742 - DNA, 25 bp, Artificial sequence
  SiRNA target sequence
aattatcctctcaacagttagtctt

SEQ ID NO: 60743 - DNA, 25 bp, Artificial sequence
  SiRNA target sequence
attatcctctcaacagttagtcttt

SEQ ID NO: 60744 - DNA, 25 bp, Artificial sequence
  SiRNA target sequence
ttatcctctcaacagttagtctttt

SEQ ID NO: 60745 - DNA, 25 bp, Artificial sequence
  SiRNA target sequence
tatcctctcaacagttagtctttta

SEQ ID NO: 60746 - DNA, 25 bp, Artificial sequence
  SiRNA target sequence
atcctctcaacagttagtcttttat

SEQ ID NO: 60747 - DNA, 25 bp, Artificial sequence
  SiRNA target sequence
tcctctcaacagttagtcttttata

SEQ ID NO: 60748 - DNA, 25 bp, Artificial sequence
  SiRNA target sequence
cctctcaacagttagtcttttatat

SEQ ID NO: 60749 - DNA, 25 bp, Artificial sequence
  SiRNA target sequence
ctctcaacagttagtcttttatatt

SEQ ID NO: 60750 - DNA, 25 bp, Artificial sequence
  SiRNA target sequence
tctcaacagttagtcttttatattt

SEQ ID NO: 60751 - DNA, 25 bp, Artificial sequence
  SiRNA target sequence
ctcaacagttagtcttttatatttc

SEQ ID NO: 60752 - DNA, 25 bp, Artificial sequence
  SiRNA target sequence
tcaacagttagtcttttatatttcg

SEQ ID NO: 60753 - DNA, 25 bp, Artificial sequence
  SiRNA target sequence
caacagttagtcttttatatttcga

SEQ ID NO: 60754 - DNA, 25 bp, Artificial sequence
  SiRNA target sequence
aacagttagtcttttatatttcgat

SEQ ID NO: 60755 - DNA, 25 bp, Artificial sequence
  SiRNA target sequence
acagttagtcttttatatttcgatt

SEQ ID NO: 60756 - DNA, 25 bp, Artificial sequence
  SiRNA target sequence
cagttagtcttttatatttcgatta

SEQ ID NO: 60757 - DNA, 25 bp, Artificial sequence
  SiRNA target sequence
agttagtcttttatatttcgattag

SEQ ID NO: 60758 - DNA, 25 bp, Artificial sequence
  SiRNA target sequence
gttagtcttttatatttcgattagt

SEQ ID NO: 60759 - DNA, 25 bp, Artificial sequence
  SiRNA target sequence
ttagtcttttatatttcgattagta

SEQ ID NO: 60760 - DNA, 25 bp, Artificial sequence
  SiRNA target sequence
tagtcttttatatttcgattagtaa

SEQ ID NO: 60761 - DNA, 25 bp, Artificial sequence
  SiRNA target sequence
agtcttttatatttcgattagtaaa

SEQ ID NO: 60762 - DNA, 25 bp, Artificial sequence
  SiRNA target sequence
gtcttttatatttcgattagtaaaa

SEQ ID NO: 60763 - DNA, 25 bp, Artificial sequence
  SiRNA target sequence
tcttttatatttcgattagtaaaac

SEQ ID NO: 60764 - DNA, 25 bp, Artificial sequence
  SiRNA target sequence
cttttatatttcgattagtaaaacg

SEQ ID NO: 60765 - DNA, 25 bp, Artificial sequence
  SiRNA target sequence
ttttatatttcgattagtaaaacgt

SEQ ID NO: 60766 - DNA, 25 bp, Artificial sequence
  SiRNA target sequence
tttatatttcgattagtaaaacgtt

SEQ ID NO: 60767 - DNA, 25 bp, Artificial sequence
  SiRNA target sequence
ttatatttcgattagtaaaacgttg

SEQ ID NO: 60768 - DNA, 25 bp, Artificial sequence
  SiRNA target sequence
tatatttcgattagtaaaacgttga

SEQ ID NO: 60769 - DNA, 25 bp, Artificial sequence
  SiRNA target sequence
atatttcgattagtaaaacgttgac

SEQ ID NO: 60770 - DNA, 25 bp, Artificial sequence
  SiRNA target sequence
tatttcgattagtaaaacgttgaca

SEQ ID NO: 60771 - DNA, 25 bp, Artificial sequence
  SiRNA target sequence
atttcgattagtaaaacgttgacaa

SEQ ID NO: 60772 - DNA, 25 bp, Artificial sequence
  SiRNA target sequence
tttcgattagtaaaacgttgacaaa

SEQ ID NO: 60773 - DNA, 25 bp, Artificial sequence
  SiRNA target sequence
ttcgattagtaaaacgttgacaaat

SEQ ID NO: 60774 - DNA, 25 bp, Artificial sequence
  SiRNA target sequence
tcgattagtaaaacgttgacaaatt

SEQ ID NO: 60775 - DNA, 25 bp, Artificial sequence
  SiRNA target sequence
cgattagtaaaacgttgacaaattc

SEQ ID NO: 60776 - DNA, 25 bp, Artificial sequence
  SiRNA target sequence
gattagtaaaacgttgacaaattcg

SEQ ID NO: 60777 - DNA, 25 bp, Artificial sequence
  SiRNA target sequence
attagtaaaacgttgacaaattcgt

SEQ ID NO: 60778 - DNA, 25 bp, Artificial sequence
  SiRNA target sequence
ttagtaaaacgttgacaaattcgtt

SEQ ID NO: 60779 - DNA, 25 bp, Artificial sequence
  SiRNA target sequence
tagtaaaacgttgacaaattcgttg

SEQ ID NO: 60780 - DNA, 25 bp, Artificial sequence
  SiRNA target sequence
agtaaaacgttgacaaattcgttga

SEQ ID NO: 60781 - DNA, 25 bp, Artificial sequence
  SiRNA target sequence
gtaaaacgttgacaaattcgttgag

SEQ ID NO: 60782 - DNA, 25 bp, Artificial sequence
  SiRNA target sequence
taaaacgttgacaaattcgttgagc

SEQ ID NO: 60783 - DNA, 25 bp, Artificial sequence
  SiRNA target sequence
aaaacgttgacaaattcgttgagcg

SEQ ID NO: 60784 - DNA, 25 bp, Artificial sequence
  SiRNA target sequence
aaacgttgacaaattcgttgagcga

SEQ ID NO: 60785 - DNA, 25 bp, Artificial sequence
  SiRNA target sequence
aacgttgacaaattcgttgagcgaa

SEQ ID NO: 60786 - DNA, 25 bp, Artificial sequence
  SiRNA target sequence
acgttgacaaattcgttgagcgaaa

SEQ ID NO: 60787 - DNA, 25 bp, Artificial sequence
  SiRNA target sequence
cgttgacaaattcgttgagcgaaat

SEQ ID NO: 60788 - DNA, 25 bp, Artificial sequence
  SiRNA target sequence
gttgacaaattcgttgagcgaaatg

SEQ ID NO: 60789 - DNA, 25 bp, Artificial sequence
  SiRNA target sequence
ttgacaaattcgttgagcgaaatgg

SEQ ID NO: 60790 - DNA, 25 bp, Artificial sequence
  SiRNA target sequence
tgacaaattcgttgagcgaaatggg

SEQ ID NO: 60791 - DNA, 25 bp, Artificial sequence
  SiRNA target sequence
gacaaattcgttgagcgaaatggga

SEQ ID NO: 60792 - DNA, 25 bp, Artificial sequence
  SiRNA target sequence
acaaattcgttgagcgaaatgggaa

SEQ ID NO: 60793 - DNA, 25 bp, Artificial sequence
  SiRNA target sequence
caaattcgttgagcgaaatgggaat

SEQ ID NO: 60794 - DNA, 25 bp, Artificial sequence
  SiRNA target sequence
aaattcgttgagcgaaatgggaatg

SEQ ID NO: 60795 - DNA, 25 bp, Artificial sequence
  SiRNA target sequence
aattcgttgagcgaaatgggaatgc

SEQ ID NO: 60796 - DNA, 25 bp, Artificial sequence
  SiRNA target sequence
attcgttgagcgaaatgggaatgct

SEQ ID NO: 60797 - DNA, 25 bp, Artificial sequence
  SiRNA target sequence
ttcgttgagcgaaatgggaatgcta

SEQ ID NO: 60798 - DNA, 25 bp, Artificial sequence
  SiRNA target sequence
tcgttgagcgaaatgggaatgctat

SEQ ID NO: 60799 - DNA, 25 bp, Artificial sequence
  SiRNA target sequence
cgttgagcgaaatgggaatgctata

SEQ ID NO: 60800 - DNA, 25 bp, Artificial sequence
  SiRNA target sequence
gttgagcgaaatgggaatgctatac

SEQ ID NO: 60801 - DNA, 25 bp, Artificial sequence
  SiRNA target sequence
ttgagcgaaatgggaatgctataca

SEQ ID NO: 60802 - DNA, 25 bp, Artificial sequence
  SiRNA target sequence
tgagcgaaatgggaatgctatacac

SEQ ID NO: 60803 - DNA, 25 bp, Artificial sequence
  SiRNA target sequence
gagcgaaatgggaatgctatacaca

SEQ ID NO: 60804 - DNA, 25 bp, Artificial sequence
  SiRNA target sequence
agcgaaatgggaatgctatacacaa

SEQ ID NO: 60805 - DNA, 25 bp, Artificial sequence
  SiRNA target sequence
gcgaaatgggaatgctatacacaag

SEQ ID NO: 60806 - DNA, 25 bp, Artificial sequence
  SiRNA target sequence
cgaaatgggaatgctatacacaaga

SEQ ID NO: 60807 - DNA, 25 bp, Artificial sequence
  SiRNA target sequence
gaaatgggaatgctatacacaagat

SEQ ID NO: 60808 - DNA, 25 bp, Artificial sequence
  SiRNA target sequence
aaatgggaatgctatacacaagata

SEQ ID NO: 60809 - DNA, 25 bp, Artificial sequence
  SiRNA target sequence
aatgggaatgctatacacaagatat

SEQ ID NO: 60810 - DNA, 25 bp, Artificial sequence
  SiRNA target sequence
atgggaatgctatacacaagatatg

SEQ ID NO: 60811 - DNA, 25 bp, Artificial sequence
  SiRNA target sequence
tgggaatgctatacacaagatatgt

SEQ ID NO: 60812 - DNA, 25 bp, Artificial sequence
  SiRNA target sequence
gggaatgctatacacaagatatgta

SEQ ID NO: 60813 - DNA, 25 bp, Artificial sequence
  SiRNA target sequence
ggaatgctatacacaagatatgtac

SEQ ID NO: 60814 - DNA, 25 bp, Artificial sequence
  SiRNA target sequence
gaatgctatacacaagatatgtaca

SEQ ID NO: 60815 - DNA, 25 bp, Artificial sequence
  SiRNA target sequence
aatgctatacacaagatatgtacaa

SEQ ID NO: 60816 - DNA, 25 bp, Artificial sequence
  SiRNA target sequence
atgctatacacaagatatgtacaag

SEQ ID NO: 60817 - DNA, 25 bp, Artificial sequence
  SiRNA target sequence
tgctatacacaagatatgtacaagg

SEQ ID NO: 60818 - DNA, 25 bp, Artificial sequence
  SiRNA target sequence
gctatacacaagatatgtacaagga

SEQ ID NO: 60819 - DNA, 25 bp, Artificial sequence
  SiRNA target sequence
ctatacacaagatatgtacaaggat

SEQ ID NO: 60820 - DNA, 25 bp, Artificial sequence
  SiRNA target sequence
tatacacaagatatgtacaaggatt

SEQ ID NO: 60821 - DNA, 25 bp, Artificial sequence
  SiRNA target sequence
atacacaagatatgtacaaggattt

SEQ ID NO: 60822 - DNA, 25 bp, Artificial sequence
  SiRNA target sequence
tacacaagatatgtacaaggatttt

SEQ ID NO: 60823 - DNA, 25 bp, Artificial sequence
  SiRNA target sequence
acacaagatatgtacaaggattttt

SEQ ID NO: 60824 - DNA, 25 bp, Artificial sequence
  SiRNA target sequence
cacaagatatgtacaaggattttta

SEQ ID NO: 60825 - DNA, 25 bp, Artificial sequence
  SiRNA target sequence
acaagatatgtacaaggatttttaa

SEQ ID NO: 60826 - DNA, 25 bp, Artificial sequence
  SiRNA target sequence
caagatatgtacaaggatttttaaa

SEQ ID NO: 60827 - DNA, 25 bp, Artificial sequence
  SiRNA target sequence
aagatatgtacaaggatttttaaat

SEQ ID NO: 60828 - DNA, 25 bp, Artificial sequence
  SiRNA target sequence
agatatgtacaaggatttttaaatg

SEQ ID NO: 60829 - DNA, 25 bp, Artificial sequence
  SiRNA target sequence
gatatgtacaaggatttttaaatgc

SEQ ID NO: 60830 - DNA, 25 bp, Artificial sequence
  SiRNA target sequence
atatgtacaaggatttttaaatgca

SEQ ID NO: 60831 - DNA, 25 bp, Artificial sequence
  SiRNA target sequence
tatgtacaaggatttttaaatgcaa

SEQ ID NO: 60832 - DNA, 25 bp, Artificial sequence
  SiRNA target sequence
atgtacaaggatttttaaatgcaaa

SEQ ID NO: 60833 - DNA, 25 bp, Artificial sequence
  SiRNA target sequence
tgtacaaggatttttaaatgcaaag

SEQ ID NO: 60834 - DNA, 25 bp, Artificial sequence
  SiRNA target sequence
gtacaaggatttttaaatgcaaagt

SEQ ID NO: 60835 - DNA, 25 bp, Artificial sequence
  SiRNA target sequence
tacaaggatttttaaatgcaaagtc

SEQ ID NO: 60836 - DNA, 25 bp, Artificial sequence
  SiRNA target sequence
acaaggatttttaaatgcaaagtct

SEQ ID NO: 60837 - DNA, 25 bp, Artificial sequence
  SiRNA target sequence
caaggatttttaaatgcaaagtctg

SEQ ID NO: 60838 - DNA, 25 bp, Artificial sequence
  SiRNA target sequence
aaggatttttaaatgcaaagtctgg

SEQ ID NO: 60839 - DNA, 25 bp, Artificial sequence
  SiRNA target sequence
aggatttttaaatgcaaagtctgga

SEQ ID NO: 60840 - DNA, 25 bp, Artificial sequence
  SiRNA target sequence
ggatttttaaatgcaaagtctggat

SEQ ID NO: 60841 - DNA, 25 bp, Artificial sequence
  SiRNA target sequence
gatttttaaatgcaaagtctggata

SEQ ID NO: 60842 - DNA, 25 bp, Artificial sequence
  SiRNA target sequence
atttttaaatgcaaagtctggatat

SEQ ID NO: 60843 - DNA, 25 bp, Artificial sequence
  SiRNA target sequence
tttttaaatgcaaagtctggatatt

SEQ ID NO: 60844 - DNA, 25 bp, Artificial sequence
  SiRNA target sequence
ttttaaatgcaaagtctggatatta

SEQ ID NO: 60845 - DNA, 25 bp, Artificial sequence
  SiRNA target sequence
tttaaatgcaaagtctggatattac

SEQ ID NO: 60846 - DNA, 25 bp, Artificial sequence
  SiRNA target sequence
ttaaatgcaaagtctggatattacg

SEQ ID NO: 60847 - DNA, 25 bp, Artificial sequence
  SiRNA target sequence
taaatgcaaagtctggatattacga

SEQ ID NO: 60848 - DNA, 25 bp, Artificial sequence
  SiRNA target sequence
aaatgcaaagtctggatattacgag

SEQ ID NO: 60849 - DNA, 25 bp, Artificial sequence
  SiRNA target sequence
aatgcaaagtctggatattacgagt

SEQ ID NO: 60850 - DNA, 25 bp, Artificial sequence
  SiRNA target sequence
atgcaaagtctggatattacgagtt

SEQ ID NO: 60851 - DNA, 25 bp, Artificial sequence
  SiRNA target sequence
tgcaaagtctggatattacgagttt

SEQ ID NO: 60852 - DNA, 25 bp, Artificial sequence
  SiRNA target sequence
gcaaagtctggatattacgagttta

SEQ ID NO: 60853 - DNA, 25 bp, Artificial sequence
  SiRNA target sequence
caaagtctggatattacgagtttaa

SEQ ID NO: 60854 - DNA, 25 bp, Artificial sequence
  SiRNA target sequence
aaagtctggatattacgagtttaaa

SEQ ID NO: 60855 - DNA, 25 bp, Artificial sequence
  SiRNA target sequence
aagtctggatattacgagtttaaag

SEQ ID NO: 60856 - DNA, 25 bp, Artificial sequence
  SiRNA target sequence
agtctggatattacgagtttaaaga

SEQ ID NO: 60857 - DNA, 25 bp, Artificial sequence
  SiRNA target sequence
gtctggatattacgagtttaaagag

SEQ ID NO: 60858 - DNA, 25 bp, Artificial sequence
  SiRNA target sequence
tctggatattacgagtttaaagagg

SEQ ID NO: 60859 - DNA, 25 bp, Artificial sequence
  SiRNA target sequence
ctggatattacgagtttaaagagga

SEQ ID NO: 60860 - DNA, 25 bp, Artificial sequence
  SiRNA target sequence
tggatattacgagtttaaagaggat

SEQ ID NO: 60861 - DNA, 25 bp, Artificial sequence
  SiRNA target sequence
ggatattacgagtttaaagaggata

SEQ ID NO: 60862 - DNA, 25 bp, Artificial sequence
  SiRNA target sequence
gatattacgagtttaaagaggatac

SEQ ID NO: 60863 - DNA, 25 bp, Artificial sequence
  SiRNA target sequence
atattacgagtttaaagaggataca

SEQ ID NO: 60864 - DNA, 25 bp, Artificial sequence
  SiRNA target sequence
tattacgagtttaaagaggatacac

SEQ ID NO: 60865 - DNA, 25 bp, Artificial sequence
  SiRNA target sequence
attacgagtttaaagaggatacaca

SEQ ID NO: 60866 - DNA, 25 bp, Artificial sequence
  SiRNA target sequence
ttacgagtttaaagaggatacacaa

SEQ ID NO: 60867 - DNA, 25 bp, Artificial sequence
  SiRNA target sequence
tacgagtttaaagaggatacacaaa

SEQ ID NO: 60868 - DNA, 25 bp, Artificial sequence
  SiRNA target sequence
acgagtttaaagaggatacacaaac

SEQ ID NO: 60869 - DNA, 25 bp, Artificial sequence
  SiRNA target sequence
cgagtttaaagaggatacacaaact

SEQ ID NO: 60870 - DNA, 25 bp, Artificial sequence
  SiRNA target sequence
gagtttaaagaggatacacaaactg

SEQ ID NO: 60871 - DNA, 25 bp, Artificial sequence
  SiRNA target sequence
agtttaaagaggatacacaaactga

SEQ ID NO: 60872 - DNA, 25 bp, Artificial sequence
  SiRNA target sequence
gtttaaagaggatacacaaactgat

SEQ ID NO: 60873 - DNA, 25 bp, Artificial sequence
  SiRNA target sequence
tttaaagaggatacacaaactgata

SEQ ID NO: 60874 - DNA, 25 bp, Artificial sequence
  SiRNA target sequence
ttaaagaggatacacaaactgataa

SEQ ID NO: 60875 - DNA, 25 bp, Artificial sequence
  SiRNA target sequence
taaagaggatacacaaactgataaa

SEQ ID NO: 60876 - DNA, 25 bp, Artificial sequence
  SiRNA target sequence
aaagaggatacacaaactgataaaa

SEQ ID NO: 60877 - DNA, 25 bp, Artificial sequence
  SiRNA target sequence
aagaggatacacaaactgataaaat

SEQ ID NO: 60878 - DNA, 25 bp, Artificial sequence
  SiRNA target sequence
agaggatacacaaactgataaaata

SEQ ID NO: 60879 - DNA, 25 bp, Artificial sequence
  SiRNA target sequence
gaggatacacaaactgataaaataa

SEQ ID NO: 60880 - DNA, 25 bp, Artificial sequence
  SiRNA target sequence
aggatacacaaactgataaaataag

SEQ ID NO: 60881 - DNA, 25 bp, Artificial sequence
  SiRNA target sequence
ggatacacaaactgataaaataaga

SEQ ID NO: 60882 - DNA, 25 bp, Artificial sequence
  SiRNA target sequence
gatacacaaactgataaaataagac

SEQ ID NO: 60883 - DNA, 25 bp, Artificial sequence
  SiRNA target sequence
atacacaaactgataaaataagact

SEQ ID NO: 60884 - DNA, 25 bp, Artificial sequence
  SiRNA target sequence
tacacaaactgataaaataagactg

SEQ ID NO: 60885 - DNA, 25 bp, Artificial sequence
  SiRNA target sequence
acacaaactgataaaataagactga

SEQ ID NO: 60886 - DNA, 25 bp, Artificial sequence
  SiRNA target sequence
cacaaactgataaaataagactgat

SEQ ID NO: 60887 - DNA, 25 bp, Artificial sequence
  SiRNA target sequence
acaaactgataaaataagactgata

SEQ ID NO: 60888 - DNA, 25 bp, Artificial sequence
  SiRNA target sequence
caaactgataaaataagactgatag

SEQ ID NO: 60889 - DNA, 25 bp, Artificial sequence
  SiRNA target sequence
aaactgataaaataagactgataga

SEQ ID NO: 60890 - DNA, 25 bp, Artificial sequence
  SiRNA target sequence
aactgataaaataagactgatagat

SEQ ID NO: 60891 - DNA, 25 bp, Artificial sequence
  SiRNA target sequence
actgataaaataagactgatagatt

SEQ ID NO: 60892 - DNA, 25 bp, Artificial sequence
  SiRNA target sequence
ctgataaaataagactgatagattt

SEQ ID NO: 60893 - DNA, 25 bp, Artificial sequence
  SiRNA target sequence
tgataaaataagactgatagatttt

SEQ ID NO: 60894 - DNA, 25 bp, Artificial sequence
  SiRNA target sequence
gataaaataagactgatagatttta

SEQ ID NO: 60895 - DNA, 25 bp, Artificial sequence
  SiRNA target sequence
ataaaataagactgatagattttaa

SEQ ID NO: 60896 - DNA, 25 bp, Artificial sequence
  SiRNA target sequence
taaaataagactgatagattttaat

SEQ ID NO: 60897 - DNA, 25 bp, Artificial sequence
  SiRNA target sequence
aaaataagactgatagattttaatg

SEQ ID NO: 60898 - DNA, 25 bp, Artificial sequence
  SiRNA target sequence
aaataagactgatagattttaatga

SEQ ID NO: 60899 - DNA, 25 bp, Artificial sequence
  SiRNA target sequence
aataagactgatagattttaatgaa

SEQ ID NO: 60900 - DNA, 25 bp, Artificial sequence
  SiRNA target sequence
ataagactgatagattttaatgaaa

SEQ ID NO: 60901 - DNA, 25 bp, Artificial sequence
  SiRNA target sequence
taagactgatagattttaatgaaaa

SEQ ID NO: 60902 - DNA, 25 bp, Artificial sequence
  SiRNA target sequence
aagactgatagattttaatgaaaag

SEQ ID NO: 60903 - DNA, 25 bp, Artificial sequence
  SiRNA target sequence
agactgatagattttaatgaaaagc

SEQ ID NO: 60904 - DNA, 25 bp, Artificial sequence
  SiRNA target sequence
gactgatagattttaatgaaaagct

SEQ ID NO: 60905 - DNA, 25 bp, Artificial sequence
  SiRNA target sequence
actgatagattttaatgaaaagcta

SEQ ID NO: 60906 - DNA, 25 bp, Artificial sequence
  SiRNA target sequence
ctgatagattttaatgaaaagctag

SEQ ID NO: 60907 - DNA, 25 bp, Artificial sequence
  SiRNA target sequence
tgatagattttaatgaaaagctaga

SEQ ID NO: 60908 - DNA, 25 bp, Artificial sequence
  SiRNA target sequence
gatagattttaatgaaaagctagaa

SEQ ID NO: 60909 - DNA, 25 bp, Artificial sequence
  SiRNA target sequence
atagattttaatgaaaagctagaat

SEQ ID NO: 60910 - DNA, 25 bp, Artificial sequence
  SiRNA target sequence
tagattttaatgaaaagctagaatt

SEQ ID NO: 60911 - DNA, 25 bp, Artificial sequence
  SiRNA target sequence
agattttaatgaaaagctagaattt

SEQ ID NO: 60912 - DNA, 25 bp, Artificial sequence
  SiRNA target sequence
gattttaatgaaaagctagaattta

SEQ ID NO: 60913 - DNA, 25 bp, Artificial sequence
  SiRNA target sequence
attttaatgaaaagctagaatttag

SEQ ID NO: 60914 - DNA, 25 bp, Artificial sequence
  SiRNA target sequence
ttttaatgaaaagctagaatttaga

SEQ ID NO: 60915 - DNA, 25 bp, Artificial sequence
  SiRNA target sequence
tttaatgaaaagctagaatttagaa

SEQ ID NO: 60916 - DNA, 25 bp, Artificial sequence
  SiRNA target sequence
ttaatgaaaagctagaatttagaaa

SEQ ID NO: 60917 - DNA, 25 bp, Artificial sequence
  SiRNA target sequence
taatgaaaagctagaatttagaaat

SEQ ID NO: 60918 - DNA, 25 bp, Artificial sequence
  SiRNA target sequence
aatgaaaagctagaatttagaaatg

SEQ ID NO: 60919 - DNA, 25 bp, Artificial sequence
  SiRNA target sequence
atgaaaagctagaatttagaaatgt

SEQ ID NO: 60920 - DNA, 25 bp, Artificial sequence
  SiRNA target sequence
tgaaaagctagaatttagaaatgta

SEQ ID NO: 60921 - DNA, 25 bp, Artificial sequence
  SiRNA target sequence
gaaaagctagaatttagaaatgtat

SEQ ID NO: 60922 - DNA, 25 bp, Artificial sequence
  SiRNA target sequence
aaaagctagaatttagaaatgtatc

SEQ ID NO: 60923 - DNA, 25 bp, Artificial sequence
  SiRNA target sequence
aaagctagaatttagaaatgtatct

SEQ ID NO: 60924 - DNA, 25 bp, Artificial sequence
  SiRNA target sequence
aagctagaatttagaaatgtatctt

SEQ ID NO: 60925 - DNA, 25 bp, Artificial sequence
  SiRNA target sequence
agctagaatttagaaatgtatcttt

SEQ ID NO: 60926 - DNA, 25 bp, Artificial sequence
  SiRNA target sequence
gctagaatttagaaatgtatctttt

SEQ ID NO: 60927 - DNA, 25 bp, Artificial sequence
  SiRNA target sequence
ctagaatttagaaatgtatctttta

SEQ ID NO: 60928 - DNA, 25 bp, Artificial sequence
  SiRNA target sequence
tagaatttagaaatgtatcttttag

SEQ ID NO: 60929 - DNA, 25 bp, Artificial sequence
  SiRNA target sequence
agaatttagaaatgtatcttttagt

SEQ ID NO: 60930 - DNA, 25 bp, Artificial sequence
  SiRNA target sequence
gaatttagaaatgtatcttttagtt

SEQ ID NO: 60931 - DNA, 25 bp, Artificial sequence
  SiRNA target sequence
aatttagaaatgtatcttttagtta

SEQ ID NO: 60932 - DNA, 25 bp, Artificial sequence
  SiRNA target sequence
atttagaaatgtatcttttagttat

SEQ ID NO: 60933 - DNA, 25 bp, Artificial sequence
  SiRNA target sequence
tttagaaatgtatcttttagttatt

SEQ ID NO: 60934 - DNA, 25 bp, Artificial sequence
  SiRNA target sequence
ttagaaatgtatcttttagttattt

SEQ ID NO: 60935 - DNA, 25 bp, Artificial sequence
  SiRNA target sequence
tagaaatgtatcttttagttattta

SEQ ID NO: 60936 - DNA, 25 bp, Artificial sequence
  SiRNA target sequence
agaaatgtatcttttagttatttaa

SEQ ID NO: 60937 - DNA, 25 bp, Artificial sequence
  SiRNA target sequence
gaaatgtatcttttagttatttaaa

SEQ ID NO: 60938 - DNA, 25 bp, Artificial sequence
  SiRNA target sequence
aaatgtatcttttagttatttaaat

SEQ ID NO: 60939 - DNA, 25 bp, Artificial sequence
  SiRNA target sequence
aatgtatcttttagttatttaaata

SEQ ID NO: 60940 - DNA, 25 bp, Artificial sequence
  SiRNA target sequence
atgtatcttttagttatttaaataa

SEQ ID NO: 60941 - DNA, 25 bp, Artificial sequence
  SiRNA target sequence
tgtatcttttagttatttaaataag

SEQ ID NO: 60942 - DNA, 25 bp, Artificial sequence
  SiRNA target sequence
gtatcttttagttatttaaataagc

SEQ ID NO: 60943 - DNA, 25 bp, Artificial sequence
  SiRNA target sequence
tatcttttagttatttaaataagcc

SEQ ID NO: 60944 - DNA, 25 bp, Artificial sequence
  SiRNA target sequence
atcttttagttatttaaataagcct

SEQ ID NO: 60945 - DNA, 25 bp, Artificial sequence
  SiRNA target sequence
tcttttagttatttaaataagccta

SEQ ID NO: 60946 - DNA, 25 bp, Artificial sequence
  SiRNA target sequence
cttttagttatttaaataagcctat

SEQ ID NO: 60947 - DNA, 25 bp, Artificial sequence
  SiRNA target sequence
ttttagttatttaaataagcctatt

SEQ ID NO: 60948 - DNA, 25 bp, Artificial sequence
  SiRNA target sequence
tttagttatttaaataagcctattt

SEQ ID NO: 60949 - DNA, 25 bp, Artificial sequence
  SiRNA target sequence
ttagttatttaaataagcctatttt

SEQ ID NO: 60950 - DNA, 25 bp, Artificial sequence
  SiRNA target sequence
tagttatttaaataagcctatttta

SEQ ID NO: 60951 - DNA, 25 bp, Artificial sequence
  SiRNA target sequence
agttatttaaataagcctattttag

SEQ ID NO: 60952 - DNA, 25 bp, Artificial sequence
  SiRNA target sequence
gttatttaaataagcctattttagt

SEQ ID NO: 60953 - DNA, 25 bp, Artificial sequence
  SiRNA target sequence
ttatttaaataagcctattttagtg

SEQ ID NO: 60954 - DNA, 25 bp, Artificial sequence
  SiRNA target sequence
tatttaaataagcctattttagtga

SEQ ID NO: 60955 - DNA, 25 bp, Artificial sequence
  SiRNA target sequence
atttaaataagcctattttagtgaa

SEQ ID NO: 60956 - DNA, 25 bp, Artificial sequence
  SiRNA target sequence
tttaaataagcctattttagtgaat

SEQ ID NO: 60957 - DNA, 25 bp, Artificial sequence
  SiRNA target sequence
ttaaataagcctattttagtgaatg

SEQ ID NO: 60958 - DNA, 25 bp, Artificial sequence
  SiRNA target sequence
taaataagcctattttagtgaatgc

SEQ ID NO: 60959 - DNA, 25 bp, Artificial sequence
  SiRNA target sequence
aaataagcctattttagtgaatgct

SEQ ID NO: 60960 - DNA, 25 bp, Artificial sequence
  SiRNA target sequence
aataagcctattttagtgaatgcta

SEQ ID NO: 60961 - DNA, 25 bp, Artificial sequence
  SiRNA target sequence
ataagcctattttagtgaatgctaa

SEQ ID NO: 60962 - DNA, 25 bp, Artificial sequence
  SiRNA target sequence
taagcctattttagtgaatgctaat

SEQ ID NO: 60963 - DNA, 25 bp, Artificial sequence
  SiRNA target sequence
aagcctattttagtgaatgctaatt

SEQ ID NO: 60964 - DNA, 25 bp, Artificial sequence
  SiRNA target sequence
agcctattttagtgaatgctaattt

SEQ ID NO: 60965 - DNA, 25 bp, Artificial sequence
  SiRNA target sequence
gcctattttagtgaatgctaatttc

SEQ ID NO: 60966 - DNA, 25 bp, Artificial sequence
  SiRNA target sequence
cctattttagtgaatgctaatttcg

SEQ ID NO: 60967 - DNA, 25 bp, Artificial sequence
  SiRNA target sequence
ctattttagtgaatgctaatttcgt

SEQ ID NO: 60968 - DNA, 25 bp, Artificial sequence
  SiRNA target sequence
tattttagtgaatgctaatttcgtt

SEQ ID NO: 60969 - DNA, 25 bp, Artificial sequence
  SiRNA target sequence
attttagtgaatgctaatttcgtta

SEQ ID NO: 60970 - DNA, 25 bp, Artificial sequence
  SiRNA target sequence
ttttagtgaatgctaatttcgttat

SEQ ID NO: 60971 - DNA, 25 bp, Artificial sequence
  SiRNA target sequence
tttagtgaatgctaatttcgttatt

SEQ ID NO: 60972 - DNA, 25 bp, Artificial sequence
  SiRNA target sequence
ttagtgaatgctaatttcgttatta

SEQ ID NO: 60973 - DNA, 25 bp, Artificial sequence
  SiRNA target sequence
tagtgaatgctaatttcgttattaa

SEQ ID NO: 60974 - DNA, 25 bp, Artificial sequence
  SiRNA target sequence
agtgaatgctaatttcgttattaat

SEQ ID NO: 60975 - DNA, 25 bp, Artificial sequence
  SiRNA target sequence
gtgaatgctaatttcgttattaata

SEQ ID NO: 60976 - DNA, 25 bp, Artificial sequence
  SiRNA target sequence
tgaatgctaatttcgttattaataa

SEQ ID NO: 60977 - DNA, 25 bp, Artificial sequence
  SiRNA target sequence
gaatgctaatttcgttattaataaa

SEQ ID NO: 60978 - DNA, 25 bp, Artificial sequence
  SiRNA target sequence
aatgctaatttcgttattaataaag

SEQ ID NO: 60979 - DNA, 25 bp, Artificial sequence
  SiRNA target sequence
atgctaatttcgttattaataaagg

SEQ ID NO: 60980 - DNA, 25 bp, Artificial sequence
  SiRNA target sequence
tgctaatttcgttattaataaaggg

SEQ ID NO: 60981 - DNA, 25 bp, Artificial sequence
  SiRNA target sequence
gctaatttcgttattaataaagggg

SEQ ID NO: 60982 - DNA, 25 bp, Artificial sequence
  SiRNA target sequence
ctaatttcgttattaataaagggga

SEQ ID NO: 60983 - DNA, 25 bp, Artificial sequence
  SiRNA target sequence
taatttcgttattaataaaggggag

SEQ ID NO: 60984 - DNA, 25 bp, Artificial sequence
  SiRNA target sequence
aatttcgttattaataaaggggagc

SEQ ID NO: 60985 - DNA, 25 bp, Artificial sequence
  SiRNA target sequence
atttcgttattaataaaggggagcg

SEQ ID NO: 60986 - DNA, 25 bp, Artificial sequence
  SiRNA target sequence
tttcgttattaataaaggggagcgt

SEQ ID NO: 60987 - DNA, 25 bp, Artificial sequence
  SiRNA target sequence
ttcgttattaataaaggggagcgtg

SEQ ID NO: 60988 - DNA, 25 bp, Artificial sequence
  SiRNA target sequence
tcgttattaataaaggggagcgtgt

SEQ ID NO: 60989 - DNA, 25 bp, Artificial sequence
  SiRNA target sequence
cgttattaataaaggggagcgtgtt

SEQ ID NO: 60990 - DNA, 25 bp, Artificial sequence
  SiRNA target sequence
gttattaataaaggggagcgtgttg

SEQ ID NO: 60991 - DNA, 25 bp, Artificial sequence
  SiRNA target sequence
ttattaataaaggggagcgtgttgc

SEQ ID NO: 60992 - DNA, 25 bp, Artificial sequence
  SiRNA target sequence
tattaataaaggggagcgtgttgct

SEQ ID NO: 60993 - DNA, 25 bp, Artificial sequence
  SiRNA target sequence
attaataaaggggagcgtgttgcta

SEQ ID NO: 60994 - DNA, 25 bp, Artificial sequence
  SiRNA target sequence
ttaataaaggggagcgtgttgctat

SEQ ID NO: 60995 - DNA, 25 bp, Artificial sequence
  SiRNA target sequence
taataaaggggagcgtgttgctatt

SEQ ID NO: 60996 - DNA, 25 bp, Artificial sequence
  SiRNA target sequence
aataaaggggagcgtgttgctatta

SEQ ID NO: 60997 - DNA, 25 bp, Artificial sequence
  SiRNA target sequence
ataaaggggagcgtgttgctattat

SEQ ID NO: 60998 - DNA, 25 bp, Artificial sequence
  SiRNA target sequence
taaaggggagcgtgttgctattata

SEQ ID NO: 60999 - DNA, 25 bp, Artificial sequence
  SiRNA target sequence
aaaggggagcgtgttgctattatag

SEQ ID NO: 61000 - DNA, 25 bp, Artificial sequence
  SiRNA target sequence
aaggggagcgtgttgctattatagg

SEQ ID NO: 61001 - DNA, 25 bp, Artificial sequence
  SiRNA target sequence
aggggagcgtgttgctattatagga

SEQ ID NO: 61002 - DNA, 25 bp, Artificial sequence
  SiRNA target sequence
ggggagcgtgttgctattataggaa

SEQ ID NO: 61003 - DNA, 25 bp, Artificial sequence
  SiRNA target sequence
gggagcgtgttgctattataggaaa

SEQ ID NO: 61004 - DNA, 25 bp, Artificial sequence
  SiRNA target sequence
ggagcgtgttgctattataggaaaa

SEQ ID NO: 61005 - DNA, 25 bp, Artificial sequence
  SiRNA target sequence
gagcgtgttgctattataggaaaaa

SEQ ID NO: 61006 - DNA, 25 bp, Artificial sequence
  SiRNA target sequence
agcgtgttgctattataggaaaaaa

SEQ ID NO: 61007 - DNA, 25 bp, Artificial sequence
  SiRNA target sequence
gcgtgttgctattataggaaaaaat

SEQ ID NO: 61008 - DNA, 25 bp, Artificial sequence
  SiRNA target sequence
cgtgttgctattataggaaaaaatg

SEQ ID NO: 61009 - DNA, 25 bp, Artificial sequence
  SiRNA target sequence
gtgttgctattataggaaaaaatgg

SEQ ID NO: 61010 - DNA, 25 bp, Artificial sequence
  SiRNA target sequence
tgttgctattataggaaaaaatgga

SEQ ID NO: 61011 - DNA, 25 bp, Artificial sequence
  SiRNA target sequence
gttgctattataggaaaaaatggaa

SEQ ID NO: 61012 - DNA, 25 bp, Artificial sequence
  SiRNA target sequence
ttgctattataggaaaaaatggaac

SEQ ID NO: 61013 - DNA, 25 bp, Artificial sequence
  SiRNA target sequence
tgctattataggaaaaaatggaaca

SEQ ID NO: 61014 - DNA, 25 bp, Artificial sequence
  SiRNA target sequence
gctattataggaaaaaatggaacag

SEQ ID NO: 61015 - DNA, 25 bp, Artificial sequence
  SiRNA target sequence
ctattataggaaaaaatggaacagg

SEQ ID NO: 61016 - DNA, 25 bp, Artificial sequence
  SiRNA target sequence
tattataggaaaaaatggaacaggt

SEQ ID NO: 61017 - DNA, 25 bp, Artificial sequence
  SiRNA target sequence
attataggaaaaaatggaacaggta

SEQ ID NO: 61018 - DNA, 25 bp, Artificial sequence
  SiRNA target sequence
ttataggaaaaaatggaacaggtaa

SEQ ID NO: 61019 - DNA, 25 bp, Artificial sequence
  SiRNA target sequence
tataggaaaaaatggaacaggtaaa

SEQ ID NO: 61020 - DNA, 25 bp, Artificial sequence
  SiRNA target sequence
ataggaaaaaatggaacaggtaaaa

SEQ ID NO: 61021 - DNA, 25 bp, Artificial sequence
  SiRNA target sequence
taggaaaaaatggaacaggtaaaag

SEQ ID NO: 61022 - DNA, 25 bp, Artificial sequence
  SiRNA target sequence
aggaaaaaatggaacaggtaaaagt

SEQ ID NO: 61023 - DNA, 25 bp, Artificial sequence
  SiRNA target sequence
ggaaaaaatggaacaggtaaaagta

SEQ ID NO: 61024 - DNA, 25 bp, Artificial sequence
  SiRNA target sequence
gaaaaaatggaacaggtaaaagtac

SEQ ID NO: 61025 - DNA, 25 bp, Artificial sequence
  SiRNA target sequence
aaaaaatggaacaggtaaaagtaca

SEQ ID NO: 61026 - DNA, 25 bp, Artificial sequence
  SiRNA target sequence
aaaaatggaacaggtaaaagtacaa

SEQ ID NO: 61027 - DNA, 25 bp, Artificial sequence
  SiRNA target sequence
aaaatggaacaggtaaaagtacaat

SEQ ID NO: 61028 - DNA, 25 bp, Artificial sequence
  SiRNA target sequence
aaatggaacaggtaaaagtacaata

SEQ ID NO: 61029 - DNA, 25 bp, Artificial sequence
  SiRNA target sequence
aatggaacaggtaaaagtacaataa

SEQ ID NO: 61030 - DNA, 25 bp, Artificial sequence
  SiRNA target sequence
atggaacaggtaaaagtacaataat

SEQ ID NO: 61031 - DNA, 25 bp, Artificial sequence
  SiRNA target sequence
tggaacaggtaaaagtacaataata

SEQ ID NO: 61032 - DNA, 25 bp, Artificial sequence
  SiRNA target sequence
ggaacaggtaaaagtacaataataa

SEQ ID NO: 61033 - DNA, 25 bp, Artificial sequence
  SiRNA target sequence
gaacaggtaaaagtacaataataaa

SEQ ID NO: 61034 - DNA, 25 bp, Artificial sequence
  SiRNA target sequence
aacaggtaaaagtacaataataaaa

SEQ ID NO: 61035 - DNA, 25 bp, Artificial sequence
  SiRNA target sequence
acaggtaaaagtacaataataaaat

SEQ ID NO: 61036 - DNA, 25 bp, Artificial sequence
  SiRNA target sequence
caggtaaaagtacaataataaaatt

SEQ ID NO: 61037 - DNA, 25 bp, Artificial sequence
  SiRNA target sequence
aggtaaaagtacaataataaaattg

SEQ ID NO: 61038 - DNA, 25 bp, Artificial sequence
  SiRNA target sequence
ggtaaaagtacaataataaaattgt

SEQ ID NO: 61039 - DNA, 25 bp, Artificial sequence
  SiRNA target sequence
gtaaaagtacaataataaaattgtt

SEQ ID NO: 61040 - DNA, 25 bp, Artificial sequence
  SiRNA target sequence
taaaagtacaataataaaattgtta

SEQ ID NO: 61041 - DNA, 25 bp, Artificial sequence
  SiRNA target sequence
aaaagtacaataataaaattgttaa

SEQ ID NO: 61042 - DNA, 25 bp, Artificial sequence
  SiRNA target sequence
aaagtacaataataaaattgttaat

SEQ ID NO: 61043 - DNA, 25 bp, Artificial sequence
  SiRNA target sequence
aagtacaataataaaattgttaatg

SEQ ID NO: 61044 - DNA, 25 bp, Artificial sequence
  SiRNA target sequence
agtacaataataaaattgttaatga

SEQ ID NO: 61045 - DNA, 25 bp, Artificial sequence
  SiRNA target sequence
gtacaataataaaattgttaatgaa

SEQ ID NO: 61046 - DNA, 25 bp, Artificial sequence
  SiRNA target sequence
tacaataataaaattgttaatgaaa

SEQ ID NO: 61047 - DNA, 25 bp, Artificial sequence
  SiRNA target sequence
acaataataaaattgttaatgaaat

SEQ ID NO: 61048 - DNA, 25 bp, Artificial sequence
  SiRNA target sequence
caataataaaattgttaatgaaatt

SEQ ID NO: 61049 - DNA, 25 bp, Artificial sequence
  SiRNA target sequence
aataataaaattgttaatgaaattt

SEQ ID NO: 61050 - DNA, 25 bp, Artificial sequence
  SiRNA target sequence
ataataaaattgttaatgaaatttt

SEQ ID NO: 61051 - DNA, 25 bp, Artificial sequence
  SiRNA target sequence
taataaaattgttaatgaaatttta

SEQ ID NO: 61052 - DNA, 25 bp, Artificial sequence
  SiRNA target sequence
aataaaattgttaatgaaattttat

SEQ ID NO: 61053 - DNA, 25 bp, Artificial sequence
  SiRNA target sequence
ataaaattgttaatgaaattttata

SEQ ID NO: 61054 - DNA, 25 bp, Artificial sequence
  SiRNA target sequence
taaaattgttaatgaaattttataa

SEQ ID NO: 61055 - DNA, 25 bp, Artificial sequence
  SiRNA target sequence
aaaattgttaatgaaattttataaa

SEQ ID NO: 61056 - DNA, 25 bp, Artificial sequence
  SiRNA target sequence
aaattgttaatgaaattttataaat

SEQ ID NO: 61057 - DNA, 25 bp, Artificial sequence
  SiRNA target sequence
aattgttaatgaaattttataaata

SEQ ID NO: 61058 - DNA, 25 bp, Artificial sequence
  SiRNA target sequence
attgttaatgaaattttataaatat

SEQ ID NO: 61059 - DNA, 25 bp, Artificial sequence
  SiRNA target sequence
ttgttaatgaaattttataaatatg

SEQ ID NO: 61060 - DNA, 25 bp, Artificial sequence
  SiRNA target sequence
tgttaatgaaattttataaatatga

SEQ ID NO: 61061 - DNA, 25 bp, Artificial sequence
  SiRNA target sequence
gttaatgaaattttataaatatgat

SEQ ID NO: 61062 - DNA, 25 bp, Artificial sequence
  SiRNA target sequence
ttaatgaaattttataaatatgatg

SEQ ID NO: 61063 - DNA, 25 bp, Artificial sequence
  SiRNA target sequence
taatgaaattttataaatatgatgg

SEQ ID NO: 61064 - DNA, 25 bp, Artificial sequence
  SiRNA target sequence
aatgaaattttataaatatgatgga

SEQ ID NO: 61065 - DNA, 25 bp, Artificial sequence
  SiRNA target sequence
atgaaattttataaatatgatggag

SEQ ID NO: 61066 - DNA, 25 bp, Artificial sequence
  SiRNA target sequence
tgaaattttataaatatgatggaga

SEQ ID NO: 61067 - DNA, 25 bp, Artificial sequence
  SiRNA target sequence
gaaattttataaatatgatggagat

SEQ ID NO: 61068 - DNA, 25 bp, Artificial sequence
  SiRNA target sequence
aaattttataaatatgatggagata

SEQ ID NO: 61069 - DNA, 25 bp, Artificial sequence
  SiRNA target sequence
aattttataaatatgatggagatat

SEQ ID NO: 61070 - DNA, 25 bp, Artificial sequence
  SiRNA target sequence
attttataaatatgatggagatata

SEQ ID NO: 61071 - DNA, 25 bp, Artificial sequence
  SiRNA target sequence
ttttataaatatgatggagatatat

SEQ ID NO: 61072 - DNA, 25 bp, Artificial sequence
  SiRNA target sequence
tttataaatatgatggagatatatt

SEQ ID NO: 61073 - DNA, 25 bp, Artificial sequence
  SiRNA target sequence
ttataaatatgatggagatatatta

SEQ ID NO: 61074 - DNA, 25 bp, Artificial sequence
  SiRNA target sequence
tataaatatgatggagatatattaa

SEQ ID NO: 61075 - DNA, 25 bp, Artificial sequence
  SiRNA target sequence
ataaatatgatggagatatattaat

SEQ ID NO: 61076 - DNA, 25 bp, Artificial sequence
  SiRNA target sequence
taaatatgatggagatatattaatt

SEQ ID NO: 61077 - DNA, 25 bp, Artificial sequence
  SiRNA target sequence
aaatatgatggagatatattaattg

SEQ ID NO: 61078 - DNA, 25 bp, Artificial sequence
  SiRNA target sequence
aatatgatggagatatattaattga

SEQ ID NO: 61079 - DNA, 25 bp, Artificial sequence
  SiRNA target sequence
atatgatggagatatattaattgat

SEQ ID NO: 61080 - DNA, 25 bp, Artificial sequence
  SiRNA target sequence
tatgatggagatatattaattgatg

SEQ ID NO: 61081 - DNA, 25 bp, Artificial sequence
  SiRNA target sequence
atgatggagatatattaattgatga

SEQ ID NO: 61082 - DNA, 25 bp, Artificial sequence
  SiRNA target sequence
tgatggagatatattaattgatgat

SEQ ID NO: 61083 - DNA, 25 bp, Artificial sequence
  SiRNA target sequence
gatggagatatattaattgatgata

SEQ ID NO: 61084 - DNA, 25 bp, Artificial sequence
  SiRNA target sequence
atggagatatattaattgatgatac

SEQ ID NO: 61085 - DNA, 25 bp, Artificial sequence
  SiRNA target sequence
tggagatatattaattgatgataca

SEQ ID NO: 61086 - DNA, 25 bp, Artificial sequence
  SiRNA target sequence
ggagatatattaattgatgatacag

SEQ ID NO: 61087 - DNA, 25 bp, Artificial sequence
  SiRNA target sequence
gagatatattaattgatgatacaga

SEQ ID NO: 61088 - DNA, 25 bp, Artificial sequence
  SiRNA target sequence
agatatattaattgatgatacagaa

SEQ ID NO: 61089 - DNA, 25 bp, Artificial sequence
  SiRNA target sequence
gatatattaattgatgatacagaaa

SEQ ID NO: 61090 - DNA, 25 bp, Artificial sequence
  SiRNA target sequence
atatattaattgatgatacagaaat

SEQ ID NO: 61091 - DNA, 25 bp, Artificial sequence
  SiRNA target sequence
tatattaattgatgatacagaaata

SEQ ID NO: 61092 - DNA, 25 bp, Artificial sequence
  SiRNA target sequence
atattaattgatgatacagaaatag

SEQ ID NO: 61093 - DNA, 25 bp, Artificial sequence
  SiRNA target sequence
tattaattgatgatacagaaataga

SEQ ID NO: 61094 - DNA, 25 bp, Artificial sequence
  SiRNA target sequence
attaattgatgatacagaaatagat

SEQ ID NO: 61095 - DNA, 25 bp, Artificial sequence
  SiRNA target sequence
ttaattgatgatacagaaatagata

SEQ ID NO: 61096 - DNA, 25 bp, Artificial sequence
  SiRNA target sequence
taattgatgatacagaaatagataa

SEQ ID NO: 61097 - DNA, 25 bp, Artificial sequence
  SiRNA target sequence
aattgatgatacagaaatagataat

SEQ ID NO: 61098 - DNA, 25 bp, Artificial sequence
  SiRNA target sequence
attgatgatacagaaatagataata

SEQ ID NO: 61099 - DNA, 25 bp, Artificial sequence
  SiRNA target sequence
ttgatgatacagaaatagataatat

SEQ ID NO: 61100 - DNA, 25 bp, Artificial sequence
  SiRNA target sequence
tgatgatacagaaatagataatatt

SEQ ID NO: 61101 - DNA, 25 bp, Artificial sequence
  SiRNA target sequence
gatgatacagaaatagataatattt

SEQ ID NO: 61102 - DNA, 25 bp, Artificial sequence
  SiRNA target sequence
atgatacagaaatagataatatttc

SEQ ID NO: 61103 - DNA, 25 bp, Artificial sequence
  SiRNA target sequence
tgatacagaaatagataatatttcg

SEQ ID NO: 61104 - DNA, 25 bp, Artificial sequence
  SiRNA target sequence
gatacagaaatagataatatttcgg

SEQ ID NO: 61105 - DNA, 25 bp, Artificial sequence
  SiRNA target sequence
atacagaaatagataatatttcgga

SEQ ID NO: 61106 - DNA, 25 bp, Artificial sequence
  SiRNA target sequence
tacagaaatagataatatttcggat

SEQ ID NO: 61107 - DNA, 25 bp, Artificial sequence
  SiRNA target sequence
acagaaatagataatatttcggata

SEQ ID NO: 61108 - DNA, 25 bp, Artificial sequence
  SiRNA target sequence
cagaaatagataatatttcggatag

SEQ ID NO: 61109 - DNA, 25 bp, Artificial sequence
  SiRNA target sequence
agaaatagataatatttcggataga

SEQ ID NO: 61110 - DNA, 25 bp, Artificial sequence
  SiRNA target sequence
gaaatagataatatttcggatagaa

SEQ ID NO: 61111 - DNA, 25 bp, Artificial sequence
  SiRNA target sequence
aaatagataatatttcggatagaag

SEQ ID NO: 61112 - DNA, 25 bp, Artificial sequence
  SiRNA target sequence
aatagataatatttcggatagaagt

SEQ ID NO: 61113 - DNA, 25 bp, Artificial sequence
  SiRNA target sequence
atagataatatttcggatagaagtt

SEQ ID NO: 61114 - DNA, 25 bp, Artificial sequence
  SiRNA target sequence
tagataatatttcggatagaagtta

SEQ ID NO: 61115 - DNA, 25 bp, Artificial sequence
  SiRNA target sequence
agataatatttcggatagaagttac

SEQ ID NO: 61116 - DNA, 25 bp, Artificial sequence
  SiRNA target sequence
gataatatttcggatagaagttaca

SEQ ID NO: 61117 - DNA, 25 bp, Artificial sequence
  SiRNA target sequence
ataatatttcggatagaagttacag

SEQ ID NO: 61118 - DNA, 25 bp, Artificial sequence
  SiRNA target sequence
taatatttcggatagaagttacaga

SEQ ID NO: 61119 - DNA, 25 bp, Artificial sequence
  SiRNA target sequence
aatatttcggatagaagttacagaa

SEQ ID NO: 61120 - DNA, 25 bp, Artificial sequence
  SiRNA target sequence
atatttcggatagaagttacagaag

SEQ ID NO: 61121 - DNA, 25 bp, Artificial sequence
  SiRNA target sequence
tatttcggatagaagttacagaagt

SEQ ID NO: 61122 - DNA, 25 bp, Artificial sequence
  SiRNA target sequence
atttcggatagaagttacagaagtt

SEQ ID NO: 61123 - DNA, 25 bp, Artificial sequence
  SiRNA target sequence
tttcggatagaagttacagaagttt

SEQ ID NO: 61124 - DNA, 25 bp, Artificial sequence
  SiRNA target sequence
ttcggatagaagttacagaagttta

SEQ ID NO: 61125 - DNA, 25 bp, Artificial sequence
  SiRNA target sequence
tcggatagaagttacagaagtttaa

SEQ ID NO: 61126 - DNA, 25 bp, Artificial sequence
  SiRNA target sequence
cggatagaagttacagaagtttaat

SEQ ID NO: 61127 - DNA, 25 bp, Artificial sequence
  SiRNA target sequence
ggatagaagttacagaagtttaata

SEQ ID NO: 61128 - DNA, 25 bp, Artificial sequence
  SiRNA target sequence
gatagaagttacagaagtttaatat

SEQ ID NO: 61129 - DNA, 25 bp, Artificial sequence
  SiRNA target sequence
atagaagttacagaagtttaatatc

SEQ ID NO: 61130 - DNA, 25 bp, Artificial sequence
  SiRNA target sequence
tagaagttacagaagtttaatatca

SEQ ID NO: 61131 - DNA, 25 bp, Artificial sequence
  SiRNA target sequence
agaagttacagaagtttaatatcat

SEQ ID NO: 61132 - DNA, 25 bp, Artificial sequence
  SiRNA target sequence
gaagttacagaagtttaatatcata

SEQ ID NO: 61133 - DNA, 25 bp, Artificial sequence
  SiRNA target sequence
aagttacagaagtttaatatcatat

SEQ ID NO: 61134 - DNA, 25 bp, Artificial sequence
  SiRNA target sequence
agttacagaagtttaatatcatatg

SEQ ID NO: 61135 - DNA, 25 bp, Artificial sequence
  SiRNA target sequence
gttacagaagtttaatatcatatgc

SEQ ID NO: 61136 - DNA, 25 bp, Artificial sequence
  SiRNA target sequence
ttacagaagtttaatatcatatgca

SEQ ID NO: 61137 - DNA, 25 bp, Artificial sequence
  SiRNA target sequence
tacagaagtttaatatcatatgcaa

SEQ ID NO: 61138 - DNA, 25 bp, Artificial sequence
  SiRNA target sequence
acagaagtttaatatcatatgcaac

SEQ ID NO: 61139 - DNA, 25 bp, Artificial sequence
  SiRNA target sequence
cagaagtttaatatcatatgcaaca

SEQ ID NO: 61140 - DNA, 25 bp, Artificial sequence
  SiRNA target sequence
agaagtttaatatcatatgcaacac

SEQ ID NO: 61141 - DNA, 25 bp, Artificial sequence
  SiRNA target sequence
gaagtttaatatcatatgcaacaca

SEQ ID NO: 61142 - DNA, 25 bp, Artificial sequence
  SiRNA target sequence
aagtttaatatcatatgcaacacaa

SEQ ID NO: 61143 - DNA, 25 bp, Artificial sequence
  SiRNA target sequence
agtttaatatcatatgcaacacaaa

SEQ ID NO: 61144 - DNA, 25 bp, Artificial sequence
  SiRNA target sequence
gtttaatatcatatgcaacacaaaa

SEQ ID NO: 61145 - DNA, 25 bp, Artificial sequence
  SiRNA target sequence
tttaatatcatatgcaacacaaaac

SEQ ID NO: 61146 - DNA, 25 bp, Artificial sequence
  SiRNA target sequence
ttaatatcatatgcaacacaaaaca

SEQ ID NO: 61147 - DNA, 25 bp, Artificial sequence
  SiRNA target sequence
taatatcatatgcaacacaaaacac

SEQ ID NO: 61148 - DNA, 25 bp, Artificial sequence
  SiRNA target sequence
aatatcatatgcaacacaaaacacg

SEQ ID NO: 61149 - DNA, 25 bp, Artificial sequence
  SiRNA target sequence
atatcatatgcaacacaaaacacgt

SEQ ID NO: 61150 - DNA, 25 bp, Artificial sequence
  SiRNA target sequence
tatcatatgcaacacaaaacacgtt

SEQ ID NO: 61151 - DNA, 25 bp, Artificial sequence
  SiRNA target sequence
atcatatgcaacacaaaacacgttc

SEQ ID NO: 61152 - DNA, 25 bp, Artificial sequence
  SiRNA target sequence
tcatatgcaacacaaaacacgttct

SEQ ID NO: 61153 - DNA, 25 bp, Artificial sequence
  SiRNA target sequence
catatgcaacacaaaacacgttctt

SEQ ID NO: 61154 - DNA, 25 bp, Artificial sequence
  SiRNA target sequence
atatgcaacacaaaacacgttctta

SEQ ID NO: 61155 - DNA, 25 bp, Artificial sequence
  SiRNA target sequence
tatgcaacacaaaacacgttcttat

SEQ ID NO: 61156 - DNA, 25 bp, Artificial sequence
  SiRNA target sequence
atgcaacacaaaacacgttcttatt

SEQ ID NO: 61157 - DNA, 25 bp, Artificial sequence
  SiRNA target sequence
tgcaacacaaaacacgttcttattc

SEQ ID NO: 61158 - DNA, 25 bp, Artificial sequence
  SiRNA target sequence
gcaacacaaaacacgttcttattcg

SEQ ID NO: 61159 - DNA, 25 bp, Artificial sequence
  SiRNA target sequence
caacacaaaacacgttcttattcga

SEQ ID NO: 61160 - DNA, 25 bp, Artificial sequence
  SiRNA target sequence
aacacaaaacacgttcttattcgat

SEQ ID NO: 61161 - DNA, 25 bp, Artificial sequence
  SiRNA target sequence
acacaaaacacgttcttattcgata

SEQ ID NO: 61162 - DNA, 25 bp, Artificial sequence
  SiRNA target sequence
cacaaaacacgttcttattcgataa

SEQ ID NO: 61163 - DNA, 25 bp, Artificial sequence
  SiRNA target sequence
acaaaacacgttcttattcgataat

SEQ ID NO: 61164 - DNA, 25 bp, Artificial sequence
  SiRNA target sequence
caaaacacgttcttattcgataata

SEQ ID NO: 61165 - DNA, 25 bp, Artificial sequence
  SiRNA target sequence
aaaacacgttcttattcgataatac

SEQ ID NO: 61166 - DNA, 25 bp, Artificial sequence
  SiRNA target sequence
aaacacgttcttattcgataatact

SEQ ID NO: 61167 - DNA, 25 bp, Artificial sequence
  SiRNA target sequence
aacacgttcttattcgataatactg

SEQ ID NO: 61168 - DNA, 25 bp, Artificial sequence
  SiRNA target sequence
acacgttcttattcgataatactgt

SEQ ID NO: 61169 - DNA, 25 bp, Artificial sequence
  SiRNA target sequence
cacgttcttattcgataatactgtg

SEQ ID NO: 61170 - DNA, 25 bp, Artificial sequence
  SiRNA target sequence
acgttcttattcgataatactgtga

SEQ ID NO: 61171 - DNA, 25 bp, Artificial sequence
  SiRNA target sequence
cgttcttattcgataatactgtgac

SEQ ID NO: 61172 - DNA, 25 bp, Artificial sequence
  SiRNA target sequence
gttcttattcgataatactgtgaca

SEQ ID NO: 61173 - DNA, 25 bp, Artificial sequence
  SiRNA target sequence
ttcttattcgataatactgtgacat

SEQ ID NO: 61174 - DNA, 25 bp, Artificial sequence
  SiRNA target sequence
tcttattcgataatactgtgacata

SEQ ID NO: 61175 - DNA, 25 bp, Artificial sequence
  SiRNA target sequence
cttattcgataatactgtgacatac

SEQ ID NO: 61176 - DNA, 25 bp, Artificial sequence
  SiRNA target sequence
ttattcgataatactgtgacataca

SEQ ID NO: 61177 - DNA, 25 bp, Artificial sequence
  SiRNA target sequence
tattcgataatactgtgacatacaa

SEQ ID NO: 61178 - DNA, 25 bp, Artificial sequence
  SiRNA target sequence
attcgataatactgtgacatacaat

SEQ ID NO: 61179 - DNA, 25 bp, Artificial sequence
  SiRNA target sequence
ttcgataatactgtgacatacaata

SEQ ID NO: 61180 - DNA, 25 bp, Artificial sequence
  SiRNA target sequence
tcgataatactgtgacatacaatat

SEQ ID NO: 61181 - DNA, 25 bp, Artificial sequence
  SiRNA target sequence
cgataatactgtgacatacaatata

SEQ ID NO: 61182 - DNA, 25 bp, Artificial sequence
  SiRNA target sequence
gataatactgtgacatacaatatat

SEQ ID NO: 61183 - DNA, 25 bp, Artificial sequence
  SiRNA target sequence
ataatactgtgacatacaatatatt

SEQ ID NO: 61184 - DNA, 25 bp, Artificial sequence
  SiRNA target sequence
taatactgtgacatacaatatattt

SEQ ID NO: 61185 - DNA, 25 bp, Artificial sequence
  SiRNA target sequence
aatactgtgacatacaatatatttt

SEQ ID NO: 61186 - DNA, 25 bp, Artificial sequence
  SiRNA target sequence
atactgtgacatacaatatatttta

SEQ ID NO: 61187 - DNA, 25 bp, Artificial sequence
  SiRNA target sequence
tactgtgacatacaatatattttac

SEQ ID NO: 61188 - DNA, 25 bp, Artificial sequence
  SiRNA target sequence
actgtgacatacaatatattttacg

SEQ ID NO: 61189 - DNA, 25 bp, Artificial sequence
  SiRNA target sequence
ctgtgacatacaatatattttacgg

SEQ ID NO: 61190 - DNA, 25 bp, Artificial sequence
  SiRNA target sequence
tgtgacatacaatatattttacggg

SEQ ID NO: 61191 - DNA, 25 bp, Artificial sequence
  SiRNA target sequence
gtgacatacaatatattttacggga

SEQ ID NO: 61192 - DNA, 25 bp, Artificial sequence
  SiRNA target sequence
tgacatacaatatattttacgggac

SEQ ID NO: 61193 - DNA, 25 bp, Artificial sequence
  SiRNA target sequence
gacatacaatatattttacgggact

SEQ ID NO: 61194 - DNA, 25 bp, Artificial sequence
  SiRNA target sequence
acatacaatatattttacgggacta

SEQ ID NO: 61195 - DNA, 25 bp, Artificial sequence
  SiRNA target sequence
catacaatatattttacgggactaa

SEQ ID NO: 61196 - DNA, 25 bp, Artificial sequence
  SiRNA target sequence
atacaatatattttacgggactaaa

SEQ ID NO: 61197 - DNA, 25 bp, Artificial sequence
  SiRNA target sequence
tacaatatattttacgggactaaaa

SEQ ID NO: 61198 - DNA, 25 bp, Artificial sequence
  SiRNA target sequence
acaatatattttacgggactaaaaa

SEQ ID NO: 61199 - DNA, 25 bp, Artificial sequence
  SiRNA target sequence
caatatattttacgggactaaaaac

SEQ ID NO: 61200 - DNA, 25 bp, Artificial sequence
  SiRNA target sequence
aatatattttacgggactaaaaacg

SEQ ID NO: 61201 - DNA, 25 bp, Artificial sequence
  SiRNA target sequence
atatattttacgggactaaaaacgt

SEQ ID NO: 61202 - DNA, 25 bp, Artificial sequence
  SiRNA target sequence
tatattttacgggactaaaaacgta

SEQ ID NO: 61203 - DNA, 25 bp, Artificial sequence
  SiRNA target sequence
atattttacgggactaaaaacgtaa

SEQ ID NO: 61204 - DNA, 25 bp, Artificial sequence
  SiRNA target sequence
tattttacgggactaaaaacgtaac

SEQ ID NO: 61205 - DNA, 25 bp, Artificial sequence
  SiRNA target sequence
attttacgggactaaaaacgtaaca

SEQ ID NO: 61206 - DNA, 25 bp, Artificial sequence
  SiRNA target sequence
ttttacgggactaaaaacgtaacag

SEQ ID NO: 61207 - DNA, 25 bp, Artificial sequence
  SiRNA target sequence
tttacgggactaaaaacgtaacaga

SEQ ID NO: 61208 - DNA, 25 bp, Artificial sequence
  SiRNA target sequence
ttacgggactaaaaacgtaacagaa

SEQ ID NO: 61209 - DNA, 25 bp, Artificial sequence
  SiRNA target sequence
tacgggactaaaaacgtaacagaaa

SEQ ID NO: 61210 - DNA, 25 bp, Artificial sequence
  SiRNA target sequence
acgggactaaaaacgtaacagaaaa

SEQ ID NO: 61211 - DNA, 25 bp, Artificial sequence
  SiRNA target sequence
cgggactaaaaacgtaacagaaaaa

SEQ ID NO: 61212 - DNA, 25 bp, Artificial sequence
  SiRNA target sequence
gggactaaaaacgtaacagaaaaag

SEQ ID NO: 61213 - DNA, 25 bp, Artificial sequence
  SiRNA target sequence
ggactaaaaacgtaacagaaaaaga

SEQ ID NO: 61214 - DNA, 25 bp, Artificial sequence
  SiRNA target sequence
gactaaaaacgtaacagaaaaagaa

SEQ ID NO: 61215 - DNA, 25 bp, Artificial sequence
  SiRNA target sequence
actaaaaacgtaacagaaaaagaag

SEQ ID NO: 61216 - DNA, 25 bp, Artificial sequence
  SiRNA target sequence
ctaaaaacgtaacagaaaaagaagt

SEQ ID NO: 61217 - DNA, 25 bp, Artificial sequence
  SiRNA target sequence
taaaaacgtaacagaaaaagaagtt

SEQ ID NO: 61218 - DNA, 25 bp, Artificial sequence
  SiRNA target sequence
aaaaacgtaacagaaaaagaagttt

SEQ ID NO: 61219 - DNA, 25 bp, Artificial sequence
  SiRNA target sequence
aaaacgtaacagaaaaagaagtttt

SEQ ID NO: 61220 - DNA, 25 bp, Artificial sequence
  SiRNA target sequence
aaacgtaacagaaaaagaagtttta

SEQ ID NO: 61221 - DNA, 25 bp, Artificial sequence
  SiRNA target sequence
aacgtaacagaaaaagaagttttag

SEQ ID NO: 61222 - DNA, 25 bp, Artificial sequence
  SiRNA target sequence
acgtaacagaaaaagaagttttaga

SEQ ID NO: 61223 - DNA, 25 bp, Artificial sequence
  SiRNA target sequence
cgtaacagaaaaagaagttttagaa

SEQ ID NO: 61224 - DNA, 25 bp, Artificial sequence
  SiRNA target sequence
gtaacagaaaaagaagttttagaat

SEQ ID NO: 61225 - DNA, 25 bp, Artificial sequence
  SiRNA target sequence
taacagaaaaagaagttttagaatt

SEQ ID NO: 61226 - DNA, 25 bp, Artificial sequence
  SiRNA target sequence
aacagaaaaagaagttttagaatta

SEQ ID NO: 61227 - DNA, 25 bp, Artificial sequence
  SiRNA target sequence
acagaaaaagaagttttagaattag

SEQ ID NO: 61228 - DNA, 25 bp, Artificial sequence
  SiRNA target sequence
cagaaaaagaagttttagaattagc

SEQ ID NO: 61229 - DNA, 25 bp, Artificial sequence
  SiRNA target sequence
agaaaaagaagttttagaattagcc

SEQ ID NO: 61230 - DNA, 25 bp, Artificial sequence
  SiRNA target sequence
gaaaaagaagttttagaattagcca

SEQ ID NO: 61231 - DNA, 25 bp, Artificial sequence
  SiRNA target sequence
aaaaagaagttttagaattagccaa

SEQ ID NO: 61232 - DNA, 25 bp, Artificial sequence
  SiRNA target sequence
aaaagaagttttagaattagccaaa

SEQ ID NO: 61233 - DNA, 25 bp, Artificial sequence
  SiRNA target sequence
aaagaagttttagaattagccaaaa

SEQ ID NO: 61234 - DNA, 25 bp, Artificial sequence
  SiRNA target sequence
aagaagttttagaattagccaaaaa

SEQ ID NO: 61235 - DNA, 25 bp, Artificial sequence
  SiRNA target sequence
agaagttttagaattagccaaaaaa

SEQ ID NO: 61236 - DNA, 25 bp, Artificial sequence
  SiRNA target sequence
gaagttttagaattagccaaaaaaa

SEQ ID NO: 61237 - DNA, 25 bp, Artificial sequence
  SiRNA target sequence
aagttttagaattagccaaaaaaat

SEQ ID NO: 61238 - DNA, 25 bp, Artificial sequence
  SiRNA target sequence
agttttagaattagccaaaaaaata

SEQ ID NO: 61239 - DNA, 25 bp, Artificial sequence
  SiRNA target sequence
gttttagaattagccaaaaaaatag

SEQ ID NO: 61240 - DNA, 25 bp, Artificial sequence
  SiRNA target sequence
ttttagaattagccaaaaaaatagg

SEQ ID NO: 61241 - DNA, 25 bp, Artificial sequence
  SiRNA target sequence
tttagaattagccaaaaaaataggt

SEQ ID NO: 61242 - DNA, 25 bp, Artificial sequence
  SiRNA target sequence
ttagaattagccaaaaaaataggtg

SEQ ID NO: 61243 - DNA, 25 bp, Artificial sequence
  SiRNA target sequence
tagaattagccaaaaaaataggtgt

SEQ ID NO: 61244 - DNA, 25 bp, Artificial sequence
  SiRNA target sequence
agaattagccaaaaaaataggtgta

SEQ ID NO: 61245 - DNA, 25 bp, Artificial sequence
  SiRNA target sequence
gaattagccaaaaaaataggtgtat

SEQ ID NO: 61246 - DNA, 25 bp, Artificial sequence
  SiRNA target sequence
aattagccaaaaaaataggtgtatt

SEQ ID NO: 61247 - DNA, 25 bp, Artificial sequence
  SiRNA target sequence
attagccaaaaaaataggtgtatta

SEQ ID NO: 61248 - DNA, 25 bp, Artificial sequence
  SiRNA target sequence
ttagccaaaaaaataggtgtattag

SEQ ID NO: 61249 - DNA, 25 bp, Artificial sequence
  SiRNA target sequence
tagccaaaaaaataggtgtattaga

SEQ ID NO: 61250 - DNA, 25 bp, Artificial sequence
  SiRNA target sequence
agccaaaaaaataggtgtattagag

SEQ ID NO: 61251 - DNA, 25 bp, Artificial sequence
  SiRNA target sequence
gccaaaaaaataggtgtattagagt

SEQ ID NO: 61252 - DNA, 25 bp, Artificial sequence
  SiRNA target sequence
ccaaaaaaataggtgtattagagtc

SEQ ID NO: 61253 - DNA, 25 bp, Artificial sequence
  SiRNA target sequence
caaaaaaataggtgtattagagtct

SEQ ID NO: 61254 - DNA, 25 bp, Artificial sequence
  SiRNA target sequence
aaaaaaataggtgtattagagtcta

SEQ ID NO: 61255 - DNA, 25 bp, Artificial sequence
  SiRNA target sequence
aaaaaataggtgtattagagtctat

SEQ ID NO: 61256 - DNA, 25 bp, Artificial sequence
  SiRNA target sequence
aaaaataggtgtattagagtctata

SEQ ID NO: 61257 - DNA, 25 bp, Artificial sequence
  SiRNA target sequence
aaaataggtgtattagagtctatac

SEQ ID NO: 61258 - DNA, 25 bp, Artificial sequence
  SiRNA target sequence
aaataggtgtattagagtctataca

SEQ ID NO: 61259 - DNA, 25 bp, Artificial sequence
  SiRNA target sequence
aataggtgtattagagtctatacag

SEQ ID NO: 61260 - DNA, 25 bp, Artificial sequence
  SiRNA target sequence
ataggtgtattagagtctatacagg

SEQ ID NO: 61261 - DNA, 25 bp, Artificial sequence
  SiRNA target sequence
taggtgtattagagtctatacagga

SEQ ID NO: 61262 - DNA, 25 bp, Artificial sequence
  SiRNA target sequence
aggtgtattagagtctatacaggaa

SEQ ID NO: 61263 - DNA, 25 bp, Artificial sequence
  SiRNA target sequence
ggtgtattagagtctatacaggaat

SEQ ID NO: 61264 - DNA, 25 bp, Artificial sequence
  SiRNA target sequence
gtgtattagagtctatacaggaatt

SEQ ID NO: 61265 - DNA, 25 bp, Artificial sequence
  SiRNA target sequence
tgtattagagtctatacaggaattt

SEQ ID NO: 61266 - DNA, 25 bp, Artificial sequence
  SiRNA target sequence
gtattagagtctatacaggaattta

SEQ ID NO: 61267 - DNA, 25 bp, Artificial sequence
  SiRNA target sequence
tattagagtctatacaggaatttaa

SEQ ID NO: 61268 - DNA, 25 bp, Artificial sequence
  SiRNA target sequence
attagagtctatacaggaatttaaa

SEQ ID NO: 61269 - DNA, 25 bp, Artificial sequence
  SiRNA target sequence
ttagagtctatacaggaatttaaag

SEQ ID NO: 61270 - DNA, 25 bp, Artificial sequence
  SiRNA target sequence
tagagtctatacaggaatttaaaga

SEQ ID NO: 61271 - DNA, 25 bp, Artificial sequence
  SiRNA target sequence
agagtctatacaggaatttaaagat

SEQ ID NO: 61272 - DNA, 25 bp, Artificial sequence
  SiRNA target sequence
gagtctatacaggaatttaaagatg

SEQ ID NO: 61273 - DNA, 25 bp, Artificial sequence
  SiRNA target sequence
agtctatacaggaatttaaagatgg

SEQ ID NO: 61274 - DNA, 25 bp, Artificial sequence
  SiRNA target sequence
gtctatacaggaatttaaagatggg

SEQ ID NO: 61275 - DNA, 25 bp, Artificial sequence
  SiRNA target sequence
tctatacaggaatttaaagatgggt

SEQ ID NO: 61276 - DNA, 25 bp, Artificial sequence
  SiRNA target sequence
ctatacaggaatttaaagatgggtt

SEQ ID NO: 61277 - DNA, 25 bp, Artificial sequence
  SiRNA target sequence
tatacaggaatttaaagatgggttt

SEQ ID NO: 61278 - DNA, 25 bp, Artificial sequence
  SiRNA target sequence
atacaggaatttaaagatgggttta

SEQ ID NO: 61279 - DNA, 25 bp, Artificial sequence
  SiRNA target sequence
tacaggaatttaaagatgggtttag

SEQ ID NO: 61280 - DNA, 25 bp, Artificial sequence
  SiRNA target sequence
acaggaatttaaagatgggtttagc

SEQ ID NO: 61281 - DNA, 25 bp, Artificial sequence
  SiRNA target sequence
caggaatttaaagatgggtttagca

SEQ ID NO: 61282 - DNA, 25 bp, Artificial sequence
  SiRNA target sequence
aggaatttaaagatgggtttagcac

SEQ ID NO: 61283 - DNA, 25 bp, Artificial sequence
  SiRNA target sequence
ggaatttaaagatgggtttagcaca

SEQ ID NO: 61284 - DNA, 25 bp, Artificial sequence
  SiRNA target sequence
gaatttaaagatgggtttagcacat

SEQ ID NO: 61285 - DNA, 25 bp, Artificial sequence
  SiRNA target sequence
aatttaaagatgggtttagcacatc

SEQ ID NO: 61286 - DNA, 25 bp, Artificial sequence
  SiRNA target sequence
atttaaagatgggtttagcacatcg

SEQ ID NO: 61287 - DNA, 25 bp, Artificial sequence
  SiRNA target sequence
tttaaagatgggtttagcacatcgg

SEQ ID NO: 61288 - DNA, 25 bp, Artificial sequence
  SiRNA target sequence
ttaaagatgggtttagcacatcggt

SEQ ID NO: 61289 - DNA, 25 bp, Artificial sequence
  SiRNA target sequence
taaagatgggtttagcacatcggtc

SEQ ID NO: 61290 - DNA, 25 bp, Artificial sequence
  SiRNA target sequence
aaagatgggtttagcacatcggtcg

SEQ ID NO: 61291 - DNA, 25 bp, Artificial sequence
  SiRNA target sequence
aagatgggtttagcacatcggtcgg

SEQ ID NO: 61292 - DNA, 25 bp, Artificial sequence
  SiRNA target sequence
agatgggtttagcacatcggtcggt

SEQ ID NO: 61293 - DNA, 25 bp, Artificial sequence
  SiRNA target sequence
gatgggtttagcacatcggtcggtg

SEQ ID NO: 61294 - DNA, 25 bp, Artificial sequence
  SiRNA target sequence
atgggtttagcacatcggtcggtga

SEQ ID NO: 61295 - DNA, 25 bp, Artificial sequence
  SiRNA target sequence
tgggtttagcacatcggtcggtgaa

SEQ ID NO: 61296 - DNA, 25 bp, Artificial sequence
  SiRNA target sequence
gggtttagcacatcggtcggtgaac

SEQ ID NO: 61297 - DNA, 25 bp, Artificial sequence
  SiRNA target sequence
ggtttagcacatcggtcggtgaacg

SEQ ID NO: 61298 - DNA, 25 bp, Artificial sequence
  SiRNA target sequence
gtttagcacatcggtcggtgaacgc

SEQ ID NO: 61299 - DNA, 25 bp, Artificial sequence
  SiRNA target sequence
tttagcacatcggtcggtgaacgcg

SEQ ID NO: 61300 - DNA, 25 bp, Artificial sequence
  SiRNA target sequence
ttagcacatcggtcggtgaacgcgg

SEQ ID NO: 61301 - DNA, 25 bp, Artificial sequence
  SiRNA target sequence
tagcacatcggtcggtgaacgcgga

SEQ ID NO: 61302 - DNA, 25 bp, Artificial sequence
  SiRNA target sequence
agcacatcggtcggtgaacgcggaa

SEQ ID NO: 61303 - DNA, 25 bp, Artificial sequence
  SiRNA target sequence
gcacatcggtcggtgaacgcggaag

SEQ ID NO: 61304 - DNA, 25 bp, Artificial sequence
  SiRNA target sequence
cacatcggtcggtgaacgcggaaga

SEQ ID NO: 61305 - DNA, 25 bp, Artificial sequence
  SiRNA target sequence
acatcggtcggtgaacgcggaagat

SEQ ID NO: 61306 - DNA, 25 bp, Artificial sequence
  SiRNA target sequence
catcggtcggtgaacgcggaagatt

SEQ ID NO: 61307 - DNA, 25 bp, Artificial sequence
  SiRNA target sequence
atcggtcggtgaacgcggaagattt

SEQ ID NO: 61308 - DNA, 25 bp, Artificial sequence
  SiRNA target sequence
tcggtcggtgaacgcggaagatttt

SEQ ID NO: 61309 - DNA, 25 bp, Artificial sequence
  SiRNA target sequence
cggtcggtgaacgcggaagattttt

SEQ ID NO: 61310 - DNA, 25 bp, Artificial sequence
  SiRNA target sequence
ggtcggtgaacgcggaagattttta

SEQ ID NO: 61311 - DNA, 25 bp, Artificial sequence
  SiRNA target sequence
gtcggtgaacgcggaagatttttat

SEQ ID NO: 61312 - DNA, 25 bp, Artificial sequence
  SiRNA target sequence
tcggtgaacgcggaagatttttatc

SEQ ID NO: 61313 - DNA, 25 bp, Artificial sequence
  SiRNA target sequence
cggtgaacgcggaagatttttatct

SEQ ID NO: 61314 - DNA, 25 bp, Artificial sequence
  SiRNA target sequence
ggtgaacgcggaagatttttatctg

SEQ ID NO: 61315 - DNA, 25 bp, Artificial sequence
  SiRNA target sequence
gtgaacgcggaagatttttatctgg

SEQ ID NO: 61316 - DNA, 25 bp, Artificial sequence
  SiRNA target sequence
tgaacgcggaagatttttatctggt

SEQ ID NO: 61317 - DNA, 25 bp, Artificial sequence
  SiRNA target sequence
gaacgcggaagatttttatctggtg

SEQ ID NO: 61318 - DNA, 25 bp, Artificial sequence
  SiRNA target sequence
aacgcggaagatttttatctggtgg

SEQ ID NO: 61319 - DNA, 25 bp, Artificial sequence
  SiRNA target sequence
acgcggaagatttttatctggtggt

SEQ ID NO: 61320 - DNA, 25 bp, Artificial sequence
  SiRNA target sequence
cgcggaagatttttatctggtggtg

SEQ ID NO: 61321 - DNA, 25 bp, Artificial sequence
  SiRNA target sequence
gcggaagatttttatctggtggtga

SEQ ID NO: 61322 - DNA, 25 bp, Artificial sequence
  SiRNA target sequence
cggaagatttttatctggtggtgaa

SEQ ID NO: 61323 - DNA, 25 bp, Artificial sequence
  SiRNA target sequence
ggaagatttttatctggtggtgaaa

SEQ ID NO: 61324 - DNA, 25 bp, Artificial sequence
  SiRNA target sequence
gaagatttttatctggtggtgaaag

SEQ ID NO: 61325 - DNA, 25 bp, Artificial sequence
  SiRNA target sequence
aagatttttatctggtggtgaaagg

SEQ ID NO: 61326 - DNA, 25 bp, Artificial sequence
  SiRNA target sequence
agatttttatctggtggtgaaaggc

SEQ ID NO: 61327 - DNA, 25 bp, Artificial sequence
  SiRNA target sequence
gatttttatctggtggtgaaaggca

SEQ ID NO: 61328 - DNA, 25 bp, Artificial sequence
  SiRNA target sequence
atttttatctggtggtgaaaggcaa

SEQ ID NO: 61329 - DNA, 25 bp, Artificial sequence
  SiRNA target sequence
tttttatctggtggtgaaaggcaaa

SEQ ID NO: 61330 - DNA, 25 bp, Artificial sequence
  SiRNA target sequence
ttttatctggtggtgaaaggcaaaa

SEQ ID NO: 61331 - DNA, 25 bp, Artificial sequence
  SiRNA target sequence
tttatctggtggtgaaaggcaaaaa

SEQ ID NO: 61332 - DNA, 25 bp, Artificial sequence
  SiRNA target sequence
ttatctggtggtgaaaggcaaaaaa

SEQ ID NO: 61333 - DNA, 25 bp, Artificial sequence
  SiRNA target sequence
tatctggtggtgaaaggcaaaaaat

SEQ ID NO: 61334 - DNA, 25 bp, Artificial sequence
  SiRNA target sequence
atctggtggtgaaaggcaaaaaatt

SEQ ID NO: 61335 - DNA, 25 bp, Artificial sequence
  SiRNA target sequence
tctggtggtgaaaggcaaaaaatta

SEQ ID NO: 61336 - DNA, 25 bp, Artificial sequence
  SiRNA target sequence
ctggtggtgaaaggcaaaaaattat

SEQ ID NO: 61337 - DNA, 25 bp, Artificial sequence
  SiRNA target sequence
tggtggtgaaaggcaaaaaattatg

SEQ ID NO: 61338 - DNA, 25 bp, Artificial sequence
  SiRNA target sequence
ggtggtgaaaggcaaaaaattatgc

SEQ ID NO: 61339 - DNA, 25 bp, Artificial sequence
  SiRNA target sequence
gtggtgaaaggcaaaaaattatgct

SEQ ID NO: 61340 - DNA, 25 bp, Artificial sequence
  SiRNA target sequence
tggtgaaaggcaaaaaattatgctg

SEQ ID NO: 61341 - DNA, 25 bp, Artificial sequence
  SiRNA target sequence
ggtgaaaggcaaaaaattatgctga

SEQ ID NO: 61342 - DNA, 25 bp, Artificial sequence
  SiRNA target sequence
gtgaaaggcaaaaaattatgctgat

SEQ ID NO: 61343 - DNA, 25 bp, Artificial sequence
  SiRNA target sequence
tgaaaggcaaaaaattatgctgatg

SEQ ID NO: 61344 - DNA, 25 bp, Artificial sequence
  SiRNA target sequence
gaaaggcaaaaaattatgctgatgc

SEQ ID NO: 61345 - DNA, 25 bp, Artificial sequence
  SiRNA target sequence
aaaggcaaaaaattatgctgatgcg

SEQ ID NO: 61346 - DNA, 25 bp, Artificial sequence
  SiRNA target sequence
aaggcaaaaaattatgctgatgcgt

SEQ ID NO: 61347 - DNA, 25 bp, Artificial sequence
  SiRNA target sequence
aggcaaaaaattatgctgatgcgtg

SEQ ID NO: 61348 - DNA, 25 bp, Artificial sequence
  SiRNA target sequence
ggcaaaaaattatgctgatgcgtgc

SEQ ID NO: 61349 - DNA, 25 bp, Artificial sequence
  SiRNA target sequence
gcaaaaaattatgctgatgcgtgca

SEQ ID NO: 61350 - DNA, 25 bp, Artificial sequence
  SiRNA target sequence
caaaaaattatgctgatgcgtgcat

SEQ ID NO: 61351 - DNA, 25 bp, Artificial sequence
  SiRNA target sequence
aaaaaattatgctgatgcgtgcatt

SEQ ID NO: 61352 - DNA, 25 bp, Artificial sequence
  SiRNA target sequence
aaaaattatgctgatgcgtgcattg

SEQ ID NO: 61353 - DNA, 25 bp, Artificial sequence
  SiRNA target sequence
aaaattatgctgatgcgtgcattgc

SEQ ID NO: 61354 - DNA, 25 bp, Artificial sequence
  SiRNA target sequence
aaattatgctgatgcgtgcattgct

SEQ ID NO: 61355 - DNA, 25 bp, Artificial sequence
  SiRNA target sequence
aattatgctgatgcgtgcattgctt

SEQ ID NO: 61356 - DNA, 25 bp, Artificial sequence
  SiRNA target sequence
attatgctgatgcgtgcattgctta

SEQ ID NO: 61357 - DNA, 25 bp, Artificial sequence
  SiRNA target sequence
ttatgctgatgcgtgcattgcttaa

SEQ ID NO: 61358 - DNA, 25 bp, Artificial sequence
  SiRNA target sequence
tatgctgatgcgtgcattgcttaaa

SEQ ID NO: 61359 - DNA, 25 bp, Artificial sequence
  SiRNA target sequence
atgctgatgcgtgcattgcttaaaa

SEQ ID NO: 61360 - DNA, 25 bp, Artificial sequence
  SiRNA target sequence
tgctgatgcgtgcattgcttaaaaa

SEQ ID NO: 61361 - DNA, 25 bp, Artificial sequence
  SiRNA target sequence
gctgatgcgtgcattgcttaaaaat

SEQ ID NO: 61362 - DNA, 25 bp, Artificial sequence
  SiRNA target sequence
ctgatgcgtgcattgcttaaaaatt

SEQ ID NO: 61363 - DNA, 25 bp, Artificial sequence
  SiRNA target sequence
tgatgcgtgcattgcttaaaaattc

SEQ ID NO: 61364 - DNA, 25 bp, Artificial sequence
  SiRNA target sequence
gatgcgtgcattgcttaaaaattca

SEQ ID NO: 61365 - DNA, 25 bp, Artificial sequence
  SiRNA target sequence
atgcgtgcattgcttaaaaattcag

SEQ ID NO: 61366 - DNA, 25 bp, Artificial sequence
  SiRNA target sequence
tgcgtgcattgcttaaaaattcaga

SEQ ID NO: 61367 - DNA, 25 bp, Artificial sequence
  SiRNA target sequence
gcgtgcattgcttaaaaattcagag

SEQ ID NO: 61368 - DNA, 25 bp, Artificial sequence
  SiRNA target sequence
cgtgcattgcttaaaaattcagaga

SEQ ID NO: 61369 - DNA, 25 bp, Artificial sequence
  SiRNA target sequence
gtgcattgcttaaaaattcagagat

SEQ ID NO: 61370 - DNA, 25 bp, Artificial sequence
  SiRNA target sequence
tgcattgcttaaaaattcagagatc

SEQ ID NO: 61371 - DNA, 25 bp, Artificial sequence
  SiRNA target sequence
gcattgcttaaaaattcagagatcg

SEQ ID NO: 61372 - DNA, 25 bp, Artificial sequence
  SiRNA target sequence
cattgcttaaaaattcagagatcgt

SEQ ID NO: 61373 - DNA, 25 bp, Artificial sequence
  SiRNA target sequence
attgcttaaaaattcagagatcgtt

SEQ ID NO: 61374 - DNA, 25 bp, Artificial sequence
  SiRNA target sequence
ttgcttaaaaattcagagatcgttt

SEQ ID NO: 61375 - DNA, 25 bp, Artificial sequence
  SiRNA target sequence
tgcttaaaaattcagagatcgtttt

SEQ ID NO: 61376 - DNA, 25 bp, Artificial sequence
  SiRNA target sequence
gcttaaaaattcagagatcgtttta

SEQ ID NO: 61377 - DNA, 25 bp, Artificial sequence
  SiRNA target sequence
cttaaaaattcagagatcgttttat

SEQ ID NO: 61378 - DNA, 25 bp, Artificial sequence
  SiRNA target sequence
ttaaaaattcagagatcgttttatt

SEQ ID NO: 61379 - DNA, 25 bp, Artificial sequence
  SiRNA target sequence
taaaaattcagagatcgttttatta

SEQ ID NO: 61380 - DNA, 25 bp, Artificial sequence
  SiRNA target sequence
aaaaattcagagatcgttttattag

SEQ ID NO: 61381 - DNA, 25 bp, Artificial sequence
  SiRNA target sequence
aaaattcagagatcgttttattaga

SEQ ID NO: 61382 - DNA, 25 bp, Artificial sequence
  SiRNA target sequence
aaattcagagatcgttttattagac

SEQ ID NO: 61383 - DNA, 25 bp, Artificial sequence
  SiRNA target sequence
aattcagagatcgttttattagacg

SEQ ID NO: 61384 - DNA, 25 bp, Artificial sequence
  SiRNA target sequence
attcagagatcgttttattagacga

SEQ ID NO: 61385 - DNA, 25 bp, Artificial sequence
  SiRNA target sequence
ttcagagatcgttttattagacgag

SEQ ID NO: 61386 - DNA, 25 bp, Artificial sequence
  SiRNA target sequence
tcagagatcgttttattagacgagc

SEQ ID NO: 61387 - DNA, 25 bp, Artificial sequence
  SiRNA target sequence
cagagatcgttttattagacgagcc

SEQ ID NO: 61388 - DNA, 25 bp, Artificial sequence
  SiRNA target sequence
agagatcgttttattagacgagcca

SEQ ID NO: 61389 - DNA, 25 bp, Artificial sequence
  SiRNA target sequence
gagatcgttttattagacgagccaa

SEQ ID NO: 61390 - DNA, 25 bp, Artificial sequence
  SiRNA target sequence
agatcgttttattagacgagccaac

SEQ ID NO: 61391 - DNA, 25 bp, Artificial sequence
  SiRNA target sequence
gatcgttttattagacgagccaacc

SEQ ID NO: 61392 - DNA, 25 bp, Artificial sequence
  SiRNA target sequence
atcgttttattagacgagccaacct

SEQ ID NO: 61393 - DNA, 25 bp, Artificial sequence
  SiRNA target sequence
tcgttttattagacgagccaacctc

SEQ ID NO: 61394 - DNA, 25 bp, Artificial sequence
  SiRNA target sequence
cgttttattagacgagccaacctca

SEQ ID NO: 61395 - DNA, 25 bp, Artificial sequence
  SiRNA target sequence
gttttattagacgagccaacctcag

SEQ ID NO: 61396 - DNA, 25 bp, Artificial sequence
  SiRNA target sequence
ttttattagacgagccaacctcagc

SEQ ID NO: 61397 - DNA, 25 bp, Artificial sequence
  SiRNA target sequence
tttattagacgagccaacctcagca

SEQ ID NO: 61398 - DNA, 25 bp, Artificial sequence
  SiRNA target sequence
ttattagacgagccaacctcagcac

SEQ ID NO: 61399 - DNA, 25 bp, Artificial sequence
  SiRNA target sequence
tattagacgagccaacctcagcact

SEQ ID NO: 61400 - DNA, 25 bp, Artificial sequence
  SiRNA target sequence
attagacgagccaacctcagcacta

SEQ ID NO: 61401 - DNA, 25 bp, Artificial sequence
  SiRNA target sequence
ttagacgagccaacctcagcactag

SEQ ID NO: 61402 - DNA, 25 bp, Artificial sequence
  SiRNA target sequence
tagacgagccaacctcagcactaga

SEQ ID NO: 61403 - DNA, 25 bp, Artificial sequence
  SiRNA target sequence
agacgagccaacctcagcactagat

SEQ ID NO: 61404 - DNA, 25 bp, Artificial sequence
  SiRNA target sequence
gacgagccaacctcagcactagata

SEQ ID NO: 61405 - DNA, 25 bp, Artificial sequence
  SiRNA target sequence
acgagccaacctcagcactagataa

SEQ ID NO: 61406 - DNA, 25 bp, Artificial sequence
  SiRNA target sequence
cgagccaacctcagcactagataaa

SEQ ID NO: 61407 - DNA, 25 bp, Artificial sequence
  SiRNA target sequence
gagccaacctcagcactagataaaa

SEQ ID NO: 61408 - DNA, 25 bp, Artificial sequence
  SiRNA target sequence
agccaacctcagcactagataaaaa

SEQ ID NO: 61409 - DNA, 25 bp, Artificial sequence
  SiRNA target sequence
gccaacctcagcactagataaaaag

SEQ ID NO: 61410 - DNA, 25 bp, Artificial sequence
  SiRNA target sequence
ccaacctcagcactagataaaaaga

SEQ ID NO: 61411 - DNA, 25 bp, Artificial sequence
  SiRNA target sequence
caacctcagcactagataaaaagag

SEQ ID NO: 61412 - DNA, 25 bp, Artificial sequence
  SiRNA target sequence
aacctcagcactagataaaaagagt

SEQ ID NO: 61413 - DNA, 25 bp, Artificial sequence
  SiRNA target sequence
acctcagcactagataaaaagagtg

SEQ ID NO: 61414 - DNA, 25 bp, Artificial sequence
  SiRNA target sequence
cctcagcactagataaaaagagtga

SEQ ID NO: 61415 - DNA, 25 bp, Artificial sequence
  SiRNA target sequence
ctcagcactagataaaaagagtgaa

SEQ ID NO: 61416 - DNA, 25 bp, Artificial sequence
  SiRNA target sequence
tcagcactagataaaaagagtgaac

SEQ ID NO: 61417 - DNA, 25 bp, Artificial sequence
  SiRNA target sequence
cagcactagataaaaagagtgaact

SEQ ID NO: 61418 - DNA, 25 bp, Artificial sequence
  SiRNA target sequence
agcactagataaaaagagtgaacta

SEQ ID NO: 61419 - DNA, 25 bp, Artificial sequence
  SiRNA target sequence
gcactagataaaaagagtgaactag

SEQ ID NO: 61420 - DNA, 25 bp, Artificial sequence
  SiRNA target sequence
cactagataaaaagagtgaactaga

SEQ ID NO: 61421 - DNA, 25 bp, Artificial sequence
  SiRNA target sequence
actagataaaaagagtgaactagaa

SEQ ID NO: 61422 - DNA, 25 bp, Artificial sequence
  SiRNA target sequence
ctagataaaaagagtgaactagaaa

SEQ ID NO: 61423 - DNA, 25 bp, Artificial sequence
  SiRNA target sequence
tagataaaaagagtgaactagaaac

SEQ ID NO: 61424 - DNA, 25 bp, Artificial sequence
  SiRNA target sequence
agataaaaagagtgaactagaaact

SEQ ID NO: 61425 - DNA, 25 bp, Artificial sequence
  SiRNA target sequence
gataaaaagagtgaactagaaacta

SEQ ID NO: 61426 - DNA, 25 bp, Artificial sequence
  SiRNA target sequence
ataaaaagagtgaactagaaactat

SEQ ID NO: 61427 - DNA, 25 bp, Artificial sequence
  SiRNA target sequence
taaaaagagtgaactagaaactatg

SEQ ID NO: 61428 - DNA, 25 bp, Artificial sequence
  SiRNA target sequence
aaaaagagtgaactagaaactatga

SEQ ID NO: 61429 - DNA, 25 bp, Artificial sequence
  SiRNA target sequence
aaaagagtgaactagaaactatgac

SEQ ID NO: 61430 - DNA, 25 bp, Artificial sequence
  SiRNA target sequence
aaagagtgaactagaaactatgaca

SEQ ID NO: 61431 - DNA, 25 bp, Artificial sequence
  SiRNA target sequence
aagagtgaactagaaactatgacat

SEQ ID NO: 61432 - DNA, 25 bp, Artificial sequence
  SiRNA target sequence
agagtgaactagaaactatgacata

SEQ ID NO: 61433 - DNA, 25 bp, Artificial sequence
  SiRNA target sequence
gagtgaactagaaactatgacatat

SEQ ID NO: 61434 - DNA, 25 bp, Artificial sequence
  SiRNA target sequence
agtgaactagaaactatgacatata

SEQ ID NO: 61435 - DNA, 25 bp, Artificial sequence
  SiRNA target sequence
gtgaactagaaactatgacatatat

SEQ ID NO: 61436 - DNA, 25 bp, Artificial sequence
  SiRNA target sequence
tgaactagaaactatgacatatatt

SEQ ID NO: 61437 - DNA, 25 bp, Artificial sequence
  SiRNA target sequence
gaactagaaactatgacatatattt

SEQ ID NO: 61438 - DNA, 25 bp, Artificial sequence
  SiRNA target sequence
aactagaaactatgacatatatttt

SEQ ID NO: 61439 - DNA, 25 bp, Artificial sequence
  SiRNA target sequence
actagaaactatgacatatattttt

SEQ ID NO: 61440 - DNA, 25 bp, Artificial sequence
  SiRNA target sequence
ctagaaactatgacatatattttta

SEQ ID NO: 61441 - DNA, 25 bp, Artificial sequence
  SiRNA target sequence
tagaaactatgacatatatttttaa

SEQ ID NO: 61442 - DNA, 25 bp, Artificial sequence
  SiRNA target sequence
agaaactatgacatatatttttaat

SEQ ID NO: 61443 - DNA, 25 bp, Artificial sequence
  SiRNA target sequence
gaaactatgacatatatttttaatg

SEQ ID NO: 61444 - DNA, 25 bp, Artificial sequence
  SiRNA target sequence
aaactatgacatatatttttaatga

SEQ ID NO: 61445 - DNA, 25 bp, Artificial sequence
  SiRNA target sequence
aactatgacatatatttttaatgaa

SEQ ID NO: 61446 - DNA, 25 bp, Artificial sequence
  SiRNA target sequence
actatgacatatatttttaatgaat

SEQ ID NO: 61447 - DNA, 25 bp, Artificial sequence
  SiRNA target sequence
ctatgacatatatttttaatgaatt

SEQ ID NO: 61448 - DNA, 25 bp, Artificial sequence
  SiRNA target sequence
tatgacatatatttttaatgaattt

SEQ ID NO: 61449 - DNA, 25 bp, Artificial sequence
  SiRNA target sequence
atgacatatatttttaatgaattta

SEQ ID NO: 61450 - DNA, 25 bp, Artificial sequence
  SiRNA target sequence
tgacatatatttttaatgaatttaa

SEQ ID NO: 61451 - DNA, 25 bp, Artificial sequence
  SiRNA target sequence
gacatatatttttaatgaatttaag

SEQ ID NO: 61452 - DNA, 25 bp, Artificial sequence
  SiRNA target sequence
acatatatttttaatgaatttaagt

SEQ ID NO: 61453 - DNA, 25 bp, Artificial sequence
  SiRNA target sequence
catatatttttaatgaatttaagta

SEQ ID NO: 61454 - DNA, 25 bp, Artificial sequence
  SiRNA target sequence
atatatttttaatgaatttaagtac

SEQ ID NO: 61455 - DNA, 25 bp, Artificial sequence
  SiRNA target sequence
tatatttttaatgaatttaagtacc

SEQ ID NO: 61456 - DNA, 25 bp, Artificial sequence
  SiRNA target sequence
atatttttaatgaatttaagtacca

SEQ ID NO: 61457 - DNA, 25 bp, Artificial sequence
  SiRNA target sequence
tatttttaatgaatttaagtaccat

SEQ ID NO: 61458 - DNA, 25 bp, Artificial sequence
  SiRNA target sequence
atttttaatgaatttaagtaccata

SEQ ID NO: 61459 - DNA, 25 bp, Artificial sequence
  SiRNA target sequence
tttttaatgaatttaagtaccatac

SEQ ID NO: 61460 - DNA, 25 bp, Artificial sequence
  SiRNA target sequence
ttttaatgaatttaagtaccatact

SEQ ID NO: 61461 - DNA, 25 bp, Artificial sequence
  SiRNA target sequence
tttaatgaatttaagtaccatactt

SEQ ID NO: 61462 - DNA, 25 bp, Artificial sequence
  SiRNA target sequence
ttaatgaatttaagtaccatacttt

SEQ ID NO: 61463 - DNA, 25 bp, Artificial sequence
  SiRNA target sequence
taatgaatttaagtaccatactttt

SEQ ID NO: 61464 - DNA, 25 bp, Artificial sequence
  SiRNA target sequence
aatgaatttaagtaccatacttttg

SEQ ID NO: 61465 - DNA, 25 bp, Artificial sequence
  SiRNA target sequence
atgaatttaagtaccatacttttgt

SEQ ID NO: 61466 - DNA, 25 bp, Artificial sequence
  SiRNA target sequence
tgaatttaagtaccatacttttgta

SEQ ID NO: 61467 - DNA, 25 bp, Artificial sequence
  SiRNA target sequence
gaatttaagtaccatacttttgtaa

SEQ ID NO: 61468 - DNA, 25 bp, Artificial sequence
  SiRNA target sequence
aatttaagtaccatacttttgtaat

SEQ ID NO: 61469 - DNA, 25 bp, Artificial sequence
  SiRNA target sequence
atttaagtaccatacttttgtaata

SEQ ID NO: 61470 - DNA, 25 bp, Artificial sequence
  SiRNA target sequence
tttaagtaccatacttttgtaataa

SEQ ID NO: 61471 - DNA, 25 bp, Artificial sequence
  SiRNA target sequence
ttaagtaccatacttttgtaataat

SEQ ID NO: 61472 - DNA, 25 bp, Artificial sequence
  SiRNA target sequence
taagtaccatacttttgtaataatt

SEQ ID NO: 61473 - DNA, 25 bp, Artificial sequence
  SiRNA target sequence
aagtaccatacttttgtaataattg

SEQ ID NO: 61474 - DNA, 25 bp, Artificial sequence
  SiRNA target sequence
agtaccatacttttgtaataattgt

SEQ ID NO: 61475 - DNA, 25 bp, Artificial sequence
  SiRNA target sequence
gtaccatacttttgtaataattgta

SEQ ID NO: 61476 - DNA, 25 bp, Artificial sequence
  SiRNA target sequence
taccatacttttgtaataattgtac

SEQ ID NO: 61477 - DNA, 25 bp, Artificial sequence
  SiRNA target sequence
accatacttttgtaataattgtaca

SEQ ID NO: 61478 - DNA, 25 bp, Artificial sequence
  SiRNA target sequence
ccatacttttgtaataattgtacac

SEQ ID NO: 61479 - DNA, 25 bp, Artificial sequence
  SiRNA target sequence
catacttttgtaataattgtacaca

SEQ ID NO: 61480 - DNA, 25 bp, Artificial sequence
  SiRNA target sequence
atacttttgtaataattgtacacaa

SEQ ID NO: 61481 - DNA, 25 bp, Artificial sequence
  SiRNA target sequence
tacttttgtaataattgtacacaat

SEQ ID NO: 61482 - DNA, 25 bp, Artificial sequence
  SiRNA target sequence
acttttgtaataattgtacacaatc

SEQ ID NO: 61483 - DNA, 25 bp, Artificial sequence
  SiRNA target sequence
cttttgtaataattgtacacaatct

SEQ ID NO: 61484 - DNA, 25 bp, Artificial sequence
  SiRNA target sequence
ttttgtaataattgtacacaatcta

SEQ ID NO: 61485 - DNA, 25 bp, Artificial sequence
  SiRNA target sequence
tttgtaataattgtacacaatctag

SEQ ID NO: 61486 - DNA, 25 bp, Artificial sequence
  SiRNA target sequence
ttgtaataattgtacacaatctaga

SEQ ID NO: 61487 - DNA, 25 bp, Artificial sequence
  SiRNA target sequence
tgtaataattgtacacaatctagaa

SEQ ID NO: 61488 - DNA, 25 bp, Artificial sequence
  SiRNA target sequence
gtaataattgtacacaatctagaat

SEQ ID NO: 61489 - DNA, 25 bp, Artificial sequence
  SiRNA target sequence
taataattgtacacaatctagaatt

SEQ ID NO: 61490 - DNA, 25 bp, Artificial sequence
  SiRNA target sequence
aataattgtacacaatctagaatta

SEQ ID NO: 61491 - DNA, 25 bp, Artificial sequence
  SiRNA target sequence
ataattgtacacaatctagaattat

SEQ ID NO: 61492 - DNA, 25 bp, Artificial sequence
  SiRNA target sequence
taattgtacacaatctagaattatt

SEQ ID NO: 61493 - DNA, 25 bp, Artificial sequence
  SiRNA target sequence
aattgtacacaatctagaattattg

SEQ ID NO: 61494 - DNA, 25 bp, Artificial sequence
  SiRNA target sequence
attgtacacaatctagaattattgg

SEQ ID NO: 61495 - DNA, 25 bp, Artificial sequence
  SiRNA target sequence
ttgtacacaatctagaattattggc

SEQ ID NO: 61496 - DNA, 25 bp, Artificial sequence
  SiRNA target sequence
tgtacacaatctagaattattggct

SEQ ID NO: 61497 - DNA, 25 bp, Artificial sequence
  SiRNA target sequence
gtacacaatctagaattattggctt

SEQ ID NO: 61498 - DNA, 25 bp, Artificial sequence
  SiRNA target sequence
tacacaatctagaattattggcttt

SEQ ID NO: 61499 - DNA, 25 bp, Artificial sequence
  SiRNA target sequence
acacaatctagaattattggctttg

SEQ ID NO: 61500 - DNA, 25 bp, Artificial sequence
  SiRNA target sequence
cacaatctagaattattggctttgt

SEQ ID NO: 61501 - DNA, 25 bp, Artificial sequence
  SiRNA target sequence
acaatctagaattattggctttgtt

SEQ ID NO: 61502 - DNA, 25 bp, Artificial sequence
  SiRNA target sequence
caatctagaattattggctttgttt

SEQ ID NO: 61503 - DNA, 25 bp, Artificial sequence
  SiRNA target sequence
aatctagaattattggctttgtttg

SEQ ID NO: 61504 - DNA, 25 bp, Artificial sequence
  SiRNA target sequence
atctagaattattggctttgtttga

SEQ ID NO: 61505 - DNA, 25 bp, Artificial sequence
  SiRNA target sequence
tctagaattattggctttgtttgat

SEQ ID NO: 61506 - DNA, 25 bp, Artificial sequence
  SiRNA target sequence
ctagaattattggctttgtttgata

SEQ ID NO: 61507 - DNA, 25 bp, Artificial sequence
  SiRNA target sequence
tagaattattggctttgtttgataa

SEQ ID NO: 61508 - DNA, 25 bp, Artificial sequence
  SiRNA target sequence
agaattattggctttgtttgataaa

SEQ ID NO: 61509 - DNA, 25 bp, Artificial sequence
  SiRNA target sequence
gaattattggctttgtttgataaaa

SEQ ID NO: 61510 - DNA, 25 bp, Artificial sequence
  SiRNA target sequence
aattattggctttgtttgataaaat

SEQ ID NO: 61511 - DNA, 25 bp, Artificial sequence
  SiRNA target sequence
attattggctttgtttgataaaatt

SEQ ID NO: 61512 - DNA, 25 bp, Artificial sequence
  SiRNA target sequence
ttattggctttgtttgataaaattt

SEQ ID NO: 61513 - DNA, 25 bp, Artificial sequence
  SiRNA target sequence
tattggctttgtttgataaaatttt

SEQ ID NO: 61514 - DNA, 25 bp, Artificial sequence
  SiRNA target sequence
attggctttgtttgataaaatttta

SEQ ID NO: 61515 - DNA, 25 bp, Artificial sequence
  SiRNA target sequence
ttggctttgtttgataaaattttat

SEQ ID NO: 61516 - DNA, 25 bp, Artificial sequence
  SiRNA target sequence
tggctttgtttgataaaattttatt

SEQ ID NO: 61517 - DNA, 25 bp, Artificial sequence
  SiRNA target sequence
ggctttgtttgataaaattttattt

SEQ ID NO: 61518 - DNA, 25 bp, Artificial sequence
  SiRNA target sequence
gctttgtttgataaaattttatttg

SEQ ID NO: 61519 - DNA, 25 bp, Artificial sequence
  SiRNA target sequence
ctttgtttgataaaattttatttgt

SEQ ID NO: 61520 - DNA, 25 bp, Artificial sequence
  SiRNA target sequence
tttgtttgataaaattttatttgta

SEQ ID NO: 61521 - DNA, 25 bp, Artificial sequence
  SiRNA target sequence
ttgtttgataaaattttatttgtaa

SEQ ID NO: 61522 - DNA, 25 bp, Artificial sequence
  SiRNA target sequence
tgtttgataaaattttatttgtaaa

SEQ ID NO: 61523 - DNA, 25 bp, Artificial sequence
  SiRNA target sequence
gtttgataaaattttatttgtaaat

SEQ ID NO: 61524 - DNA, 25 bp, Artificial sequence
  SiRNA target sequence
tttgataaaattttatttgtaaatg

SEQ ID NO: 61525 - DNA, 25 bp, Artificial sequence
  SiRNA target sequence
ttgataaaattttatttgtaaatgg

SEQ ID NO: 61526 - DNA, 25 bp, Artificial sequence
  SiRNA target sequence
tgataaaattttatttgtaaatggt

SEQ ID NO: 61527 - DNA, 25 bp, Artificial sequence
  SiRNA target sequence
gataaaattttatttgtaaatggta

SEQ ID NO: 61528 - DNA, 25 bp, Artificial sequence
  SiRNA target sequence
ataaaattttatttgtaaatggtaa

SEQ ID NO: 61529 - DNA, 25 bp, Artificial sequence
  SiRNA target sequence
taaaattttatttgtaaatggtaat

SEQ ID NO: 61530 - DNA, 25 bp, Artificial sequence
  SiRNA target sequence
aaaattttatttgtaaatggtaatg

SEQ ID NO: 61531 - DNA, 25 bp, Artificial sequence
  SiRNA target sequence
aaattttatttgtaaatggtaatga

SEQ ID NO: 61532 - DNA, 25 bp, Artificial sequence
  SiRNA target sequence
aattttatttgtaaatggtaatgag

SEQ ID NO: 61533 - DNA, 25 bp, Artificial sequence
  SiRNA target sequence
attttatttgtaaatggtaatgagg

SEQ ID NO: 61534 - DNA, 25 bp, Artificial sequence
  SiRNA target sequence
ttttatttgtaaatggtaatgaggt

SEQ ID NO: 61535 - DNA, 25 bp, Artificial sequence
  SiRNA target sequence
tttatttgtaaatggtaatgaggta

SEQ ID NO: 61536 - DNA, 25 bp, Artificial sequence
  SiRNA target sequence
ttatttgtaaatggtaatgaggtaa

SEQ ID NO: 61537 - DNA, 25 bp, Artificial sequence
  SiRNA target sequence
tatttgtaaatggtaatgaggtaac

SEQ ID NO: 61538 - DNA, 25 bp, Artificial sequence
  SiRNA target sequence
atttgtaaatggtaatgaggtaaca

SEQ ID NO: 61539 - DNA, 25 bp, Artificial sequence
  SiRNA target sequence
tttgtaaatggtaatgaggtaacaa

SEQ ID NO: 61540 - DNA, 25 bp, Artificial sequence
  SiRNA target sequence
ttgtaaatggtaatgaggtaacaat

SEQ ID NO: 61541 - DNA, 25 bp, Artificial sequence
  SiRNA target sequence
tgtaaatggtaatgaggtaacaatg

SEQ ID NO: 61542 - DNA, 25 bp, Artificial sequence
  SiRNA target sequence
gtaaatggtaatgaggtaacaatga

SEQ ID NO: 61543 - DNA, 25 bp, Artificial sequence
  SiRNA target sequence
taaatggtaatgaggtaacaatgat

SEQ ID NO: 61544 - DNA, 25 bp, Artificial sequence
  SiRNA target sequence
aaatggtaatgaggtaacaatgata

SEQ ID NO: 61545 - DNA, 25 bp, Artificial sequence
  SiRNA target sequence
aatggtaatgaggtaacaatgatag

SEQ ID NO: 61546 - DNA, 25 bp, Artificial sequence
  SiRNA target sequence
atggtaatgaggtaacaatgataga

SEQ ID NO: 61547 - DNA, 25 bp, Artificial sequence
  SiRNA target sequence
tggtaatgaggtaacaatgatagaa

SEQ ID NO: 61548 - DNA, 25 bp, Artificial sequence
  SiRNA target sequence
ggtaatgaggtaacaatgatagaag

SEQ ID NO: 61549 - DNA, 25 bp, Artificial sequence
  SiRNA target sequence
gtaatgaggtaacaatgatagaaga

SEQ ID NO: 61550 - DNA, 25 bp, Artificial sequence
  SiRNA target sequence
taatgaggtaacaatgatagaagac

SEQ ID NO: 61551 - DNA, 25 bp, Artificial sequence
  SiRNA target sequence
aatgaggtaacaatgatagaagaca

SEQ ID NO: 61552 - DNA, 25 bp, Artificial sequence
  SiRNA target sequence
atgaggtaacaatgatagaagacat

SEQ ID NO: 61553 - DNA, 25 bp, Artificial sequence
  SiRNA target sequence
tgaggtaacaatgatagaagacatt

SEQ ID NO: 61554 - DNA, 25 bp, Artificial sequence
  SiRNA target sequence
gaggtaacaatgatagaagacatta

SEQ ID NO: 61555 - DNA, 25 bp, Artificial sequence
  SiRNA target sequence
aggtaacaatgatagaagacattaa

SEQ ID NO: 61556 - DNA, 25 bp, Artificial sequence
  SiRNA target sequence
ggtaacaatgatagaagacattaac

SEQ ID NO: 61557 - DNA, 25 bp, Artificial sequence
  SiRNA target sequence
gtaacaatgatagaagacattaaca

SEQ ID NO: 61558 - DNA, 25 bp, Artificial sequence
  SiRNA target sequence
taacaatgatagaagacattaacaa

SEQ ID NO: 61559 - DNA, 25 bp, Artificial sequence
  SiRNA target sequence
aacaatgatagaagacattaacaaa

SEQ ID NO: 61560 - DNA, 25 bp, Artificial sequence
  SiRNA target sequence
acaatgatagaagacattaacaaaa

SEQ ID NO: 61561 - DNA, 25 bp, Artificial sequence
  SiRNA target sequence
caatgatagaagacattaacaaaaa

SEQ ID NO: 61562 - DNA, 25 bp, Artificial sequence
  SiRNA target sequence
aatgatagaagacattaacaaaaaa

SEQ ID NO: 61563 - DNA, 25 bp, Artificial sequence
  SiRNA target sequence
atgatagaagacattaacaaaaaac

SEQ ID NO: 61564 - DNA, 25 bp, Artificial sequence
  SiRNA target sequence
tgatagaagacattaacaaaaaact

SEQ ID NO: 61565 - DNA, 25 bp, Artificial sequence
  SiRNA target sequence
gatagaagacattaacaaaaaactt

SEQ ID NO: 61566 - DNA, 25 bp, Artificial sequence
  SiRNA target sequence
atagaagacattaacaaaaaacttg

SEQ ID NO: 61567 - DNA, 25 bp, Artificial sequence
  SiRNA target sequence
tagaagacattaacaaaaaacttga

SEQ ID NO: 61568 - DNA, 25 bp, Artificial sequence
  SiRNA target sequence
agaagacattaacaaaaaacttgaa

SEQ ID NO: 61569 - DNA, 25 bp, Artificial sequence
  SiRNA target sequence
gaagacattaacaaaaaacttgaag

SEQ ID NO: 61570 - DNA, 25 bp, Artificial sequence
  SiRNA target sequence
aagacattaacaaaaaacttgaaga

SEQ ID NO: 61571 - DNA, 25 bp, Artificial sequence
  SiRNA target sequence
agacattaacaaaaaacttgaagaa

SEQ ID NO: 61572 - DNA, 25 bp, Artificial sequence
  SiRNA target sequence
gacattaacaaaaaacttgaagaaa

SEQ ID NO: 61573 - DNA, 25 bp, Artificial sequence
  SiRNA target sequence
acattaacaaaaaacttgaagaaaa

SEQ ID NO: 61574 - DNA, 25 bp, Artificial sequence
  SiRNA target sequence
cattaacaaaaaacttgaagaaaat

SEQ ID NO: 61575 - DNA, 25 bp, Artificial sequence
  SiRNA target sequence
attaacaaaaaacttgaagaaaatt

SEQ ID NO: 61576 - DNA, 25 bp, Artificial sequence
  SiRNA target sequence
ttaacaaaaaacttgaagaaaattc

SEQ ID NO: 61577 - DNA, 25 bp, Artificial sequence
  SiRNA target sequence
taacaaaaaacttgaagaaaattca

SEQ ID NO: 61578 - DNA, 25 bp, Artificial sequence
  SiRNA target sequence
aacaaaaaacttgaagaaaattcaa

SEQ ID NO: 61579 - DNA, 25 bp, Artificial sequence
  SiRNA target sequence
acaaaaaacttgaagaaaattcaaa

SEQ ID NO: 61580 - DNA, 25 bp, Artificial sequence
  SiRNA target sequence
caaaaaacttgaagaaaattcaaag

SEQ ID NO: 61581 - DNA, 25 bp, Artificial sequence
  SiRNA target sequence
aaaaaacttgaagaaaattcaaagt

SEQ ID NO: 61582 - DNA, 25 bp, Artificial sequence
  SiRNA target sequence
aaaaacttgaagaaaattcaaagta

SEQ ID NO: 61583 - DNA, 25 bp, Artificial sequence
  SiRNA target sequence
aaaacttgaagaaaattcaaagtat

SEQ ID NO: 61584 - DNA, 25 bp, Artificial sequence
  SiRNA target sequence
aaacttgaagaaaattcaaagtatt

SEQ ID NO: 61585 - DNA, 25 bp, Artificial sequence
  SiRNA target sequence
aacttgaagaaaattcaaagtattt

SEQ ID NO: 61586 - DNA, 25 bp, Artificial sequence
  SiRNA target sequence
acttgaagaaaattcaaagtatttt

SEQ ID NO: 61587 - DNA, 25 bp, Artificial sequence
  SiRNA target sequence
cttgaagaaaattcaaagtattttg

SEQ ID NO: 61588 - DNA, 25 bp, Artificial sequence
  SiRNA target sequence
ttgaagaaaattcaaagtattttgc

SEQ ID NO: 61589 - DNA, 25 bp, Artificial sequence
  SiRNA target sequence
tgaagaaaattcaaagtattttgca

SEQ ID NO: 61590 - DNA, 25 bp, Artificial sequence
  SiRNA target sequence
gaagaaaattcaaagtattttgcag

SEQ ID NO: 61591 - DNA, 25 bp, Artificial sequence
  SiRNA target sequence
aagaaaattcaaagtattttgcaga

SEQ ID NO: 61592 - DNA, 25 bp, Artificial sequence
  SiRNA target sequence
agaaaattcaaagtattttgcagat

SEQ ID NO: 61593 - DNA, 25 bp, Artificial sequence
  SiRNA target sequence
gaaaattcaaagtattttgcagata

SEQ ID NO: 61594 - DNA, 25 bp, Artificial sequence
  SiRNA target sequence
aaaattcaaagtattttgcagatat

SEQ ID NO: 61595 - DNA, 25 bp, Artificial sequence
  SiRNA target sequence
aaattcaaagtattttgcagatatt

SEQ ID NO: 61596 - DNA, 25 bp, Artificial sequence
  SiRNA target sequence
aattcaaagtattttgcagatattt

SEQ ID NO: 61597 - DNA, 25 bp, Artificial sequence
  SiRNA target sequence
attcaaagtattttgcagatatttt

SEQ ID NO: 61598 - DNA, 25 bp, Artificial sequence
  SiRNA target sequence
ttcaaagtattttgcagatatttta

SEQ ID NO: 61599 - DNA, 25 bp, Artificial sequence
  SiRNA target sequence
tcaaagtattttgcagatattttaa

SEQ ID NO: 61600 - DNA, 25 bp, Artificial sequence
  SiRNA target sequence
caaagtattttgcagatattttaaa

SEQ ID NO: 61601 - DNA, 25 bp, Artificial sequence
  SiRNA target sequence
aaagtattttgcagatattttaaac

SEQ ID NO: 61602 - DNA, 25 bp, Artificial sequence
  SiRNA target sequence
aagtattttgcagatattttaaaca

SEQ ID NO: 61603 - DNA, 25 bp, Artificial sequence
  SiRNA target sequence
agtattttgcagatattttaaacaa

SEQ ID NO: 61604 - DNA, 25 bp, Artificial sequence
  SiRNA target sequence
gtattttgcagatattttaaacaac

SEQ ID NO: 61605 - DNA, 25 bp, Artificial sequence
  SiRNA target sequence
tattttgcagatattttaaacaacg

SEQ ID NO: 61606 - DNA, 25 bp, Artificial sequence
  SiRNA target sequence
attttgcagatattttaaacaacga

SEQ ID NO: 61607 - DNA, 25 bp, Artificial sequence
  SiRNA target sequence
ttttgcagatattttaaacaacgaa

SEQ ID NO: 61608 - DNA, 25 bp, Artificial sequence
  SiRNA target sequence
tttgcagatattttaaacaacgaat

SEQ ID NO: 61609 - DNA, 25 bp, Artificial sequence
  SiRNA target sequence
ttgcagatattttaaacaacgaata

SEQ ID NO: 61610 - DNA, 25 bp, Artificial sequence
  SiRNA target sequence
tgcagatattttaaacaacgaataa

SEQ ID NO: 61611 - DNA, 26 bp, Artificial sequence
  SiRNA target sequence
atgaaggaaaaaaccaattatgaaat

SEQ ID NO: 61612 - DNA, 26 bp, Artificial sequence
  SiRNA target sequence
tgaaggaaaaaaccaattatgaaatt

SEQ ID NO: 61613 - DNA, 26 bp, Artificial sequence
  SiRNA target sequence
gaaggaaaaaaccaattatgaaattt

SEQ ID NO: 61614 - DNA, 26 bp, Artificial sequence
  SiRNA target sequence
aaggaaaaaaccaattatgaaatttt

SEQ ID NO: 61615 - DNA, 26 bp, Artificial sequence
  SiRNA target sequence
aggaaaaaaccaattatgaaatttta

SEQ ID NO: 61616 - DNA, 26 bp, Artificial sequence
  SiRNA target sequence
ggaaaaaaccaattatgaaattttat

SEQ ID NO: 61617 - DNA, 26 bp, Artificial sequence
  SiRNA target sequence
gaaaaaaccaattatgaaattttata

SEQ ID NO: 61618 - DNA, 26 bp, Artificial sequence
  SiRNA target sequence
aaaaaaccaattatgaaattttatat

SEQ ID NO: 61619 - DNA, 26 bp, Artificial sequence
  SiRNA target sequence
aaaaaccaattatgaaattttatatg

SEQ ID NO: 61620 - DNA, 26 bp, Artificial sequence
  SiRNA target sequence
aaaaccaattatgaaattttatatga

SEQ ID NO: 61621 - DNA, 26 bp, Artificial sequence
  SiRNA target sequence
aaaccaattatgaaattttatatgat

SEQ ID NO: 61622 - DNA, 26 bp, Artificial sequence
  SiRNA target sequence
aaccaattatgaaattttatatgata

SEQ ID NO: 61623 - DNA, 26 bp, Artificial sequence
  SiRNA target sequence
accaattatgaaattttatatgatac

SEQ ID NO: 61624 - DNA, 26 bp, Artificial sequence
  SiRNA target sequence
ccaattatgaaattttatatgataca

SEQ ID NO: 61625 - DNA, 26 bp, Artificial sequence
  SiRNA target sequence
caattatgaaattttatatgatacat

SEQ ID NO: 61626 - DNA, 26 bp, Artificial sequence
  SiRNA target sequence
aattatgaaattttatatgatacatt

SEQ ID NO: 61627 - DNA, 26 bp, Artificial sequence
  SiRNA target sequence
attatgaaattttatatgatacattt

SEQ ID NO: 61628 - DNA, 26 bp, Artificial sequence
  SiRNA target sequence
ttatgaaattttatatgatacatttg

SEQ ID NO: 61629 - DNA, 26 bp, Artificial sequence
  SiRNA target sequence
tatgaaattttatatgatacatttgt

SEQ ID NO: 61630 - DNA, 26 bp, Artificial sequence
  SiRNA target sequence
atgaaattttatatgatacatttgta

SEQ ID NO: 61631 - DNA, 26 bp, Artificial sequence
  SiRNA target sequence
tgaaattttatatgatacatttgtaa

SEQ ID NO: 61632 - DNA, 26 bp, Artificial sequence
  SiRNA target sequence
gaaattttatatgatacatttgtaaa

SEQ ID NO: 61633 - DNA, 26 bp, Artificial sequence
  SiRNA target sequence
aaattttatatgatacatttgtaaaa

SEQ ID NO: 61634 - DNA, 26 bp, Artificial sequence
  SiRNA target sequence
aattttatatgatacatttgtaaaat

SEQ ID NO: 61635 - DNA, 26 bp, Artificial sequence
  SiRNA target sequence
attttatatgatacatttgtaaaata

SEQ ID NO: 61636 - DNA, 26 bp, Artificial sequence
  SiRNA target sequence
ttttatatgatacatttgtaaaatat

SEQ ID NO: 61637 - DNA, 26 bp, Artificial sequence
  SiRNA target sequence
tttatatgatacatttgtaaaatatt

SEQ ID NO: 61638 - DNA, 26 bp, Artificial sequence
  SiRNA target sequence
ttatatgatacatttgtaaaatattg

SEQ ID NO: 61639 - DNA, 26 bp, Artificial sequence
  SiRNA target sequence
tatatgatacatttgtaaaatattgt

SEQ ID NO: 61640 - DNA, 26 bp, Artificial sequence
  SiRNA target sequence
atatgatacatttgtaaaatattgtt

SEQ ID NO: 61641 - DNA, 26 bp, Artificial sequence
  SiRNA target sequence
tatgatacatttgtaaaatattgtta

SEQ ID NO: 61642 - DNA, 26 bp, Artificial sequence
  SiRNA target sequence
atgatacatttgtaaaatattgttac

SEQ ID NO: 61643 - DNA, 26 bp, Artificial sequence
  SiRNA target sequence
tgatacatttgtaaaatattgttaca

SEQ ID NO: 61644 - DNA, 26 bp, Artificial sequence
  SiRNA target sequence
gatacatttgtaaaatattgttacaa

SEQ ID NO: 61645 - DNA, 26 bp, Artificial sequence
  SiRNA target sequence
atacatttgtaaaatattgttacaat

SEQ ID NO: 61646 - DNA, 26 bp, Artificial sequence
  SiRNA target sequence
tacatttgtaaaatattgttacaata

SEQ ID NO: 61647 - DNA, 26 bp, Artificial sequence
  SiRNA target sequence
acatttgtaaaatattgttacaatat

SEQ ID NO: 61648 - DNA, 26 bp, Artificial sequence
  SiRNA target sequence
catttgtaaaatattgttacaatatt

SEQ ID NO: 61649 - DNA, 26 bp, Artificial sequence
  SiRNA target sequence
atttgtaaaatattgttacaatattt

SEQ ID NO: 61650 - DNA, 26 bp, Artificial sequence
  SiRNA target sequence
tttgtaaaatattgttacaatatttc

SEQ ID NO: 61651 - DNA, 26 bp, Artificial sequence
  SiRNA target sequence
ttgtaaaatattgttacaatatttcc

SEQ ID NO: 61652 - DNA, 26 bp, Artificial sequence
  SiRNA target sequence
tgtaaaatattgttacaatatttcct

SEQ ID NO: 61653 - DNA, 26 bp, Artificial sequence
  SiRNA target sequence
gtaaaatattgttacaatatttccta

SEQ ID NO: 61654 - DNA, 26 bp, Artificial sequence
  SiRNA target sequence
taaaatattgttacaatatttcctat

SEQ ID NO: 61655 - DNA, 26 bp, Artificial sequence
  SiRNA target sequence
aaaatattgttacaatatttcctata

SEQ ID NO: 61656 - DNA, 26 bp, Artificial sequence
  SiRNA target sequence
aaatattgttacaatatttcctatat

SEQ ID NO: 61657 - DNA, 26 bp, Artificial sequence
  SiRNA target sequence
aatattgttacaatatttcctatata

SEQ ID NO: 61658 - DNA, 26 bp, Artificial sequence
  SiRNA target sequence
atattgttacaatatttcctatataa

SEQ ID NO: 61659 - DNA, 26 bp, Artificial sequence
  SiRNA target sequence
tattgttacaatatttcctatataag

SEQ ID NO: 61660 - DNA, 26 bp, Artificial sequence
  SiRNA target sequence
attgttacaatatttcctatataagg

SEQ ID NO: 61661 - DNA, 26 bp, Artificial sequence
  SiRNA target sequence
ttgttacaatatttcctatataaggt

SEQ ID NO: 61662 - DNA, 26 bp, Artificial sequence
  SiRNA target sequence
tgttacaatatttcctatataaggta

SEQ ID NO: 61663 - DNA, 26 bp, Artificial sequence
  SiRNA target sequence
gttacaatatttcctatataaggtac

SEQ ID NO: 61664 - DNA, 26 bp, Artificial sequence
  SiRNA target sequence
ttacaatatttcctatataaggtacg

SEQ ID NO: 61665 - DNA, 26 bp, Artificial sequence
  SiRNA target sequence
tacaatatttcctatataaggtacgt

SEQ ID NO: 61666 - DNA, 26 bp, Artificial sequence
  SiRNA target sequence
acaatatttcctatataaggtacgta

SEQ ID NO: 61667 - DNA, 26 bp, Artificial sequence
  SiRNA target sequence
caatatttcctatataaggtacgtaa

SEQ ID NO: 61668 - DNA, 26 bp, Artificial sequence
  SiRNA target sequence
aatatttcctatataaggtacgtaat

SEQ ID NO: 61669 - DNA, 26 bp, Artificial sequence
  SiRNA target sequence
atatttcctatataaggtacgtaatg

SEQ ID NO: 61670 - DNA, 26 bp, Artificial sequence
  SiRNA target sequence
tatttcctatataaggtacgtaatgt

SEQ ID NO: 61671 - DNA, 26 bp, Artificial sequence
  SiRNA target sequence
atttcctatataaggtacgtaatgtt

SEQ ID NO: 61672 - DNA, 26 bp, Artificial sequence
  SiRNA target sequence
tttcctatataaggtacgtaatgttt

SEQ ID NO: 61673 - DNA, 26 bp, Artificial sequence
  SiRNA target sequence
ttcctatataaggtacgtaatgtttc

SEQ ID NO: 61674 - DNA, 26 bp, Artificial sequence
  SiRNA target sequence
tcctatataaggtacgtaatgtttcc

SEQ ID NO: 61675 - DNA, 26 bp, Artificial sequence
  SiRNA target sequence
cctatataaggtacgtaatgtttccc

SEQ ID NO: 61676 - DNA, 26 bp, Artificial sequence
  SiRNA target sequence
ctatataaggtacgtaatgtttccca

SEQ ID NO: 61677 - DNA, 26 bp, Artificial sequence
  SiRNA target sequence
tatataaggtacgtaatgtttcccat

SEQ ID NO: 61678 - DNA, 26 bp, Artificial sequence
  SiRNA target sequence
atataaggtacgtaatgtttcccata

SEQ ID NO: 61679 - DNA, 26 bp, Artificial sequence
  SiRNA target sequence
tataaggtacgtaatgtttcccatat

SEQ ID NO: 61680 - DNA, 26 bp, Artificial sequence
  SiRNA target sequence
ataaggtacgtaatgtttcccatatt

SEQ ID NO: 61681 - DNA, 26 bp, Artificial sequence
  SiRNA target sequence
taaggtacgtaatgtttcccatatta

SEQ ID NO: 61682 - DNA, 26 bp, Artificial sequence
  SiRNA target sequence
aaggtacgtaatgtttcccatattac

SEQ ID NO: 61683 - DNA, 26 bp, Artificial sequence
  SiRNA target sequence
aggtacgtaatgtttcccatattact

SEQ ID NO: 61684 - DNA, 26 bp, Artificial sequence
  SiRNA target sequence
ggtacgtaatgtttcccatattactg

SEQ ID NO: 61685 - DNA, 26 bp, Artificial sequence
  SiRNA target sequence
gtacgtaatgtttcccatattactgt

SEQ ID NO: 61686 - DNA, 26 bp, Artificial sequence
  SiRNA target sequence
tacgtaatgtttcccatattactgtc

SEQ ID NO: 61687 - DNA, 26 bp, Artificial sequence
  SiRNA target sequence
acgtaatgtttcccatattactgtct

SEQ ID NO: 61688 - DNA, 26 bp, Artificial sequence
  SiRNA target sequence
cgtaatgtttcccatattactgtcta

SEQ ID NO: 61689 - DNA, 26 bp, Artificial sequence
  SiRNA target sequence
gtaatgtttcccatattactgtctac

SEQ ID NO: 61690 - DNA, 26 bp, Artificial sequence
  SiRNA target sequence
taatgtttcccatattactgtctaca

SEQ ID NO: 61691 - DNA, 26 bp, Artificial sequence
  SiRNA target sequence
aatgtttcccatattactgtctacaa

SEQ ID NO: 61692 - DNA, 26 bp, Artificial sequence
  SiRNA target sequence
atgtttcccatattactgtctacaat

SEQ ID NO: 61693 - DNA, 26 bp, Artificial sequence
  SiRNA target sequence
tgtttcccatattactgtctacaatt

SEQ ID NO: 61694 - DNA, 26 bp, Artificial sequence
  SiRNA target sequence
gtttcccatattactgtctacaatta

SEQ ID NO: 61695 - DNA, 26 bp, Artificial sequence
  SiRNA target sequence
tttcccatattactgtctacaattat

SEQ ID NO: 61696 - DNA, 26 bp, Artificial sequence
  SiRNA target sequence
ttcccatattactgtctacaattata

SEQ ID NO: 61697 - DNA, 26 bp, Artificial sequence
  SiRNA target sequence
tcccatattactgtctacaattatag

SEQ ID NO: 61698 - DNA, 26 bp, Artificial sequence
  SiRNA target sequence
cccatattactgtctacaattatagc

SEQ ID NO: 61699 - DNA, 26 bp, Artificial sequence
  SiRNA target sequence
ccatattactgtctacaattatagct

SEQ ID NO: 61700 - DNA, 26 bp, Artificial sequence
  SiRNA target sequence
catattactgtctacaattatagctt

SEQ ID NO: 61701 - DNA, 26 bp, Artificial sequence
  SiRNA target sequence
atattactgtctacaattatagcttg

SEQ ID NO: 61702 - DNA, 26 bp, Artificial sequence
  SiRNA target sequence
tattactgtctacaattatagcttgt

SEQ ID NO: 61703 - DNA, 26 bp, Artificial sequence
  SiRNA target sequence
attactgtctacaattatagcttgtt

SEQ ID NO: 61704 - DNA, 26 bp, Artificial sequence
  SiRNA target sequence
ttactgtctacaattatagcttgtta

SEQ ID NO: 61705 - DNA, 26 bp, Artificial sequence
  SiRNA target sequence
tactgtctacaattatagcttgttat

SEQ ID NO: 61706 - DNA, 26 bp, Artificial sequence
  SiRNA target sequence
actgtctacaattatagcttgttatc

SEQ ID NO: 61707 - DNA, 26 bp, Artificial sequence
  SiRNA target sequence
ctgtctacaattatagcttgttatct

SEQ ID NO: 61708 - DNA, 26 bp, Artificial sequence
  SiRNA target sequence
tgtctacaattatagcttgttatctc

SEQ ID NO: 61709 - DNA, 26 bp, Artificial sequence
  SiRNA target sequence
gtctacaattatagcttgttatctcg

SEQ ID NO: 61710 - DNA, 26 bp, Artificial sequence
  SiRNA target sequence
tctacaattatagcttgttatctcga

SEQ ID NO: 61711 - DNA, 26 bp, Artificial sequence
  SiRNA target sequence
ctacaattatagcttgttatctcgaa

SEQ ID NO: 61712 - DNA, 26 bp, Artificial sequence
  SiRNA target sequence
tacaattatagcttgttatctcgaag

SEQ ID NO: 61713 - DNA, 26 bp, Artificial sequence
  SiRNA target sequence
acaattatagcttgttatctcgaagt

SEQ ID NO: 61714 - DNA, 26 bp, Artificial sequence
  SiRNA target sequence
caattatagcttgttatctcgaagtt

SEQ ID NO: 61715 - DNA, 26 bp, Artificial sequence
  SiRNA target sequence
aattatagcttgttatctcgaagttc

SEQ ID NO: 61716 - DNA, 26 bp, Artificial sequence
  SiRNA target sequence
attatagcttgttatctcgaagttca

SEQ ID NO: 61717 - DNA, 26 bp, Artificial sequence
  SiRNA target sequence
ttatagcttgttatctcgaagttcag

SEQ ID NO: 61718 - DNA, 26 bp, Artificial sequence
  SiRNA target sequence
tatagcttgttatctcgaagttcagg

SEQ ID NO: 61719 - DNA, 26 bp, Artificial sequence
  SiRNA target sequence
atagcttgttatctcgaagttcaggc

SEQ ID NO: 61720 - DNA, 26 bp, Artificial sequence
  SiRNA target sequence
tagcttgttatctcgaagttcaggca

SEQ ID NO: 61721 - DNA, 26 bp, Artificial sequence
  SiRNA target sequence
agcttgttatctcgaagttcaggcaa

SEQ ID NO: 61722 - DNA, 26 bp, Artificial sequence
  SiRNA target sequence
gcttgttatctcgaagttcaggcaag

SEQ ID NO: 61723 - DNA, 26 bp, Artificial sequence
  SiRNA target sequence
cttgttatctcgaagttcaggcaagt

SEQ ID NO: 61724 - DNA, 26 bp, Artificial sequence
  SiRNA target sequence
ttgttatctcgaagttcaggcaagta

SEQ ID NO: 61725 - DNA, 26 bp, Artificial sequence
  SiRNA target sequence
tgttatctcgaagttcaggcaagtaa

SEQ ID NO: 61726 - DNA, 26 bp, Artificial sequence
  SiRNA target sequence
gttatctcgaagttcaggcaagtaac

SEQ ID NO: 61727 - DNA, 26 bp, Artificial sequence
  SiRNA target sequence
ttatctcgaagttcaggcaagtaaca

SEQ ID NO: 61728 - DNA, 26 bp, Artificial sequence
  SiRNA target sequence
tatctcgaagttcaggcaagtaacat

SEQ ID NO: 61729 - DNA, 26 bp, Artificial sequence
  SiRNA target sequence
atctcgaagttcaggcaagtaacata

SEQ ID NO: 61730 - DNA, 26 bp, Artificial sequence
  SiRNA target sequence
tctcgaagttcaggcaagtaacatat

SEQ ID NO: 61731 - DNA, 26 bp, Artificial sequence
  SiRNA target sequence
ctcgaagttcaggcaagtaacatatc

SEQ ID NO: 61732 - DNA, 26 bp, Artificial sequence
  SiRNA target sequence
tcgaagttcaggcaagtaacatatca

SEQ ID NO: 61733 - DNA, 26 bp, Artificial sequence
  SiRNA target sequence
cgaagttcaggcaagtaacatatcaa

SEQ ID NO: 61734 - DNA, 26 bp, Artificial sequence
  SiRNA target sequence
gaagttcaggcaagtaacatatcaaa

SEQ ID NO: 61735 - DNA, 26 bp, Artificial sequence
  SiRNA target sequence
aagttcaggcaagtaacatatcaaaa

SEQ ID NO: 61736 - DNA, 26 bp, Artificial sequence
  SiRNA target sequence
agttcaggcaagtaacatatcaaaaa

SEQ ID NO: 61737 - DNA, 26 bp, Artificial sequence
  SiRNA target sequence
gttcaggcaagtaacatatcaaaaag

SEQ ID NO: 61738 - DNA, 26 bp, Artificial sequence
  SiRNA target sequence
ttcaggcaagtaacatatcaaaaaga

SEQ ID NO: 61739 - DNA, 26 bp, Artificial sequence
  SiRNA target sequence
tcaggcaagtaacatatcaaaaagaa

SEQ ID NO: 61740 - DNA, 26 bp, Artificial sequence
  SiRNA target sequence
caggcaagtaacatatcaaaaagaat

SEQ ID NO: 61741 - DNA, 26 bp, Artificial sequence
  SiRNA target sequence
aggcaagtaacatatcaaaaagaatt

SEQ ID NO: 61742 - DNA, 26 bp, Artificial sequence
  SiRNA target sequence
ggcaagtaacatatcaaaaagaattg

SEQ ID NO: 61743 - DNA, 26 bp, Artificial sequence
  SiRNA target sequence
gcaagtaacatatcaaaaagaattgc

SEQ ID NO: 61744 - DNA, 26 bp, Artificial sequence
  SiRNA target sequence
caagtaacatatcaaaaagaattgca

SEQ ID NO: 61745 - DNA, 26 bp, Artificial sequence
  SiRNA target sequence
aagtaacatatcaaaaagaattgcag

SEQ ID NO: 61746 - DNA, 26 bp, Artificial sequence
  SiRNA target sequence
agtaacatatcaaaaagaattgcaga

SEQ ID NO: 61747 - DNA, 26 bp, Artificial sequence
  SiRNA target sequence
gtaacatatcaaaaagaattgcagaa

SEQ ID NO: 61748 - DNA, 26 bp, Artificial sequence
  SiRNA target sequence
taacatatcaaaaagaattgcagaag

SEQ ID NO: 61749 - DNA, 26 bp, Artificial sequence
  SiRNA target sequence
aacatatcaaaaagaattgcagaaga

SEQ ID NO: 61750 - DNA, 26 bp, Artificial sequence
  SiRNA target sequence
acatatcaaaaagaattgcagaagat

SEQ ID NO: 61751 - DNA, 26 bp, Artificial sequence
  SiRNA target sequence
catatcaaaaagaattgcagaagatt

SEQ ID NO: 61752 - DNA, 26 bp, Artificial sequence
  SiRNA target sequence
atatcaaaaagaattgcagaagattt

SEQ ID NO: 61753 - DNA, 26 bp, Artificial sequence
  SiRNA target sequence
tatcaaaaagaattgcagaagatttt

SEQ ID NO: 61754 - DNA, 26 bp, Artificial sequence
  SiRNA target sequence
atcaaaaagaattgcagaagattttg

SEQ ID NO: 61755 - DNA, 26 bp, Artificial sequence
  SiRNA target sequence
tcaaaaagaattgcagaagattttga

SEQ ID NO: 61756 - DNA, 26 bp, Artificial sequence
  SiRNA target sequence
caaaaagaattgcagaagattttgaa

SEQ ID NO: 61757 - DNA, 26 bp, Artificial sequence
  SiRNA target sequence
aaaaagaattgcagaagattttgaaa

SEQ ID NO: 61758 - DNA, 26 bp, Artificial sequence
  SiRNA target sequence
aaaagaattgcagaagattttgaaaa

SEQ ID NO: 61759 - DNA, 26 bp, Artificial sequence
  SiRNA target sequence
aaagaattgcagaagattttgaaaat

SEQ ID NO: 61760 - DNA, 26 bp, Artificial sequence
  SiRNA target sequence
aagaattgcagaagattttgaaaata

SEQ ID NO: 61761 - DNA, 26 bp, Artificial sequence
  SiRNA target sequence
agaattgcagaagattttgaaaataa

SEQ ID NO: 61762 - DNA, 26 bp, Artificial sequence
  SiRNA target sequence
gaattgcagaagattttgaaaataaa

SEQ ID NO: 61763 - DNA, 26 bp, Artificial sequence
  SiRNA target sequence
aattgcagaagattttgaaaataaaa

SEQ ID NO: 61764 - DNA, 26 bp, Artificial sequence
  SiRNA target sequence
attgcagaagattttgaaaataaaat

SEQ ID NO: 61765 - DNA, 26 bp, Artificial sequence
  SiRNA target sequence
ttgcagaagattttgaaaataaaata

SEQ ID NO: 61766 - DNA, 26 bp, Artificial sequence
  SiRNA target sequence
tgcagaagattttgaaaataaaataa

SEQ ID NO: 61767 - DNA, 26 bp, Artificial sequence
  SiRNA target sequence
gcagaagattttgaaaataaaataaa

SEQ ID NO: 61768 - DNA, 26 bp, Artificial sequence
  SiRNA target sequence
cagaagattttgaaaataaaataaat

SEQ ID NO: 61769 - DNA, 26 bp, Artificial sequence
  SiRNA target sequence
agaagattttgaaaataaaataaatg

SEQ ID NO: 61770 - DNA, 26 bp, Artificial sequence
  SiRNA target sequence
gaagattttgaaaataaaataaatgc

SEQ ID NO: 61771 - DNA, 26 bp, Artificial sequence
  SiRNA target sequence
aagattttgaaaataaaataaatgca

SEQ ID NO: 61772 - DNA, 26 bp, Artificial sequence
  SiRNA target sequence
agattttgaaaataaaataaatgcag

SEQ ID NO: 61773 - DNA, 26 bp, Artificial sequence
  SiRNA target sequence
gattttgaaaataaaataaatgcagg

SEQ ID NO: 61774 - DNA, 26 bp, Artificial sequence
  SiRNA target sequence
attttgaaaataaaataaatgcagga

SEQ ID NO: 61775 - DNA, 26 bp, Artificial sequence
  SiRNA target sequence
ttttgaaaataaaataaatgcaggaa

SEQ ID NO: 61776 - DNA, 26 bp, Artificial sequence
  SiRNA target sequence
tttgaaaataaaataaatgcaggaaa

SEQ ID NO: 61777 - DNA, 26 bp, Artificial sequence
  SiRNA target sequence
ttgaaaataaaataaatgcaggaaaa

SEQ ID NO: 61778 - DNA, 26 bp, Artificial sequence
  SiRNA target sequence
tgaaaataaaataaatgcaggaaaaa

SEQ ID NO: 61779 - DNA, 26 bp, Artificial sequence
  SiRNA target sequence
gaaaataaaataaatgcaggaaaaag

SEQ ID NO: 61780 - DNA, 26 bp, Artificial sequence
  SiRNA target sequence
aaaataaaataaatgcaggaaaaagt

SEQ ID NO: 61781 - DNA, 26 bp, Artificial sequence
  SiRNA target sequence
aaataaaataaatgcaggaaaaagta

SEQ ID NO: 61782 - DNA, 26 bp, Artificial sequence
  SiRNA target sequence
aataaaataaatgcaggaaaaagtat

SEQ ID NO: 61783 - DNA, 26 bp, Artificial sequence
  SiRNA target sequence
ataaaataaatgcaggaaaaagtata

SEQ ID NO: 61784 - DNA, 26 bp, Artificial sequence
  SiRNA target sequence
taaaataaatgcaggaaaaagtatat

SEQ ID NO: 61785 - DNA, 26 bp, Artificial sequence
  SiRNA target sequence
aaaataaatgcaggaaaaagtatatt

SEQ ID NO: 61786 - DNA, 26 bp, Artificial sequence
  SiRNA target sequence
aaataaatgcaggaaaaagtatattt

SEQ ID NO: 61787 - DNA, 26 bp, Artificial sequence
  SiRNA target sequence
aataaatgcaggaaaaagtatattta

SEQ ID NO: 61788 - DNA, 26 bp, Artificial sequence
  SiRNA target sequence
ataaatgcaggaaaaagtatatttaa

SEQ ID NO: 61789 - DNA, 26 bp, Artificial sequence
  SiRNA target sequence
taaatgcaggaaaaagtatatttaaa

SEQ ID NO: 61790 - DNA, 26 bp, Artificial sequence
  SiRNA target sequence
aaatgcaggaaaaagtatatttaaat

SEQ ID NO: 61791 - DNA, 26 bp, Artificial sequence
  SiRNA target sequence
aatgcaggaaaaagtatatttaaata

SEQ ID NO: 61792 - DNA, 26 bp, Artificial sequence
  SiRNA target sequence
atgcaggaaaaagtatatttaaatat

SEQ ID NO: 61793 - DNA, 26 bp, Artificial sequence
  SiRNA target sequence
tgcaggaaaaagtatatttaaatata

SEQ ID NO: 61794 - DNA, 26 bp, Artificial sequence
  SiRNA target sequence
gcaggaaaaagtatatttaaatatat

SEQ ID NO: 61795 - DNA, 26 bp, Artificial sequence
  SiRNA target sequence
caggaaaaagtatatttaaatatatt

SEQ ID NO: 61796 - DNA, 26 bp, Artificial sequence
  SiRNA target sequence
aggaaaaagtatatttaaatatattt

SEQ ID NO: 61797 - DNA, 26 bp, Artificial sequence
  SiRNA target sequence
ggaaaaagtatatttaaatatatttt

SEQ ID NO: 61798 - DNA, 26 bp, Artificial sequence
  SiRNA target sequence
gaaaaagtatatttaaatatatttta

SEQ ID NO: 61799 - DNA, 26 bp, Artificial sequence
  SiRNA target sequence
aaaaagtatatttaaatatattttat

SEQ ID NO: 61800 - DNA, 26 bp, Artificial sequence
  SiRNA target sequence
aaaagtatatttaaatatattttatt

SEQ ID NO: 61801 - DNA, 26 bp, Artificial sequence
  SiRNA target sequence
aaagtatatttaaatatattttattt

SEQ ID NO: 61802 - DNA, 26 bp, Artificial sequence
  SiRNA target sequence
aagtatatttaaatatattttatttt

SEQ ID NO: 61803 - DNA, 26 bp, Artificial sequence
  SiRNA target sequence
agtatatttaaatatattttattttt

SEQ ID NO: 61804 - DNA, 26 bp, Artificial sequence
  SiRNA target sequence
gtatatttaaatatattttattttta

SEQ ID NO: 61805 - DNA, 26 bp, Artificial sequence
  SiRNA target sequence
tatatttaaatatattttatttttaa

SEQ ID NO: 61806 - DNA, 26 bp, Artificial sequence
  SiRNA target sequence
atatttaaatatattttatttttaac

SEQ ID NO: 61807 - DNA, 26 bp, Artificial sequence
  SiRNA target sequence
tatttaaatatattttatttttaact

SEQ ID NO: 61808 - DNA, 26 bp, Artificial sequence
  SiRNA target sequence
atttaaatatattttatttttaactt

SEQ ID NO: 61809 - DNA, 26 bp, Artificial sequence
  SiRNA target sequence
tttaaatatattttatttttaacttc

SEQ ID NO: 61810 - DNA, 26 bp, Artificial sequence
  SiRNA target sequence
ttaaatatattttatttttaacttca

SEQ ID NO: 61811 - DNA, 26 bp, Artificial sequence
  SiRNA target sequence
taaatatattttatttttaacttcat

SEQ ID NO: 61812 - DNA, 26 bp, Artificial sequence
  SiRNA target sequence
aaatatattttatttttaacttcatc

SEQ ID NO: 61813 - DNA, 26 bp, Artificial sequence
  SiRNA target sequence
aatatattttatttttaacttcatca

SEQ ID NO: 61814 - DNA, 26 bp, Artificial sequence
  SiRNA target sequence
atatattttatttttaacttcatcaa

SEQ ID NO: 61815 - DNA, 26 bp, Artificial sequence
  SiRNA target sequence
tatattttatttttaacttcatcaat

SEQ ID NO: 61816 - DNA, 26 bp, Artificial sequence
  SiRNA target sequence
atattttatttttaacttcatcaata

SEQ ID NO: 61817 - DNA, 26 bp, Artificial sequence
  SiRNA target sequence
tattttatttttaacttcatcaatag

SEQ ID NO: 61818 - DNA, 26 bp, Artificial sequence
  SiRNA target sequence
attttatttttaacttcatcaatagt

SEQ ID NO: 61819 - DNA, 26 bp, Artificial sequence
  SiRNA target sequence
ttttatttttaacttcatcaatagta

SEQ ID NO: 61820 - DNA, 26 bp, Artificial sequence
  SiRNA target sequence
tttatttttaacttcatcaatagtat

SEQ ID NO: 61821 - DNA, 26 bp, Artificial sequence
  SiRNA target sequence
ttatttttaacttcatcaatagtatt

SEQ ID NO: 61822 - DNA, 26 bp, Artificial sequence
  SiRNA target sequence
tatttttaacttcatcaatagtatta

SEQ ID NO: 61823 - DNA, 26 bp, Artificial sequence
  SiRNA target sequence
atttttaacttcatcaatagtattaa

SEQ ID NO: 61824 - DNA, 26 bp, Artificial sequence
  SiRNA target sequence
tttttaacttcatcaatagtattaag

SEQ ID NO: 61825 - DNA, 26 bp, Artificial sequence
  SiRNA target sequence
ttttaacttcatcaatagtattaaga

SEQ ID NO: 61826 - DNA, 26 bp, Artificial sequence
  SiRNA target sequence
tttaacttcatcaatagtattaagac

SEQ ID NO: 61827 - DNA, 26 bp, Artificial sequence
  SiRNA target sequence
ttaacttcatcaatagtattaagaca

SEQ ID NO: 61828 - DNA, 26 bp, Artificial sequence
  SiRNA target sequence
taacttcatcaatagtattaagacaa

SEQ ID NO: 61829 - DNA, 26 bp, Artificial sequence
  SiRNA target sequence
aacttcatcaatagtattaagacaaa

SEQ ID NO: 61830 - DNA, 26 bp, Artificial sequence
  SiRNA target sequence
acttcatcaatagtattaagacaaat

SEQ ID NO: 61831 - DNA, 26 bp, Artificial sequence
  SiRNA target sequence
cttcatcaatagtattaagacaaatt

SEQ ID NO: 61832 - DNA, 26 bp, Artificial sequence
  SiRNA target sequence
ttcatcaatagtattaagacaaatta

SEQ ID NO: 61833 - DNA, 26 bp, Artificial sequence
  SiRNA target sequence
tcatcaatagtattaagacaaattaa

SEQ ID NO: 61834 - DNA, 26 bp, Artificial sequence
  SiRNA target sequence
catcaatagtattaagacaaattaat

SEQ ID NO: 61835 - DNA, 26 bp, Artificial sequence
  SiRNA target sequence
atcaatagtattaagacaaattaatg

SEQ ID NO: 61836 - DNA, 26 bp, Artificial sequence
  SiRNA target sequence
tcaatagtattaagacaaattaatga

SEQ ID NO: 61837 - DNA, 26 bp, Artificial sequence
  SiRNA target sequence
caatagtattaagacaaattaatgat

SEQ ID NO: 61838 - DNA, 26 bp, Artificial sequence
  SiRNA target sequence
aatagtattaagacaaattaatgata

SEQ ID NO: 61839 - DNA, 26 bp, Artificial sequence
  SiRNA target sequence
atagtattaagacaaattaatgatat

SEQ ID NO: 61840 - DNA, 26 bp, Artificial sequence
  SiRNA target sequence
tagtattaagacaaattaatgatatt

SEQ ID NO: 61841 - DNA, 26 bp, Artificial sequence
  SiRNA target sequence
agtattaagacaaattaatgatattg

SEQ ID NO: 61842 - DNA, 26 bp, Artificial sequence
  SiRNA target sequence
gtattaagacaaattaatgatattgt

SEQ ID NO: 61843 - DNA, 26 bp, Artificial sequence
  SiRNA target sequence
tattaagacaaattaatgatattgtg

SEQ ID NO: 61844 - DNA, 26 bp, Artificial sequence
  SiRNA target sequence
attaagacaaattaatgatattgtgt

SEQ ID NO: 61845 - DNA, 26 bp, Artificial sequence
  SiRNA target sequence
ttaagacaaattaatgatattgtgtt

SEQ ID NO: 61846 - DNA, 26 bp, Artificial sequence
  SiRNA target sequence
taagacaaattaatgatattgtgttt

SEQ ID NO: 61847 - DNA, 26 bp, Artificial sequence
  SiRNA target sequence
aagacaaattaatgatattgtgttta

SEQ ID NO: 61848 - DNA, 26 bp, Artificial sequence
  SiRNA target sequence
agacaaattaatgatattgtgtttag

SEQ ID NO: 61849 - DNA, 26 bp, Artificial sequence
  SiRNA target sequence
gacaaattaatgatattgtgtttagc

SEQ ID NO: 61850 - DNA, 26 bp, Artificial sequence
  SiRNA target sequence
acaaattaatgatattgtgtttagcg

SEQ ID NO: 61851 - DNA, 26 bp, Artificial sequence
  SiRNA target sequence
caaattaatgatattgtgtttagcgg

SEQ ID NO: 61852 - DNA, 26 bp, Artificial sequence
  SiRNA target sequence
aaattaatgatattgtgtttagcggg

SEQ ID NO: 61853 - DNA, 26 bp, Artificial sequence
  SiRNA target sequence
aattaatgatattgtgtttagcgggc

SEQ ID NO: 61854 - DNA, 26 bp, Artificial sequence
  SiRNA target sequence
attaatgatattgtgtttagcgggcc

SEQ ID NO: 61855 - DNA, 26 bp, Artificial sequence
  SiRNA target sequence
ttaatgatattgtgtttagcgggcca

SEQ ID NO: 61856 - DNA, 26 bp, Artificial sequence
  SiRNA target sequence
taatgatattgtgtttagcgggccaa

SEQ ID NO: 61857 - DNA, 26 bp, Artificial sequence
  SiRNA target sequence
aatgatattgtgtttagcgggccaat

SEQ ID NO: 61858 - DNA, 26 bp, Artificial sequence
  SiRNA target sequence
atgatattgtgtttagcgggccaata

SEQ ID NO: 61859 - DNA, 26 bp, Artificial sequence
  SiRNA target sequence
tgatattgtgtttagcgggccaatac

SEQ ID NO: 61860 - DNA, 26 bp, Artificial sequence
  SiRNA target sequence
gatattgtgtttagcgggccaataca

SEQ ID NO: 61861 - DNA, 26 bp, Artificial sequence
  SiRNA target sequence
atattgtgtttagcgggccaatacaa

SEQ ID NO: 61862 - DNA, 26 bp, Artificial sequence
  SiRNA target sequence
tattgtgtttagcgggccaatacaat

SEQ ID NO: 61863 - DNA, 26 bp, Artificial sequence
  SiRNA target sequence
attgtgtttagcgggccaatacaatt

SEQ ID NO: 61864 - DNA, 26 bp, Artificial sequence
  SiRNA target sequence
ttgtgtttagcgggccaatacaattt

SEQ ID NO: 61865 - DNA, 26 bp, Artificial sequence
  SiRNA target sequence
tgtgtttagcgggccaatacaatttt

SEQ ID NO: 61866 - DNA, 26 bp, Artificial sequence
  SiRNA target sequence
gtgtttagcgggccaatacaattttt

SEQ ID NO: 61867 - DNA, 26 bp, Artificial sequence
  SiRNA target sequence
tgtttagcgggccaatacaattttta

SEQ ID NO: 61868 - DNA, 26 bp, Artificial sequence
  SiRNA target sequence
gtttagcgggccaatacaatttttat

SEQ ID NO: 61869 - DNA, 26 bp, Artificial sequence
  SiRNA target sequence
tttagcgggccaatacaatttttata

SEQ ID NO: 61870 - DNA, 26 bp, Artificial sequence
  SiRNA target sequence
ttagcgggccaatacaatttttatat

SEQ ID NO: 61871 - DNA, 26 bp, Artificial sequence
  SiRNA target sequence
tagcgggccaatacaatttttatata

SEQ ID NO: 61872 - DNA, 26 bp, Artificial sequence
  SiRNA target sequence
agcgggccaatacaatttttatataa

SEQ ID NO: 61873 - DNA, 26 bp, Artificial sequence
  SiRNA target sequence
gcgggccaatacaatttttatataaa

SEQ ID NO: 61874 - DNA, 26 bp, Artificial sequence
  SiRNA target sequence
cgggccaatacaatttttatataaaa

SEQ ID NO: 61875 - DNA, 26 bp, Artificial sequence
  SiRNA target sequence
gggccaatacaatttttatataaaat

SEQ ID NO: 61876 - DNA, 26 bp, Artificial sequence
  SiRNA target sequence
ggccaatacaatttttatataaaatt

SEQ ID NO: 61877 - DNA, 26 bp, Artificial sequence
  SiRNA target sequence
gccaatacaatttttatataaaattg

SEQ ID NO: 61878 - DNA, 26 bp, Artificial sequence
  SiRNA target sequence
ccaatacaatttttatataaaattgt

SEQ ID NO: 61879 - DNA, 26 bp, Artificial sequence
  SiRNA target sequence
caatacaatttttatataaaattgtt

SEQ ID NO: 61880 - DNA, 26 bp, Artificial sequence
  SiRNA target sequence
aatacaatttttatataaaattgttg

SEQ ID NO: 61881 - DNA, 26 bp, Artificial sequence
  SiRNA target sequence
atacaatttttatataaaattgttgg

SEQ ID NO: 61882 - DNA, 26 bp, Artificial sequence
  SiRNA target sequence
tacaatttttatataaaattgttgga

SEQ ID NO: 61883 - DNA, 26 bp, Artificial sequence
  SiRNA target sequence
acaatttttatataaaattgttggag

SEQ ID NO: 61884 - DNA, 26 bp, Artificial sequence
  SiRNA target sequence
caatttttatataaaattgttggagt

SEQ ID NO: 61885 - DNA, 26 bp, Artificial sequence
  SiRNA target sequence
aatttttatataaaattgttggagtt

SEQ ID NO: 61886 - DNA, 26 bp, Artificial sequence
  SiRNA target sequence
atttttatataaaattgttggagttg

SEQ ID NO: 61887 - DNA, 26 bp, Artificial sequence
  SiRNA target sequence
tttttatataaaattgttggagttga

SEQ ID NO: 61888 - DNA, 26 bp, Artificial sequence
  SiRNA target sequence
ttttatataaaattgttggagttgaa

SEQ ID NO: 61889 - DNA, 26 bp, Artificial sequence
  SiRNA target sequence
tttatataaaattgttggagttgaag

SEQ ID NO: 61890 - DNA, 26 bp, Artificial sequence
  SiRNA target sequence
ttatataaaattgttggagttgaagc

SEQ ID NO: 61891 - DNA, 26 bp, Artificial sequence
  SiRNA target sequence
tatataaaattgttggagttgaagca

SEQ ID NO: 61892 - DNA, 26 bp, Artificial sequence
  SiRNA target sequence
atataaaattgttggagttgaagcat

SEQ ID NO: 61893 - DNA, 26 bp, Artificial sequence
  SiRNA target sequence
tataaaattgttggagttgaagcatt

SEQ ID NO: 61894 - DNA, 26 bp, Artificial sequence
  SiRNA target sequence
ataaaattgttggagttgaagcattt

SEQ ID NO: 61895 - DNA, 26 bp, Artificial sequence
  SiRNA target sequence
taaaattgttggagttgaagcatttt

SEQ ID NO: 61896 - DNA, 26 bp, Artificial sequence
  SiRNA target sequence
aaaattgttggagttgaagcatttta

SEQ ID NO: 61897 - DNA, 26 bp, Artificial sequence
  SiRNA target sequence
aaattgttggagttgaagcattttat

SEQ ID NO: 61898 - DNA, 26 bp, Artificial sequence
  SiRNA target sequence
aattgttggagttgaagcattttatc

SEQ ID NO: 61899 - DNA, 26 bp, Artificial sequence
  SiRNA target sequence
attgttggagttgaagcattttatca

SEQ ID NO: 61900 - DNA, 26 bp, Artificial sequence
  SiRNA target sequence
ttgttggagttgaagcattttatcat

SEQ ID NO: 61901 - DNA, 26 bp, Artificial sequence
  SiRNA target sequence
tgttggagttgaagcattttatcatt

SEQ ID NO: 61902 - DNA, 26 bp, Artificial sequence
  SiRNA target sequence
gttggagttgaagcattttatcatta

SEQ ID NO: 61903 - DNA, 26 bp, Artificial sequence
  SiRNA target sequence
ttggagttgaagcattttatcattac

SEQ ID NO: 61904 - DNA, 26 bp, Artificial sequence
  SiRNA target sequence
tggagttgaagcattttatcattaca

SEQ ID NO: 61905 - DNA, 26 bp, Artificial sequence
  SiRNA target sequence
ggagttgaagcattttatcattacat

SEQ ID NO: 61906 - DNA, 26 bp, Artificial sequence
  SiRNA target sequence
gagttgaagcattttatcattacatt

SEQ ID NO: 61907 - DNA, 26 bp, Artificial sequence
  SiRNA target sequence
agttgaagcattttatcattacattt

SEQ ID NO: 61908 - DNA, 26 bp, Artificial sequence
  SiRNA target sequence
gttgaagcattttatcattacatttc

SEQ ID NO: 61909 - DNA, 26 bp, Artificial sequence
  SiRNA target sequence
ttgaagcattttatcattacatttca

SEQ ID NO: 61910 - DNA, 26 bp, Artificial sequence
  SiRNA target sequence
tgaagcattttatcattacatttcat

SEQ ID NO: 61911 - DNA, 26 bp, Artificial sequence
  SiRNA target sequence
gaagcattttatcattacatttcatt

SEQ ID NO: 61912 - DNA, 26 bp, Artificial sequence
  SiRNA target sequence
aagcattttatcattacatttcatta

SEQ ID NO: 61913 - DNA, 26 bp, Artificial sequence
  SiRNA target sequence
agcattttatcattacatttcattaa

SEQ ID NO: 61914 - DNA, 26 bp, Artificial sequence
  SiRNA target sequence
gcattttatcattacatttcattaaa

SEQ ID NO: 61915 - DNA, 26 bp, Artificial sequence
  SiRNA target sequence
cattttatcattacatttcattaaac

SEQ ID NO: 61916 - DNA, 26 bp, Artificial sequence
  SiRNA target sequence
attttatcattacatttcattaaact

SEQ ID NO: 61917 - DNA, 26 bp, Artificial sequence
  SiRNA target sequence
ttttatcattacatttcattaaactt

SEQ ID NO: 61918 - DNA, 26 bp, Artificial sequence
  SiRNA target sequence
tttatcattacatttcattaaactta

SEQ ID NO: 61919 - DNA, 26 bp, Artificial sequence
  SiRNA target sequence
ttatcattacatttcattaaacttag

SEQ ID NO: 61920 - DNA, 26 bp, Artificial sequence
  SiRNA target sequence
tatcattacatttcattaaacttaga

SEQ ID NO: 61921 - DNA, 26 bp, Artificial sequence
  SiRNA target sequence
atcattacatttcattaaacttagaa

SEQ ID NO: 61922 - DNA, 26 bp, Artificial sequence
  SiRNA target sequence
tcattacatttcattaaacttagaaa

SEQ ID NO: 61923 - DNA, 26 bp, Artificial sequence
  SiRNA target sequence
cattacatttcattaaacttagaaaa

SEQ ID NO: 61924 - DNA, 26 bp, Artificial sequence
  SiRNA target sequence
attacatttcattaaacttagaaaat

SEQ ID NO: 61925 - DNA, 26 bp, Artificial sequence
  SiRNA target sequence
ttacatttcattaaacttagaaaatt

SEQ ID NO: 61926 - DNA, 26 bp, Artificial sequence
  SiRNA target sequence
tacatttcattaaacttagaaaattt

SEQ ID NO: 61927 - DNA, 26 bp, Artificial sequence
  SiRNA target sequence
acatttcattaaacttagaaaatttt

SEQ ID NO: 61928 - DNA, 26 bp, Artificial sequence
  SiRNA target sequence
catttcattaaacttagaaaatttta

SEQ ID NO: 61929 - DNA, 26 bp, Artificial sequence
  SiRNA target sequence
atttcattaaacttagaaaattttaa

SEQ ID NO: 61930 - DNA, 26 bp, Artificial sequence
  SiRNA target sequence
tttcattaaacttagaaaattttaac

SEQ ID NO: 61931 - DNA, 26 bp, Artificial sequence
  SiRNA target sequence
ttcattaaacttagaaaattttaaca

SEQ ID NO: 61932 - DNA, 26 bp, Artificial sequence
  SiRNA target sequence
tcattaaacttagaaaattttaacaa

SEQ ID NO: 61933 - DNA, 26 bp, Artificial sequence
  SiRNA target sequence
cattaaacttagaaaattttaacaaa

SEQ ID NO: 61934 - DNA, 26 bp, Artificial sequence
  SiRNA target sequence
attaaacttagaaaattttaacaaaa

SEQ ID NO: 61935 - DNA, 26 bp, Artificial sequence
  SiRNA target sequence
ttaaacttagaaaattttaacaaaat

SEQ ID NO: 61936 - DNA, 26 bp, Artificial sequence
  SiRNA target sequence
taaacttagaaaattttaacaaaata

SEQ ID NO: 61937 - DNA, 26 bp, Artificial sequence
  SiRNA target sequence
aaacttagaaaattttaacaaaatag

SEQ ID NO: 61938 - DNA, 26 bp, Artificial sequence
  SiRNA target sequence
aacttagaaaattttaacaaaatagg

SEQ ID NO: 61939 - DNA, 26 bp, Artificial sequence
  SiRNA target sequence
acttagaaaattttaacaaaatagga

SEQ ID NO: 61940 - DNA, 26 bp, Artificial sequence
  SiRNA target sequence
cttagaaaattttaacaaaataggaa

SEQ ID NO: 61941 - DNA, 26 bp, Artificial sequence
  SiRNA target sequence
ttagaaaattttaacaaaataggaag

SEQ ID NO: 61942 - DNA, 26 bp, Artificial sequence
  SiRNA target sequence
tagaaaattttaacaaaataggaagt

SEQ ID NO: 61943 - DNA, 26 bp, Artificial sequence
  SiRNA target sequence
agaaaattttaacaaaataggaagtg

SEQ ID NO: 61944 - DNA, 26 bp, Artificial sequence
  SiRNA target sequence
gaaaattttaacaaaataggaagtgg

SEQ ID NO: 61945 - DNA, 26 bp, Artificial sequence
  SiRNA target sequence
aaaattttaacaaaataggaagtgga

SEQ ID NO: 61946 - DNA, 26 bp, Artificial sequence
  SiRNA target sequence
aaattttaacaaaataggaagtggag

SEQ ID NO: 61947 - DNA, 26 bp, Artificial sequence
  SiRNA target sequence
aattttaacaaaataggaagtggaga

SEQ ID NO: 61948 - DNA, 26 bp, Artificial sequence
  SiRNA target sequence
attttaacaaaataggaagtggagag

SEQ ID NO: 61949 - DNA, 26 bp, Artificial sequence
  SiRNA target sequence
ttttaacaaaataggaagtggagaga

SEQ ID NO: 61950 - DNA, 26 bp, Artificial sequence
  SiRNA target sequence
tttaacaaaataggaagtggagagat

SEQ ID NO: 61951 - DNA, 26 bp, Artificial sequence
  SiRNA target sequence
ttaacaaaataggaagtggagagata

SEQ ID NO: 61952 - DNA, 26 bp, Artificial sequence
  SiRNA target sequence
taacaaaataggaagtggagagatac

SEQ ID NO: 61953 - DNA, 26 bp, Artificial sequence
  SiRNA target sequence
aacaaaataggaagtggagagataca

SEQ ID NO: 61954 - DNA, 26 bp, Artificial sequence
  SiRNA target sequence
acaaaataggaagtggagagatacaa

SEQ ID NO: 61955 - DNA, 26 bp, Artificial sequence
  SiRNA target sequence
caaaataggaagtggagagatacaaa

SEQ ID NO: 61956 - DNA, 26 bp, Artificial sequence
  SiRNA target sequence
aaaataggaagtggagagatacaaat

SEQ ID NO: 61957 - DNA, 26 bp, Artificial sequence
  SiRNA target sequence
aaataggaagtggagagatacaaatg

SEQ ID NO: 61958 - DNA, 26 bp, Artificial sequence
  SiRNA target sequence
aataggaagtggagagatacaaatga

SEQ ID NO: 61959 - DNA, 26 bp, Artificial sequence
  SiRNA target sequence
ataggaagtggagagatacaaatgat

SEQ ID NO: 61960 - DNA, 26 bp, Artificial sequence
  SiRNA target sequence
taggaagtggagagatacaaatgatt

SEQ ID NO: 61961 - DNA, 26 bp, Artificial sequence
  SiRNA target sequence
aggaagtggagagatacaaatgatta

SEQ ID NO: 61962 - DNA, 26 bp, Artificial sequence
  SiRNA target sequence
ggaagtggagagatacaaatgattat

SEQ ID NO: 61963 - DNA, 26 bp, Artificial sequence
  SiRNA target sequence
gaagtggagagatacaaatgattatt

SEQ ID NO: 61964 - DNA, 26 bp, Artificial sequence
  SiRNA target sequence
aagtggagagatacaaatgattattg

SEQ ID NO: 61965 - DNA, 26 bp, Artificial sequence
  SiRNA target sequence
agtggagagatacaaatgattattga

SEQ ID NO: 61966 - DNA, 26 bp, Artificial sequence
  SiRNA target sequence
gtggagagatacaaatgattattgag

SEQ ID NO: 61967 - DNA, 26 bp, Artificial sequence
  SiRNA target sequence
tggagagatacaaatgattattgagc

SEQ ID NO: 61968 - DNA, 26 bp, Artificial sequence
  SiRNA target sequence
ggagagatacaaatgattattgagcg

SEQ ID NO: 61969 - DNA, 26 bp, Artificial sequence
  SiRNA target sequence
gagagatacaaatgattattgagcgg

SEQ ID NO: 61970 - DNA, 26 bp, Artificial sequence
  SiRNA target sequence
agagatacaaatgattattgagcgga

SEQ ID NO: 61971 - DNA, 26 bp, Artificial sequence
  SiRNA target sequence
gagatacaaatgattattgagcggaa

SEQ ID NO: 61972 - DNA, 26 bp, Artificial sequence
  SiRNA target sequence
agatacaaatgattattgagcggaaa

SEQ ID NO: 61973 - DNA, 26 bp, Artificial sequence
  SiRNA target sequence
gatacaaatgattattgagcggaaaa

SEQ ID NO: 61974 - DNA, 26 bp, Artificial sequence
  SiRNA target sequence
atacaaatgattattgagcggaaaag

SEQ ID NO: 61975 - DNA, 26 bp, Artificial sequence
  SiRNA target sequence
tacaaatgattattgagcggaaaagt

SEQ ID NO: 61976 - DNA, 26 bp, Artificial sequence
  SiRNA target sequence
acaaatgattattgagcggaaaagta

SEQ ID NO: 61977 - DNA, 26 bp, Artificial sequence
  SiRNA target sequence
caaatgattattgagcggaaaagtag

SEQ ID NO: 61978 - DNA, 26 bp, Artificial sequence
  SiRNA target sequence
aaatgattattgagcggaaaagtaga

SEQ ID NO: 61979 - DNA, 26 bp, Artificial sequence
  SiRNA target sequence
aatgattattgagcggaaaagtagag

SEQ ID NO: 61980 - DNA, 26 bp, Artificial sequence
  SiRNA target sequence
atgattattgagcggaaaagtagagc

SEQ ID NO: 61981 - DNA, 26 bp, Artificial sequence
  SiRNA target sequence
tgattattgagcggaaaagtagagca

SEQ ID NO: 61982 - DNA, 26 bp, Artificial sequence
  SiRNA target sequence
gattattgagcggaaaagtagagcat

SEQ ID NO: 61983 - DNA, 26 bp, Artificial sequence
  SiRNA target sequence
attattgagcggaaaagtagagcata

SEQ ID NO: 61984 - DNA, 26 bp, Artificial sequence
  SiRNA target sequence
ttattgagcggaaaagtagagcatat

SEQ ID NO: 61985 - DNA, 26 bp, Artificial sequence
  SiRNA target sequence
tattgagcggaaaagtagagcatatg

SEQ ID NO: 61986 - DNA, 26 bp, Artificial sequence
  SiRNA target sequence
attgagcggaaaagtagagcatatgg

SEQ ID NO: 61987 - DNA, 26 bp, Artificial sequence
  SiRNA target sequence
ttgagcggaaaagtagagcatatggt

SEQ ID NO: 61988 - DNA, 26 bp, Artificial sequence
  SiRNA target sequence
tgagcggaaaagtagagcatatggtg

SEQ ID NO: 61989 - DNA, 26 bp, Artificial sequence
  SiRNA target sequence
gagcggaaaagtagagcatatggtga

SEQ ID NO: 61990 - DNA, 26 bp, Artificial sequence
  SiRNA target sequence
agcggaaaagtagagcatatggtgac

SEQ ID NO: 61991 - DNA, 26 bp, Artificial sequence
  SiRNA target sequence
gcggaaaagtagagcatatggtgaca

SEQ ID NO: 61992 - DNA, 26 bp, Artificial sequence
  SiRNA target sequence
cggaaaagtagagcatatggtgacat

SEQ ID NO: 61993 - DNA, 26 bp, Artificial sequence
  SiRNA target sequence
ggaaaagtagagcatatggtgacata

SEQ ID NO: 61994 - DNA, 26 bp, Artificial sequence
  SiRNA target sequence
gaaaagtagagcatatggtgacatac

SEQ ID NO: 61995 - DNA, 26 bp, Artificial sequence
  SiRNA target sequence
aaaagtagagcatatggtgacatact

SEQ ID NO: 61996 - DNA, 26 bp, Artificial sequence
  SiRNA target sequence
aaagtagagcatatggtgacatacta

SEQ ID NO: 61997 - DNA, 26 bp, Artificial sequence
  SiRNA target sequence
aagtagagcatatggtgacatactag

SEQ ID NO: 61998 - DNA, 26 bp, Artificial sequence
  SiRNA target sequence
agtagagcatatggtgacatactaga

SEQ ID NO: 61999 - DNA, 26 bp, Artificial sequence
  SiRNA target sequence
gtagagcatatggtgacatactagaa

SEQ ID NO: 62000 - DNA, 26 bp, Artificial sequence
  SiRNA target sequence
tagagcatatggtgacatactagaac

SEQ ID NO: 62001 - DNA, 26 bp, Artificial sequence
  SiRNA target sequence
agagcatatggtgacatactagaact

SEQ ID NO: 62002 - DNA, 26 bp, Artificial sequence
  SiRNA target sequence
gagcatatggtgacatactagaacta

SEQ ID NO: 62003 - DNA, 26 bp, Artificial sequence
  SiRNA target sequence
agcatatggtgacatactagaactaa

SEQ ID NO: 62004 - DNA, 26 bp, Artificial sequence
  SiRNA target sequence
gcatatggtgacatactagaactaac

SEQ ID NO: 62005 - DNA, 26 bp, Artificial sequence
  SiRNA target sequence
catatggtgacatactagaactaact

SEQ ID NO: 62006 - DNA, 26 bp, Artificial sequence
  SiRNA target sequence
atatggtgacatactagaactaacta

SEQ ID NO: 62007 - DNA, 26 bp, Artificial sequence
  SiRNA target sequence
tatggtgacatactagaactaactac

SEQ ID NO: 62008 - DNA, 26 bp, Artificial sequence
  SiRNA target sequence
atggtgacatactagaactaactact

SEQ ID NO: 62009 - DNA, 26 bp, Artificial sequence
  SiRNA target sequence
tggtgacatactagaactaactactc

SEQ ID NO: 62010 - DNA, 26 bp, Artificial sequence
  SiRNA target sequence
ggtgacatactagaactaactactct

SEQ ID NO: 62011 - DNA, 26 bp, Artificial sequence
  SiRNA target sequence
gtgacatactagaactaactactctc

SEQ ID NO: 62012 - DNA, 26 bp, Artificial sequence
  SiRNA target sequence
tgacatactagaactaactactctct

SEQ ID NO: 62013 - DNA, 26 bp, Artificial sequence
  SiRNA target sequence
gacatactagaactaactactctctc

SEQ ID NO: 62014 - DNA, 26 bp, Artificial sequence
  SiRNA target sequence
acatactagaactaactactctctcg

SEQ ID NO: 62015 - DNA, 26 bp, Artificial sequence
  SiRNA target sequence
catactagaactaactactctctcgg

SEQ ID NO: 62016 - DNA, 26 bp, Artificial sequence
  SiRNA target sequence
atactagaactaactactctctcggc

SEQ ID NO: 62017 - DNA, 26 bp, Artificial sequence
  SiRNA target sequence
tactagaactaactactctctcggcc

SEQ ID NO: 62018 - DNA, 26 bp, Artificial sequence
  SiRNA target sequence
actagaactaactactctctcggccg

SEQ ID NO: 62019 - DNA, 26 bp, Artificial sequence
  SiRNA target sequence
ctagaactaactactctctcggccgt

SEQ ID NO: 62020 - DNA, 26 bp, Artificial sequence
  SiRNA target sequence
tagaactaactactctctcggccgta

SEQ ID NO: 62021 - DNA, 26 bp, Artificial sequence
  SiRNA target sequence
agaactaactactctctcggccgtac

SEQ ID NO: 62022 - DNA, 26 bp, Artificial sequence
  SiRNA target sequence
gaactaactactctctcggccgtacc

SEQ ID NO: 62023 - DNA, 26 bp, Artificial sequence
  SiRNA target sequence
aactaactactctctcggccgtacca

SEQ ID NO: 62024 - DNA, 26 bp, Artificial sequence
  SiRNA target sequence
actaactactctctcggccgtaccaa

SEQ ID NO: 62025 - DNA, 26 bp, Artificial sequence
  SiRNA target sequence
ctaactactctctcggccgtaccaac

SEQ ID NO: 62026 - DNA, 26 bp, Artificial sequence
  SiRNA target sequence
taactactctctcggccgtaccaacc

SEQ ID NO: 62027 - DNA, 26 bp, Artificial sequence
  SiRNA target sequence
aactactctctcggccgtaccaacct

SEQ ID NO: 62028 - DNA, 26 bp, Artificial sequence
  SiRNA target sequence
actactctctcggccgtaccaacctg

SEQ ID NO: 62029 - DNA, 26 bp, Artificial sequence
  SiRNA target sequence
ctactctctcggccgtaccaacctgt

SEQ ID NO: 62030 - DNA, 26 bp, Artificial sequence
  SiRNA target sequence
tactctctcggccgtaccaacctgta

SEQ ID NO: 62031 - DNA, 26 bp, Artificial sequence
  SiRNA target sequence
actctctcggccgtaccaacctgtat

SEQ ID NO: 62032 - DNA, 26 bp, Artificial sequence
  SiRNA target sequence
ctctctcggccgtaccaacctgtatt

SEQ ID NO: 62033 - DNA, 26 bp, Artificial sequence
  SiRNA target sequence
tctctcggccgtaccaacctgtattg

SEQ ID NO: 62034 - DNA, 26 bp, Artificial sequence
  SiRNA target sequence
ctctcggccgtaccaacctgtattgt

SEQ ID NO: 62035 - DNA, 26 bp, Artificial sequence
  SiRNA target sequence
tctcggccgtaccaacctgtattgta

SEQ ID NO: 62036 - DNA, 26 bp, Artificial sequence
  SiRNA target sequence
ctcggccgtaccaacctgtattgtag

SEQ ID NO: 62037 - DNA, 26 bp, Artificial sequence
  SiRNA target sequence
tcggccgtaccaacctgtattgtagt

SEQ ID NO: 62038 - DNA, 26 bp, Artificial sequence
  SiRNA target sequence
cggccgtaccaacctgtattgtagtt

SEQ ID NO: 62039 - DNA, 26 bp, Artificial sequence
  SiRNA target sequence
ggccgtaccaacctgtattgtagtta

SEQ ID NO: 62040 - DNA, 26 bp, Artificial sequence
  SiRNA target sequence
gccgtaccaacctgtattgtagttat

SEQ ID NO: 62041 - DNA, 26 bp, Artificial sequence
  SiRNA target sequence
ccgtaccaacctgtattgtagttatt

SEQ ID NO: 62042 - DNA, 26 bp, Artificial sequence
  SiRNA target sequence
cgtaccaacctgtattgtagttatta

SEQ ID NO: 62043 - DNA, 26 bp, Artificial sequence
  SiRNA target sequence
gtaccaacctgtattgtagttattat

SEQ ID NO: 62044 - DNA, 26 bp, Artificial sequence
  SiRNA target sequence
taccaacctgtattgtagttattatg

SEQ ID NO: 62045 - DNA, 26 bp, Artificial sequence
  SiRNA target sequence
accaacctgtattgtagttattatgt

SEQ ID NO: 62046 - DNA, 26 bp, Artificial sequence
  SiRNA target sequence
ccaacctgtattgtagttattatgtc

SEQ ID NO: 62047 - DNA, 26 bp, Artificial sequence
  SiRNA target sequence
caacctgtattgtagttattatgtcg

SEQ ID NO: 62048 - DNA, 26 bp, Artificial sequence
  SiRNA target sequence
aacctgtattgtagttattatgtcgt

SEQ ID NO: 62049 - DNA, 26 bp, Artificial sequence
  SiRNA target sequence
acctgtattgtagttattatgtcgtt

SEQ ID NO: 62050 - DNA, 26 bp, Artificial sequence
  SiRNA target sequence
cctgtattgtagttattatgtcgttt

SEQ ID NO: 62051 - DNA, 26 bp, Artificial sequence
  SiRNA target sequence
ctgtattgtagttattatgtcgtttt

SEQ ID NO: 62052 - DNA, 26 bp, Artificial sequence
  SiRNA target sequence
tgtattgtagttattatgtcgttttt

SEQ ID NO: 62053 - DNA, 26 bp, Artificial sequence
  SiRNA target sequence
gtattgtagttattatgtcgtttttc

SEQ ID NO: 62054 - DNA, 26 bp, Artificial sequence
  SiRNA target sequence
tattgtagttattatgtcgtttttct

SEQ ID NO: 62055 - DNA, 26 bp, Artificial sequence
  SiRNA target sequence
attgtagttattatgtcgtttttctc

SEQ ID NO: 62056 - DNA, 26 bp, Artificial sequence
  SiRNA target sequence
ttgtagttattatgtcgtttttctca

SEQ ID NO: 62057 - DNA, 26 bp, Artificial sequence
  SiRNA target sequence
tgtagttattatgtcgtttttctcag

SEQ ID NO: 62058 - DNA, 26 bp, Artificial sequence
  SiRNA target sequence
gtagttattatgtcgtttttctcagt

SEQ ID NO: 62059 - DNA, 26 bp, Artificial sequence
  SiRNA target sequence
tagttattatgtcgtttttctcagta

SEQ ID NO: 62060 - DNA, 26 bp, Artificial sequence
  SiRNA target sequence
agttattatgtcgtttttctcagtat

SEQ ID NO: 62061 - DNA, 26 bp, Artificial sequence
  SiRNA target sequence
gttattatgtcgtttttctcagtata

SEQ ID NO: 62062 - DNA, 26 bp, Artificial sequence
  SiRNA target sequence
ttattatgtcgtttttctcagtatat

SEQ ID NO: 62063 - DNA, 26 bp, Artificial sequence
  SiRNA target sequence
tattatgtcgtttttctcagtatata

SEQ ID NO: 62064 - DNA, 26 bp, Artificial sequence
  SiRNA target sequence
attatgtcgtttttctcagtatataa

SEQ ID NO: 62065 - DNA, 26 bp, Artificial sequence
  SiRNA target sequence
ttatgtcgtttttctcagtatataaa

SEQ ID NO: 62066 - DNA, 26 bp, Artificial sequence
  SiRNA target sequence
tatgtcgtttttctcagtatataaaa

SEQ ID NO: 62067 - DNA, 26 bp, Artificial sequence
  SiRNA target sequence
atgtcgtttttctcagtatataaaaa

SEQ ID NO: 62068 - DNA, 26 bp, Artificial sequence
  SiRNA target sequence
tgtcgtttttctcagtatataaaaat

SEQ ID NO: 62069 - DNA, 26 bp, Artificial sequence
  SiRNA target sequence
gtcgtttttctcagtatataaaaatt

SEQ ID NO: 62070 - DNA, 26 bp, Artificial sequence
  SiRNA target sequence
tcgtttttctcagtatataaaaattt

SEQ ID NO: 62071 - DNA, 26 bp, Artificial sequence
  SiRNA target sequence
cgtttttctcagtatataaaaatttg

SEQ ID NO: 62072 - DNA, 26 bp, Artificial sequence
  SiRNA target sequence
gtttttctcagtatataaaaatttgg

SEQ ID NO: 62073 - DNA, 26 bp, Artificial sequence
  SiRNA target sequence
tttttctcagtatataaaaatttggg

SEQ ID NO: 62074 - DNA, 26 bp, Artificial sequence
  SiRNA target sequence
ttttctcagtatataaaaatttggga

SEQ ID NO: 62075 - DNA, 26 bp, Artificial sequence
  SiRNA target sequence
tttctcagtatataaaaatttgggaa

SEQ ID NO: 62076 - DNA, 26 bp, Artificial sequence
  SiRNA target sequence
ttctcagtatataaaaatttgggaag

SEQ ID NO: 62077 - DNA, 26 bp, Artificial sequence
  SiRNA target sequence
tctcagtatataaaaatttgggaaga

SEQ ID NO: 62078 - DNA, 26 bp, Artificial sequence
  SiRNA target sequence
ctcagtatataaaaatttgggaagag

SEQ ID NO: 62079 - DNA, 26 bp, Artificial sequence
  SiRNA target sequence
tcagtatataaaaatttgggaagaga

SEQ ID NO: 62080 - DNA, 26 bp, Artificial sequence
  SiRNA target sequence
cagtatataaaaatttgggaagagat

SEQ ID NO: 62081 - DNA, 26 bp, Artificial sequence
  SiRNA target sequence
agtatataaaaatttgggaagagatg

SEQ ID NO: 62082 - DNA, 26 bp, Artificial sequence
  SiRNA target sequence
gtatataaaaatttgggaagagatgc

SEQ ID NO: 62083 - DNA, 26 bp, Artificial sequence
  SiRNA target sequence
tatataaaaatttgggaagagatgca

SEQ ID NO: 62084 - DNA, 26 bp, Artificial sequence
  SiRNA target sequence
atataaaaatttgggaagagatgcac

SEQ ID NO: 62085 - DNA, 26 bp, Artificial sequence
  SiRNA target sequence
tataaaaatttgggaagagatgcact

SEQ ID NO: 62086 - DNA, 26 bp, Artificial sequence
  SiRNA target sequence
ataaaaatttgggaagagatgcactc

SEQ ID NO: 62087 - DNA, 26 bp, Artificial sequence
  SiRNA target sequence
taaaaatttgggaagagatgcactct

SEQ ID NO: 62088 - DNA, 26 bp, Artificial sequence
  SiRNA target sequence
aaaaatttgggaagagatgcactcta

SEQ ID NO: 62089 - DNA, 26 bp, Artificial sequence
  SiRNA target sequence
aaaatttgggaagagatgcactctac

SEQ ID NO: 62090 - DNA, 26 bp, Artificial sequence
  SiRNA target sequence
aaatttgggaagagatgcactctacg

SEQ ID NO: 62091 - DNA, 26 bp, Artificial sequence
  SiRNA target sequence
aatttgggaagagatgcactctacgt

SEQ ID NO: 62092 - DNA, 26 bp, Artificial sequence
  SiRNA target sequence
atttgggaagagatgcactctacgta

SEQ ID NO: 62093 - DNA, 26 bp, Artificial sequence
  SiRNA target sequence
tttgggaagagatgcactctacgtaa

SEQ ID NO: 62094 - DNA, 26 bp, Artificial sequence
  SiRNA target sequence
ttgggaagagatgcactctacgtaat

SEQ ID NO: 62095 - DNA, 26 bp, Artificial sequence
  SiRNA target sequence
tgggaagagatgcactctacgtaatg

SEQ ID NO: 62096 - DNA, 26 bp, Artificial sequence
  SiRNA target sequence
gggaagagatgcactctacgtaatgt

SEQ ID NO: 62097 - DNA, 26 bp, Artificial sequence
  SiRNA target sequence
ggaagagatgcactctacgtaatgtt

SEQ ID NO: 62098 - DNA, 26 bp, Artificial sequence
  SiRNA target sequence
gaagagatgcactctacgtaatgttg

SEQ ID NO: 62099 - DNA, 26 bp, Artificial sequence
  SiRNA target sequence
aagagatgcactctacgtaatgttgg

SEQ ID NO: 62100 - DNA, 26 bp, Artificial sequence
  SiRNA target sequence
agagatgcactctacgtaatgttggc

SEQ ID NO: 62101 - DNA, 26 bp, Artificial sequence
  SiRNA target sequence
gagatgcactctacgtaatgttggct

SEQ ID NO: 62102 - DNA, 26 bp, Artificial sequence
  SiRNA target sequence
agatgcactctacgtaatgttggcta

SEQ ID NO: 62103 - DNA, 26 bp, Artificial sequence
  SiRNA target sequence
gatgcactctacgtaatgttggctac

SEQ ID NO: 62104 - DNA, 26 bp, Artificial sequence
  SiRNA target sequence
atgcactctacgtaatgttggctaca

SEQ ID NO: 62105 - DNA, 26 bp, Artificial sequence
  SiRNA target sequence
tgcactctacgtaatgttggctacaa

SEQ ID NO: 62106 - DNA, 26 bp, Artificial sequence
  SiRNA target sequence
gcactctacgtaatgttggctacaag

SEQ ID NO: 62107 - DNA, 26 bp, Artificial sequence
  SiRNA target sequence
cactctacgtaatgttggctacaagt

SEQ ID NO: 62108 - DNA, 26 bp, Artificial sequence
  SiRNA target sequence
actctacgtaatgttggctacaagtg

SEQ ID NO: 62109 - DNA, 26 bp, Artificial sequence
  SiRNA target sequence
ctctacgtaatgttggctacaagtgc

SEQ ID NO: 62110 - DNA, 26 bp, Artificial sequence
  SiRNA target sequence
tctacgtaatgttggctacaagtgcc

SEQ ID NO: 62111 - DNA, 26 bp, Artificial sequence
  SiRNA target sequence
ctacgtaatgttggctacaagtgcct

SEQ ID NO: 62112 - DNA, 26 bp, Artificial sequence
  SiRNA target sequence
tacgtaatgttggctacaagtgcctt

SEQ ID NO: 62113 - DNA, 26 bp, Artificial sequence
  SiRNA target sequence
acgtaatgttggctacaagtgccttg

SEQ ID NO: 62114 - DNA, 26 bp, Artificial sequence
  SiRNA target sequence
cgtaatgttggctacaagtgccttgt

SEQ ID NO: 62115 - DNA, 26 bp, Artificial sequence
  SiRNA target sequence
gtaatgttggctacaagtgccttgta

SEQ ID NO: 62116 - DNA, 26 bp, Artificial sequence
  SiRNA target sequence
taatgttggctacaagtgccttgtat

SEQ ID NO: 62117 - DNA, 26 bp, Artificial sequence
  SiRNA target sequence
aatgttggctacaagtgccttgtatg

SEQ ID NO: 62118 - DNA, 26 bp, Artificial sequence
  SiRNA target sequence
atgttggctacaagtgccttgtatgt

SEQ ID NO: 62119 - DNA, 26 bp, Artificial sequence
  SiRNA target sequence
tgttggctacaagtgccttgtatgtg

SEQ ID NO: 62120 - DNA, 26 bp, Artificial sequence
  SiRNA target sequence
gttggctacaagtgccttgtatgtgt

SEQ ID NO: 62121 - DNA, 26 bp, Artificial sequence
  SiRNA target sequence
ttggctacaagtgccttgtatgtgta

SEQ ID NO: 62122 - DNA, 26 bp, Artificial sequence
  SiRNA target sequence
tggctacaagtgccttgtatgtgtat

SEQ ID NO: 62123 - DNA, 26 bp, Artificial sequence
  SiRNA target sequence
ggctacaagtgccttgtatgtgtatt

SEQ ID NO: 62124 - DNA, 26 bp, Artificial sequence
  SiRNA target sequence
gctacaagtgccttgtatgtgtattt

SEQ ID NO: 62125 - DNA, 26 bp, Artificial sequence
  SiRNA target sequence
ctacaagtgccttgtatgtgtatttt

SEQ ID NO: 62126 - DNA, 26 bp, Artificial sequence
  SiRNA target sequence
tacaagtgccttgtatgtgtatttta

SEQ ID NO: 62127 - DNA, 26 bp, Artificial sequence
  SiRNA target sequence
acaagtgccttgtatgtgtattttac

SEQ ID NO: 62128 - DNA, 26 bp, Artificial sequence
  SiRNA target sequence
caagtgccttgtatgtgtattttaca

SEQ ID NO: 62129 - DNA, 26 bp, Artificial sequence
  SiRNA target sequence
aagtgccttgtatgtgtattttacat

SEQ ID NO: 62130 - DNA, 26 bp, Artificial sequence
  SiRNA target sequence
agtgccttgtatgtgtattttacatt

SEQ ID NO: 62131 - DNA, 26 bp, Artificial sequence
  SiRNA target sequence
gtgccttgtatgtgtattttacattt

SEQ ID NO: 62132 - DNA, 26 bp, Artificial sequence
  SiRNA target sequence
tgccttgtatgtgtattttacatttg

SEQ ID NO: 62133 - DNA, 26 bp, Artificial sequence
  SiRNA target sequence
gccttgtatgtgtattttacatttgt

SEQ ID NO: 62134 - DNA, 26 bp, Artificial sequence
  SiRNA target sequence
ccttgtatgtgtattttacatttgta

SEQ ID NO: 62135 - DNA, 26 bp, Artificial sequence
  SiRNA target sequence
cttgtatgtgtattttacatttgtat

SEQ ID NO: 62136 - DNA, 26 bp, Artificial sequence
  SiRNA target sequence
ttgtatgtgtattttacatttgtatt

SEQ ID NO: 62137 - DNA, 26 bp, Artificial sequence
  SiRNA target sequence
tgtatgtgtattttacatttgtattt

SEQ ID NO: 62138 - DNA, 26 bp, Artificial sequence
  SiRNA target sequence
gtatgtgtattttacatttgtatttt

SEQ ID NO: 62139 - DNA, 26 bp, Artificial sequence
  SiRNA target sequence
tatgtgtattttacatttgtattttc

SEQ ID NO: 62140 - DNA, 26 bp, Artificial sequence
  SiRNA target sequence
atgtgtattttacatttgtattttca

SEQ ID NO: 62141 - DNA, 26 bp, Artificial sequence
  SiRNA target sequence
tgtgtattttacatttgtattttcaa

SEQ ID NO: 62142 - DNA, 26 bp, Artificial sequence
  SiRNA target sequence
gtgtattttacatttgtattttcaat

SEQ ID NO: 62143 - DNA, 26 bp, Artificial sequence
  SiRNA target sequence
tgtattttacatttgtattttcaata

SEQ ID NO: 62144 - DNA, 26 bp, Artificial sequence
  SiRNA target sequence
gtattttacatttgtattttcaatat

SEQ ID NO: 62145 - DNA, 26 bp, Artificial sequence
  SiRNA target sequence
tattttacatttgtattttcaatatg

SEQ ID NO: 62146 - DNA, 26 bp, Artificial sequence
  SiRNA target sequence
attttacatttgtattttcaatatgg

SEQ ID NO: 62147 - DNA, 26 bp, Artificial sequence
  SiRNA target sequence
ttttacatttgtattttcaatatgga

SEQ ID NO: 62148 - DNA, 26 bp, Artificial sequence
  SiRNA target sequence
tttacatttgtattttcaatatggag

SEQ ID NO: 62149 - DNA, 26 bp, Artificial sequence
  SiRNA target sequence
ttacatttgtattttcaatatggaga

SEQ ID NO: 62150 - DNA, 26 bp, Artificial sequence
  SiRNA target sequence
tacatttgtattttcaatatggagaa

SEQ ID NO: 62151 - DNA, 26 bp, Artificial sequence
  SiRNA target sequence
acatttgtattttcaatatggagaaa

SEQ ID NO: 62152 - DNA, 26 bp, Artificial sequence
  SiRNA target sequence
catttgtattttcaatatggagaaac

SEQ ID NO: 62153 - DNA, 26 bp, Artificial sequence
  SiRNA target sequence
atttgtattttcaatatggagaaaca

SEQ ID NO: 62154 - DNA, 26 bp, Artificial sequence
  SiRNA target sequence
tttgtattttcaatatggagaaacaa

SEQ ID NO: 62155 - DNA, 26 bp, Artificial sequence
  SiRNA target sequence
ttgtattttcaatatggagaaacaat

SEQ ID NO: 62156 - DNA, 26 bp, Artificial sequence
  SiRNA target sequence
tgtattttcaatatggagaaacaata

SEQ ID NO: 62157 - DNA, 26 bp, Artificial sequence
  SiRNA target sequence
gtattttcaatatggagaaacaatat

SEQ ID NO: 62158 - DNA, 26 bp, Artificial sequence
  SiRNA target sequence
tattttcaatatggagaaacaatatt

SEQ ID NO: 62159 - DNA, 26 bp, Artificial sequence
  SiRNA target sequence
attttcaatatggagaaacaatatta

SEQ ID NO: 62160 - DNA, 26 bp, Artificial sequence
  SiRNA target sequence
ttttcaatatggagaaacaatattag

SEQ ID NO: 62161 - DNA, 26 bp, Artificial sequence
  SiRNA target sequence
tttcaatatggagaaacaatattaga

SEQ ID NO: 62162 - DNA, 26 bp, Artificial sequence
  SiRNA target sequence
ttcaatatggagaaacaatattagaa

SEQ ID NO: 62163 - DNA, 26 bp, Artificial sequence
  SiRNA target sequence
tcaatatggagaaacaatattagaag

SEQ ID NO: 62164 - DNA, 26 bp, Artificial sequence
  SiRNA target sequence
caatatggagaaacaatattagaaga

SEQ ID NO: 62165 - DNA, 26 bp, Artificial sequence
  SiRNA target sequence
aatatggagaaacaatattagaagac

SEQ ID NO: 62166 - DNA, 26 bp, Artificial sequence
  SiRNA target sequence
atatggagaaacaatattagaagaca

SEQ ID NO: 62167 - DNA, 26 bp, Artificial sequence
  SiRNA target sequence
tatggagaaacaatattagaagacaa

SEQ ID NO: 62168 - DNA, 26 bp, Artificial sequence
  SiRNA target sequence
atggagaaacaatattagaagacaat

SEQ ID NO: 62169 - DNA, 26 bp, Artificial sequence
  SiRNA target sequence
tggagaaacaatattagaagacaata

SEQ ID NO: 62170 - DNA, 26 bp, Artificial sequence
  SiRNA target sequence
ggagaaacaatattagaagacaatat

SEQ ID NO: 62171 - DNA, 26 bp, Artificial sequence
  SiRNA target sequence
gagaaacaatattagaagacaatata

SEQ ID NO: 62172 - DNA, 26 bp, Artificial sequence
  SiRNA target sequence
agaaacaatattagaagacaatataa

SEQ ID NO: 62173 - DNA, 26 bp, Artificial sequence
  SiRNA target sequence
gaaacaatattagaagacaatataat

SEQ ID NO: 62174 - DNA, 26 bp, Artificial sequence
  SiRNA target sequence
aaacaatattagaagacaatataata

SEQ ID NO: 62175 - DNA, 26 bp, Artificial sequence
  SiRNA target sequence
aacaatattagaagacaatataataa

SEQ ID NO: 62176 - DNA, 26 bp, Artificial sequence
  SiRNA target sequence
acaatattagaagacaatataataag

SEQ ID NO: 62177 - DNA, 26 bp, Artificial sequence
  SiRNA target sequence
caatattagaagacaatataataagt

SEQ ID NO: 62178 - DNA, 26 bp, Artificial sequence
  SiRNA target sequence
aatattagaagacaatataataagtc

SEQ ID NO: 62179 - DNA, 26 bp, Artificial sequence
  SiRNA target sequence
atattagaagacaatataataagtca

SEQ ID NO: 62180 - DNA, 26 bp, Artificial sequence
  SiRNA target sequence
tattagaagacaatataataagtcac

SEQ ID NO: 62181 - DNA, 26 bp, Artificial sequence
  SiRNA target sequence
attagaagacaatataataagtcaca

SEQ ID NO: 62182 - DNA, 26 bp, Artificial sequence
  SiRNA target sequence
ttagaagacaatataataagtcacag

SEQ ID NO: 62183 - DNA, 26 bp, Artificial sequence
  SiRNA target sequence
tagaagacaatataataagtcacagg

SEQ ID NO: 62184 - DNA, 26 bp, Artificial sequence
  SiRNA target sequence
agaagacaatataataagtcacagga

SEQ ID NO: 62185 - DNA, 26 bp, Artificial sequence
  SiRNA target sequence
gaagacaatataataagtcacaggat

SEQ ID NO: 62186 - DNA, 26 bp, Artificial sequence
  SiRNA target sequence
aagacaatataataagtcacaggata

SEQ ID NO: 62187 - DNA, 26 bp, Artificial sequence
  SiRNA target sequence
agacaatataataagtcacaggataa

SEQ ID NO: 62188 - DNA, 26 bp, Artificial sequence
  SiRNA target sequence
gacaatataataagtcacaggataaa

SEQ ID NO: 62189 - DNA, 26 bp, Artificial sequence
  SiRNA target sequence
acaatataataagtcacaggataaat

SEQ ID NO: 62190 - DNA, 26 bp, Artificial sequence
  SiRNA target sequence
caatataataagtcacaggataaatt

SEQ ID NO: 62191 - DNA, 26 bp, Artificial sequence
  SiRNA target sequence
aatataataagtcacaggataaatta

SEQ ID NO: 62192 - DNA, 26 bp, Artificial sequence
  SiRNA target sequence
atataataagtcacaggataaattat

SEQ ID NO: 62193 - DNA, 26 bp, Artificial sequence
  SiRNA target sequence
tataataagtcacaggataaattatc

SEQ ID NO: 62194 - DNA, 26 bp, Artificial sequence
  SiRNA target sequence
ataataagtcacaggataaattatcg

SEQ ID NO: 62195 - DNA, 26 bp, Artificial sequence
  SiRNA target sequence
taataagtcacaggataaattatcga

SEQ ID NO: 62196 - DNA, 26 bp, Artificial sequence
  SiRNA target sequence
aataagtcacaggataaattatcgaa

SEQ ID NO: 62197 - DNA, 26 bp, Artificial sequence
  SiRNA target sequence
ataagtcacaggataaattatcgaat

SEQ ID NO: 62198 - DNA, 26 bp, Artificial sequence
  SiRNA target sequence
taagtcacaggataaattatcgaata

SEQ ID NO: 62199 - DNA, 26 bp, Artificial sequence
  SiRNA target sequence
aagtcacaggataaattatcgaataa

SEQ ID NO: 62200 - DNA, 26 bp, Artificial sequence
  SiRNA target sequence
agtcacaggataaattatcgaataaa

SEQ ID NO: 62201 - DNA, 26 bp, Artificial sequence
  SiRNA target sequence
gtcacaggataaattatcgaataaat

SEQ ID NO: 62202 - DNA, 26 bp, Artificial sequence
  SiRNA target sequence
tcacaggataaattatcgaataaatt

SEQ ID NO: 62203 - DNA, 26 bp, Artificial sequence
  SiRNA target sequence
cacaggataaattatcgaataaatta

SEQ ID NO: 62204 - DNA, 26 bp, Artificial sequence
  SiRNA target sequence
acaggataaattatcgaataaattac

SEQ ID NO: 62205 - DNA, 26 bp, Artificial sequence
  SiRNA target sequence
caggataaattatcgaataaattaca

SEQ ID NO: 62206 - DNA, 26 bp, Artificial sequence
  SiRNA target sequence
aggataaattatcgaataaattacaa

SEQ ID NO: 62207 - DNA, 26 bp, Artificial sequence
  SiRNA target sequence
ggataaattatcgaataaattacaag

SEQ ID NO: 62208 - DNA, 26 bp, Artificial sequence
  SiRNA target sequence
gataaattatcgaataaattacaaga

SEQ ID NO: 62209 - DNA, 26 bp, Artificial sequence
  SiRNA target sequence
ataaattatcgaataaattacaagat

SEQ ID NO: 62210 - DNA, 26 bp, Artificial sequence
  SiRNA target sequence
taaattatcgaataaattacaagatt

SEQ ID NO: 62211 - DNA, 26 bp, Artificial sequence
  SiRNA target sequence
aaattatcgaataaattacaagattt

SEQ ID NO: 62212 - DNA, 26 bp, Artificial sequence
  SiRNA target sequence
aattatcgaataaattacaagatttt

SEQ ID NO: 62213 - DNA, 26 bp, Artificial sequence
  SiRNA target sequence
attatcgaataaattacaagattttt

SEQ ID NO: 62214 - DNA, 26 bp, Artificial sequence
  SiRNA target sequence
ttatcgaataaattacaagatttttt

SEQ ID NO: 62215 - DNA, 26 bp, Artificial sequence
  SiRNA target sequence
tatcgaataaattacaagatttttta

SEQ ID NO: 62216 - DNA, 26 bp, Artificial sequence
  SiRNA target sequence
atcgaataaattacaagattttttag

SEQ ID NO: 62217 - DNA, 26 bp, Artificial sequence
  SiRNA target sequence
tcgaataaattacaagattttttagc

SEQ ID NO: 62218 - DNA, 26 bp, Artificial sequence
  SiRNA target sequence
cgaataaattacaagattttttagct

SEQ ID NO: 62219 - DNA, 26 bp, Artificial sequence
  SiRNA target sequence
gaataaattacaagattttttagcta

SEQ ID NO: 62220 - DNA, 26 bp, Artificial sequence
  SiRNA target sequence
aataaattacaagattttttagctaa

SEQ ID NO: 62221 - DNA, 26 bp, Artificial sequence
  SiRNA target sequence
ataaattacaagattttttagctaat

SEQ ID NO: 62222 - DNA, 26 bp, Artificial sequence
  SiRNA target sequence
taaattacaagattttttagctaatc

SEQ ID NO: 62223 - DNA, 26 bp, Artificial sequence
  SiRNA target sequence
aaattacaagattttttagctaatca

SEQ ID NO: 62224 - DNA, 26 bp, Artificial sequence
  SiRNA target sequence
aattacaagattttttagctaatcat

SEQ ID NO: 62225 - DNA, 26 bp, Artificial sequence
  SiRNA target sequence
attacaagattttttagctaatcatg

SEQ ID NO: 62226 - DNA, 26 bp, Artificial sequence
  SiRNA target sequence
ttacaagattttttagctaatcatga

SEQ ID NO: 62227 - DNA, 26 bp, Artificial sequence
  SiRNA target sequence
tacaagattttttagctaatcatgaa

SEQ ID NO: 62228 - DNA, 26 bp, Artificial sequence
  SiRNA target sequence
acaagattttttagctaatcatgaaa

SEQ ID NO: 62229 - DNA, 26 bp, Artificial sequence
  SiRNA target sequence
caagattttttagctaatcatgaaac

SEQ ID NO: 62230 - DNA, 26 bp, Artificial sequence
  SiRNA target sequence
aagattttttagctaatcatgaaaca

SEQ ID NO: 62231 - DNA, 26 bp, Artificial sequence
  SiRNA target sequence
agattttttagctaatcatgaaacaa

SEQ ID NO: 62232 - DNA, 26 bp, Artificial sequence
  SiRNA target sequence
gattttttagctaatcatgaaacaat

SEQ ID NO: 62233 - DNA, 26 bp, Artificial sequence
  SiRNA target sequence
attttttagctaatcatgaaacaatt

SEQ ID NO: 62234 - DNA, 26 bp, Artificial sequence
  SiRNA target sequence
ttttttagctaatcatgaaacaatta

SEQ ID NO: 62235 - DNA, 26 bp, Artificial sequence
  SiRNA target sequence
tttttagctaatcatgaaacaattaa

SEQ ID NO: 62236 - DNA, 26 bp, Artificial sequence
  SiRNA target sequence
ttttagctaatcatgaaacaattaaa

SEQ ID NO: 62237 - DNA, 26 bp, Artificial sequence
  SiRNA target sequence
tttagctaatcatgaaacaattaaag

SEQ ID NO: 62238 - DNA, 26 bp, Artificial sequence
  SiRNA target sequence
ttagctaatcatgaaacaattaaagc

SEQ ID NO: 62239 - DNA, 26 bp, Artificial sequence
  SiRNA target sequence
tagctaatcatgaaacaattaaagcc

SEQ ID NO: 62240 - DNA, 26 bp, Artificial sequence
  SiRNA target sequence
agctaatcatgaaacaattaaagcct

SEQ ID NO: 62241 - DNA, 26 bp, Artificial sequence
  SiRNA target sequence
gctaatcatgaaacaattaaagccta

SEQ ID NO: 62242 - DNA, 26 bp, Artificial sequence
  SiRNA target sequence
ctaatcatgaaacaattaaagcctat

SEQ ID NO: 62243 - DNA, 26 bp, Artificial sequence
  SiRNA target sequence
taatcatgaaacaattaaagcctata

SEQ ID NO: 62244 - DNA, 26 bp, Artificial sequence
  SiRNA target sequence
aatcatgaaacaattaaagcctataa

SEQ ID NO: 62245 - DNA, 26 bp, Artificial sequence
  SiRNA target sequence
atcatgaaacaattaaagcctataat

SEQ ID NO: 62246 - DNA, 26 bp, Artificial sequence
  SiRNA target sequence
tcatgaaacaattaaagcctataata

SEQ ID NO: 62247 - DNA, 26 bp, Artificial sequence
  SiRNA target sequence
catgaaacaattaaagcctataatat

SEQ ID NO: 62248 - DNA, 26 bp, Artificial sequence
  SiRNA target sequence
atgaaacaattaaagcctataatatg

SEQ ID NO: 62249 - DNA, 26 bp, Artificial sequence
  SiRNA target sequence
tgaaacaattaaagcctataatatgg

SEQ ID NO: 62250 - DNA, 26 bp, Artificial sequence
  SiRNA target sequence
gaaacaattaaagcctataatatgga

SEQ ID NO: 62251 - DNA, 26 bp, Artificial sequence
  SiRNA target sequence
aaacaattaaagcctataatatggaa

SEQ ID NO: 62252 - DNA, 26 bp, Artificial sequence
  SiRNA target sequence
aacaattaaagcctataatatggaag

SEQ ID NO: 62253 - DNA, 26 bp, Artificial sequence
  SiRNA target sequence
acaattaaagcctataatatggaaga

SEQ ID NO: 62254 - DNA, 26 bp, Artificial sequence
  SiRNA target sequence
caattaaagcctataatatggaagaa

SEQ ID NO: 62255 - DNA, 26 bp, Artificial sequence
  SiRNA target sequence
aattaaagcctataatatggaagaag

SEQ ID NO: 62256 - DNA, 26 bp, Artificial sequence
  SiRNA target sequence
attaaagcctataatatggaagaaga

SEQ ID NO: 62257 - DNA, 26 bp, Artificial sequence
  SiRNA target sequence
ttaaagcctataatatggaagaagaa

SEQ ID NO: 62258 - DNA, 26 bp, Artificial sequence
  SiRNA target sequence
taaagcctataatatggaagaagaaa

SEQ ID NO: 62259 - DNA, 26 bp, Artificial sequence
  SiRNA target sequence
aaagcctataatatggaagaagaaac

SEQ ID NO: 62260 - DNA, 26 bp, Artificial sequence
  SiRNA target sequence
aagcctataatatggaagaagaaact

SEQ ID NO: 62261 - DNA, 26 bp, Artificial sequence
  SiRNA target sequence
agcctataatatggaagaagaaacta

SEQ ID NO: 62262 - DNA, 26 bp, Artificial sequence
  SiRNA target sequence
gcctataatatggaagaagaaactat

SEQ ID NO: 62263 - DNA, 26 bp, Artificial sequence
  SiRNA target sequence
cctataatatggaagaagaaactatt

SEQ ID NO: 62264 - DNA, 26 bp, Artificial sequence
  SiRNA target sequence
ctataatatggaagaagaaactatta

SEQ ID NO: 62265 - DNA, 26 bp, Artificial sequence
  SiRNA target sequence
tataatatggaagaagaaactattac

SEQ ID NO: 62266 - DNA, 26 bp, Artificial sequence
  SiRNA target sequence
ataatatggaagaagaaactattaca

SEQ ID NO: 62267 - DNA, 26 bp, Artificial sequence
  SiRNA target sequence
taatatggaagaagaaactattacat

SEQ ID NO: 62268 - DNA, 26 bp, Artificial sequence
  SiRNA target sequence
aatatggaagaagaaactattacata

SEQ ID NO: 62269 - DNA, 26 bp, Artificial sequence
  SiRNA target sequence
atatggaagaagaaactattacatat

SEQ ID NO: 62270 - DNA, 26 bp, Artificial sequence
  SiRNA target sequence
tatggaagaagaaactattacatatt

SEQ ID NO: 62271 - DNA, 26 bp, Artificial sequence
  SiRNA target sequence
atggaagaagaaactattacatattt

SEQ ID NO: 62272 - DNA, 26 bp, Artificial sequence
  SiRNA target sequence
tggaagaagaaactattacatatttt

SEQ ID NO: 62273 - DNA, 26 bp, Artificial sequence
  SiRNA target sequence
ggaagaagaaactattacatattttg

SEQ ID NO: 62274 - DNA, 26 bp, Artificial sequence
  SiRNA target sequence
gaagaagaaactattacatattttga

SEQ ID NO: 62275 - DNA, 26 bp, Artificial sequence
  SiRNA target sequence
aagaagaaactattacatattttgat

SEQ ID NO: 62276 - DNA, 26 bp, Artificial sequence
  SiRNA target sequence
agaagaaactattacatattttgatg

SEQ ID NO: 62277 - DNA, 26 bp, Artificial sequence
  SiRNA target sequence
gaagaaactattacatattttgatga

SEQ ID NO: 62278 - DNA, 26 bp, Artificial sequence
  SiRNA target sequence
aagaaactattacatattttgatgaa

SEQ ID NO: 62279 - DNA, 26 bp, Artificial sequence
  SiRNA target sequence
agaaactattacatattttgatgaaa

SEQ ID NO: 62280 - DNA, 26 bp, Artificial sequence
  SiRNA target sequence
gaaactattacatattttgatgaaaa

SEQ ID NO: 62281 - DNA, 26 bp, Artificial sequence
  SiRNA target sequence
aaactattacatattttgatgaaaat

SEQ ID NO: 62282 - DNA, 26 bp, Artificial sequence
  SiRNA target sequence
aactattacatattttgatgaaaatc

SEQ ID NO: 62283 - DNA, 26 bp, Artificial sequence
  SiRNA target sequence
actattacatattttgatgaaaatca

SEQ ID NO: 62284 - DNA, 26 bp, Artificial sequence
  SiRNA target sequence
ctattacatattttgatgaaaatcaa

SEQ ID NO: 62285 - DNA, 26 bp, Artificial sequence
  SiRNA target sequence
tattacatattttgatgaaaatcaaa

SEQ ID NO: 62286 - DNA, 26 bp, Artificial sequence
  SiRNA target sequence
attacatattttgatgaaaatcaaaa

SEQ ID NO: 62287 - DNA, 26 bp, Artificial sequence
  SiRNA target sequence
ttacatattttgatgaaaatcaaaaa

SEQ ID NO: 62288 - DNA, 26 bp, Artificial sequence
  SiRNA target sequence
tacatattttgatgaaaatcaaaaac

SEQ ID NO: 62289 - DNA, 26 bp, Artificial sequence
  SiRNA target sequence
acatattttgatgaaaatcaaaaacc

SEQ ID NO: 62290 - DNA, 26 bp, Artificial sequence
  SiRNA target sequence
catattttgatgaaaatcaaaaaccg

SEQ ID NO: 62291 - DNA, 26 bp, Artificial sequence
  SiRNA target sequence
atattttgatgaaaatcaaaaaccgg

SEQ ID NO: 62292 - DNA, 26 bp, Artificial sequence
  SiRNA target sequence
tattttgatgaaaatcaaaaaccggt

SEQ ID NO: 62293 - DNA, 26 bp, Artificial sequence
  SiRNA target sequence
attttgatgaaaatcaaaaaccggta

SEQ ID NO: 62294 - DNA, 26 bp, Artificial sequence
  SiRNA target sequence
ttttgatgaaaatcaaaaaccggtag

SEQ ID NO: 62295 - DNA, 26 bp, Artificial sequence
  SiRNA target sequence
tttgatgaaaatcaaaaaccggtaga

SEQ ID NO: 62296 - DNA, 26 bp, Artificial sequence
  SiRNA target sequence
ttgatgaaaatcaaaaaccggtagaa

SEQ ID NO: 62297 - DNA, 26 bp, Artificial sequence
  SiRNA target sequence
tgatgaaaatcaaaaaccggtagaat

SEQ ID NO: 62298 - DNA, 26 bp, Artificial sequence
  SiRNA target sequence
gatgaaaatcaaaaaccggtagaata

SEQ ID NO: 62299 - DNA, 26 bp, Artificial sequence
  SiRNA target sequence
atgaaaatcaaaaaccggtagaatat

SEQ ID NO: 62300 - DNA, 26 bp, Artificial sequence
  SiRNA target sequence
tgaaaatcaaaaaccggtagaatatt

SEQ ID NO: 62301 - DNA, 26 bp, Artificial sequence
  SiRNA target sequence
gaaaatcaaaaaccggtagaatattt

SEQ ID NO: 62302 - DNA, 26 bp, Artificial sequence
  SiRNA target sequence
aaaatcaaaaaccggtagaatatttt

SEQ ID NO: 62303 - DNA, 26 bp, Artificial sequence
  SiRNA target sequence
aaatcaaaaaccggtagaatattttg

SEQ ID NO: 62304 - DNA, 26 bp, Artificial sequence
  SiRNA target sequence
aatcaaaaaccggtagaatattttgg

SEQ ID NO: 62305 - DNA, 26 bp, Artificial sequence
  SiRNA target sequence
atcaaaaaccggtagaatattttggg

SEQ ID NO: 62306 - DNA, 26 bp, Artificial sequence
  SiRNA target sequence
tcaaaaaccggtagaatattttgggg

SEQ ID NO: 62307 - DNA, 26 bp, Artificial sequence
  SiRNA target sequence
caaaaaccggtagaatattttggggt

SEQ ID NO: 62308 - DNA, 26 bp, Artificial sequence
  SiRNA target sequence
aaaaaccggtagaatattttggggta

SEQ ID NO: 62309 - DNA, 26 bp, Artificial sequence
  SiRNA target sequence
aaaaccggtagaatattttggggtaa

SEQ ID NO: 62310 - DNA, 26 bp, Artificial sequence
  SiRNA target sequence
aaaccggtagaatattttggggtaaa

SEQ ID NO: 62311 - DNA, 26 bp, Artificial sequence
  SiRNA target sequence
aaccggtagaatattttggggtaaag

SEQ ID NO: 62312 - DNA, 26 bp, Artificial sequence
  SiRNA target sequence
accggtagaatattttggggtaaagt

SEQ ID NO: 62313 - DNA, 26 bp, Artificial sequence
  SiRNA target sequence
ccggtagaatattttggggtaaagtc

SEQ ID NO: 62314 - DNA, 26 bp, Artificial sequence
  SiRNA target sequence
cggtagaatattttggggtaaagtct

SEQ ID NO: 62315 - DNA, 26 bp, Artificial sequence
  SiRNA target sequence
ggtagaatattttggggtaaagtctc

SEQ ID NO: 62316 - DNA, 26 bp, Artificial sequence
  SiRNA target sequence
gtagaatattttggggtaaagtctca

SEQ ID NO: 62317 - DNA, 26 bp, Artificial sequence
  SiRNA target sequence
tagaatattttggggtaaagtctcac

SEQ ID NO: 62318 - DNA, 26 bp, Artificial sequence
  SiRNA target sequence
agaatattttggggtaaagtctcaca

SEQ ID NO: 62319 - DNA, 26 bp, Artificial sequence
  SiRNA target sequence
gaatattttggggtaaagtctcacag

SEQ ID NO: 62320 - DNA, 26 bp, Artificial sequence
  SiRNA target sequence
aatattttggggtaaagtctcacaga

SEQ ID NO: 62321 - DNA, 26 bp, Artificial sequence
  SiRNA target sequence
atattttggggtaaagtctcacagaa

SEQ ID NO: 62322 - DNA, 26 bp, Artificial sequence
  SiRNA target sequence
tattttggggtaaagtctcacagaat

SEQ ID NO: 62323 - DNA, 26 bp, Artificial sequence
  SiRNA target sequence
attttggggtaaagtctcacagaatt

SEQ ID NO: 62324 - DNA, 26 bp, Artificial sequence
  SiRNA target sequence
ttttggggtaaagtctcacagaattt

SEQ ID NO: 62325 - DNA, 26 bp, Artificial sequence
  SiRNA target sequence
tttggggtaaagtctcacagaatttt

SEQ ID NO: 62326 - DNA, 26 bp, Artificial sequence
  SiRNA target sequence
ttggggtaaagtctcacagaattttg

SEQ ID NO: 62327 - DNA, 26 bp, Artificial sequence
  SiRNA target sequence
tggggtaaagtctcacagaattttgt

SEQ ID NO: 62328 - DNA, 26 bp, Artificial sequence
  SiRNA target sequence
ggggtaaagtctcacagaattttgtt

SEQ ID NO: 62329 - DNA, 26 bp, Artificial sequence
  SiRNA target sequence
gggtaaagtctcacagaattttgttc

SEQ ID NO: 62330 - DNA, 26 bp, Artificial sequence
  SiRNA target sequence
ggtaaagtctcacagaattttgttct

SEQ ID NO: 62331 - DNA, 26 bp, Artificial sequence
  SiRNA target sequence
gtaaagtctcacagaattttgttctc

SEQ ID NO: 62332 - DNA, 26 bp, Artificial sequence
  SiRNA target sequence
taaagtctcacagaattttgttctct

SEQ ID NO: 62333 - DNA, 26 bp, Artificial sequence
  SiRNA target sequence
aaagtctcacagaattttgttctctc

SEQ ID NO: 62334 - DNA, 26 bp, Artificial sequence
  SiRNA target sequence
aagtctcacagaattttgttctctct

SEQ ID NO: 62335 - DNA, 26 bp, Artificial sequence
  SiRNA target sequence
agtctcacagaattttgttctctctt

SEQ ID NO: 62336 - DNA, 26 bp, Artificial sequence
  SiRNA target sequence
gtctcacagaattttgttctctcttt

SEQ ID NO: 62337 - DNA, 26 bp, Artificial sequence
  SiRNA target sequence
tctcacagaattttgttctctctttt

SEQ ID NO: 62338 - DNA, 26 bp, Artificial sequence
  SiRNA target sequence
ctcacagaattttgttctctctttta

SEQ ID NO: 62339 - DNA, 26 bp, Artificial sequence
  SiRNA target sequence
tcacagaattttgttctctcttttat

SEQ ID NO: 62340 - DNA, 26 bp, Artificial sequence
  SiRNA target sequence
cacagaattttgttctctcttttata

SEQ ID NO: 62341 - DNA, 26 bp, Artificial sequence
  SiRNA target sequence
acagaattttgttctctcttttatat

SEQ ID NO: 62342 - DNA, 26 bp, Artificial sequence
  SiRNA target sequence
cagaattttgttctctcttttatata

SEQ ID NO: 62343 - DNA, 26 bp, Artificial sequence
  SiRNA target sequence
agaattttgttctctcttttatatat

SEQ ID NO: 62344 - DNA, 26 bp, Artificial sequence
  SiRNA target sequence
gaattttgttctctcttttatatata

SEQ ID NO: 62345 - DNA, 26 bp, Artificial sequence
  SiRNA target sequence
aattttgttctctcttttatatatac

SEQ ID NO: 62346 - DNA, 26 bp, Artificial sequence
  SiRNA target sequence
attttgttctctcttttatatataca

SEQ ID NO: 62347 - DNA, 26 bp, Artificial sequence
  SiRNA target sequence
ttttgttctctcttttatatatacaa

SEQ ID NO: 62348 - DNA, 26 bp, Artificial sequence
  SiRNA target sequence
tttgttctctcttttatatatacaaa

SEQ ID NO: 62349 - DNA, 26 bp, Artificial sequence
  SiRNA target sequence
ttgttctctcttttatatatacaaaa

SEQ ID NO: 62350 - DNA, 26 bp, Artificial sequence
  SiRNA target sequence
tgttctctcttttatatatacaaaaa

SEQ ID NO: 62351 - DNA, 26 bp, Artificial sequence
  SiRNA target sequence
gttctctcttttatatatacaaaaaa

SEQ ID NO: 62352 - DNA, 26 bp, Artificial sequence
  SiRNA target sequence
ttctctcttttatatatacaaaaaat

SEQ ID NO: 62353 - DNA, 26 bp, Artificial sequence
  SiRNA target sequence
tctctcttttatatatacaaaaaatg

SEQ ID NO: 62354 - DNA, 26 bp, Artificial sequence
  SiRNA target sequence
ctctcttttatatatacaaaaaatga

SEQ ID NO: 62355 - DNA, 26 bp, Artificial sequence
  SiRNA target sequence
tctcttttatatatacaaaaaatgac

SEQ ID NO: 62356 - DNA, 26 bp, Artificial sequence
  SiRNA target sequence
ctcttttatatatacaaaaaatgaca

SEQ ID NO: 62357 - DNA, 26 bp, Artificial sequence
  SiRNA target sequence
tcttttatatatacaaaaaatgacat

SEQ ID NO: 62358 - DNA, 26 bp, Artificial sequence
  SiRNA target sequence
cttttatatatacaaaaaatgacatt

SEQ ID NO: 62359 - DNA, 26 bp, Artificial sequence
  SiRNA target sequence
ttttatatatacaaaaaatgacattt

SEQ ID NO: 62360 - DNA, 26 bp, Artificial sequence
  SiRNA target sequence
tttatatatacaaaaaatgacatttg

SEQ ID NO: 62361 - DNA, 26 bp, Artificial sequence
  SiRNA target sequence
ttatatatacaaaaaatgacatttgc

SEQ ID NO: 62362 - DNA, 26 bp, Artificial sequence
  SiRNA target sequence
tatatatacaaaaaatgacatttgcg

SEQ ID NO: 62363 - DNA, 26 bp, Artificial sequence
  SiRNA target sequence
atatatacaaaaaatgacatttgcga

SEQ ID NO: 62364 - DNA, 26 bp, Artificial sequence
  SiRNA target sequence
tatatacaaaaaatgacatttgcgat

SEQ ID NO: 62365 - DNA, 26 bp, Artificial sequence
  SiRNA target sequence
atatacaaaaaatgacatttgcgata

SEQ ID NO: 62366 - DNA, 26 bp, Artificial sequence
  SiRNA target sequence
tatacaaaaaatgacatttgcgatac

SEQ ID NO: 62367 - DNA, 26 bp, Artificial sequence
  SiRNA target sequence
atacaaaaaatgacatttgcgataca

SEQ ID NO: 62368 - DNA, 26 bp, Artificial sequence
  SiRNA target sequence
tacaaaaaatgacatttgcgatacag

SEQ ID NO: 62369 - DNA, 26 bp, Artificial sequence
  SiRNA target sequence
acaaaaaatgacatttgcgatacagg

SEQ ID NO: 62370 - DNA, 26 bp, Artificial sequence
  SiRNA target sequence
caaaaaatgacatttgcgatacaggc

SEQ ID NO: 62371 - DNA, 26 bp, Artificial sequence
  SiRNA target sequence
aaaaaatgacatttgcgatacaggca

SEQ ID NO: 62372 - DNA, 26 bp, Artificial sequence
  SiRNA target sequence
aaaaatgacatttgcgatacaggcaa

SEQ ID NO: 62373 - DNA, 26 bp, Artificial sequence
  SiRNA target sequence
aaaatgacatttgcgatacaggcaat

SEQ ID NO: 62374 - DNA, 26 bp, Artificial sequence
  SiRNA target sequence
aaatgacatttgcgatacaggcaatt

SEQ ID NO: 62375 - DNA, 26 bp, Artificial sequence
  SiRNA target sequence
aatgacatttgcgatacaggcaatta

SEQ ID NO: 62376 - DNA, 26 bp, Artificial sequence
  SiRNA target sequence
atgacatttgcgatacaggcaattat

SEQ ID NO: 62377 - DNA, 26 bp, Artificial sequence
  SiRNA target sequence
tgacatttgcgatacaggcaattatt

SEQ ID NO: 62378 - DNA, 26 bp, Artificial sequence
  SiRNA target sequence
gacatttgcgatacaggcaattatta

SEQ ID NO: 62379 - DNA, 26 bp, Artificial sequence
  SiRNA target sequence
acatttgcgatacaggcaattattat

SEQ ID NO: 62380 - DNA, 26 bp, Artificial sequence
  SiRNA target sequence
catttgcgatacaggcaattattatt

SEQ ID NO: 62381 - DNA, 26 bp, Artificial sequence
  SiRNA target sequence
atttgcgatacaggcaattattatta

SEQ ID NO: 62382 - DNA, 26 bp, Artificial sequence
  SiRNA target sequence
tttgcgatacaggcaattattattat

SEQ ID NO: 62383 - DNA, 26 bp, Artificial sequence
  SiRNA target sequence
ttgcgatacaggcaattattattatc

SEQ ID NO: 62384 - DNA, 26 bp, Artificial sequence
  SiRNA target sequence
tgcgatacaggcaattattattatca

SEQ ID NO: 62385 - DNA, 26 bp, Artificial sequence
  SiRNA target sequence
gcgatacaggcaattattattatcac

SEQ ID NO: 62386 - DNA, 26 bp, Artificial sequence
  SiRNA target sequence
cgatacaggcaattattattatcaca

SEQ ID NO: 62387 - DNA, 26 bp, Artificial sequence
  SiRNA target sequence
gatacaggcaattattattatcacat

SEQ ID NO: 62388 - DNA, 26 bp, Artificial sequence
  SiRNA target sequence
atacaggcaattattattatcacatt

SEQ ID NO: 62389 - DNA, 26 bp, Artificial sequence
  SiRNA target sequence
tacaggcaattattattatcacatta

SEQ ID NO: 62390 - DNA, 26 bp, Artificial sequence
  SiRNA target sequence
acaggcaattattattatcacattag

SEQ ID NO: 62391 - DNA, 26 bp, Artificial sequence
  SiRNA target sequence
caggcaattattattatcacattagg

SEQ ID NO: 62392 - DNA, 26 bp, Artificial sequence
  SiRNA target sequence
aggcaattattattatcacattagga

SEQ ID NO: 62393 - DNA, 26 bp, Artificial sequence
  SiRNA target sequence
ggcaattattattatcacattaggat

SEQ ID NO: 62394 - DNA, 26 bp, Artificial sequence
  SiRNA target sequence
gcaattattattatcacattaggatc

SEQ ID NO: 62395 - DNA, 26 bp, Artificial sequence
  SiRNA target sequence
caattattattatcacattaggatct

SEQ ID NO: 62396 - DNA, 26 bp, Artificial sequence
  SiRNA target sequence
aattattattatcacattaggatctt

SEQ ID NO: 62397 - DNA, 26 bp, Artificial sequence
  SiRNA target sequence
attattattatcacattaggatcttt

SEQ ID NO: 62398 - DNA, 26 bp, Artificial sequence
  SiRNA target sequence
ttattattatcacattaggatctttt

SEQ ID NO: 62399 - DNA, 26 bp, Artificial sequence
  SiRNA target sequence
tattattatcacattaggatcttttg

SEQ ID NO: 62400 - DNA, 26 bp, Artificial sequence
  SiRNA target sequence
attattatcacattaggatcttttgg

SEQ ID NO: 62401 - DNA, 26 bp, Artificial sequence
  SiRNA target sequence
ttattatcacattaggatcttttgga

SEQ ID NO: 62402 - DNA, 26 bp, Artificial sequence
  SiRNA target sequence
tattatcacattaggatcttttggat

SEQ ID NO: 62403 - DNA, 26 bp, Artificial sequence
  SiRNA target sequence
attatcacattaggatcttttggata

SEQ ID NO: 62404 - DNA, 26 bp, Artificial sequence
  SiRNA target sequence
ttatcacattaggatcttttggatat

SEQ ID NO: 62405 - DNA, 26 bp, Artificial sequence
  SiRNA target sequence
tatcacattaggatcttttggatatt

SEQ ID NO: 62406 - DNA, 26 bp, Artificial sequence
  SiRNA target sequence
atcacattaggatcttttggatattt

SEQ ID NO: 62407 - DNA, 26 bp, Artificial sequence
  SiRNA target sequence
tcacattaggatcttttggatatttt

SEQ ID NO: 62408 - DNA, 26 bp, Artificial sequence
  SiRNA target sequence
cacattaggatcttttggatattttc

SEQ ID NO: 62409 - DNA, 26 bp, Artificial sequence
  SiRNA target sequence
acattaggatcttttggatattttcc

SEQ ID NO: 62410 - DNA, 26 bp, Artificial sequence
  SiRNA target sequence
cattaggatcttttggatattttccg

SEQ ID NO: 62411 - DNA, 26 bp, Artificial sequence
  SiRNA target sequence
attaggatcttttggatattttccga

SEQ ID NO: 62412 - DNA, 26 bp, Artificial sequence
  SiRNA target sequence
ttaggatcttttggatattttccgat

SEQ ID NO: 62413 - DNA, 26 bp, Artificial sequence
  SiRNA target sequence
taggatcttttggatattttccgatt

SEQ ID NO: 62414 - DNA, 26 bp, Artificial sequence
  SiRNA target sequence
aggatcttttggatattttccgatta

SEQ ID NO: 62415 - DNA, 26 bp, Artificial sequence
  SiRNA target sequence
ggatcttttggatattttccgattaa

SEQ ID NO: 62416 - DNA, 26 bp, Artificial sequence
  SiRNA target sequence
gatcttttggatattttccgattaaa

SEQ ID NO: 62417 - DNA, 26 bp, Artificial sequence
  SiRNA target sequence
atcttttggatattttccgattaaat

SEQ ID NO: 62418 - DNA, 26 bp, Artificial sequence
  SiRNA target sequence
tcttttggatattttccgattaaatt

SEQ ID NO: 62419 - DNA, 26 bp, Artificial sequence
  SiRNA target sequence
cttttggatattttccgattaaatta

SEQ ID NO: 62420 - DNA, 26 bp, Artificial sequence
  SiRNA target sequence
ttttggatattttccgattaaattat

SEQ ID NO: 62421 - DNA, 26 bp, Artificial sequence
  SiRNA target sequence
tttggatattttccgattaaattatc

SEQ ID NO: 62422 - DNA, 26 bp, Artificial sequence
  SiRNA target sequence
ttggatattttccgattaaattatcc

SEQ ID NO: 62423 - DNA, 26 bp, Artificial sequence
  SiRNA target sequence
tggatattttccgattaaattatcct

SEQ ID NO: 62424 - DNA, 26 bp, Artificial sequence
  SiRNA target sequence
ggatattttccgattaaattatcctc

SEQ ID NO: 62425 - DNA, 26 bp, Artificial sequence
  SiRNA target sequence
gatattttccgattaaattatcctct

SEQ ID NO: 62426 - DNA, 26 bp, Artificial sequence
  SiRNA target sequence
atattttccgattaaattatcctctc

SEQ ID NO: 62427 - DNA, 26 bp, Artificial sequence
  SiRNA target sequence
tattttccgattaaattatcctctca

SEQ ID NO: 62428 - DNA, 26 bp, Artificial sequence
  SiRNA target sequence
attttccgattaaattatcctctcaa

SEQ ID NO: 62429 - DNA, 26 bp, Artificial sequence
  SiRNA target sequence
ttttccgattaaattatcctctcaac

SEQ ID NO: 62430 - DNA, 26 bp, Artificial sequence
  SiRNA target sequence
tttccgattaaattatcctctcaaca

SEQ ID NO: 62431 - DNA, 26 bp, Artificial sequence
  SiRNA target sequence
ttccgattaaattatcctctcaacag

SEQ ID NO: 62432 - DNA, 26 bp, Artificial sequence
  SiRNA target sequence
tccgattaaattatcctctcaacagt

SEQ ID NO: 62433 - DNA, 26 bp, Artificial sequence
  SiRNA target sequence
ccgattaaattatcctctcaacagtt

SEQ ID NO: 62434 - DNA, 26 bp, Artificial sequence
  SiRNA target sequence
cgattaaattatcctctcaacagtta

SEQ ID NO: 62435 - DNA, 26 bp, Artificial sequence
  SiRNA target sequence
gattaaattatcctctcaacagttag

SEQ ID NO: 62436 - DNA, 26 bp, Artificial sequence
  SiRNA target sequence
attaaattatcctctcaacagttagt

SEQ ID NO: 62437 - DNA, 26 bp, Artificial sequence
  SiRNA target sequence
ttaaattatcctctcaacagttagtc

SEQ ID NO: 62438 - DNA, 26 bp, Artificial sequence
  SiRNA target sequence
taaattatcctctcaacagttagtct

SEQ ID NO: 62439 - DNA, 26 bp, Artificial sequence
  SiRNA target sequence
aaattatcctctcaacagttagtctt

SEQ ID NO: 62440 - DNA, 26 bp, Artificial sequence
  SiRNA target sequence
aattatcctctcaacagttagtcttt

SEQ ID NO: 62441 - DNA, 26 bp, Artificial sequence
  SiRNA target sequence
attatcctctcaacagttagtctttt

SEQ ID NO: 62442 - DNA, 26 bp, Artificial sequence
  SiRNA target sequence
ttatcctctcaacagttagtctttta

SEQ ID NO: 62443 - DNA, 26 bp, Artificial sequence
  SiRNA target sequence
tatcctctcaacagttagtcttttat

SEQ ID NO: 62444 - DNA, 26 bp, Artificial sequence
  SiRNA target sequence
atcctctcaacagttagtcttttata

SEQ ID NO: 62445 - DNA, 26 bp, Artificial sequence
  SiRNA target sequence
tcctctcaacagttagtcttttatat

SEQ ID NO: 62446 - DNA, 26 bp, Artificial sequence
  SiRNA target sequence
cctctcaacagttagtcttttatatt

SEQ ID NO: 62447 - DNA, 26 bp, Artificial sequence
  SiRNA target sequence
ctctcaacagttagtcttttatattt

SEQ ID NO: 62448 - DNA, 26 bp, Artificial sequence
  SiRNA target sequence
tctcaacagttagtcttttatatttc

SEQ ID NO: 62449 - DNA, 26 bp, Artificial sequence
  SiRNA target sequence
ctcaacagttagtcttttatatttcg

SEQ ID NO: 62450 - DNA, 26 bp, Artificial sequence
  SiRNA target sequence
tcaacagttagtcttttatatttcga

SEQ ID NO: 62451 - DNA, 26 bp, Artificial sequence
  SiRNA target sequence
caacagttagtcttttatatttcgat

SEQ ID NO: 62452 - DNA, 26 bp, Artificial sequence
  SiRNA target sequence
aacagttagtcttttatatttcgatt

SEQ ID NO: 62453 - DNA, 26 bp, Artificial sequence
  SiRNA target sequence
acagttagtcttttatatttcgatta

SEQ ID NO: 62454 - DNA, 26 bp, Artificial sequence
  SiRNA target sequence
cagttagtcttttatatttcgattag

SEQ ID NO: 62455 - DNA, 26 bp, Artificial sequence
  SiRNA target sequence
agttagtcttttatatttcgattagt

SEQ ID NO: 62456 - DNA, 26 bp, Artificial sequence
  SiRNA target sequence
gttagtcttttatatttcgattagta

SEQ ID NO: 62457 - DNA, 26 bp, Artificial sequence
  SiRNA target sequence
ttagtcttttatatttcgattagtaa

SEQ ID NO: 62458 - DNA, 26 bp, Artificial sequence
  SiRNA target sequence
tagtcttttatatttcgattagtaaa

SEQ ID NO: 62459 - DNA, 26 bp, Artificial sequence
  SiRNA target sequence
agtcttttatatttcgattagtaaaa

SEQ ID NO: 62460 - DNA, 26 bp, Artificial sequence
  SiRNA target sequence
gtcttttatatttcgattagtaaaac

SEQ ID NO: 62461 - DNA, 26 bp, Artificial sequence
  SiRNA target sequence
tcttttatatttcgattagtaaaacg

SEQ ID NO: 62462 - DNA, 26 bp, Artificial sequence
  SiRNA target sequence
cttttatatttcgattagtaaaacgt

SEQ ID NO: 62463 - DNA, 26 bp, Artificial sequence
  SiRNA target sequence
ttttatatttcgattagtaaaacgtt

SEQ ID NO: 62464 - DNA, 26 bp, Artificial sequence
  SiRNA target sequence
tttatatttcgattagtaaaacgttg

SEQ ID NO: 62465 - DNA, 26 bp, Artificial sequence
  SiRNA target sequence
ttatatttcgattagtaaaacgttga

SEQ ID NO: 62466 - DNA, 26 bp, Artificial sequence
  SiRNA target sequence
tatatttcgattagtaaaacgttgac

SEQ ID NO: 62467 - DNA, 26 bp, Artificial sequence
  SiRNA target sequence
atatttcgattagtaaaacgttgaca

SEQ ID NO: 62468 - DNA, 26 bp, Artificial sequence
  SiRNA target sequence
tatttcgattagtaaaacgttgacaa

SEQ ID NO: 62469 - DNA, 26 bp, Artificial sequence
  SiRNA target sequence
atttcgattagtaaaacgttgacaaa

SEQ ID NO: 62470 - DNA, 26 bp, Artificial sequence
  SiRNA target sequence
tttcgattagtaaaacgttgacaaat

SEQ ID NO: 62471 - DNA, 26 bp, Artificial sequence
  SiRNA target sequence
ttcgattagtaaaacgttgacaaatt

SEQ ID NO: 62472 - DNA, 26 bp, Artificial sequence
  SiRNA target sequence
tcgattagtaaaacgttgacaaattc

SEQ ID NO: 62473 - DNA, 26 bp, Artificial sequence
  SiRNA target sequence
cgattagtaaaacgttgacaaattcg

SEQ ID NO: 62474 - DNA, 26 bp, Artificial sequence
  SiRNA target sequence
gattagtaaaacgttgacaaattcgt

SEQ ID NO: 62475 - DNA, 26 bp, Artificial sequence
  SiRNA target sequence
attagtaaaacgttgacaaattcgtt

SEQ ID NO: 62476 - DNA, 26 bp, Artificial sequence
  SiRNA target sequence
ttagtaaaacgttgacaaattcgttg

SEQ ID NO: 62477 - DNA, 26 bp, Artificial sequence
  SiRNA target sequence
tagtaaaacgttgacaaattcgttga

SEQ ID NO: 62478 - DNA, 26 bp, Artificial sequence
  SiRNA target sequence
agtaaaacgttgacaaattcgttgag

SEQ ID NO: 62479 - DNA, 26 bp, Artificial sequence
  SiRNA target sequence
gtaaaacgttgacaaattcgttgagc

SEQ ID NO: 62480 - DNA, 26 bp, Artificial sequence
  SiRNA target sequence
taaaacgttgacaaattcgttgagcg

SEQ ID NO: 62481 - DNA, 26 bp, Artificial sequence
  SiRNA target sequence
aaaacgttgacaaattcgttgagcga

SEQ ID NO: 62482 - DNA, 26 bp, Artificial sequence
  SiRNA target sequence
aaacgttgacaaattcgttgagcgaa

SEQ ID NO: 62483 - DNA, 26 bp, Artificial sequence
  SiRNA target sequence
aacgttgacaaattcgttgagcgaaa

SEQ ID NO: 62484 - DNA, 26 bp, Artificial sequence
  SiRNA target sequence
acgttgacaaattcgttgagcgaaat

SEQ ID NO: 62485 - DNA, 26 bp, Artificial sequence
  SiRNA target sequence
cgttgacaaattcgttgagcgaaatg

SEQ ID NO: 62486 - DNA, 26 bp, Artificial sequence
  SiRNA target sequence
gttgacaaattcgttgagcgaaatgg

SEQ ID NO: 62487 - DNA, 26 bp, Artificial sequence
  SiRNA target sequence
ttgacaaattcgttgagcgaaatggg

SEQ ID NO: 62488 - DNA, 26 bp, Artificial sequence
  SiRNA target sequence
tgacaaattcgttgagcgaaatggga

SEQ ID NO: 62489 - DNA, 26 bp, Artificial sequence
  SiRNA target sequence
gacaaattcgttgagcgaaatgggaa

SEQ ID NO: 62490 - DNA, 26 bp, Artificial sequence
  SiRNA target sequence
acaaattcgttgagcgaaatgggaat

SEQ ID NO: 62491 - DNA, 26 bp, Artificial sequence
  SiRNA target sequence
caaattcgttgagcgaaatgggaatg

SEQ ID NO: 62492 - DNA, 26 bp, Artificial sequence
  SiRNA target sequence
aaattcgttgagcgaaatgggaatgc

SEQ ID NO: 62493 - DNA, 26 bp, Artificial sequence
  SiRNA target sequence
aattcgttgagcgaaatgggaatgct

SEQ ID NO: 62494 - DNA, 26 bp, Artificial sequence
  SiRNA target sequence
attcgttgagcgaaatgggaatgcta

SEQ ID NO: 62495 - DNA, 26 bp, Artificial sequence
  SiRNA target sequence
ttcgttgagcgaaatgggaatgctat

SEQ ID NO: 62496 - DNA, 26 bp, Artificial sequence
  SiRNA target sequence
tcgttgagcgaaatgggaatgctata

SEQ ID NO: 62497 - DNA, 26 bp, Artificial sequence
  SiRNA target sequence
cgttgagcgaaatgggaatgctatac

SEQ ID NO: 62498 - DNA, 26 bp, Artificial sequence
  SiRNA target sequence
gttgagcgaaatgggaatgctataca

SEQ ID NO: 62499 - DNA, 26 bp, Artificial sequence
  SiRNA target sequence
ttgagcgaaatgggaatgctatacac

SEQ ID NO: 62500 - DNA, 26 bp, Artificial sequence
  SiRNA target sequence
tgagcgaaatgggaatgctatacaca

SEQ ID NO: 62501 - DNA, 26 bp, Artificial sequence
  SiRNA target sequence
gagcgaaatgggaatgctatacacaa

SEQ ID NO: 62502 - DNA, 26 bp, Artificial sequence
  SiRNA target sequence
agcgaaatgggaatgctatacacaag

SEQ ID NO: 62503 - DNA, 26 bp, Artificial sequence
  SiRNA target sequence
gcgaaatgggaatgctatacacaaga

SEQ ID NO: 62504 - DNA, 26 bp, Artificial sequence
  SiRNA target sequence
cgaaatgggaatgctatacacaagat

SEQ ID NO: 62505 - DNA, 26 bp, Artificial sequence
  SiRNA target sequence
gaaatgggaatgctatacacaagata

SEQ ID NO: 62506 - DNA, 26 bp, Artificial sequence
  SiRNA target sequence
aaatgggaatgctatacacaagatat

SEQ ID NO: 62507 - DNA, 26 bp, Artificial sequence
  SiRNA target sequence
aatgggaatgctatacacaagatatg

SEQ ID NO: 62508 - DNA, 26 bp, Artificial sequence
  SiRNA target sequence
atgggaatgctatacacaagatatgt

SEQ ID NO: 62509 - DNA, 26 bp, Artificial sequence
  SiRNA target sequence
tgggaatgctatacacaagatatgta

SEQ ID NO: 62510 - DNA, 26 bp, Artificial sequence
  SiRNA target sequence
gggaatgctatacacaagatatgtac

SEQ ID NO: 62511 - DNA, 26 bp, Artificial sequence
  SiRNA target sequence
ggaatgctatacacaagatatgtaca

SEQ ID NO: 62512 - DNA, 26 bp, Artificial sequence
  SiRNA target sequence
gaatgctatacacaagatatgtacaa

SEQ ID NO: 62513 - DNA, 26 bp, Artificial sequence
  SiRNA target sequence
aatgctatacacaagatatgtacaag

SEQ ID NO: 62514 - DNA, 26 bp, Artificial sequence
  SiRNA target sequence
atgctatacacaagatatgtacaagg

SEQ ID NO: 62515 - DNA, 26 bp, Artificial sequence
  SiRNA target sequence
tgctatacacaagatatgtacaagga

SEQ ID NO: 62516 - DNA, 26 bp, Artificial sequence
  SiRNA target sequence
gctatacacaagatatgtacaaggat

SEQ ID NO: 62517 - DNA, 26 bp, Artificial sequence
  SiRNA target sequence
ctatacacaagatatgtacaaggatt

SEQ ID NO: 62518 - DNA, 26 bp, Artificial sequence
  SiRNA target sequence
tatacacaagatatgtacaaggattt

SEQ ID NO: 62519 - DNA, 26 bp, Artificial sequence
  SiRNA target sequence
atacacaagatatgtacaaggatttt

SEQ ID NO: 62520 - DNA, 26 bp, Artificial sequence
  SiRNA target sequence
tacacaagatatgtacaaggattttt

SEQ ID NO: 62521 - DNA, 26 bp, Artificial sequence
  SiRNA target sequence
acacaagatatgtacaaggattttta

SEQ ID NO: 62522 - DNA, 26 bp, Artificial sequence
  SiRNA target sequence
cacaagatatgtacaaggatttttaa

SEQ ID NO: 62523 - DNA, 26 bp, Artificial sequence
  SiRNA target sequence
acaagatatgtacaaggatttttaaa

SEQ ID NO: 62524 - DNA, 26 bp, Artificial sequence
  SiRNA target sequence
caagatatgtacaaggatttttaaat

SEQ ID NO: 62525 - DNA, 26 bp, Artificial sequence
  SiRNA target sequence
aagatatgtacaaggatttttaaatg

SEQ ID NO: 62526 - DNA, 26 bp, Artificial sequence
  SiRNA target sequence
agatatgtacaaggatttttaaatgc

SEQ ID NO: 62527 - DNA, 26 bp, Artificial sequence
  SiRNA target sequence
gatatgtacaaggatttttaaatgca

SEQ ID NO: 62528 - DNA, 26 bp, Artificial sequence
  SiRNA target sequence
atatgtacaaggatttttaaatgcaa

SEQ ID NO: 62529 - DNA, 26 bp, Artificial sequence
  SiRNA target sequence
tatgtacaaggatttttaaatgcaaa

SEQ ID NO: 62530 - DNA, 26 bp, Artificial sequence
  SiRNA target sequence
atgtacaaggatttttaaatgcaaag

SEQ ID NO: 62531 - DNA, 26 bp, Artificial sequence
  SiRNA target sequence
tgtacaaggatttttaaatgcaaagt

SEQ ID NO: 62532 - DNA, 26 bp, Artificial sequence
  SiRNA target sequence
gtacaaggatttttaaatgcaaagtc

SEQ ID NO: 62533 - DNA, 26 bp, Artificial sequence
  SiRNA target sequence
tacaaggatttttaaatgcaaagtct

SEQ ID NO: 62534 - DNA, 26 bp, Artificial sequence
  SiRNA target sequence
acaaggatttttaaatgcaaagtctg

SEQ ID NO: 62535 - DNA, 26 bp, Artificial sequence
  SiRNA target sequence
caaggatttttaaatgcaaagtctgg

SEQ ID NO: 62536 - DNA, 26 bp, Artificial sequence
  SiRNA target sequence
aaggatttttaaatgcaaagtctgga

SEQ ID NO: 62537 - DNA, 26 bp, Artificial sequence
  SiRNA target sequence
aggatttttaaatgcaaagtctggat

SEQ ID NO: 62538 - DNA, 26 bp, Artificial sequence
  SiRNA target sequence
ggatttttaaatgcaaagtctggata

SEQ ID NO: 62539 - DNA, 26 bp, Artificial sequence
  SiRNA target sequence
gatttttaaatgcaaagtctggatat

SEQ ID NO: 62540 - DNA, 26 bp, Artificial sequence
  SiRNA target sequence
atttttaaatgcaaagtctggatatt

SEQ ID NO: 62541 - DNA, 26 bp, Artificial sequence
  SiRNA target sequence
tttttaaatgcaaagtctggatatta

SEQ ID NO: 62542 - DNA, 26 bp, Artificial sequence
  SiRNA target sequence
ttttaaatgcaaagtctggatattac

SEQ ID NO: 62543 - DNA, 26 bp, Artificial sequence
  SiRNA target sequence
tttaaatgcaaagtctggatattacg

SEQ ID NO: 62544 - DNA, 26 bp, Artificial sequence
  SiRNA target sequence
ttaaatgcaaagtctggatattacga

SEQ ID NO: 62545 - DNA, 26 bp, Artificial sequence
  SiRNA target sequence
taaatgcaaagtctggatattacgag

SEQ ID NO: 62546 - DNA, 26 bp, Artificial sequence
  SiRNA target sequence
aaatgcaaagtctggatattacgagt

SEQ ID NO: 62547 - DNA, 26 bp, Artificial sequence
  SiRNA target sequence
aatgcaaagtctggatattacgagtt

SEQ ID NO: 62548 - DNA, 26 bp, Artificial sequence
  SiRNA target sequence
atgcaaagtctggatattacgagttt

SEQ ID NO: 62549 - DNA, 26 bp, Artificial sequence
  SiRNA target sequence
tgcaaagtctggatattacgagttta

SEQ ID NO: 62550 - DNA, 26 bp, Artificial sequence
  SiRNA target sequence
gcaaagtctggatattacgagtttaa

SEQ ID NO: 62551 - DNA, 26 bp, Artificial sequence
  SiRNA target sequence
caaagtctggatattacgagtttaaa

SEQ ID NO: 62552 - DNA, 26 bp, Artificial sequence
  SiRNA target sequence
aaagtctggatattacgagtttaaag

SEQ ID NO: 62553 - DNA, 26 bp, Artificial sequence
  SiRNA target sequence
aagtctggatattacgagtttaaaga

SEQ ID NO: 62554 - DNA, 26 bp, Artificial sequence
  SiRNA target sequence
agtctggatattacgagtttaaagag

SEQ ID NO: 62555 - DNA, 26 bp, Artificial sequence
  SiRNA target sequence
gtctggatattacgagtttaaagagg

SEQ ID NO: 62556 - DNA, 26 bp, Artificial sequence
  SiRNA target sequence
tctggatattacgagtttaaagagga

SEQ ID NO: 62557 - DNA, 26 bp, Artificial sequence
  SiRNA target sequence
ctggatattacgagtttaaagaggat

SEQ ID NO: 62558 - DNA, 26 bp, Artificial sequence
  SiRNA target sequence
tggatattacgagtttaaagaggata

SEQ ID NO: 62559 - DNA, 26 bp, Artificial sequence
  SiRNA target sequence
ggatattacgagtttaaagaggatac

SEQ ID NO: 62560 - DNA, 26 bp, Artificial sequence
  SiRNA target sequence
gatattacgagtttaaagaggataca

SEQ ID NO: 62561 - DNA, 26 bp, Artificial sequence
  SiRNA target sequence
atattacgagtttaaagaggatacac

SEQ ID NO: 62562 - DNA, 26 bp, Artificial sequence
  SiRNA target sequence
tattacgagtttaaagaggatacaca

SEQ ID NO: 62563 - DNA, 26 bp, Artificial sequence
  SiRNA target sequence
attacgagtttaaagaggatacacaa

SEQ ID NO: 62564 - DNA, 26 bp, Artificial sequence
  SiRNA target sequence
ttacgagtttaaagaggatacacaaa

SEQ ID NO: 62565 - DNA, 26 bp, Artificial sequence
  SiRNA target sequence
tacgagtttaaagaggatacacaaac

SEQ ID NO: 62566 - DNA, 26 bp, Artificial sequence
  SiRNA target sequence
acgagtttaaagaggatacacaaact

SEQ ID NO: 62567 - DNA, 26 bp, Artificial sequence
  SiRNA target sequence
cgagtttaaagaggatacacaaactg

SEQ ID NO: 62568 - DNA, 26 bp, Artificial sequence
  SiRNA target sequence
gagtttaaagaggatacacaaactga

SEQ ID NO: 62569 - DNA, 26 bp, Artificial sequence
  SiRNA target sequence
agtttaaagaggatacacaaactgat

SEQ ID NO: 62570 - DNA, 26 bp, Artificial sequence
  SiRNA target sequence
gtttaaagaggatacacaaactgata

SEQ ID NO: 62571 - DNA, 26 bp, Artificial sequence
  SiRNA target sequence
tttaaagaggatacacaaactgataa

SEQ ID NO: 62572 - DNA, 26 bp, Artificial sequence
  SiRNA target sequence
ttaaagaggatacacaaactgataaa

SEQ ID NO: 62573 - DNA, 26 bp, Artificial sequence
  SiRNA target sequence
taaagaggatacacaaactgataaaa

SEQ ID NO: 62574 - DNA, 26 bp, Artificial sequence
  SiRNA target sequence
aaagaggatacacaaactgataaaat

SEQ ID NO: 62575 - DNA, 26 bp, Artificial sequence
  SiRNA target sequence
aagaggatacacaaactgataaaata

SEQ ID NO: 62576 - DNA, 26 bp, Artificial sequence
  SiRNA target sequence
agaggatacacaaactgataaaataa

SEQ ID NO: 62577 - DNA, 26 bp, Artificial sequence
  SiRNA target sequence
gaggatacacaaactgataaaataag

SEQ ID NO: 62578 - DNA, 26 bp, Artificial sequence
  SiRNA target sequence
aggatacacaaactgataaaataaga

SEQ ID NO: 62579 - DNA, 26 bp, Artificial sequence
  SiRNA target sequence
ggatacacaaactgataaaataagac

SEQ ID NO: 62580 - DNA, 26 bp, Artificial sequence
  SiRNA target sequence
gatacacaaactgataaaataagact

SEQ ID NO: 62581 - DNA, 26 bp, Artificial sequence
  SiRNA target sequence
atacacaaactgataaaataagactg

SEQ ID NO: 62582 - DNA, 26 bp, Artificial sequence
  SiRNA target sequence
tacacaaactgataaaataagactga

SEQ ID NO: 62583 - DNA, 26 bp, Artificial sequence
  SiRNA target sequence
acacaaactgataaaataagactgat

SEQ ID NO: 62584 - DNA, 26 bp, Artificial sequence
  SiRNA target sequence
cacaaactgataaaataagactgata

SEQ ID NO: 62585 - DNA, 26 bp, Artificial sequence
  SiRNA target sequence
acaaactgataaaataagactgatag

SEQ ID NO: 62586 - DNA, 26 bp, Artificial sequence
  SiRNA target sequence
caaactgataaaataagactgataga

SEQ ID NO: 62587 - DNA, 26 bp, Artificial sequence
  SiRNA target sequence
aaactgataaaataagactgatagat

SEQ ID NO: 62588 - DNA, 26 bp, Artificial sequence
  SiRNA target sequence
aactgataaaataagactgatagatt

SEQ ID NO: 62589 - DNA, 26 bp, Artificial sequence
  SiRNA target sequence
actgataaaataagactgatagattt

SEQ ID NO: 62590 - DNA, 26 bp, Artificial sequence
  SiRNA target sequence
ctgataaaataagactgatagatttt

SEQ ID NO: 62591 - DNA, 26 bp, Artificial sequence
  SiRNA target sequence
tgataaaataagactgatagatttta

SEQ ID NO: 62592 - DNA, 26 bp, Artificial sequence
  SiRNA target sequence
gataaaataagactgatagattttaa

SEQ ID NO: 62593 - DNA, 26 bp, Artificial sequence
  SiRNA target sequence
ataaaataagactgatagattttaat

SEQ ID NO: 62594 - DNA, 26 bp, Artificial sequence
  SiRNA target sequence
taaaataagactgatagattttaatg

SEQ ID NO: 62595 - DNA, 26 bp, Artificial sequence
  SiRNA target sequence
aaaataagactgatagattttaatga

SEQ ID NO: 62596 - DNA, 26 bp, Artificial sequence
  SiRNA target sequence
aaataagactgatagattttaatgaa

SEQ ID NO: 62597 - DNA, 26 bp, Artificial sequence
  SiRNA target sequence
aataagactgatagattttaatgaaa

SEQ ID NO: 62598 - DNA, 26 bp, Artificial sequence
  SiRNA target sequence
ataagactgatagattttaatgaaaa

SEQ ID NO: 62599 - DNA, 26 bp, Artificial sequence
  SiRNA target sequence
taagactgatagattttaatgaaaag

SEQ ID NO: 62600 - DNA, 26 bp, Artificial sequence
  SiRNA target sequence
aagactgatagattttaatgaaaagc

SEQ ID NO: 62601 - DNA, 26 bp, Artificial sequence
  SiRNA target sequence
agactgatagattttaatgaaaagct

SEQ ID NO: 62602 - DNA, 26 bp, Artificial sequence
  SiRNA target sequence
gactgatagattttaatgaaaagcta

SEQ ID NO: 62603 - DNA, 26 bp, Artificial sequence
  SiRNA target sequence
actgatagattttaatgaaaagctag

SEQ ID NO: 62604 - DNA, 26 bp, Artificial sequence
  SiRNA target sequence
ctgatagattttaatgaaaagctaga

SEQ ID NO: 62605 - DNA, 26 bp, Artificial sequence
  SiRNA target sequence
tgatagattttaatgaaaagctagaa

SEQ ID NO: 62606 - DNA, 26 bp, Artificial sequence
  SiRNA target sequence
gatagattttaatgaaaagctagaat

SEQ ID NO: 62607 - DNA, 26 bp, Artificial sequence
  SiRNA target sequence
atagattttaatgaaaagctagaatt

SEQ ID NO: 62608 - DNA, 26 bp, Artificial sequence
  SiRNA target sequence
tagattttaatgaaaagctagaattt

SEQ ID NO: 62609 - DNA, 26 bp, Artificial sequence
  SiRNA target sequence
agattttaatgaaaagctagaattta

SEQ ID NO: 62610 - DNA, 26 bp, Artificial sequence
  SiRNA target sequence
gattttaatgaaaagctagaatttag

SEQ ID NO: 62611 - DNA, 26 bp, Artificial sequence
  SiRNA target sequence
attttaatgaaaagctagaatttaga

SEQ ID NO: 62612 - DNA, 26 bp, Artificial sequence
  SiRNA target sequence
ttttaatgaaaagctagaatttagaa

SEQ ID NO: 62613 - DNA, 26 bp, Artificial sequence
  SiRNA target sequence
tttaatgaaaagctagaatttagaaa

SEQ ID NO: 62614 - DNA, 26 bp, Artificial sequence
  SiRNA target sequence
ttaatgaaaagctagaatttagaaat

SEQ ID NO: 62615 - DNA, 26 bp, Artificial sequence
  SiRNA target sequence
taatgaaaagctagaatttagaaatg

SEQ ID NO: 62616 - DNA, 26 bp, Artificial sequence
  SiRNA target sequence
aatgaaaagctagaatttagaaatgt

SEQ ID NO: 62617 - DNA, 26 bp, Artificial sequence
  SiRNA target sequence
atgaaaagctagaatttagaaatgta

SEQ ID NO: 62618 - DNA, 26 bp, Artificial sequence
  SiRNA target sequence
tgaaaagctagaatttagaaatgtat

SEQ ID NO: 62619 - DNA, 26 bp, Artificial sequence
  SiRNA target sequence
gaaaagctagaatttagaaatgtatc

SEQ ID NO: 62620 - DNA, 26 bp, Artificial sequence
  SiRNA target sequence
aaaagctagaatttagaaatgtatct

SEQ ID NO: 62621 - DNA, 26 bp, Artificial sequence
  SiRNA target sequence
aaagctagaatttagaaatgtatctt

SEQ ID NO: 62622 - DNA, 26 bp, Artificial sequence
  SiRNA target sequence
aagctagaatttagaaatgtatcttt

SEQ ID NO: 62623 - DNA, 26 bp, Artificial sequence
  SiRNA target sequence
agctagaatttagaaatgtatctttt

SEQ ID NO: 62624 - DNA, 26 bp, Artificial sequence
  SiRNA target sequence
gctagaatttagaaatgtatctttta

SEQ ID NO: 62625 - DNA, 26 bp, Artificial sequence
  SiRNA target sequence
ctagaatttagaaatgtatcttttag

SEQ ID NO: 62626 - DNA, 26 bp, Artificial sequence
  SiRNA target sequence
tagaatttagaaatgtatcttttagt

SEQ ID NO: 62627 - DNA, 26 bp, Artificial sequence
  SiRNA target sequence
agaatttagaaatgtatcttttagtt

SEQ ID NO: 62628 - DNA, 26 bp, Artificial sequence
  SiRNA target sequence
gaatttagaaatgtatcttttagtta

SEQ ID NO: 62629 - DNA, 26 bp, Artificial sequence
  SiRNA target sequence
aatttagaaatgtatcttttagttat

SEQ ID NO: 62630 - DNA, 26 bp, Artificial sequence
  SiRNA target sequence
atttagaaatgtatcttttagttatt

SEQ ID NO: 62631 - DNA, 26 bp, Artificial sequence
  SiRNA target sequence
tttagaaatgtatcttttagttattt

SEQ ID NO: 62632 - DNA, 26 bp, Artificial sequence
  SiRNA target sequence
ttagaaatgtatcttttagttattta

SEQ ID NO: 62633 - DNA, 26 bp, Artificial sequence
  SiRNA target sequence
tagaaatgtatcttttagttatttaa

SEQ ID NO: 62634 - DNA, 26 bp, Artificial sequence
  SiRNA target sequence
agaaatgtatcttttagttatttaaa

SEQ ID NO: 62635 - DNA, 26 bp, Artificial sequence
  SiRNA target sequence
gaaatgtatcttttagttatttaaat

SEQ ID NO: 62636 - DNA, 26 bp, Artificial sequence
  SiRNA target sequence
aaatgtatcttttagttatttaaata

SEQ ID NO: 62637 - DNA, 26 bp, Artificial sequence
  SiRNA target sequence
aatgtatcttttagttatttaaataa

SEQ ID NO: 62638 - DNA, 26 bp, Artificial sequence
  SiRNA target sequence
atgtatcttttagttatttaaataag

SEQ ID NO: 62639 - DNA, 26 bp, Artificial sequence
  SiRNA target sequence
tgtatcttttagttatttaaataagc

SEQ ID NO: 62640 - DNA, 26 bp, Artificial sequence
  SiRNA target sequence
gtatcttttagttatttaaataagcc

SEQ ID NO: 62641 - DNA, 26 bp, Artificial sequence
  SiRNA target sequence
tatcttttagttatttaaataagcct

SEQ ID NO: 62642 - DNA, 26 bp, Artificial sequence
  SiRNA target sequence
atcttttagttatttaaataagccta

SEQ ID NO: 62643 - DNA, 26 bp, Artificial sequence
  SiRNA target sequence
tcttttagttatttaaataagcctat

SEQ ID NO: 62644 - DNA, 26 bp, Artificial sequence
  SiRNA target sequence
cttttagttatttaaataagcctatt

SEQ ID NO: 62645 - DNA, 26 bp, Artificial sequence
  SiRNA target sequence
ttttagttatttaaataagcctattt

SEQ ID NO: 62646 - DNA, 26 bp, Artificial sequence
  SiRNA target sequence
tttagttatttaaataagcctatttt

SEQ ID NO: 62647 - DNA, 26 bp, Artificial sequence
  SiRNA target sequence
ttagttatttaaataagcctatttta

SEQ ID NO: 62648 - DNA, 26 bp, Artificial sequence
  SiRNA target sequence
tagttatttaaataagcctattttag

SEQ ID NO: 62649 - DNA, 26 bp, Artificial sequence
  SiRNA target sequence
agttatttaaataagcctattttagt

SEQ ID NO: 62650 - DNA, 26 bp, Artificial sequence
  SiRNA target sequence
gttatttaaataagcctattttagtg

SEQ ID NO: 62651 - DNA, 26 bp, Artificial sequence
  SiRNA target sequence
ttatttaaataagcctattttagtga

SEQ ID NO: 62652 - DNA, 26 bp, Artificial sequence
  SiRNA target sequence
tatttaaataagcctattttagtgaa

SEQ ID NO: 62653 - DNA, 26 bp, Artificial sequence
  SiRNA target sequence
atttaaataagcctattttagtgaat

SEQ ID NO: 62654 - DNA, 26 bp, Artificial sequence
  SiRNA target sequence
tttaaataagcctattttagtgaatg

SEQ ID NO: 62655 - DNA, 26 bp, Artificial sequence
  SiRNA target sequence
ttaaataagcctattttagtgaatgc

SEQ ID NO: 62656 - DNA, 26 bp, Artificial sequence
  SiRNA target sequence
taaataagcctattttagtgaatgct

SEQ ID NO: 62657 - DNA, 26 bp, Artificial sequence
  SiRNA target sequence
aaataagcctattttagtgaatgcta

SEQ ID NO: 62658 - DNA, 26 bp, Artificial sequence
  SiRNA target sequence
aataagcctattttagtgaatgctaa

SEQ ID NO: 62659 - DNA, 26 bp, Artificial sequence
  SiRNA target sequence
ataagcctattttagtgaatgctaat

SEQ ID NO: 62660 - DNA, 26 bp, Artificial sequence
  SiRNA target sequence
taagcctattttagtgaatgctaatt

SEQ ID NO: 62661 - DNA, 26 bp, Artificial sequence
  SiRNA target sequence
aagcctattttagtgaatgctaattt

SEQ ID NO: 62662 - DNA, 26 bp, Artificial sequence
  SiRNA target sequence
agcctattttagtgaatgctaatttc

SEQ ID NO: 62663 - DNA, 26 bp, Artificial sequence
  SiRNA target sequence
gcctattttagtgaatgctaatttcg

SEQ ID NO: 62664 - DNA, 26 bp, Artificial sequence
  SiRNA target sequence
cctattttagtgaatgctaatttcgt

SEQ ID NO: 62665 - DNA, 26 bp, Artificial sequence
  SiRNA target sequence
ctattttagtgaatgctaatttcgtt

SEQ ID NO: 62666 - DNA, 26 bp, Artificial sequence
  SiRNA target sequence
tattttagtgaatgctaatttcgtta

SEQ ID NO: 62667 - DNA, 26 bp, Artificial sequence
  SiRNA target sequence
attttagtgaatgctaatttcgttat

SEQ ID NO: 62668 - DNA, 26 bp, Artificial sequence
  SiRNA target sequence
ttttagtgaatgctaatttcgttatt

SEQ ID NO: 62669 - DNA, 26 bp, Artificial sequence
  SiRNA target sequence
tttagtgaatgctaatttcgttatta

SEQ ID NO: 62670 - DNA, 26 bp, Artificial sequence
  SiRNA target sequence
ttagtgaatgctaatttcgttattaa

SEQ ID NO: 62671 - DNA, 26 bp, Artificial sequence
  SiRNA target sequence
tagtgaatgctaatttcgttattaat

SEQ ID NO: 62672 - DNA, 26 bp, Artificial sequence
  SiRNA target sequence
agtgaatgctaatttcgttattaata

SEQ ID NO: 62673 - DNA, 26 bp, Artificial sequence
  SiRNA target sequence
gtgaatgctaatttcgttattaataa

SEQ ID NO: 62674 - DNA, 26 bp, Artificial sequence
  SiRNA target sequence
tgaatgctaatttcgttattaataaa

SEQ ID NO: 62675 - DNA, 26 bp, Artificial sequence
  SiRNA target sequence
gaatgctaatttcgttattaataaag

SEQ ID NO: 62676 - DNA, 26 bp, Artificial sequence
  SiRNA target sequence
aatgctaatttcgttattaataaagg

SEQ ID NO: 62677 - DNA, 26 bp, Artificial sequence
  SiRNA target sequence
atgctaatttcgttattaataaaggg

SEQ ID NO: 62678 - DNA, 26 bp, Artificial sequence
  SiRNA target sequence
tgctaatttcgttattaataaagggg

SEQ ID NO: 62679 - DNA, 26 bp, Artificial sequence
  SiRNA target sequence
gctaatttcgttattaataaagggga

SEQ ID NO: 62680 - DNA, 26 bp, Artificial sequence
  SiRNA target sequence
ctaatttcgttattaataaaggggag

SEQ ID NO: 62681 - DNA, 26 bp, Artificial sequence
  SiRNA target sequence
taatttcgttattaataaaggggagc

SEQ ID NO: 62682 - DNA, 26 bp, Artificial sequence
  SiRNA target sequence
aatttcgttattaataaaggggagcg

SEQ ID NO: 62683 - DNA, 26 bp, Artificial sequence
  SiRNA target sequence
atttcgttattaataaaggggagcgt

SEQ ID NO: 62684 - DNA, 26 bp, Artificial sequence
  SiRNA target sequence
tttcgttattaataaaggggagcgtg

SEQ ID NO: 62685 - DNA, 26 bp, Artificial sequence
  SiRNA target sequence
ttcgttattaataaaggggagcgtgt

SEQ ID NO: 62686 - DNA, 26 bp, Artificial sequence
  SiRNA target sequence
tcgttattaataaaggggagcgtgtt

SEQ ID NO: 62687 - DNA, 26 bp, Artificial sequence
  SiRNA target sequence
cgttattaataaaggggagcgtgttg

SEQ ID NO: 62688 - DNA, 26 bp, Artificial sequence
  SiRNA target sequence
gttattaataaaggggagcgtgttgc

SEQ ID NO: 62689 - DNA, 26 bp, Artificial sequence
  SiRNA target sequence
ttattaataaaggggagcgtgttgct

SEQ ID NO: 62690 - DNA, 26 bp, Artificial sequence
  SiRNA target sequence
tattaataaaggggagcgtgttgcta

SEQ ID NO: 62691 - DNA, 26 bp, Artificial sequence
  SiRNA target sequence
attaataaaggggagcgtgttgctat

SEQ ID NO: 62692 - DNA, 26 bp, Artificial sequence
  SiRNA target sequence
ttaataaaggggagcgtgttgctatt

SEQ ID NO: 62693 - DNA, 26 bp, Artificial sequence
  SiRNA target sequence
taataaaggggagcgtgttgctatta

SEQ ID NO: 62694 - DNA, 26 bp, Artificial sequence
  SiRNA target sequence
aataaaggggagcgtgttgctattat

SEQ ID NO: 62695 - DNA, 26 bp, Artificial sequence
  SiRNA target sequence
ataaaggggagcgtgttgctattata

SEQ ID NO: 62696 - DNA, 26 bp, Artificial sequence
  SiRNA target sequence
taaaggggagcgtgttgctattatag

SEQ ID NO: 62697 - DNA, 26 bp, Artificial sequence
  SiRNA target sequence
aaaggggagcgtgttgctattatagg

SEQ ID NO: 62698 - DNA, 26 bp, Artificial sequence
  SiRNA target sequence
aaggggagcgtgttgctattatagga

SEQ ID NO: 62699 - DNA, 26 bp, Artificial sequence
  SiRNA target sequence
aggggagcgtgttgctattataggaa

SEQ ID NO: 62700 - DNA, 26 bp, Artificial sequence
  SiRNA target sequence
ggggagcgtgttgctattataggaaa

SEQ ID NO: 62701 - DNA, 26 bp, Artificial sequence
  SiRNA target sequence
gggagcgtgttgctattataggaaaa

SEQ ID NO: 62702 - DNA, 26 bp, Artificial sequence
  SiRNA target sequence
ggagcgtgttgctattataggaaaaa

SEQ ID NO: 62703 - DNA, 26 bp, Artificial sequence
  SiRNA target sequence
gagcgtgttgctattataggaaaaaa

SEQ ID NO: 62704 - DNA, 26 bp, Artificial sequence
  SiRNA target sequence
agcgtgttgctattataggaaaaaat

SEQ ID NO: 62705 - DNA, 26 bp, Artificial sequence
  SiRNA target sequence
gcgtgttgctattataggaaaaaatg

SEQ ID NO: 62706 - DNA, 26 bp, Artificial sequence
  SiRNA target sequence
cgtgttgctattataggaaaaaatgg

SEQ ID NO: 62707 - DNA, 26 bp, Artificial sequence
  SiRNA target sequence
gtgttgctattataggaaaaaatgga

SEQ ID NO: 62708 - DNA, 26 bp, Artificial sequence
  SiRNA target sequence
tgttgctattataggaaaaaatggaa

SEQ ID NO: 62709 - DNA, 26 bp, Artificial sequence
  SiRNA target sequence
gttgctattataggaaaaaatggaac

SEQ ID NO: 62710 - DNA, 26 bp, Artificial sequence
  SiRNA target sequence
ttgctattataggaaaaaatggaaca

SEQ ID NO: 62711 - DNA, 26 bp, Artificial sequence
  SiRNA target sequence
tgctattataggaaaaaatggaacag

SEQ ID NO: 62712 - DNA, 26 bp, Artificial sequence
  SiRNA target sequence
gctattataggaaaaaatggaacagg

SEQ ID NO: 62713 - DNA, 26 bp, Artificial sequence
  SiRNA target sequence
ctattataggaaaaaatggaacaggt

SEQ ID NO: 62714 - DNA, 26 bp, Artificial sequence
  SiRNA target sequence
tattataggaaaaaatggaacaggta

SEQ ID NO: 62715 - DNA, 26 bp, Artificial sequence
  SiRNA target sequence
attataggaaaaaatggaacaggtaa

SEQ ID NO: 62716 - DNA, 26 bp, Artificial sequence
  SiRNA target sequence
ttataggaaaaaatggaacaggtaaa

SEQ ID NO: 62717 - DNA, 26 bp, Artificial sequence
  SiRNA target sequence
tataggaaaaaatggaacaggtaaaa

SEQ ID NO: 62718 - DNA, 26 bp, Artificial sequence
  SiRNA target sequence
ataggaaaaaatggaacaggtaaaag

SEQ ID NO: 62719 - DNA, 26 bp, Artificial sequence
  SiRNA target sequence
taggaaaaaatggaacaggtaaaagt

SEQ ID NO: 62720 - DNA, 26 bp, Artificial sequence
  SiRNA target sequence
aggaaaaaatggaacaggtaaaagta

SEQ ID NO: 62721 - DNA, 26 bp, Artificial sequence
  SiRNA target sequence
ggaaaaaatggaacaggtaaaagtac

SEQ ID NO: 62722 - DNA, 26 bp, Artificial sequence
  SiRNA target sequence
gaaaaaatggaacaggtaaaagtaca

SEQ ID NO: 62723 - DNA, 26 bp, Artificial sequence
  SiRNA target sequence
aaaaaatggaacaggtaaaagtacaa

SEQ ID NO: 62724 - DNA, 26 bp, Artificial sequence
  SiRNA target sequence
aaaaatggaacaggtaaaagtacaat

SEQ ID NO: 62725 - DNA, 26 bp, Artificial sequence
  SiRNA target sequence
aaaatggaacaggtaaaagtacaata

SEQ ID NO: 62726 - DNA, 26 bp, Artificial sequence
  SiRNA target sequence
aaatggaacaggtaaaagtacaataa

SEQ ID NO: 62727 - DNA, 26 bp, Artificial sequence
  SiRNA target sequence
aatggaacaggtaaaagtacaataat

SEQ ID NO: 62728 - DNA, 26 bp, Artificial sequence
  SiRNA target sequence
atggaacaggtaaaagtacaataata

SEQ ID NO: 62729 - DNA, 26 bp, Artificial sequence
  SiRNA target sequence
tggaacaggtaaaagtacaataataa

SEQ ID NO: 62730 - DNA, 26 bp, Artificial sequence
  SiRNA target sequence
ggaacaggtaaaagtacaataataaa

SEQ ID NO: 62731 - DNA, 26 bp, Artificial sequence
  SiRNA target sequence
gaacaggtaaaagtacaataataaaa

SEQ ID NO: 62732 - DNA, 26 bp, Artificial sequence
  SiRNA target sequence
aacaggtaaaagtacaataataaaat

SEQ ID NO: 62733 - DNA, 26 bp, Artificial sequence
  SiRNA target sequence
acaggtaaaagtacaataataaaatt

SEQ ID NO: 62734 - DNA, 26 bp, Artificial sequence
  SiRNA target sequence
caggtaaaagtacaataataaaattg

SEQ ID NO: 62735 - DNA, 26 bp, Artificial sequence
  SiRNA target sequence
aggtaaaagtacaataataaaattgt

SEQ ID NO: 62736 - DNA, 26 bp, Artificial sequence
  SiRNA target sequence
ggtaaaagtacaataataaaattgtt

SEQ ID NO: 62737 - DNA, 26 bp, Artificial sequence
  SiRNA target sequence
gtaaaagtacaataataaaattgtta

SEQ ID NO: 62738 - DNA, 26 bp, Artificial sequence
  SiRNA target sequence
taaaagtacaataataaaattgttaa

SEQ ID NO: 62739 - DNA, 26 bp, Artificial sequence
  SiRNA target sequence
aaaagtacaataataaaattgttaat

SEQ ID NO: 62740 - DNA, 26 bp, Artificial sequence
  SiRNA target sequence
aaagtacaataataaaattgttaatg

SEQ ID NO: 62741 - DNA, 26 bp, Artificial sequence
  SiRNA target sequence
aagtacaataataaaattgttaatga

SEQ ID NO: 62742 - DNA, 26 bp, Artificial sequence
  SiRNA target sequence
agtacaataataaaattgttaatgaa

SEQ ID NO: 62743 - DNA, 26 bp, Artificial sequence
  SiRNA target sequence
gtacaataataaaattgttaatgaaa

SEQ ID NO: 62744 - DNA, 26 bp, Artificial sequence
  SiRNA target sequence
tacaataataaaattgttaatgaaat

SEQ ID NO: 62745 - DNA, 26 bp, Artificial sequence
  SiRNA target sequence
acaataataaaattgttaatgaaatt

SEQ ID NO: 62746 - DNA, 26 bp, Artificial sequence
  SiRNA target sequence
caataataaaattgttaatgaaattt

SEQ ID NO: 62747 - DNA, 26 bp, Artificial sequence
  SiRNA target sequence
aataataaaattgttaatgaaatttt

SEQ ID NO: 62748 - DNA, 26 bp, Artificial sequence
  SiRNA target sequence
ataataaaattgttaatgaaatttta

SEQ ID NO: 62749 - DNA, 26 bp, Artificial sequence
  SiRNA target sequence
taataaaattgttaatgaaattttat

SEQ ID NO: 62750 - DNA, 26 bp, Artificial sequence
  SiRNA target sequence
aataaaattgttaatgaaattttata

SEQ ID NO: 62751 - DNA, 26 bp, Artificial sequence
  SiRNA target sequence
ataaaattgttaatgaaattttataa

SEQ ID NO: 62752 - DNA, 26 bp, Artificial sequence
  SiRNA target sequence
taaaattgttaatgaaattttataaa

SEQ ID NO: 62753 - DNA, 26 bp, Artificial sequence
  SiRNA target sequence
aaaattgttaatgaaattttataaat

SEQ ID NO: 62754 - DNA, 26 bp, Artificial sequence
  SiRNA target sequence
aaattgttaatgaaattttataaata

SEQ ID NO: 62755 - DNA, 26 bp, Artificial sequence
  SiRNA target sequence
aattgttaatgaaattttataaatat

SEQ ID NO: 62756 - DNA, 26 bp, Artificial sequence
  SiRNA target sequence
attgttaatgaaattttataaatatg

SEQ ID NO: 62757 - DNA, 26 bp, Artificial sequence
  SiRNA target sequence
ttgttaatgaaattttataaatatga

SEQ ID NO: 62758 - DNA, 26 bp, Artificial sequence
  SiRNA target sequence
tgttaatgaaattttataaatatgat

SEQ ID NO: 62759 - DNA, 26 bp, Artificial sequence
  SiRNA target sequence
gttaatgaaattttataaatatgatg

SEQ ID NO: 62760 - DNA, 26 bp, Artificial sequence
  SiRNA target sequence
ttaatgaaattttataaatatgatgg

SEQ ID NO: 62761 - DNA, 26 bp, Artificial sequence
  SiRNA target sequence
taatgaaattttataaatatgatgga

SEQ ID NO: 62762 - DNA, 26 bp, Artificial sequence
  SiRNA target sequence
aatgaaattttataaatatgatggag

SEQ ID NO: 62763 - DNA, 26 bp, Artificial sequence
  SiRNA target sequence
atgaaattttataaatatgatggaga

SEQ ID NO: 62764 - DNA, 26 bp, Artificial sequence
  SiRNA target sequence
tgaaattttataaatatgatggagat

SEQ ID NO: 62765 - DNA, 26 bp, Artificial sequence
  SiRNA target sequence
gaaattttataaatatgatggagata

SEQ ID NO: 62766 - DNA, 26 bp, Artificial sequence
  SiRNA target sequence
aaattttataaatatgatggagatat

SEQ ID NO: 62767 - DNA, 26 bp, Artificial sequence
  SiRNA target sequence
aattttataaatatgatggagatata

SEQ ID NO: 62768 - DNA, 26 bp, Artificial sequence
  SiRNA target sequence
attttataaatatgatggagatatat

SEQ ID NO: 62769 - DNA, 26 bp, Artificial sequence
  SiRNA target sequence
ttttataaatatgatggagatatatt

SEQ ID NO: 62770 - DNA, 26 bp, Artificial sequence
  SiRNA target sequence
tttataaatatgatggagatatatta

SEQ ID NO: 62771 - DNA, 26 bp, Artificial sequence
  SiRNA target sequence
ttataaatatgatggagatatattaa

SEQ ID NO: 62772 - DNA, 26 bp, Artificial sequence
  SiRNA target sequence
tataaatatgatggagatatattaat

SEQ ID NO: 62773 - DNA, 26 bp, Artificial sequence
  SiRNA target sequence
ataaatatgatggagatatattaatt

SEQ ID NO: 62774 - DNA, 26 bp, Artificial sequence
  SiRNA target sequence
taaatatgatggagatatattaattg

SEQ ID NO: 62775 - DNA, 26 bp, Artificial sequence
  SiRNA target sequence
aaatatgatggagatatattaattga

SEQ ID NO: 62776 - DNA, 26 bp, Artificial sequence
  SiRNA target sequence
aatatgatggagatatattaattgat

SEQ ID NO: 62777 - DNA, 26 bp, Artificial sequence
  SiRNA target sequence
atatgatggagatatattaattgatg

SEQ ID NO: 62778 - DNA, 26 bp, Artificial sequence
  SiRNA target sequence
tatgatggagatatattaattgatga

SEQ ID NO: 62779 - DNA, 26 bp, Artificial sequence
  SiRNA target sequence
atgatggagatatattaattgatgat

SEQ ID NO: 62780 - DNA, 26 bp, Artificial sequence
  SiRNA target sequence
tgatggagatatattaattgatgata

SEQ ID NO: 62781 - DNA, 26 bp, Artificial sequence
  SiRNA target sequence
gatggagatatattaattgatgatac

SEQ ID NO: 62782 - DNA, 26 bp, Artificial sequence
  SiRNA target sequence
atggagatatattaattgatgataca

SEQ ID NO: 62783 - DNA, 26 bp, Artificial sequence
  SiRNA target sequence
tggagatatattaattgatgatacag

SEQ ID NO: 62784 - DNA, 26 bp, Artificial sequence
  SiRNA target sequence
ggagatatattaattgatgatacaga

SEQ ID NO: 62785 - DNA, 26 bp, Artificial sequence
  SiRNA target sequence
gagatatattaattgatgatacagaa

SEQ ID NO: 62786 - DNA, 26 bp, Artificial sequence
  SiRNA target sequence
agatatattaattgatgatacagaaa

SEQ ID NO: 62787 - DNA, 26 bp, Artificial sequence
  SiRNA target sequence
gatatattaattgatgatacagaaat

SEQ ID NO: 62788 - DNA, 26 bp, Artificial sequence
  SiRNA target sequence
atatattaattgatgatacagaaata

SEQ ID NO: 62789 - DNA, 26 bp, Artificial sequence
  SiRNA target sequence
tatattaattgatgatacagaaatag

SEQ ID NO: 62790 - DNA, 26 bp, Artificial sequence
  SiRNA target sequence
atattaattgatgatacagaaataga

SEQ ID NO: 62791 - DNA, 26 bp, Artificial sequence
  SiRNA target sequence
tattaattgatgatacagaaatagat

SEQ ID NO: 62792 - DNA, 26 bp, Artificial sequence
  SiRNA target sequence
attaattgatgatacagaaatagata

SEQ ID NO: 62793 - DNA, 26 bp, Artificial sequence
  SiRNA target sequence
ttaattgatgatacagaaatagataa

SEQ ID NO: 62794 - DNA, 26 bp, Artificial sequence
  SiRNA target sequence
taattgatgatacagaaatagataat

SEQ ID NO: 62795 - DNA, 26 bp, Artificial sequence
  SiRNA target sequence
aattgatgatacagaaatagataata

SEQ ID NO: 62796 - DNA, 26 bp, Artificial sequence
  SiRNA target sequence
attgatgatacagaaatagataatat

SEQ ID NO: 62797 - DNA, 26 bp, Artificial sequence
  SiRNA target sequence
ttgatgatacagaaatagataatatt

SEQ ID NO: 62798 - DNA, 26 bp, Artificial sequence
  SiRNA target sequence
tgatgatacagaaatagataatattt

SEQ ID NO: 62799 - DNA, 26 bp, Artificial sequence
  SiRNA target sequence
gatgatacagaaatagataatatttc

SEQ ID NO: 62800 - DNA, 26 bp, Artificial sequence
  SiRNA target sequence
atgatacagaaatagataatatttcg

SEQ ID NO: 62801 - DNA, 26 bp, Artificial sequence
  SiRNA target sequence
tgatacagaaatagataatatttcgg

SEQ ID NO: 62802 - DNA, 26 bp, Artificial sequence
  SiRNA target sequence
gatacagaaatagataatatttcgga

SEQ ID NO: 62803 - DNA, 26 bp, Artificial sequence
  SiRNA target sequence
atacagaaatagataatatttcggat

SEQ ID NO: 62804 - DNA, 26 bp, Artificial sequence
  SiRNA target sequence
tacagaaatagataatatttcggata

SEQ ID NO: 62805 - DNA, 26 bp, Artificial sequence
  SiRNA target sequence
acagaaatagataatatttcggatag

SEQ ID NO: 62806 - DNA, 26 bp, Artificial sequence
  SiRNA target sequence
cagaaatagataatatttcggataga

SEQ ID NO: 62807 - DNA, 26 bp, Artificial sequence
  SiRNA target sequence
agaaatagataatatttcggatagaa

SEQ ID NO: 62808 - DNA, 26 bp, Artificial sequence
  SiRNA target sequence
gaaatagataatatttcggatagaag

SEQ ID NO: 62809 - DNA, 26 bp, Artificial sequence
  SiRNA target sequence
aaatagataatatttcggatagaagt

SEQ ID NO: 62810 - DNA, 26 bp, Artificial sequence
  SiRNA target sequence
aatagataatatttcggatagaagtt

SEQ ID NO: 62811 - DNA, 26 bp, Artificial sequence
  SiRNA target sequence
atagataatatttcggatagaagtta

SEQ ID NO: 62812 - DNA, 26 bp, Artificial sequence
  SiRNA target sequence
tagataatatttcggatagaagttac

SEQ ID NO: 62813 - DNA, 26 bp, Artificial sequence
  SiRNA target sequence
agataatatttcggatagaagttaca

SEQ ID NO: 62814 - DNA, 26 bp, Artificial sequence
  SiRNA target sequence
gataatatttcggatagaagttacag

SEQ ID NO: 62815 - DNA, 26 bp, Artificial sequence
  SiRNA target sequence
ataatatttcggatagaagttacaga

SEQ ID NO: 62816 - DNA, 26 bp, Artificial sequence
  SiRNA target sequence
taatatttcggatagaagttacagaa

SEQ ID NO: 62817 - DNA, 26 bp, Artificial sequence
  SiRNA target sequence
aatatttcggatagaagttacagaag

SEQ ID NO: 62818 - DNA, 26 bp, Artificial sequence
  SiRNA target sequence
atatttcggatagaagttacagaagt

SEQ ID NO: 62819 - DNA, 26 bp, Artificial sequence
  SiRNA target sequence
tatttcggatagaagttacagaagtt

SEQ ID NO: 62820 - DNA, 26 bp, Artificial sequence
  SiRNA target sequence
atttcggatagaagttacagaagttt

SEQ ID NO: 62821 - DNA, 26 bp, Artificial sequence
  SiRNA target sequence
tttcggatagaagttacagaagttta

SEQ ID NO: 62822 - DNA, 26 bp, Artificial sequence
  SiRNA target sequence
ttcggatagaagttacagaagtttaa

SEQ ID NO: 62823 - DNA, 26 bp, Artificial sequence
  SiRNA target sequence
tcggatagaagttacagaagtttaat

SEQ ID NO: 62824 - DNA, 26 bp, Artificial sequence
  SiRNA target sequence
cggatagaagttacagaagtttaata

SEQ ID NO: 62825 - DNA, 26 bp, Artificial sequence
  SiRNA target sequence
ggatagaagttacagaagtttaatat

SEQ ID NO: 62826 - DNA, 26 bp, Artificial sequence
  SiRNA target sequence
gatagaagttacagaagtttaatatc

SEQ ID NO: 62827 - DNA, 26 bp, Artificial sequence
  SiRNA target sequence
atagaagttacagaagtttaatatca

SEQ ID NO: 62828 - DNA, 26 bp, Artificial sequence
  SiRNA target sequence
tagaagttacagaagtttaatatcat

SEQ ID NO: 62829 - DNA, 26 bp, Artificial sequence
  SiRNA target sequence
agaagttacagaagtttaatatcata

SEQ ID NO: 62830 - DNA, 26 bp, Artificial sequence
  SiRNA target sequence
gaagttacagaagtttaatatcatat

SEQ ID NO: 62831 - DNA, 26 bp, Artificial sequence
  SiRNA target sequence
aagttacagaagtttaatatcatatg

SEQ ID NO: 62832 - DNA, 26 bp, Artificial sequence
  SiRNA target sequence
agttacagaagtttaatatcatatgc

SEQ ID NO: 62833 - DNA, 26 bp, Artificial sequence
  SiRNA target sequence
gttacagaagtttaatatcatatgca

SEQ ID NO: 62834 - DNA, 26 bp, Artificial sequence
  SiRNA target sequence
ttacagaagtttaatatcatatgcaa

SEQ ID NO: 62835 - DNA, 26 bp, Artificial sequence
  SiRNA target sequence
tacagaagtttaatatcatatgcaac

SEQ ID NO: 62836 - DNA, 26 bp, Artificial sequence
  SiRNA target sequence
acagaagtttaatatcatatgcaaca

SEQ ID NO: 62837 - DNA, 26 bp, Artificial sequence
  SiRNA target sequence
cagaagtttaatatcatatgcaacac

SEQ ID NO: 62838 - DNA, 26 bp, Artificial sequence
  SiRNA target sequence
agaagtttaatatcatatgcaacaca

SEQ ID NO: 62839 - DNA, 26 bp, Artificial sequence
  SiRNA target sequence
gaagtttaatatcatatgcaacacaa

SEQ ID NO: 62840 - DNA, 26 bp, Artificial sequence
  SiRNA target sequence
aagtttaatatcatatgcaacacaaa

SEQ ID NO: 62841 - DNA, 26 bp, Artificial sequence
  SiRNA target sequence
agtttaatatcatatgcaacacaaaa

SEQ ID NO: 62842 - DNA, 26 bp, Artificial sequence
  SiRNA target sequence
gtttaatatcatatgcaacacaaaac

SEQ ID NO: 62843 - DNA, 26 bp, Artificial sequence
  SiRNA target sequence
tttaatatcatatgcaacacaaaaca

SEQ ID NO: 62844 - DNA, 26 bp, Artificial sequence
  SiRNA target sequence
ttaatatcatatgcaacacaaaacac

SEQ ID NO: 62845 - DNA, 26 bp, Artificial sequence
  SiRNA target sequence
taatatcatatgcaacacaaaacacg

SEQ ID NO: 62846 - DNA, 26 bp, Artificial sequence
  SiRNA target sequence
aatatcatatgcaacacaaaacacgt

SEQ ID NO: 62847 - DNA, 26 bp, Artificial sequence
  SiRNA target sequence
atatcatatgcaacacaaaacacgtt

SEQ ID NO: 62848 - DNA, 26 bp, Artificial sequence
  SiRNA target sequence
tatcatatgcaacacaaaacacgttc

SEQ ID NO: 62849 - DNA, 26 bp, Artificial sequence
  SiRNA target sequence
atcatatgcaacacaaaacacgttct

SEQ ID NO: 62850 - DNA, 26 bp, Artificial sequence
  SiRNA target sequence
tcatatgcaacacaaaacacgttctt

SEQ ID NO: 62851 - DNA, 26 bp, Artificial sequence
  SiRNA target sequence
catatgcaacacaaaacacgttctta

SEQ ID NO: 62852 - DNA, 26 bp, Artificial sequence
  SiRNA target sequence
atatgcaacacaaaacacgttcttat

SEQ ID NO: 62853 - DNA, 26 bp, Artificial sequence
  SiRNA target sequence
tatgcaacacaaaacacgttcttatt

SEQ ID NO: 62854 - DNA, 26 bp, Artificial sequence
  SiRNA target sequence
atgcaacacaaaacacgttcttattc

SEQ ID NO: 62855 - DNA, 26 bp, Artificial sequence
  SiRNA target sequence
tgcaacacaaaacacgttcttattcg

SEQ ID NO: 62856 - DNA, 26 bp, Artificial sequence
  SiRNA target sequence
gcaacacaaaacacgttcttattcga

SEQ ID NO: 62857 - DNA, 26 bp, Artificial sequence
  SiRNA target sequence
caacacaaaacacgttcttattcgat

SEQ ID NO: 62858 - DNA, 26 bp, Artificial sequence
  SiRNA target sequence
aacacaaaacacgttcttattcgata

SEQ ID NO: 62859 - DNA, 26 bp, Artificial sequence
  SiRNA target sequence
acacaaaacacgttcttattcgataa

SEQ ID NO: 62860 - DNA, 26 bp, Artificial sequence
  SiRNA target sequence
cacaaaacacgttcttattcgataat

SEQ ID NO: 62861 - DNA, 26 bp, Artificial sequence
  SiRNA target sequence
acaaaacacgttcttattcgataata

SEQ ID NO: 62862 - DNA, 26 bp, Artificial sequence
  SiRNA target sequence
caaaacacgttcttattcgataatac

SEQ ID NO: 62863 - DNA, 26 bp, Artificial sequence
  SiRNA target sequence
aaaacacgttcttattcgataatact

SEQ ID NO: 62864 - DNA, 26 bp, Artificial sequence
  SiRNA target sequence
aaacacgttcttattcgataatactg

SEQ ID NO: 62865 - DNA, 26 bp, Artificial sequence
  SiRNA target sequence
aacacgttcttattcgataatactgt

SEQ ID NO: 62866 - DNA, 26 bp, Artificial sequence
  SiRNA target sequence
acacgttcttattcgataatactgtg

SEQ ID NO: 62867 - DNA, 26 bp, Artificial sequence
  SiRNA target sequence
cacgttcttattcgataatactgtga

SEQ ID NO: 62868 - DNA, 26 bp, Artificial sequence
  SiRNA target sequence
acgttcttattcgataatactgtgac

SEQ ID NO: 62869 - DNA, 26 bp, Artificial sequence
  SiRNA target sequence
cgttcttattcgataatactgtgaca

SEQ ID NO: 62870 - DNA, 26 bp, Artificial sequence
  SiRNA target sequence
gttcttattcgataatactgtgacat

SEQ ID NO: 62871 - DNA, 26 bp, Artificial sequence
  SiRNA target sequence
ttcttattcgataatactgtgacata

SEQ ID NO: 62872 - DNA, 26 bp, Artificial sequence
  SiRNA target sequence
tcttattcgataatactgtgacatac

SEQ ID NO: 62873 - DNA, 26 bp, Artificial sequence
  SiRNA target sequence
cttattcgataatactgtgacataca

SEQ ID NO: 62874 - DNA, 26 bp, Artificial sequence
  SiRNA target sequence
ttattcgataatactgtgacatacaa

SEQ ID NO: 62875 - DNA, 26 bp, Artificial sequence
  SiRNA target sequence
tattcgataatactgtgacatacaat

SEQ ID NO: 62876 - DNA, 26 bp, Artificial sequence
  SiRNA target sequence
attcgataatactgtgacatacaata

SEQ ID NO: 62877 - DNA, 26 bp, Artificial sequence
  SiRNA target sequence
ttcgataatactgtgacatacaatat

SEQ ID NO: 62878 - DNA, 26 bp, Artificial sequence
  SiRNA target sequence
tcgataatactgtgacatacaatata

SEQ ID NO: 62879 - DNA, 26 bp, Artificial sequence
  SiRNA target sequence
cgataatactgtgacatacaatatat

SEQ ID NO: 62880 - DNA, 26 bp, Artificial sequence
  SiRNA target sequence
gataatactgtgacatacaatatatt

SEQ ID NO: 62881 - DNA, 26 bp, Artificial sequence
  SiRNA target sequence
ataatactgtgacatacaatatattt

SEQ ID NO: 62882 - DNA, 26 bp, Artificial sequence
  SiRNA target sequence
taatactgtgacatacaatatatttt

SEQ ID NO: 62883 - DNA, 26 bp, Artificial sequence
  SiRNA target sequence
aatactgtgacatacaatatatttta

SEQ ID NO: 62884 - DNA, 26 bp, Artificial sequence
  SiRNA target sequence
atactgtgacatacaatatattttac

SEQ ID NO: 62885 - DNA, 26 bp, Artificial sequence
  SiRNA target sequence
tactgtgacatacaatatattttacg

SEQ ID NO: 62886 - DNA, 26 bp, Artificial sequence
  SiRNA target sequence
actgtgacatacaatatattttacgg

SEQ ID NO: 62887 - DNA, 26 bp, Artificial sequence
  SiRNA target sequence
ctgtgacatacaatatattttacggg

SEQ ID NO: 62888 - DNA, 26 bp, Artificial sequence
  SiRNA target sequence
tgtgacatacaatatattttacggga

SEQ ID NO: 62889 - DNA, 26 bp, Artificial sequence
  SiRNA target sequence
gtgacatacaatatattttacgggac

SEQ ID NO: 62890 - DNA, 26 bp, Artificial sequence
  SiRNA target sequence
tgacatacaatatattttacgggact

SEQ ID NO: 62891 - DNA, 26 bp, Artificial sequence
  SiRNA target sequence
gacatacaatatattttacgggacta

SEQ ID NO: 62892 - DNA, 26 bp, Artificial sequence
  SiRNA target sequence
acatacaatatattttacgggactaa

SEQ ID NO: 62893 - DNA, 26 bp, Artificial sequence
  SiRNA target sequence
catacaatatattttacgggactaaa

SEQ ID NO: 62894 - DNA, 26 bp, Artificial sequence
  SiRNA target sequence
atacaatatattttacgggactaaaa

SEQ ID NO: 62895 - DNA, 26 bp, Artificial sequence
  SiRNA target sequence
tacaatatattttacgggactaaaaa

SEQ ID NO: 62896 - DNA, 26 bp, Artificial sequence
  SiRNA target sequence
acaatatattttacgggactaaaaac

SEQ ID NO: 62897 - DNA, 26 bp, Artificial sequence
  SiRNA target sequence
caatatattttacgggactaaaaacg

SEQ ID NO: 62898 - DNA, 26 bp, Artificial sequence
  SiRNA target sequence
aatatattttacgggactaaaaacgt

SEQ ID NO: 62899 - DNA, 26 bp, Artificial sequence
  SiRNA target sequence
atatattttacgggactaaaaacgta

SEQ ID NO: 62900 - DNA, 26 bp, Artificial sequence
  SiRNA target sequence
tatattttacgggactaaaaacgtaa

SEQ ID NO: 62901 - DNA, 26 bp, Artificial sequence
  SiRNA target sequence
atattttacgggactaaaaacgtaac

SEQ ID NO: 62902 - DNA, 26 bp, Artificial sequence
  SiRNA target sequence
tattttacgggactaaaaacgtaaca

SEQ ID NO: 62903 - DNA, 26 bp, Artificial sequence
  SiRNA target sequence
attttacgggactaaaaacgtaacag

SEQ ID NO: 62904 - DNA, 26 bp, Artificial sequence
  SiRNA target sequence
ttttacgggactaaaaacgtaacaga

SEQ ID NO: 62905 - DNA, 26 bp, Artificial sequence
  SiRNA target sequence
tttacgggactaaaaacgtaacagaa

SEQ ID NO: 62906 - DNA, 26 bp, Artificial sequence
  SiRNA target sequence
ttacgggactaaaaacgtaacagaaa

SEQ ID NO: 62907 - DNA, 26 bp, Artificial sequence
  SiRNA target sequence
tacgggactaaaaacgtaacagaaaa

SEQ ID NO: 62908 - DNA, 26 bp, Artificial sequence
  SiRNA target sequence
acgggactaaaaacgtaacagaaaaa

SEQ ID NO: 62909 - DNA, 26 bp, Artificial sequence
  SiRNA target sequence
cgggactaaaaacgtaacagaaaaag

SEQ ID NO: 62910 - DNA, 26 bp, Artificial sequence
  SiRNA target sequence
gggactaaaaacgtaacagaaaaaga

SEQ ID NO: 62911 - DNA, 26 bp, Artificial sequence
  SiRNA target sequence
ggactaaaaacgtaacagaaaaagaa

SEQ ID NO: 62912 - DNA, 26 bp, Artificial sequence
  SiRNA target sequence
gactaaaaacgtaacagaaaaagaag

SEQ ID NO: 62913 - DNA, 26 bp, Artificial sequence
  SiRNA target sequence
actaaaaacgtaacagaaaaagaagt

SEQ ID NO: 62914 - DNA, 26 bp, Artificial sequence
  SiRNA target sequence
ctaaaaacgtaacagaaaaagaagtt

SEQ ID NO: 62915 - DNA, 26 bp, Artificial sequence
  SiRNA target sequence
taaaaacgtaacagaaaaagaagttt

SEQ ID NO: 62916 - DNA, 26 bp, Artificial sequence
  SiRNA target sequence
aaaaacgtaacagaaaaagaagtttt

SEQ ID NO: 62917 - DNA, 26 bp, Artificial sequence
  SiRNA target sequence
aaaacgtaacagaaaaagaagtttta

SEQ ID NO: 62918 - DNA, 26 bp, Artificial sequence
  SiRNA target sequence
aaacgtaacagaaaaagaagttttag

SEQ ID NO: 62919 - DNA, 26 bp, Artificial sequence
  SiRNA target sequence
aacgtaacagaaaaagaagttttaga

SEQ ID NO: 62920 - DNA, 26 bp, Artificial sequence
  SiRNA target sequence
acgtaacagaaaaagaagttttagaa

SEQ ID NO: 62921 - DNA, 26 bp, Artificial sequence
  SiRNA target sequence
cgtaacagaaaaagaagttttagaat

SEQ ID NO: 62922 - DNA, 26 bp, Artificial sequence
  SiRNA target sequence
gtaacagaaaaagaagttttagaatt

SEQ ID NO: 62923 - DNA, 26 bp, Artificial sequence
  SiRNA target sequence
taacagaaaaagaagttttagaatta

SEQ ID NO: 62924 - DNA, 26 bp, Artificial sequence
  SiRNA target sequence
aacagaaaaagaagttttagaattag

SEQ ID NO: 62925 - DNA, 26 bp, Artificial sequence
  SiRNA target sequence
acagaaaaagaagttttagaattagc

SEQ ID NO: 62926 - DNA, 26 bp, Artificial sequence
  SiRNA target sequence
cagaaaaagaagttttagaattagcc

SEQ ID NO: 62927 - DNA, 26 bp, Artificial sequence
  SiRNA target sequence
agaaaaagaagttttagaattagcca

SEQ ID NO: 62928 - DNA, 26 bp, Artificial sequence
  SiRNA target sequence
gaaaaagaagttttagaattagccaa

SEQ ID NO: 62929 - DNA, 26 bp, Artificial sequence
  SiRNA target sequence
aaaaagaagttttagaattagccaaa

SEQ ID NO: 62930 - DNA, 26 bp, Artificial sequence
  SiRNA target sequence
aaaagaagttttagaattagccaaaa

SEQ ID NO: 62931 - DNA, 26 bp, Artificial sequence
  SiRNA target sequence
aaagaagttttagaattagccaaaaa

SEQ ID NO: 62932 - DNA, 26 bp, Artificial sequence
  SiRNA target sequence
aagaagttttagaattagccaaaaaa

SEQ ID NO: 62933 - DNA, 26 bp, Artificial sequence
  SiRNA target sequence
agaagttttagaattagccaaaaaaa

SEQ ID NO: 62934 - DNA, 26 bp, Artificial sequence
  SiRNA target sequence
gaagttttagaattagccaaaaaaat

SEQ ID NO: 62935 - DNA, 26 bp, Artificial sequence
  SiRNA target sequence
aagttttagaattagccaaaaaaata

SEQ ID NO: 62936 - DNA, 26 bp, Artificial sequence
  SiRNA target sequence
agttttagaattagccaaaaaaatag

SEQ ID NO: 62937 - DNA, 26 bp, Artificial sequence
  SiRNA target sequence
gttttagaattagccaaaaaaatagg

SEQ ID NO: 62938 - DNA, 26 bp, Artificial sequence
  SiRNA target sequence
ttttagaattagccaaaaaaataggt

SEQ ID NO: 62939 - DNA, 26 bp, Artificial sequence
  SiRNA target sequence
tttagaattagccaaaaaaataggtg

SEQ ID NO: 62940 - DNA, 26 bp, Artificial sequence
  SiRNA target sequence
ttagaattagccaaaaaaataggtgt

SEQ ID NO: 62941 - DNA, 26 bp, Artificial sequence
  SiRNA target sequence
tagaattagccaaaaaaataggtgta

SEQ ID NO: 62942 - DNA, 26 bp, Artificial sequence
  SiRNA target sequence
agaattagccaaaaaaataggtgtat

SEQ ID NO: 62943 - DNA, 26 bp, Artificial sequence
  SiRNA target sequence
gaattagccaaaaaaataggtgtatt

SEQ ID NO: 62944 - DNA, 26 bp, Artificial sequence
  SiRNA target sequence
aattagccaaaaaaataggtgtatta

SEQ ID NO: 62945 - DNA, 26 bp, Artificial sequence
  SiRNA target sequence
attagccaaaaaaataggtgtattag

SEQ ID NO: 62946 - DNA, 26 bp, Artificial sequence
  SiRNA target sequence
ttagccaaaaaaataggtgtattaga

SEQ ID NO: 62947 - DNA, 26 bp, Artificial sequence
  SiRNA target sequence
tagccaaaaaaataggtgtattagag

SEQ ID NO: 62948 - DNA, 26 bp, Artificial sequence
  SiRNA target sequence
agccaaaaaaataggtgtattagagt

SEQ ID NO: 62949 - DNA, 26 bp, Artificial sequence
  SiRNA target sequence
gccaaaaaaataggtgtattagagtc

SEQ ID NO: 62950 - DNA, 26 bp, Artificial sequence
  SiRNA target sequence
ccaaaaaaataggtgtattagagtct

SEQ ID NO: 62951 - DNA, 26 bp, Artificial sequence
  SiRNA target sequence
caaaaaaataggtgtattagagtcta

SEQ ID NO: 62952 - DNA, 26 bp, Artificial sequence
  SiRNA target sequence
aaaaaaataggtgtattagagtctat

SEQ ID NO: 62953 - DNA, 26 bp, Artificial sequence
  SiRNA target sequence
aaaaaataggtgtattagagtctata

SEQ ID NO: 62954 - DNA, 26 bp, Artificial sequence
  SiRNA target sequence
aaaaataggtgtattagagtctatac

SEQ ID NO: 62955 - DNA, 26 bp, Artificial sequence
  SiRNA target sequence
aaaataggtgtattagagtctataca

SEQ ID NO: 62956 - DNA, 26 bp, Artificial sequence
  SiRNA target sequence
aaataggtgtattagagtctatacag

SEQ ID NO: 62957 - DNA, 26 bp, Artificial sequence
  SiRNA target sequence
aataggtgtattagagtctatacagg

SEQ ID NO: 62958 - DNA, 26 bp, Artificial sequence
  SiRNA target sequence
ataggtgtattagagtctatacagga

SEQ ID NO: 62959 - DNA, 26 bp, Artificial sequence
  SiRNA target sequence
taggtgtattagagtctatacaggaa

SEQ ID NO: 62960 - DNA, 26 bp, Artificial sequence
  SiRNA target sequence
aggtgtattagagtctatacaggaat

SEQ ID NO: 62961 - DNA, 26 bp, Artificial sequence
  SiRNA target sequence
ggtgtattagagtctatacaggaatt

SEQ ID NO: 62962 - DNA, 26 bp, Artificial sequence
  SiRNA target sequence
gtgtattagagtctatacaggaattt

SEQ ID NO: 62963 - DNA, 26 bp, Artificial sequence
  SiRNA target sequence
tgtattagagtctatacaggaattta

SEQ ID NO: 62964 - DNA, 26 bp, Artificial sequence
  SiRNA target sequence
gtattagagtctatacaggaatttaa

SEQ ID NO: 62965 - DNA, 26 bp, Artificial sequence
  SiRNA target sequence
tattagagtctatacaggaatttaaa

SEQ ID NO: 62966 - DNA, 26 bp, Artificial sequence
  SiRNA target sequence
attagagtctatacaggaatttaaag

SEQ ID NO: 62967 - DNA, 26 bp, Artificial sequence
  SiRNA target sequence
ttagagtctatacaggaatttaaaga

SEQ ID NO: 62968 - DNA, 26 bp, Artificial sequence
  SiRNA target sequence
tagagtctatacaggaatttaaagat

SEQ ID NO: 62969 - DNA, 26 bp, Artificial sequence
  SiRNA target sequence
agagtctatacaggaatttaaagatg

SEQ ID NO: 62970 - DNA, 26 bp, Artificial sequence
  SiRNA target sequence
gagtctatacaggaatttaaagatgg

SEQ ID NO: 62971 - DNA, 26 bp, Artificial sequence
  SiRNA target sequence
agtctatacaggaatttaaagatggg

SEQ ID NO: 62972 - DNA, 26 bp, Artificial sequence
  SiRNA target sequence
gtctatacaggaatttaaagatgggt

SEQ ID NO: 62973 - DNA, 26 bp, Artificial sequence
  SiRNA target sequence
tctatacaggaatttaaagatgggtt

SEQ ID NO: 62974 - DNA, 26 bp, Artificial sequence
  SiRNA target sequence
ctatacaggaatttaaagatgggttt

SEQ ID NO: 62975 - DNA, 26 bp, Artificial sequence
  SiRNA target sequence
tatacaggaatttaaagatgggttta

SEQ ID NO: 62976 - DNA, 26 bp, Artificial sequence
  SiRNA target sequence
atacaggaatttaaagatgggtttag

SEQ ID NO: 62977 - DNA, 26 bp, Artificial sequence
  SiRNA target sequence
tacaggaatttaaagatgggtttagc

SEQ ID NO: 62978 - DNA, 26 bp, Artificial sequence
  SiRNA target sequence
acaggaatttaaagatgggtttagca

SEQ ID NO: 62979 - DNA, 26 bp, Artificial sequence
  SiRNA target sequence
caggaatttaaagatgggtttagcac

SEQ ID NO: 62980 - DNA, 26 bp, Artificial sequence
  SiRNA target sequence
aggaatttaaagatgggtttagcaca

SEQ ID NO: 62981 - DNA, 26 bp, Artificial sequence
  SiRNA target sequence
ggaatttaaagatgggtttagcacat

SEQ ID NO: 62982 - DNA, 26 bp, Artificial sequence
  SiRNA target sequence
gaatttaaagatgggtttagcacatc

SEQ ID NO: 62983 - DNA, 26 bp, Artificial sequence
  SiRNA target sequence
aatttaaagatgggtttagcacatcg

SEQ ID NO: 62984 - DNA, 26 bp, Artificial sequence
  SiRNA target sequence
atttaaagatgggtttagcacatcgg

SEQ ID NO: 62985 - DNA, 26 bp, Artificial sequence
  SiRNA target sequence
tttaaagatgggtttagcacatcggt

SEQ ID NO: 62986 - DNA, 26 bp, Artificial sequence
  SiRNA target sequence
ttaaagatgggtttagcacatcggtc

SEQ ID NO: 62987 - DNA, 26 bp, Artificial sequence
  SiRNA target sequence
taaagatgggtttagcacatcggtcg

SEQ ID NO: 62988 - DNA, 26 bp, Artificial sequence
  SiRNA target sequence
aaagatgggtttagcacatcggtcgg

SEQ ID NO: 62989 - DNA, 26 bp, Artificial sequence
  SiRNA target sequence
aagatgggtttagcacatcggtcggt

SEQ ID NO: 62990 - DNA, 26 bp, Artificial sequence
  SiRNA target sequence
agatgggtttagcacatcggtcggtg

SEQ ID NO: 62991 - DNA, 26 bp, Artificial sequence
  SiRNA target sequence
gatgggtttagcacatcggtcggtga

SEQ ID NO: 62992 - DNA, 26 bp, Artificial sequence
  SiRNA target sequence
atgggtttagcacatcggtcggtgaa

SEQ ID NO: 62993 - DNA, 26 bp, Artificial sequence
  SiRNA target sequence
tgggtttagcacatcggtcggtgaac

SEQ ID NO: 62994 - DNA, 26 bp, Artificial sequence
  SiRNA target sequence
gggtttagcacatcggtcggtgaacg

SEQ ID NO: 62995 - DNA, 26 bp, Artificial sequence
  SiRNA target sequence
ggtttagcacatcggtcggtgaacgc

SEQ ID NO: 62996 - DNA, 26 bp, Artificial sequence
  SiRNA target sequence
gtttagcacatcggtcggtgaacgcg

SEQ ID NO: 62997 - DNA, 26 bp, Artificial sequence
  SiRNA target sequence
tttagcacatcggtcggtgaacgcgg

SEQ ID NO: 62998 - DNA, 26 bp, Artificial sequence
  SiRNA target sequence
ttagcacatcggtcggtgaacgcgga

SEQ ID NO: 62999 - DNA, 26 bp, Artificial sequence
  SiRNA target sequence
tagcacatcggtcggtgaacgcggaa

SEQ ID NO: 63000 - DNA, 26 bp, Artificial sequence
  SiRNA target sequence
agcacatcggtcggtgaacgcggaag

SEQ ID NO: 63001 - DNA, 26 bp, Artificial sequence
  SiRNA target sequence
gcacatcggtcggtgaacgcggaaga

SEQ ID NO: 63002 - DNA, 26 bp, Artificial sequence
  SiRNA target sequence
cacatcggtcggtgaacgcggaagat

SEQ ID NO: 63003 - DNA, 26 bp, Artificial sequence
  SiRNA target sequence
acatcggtcggtgaacgcggaagatt

SEQ ID NO: 63004 - DNA, 26 bp, Artificial sequence
  SiRNA target sequence
catcggtcggtgaacgcggaagattt

SEQ ID NO: 63005 - DNA, 26 bp, Artificial sequence
  SiRNA target sequence
atcggtcggtgaacgcggaagatttt

SEQ ID NO: 63006 - DNA, 26 bp, Artificial sequence
  SiRNA target sequence
tcggtcggtgaacgcggaagattttt

SEQ ID NO: 63007 - DNA, 26 bp, Artificial sequence
  SiRNA target sequence
cggtcggtgaacgcggaagattttta

SEQ ID NO: 63008 - DNA, 26 bp, Artificial sequence
  SiRNA target sequence
ggtcggtgaacgcggaagatttttat

SEQ ID NO: 63009 - DNA, 26 bp, Artificial sequence
  SiRNA target sequence
gtcggtgaacgcggaagatttttatc

SEQ ID NO: 63010 - DNA, 26 bp, Artificial sequence
  SiRNA target sequence
tcggtgaacgcggaagatttttatct

SEQ ID NO: 63011 - DNA, 26 bp, Artificial sequence
  SiRNA target sequence
cggtgaacgcggaagatttttatctg

SEQ ID NO: 63012 - DNA, 26 bp, Artificial sequence
  SiRNA target sequence
ggtgaacgcggaagatttttatctgg

SEQ ID NO: 63013 - DNA, 26 bp, Artificial sequence
  SiRNA target sequence
gtgaacgcggaagatttttatctggt

SEQ ID NO: 63014 - DNA, 26 bp, Artificial sequence
  SiRNA target sequence
tgaacgcggaagatttttatctggtg

SEQ ID NO: 63015 - DNA, 26 bp, Artificial sequence
  SiRNA target sequence
gaacgcggaagatttttatctggtgg

SEQ ID NO: 63016 - DNA, 26 bp, Artificial sequence
  SiRNA target sequence
aacgcggaagatttttatctggtggt

SEQ ID NO: 63017 - DNA, 26 bp, Artificial sequence
  SiRNA target sequence
acgcggaagatttttatctggtggtg

SEQ ID NO: 63018 - DNA, 26 bp, Artificial sequence
  SiRNA target sequence
cgcggaagatttttatctggtggtga

SEQ ID NO: 63019 - DNA, 26 bp, Artificial sequence
  SiRNA target sequence
gcggaagatttttatctggtggtgaa

SEQ ID NO: 63020 - DNA, 26 bp, Artificial sequence
  SiRNA target sequence
cggaagatttttatctggtggtgaaa

SEQ ID NO: 63021 - DNA, 26 bp, Artificial sequence
  SiRNA target sequence
ggaagatttttatctggtggtgaaag

SEQ ID NO: 63022 - DNA, 26 bp, Artificial sequence
  SiRNA target sequence
gaagatttttatctggtggtgaaagg

SEQ ID NO: 63023 - DNA, 26 bp, Artificial sequence
  SiRNA target sequence
aagatttttatctggtggtgaaaggc

SEQ ID NO: 63024 - DNA, 26 bp, Artificial sequence
  SiRNA target sequence
agatttttatctggtggtgaaaggca

SEQ ID NO: 63025 - DNA, 26 bp, Artificial sequence
  SiRNA target sequence
gatttttatctggtggtgaaaggcaa

SEQ ID NO: 63026 - DNA, 26 bp, Artificial sequence
  SiRNA target sequence
atttttatctggtggtgaaaggcaaa

SEQ ID NO: 63027 - DNA, 26 bp, Artificial sequence
  SiRNA target sequence
tttttatctggtggtgaaaggcaaaa

SEQ ID NO: 63028 - DNA, 26 bp, Artificial sequence
  SiRNA target sequence
ttttatctggtggtgaaaggcaaaaa

SEQ ID NO: 63029 - DNA, 26 bp, Artificial sequence
  SiRNA target sequence
tttatctggtggtgaaaggcaaaaaa

SEQ ID NO: 63030 - DNA, 26 bp, Artificial sequence
  SiRNA target sequence
ttatctggtggtgaaaggcaaaaaat

SEQ ID NO: 63031 - DNA, 26 bp, Artificial sequence
  SiRNA target sequence
tatctggtggtgaaaggcaaaaaatt

SEQ ID NO: 63032 - DNA, 26 bp, Artificial sequence
  SiRNA target sequence
atctggtggtgaaaggcaaaaaatta

SEQ ID NO: 63033 - DNA, 26 bp, Artificial sequence
  SiRNA target sequence
tctggtggtgaaaggcaaaaaattat

SEQ ID NO: 63034 - DNA, 26 bp, Artificial sequence
  SiRNA target sequence
ctggtggtgaaaggcaaaaaattatg

SEQ ID NO: 63035 - DNA, 26 bp, Artificial sequence
  SiRNA target sequence
tggtggtgaaaggcaaaaaattatgc

SEQ ID NO: 63036 - DNA, 26 bp, Artificial sequence
  SiRNA target sequence
ggtggtgaaaggcaaaaaattatgct

SEQ ID NO: 63037 - DNA, 26 bp, Artificial sequence
  SiRNA target sequence
gtggtgaaaggcaaaaaattatgctg

SEQ ID NO: 63038 - DNA, 26 bp, Artificial sequence
  SiRNA target sequence
tggtgaaaggcaaaaaattatgctga

SEQ ID NO: 63039 - DNA, 26 bp, Artificial sequence
  SiRNA target sequence
ggtgaaaggcaaaaaattatgctgat

SEQ ID NO: 63040 - DNA, 26 bp, Artificial sequence
  SiRNA target sequence
gtgaaaggcaaaaaattatgctgatg

SEQ ID NO: 63041 - DNA, 26 bp, Artificial sequence
  SiRNA target sequence
tgaaaggcaaaaaattatgctgatgc

SEQ ID NO: 63042 - DNA, 26 bp, Artificial sequence
  SiRNA target sequence
gaaaggcaaaaaattatgctgatgcg

SEQ ID NO: 63043 - DNA, 26 bp, Artificial sequence
  SiRNA target sequence
aaaggcaaaaaattatgctgatgcgt

SEQ ID NO: 63044 - DNA, 26 bp, Artificial sequence
  SiRNA target sequence
aaggcaaaaaattatgctgatgcgtg

SEQ ID NO: 63045 - DNA, 26 bp, Artificial sequence
  SiRNA target sequence
aggcaaaaaattatgctgatgcgtgc

SEQ ID NO: 63046 - DNA, 26 bp, Artificial sequence
  SiRNA target sequence
ggcaaaaaattatgctgatgcgtgca

SEQ ID NO: 63047 - DNA, 26 bp, Artificial sequence
  SiRNA target sequence
gcaaaaaattatgctgatgcgtgcat

SEQ ID NO: 63048 - DNA, 26 bp, Artificial sequence
  SiRNA target sequence
caaaaaattatgctgatgcgtgcatt

SEQ ID NO: 63049 - DNA, 26 bp, Artificial sequence
  SiRNA target sequence
aaaaaattatgctgatgcgtgcattg

SEQ ID NO: 63050 - DNA, 26 bp, Artificial sequence
  SiRNA target sequence
aaaaattatgctgatgcgtgcattgc

SEQ ID NO: 63051 - DNA, 26 bp, Artificial sequence
  SiRNA target sequence
aaaattatgctgatgcgtgcattgct

SEQ ID NO: 63052 - DNA, 26 bp, Artificial sequence
  SiRNA target sequence
aaattatgctgatgcgtgcattgctt

SEQ ID NO: 63053 - DNA, 26 bp, Artificial sequence
  SiRNA target sequence
aattatgctgatgcgtgcattgctta

SEQ ID NO: 63054 - DNA, 26 bp, Artificial sequence
  SiRNA target sequence
attatgctgatgcgtgcattgcttaa

SEQ ID NO: 63055 - DNA, 26 bp, Artificial sequence
  SiRNA target sequence
ttatgctgatgcgtgcattgcttaaa

SEQ ID NO: 63056 - DNA, 26 bp, Artificial sequence
  SiRNA target sequence
tatgctgatgcgtgcattgcttaaaa

SEQ ID NO: 63057 - DNA, 26 bp, Artificial sequence
  SiRNA target sequence
atgctgatgcgtgcattgcttaaaaa

SEQ ID NO: 63058 - DNA, 26 bp, Artificial sequence
  SiRNA target sequence
tgctgatgcgtgcattgcttaaaaat

SEQ ID NO: 63059 - DNA, 26 bp, Artificial sequence
  SiRNA target sequence
gctgatgcgtgcattgcttaaaaatt

SEQ ID NO: 63060 - DNA, 26 bp, Artificial sequence
  SiRNA target sequence
ctgatgcgtgcattgcttaaaaattc

SEQ ID NO: 63061 - DNA, 26 bp, Artificial sequence
  SiRNA target sequence
tgatgcgtgcattgcttaaaaattca

SEQ ID NO: 63062 - DNA, 26 bp, Artificial sequence
  SiRNA target sequence
gatgcgtgcattgcttaaaaattcag

SEQ ID NO: 63063 - DNA, 26 bp, Artificial sequence
  SiRNA target sequence
atgcgtgcattgcttaaaaattcaga

SEQ ID NO: 63064 - DNA, 26 bp, Artificial sequence
  SiRNA target sequence
tgcgtgcattgcttaaaaattcagag

SEQ ID NO: 63065 - DNA, 26 bp, Artificial sequence
  SiRNA target sequence
gcgtgcattgcttaaaaattcagaga

SEQ ID NO: 63066 - DNA, 26 bp, Artificial sequence
  SiRNA target sequence
cgtgcattgcttaaaaattcagagat

SEQ ID NO: 63067 - DNA, 26 bp, Artificial sequence
  SiRNA target sequence
gtgcattgcttaaaaattcagagatc

SEQ ID NO: 63068 - DNA, 26 bp, Artificial sequence
  SiRNA target sequence
tgcattgcttaaaaattcagagatcg

SEQ ID NO: 63069 - DNA, 26 bp, Artificial sequence
  SiRNA target sequence
gcattgcttaaaaattcagagatcgt

SEQ ID NO: 63070 - DNA, 26 bp, Artificial sequence
  SiRNA target sequence
cattgcttaaaaattcagagatcgtt

SEQ ID NO: 63071 - DNA, 26 bp, Artificial sequence
  SiRNA target sequence
attgcttaaaaattcagagatcgttt

SEQ ID NO: 63072 - DNA, 26 bp, Artificial sequence
  SiRNA target sequence
ttgcttaaaaattcagagatcgtttt

SEQ ID NO: 63073 - DNA, 26 bp, Artificial sequence
  SiRNA target sequence
tgcttaaaaattcagagatcgtttta

SEQ ID NO: 63074 - DNA, 26 bp, Artificial sequence
  SiRNA target sequence
gcttaaaaattcagagatcgttttat

SEQ ID NO: 63075 - DNA, 26 bp, Artificial sequence
  SiRNA target sequence
cttaaaaattcagagatcgttttatt

SEQ ID NO: 63076 - DNA, 26 bp, Artificial sequence
  SiRNA target sequence
ttaaaaattcagagatcgttttatta

SEQ ID NO: 63077 - DNA, 26 bp, Artificial sequence
  SiRNA target sequence
taaaaattcagagatcgttttattag

SEQ ID NO: 63078 - DNA, 26 bp, Artificial sequence
  SiRNA target sequence
aaaaattcagagatcgttttattaga

SEQ ID NO: 63079 - DNA, 26 bp, Artificial sequence
  SiRNA target sequence
aaaattcagagatcgttttattagac

SEQ ID NO: 63080 - DNA, 26 bp, Artificial sequence
  SiRNA target sequence
aaattcagagatcgttttattagacg

SEQ ID NO: 63081 - DNA, 26 bp, Artificial sequence
  SiRNA target sequence
aattcagagatcgttttattagacga

SEQ ID NO: 63082 - DNA, 26 bp, Artificial sequence
  SiRNA target sequence
attcagagatcgttttattagacgag

SEQ ID NO: 63083 - DNA, 26 bp, Artificial sequence
  SiRNA target sequence
ttcagagatcgttttattagacgagc

SEQ ID NO: 63084 - DNA, 26 bp, Artificial sequence
  SiRNA target sequence
tcagagatcgttttattagacgagcc

SEQ ID NO: 63085 - DNA, 26 bp, Artificial sequence
  SiRNA target sequence
cagagatcgttttattagacgagcca

SEQ ID NO: 63086 - DNA, 26 bp, Artificial sequence
  SiRNA target sequence
agagatcgttttattagacgagccaa

SEQ ID NO: 63087 - DNA, 26 bp, Artificial sequence
  SiRNA target sequence
gagatcgttttattagacgagccaac

SEQ ID NO: 63088 - DNA, 26 bp, Artificial sequence
  SiRNA target sequence
agatcgttttattagacgagccaacc

SEQ ID NO: 63089 - DNA, 26 bp, Artificial sequence
  SiRNA target sequence
gatcgttttattagacgagccaacct

SEQ ID NO: 63090 - DNA, 26 bp, Artificial sequence
  SiRNA target sequence
atcgttttattagacgagccaacctc

SEQ ID NO: 63091 - DNA, 26 bp, Artificial sequence
  SiRNA target sequence
tcgttttattagacgagccaacctca

SEQ ID NO: 63092 - DNA, 26 bp, Artificial sequence
  SiRNA target sequence
cgttttattagacgagccaacctcag

SEQ ID NO: 63093 - DNA, 26 bp, Artificial sequence
  SiRNA target sequence
gttttattagacgagccaacctcagc

SEQ ID NO: 63094 - DNA, 26 bp, Artificial sequence
  SiRNA target sequence
ttttattagacgagccaacctcagca

SEQ ID NO: 63095 - DNA, 26 bp, Artificial sequence
  SiRNA target sequence
tttattagacgagccaacctcagcac

SEQ ID NO: 63096 - DNA, 26 bp, Artificial sequence
  SiRNA target sequence
ttattagacgagccaacctcagcact

SEQ ID NO: 63097 - DNA, 26 bp, Artificial sequence
  SiRNA target sequence
tattagacgagccaacctcagcacta

SEQ ID NO: 63098 - DNA, 26 bp, Artificial sequence
  SiRNA target sequence
attagacgagccaacctcagcactag

SEQ ID NO: 63099 - DNA, 26 bp, Artificial sequence
  SiRNA target sequence
ttagacgagccaacctcagcactaga

SEQ ID NO: 63100 - DNA, 26 bp, Artificial sequence
  SiRNA target sequence
tagacgagccaacctcagcactagat

SEQ ID NO: 63101 - DNA, 26 bp, Artificial sequence
  SiRNA target sequence
agacgagccaacctcagcactagata

SEQ ID NO: 63102 - DNA, 26 bp, Artificial sequence
  SiRNA target sequence
gacgagccaacctcagcactagataa

SEQ ID NO: 63103 - DNA, 26 bp, Artificial sequence
  SiRNA target sequence
acgagccaacctcagcactagataaa

SEQ ID NO: 63104 - DNA, 26 bp, Artificial sequence
  SiRNA target sequence
cgagccaacctcagcactagataaaa

SEQ ID NO: 63105 - DNA, 26 bp, Artificial sequence
  SiRNA target sequence
gagccaacctcagcactagataaaaa

SEQ ID NO: 63106 - DNA, 26 bp, Artificial sequence
  SiRNA target sequence
agccaacctcagcactagataaaaag

SEQ ID NO: 63107 - DNA, 26 bp, Artificial sequence
  SiRNA target sequence
gccaacctcagcactagataaaaaga

SEQ ID NO: 63108 - DNA, 26 bp, Artificial sequence
  SiRNA target sequence
ccaacctcagcactagataaaaagag

SEQ ID NO: 63109 - DNA, 26 bp, Artificial sequence
  SiRNA target sequence
caacctcagcactagataaaaagagt

SEQ ID NO: 63110 - DNA, 26 bp, Artificial sequence
  SiRNA target sequence
aacctcagcactagataaaaagagtg

SEQ ID NO: 63111 - DNA, 26 bp, Artificial sequence
  SiRNA target sequence
acctcagcactagataaaaagagtga

SEQ ID NO: 63112 - DNA, 26 bp, Artificial sequence
  SiRNA target sequence
cctcagcactagataaaaagagtgaa

SEQ ID NO: 63113 - DNA, 26 bp, Artificial sequence
  SiRNA target sequence
ctcagcactagataaaaagagtgaac

SEQ ID NO: 63114 - DNA, 26 bp, Artificial sequence
  SiRNA target sequence
tcagcactagataaaaagagtgaact

SEQ ID NO: 63115 - DNA, 26 bp, Artificial sequence
  SiRNA target sequence
cagcactagataaaaagagtgaacta

SEQ ID NO: 63116 - DNA, 26 bp, Artificial sequence
  SiRNA target sequence
agcactagataaaaagagtgaactag

SEQ ID NO: 63117 - DNA, 26 bp, Artificial sequence
  SiRNA target sequence
gcactagataaaaagagtgaactaga

SEQ ID NO: 63118 - DNA, 26 bp, Artificial sequence
  SiRNA target sequence
cactagataaaaagagtgaactagaa

SEQ ID NO: 63119 - DNA, 26 bp, Artificial sequence
  SiRNA target sequence
actagataaaaagagtgaactagaaa

SEQ ID NO: 63120 - DNA, 26 bp, Artificial sequence
  SiRNA target sequence
ctagataaaaagagtgaactagaaac

SEQ ID NO: 63121 - DNA, 26 bp, Artificial sequence
  SiRNA target sequence
tagataaaaagagtgaactagaaact

SEQ ID NO: 63122 - DNA, 26 bp, Artificial sequence
  SiRNA target sequence
agataaaaagagtgaactagaaacta

SEQ ID NO: 63123 - DNA, 26 bp, Artificial sequence
  SiRNA target sequence
gataaaaagagtgaactagaaactat

SEQ ID NO: 63124 - DNA, 26 bp, Artificial sequence
  SiRNA target sequence
ataaaaagagtgaactagaaactatg

SEQ ID NO: 63125 - DNA, 26 bp, Artificial sequence
  SiRNA target sequence
taaaaagagtgaactagaaactatga

SEQ ID NO: 63126 - DNA, 26 bp, Artificial sequence
  SiRNA target sequence
aaaaagagtgaactagaaactatgac

SEQ ID NO: 63127 - DNA, 26 bp, Artificial sequence
  SiRNA target sequence
aaaagagtgaactagaaactatgaca

SEQ ID NO: 63128 - DNA, 26 bp, Artificial sequence
  SiRNA target sequence
aaagagtgaactagaaactatgacat

SEQ ID NO: 63129 - DNA, 26 bp, Artificial sequence
  SiRNA target sequence
aagagtgaactagaaactatgacata

SEQ ID NO: 63130 - DNA, 26 bp, Artificial sequence
  SiRNA target sequence
agagtgaactagaaactatgacatat

SEQ ID NO: 63131 - DNA, 26 bp, Artificial sequence
  SiRNA target sequence
gagtgaactagaaactatgacatata

SEQ ID NO: 63132 - DNA, 26 bp, Artificial sequence
  SiRNA target sequence
agtgaactagaaactatgacatatat

SEQ ID NO: 63133 - DNA, 26 bp, Artificial sequence
  SiRNA target sequence
gtgaactagaaactatgacatatatt

SEQ ID NO: 63134 - DNA, 26 bp, Artificial sequence
  SiRNA target sequence
tgaactagaaactatgacatatattt

SEQ ID NO: 63135 - DNA, 26 bp, Artificial sequence
  SiRNA target sequence
gaactagaaactatgacatatatttt

SEQ ID NO: 63136 - DNA, 26 bp, Artificial sequence
  SiRNA target sequence
aactagaaactatgacatatattttt

SEQ ID NO: 63137 - DNA, 26 bp, Artificial sequence
  SiRNA target sequence
actagaaactatgacatatattttta

SEQ ID NO: 63138 - DNA, 26 bp, Artificial sequence
  SiRNA target sequence
ctagaaactatgacatatatttttaa

SEQ ID NO: 63139 - DNA, 26 bp, Artificial sequence
  SiRNA target sequence
tagaaactatgacatatatttttaat

SEQ ID NO: 63140 - DNA, 26 bp, Artificial sequence
  SiRNA target sequence
agaaactatgacatatatttttaatg

SEQ ID NO: 63141 - DNA, 26 bp, Artificial sequence
  SiRNA target sequence
gaaactatgacatatatttttaatga

SEQ ID NO: 63142 - DNA, 26 bp, Artificial sequence
  SiRNA target sequence
aaactatgacatatatttttaatgaa

SEQ ID NO: 63143 - DNA, 26 bp, Artificial sequence
  SiRNA target sequence
aactatgacatatatttttaatgaat

SEQ ID NO: 63144 - DNA, 26 bp, Artificial sequence
  SiRNA target sequence
actatgacatatatttttaatgaatt

SEQ ID NO: 63145 - DNA, 26 bp, Artificial sequence
  SiRNA target sequence
ctatgacatatatttttaatgaattt

SEQ ID NO: 63146 - DNA, 26 bp, Artificial sequence
  SiRNA target sequence
tatgacatatatttttaatgaattta

SEQ ID NO: 63147 - DNA, 26 bp, Artificial sequence
  SiRNA target sequence
atgacatatatttttaatgaatttaa

SEQ ID NO: 63148 - DNA, 26 bp, Artificial sequence
  SiRNA target sequence
tgacatatatttttaatgaatttaag

SEQ ID NO: 63149 - DNA, 26 bp, Artificial sequence
  SiRNA target sequence
gacatatatttttaatgaatttaagt

SEQ ID NO: 63150 - DNA, 26 bp, Artificial sequence
  SiRNA target sequence
acatatatttttaatgaatttaagta

SEQ ID NO: 63151 - DNA, 26 bp, Artificial sequence
  SiRNA target sequence
catatatttttaatgaatttaagtac

SEQ ID NO: 63152 - DNA, 26 bp, Artificial sequence
  SiRNA target sequence
atatatttttaatgaatttaagtacc

SEQ ID NO: 63153 - DNA, 26 bp, Artificial sequence
  SiRNA target sequence
tatatttttaatgaatttaagtacca

SEQ ID NO: 63154 - DNA, 26 bp, Artificial sequence
  SiRNA target sequence
atatttttaatgaatttaagtaccat

SEQ ID NO: 63155 - DNA, 26 bp, Artificial sequence
  SiRNA target sequence
tatttttaatgaatttaagtaccata

SEQ ID NO: 63156 - DNA, 26 bp, Artificial sequence
  SiRNA target sequence
atttttaatgaatttaagtaccatac

SEQ ID NO: 63157 - DNA, 26 bp, Artificial sequence
  SiRNA target sequence
tttttaatgaatttaagtaccatact

SEQ ID NO: 63158 - DNA, 26 bp, Artificial sequence
  SiRNA target sequence
ttttaatgaatttaagtaccatactt

SEQ ID NO: 63159 - DNA, 26 bp, Artificial sequence
  SiRNA target sequence
tttaatgaatttaagtaccatacttt

SEQ ID NO: 63160 - DNA, 26 bp, Artificial sequence
  SiRNA target sequence
ttaatgaatttaagtaccatactttt

SEQ ID NO: 63161 - DNA, 26 bp, Artificial sequence
  SiRNA target sequence
taatgaatttaagtaccatacttttg

SEQ ID NO: 63162 - DNA, 26 bp, Artificial sequence
  SiRNA target sequence
aatgaatttaagtaccatacttttgt

SEQ ID NO: 63163 - DNA, 26 bp, Artificial sequence
  SiRNA target sequence
atgaatttaagtaccatacttttgta

SEQ ID NO: 63164 - DNA, 26 bp, Artificial sequence
  SiRNA target sequence
tgaatttaagtaccatacttttgtaa

SEQ ID NO: 63165 - DNA, 26 bp, Artificial sequence
  SiRNA target sequence
gaatttaagtaccatacttttgtaat

SEQ ID NO: 63166 - DNA, 26 bp, Artificial sequence
  SiRNA target sequence
aatttaagtaccatacttttgtaata

SEQ ID NO: 63167 - DNA, 26 bp, Artificial sequence
  SiRNA target sequence
atttaagtaccatacttttgtaataa

SEQ ID NO: 63168 - DNA, 26 bp, Artificial sequence
  SiRNA target sequence
tttaagtaccatacttttgtaataat

SEQ ID NO: 63169 - DNA, 26 bp, Artificial sequence
  SiRNA target sequence
ttaagtaccatacttttgtaataatt

SEQ ID NO: 63170 - DNA, 26 bp, Artificial sequence
  SiRNA target sequence
taagtaccatacttttgtaataattg

SEQ ID NO: 63171 - DNA, 26 bp, Artificial sequence
  SiRNA target sequence
aagtaccatacttttgtaataattgt

SEQ ID NO: 63172 - DNA, 26 bp, Artificial sequence
  SiRNA target sequence
agtaccatacttttgtaataattgta

SEQ ID NO: 63173 - DNA, 26 bp, Artificial sequence
  SiRNA target sequence
gtaccatacttttgtaataattgtac

SEQ ID NO: 63174 - DNA, 26 bp, Artificial sequence
  SiRNA target sequence
taccatacttttgtaataattgtaca

SEQ ID NO: 63175 - DNA, 26 bp, Artificial sequence
  SiRNA target sequence
accatacttttgtaataattgtacac

SEQ ID NO: 63176 - DNA, 26 bp, Artificial sequence
  SiRNA target sequence
ccatacttttgtaataattgtacaca

SEQ ID NO: 63177 - DNA, 26 bp, Artificial sequence
  SiRNA target sequence
catacttttgtaataattgtacacaa

SEQ ID NO: 63178 - DNA, 26 bp, Artificial sequence
  SiRNA target sequence
atacttttgtaataattgtacacaat

SEQ ID NO: 63179 - DNA, 26 bp, Artificial sequence
  SiRNA target sequence
tacttttgtaataattgtacacaatc

SEQ ID NO: 63180 - DNA, 26 bp, Artificial sequence
  SiRNA target sequence
acttttgtaataattgtacacaatct

SEQ ID NO: 63181 - DNA, 26 bp, Artificial sequence
  SiRNA target sequence
cttttgtaataattgtacacaatcta

SEQ ID NO: 63182 - DNA, 26 bp, Artificial sequence
  SiRNA target sequence
ttttgtaataattgtacacaatctag

SEQ ID NO: 63183 - DNA, 26 bp, Artificial sequence
  SiRNA target sequence
tttgtaataattgtacacaatctaga

SEQ ID NO: 63184 - DNA, 26 bp, Artificial sequence
  SiRNA target sequence
ttgtaataattgtacacaatctagaa

SEQ ID NO: 63185 - DNA, 26 bp, Artificial sequence
  SiRNA target sequence
tgtaataattgtacacaatctagaat

SEQ ID NO: 63186 - DNA, 26 bp, Artificial sequence
  SiRNA target sequence
gtaataattgtacacaatctagaatt

SEQ ID NO: 63187 - DNA, 26 bp, Artificial sequence
  SiRNA target sequence
taataattgtacacaatctagaatta

SEQ ID NO: 63188 - DNA, 26 bp, Artificial sequence
  SiRNA target sequence
aataattgtacacaatctagaattat

SEQ ID NO: 63189 - DNA, 26 bp, Artificial sequence
  SiRNA target sequence
ataattgtacacaatctagaattatt

SEQ ID NO: 63190 - DNA, 26 bp, Artificial sequence
  SiRNA target sequence
taattgtacacaatctagaattattg

SEQ ID NO: 63191 - DNA, 26 bp, Artificial sequence
  SiRNA target sequence
aattgtacacaatctagaattattgg

SEQ ID NO: 63192 - DNA, 26 bp, Artificial sequence
  SiRNA target sequence
attgtacacaatctagaattattggc

SEQ ID NO: 63193 - DNA, 26 bp, Artificial sequence
  SiRNA target sequence
ttgtacacaatctagaattattggct

SEQ ID NO: 63194 - DNA, 26 bp, Artificial sequence
  SiRNA target sequence
tgtacacaatctagaattattggctt

SEQ ID NO: 63195 - DNA, 26 bp, Artificial sequence
  SiRNA target sequence
gtacacaatctagaattattggcttt

SEQ ID NO: 63196 - DNA, 26 bp, Artificial sequence
  SiRNA target sequence
tacacaatctagaattattggctttg

SEQ ID NO: 63197 - DNA, 26 bp, Artificial sequence
  SiRNA target sequence
acacaatctagaattattggctttgt

SEQ ID NO: 63198 - DNA, 26 bp, Artificial sequence
  SiRNA target sequence
cacaatctagaattattggctttgtt

SEQ ID NO: 63199 - DNA, 26 bp, Artificial sequence
  SiRNA target sequence
acaatctagaattattggctttgttt

SEQ ID NO: 63200 - DNA, 26 bp, Artificial sequence
  SiRNA target sequence
caatctagaattattggctttgtttg

SEQ ID NO: 63201 - DNA, 26 bp, Artificial sequence
  SiRNA target sequence
aatctagaattattggctttgtttga

SEQ ID NO: 63202 - DNA, 26 bp, Artificial sequence
  SiRNA target sequence
atctagaattattggctttgtttgat

SEQ ID NO: 63203 - DNA, 26 bp, Artificial sequence
  SiRNA target sequence
tctagaattattggctttgtttgata

SEQ ID NO: 63204 - DNA, 26 bp, Artificial sequence
  SiRNA target sequence
ctagaattattggctttgtttgataa

SEQ ID NO: 63205 - DNA, 26 bp, Artificial sequence
  SiRNA target sequence
tagaattattggctttgtttgataaa

SEQ ID NO: 63206 - DNA, 26 bp, Artificial sequence
  SiRNA target sequence
agaattattggctttgtttgataaaa

SEQ ID NO: 63207 - DNA, 26 bp, Artificial sequence
  SiRNA target sequence
gaattattggctttgtttgataaaat

SEQ ID NO: 63208 - DNA, 26 bp, Artificial sequence
  SiRNA target sequence
aattattggctttgtttgataaaatt

SEQ ID NO: 63209 - DNA, 26 bp, Artificial sequence
  SiRNA target sequence
attattggctttgtttgataaaattt

SEQ ID NO: 63210 - DNA, 26 bp, Artificial sequence
  SiRNA target sequence
ttattggctttgtttgataaaatttt

SEQ ID NO: 63211 - DNA, 26 bp, Artificial sequence
  SiRNA target sequence
tattggctttgtttgataaaatttta

SEQ ID NO: 63212 - DNA, 26 bp, Artificial sequence
  SiRNA target sequence
attggctttgtttgataaaattttat

SEQ ID NO: 63213 - DNA, 26 bp, Artificial sequence
  SiRNA target sequence
ttggctttgtttgataaaattttatt

SEQ ID NO: 63214 - DNA, 26 bp, Artificial sequence
  SiRNA target sequence
tggctttgtttgataaaattttattt

SEQ ID NO: 63215 - DNA, 26 bp, Artificial sequence
  SiRNA target sequence
ggctttgtttgataaaattttatttg

SEQ ID NO: 63216 - DNA, 26 bp, Artificial sequence
  SiRNA target sequence
gctttgtttgataaaattttatttgt

SEQ ID NO: 63217 - DNA, 26 bp, Artificial sequence
  SiRNA target sequence
ctttgtttgataaaattttatttgta

SEQ ID NO: 63218 - DNA, 26 bp, Artificial sequence
  SiRNA target sequence
tttgtttgataaaattttatttgtaa

SEQ ID NO: 63219 - DNA, 26 bp, Artificial sequence
  SiRNA target sequence
ttgtttgataaaattttatttgtaaa

SEQ ID NO: 63220 - DNA, 26 bp, Artificial sequence
  SiRNA target sequence
tgtttgataaaattttatttgtaaat

SEQ ID NO: 63221 - DNA, 26 bp, Artificial sequence
  SiRNA target sequence
gtttgataaaattttatttgtaaatg

SEQ ID NO: 63222 - DNA, 26 bp, Artificial sequence
  SiRNA target sequence
tttgataaaattttatttgtaaatgg

SEQ ID NO: 63223 - DNA, 26 bp, Artificial sequence
  SiRNA target sequence
ttgataaaattttatttgtaaatggt

SEQ ID NO: 63224 - DNA, 26 bp, Artificial sequence
  SiRNA target sequence
tgataaaattttatttgtaaatggta

SEQ ID NO: 63225 - DNA, 26 bp, Artificial sequence
  SiRNA target sequence
gataaaattttatttgtaaatggtaa

SEQ ID NO: 63226 - DNA, 26 bp, Artificial sequence
  SiRNA target sequence
ataaaattttatttgtaaatggtaat

SEQ ID NO: 63227 - DNA, 26 bp, Artificial sequence
  SiRNA target sequence
taaaattttatttgtaaatggtaatg

SEQ ID NO: 63228 - DNA, 26 bp, Artificial sequence
  SiRNA target sequence
aaaattttatttgtaaatggtaatga

SEQ ID NO: 63229 - DNA, 26 bp, Artificial sequence
  SiRNA target sequence
aaattttatttgtaaatggtaatgag

SEQ ID NO: 63230 - DNA, 26 bp, Artificial sequence
  SiRNA target sequence
aattttatttgtaaatggtaatgagg

SEQ ID NO: 63231 - DNA, 26 bp, Artificial sequence
  SiRNA target sequence
attttatttgtaaatggtaatgaggt

SEQ ID NO: 63232 - DNA, 26 bp, Artificial sequence
  SiRNA target sequence
ttttatttgtaaatggtaatgaggta

SEQ ID NO: 63233 - DNA, 26 bp, Artificial sequence
  SiRNA target sequence
tttatttgtaaatggtaatgaggtaa

SEQ ID NO: 63234 - DNA, 26 bp, Artificial sequence
  SiRNA target sequence
ttatttgtaaatggtaatgaggtaac

SEQ ID NO: 63235 - DNA, 26 bp, Artificial sequence
  SiRNA target sequence
tatttgtaaatggtaatgaggtaaca

SEQ ID NO: 63236 - DNA, 26 bp, Artificial sequence
  SiRNA target sequence
atttgtaaatggtaatgaggtaacaa

SEQ ID NO: 63237 - DNA, 26 bp, Artificial sequence
  SiRNA target sequence
tttgtaaatggtaatgaggtaacaat

SEQ ID NO: 63238 - DNA, 26 bp, Artificial sequence
  SiRNA target sequence
ttgtaaatggtaatgaggtaacaatg

SEQ ID NO: 63239 - DNA, 26 bp, Artificial sequence
  SiRNA target sequence
tgtaaatggtaatgaggtaacaatga

SEQ ID NO: 63240 - DNA, 26 bp, Artificial sequence
  SiRNA target sequence
gtaaatggtaatgaggtaacaatgat

SEQ ID NO: 63241 - DNA, 26 bp, Artificial sequence
  SiRNA target sequence
taaatggtaatgaggtaacaatgata

SEQ ID NO: 63242 - DNA, 26 bp, Artificial sequence
  SiRNA target sequence
aaatggtaatgaggtaacaatgatag

SEQ ID NO: 63243 - DNA, 26 bp, Artificial sequence
  SiRNA target sequence
aatggtaatgaggtaacaatgataga

SEQ ID NO: 63244 - DNA, 26 bp, Artificial sequence
  SiRNA target sequence
atggtaatgaggtaacaatgatagaa

SEQ ID NO: 63245 - DNA, 26 bp, Artificial sequence
  SiRNA target sequence
tggtaatgaggtaacaatgatagaag

SEQ ID NO: 63246 - DNA, 26 bp, Artificial sequence
  SiRNA target sequence
ggtaatgaggtaacaatgatagaaga

SEQ ID NO: 63247 - DNA, 26 bp, Artificial sequence
  SiRNA target sequence
gtaatgaggtaacaatgatagaagac

SEQ ID NO: 63248 - DNA, 26 bp, Artificial sequence
  SiRNA target sequence
taatgaggtaacaatgatagaagaca

SEQ ID NO: 63249 - DNA, 26 bp, Artificial sequence
  SiRNA target sequence
aatgaggtaacaatgatagaagacat

SEQ ID NO: 63250 - DNA, 26 bp, Artificial sequence
  SiRNA target sequence
atgaggtaacaatgatagaagacatt

SEQ ID NO: 63251 - DNA, 26 bp, Artificial sequence
  SiRNA target sequence
tgaggtaacaatgatagaagacatta

SEQ ID NO: 63252 - DNA, 26 bp, Artificial sequence
  SiRNA target sequence
gaggtaacaatgatagaagacattaa

SEQ ID NO: 63253 - DNA, 26 bp, Artificial sequence
  SiRNA target sequence
aggtaacaatgatagaagacattaac

SEQ ID NO: 63254 - DNA, 26 bp, Artificial sequence
  SiRNA target sequence
ggtaacaatgatagaagacattaaca

SEQ ID NO: 63255 - DNA, 26 bp, Artificial sequence
  SiRNA target sequence
gtaacaatgatagaagacattaacaa

SEQ ID NO: 63256 - DNA, 26 bp, Artificial sequence
  SiRNA target sequence
taacaatgatagaagacattaacaaa

SEQ ID NO: 63257 - DNA, 26 bp, Artificial sequence
  SiRNA target sequence
aacaatgatagaagacattaacaaaa

SEQ ID NO: 63258 - DNA, 26 bp, Artificial sequence
  SiRNA target sequence
acaatgatagaagacattaacaaaaa

SEQ ID NO: 63259 - DNA, 26 bp, Artificial sequence
  SiRNA target sequence
caatgatagaagacattaacaaaaaa

SEQ ID NO: 63260 - DNA, 26 bp, Artificial sequence
  SiRNA target sequence
aatgatagaagacattaacaaaaaac

SEQ ID NO: 63261 - DNA, 26 bp, Artificial sequence
  SiRNA target sequence
atgatagaagacattaacaaaaaact

SEQ ID NO: 63262 - DNA, 26 bp, Artificial sequence
  SiRNA target sequence
tgatagaagacattaacaaaaaactt

SEQ ID NO: 63263 - DNA, 26 bp, Artificial sequence
  SiRNA target sequence
gatagaagacattaacaaaaaacttg

SEQ ID NO: 63264 - DNA, 26 bp, Artificial sequence
  SiRNA target sequence
atagaagacattaacaaaaaacttga

SEQ ID NO: 63265 - DNA, 26 bp, Artificial sequence
  SiRNA target sequence
tagaagacattaacaaaaaacttgaa

SEQ ID NO: 63266 - DNA, 26 bp, Artificial sequence
  SiRNA target sequence
agaagacattaacaaaaaacttgaag

SEQ ID NO: 63267 - DNA, 26 bp, Artificial sequence
  SiRNA target sequence
gaagacattaacaaaaaacttgaaga

SEQ ID NO: 63268 - DNA, 26 bp, Artificial sequence
  SiRNA target sequence
aagacattaacaaaaaacttgaagaa

SEQ ID NO: 63269 - DNA, 26 bp, Artificial sequence
  SiRNA target sequence
agacattaacaaaaaacttgaagaaa

SEQ ID NO: 63270 - DNA, 26 bp, Artificial sequence
  SiRNA target sequence
gacattaacaaaaaacttgaagaaaa

SEQ ID NO: 63271 - DNA, 26 bp, Artificial sequence
  SiRNA target sequence
acattaacaaaaaacttgaagaaaat

SEQ ID NO: 63272 - DNA, 26 bp, Artificial sequence
  SiRNA target sequence
cattaacaaaaaacttgaagaaaatt

SEQ ID NO: 63273 - DNA, 26 bp, Artificial sequence
  SiRNA target sequence
attaacaaaaaacttgaagaaaattc

SEQ ID NO: 63274 - DNA, 26 bp, Artificial sequence
  SiRNA target sequence
ttaacaaaaaacttgaagaaaattca

SEQ ID NO: 63275 - DNA, 26 bp, Artificial sequence
  SiRNA target sequence
taacaaaaaacttgaagaaaattcaa

SEQ ID NO: 63276 - DNA, 26 bp, Artificial sequence
  SiRNA target sequence
aacaaaaaacttgaagaaaattcaaa

SEQ ID NO: 63277 - DNA, 26 bp, Artificial sequence
  SiRNA target sequence
acaaaaaacttgaagaaaattcaaag

SEQ ID NO: 63278 - DNA, 26 bp, Artificial sequence
  SiRNA target sequence
caaaaaacttgaagaaaattcaaagt

SEQ ID NO: 63279 - DNA, 26 bp, Artificial sequence
  SiRNA target sequence
aaaaaacttgaagaaaattcaaagta

SEQ ID NO: 63280 - DNA, 26 bp, Artificial sequence
  SiRNA target sequence
aaaaacttgaagaaaattcaaagtat

SEQ ID NO: 63281 - DNA, 26 bp, Artificial sequence
  SiRNA target sequence
aaaacttgaagaaaattcaaagtatt

SEQ ID NO: 63282 - DNA, 26 bp, Artificial sequence
  SiRNA target sequence
aaacttgaagaaaattcaaagtattt

SEQ ID NO: 63283 - DNA, 26 bp, Artificial sequence
  SiRNA target sequence
aacttgaagaaaattcaaagtatttt

SEQ ID NO: 63284 - DNA, 26 bp, Artificial sequence
  SiRNA target sequence
acttgaagaaaattcaaagtattttg

SEQ ID NO: 63285 - DNA, 26 bp, Artificial sequence
  SiRNA target sequence
cttgaagaaaattcaaagtattttgc

SEQ ID NO: 63286 - DNA, 26 bp, Artificial sequence
  SiRNA target sequence
ttgaagaaaattcaaagtattttgca

SEQ ID NO: 63287 - DNA, 26 bp, Artificial sequence
  SiRNA target sequence
tgaagaaaattcaaagtattttgcag

SEQ ID NO: 63288 - DNA, 26 bp, Artificial sequence
  SiRNA target sequence
gaagaaaattcaaagtattttgcaga

SEQ ID NO: 63289 - DNA, 26 bp, Artificial sequence
  SiRNA target sequence
aagaaaattcaaagtattttgcagat

SEQ ID NO: 63290 - DNA, 26 bp, Artificial sequence
  SiRNA target sequence
agaaaattcaaagtattttgcagata

SEQ ID NO: 63291 - DNA, 26 bp, Artificial sequence
  SiRNA target sequence
gaaaattcaaagtattttgcagatat

SEQ ID NO: 63292 - DNA, 26 bp, Artificial sequence
  SiRNA target sequence
aaaattcaaagtattttgcagatatt

SEQ ID NO: 63293 - DNA, 26 bp, Artificial sequence
  SiRNA target sequence
aaattcaaagtattttgcagatattt

SEQ ID NO: 63294 - DNA, 26 bp, Artificial sequence
  SiRNA target sequence
aattcaaagtattttgcagatatttt

SEQ ID NO: 63295 - DNA, 26 bp, Artificial sequence
  SiRNA target sequence
attcaaagtattttgcagatatttta

SEQ ID NO: 63296 - DNA, 26 bp, Artificial sequence
  SiRNA target sequence
ttcaaagtattttgcagatattttaa

SEQ ID NO: 63297 - DNA, 26 bp, Artificial sequence
  SiRNA target sequence
tcaaagtattttgcagatattttaaa

SEQ ID NO: 63298 - DNA, 26 bp, Artificial sequence
  SiRNA target sequence
caaagtattttgcagatattttaaac

SEQ ID NO: 63299 - DNA, 26 bp, Artificial sequence
  SiRNA target sequence
aaagtattttgcagatattttaaaca

SEQ ID NO: 63300 - DNA, 26 bp, Artificial sequence
  SiRNA target sequence
aagtattttgcagatattttaaacaa

SEQ ID NO: 63301 - DNA, 26 bp, Artificial sequence
  SiRNA target sequence
agtattttgcagatattttaaacaac

SEQ ID NO: 63302 - DNA, 26 bp, Artificial sequence
  SiRNA target sequence
gtattttgcagatattttaaacaacg

SEQ ID NO: 63303 - DNA, 26 bp, Artificial sequence
  SiRNA target sequence
tattttgcagatattttaaacaacga

SEQ ID NO: 63304 - DNA, 26 bp, Artificial sequence
  SiRNA target sequence
attttgcagatattttaaacaacgaa

SEQ ID NO: 63305 - DNA, 26 bp, Artificial sequence
  SiRNA target sequence
ttttgcagatattttaaacaacgaat

SEQ ID NO: 63306 - DNA, 26 bp, Artificial sequence
  SiRNA target sequence
tttgcagatattttaaacaacgaata

SEQ ID NO: 63307 - DNA, 26 bp, Artificial sequence
  SiRNA target sequence
ttgcagatattttaaacaacgaataa

SEQ ID NO: 63308 - DNA, 27 bp, Artificial sequence
  SiRNA target sequence
atgaaggaaaaaaccaattatgaaatt

SEQ ID NO: 63309 - DNA, 27 bp, Artificial sequence
  SiRNA target sequence
tgaaggaaaaaaccaattatgaaattt

SEQ ID NO: 63310 - DNA, 27 bp, Artificial sequence
  SiRNA target sequence
gaaggaaaaaaccaattatgaaatttt

SEQ ID NO: 63311 - DNA, 27 bp, Artificial sequence
  SiRNA target sequence
aaggaaaaaaccaattatgaaatttta

SEQ ID NO: 63312 - DNA, 27 bp, Artificial sequence
  SiRNA target sequence
aggaaaaaaccaattatgaaattttat

SEQ ID NO: 63313 - DNA, 27 bp, Artificial sequence
  SiRNA target sequence
ggaaaaaaccaattatgaaattttata

SEQ ID NO: 63314 - DNA, 27 bp, Artificial sequence
  SiRNA target sequence
gaaaaaaccaattatgaaattttatat

SEQ ID NO: 63315 - DNA, 27 bp, Artificial sequence
  SiRNA target sequence
aaaaaaccaattatgaaattttatatg

SEQ ID NO: 63316 - DNA, 27 bp, Artificial sequence
  SiRNA target sequence
aaaaaccaattatgaaattttatatga

SEQ ID NO: 63317 - DNA, 27 bp, Artificial sequence
  SiRNA target sequence
aaaaccaattatgaaattttatatgat

SEQ ID NO: 63318 - DNA, 27 bp, Artificial sequence
  SiRNA target sequence
aaaccaattatgaaattttatatgata

SEQ ID NO: 63319 - DNA, 27 bp, Artificial sequence
  SiRNA target sequence
aaccaattatgaaattttatatgatac

SEQ ID NO: 63320 - DNA, 27 bp, Artificial sequence
  SiRNA target sequence
accaattatgaaattttatatgataca

SEQ ID NO: 63321 - DNA, 27 bp, Artificial sequence
  SiRNA target sequence
ccaattatgaaattttatatgatacat

SEQ ID NO: 63322 - DNA, 27 bp, Artificial sequence
  SiRNA target sequence
caattatgaaattttatatgatacatt

SEQ ID NO: 63323 - DNA, 27 bp, Artificial sequence
  SiRNA target sequence
aattatgaaattttatatgatacattt

SEQ ID NO: 63324 - DNA, 27 bp, Artificial sequence
  SiRNA target sequence
attatgaaattttatatgatacatttg

SEQ ID NO: 63325 - DNA, 27 bp, Artificial sequence
  SiRNA target sequence
ttatgaaattttatatgatacatttgt

SEQ ID NO: 63326 - DNA, 27 bp, Artificial sequence
  SiRNA target sequence
tatgaaattttatatgatacatttgta

SEQ ID NO: 63327 - DNA, 27 bp, Artificial sequence
  SiRNA target sequence
atgaaattttatatgatacatttgtaa

SEQ ID NO: 63328 - DNA, 27 bp, Artificial sequence
  SiRNA target sequence
tgaaattttatatgatacatttgtaaa

SEQ ID NO: 63329 - DNA, 27 bp, Artificial sequence
  SiRNA target sequence
gaaattttatatgatacatttgtaaaa

SEQ ID NO: 63330 - DNA, 27 bp, Artificial sequence
  SiRNA target sequence
aaattttatatgatacatttgtaaaat

SEQ ID NO: 63331 - DNA, 27 bp, Artificial sequence
  SiRNA target sequence
aattttatatgatacatttgtaaaata

SEQ ID NO: 63332 - DNA, 27 bp, Artificial sequence
  SiRNA target sequence
attttatatgatacatttgtaaaatat

SEQ ID NO: 63333 - DNA, 27 bp, Artificial sequence
  SiRNA target sequence
ttttatatgatacatttgtaaaatatt

SEQ ID NO: 63334 - DNA, 27 bp, Artificial sequence
  SiRNA target sequence
tttatatgatacatttgtaaaatattg

SEQ ID NO: 63335 - DNA, 27 bp, Artificial sequence
  SiRNA target sequence
ttatatgatacatttgtaaaatattgt

SEQ ID NO: 63336 - DNA, 27 bp, Artificial sequence
  SiRNA target sequence
tatatgatacatttgtaaaatattgtt

SEQ ID NO: 63337 - DNA, 27 bp, Artificial sequence
  SiRNA target sequence
atatgatacatttgtaaaatattgtta

SEQ ID NO: 63338 - DNA, 27 bp, Artificial sequence
  SiRNA target sequence
tatgatacatttgtaaaatattgttac

SEQ ID NO: 63339 - DNA, 27 bp, Artificial sequence
  SiRNA target sequence
atgatacatttgtaaaatattgttaca

SEQ ID NO: 63340 - DNA, 27 bp, Artificial sequence
  SiRNA target sequence
tgatacatttgtaaaatattgttacaa

SEQ ID NO: 63341 - DNA, 27 bp, Artificial sequence
  SiRNA target sequence
gatacatttgtaaaatattgttacaat

SEQ ID NO: 63342 - DNA, 27 bp, Artificial sequence
  SiRNA target sequence
atacatttgtaaaatattgttacaata

SEQ ID NO: 63343 - DNA, 27 bp, Artificial sequence
  SiRNA target sequence
tacatttgtaaaatattgttacaatat

SEQ ID NO: 63344 - DNA, 27 bp, Artificial sequence
  SiRNA target sequence
acatttgtaaaatattgttacaatatt

SEQ ID NO: 63345 - DNA, 27 bp, Artificial sequence
  SiRNA target sequence
catttgtaaaatattgttacaatattt

SEQ ID NO: 63346 - DNA, 27 bp, Artificial sequence
  SiRNA target sequence
atttgtaaaatattgttacaatatttc

SEQ ID NO: 63347 - DNA, 27 bp, Artificial sequence
  SiRNA target sequence
tttgtaaaatattgttacaatatttcc

SEQ ID NO: 63348 - DNA, 27 bp, Artificial sequence
  SiRNA target sequence
ttgtaaaatattgttacaatatttcct

SEQ ID NO: 63349 - DNA, 27 bp, Artificial sequence
  SiRNA target sequence
tgtaaaatattgttacaatatttccta

SEQ ID NO: 63350 - DNA, 27 bp, Artificial sequence
  SiRNA target sequence
gtaaaatattgttacaatatttcctat

SEQ ID NO: 63351 - DNA, 27 bp, Artificial sequence
  SiRNA target sequence
taaaatattgttacaatatttcctata

SEQ ID NO: 63352 - DNA, 27 bp, Artificial sequence
  SiRNA target sequence
aaaatattgttacaatatttcctatat

SEQ ID NO: 63353 - DNA, 27 bp, Artificial sequence
  SiRNA target sequence
aaatattgttacaatatttcctatata

SEQ ID NO: 63354 - DNA, 27 bp, Artificial sequence
  SiRNA target sequence
aatattgttacaatatttcctatataa

SEQ ID NO: 63355 - DNA, 27 bp, Artificial sequence
  SiRNA target sequence
atattgttacaatatttcctatataag

SEQ ID NO: 63356 - DNA, 27 bp, Artificial sequence
  SiRNA target sequence
tattgttacaatatttcctatataagg

SEQ ID NO: 63357 - DNA, 27 bp, Artificial sequence
  SiRNA target sequence
attgttacaatatttcctatataaggt

SEQ ID NO: 63358 - DNA, 27 bp, Artificial sequence
  SiRNA target sequence
ttgttacaatatttcctatataaggta

SEQ ID NO: 63359 - DNA, 27 bp, Artificial sequence
  SiRNA target sequence
tgttacaatatttcctatataaggtac

SEQ ID NO: 63360 - DNA, 27 bp, Artificial sequence
  SiRNA target sequence
gttacaatatttcctatataaggtacg

SEQ ID NO: 63361 - DNA, 27 bp, Artificial sequence
  SiRNA target sequence
ttacaatatttcctatataaggtacgt

SEQ ID NO: 63362 - DNA, 27 bp, Artificial sequence
  SiRNA target sequence
tacaatatttcctatataaggtacgta

SEQ ID NO: 63363 - DNA, 27 bp, Artificial sequence
  SiRNA target sequence
acaatatttcctatataaggtacgtaa

SEQ ID NO: 63364 - DNA, 27 bp, Artificial sequence
  SiRNA target sequence
caatatttcctatataaggtacgtaat

SEQ ID NO: 63365 - DNA, 27 bp, Artificial sequence
  SiRNA target sequence
aatatttcctatataaggtacgtaatg

SEQ ID NO: 63366 - DNA, 27 bp, Artificial sequence
  SiRNA target sequence
atatttcctatataaggtacgtaatgt

SEQ ID NO: 63367 - DNA, 27 bp, Artificial sequence
  SiRNA target sequence
tatttcctatataaggtacgtaatgtt

SEQ ID NO: 63368 - DNA, 27 bp, Artificial sequence
  SiRNA target sequence
atttcctatataaggtacgtaatgttt

SEQ ID NO: 63369 - DNA, 27 bp, Artificial sequence
  SiRNA target sequence
tttcctatataaggtacgtaatgtttc

SEQ ID NO: 63370 - DNA, 27 bp, Artificial sequence
  SiRNA target sequence
ttcctatataaggtacgtaatgtttcc

SEQ ID NO: 63371 - DNA, 27 bp, Artificial sequence
  SiRNA target sequence
tcctatataaggtacgtaatgtttccc

SEQ ID NO: 63372 - DNA, 27 bp, Artificial sequence
  SiRNA target sequence
cctatataaggtacgtaatgtttccca

SEQ ID NO: 63373 - DNA, 27 bp, Artificial sequence
  SiRNA target sequence
ctatataaggtacgtaatgtttcccat

SEQ ID NO: 63374 - DNA, 27 bp, Artificial sequence
  SiRNA target sequence
tatataaggtacgtaatgtttcccata

SEQ ID NO: 63375 - DNA, 27 bp, Artificial sequence
  SiRNA target sequence
atataaggtacgtaatgtttcccatat

SEQ ID NO: 63376 - DNA, 27 bp, Artificial sequence
  SiRNA target sequence
tataaggtacgtaatgtttcccatatt

SEQ ID NO: 63377 - DNA, 27 bp, Artificial sequence
  SiRNA target sequence
ataaggtacgtaatgtttcccatatta

SEQ ID NO: 63378 - DNA, 27 bp, Artificial sequence
  SiRNA target sequence
taaggtacgtaatgtttcccatattac

SEQ ID NO: 63379 - DNA, 27 bp, Artificial sequence
  SiRNA target sequence
aaggtacgtaatgtttcccatattact

SEQ ID NO: 63380 - DNA, 27 bp, Artificial sequence
  SiRNA target sequence
aggtacgtaatgtttcccatattactg

SEQ ID NO: 63381 - DNA, 27 bp, Artificial sequence
  SiRNA target sequence
ggtacgtaatgtttcccatattactgt

SEQ ID NO: 63382 - DNA, 27 bp, Artificial sequence
  SiRNA target sequence
gtacgtaatgtttcccatattactgtc

SEQ ID NO: 63383 - DNA, 27 bp, Artificial sequence
  SiRNA target sequence
tacgtaatgtttcccatattactgtct

SEQ ID NO: 63384 - DNA, 27 bp, Artificial sequence
  SiRNA target sequence
acgtaatgtttcccatattactgtcta

SEQ ID NO: 63385 - DNA, 27 bp, Artificial sequence
  SiRNA target sequence
cgtaatgtttcccatattactgtctac

SEQ ID NO: 63386 - DNA, 27 bp, Artificial sequence
  SiRNA target sequence
gtaatgtttcccatattactgtctaca

SEQ ID NO: 63387 - DNA, 27 bp, Artificial sequence
  SiRNA target sequence
taatgtttcccatattactgtctacaa

SEQ ID NO: 63388 - DNA, 27 bp, Artificial sequence
  SiRNA target sequence
aatgtttcccatattactgtctacaat

SEQ ID NO: 63389 - DNA, 27 bp, Artificial sequence
  SiRNA target sequence
atgtttcccatattactgtctacaatt

SEQ ID NO: 63390 - DNA, 27 bp, Artificial sequence
  SiRNA target sequence
tgtttcccatattactgtctacaatta

SEQ ID NO: 63391 - DNA, 27 bp, Artificial sequence
  SiRNA target sequence
gtttcccatattactgtctacaattat

SEQ ID NO: 63392 - DNA, 27 bp, Artificial sequence
  SiRNA target sequence
tttcccatattactgtctacaattata

SEQ ID NO: 63393 - DNA, 27 bp, Artificial sequence
  SiRNA target sequence
ttcccatattactgtctacaattatag

SEQ ID NO: 63394 - DNA, 27 bp, Artificial sequence
  SiRNA target sequence
tcccatattactgtctacaattatagc

SEQ ID NO: 63395 - DNA, 27 bp, Artificial sequence
  SiRNA target sequence
cccatattactgtctacaattatagct

SEQ ID NO: 63396 - DNA, 27 bp, Artificial sequence
  SiRNA target sequence
ccatattactgtctacaattatagctt

SEQ ID NO: 63397 - DNA, 27 bp, Artificial sequence
  SiRNA target sequence
catattactgtctacaattatagcttg

SEQ ID NO: 63398 - DNA, 27 bp, Artificial sequence
  SiRNA target sequence
atattactgtctacaattatagcttgt

SEQ ID NO: 63399 - DNA, 27 bp, Artificial sequence
  SiRNA target sequence
tattactgtctacaattatagcttgtt

SEQ ID NO: 63400 - DNA, 27 bp, Artificial sequence
  SiRNA target sequence
attactgtctacaattatagcttgtta

SEQ ID NO: 63401 - DNA, 27 bp, Artificial sequence
  SiRNA target sequence
ttactgtctacaattatagcttgttat

SEQ ID NO: 63402 - DNA, 27 bp, Artificial sequence
  SiRNA target sequence
tactgtctacaattatagcttgttatc

SEQ ID NO: 63403 - DNA, 27 bp, Artificial sequence
  SiRNA target sequence
actgtctacaattatagcttgttatct

SEQ ID NO: 63404 - DNA, 27 bp, Artificial sequence
  SiRNA target sequence
ctgtctacaattatagcttgttatctc

SEQ ID NO: 63405 - DNA, 27 bp, Artificial sequence
  SiRNA target sequence
tgtctacaattatagcttgttatctcg

SEQ ID NO: 63406 - DNA, 27 bp, Artificial sequence
  SiRNA target sequence
gtctacaattatagcttgttatctcga

SEQ ID NO: 63407 - DNA, 27 bp, Artificial sequence
  SiRNA target sequence
tctacaattatagcttgttatctcgaa

SEQ ID NO: 63408 - DNA, 27 bp, Artificial sequence
  SiRNA target sequence
ctacaattatagcttgttatctcgaag

SEQ ID NO: 63409 - DNA, 27 bp, Artificial sequence
  SiRNA target sequence
tacaattatagcttgttatctcgaagt

SEQ ID NO: 63410 - DNA, 27 bp, Artificial sequence
  SiRNA target sequence
acaattatagcttgttatctcgaagtt

SEQ ID NO: 63411 - DNA, 27 bp, Artificial sequence
  SiRNA target sequence
caattatagcttgttatctcgaagttc

SEQ ID NO: 63412 - DNA, 27 bp, Artificial sequence
  SiRNA target sequence
aattatagcttgttatctcgaagttca

SEQ ID NO: 63413 - DNA, 27 bp, Artificial sequence
  SiRNA target sequence
attatagcttgttatctcgaagttcag

SEQ ID NO: 63414 - DNA, 27 bp, Artificial sequence
  SiRNA target sequence
ttatagcttgttatctcgaagttcagg

SEQ ID NO: 63415 - DNA, 27 bp, Artificial sequence
  SiRNA target sequence
tatagcttgttatctcgaagttcaggc

SEQ ID NO: 63416 - DNA, 27 bp, Artificial sequence
  SiRNA target sequence
atagcttgttatctcgaagttcaggca

SEQ ID NO: 63417 - DNA, 27 bp, Artificial sequence
  SiRNA target sequence
tagcttgttatctcgaagttcaggcaa

SEQ ID NO: 63418 - DNA, 27 bp, Artificial sequence
  SiRNA target sequence
agcttgttatctcgaagttcaggcaag

SEQ ID NO: 63419 - DNA, 27 bp, Artificial sequence
  SiRNA target sequence
gcttgttatctcgaagttcaggcaagt

SEQ ID NO: 63420 - DNA, 27 bp, Artificial sequence
  SiRNA target sequence
cttgttatctcgaagttcaggcaagta

SEQ ID NO: 63421 - DNA, 27 bp, Artificial sequence
  SiRNA target sequence
ttgttatctcgaagttcaggcaagtaa

SEQ ID NO: 63422 - DNA, 27 bp, Artificial sequence
  SiRNA target sequence
tgttatctcgaagttcaggcaagtaac

SEQ ID NO: 63423 - DNA, 27 bp, Artificial sequence
  SiRNA target sequence
gttatctcgaagttcaggcaagtaaca

SEQ ID NO: 63424 - DNA, 27 bp, Artificial sequence
  SiRNA target sequence
ttatctcgaagttcaggcaagtaacat

SEQ ID NO: 63425 - DNA, 27 bp, Artificial sequence
  SiRNA target sequence
tatctcgaagttcaggcaagtaacata

SEQ ID NO: 63426 - DNA, 27 bp, Artificial sequence
  SiRNA target sequence
atctcgaagttcaggcaagtaacatat

SEQ ID NO: 63427 - DNA, 27 bp, Artificial sequence
  SiRNA target sequence
tctcgaagttcaggcaagtaacatatc

SEQ ID NO: 63428 - DNA, 27 bp, Artificial sequence
  SiRNA target sequence
ctcgaagttcaggcaagtaacatatca

SEQ ID NO: 63429 - DNA, 27 bp, Artificial sequence
  SiRNA target sequence
tcgaagttcaggcaagtaacatatcaa

SEQ ID NO: 63430 - DNA, 27 bp, Artificial sequence
  SiRNA target sequence
cgaagttcaggcaagtaacatatcaaa

SEQ ID NO: 63431 - DNA, 27 bp, Artificial sequence
  SiRNA target sequence
gaagttcaggcaagtaacatatcaaaa

SEQ ID NO: 63432 - DNA, 27 bp, Artificial sequence
  SiRNA target sequence
aagttcaggcaagtaacatatcaaaaa

SEQ ID NO: 63433 - DNA, 27 bp, Artificial sequence
  SiRNA target sequence
agttcaggcaagtaacatatcaaaaag

SEQ ID NO: 63434 - DNA, 27 bp, Artificial sequence
  SiRNA target sequence
gttcaggcaagtaacatatcaaaaaga

SEQ ID NO: 63435 - DNA, 27 bp, Artificial sequence
  SiRNA target sequence
ttcaggcaagtaacatatcaaaaagaa

SEQ ID NO: 63436 - DNA, 27 bp, Artificial sequence
  SiRNA target sequence
tcaggcaagtaacatatcaaaaagaat

SEQ ID NO: 63437 - DNA, 27 bp, Artificial sequence
  SiRNA target sequence
caggcaagtaacatatcaaaaagaatt

SEQ ID NO: 63438 - DNA, 27 bp, Artificial sequence
  SiRNA target sequence
aggcaagtaacatatcaaaaagaattg

SEQ ID NO: 63439 - DNA, 27 bp, Artificial sequence
  SiRNA target sequence
ggcaagtaacatatcaaaaagaattgc

SEQ ID NO: 63440 - DNA, 27 bp, Artificial sequence
  SiRNA target sequence
gcaagtaacatatcaaaaagaattgca

SEQ ID NO: 63441 - DNA, 27 bp, Artificial sequence
  SiRNA target sequence
caagtaacatatcaaaaagaattgcag

SEQ ID NO: 63442 - DNA, 27 bp, Artificial sequence
  SiRNA target sequence
aagtaacatatcaaaaagaattgcaga

SEQ ID NO: 63443 - DNA, 27 bp, Artificial sequence
  SiRNA target sequence
agtaacatatcaaaaagaattgcagaa

SEQ ID NO: 63444 - DNA, 27 bp, Artificial sequence
  SiRNA target sequence
gtaacatatcaaaaagaattgcagaag

SEQ ID NO: 63445 - DNA, 27 bp, Artificial sequence
  SiRNA target sequence
taacatatcaaaaagaattgcagaaga

SEQ ID NO: 63446 - DNA, 27 bp, Artificial sequence
  SiRNA target sequence
aacatatcaaaaagaattgcagaagat

SEQ ID NO: 63447 - DNA, 27 bp, Artificial sequence
  SiRNA target sequence
acatatcaaaaagaattgcagaagatt

SEQ ID NO: 63448 - DNA, 27 bp, Artificial sequence
  SiRNA target sequence
catatcaaaaagaattgcagaagattt

SEQ ID NO: 63449 - DNA, 27 bp, Artificial sequence
  SiRNA target sequence
atatcaaaaagaattgcagaagatttt

SEQ ID NO: 63450 - DNA, 27 bp, Artificial sequence
  SiRNA target sequence
tatcaaaaagaattgcagaagattttg

SEQ ID NO: 63451 - DNA, 27 bp, Artificial sequence
  SiRNA target sequence
atcaaaaagaattgcagaagattttga

SEQ ID NO: 63452 - DNA, 27 bp, Artificial sequence
  SiRNA target sequence
tcaaaaagaattgcagaagattttgaa

SEQ ID NO: 63453 - DNA, 27 bp, Artificial sequence
  SiRNA target sequence
caaaaagaattgcagaagattttgaaa

SEQ ID NO: 63454 - DNA, 27 bp, Artificial sequence
  SiRNA target sequence
aaaaagaattgcagaagattttgaaaa

SEQ ID NO: 63455 - DNA, 27 bp, Artificial sequence
  SiRNA target sequence
aaaagaattgcagaagattttgaaaat

SEQ ID NO: 63456 - DNA, 27 bp, Artificial sequence
  SiRNA target sequence
aaagaattgcagaagattttgaaaata

SEQ ID NO: 63457 - DNA, 27 bp, Artificial sequence
  SiRNA target sequence
aagaattgcagaagattttgaaaataa

SEQ ID NO: 63458 - DNA, 27 bp, Artificial sequence
  SiRNA target sequence
agaattgcagaagattttgaaaataaa

SEQ ID NO: 63459 - DNA, 27 bp, Artificial sequence
  SiRNA target sequence
gaattgcagaagattttgaaaataaaa

SEQ ID NO: 63460 - DNA, 27 bp, Artificial sequence
  SiRNA target sequence
aattgcagaagattttgaaaataaaat

SEQ ID NO: 63461 - DNA, 27 bp, Artificial sequence
  SiRNA target sequence
attgcagaagattttgaaaataaaata

SEQ ID NO: 63462 - DNA, 27 bp, Artificial sequence
  SiRNA target sequence
ttgcagaagattttgaaaataaaataa

SEQ ID NO: 63463 - DNA, 27 bp, Artificial sequence
  SiRNA target sequence
tgcagaagattttgaaaataaaataaa

SEQ ID NO: 63464 - DNA, 27 bp, Artificial sequence
  SiRNA target sequence
gcagaagattttgaaaataaaataaat

SEQ ID NO: 63465 - DNA, 27 bp, Artificial sequence
  SiRNA target sequence
cagaagattttgaaaataaaataaatg

SEQ ID NO: 63466 - DNA, 27 bp, Artificial sequence
  SiRNA target sequence
agaagattttgaaaataaaataaatgc

SEQ ID NO: 63467 - DNA, 27 bp, Artificial sequence
  SiRNA target sequence
gaagattttgaaaataaaataaatgca

SEQ ID NO: 63468 - DNA, 27 bp, Artificial sequence
  SiRNA target sequence
aagattttgaaaataaaataaatgcag

SEQ ID NO: 63469 - DNA, 27 bp, Artificial sequence
  SiRNA target sequence
agattttgaaaataaaataaatgcagg

SEQ ID NO: 63470 - DNA, 27 bp, Artificial sequence
  SiRNA target sequence
gattttgaaaataaaataaatgcagga

SEQ ID NO: 63471 - DNA, 27 bp, Artificial sequence
  SiRNA target sequence
attttgaaaataaaataaatgcaggaa

SEQ ID NO: 63472 - DNA, 27 bp, Artificial sequence
  SiRNA target sequence
ttttgaaaataaaataaatgcaggaaa

SEQ ID NO: 63473 - DNA, 27 bp, Artificial sequence
  SiRNA target sequence
tttgaaaataaaataaatgcaggaaaa

SEQ ID NO: 63474 - DNA, 27 bp, Artificial sequence
  SiRNA target sequence
ttgaaaataaaataaatgcaggaaaaa

SEQ ID NO: 63475 - DNA, 27 bp, Artificial sequence
  SiRNA target sequence
tgaaaataaaataaatgcaggaaaaag

SEQ ID NO: 63476 - DNA, 27 bp, Artificial sequence
  SiRNA target sequence
gaaaataaaataaatgcaggaaaaagt

SEQ ID NO: 63477 - DNA, 27 bp, Artificial sequence
  SiRNA target sequence
aaaataaaataaatgcaggaaaaagta

SEQ ID NO: 63478 - DNA, 27 bp, Artificial sequence
  SiRNA target sequence
aaataaaataaatgcaggaaaaagtat

SEQ ID NO: 63479 - DNA, 27 bp, Artificial sequence
  SiRNA target sequence
aataaaataaatgcaggaaaaagtata

SEQ ID NO: 63480 - DNA, 27 bp, Artificial sequence
  SiRNA target sequence
ataaaataaatgcaggaaaaagtatat

SEQ ID NO: 63481 - DNA, 27 bp, Artificial sequence
  SiRNA target sequence
taaaataaatgcaggaaaaagtatatt

SEQ ID NO: 63482 - DNA, 27 bp, Artificial sequence
  SiRNA target sequence
aaaataaatgcaggaaaaagtatattt

SEQ ID NO: 63483 - DNA, 27 bp, Artificial sequence
  SiRNA target sequence
aaataaatgcaggaaaaagtatattta

SEQ ID NO: 63484 - DNA, 27 bp, Artificial sequence
  SiRNA target sequence
aataaatgcaggaaaaagtatatttaa

SEQ ID NO: 63485 - DNA, 27 bp, Artificial sequence
  SiRNA target sequence
ataaatgcaggaaaaagtatatttaaa

SEQ ID NO: 63486 - DNA, 27 bp, Artificial sequence
  SiRNA target sequence
taaatgcaggaaaaagtatatttaaat

SEQ ID NO: 63487 - DNA, 27 bp, Artificial sequence
  SiRNA target sequence
aaatgcaggaaaaagtatatttaaata

SEQ ID NO: 63488 - DNA, 27 bp, Artificial sequence
  SiRNA target sequence
aatgcaggaaaaagtatatttaaatat

SEQ ID NO: 63489 - DNA, 27 bp, Artificial sequence
  SiRNA target sequence
atgcaggaaaaagtatatttaaatata

SEQ ID NO: 63490 - DNA, 27 bp, Artificial sequence
  SiRNA target sequence
tgcaggaaaaagtatatttaaatatat

SEQ ID NO: 63491 - DNA, 27 bp, Artificial sequence
  SiRNA target sequence
gcaggaaaaagtatatttaaatatatt

SEQ ID NO: 63492 - DNA, 27 bp, Artificial sequence
  SiRNA target sequence
caggaaaaagtatatttaaatatattt

SEQ ID NO: 63493 - DNA, 27 bp, Artificial sequence
  SiRNA target sequence
aggaaaaagtatatttaaatatatttt

SEQ ID NO: 63494 - DNA, 27 bp, Artificial sequence
  SiRNA target sequence
ggaaaaagtatatttaaatatatttta

SEQ ID NO: 63495 - DNA, 27 bp, Artificial sequence
  SiRNA target sequence
gaaaaagtatatttaaatatattttat

SEQ ID NO: 63496 - DNA, 27 bp, Artificial sequence
  SiRNA target sequence
aaaaagtatatttaaatatattttatt

SEQ ID NO: 63497 - DNA, 27 bp, Artificial sequence
  SiRNA target sequence
aaaagtatatttaaatatattttattt

SEQ ID NO: 63498 - DNA, 27 bp, Artificial sequence
  SiRNA target sequence
aaagtatatttaaatatattttatttt

SEQ ID NO: 63499 - DNA, 27 bp, Artificial sequence
  SiRNA target sequence
aagtatatttaaatatattttattttt

SEQ ID NO: 63500 - DNA, 27 bp, Artificial sequence
  SiRNA target sequence
agtatatttaaatatattttattttta

SEQ ID NO: 63501 - DNA, 27 bp, Artificial sequence
  SiRNA target sequence
gtatatttaaatatattttatttttaa

SEQ ID NO: 63502 - DNA, 27 bp, Artificial sequence
  SiRNA target sequence
tatatttaaatatattttatttttaac

SEQ ID NO: 63503 - DNA, 27 bp, Artificial sequence
  SiRNA target sequence
atatttaaatatattttatttttaact

SEQ ID NO: 63504 - DNA, 27 bp, Artificial sequence
  SiRNA target sequence
tatttaaatatattttatttttaactt

SEQ ID NO: 63505 - DNA, 27 bp, Artificial sequence
  SiRNA target sequence
atttaaatatattttatttttaacttc

SEQ ID NO: 63506 - DNA, 27 bp, Artificial sequence
  SiRNA target sequence
tttaaatatattttatttttaacttca

SEQ ID NO: 63507 - DNA, 27 bp, Artificial sequence
  SiRNA target sequence
ttaaatatattttatttttaacttcat

SEQ ID NO: 63508 - DNA, 27 bp, Artificial sequence
  SiRNA target sequence
taaatatattttatttttaacttcatc

SEQ ID NO: 63509 - DNA, 27 bp, Artificial sequence
  SiRNA target sequence
aaatatattttatttttaacttcatca

SEQ ID NO: 63510 - DNA, 27 bp, Artificial sequence
  SiRNA target sequence
aatatattttatttttaacttcatcaa

SEQ ID NO: 63511 - DNA, 27 bp, Artificial sequence
  SiRNA target sequence
atatattttatttttaacttcatcaat

SEQ ID NO: 63512 - DNA, 27 bp, Artificial sequence
  SiRNA target sequence
tatattttatttttaacttcatcaata

SEQ ID NO: 63513 - DNA, 27 bp, Artificial sequence
  SiRNA target sequence
atattttatttttaacttcatcaatag

SEQ ID NO: 63514 - DNA, 27 bp, Artificial sequence
  SiRNA target sequence
tattttatttttaacttcatcaatagt

SEQ ID NO: 63515 - DNA, 27 bp, Artificial sequence
  SiRNA target sequence
attttatttttaacttcatcaatagta

SEQ ID NO: 63516 - DNA, 27 bp, Artificial sequence
  SiRNA target sequence
ttttatttttaacttcatcaatagtat

SEQ ID NO: 63517 - DNA, 27 bp, Artificial sequence
  SiRNA target sequence
tttatttttaacttcatcaatagtatt

SEQ ID NO: 63518 - DNA, 27 bp, Artificial sequence
  SiRNA target sequence
ttatttttaacttcatcaatagtatta

SEQ ID NO: 63519 - DNA, 27 bp, Artificial sequence
  SiRNA target sequence
tatttttaacttcatcaatagtattaa

SEQ ID NO: 63520 - DNA, 27 bp, Artificial sequence
  SiRNA target sequence
atttttaacttcatcaatagtattaag

SEQ ID NO: 63521 - DNA, 27 bp, Artificial sequence
  SiRNA target sequence
tttttaacttcatcaatagtattaaga

SEQ ID NO: 63522 - DNA, 27 bp, Artificial sequence
  SiRNA target sequence
ttttaacttcatcaatagtattaagac

SEQ ID NO: 63523 - DNA, 27 bp, Artificial sequence
  SiRNA target sequence
tttaacttcatcaatagtattaagaca

SEQ ID NO: 63524 - DNA, 27 bp, Artificial sequence
  SiRNA target sequence
ttaacttcatcaatagtattaagacaa

SEQ ID NO: 63525 - DNA, 27 bp, Artificial sequence
  SiRNA target sequence
taacttcatcaatagtattaagacaaa

SEQ ID NO: 63526 - DNA, 27 bp, Artificial sequence
  SiRNA target sequence
aacttcatcaatagtattaagacaaat

SEQ ID NO: 63527 - DNA, 27 bp, Artificial sequence
  SiRNA target sequence
acttcatcaatagtattaagacaaatt

SEQ ID NO: 63528 - DNA, 27 bp, Artificial sequence
  SiRNA target sequence
cttcatcaatagtattaagacaaatta

SEQ ID NO: 63529 - DNA, 27 bp, Artificial sequence
  SiRNA target sequence
ttcatcaatagtattaagacaaattaa

SEQ ID NO: 63530 - DNA, 27 bp, Artificial sequence
  SiRNA target sequence
tcatcaatagtattaagacaaattaat

SEQ ID NO: 63531 - DNA, 27 bp, Artificial sequence
  SiRNA target sequence
catcaatagtattaagacaaattaatg

SEQ ID NO: 63532 - DNA, 27 bp, Artificial sequence
  SiRNA target sequence
atcaatagtattaagacaaattaatga

SEQ ID NO: 63533 - DNA, 27 bp, Artificial sequence
  SiRNA target sequence
tcaatagtattaagacaaattaatgat

SEQ ID NO: 63534 - DNA, 27 bp, Artificial sequence
  SiRNA target sequence
caatagtattaagacaaattaatgata

SEQ ID NO: 63535 - DNA, 27 bp, Artificial sequence
  SiRNA target sequence
aatagtattaagacaaattaatgatat

SEQ ID NO: 63536 - DNA, 27 bp, Artificial sequence
  SiRNA target sequence
atagtattaagacaaattaatgatatt

SEQ ID NO: 63537 - DNA, 27 bp, Artificial sequence
  SiRNA target sequence
tagtattaagacaaattaatgatattg

SEQ ID NO: 63538 - DNA, 27 bp, Artificial sequence
  SiRNA target sequence
agtattaagacaaattaatgatattgt

SEQ ID NO: 63539 - DNA, 27 bp, Artificial sequence
  SiRNA target sequence
gtattaagacaaattaatgatattgtg

SEQ ID NO: 63540 - DNA, 27 bp, Artificial sequence
  SiRNA target sequence
tattaagacaaattaatgatattgtgt

SEQ ID NO: 63541 - DNA, 27 bp, Artificial sequence
  SiRNA target sequence
attaagacaaattaatgatattgtgtt

SEQ ID NO: 63542 - DNA, 27 bp, Artificial sequence
  SiRNA target sequence
ttaagacaaattaatgatattgtgttt

SEQ ID NO: 63543 - DNA, 27 bp, Artificial sequence
  SiRNA target sequence
taagacaaattaatgatattgtgttta

SEQ ID NO: 63544 - DNA, 27 bp, Artificial sequence
  SiRNA target sequence
aagacaaattaatgatattgtgtttag

SEQ ID NO: 63545 - DNA, 27 bp, Artificial sequence
  SiRNA target sequence
agacaaattaatgatattgtgtttagc

SEQ ID NO: 63546 - DNA, 27 bp, Artificial sequence
  SiRNA target sequence
gacaaattaatgatattgtgtttagcg

SEQ ID NO: 63547 - DNA, 27 bp, Artificial sequence
  SiRNA target sequence
acaaattaatgatattgtgtttagcgg

SEQ ID NO: 63548 - DNA, 27 bp, Artificial sequence
  SiRNA target sequence
caaattaatgatattgtgtttagcggg

SEQ ID NO: 63549 - DNA, 27 bp, Artificial sequence
  SiRNA target sequence
aaattaatgatattgtgtttagcgggc

SEQ ID NO: 63550 - DNA, 27 bp, Artificial sequence
  SiRNA target sequence
aattaatgatattgtgtttagcgggcc

SEQ ID NO: 63551 - DNA, 27 bp, Artificial sequence
  SiRNA target sequence
attaatgatattgtgtttagcgggcca

SEQ ID NO: 63552 - DNA, 27 bp, Artificial sequence
  SiRNA target sequence
ttaatgatattgtgtttagcgggccaa

SEQ ID NO: 63553 - DNA, 27 bp, Artificial sequence
  SiRNA target sequence
taatgatattgtgtttagcgggccaat

SEQ ID NO: 63554 - DNA, 27 bp, Artificial sequence
  SiRNA target sequence
aatgatattgtgtttagcgggccaata

SEQ ID NO: 63555 - DNA, 27 bp, Artificial sequence
  SiRNA target sequence
atgatattgtgtttagcgggccaatac

SEQ ID NO: 63556 - DNA, 27 bp, Artificial sequence
  SiRNA target sequence
tgatattgtgtttagcgggccaataca

SEQ ID NO: 63557 - DNA, 27 bp, Artificial sequence
  SiRNA target sequence
gatattgtgtttagcgggccaatacaa

SEQ ID NO: 63558 - DNA, 27 bp, Artificial sequence
  SiRNA target sequence
atattgtgtttagcgggccaatacaat

SEQ ID NO: 63559 - DNA, 27 bp, Artificial sequence
  SiRNA target sequence
tattgtgtttagcgggccaatacaatt

SEQ ID NO: 63560 - DNA, 27 bp, Artificial sequence
  SiRNA target sequence
attgtgtttagcgggccaatacaattt

SEQ ID NO: 63561 - DNA, 27 bp, Artificial sequence
  SiRNA target sequence
ttgtgtttagcgggccaatacaatttt

SEQ ID NO: 63562 - DNA, 27 bp, Artificial sequence
  SiRNA target sequence
tgtgtttagcgggccaatacaattttt

SEQ ID NO: 63563 - DNA, 27 bp, Artificial sequence
  SiRNA target sequence
gtgtttagcgggccaatacaattttta

SEQ ID NO: 63564 - DNA, 27 bp, Artificial sequence
  SiRNA target sequence
tgtttagcgggccaatacaatttttat

SEQ ID NO: 63565 - DNA, 27 bp, Artificial sequence
  SiRNA target sequence
gtttagcgggccaatacaatttttata

SEQ ID NO: 63566 - DNA, 27 bp, Artificial sequence
  SiRNA target sequence
tttagcgggccaatacaatttttatat

SEQ ID NO: 63567 - DNA, 27 bp, Artificial sequence
  SiRNA target sequence
ttagcgggccaatacaatttttatata

SEQ ID NO: 63568 - DNA, 27 bp, Artificial sequence
  SiRNA target sequence
tagcgggccaatacaatttttatataa

SEQ ID NO: 63569 - DNA, 27 bp, Artificial sequence
  SiRNA target sequence
agcgggccaatacaatttttatataaa

SEQ ID NO: 63570 - DNA, 27 bp, Artificial sequence
  SiRNA target sequence
gcgggccaatacaatttttatataaaa

SEQ ID NO: 63571 - DNA, 27 bp, Artificial sequence
  SiRNA target sequence
cgggccaatacaatttttatataaaat

SEQ ID NO: 63572 - DNA, 27 bp, Artificial sequence
  SiRNA target sequence
gggccaatacaatttttatataaaatt

SEQ ID NO: 63573 - DNA, 27 bp, Artificial sequence
  SiRNA target sequence
ggccaatacaatttttatataaaattg

SEQ ID NO: 63574 - DNA, 27 bp, Artificial sequence
  SiRNA target sequence
gccaatacaatttttatataaaattgt

SEQ ID NO: 63575 - DNA, 27 bp, Artificial sequence
  SiRNA target sequence
ccaatacaatttttatataaaattgtt

SEQ ID NO: 63576 - DNA, 27 bp, Artificial sequence
  SiRNA target sequence
caatacaatttttatataaaattgttg

SEQ ID NO: 63577 - DNA, 27 bp, Artificial sequence
  SiRNA target sequence
aatacaatttttatataaaattgttgg

SEQ ID NO: 63578 - DNA, 27 bp, Artificial sequence
  SiRNA target sequence
atacaatttttatataaaattgttgga

SEQ ID NO: 63579 - DNA, 27 bp, Artificial sequence
  SiRNA target sequence
tacaatttttatataaaattgttggag

SEQ ID NO: 63580 - DNA, 27 bp, Artificial sequence
  SiRNA target sequence
acaatttttatataaaattgttggagt

SEQ ID NO: 63581 - DNA, 27 bp, Artificial sequence
  SiRNA target sequence
caatttttatataaaattgttggagtt

SEQ ID NO: 63582 - DNA, 27 bp, Artificial sequence
  SiRNA target sequence
aatttttatataaaattgttggagttg

SEQ ID NO: 63583 - DNA, 27 bp, Artificial sequence
  SiRNA target sequence
atttttatataaaattgttggagttga

SEQ ID NO: 63584 - DNA, 27 bp, Artificial sequence
  SiRNA target sequence
tttttatataaaattgttggagttgaa

SEQ ID NO: 63585 - DNA, 27 bp, Artificial sequence
  SiRNA target sequence
ttttatataaaattgttggagttgaag

SEQ ID NO: 63586 - DNA, 27 bp, Artificial sequence
  SiRNA target sequence
tttatataaaattgttggagttgaagc

SEQ ID NO: 63587 - DNA, 27 bp, Artificial sequence
  SiRNA target sequence
ttatataaaattgttggagttgaagca

SEQ ID NO: 63588 - DNA, 27 bp, Artificial sequence
  SiRNA target sequence
tatataaaattgttggagttgaagcat

SEQ ID NO: 63589 - DNA, 27 bp, Artificial sequence
  SiRNA target sequence
atataaaattgttggagttgaagcatt

SEQ ID NO: 63590 - DNA, 27 bp, Artificial sequence
  SiRNA target sequence
tataaaattgttggagttgaagcattt

SEQ ID NO: 63591 - DNA, 27 bp, Artificial sequence
  SiRNA target sequence
ataaaattgttggagttgaagcatttt

SEQ ID NO: 63592 - DNA, 27 bp, Artificial sequence
  SiRNA target sequence
taaaattgttggagttgaagcatttta

SEQ ID NO: 63593 - DNA, 27 bp, Artificial sequence
  SiRNA target sequence
aaaattgttggagttgaagcattttat

SEQ ID NO: 63594 - DNA, 27 bp, Artificial sequence
  SiRNA target sequence
aaattgttggagttgaagcattttatc

SEQ ID NO: 63595 - DNA, 27 bp, Artificial sequence
  SiRNA target sequence
aattgttggagttgaagcattttatca

SEQ ID NO: 63596 - DNA, 27 bp, Artificial sequence
  SiRNA target sequence
attgttggagttgaagcattttatcat

SEQ ID NO: 63597 - DNA, 27 bp, Artificial sequence
  SiRNA target sequence
ttgttggagttgaagcattttatcatt

SEQ ID NO: 63598 - DNA, 27 bp, Artificial sequence
  SiRNA target sequence
tgttggagttgaagcattttatcatta

SEQ ID NO: 63599 - DNA, 27 bp, Artificial sequence
  SiRNA target sequence
gttggagttgaagcattttatcattac

SEQ ID NO: 63600 - DNA, 27 bp, Artificial sequence
  SiRNA target sequence
ttggagttgaagcattttatcattaca

SEQ ID NO: 63601 - DNA, 27 bp, Artificial sequence
  SiRNA target sequence
tggagttgaagcattttatcattacat

SEQ ID NO: 63602 - DNA, 27 bp, Artificial sequence
  SiRNA target sequence
ggagttgaagcattttatcattacatt

SEQ ID NO: 63603 - DNA, 27 bp, Artificial sequence
  SiRNA target sequence
gagttgaagcattttatcattacattt

SEQ ID NO: 63604 - DNA, 27 bp, Artificial sequence
  SiRNA target sequence
agttgaagcattttatcattacatttc

SEQ ID NO: 63605 - DNA, 27 bp, Artificial sequence
  SiRNA target sequence
gttgaagcattttatcattacatttca

SEQ ID NO: 63606 - DNA, 27 bp, Artificial sequence
  SiRNA target sequence
ttgaagcattttatcattacatttcat

SEQ ID NO: 63607 - DNA, 27 bp, Artificial sequence
  SiRNA target sequence
tgaagcattttatcattacatttcatt

SEQ ID NO: 63608 - DNA, 27 bp, Artificial sequence
  SiRNA target sequence
gaagcattttatcattacatttcatta

SEQ ID NO: 63609 - DNA, 27 bp, Artificial sequence
  SiRNA target sequence
aagcattttatcattacatttcattaa

SEQ ID NO: 63610 - DNA, 27 bp, Artificial sequence
  SiRNA target sequence
agcattttatcattacatttcattaaa

SEQ ID NO: 63611 - DNA, 27 bp, Artificial sequence
  SiRNA target sequence
gcattttatcattacatttcattaaac

SEQ ID NO: 63612 - DNA, 27 bp, Artificial sequence
  SiRNA target sequence
cattttatcattacatttcattaaact

SEQ ID NO: 63613 - DNA, 27 bp, Artificial sequence
  SiRNA target sequence
attttatcattacatttcattaaactt

SEQ ID NO: 63614 - DNA, 27 bp, Artificial sequence
  SiRNA target sequence
ttttatcattacatttcattaaactta

SEQ ID NO: 63615 - DNA, 27 bp, Artificial sequence
  SiRNA target sequence
tttatcattacatttcattaaacttag

SEQ ID NO: 63616 - DNA, 27 bp, Artificial sequence
  SiRNA target sequence
ttatcattacatttcattaaacttaga

SEQ ID NO: 63617 - DNA, 27 bp, Artificial sequence
  SiRNA target sequence
tatcattacatttcattaaacttagaa

SEQ ID NO: 63618 - DNA, 27 bp, Artificial sequence
  SiRNA target sequence
atcattacatttcattaaacttagaaa

SEQ ID NO: 63619 - DNA, 27 bp, Artificial sequence
  SiRNA target sequence
tcattacatttcattaaacttagaaaa

SEQ ID NO: 63620 - DNA, 27 bp, Artificial sequence
  SiRNA target sequence
cattacatttcattaaacttagaaaat

SEQ ID NO: 63621 - DNA, 27 bp, Artificial sequence
  SiRNA target sequence
attacatttcattaaacttagaaaatt

SEQ ID NO: 63622 - DNA, 27 bp, Artificial sequence
  SiRNA target sequence
ttacatttcattaaacttagaaaattt

SEQ ID NO: 63623 - DNA, 27 bp, Artificial sequence
  SiRNA target sequence
tacatttcattaaacttagaaaatttt

SEQ ID NO: 63624 - DNA, 27 bp, Artificial sequence
  SiRNA target sequence
acatttcattaaacttagaaaatttta

SEQ ID NO: 63625 - DNA, 27 bp, Artificial sequence
  SiRNA target sequence
catttcattaaacttagaaaattttaa

SEQ ID NO: 63626 - DNA, 27 bp, Artificial sequence
  SiRNA target sequence
atttcattaaacttagaaaattttaac

SEQ ID NO: 63627 - DNA, 27 bp, Artificial sequence
  SiRNA target sequence
tttcattaaacttagaaaattttaaca

SEQ ID NO: 63628 - DNA, 27 bp, Artificial sequence
  SiRNA target sequence
ttcattaaacttagaaaattttaacaa

SEQ ID NO: 63629 - DNA, 27 bp, Artificial sequence
  SiRNA target sequence
tcattaaacttagaaaattttaacaaa

SEQ ID NO: 63630 - DNA, 27 bp, Artificial sequence
  SiRNA target sequence
cattaaacttagaaaattttaacaaaa

SEQ ID NO: 63631 - DNA, 27 bp, Artificial sequence
  SiRNA target sequence
attaaacttagaaaattttaacaaaat

SEQ ID NO: 63632 - DNA, 27 bp, Artificial sequence
  SiRNA target sequence
ttaaacttagaaaattttaacaaaata

SEQ ID NO: 63633 - DNA, 27 bp, Artificial sequence
  SiRNA target sequence
taaacttagaaaattttaacaaaatag

SEQ ID NO: 63634 - DNA, 27 bp, Artificial sequence
  SiRNA target sequence
aaacttagaaaattttaacaaaatagg

SEQ ID NO: 63635 - DNA, 27 bp, Artificial sequence
  SiRNA target sequence
aacttagaaaattttaacaaaatagga

SEQ ID NO: 63636 - DNA, 27 bp, Artificial sequence
  SiRNA target sequence
acttagaaaattttaacaaaataggaa

SEQ ID NO: 63637 - DNA, 27 bp, Artificial sequence
  SiRNA target sequence
cttagaaaattttaacaaaataggaag

SEQ ID NO: 63638 - DNA, 27 bp, Artificial sequence
  SiRNA target sequence
ttagaaaattttaacaaaataggaagt

SEQ ID NO: 63639 - DNA, 27 bp, Artificial sequence
  SiRNA target sequence
tagaaaattttaacaaaataggaagtg

SEQ ID NO: 63640 - DNA, 27 bp, Artificial sequence
  SiRNA target sequence
agaaaattttaacaaaataggaagtgg

SEQ ID NO: 63641 - DNA, 27 bp, Artificial sequence
  SiRNA target sequence
gaaaattttaacaaaataggaagtgga

SEQ ID NO: 63642 - DNA, 27 bp, Artificial sequence
  SiRNA target sequence
aaaattttaacaaaataggaagtggag

SEQ ID NO: 63643 - DNA, 27 bp, Artificial sequence
  SiRNA target sequence
aaattttaacaaaataggaagtggaga

SEQ ID NO: 63644 - DNA, 27 bp, Artificial sequence
  SiRNA target sequence
aattttaacaaaataggaagtggagag

SEQ ID NO: 63645 - DNA, 27 bp, Artificial sequence
  SiRNA target sequence
attttaacaaaataggaagtggagaga

SEQ ID NO: 63646 - DNA, 27 bp, Artificial sequence
  SiRNA target sequence
ttttaacaaaataggaagtggagagat

SEQ ID NO: 63647 - DNA, 27 bp, Artificial sequence
  SiRNA target sequence
tttaacaaaataggaagtggagagata

SEQ ID NO: 63648 - DNA, 27 bp, Artificial sequence
  SiRNA target sequence
ttaacaaaataggaagtggagagatac

SEQ ID NO: 63649 - DNA, 27 bp, Artificial sequence
  SiRNA target sequence
taacaaaataggaagtggagagataca

SEQ ID NO: 63650 - DNA, 27 bp, Artificial sequence
  SiRNA target sequence
aacaaaataggaagtggagagatacaa

SEQ ID NO: 63651 - DNA, 27 bp, Artificial sequence
  SiRNA target sequence
acaaaataggaagtggagagatacaaa

SEQ ID NO: 63652 - DNA, 27 bp, Artificial sequence
  SiRNA target sequence
caaaataggaagtggagagatacaaat

SEQ ID NO: 63653 - DNA, 27 bp, Artificial sequence
  SiRNA target sequence
aaaataggaagtggagagatacaaatg

SEQ ID NO: 63654 - DNA, 27 bp, Artificial sequence
  SiRNA target sequence
aaataggaagtggagagatacaaatga

SEQ ID NO: 63655 - DNA, 27 bp, Artificial sequence
  SiRNA target sequence
aataggaagtggagagatacaaatgat

SEQ ID NO: 63656 - DNA, 27 bp, Artificial sequence
  SiRNA target sequence
ataggaagtggagagatacaaatgatt

SEQ ID NO: 63657 - DNA, 27 bp, Artificial sequence
  SiRNA target sequence
taggaagtggagagatacaaatgatta

SEQ ID NO: 63658 - DNA, 27 bp, Artificial sequence
  SiRNA target sequence
aggaagtggagagatacaaatgattat

SEQ ID NO: 63659 - DNA, 27 bp, Artificial sequence
  SiRNA target sequence
ggaagtggagagatacaaatgattatt

SEQ ID NO: 63660 - DNA, 27 bp, Artificial sequence
  SiRNA target sequence
gaagtggagagatacaaatgattattg

SEQ ID NO: 63661 - DNA, 27 bp, Artificial sequence
  SiRNA target sequence
aagtggagagatacaaatgattattga

SEQ ID NO: 63662 - DNA, 27 bp, Artificial sequence
  SiRNA target sequence
agtggagagatacaaatgattattgag

SEQ ID NO: 63663 - DNA, 27 bp, Artificial sequence
  SiRNA target sequence
gtggagagatacaaatgattattgagc

SEQ ID NO: 63664 - DNA, 27 bp, Artificial sequence
  SiRNA target sequence
tggagagatacaaatgattattgagcg

SEQ ID NO: 63665 - DNA, 27 bp, Artificial sequence
  SiRNA target sequence
ggagagatacaaatgattattgagcgg

SEQ ID NO: 63666 - DNA, 27 bp, Artificial sequence
  SiRNA target sequence
gagagatacaaatgattattgagcgga

SEQ ID NO: 63667 - DNA, 27 bp, Artificial sequence
  SiRNA target sequence
agagatacaaatgattattgagcggaa

SEQ ID NO: 63668 - DNA, 27 bp, Artificial sequence
  SiRNA target sequence
gagatacaaatgattattgagcggaaa

SEQ ID NO: 63669 - DNA, 27 bp, Artificial sequence
  SiRNA target sequence
agatacaaatgattattgagcggaaaa

SEQ ID NO: 63670 - DNA, 27 bp, Artificial sequence
  SiRNA target sequence
gatacaaatgattattgagcggaaaag

SEQ ID NO: 63671 - DNA, 27 bp, Artificial sequence
  SiRNA target sequence
atacaaatgattattgagcggaaaagt

SEQ ID NO: 63672 - DNA, 27 bp, Artificial sequence
  SiRNA target sequence
tacaaatgattattgagcggaaaagta

SEQ ID NO: 63673 - DNA, 27 bp, Artificial sequence
  SiRNA target sequence
acaaatgattattgagcggaaaagtag

SEQ ID NO: 63674 - DNA, 27 bp, Artificial sequence
  SiRNA target sequence
caaatgattattgagcggaaaagtaga

SEQ ID NO: 63675 - DNA, 27 bp, Artificial sequence
  SiRNA target sequence
aaatgattattgagcggaaaagtagag

SEQ ID NO: 63676 - DNA, 27 bp, Artificial sequence
  SiRNA target sequence
aatgattattgagcggaaaagtagagc

SEQ ID NO: 63677 - DNA, 27 bp, Artificial sequence
  SiRNA target sequence
atgattattgagcggaaaagtagagca

SEQ ID NO: 63678 - DNA, 27 bp, Artificial sequence
  SiRNA target sequence
tgattattgagcggaaaagtagagcat

SEQ ID NO: 63679 - DNA, 27 bp, Artificial sequence
  SiRNA target sequence
gattattgagcggaaaagtagagcata

SEQ ID NO: 63680 - DNA, 27 bp, Artificial sequence
  SiRNA target sequence
attattgagcggaaaagtagagcatat

SEQ ID NO: 63681 - DNA, 27 bp, Artificial sequence
  SiRNA target sequence
ttattgagcggaaaagtagagcatatg

SEQ ID NO: 63682 - DNA, 27 bp, Artificial sequence
  SiRNA target sequence
tattgagcggaaaagtagagcatatgg

SEQ ID NO: 63683 - DNA, 27 bp, Artificial sequence
  SiRNA target sequence
attgagcggaaaagtagagcatatggt

SEQ ID NO: 63684 - DNA, 27 bp, Artificial sequence
  SiRNA target sequence
ttgagcggaaaagtagagcatatggtg

SEQ ID NO: 63685 - DNA, 27 bp, Artificial sequence
  SiRNA target sequence
tgagcggaaaagtagagcatatggtga

SEQ ID NO: 63686 - DNA, 27 bp, Artificial sequence
  SiRNA target sequence
gagcggaaaagtagagcatatggtgac

SEQ ID NO: 63687 - DNA, 27 bp, Artificial sequence
  SiRNA target sequence
agcggaaaagtagagcatatggtgaca

SEQ ID NO: 63688 - DNA, 27 bp, Artificial sequence
  SiRNA target sequence
gcggaaaagtagagcatatggtgacat

SEQ ID NO: 63689 - DNA, 27 bp, Artificial sequence
  SiRNA target sequence
cggaaaagtagagcatatggtgacata

SEQ ID NO: 63690 - DNA, 27 bp, Artificial sequence
  SiRNA target sequence
ggaaaagtagagcatatggtgacatac

SEQ ID NO: 63691 - DNA, 27 bp, Artificial sequence
  SiRNA target sequence
gaaaagtagagcatatggtgacatact

SEQ ID NO: 63692 - DNA, 27 bp, Artificial sequence
  SiRNA target sequence
aaaagtagagcatatggtgacatacta

SEQ ID NO: 63693 - DNA, 27 bp, Artificial sequence
  SiRNA target sequence
aaagtagagcatatggtgacatactag

SEQ ID NO: 63694 - DNA, 27 bp, Artificial sequence
  SiRNA target sequence
aagtagagcatatggtgacatactaga

SEQ ID NO: 63695 - DNA, 27 bp, Artificial sequence
  SiRNA target sequence
agtagagcatatggtgacatactagaa

SEQ ID NO: 63696 - DNA, 27 bp, Artificial sequence
  SiRNA target sequence
gtagagcatatggtgacatactagaac

SEQ ID NO: 63697 - DNA, 27 bp, Artificial sequence
  SiRNA target sequence
tagagcatatggtgacatactagaact

SEQ ID NO: 63698 - DNA, 27 bp, Artificial sequence
  SiRNA target sequence
agagcatatggtgacatactagaacta

SEQ ID NO: 63699 - DNA, 27 bp, Artificial sequence
  SiRNA target sequence
gagcatatggtgacatactagaactaa

SEQ ID NO: 63700 - DNA, 27 bp, Artificial sequence
  SiRNA target sequence
agcatatggtgacatactagaactaac

SEQ ID NO: 63701 - DNA, 27 bp, Artificial sequence
  SiRNA target sequence
gcatatggtgacatactagaactaact

SEQ ID NO: 63702 - DNA, 27 bp, Artificial sequence
  SiRNA target sequence
catatggtgacatactagaactaacta

SEQ ID NO: 63703 - DNA, 27 bp, Artificial sequence
  SiRNA target sequence
atatggtgacatactagaactaactac

SEQ ID NO: 63704 - DNA, 27 bp, Artificial sequence
  SiRNA target sequence
tatggtgacatactagaactaactact

SEQ ID NO: 63705 - DNA, 27 bp, Artificial sequence
  SiRNA target sequence
atggtgacatactagaactaactactc

SEQ ID NO: 63706 - DNA, 27 bp, Artificial sequence
  SiRNA target sequence
tggtgacatactagaactaactactct

SEQ ID NO: 63707 - DNA, 27 bp, Artificial sequence
  SiRNA target sequence
ggtgacatactagaactaactactctc

SEQ ID NO: 63708 - DNA, 27 bp, Artificial sequence
  SiRNA target sequence
gtgacatactagaactaactactctct

SEQ ID NO: 63709 - DNA, 27 bp, Artificial sequence
  SiRNA target sequence
tgacatactagaactaactactctctc

SEQ ID NO: 63710 - DNA, 27 bp, Artificial sequence
  SiRNA target sequence
gacatactagaactaactactctctcg

SEQ ID NO: 63711 - DNA, 27 bp, Artificial sequence
  SiRNA target sequence
acatactagaactaactactctctcgg

SEQ ID NO: 63712 - DNA, 27 bp, Artificial sequence
  SiRNA target sequence
catactagaactaactactctctcggc

SEQ ID NO: 63713 - DNA, 27 bp, Artificial sequence
  SiRNA target sequence
atactagaactaactactctctcggcc

SEQ ID NO: 63714 - DNA, 27 bp, Artificial sequence
  SiRNA target sequence
tactagaactaactactctctcggccg

SEQ ID NO: 63715 - DNA, 27 bp, Artificial sequence
  SiRNA target sequence
actagaactaactactctctcggccgt

SEQ ID NO: 63716 - DNA, 27 bp, Artificial sequence
  SiRNA target sequence
ctagaactaactactctctcggccgta

SEQ ID NO: 63717 - DNA, 27 bp, Artificial sequence
  SiRNA target sequence
tagaactaactactctctcggccgtac

SEQ ID NO: 63718 - DNA, 27 bp, Artificial sequence
  SiRNA target sequence
agaactaactactctctcggccgtacc

SEQ ID NO: 63719 - DNA, 27 bp, Artificial sequence
  SiRNA target sequence
gaactaactactctctcggccgtacca

SEQ ID NO: 63720 - DNA, 27 bp, Artificial sequence
  SiRNA target sequence
aactaactactctctcggccgtaccaa

SEQ ID NO: 63721 - DNA, 27 bp, Artificial sequence
  SiRNA target sequence
actaactactctctcggccgtaccaac

SEQ ID NO: 63722 - DNA, 27 bp, Artificial sequence
  SiRNA target sequence
ctaactactctctcggccgtaccaacc

SEQ ID NO: 63723 - DNA, 27 bp, Artificial sequence
  SiRNA target sequence
taactactctctcggccgtaccaacct

SEQ ID NO: 63724 - DNA, 27 bp, Artificial sequence
  SiRNA target sequence
aactactctctcggccgtaccaacctg

SEQ ID NO: 63725 - DNA, 27 bp, Artificial sequence
  SiRNA target sequence
actactctctcggccgtaccaacctgt

SEQ ID NO: 63726 - DNA, 27 bp, Artificial sequence
  SiRNA target sequence
ctactctctcggccgtaccaacctgta

SEQ ID NO: 63727 - DNA, 27 bp, Artificial sequence
  SiRNA target sequence
tactctctcggccgtaccaacctgtat

SEQ ID NO: 63728 - DNA, 27 bp, Artificial sequence
  SiRNA target sequence
actctctcggccgtaccaacctgtatt

SEQ ID NO: 63729 - DNA, 27 bp, Artificial sequence
  SiRNA target sequence
ctctctcggccgtaccaacctgtattg

SEQ ID NO: 63730 - DNA, 27 bp, Artificial sequence
  SiRNA target sequence
tctctcggccgtaccaacctgtattgt

SEQ ID NO: 63731 - DNA, 27 bp, Artificial sequence
  SiRNA target sequence
ctctcggccgtaccaacctgtattgta

SEQ ID NO: 63732 - DNA, 27 bp, Artificial sequence
  SiRNA target sequence
tctcggccgtaccaacctgtattgtag

SEQ ID NO: 63733 - DNA, 27 bp, Artificial sequence
  SiRNA target sequence
ctcggccgtaccaacctgtattgtagt

SEQ ID NO: 63734 - DNA, 27 bp, Artificial sequence
  SiRNA target sequence
tcggccgtaccaacctgtattgtagtt

SEQ ID NO: 63735 - DNA, 27 bp, Artificial sequence
  SiRNA target sequence
cggccgtaccaacctgtattgtagtta

SEQ ID NO: 63736 - DNA, 27 bp, Artificial sequence
  SiRNA target sequence
ggccgtaccaacctgtattgtagttat

SEQ ID NO: 63737 - DNA, 27 bp, Artificial sequence
  SiRNA target sequence
gccgtaccaacctgtattgtagttatt

SEQ ID NO: 63738 - DNA, 27 bp, Artificial sequence
  SiRNA target sequence
ccgtaccaacctgtattgtagttatta

SEQ ID NO: 63739 - DNA, 27 bp, Artificial sequence
  SiRNA target sequence
cgtaccaacctgtattgtagttattat

SEQ ID NO: 63740 - DNA, 27 bp, Artificial sequence
  SiRNA target sequence
gtaccaacctgtattgtagttattatg

SEQ ID NO: 63741 - DNA, 27 bp, Artificial sequence
  SiRNA target sequence
taccaacctgtattgtagttattatgt

SEQ ID NO: 63742 - DNA, 27 bp, Artificial sequence
  SiRNA target sequence
accaacctgtattgtagttattatgtc

SEQ ID NO: 63743 - DNA, 27 bp, Artificial sequence
  SiRNA target sequence
ccaacctgtattgtagttattatgtcg

SEQ ID NO: 63744 - DNA, 27 bp, Artificial sequence
  SiRNA target sequence
caacctgtattgtagttattatgtcgt

SEQ ID NO: 63745 - DNA, 27 bp, Artificial sequence
  SiRNA target sequence
aacctgtattgtagttattatgtcgtt

SEQ ID NO: 63746 - DNA, 27 bp, Artificial sequence
  SiRNA target sequence
acctgtattgtagttattatgtcgttt

SEQ ID NO: 63747 - DNA, 27 bp, Artificial sequence
  SiRNA target sequence
cctgtattgtagttattatgtcgtttt

SEQ ID NO: 63748 - DNA, 27 bp, Artificial sequence
  SiRNA target sequence
ctgtattgtagttattatgtcgttttt

SEQ ID NO: 63749 - DNA, 27 bp, Artificial sequence
  SiRNA target sequence
tgtattgtagttattatgtcgtttttc

SEQ ID NO: 63750 - DNA, 27 bp, Artificial sequence
  SiRNA target sequence
gtattgtagttattatgtcgtttttct

SEQ ID NO: 63751 - DNA, 27 bp, Artificial sequence
  SiRNA target sequence
tattgtagttattatgtcgtttttctc

SEQ ID NO: 63752 - DNA, 27 bp, Artificial sequence
  SiRNA target sequence
attgtagttattatgtcgtttttctca

SEQ ID NO: 63753 - DNA, 27 bp, Artificial sequence
  SiRNA target sequence
ttgtagttattatgtcgtttttctcag

SEQ ID NO: 63754 - DNA, 27 bp, Artificial sequence
  SiRNA target sequence
tgtagttattatgtcgtttttctcagt

SEQ ID NO: 63755 - DNA, 27 bp, Artificial sequence
  SiRNA target sequence
gtagttattatgtcgtttttctcagta

SEQ ID NO: 63756 - DNA, 27 bp, Artificial sequence
  SiRNA target sequence
tagttattatgtcgtttttctcagtat

SEQ ID NO: 63757 - DNA, 27 bp, Artificial sequence
  SiRNA target sequence
agttattatgtcgtttttctcagtata

SEQ ID NO: 63758 - DNA, 27 bp, Artificial sequence
  SiRNA target sequence
gttattatgtcgtttttctcagtatat

SEQ ID NO: 63759 - DNA, 27 bp, Artificial sequence
  SiRNA target sequence
ttattatgtcgtttttctcagtatata

SEQ ID NO: 63760 - DNA, 27 bp, Artificial sequence
  SiRNA target sequence
tattatgtcgtttttctcagtatataa

SEQ ID NO: 63761 - DNA, 27 bp, Artificial sequence
  SiRNA target sequence
attatgtcgtttttctcagtatataaa

SEQ ID NO: 63762 - DNA, 27 bp, Artificial sequence
  SiRNA target sequence
ttatgtcgtttttctcagtatataaaa

SEQ ID NO: 63763 - DNA, 27 bp, Artificial sequence
  SiRNA target sequence
tatgtcgtttttctcagtatataaaaa

SEQ ID NO: 63764 - DNA, 27 bp, Artificial sequence
  SiRNA target sequence
atgtcgtttttctcagtatataaaaat

SEQ ID NO: 63765 - DNA, 27 bp, Artificial sequence
  SiRNA target sequence
tgtcgtttttctcagtatataaaaatt

SEQ ID NO: 63766 - DNA, 27 bp, Artificial sequence
  SiRNA target sequence
gtcgtttttctcagtatataaaaattt

SEQ ID NO: 63767 - DNA, 27 bp, Artificial sequence
  SiRNA target sequence
tcgtttttctcagtatataaaaatttg

SEQ ID NO: 63768 - DNA, 27 bp, Artificial sequence
  SiRNA target sequence
cgtttttctcagtatataaaaatttgg

SEQ ID NO: 63769 - DNA, 27 bp, Artificial sequence
  SiRNA target sequence
gtttttctcagtatataaaaatttggg

SEQ ID NO: 63770 - DNA, 27 bp, Artificial sequence
  SiRNA target sequence
tttttctcagtatataaaaatttggga

SEQ ID NO: 63771 - DNA, 27 bp, Artificial sequence
  SiRNA target sequence
ttttctcagtatataaaaatttgggaa

SEQ ID NO: 63772 - DNA, 27 bp, Artificial sequence
  SiRNA target sequence
tttctcagtatataaaaatttgggaag

SEQ ID NO: 63773 - DNA, 27 bp, Artificial sequence
  SiRNA target sequence
ttctcagtatataaaaatttgggaaga

SEQ ID NO: 63774 - DNA, 27 bp, Artificial sequence
  SiRNA target sequence
tctcagtatataaaaatttgggaagag

SEQ ID NO: 63775 - DNA, 27 bp, Artificial sequence
  SiRNA target sequence
ctcagtatataaaaatttgggaagaga

SEQ ID NO: 63776 - DNA, 27 bp, Artificial sequence
  SiRNA target sequence
tcagtatataaaaatttgggaagagat

SEQ ID NO: 63777 - DNA, 27 bp, Artificial sequence
  SiRNA target sequence
cagtatataaaaatttgggaagagatg

SEQ ID NO: 63778 - DNA, 27 bp, Artificial sequence
  SiRNA target sequence
agtatataaaaatttgggaagagatgc

SEQ ID NO: 63779 - DNA, 27 bp, Artificial sequence
  SiRNA target sequence
gtatataaaaatttgggaagagatgca

SEQ ID NO: 63780 - DNA, 27 bp, Artificial sequence
  SiRNA target sequence
tatataaaaatttgggaagagatgcac

SEQ ID NO: 63781 - DNA, 27 bp, Artificial sequence
  SiRNA target sequence
atataaaaatttgggaagagatgcact

SEQ ID NO: 63782 - DNA, 27 bp, Artificial sequence
  SiRNA target sequence
tataaaaatttgggaagagatgcactc

SEQ ID NO: 63783 - DNA, 27 bp, Artificial sequence
  SiRNA target sequence
ataaaaatttgggaagagatgcactct

SEQ ID NO: 63784 - DNA, 27 bp, Artificial sequence
  SiRNA target sequence
taaaaatttgggaagagatgcactcta

SEQ ID NO: 63785 - DNA, 27 bp, Artificial sequence
  SiRNA target sequence
aaaaatttgggaagagatgcactctac

SEQ ID NO: 63786 - DNA, 27 bp, Artificial sequence
  SiRNA target sequence
aaaatttgggaagagatgcactctacg

SEQ ID NO: 63787 - DNA, 27 bp, Artificial sequence
  SiRNA target sequence
aaatttgggaagagatgcactctacgt

SEQ ID NO: 63788 - DNA, 27 bp, Artificial sequence
  SiRNA target sequence
aatttgggaagagatgcactctacgta

SEQ ID NO: 63789 - DNA, 27 bp, Artificial sequence
  SiRNA target sequence
atttgggaagagatgcactctacgtaa

SEQ ID NO: 63790 - DNA, 27 bp, Artificial sequence
  SiRNA target sequence
tttgggaagagatgcactctacgtaat

SEQ ID NO: 63791 - DNA, 27 bp, Artificial sequence
  SiRNA target sequence
ttgggaagagatgcactctacgtaatg

SEQ ID NO: 63792 - DNA, 27 bp, Artificial sequence
  SiRNA target sequence
tgggaagagatgcactctacgtaatgt

SEQ ID NO: 63793 - DNA, 27 bp, Artificial sequence
  SiRNA target sequence
gggaagagatgcactctacgtaatgtt

SEQ ID NO: 63794 - DNA, 27 bp, Artificial sequence
  SiRNA target sequence
ggaagagatgcactctacgtaatgttg

SEQ ID NO: 63795 - DNA, 27 bp, Artificial sequence
  SiRNA target sequence
gaagagatgcactctacgtaatgttgg

SEQ ID NO: 63796 - DNA, 27 bp, Artificial sequence
  SiRNA target sequence
aagagatgcactctacgtaatgttggc

SEQ ID NO: 63797 - DNA, 27 bp, Artificial sequence
  SiRNA target sequence
agagatgcactctacgtaatgttggct

SEQ ID NO: 63798 - DNA, 27 bp, Artificial sequence
  SiRNA target sequence
gagatgcactctacgtaatgttggcta

SEQ ID NO: 63799 - DNA, 27 bp, Artificial sequence
  SiRNA target sequence
agatgcactctacgtaatgttggctac

SEQ ID NO: 63800 - DNA, 27 bp, Artificial sequence
  SiRNA target sequence
gatgcactctacgtaatgttggctaca

SEQ ID NO: 63801 - DNA, 27 bp, Artificial sequence
  SiRNA target sequence
atgcactctacgtaatgttggctacaa

SEQ ID NO: 63802 - DNA, 27 bp, Artificial sequence
  SiRNA target sequence
tgcactctacgtaatgttggctacaag

SEQ ID NO: 63803 - DNA, 27 bp, Artificial sequence
  SiRNA target sequence
gcactctacgtaatgttggctacaagt

SEQ ID NO: 63804 - DNA, 27 bp, Artificial sequence
  SiRNA target sequence
cactctacgtaatgttggctacaagtg

SEQ ID NO: 63805 - DNA, 27 bp, Artificial sequence
  SiRNA target sequence
actctacgtaatgttggctacaagtgc

SEQ ID NO: 63806 - DNA, 27 bp, Artificial sequence
  SiRNA target sequence
ctctacgtaatgttggctacaagtgcc

SEQ ID NO: 63807 - DNA, 27 bp, Artificial sequence
  SiRNA target sequence
tctacgtaatgttggctacaagtgcct

SEQ ID NO: 63808 - DNA, 27 bp, Artificial sequence
  SiRNA target sequence
ctacgtaatgttggctacaagtgcctt

SEQ ID NO: 63809 - DNA, 27 bp, Artificial sequence
  SiRNA target sequence
tacgtaatgttggctacaagtgccttg

SEQ ID NO: 63810 - DNA, 27 bp, Artificial sequence
  SiRNA target sequence
acgtaatgttggctacaagtgccttgt

SEQ ID NO: 63811 - DNA, 27 bp, Artificial sequence
  SiRNA target sequence
cgtaatgttggctacaagtgccttgta

SEQ ID NO: 63812 - DNA, 27 bp, Artificial sequence
  SiRNA target sequence
gtaatgttggctacaagtgccttgtat

SEQ ID NO: 63813 - DNA, 27 bp, Artificial sequence
  SiRNA target sequence
taatgttggctacaagtgccttgtatg

SEQ ID NO: 63814 - DNA, 27 bp, Artificial sequence
  SiRNA target sequence
aatgttggctacaagtgccttgtatgt

SEQ ID NO: 63815 - DNA, 27 bp, Artificial sequence
  SiRNA target sequence
atgttggctacaagtgccttgtatgtg

SEQ ID NO: 63816 - DNA, 27 bp, Artificial sequence
  SiRNA target sequence
tgttggctacaagtgccttgtatgtgt

SEQ ID NO: 63817 - DNA, 27 bp, Artificial sequence
  SiRNA target sequence
gttggctacaagtgccttgtatgtgta

SEQ ID NO: 63818 - DNA, 27 bp, Artificial sequence
  SiRNA target sequence
ttggctacaagtgccttgtatgtgtat

SEQ ID NO: 63819 - DNA, 27 bp, Artificial sequence
  SiRNA target sequence
tggctacaagtgccttgtatgtgtatt

SEQ ID NO: 63820 - DNA, 27 bp, Artificial sequence
  SiRNA target sequence
ggctacaagtgccttgtatgtgtattt

SEQ ID NO: 63821 - DNA, 27 bp, Artificial sequence
  SiRNA target sequence
gctacaagtgccttgtatgtgtatttt

SEQ ID NO: 63822 - DNA, 27 bp, Artificial sequence
  SiRNA target sequence
ctacaagtgccttgtatgtgtatttta

SEQ ID NO: 63823 - DNA, 27 bp, Artificial sequence
  SiRNA target sequence
tacaagtgccttgtatgtgtattttac

SEQ ID NO: 63824 - DNA, 27 bp, Artificial sequence
  SiRNA target sequence
acaagtgccttgtatgtgtattttaca

SEQ ID NO: 63825 - DNA, 27 bp, Artificial sequence
  SiRNA target sequence
caagtgccttgtatgtgtattttacat

SEQ ID NO: 63826 - DNA, 27 bp, Artificial sequence
  SiRNA target sequence
aagtgccttgtatgtgtattttacatt

SEQ ID NO: 63827 - DNA, 27 bp, Artificial sequence
  SiRNA target sequence
agtgccttgtatgtgtattttacattt

SEQ ID NO: 63828 - DNA, 27 bp, Artificial sequence
  SiRNA target sequence
gtgccttgtatgtgtattttacatttg

SEQ ID NO: 63829 - DNA, 27 bp, Artificial sequence
  SiRNA target sequence
tgccttgtatgtgtattttacatttgt

SEQ ID NO: 63830 - DNA, 27 bp, Artificial sequence
  SiRNA target sequence
gccttgtatgtgtattttacatttgta

SEQ ID NO: 63831 - DNA, 27 bp, Artificial sequence
  SiRNA target sequence
ccttgtatgtgtattttacatttgtat

SEQ ID NO: 63832 - DNA, 27 bp, Artificial sequence
  SiRNA target sequence
cttgtatgtgtattttacatttgtatt

SEQ ID NO: 63833 - DNA, 27 bp, Artificial sequence
  SiRNA target sequence
ttgtatgtgtattttacatttgtattt

SEQ ID NO: 63834 - DNA, 27 bp, Artificial sequence
  SiRNA target sequence
tgtatgtgtattttacatttgtatttt

SEQ ID NO: 63835 - DNA, 27 bp, Artificial sequence
  SiRNA target sequence
gtatgtgtattttacatttgtattttc

SEQ ID NO: 63836 - DNA, 27 bp, Artificial sequence
  SiRNA target sequence
tatgtgtattttacatttgtattttca

SEQ ID NO: 63837 - DNA, 27 bp, Artificial sequence
  SiRNA target sequence
atgtgtattttacatttgtattttcaa

SEQ ID NO: 63838 - DNA, 27 bp, Artificial sequence
  SiRNA target sequence
tgtgtattttacatttgtattttcaat

SEQ ID NO: 63839 - DNA, 27 bp, Artificial sequence
  SiRNA target sequence
gtgtattttacatttgtattttcaata

SEQ ID NO: 63840 - DNA, 27 bp, Artificial sequence
  SiRNA target sequence
tgtattttacatttgtattttcaatat

SEQ ID NO: 63841 - DNA, 27 bp, Artificial sequence
  SiRNA target sequence
gtattttacatttgtattttcaatatg

SEQ ID NO: 63842 - DNA, 27 bp, Artificial sequence
  SiRNA target sequence
tattttacatttgtattttcaatatgg

SEQ ID NO: 63843 - DNA, 27 bp, Artificial sequence
  SiRNA target sequence
attttacatttgtattttcaatatgga

SEQ ID NO: 63844 - DNA, 27 bp, Artificial sequence
  SiRNA target sequence
ttttacatttgtattttcaatatggag

SEQ ID NO: 63845 - DNA, 27 bp, Artificial sequence
  SiRNA target sequence
tttacatttgtattttcaatatggaga

SEQ ID NO: 63846 - DNA, 27 bp, Artificial sequence
  SiRNA target sequence
ttacatttgtattttcaatatggagaa

SEQ ID NO: 63847 - DNA, 27 bp, Artificial sequence
  SiRNA target sequence
tacatttgtattttcaatatggagaaa

SEQ ID NO: 63848 - DNA, 27 bp, Artificial sequence
  SiRNA target sequence
acatttgtattttcaatatggagaaac

SEQ ID NO: 63849 - DNA, 27 bp, Artificial sequence
  SiRNA target sequence
catttgtattttcaatatggagaaaca

SEQ ID NO: 63850 - DNA, 27 bp, Artificial sequence
  SiRNA target sequence
atttgtattttcaatatggagaaacaa

SEQ ID NO: 63851 - DNA, 27 bp, Artificial sequence
  SiRNA target sequence
tttgtattttcaatatggagaaacaat

SEQ ID NO: 63852 - DNA, 27 bp, Artificial sequence
  SiRNA target sequence
ttgtattttcaatatggagaaacaata

SEQ ID NO: 63853 - DNA, 27 bp, Artificial sequence
  SiRNA target sequence
tgtattttcaatatggagaaacaatat

SEQ ID NO: 63854 - DNA, 27 bp, Artificial sequence
  SiRNA target sequence
gtattttcaatatggagaaacaatatt

SEQ ID NO: 63855 - DNA, 27 bp, Artificial sequence
  SiRNA target sequence
tattttcaatatggagaaacaatatta

SEQ ID NO: 63856 - DNA, 27 bp, Artificial sequence
  SiRNA target sequence
attttcaatatggagaaacaatattag

SEQ ID NO: 63857 - DNA, 27 bp, Artificial sequence
  SiRNA target sequence
ttttcaatatggagaaacaatattaga

SEQ ID NO: 63858 - DNA, 27 bp, Artificial sequence
  SiRNA target sequence
tttcaatatggagaaacaatattagaa

SEQ ID NO: 63859 - DNA, 27 bp, Artificial sequence
  SiRNA target sequence
ttcaatatggagaaacaatattagaag

SEQ ID NO: 63860 - DNA, 27 bp, Artificial sequence
  SiRNA target sequence
tcaatatggagaaacaatattagaaga

SEQ ID NO: 63861 - DNA, 27 bp, Artificial sequence
  SiRNA target sequence
caatatggagaaacaatattagaagac

SEQ ID NO: 63862 - DNA, 27 bp, Artificial sequence
  SiRNA target sequence
aatatggagaaacaatattagaagaca

SEQ ID NO: 63863 - DNA, 27 bp, Artificial sequence
  SiRNA target sequence
atatggagaaacaatattagaagacaa

SEQ ID NO: 63864 - DNA, 27 bp, Artificial sequence
  SiRNA target sequence
tatggagaaacaatattagaagacaat

SEQ ID NO: 63865 - DNA, 27 bp, Artificial sequence
  SiRNA target sequence
atggagaaacaatattagaagacaata

SEQ ID NO: 63866 - DNA, 27 bp, Artificial sequence
  SiRNA target sequence
tggagaaacaatattagaagacaatat

SEQ ID NO: 63867 - DNA, 27 bp, Artificial sequence
  SiRNA target sequence
ggagaaacaatattagaagacaatata

SEQ ID NO: 63868 - DNA, 27 bp, Artificial sequence
  SiRNA target sequence
gagaaacaatattagaagacaatataa

SEQ ID NO: 63869 - DNA, 27 bp, Artificial sequence
  SiRNA target sequence
agaaacaatattagaagacaatataat

SEQ ID NO: 63870 - DNA, 27 bp, Artificial sequence
  SiRNA target sequence
gaaacaatattagaagacaatataata

SEQ ID NO: 63871 - DNA, 27 bp, Artificial sequence
  SiRNA target sequence
aaacaatattagaagacaatataataa

SEQ ID NO: 63872 - DNA, 27 bp, Artificial sequence
  SiRNA target sequence
aacaatattagaagacaatataataag

SEQ ID NO: 63873 - DNA, 27 bp, Artificial sequence
  SiRNA target sequence
acaatattagaagacaatataataagt

SEQ ID NO: 63874 - DNA, 27 bp, Artificial sequence
  SiRNA target sequence
caatattagaagacaatataataagtc

SEQ ID NO: 63875 - DNA, 27 bp, Artificial sequence
  SiRNA target sequence
aatattagaagacaatataataagtca

SEQ ID NO: 63876 - DNA, 27 bp, Artificial sequence
  SiRNA target sequence
atattagaagacaatataataagtcac

SEQ ID NO: 63877 - DNA, 27 bp, Artificial sequence
  SiRNA target sequence
tattagaagacaatataataagtcaca

SEQ ID NO: 63878 - DNA, 27 bp, Artificial sequence
  SiRNA target sequence
attagaagacaatataataagtcacag

SEQ ID NO: 63879 - DNA, 27 bp, Artificial sequence
  SiRNA target sequence
ttagaagacaatataataagtcacagg

SEQ ID NO: 63880 - DNA, 27 bp, Artificial sequence
  SiRNA target sequence
tagaagacaatataataagtcacagga

SEQ ID NO: 63881 - DNA, 27 bp, Artificial sequence
  SiRNA target sequence
agaagacaatataataagtcacaggat

SEQ ID NO: 63882 - DNA, 27 bp, Artificial sequence
  SiRNA target sequence
gaagacaatataataagtcacaggata

SEQ ID NO: 63883 - DNA, 27 bp, Artificial sequence
  SiRNA target sequence
aagacaatataataagtcacaggataa

SEQ ID NO: 63884 - DNA, 27 bp, Artificial sequence
  SiRNA target sequence
agacaatataataagtcacaggataaa

SEQ ID NO: 63885 - DNA, 27 bp, Artificial sequence
  SiRNA target sequence
gacaatataataagtcacaggataaat

SEQ ID NO: 63886 - DNA, 27 bp, Artificial sequence
  SiRNA target sequence
acaatataataagtcacaggataaatt

SEQ ID NO: 63887 - DNA, 27 bp, Artificial sequence
  SiRNA target sequence
caatataataagtcacaggataaatta

SEQ ID NO: 63888 - DNA, 27 bp, Artificial sequence
  SiRNA target sequence
aatataataagtcacaggataaattat

SEQ ID NO: 63889 - DNA, 27 bp, Artificial sequence
  SiRNA target sequence
atataataagtcacaggataaattatc

SEQ ID NO: 63890 - DNA, 27 bp, Artificial sequence
  SiRNA target sequence
tataataagtcacaggataaattatcg

SEQ ID NO: 63891 - DNA, 27 bp, Artificial sequence
  SiRNA target sequence
ataataagtcacaggataaattatcga

SEQ ID NO: 63892 - DNA, 27 bp, Artificial sequence
  SiRNA target sequence
taataagtcacaggataaattatcgaa

SEQ ID NO: 63893 - DNA, 27 bp, Artificial sequence
  SiRNA target sequence
aataagtcacaggataaattatcgaat

SEQ ID NO: 63894 - DNA, 27 bp, Artificial sequence
  SiRNA target sequence
ataagtcacaggataaattatcgaata

SEQ ID NO: 63895 - DNA, 27 bp, Artificial sequence
  SiRNA target sequence
taagtcacaggataaattatcgaataa

SEQ ID NO: 63896 - DNA, 27 bp, Artificial sequence
  SiRNA target sequence
aagtcacaggataaattatcgaataaa

SEQ ID NO: 63897 - DNA, 27 bp, Artificial sequence
  SiRNA target sequence
agtcacaggataaattatcgaataaat

SEQ ID NO: 63898 - DNA, 27 bp, Artificial sequence
  SiRNA target sequence
gtcacaggataaattatcgaataaatt

SEQ ID NO: 63899 - DNA, 27 bp, Artificial sequence
  SiRNA target sequence
tcacaggataaattatcgaataaatta

SEQ ID NO: 63900 - DNA, 27 bp, Artificial sequence
  SiRNA target sequence
cacaggataaattatcgaataaattac

SEQ ID NO: 63901 - DNA, 27 bp, Artificial sequence
  SiRNA target sequence
acaggataaattatcgaataaattaca

SEQ ID NO: 63902 - DNA, 27 bp, Artificial sequence
  SiRNA target sequence
caggataaattatcgaataaattacaa

SEQ ID NO: 63903 - DNA, 27 bp, Artificial sequence
  SiRNA target sequence
aggataaattatcgaataaattacaag

SEQ ID NO: 63904 - DNA, 27 bp, Artificial sequence
  SiRNA target sequence
ggataaattatcgaataaattacaaga

SEQ ID NO: 63905 - DNA, 27 bp, Artificial sequence
  SiRNA target sequence
gataaattatcgaataaattacaagat

SEQ ID NO: 63906 - DNA, 27 bp, Artificial sequence
  SiRNA target sequence
ataaattatcgaataaattacaagatt

SEQ ID NO: 63907 - DNA, 27 bp, Artificial sequence
  SiRNA target sequence
taaattatcgaataaattacaagattt

SEQ ID NO: 63908 - DNA, 27 bp, Artificial sequence
  SiRNA target sequence
aaattatcgaataaattacaagatttt

SEQ ID NO: 63909 - DNA, 27 bp, Artificial sequence
  SiRNA target sequence
aattatcgaataaattacaagattttt

SEQ ID NO: 63910 - DNA, 27 bp, Artificial sequence
  SiRNA target sequence
attatcgaataaattacaagatttttt

SEQ ID NO: 63911 - DNA, 27 bp, Artificial sequence
  SiRNA target sequence
ttatcgaataaattacaagatttttta

SEQ ID NO: 63912 - DNA, 27 bp, Artificial sequence
  SiRNA target sequence
tatcgaataaattacaagattttttag

SEQ ID NO: 63913 - DNA, 27 bp, Artificial sequence
  SiRNA target sequence
atcgaataaattacaagattttttagc

SEQ ID NO: 63914 - DNA, 27 bp, Artificial sequence
  SiRNA target sequence
tcgaataaattacaagattttttagct

SEQ ID NO: 63915 - DNA, 27 bp, Artificial sequence
  SiRNA target sequence
cgaataaattacaagattttttagcta

SEQ ID NO: 63916 - DNA, 27 bp, Artificial sequence
  SiRNA target sequence
gaataaattacaagattttttagctaa

SEQ ID NO: 63917 - DNA, 27 bp, Artificial sequence
  SiRNA target sequence
aataaattacaagattttttagctaat

SEQ ID NO: 63918 - DNA, 27 bp, Artificial sequence
  SiRNA target sequence
ataaattacaagattttttagctaatc

SEQ ID NO: 63919 - DNA, 27 bp, Artificial sequence
  SiRNA target sequence
taaattacaagattttttagctaatca

SEQ ID NO: 63920 - DNA, 27 bp, Artificial sequence
  SiRNA target sequence
aaattacaagattttttagctaatcat

SEQ ID NO: 63921 - DNA, 27 bp, Artificial sequence
  SiRNA target sequence
aattacaagattttttagctaatcatg

SEQ ID NO: 63922 - DNA, 27 bp, Artificial sequence
  SiRNA target sequence
attacaagattttttagctaatcatga

SEQ ID NO: 63923 - DNA, 27 bp, Artificial sequence
  SiRNA target sequence
ttacaagattttttagctaatcatgaa

SEQ ID NO: 63924 - DNA, 27 bp, Artificial sequence
  SiRNA target sequence
tacaagattttttagctaatcatgaaa

SEQ ID NO: 63925 - DNA, 27 bp, Artificial sequence
  SiRNA target sequence
acaagattttttagctaatcatgaaac

SEQ ID NO: 63926 - DNA, 27 bp, Artificial sequence
  SiRNA target sequence
caagattttttagctaatcatgaaaca

SEQ ID NO: 63927 - DNA, 27 bp, Artificial sequence
  SiRNA target sequence
aagattttttagctaatcatgaaacaa

SEQ ID NO: 63928 - DNA, 27 bp, Artificial sequence
  SiRNA target sequence
agattttttagctaatcatgaaacaat

SEQ ID NO: 63929 - DNA, 27 bp, Artificial sequence
  SiRNA target sequence
gattttttagctaatcatgaaacaatt

SEQ ID NO: 63930 - DNA, 27 bp, Artificial sequence
  SiRNA target sequence
attttttagctaatcatgaaacaatta

SEQ ID NO: 63931 - DNA, 27 bp, Artificial sequence
  SiRNA target sequence
ttttttagctaatcatgaaacaattaa

SEQ ID NO: 63932 - DNA, 27 bp, Artificial sequence
  SiRNA target sequence
tttttagctaatcatgaaacaattaaa

SEQ ID NO: 63933 - DNA, 27 bp, Artificial sequence
  SiRNA target sequence
ttttagctaatcatgaaacaattaaag

SEQ ID NO: 63934 - DNA, 27 bp, Artificial sequence
  SiRNA target sequence
tttagctaatcatgaaacaattaaagc

SEQ ID NO: 63935 - DNA, 27 bp, Artificial sequence
  SiRNA target sequence
ttagctaatcatgaaacaattaaagcc

SEQ ID NO: 63936 - DNA, 27 bp, Artificial sequence
  SiRNA target sequence
tagctaatcatgaaacaattaaagcct

SEQ ID NO: 63937 - DNA, 27 bp, Artificial sequence
  SiRNA target sequence
agctaatcatgaaacaattaaagccta

SEQ ID NO: 63938 - DNA, 27 bp, Artificial sequence
  SiRNA target sequence
gctaatcatgaaacaattaaagcctat

SEQ ID NO: 63939 - DNA, 27 bp, Artificial sequence
  SiRNA target sequence
ctaatcatgaaacaattaaagcctata

SEQ ID NO: 63940 - DNA, 27 bp, Artificial sequence
  SiRNA target sequence
taatcatgaaacaattaaagcctataa

SEQ ID NO: 63941 - DNA, 27 bp, Artificial sequence
  SiRNA target sequence
aatcatgaaacaattaaagcctataat

SEQ ID NO: 63942 - DNA, 27 bp, Artificial sequence
  SiRNA target sequence
atcatgaaacaattaaagcctataata

SEQ ID NO: 63943 - DNA, 27 bp, Artificial sequence
  SiRNA target sequence
tcatgaaacaattaaagcctataatat

SEQ ID NO: 63944 - DNA, 27 bp, Artificial sequence
  SiRNA target sequence
catgaaacaattaaagcctataatatg

SEQ ID NO: 63945 - DNA, 27 bp, Artificial sequence
  SiRNA target sequence
atgaaacaattaaagcctataatatgg

SEQ ID NO: 63946 - DNA, 27 bp, Artificial sequence
  SiRNA target sequence
tgaaacaattaaagcctataatatgga

SEQ ID NO: 63947 - DNA, 27 bp, Artificial sequence
  SiRNA target sequence
gaaacaattaaagcctataatatggaa

SEQ ID NO: 63948 - DNA, 27 bp, Artificial sequence
  SiRNA target sequence
aaacaattaaagcctataatatggaag

SEQ ID NO: 63949 - DNA, 27 bp, Artificial sequence
  SiRNA target sequence
aacaattaaagcctataatatggaaga

SEQ ID NO: 63950 - DNA, 27 bp, Artificial sequence
  SiRNA target sequence
acaattaaagcctataatatggaagaa

SEQ ID NO: 63951 - DNA, 27 bp, Artificial sequence
  SiRNA target sequence
caattaaagcctataatatggaagaag

SEQ ID NO: 63952 - DNA, 27 bp, Artificial sequence
  SiRNA target sequence
aattaaagcctataatatggaagaaga

SEQ ID NO: 63953 - DNA, 27 bp, Artificial sequence
  SiRNA target sequence
attaaagcctataatatggaagaagaa

SEQ ID NO: 63954 - DNA, 27 bp, Artificial sequence
  SiRNA target sequence
ttaaagcctataatatggaagaagaaa

SEQ ID NO: 63955 - DNA, 27 bp, Artificial sequence
  SiRNA target sequence
taaagcctataatatggaagaagaaac

SEQ ID NO: 63956 - DNA, 27 bp, Artificial sequence
  SiRNA target sequence
aaagcctataatatggaagaagaaact

SEQ ID NO: 63957 - DNA, 27 bp, Artificial sequence
  SiRNA target sequence
aagcctataatatggaagaagaaacta

SEQ ID NO: 63958 - DNA, 27 bp, Artificial sequence
  SiRNA target sequence
agcctataatatggaagaagaaactat

SEQ ID NO: 63959 - DNA, 27 bp, Artificial sequence
  SiRNA target sequence
gcctataatatggaagaagaaactatt

SEQ ID NO: 63960 - DNA, 27 bp, Artificial sequence
  SiRNA target sequence
cctataatatggaagaagaaactatta

SEQ ID NO: 63961 - DNA, 27 bp, Artificial sequence
  SiRNA target sequence
ctataatatggaagaagaaactattac

SEQ ID NO: 63962 - DNA, 27 bp, Artificial sequence
  SiRNA target sequence
tataatatggaagaagaaactattaca

SEQ ID NO: 63963 - DNA, 27 bp, Artificial sequence
  SiRNA target sequence
ataatatggaagaagaaactattacat

SEQ ID NO: 63964 - DNA, 27 bp, Artificial sequence
  SiRNA target sequence
taatatggaagaagaaactattacata

SEQ ID NO: 63965 - DNA, 27 bp, Artificial sequence
  SiRNA target sequence
aatatggaagaagaaactattacatat

SEQ ID NO: 63966 - DNA, 27 bp, Artificial sequence
  SiRNA target sequence
atatggaagaagaaactattacatatt

SEQ ID NO: 63967 - DNA, 27 bp, Artificial sequence
  SiRNA target sequence
tatggaagaagaaactattacatattt

SEQ ID NO: 63968 - DNA, 27 bp, Artificial sequence
  SiRNA target sequence
atggaagaagaaactattacatatttt

SEQ ID NO: 63969 - DNA, 27 bp, Artificial sequence
  SiRNA target sequence
tggaagaagaaactattacatattttg

SEQ ID NO: 63970 - DNA, 27 bp, Artificial sequence
  SiRNA target sequence
ggaagaagaaactattacatattttga

SEQ ID NO: 63971 - DNA, 27 bp, Artificial sequence
  SiRNA target sequence
gaagaagaaactattacatattttgat

SEQ ID NO: 63972 - DNA, 27 bp, Artificial sequence
  SiRNA target sequence
aagaagaaactattacatattttgatg

SEQ ID NO: 63973 - DNA, 27 bp, Artificial sequence
  SiRNA target sequence
agaagaaactattacatattttgatga

SEQ ID NO: 63974 - DNA, 27 bp, Artificial sequence
  SiRNA target sequence
gaagaaactattacatattttgatgaa

SEQ ID NO: 63975 - DNA, 27 bp, Artificial sequence
  SiRNA target sequence
aagaaactattacatattttgatgaaa

SEQ ID NO: 63976 - DNA, 27 bp, Artificial sequence
  SiRNA target sequence
agaaactattacatattttgatgaaaa

SEQ ID NO: 63977 - DNA, 27 bp, Artificial sequence
  SiRNA target sequence
gaaactattacatattttgatgaaaat

SEQ ID NO: 63978 - DNA, 27 bp, Artificial sequence
  SiRNA target sequence
aaactattacatattttgatgaaaatc

SEQ ID NO: 63979 - DNA, 27 bp, Artificial sequence
  SiRNA target sequence
aactattacatattttgatgaaaatca

SEQ ID NO: 63980 - DNA, 27 bp, Artificial sequence
  SiRNA target sequence
actattacatattttgatgaaaatcaa

SEQ ID NO: 63981 - DNA, 27 bp, Artificial sequence
  SiRNA target sequence
ctattacatattttgatgaaaatcaaa

SEQ ID NO: 63982 - DNA, 27 bp, Artificial sequence
  SiRNA target sequence
tattacatattttgatgaaaatcaaaa

SEQ ID NO: 63983 - DNA, 27 bp, Artificial sequence
  SiRNA target sequence
attacatattttgatgaaaatcaaaaa

SEQ ID NO: 63984 - DNA, 27 bp, Artificial sequence
  SiRNA target sequence
ttacatattttgatgaaaatcaaaaac

SEQ ID NO: 63985 - DNA, 27 bp, Artificial sequence
  SiRNA target sequence
tacatattttgatgaaaatcaaaaacc

SEQ ID NO: 63986 - DNA, 27 bp, Artificial sequence
  SiRNA target sequence
acatattttgatgaaaatcaaaaaccg

SEQ ID NO: 63987 - DNA, 27 bp, Artificial sequence
  SiRNA target sequence
catattttgatgaaaatcaaaaaccgg

SEQ ID NO: 63988 - DNA, 27 bp, Artificial sequence
  SiRNA target sequence
atattttgatgaaaatcaaaaaccggt

SEQ ID NO: 63989 - DNA, 27 bp, Artificial sequence
  SiRNA target sequence
tattttgatgaaaatcaaaaaccggta

SEQ ID NO: 63990 - DNA, 27 bp, Artificial sequence
  SiRNA target sequence
attttgatgaaaatcaaaaaccggtag

SEQ ID NO: 63991 - DNA, 27 bp, Artificial sequence
  SiRNA target sequence
ttttgatgaaaatcaaaaaccggtaga

SEQ ID NO: 63992 - DNA, 27 bp, Artificial sequence
  SiRNA target sequence
tttgatgaaaatcaaaaaccggtagaa

SEQ ID NO: 63993 - DNA, 27 bp, Artificial sequence
  SiRNA target sequence
ttgatgaaaatcaaaaaccggtagaat

SEQ ID NO: 63994 - DNA, 27 bp, Artificial sequence
  SiRNA target sequence
tgatgaaaatcaaaaaccggtagaata

SEQ ID NO: 63995 - DNA, 27 bp, Artificial sequence
  SiRNA target sequence
gatgaaaatcaaaaaccggtagaatat

SEQ ID NO: 63996 - DNA, 27 bp, Artificial sequence
  SiRNA target sequence
atgaaaatcaaaaaccggtagaatatt

SEQ ID NO: 63997 - DNA, 27 bp, Artificial sequence
  SiRNA target sequence
tgaaaatcaaaaaccggtagaatattt

SEQ ID NO: 63998 - DNA, 27 bp, Artificial sequence
  SiRNA target sequence
gaaaatcaaaaaccggtagaatatttt

SEQ ID NO: 63999 - DNA, 27 bp, Artificial sequence
  SiRNA target sequence
aaaatcaaaaaccggtagaatattttg

SEQ ID NO: 64000 - DNA, 27 bp, Artificial sequence
  SiRNA target sequence
aaatcaaaaaccggtagaatattttgg

SEQ ID NO: 64001 - DNA, 27 bp, Artificial sequence
  SiRNA target sequence
aatcaaaaaccggtagaatattttggg

SEQ ID NO: 64002 - DNA, 27 bp, Artificial sequence
  SiRNA target sequence
atcaaaaaccggtagaatattttgggg

SEQ ID NO: 64003 - DNA, 27 bp, Artificial sequence
  SiRNA target sequence
tcaaaaaccggtagaatattttggggt

SEQ ID NO: 64004 - DNA, 27 bp, Artificial sequence
  SiRNA target sequence
caaaaaccggtagaatattttggggta

SEQ ID NO: 64005 - DNA, 27 bp, Artificial sequence
  SiRNA target sequence
aaaaaccggtagaatattttggggtaa

SEQ ID NO: 64006 - DNA, 27 bp, Artificial sequence
  SiRNA target sequence
aaaaccggtagaatattttggggtaaa

SEQ ID NO: 64007 - DNA, 27 bp, Artificial sequence
  SiRNA target sequence
aaaccggtagaatattttggggtaaag

SEQ ID NO: 64008 - DNA, 27 bp, Artificial sequence
  SiRNA target sequence
aaccggtagaatattttggggtaaagt

SEQ ID NO: 64009 - DNA, 27 bp, Artificial sequence
  SiRNA target sequence
accggtagaatattttggggtaaagtc

SEQ ID NO: 64010 - DNA, 27 bp, Artificial sequence
  SiRNA target sequence
ccggtagaatattttggggtaaagtct

SEQ ID NO: 64011 - DNA, 27 bp, Artificial sequence
  SiRNA target sequence
cggtagaatattttggggtaaagtctc

SEQ ID NO: 64012 - DNA, 27 bp, Artificial sequence
  SiRNA target sequence
ggtagaatattttggggtaaagtctca

SEQ ID NO: 64013 - DNA, 27 bp, Artificial sequence
  SiRNA target sequence
gtagaatattttggggtaaagtctcac

SEQ ID NO: 64014 - DNA, 27 bp, Artificial sequence
  SiRNA target sequence
tagaatattttggggtaaagtctcaca

SEQ ID NO: 64015 - DNA, 27 bp, Artificial sequence
  SiRNA target sequence
agaatattttggggtaaagtctcacag

SEQ ID NO: 64016 - DNA, 27 bp, Artificial sequence
  SiRNA target sequence
gaatattttggggtaaagtctcacaga

SEQ ID NO: 64017 - DNA, 27 bp, Artificial sequence
  SiRNA target sequence
aatattttggggtaaagtctcacagaa

SEQ ID NO: 64018 - DNA, 27 bp, Artificial sequence
  SiRNA target sequence
atattttggggtaaagtctcacagaat

SEQ ID NO: 64019 - DNA, 27 bp, Artificial sequence
  SiRNA target sequence
tattttggggtaaagtctcacagaatt

SEQ ID NO: 64020 - DNA, 27 bp, Artificial sequence
  SiRNA target sequence
attttggggtaaagtctcacagaattt

SEQ ID NO: 64021 - DNA, 27 bp, Artificial sequence
  SiRNA target sequence
ttttggggtaaagtctcacagaatttt

SEQ ID NO: 64022 - DNA, 27 bp, Artificial sequence
  SiRNA target sequence
tttggggtaaagtctcacagaattttg

SEQ ID NO: 64023 - DNA, 27 bp, Artificial sequence
  SiRNA target sequence
ttggggtaaagtctcacagaattttgt

SEQ ID NO: 64024 - DNA, 27 bp, Artificial sequence
  SiRNA target sequence
tggggtaaagtctcacagaattttgtt

SEQ ID NO: 64025 - DNA, 27 bp, Artificial sequence
  SiRNA target sequence
ggggtaaagtctcacagaattttgttc

SEQ ID NO: 64026 - DNA, 27 bp, Artificial sequence
  SiRNA target sequence
gggtaaagtctcacagaattttgttct

SEQ ID NO: 64027 - DNA, 27 bp, Artificial sequence
  SiRNA target sequence
ggtaaagtctcacagaattttgttctc

SEQ ID NO: 64028 - DNA, 27 bp, Artificial sequence
  SiRNA target sequence
gtaaagtctcacagaattttgttctct

SEQ ID NO: 64029 - DNA, 27 bp, Artificial sequence
  SiRNA target sequence
taaagtctcacagaattttgttctctc

SEQ ID NO: 64030 - DNA, 27 bp, Artificial sequence
  SiRNA target sequence
aaagtctcacagaattttgttctctct

SEQ ID NO: 64031 - DNA, 27 bp, Artificial sequence
  SiRNA target sequence
aagtctcacagaattttgttctctctt

SEQ ID NO: 64032 - DNA, 27 bp, Artificial sequence
  SiRNA target sequence
agtctcacagaattttgttctctcttt

SEQ ID NO: 64033 - DNA, 27 bp, Artificial sequence
  SiRNA target sequence
gtctcacagaattttgttctctctttt

SEQ ID NO: 64034 - DNA, 27 bp, Artificial sequence
  SiRNA target sequence
tctcacagaattttgttctctctttta

SEQ ID NO: 64035 - DNA, 27 bp, Artificial sequence
  SiRNA target sequence
ctcacagaattttgttctctcttttat

SEQ ID NO: 64036 - DNA, 27 bp, Artificial sequence
  SiRNA target sequence
tcacagaattttgttctctcttttata

SEQ ID NO: 64037 - DNA, 27 bp, Artificial sequence
  SiRNA target sequence
cacagaattttgttctctcttttatat

SEQ ID NO: 64038 - DNA, 27 bp, Artificial sequence
  SiRNA target sequence
acagaattttgttctctcttttatata

SEQ ID NO: 64039 - DNA, 27 bp, Artificial sequence
  SiRNA target sequence
cagaattttgttctctcttttatatat

SEQ ID NO: 64040 - DNA, 27 bp, Artificial sequence
  SiRNA target sequence
agaattttgttctctcttttatatata

SEQ ID NO: 64041 - DNA, 27 bp, Artificial sequence
  SiRNA target sequence
gaattttgttctctcttttatatatac

SEQ ID NO: 64042 - DNA, 27 bp, Artificial sequence
  SiRNA target sequence
aattttgttctctcttttatatataca

SEQ ID NO: 64043 - DNA, 27 bp, Artificial sequence
  SiRNA target sequence
attttgttctctcttttatatatacaa

SEQ ID NO: 64044 - DNA, 27 bp, Artificial sequence
  SiRNA target sequence
ttttgttctctcttttatatatacaaa

SEQ ID NO: 64045 - DNA, 27 bp, Artificial sequence
  SiRNA target sequence
tttgttctctcttttatatatacaaaa

SEQ ID NO: 64046 - DNA, 27 bp, Artificial sequence
  SiRNA target sequence
ttgttctctcttttatatatacaaaaa

SEQ ID NO: 64047 - DNA, 27 bp, Artificial sequence
  SiRNA target sequence
tgttctctcttttatatatacaaaaaa

SEQ ID NO: 64048 - DNA, 27 bp, Artificial sequence
  SiRNA target sequence
gttctctcttttatatatacaaaaaat

SEQ ID NO: 64049 - DNA, 27 bp, Artificial sequence
  SiRNA target sequence
ttctctcttttatatatacaaaaaatg

SEQ ID NO: 64050 - DNA, 27 bp, Artificial sequence
  SiRNA target sequence
tctctcttttatatatacaaaaaatga

SEQ ID NO: 64051 - DNA, 27 bp, Artificial sequence
  SiRNA target sequence
ctctcttttatatatacaaaaaatgac

SEQ ID NO: 64052 - DNA, 27 bp, Artificial sequence
  SiRNA target sequence
tctcttttatatatacaaaaaatgaca

SEQ ID NO: 64053 - DNA, 27 bp, Artificial sequence
  SiRNA target sequence
ctcttttatatatacaaaaaatgacat

SEQ ID NO: 64054 - DNA, 27 bp, Artificial sequence
  SiRNA target sequence
tcttttatatatacaaaaaatgacatt

SEQ ID NO: 64055 - DNA, 27 bp, Artificial sequence
  SiRNA target sequence
cttttatatatacaaaaaatgacattt

SEQ ID NO: 64056 - DNA, 27 bp, Artificial sequence
  SiRNA target sequence
ttttatatatacaaaaaatgacatttg

SEQ ID NO: 64057 - DNA, 27 bp, Artificial sequence
  SiRNA target sequence
tttatatatacaaaaaatgacatttgc

SEQ ID NO: 64058 - DNA, 27 bp, Artificial sequence
  SiRNA target sequence
ttatatatacaaaaaatgacatttgcg

SEQ ID NO: 64059 - DNA, 27 bp, Artificial sequence
  SiRNA target sequence
tatatatacaaaaaatgacatttgcga

SEQ ID NO: 64060 - DNA, 27 bp, Artificial sequence
  SiRNA target sequence
atatatacaaaaaatgacatttgcgat

SEQ ID NO: 64061 - DNA, 27 bp, Artificial sequence
  SiRNA target sequence
tatatacaaaaaatgacatttgcgata

SEQ ID NO: 64062 - DNA, 27 bp, Artificial sequence
  SiRNA target sequence
atatacaaaaaatgacatttgcgatac

SEQ ID NO: 64063 - DNA, 27 bp, Artificial sequence
  SiRNA target sequence
tatacaaaaaatgacatttgcgataca

SEQ ID NO: 64064 - DNA, 27 bp, Artificial sequence
  SiRNA target sequence
atacaaaaaatgacatttgcgatacag

SEQ ID NO: 64065 - DNA, 27 bp, Artificial sequence
  SiRNA target sequence
tacaaaaaatgacatttgcgatacagg

SEQ ID NO: 64066 - DNA, 27 bp, Artificial sequence
  SiRNA target sequence
acaaaaaatgacatttgcgatacaggc

SEQ ID NO: 64067 - DNA, 27 bp, Artificial sequence
  SiRNA target sequence
caaaaaatgacatttgcgatacaggca

SEQ ID NO: 64068 - DNA, 27 bp, Artificial sequence
  SiRNA target sequence
aaaaaatgacatttgcgatacaggcaa

SEQ ID NO: 64069 - DNA, 27 bp, Artificial sequence
  SiRNA target sequence
aaaaatgacatttgcgatacaggcaat

SEQ ID NO: 64070 - DNA, 27 bp, Artificial sequence
  SiRNA target sequence
aaaatgacatttgcgatacaggcaatt

SEQ ID NO: 64071 - DNA, 27 bp, Artificial sequence
  SiRNA target sequence
aaatgacatttgcgatacaggcaatta

SEQ ID NO: 64072 - DNA, 27 bp, Artificial sequence
  SiRNA target sequence
aatgacatttgcgatacaggcaattat

SEQ ID NO: 64073 - DNA, 27 bp, Artificial sequence
  SiRNA target sequence
atgacatttgcgatacaggcaattatt

SEQ ID NO: 64074 - DNA, 27 bp, Artificial sequence
  SiRNA target sequence
tgacatttgcgatacaggcaattatta

SEQ ID NO: 64075 - DNA, 27 bp, Artificial sequence
  SiRNA target sequence
gacatttgcgatacaggcaattattat

SEQ ID NO: 64076 - DNA, 27 bp, Artificial sequence
  SiRNA target sequence
acatttgcgatacaggcaattattatt

SEQ ID NO: 64077 - DNA, 27 bp, Artificial sequence
  SiRNA target sequence
catttgcgatacaggcaattattatta

SEQ ID NO: 64078 - DNA, 27 bp, Artificial sequence
  SiRNA target sequence
atttgcgatacaggcaattattattat

SEQ ID NO: 64079 - DNA, 27 bp, Artificial sequence
  SiRNA target sequence
tttgcgatacaggcaattattattatc

SEQ ID NO: 64080 - DNA, 27 bp, Artificial sequence
  SiRNA target sequence
ttgcgatacaggcaattattattatca

SEQ ID NO: 64081 - DNA, 27 bp, Artificial sequence
  SiRNA target sequence
tgcgatacaggcaattattattatcac

SEQ ID NO: 64082 - DNA, 27 bp, Artificial sequence
  SiRNA target sequence
gcgatacaggcaattattattatcaca

SEQ ID NO: 64083 - DNA, 27 bp, Artificial sequence
  SiRNA target sequence
cgatacaggcaattattattatcacat

SEQ ID NO: 64084 - DNA, 27 bp, Artificial sequence
  SiRNA target sequence
gatacaggcaattattattatcacatt

SEQ ID NO: 64085 - DNA, 27 bp, Artificial sequence
  SiRNA target sequence
atacaggcaattattattatcacatta

SEQ ID NO: 64086 - DNA, 27 bp, Artificial sequence
  SiRNA target sequence
tacaggcaattattattatcacattag

SEQ ID NO: 64087 - DNA, 27 bp, Artificial sequence
  SiRNA target sequence
acaggcaattattattatcacattagg

SEQ ID NO: 64088 - DNA, 27 bp, Artificial sequence
  SiRNA target sequence
caggcaattattattatcacattagga

SEQ ID NO: 64089 - DNA, 27 bp, Artificial sequence
  SiRNA target sequence
aggcaattattattatcacattaggat

SEQ ID NO: 64090 - DNA, 27 bp, Artificial sequence
  SiRNA target sequence
ggcaattattattatcacattaggatc

SEQ ID NO: 64091 - DNA, 27 bp, Artificial sequence
  SiRNA target sequence
gcaattattattatcacattaggatct

SEQ ID NO: 64092 - DNA, 27 bp, Artificial sequence
  SiRNA target sequence
caattattattatcacattaggatctt

SEQ ID NO: 64093 - DNA, 27 bp, Artificial sequence
  SiRNA target sequence
aattattattatcacattaggatcttt

SEQ ID NO: 64094 - DNA, 27 bp, Artificial sequence
  SiRNA target sequence
attattattatcacattaggatctttt

SEQ ID NO: 64095 - DNA, 27 bp, Artificial sequence
  SiRNA target sequence
ttattattatcacattaggatcttttg

SEQ ID NO: 64096 - DNA, 27 bp, Artificial sequence
  SiRNA target sequence
tattattatcacattaggatcttttgg

SEQ ID NO: 64097 - DNA, 27 bp, Artificial sequence
  SiRNA target sequence
attattatcacattaggatcttttgga

SEQ ID NO: 64098 - DNA, 27 bp, Artificial sequence
  SiRNA target sequence
ttattatcacattaggatcttttggat

SEQ ID NO: 64099 - DNA, 27 bp, Artificial sequence
  SiRNA target sequence
tattatcacattaggatcttttggata

SEQ ID NO: 64100 - DNA, 27 bp, Artificial sequence
  SiRNA target sequence
attatcacattaggatcttttggatat

SEQ ID NO: 64101 - DNA, 27 bp, Artificial sequence
  SiRNA target sequence
ttatcacattaggatcttttggatatt

SEQ ID NO: 64102 - DNA, 27 bp, Artificial sequence
  SiRNA target sequence
tatcacattaggatcttttggatattt

SEQ ID NO: 64103 - DNA, 27 bp, Artificial sequence
  SiRNA target sequence
atcacattaggatcttttggatatttt

SEQ ID NO: 64104 - DNA, 27 bp, Artificial sequence
  SiRNA target sequence
tcacattaggatcttttggatattttc

SEQ ID NO: 64105 - DNA, 27 bp, Artificial sequence
  SiRNA target sequence
cacattaggatcttttggatattttcc

SEQ ID NO: 64106 - DNA, 27 bp, Artificial sequence
  SiRNA target sequence
acattaggatcttttggatattttccg

SEQ ID NO: 64107 - DNA, 27 bp, Artificial sequence
  SiRNA target sequence
cattaggatcttttggatattttccga

SEQ ID NO: 64108 - DNA, 27 bp, Artificial sequence
  SiRNA target sequence
attaggatcttttggatattttccgat

SEQ ID NO: 64109 - DNA, 27 bp, Artificial sequence
  SiRNA target sequence
ttaggatcttttggatattttccgatt

SEQ ID NO: 64110 - DNA, 27 bp, Artificial sequence
  SiRNA target sequence
taggatcttttggatattttccgatta

SEQ ID NO: 64111 - DNA, 27 bp, Artificial sequence
  SiRNA target sequence
aggatcttttggatattttccgattaa

SEQ ID NO: 64112 - DNA, 27 bp, Artificial sequence
  SiRNA target sequence
ggatcttttggatattttccgattaaa

SEQ ID NO: 64113 - DNA, 27 bp, Artificial sequence
  SiRNA target sequence
gatcttttggatattttccgattaaat

SEQ ID NO: 64114 - DNA, 27 bp, Artificial sequence
  SiRNA target sequence
atcttttggatattttccgattaaatt

SEQ ID NO: 64115 - DNA, 27 bp, Artificial sequence
  SiRNA target sequence
tcttttggatattttccgattaaatta

SEQ ID NO: 64116 - DNA, 27 bp, Artificial sequence
  SiRNA target sequence
cttttggatattttccgattaaattat

SEQ ID NO: 64117 - DNA, 27 bp, Artificial sequence
  SiRNA target sequence
ttttggatattttccgattaaattatc

SEQ ID NO: 64118 - DNA, 27 bp, Artificial sequence
  SiRNA target sequence
tttggatattttccgattaaattatcc

SEQ ID NO: 64119 - DNA, 27 bp, Artificial sequence
  SiRNA target sequence
ttggatattttccgattaaattatcct

SEQ ID NO: 64120 - DNA, 27 bp, Artificial sequence
  SiRNA target sequence
tggatattttccgattaaattatcctc

SEQ ID NO: 64121 - DNA, 27 bp, Artificial sequence
  SiRNA target sequence
ggatattttccgattaaattatcctct

SEQ ID NO: 64122 - DNA, 27 bp, Artificial sequence
  SiRNA target sequence
gatattttccgattaaattatcctctc

SEQ ID NO: 64123 - DNA, 27 bp, Artificial sequence
  SiRNA target sequence
atattttccgattaaattatcctctca

SEQ ID NO: 64124 - DNA, 27 bp, Artificial sequence
  SiRNA target sequence
tattttccgattaaattatcctctcaa

SEQ ID NO: 64125 - DNA, 27 bp, Artificial sequence
  SiRNA target sequence
attttccgattaaattatcctctcaac

SEQ ID NO: 64126 - DNA, 27 bp, Artificial sequence
  SiRNA target sequence
ttttccgattaaattatcctctcaaca

SEQ ID NO: 64127 - DNA, 27 bp, Artificial sequence
  SiRNA target sequence
tttccgattaaattatcctctcaacag

SEQ ID NO: 64128 - DNA, 27 bp, Artificial sequence
  SiRNA target sequence
ttccgattaaattatcctctcaacagt

SEQ ID NO: 64129 - DNA, 27 bp, Artificial sequence
  SiRNA target sequence
tccgattaaattatcctctcaacagtt

SEQ ID NO: 64130 - DNA, 27 bp, Artificial sequence
  SiRNA target sequence
ccgattaaattatcctctcaacagtta

SEQ ID NO: 64131 - DNA, 27 bp, Artificial sequence
  SiRNA target sequence
cgattaaattatcctctcaacagttag

SEQ ID NO: 64132 - DNA, 27 bp, Artificial sequence
  SiRNA target sequence
gattaaattatcctctcaacagttagt

SEQ ID NO: 64133 - DNA, 27 bp, Artificial sequence
  SiRNA target sequence
attaaattatcctctcaacagttagtc

SEQ ID NO: 64134 - DNA, 27 bp, Artificial sequence
  SiRNA target sequence
ttaaattatcctctcaacagttagtct

SEQ ID NO: 64135 - DNA, 27 bp, Artificial sequence
  SiRNA target sequence
taaattatcctctcaacagttagtctt

SEQ ID NO: 64136 - DNA, 27 bp, Artificial sequence
  SiRNA target sequence
aaattatcctctcaacagttagtcttt

SEQ ID NO: 64137 - DNA, 27 bp, Artificial sequence
  SiRNA target sequence
aattatcctctcaacagttagtctttt

SEQ ID NO: 64138 - DNA, 27 bp, Artificial sequence
  SiRNA target sequence
attatcctctcaacagttagtctttta

SEQ ID NO: 64139 - DNA, 27 bp, Artificial sequence
  SiRNA target sequence
ttatcctctcaacagttagtcttttat

SEQ ID NO: 64140 - DNA, 27 bp, Artificial sequence
  SiRNA target sequence
tatcctctcaacagttagtcttttata

SEQ ID NO: 64141 - DNA, 27 bp, Artificial sequence
  SiRNA target sequence
atcctctcaacagttagtcttttatat

SEQ ID NO: 64142 - DNA, 27 bp, Artificial sequence
  SiRNA target sequence
tcctctcaacagttagtcttttatatt

SEQ ID NO: 64143 - DNA, 27 bp, Artificial sequence
  SiRNA target sequence
cctctcaacagttagtcttttatattt

SEQ ID NO: 64144 - DNA, 27 bp, Artificial sequence
  SiRNA target sequence
ctctcaacagttagtcttttatatttc

SEQ ID NO: 64145 - DNA, 27 bp, Artificial sequence
  SiRNA target sequence
tctcaacagttagtcttttatatttcg

SEQ ID NO: 64146 - DNA, 27 bp, Artificial sequence
  SiRNA target sequence
ctcaacagttagtcttttatatttcga

SEQ ID NO: 64147 - DNA, 27 bp, Artificial sequence
  SiRNA target sequence
tcaacagttagtcttttatatttcgat

SEQ ID NO: 64148 - DNA, 27 bp, Artificial sequence
  SiRNA target sequence
caacagttagtcttttatatttcgatt

SEQ ID NO: 64149 - DNA, 27 bp, Artificial sequence
  SiRNA target sequence
aacagttagtcttttatatttcgatta

SEQ ID NO: 64150 - DNA, 27 bp, Artificial sequence
  SiRNA target sequence
acagttagtcttttatatttcgattag

SEQ ID NO: 64151 - DNA, 27 bp, Artificial sequence
  SiRNA target sequence
cagttagtcttttatatttcgattagt

SEQ ID NO: 64152 - DNA, 27 bp, Artificial sequence
  SiRNA target sequence
agttagtcttttatatttcgattagta

SEQ ID NO: 64153 - DNA, 27 bp, Artificial sequence
  SiRNA target sequence
gttagtcttttatatttcgattagtaa

SEQ ID NO: 64154 - DNA, 27 bp, Artificial sequence
  SiRNA target sequence
ttagtcttttatatttcgattagtaaa

SEQ ID NO: 64155 - DNA, 27 bp, Artificial sequence
  SiRNA target sequence
tagtcttttatatttcgattagtaaaa

SEQ ID NO: 64156 - DNA, 27 bp, Artificial sequence
  SiRNA target sequence
agtcttttatatttcgattagtaaaac

SEQ ID NO: 64157 - DNA, 27 bp, Artificial sequence
  SiRNA target sequence
gtcttttatatttcgattagtaaaacg

SEQ ID NO: 64158 - DNA, 27 bp, Artificial sequence
  SiRNA target sequence
tcttttatatttcgattagtaaaacgt

SEQ ID NO: 64159 - DNA, 27 bp, Artificial sequence
  SiRNA target sequence
cttttatatttcgattagtaaaacgtt

SEQ ID NO: 64160 - DNA, 27 bp, Artificial sequence
  SiRNA target sequence
ttttatatttcgattagtaaaacgttg

SEQ ID NO: 64161 - DNA, 27 bp, Artificial sequence
  SiRNA target sequence
tttatatttcgattagtaaaacgttga

SEQ ID NO: 64162 - DNA, 27 bp, Artificial sequence
  SiRNA target sequence
ttatatttcgattagtaaaacgttgac

SEQ ID NO: 64163 - DNA, 27 bp, Artificial sequence
  SiRNA target sequence
tatatttcgattagtaaaacgttgaca

SEQ ID NO: 64164 - DNA, 27 bp, Artificial sequence
  SiRNA target sequence
atatttcgattagtaaaacgttgacaa

SEQ ID NO: 64165 - DNA, 27 bp, Artificial sequence
  SiRNA target sequence
tatttcgattagtaaaacgttgacaaa

SEQ ID NO: 64166 - DNA, 27 bp, Artificial sequence
  SiRNA target sequence
atttcgattagtaaaacgttgacaaat

SEQ ID NO: 64167 - DNA, 27 bp, Artificial sequence
  SiRNA target sequence
tttcgattagtaaaacgttgacaaatt

SEQ ID NO: 64168 - DNA, 27 bp, Artificial sequence
  SiRNA target sequence
ttcgattagtaaaacgttgacaaattc

SEQ ID NO: 64169 - DNA, 27 bp, Artificial sequence
  SiRNA target sequence
tcgattagtaaaacgttgacaaattcg

SEQ ID NO: 64170 - DNA, 27 bp, Artificial sequence
  SiRNA target sequence
cgattagtaaaacgttgacaaattcgt

SEQ ID NO: 64171 - DNA, 27 bp, Artificial sequence
  SiRNA target sequence
gattagtaaaacgttgacaaattcgtt

SEQ ID NO: 64172 - DNA, 27 bp, Artificial sequence
  SiRNA target sequence
attagtaaaacgttgacaaattcgttg

SEQ ID NO: 64173 - DNA, 27 bp, Artificial sequence
  SiRNA target sequence
ttagtaaaacgttgacaaattcgttga

SEQ ID NO: 64174 - DNA, 27 bp, Artificial sequence
  SiRNA target sequence
tagtaaaacgttgacaaattcgttgag

SEQ ID NO: 64175 - DNA, 27 bp, Artificial sequence
  SiRNA target sequence
agtaaaacgttgacaaattcgttgagc

SEQ ID NO: 64176 - DNA, 27 bp, Artificial sequence
  SiRNA target sequence
gtaaaacgttgacaaattcgttgagcg

SEQ ID NO: 64177 - DNA, 27 bp, Artificial sequence
  SiRNA target sequence
taaaacgttgacaaattcgttgagcga

SEQ ID NO: 64178 - DNA, 27 bp, Artificial sequence
  SiRNA target sequence
aaaacgttgacaaattcgttgagcgaa

SEQ ID NO: 64179 - DNA, 27 bp, Artificial sequence
  SiRNA target sequence
aaacgttgacaaattcgttgagcgaaa

SEQ ID NO: 64180 - DNA, 27 bp, Artificial sequence
  SiRNA target sequence
aacgttgacaaattcgttgagcgaaat

SEQ ID NO: 64181 - DNA, 27 bp, Artificial sequence
  SiRNA target sequence
acgttgacaaattcgttgagcgaaatg

SEQ ID NO: 64182 - DNA, 27 bp, Artificial sequence
  SiRNA target sequence
cgttgacaaattcgttgagcgaaatgg

SEQ ID NO: 64183 - DNA, 27 bp, Artificial sequence
  SiRNA target sequence
gttgacaaattcgttgagcgaaatggg

SEQ ID NO: 64184 - DNA, 27 bp, Artificial sequence
  SiRNA target sequence
ttgacaaattcgttgagcgaaatggga

SEQ ID NO: 64185 - DNA, 27 bp, Artificial sequence
  SiRNA target sequence
tgacaaattcgttgagcgaaatgggaa

SEQ ID NO: 64186 - DNA, 27 bp, Artificial sequence
  SiRNA target sequence
gacaaattcgttgagcgaaatgggaat

SEQ ID NO: 64187 - DNA, 27 bp, Artificial sequence
  SiRNA target sequence
acaaattcgttgagcgaaatgggaatg

SEQ ID NO: 64188 - DNA, 27 bp, Artificial sequence
  SiRNA target sequence
caaattcgttgagcgaaatgggaatgc

SEQ ID NO: 64189 - DNA, 27 bp, Artificial sequence
  SiRNA target sequence
aaattcgttgagcgaaatgggaatgct

SEQ ID NO: 64190 - DNA, 27 bp, Artificial sequence
  SiRNA target sequence
aattcgttgagcgaaatgggaatgcta

SEQ ID NO: 64191 - DNA, 27 bp, Artificial sequence
  SiRNA target sequence
attcgttgagcgaaatgggaatgctat

SEQ ID NO: 64192 - DNA, 27 bp, Artificial sequence
  SiRNA target sequence
ttcgttgagcgaaatgggaatgctata

SEQ ID NO: 64193 - DNA, 27 bp, Artificial sequence
  SiRNA target sequence
tcgttgagcgaaatgggaatgctatac

SEQ ID NO: 64194 - DNA, 27 bp, Artificial sequence
  SiRNA target sequence
cgttgagcgaaatgggaatgctataca

SEQ ID NO: 64195 - DNA, 27 bp, Artificial sequence
  SiRNA target sequence
gttgagcgaaatgggaatgctatacac

SEQ ID NO: 64196 - DNA, 27 bp, Artificial sequence
  SiRNA target sequence
ttgagcgaaatgggaatgctatacaca

SEQ ID NO: 64197 - DNA, 27 bp, Artificial sequence
  SiRNA target sequence
tgagcgaaatgggaatgctatacacaa

SEQ ID NO: 64198 - DNA, 27 bp, Artificial sequence
  SiRNA target sequence
gagcgaaatgggaatgctatacacaag

SEQ ID NO: 64199 - DNA, 27 bp, Artificial sequence
  SiRNA target sequence
agcgaaatgggaatgctatacacaaga

SEQ ID NO: 64200 - DNA, 27 bp, Artificial sequence
  SiRNA target sequence
gcgaaatgggaatgctatacacaagat

SEQ ID NO: 64201 - DNA, 27 bp, Artificial sequence
  SiRNA target sequence
cgaaatgggaatgctatacacaagata

SEQ ID NO: 64202 - DNA, 27 bp, Artificial sequence
  SiRNA target sequence
gaaatgggaatgctatacacaagatat

SEQ ID NO: 64203 - DNA, 27 bp, Artificial sequence
  SiRNA target sequence
aaatgggaatgctatacacaagatatg

SEQ ID NO: 64204 - DNA, 27 bp, Artificial sequence
  SiRNA target sequence
aatgggaatgctatacacaagatatgt

SEQ ID NO: 64205 - DNA, 27 bp, Artificial sequence
  SiRNA target sequence
atgggaatgctatacacaagatatgta

SEQ ID NO: 64206 - DNA, 27 bp, Artificial sequence
  SiRNA target sequence
tgggaatgctatacacaagatatgtac

SEQ ID NO: 64207 - DNA, 27 bp, Artificial sequence
  SiRNA target sequence
gggaatgctatacacaagatatgtaca

SEQ ID NO: 64208 - DNA, 27 bp, Artificial sequence
  SiRNA target sequence
ggaatgctatacacaagatatgtacaa

SEQ ID NO: 64209 - DNA, 27 bp, Artificial sequence
  SiRNA target sequence
gaatgctatacacaagatatgtacaag

SEQ ID NO: 64210 - DNA, 27 bp, Artificial sequence
  SiRNA target sequence
aatgctatacacaagatatgtacaagg

SEQ ID NO: 64211 - DNA, 27 bp, Artificial sequence
  SiRNA target sequence
atgctatacacaagatatgtacaagga

SEQ ID NO: 64212 - DNA, 27 bp, Artificial sequence
  SiRNA target sequence
tgctatacacaagatatgtacaaggat

SEQ ID NO: 64213 - DNA, 27 bp, Artificial sequence
  SiRNA target sequence
gctatacacaagatatgtacaaggatt

SEQ ID NO: 64214 - DNA, 27 bp, Artificial sequence
  SiRNA target sequence
ctatacacaagatatgtacaaggattt

SEQ ID NO: 64215 - DNA, 27 bp, Artificial sequence
  SiRNA target sequence
tatacacaagatatgtacaaggatttt

SEQ ID NO: 64216 - DNA, 27 bp, Artificial sequence
  SiRNA target sequence
atacacaagatatgtacaaggattttt

SEQ ID NO: 64217 - DNA, 27 bp, Artificial sequence
  SiRNA target sequence
tacacaagatatgtacaaggattttta

SEQ ID NO: 64218 - DNA, 27 bp, Artificial sequence
  SiRNA target sequence
acacaagatatgtacaaggatttttaa

SEQ ID NO: 64219 - DNA, 27 bp, Artificial sequence
  SiRNA target sequence
cacaagatatgtacaaggatttttaaa

SEQ ID NO: 64220 - DNA, 27 bp, Artificial sequence
  SiRNA target sequence
acaagatatgtacaaggatttttaaat

SEQ ID NO: 64221 - DNA, 27 bp, Artificial sequence
  SiRNA target sequence
caagatatgtacaaggatttttaaatg

SEQ ID NO: 64222 - DNA, 27 bp, Artificial sequence
  SiRNA target sequence
aagatatgtacaaggatttttaaatgc

SEQ ID NO: 64223 - DNA, 27 bp, Artificial sequence
  SiRNA target sequence
agatatgtacaaggatttttaaatgca

SEQ ID NO: 64224 - DNA, 27 bp, Artificial sequence
  SiRNA target sequence
gatatgtacaaggatttttaaatgcaa

SEQ ID NO: 64225 - DNA, 27 bp, Artificial sequence
  SiRNA target sequence
atatgtacaaggatttttaaatgcaaa

SEQ ID NO: 64226 - DNA, 27 bp, Artificial sequence
  SiRNA target sequence
tatgtacaaggatttttaaatgcaaag

SEQ ID NO: 64227 - DNA, 27 bp, Artificial sequence
  SiRNA target sequence
atgtacaaggatttttaaatgcaaagt

SEQ ID NO: 64228 - DNA, 27 bp, Artificial sequence
  SiRNA target sequence
tgtacaaggatttttaaatgcaaagtc

SEQ ID NO: 64229 - DNA, 27 bp, Artificial sequence
  SiRNA target sequence
gtacaaggatttttaaatgcaaagtct

SEQ ID NO: 64230 - DNA, 27 bp, Artificial sequence
  SiRNA target sequence
tacaaggatttttaaatgcaaagtctg

SEQ ID NO: 64231 - DNA, 27 bp, Artificial sequence
  SiRNA target sequence
acaaggatttttaaatgcaaagtctgg

SEQ ID NO: 64232 - DNA, 27 bp, Artificial sequence
  SiRNA target sequence
caaggatttttaaatgcaaagtctgga

SEQ ID NO: 64233 - DNA, 27 bp, Artificial sequence
  SiRNA target sequence
aaggatttttaaatgcaaagtctggat

SEQ ID NO: 64234 - DNA, 27 bp, Artificial sequence
  SiRNA target sequence
aggatttttaaatgcaaagtctggata

SEQ ID NO: 64235 - DNA, 27 bp, Artificial sequence
  SiRNA target sequence
ggatttttaaatgcaaagtctggatat

SEQ ID NO: 64236 - DNA, 27 bp, Artificial sequence
  SiRNA target sequence
gatttttaaatgcaaagtctggatatt

SEQ ID NO: 64237 - DNA, 27 bp, Artificial sequence
  SiRNA target sequence
atttttaaatgcaaagtctggatatta

SEQ ID NO: 64238 - DNA, 27 bp, Artificial sequence
  SiRNA target sequence
tttttaaatgcaaagtctggatattac

SEQ ID NO: 64239 - DNA, 27 bp, Artificial sequence
  SiRNA target sequence
ttttaaatgcaaagtctggatattacg

SEQ ID NO: 64240 - DNA, 27 bp, Artificial sequence
  SiRNA target sequence
tttaaatgcaaagtctggatattacga

SEQ ID NO: 64241 - DNA, 27 bp, Artificial sequence
  SiRNA target sequence
ttaaatgcaaagtctggatattacgag

SEQ ID NO: 64242 - DNA, 27 bp, Artificial sequence
  SiRNA target sequence
taaatgcaaagtctggatattacgagt

SEQ ID NO: 64243 - DNA, 27 bp, Artificial sequence
  SiRNA target sequence
aaatgcaaagtctggatattacgagtt

SEQ ID NO: 64244 - DNA, 27 bp, Artificial sequence
  SiRNA target sequence
aatgcaaagtctggatattacgagttt

SEQ ID NO: 64245 - DNA, 27 bp, Artificial sequence
  SiRNA target sequence
atgcaaagtctggatattacgagttta

SEQ ID NO: 64246 - DNA, 27 bp, Artificial sequence
  SiRNA target sequence
tgcaaagtctggatattacgagtttaa

SEQ ID NO: 64247 - DNA, 27 bp, Artificial sequence
  SiRNA target sequence
gcaaagtctggatattacgagtttaaa

SEQ ID NO: 64248 - DNA, 27 bp, Artificial sequence
  SiRNA target sequence
caaagtctggatattacgagtttaaag

SEQ ID NO: 64249 - DNA, 27 bp, Artificial sequence
  SiRNA target sequence
aaagtctggatattacgagtttaaaga

SEQ ID NO: 64250 - DNA, 27 bp, Artificial sequence
  SiRNA target sequence
aagtctggatattacgagtttaaagag

SEQ ID NO: 64251 - DNA, 27 bp, Artificial sequence
  SiRNA target sequence
agtctggatattacgagtttaaagagg

SEQ ID NO: 64252 - DNA, 27 bp, Artificial sequence
  SiRNA target sequence
gtctggatattacgagtttaaagagga

SEQ ID NO: 64253 - DNA, 27 bp, Artificial sequence
  SiRNA target sequence
tctggatattacgagtttaaagaggat

SEQ ID NO: 64254 - DNA, 27 bp, Artificial sequence
  SiRNA target sequence
ctggatattacgagtttaaagaggata

SEQ ID NO: 64255 - DNA, 27 bp, Artificial sequence
  SiRNA target sequence
tggatattacgagtttaaagaggatac

SEQ ID NO: 64256 - DNA, 27 bp, Artificial sequence
  SiRNA target sequence
ggatattacgagtttaaagaggataca

SEQ ID NO: 64257 - DNA, 27 bp, Artificial sequence
  SiRNA target sequence
gatattacgagtttaaagaggatacac

SEQ ID NO: 64258 - DNA, 27 bp, Artificial sequence
  SiRNA target sequence
atattacgagtttaaagaggatacaca

SEQ ID NO: 64259 - DNA, 27 bp, Artificial sequence
  SiRNA target sequence
tattacgagtttaaagaggatacacaa

SEQ ID NO: 64260 - DNA, 27 bp, Artificial sequence
  SiRNA target sequence
attacgagtttaaagaggatacacaaa

SEQ ID NO: 64261 - DNA, 27 bp, Artificial sequence
  SiRNA target sequence
ttacgagtttaaagaggatacacaaac

SEQ ID NO: 64262 - DNA, 27 bp, Artificial sequence
  SiRNA target sequence
tacgagtttaaagaggatacacaaact

SEQ ID NO: 64263 - DNA, 27 bp, Artificial sequence
  SiRNA target sequence
acgagtttaaagaggatacacaaactg

SEQ ID NO: 64264 - DNA, 27 bp, Artificial sequence
  SiRNA target sequence
cgagtttaaagaggatacacaaactga

SEQ ID NO: 64265 - DNA, 27 bp, Artificial sequence
  SiRNA target sequence
gagtttaaagaggatacacaaactgat

SEQ ID NO: 64266 - DNA, 27 bp, Artificial sequence
  SiRNA target sequence
agtttaaagaggatacacaaactgata

SEQ ID NO: 64267 - DNA, 27 bp, Artificial sequence
  SiRNA target sequence
gtttaaagaggatacacaaactgataa

SEQ ID NO: 64268 - DNA, 27 bp, Artificial sequence
  SiRNA target sequence
tttaaagaggatacacaaactgataaa

SEQ ID NO: 64269 - DNA, 27 bp, Artificial sequence
  SiRNA target sequence
ttaaagaggatacacaaactgataaaa

SEQ ID NO: 64270 - DNA, 27 bp, Artificial sequence
  SiRNA target sequence
taaagaggatacacaaactgataaaat

SEQ ID NO: 64271 - DNA, 27 bp, Artificial sequence
  SiRNA target sequence
aaagaggatacacaaactgataaaata

SEQ ID NO: 64272 - DNA, 27 bp, Artificial sequence
  SiRNA target sequence
aagaggatacacaaactgataaaataa

SEQ ID NO: 64273 - DNA, 27 bp, Artificial sequence
  SiRNA target sequence
agaggatacacaaactgataaaataag

SEQ ID NO: 64274 - DNA, 27 bp, Artificial sequence
  SiRNA target sequence
gaggatacacaaactgataaaataaga

SEQ ID NO: 64275 - DNA, 27 bp, Artificial sequence
  SiRNA target sequence
aggatacacaaactgataaaataagac

SEQ ID NO: 64276 - DNA, 27 bp, Artificial sequence
  SiRNA target sequence
ggatacacaaactgataaaataagact

SEQ ID NO: 64277 - DNA, 27 bp, Artificial sequence
  SiRNA target sequence
gatacacaaactgataaaataagactg

SEQ ID NO: 64278 - DNA, 27 bp, Artificial sequence
  SiRNA target sequence
atacacaaactgataaaataagactga

SEQ ID NO: 64279 - DNA, 27 bp, Artificial sequence
  SiRNA target sequence
tacacaaactgataaaataagactgat

SEQ ID NO: 64280 - DNA, 27 bp, Artificial sequence
  SiRNA target sequence
acacaaactgataaaataagactgata

SEQ ID NO: 64281 - DNA, 27 bp, Artificial sequence
  SiRNA target sequence
cacaaactgataaaataagactgatag

SEQ ID NO: 64282 - DNA, 27 bp, Artificial sequence
  SiRNA target sequence
acaaactgataaaataagactgataga

SEQ ID NO: 64283 - DNA, 27 bp, Artificial sequence
  SiRNA target sequence
caaactgataaaataagactgatagat

SEQ ID NO: 64284 - DNA, 27 bp, Artificial sequence
  SiRNA target sequence
aaactgataaaataagactgatagatt

SEQ ID NO: 64285 - DNA, 27 bp, Artificial sequence
  SiRNA target sequence
aactgataaaataagactgatagattt

SEQ ID NO: 64286 - DNA, 27 bp, Artificial sequence
  SiRNA target sequence
actgataaaataagactgatagatttt

SEQ ID NO: 64287 - DNA, 27 bp, Artificial sequence
  SiRNA target sequence
ctgataaaataagactgatagatttta

SEQ ID NO: 64288 - DNA, 27 bp, Artificial sequence
  SiRNA target sequence
tgataaaataagactgatagattttaa

SEQ ID NO: 64289 - DNA, 27 bp, Artificial sequence
  SiRNA target sequence
gataaaataagactgatagattttaat

SEQ ID NO: 64290 - DNA, 27 bp, Artificial sequence
  SiRNA target sequence
ataaaataagactgatagattttaatg

SEQ ID NO: 64291 - DNA, 27 bp, Artificial sequence
  SiRNA target sequence
taaaataagactgatagattttaatga

SEQ ID NO: 64292 - DNA, 27 bp, Artificial sequence
  SiRNA target sequence
aaaataagactgatagattttaatgaa

SEQ ID NO: 64293 - DNA, 27 bp, Artificial sequence
  SiRNA target sequence
aaataagactgatagattttaatgaaa

SEQ ID NO: 64294 - DNA, 27 bp, Artificial sequence
  SiRNA target sequence
aataagactgatagattttaatgaaaa

SEQ ID NO: 64295 - DNA, 27 bp, Artificial sequence
  SiRNA target sequence
ataagactgatagattttaatgaaaag

SEQ ID NO: 64296 - DNA, 27 bp, Artificial sequence
  SiRNA target sequence
taagactgatagattttaatgaaaagc

SEQ ID NO: 64297 - DNA, 27 bp, Artificial sequence
  SiRNA target sequence
aagactgatagattttaatgaaaagct

SEQ ID NO: 64298 - DNA, 27 bp, Artificial sequence
  SiRNA target sequence
agactgatagattttaatgaaaagcta

SEQ ID NO: 64299 - DNA, 27 bp, Artificial sequence
  SiRNA target sequence
gactgatagattttaatgaaaagctag

SEQ ID NO: 64300 - DNA, 27 bp, Artificial sequence
  SiRNA target sequence
actgatagattttaatgaaaagctaga

SEQ ID NO: 64301 - DNA, 27 bp, Artificial sequence
  SiRNA target sequence
ctgatagattttaatgaaaagctagaa

SEQ ID NO: 64302 - DNA, 27 bp, Artificial sequence
  SiRNA target sequence
tgatagattttaatgaaaagctagaat

SEQ ID NO: 64303 - DNA, 27 bp, Artificial sequence
  SiRNA target sequence
gatagattttaatgaaaagctagaatt

SEQ ID NO: 64304 - DNA, 27 bp, Artificial sequence
  SiRNA target sequence
atagattttaatgaaaagctagaattt

SEQ ID NO: 64305 - DNA, 27 bp, Artificial sequence
  SiRNA target sequence
tagattttaatgaaaagctagaattta

SEQ ID NO: 64306 - DNA, 27 bp, Artificial sequence
  SiRNA target sequence
agattttaatgaaaagctagaatttag

SEQ ID NO: 64307 - DNA, 27 bp, Artificial sequence
  SiRNA target sequence
gattttaatgaaaagctagaatttaga

SEQ ID NO: 64308 - DNA, 27 bp, Artificial sequence
  SiRNA target sequence
attttaatgaaaagctagaatttagaa

SEQ ID NO: 64309 - DNA, 27 bp, Artificial sequence
  SiRNA target sequence
ttttaatgaaaagctagaatttagaaa

SEQ ID NO: 64310 - DNA, 27 bp, Artificial sequence
  SiRNA target sequence
tttaatgaaaagctagaatttagaaat

SEQ ID NO: 64311 - DNA, 27 bp, Artificial sequence
  SiRNA target sequence
ttaatgaaaagctagaatttagaaatg

SEQ ID NO: 64312 - DNA, 27 bp, Artificial sequence
  SiRNA target sequence
taatgaaaagctagaatttagaaatgt

SEQ ID NO: 64313 - DNA, 27 bp, Artificial sequence
  SiRNA target sequence
aatgaaaagctagaatttagaaatgta

SEQ ID NO: 64314 - DNA, 27 bp, Artificial sequence
  SiRNA target sequence
atgaaaagctagaatttagaaatgtat

SEQ ID NO: 64315 - DNA, 27 bp, Artificial sequence
  SiRNA target sequence
tgaaaagctagaatttagaaatgtatc

SEQ ID NO: 64316 - DNA, 27 bp, Artificial sequence
  SiRNA target sequence
gaaaagctagaatttagaaatgtatct

SEQ ID NO: 64317 - DNA, 27 bp, Artificial sequence
  SiRNA target sequence
aaaagctagaatttagaaatgtatctt

SEQ ID NO: 64318 - DNA, 27 bp, Artificial sequence
  SiRNA target sequence
aaagctagaatttagaaatgtatcttt

SEQ ID NO: 64319 - DNA, 27 bp, Artificial sequence
  SiRNA target sequence
aagctagaatttagaaatgtatctttt

SEQ ID NO: 64320 - DNA, 27 bp, Artificial sequence
  SiRNA target sequence
agctagaatttagaaatgtatctttta

SEQ ID NO: 64321 - DNA, 27 bp, Artificial sequence
  SiRNA target sequence
gctagaatttagaaatgtatcttttag

SEQ ID NO: 64322 - DNA, 27 bp, Artificial sequence
  SiRNA target sequence
ctagaatttagaaatgtatcttttagt

SEQ ID NO: 64323 - DNA, 27 bp, Artificial sequence
  SiRNA target sequence
tagaatttagaaatgtatcttttagtt

SEQ ID NO: 64324 - DNA, 27 bp, Artificial sequence
  SiRNA target sequence
agaatttagaaatgtatcttttagtta

SEQ ID NO: 64325 - DNA, 27 bp, Artificial sequence
  SiRNA target sequence
gaatttagaaatgtatcttttagttat

SEQ ID NO: 64326 - DNA, 27 bp, Artificial sequence
  SiRNA target sequence
aatttagaaatgtatcttttagttatt

SEQ ID NO: 64327 - DNA, 27 bp, Artificial sequence
  SiRNA target sequence
atttagaaatgtatcttttagttattt

SEQ ID NO: 64328 - DNA, 27 bp, Artificial sequence
  SiRNA target sequence
tttagaaatgtatcttttagttattta

SEQ ID NO: 64329 - DNA, 27 bp, Artificial sequence
  SiRNA target sequence
ttagaaatgtatcttttagttatttaa

SEQ ID NO: 64330 - DNA, 27 bp, Artificial sequence
  SiRNA target sequence
tagaaatgtatcttttagttatttaaa

SEQ ID NO: 64331 - DNA, 27 bp, Artificial sequence
  SiRNA target sequence
agaaatgtatcttttagttatttaaat

SEQ ID NO: 64332 - DNA, 27 bp, Artificial sequence
  SiRNA target sequence
gaaatgtatcttttagttatttaaata

SEQ ID NO: 64333 - DNA, 27 bp, Artificial sequence
  SiRNA target sequence
aaatgtatcttttagttatttaaataa

SEQ ID NO: 64334 - DNA, 27 bp, Artificial sequence
  SiRNA target sequence
aatgtatcttttagttatttaaataag

SEQ ID NO: 64335 - DNA, 27 bp, Artificial sequence
  SiRNA target sequence
atgtatcttttagttatttaaataagc

SEQ ID NO: 64336 - DNA, 27 bp, Artificial sequence
  SiRNA target sequence
tgtatcttttagttatttaaataagcc

SEQ ID NO: 64337 - DNA, 27 bp, Artificial sequence
  SiRNA target sequence
gtatcttttagttatttaaataagcct

SEQ ID NO: 64338 - DNA, 27 bp, Artificial sequence
  SiRNA target sequence
tatcttttagttatttaaataagccta

SEQ ID NO: 64339 - DNA, 27 bp, Artificial sequence
  SiRNA target sequence
atcttttagttatttaaataagcctat

SEQ ID NO: 64340 - DNA, 27 bp, Artificial sequence
  SiRNA target sequence
tcttttagttatttaaataagcctatt

SEQ ID NO: 64341 - DNA, 27 bp, Artificial sequence
  SiRNA target sequence
cttttagttatttaaataagcctattt

SEQ ID NO: 64342 - DNA, 27 bp, Artificial sequence
  SiRNA target sequence
ttttagttatttaaataagcctatttt

SEQ ID NO: 64343 - DNA, 27 bp, Artificial sequence
  SiRNA target sequence
tttagttatttaaataagcctatttta

SEQ ID NO: 64344 - DNA, 27 bp, Artificial sequence
  SiRNA target sequence
ttagttatttaaataagcctattttag

SEQ ID NO: 64345 - DNA, 27 bp, Artificial sequence
  SiRNA target sequence
tagttatttaaataagcctattttagt

SEQ ID NO: 64346 - DNA, 27 bp, Artificial sequence
  SiRNA target sequence
agttatttaaataagcctattttagtg

SEQ ID NO: 64347 - DNA, 27 bp, Artificial sequence
  SiRNA target sequence
gttatttaaataagcctattttagtga

SEQ ID NO: 64348 - DNA, 27 bp, Artificial sequence
  SiRNA target sequence
ttatttaaataagcctattttagtgaa

SEQ ID NO: 64349 - DNA, 27 bp, Artificial sequence
  SiRNA target sequence
tatttaaataagcctattttagtgaat

SEQ ID NO: 64350 - DNA, 27 bp, Artificial sequence
  SiRNA target sequence
atttaaataagcctattttagtgaatg

SEQ ID NO: 64351 - DNA, 27 bp, Artificial sequence
  SiRNA target sequence
tttaaataagcctattttagtgaatgc

SEQ ID NO: 64352 - DNA, 27 bp, Artificial sequence
  SiRNA target sequence
ttaaataagcctattttagtgaatgct

SEQ ID NO: 64353 - DNA, 27 bp, Artificial sequence
  SiRNA target sequence
taaataagcctattttagtgaatgcta

SEQ ID NO: 64354 - DNA, 27 bp, Artificial sequence
  SiRNA target sequence
aaataagcctattttagtgaatgctaa

SEQ ID NO: 64355 - DNA, 27 bp, Artificial sequence
  SiRNA target sequence
aataagcctattttagtgaatgctaat

SEQ ID NO: 64356 - DNA, 27 bp, Artificial sequence
  SiRNA target sequence
ataagcctattttagtgaatgctaatt

SEQ ID NO: 64357 - DNA, 27 bp, Artificial sequence
  SiRNA target sequence
taagcctattttagtgaatgctaattt

SEQ ID NO: 64358 - DNA, 27 bp, Artificial sequence
  SiRNA target sequence
aagcctattttagtgaatgctaatttc

SEQ ID NO: 64359 - DNA, 27 bp, Artificial sequence
  SiRNA target sequence
agcctattttagtgaatgctaatttcg

SEQ ID NO: 64360 - DNA, 27 bp, Artificial sequence
  SiRNA target sequence
gcctattttagtgaatgctaatttcgt

SEQ ID NO: 64361 - DNA, 27 bp, Artificial sequence
  SiRNA target sequence
cctattttagtgaatgctaatttcgtt

SEQ ID NO: 64362 - DNA, 27 bp, Artificial sequence
  SiRNA target sequence
ctattttagtgaatgctaatttcgtta

SEQ ID NO: 64363 - DNA, 27 bp, Artificial sequence
  SiRNA target sequence
tattttagtgaatgctaatttcgttat

SEQ ID NO: 64364 - DNA, 27 bp, Artificial sequence
  SiRNA target sequence
attttagtgaatgctaatttcgttatt

SEQ ID NO: 64365 - DNA, 27 bp, Artificial sequence
  SiRNA target sequence
ttttagtgaatgctaatttcgttatta

SEQ ID NO: 64366 - DNA, 27 bp, Artificial sequence
  SiRNA target sequence
tttagtgaatgctaatttcgttattaa

SEQ ID NO: 64367 - DNA, 27 bp, Artificial sequence
  SiRNA target sequence
ttagtgaatgctaatttcgttattaat

SEQ ID NO: 64368 - DNA, 27 bp, Artificial sequence
  SiRNA target sequence
tagtgaatgctaatttcgttattaata

SEQ ID NO: 64369 - DNA, 27 bp, Artificial sequence
  SiRNA target sequence
agtgaatgctaatttcgttattaataa

SEQ ID NO: 64370 - DNA, 27 bp, Artificial sequence
  SiRNA target sequence
gtgaatgctaatttcgttattaataaa

SEQ ID NO: 64371 - DNA, 27 bp, Artificial sequence
  SiRNA target sequence
tgaatgctaatttcgttattaataaag

SEQ ID NO: 64372 - DNA, 27 bp, Artificial sequence
  SiRNA target sequence
gaatgctaatttcgttattaataaagg

SEQ ID NO: 64373 - DNA, 27 bp, Artificial sequence
  SiRNA target sequence
aatgctaatttcgttattaataaaggg

SEQ ID NO: 64374 - DNA, 27 bp, Artificial sequence
  SiRNA target sequence
atgctaatttcgttattaataaagggg

SEQ ID NO: 64375 - DNA, 27 bp, Artificial sequence
  SiRNA target sequence
tgctaatttcgttattaataaagggga

SEQ ID NO: 64376 - DNA, 27 bp, Artificial sequence
  SiRNA target sequence
gctaatttcgttattaataaaggggag

SEQ ID NO: 64377 - DNA, 27 bp, Artificial sequence
  SiRNA target sequence
ctaatttcgttattaataaaggggagc

SEQ ID NO: 64378 - DNA, 27 bp, Artificial sequence
  SiRNA target sequence
taatttcgttattaataaaggggagcg

SEQ ID NO: 64379 - DNA, 27 bp, Artificial sequence
  SiRNA target sequence
aatttcgttattaataaaggggagcgt

SEQ ID NO: 64380 - DNA, 27 bp, Artificial sequence
  SiRNA target sequence
atttcgttattaataaaggggagcgtg

SEQ ID NO: 64381 - DNA, 27 bp, Artificial sequence
  SiRNA target sequence
tttcgttattaataaaggggagcgtgt

SEQ ID NO: 64382 - DNA, 27 bp, Artificial sequence
  SiRNA target sequence
ttcgttattaataaaggggagcgtgtt

SEQ ID NO: 64383 - DNA, 27 bp, Artificial sequence
  SiRNA target sequence
tcgttattaataaaggggagcgtgttg

SEQ ID NO: 64384 - DNA, 27 bp, Artificial sequence
  SiRNA target sequence
cgttattaataaaggggagcgtgttgc

SEQ ID NO: 64385 - DNA, 27 bp, Artificial sequence
  SiRNA target sequence
gttattaataaaggggagcgtgttgct

SEQ ID NO: 64386 - DNA, 27 bp, Artificial sequence
  SiRNA target sequence
ttattaataaaggggagcgtgttgcta

SEQ ID NO: 64387 - DNA, 27 bp, Artificial sequence
  SiRNA target sequence
tattaataaaggggagcgtgttgctat

SEQ ID NO: 64388 - DNA, 27 bp, Artificial sequence
  SiRNA target sequence
attaataaaggggagcgtgttgctatt

SEQ ID NO: 64389 - DNA, 27 bp, Artificial sequence
  SiRNA target sequence
ttaataaaggggagcgtgttgctatta

SEQ ID NO: 64390 - DNA, 27 bp, Artificial sequence
  SiRNA target sequence
taataaaggggagcgtgttgctattat

SEQ ID NO: 64391 - DNA, 27 bp, Artificial sequence
  SiRNA target sequence
aataaaggggagcgtgttgctattata

SEQ ID NO: 64392 - DNA, 27 bp, Artificial sequence
  SiRNA target sequence
ataaaggggagcgtgttgctattatag

SEQ ID NO: 64393 - DNA, 27 bp, Artificial sequence
  SiRNA target sequence
taaaggggagcgtgttgctattatagg

SEQ ID NO: 64394 - DNA, 27 bp, Artificial sequence
  SiRNA target sequence
aaaggggagcgtgttgctattatagga

SEQ ID NO: 64395 - DNA, 27 bp, Artificial sequence
  SiRNA target sequence
aaggggagcgtgttgctattataggaa

SEQ ID NO: 64396 - DNA, 27 bp, Artificial sequence
  SiRNA target sequence
aggggagcgtgttgctattataggaaa

SEQ ID NO: 64397 - DNA, 27 bp, Artificial sequence
  SiRNA target sequence
ggggagcgtgttgctattataggaaaa

SEQ ID NO: 64398 - DNA, 27 bp, Artificial sequence
  SiRNA target sequence
gggagcgtgttgctattataggaaaaa

SEQ ID NO: 64399 - DNA, 27 bp, Artificial sequence
  SiRNA target sequence
ggagcgtgttgctattataggaaaaaa

SEQ ID NO: 64400 - DNA, 27 bp, Artificial sequence
  SiRNA target sequence
gagcgtgttgctattataggaaaaaat

SEQ ID NO: 64401 - DNA, 27 bp, Artificial sequence
  SiRNA target sequence
agcgtgttgctattataggaaaaaatg

SEQ ID NO: 64402 - DNA, 27 bp, Artificial sequence
  SiRNA target sequence
gcgtgttgctattataggaaaaaatgg

SEQ ID NO: 64403 - DNA, 27 bp, Artificial sequence
  SiRNA target sequence
cgtgttgctattataggaaaaaatgga

SEQ ID NO: 64404 - DNA, 27 bp, Artificial sequence
  SiRNA target sequence
gtgttgctattataggaaaaaatggaa

SEQ ID NO: 64405 - DNA, 27 bp, Artificial sequence
  SiRNA target sequence
tgttgctattataggaaaaaatggaac

SEQ ID NO: 64406 - DNA, 27 bp, Artificial sequence
  SiRNA target sequence
gttgctattataggaaaaaatggaaca

SEQ ID NO: 64407 - DNA, 27 bp, Artificial sequence
  SiRNA target sequence
ttgctattataggaaaaaatggaacag

SEQ ID NO: 64408 - DNA, 27 bp, Artificial sequence
  SiRNA target sequence
tgctattataggaaaaaatggaacagg

SEQ ID NO: 64409 - DNA, 27 bp, Artificial sequence
  SiRNA target sequence
gctattataggaaaaaatggaacaggt

SEQ ID NO: 64410 - DNA, 27 bp, Artificial sequence
  SiRNA target sequence
ctattataggaaaaaatggaacaggta

SEQ ID NO: 64411 - DNA, 27 bp, Artificial sequence
  SiRNA target sequence
tattataggaaaaaatggaacaggtaa

SEQ ID NO: 64412 - DNA, 27 bp, Artificial sequence
  SiRNA target sequence
attataggaaaaaatggaacaggtaaa
